United States Patent 7,888,497 (BIOINFORMATICALLY DETECTABLE GROUP OF NOVEL REGULATORY OLIGONUCLEOTIDES AND USES THEREOF) - sequence listing, part 166

SEQ ID NO: 6942506 - DNA, 22 bp, Homo sapiens
tgcatctttttccaagtttatt

SEQ ID NO: 6942507 - DNA, 21 bp, Homo sapiens
acattacagggtgatgtgtct

SEQ ID NO: 6942508 - DNA, 22 bp, Homo sapiens
cctaaagaattttcatagagct

SEQ ID NO: 6942509 - DNA, 22 bp, Homo sapiens
cttgctgccagccaccatactg

SEQ ID NO: 6942510 - DNA, 23 bp, Homo sapiens
ttacaaggctagaattccagcga

SEQ ID NO: 6942511 - DNA, 22 bp, Homo sapiens
tgctgagagccagggctggcat

SEQ ID NO: 6942512 - DNA, 22 bp, Homo sapiens
ccaggtgtggggaggactcaca

SEQ ID NO: 6942513 - DNA, 22 bp, Homo sapiens
gcagcagtactcaatatcctgg

SEQ ID NO: 6942514 - DNA, 22 bp, Homo sapiens
cagggatgagcagatggagcaa

SEQ ID NO: 6942515 - DNA, 22 bp, Homo sapiens
gaggtacagagtgttccaatgt

SEQ ID NO: 6942516 - DNA, 22 bp, Homo sapiens
tgctgaagtccatctgtttgac

SEQ ID NO: 6942517 - DNA, 22 bp, Homo sapiens
tgtatgtattggtcagggttct

SEQ ID NO: 6942518 - DNA, 22 bp, Homo sapiens
tggggagaaatgtctttgttcc

SEQ ID NO: 6942519 - DNA, 22 bp, Homo sapiens
atcacctgatggtgaacaaggg

SEQ ID NO: 6942520 - DNA, 22 bp, Homo sapiens
atacttctagaaatactatgca

SEQ ID NO: 6942521 - DNA, 22 bp, Homo sapiens
tgtcaagatgacagatagatga

SEQ ID NO: 6942522 - DNA, 22 bp, Homo sapiens
taagagctacagcccagggttc

SEQ ID NO: 6942523 - DNA, 22 bp, Homo sapiens
agaattttatctaaagggagta

SEQ ID NO: 6942524 - DNA, 22 bp, Homo sapiens
caagcagaggtttatgtattag

SEQ ID NO: 6942525 - DNA, 22 bp, Homo sapiens
aataagccagcccatgtgaccc

SEQ ID NO: 6942526 - DNA, 22 bp, Homo sapiens
tttcctggagggtccccagcag

SEQ ID NO: 6942527 - DNA, 22 bp, Homo sapiens
ttctttgggcaattgctggccc

SEQ ID NO: 6942528 - DNA, 22 bp, Homo sapiens
aggtggctgagctgtgcccctg

SEQ ID NO: 6942529 - DNA, 22 bp, Homo sapiens
tctgtcattttgtatctacatg

SEQ ID NO: 6942530 - DNA, 22 bp, Homo sapiens
ttggaagttcttagccttttca

SEQ ID NO: 6942531 - DNA, 22 bp, Homo sapiens
tcaggtggaattaattaagaga

SEQ ID NO: 6942532 - DNA, 22 bp, Homo sapiens
gtagggacttgttttactagta

SEQ ID NO: 6942533 - DNA, 22 bp, Homo sapiens
atttttgtatccccagctcctg

SEQ ID NO: 6942534 - DNA, 22 bp, Homo sapiens
ttagagaagctgtaattattca

SEQ ID NO: 6942535 - DNA, 22 bp, Homo sapiens
aagactgtctgggacaagatga

SEQ ID NO: 6942536 - DNA, 22 bp, Homo sapiens
actgtaacgccagctttaaatg

SEQ ID NO: 6942537 - DNA, 22 bp, Homo sapiens
gatgtgtaacatgctgtgacat

SEQ ID NO: 6942538 - DNA, 22 bp, Homo sapiens
tgcataaatagtacctgctttt

SEQ ID NO: 6942539 - DNA, 22 bp, Homo sapiens
gggcactgtgctgggtgcttta

SEQ ID NO: 6942540 - DNA, 22 bp, Homo sapiens
gtgcatcgtgctgtaggctgac

SEQ ID NO: 6942541 - DNA, 22 bp, Homo sapiens
tgactatctagagtggggcaaa

SEQ ID NO: 6942542 - DNA, 22 bp, Homo sapiens
gactgtggcgtagatgctggga

SEQ ID NO: 6942543 - DNA, 22 bp, Homo sapiens
acctctgagatgagtcagggga

SEQ ID NO: 6942544 - DNA, 22 bp, Homo sapiens
ctcctccttcctgtgttgtgca

SEQ ID NO: 6942545 - DNA, 22 bp, Homo sapiens
tattgctttgtgtcataagcaa

SEQ ID NO: 6942546 - DNA, 22 bp, Homo sapiens
tgcacattcacttaggtattgt

SEQ ID NO: 6942547 - DNA, 22 bp, Homo sapiens
tgcttctggagtaacagggtga

SEQ ID NO: 6942548 - DNA, 22 bp, Homo sapiens
tgcatttagttttaataaagga

SEQ ID NO: 6942549 - DNA, 22 bp, Homo sapiens
gggccctggatttaagcatgga

SEQ ID NO: 6942550 - DNA, 22 bp, Homo sapiens
tagatgctgggaaggctgctgg

SEQ ID NO: 6942551 - DNA, 22 bp, Homo sapiens
aaagtttttaagcaagaccctt

SEQ ID NO: 6942552 - DNA, 22 bp, Homo sapiens
ggcctgctctggctgtggtcag

SEQ ID NO: 6942553 - DNA, 22 bp, Homo sapiens
aagaacgaactttgctaattgt

SEQ ID NO: 6942554 - DNA, 22 bp, Homo sapiens
tttggcctctgggagaatattc

SEQ ID NO: 6942555 - DNA, 22 bp, Homo sapiens
aaagtgctttcccacatttgtt

SEQ ID NO: 6942556 - DNA, 22 bp, Homo sapiens
ttccagatttctacacaagacc

SEQ ID NO: 6942557 - DNA, 22 bp, Homo sapiens
gaagccccaaaccctcgccatc

SEQ ID NO: 6942558 - DNA, 22 bp, Homo sapiens
tgttcctggttcctgcatgatg

SEQ ID NO: 6942559 - DNA, 22 bp, Homo sapiens
tttggacaaatgtctgactttc

SEQ ID NO: 6942560 - DNA, 22 bp, Homo sapiens
agtagaccaaacatttaaaacc

SEQ ID NO: 6942561 - DNA, 21 bp, Homo sapiens
tgtgacctgatgtagtacatt

SEQ ID NO: 6942562 - DNA, 22 bp, Homo sapiens
tcagtgtttcctgtggtacagc

SEQ ID NO: 6942563 - DNA, 22 bp, Homo sapiens
atattagtttggagactacaat

SEQ ID NO: 6942564 - DNA, 22 bp, Homo sapiens
actgactagacttacaacagag

SEQ ID NO: 6942565 - DNA, 22 bp, Homo sapiens
ggaggcggggaaggcatcccat

SEQ ID NO: 6942566 - DNA, 22 bp, Homo sapiens
gcacttggagggagggttcaag

SEQ ID NO: 6942567 - DNA, 22 bp, Homo sapiens
gccacaggtgggctctgggaaa

SEQ ID NO: 6942568 - DNA, 22 bp, Homo sapiens
attctctgttcaaggatggtga

SEQ ID NO: 6942569 - DNA, 22 bp, Homo sapiens
tagactggaagctccttgaggc

SEQ ID NO: 6942570 - DNA, 22 bp, Homo sapiens
cagtttccctgcttgaaaacgt

SEQ ID NO: 6942571 - DNA, 22 bp, Homo sapiens
tcctggagcttccttcatggta

SEQ ID NO: 6942572 - DNA, 22 bp, Homo sapiens
gaggactgaaacttacaggaaa

SEQ ID NO: 6942573 - DNA, 22 bp, Homo sapiens
tgactcttggtgattactgggt

SEQ ID NO: 6942574 - DNA, 22 bp, Homo sapiens
cagctggttatcagagaggcct

SEQ ID NO: 6942575 - DNA, 22 bp, Homo sapiens
tctagggaacctatcctatgat

SEQ ID NO: 6942576 - DNA, 23 bp, Homo sapiens
tgggaattgcagggggttctgcc

SEQ ID NO: 6942577 - DNA, 22 bp, Homo sapiens
tcagagcatgtgggctgcagtt

SEQ ID NO: 6942578 - DNA, 22 bp, Homo sapiens
tctgtacagtaccagatagtaa

SEQ ID NO: 6942579 - DNA, 22 bp, Homo sapiens
aacctctctgtgccctgacttt

SEQ ID NO: 6942580 - DNA, 22 bp, Homo sapiens
tgaaaggcagttagaggtgttt

SEQ ID NO: 6942581 - DNA, 22 bp, Homo sapiens
aggcactgggtaattagtagct

SEQ ID NO: 6942582 - DNA, 18 bp, Homo sapiens
ctgccacttaatgtggtg

SEQ ID NO: 6942583 - DNA, 21 bp, Homo sapiens
atcattgcagagcacattaaa

SEQ ID NO: 6942584 - DNA, 16 bp, Homo sapiens
tttctcattgtcatca

SEQ ID NO: 6942585 - DNA, 23 bp, Homo sapiens
tcagtgtctagttgtggaattga

SEQ ID NO: 6942586 - DNA, 20 bp, Homo sapiens
gagggctcgtggatggataa

SEQ ID NO: 6942587 - DNA, 22 bp, Homo sapiens
tgcaggcagctaaaccatgtaa

SEQ ID NO: 6942588 - DNA, 22 bp, Homo sapiens
acccagttcctaagcatccatg

SEQ ID NO: 6942589 - DNA, 22 bp, Homo sapiens
cagcttggcgaatgtaggtatg

SEQ ID NO: 6942590 - DNA, 22 bp, Homo sapiens
ggaggagacagtaaaaagcacg

SEQ ID NO: 6942591 - DNA, 22 bp, Homo sapiens
ttccagaaaacgctttatttag

SEQ ID NO: 6942592 - DNA, 16 bp, Homo sapiens
aggcagcatgttagtg

SEQ ID NO: 6942593 - DNA, 22 bp, Homo sapiens
tcagttgccagtattttatata

SEQ ID NO: 6942594 - DNA, 22 bp, Homo sapiens
ggacaaaggtagacagtctctg

SEQ ID NO: 6942595 - DNA, 21 bp, Homo sapiens
gagcccaggcatctcattaat

SEQ ID NO: 6942596 - DNA, 22 bp, Homo sapiens
tacagggaatgggacataaatc

SEQ ID NO: 6942597 - DNA, 22 bp, Homo sapiens
gttcccaccatgctgcacccat

SEQ ID NO: 6942598 - DNA, 22 bp, Homo sapiens
gaatttgtgctcaggaagatta

SEQ ID NO: 6942599 - DNA, 20 bp, Homo sapiens
ctccaaattcctgaggataa

SEQ ID NO: 6942600 - DNA, 22 bp, Homo sapiens
gagagttattattatccccatt

SEQ ID NO: 6942601 - DNA, 22 bp, Homo sapiens
atcttgattccattatctttgt

SEQ ID NO: 6942602 - DNA, 22 bp, Homo sapiens
atatacttccccattatggggg

SEQ ID NO: 6942603 - DNA, 22 bp, Homo sapiens
atcagtgacttcttccaaagtt

SEQ ID NO: 6942604 - DNA, 22 bp, Homo sapiens
aagaggccttggtctgacctga

SEQ ID NO: 6942605 - DNA, 18 bp, Homo sapiens
ccattgtcctgaggatcc

SEQ ID NO: 6942606 - DNA, 22 bp, Homo sapiens
atgtgccacatgatattgtctc

SEQ ID NO: 6942607 - DNA, 22 bp, Homo sapiens
tctcactaagttatgataatca

SEQ ID NO: 6942608 - DNA, 22 bp, Homo sapiens
tggccagtgcctgccagtgcag

SEQ ID NO: 6942609 - DNA, 22 bp, Homo sapiens
gcctggagggttgaggttttgt

SEQ ID NO: 6942610 - DNA, 22 bp, Homo sapiens
ccacatcagaaatgtttactca

SEQ ID NO: 6942611 - DNA, 22 bp, Homo sapiens
acacatatgccattacagcaaa

SEQ ID NO: 6942612 - DNA, 22 bp, Homo sapiens
tgcattaagggcctggagatac

SEQ ID NO: 6942613 - DNA, 22 bp, Homo sapiens
atggaaatatctttagagctta

SEQ ID NO: 6942614 - DNA, 22 bp, Homo sapiens
acagttaaggaaatggaggttc

SEQ ID NO: 6942615 - DNA, 22 bp, Homo sapiens
atgaggtagctgtggctggctg

SEQ ID NO: 6942616 - DNA, 22 bp, Homo sapiens
tgagttcatatagttcaagata

SEQ ID NO: 6942617 - DNA, 22 bp, Homo sapiens
ccttggtgctctgctgggatgg

SEQ ID NO: 6942618 - DNA, 20 bp, Homo sapiens
agggcaaaatccaaaagtct

SEQ ID NO: 6942619 - DNA, 23 bp, Homo sapiens
tcactgtgcccattgaggtagag

SEQ ID NO: 6942620 - DNA, 22 bp, Homo sapiens
tctgatgtaagttcttccagag

SEQ ID NO: 6942621 - DNA, 22 bp, Homo sapiens
ttgttcactatgaagaggttgg

SEQ ID NO: 6942622 - DNA, 22 bp, Homo sapiens
aagaaagggctattgttctcca

SEQ ID NO: 6942623 - DNA, 22 bp, Homo sapiens
ctcctcttggaatgcgtggctc

SEQ ID NO: 6942624 - DNA, 22 bp, Homo sapiens
attaaatgatggcatgtcttat

SEQ ID NO: 6942625 - DNA, 22 bp, Homo sapiens
acagggaatggagggatcagta

SEQ ID NO: 6942626 - DNA, 22 bp, Homo sapiens
ttatgttatgctatttcagata

SEQ ID NO: 6942627 - DNA, 22 bp, Homo sapiens
gggctgacatatttggtgctct

SEQ ID NO: 6942628 - DNA, 19 bp, Homo sapiens
gttcccattgcagttgtgg

SEQ ID NO: 6942629 - DNA, 22 bp, Homo sapiens
ccctgtgcatattgccagatac

SEQ ID NO: 6942630 - DNA, 22 bp, Homo sapiens
caggacaatggtcatactggat

SEQ ID NO: 6942631 - DNA, 22 bp, Homo sapiens
tattgatatgcagaactgactt

SEQ ID NO: 6942632 - DNA, 22 bp, Homo sapiens
tagaaatgtgataatagcttaa

SEQ ID NO: 6942633 - DNA, 22 bp, Homo sapiens
cccagctcttcaagtcaccccc

SEQ ID NO: 6942634 - DNA, 22 bp, Homo sapiens
gaagatctgcagcctcaggcga

SEQ ID NO: 6942635 - DNA, 22 bp, Homo sapiens
ctggctgggagcgagctgctca

SEQ ID NO: 6942636 - DNA, 22 bp, Homo sapiens
gtgggcagaggagagaacatta

SEQ ID NO: 6942637 - DNA, 22 bp, Homo sapiens
agaagctatttagctgcacttt

SEQ ID NO: 6942638 - DNA, 22 bp, Homo sapiens
tgctccagcaccaagagctcca

SEQ ID NO: 6942639 - DNA, 22 bp, Homo sapiens
tctctgggtaaagttctctcat

SEQ ID NO: 6942640 - DNA, 21 bp, Homo sapiens
tcccattgttcccctccagtg

SEQ ID NO: 6942641 - DNA, 22 bp, Homo sapiens
aatgtctatttgctacaaagcc

SEQ ID NO: 6942642 - DNA, 22 bp, Homo sapiens
gctctatggtgagtgtctgtga

SEQ ID NO: 6942643 - DNA, 22 bp, Homo sapiens
tgcagcatctccttaaatcttg

SEQ ID NO: 6942644 - DNA, 22 bp, Homo sapiens
ggacacaaaagtgaataaaata

SEQ ID NO: 6942645 - DNA, 22 bp, Homo sapiens
ttaatatgttgaaatttattag

SEQ ID NO: 6942646 - DNA, 22 bp, Homo sapiens
aatggctttggcaggaatttca

SEQ ID NO: 6942647 - DNA, 22 bp, Homo sapiens
caggcagccaggggacctgtcc

SEQ ID NO: 6942648 - DNA, 22 bp, Homo sapiens
catctcatttattccaactcag

SEQ ID NO: 6942649 - DNA, 22 bp, Homo sapiens
cctgtgatattgttcataatat

SEQ ID NO: 6942650 - DNA, 22 bp, Homo sapiens
aggcagccacatgagctcctga

SEQ ID NO: 6942651 - DNA, 22 bp, Homo sapiens
tgcaggtggcagcggggcacca

SEQ ID NO: 6942652 - DNA, 22 bp, Homo sapiens
tctccaatgcttaggaaagttt

SEQ ID NO: 6942653 - DNA, 22 bp, Homo sapiens
tttcctttctagaagcctaaat

SEQ ID NO: 6942654 - DNA, 22 bp, Homo sapiens
ctaggccacttgctctcatgga

SEQ ID NO: 6942655 - DNA, 22 bp, Homo sapiens
tacatagtattcacattgtttt

SEQ ID NO: 6942656 - DNA, 22 bp, Homo sapiens
ttccatgaaagtgaaatggagc

SEQ ID NO: 6942657 - DNA, 22 bp, Homo sapiens
ggcctcagtttcttcaactgta

SEQ ID NO: 6942658 - DNA, 22 bp, Homo sapiens
aagtagttaggaacattctctc

SEQ ID NO: 6942659 - DNA, 22 bp, Homo sapiens
acacatgtacagattagtattt

SEQ ID NO: 6942660 - DNA, 22 bp, Homo sapiens
aggccagcctgcccaaagctgc

SEQ ID NO: 6942661 - DNA, 22 bp, Homo sapiens
agtctttacatgtgttatatat

SEQ ID NO: 6942662 - DNA, 22 bp, Homo sapiens
aacagcagaaactgcaagctac

SEQ ID NO: 6942663 - DNA, 22 bp, Homo sapiens
ggccagagagcagccaggattc

SEQ ID NO: 6942664 - DNA, 22 bp, Homo sapiens
atacatgactcacacattctgc

SEQ ID NO: 6942665 - DNA, 22 bp, Homo sapiens
agatgtttgtaaacacactgct

SEQ ID NO: 6942666 - DNA, 22 bp, Homo sapiens
gtcacagtgtcctacaggttga

SEQ ID NO: 6942667 - DNA, 22 bp, Homo sapiens
cctgctatcattctaggcttcc

SEQ ID NO: 6942668 - DNA, 22 bp, Homo sapiens
tgcttatccaggcaatgcattc

SEQ ID NO: 6942669 - DNA, 22 bp, Homo sapiens
gtgccgtgggccttagtgatct

SEQ ID NO: 6942670 - DNA, 20 bp, Homo sapiens
agtgtttgctcacagtctcc

SEQ ID NO: 6942671 - DNA, 21 bp, Homo sapiens
tggcagactagagtatagatg

SEQ ID NO: 6942672 - DNA, 22 bp, Homo sapiens
actttccacaccattttgtggt

SEQ ID NO: 6942673 - DNA, 22 bp, Homo sapiens
gaaggcctctccccttctccag

SEQ ID NO: 6942674 - DNA, 19 bp, Homo sapiens
cattttaagcatccccagt

SEQ ID NO: 6942675 - DNA, 22 bp, Homo sapiens
tctagagacaaaggaaggaggg

SEQ ID NO: 6942676 - DNA, 22 bp, Homo sapiens
gtggatgatgagtgactacaga

SEQ ID NO: 6942677 - DNA, 22 bp, Homo sapiens
atccagacacctactgctactt

SEQ ID NO: 6942678 - DNA, 22 bp, Homo sapiens
cacaacttagcagcttgaaaca

SEQ ID NO: 6942679 - DNA, 19 bp, Homo sapiens
ggtaaatgatacatgctga

SEQ ID NO: 6942680 - DNA, 22 bp, Homo sapiens
cacccaggcaaggattctgcaa

SEQ ID NO: 6942681 - DNA, 22 bp, Homo sapiens
ttgaggtcaagtaaccactgga

SEQ ID NO: 6942682 - DNA, 22 bp, Homo sapiens
aaggaaatctttgtaacatctt

SEQ ID NO: 6942683 - DNA, 22 bp, Homo sapiens
agttcacagaatggccagaact

SEQ ID NO: 6942684 - DNA, 22 bp, Homo sapiens
ttggtttactaggattcaaatt

SEQ ID NO: 6942685 - DNA, 22 bp, Homo sapiens
ttgtgagagaaaatgtgtatat

SEQ ID NO: 6942686 - DNA, 22 bp, Homo sapiens
ctctgtccacaggtttgtccct

SEQ ID NO: 6942687 - DNA, 22 bp, Homo sapiens
gaagtcagaaaagaattaggga

SEQ ID NO: 6942688 - DNA, 16 bp, Homo sapiens
gctgaagtgagtatag

SEQ ID NO: 6942689 - DNA, 17 bp, Homo sapiens
tcagcatacacagagaa

SEQ ID NO: 6942690 - DNA, 22 bp, Homo sapiens
gctgtgtctgttttacgtcaag

SEQ ID NO: 6942691 - DNA, 22 bp, Homo sapiens
tgcaatttttatcaattcagca

SEQ ID NO: 6942692 - DNA, 19 bp, Homo sapiens
ggaagccaggtcagcccac

SEQ ID NO: 6942693 - DNA, 22 bp, Homo sapiens
acagtagagcatttgttttgat

SEQ ID NO: 6942694 - DNA, 22 bp, Homo sapiens
taggaatgtctatgcagtgagg

SEQ ID NO: 6942695 - DNA, 21 bp, Homo sapiens
agagggagagtggcccttcca

SEQ ID NO: 6942696 - DNA, 22 bp, Homo sapiens
agcttgtctaaggacacagctt

SEQ ID NO: 6942697 - DNA, 22 bp, Homo sapiens
gccactggcgctgtgcagagtg

SEQ ID NO: 6942698 - DNA, 22 bp, Homo sapiens
gatctcagacaggtggacaggg

SEQ ID NO: 6942699 - DNA, 22 bp, Homo sapiens
aaaggactgatgctgagtacct

SEQ ID NO: 6942700 - DNA, 22 bp, Homo sapiens
gcagtagtttcaaaacaagaaa

SEQ ID NO: 6942701 - DNA, 22 bp, Homo sapiens
tatatactttcttcctgggtag

SEQ ID NO: 6942702 - DNA, 22 bp, Homo sapiens
atagggcatcctttattgagat

SEQ ID NO: 6942703 - DNA, 22 bp, Homo sapiens
atcagagtcagaggctagagct

SEQ ID NO: 6942704 - DNA, 22 bp, Homo sapiens
ttcaagcaccaaattagtaggc

SEQ ID NO: 6942705 - DNA, 22 bp, Homo sapiens
ggctccctgggggtcggagagt

SEQ ID NO: 6942706 - DNA, 22 bp, Homo sapiens
tctggctctccagtgctcttag

SEQ ID NO: 6942707 - DNA, 22 bp, Homo sapiens
ccaggaagtatgacccaacaga

SEQ ID NO: 6942708 - DNA, 22 bp, Homo sapiens
acaaatttgaatcctgacttct

SEQ ID NO: 6942709 - DNA, 22 bp, Homo sapiens
aaaaggcattttgtcaaccata

SEQ ID NO: 6942710 - DNA, 22 bp, Homo sapiens
cagtacgctcacgtatatgatt

SEQ ID NO: 6942711 - DNA, 19 bp, Homo sapiens
tctagacaccaaagttgtc

SEQ ID NO: 6942712 - DNA, 22 bp, Homo sapiens
agttctggcgcccatgagcaga

SEQ ID NO: 6942713 - DNA, 22 bp, Homo sapiens
aaagagactggtggcattttgc

SEQ ID NO: 6942714 - DNA, 22 bp, Homo sapiens
tgacaagatcacagtcaagtgt

SEQ ID NO: 6942715 - DNA, 22 bp, Homo sapiens
gtcctgggagatgggaccctga

SEQ ID NO: 6942716 - DNA, 22 bp, Homo sapiens
cactgtctgagctggtgattag

SEQ ID NO: 6942717 - DNA, 22 bp, Homo sapiens
ttcatactgtttaagttctgtt

SEQ ID NO: 6942718 - DNA, 22 bp, Homo sapiens
aggtccctcgcacatgcagggt

SEQ ID NO: 6942719 - DNA, 22 bp, Homo sapiens
ccttcgaaggtgctgggatggt

SEQ ID NO: 6942720 - DNA, 22 bp, Homo sapiens
ggacagtggcctggtggtatag

SEQ ID NO: 6942721 - DNA, 22 bp, Homo sapiens
aggcagcatccagaggagaatg

SEQ ID NO: 6942722 - DNA, 22 bp, Homo sapiens
tctttggcacttctgttttaag

SEQ ID NO: 6942723 - DNA, 22 bp, Homo sapiens
gcttcagggttatgcaagagtg

SEQ ID NO: 6942724 - DNA, 17 bp, Homo sapiens
tgcatgcgtctgtgata

SEQ ID NO: 6942725 - DNA, 22 bp, Homo sapiens
gctcaggcctggctatccattg

SEQ ID NO: 6942726 - DNA, 22 bp, Homo sapiens
gggcatgtacataatctagaaa

SEQ ID NO: 6942727 - DNA, 22 bp, Homo sapiens
gctgcattgctataaaatacaa

SEQ ID NO: 6942728 - DNA, 22 bp, Homo sapiens
agaataaccagtgtttcacagt

SEQ ID NO: 6942729 - DNA, 22 bp, Homo sapiens
acactgttttagggaagaaaat

SEQ ID NO: 6942730 - DNA, 22 bp, Homo sapiens
ggggctctcaggtctccccaaa

SEQ ID NO: 6942731 - DNA, 22 bp, Homo sapiens
tctctcttcatgcttttagaat

SEQ ID NO: 6942732 - DNA, 22 bp, Homo sapiens
agaagtttggatgccatcatag

SEQ ID NO: 6942733 - DNA, 22 bp, Homo sapiens
tagtgattttcatattacatta

SEQ ID NO: 6942734 - DNA, 22 bp, Homo sapiens
ccttgatggtgagagctgcaga

SEQ ID NO: 6942735 - DNA, 22 bp, Homo sapiens
caggtggcagaggtctctggaa

SEQ ID NO: 6942736 - DNA, 22 bp, Homo sapiens
ttgacaggaatctttttgttat

SEQ ID NO: 6942737 - DNA, 22 bp, Homo sapiens
agaatcattatatttattaagc

SEQ ID NO: 6942738 - DNA, 22 bp, Homo sapiens
caagcagaagcctcaggggcat

SEQ ID NO: 6942739 - DNA, 22 bp, Homo sapiens
ccagactggggctccttgaggg

SEQ ID NO: 6942740 - DNA, 22 bp, Homo sapiens
tttgaaaagaaccatcgcctta

SEQ ID NO: 6942741 - DNA, 22 bp, Homo sapiens
gcaccagcctgagcctcttgca

SEQ ID NO: 6942742 - DNA, 22 bp, Homo sapiens
tgaaggaggaatgtggcctcca

SEQ ID NO: 6942743 - DNA, 22 bp, Homo sapiens
cttgctctagatgttcagagct

SEQ ID NO: 6942744 - DNA, 22 bp, Homo sapiens
catgttggtgtgctgcacccgt

SEQ ID NO: 6942745 - DNA, 22 bp, Homo sapiens
ctcctggagcagcaggcgcagg

SEQ ID NO: 6942746 - DNA, 22 bp, Homo sapiens
ctgaactcatgatatgcttttg

SEQ ID NO: 6942747 - DNA, 22 bp, Homo sapiens
attgtctctgaattttcagctg

SEQ ID NO: 6942748 - DNA, 22 bp, Homo sapiens
cttgtatacagagaaggctcat

SEQ ID NO: 6942749 - DNA, 20 bp, Homo sapiens
tgatggtattaggaggtgtg

SEQ ID NO: 6942750 - DNA, 22 bp, Homo sapiens
tcccacaacctttctgtaaatc

SEQ ID NO: 6942751 - DNA, 22 bp, Homo sapiens
gaatgttcctcagacttcccca

SEQ ID NO: 6942752 - DNA, 22 bp, Homo sapiens
atcataaaccactttgtaatct

SEQ ID NO: 6942753 - DNA, 22 bp, Homo sapiens
tgctggttctttccttcccttc

SEQ ID NO: 6942754 - DNA, 22 bp, Homo sapiens
aattgcttgtcttcttccctac

SEQ ID NO: 6942755 - DNA, 22 bp, Homo sapiens
tgagttcaaagacaggtatagg

SEQ ID NO: 6942756 - DNA, 22 bp, Homo sapiens
tttaaaatttagacctctccac

SEQ ID NO: 6942757 - DNA, 22 bp, Homo sapiens
caggcctcccggtgcacactga

SEQ ID NO: 6942758 - DNA, 22 bp, Homo sapiens
tataactaatactggccatgag

SEQ ID NO: 6942759 - DNA, 22 bp, Homo sapiens
aacctgcatgtttctaaaagca

SEQ ID NO: 6942760 - DNA, 22 bp, Homo sapiens
agctgctcacagggattcatgc

SEQ ID NO: 6942761 - DNA, 22 bp, Homo sapiens
aggctcagtctgttcatgcact

SEQ ID NO: 6942762 - DNA, 22 bp, Homo sapiens
ctgtccagtcagaacgtcatta

SEQ ID NO: 6942763 - DNA, 22 bp, Homo sapiens
tctgagctggagcccatcacct

SEQ ID NO: 6942764 - DNA, 22 bp, Homo sapiens
attcagttccttgtgattgtag

SEQ ID NO: 6942765 - DNA, 19 bp, Homo sapiens
agttattgatctattcagg

SEQ ID NO: 6942766 - DNA, 22 bp, Homo sapiens
tgtctgtaatcaactgagtttc

SEQ ID NO: 6942767 - DNA, 22 bp, Homo sapiens
aaggatagaataactcttgact

SEQ ID NO: 6942768 - DNA, 22 bp, Homo sapiens
tgttcacaggaggggcttatgg

SEQ ID NO: 6942769 - DNA, 22 bp, Homo sapiens
aagagattggttataagagatt

SEQ ID NO: 6942770 - DNA, 22 bp, Homo sapiens
gggcagtgtcgaggtctggtcc

SEQ ID NO: 6942771 - DNA, 21 bp, Homo sapiens
agcctcaggttgttggttctt

SEQ ID NO: 6942772 - DNA, 22 bp, Homo sapiens
agcagggtcctgaggtgagtca

SEQ ID NO: 6942773 - DNA, 22 bp, Homo sapiens
tcagagctttggagaccaggaa

SEQ ID NO: 6942774 - DNA, 22 bp, Homo sapiens
ggcacaatcatgaagttgagtt

SEQ ID NO: 6942775 - DNA, 22 bp, Homo sapiens
tcagttgctaaatggtgtagtg

SEQ ID NO: 6942776 - DNA, 22 bp, Homo sapiens
tgatacatgattggtatggcga

SEQ ID NO: 6942777 - DNA, 23 bp, Homo sapiens
catcagaggttgccactccctgg

SEQ ID NO: 6942778 - DNA, 22 bp, Homo sapiens
gtcttatttaaggacaagaaga

SEQ ID NO: 6942779 - DNA, 22 bp, Homo sapiens
ctgtgccctctttgctggcctt

SEQ ID NO: 6942780 - DNA, 22 bp, Homo sapiens
aatgacctcagagcacccagaa

SEQ ID NO: 6942781 - DNA, 22 bp, Homo sapiens
gccctttattagagctgccatt

SEQ ID NO: 6942782 - DNA, 22 bp, Homo sapiens
ctgggccttgccaggggtgtct

SEQ ID NO: 6942783 - DNA, 22 bp, Homo sapiens
ataaacctatgctaagctgtgg

SEQ ID NO: 6942784 - DNA, 22 bp, Homo sapiens
tcgtaaggttgtttacaacaat

SEQ ID NO: 6942785 - DNA, 22 bp, Homo sapiens
gaacattcctggaagagtgctt

SEQ ID NO: 6942786 - DNA, 22 bp, Homo sapiens
agggctctgagtgggaaagagg

SEQ ID NO: 6942787 - DNA, 22 bp, Homo sapiens
gatctccatctgcagtgtctgg

SEQ ID NO: 6942788 - DNA, 22 bp, Homo sapiens
actgtaatatgaaggtcctatt

SEQ ID NO: 6942789 - DNA, 19 bp, Homo sapiens
tctggctgccaaggattga

SEQ ID NO: 6942790 - DNA, 22 bp, Homo sapiens
atggctgcagtccgtgccctgg

SEQ ID NO: 6942791 - DNA, 22 bp, Homo sapiens
cataggaaaagcattcttcttg

SEQ ID NO: 6942792 - DNA, 22 bp, Homo sapiens
tctgggaagcctgtatgcagaa

SEQ ID NO: 6942793 - DNA, 22 bp, Homo sapiens
ggttccagaccacgggtgttct

SEQ ID NO: 6942794 - DNA, 22 bp, Homo sapiens
agtccaaacaaacttcccgagg

SEQ ID NO: 6942795 - DNA, 22 bp, Homo sapiens
gtggaacagggagcctggaatg

SEQ ID NO: 6942796 - DNA, 22 bp, Homo sapiens
ctggctgcagctccgaggaaga

SEQ ID NO: 6942797 - DNA, 22 bp, Homo sapiens
ggaagtttcaggaatctgcatt

SEQ ID NO: 6942798 - DNA, 22 bp, Homo sapiens
tcctgaggccctgttagggtct

SEQ ID NO: 6942799 - DNA, 22 bp, Homo sapiens
gcaaccatttggaatgtaaaaa

SEQ ID NO: 6942800 - DNA, 22 bp, Homo sapiens
cagtgtctgggacagaaagtca

SEQ ID NO: 6942801 - DNA, 22 bp, Homo sapiens
cccctcttgtgggctcaggtca

SEQ ID NO: 6942802 - DNA, 22 bp, Homo sapiens
tgagttaaatgagaacatgaaa

SEQ ID NO: 6942803 - DNA, 22 bp, Homo sapiens
gatgtctctcacatagaaggta

SEQ ID NO: 6942804 - DNA, 22 bp, Homo sapiens
tctgtaaacacccgtaagcttt

SEQ ID NO: 6942805 - DNA, 22 bp, Homo sapiens
ttgtgataacagaattcactct

SEQ ID NO: 6942806 - DNA, 22 bp, Homo sapiens
cacagggagaggaacagcgcag

SEQ ID NO: 6942807 - DNA, 22 bp, Homo sapiens
cagtcttttgtatattagcaga

SEQ ID NO: 6942808 - DNA, 22 bp, Homo sapiens
actgaggtcaggggtatgtgat

SEQ ID NO: 6942809 - DNA, 22 bp, Homo sapiens
gtgcaggctctcgttcttgaca

SEQ ID NO: 6942810 - DNA, 22 bp, Homo sapiens
attaacatgcagccagacacac

SEQ ID NO: 6942811 - DNA, 22 bp, Homo sapiens
ggtttgcattctgaaaggctca

SEQ ID NO: 6942812 - DNA, 23 bp, Homo sapiens
aggtgccaactgagagctgagag

SEQ ID NO: 6942813 - DNA, 22 bp, Homo sapiens
tcccaggctgggggcctgaagt

SEQ ID NO: 6942814 - DNA, 22 bp, Homo sapiens
atgcccctggcctggggaacat

SEQ ID NO: 6942815 - DNA, 22 bp, Homo sapiens
tttctgcaggtattgcataagt

SEQ ID NO: 6942816 - DNA, 22 bp, Homo sapiens
ctgaaggctaaaatggactgaa

SEQ ID NO: 6942817 - DNA, 21 bp, Homo sapiens
tctctgggaggacttgtgaga

SEQ ID NO: 6942818 - DNA, 22 bp, Homo sapiens
ttgattaatcccatgtgagtag

SEQ ID NO: 6942819 - DNA, 22 bp, Homo sapiens
ttcattcaaagaggcatccaag

SEQ ID NO: 6942820 - DNA, 22 bp, Homo sapiens
ctcactgtgccttttcccaaac

SEQ ID NO: 6942821 - DNA, 22 bp, Homo sapiens
ctctaggctgcccaggagctga

SEQ ID NO: 6942822 - DNA, 23 bp, Homo sapiens
caggacatgggaggaagtatggc

SEQ ID NO: 6942823 - DNA, 20 bp, Homo sapiens
tttctgcagatgtttacatg

SEQ ID NO: 6942824 - DNA, 22 bp, Homo sapiens
ggtggcattcagtaagtatata

SEQ ID NO: 6942825 - DNA, 22 bp, Homo sapiens
catggcactgagcaggtatgca

SEQ ID NO: 6942826 - DNA, 22 bp, Homo sapiens
gctgcctggagctcagcctgcc

SEQ ID NO: 6942827 - DNA, 22 bp, Homo sapiens
tcttgaagaaagtcaagttatt

SEQ ID NO: 6942828 - DNA, 22 bp, Homo sapiens
tggggctcacctaggctggaag

SEQ ID NO: 6942829 - DNA, 22 bp, Homo sapiens
tggctggttttggtgagctccg

SEQ ID NO: 6942830 - DNA, 22 bp, Homo sapiens
agcagatagtagaacatgtata

SEQ ID NO: 6942831 - DNA, 22 bp, Homo sapiens
tcacctctactcagcctagttc

SEQ ID NO: 6942832 - DNA, 22 bp, Homo sapiens
tccaggctgcaaggccacaggg

SEQ ID NO: 6942833 - DNA, 22 bp, Homo sapiens
tatgaactgctcttgtgttttg

SEQ ID NO: 6942834 - DNA, 22 bp, Homo sapiens
atgccttatagtccacagtgga

SEQ ID NO: 6942835 - DNA, 22 bp, Homo sapiens
caggacatcttctgtgttttta

SEQ ID NO: 6942836 - DNA, 22 bp, Homo sapiens
ttggatgtttgaaatcacgtac

SEQ ID NO: 6942837 - DNA, 22 bp, Homo sapiens
tgttaaatgtattatgtgttct

SEQ ID NO: 6942838 - DNA, 22 bp, Homo sapiens
agtttatgttgtttataagcca

SEQ ID NO: 6942839 - DNA, 22 bp, Homo sapiens
agaggacagacggaaagtgcca

SEQ ID NO: 6942840 - DNA, 22 bp, Homo sapiens
tttctgggactggggagattct

SEQ ID NO: 6942841 - DNA, 22 bp, Homo sapiens
ctgtaaaactgcttaagtatgc

SEQ ID NO: 6942842 - DNA, 22 bp, Homo sapiens
ctggcagtgcccagtcactgtt

SEQ ID NO: 6942843 - DNA, 22 bp, Homo sapiens
ctgaaactatggggaggggagc

SEQ ID NO: 6942844 - DNA, 22 bp, Homo sapiens
tatcataggtgtcataatagca

SEQ ID NO: 6942845 - DNA, 22 bp, Homo sapiens
cgctgcagtttatgtgttcctg

SEQ ID NO: 6942846 - DNA, 22 bp, Homo sapiens
ggcaggcaggagcgtgcttggg

SEQ ID NO: 6942847 - DNA, 23 bp, Homo sapiens
tatgatcatgatattgcagggga

SEQ ID NO: 6942848 - DNA, 22 bp, Homo sapiens
tcacaacttgaagctgatttaa

SEQ ID NO: 6942849 - DNA, 22 bp, Homo sapiens
atacccagtccaatctcttagc

SEQ ID NO: 6942850 - DNA, 22 bp, Homo sapiens
ctcctggacatggagcggagga

SEQ ID NO: 6942851 - DNA, 22 bp, Homo sapiens
ggtggttcacgcctataatccc

SEQ ID NO: 6942852 - DNA, 22 bp, Homo sapiens
caattcccagctgccgggctgc

SEQ ID NO: 6942853 - DNA, 22 bp, Homo sapiens
atcctgttagcaccttcaaact

SEQ ID NO: 6942854 - DNA, 21 bp, Homo sapiens
acagagtagttgaaacagaga

SEQ ID NO: 6942855 - DNA, 22 bp, Homo sapiens
ggcgcagaacatgctatacaca

SEQ ID NO: 6942856 - DNA, 22 bp, Homo sapiens
tagcagtctttctttgggacta

SEQ ID NO: 6942857 - DNA, 23 bp, Homo sapiens
ccactctcccaccatatctgtat

SEQ ID NO: 6942858 - DNA, 22 bp, Homo sapiens
ttacagtttaagaggaaacaaa

SEQ ID NO: 6942859 - DNA, 22 bp, Homo sapiens
attctcaatggctactttcata

SEQ ID NO: 6942860 - DNA, 22 bp, Homo sapiens
gccttgggcacaggcagggccc

SEQ ID NO: 6942861 - DNA, 22 bp, Homo sapiens
caggctgcggtcggctctggtc

SEQ ID NO: 6942862 - DNA, 22 bp, Homo sapiens
ggcctgtgagcccttgcatgta

SEQ ID NO: 6942863 - DNA, 22 bp, Homo sapiens
aatctccatttaccctgcatct

SEQ ID NO: 6942864 - DNA, 20 bp, Homo sapiens
gcaagtgaaaactatgggtg

SEQ ID NO: 6942865 - DNA, 22 bp, Homo sapiens
ttacacaaacacattccagata

SEQ ID NO: 6942866 - DNA, 22 bp, Homo sapiens
tttagagtcattttatattgac

SEQ ID NO: 6942867 - DNA, 23 bp, Homo sapiens
tcagaatgcactgaatttaccct

SEQ ID NO: 6942868 - DNA, 22 bp, Homo sapiens
tagaccattttacaatagtgtg

SEQ ID NO: 6942869 - DNA, 17 bp, Homo sapiens
tctagaagtgcttacat

SEQ ID NO: 6942870 - DNA, 22 bp, Homo sapiens
cagctattattttctctaaatt

SEQ ID NO: 6942871 - DNA, 22 bp, Homo sapiens
tagcatttggcaccagttattt

SEQ ID NO: 6942872 - DNA, 22 bp, Homo sapiens
tcttggctttctcctagggatg

SEQ ID NO: 6942873 - DNA, 22 bp, Homo sapiens
atggaattaataggggaatact

SEQ ID NO: 6942874 - DNA, 22 bp, Homo sapiens
tacttctgttcttaaaccaaga

SEQ ID NO: 6942875 - DNA, 22 bp, Homo sapiens
tgctccagcgctgccaccagtt

SEQ ID NO: 6942876 - DNA, 22 bp, Homo sapiens
actggcaaaatagtatattcct

SEQ ID NO: 6942877 - DNA, 22 bp, Homo sapiens
ggatgctgatatagagcattct

SEQ ID NO: 6942878 - DNA, 17 bp, Homo sapiens
agtttttggacctgtgt

SEQ ID NO: 6942879 - DNA, 22 bp, Homo sapiens
ttctcacagaagcacgaagcct

SEQ ID NO: 6942880 - DNA, 22 bp, Homo sapiens
aggcaggcaaccacctgggaag

SEQ ID NO: 6942881 - DNA, 22 bp, Homo sapiens
atatttcagctttacttaggaa

SEQ ID NO: 6942882 - DNA, 22 bp, Homo sapiens
tcacaagaactttggagggata

SEQ ID NO: 6942883 - DNA, 22 bp, Homo sapiens
gcagaatatattactgagcctc

SEQ ID NO: 6942884 - DNA, 17 bp, Homo sapiens
tgtaaaacccagaggtc

SEQ ID NO: 6942885 - DNA, 22 bp, Homo sapiens
aaaggttagttcttagaagtgc

SEQ ID NO: 6942886 - DNA, 22 bp, Homo sapiens
aagatacattatgtctctctga

SEQ ID NO: 6942887 - DNA, 22 bp, Homo sapiens
taggccttgaaagtagctctgc

SEQ ID NO: 6942888 - DNA, 22 bp, Homo sapiens
tgtttgtgagatgtgaggtacg

SEQ ID NO: 6942889 - DNA, 22 bp, Homo sapiens
gggctgatgtgacagaactctc

SEQ ID NO: 6942890 - DNA, 22 bp, Homo sapiens
tcatggaaggagtggccaagtg

SEQ ID NO: 6942891 - DNA, 22 bp, Homo sapiens
tatttgctctcggcccggcccc

SEQ ID NO: 6942892 - DNA, 22 bp, Homo sapiens
gcagcccaggctcgctcactgc

SEQ ID NO: 6942893 - DNA, 22 bp, Homo sapiens
gcttctctggcctgcagggcat

SEQ ID NO: 6942894 - DNA, 22 bp, Homo sapiens
ttcaggaaattggagtccttct

SEQ ID NO: 6942895 - DNA, 22 bp, Homo sapiens
gatttacagctatacccaatgg

SEQ ID NO: 6942896 - DNA, 22 bp, Homo sapiens
tgtctgagtgtgcctgggcatt

SEQ ID NO: 6942897 - DNA, 22 bp, Homo sapiens
tgtgcgctccggcgagtcagcg

SEQ ID NO: 6942898 - DNA, 19 bp, Homo sapiens
tttggaactttttgatgcc

SEQ ID NO: 6942899 - DNA, 22 bp, Homo sapiens
ctgcagttgactccctgtttgc

SEQ ID NO: 6942900 - DNA, 22 bp, Homo sapiens
agaagcttccacggatgtgtct

SEQ ID NO: 6942901 - DNA, 22 bp, Homo sapiens
tcagctctgcaaggtcacctcc

SEQ ID NO: 6942902 - DNA, 22 bp, Homo sapiens
ttggcccagcatgcgggtctgt

SEQ ID NO: 6942903 - DNA, 22 bp, Homo sapiens
ggtgctattcctatacagcatt

SEQ ID NO: 6942904 - DNA, 22 bp, Homo sapiens
agtgatgtaggtggattctggc

SEQ ID NO: 6942905 - DNA, 22 bp, Homo sapiens
tcttttaagcctctggcatagg

SEQ ID NO: 6942906 - DNA, 22 bp, Homo sapiens
ggaacaggaaaggagggatgct

SEQ ID NO: 6942907 - DNA, 22 bp, Homo sapiens
gaggtggccaagcgaggaaggg

SEQ ID NO: 6942908 - DNA, 16 bp, Homo sapiens
tctctgagtgctaagt

SEQ ID NO: 6942909 - DNA, 22 bp, Homo sapiens
aatcttagagtgtttttgaagc

SEQ ID NO: 6942910 - DNA, 22 bp, Homo sapiens
gctttagatctgactttctgtg

SEQ ID NO: 6942911 - DNA, 22 bp, Homo sapiens
atagagtacagtctttgattat

SEQ ID NO: 6942912 - DNA, 22 bp, Homo sapiens
aggaatgtgactattttttcag

SEQ ID NO: 6942913 - DNA, 18 bp, Homo sapiens
tctgtaatttttccttga

SEQ ID NO: 6942914 - DNA, 22 bp, Homo sapiens
aatgtggttaacccatttaaga

SEQ ID NO: 6942915 - DNA, 22 bp, Homo sapiens
atgcctggtcccacctctaggt

SEQ ID NO: 6942916 - DNA, 22 bp, Homo sapiens
caggagtccagagtgtcatttt

SEQ ID NO: 6942917 - DNA, 21 bp, Homo sapiens
tctatcacctaaattaaacag

SEQ ID NO: 6942918 - DNA, 22 bp, Homo sapiens
ggttaagccatcagatggatct

SEQ ID NO: 6942919 - DNA, 22 bp, Homo sapiens
ccaagtactctcaccaaagctt

SEQ ID NO: 6942920 - DNA, 22 bp, Homo sapiens
gctgagaaatgcagacatgctg

SEQ ID NO: 6942921 - DNA, 22 bp, Homo sapiens
gtttacagtactcacttgcatt

SEQ ID NO: 6942922 - DNA, 22 bp, Homo sapiens
gaagagagagtggggttctgcg

SEQ ID NO: 6942923 - DNA, 22 bp, Homo sapiens
tctttatgcctacctgggaaga

SEQ ID NO: 6942924 - DNA, 22 bp, Homo sapiens
gcaaagacaaattagaactcct

SEQ ID NO: 6942925 - DNA, 22 bp, Homo sapiens
gaggtttcactgtgttgtccag

SEQ ID NO: 6942926 - DNA, 22 bp, Homo sapiens
ctggccagagttggagggtgtg

SEQ ID NO: 6942927 - DNA, 22 bp, Homo sapiens
atccatttgtaaatgttagagt

SEQ ID NO: 6942928 - DNA, 23 bp, Homo sapiens
ctgtggagccctttgttgggaga

SEQ ID NO: 6942929 - DNA, 22 bp, Homo sapiens
attgctaggaacaggttgcacc

SEQ ID NO: 6942930 - DNA, 22 bp, Homo sapiens
agtctgcttttgtgaagagctg

SEQ ID NO: 6942931 - DNA, 22 bp, Homo sapiens
acatgcatacacgtacatacct

SEQ ID NO: 6942932 - DNA, 23 bp, Homo sapiens
cgtgtccttcagggagagtgtgg

SEQ ID NO: 6942933 - DNA, 22 bp, Homo sapiens
tagttaaagagatccacattcc

SEQ ID NO: 6942934 - DNA, 22 bp, Homo sapiens
cccctggggatcagctggaatt

SEQ ID NO: 6942935 - DNA, 22 bp, Homo sapiens
ttccctctttcactgtgatttt

SEQ ID NO: 6942936 - DNA, 22 bp, Homo sapiens
gctctgagcccccagaagcaga

SEQ ID NO: 6942937 - DNA, 22 bp, Homo sapiens
acagagcttaattcaggagctt

SEQ ID NO: 6942938 - DNA, 20 bp, Homo sapiens
agaaacagcacaattctgtt

SEQ ID NO: 6942939 - DNA, 22 bp, Homo sapiens
atttcttgtgggaaatgcagca

SEQ ID NO: 6942940 - DNA, 22 bp, Homo sapiens
aaatgtcctgagattcaactta

SEQ ID NO: 6942941 - DNA, 22 bp, Homo sapiens
cttgctgctctggagtcatgcc

SEQ ID NO: 6942942 - DNA, 22 bp, Homo sapiens
acaagttccactacagagttgt

SEQ ID NO: 6942943 - DNA, 22 bp, Homo sapiens
gcagaattgaaatgtgtcactt

SEQ ID NO: 6942944 - DNA, 22 bp, Homo sapiens
gcctatacaaactgagcttgag

SEQ ID NO: 6942945 - DNA, 22 bp, Homo sapiens
actgcagccccctattaggact

SEQ ID NO: 6942946 - DNA, 22 bp, Homo sapiens
gtgaataacctactccaggcct

SEQ ID NO: 6942947 - DNA, 22 bp, Homo sapiens
taagggaacagcttcaaactca

SEQ ID NO: 6942948 - DNA, 22 bp, Homo sapiens
gttgtaaatgactggcattggg

SEQ ID NO: 6942949 - DNA, 22 bp, Homo sapiens
aggctgtagtgcatgtgctatg

SEQ ID NO: 6942950 - DNA, 22 bp, Homo sapiens
aacacatatttttgctgagcat

SEQ ID NO: 6942951 - DNA, 22 bp, Homo sapiens
gtgagcatcaaaaacgtgtatg

SEQ ID NO: 6942952 - DNA, 22 bp, Homo sapiens
atggtcaaagataaagtgatct

SEQ ID NO: 6942953 - DNA, 22 bp, Homo sapiens
ggcaaaaaccataattactttt

SEQ ID NO: 6942954 - DNA, 22 bp, Homo sapiens
gcctgttaaacatgcggctcaa

SEQ ID NO: 6942955 - DNA, 22 bp, Homo sapiens
tgcaaattcaaacattttcctg

SEQ ID NO: 6942956 - DNA, 22 bp, Homo sapiens
gtgagagaaattggagggaatg

SEQ ID NO: 6942957 - DNA, 22 bp, Homo sapiens
cccagcctactctgccatagca

SEQ ID NO: 6942958 - DNA, 22 bp, Homo sapiens
agcagcagctctgttgccctac

SEQ ID NO: 6942959 - DNA, 22 bp, Homo sapiens
tccaggaaagtgggatgtgtgt

SEQ ID NO: 6942960 - DNA, 22 bp, Homo sapiens
atctttaaagacatgtgaactt

SEQ ID NO: 6942961 - DNA, 22 bp, Homo sapiens
agcaggcaaggtccgtgcctcg

SEQ ID NO: 6942962 - DNA, 22 bp, Homo sapiens
ttgggagttcctactgcggttt

SEQ ID NO: 6942963 - DNA, 22 bp, Homo sapiens
tcagagcaacttttcctgcttt

SEQ ID NO: 6942964 - DNA, 22 bp, Homo sapiens
atactacatactatgtaaacat

SEQ ID NO: 6942965 - DNA, 22 bp, Homo sapiens
gctgagcctagctgtctcctgt

SEQ ID NO: 6942966 - DNA, 22 bp, Homo sapiens
ctgcatccatgttgctgcaaag

SEQ ID NO: 6942967 - DNA, 22 bp, Homo sapiens
cagaaagccctatgtacagtgg

SEQ ID NO: 6942968 - DNA, 22 bp, Homo sapiens
gttaagaattcgttctcatgtt

SEQ ID NO: 6942969 - DNA, 22 bp, Homo sapiens
ttgaattcatttctcattgagt

SEQ ID NO: 6942970 - DNA, 22 bp, Homo sapiens
tcattgcagtagggagagaccc

SEQ ID NO: 6942971 - DNA, 23 bp, Homo sapiens
ttgagcatttgtggatactgaaa

SEQ ID NO: 6942972 - DNA, 20 bp, Homo sapiens
tggaaggtcccagaggaatt

SEQ ID NO: 6942973 - DNA, 22 bp, Homo sapiens
agagttgaagtataatagggat

SEQ ID NO: 6942974 - DNA, 22 bp, Homo sapiens
ttgtctgatgttccctcatgat

SEQ ID NO: 6942975 - DNA, 22 bp, Homo sapiens
ttttacaggtgtgagccaccat

SEQ ID NO: 6942976 - DNA, 22 bp, Homo sapiens
tattgattcctgctttctgctc

SEQ ID NO: 6942977 - DNA, 22 bp, Homo sapiens
catgatggatgtgcacttcgct

SEQ ID NO: 6942978 - DNA, 22 bp, Homo sapiens
ggtgatgtttgagttgagacag

SEQ ID NO: 6942979 - DNA, 22 bp, Homo sapiens
ggtggctccgcttccatgggct

SEQ ID NO: 6942980 - DNA, 22 bp, Homo sapiens
cagaggaagttccttgatgaga

SEQ ID NO: 6942981 - DNA, 22 bp, Homo sapiens
atgtttccagctcagctgcagg

SEQ ID NO: 6942982 - DNA, 22 bp, Homo sapiens
tggcaggcagctggcatcctaa

SEQ ID NO: 6942983 - DNA, 18 bp, Homo sapiens
ggtgagggagctggaagc

SEQ ID NO: 6942984 - DNA, 22 bp, Homo sapiens
tcccagaatctccagtgctaca

SEQ ID NO: 6942985 - DNA, 22 bp, Homo sapiens
ttggcagcatacagttggattg

SEQ ID NO: 6942986 - DNA, 23 bp, Homo sapiens
tgcttaattcctctgcttcacct

SEQ ID NO: 6942987 - DNA, 22 bp, Homo sapiens
taaggtttcttcagatactagt

SEQ ID NO: 6942988 - DNA, 22 bp, Homo sapiens
gcctttggatggtttttctatt

SEQ ID NO: 6942989 - DNA, 22 bp, Homo sapiens
agatgcctgccagttatttagc

SEQ ID NO: 6942990 - DNA, 22 bp, Homo sapiens
ggaagggaatccatctggttag

SEQ ID NO: 6942991 - DNA, 22 bp, Homo sapiens
tgggcggactcgggcatggaat

SEQ ID NO: 6942992 - DNA, 22 bp, Homo sapiens
aaggtgttcaggttttcccatt

SEQ ID NO: 6942993 - DNA, 22 bp, Homo sapiens
gtaacattttgagcagtaggct

SEQ ID NO: 6942994 - DNA, 22 bp, Homo sapiens
cagaagaaagtggggagacaag

SEQ ID NO: 6942995 - DNA, 22 bp, Homo sapiens
tggaaactatagtcacaataga

SEQ ID NO: 6942996 - DNA, 22 bp, Homo sapiens
cagcaggagcagtcagactcct

SEQ ID NO: 6942997 - DNA, 22 bp, Homo sapiens
gtacaggcagcaaacaccataa

SEQ ID NO: 6942998 - DNA, 22 bp, Homo sapiens
tcgggctcctgcacttggagac

SEQ ID NO: 6942999 - DNA, 22 bp, Homo sapiens
ggcattgatgggagatggtgga

SEQ ID NO: 6943000 - DNA, 22 bp, Homo sapiens
acagctggaggtctgtgagcac

SEQ ID NO: 6943001 - DNA, 22 bp, Homo sapiens
tatcctactccttcacaccttg

SEQ ID NO: 6943002 - DNA, 22 bp, Homo sapiens
tatttccagcagtaagaagaca

SEQ ID NO: 6943003 - DNA, 22 bp, Homo sapiens
cagtaatatctgttgaagctat

SEQ ID NO: 6943004 - DNA, 22 bp, Homo sapiens
cagcccttccttctgtttatac

SEQ ID NO: 6943005 - DNA, 22 bp, Homo sapiens
ctgggctctaagggagcaccgt

SEQ ID NO: 6943006 - DNA, 22 bp, Homo sapiens
agtatgttgacttattcttgga

SEQ ID NO: 6943007 - DNA, 22 bp, Homo sapiens
ccctccctgaagaagttactct

SEQ ID NO: 6943008 - DNA, 22 bp, Homo sapiens
tccaatgtgtttgtggcatgga

SEQ ID NO: 6943009 - DNA, 22 bp, Homo sapiens
agccctgagctggcctgggctt

SEQ ID NO: 6943010 - DNA, 22 bp, Homo sapiens
attcacacatactcatgtgtga

SEQ ID NO: 6943011 - DNA, 22 bp, Homo sapiens
atggctggaagagtcgaagagt

SEQ ID NO: 6943012 - DNA, 22 bp, Homo sapiens
acactgacgcttgacagtcacc

SEQ ID NO: 6943013 - DNA, 22 bp, Homo sapiens
cattttgtaagtctctcttgtt

SEQ ID NO: 6943014 - DNA, 22 bp, Homo sapiens
tcagccagtttgattctatttg

SEQ ID NO: 6943015 - DNA, 22 bp, Homo sapiens
accaggactttgtattcagctt

SEQ ID NO: 6943016 - DNA, 22 bp, Homo sapiens
gcccagcaggggatggcagctc

SEQ ID NO: 6943017 - DNA, 22 bp, Homo sapiens
ggtttccaatgacaaacactgt

SEQ ID NO: 6943018 - DNA, 22 bp, Homo sapiens
gggcctgactgagagctcctca

SEQ ID NO: 6943019 - DNA, 15 bp, Homo sapiens
tccagtggaggcact

SEQ ID NO: 6943020 - DNA, 22 bp, Homo sapiens
atcacattctttcaaagcagtc

SEQ ID NO: 6943021 - DNA, 19 bp, Homo sapiens
gctgggtgaggtcgttgga

SEQ ID NO: 6943022 - DNA, 22 bp, Homo sapiens
gtagagcaggacttgagatgtt

SEQ ID NO: 6943023 - DNA, 23 bp, Homo sapiens
caaaagttagcccttcccatctc

SEQ ID NO: 6943024 - DNA, 22 bp, Homo sapiens
aagagctgtgggtggtagtcct

SEQ ID NO: 6943025 - DNA, 22 bp, Homo sapiens
ctgccacaggggagcaggcaga

SEQ ID NO: 6943026 - DNA, 22 bp, Homo sapiens
actggctgatcacctgcctcag

SEQ ID NO: 6943027 - DNA, 22 bp, Homo sapiens
cacactgccacattcactcttc

SEQ ID NO: 6943028 - DNA, 22 bp, Homo sapiens
atgtggcagtgggaggtgaatt

SEQ ID NO: 6943029 - DNA, 22 bp, Homo sapiens
aaatttctaagcagccacttcc

SEQ ID NO: 6943030 - DNA, 22 bp, Homo sapiens
gaatgtccctgcagttgctgcc

SEQ ID NO: 6943031 - DNA, 22 bp, Homo sapiens
atcaggatgctgtcagttacca

SEQ ID NO: 6943032 - DNA, 22 bp, Homo sapiens
tcctaaagtccaggtgggaatt

SEQ ID NO: 6943033 - DNA, 22 bp, Homo sapiens
ttccagttggagcctgccttta

SEQ ID NO: 6943034 - DNA, 22 bp, Homo sapiens
cctctgtccccagtgcaggcct

SEQ ID NO: 6943035 - DNA, 22 bp, Homo sapiens
cccttcaagctctctgggtttt

SEQ ID NO: 6943036 - DNA, 22 bp, Homo sapiens
ccataaagtaggaaacactaca

SEQ ID NO: 6943037 - DNA, 22 bp, Homo sapiens
gttatatatagtatttctctga

SEQ ID NO: 6943038 - DNA, 22 bp, Homo sapiens
cttgaaagtcagcagagtggat

SEQ ID NO: 6943039 - DNA, 22 bp, Homo sapiens
acttcacaaagagatcatctaa

SEQ ID NO: 6943040 - DNA, 22 bp, Homo sapiens
ttgtttggaacttggtgccacc

SEQ ID NO: 6943041 - DNA, 22 bp, Homo sapiens
aagggattgatcttgacacagt

SEQ ID NO: 6943042 - DNA, 22 bp, Homo sapiens
tgattttattgaaacttcactt

SEQ ID NO: 6943043 - DNA, 22 bp, Homo sapiens
ggcatgtgcctgaggtcacaca

SEQ ID NO: 6943044 - DNA, 17 bp, Homo sapiens
acatttgcaaaggtctg

SEQ ID NO: 6943045 - DNA, 23 bp, Homo sapiens
tctgttcaaggctttctccttga

SEQ ID NO: 6943046 - DNA, 22 bp, Homo sapiens
ggaagagggaaccacgactgta

SEQ ID NO: 6943047 - DNA, 22 bp, Homo sapiens
accctggaggtggaggtgcagt

SEQ ID NO: 6943048 - DNA, 22 bp, Homo sapiens
aatggcttgcaaatgggtccat

SEQ ID NO: 6943049 - DNA, 22 bp, Homo sapiens
atctgtaactgctatcatctcc

SEQ ID NO: 6943050 - DNA, 22 bp, Homo sapiens
cacccacccagaagatcctggc

SEQ ID NO: 6943051 - DNA, 22 bp, Homo sapiens
gtggacatgcatacatatgttt

SEQ ID NO: 6943052 - DNA, 22 bp, Homo sapiens
gcatgcaaggggtgtgaagtga

SEQ ID NO: 6943053 - DNA, 22 bp, Homo sapiens
ttcctcagtgcccccatacggt

SEQ ID NO: 6943054 - DNA, 22 bp, Homo sapiens
tggctaggaatccatgactctc

SEQ ID NO: 6943055 - DNA, 22 bp, Homo sapiens
ttccttctattcagctccaaga

SEQ ID NO: 6943056 - DNA, 22 bp, Homo sapiens
atgtcttcatagcttatatcca

SEQ ID NO: 6943057 - DNA, 22 bp, Homo sapiens
agaggccagcagtgcctatctg

SEQ ID NO: 6943058 - DNA, 22 bp, Homo sapiens
attgagaaggagattggcatct

SEQ ID NO: 6943059 - DNA, 22 bp, Homo sapiens
ctcttgatgactgttgctggtt

SEQ ID NO: 6943060 - DNA, 22 bp, Homo sapiens
cctgggtggctgcctgcctttc

SEQ ID NO: 6943061 - DNA, 22 bp, Homo sapiens
tctgatgtggagacactgtttt

SEQ ID NO: 6943062 - DNA, 22 bp, Homo sapiens
atttcctgtacctatcaaggca

SEQ ID NO: 6943063 - DNA, 19 bp, Homo sapiens
acaatgttgttggacactc

SEQ ID NO: 6943064 - DNA, 23 bp, Homo sapiens
atgcaaagtgctgtcatgtagac

SEQ ID NO: 6943065 - DNA, 22 bp, Homo sapiens
gtgccgctggagctggaattga

SEQ ID NO: 6943066 - DNA, 22 bp, Homo sapiens
gtgcagtactagagcaccagga

SEQ ID NO: 6943067 - DNA, 22 bp, Homo sapiens
ggacagagcagacgagcagcgg

SEQ ID NO: 6943068 - DNA, 21 bp, Homo sapiens
tccactcgtattctgttggca

SEQ ID NO: 6943069 - DNA, 19 bp, Homo sapiens
atttgcttgtctgctctgc

SEQ ID NO: 6943070 - DNA, 22 bp, Homo sapiens
ttgttacttgcatgtagactaa

SEQ ID NO: 6943071 - DNA, 22 bp, Homo sapiens
aatttgttataacttgggctga

SEQ ID NO: 6943072 - DNA, 22 bp, Homo sapiens
ttacatacctcatagactcagg

SEQ ID NO: 6943073 - DNA, 22 bp, Homo sapiens
ttggtgaacacatacacatttt

SEQ ID NO: 6943074 - DNA, 22 bp, Homo sapiens
ggtcagagaaaagtagggtgtt

SEQ ID NO: 6943075 - DNA, 22 bp, Homo sapiens
tgtgcctgagtctcggcccacc

SEQ ID NO: 6943076 - DNA, 22 bp, Homo sapiens
gtttttatatcctgtggagtgt

SEQ ID NO: 6943077 - DNA, 22 bp, Homo sapiens
tagcaatgtgtgtgtataaatt

SEQ ID NO: 6943078 - DNA, 22 bp, Homo sapiens
tgtcctgccagcccggactgtg

SEQ ID NO: 6943079 - DNA, 19 bp, Homo sapiens
agctctgtcaggctacata

SEQ ID NO: 6943080 - DNA, 22 bp, Homo sapiens
aaagtgctgggattacaggcct

SEQ ID NO: 6943081 - DNA, 18 bp, Homo sapiens
tcttcatctcctgagctg

SEQ ID NO: 6943082 - DNA, 22 bp, Homo sapiens
ccagtctgaggcctggtgaggg

SEQ ID NO: 6943083 - DNA, 22 bp, Homo sapiens
cctcagaagctcaaggacattg

SEQ ID NO: 6943084 - DNA, 22 bp, Homo sapiens
taggtggtgtgcgaagagcgtg

SEQ ID NO: 6943085 - DNA, 22 bp, Homo sapiens
tgctggcagtggcagtgatggt

SEQ ID NO: 6943086 - DNA, 22 bp, Homo sapiens
ataattgtgggcagtgtgatat

SEQ ID NO: 6943087 - DNA, 21 bp, Homo sapiens
tctctaaaaagattctatttg

SEQ ID NO: 6943088 - DNA, 22 bp, Homo sapiens
ctttcaatgtgcctgccttggg

SEQ ID NO: 6943089 - DNA, 22 bp, Homo sapiens
cagaatttagcacaatgtatgg

SEQ ID NO: 6943090 - DNA, 22 bp, Homo sapiens
gtggatggagctggaagccatt

SEQ ID NO: 6943091 - DNA, 22 bp, Homo sapiens
cgcatgagacctgccggccatc

SEQ ID NO: 6943092 - DNA, 22 bp, Homo sapiens
ttcaactgggcggatctgagaa

SEQ ID NO: 6943093 - DNA, 22 bp, Homo sapiens
ggggtgagttagcgtcggcttg

SEQ ID NO: 6943094 - DNA, 22 bp, Homo sapiens
actgagacaactgtgtttctaa

SEQ ID NO: 6943095 - DNA, 22 bp, Homo sapiens
gtttgcagttgtcatcctcctg

SEQ ID NO: 6943096 - DNA, 21 bp, Homo sapiens
gtggccctggtgtggctgcac

SEQ ID NO: 6943097 - DNA, 22 bp, Homo sapiens
ctgaattatttaaggtgaaggg

SEQ ID NO: 6943098 - DNA, 22 bp, Homo sapiens
atgttcctcactattttggccc

SEQ ID NO: 6943099 - DNA, 23 bp, Homo sapiens
cacggcagcctccgagggtgctg

SEQ ID NO: 6943100 - DNA, 22 bp, Homo sapiens
tcagagtgttttactaaacaag

SEQ ID NO: 6943101 - DNA, 22 bp, Homo sapiens
gcagtagtccataagtactctg

SEQ ID NO: 6943102 - DNA, 22 bp, Homo sapiens
aggcttcgcaaggttagagctg

SEQ ID NO: 6943103 - DNA, 22 bp, Homo sapiens
actttgcatggaaaatggtcat

SEQ ID NO: 6943104 - DNA, 22 bp, Homo sapiens
gcaagtcctttgcatgcaggga

SEQ ID NO: 6943105 - DNA, 22 bp, Homo sapiens
agaagcacggttttgtctagca

SEQ ID NO: 6943106 - DNA, 20 bp, Homo sapiens
ctgcttaagtaagtgacaca

SEQ ID NO: 6943107 - DNA, 22 bp, Homo sapiens
gacattgacagtcctccttata

SEQ ID NO: 6943108 - DNA, 22 bp, Homo sapiens
ggaatactaaaggaagcaattg

SEQ ID NO: 6943109 - DNA, 22 bp, Homo sapiens
ttacagtgacagttgctatgat

SEQ ID NO: 6943110 - DNA, 22 bp, Homo sapiens
gtcctattagcatattgaatac

SEQ ID NO: 6943111 - DNA, 22 bp, Homo sapiens
ctgagaaggaagcctccactct

SEQ ID NO: 6943112 - DNA, 21 bp, Homo sapiens
atatgccaaatgccagtaacc

SEQ ID NO: 6943113 - DNA, 22 bp, Homo sapiens
tccttggaggtgttcatctgcc

SEQ ID NO: 6943114 - DNA, 22 bp, Homo sapiens
actagttttccataatatagga

SEQ ID NO: 6943115 - DNA, 22 bp, Homo sapiens
tccacttccacgtgtgcagaat

SEQ ID NO: 6943116 - DNA, 22 bp, Homo sapiens
gttcattcatcaaatatttact

SEQ ID NO: 6943117 - DNA, 22 bp, Homo sapiens
tcatcatctgcaagctcatgtc

SEQ ID NO: 6943118 - DNA, 22 bp, Homo sapiens
tgggttataatttgttatgaat

SEQ ID NO: 6943119 - DNA, 22 bp, Homo sapiens
tcagaaatcttgtcaaggcatc

SEQ ID NO: 6943120 - DNA, 19 bp, Homo sapiens
cttcttcttggcagccaag

SEQ ID NO: 6943121 - DNA, 22 bp, Homo sapiens
tgtgtatattaggacacattct

SEQ ID NO: 6943122 - DNA, 22 bp, Homo sapiens
ctgctagcccgccggccagcga

SEQ ID NO: 6943123 - DNA, 22 bp, Homo sapiens
agaatgtgatatagtgatatgt

SEQ ID NO: 6943124 - DNA, 22 bp, Homo sapiens
ggtcaacactgtgaccaacagg

SEQ ID NO: 6943125 - DNA, 20 bp, Homo sapiens
tggttgaatttttagtgacc

SEQ ID NO: 6943126 - DNA, 22 bp, Homo sapiens
gcagggctgggatttgagccca

SEQ ID NO: 6943127 - DNA, 19 bp, Homo sapiens
cagcaagaatgaaggcata

SEQ ID NO: 6943128 - DNA, 21 bp, Homo sapiens
tggacttatggagtgtttctt

SEQ ID NO: 6943129 - DNA, 22 bp, Homo sapiens
ctgcctgctgacattctttata

SEQ ID NO: 6943130 - DNA, 22 bp, Homo sapiens
agtggcagggacttcatataaa

SEQ ID NO: 6943131 - DNA, 22 bp, Homo sapiens
catggcaggaggctgctggcag

SEQ ID NO: 6943132 - DNA, 22 bp, Homo sapiens
ttacaacttgcagaggatgttg

SEQ ID NO: 6943133 - DNA, 22 bp, Homo sapiens
cctctgtgtgtgcatgcatgcg

SEQ ID NO: 6943134 - DNA, 22 bp, Homo sapiens
caagctgccaccagaagagcat

SEQ ID NO: 6943135 - DNA, 22 bp, Homo sapiens
acagtgtttggcaatgcatgca

SEQ ID NO: 6943136 - DNA, 20 bp, Homo sapiens
ctggaagcctttccagagca

SEQ ID NO: 6943137 - DNA, 22 bp, Homo sapiens
ccagcttttcctctcattgctt

SEQ ID NO: 6943138 - DNA, 22 bp, Homo sapiens
tcaggaagtggtaaaggatgtt

SEQ ID NO: 6943139 - DNA, 22 bp, Homo sapiens
agtccccctctgagcccaggga

SEQ ID NO: 6943140 - DNA, 22 bp, Homo sapiens
acagtggcagtcgtgttctcta

SEQ ID NO: 6943141 - DNA, 22 bp, Homo sapiens
atggtcttctcaagcaacactg

SEQ ID NO: 6943142 - DNA, 22 bp, Homo sapiens
taaattgtcctccccctggtat

SEQ ID NO: 6943143 - DNA, 22 bp, Homo sapiens
acagttagtgagatgtctgttt

SEQ ID NO: 6943144 - DNA, 22 bp, Homo sapiens
caaagccatagagtagataaga

SEQ ID NO: 6943145 - DNA, 22 bp, Homo sapiens
tgaaatagacttgcactatatg

SEQ ID NO: 6943146 - DNA, 22 bp, Homo sapiens
ctcagcactgacccaggagatg

SEQ ID NO: 6943147 - DNA, 21 bp, Homo sapiens
aggagaaacacaggtcagccc

SEQ ID NO: 6943148 - DNA, 22 bp, Homo sapiens
cagctggatgggagaccatgtt

SEQ ID NO: 6943149 - DNA, 22 bp, Homo sapiens
gatttggcctttcgcatggtat

SEQ ID NO: 6943150 - DNA, 22 bp, Homo sapiens
tcagtccctcgcaccctgccat

SEQ ID NO: 6943151 - DNA, 22 bp, Homo sapiens
acatagcttaaatgagaagata

SEQ ID NO: 6943152 - DNA, 22 bp, Homo sapiens
cctgtgtggccgcactgctccc

SEQ ID NO: 6943153 - DNA, 19 bp, Homo sapiens
tctgacagccccagtcaac

SEQ ID NO: 6943154 - DNA, 22 bp, Homo sapiens
gtcttttttacaccttacatca

SEQ ID NO: 6943155 - DNA, 22 bp, Homo sapiens
caaggaatatttaagaacgtca

SEQ ID NO: 6943156 - DNA, 22 bp, Homo sapiens
ttctcacattcagaacttttat

SEQ ID NO: 6943157 - DNA, 20 bp, Homo sapiens
acatgcgcaggccagtgggc

SEQ ID NO: 6943158 - DNA, 22 bp, Homo sapiens
tgcttctgctgatattttgtga

SEQ ID NO: 6943159 - DNA, 22 bp, Homo sapiens
ggaagtattcaatcctgccaca

SEQ ID NO: 6943160 - DNA, 22 bp, Homo sapiens
actttcatgttggtgaagggtt

SEQ ID NO: 6943161 - DNA, 19 bp, Homo sapiens
ccaggccatcccagttccc

SEQ ID NO: 6943162 - DNA, 22 bp, Homo sapiens
ggcctctgcaggcctcgacaag

SEQ ID NO: 6943163 - DNA, 22 bp, Homo sapiens
attagaatgcagggttcattgt

SEQ ID NO: 6943164 - DNA, 22 bp, Homo sapiens
gtgggcaggtaggcaccagcta

SEQ ID NO: 6943165 - DNA, 22 bp, Homo sapiens
tggccctgtcctcatttcatct

SEQ ID NO: 6943166 - DNA, 22 bp, Homo sapiens
gctctttagacatagtctgaag

SEQ ID NO: 6943167 - DNA, 22 bp, Homo sapiens
catctttgaactctgtataaac

SEQ ID NO: 6943168 - DNA, 22 bp, Homo sapiens
tcaacttggctttttaaagtcc

SEQ ID NO: 6943169 - DNA, 22 bp, Homo sapiens
ttcgtatttatattctcaatac

SEQ ID NO: 6943170 - DNA, 22 bp, Homo sapiens
agcagagcctgggctaggggtg

SEQ ID NO: 6943171 - DNA, 20 bp, Homo sapiens
aggctgcctaaggctctgca

SEQ ID NO: 6943172 - DNA, 22 bp, Homo sapiens
tgagagagggatgcaccctcct

SEQ ID NO: 6943173 - DNA, 22 bp, Homo sapiens
gggatctgagtaggcagaagct

SEQ ID NO: 6943174 - DNA, 22 bp, Homo sapiens
caccatcttttggaggggaatt

SEQ ID NO: 6943175 - DNA, 22 bp, Homo sapiens
caaagccaggctttctaatgta

SEQ ID NO: 6943176 - DNA, 20 bp, Homo sapiens
tctgggttgaaatcaagatc

SEQ ID NO: 6943177 - DNA, 22 bp, Homo sapiens
accaaataggcttcctgggttg

SEQ ID NO: 6943178 - DNA, 22 bp, Homo sapiens
tttaaatgctttaagcaagggt

SEQ ID NO: 6943179 - DNA, 22 bp, Homo sapiens
taatctgttaatatttgtatcc

SEQ ID NO: 6943180 - DNA, 22 bp, Homo sapiens
gggcactgaatgccaagctagg

SEQ ID NO: 6943181 - DNA, 22 bp, Homo sapiens
aatgaactggagaacaatgacc

SEQ ID NO: 6943182 - DNA, 22 bp, Homo sapiens
aagctgccctgtgttagagttc

SEQ ID NO: 6943183 - DNA, 22 bp, Homo sapiens
atgccactgcgctccagcctgg

SEQ ID NO: 6943184 - DNA, 22 bp, Homo sapiens
gccagccagggaagggagagac

SEQ ID NO: 6943185 - DNA, 17 bp, Homo sapiens
cagccagtcccttcatt

SEQ ID NO: 6943186 - DNA, 17 bp, Homo sapiens
acacatcttggctttgc

SEQ ID NO: 6943187 - DNA, 22 bp, Homo sapiens
ccaagtcctgtctctcaatcat

SEQ ID NO: 6943188 - DNA, 22 bp, Homo sapiens
ctttggtaccaccccagagtgg

SEQ ID NO: 6943189 - DNA, 22 bp, Homo sapiens
aatggcttttgcacttaaatcg

SEQ ID NO: 6943190 - DNA, 22 bp, Homo sapiens
acactagctaaatgctgattaa

SEQ ID NO: 6943191 - DNA, 22 bp, Homo sapiens
tgagccaggctccatgccacct

SEQ ID NO: 6943192 - DNA, 22 bp, Homo sapiens
ccttttctacaagcaaatgtgc

SEQ ID NO: 6943193 - DNA, 22 bp, Homo sapiens
attatagggaattctagaagtc

SEQ ID NO: 6943194 - DNA, 23 bp, Homo sapiens
accagcaaaaatgacagcccagg

SEQ ID NO: 6943195 - DNA, 22 bp, Homo sapiens
gcctgctggacattggccggcc

SEQ ID NO: 6943196 - DNA, 22 bp, Homo sapiens
aaacagtttcattttcatgacc

SEQ ID NO: 6943197 - DNA, 22 bp, Homo sapiens
tggtaaaaactgcaattacttt

SEQ ID NO: 6943198 - DNA, 22 bp, Homo sapiens
aagcagagaatctgggagcgag

SEQ ID NO: 6943199 - DNA, 22 bp, Homo sapiens
cctggatctaaggaagctggga

SEQ ID NO: 6943200 - DNA, 22 bp, Homo sapiens
tccagcttgcttcaggatggtc

SEQ ID NO: 6943201 - DNA, 22 bp, Homo sapiens
tcacagacgcctcccctcgcct

SEQ ID NO: 6943202 - DNA, 19 bp, Homo sapiens
aaatggctttctacttaat

SEQ ID NO: 6943203 - DNA, 22 bp, Homo sapiens
gtctatgtgtaatagcatgtgt

SEQ ID NO: 6943204 - DNA, 17 bp, Homo sapiens
atctctctaaggcaggc

SEQ ID NO: 6943205 - DNA, 20 bp, Homo sapiens
tgccccaggcctgcacctgc

SEQ ID NO: 6943206 - DNA, 22 bp, Homo sapiens
accacatagctttgctttttgt

SEQ ID NO: 6943207 - DNA, 22 bp, Homo sapiens
tcggagctgtagatgaaaccct

SEQ ID NO: 6943208 - DNA, 22 bp, Homo sapiens
tgtaggatgtaaggcaggcatc

SEQ ID NO: 6943209 - DNA, 22 bp, Homo sapiens
ttcacattgtgcagattatggt

SEQ ID NO: 6943210 - DNA, 22 bp, Homo sapiens
tttccaagactccagttctccc

SEQ ID NO: 6943211 - DNA, 22 bp, Homo sapiens
gggaggctgccatccttcagga

SEQ ID NO: 6943212 - DNA, 22 bp, Homo sapiens
gcagtcagacaggaggagctcc

SEQ ID NO: 6943213 - DNA, 22 bp, Homo sapiens
aattctgattagatgcctttgt

SEQ ID NO: 6943214 - DNA, 22 bp, Homo sapiens
ctgacagcgagagagttgcccc

SEQ ID NO: 6943215 - DNA, 22 bp, Homo sapiens
actggcagagggaaaaccattc

SEQ ID NO: 6943216 - DNA, 22 bp, Homo sapiens
gggctgcctttcttctgggagc

SEQ ID NO: 6943217 - DNA, 22 bp, Homo sapiens
ttgcaaagagtcatgtaagtca

SEQ ID NO: 6943218 - DNA, 22 bp, Homo sapiens
tggctttcgctatagagcacgg

SEQ ID NO: 6943219 - DNA, 22 bp, Homo sapiens
tatggcttctgctttcttgact

SEQ ID NO: 6943220 - DNA, 22 bp, Homo sapiens
agcacaggtacggagatgctac

SEQ ID NO: 6943221 - DNA, 22 bp, Homo sapiens
ctgtccagggtgtgcaggggct

SEQ ID NO: 6943222 - DNA, 22 bp, Homo sapiens
cacgatggagtcctatggggca

SEQ ID NO: 6943223 - DNA, 18 bp, Homo sapiens
caggccctgtctggcctc

SEQ ID NO: 6943224 - DNA, 22 bp, Homo sapiens
gtgcaggagctcccgcagtggt

SEQ ID NO: 6943225 - DNA, 23 bp, Homo sapiens
gctacagctgactgtcattccct

SEQ ID NO: 6943226 - DNA, 22 bp, Homo sapiens
gttgacagaaaaataacatagc

SEQ ID NO: 6943227 - DNA, 22 bp, Homo sapiens
tgccctgatgatcctcctcgca

SEQ ID NO: 6943228 - DNA, 22 bp, Homo sapiens
cgggtggttttcatcaagatgg

SEQ ID NO: 6943229 - DNA, 22 bp, Homo sapiens
tatgaactgtgagtgtgatggg

SEQ ID NO: 6943230 - DNA, 22 bp, Homo sapiens
agctgagggcaggatggggtga

SEQ ID NO: 6943231 - DNA, 22 bp, Homo sapiens
attggcatattggctactttca

SEQ ID NO: 6943232 - DNA, 22 bp, Homo sapiens
tgtaagaaaagtaaatagtgac

SEQ ID NO: 6943233 - DNA, 22 bp, Homo sapiens
tcagcctcaggtgttcagattt

SEQ ID NO: 6943234 - DNA, 22 bp, Homo sapiens
tggcaaggctgtgggggcagag

SEQ ID NO: 6943235 - DNA, 22 bp, Homo sapiens
gctgagcaggtgtaaggaaggc

SEQ ID NO: 6943236 - DNA, 22 bp, Homo sapiens
cagaatttaagtggattattct

SEQ ID NO: 6943237 - DNA, 22 bp, Homo sapiens
acgtggagagaatagggcacca

SEQ ID NO: 6943238 - DNA, 22 bp, Homo sapiens
attctgcataatttcctggcag

SEQ ID NO: 6943239 - DNA, 22 bp, Homo sapiens
ctgttatctgttattgccagtt

SEQ ID NO: 6943240 - DNA, 22 bp, Homo sapiens
cttgaatctggctttgccactt

SEQ ID NO: 6943241 - DNA, 22 bp, Homo sapiens
ccttccttgagaagcaattcct

SEQ ID NO: 6943242 - DNA, 22 bp, Homo sapiens
atacagtaattgcataggcttc

SEQ ID NO: 6943243 - DNA, 22 bp, Homo sapiens
aaggcagttcactcacgcagcc

SEQ ID NO: 6943244 - DNA, 22 bp, Homo sapiens
attagcaaattctaattcacta

SEQ ID NO: 6943245 - DNA, 22 bp, Homo sapiens
tacagaatgtgtatcattacca

SEQ ID NO: 6943246 - DNA, 22 bp, Homo sapiens
agggttgcaccatgttggtcag

SEQ ID NO: 6943247 - DNA, 22 bp, Homo sapiens
aaggtcattttttcctctgttg

SEQ ID NO: 6943248 - DNA, 22 bp, Homo sapiens
ttgatgcttaaggtaaaacaga

SEQ ID NO: 6943249 - DNA, 22 bp, Homo sapiens
ctgaggtggcatcctagctcta

SEQ ID NO: 6943250 - DNA, 22 bp, Homo sapiens
tcatgcttaaaagacacttgag

SEQ ID NO: 6943251 - DNA, 22 bp, Homo sapiens
atttggtagtgattgaaattat

SEQ ID NO: 6943252 - DNA, 22 bp, Homo sapiens
acagctcagacatcactgctct

SEQ ID NO: 6943253 - DNA, 22 bp, Homo sapiens
ggagcagcctgtgtagacgggg

SEQ ID NO: 6943254 - DNA, 22 bp, Homo sapiens
atgcatgtttaaggggcatgca

SEQ ID NO: 6943255 - DNA, 22 bp, Homo sapiens
acaggaagaaagtgcagtagat

SEQ ID NO: 6943256 - DNA, 22 bp, Homo sapiens
ttctctggaaggctctacggga

SEQ ID NO: 6943257 - DNA, 22 bp, Homo sapiens
caggcagagtgagaagcccttg

SEQ ID NO: 6943258 - DNA, 22 bp, Homo sapiens
atagtacagagggctactggtt

SEQ ID NO: 6943259 - DNA, 21 bp, Homo sapiens
gtacagggatagtagtgtcaa

SEQ ID NO: 6943260 - DNA, 22 bp, Homo sapiens
ccaaccattggctaagaattgg

SEQ ID NO: 6943261 - DNA, 22 bp, Homo sapiens
tgaggcttggaggctccagtgg

SEQ ID NO: 6943262 - DNA, 22 bp, Homo sapiens
cctgtgacccttccagtctact

SEQ ID NO: 6943263 - DNA, 22 bp, Homo sapiens
tgaacagtgatctacatgtggc

SEQ ID NO: 6943264 - DNA, 17 bp, Homo sapiens
ccttcctcatctccttc

SEQ ID NO: 6943265 - DNA, 22 bp, Homo sapiens
acaagcatgggctttgacatca

SEQ ID NO: 6943266 - DNA, 22 bp, Homo sapiens
tcatgctttgttaatgtggcac

SEQ ID NO: 6943267 - DNA, 22 bp, Homo sapiens
aaagtgcagtccatgaaattaa

SEQ ID NO: 6943268 - DNA, 22 bp, Homo sapiens
caggggctgaaatgttggggtt

SEQ ID NO: 6943269 - DNA, 22 bp, Homo sapiens
tcaggacaatagtgatttttac

SEQ ID NO: 6943270 - DNA, 22 bp, Homo sapiens
taggggtcccactctcagagtt

SEQ ID NO: 6943271 - DNA, 22 bp, Homo sapiens
gcacatgtgggtaagcacatgg

SEQ ID NO: 6943272 - DNA, 22 bp, Homo sapiens
tccatgtgccaaggggcagagg

SEQ ID NO: 6943273 - DNA, 22 bp, Homo sapiens
cagggcttctataccaattcat

SEQ ID NO: 6943274 - DNA, 22 bp, Homo sapiens
gccacacttattctcatgcaca

SEQ ID NO: 6943275 - DNA, 22 bp, Homo sapiens
aggcatttttgttaatctttgg

SEQ ID NO: 6943276 - DNA, 22 bp, Homo sapiens
gaggagccaaggtatgtgtgtt

SEQ ID NO: 6943277 - DNA, 22 bp, Homo sapiens
gaggtgttgggtgaggtgcctg

SEQ ID NO: 6943278 - DNA, 22 bp, Homo sapiens
agctgagttaattcatcactta

SEQ ID NO: 6943279 - DNA, 22 bp, Homo sapiens
ttcctcaggtgctacaaagcag

SEQ ID NO: 6943280 - DNA, 22 bp, Homo sapiens
gaagtcctggtcctctcattca

SEQ ID NO: 6943281 - DNA, 22 bp, Homo sapiens
aaagcagcctgctcatcctgga

SEQ ID NO: 6943282 - DNA, 22 bp, Homo sapiens
tctacactccagagtctcatca

SEQ ID NO: 6943283 - DNA, 22 bp, Homo sapiens
gggcggatcatttgaggtcagg

SEQ ID NO: 6943284 - DNA, 22 bp, Homo sapiens
ctgaggtttacaagctattgct

SEQ ID NO: 6943285 - DNA, 22 bp, Homo sapiens
attctgctcattttatttccag

SEQ ID NO: 6943286 - DNA, 22 bp, Homo sapiens
cagggtcaagagactccagcag

SEQ ID NO: 6943287 - DNA, 22 bp, Homo sapiens
ctgcctctgcgtcccacagagt

SEQ ID NO: 6943288 - DNA, 22 bp, Homo sapiens
ggctcagcccccacgcttcttc

SEQ ID NO: 6943289 - DNA, 22 bp, Homo sapiens
atttccagactttttccaggaa

SEQ ID NO: 6943290 - DNA, 22 bp, Homo sapiens
aacctagacagggcctctgtta

SEQ ID NO: 6943291 - DNA, 22 bp, Homo sapiens
tttagcaacgaagcactcgaca

SEQ ID NO: 6943292 - DNA, 22 bp, Homo sapiens
tcaggaagaaattctgtatctt

SEQ ID NO: 6943293 - DNA, 15 bp, Homo sapiens
aacccagagccttcc

SEQ ID NO: 6943294 - DNA, 22 bp, Homo sapiens
gaggttccagacagcttaggga

SEQ ID NO: 6943295 - DNA, 20 bp, Homo sapiens
ctgaccagcagcctgtctcc

SEQ ID NO: 6943296 - DNA, 22 bp, Homo sapiens
aggtgccaattttcagtgaaca

SEQ ID NO: 6943297 - DNA, 22 bp, Homo sapiens
agcattgaggtgggtttctctt

SEQ ID NO: 6943298 - DNA, 22 bp, Homo sapiens
tttccagtgattgctgctctca

SEQ ID NO: 6943299 - DNA, 22 bp, Homo sapiens
gcaaatgaactgatgccaatgg

SEQ ID NO: 6943300 - DNA, 22 bp, Homo sapiens
caatgatgtttagataaaatcc

SEQ ID NO: 6943301 - DNA, 22 bp, Homo sapiens
tttgtaaaggcctgaatttcag

SEQ ID NO: 6943302 - DNA, 17 bp, Homo sapiens
taggagactggctgtcc

SEQ ID NO: 6943303 - DNA, 22 bp, Homo sapiens
ccaggcccccgagcagaagaca

SEQ ID NO: 6943304 - DNA, 22 bp, Homo sapiens
atacagaagcctgtatttctgg

SEQ ID NO: 6943305 - DNA, 22 bp, Homo sapiens
tcacagtaactttgttgctttt

SEQ ID NO: 6943306 - DNA, 22 bp, Homo sapiens
ctccagattccgtttattcagg

SEQ ID NO: 6943307 - DNA, 22 bp, Homo sapiens
cactggaagttcattctcagaa

SEQ ID NO: 6943308 - DNA, 22 bp, Homo sapiens
tatccaaacatatagtctctct

SEQ ID NO: 6943309 - DNA, 22 bp, Homo sapiens
gatgcactgcagtatatactgt

SEQ ID NO: 6943310 - DNA, 22 bp, Homo sapiens
tcttaagccactgagaaaataa

SEQ ID NO: 6943311 - DNA, 22 bp, Homo sapiens
agatacagcctgccaggttctt

SEQ ID NO: 6943312 - DNA, 22 bp, Homo sapiens
ttgccagggctttggtggcatc

SEQ ID NO: 6943313 - DNA, 22 bp, Homo sapiens
atggccaagcatgcctgtggcc

SEQ ID NO: 6943314 - DNA, 22 bp, Homo sapiens
gtagaactccagttctgtggca

SEQ ID NO: 6943315 - DNA, 22 bp, Homo sapiens
ttacagtaacattttcagtctg

SEQ ID NO: 6943316 - DNA, 22 bp, Homo sapiens
attacagaagatatgctcaaca

SEQ ID NO: 6943317 - DNA, 22 bp, Homo sapiens
tggctcagagagggagtgtgga

SEQ ID NO: 6943318 - DNA, 22 bp, Homo sapiens
ggtcccaatctaatcacatgag

SEQ ID NO: 6943319 - DNA, 22 bp, Homo sapiens
cacatgcatgccaggctcacag

SEQ ID NO: 6943320 - DNA, 22 bp, Homo sapiens
ctcctgggggacagcggcaggg

SEQ ID NO: 6943321 - DNA, 20 bp, Homo sapiens
gagtatgtaggatggtatca

SEQ ID NO: 6943322 - DNA, 19 bp, Homo sapiens
gggagttgttctgatccta

SEQ ID NO: 6943323 - DNA, 22 bp, Homo sapiens
tctctgtgcccagtagttctct

SEQ ID NO: 6943324 - DNA, 22 bp, Homo sapiens
tcacttattaactcataccatt

SEQ ID NO: 6943325 - DNA, 22 bp, Homo sapiens
cctctgtgatttctgagccaat

SEQ ID NO: 6943326 - DNA, 22 bp, Homo sapiens
ctgtatggtggttatgtaagag

SEQ ID NO: 6943327 - DNA, 22 bp, Homo sapiens
ctaggaatccttttagagttgg

SEQ ID NO: 6943328 - DNA, 22 bp, Homo sapiens
tttagaagggctggtcagaaat

SEQ ID NO: 6943329 - DNA, 22 bp, Homo sapiens
agacataagccagtcactcact

SEQ ID NO: 6943330 - DNA, 22 bp, Homo sapiens
cactctgggctcttgtttcaga

SEQ ID NO: 6943331 - DNA, 20 bp, Homo sapiens
cctggctttgcatctgtgat

SEQ ID NO: 6943332 - DNA, 22 bp, Homo sapiens
tggcatgggcaaaccagggaaa

SEQ ID NO: 6943333 - DNA, 22 bp, Homo sapiens
cagctggctccacctctgggct

SEQ ID NO: 6943334 - DNA, 22 bp, Homo sapiens
gctggcttccatgcggacatca

SEQ ID NO: 6943335 - DNA, 19 bp, Homo sapiens
cctttggatttgtttagtc

SEQ ID NO: 6943336 - DNA, 22 bp, Homo sapiens
tgtctatagcctgatttgttgg

SEQ ID NO: 6943337 - DNA, 22 bp, Homo sapiens
ttggaattaaaaggagaacttc

SEQ ID NO: 6943338 - DNA, 22 bp, Homo sapiens
tacgggaagtacagcggaaccc

SEQ ID NO: 6943339 - DNA, 22 bp, Homo sapiens
tttggtgtctggctgtatggac

SEQ ID NO: 6943340 - DNA, 22 bp, Homo sapiens
aagtcgtcgaagatggaggttg

SEQ ID NO: 6943341 - DNA, 22 bp, Homo sapiens
tcaagaagtctgtaccatttga

SEQ ID NO: 6943342 - DNA, 22 bp, Homo sapiens
tgggctctgcatcagtgcccat

SEQ ID NO: 6943343 - DNA, 17 bp, Homo sapiens
aacagttaatgggggaa

SEQ ID NO: 6943344 - DNA, 22 bp, Homo sapiens
tgcctccaggaggggcagctct

SEQ ID NO: 6943345 - DNA, 22 bp, Homo sapiens
ttctggttctcaggaatgctaa

SEQ ID NO: 6943346 - DNA, 22 bp, Homo sapiens
tggaatcagttacatgtggttg

SEQ ID NO: 6943347 - DNA, 22 bp, Homo sapiens
catgtgggacaatctcaggtat

SEQ ID NO: 6943348 - DNA, 22 bp, Homo sapiens
gtctgtcactcaggggctggag

SEQ ID NO: 6943349 - DNA, 22 bp, Homo sapiens
ggctgagtctgtgacccatgcg

SEQ ID NO: 6943350 - DNA, 22 bp, Homo sapiens
ggaagaaagacatttattttga

SEQ ID NO: 6943351 - DNA, 22 bp, Homo sapiens
gagctttgtagcaggaaggaag

SEQ ID NO: 6943352 - DNA, 22 bp, Homo sapiens
tgcatatatttgagattatggc

SEQ ID NO: 6943353 - DNA, 22 bp, Homo sapiens
ctccaggaccagggctcctgga

SEQ ID NO: 6943354 - DNA, 22 bp, Homo sapiens
aggtccagttttcagttctcat

SEQ ID NO: 6943355 - DNA, 22 bp, Homo sapiens
tgtctgaaggcaggtggagaac

SEQ ID NO: 6943356 - DNA, 17 bp, Homo sapiens
tctcctggctctatcag

SEQ ID NO: 6943357 - DNA, 22 bp, Homo sapiens
gctgggtcctatgctggtagag

SEQ ID NO: 6943358 - DNA, 22 bp, Homo sapiens
ggttactcaagcctgccttctc

SEQ ID NO: 6943359 - DNA, 22 bp, Homo sapiens
agttctggtggtttggagatct

SEQ ID NO: 6943360 - DNA, 22 bp, Homo sapiens
accctttcttactcacacgctc

SEQ ID NO: 6943361 - DNA, 22 bp, Homo sapiens
ttgaggtccccagtacccactg

SEQ ID NO: 6943362 - DNA, 22 bp, Homo sapiens
ctcctccacagacctactgaat

SEQ ID NO: 6943363 - DNA, 22 bp, Homo sapiens
tcagctcctcagagcctcagtt

SEQ ID NO: 6943364 - DNA, 22 bp, Homo sapiens
gcagctgtcactttcacaatgc

SEQ ID NO: 6943365 - DNA, 23 bp, Homo sapiens
agagagagtttgtgtcaggtacc

SEQ ID NO: 6943366 - DNA, 22 bp, Homo sapiens
attgatggagagatttccattg

SEQ ID NO: 6943367 - DNA, 22 bp, Homo sapiens
aggcagtggaaggagaaagcaa

SEQ ID NO: 6943368 - DNA, 22 bp, Homo sapiens
caggggaagatgccaagggaga

SEQ ID NO: 6943369 - DNA, 22 bp, Homo sapiens
gctggagcgggttcgggccgct

SEQ ID NO: 6943370 - DNA, 22 bp, Homo sapiens
aagggccacttactcctgctgt

SEQ ID NO: 6943371 - DNA, 22 bp, Homo sapiens
tgaacacagggccaaacttgag

SEQ ID NO: 6943372 - DNA, 22 bp, Homo sapiens
gacatgcaatgcagtggtaagt

SEQ ID NO: 6943373 - DNA, 22 bp, Homo sapiens
taggtgtgggctcaggaatgtg

SEQ ID NO: 6943374 - DNA, 22 bp, Homo sapiens
gctgtacctccatcagcacctc

SEQ ID NO: 6943375 - DNA, 22 bp, Homo sapiens
tctcttcccggataaagtaagt

SEQ ID NO: 6943376 - DNA, 22 bp, Homo sapiens
aattgaaattctttgtggtcca

SEQ ID NO: 6943377 - DNA, 21 bp, Homo sapiens
tgaactctggtcatcttcatt

SEQ ID NO: 6943378 - DNA, 22 bp, Homo sapiens
ttggaccaattcctgatatttt

SEQ ID NO: 6943379 - DNA, 22 bp, Homo sapiens
ttattgacttattaattgtgct

SEQ ID NO: 6943380 - DNA, 22 bp, Homo sapiens
cccagcatggagtgaggactca

SEQ ID NO: 6943381 - DNA, 22 bp, Homo sapiens
atcactgagcttcagtgctggc

SEQ ID NO: 6943382 - DNA, 22 bp, Homo sapiens
agcatgcatttttggactgtgc

SEQ ID NO: 6943383 - DNA, 22 bp, Homo sapiens
agctggtcttaaatgtgtccag

SEQ ID NO: 6943384 - DNA, 22 bp, Homo sapiens
aggctccattcatgtgaaggca

SEQ ID NO: 6943385 - DNA, 22 bp, Homo sapiens
agactgagactggggaaagaca

SEQ ID NO: 6943386 - DNA, 18 bp, Homo sapiens
gggaagccgggaagccgg

SEQ ID NO: 6943387 - DNA, 23 bp, Homo sapiens
aggttcaggagatggaggaacaa

SEQ ID NO: 6943388 - DNA, 22 bp, Homo sapiens
agagaaatttccctgccttctg

SEQ ID NO: 6943389 - DNA, 22 bp, Homo sapiens
acgttttcagccttaatgtaga

SEQ ID NO: 6943390 - DNA, 22 bp, Homo sapiens
ttgaattataagtgtgtctact

SEQ ID NO: 6943391 - DNA, 22 bp, Homo sapiens
tttagatgctgtatgttatttc

SEQ ID NO: 6943392 - DNA, 22 bp, Homo sapiens
gctgggcagtgagtgagtcctt

SEQ ID NO: 6943393 - DNA, 20 bp, Homo sapiens
gcaaaataggctctgttggt

SEQ ID NO: 6943394 - DNA, 22 bp, Homo sapiens
tggaatgttgctctgccttgcg

SEQ ID NO: 6943395 - DNA, 22 bp, Homo sapiens
tctgagaagcaccttctggaca

SEQ ID NO: 6943396 - DNA, 22 bp, Homo sapiens
ctctttggggctggaagcctag

SEQ ID NO: 6943397 - DNA, 22 bp, Homo sapiens
tagggatgacgaaaggacagag

SEQ ID NO: 6943398 - DNA, 22 bp, Homo sapiens
cagccggacctgagggattcct

SEQ ID NO: 6943399 - DNA, 23 bp, Homo sapiens
ccctgcatctgtccctcaccagt

SEQ ID NO: 6943400 - DNA, 22 bp, Homo sapiens
gactgtggcaggctcagcactg

SEQ ID NO: 6943401 - DNA, 22 bp, Homo sapiens
ggctgtgattggtggatgtgaa

SEQ ID NO: 6943402 - DNA, 22 bp, Homo sapiens
tgccttttctgtagctctggaa

SEQ ID NO: 6943403 - DNA, 22 bp, Homo sapiens
ccagctgtctggttccagagcc

SEQ ID NO: 6943404 - DNA, 22 bp, Homo sapiens
ttagagtagagccatttctgtt

SEQ ID NO: 6943405 - DNA, 19 bp, Homo sapiens
acaaatagttacatatcct

SEQ ID NO: 6943406 - DNA, 22 bp, Homo sapiens
agggcctgtctgtagaactgaa

SEQ ID NO: 6943407 - DNA, 22 bp, Homo sapiens
agaatatagttaccaaattctg

SEQ ID NO: 6943408 - DNA, 22 bp, Homo sapiens
aaatgcatcagctcataagaga

SEQ ID NO: 6943409 - DNA, 22 bp, Homo sapiens
gtcccaggtcccagcacatctg

SEQ ID NO: 6943410 - DNA, 22 bp, Homo sapiens
gccaaggcctgcagcacctcat

SEQ ID NO: 6943411 - DNA, 22 bp, Homo sapiens
taggggtcttgttggcatcacg

SEQ ID NO: 6943412 - DNA, 22 bp, Homo sapiens
aagagcttccctgttgtagagg

SEQ ID NO: 6943413 - DNA, 22 bp, Homo sapiens
atatccttgagacgtggctact

SEQ ID NO: 6943414 - DNA, 22 bp, Homo sapiens
ttcctctgaaatggcttggaaa

SEQ ID NO: 6943415 - DNA, 22 bp, Homo sapiens
atcatcttcatattcctcagct

SEQ ID NO: 6943416 - DNA, 22 bp, Homo sapiens
aaattgctgttgggtgactctt

SEQ ID NO: 6943417 - DNA, 22 bp, Homo sapiens
gagatgttgttcaaagatttta

SEQ ID NO: 6943418 - DNA, 22 bp, Homo sapiens
tcaggagggagtgtggatagag

SEQ ID NO: 6943419 - DNA, 22 bp, Homo sapiens
tcagggcatccattgcctgttg

SEQ ID NO: 6943420 - DNA, 17 bp, Homo sapiens
ttccttgggtgctgggt

SEQ ID NO: 6943421 - DNA, 22 bp, Homo sapiens
ggcctgctgctggttagatggg

SEQ ID NO: 6943422 - DNA, 22 bp, Homo sapiens
caggtgacaagacaggtaatat

SEQ ID NO: 6943423 - DNA, 22 bp, Homo sapiens
ggcttctgagtgctctgctgtt

SEQ ID NO: 6943424 - DNA, 22 bp, Homo sapiens
tggaagcttctgaccatttttg

SEQ ID NO: 6943425 - DNA, 22 bp, Homo sapiens
tgctctgggctatctgagaaag

SEQ ID NO: 6943426 - DNA, 22 bp, Homo sapiens
tgccctgaggcactccatccat

SEQ ID NO: 6943427 - DNA, 22 bp, Homo sapiens
gagggccagatcccaggaggaa

SEQ ID NO: 6943428 - DNA, 22 bp, Homo sapiens
taggaatttttgtaatggtact

SEQ ID NO: 6943429 - DNA, 22 bp, Homo sapiens
tgtagaagctagcctggagcca

SEQ ID NO: 6943430 - DNA, 22 bp, Homo sapiens
aatcaggagctgaggtttagcc

SEQ ID NO: 6943431 - DNA, 22 bp, Homo sapiens
tccattcaggccagtgcaaagt

SEQ ID NO: 6943432 - DNA, 22 bp, Homo sapiens
taatggtatttcaagacttgcc

SEQ ID NO: 6943433 - DNA, 22 bp, Homo sapiens
tgtggccataaagcttaaaatg

SEQ ID NO: 6943434 - DNA, 22 bp, Homo sapiens
tttgaaagggacaaagtcactg

SEQ ID NO: 6943435 - DNA, 22 bp, Homo sapiens
ctggatcccgtctgagcctcct

SEQ ID NO: 6943436 - DNA, 22 bp, Homo sapiens
tcccacacttgaaacaaggctg

SEQ ID NO: 6943437 - DNA, 22 bp, Homo sapiens
tcagctgtccgcagcccacttc

SEQ ID NO: 6943438 - DNA, 22 bp, Homo sapiens
acctgaggcctccccagcagac

SEQ ID NO: 6943439 - DNA, 22 bp, Homo sapiens
agagaggttaaggagctcttgt

SEQ ID NO: 6943440 - DNA, 22 bp, Homo sapiens
catgcaggcacccagagcccac

SEQ ID NO: 6943441 - DNA, 20 bp, Homo sapiens
ttctctggatagccagatgt

SEQ ID NO: 6943442 - DNA, 19 bp, Homo sapiens
aaaaagaggctataatatt

SEQ ID NO: 6943443 - DNA, 22 bp, Homo sapiens
ttagtgtctcacctaaaatctg

SEQ ID NO: 6943444 - DNA, 22 bp, Homo sapiens
tttgttcacagggttgttgtag

SEQ ID NO: 6943445 - DNA, 22 bp, Homo sapiens
ctgaaagggagaacaccaagag

SEQ ID NO: 6943446 - DNA, 22 bp, Homo sapiens
caggctggagttcagtggtgtg

SEQ ID NO: 6943447 - DNA, 22 bp, Homo sapiens
ttaagagatttaggaacattat

SEQ ID NO: 6943448 - DNA, 22 bp, Homo sapiens
ccaataactgtaactttctgtg

SEQ ID NO: 6943449 - DNA, 22 bp, Homo sapiens
aattatgaggtagatatcacat

SEQ ID NO: 6943450 - DNA, 22 bp, Homo sapiens
gcacacagaacatttggatcct

SEQ ID NO: 6943451 - DNA, 22 bp, Homo sapiens
attgtctttaaaaatatacaac

SEQ ID NO: 6943452 - DNA, 22 bp, Homo sapiens
tatgtgataggcattttactga

SEQ ID NO: 6943453 - DNA, 22 bp, Homo sapiens
tccacctccatgctgggcagag

SEQ ID NO: 6943454 - DNA, 22 bp, Homo sapiens
aagacaatgagtcctgatggga

SEQ ID NO: 6943455 - DNA, 22 bp, Homo sapiens
tcagctccagagttgcacagtg

SEQ ID NO: 6943456 - DNA, 22 bp, Homo sapiens
gctcctggagagattgagaaag

SEQ ID NO: 6943457 - DNA, 22 bp, Homo sapiens
tagttaaaataatggagatgtt

SEQ ID NO: 6943458 - DNA, 22 bp, Homo sapiens
gacaatctggacccagtcttca

SEQ ID NO: 6943459 - DNA, 22 bp, Homo sapiens
tgtagtgaggaaagactggttg

SEQ ID NO: 6943460 - DNA, 22 bp, Homo sapiens
ctggcagatagtaagtgatcaa

SEQ ID NO: 6943461 - DNA, 22 bp, Homo sapiens
taggccaggacagagcttccag

SEQ ID NO: 6943462 - DNA, 22 bp, Homo sapiens
gaggcatgcagagctggagcag

SEQ ID NO: 6943463 - DNA, 22 bp, Homo sapiens
ctcaggctgtctaatggattag

SEQ ID NO: 6943464 - DNA, 22 bp, Homo sapiens
agatttgtcagctcagtcttta

SEQ ID NO: 6943465 - DNA, 22 bp, Homo sapiens
ggatggcttgcatttgaggact

SEQ ID NO: 6943466 - DNA, 23 bp, Homo sapiens
ttctaaggtatggtttatacctg

SEQ ID NO: 6943467 - DNA, 22 bp, Homo sapiens
cccaggaggtggaggttgcagc

SEQ ID NO: 6943468 - DNA, 22 bp, Homo sapiens
tggcacaggaatttagatgcag

SEQ ID NO: 6943469 - DNA, 20 bp, Homo sapiens
attcagaataggcatgtaaa

SEQ ID NO: 6943470 - DNA, 22 bp, Homo sapiens
ctgtgcagctggcttcctggaa

SEQ ID NO: 6943471 - DNA, 22 bp, Homo sapiens
tgctgctgaaaaggtgtgctta

SEQ ID NO: 6943472 - DNA, 21 bp, Homo sapiens
cagaggcctatcacagactcc

SEQ ID NO: 6943473 - DNA, 22 bp, Homo sapiens
ttccatgtactgggttttgtat

SEQ ID NO: 6943474 - DNA, 22 bp, Homo sapiens
gaggcaacttcctgtcctctcc

SEQ ID NO: 6943475 - DNA, 22 bp, Homo sapiens
ccaaggttgcaggcctcagaga

SEQ ID NO: 6943476 - DNA, 22 bp, Homo sapiens
gagtcagaattgtattttaaac

SEQ ID NO: 6943477 - DNA, 22 bp, Homo sapiens
tctgaggaataagaaggaagtg

SEQ ID NO: 6943478 - DNA, 22 bp, Homo sapiens
ctgggggtcttgaaagggagag

SEQ ID NO: 6943479 - DNA, 22 bp, Homo sapiens
aagagccatatatgcagctaga

SEQ ID NO: 6943480 - DNA, 18 bp, Homo sapiens
ggctatgcatttggggta

SEQ ID NO: 6943481 - DNA, 22 bp, Homo sapiens
aaatgtgcatgagtcagaagtg

SEQ ID NO: 6943482 - DNA, 22 bp, Homo sapiens
tatagctttgctgagaaaaaga

SEQ ID NO: 6943483 - DNA, 22 bp, Homo sapiens
agaaatagcagagtcaggcggg

SEQ ID NO: 6943484 - DNA, 22 bp, Homo sapiens
acagtgacactcaggtgggatg

SEQ ID NO: 6943485 - DNA, 22 bp, Homo sapiens
tgggccagtagctactcgcaag

SEQ ID NO: 6943486 - DNA, 22 bp, Homo sapiens
tctgtgcacaataggcattttt

SEQ ID NO: 6943487 - DNA, 23 bp, Homo sapiens
tccaggaccctggtagacacaca

SEQ ID NO: 6943488 - DNA, 18 bp, Homo sapiens
tccaggtcccaggggaag

SEQ ID NO: 6943489 - DNA, 22 bp, Homo sapiens
aataagagcactggctttggag

SEQ ID NO: 6943490 - DNA, 22 bp, Homo sapiens
ctggtcactggtctcatccagc

SEQ ID NO: 6943491 - DNA, 20 bp, Homo sapiens
tagcaagcaggaggtgcaga

SEQ ID NO: 6943492 - DNA, 22 bp, Homo sapiens
agactcctcggaccaatcagcg

SEQ ID NO: 6943493 - DNA, 22 bp, Homo sapiens
tcaggtgtatcatggagttgaa

SEQ ID NO: 6943494 - DNA, 22 bp, Homo sapiens
acctacagatctttgaatgtgt

SEQ ID NO: 6943495 - DNA, 22 bp, Homo sapiens
tggctaagcatgctccagctgc

SEQ ID NO: 6943496 - DNA, 22 bp, Homo sapiens
caacttgttcttggtagatcta

SEQ ID NO: 6943497 - DNA, 22 bp, Homo sapiens
ggagatggctctgcaaggtcta

SEQ ID NO: 6943498 - DNA, 22 bp, Homo sapiens
tggtcattggtagtgcagggag

SEQ ID NO: 6943499 - DNA, 22 bp, Homo sapiens
ttgatttgattgtaatggctct

SEQ ID NO: 6943500 - DNA, 22 bp, Homo sapiens
tgaaatgtctcacttagacttt

SEQ ID NO: 6943501 - DNA, 22 bp, Homo sapiens
agttcactttctgtagtggaag

SEQ ID NO: 6943502 - DNA, 22 bp, Homo sapiens
agagtgattcgttcaagaacca

SEQ ID NO: 6943503 - DNA, 22 bp, Homo sapiens
aaaagtgatgggatggcacttc

SEQ ID NO: 6943504 - DNA, 18 bp, Homo sapiens
taaacctttcttgtggca

SEQ ID NO: 6943505 - DNA, 22 bp, Homo sapiens
tagcaaaagctcaacaggaagg

SEQ ID NO: 6943506 - DNA, 20 bp, Homo sapiens
atcctctcctgattaattca

SEQ ID NO: 6943507 - DNA, 22 bp, Homo sapiens
gaccttgtgatccagccacctt

SEQ ID NO: 6943508 - DNA, 22 bp, Homo sapiens
tcacagctcactgtagcctcga

SEQ ID NO: 6943509 - DNA, 22 bp, Homo sapiens
tttggccaagaaagttctgtgg

SEQ ID NO: 6943510 - DNA, 22 bp, Homo sapiens
ttctctggagagtatcttctta

SEQ ID NO: 6943511 - DNA, 22 bp, Homo sapiens
ctgtttgtccaacttgtcccga

SEQ ID NO: 6943512 - DNA, 22 bp, Homo sapiens
atgtttaaatttatagacagtg

SEQ ID NO: 6943513 - DNA, 22 bp, Homo sapiens
agggctgaagggaggtgctcat

SEQ ID NO: 6943514 - DNA, 22 bp, Homo sapiens
agcagttactagttaaatgcat

SEQ ID NO: 6943515 - DNA, 22 bp, Homo sapiens
tttccaaaatgaatctaatgca

SEQ ID NO: 6943516 - DNA, 22 bp, Homo sapiens
ggcctgggcccactgtcaagag

SEQ ID NO: 6943517 - DNA, 22 bp, Homo sapiens
tttctgttgtacttaaactagg

SEQ ID NO: 6943518 - DNA, 22 bp, Homo sapiens
ctaacgaatatgtatgcatgtt

SEQ ID NO: 6943519 - DNA, 22 bp, Homo sapiens
cctcagaggtgaacatcagtgc

SEQ ID NO: 6943520 - DNA, 22 bp, Homo sapiens
tcttattcagtgggctctgcca

SEQ ID NO: 6943521 - DNA, 22 bp, Homo sapiens
ggtagtcatggatagctatgag

SEQ ID NO: 6943522 - DNA, 22 bp, Homo sapiens
agcacacatcacttctgctcat

SEQ ID NO: 6943523 - DNA, 22 bp, Homo sapiens
tagcaaccctatattgaagatg

SEQ ID NO: 6943524 - DNA, 22 bp, Homo sapiens
gggagctgtagtccagataccg

SEQ ID NO: 6943525 - DNA, 22 bp, Homo sapiens
ttgagtactccgggtgcacttg

SEQ ID NO: 6943526 - DNA, 22 bp, Homo sapiens
ctggaatgggagtcagacagag

SEQ ID NO: 6943527 - DNA, 22 bp, Homo sapiens
ccagacctaagcatcagtgcat

SEQ ID NO: 6943528 - DNA, 22 bp, Homo sapiens
cttcacataaacaaagggccat

SEQ ID NO: 6943529 - DNA, 22 bp, Homo sapiens
agctcagcccgttagtaagccc

SEQ ID NO: 6943530 - DNA, 22 bp, Homo sapiens
tcaaatctcattgcctaaaact

SEQ ID NO: 6943531 - DNA, 17 bp, Homo sapiens
ctcctgagtgaaaggga

SEQ ID NO: 6943532 - DNA, 22 bp, Homo sapiens
ctgctctaggttcctgcatatg

SEQ ID NO: 6943533 - DNA, 22 bp, Homo sapiens
ttgacaatgtcctttgaatttc

SEQ ID NO: 6943534 - DNA, 22 bp, Homo sapiens
ataagacacgccccactcactc

SEQ ID NO: 6943535 - DNA, 22 bp, Homo sapiens
atgacatcactacattattcct

SEQ ID NO: 6943536 - DNA, 22 bp, Homo sapiens
ggaggctcagactccatcctca

SEQ ID NO: 6943537 - DNA, 22 bp, Homo sapiens
tgcgatggcgtagacaaatccc

SEQ ID NO: 6943538 - DNA, 22 bp, Homo sapiens
agtggcttgctctgcctcagcc

SEQ ID NO: 6943539 - DNA, 22 bp, Homo sapiens
ctcctgtgaggcttaagcccag

SEQ ID NO: 6943540 - DNA, 18 bp, Homo sapiens
gccagaggtactactgat

SEQ ID NO: 6943541 - DNA, 22 bp, Homo sapiens
ggctcatatcccggccatcatt

SEQ ID NO: 6943542 - DNA, 19 bp, Homo sapiens
agcatctccctgatcattc

SEQ ID NO: 6943543 - DNA, 22 bp, Homo sapiens
ccacagggcacaagggaggttg

SEQ ID NO: 6943544 - DNA, 22 bp, Homo sapiens
acagttacatcacttactgaca

SEQ ID NO: 6943545 - DNA, 20 bp, Homo sapiens
ttttagcagaaagaaagctc

SEQ ID NO: 6943546 - DNA, 22 bp, Homo sapiens
ttggtacaatgtgctaggtagg

SEQ ID NO: 6943547 - DNA, 22 bp, Homo sapiens
atggcatcgtcaccttttcagt

SEQ ID NO: 6943548 - DNA, 22 bp, Homo sapiens
gggtctaggagacatgggcaag

SEQ ID NO: 6943549 - DNA, 20 bp, Homo sapiens
tgtcttccagcaggtgttta

SEQ ID NO: 6943550 - DNA, 22 bp, Homo sapiens
atgcatgagaatatcccatgct

SEQ ID NO: 6943551 - DNA, 22 bp, Homo sapiens
tcttctcccatctccaggcagg

SEQ ID NO: 6943552 - DNA, 22 bp, Homo sapiens
agcacagtggcttctatgtcta

SEQ ID NO: 6943553 - DNA, 22 bp, Homo sapiens
atgcagatgtttggttcattgt

SEQ ID NO: 6943554 - DNA, 22 bp, Homo sapiens
ctttatgtccaccagactgcaa

SEQ ID NO: 6943555 - DNA, 22 bp, Homo sapiens
atgaatgatttgtcagtcacag

SEQ ID NO: 6943556 - DNA, 22 bp, Homo sapiens
aagctgaaataatatctatgtt

SEQ ID NO: 6943557 - DNA, 22 bp, Homo sapiens
attgatccacagtttcgcttaa

SEQ ID NO: 6943558 - DNA, 22 bp, Homo sapiens
tgtctgaaccctggccctgcct

SEQ ID NO: 6943559 - DNA, 22 bp, Homo sapiens
aagcactggagatgccagagtg

SEQ ID NO: 6943560 - DNA, 22 bp, Homo sapiens
atttgtctttggacctgtgaga

SEQ ID NO: 6943561 - DNA, 22 bp, Homo sapiens
tggtctgaaggtggatttgaga

SEQ ID NO: 6943562 - DNA, 19 bp, Homo sapiens
gctcagagccatgggggct

SEQ ID NO: 6943563 - DNA, 22 bp, Homo sapiens
ttggggataagaattgaatgca

SEQ ID NO: 6943564 - DNA, 22 bp, Homo sapiens
cagcatgcctgggctgcctgcc

SEQ ID NO: 6943565 - DNA, 22 bp, Homo sapiens
gggcttgctaagaagagcgcat

SEQ ID NO: 6943566 - DNA, 22 bp, Homo sapiens
aagacgcttcctgccgccgcac

SEQ ID NO: 6943567 - DNA, 22 bp, Homo sapiens
tcatcccagtgtccatgctcag

SEQ ID NO: 6943568 - DNA, 22 bp, Homo sapiens
taggcagtagcaggatctgcca

SEQ ID NO: 6943569 - DNA, 22 bp, Homo sapiens
ttggcagaatgggcagcttgag

SEQ ID NO: 6943570 - DNA, 22 bp, Homo sapiens
actgaatagtgctgcattgtac

SEQ ID NO: 6943571 - DNA, 22 bp, Homo sapiens
ctgtcatggtttgaatgctcgc

SEQ ID NO: 6943572 - DNA, 22 bp, Homo sapiens
ctcctctggcttcctggaggca

SEQ ID NO: 6943573 - DNA, 22 bp, Homo sapiens
ctctgggtctataatgcagctg

SEQ ID NO: 6943574 - DNA, 22 bp, Homo sapiens
tagcacctgatacctagtatgt

SEQ ID NO: 6943575 - DNA, 22 bp, Homo sapiens
agcaacaggaaatagctgatta

SEQ ID NO: 6943576 - DNA, 22 bp, Homo sapiens
catcaaagcttttttctgtgtt

SEQ ID NO: 6943577 - DNA, 22 bp, Homo sapiens
tggcatgttaaataagatcata

SEQ ID NO: 6943578 - DNA, 22 bp, Homo sapiens
cagaagtggcctcagagggagt

SEQ ID NO: 6943579 - DNA, 22 bp, Homo sapiens
aaactcttcctttctttaaagt

SEQ ID NO: 6943580 - DNA, 22 bp, Homo sapiens
tcatttgggtcagttttccata

SEQ ID NO: 6943581 - DNA, 19 bp, Homo sapiens
tctgaggtggaactggggg

SEQ ID NO: 6943582 - DNA, 23 bp, Homo sapiens
tcacatttaacccctcagacctc

SEQ ID NO: 6943583 - DNA, 22 bp, Homo sapiens
cagcatcattcatctggggtaa

SEQ ID NO: 6943584 - DNA, 22 bp, Homo sapiens
agcaggtgatcgcgtgtgctcc

SEQ ID NO: 6943585 - DNA, 22 bp, Homo sapiens
acatgcagggctttttgcctct

SEQ ID NO: 6943586 - DNA, 22 bp, Homo sapiens
aggctcagtgatgtaaaatata

SEQ ID NO: 6943587 - DNA, 22 bp, Homo sapiens
atcaagagaaggggaagatgaa

SEQ ID NO: 6943588 - DNA, 22 bp, Homo sapiens
aagggctggccctgggaagagt

SEQ ID NO: 6943589 - DNA, 22 bp, Homo sapiens
agggcctctggaacactgaggg

SEQ ID NO: 6943590 - DNA, 22 bp, Homo sapiens
tgggctctgaagggtcccggat

SEQ ID NO: 6943591 - DNA, 22 bp, Homo sapiens
agtcccagcttcccccatgcag

SEQ ID NO: 6943592 - DNA, 22 bp, Homo sapiens
tcagtctttttctcttaagtac

SEQ ID NO: 6943593 - DNA, 22 bp, Homo sapiens
ccaggtggacggcgagtacagg

SEQ ID NO: 6943594 - DNA, 22 bp, Homo sapiens
cagcttcttcagtcctggagct

SEQ ID NO: 6943595 - DNA, 22 bp, Homo sapiens
ttcctctcgctctccggggccc

SEQ ID NO: 6943596 - DNA, 21 bp, Homo sapiens
tcacaggtcaatgtgtgaagg

SEQ ID NO: 6943597 - DNA, 22 bp, Homo sapiens
gagagcaggaggcagcgggacg

SEQ ID NO: 6943598 - DNA, 22 bp, Homo sapiens
tgaggcgtctccctgagctcac

SEQ ID NO: 6943599 - DNA, 21 bp, Homo sapiens
ttggagtagcactatgtaaac

SEQ ID NO: 6943600 - DNA, 22 bp, Homo sapiens
cagagtcattgacttccaggag

SEQ ID NO: 6943601 - DNA, 22 bp, Homo sapiens
gcagtatacactgatacatgag

SEQ ID NO: 6943602 - DNA, 22 bp, Homo sapiens
ggcaggtcaggtccatgaccaa

SEQ ID NO: 6943603 - DNA, 22 bp, Homo sapiens
gagaccaaggattgaatgctgg

SEQ ID NO: 6943604 - DNA, 22 bp, Homo sapiens
cagctcttcagagtgagcaatg

SEQ ID NO: 6943605 - DNA, 22 bp, Homo sapiens
ctcacagtgtcaacattaacta

SEQ ID NO: 6943606 - DNA, 22 bp, Homo sapiens
agctctgaagcttatctgatgt

SEQ ID NO: 6943607 - DNA, 22 bp, Homo sapiens
gcctgggattctcaaaggggtg

SEQ ID NO: 6943608 - DNA, 22 bp, Homo sapiens
gtcttatttaaagagatcatac

SEQ ID NO: 6943609 - DNA, 22 bp, Homo sapiens
acctcagagatacaaaccatgg

SEQ ID NO: 6943610 - DNA, 22 bp, Homo sapiens
cctcacagccctcctctagcac

SEQ ID NO: 6943611 - DNA, 22 bp, Homo sapiens
ctcctggaagcccgccctgctg

SEQ ID NO: 6943612 - DNA, 22 bp, Homo sapiens
tcatgcaaagccaattccagct

SEQ ID NO: 6943613 - DNA, 22 bp, Homo sapiens
tgaagatcctatctgcaaatat

SEQ ID NO: 6943614 - DNA, 22 bp, Homo sapiens
cctgctcagccccagctcaccc

SEQ ID NO: 6943615 - DNA, 22 bp, Homo sapiens
tgagtgctctgtatgtgccaga

SEQ ID NO: 6943616 - DNA, 22 bp, Homo sapiens
cactgagggggtggtttcagga

SEQ ID NO: 6943617 - DNA, 22 bp, Homo sapiens
agtgtctgctaggttcatcaac

SEQ ID NO: 6943618 - DNA, 22 bp, Homo sapiens
atgcacagaacaattttaagag

SEQ ID NO: 6943619 - DNA, 22 bp, Homo sapiens
aatcacattgaatctgctacct

SEQ ID NO: 6943620 - DNA, 22 bp, Homo sapiens
catttctccgccgagatcactg

SEQ ID NO: 6943621 - DNA, 22 bp, Homo sapiens
aaagggctcccaggatcatctc

SEQ ID NO: 6943622 - DNA, 22 bp, Homo sapiens
tgcacacaagttggagaatgaa

SEQ ID NO: 6943623 - DNA, 22 bp, Homo sapiens
agaccatagggacctcaggttg

SEQ ID NO: 6943624 - DNA, 22 bp, Homo sapiens
gtattacatttagtaattaggc

SEQ ID NO: 6943625 - DNA, 22 bp, Homo sapiens
gagaggctgggttggagatcga

SEQ ID NO: 6943626 - DNA, 22 bp, Homo sapiens
accattctggttaagaacccat

SEQ ID NO: 6943627 - DNA, 22 bp, Homo sapiens
aggaggaactcagaaagaaggt

SEQ ID NO: 6943628 - DNA, 22 bp, Homo sapiens
gggctcagccccattgaaccag

SEQ ID NO: 6943629 - DNA, 22 bp, Homo sapiens
gtcctgcttcccacagaaaccg

SEQ ID NO: 6943630 - DNA, 21 bp, Homo sapiens
catggggttgctatagcaaaa

SEQ ID NO: 6943631 - DNA, 20 bp, Homo sapiens
atattgcaaggaagctggat

SEQ ID NO: 6943632 - DNA, 19 bp, Homo sapiens
tttttaatgggctggagca

SEQ ID NO: 6943633 - DNA, 22 bp, Homo sapiens
atgtttctgaagtttacagata

SEQ ID NO: 6943634 - DNA, 21 bp, Homo sapiens
ctgccttgaatggtactggga

SEQ ID NO: 6943635 - DNA, 22 bp, Homo sapiens
attatttggaataggcattgca

SEQ ID NO: 6943636 - DNA, 22 bp, Homo sapiens
agtctgtcattaaacttcccaa

SEQ ID NO: 6943637 - DNA, 18 bp, Homo sapiens
ctctttctttggcacaaa

SEQ ID NO: 6943638 - DNA, 22 bp, Homo sapiens
cagggagggaggaaaatttgct

SEQ ID NO: 6943639 - DNA, 22 bp, Homo sapiens
atgttcttagcaaagtacttgc

SEQ ID NO: 6943640 - DNA, 23 bp, Homo sapiens
gctttatagttctcccaacatta

SEQ ID NO: 6943641 - DNA, 22 bp, Homo sapiens
cactatttgctttgggctagag

SEQ ID NO: 6943642 - DNA, 22 bp, Homo sapiens
tgcatgatgttaaacatcaggt

SEQ ID NO: 6943643 - DNA, 22 bp, Homo sapiens
tccaagacaagcacattcctgc

SEQ ID NO: 6943644 - DNA, 22 bp, Homo sapiens
cctgctgttagatttcagtcac

SEQ ID NO: 6943645 - DNA, 22 bp, Homo sapiens
tgtgcctggcattctgggcttc

SEQ ID NO: 6943646 - DNA, 22 bp, Homo sapiens
taggagggttagagggaaatat

SEQ ID NO: 6943647 - DNA, 22 bp, Homo sapiens
gaggaacaagctgctttatctt

SEQ ID NO: 6943648 - DNA, 22 bp, Homo sapiens
gtgctggcctcagagggtcatg

SEQ ID NO: 6943649 - DNA, 19 bp, Homo sapiens
tactccaatcaggaacaca

SEQ ID NO: 6943650 - DNA, 22 bp, Homo sapiens
gcagctttggaggtggaactct

SEQ ID NO: 6943651 - DNA, 22 bp, Homo sapiens
tccagagcctttccacccactt

SEQ ID NO: 6943652 - DNA, 22 bp, Homo sapiens
ttatagttatgaaagactgagg

SEQ ID NO: 6943653 - DNA, 22 bp, Homo sapiens
ttccctggctcttctacatcgt

SEQ ID NO: 6943654 - DNA, 22 bp, Homo sapiens
tctgcacaattgatcatggcaa

SEQ ID NO: 6943655 - DNA, 22 bp, Homo sapiens
aaacattgacctcatcctggca

SEQ ID NO: 6943656 - DNA, 21 bp, Homo sapiens
tgtctcctgttggcacatggc

SEQ ID NO: 6943657 - DNA, 22 bp, Homo sapiens
atgtgtcaggtacactcattag

SEQ ID NO: 6943658 - DNA, 22 bp, Homo sapiens
tagcagcactatttgttgtagt

SEQ ID NO: 6943659 - DNA, 22 bp, Homo sapiens
gtgctgatgttgcttcccttgg

SEQ ID NO: 6943660 - DNA, 22 bp, Homo sapiens
gccctgctgctggcagaggcgc

SEQ ID NO: 6943661 - DNA, 22 bp, Homo sapiens
tgtctccaggggcaggccagcc

SEQ ID NO: 6943662 - DNA, 22 bp, Homo sapiens
ctgtgggtggctgtgccccagg

SEQ ID NO: 6943663 - DNA, 18 bp, Homo sapiens
gggcggaagggaagataa

SEQ ID NO: 6943664 - DNA, 22 bp, Homo sapiens
caggtctgcagacagggccatg

SEQ ID NO: 6943665 - DNA, 22 bp, Homo sapiens
ctgtttgctggctatgaactcc

SEQ ID NO: 6943666 - DNA, 22 bp, Homo sapiens
atgcagatatgcaaactgtagt

SEQ ID NO: 6943667 - DNA, 22 bp, Homo sapiens
agtccttgaatgttttgaaatc

SEQ ID NO: 6943668 - DNA, 22 bp, Homo sapiens
acagtgatgggggtgcaggaag

SEQ ID NO: 6943669 - DNA, 22 bp, Homo sapiens
attgagcaatagtgtttgcagc

SEQ ID NO: 6943670 - DNA, 22 bp, Homo sapiens
aatcagaaagatcttgatgaga

SEQ ID NO: 6943671 - DNA, 22 bp, Homo sapiens
gctgcagtgttggacctcaggg

SEQ ID NO: 6943672 - DNA, 18 bp, Homo sapiens
gtttacacattctagaaa

SEQ ID NO: 6943673 - DNA, 22 bp, Homo sapiens
agtggggagtttccagatgtgt

SEQ ID NO: 6943674 - DNA, 22 bp, Homo sapiens
tctcttttatgtacaccctgac

SEQ ID NO: 6943675 - DNA, 22 bp, Homo sapiens
gaaattattgctagagactgca

SEQ ID NO: 6943676 - DNA, 22 bp, Homo sapiens
aagacctctgaggtagaagttc

SEQ ID NO: 6943677 - DNA, 22 bp, Homo sapiens
ggctgcagcggattggggattg

SEQ ID NO: 6943678 - DNA, 22 bp, Homo sapiens
atttcatgtaaatggaatgata

SEQ ID NO: 6943679 - DNA, 22 bp, Homo sapiens
tcaatgcaacttccacctccca

SEQ ID NO: 6943680 - DNA, 21 bp, Homo sapiens
tctggagctgcaggctgggca

SEQ ID NO: 6943681 - DNA, 22 bp, Homo sapiens
agctgcaggttcagcattccac

SEQ ID NO: 6943682 - DNA, 22 bp, Homo sapiens
tttcctttctcaagagccggca

SEQ ID NO: 6943683 - DNA, 22 bp, Homo sapiens
agcagaggtgtttattatggga

SEQ ID NO: 6943684 - DNA, 22 bp, Homo sapiens
gcatctgtgaatttgatataca

SEQ ID NO: 6943685 - DNA, 22 bp, Homo sapiens
cctgtacaagctcttggtgaca

SEQ ID NO: 6943686 - DNA, 22 bp, Homo sapiens
gtcatattgaagaagactggca

SEQ ID NO: 6943687 - DNA, 22 bp, Homo sapiens
agtcttccctgtgccagagtgt

SEQ ID NO: 6943688 - DNA, 22 bp, Homo sapiens
aatatttcaaaaggaaacacag

SEQ ID NO: 6943689 - DNA, 22 bp, Homo sapiens
tccttgtaacgttgggctgggg

SEQ ID NO: 6943690 - DNA, 22 bp, Homo sapiens
ttcctgcagcaaggagaagctg

SEQ ID NO: 6943691 - DNA, 22 bp, Homo sapiens
ggctgcaaaggaaaagtggtga

SEQ ID NO: 6943692 - DNA, 22 bp, Homo sapiens
agcatgctggtgttcatggcag

SEQ ID NO: 6943693 - DNA, 22 bp, Homo sapiens
aacactgagtatcagagttggg

SEQ ID NO: 6943694 - DNA, 22 bp, Homo sapiens
gacagcagacaaaccatgtttt

SEQ ID NO: 6943695 - DNA, 22 bp, Homo sapiens
ctggttcagtgaaaggcatggg

SEQ ID NO: 6943696 - DNA, 22 bp, Homo sapiens
ctagggtgtgcagattttgcct

SEQ ID NO: 6943697 - DNA, 22 bp, Homo sapiens
aagcttgtcagtgcaattttac

SEQ ID NO: 6943698 - DNA, 22 bp, Homo sapiens
tcacatcttattagagtatctc

SEQ ID NO: 6943699 - DNA, 22 bp, Homo sapiens
gcagcccaagagactctgttga

SEQ ID NO: 6943700 - DNA, 23 bp, Homo sapiens
tcctgagggtttcccagccttgg

SEQ ID NO: 6943701 - DNA, 22 bp, Homo sapiens
cagtgggtcctgcgtctgccag

SEQ ID NO: 6943702 - DNA, 22 bp, Homo sapiens
taggccagaggagcagctttgg

SEQ ID NO: 6943703 - DNA, 22 bp, Homo sapiens
gtgtgtacaaatttcatgtaaa

SEQ ID NO: 6943704 - DNA, 22 bp, Homo sapiens
atgtatttgcttgttatggatt

SEQ ID NO: 6943705 - DNA, 22 bp, Homo sapiens
ccctgaggcagtaggagctttt

SEQ ID NO: 6943706 - DNA, 22 bp, Homo sapiens
tcatgcttagtttaatgctctg

SEQ ID NO: 6943707 - DNA, 22 bp, Homo sapiens
tcagcccaccttcaggggagtt

SEQ ID NO: 6943708 - DNA, 20 bp, Homo sapiens
aacacactggtggcatcagg

SEQ ID NO: 6943709 - DNA, 22 bp, Homo sapiens
caatgttccctgtactgctttt

SEQ ID NO: 6943710 - DNA, 22 bp, Homo sapiens
caagaacagtttgccaaattgg

SEQ ID NO: 6943711 - DNA, 22 bp, Homo sapiens
tcagagcacttggctcatggca

SEQ ID NO: 6943712 - DNA, 22 bp, Homo sapiens
ttcacagtaatgtgcccaggta

SEQ ID NO: 6943713 - DNA, 22 bp, Homo sapiens
tcctggagtgtcttccccaagg

SEQ ID NO: 6943714 - DNA, 22 bp, Homo sapiens
tttctagatattccttgaagtg

SEQ ID NO: 6943715 - DNA, 22 bp, Homo sapiens
gtctggaagctctaggggagaa

SEQ ID NO: 6943716 - DNA, 22 bp, Homo sapiens
agtctattgcctaacagagagg

SEQ ID NO: 6943717 - DNA, 22 bp, Homo sapiens
gctctgcccaggaccgtccttg

SEQ ID NO: 6943718 - DNA, 17 bp, Homo sapiens
gctggctgacccatgcc

SEQ ID NO: 6943719 - DNA, 22 bp, Homo sapiens
tcatttaatagcttttgtcttt

SEQ ID NO: 6943720 - DNA, 19 bp, Homo sapiens
aaggtggtttgtctctgta

SEQ ID NO: 6943721 - DNA, 22 bp, Homo sapiens
ttccttgaccactgcataatga

SEQ ID NO: 6943722 - DNA, 20 bp, Homo sapiens
atgcaaatcccaaaatcagg

SEQ ID NO: 6943723 - DNA, 22 bp, Homo sapiens
ccttggcaggcacgtcctgcgg

SEQ ID NO: 6943724 - DNA, 22 bp, Homo sapiens
tgttttcaagtcaaggccaaat

SEQ ID NO: 6943725 - DNA, 19 bp, Homo sapiens
gcttcccaccagccagccc

SEQ ID NO: 6943726 - DNA, 22 bp, Homo sapiens
agaatatgatcggaatacagat

SEQ ID NO: 6943727 - DNA, 22 bp, Homo sapiens
cccgtaaagcatgggttatgct

SEQ ID NO: 6943728 - DNA, 22 bp, Homo sapiens
ttctagtgtccttggacttgct

SEQ ID NO: 6943729 - DNA, 22 bp, Homo sapiens
ctgcctgttagtctagcagtta

SEQ ID NO: 6943730 - DNA, 22 bp, Homo sapiens
tttgaacagggaatgttccaca

SEQ ID NO: 6943731 - DNA, 23 bp, Homo sapiens
gtgtgccaagcactgtgccagga

SEQ ID NO: 6943732 - DNA, 22 bp, Homo sapiens
cctggccaatctagggctgtta

SEQ ID NO: 6943733 - DNA, 23 bp, Homo sapiens
gctcatccacggagaggggctcc

SEQ ID NO: 6943734 - DNA, 22 bp, Homo sapiens
aggccaggtggtcatgcttgct

SEQ ID NO: 6943735 - DNA, 22 bp, Homo sapiens
atggttatgcaaacatgatgca

SEQ ID NO: 6943736 - DNA, 22 bp, Homo sapiens
tgggaacaacatgcactgccac

SEQ ID NO: 6943737 - DNA, 23 bp, Homo sapiens
aaagatgtgagtattcatatggc

SEQ ID NO: 6943738 - DNA, 22 bp, Homo sapiens
ctgggaggtgaacagaaaaact

SEQ ID NO: 6943739 - DNA, 22 bp, Homo sapiens
cagtaaatgagaagctagtaat

SEQ ID NO: 6943740 - DNA, 22 bp, Homo sapiens
ttcagtatttcatgactttctt

SEQ ID NO: 6943741 - DNA, 22 bp, Homo sapiens
cacaattattatctctttctac

SEQ ID NO: 6943742 - DNA, 22 bp, Homo sapiens
gcacatcagccactttgaatgg

SEQ ID NO: 6943743 - DNA, 22 bp, Homo sapiens
tgcagagtcacccagataatta

SEQ ID NO: 6943744 - DNA, 22 bp, Homo sapiens
acaacctgttcgtttccacaga

SEQ ID NO: 6943745 - DNA, 22 bp, Homo sapiens
attcctcattatttactgagga

SEQ ID NO: 6943746 - DNA, 22 bp, Homo sapiens
acttttcccttggtagagttgc

SEQ ID NO: 6943747 - DNA, 22 bp, Homo sapiens
cagtcaaacttataggcacatt

SEQ ID NO: 6943748 - DNA, 22 bp, Homo sapiens
tctaactctgccaggacacaga

SEQ ID NO: 6943749 - DNA, 22 bp, Homo sapiens
tcacatttgttcctctgcactt

SEQ ID NO: 6943750 - DNA, 22 bp, Homo sapiens
tgatgcatgaggagctgggtgc

SEQ ID NO: 6943751 - DNA, 20 bp, Homo sapiens
ctccaaggcttgcaggaggc

SEQ ID NO: 6943752 - DNA, 19 bp, Homo sapiens
agcacagacaagaccagca

SEQ ID NO: 6943753 - DNA, 22 bp, Homo sapiens
gagctcagcactaaaatcatgt

SEQ ID NO: 6943754 - DNA, 22 bp, Homo sapiens
cccagtgtggttgtgaattctg

SEQ ID NO: 6943755 - DNA, 22 bp, Homo sapiens
tgtctcctctgtcctgtcagga

SEQ ID NO: 6943756 - DNA, 22 bp, Homo sapiens
ttgcacatgatagatgatttct

SEQ ID NO: 6943757 - DNA, 22 bp, Homo sapiens
atgtgcagcctttcttcatcat

SEQ ID NO: 6943758 - DNA, 22 bp, Homo sapiens
gtggccattttttcctagcaca

SEQ ID NO: 6943759 - DNA, 18 bp, Homo sapiens
ggctgctcctctccctac

SEQ ID NO: 6943760 - DNA, 22 bp, Homo sapiens
tgtgtacacaatgattgcagag

SEQ ID NO: 6943761 - DNA, 22 bp, Homo sapiens
gtggccataggaggtcagatga

SEQ ID NO: 6943762 - DNA, 23 bp, Homo sapiens
attagacactttgggttgtcttc

SEQ ID NO: 6943763 - DNA, 22 bp, Homo sapiens
tctgcaaggggttctttaggcc

SEQ ID NO: 6943764 - DNA, 22 bp, Homo sapiens
attcactgtggtgactgatata

SEQ ID NO: 6943765 - DNA, 22 bp, Homo sapiens
ggctctatgtggtggttttgat

SEQ ID NO: 6943766 - DNA, 22 bp, Homo sapiens
tagatttctaacagtgtgcttg

SEQ ID NO: 6943767 - DNA, 22 bp, Homo sapiens
ccagttgggatttgtcctggtt

SEQ ID NO: 6943768 - DNA, 22 bp, Homo sapiens
ggacctggcaatttgcatctct

SEQ ID NO: 6943769 - DNA, 22 bp, Homo sapiens
ggtctgcgatggcaagggtctt

SEQ ID NO: 6943770 - DNA, 22 bp, Homo sapiens
gcatttcaaaattccaggcaag

SEQ ID NO: 6943771 - DNA, 22 bp, Homo sapiens
tgcttgattaagccttgtttgc

SEQ ID NO: 6943772 - DNA, 22 bp, Homo sapiens
tccagcattcttagacctctat

SEQ ID NO: 6943773 - DNA, 22 bp, Homo sapiens
aaactacactttgggaccagca

SEQ ID NO: 6943774 - DNA, 22 bp, Homo sapiens
cccttgaggtagactgaacacc

SEQ ID NO: 6943775 - DNA, 18 bp, Homo sapiens
gtccatccaggcagtgtc

SEQ ID NO: 6943776 - DNA, 22 bp, Homo sapiens
tctccaaactcagactaagtat

SEQ ID NO: 6943777 - DNA, 22 bp, Homo sapiens
aagtcaccctagggcctggact

SEQ ID NO: 6943778 - DNA, 22 bp, Homo sapiens
cccaggcacagattatcccaat

SEQ ID NO: 6943779 - DNA, 22 bp, Homo sapiens
cttgtaattataatgtactgtt

SEQ ID NO: 6943780 - DNA, 22 bp, Homo sapiens
ccagtggaattaaaaataagtg

SEQ ID NO: 6943781 - DNA, 22 bp, Homo sapiens
ttgagcaagcctgcggcgggaa

SEQ ID NO: 6943782 - DNA, 22 bp, Homo sapiens
gccctctcggcatagcaggggc

SEQ ID NO: 6943783 - DNA, 20 bp, Homo sapiens
gagggtgggacttcctaggc

SEQ ID NO: 6943784 - DNA, 22 bp, Homo sapiens
gttgtacatatgaggataagtt

SEQ ID NO: 6943785 - DNA, 22 bp, Homo sapiens
tcaacagtggcaaagaggcacg

SEQ ID NO: 6943786 - DNA, 22 bp, Homo sapiens
cagtggagaggcatgcttggca

SEQ ID NO: 6943787 - DNA, 22 bp, Homo sapiens
actttgaaactaaaattcatta

SEQ ID NO: 6943788 - DNA, 22 bp, Homo sapiens
gcttaagatgtttgtggcaatt

SEQ ID NO: 6943789 - DNA, 22 bp, Homo sapiens
gagccccagccctgcttctata

SEQ ID NO: 6943790 - DNA, 22 bp, Homo sapiens
gatgaagtcattatccttttgg

SEQ ID NO: 6943791 - DNA, 22 bp, Homo sapiens
ggcagtgagctggagggaagga

SEQ ID NO: 6943792 - DNA, 23 bp, Homo sapiens
gggaaaggatatgatcctagggg

SEQ ID NO: 6943793 - DNA, 22 bp, Homo sapiens
tgctttgcaaaagaacatagtg

SEQ ID NO: 6943794 - DNA, 22 bp, Homo sapiens
tctggccttatctgtccaagcc

SEQ ID NO: 6943795 - DNA, 22 bp, Homo sapiens
gaggcagagaccttcaggacct

SEQ ID NO: 6943796 - DNA, 17 bp, Homo sapiens
tccatgagacatgaaga

SEQ ID NO: 6943797 - DNA, 22 bp, Homo sapiens
aagagcatggagttcccctaaa

SEQ ID NO: 6943798 - DNA, 22 bp, Homo sapiens
gaatacacgaatagagcatggt

SEQ ID NO: 6943799 - DNA, 22 bp, Homo sapiens
tatttccacttaggtgcctgtt

SEQ ID NO: 6943800 - DNA, 22 bp, Homo sapiens
taacagcaaccacagtgctggt

SEQ ID NO: 6943801 - DNA, 22 bp, Homo sapiens
acttagcaggtactttcatatt

SEQ ID NO: 6943802 - DNA, 22 bp, Homo sapiens
ctgggacacagccttacctggg

SEQ ID NO: 6943803 - DNA, 22 bp, Homo sapiens
taatcactgtgagtctgttttc

SEQ ID NO: 6943804 - DNA, 22 bp, Homo sapiens
tcccactgtcttctcgtgctcg

SEQ ID NO: 6943805 - DNA, 22 bp, Homo sapiens
aaatatgatactcccttttagt

SEQ ID NO: 6943806 - DNA, 22 bp, Homo sapiens
ctctggcctggggcctgctccc

SEQ ID NO: 6943807 - DNA, 21 bp, Homo sapiens
tggcagagtgcagtctataca

SEQ ID NO: 6943808 - DNA, 22 bp, Homo sapiens
tgataaactggagaggtggagg

SEQ ID NO: 6943809 - DNA, 22 bp, Homo sapiens
tgttcctgcaaggaactggtgc

SEQ ID NO: 6943810 - DNA, 22 bp, Homo sapiens
gcagcatccccaggcagcaggg

SEQ ID NO: 6943811 - DNA, 22 bp, Homo sapiens
ccaggaggcggaaggtacagtg

SEQ ID NO: 6943812 - DNA, 22 bp, Homo sapiens
aaagctatagggtcaagcattt

SEQ ID NO: 6943813 - DNA, 21 bp, Homo sapiens
tggaagtggttcatttgctgc

SEQ ID NO: 6943814 - DNA, 22 bp, Homo sapiens
tctgctgtgaggaggcaggatg

SEQ ID NO: 6943815 - DNA, 20 bp, Homo sapiens
agtggagcagcccaagcagc

SEQ ID NO: 6943816 - DNA, 22 bp, Homo sapiens
atgcttgaaaaccccatgaata

SEQ ID NO: 6943817 - DNA, 23 bp, Homo sapiens
tctggctccatccttggggatcc

SEQ ID NO: 6943818 - DNA, 19 bp, Homo sapiens
ggtggctcagggcccagcc

SEQ ID NO: 6943819 - DNA, 22 bp, Homo sapiens
atgatggtgaggttgagcacag

SEQ ID NO: 6943820 - DNA, 22 bp, Homo sapiens
tcataaatgcagtgtcataaat

SEQ ID NO: 6943821 - DNA, 20 bp, Homo sapiens
tcgtagggtcagctcaccat

SEQ ID NO: 6943822 - DNA, 22 bp, Homo sapiens
cacttaagcagttaatttatct

SEQ ID NO: 6943823 - DNA, 22 bp, Homo sapiens
gctctgaaaaatggaggttggc

SEQ ID NO: 6943824 - DNA, 18 bp, Homo sapiens
tctcaaaaataatggctt

SEQ ID NO: 6943825 - DNA, 22 bp, Homo sapiens
cagaaaggcacccactgggtct

SEQ ID NO: 6943826 - DNA, 22 bp, Homo sapiens
tgtgtgattgcacttatatgag

SEQ ID NO: 6943827 - DNA, 22 bp, Homo sapiens
gaggacacatgactccagcagg

SEQ ID NO: 6943828 - DNA, 22 bp, Homo sapiens
cagaacacattttcagagtcaa

SEQ ID NO: 6943829 - DNA, 22 bp, Homo sapiens
ggaagtctcagcaacagagtta

SEQ ID NO: 6943830 - DNA, 22 bp, Homo sapiens
tgagatgaataactcctgctaa

SEQ ID NO: 6943831 - DNA, 22 bp, Homo sapiens
ctagagaaacgccgtgggagga

SEQ ID NO: 6943832 - DNA, 22 bp, Homo sapiens
gaaaggcatcttcagtctctga

SEQ ID NO: 6943833 - DNA, 21 bp, Homo sapiens
ttctagaaccgtgggcggttc

SEQ ID NO: 6943834 - DNA, 22 bp, Homo sapiens
gcccagccagagctgtgtgatg

SEQ ID NO: 6943835 - DNA, 22 bp, Homo sapiens
gctgctgggggaacagttaaaa

SEQ ID NO: 6943836 - DNA, 23 bp, Homo sapiens
tgtagctgtctgagcagacactg

SEQ ID NO: 6943837 - DNA, 22 bp, Homo sapiens
gctgctctgaaaatgactgttg

SEQ ID NO: 6943838 - DNA, 22 bp, Homo sapiens
ccagccacagcttccagctcct

SEQ ID NO: 6943839 - DNA, 22 bp, Homo sapiens
aaagagtttacaaattaggtaa

SEQ ID NO: 6943840 - DNA, 18 bp, Homo sapiens
ttgcttcttttctctagg

SEQ ID NO: 6943841 - DNA, 22 bp, Homo sapiens
aaaagcattacatggtacgtat

SEQ ID NO: 6943842 - DNA, 22 bp, Homo sapiens
aagtctgatcatttcttctata

SEQ ID NO: 6943843 - DNA, 23 bp, Homo sapiens
agtggctgagagtgtttcatatg

SEQ ID NO: 6943844 - DNA, 22 bp, Homo sapiens
gcctttcagttccatcaaagga

SEQ ID NO: 6943845 - DNA, 22 bp, Homo sapiens
acacaggggaaagtggagctga

SEQ ID NO: 6943846 - DNA, 22 bp, Homo sapiens
aagatactcagtggatatgcat

SEQ ID NO: 6943847 - DNA, 22 bp, Homo sapiens
catcagcactatgattaaagta

SEQ ID NO: 6943848 - DNA, 22 bp, Homo sapiens
aaaggccatggttggagtgttt

SEQ ID NO: 6943849 - DNA, 22 bp, Homo sapiens
aagatggctgcagcaattccaa

SEQ ID NO: 6943850 - DNA, 22 bp, Homo sapiens
taagagctgttcaggtacccat

SEQ ID NO: 6943851 - DNA, 22 bp, Homo sapiens
tctagaaaaaaactgctgtgga

SEQ ID NO: 6943852 - DNA, 22 bp, Homo sapiens
tcagccaagcgtaggatattgg

SEQ ID NO: 6943853 - DNA, 22 bp, Homo sapiens
gtcccagaaacatattgctggt

SEQ ID NO: 6943854 - DNA, 22 bp, Homo sapiens
tggtaggagatatggtctccga

SEQ ID NO: 6943855 - DNA, 22 bp, Homo sapiens
gggaggtgatggcaagcagcgg

SEQ ID NO: 6943856 - DNA, 22 bp, Homo sapiens
cagttgctacagttcaagtgtg

SEQ ID NO: 6943857 - DNA, 22 bp, Homo sapiens
agggccacagctcaattaaaag

SEQ ID NO: 6943858 - DNA, 20 bp, Homo sapiens
attagtgcatctggacatgc

SEQ ID NO: 6943859 - DNA, 22 bp, Homo sapiens
tacaggctagggagagtgactg

SEQ ID NO: 6943860 - DNA, 22 bp, Homo sapiens
cctgcagctttgcctcctgaac

SEQ ID NO: 6943861 - DNA, 22 bp, Homo sapiens
gggcagaggttcaacttcaaca

SEQ ID NO: 6943862 - DNA, 22 bp, Homo sapiens
aacacaggtttgtggtaaataa

SEQ ID NO: 6943863 - DNA, 22 bp, Homo sapiens
ccggcgaccgctgtcggaggcg

SEQ ID NO: 6943864 - DNA, 19 bp, Homo sapiens
agccagagtggcccagggg

SEQ ID NO: 6943865 - DNA, 22 bp, Homo sapiens
agtgaacctagcatggattatc

SEQ ID NO: 6943866 - DNA, 22 bp, Homo sapiens
gaactttaatcccttgggctta

SEQ ID NO: 6943867 - DNA, 22 bp, Homo sapiens
cctcagtgtgcagcagcatctg

SEQ ID NO: 6943868 - DNA, 22 bp, Homo sapiens
ctctgggcaccaaagagcagct

SEQ ID NO: 6943869 - DNA, 22 bp, Homo sapiens
agtgaaatatgcccattgctgt

SEQ ID NO: 6943870 - DNA, 22 bp, Homo sapiens
aaacttgaggcaatgaaggtgt

SEQ ID NO: 6943871 - DNA, 23 bp, Homo sapiens
tgtcttggtttcttcaccctagt

SEQ ID NO: 6943872 - DNA, 22 bp, Homo sapiens
atcttaatcgagtccatgaaaa

SEQ ID NO: 6943873 - DNA, 19 bp, Homo sapiens
tttatgtcattgaggtcat

SEQ ID NO: 6943874 - DNA, 22 bp, Homo sapiens
aggaccagtgagtctggcaagt

SEQ ID NO: 6943875 - DNA, 22 bp, Homo sapiens
tggccagctttgactgtaaacc

SEQ ID NO: 6943876 - DNA, 19 bp, Homo sapiens
caactgccccctcaaacat

SEQ ID NO: 6943877 - DNA, 22 bp, Homo sapiens
tagctgttaatatacaaatggt

SEQ ID NO: 6943878 - DNA, 22 bp, Homo sapiens
cactggtagtttcagcaaccag

SEQ ID NO: 6943879 - DNA, 22 bp, Homo sapiens
gatgtacaagattgtaggaatg

SEQ ID NO: 6943880 - DNA, 22 bp, Homo sapiens
actggagtccagacccaagagg

SEQ ID NO: 6943881 - DNA, 22 bp, Homo sapiens
tctatgtctccaccttcgcaga

SEQ ID NO: 6943882 - DNA, 22 bp, Homo sapiens
cacaggcttttttggctgatgt

SEQ ID NO: 6943883 - DNA, 22 bp, Homo sapiens
cttttgattgagcagtttcaaa

SEQ ID NO: 6943884 - DNA, 22 bp, Homo sapiens
tgaccgttttggcacccatgct

SEQ ID NO: 6943885 - DNA, 22 bp, Homo sapiens
agccttcagcagttcaggtgcc

SEQ ID NO: 6943886 - DNA, 22 bp, Homo sapiens
atgcaactacttctgcaccaat

SEQ ID NO: 6943887 - DNA, 23 bp, Homo sapiens
aaatgtgagggaaaatctttctg

SEQ ID NO: 6943888 - DNA, 22 bp, Homo sapiens
ctggctctgggcctcagacact

SEQ ID NO: 6943889 - DNA, 22 bp, Homo sapiens
aaatgtattgcataggatattt

SEQ ID NO: 6943890 - DNA, 21 bp, Homo sapiens
gttctggaggctgcaagtcca

SEQ ID NO: 6943891 - DNA, 22 bp, Homo sapiens
gcgaggtatgtggatggtgcca

SEQ ID NO: 6943892 - DNA, 22 bp, Homo sapiens
tgtgttatctatctcgatgctt

SEQ ID NO: 6943893 - DNA, 22 bp, Homo sapiens
ggcctgctgctatgacttcctg

SEQ ID NO: 6943894 - DNA, 22 bp, Homo sapiens
tgggccagttctttactcgtcc

SEQ ID NO: 6943895 - DNA, 22 bp, Homo sapiens
agaatcaattagattctatgag

SEQ ID NO: 6943896 - DNA, 22 bp, Homo sapiens
cggccttggtcggcccacagct

SEQ ID NO: 6943897 - DNA, 22 bp, Homo sapiens
ttgagggacagaggtgctgtct

SEQ ID NO: 6943898 - DNA, 22 bp, Homo sapiens
gaaaggtgccccataggcagga

SEQ ID NO: 6943899 - DNA, 22 bp, Homo sapiens
tttacatagtgctttcccacta

SEQ ID NO: 6943900 - DNA, 22 bp, Homo sapiens
tatgaccttaggaagcaagaag

SEQ ID NO: 6943901 - DNA, 22 bp, Homo sapiens
ccaggagctatgtacacactat

SEQ ID NO: 6943902 - DNA, 22 bp, Homo sapiens
cctgggcaacatagggagaccc

SEQ ID NO: 6943903 - DNA, 22 bp, Homo sapiens
cattcaagagtggacataatgc

SEQ ID NO: 6943904 - DNA, 22 bp, Homo sapiens
ctcagggacagtatcatttagg

SEQ ID NO: 6943905 - DNA, 17 bp, Homo sapiens
agatgctggccacatgt

SEQ ID NO: 6943906 - DNA, 22 bp, Homo sapiens
agaggccagatcatcatagatg

SEQ ID NO: 6943907 - DNA, 22 bp, Homo sapiens
cctatgtctgtatcccccgttt

SEQ ID NO: 6943908 - DNA, 22 bp, Homo sapiens
cgaggctagaggcaggctcggc

SEQ ID NO: 6943909 - DNA, 22 bp, Homo sapiens
aagatggcatctcctatagatg

SEQ ID NO: 6943910 - DNA, 22 bp, Homo sapiens
ctgatattattgaagctggagt

SEQ ID NO: 6943911 - DNA, 22 bp, Homo sapiens
catctttgggctgcatggaagg

SEQ ID NO: 6943912 - DNA, 22 bp, Homo sapiens
ccatgagccaggctgaggaagc

SEQ ID NO: 6943913 - DNA, 22 bp, Homo sapiens
gggcatttaaacaagcatacaa

SEQ ID NO: 6943914 - DNA, 22 bp, Homo sapiens
ggcagtggcatgtgggtagtgg

SEQ ID NO: 6943915 - DNA, 22 bp, Homo sapiens
gtgaagagctgttgcagagatt

SEQ ID NO: 6943916 - DNA, 22 bp, Homo sapiens
tccaggccaatgtagcaggccc

SEQ ID NO: 6943917 - DNA, 22 bp, Homo sapiens
ccagagctgcaggtaaaatgct

SEQ ID NO: 6943918 - DNA, 22 bp, Homo sapiens
gtggcagctggtatgcagacag

SEQ ID NO: 6943919 - DNA, 22 bp, Homo sapiens
tttctgcagtctctcagaagcc

SEQ ID NO: 6943920 - DNA, 22 bp, Homo sapiens
tggtggctgttgcagaactgag

SEQ ID NO: 6943921 - DNA, 22 bp, Homo sapiens
tctgattacttgagttatttag

SEQ ID NO: 6943922 - DNA, 22 bp, Homo sapiens
actcagacagaccaaagttctg

SEQ ID NO: 6943923 - DNA, 22 bp, Homo sapiens
tccagggaagagcagaggctac

SEQ ID NO: 6943924 - DNA, 22 bp, Homo sapiens
tctgtcactattggccagaaca

SEQ ID NO: 6943925 - DNA, 22 bp, Homo sapiens
agcccatgcaacaggcctagcg

SEQ ID NO: 6943926 - DNA, 22 bp, Homo sapiens
tgccttgctctgtaaaatctct

SEQ ID NO: 6943927 - DNA, 23 bp, Homo sapiens
ttgtgtctacttcctatctaggg

SEQ ID NO: 6943928 - DNA, 20 bp, Homo sapiens
ttatgcaggtcatctcaact

SEQ ID NO: 6943929 - DNA, 20 bp, Homo sapiens
tgtaaacaatagtgttcttg

SEQ ID NO: 6943930 - DNA, 22 bp, Homo sapiens
agagaattttaaaagccttgaa

SEQ ID NO: 6943931 - DNA, 22 bp, Homo sapiens
caggtctgaagagtcacatgcc

SEQ ID NO: 6943932 - DNA, 22 bp, Homo sapiens
gagagggctctgtgtgggtact

SEQ ID NO: 6943933 - DNA, 22 bp, Homo sapiens
cctgggagccaagcctctgtgt

SEQ ID NO: 6943934 - DNA, 22 bp, Homo sapiens
agtgcagggcctgcccagcagg

SEQ ID NO: 6943935 - DNA, 22 bp, Homo sapiens
cctgcaccacaaggcttcagag

SEQ ID NO: 6943936 - DNA, 22 bp, Homo sapiens
agaggcttggaggtgcaaggtt

SEQ ID NO: 6943937 - DNA, 22 bp, Homo sapiens
tggcctggttatattgctatca

SEQ ID NO: 6943938 - DNA, 22 bp, Homo sapiens
gcagggtccatggaggcagccc

SEQ ID NO: 6943939 - DNA, 22 bp, Homo sapiens
gttctctgcgctcccggcccgg

SEQ ID NO: 6943940 - DNA, 22 bp, Homo sapiens
ttgagaaaacattgagggccat

SEQ ID NO: 6943941 - DNA, 22 bp, Homo sapiens
cactggctatgagggagatggg

SEQ ID NO: 6943942 - DNA, 22 bp, Homo sapiens
tgagacttaagaggtcatgttg

SEQ ID NO: 6943943 - DNA, 22 bp, Homo sapiens
ctgctttgaaaataaacttgtc

SEQ ID NO: 6943944 - DNA, 22 bp, Homo sapiens
gtttacagagacagaaagtagt

SEQ ID NO: 6943945 - DNA, 22 bp, Homo sapiens
ttgaaaacagcgtagattcaca

SEQ ID NO: 6943946 - DNA, 22 bp, Homo sapiens
ttggcagagggaccagcctaca

SEQ ID NO: 6943947 - DNA, 22 bp, Homo sapiens
gactgcctttttgagcaaaatg

SEQ ID NO: 6943948 - DNA, 21 bp, Homo sapiens
tttctcagttgtgtgagcagc

SEQ ID NO: 6943949 - DNA, 22 bp, Homo sapiens
atgcagtttatctccaaatcat

SEQ ID NO: 6943950 - DNA, 22 bp, Homo sapiens
cactagatgataatcagctgga

SEQ ID NO: 6943951 - DNA, 22 bp, Homo sapiens
ctgacagctgaagggtcccaga

SEQ ID NO: 6943952 - DNA, 22 bp, Homo sapiens
agctgctttgctgggcaggccc

SEQ ID NO: 6943953 - DNA, 22 bp, Homo sapiens
gaggagagaacattcctccata

SEQ ID NO: 6943954 - DNA, 22 bp, Homo sapiens
tccaggtatgacatggctgttt

SEQ ID NO: 6943955 - DNA, 22 bp, Homo sapiens
aaactaaggtgctgtggactga

SEQ ID NO: 6943956 - DNA, 22 bp, Homo sapiens
catcataataacccagacacag

SEQ ID NO: 6943957 - DNA, 21 bp, Homo sapiens
tggaaacttctagcttacgta

SEQ ID NO: 6943958 - DNA, 22 bp, Homo sapiens
ttgcatgcaaggcctccgtggc

SEQ ID NO: 6943959 - DNA, 22 bp, Homo sapiens
aggtcatttttgccttctattt

SEQ ID NO: 6943960 - DNA, 22 bp, Homo sapiens
caagttcacttgtctacaaggg

SEQ ID NO: 6943961 - DNA, 22 bp, Homo sapiens
cagctgaagagaggtgctgagt

SEQ ID NO: 6943962 - DNA, 22 bp, Homo sapiens
tctaagaattgaagtggctctt

SEQ ID NO: 6943963 - DNA, 21 bp, Homo sapiens
aaatttctgcaagcctcaact

SEQ ID NO: 6943964 - DNA, 22 bp, Homo sapiens
taacatgtttgtacactgaaac

SEQ ID NO: 6943965 - DNA, 22 bp, Homo sapiens
tgcacccacttagctgaagttc

SEQ ID NO: 6943966 - DNA, 22 bp, Homo sapiens
acaatcccacaagaaacactgg

SEQ ID NO: 6943967 - DNA, 22 bp, Homo sapiens
ctagcccactgcaaatgttggc

SEQ ID NO: 6943968 - DNA, 22 bp, Homo sapiens
tgtctactgctgacactaacag

SEQ ID NO: 6943969 - DNA, 22 bp, Homo sapiens
aaagtaacaaaactgtgtgcca

SEQ ID NO: 6943970 - DNA, 22 bp, Homo sapiens
tggggagcccactcacctcccc

SEQ ID NO: 6943971 - DNA, 22 bp, Homo sapiens
ataaaggcagattttggacctc

SEQ ID NO: 6943972 - DNA, 22 bp, Homo sapiens
atgcataatgtatgtattgact

SEQ ID NO: 6943973 - DNA, 22 bp, Homo sapiens
gttctatttcagtaagcaggca

SEQ ID NO: 6943974 - DNA, 22 bp, Homo sapiens
tagcaaatgtaaaatgcctaca

SEQ ID NO: 6943975 - DNA, 22 bp, Homo sapiens
aggttatcatcagttgagcact

SEQ ID NO: 6943976 - DNA, 22 bp, Homo sapiens
ttgatcttggactttccagcct

SEQ ID NO: 6943977 - DNA, 22 bp, Homo sapiens
cagggctcaccactgggatcct

SEQ ID NO: 6943978 - DNA, 22 bp, Homo sapiens
agctctggctaagctgataaat

SEQ ID NO: 6943979 - DNA, 22 bp, Homo sapiens
attgtgaataatgctgcaataa

SEQ ID NO: 6943980 - DNA, 22 bp, Homo sapiens
ctgggtctcaggagttctgagg

SEQ ID NO: 6943981 - DNA, 22 bp, Homo sapiens
tctctgagttgtaaaaaatagt

SEQ ID NO: 6943982 - DNA, 22 bp, Homo sapiens
ctgtcacctctgtggacccact

SEQ ID NO: 6943983 - DNA, 22 bp, Homo sapiens
tgtgcctggtccctgagtcgag

SEQ ID NO: 6943984 - DNA, 22 bp, Homo sapiens
atgtctttataaatgtataatg

SEQ ID NO: 6943985 - DNA, 22 bp, Homo sapiens
gcctggagagcactgtgcgctt

SEQ ID NO: 6943986 - DNA, 22 bp, Homo sapiens
ttccacaacaaccaagcatata

SEQ ID NO: 6943987 - DNA, 22 bp, Homo sapiens
tcatatgtatgatctctgtaca

SEQ ID NO: 6943988 - DNA, 22 bp, Homo sapiens
gtgtgtgtatctgcctatcaca

SEQ ID NO: 6943989 - DNA, 22 bp, Homo sapiens
aatgtgaccttctttggaaata

SEQ ID NO: 6943990 - DNA, 22 bp, Homo sapiens
aggtcattgttaagtcaccata

SEQ ID NO: 6943991 - DNA, 22 bp, Homo sapiens
attgacaatgtatttgtatctg

SEQ ID NO: 6943992 - DNA, 22 bp, Homo sapiens
tccagcagggaattagtagtct

SEQ ID NO: 6943993 - DNA, 22 bp, Homo sapiens
atttctacagtacacatgcatt

SEQ ID NO: 6943994 - DNA, 22 bp, Homo sapiens
tacagggtataggtacagatga

SEQ ID NO: 6943995 - DNA, 22 bp, Homo sapiens
ttacagtcctttgtattgttta

SEQ ID NO: 6943996 - DNA, 22 bp, Homo sapiens
tggcggggcagctctggcttct

SEQ ID NO: 6943997 - DNA, 22 bp, Homo sapiens
agacaatggagagcagagtact

SEQ ID NO: 6943998 - DNA, 22 bp, Homo sapiens
agacatgaaaattccaaacatc

SEQ ID NO: 6943999 - DNA, 22 bp, Homo sapiens
cgccaggcttggtagctcatgc

SEQ ID NO: 6944000 - DNA, 22 bp, Homo sapiens
agcaggaagtagtctgtaagca

SEQ ID NO: 6944001 - DNA, 22 bp, Homo sapiens
aaagttggctcttatgcttgtg

SEQ ID NO: 6944002 - DNA, 20 bp, Homo sapiens
ccagaaggtaggatggaaca

SEQ ID NO: 6944003 - DNA, 22 bp, Homo sapiens
gcagcatacagggagagtactc

SEQ ID NO: 6944004 - DNA, 22 bp, Homo sapiens
cagtgggatatgggggcagcat

SEQ ID NO: 6944005 - DNA, 22 bp, Homo sapiens
gctggcagaatttcttcttgct

SEQ ID NO: 6944006 - DNA, 22 bp, Homo sapiens
tcccaccccttgactctttaag

SEQ ID NO: 6944007 - DNA, 22 bp, Homo sapiens
ctgcacagtgttggaagctgcc

SEQ ID NO: 6944008 - DNA, 20 bp, Homo sapiens
attctaaagctctgctcttt

SEQ ID NO: 6944009 - DNA, 22 bp, Homo sapiens
attagttggggtggagaaggat

SEQ ID NO: 6944010 - DNA, 22 bp, Homo sapiens
gagaccccctgagttatggcct

SEQ ID NO: 6944011 - DNA, 22 bp, Homo sapiens
gctagccaagatgggtcacaaa

SEQ ID NO: 6944012 - DNA, 22 bp, Homo sapiens
atcatttagtggggcattggaa

SEQ ID NO: 6944013 - DNA, 22 bp, Homo sapiens
ggctttatgcacagcagatggt

SEQ ID NO: 6944014 - DNA, 22 bp, Homo sapiens
gatgtaaactgggacttcctag

SEQ ID NO: 6944015 - DNA, 20 bp, Homo sapiens
gctggtgggggcttgacatg

SEQ ID NO: 6944016 - DNA, 22 bp, Homo sapiens
caaagtaatttggagatatata

SEQ ID NO: 6944017 - DNA, 22 bp, Homo sapiens
ttcatgtttcatttgttactat

SEQ ID NO: 6944018 - DNA, 20 bp, Homo sapiens
cctgcctggccattccttgg

SEQ ID NO: 6944019 - DNA, 22 bp, Homo sapiens
cgcccagctgaaatctccaggc

SEQ ID NO: 6944020 - DNA, 22 bp, Homo sapiens
ttgctgagtgaccaataaatat

SEQ ID NO: 6944021 - DNA, 22 bp, Homo sapiens
atccaaagatggaaagaacttt

SEQ ID NO: 6944022 - DNA, 19 bp, Homo sapiens
tccagcctgctgtttctct

SEQ ID NO: 6944023 - DNA, 22 bp, Homo sapiens
tggtattacagcattccatatt

SEQ ID NO: 6944024 - DNA, 20 bp, Homo sapiens
tcatggaatctcactctagt

SEQ ID NO: 6944025 - DNA, 22 bp, Homo sapiens
ggacatttttcttcctacaatg

SEQ ID NO: 6944026 - DNA, 22 bp, Homo sapiens
tgaaggcttggattggtcattt

SEQ ID NO: 6944027 - DNA, 22 bp, Homo sapiens
gctggtgtttcccgcggctcca

SEQ ID NO: 6944028 - DNA, 22 bp, Homo sapiens
gtgggcagtgcctgacggatga

SEQ ID NO: 6944029 - DNA, 22 bp, Homo sapiens
aagagccctctgtgtttctgag

SEQ ID NO: 6944030 - DNA, 22 bp, Homo sapiens
gcatccatggagagcactctga

SEQ ID NO: 6944031 - DNA, 22 bp, Homo sapiens
ttttcagaattagcataccatt

SEQ ID NO: 6944032 - DNA, 22 bp, Homo sapiens
agtgtgacaaatctatggctca

SEQ ID NO: 6944033 - DNA, 22 bp, Homo sapiens
gaactggttacagagggatgtt

SEQ ID NO: 6944034 - DNA, 22 bp, Homo sapiens
gaaagagtatgggagctttact

SEQ ID NO: 6944035 - DNA, 22 bp, Homo sapiens
ttccttgttgaaaatgtctgca

SEQ ID NO: 6944036 - DNA, 22 bp, Homo sapiens
gttctgctgtgtctcagcaggt

SEQ ID NO: 6944037 - DNA, 22 bp, Homo sapiens
agggagaagagaacaaagccct

SEQ ID NO: 6944038 - DNA, 22 bp, Homo sapiens
ccagagcctcgcccggagcctc

SEQ ID NO: 6944039 - DNA, 22 bp, Homo sapiens
aagcagctgcaggttcaaagga

SEQ ID NO: 6944040 - DNA, 18 bp, Homo sapiens
agtgtttatttaggtgaa

SEQ ID NO: 6944041 - DNA, 22 bp, Homo sapiens
tccaaaggcaaaactgtggtgt

SEQ ID NO: 6944042 - DNA, 21 bp, Homo sapiens
ctcttgtctttgctcagtagc

SEQ ID NO: 6944043 - DNA, 22 bp, Homo sapiens
ttctgtaggacttctgccaact

SEQ ID NO: 6944044 - DNA, 22 bp, Homo sapiens
accaggagttttgaccaggggc

SEQ ID NO: 6944045 - DNA, 22 bp, Homo sapiens
tccttgaatgaagagaggtgac

SEQ ID NO: 6944046 - DNA, 18 bp, Homo sapiens
tcagggaatcttggcctt

SEQ ID NO: 6944047 - DNA, 22 bp, Homo sapiens
tgcagcgaaacatgagtttaat

SEQ ID NO: 6944048 - DNA, 22 bp, Homo sapiens
tgtccattgcttatttctactt

SEQ ID NO: 6944049 - DNA, 22 bp, Homo sapiens
atgagttcatactttcagtacc

SEQ ID NO: 6944050 - DNA, 20 bp, Homo sapiens
gggctctgcttggcagaagt

SEQ ID NO: 6944051 - DNA, 22 bp, Homo sapiens
gatgacaaaacttttgccagca

SEQ ID NO: 6944052 - DNA, 22 bp, Homo sapiens
tatagcaaggacataatatgct

SEQ ID NO: 6944053 - DNA, 22 bp, Homo sapiens
gttcacaaatatgcacttacga

SEQ ID NO: 6944054 - DNA, 20 bp, Homo sapiens
tcacatctggcagctgatga

SEQ ID NO: 6944055 - DNA, 22 bp, Homo sapiens
ttgtcctgagataaggaacaga

SEQ ID NO: 6944056 - DNA, 22 bp, Homo sapiens
ctgcagtgaaatcaggaagcaa

SEQ ID NO: 6944057 - DNA, 22 bp, Homo sapiens
attccaaacgcctcgcggactt

SEQ ID NO: 6944058 - DNA, 22 bp, Homo sapiens
aatggcaagagccacagaggcg

SEQ ID NO: 6944059 - DNA, 22 bp, Homo sapiens
acatagaacctggcacatagta

SEQ ID NO: 6944060 - DNA, 22 bp, Homo sapiens
agcagcagccgtagccttatta

SEQ ID NO: 6944061 - DNA, 16 bp, Homo sapiens
ccttggactggactgg

SEQ ID NO: 6944062 - DNA, 22 bp, Homo sapiens
acaggccagcctggggtaaggt

SEQ ID NO: 6944063 - DNA, 22 bp, Homo sapiens
atggctcttgaattgatactct

SEQ ID NO: 6944064 - DNA, 22 bp, Homo sapiens
aaatatgtaagattagcactag

SEQ ID NO: 6944065 - DNA, 22 bp, Homo sapiens
taaggacattagaaatgatgct

SEQ ID NO: 6944066 - DNA, 22 bp, Homo sapiens
cagtaatagatttgagagtggt

SEQ ID NO: 6944067 - DNA, 22 bp, Homo sapiens
ggaaacagagggcacctgagcc

SEQ ID NO: 6944068 - DNA, 22 bp, Homo sapiens
tttgtattacaaagtcacagta

SEQ ID NO: 6944069 - DNA, 22 bp, Homo sapiens
actttgttcctttcacaaagaa

SEQ ID NO: 6944070 - DNA, 20 bp, Homo sapiens
actttatgagttcaattttg

SEQ ID NO: 6944071 - DNA, 22 bp, Homo sapiens
tgccctgtctaagctgtcagta

SEQ ID NO: 6944072 - DNA, 22 bp, Homo sapiens
ctttcacagctgtgcttatgat

SEQ ID NO: 6944073 - DNA, 22 bp, Homo sapiens
tcagacatatcaataggcactt

SEQ ID NO: 6944074 - DNA, 22 bp, Homo sapiens
catcccattggctaaggcaaat

SEQ ID NO: 6944075 - DNA, 22 bp, Homo sapiens
acgggtggtaatgagaaaagga

SEQ ID NO: 6944076 - DNA, 23 bp, Homo sapiens
gccagctttggtctgtctcctag

SEQ ID NO: 6944077 - DNA, 22 bp, Homo sapiens
ctcacccctgtaattccagcac

SEQ ID NO: 6944078 - DNA, 22 bp, Homo sapiens
gtaacagtttgggttccaattg

SEQ ID NO: 6944079 - DNA, 22 bp, Homo sapiens
ttctacacacctctgaggacat

SEQ ID NO: 6944080 - DNA, 22 bp, Homo sapiens
ttattcagttcccttcactctc

SEQ ID NO: 6944081 - DNA, 22 bp, Homo sapiens
ccatttggaggtcattaggaca

SEQ ID NO: 6944082 - DNA, 22 bp, Homo sapiens
tgccaagaccacaattgctttt

SEQ ID NO: 6944083 - DNA, 22 bp, Homo sapiens
cagccctcctttcactcccagg

SEQ ID NO: 6944084 - DNA, 22 bp, Homo sapiens
agccttcataatcttgggcttt

SEQ ID NO: 6944085 - DNA, 22 bp, Homo sapiens
aagacctgagtatagatccctg

SEQ ID NO: 6944086 - DNA, 22 bp, Homo sapiens
ttcttttaattgtgggggagtg

SEQ ID NO: 6944087 - DNA, 22 bp, Homo sapiens
tgtggagctcagaagtagcagt

SEQ ID NO: 6944088 - DNA, 21 bp, Homo sapiens
tgatcctaggcagtgtgattc

SEQ ID NO: 6944089 - DNA, 22 bp, Homo sapiens
gcagctcacacagcaagttttg

SEQ ID NO: 6944090 - DNA, 22 bp, Homo sapiens
ctggagggaggaggctgctatt

SEQ ID NO: 6944091 - DNA, 22 bp, Homo sapiens
tattgggaaaagggcgatggct

SEQ ID NO: 6944092 - DNA, 22 bp, Homo sapiens
gcccatccctgaaccaactggg

SEQ ID NO: 6944093 - DNA, 22 bp, Homo sapiens
cccaggctgatgggatgggcca

SEQ ID NO: 6944094 - DNA, 22 bp, Homo sapiens
gctctgccccaggaactcagcc

SEQ ID NO: 6944095 - DNA, 22 bp, Homo sapiens
agaagcttgaaggagcagtgac

SEQ ID NO: 6944096 - DNA, 22 bp, Homo sapiens
catctgttgagttctccgtgct

SEQ ID NO: 6944097 - DNA, 22 bp, Homo sapiens
ctatttgaattgtcacaggcta

SEQ ID NO: 6944098 - DNA, 22 bp, Homo sapiens
taacttgaacatggagagtaag

SEQ ID NO: 6944099 - DNA, 22 bp, Homo sapiens
ggctcagacctcccagctccag

SEQ ID NO: 6944100 - DNA, 22 bp, Homo sapiens
gaaacaatttttgttgtctaag

SEQ ID NO: 6944101 - DNA, 22 bp, Homo sapiens
tgtacaatgtggccagtgttaa

SEQ ID NO: 6944102 - DNA, 22 bp, Homo sapiens
ttataggaaatagttcatgcga

SEQ ID NO: 6944103 - DNA, 22 bp, Homo sapiens
tatctgttagctaatgaatgag

SEQ ID NO: 6944104 - DNA, 22 bp, Homo sapiens
gggggtttctgggctgagcaga

SEQ ID NO: 6944105 - DNA, 22 bp, Homo sapiens
tgcgatgcaacagcttggcgga

SEQ ID NO: 6944106 - DNA, 22 bp, Homo sapiens
atgcctccaagattcttacgtt

SEQ ID NO: 6944107 - DNA, 22 bp, Homo sapiens
tcctctggaacctcacccttgc

SEQ ID NO: 6944108 - DNA, 22 bp, Homo sapiens
atgtatgtatgtacttttgtat

SEQ ID NO: 6944109 - DNA, 21 bp, Homo sapiens
attggaaaaggtagttggctt

SEQ ID NO: 6944110 - DNA, 22 bp, Homo sapiens
gtacaaattaggaagctttgtg

SEQ ID NO: 6944111 - DNA, 22 bp, Homo sapiens
tagctgaattgtgggagaccta

SEQ ID NO: 6944112 - DNA, 22 bp, Homo sapiens
ctaggttaaagcggttttatgt

SEQ ID NO: 6944113 - DNA, 22 bp, Homo sapiens
aatgatggtcatggcaactttt

SEQ ID NO: 6944114 - DNA, 22 bp, Homo sapiens
ttgaagagacaatttggaaagc

SEQ ID NO: 6944115 - DNA, 22 bp, Homo sapiens
ctgaccagccctgcccagggaa

SEQ ID NO: 6944116 - DNA, 22 bp, Homo sapiens
tcactcagtttttggcctctgc

SEQ ID NO: 6944117 - DNA, 22 bp, Homo sapiens
agcagcagaaagttgatggcag

SEQ ID NO: 6944118 - DNA, 22 bp, Homo sapiens
ctggtccattctctccctgaag

SEQ ID NO: 6944119 - DNA, 22 bp, Homo sapiens
tcatttgtgctgtcagcatgca

SEQ ID NO: 6944120 - DNA, 22 bp, Homo sapiens
ggaagtatttgtttttgcatcc

SEQ ID NO: 6944121 - DNA, 22 bp, Homo sapiens
gtaattctagagtttggacagc

SEQ ID NO: 6944122 - DNA, 18 bp, Homo sapiens
tgttatgagactctagga

SEQ ID NO: 6944123 - DNA, 22 bp, Homo sapiens
tcctgggcacaagtgagtctcc

SEQ ID NO: 6944124 - DNA, 22 bp, Homo sapiens
ataatggtgaacaaaatgactc

SEQ ID NO: 6944125 - DNA, 22 bp, Homo sapiens
tctgtgcaagtatttgacattt

SEQ ID NO: 6944126 - DNA, 22 bp, Homo sapiens
ttgagcatcaattaagtgagtt

SEQ ID NO: 6944127 - DNA, 22 bp, Homo sapiens
ttgattttgcctgatctgagag

SEQ ID NO: 6944128 - DNA, 20 bp, Homo sapiens
ctgggctcaagtgatcctcc

SEQ ID NO: 6944129 - DNA, 22 bp, Homo sapiens
atgcttaatacactgttaaagg

SEQ ID NO: 6944130 - DNA, 22 bp, Homo sapiens
aggacctgtagggcctgcatcc

SEQ ID NO: 6944131 - DNA, 22 bp, Homo sapiens
gagagctgtcagcgtagcaccg

SEQ ID NO: 6944132 - DNA, 22 bp, Homo sapiens
caggttctgaggatggtgcctg

SEQ ID NO: 6944133 - DNA, 22 bp, Homo sapiens
caggtgtttaggtttcatggat

SEQ ID NO: 6944134 - DNA, 22 bp, Homo sapiens
atgtctgttttcatatcagata

SEQ ID NO: 6944135 - DNA, 19 bp, Homo sapiens
ccatggagagagatgcatt

SEQ ID NO: 6944136 - DNA, 22 bp, Homo sapiens
gcttctgagttcttgcttaata

SEQ ID NO: 6944137 - DNA, 22 bp, Homo sapiens
gagtccaccacagctcaaagag

SEQ ID NO: 6944138 - DNA, 22 bp, Homo sapiens
tatttcaggctatatttcttgt

SEQ ID NO: 6944139 - DNA, 22 bp, Homo sapiens
caagacttcaccgctctgtgct

SEQ ID NO: 6944140 - DNA, 22 bp, Homo sapiens
atcctgggcctcagaggtgtgt

SEQ ID NO: 6944141 - DNA, 22 bp, Homo sapiens
ttttgcgataaagtgtgtgtct

SEQ ID NO: 6944142 - DNA, 22 bp, Homo sapiens
tcaaataccagcaatttcatgt

SEQ ID NO: 6944143 - DNA, 20 bp, Homo sapiens
tgctgggcatgcagtggaaa

SEQ ID NO: 6944144 - DNA, 22 bp, Homo sapiens
gctgagtgaggtccagagcttg

SEQ ID NO: 6944145 - DNA, 22 bp, Homo sapiens
aacctttcaattatcctcatct

SEQ ID NO: 6944146 - DNA, 22 bp, Homo sapiens
gtcctctagggtgtccagttga

SEQ ID NO: 6944147 - DNA, 22 bp, Homo sapiens
ttatagaatgtttccaatgcct

SEQ ID NO: 6944148 - DNA, 22 bp, Homo sapiens
ataaatctcttaagactcaaca

SEQ ID NO: 6944149 - DNA, 22 bp, Homo sapiens
gctggtccagggcctctgtggg

SEQ ID NO: 6944150 - DNA, 22 bp, Homo sapiens
ctggcacacagaggccctcggg

SEQ ID NO: 6944151 - DNA, 22 bp, Homo sapiens
tcattttgcagagctgaggaac

SEQ ID NO: 6944152 - DNA, 22 bp, Homo sapiens
tgctgcaggccttggctgggaa

SEQ ID NO: 6944153 - DNA, 21 bp, Homo sapiens
gcagccactgccttcaacaat

SEQ ID NO: 6944154 - DNA, 18 bp, Homo sapiens
tcttccagcttctggagg

SEQ ID NO: 6944155 - DNA, 22 bp, Homo sapiens
cagaatgagtagcatcttcacc

SEQ ID NO: 6944156 - DNA, 22 bp, Homo sapiens
aggaatatgagctgctgcagtg

SEQ ID NO: 6944157 - DNA, 22 bp, Homo sapiens
ccagctgctgacatgggcaggt

SEQ ID NO: 6944158 - DNA, 22 bp, Homo sapiens
tattgaggatctcctgctaatt

SEQ ID NO: 6944159 - DNA, 22 bp, Homo sapiens
tctgccacttgaggtcattggc

SEQ ID NO: 6944160 - DNA, 22 bp, Homo sapiens
caggtctgtgtgccatttccaa

SEQ ID NO: 6944161 - DNA, 22 bp, Homo sapiens
tattgtccatggctgctttggt

SEQ ID NO: 6944162 - DNA, 19 bp, Homo sapiens
cagctgcaccgtgaccatc

SEQ ID NO: 6944163 - DNA, 20 bp, Homo sapiens
agcaggccttggggagagga

SEQ ID NO: 6944164 - DNA, 22 bp, Homo sapiens
agctttattaactctccaggtg

SEQ ID NO: 6944165 - DNA, 20 bp, Homo sapiens
agtggggagtcaggagtgcc

SEQ ID NO: 6944166 - DNA, 22 bp, Homo sapiens
caagggccctgtctatgtatcc

SEQ ID NO: 6944167 - DNA, 22 bp, Homo sapiens
gacaggcttcatgatggcagga

SEQ ID NO: 6944168 - DNA, 22 bp, Homo sapiens
tgtagaggaaagatgaaggccg

SEQ ID NO: 6944169 - DNA, 20 bp, Homo sapiens
catctcctgcctccatgttc

SEQ ID NO: 6944170 - DNA, 22 bp, Homo sapiens
agcagggcagcttttttcagaa

SEQ ID NO: 6944171 - DNA, 22 bp, Homo sapiens
tgtctcctactgcctgtggatc

SEQ ID NO: 6944172 - DNA, 22 bp, Homo sapiens
ggcactgagaacaggctgactt

SEQ ID NO: 6944173 - DNA, 22 bp, Homo sapiens
ggagccagattgtataaaaaag

SEQ ID NO: 6944174 - DNA, 22 bp, Homo sapiens
taatttacttgcaaataacaat

SEQ ID NO: 6944175 - DNA, 22 bp, Homo sapiens
ctgttcctgtagagtccaagtc

SEQ ID NO: 6944176 - DNA, 22 bp, Homo sapiens
ctattctgcttgaaattattct

SEQ ID NO: 6944177 - DNA, 22 bp, Homo sapiens
ctgcagattggcctgatgttca

SEQ ID NO: 6944178 - DNA, 22 bp, Homo sapiens
atggtatacaattatggactgt

SEQ ID NO: 6944179 - DNA, 22 bp, Homo sapiens
tattgcaggttccaaccgggaa

SEQ ID NO: 6944180 - DNA, 22 bp, Homo sapiens
gccaccagccccatgcgctgtg

SEQ ID NO: 6944181 - DNA, 21 bp, Homo sapiens
aaatacagaaacttgttttca

SEQ ID NO: 6944182 - DNA, 22 bp, Homo sapiens
cagaggccaggctgcctgactg

SEQ ID NO: 6944183 - DNA, 22 bp, Homo sapiens
tgtccttataagaaaaggaaat

SEQ ID NO: 6944184 - DNA, 22 bp, Homo sapiens
agtgaagcctgctgaaagtggc

SEQ ID NO: 6944185 - DNA, 23 bp, Homo sapiens
gggaagtggggatttgaagtcat

SEQ ID NO: 6944186 - DNA, 22 bp, Homo sapiens
ttagtgatgactagacttttgt

SEQ ID NO: 6944187 - DNA, 22 bp, Homo sapiens
agcacattaagtgagttcatgt

SEQ ID NO: 6944188 - DNA, 21 bp, Homo sapiens
atcagcaaatgcctgtctccc

SEQ ID NO: 6944189 - DNA, 22 bp, Homo sapiens
aatctcagaaactggtggattt

SEQ ID NO: 6944190 - DNA, 22 bp, Homo sapiens
cagagcagaaggtccaagcctg

SEQ ID NO: 6944191 - DNA, 22 bp, Homo sapiens
cctgtattaggtagacaactat

SEQ ID NO: 6944192 - DNA, 22 bp, Homo sapiens
cactgttgaagatacttcctct

SEQ ID NO: 6944193 - DNA, 22 bp, Homo sapiens
actcaggaaaaatgtagtgata

SEQ ID NO: 6944194 - DNA, 22 bp, Homo sapiens
ccagctttcctgcgagttgatt

SEQ ID NO: 6944195 - DNA, 22 bp, Homo sapiens
acccgggaggcaggagtcatag

SEQ ID NO: 6944196 - DNA, 22 bp, Homo sapiens
cagtgatgaatgaaccacaggt

SEQ ID NO: 6944197 - DNA, 22 bp, Homo sapiens
ctagtattaagtgtgagtaaaa

SEQ ID NO: 6944198 - DNA, 22 bp, Homo sapiens
aggtggcagactaacagaagga

SEQ ID NO: 6944199 - DNA, 22 bp, Homo sapiens
ttgctcacttggaactaggcat

SEQ ID NO: 6944200 - DNA, 22 bp, Homo sapiens
gagctctgtccacacttggaga

SEQ ID NO: 6944201 - DNA, 22 bp, Homo sapiens
cctgcccagggtcaccacagag

SEQ ID NO: 6944202 - DNA, 19 bp, Homo sapiens
gagttctctgcatcagtga

SEQ ID NO: 6944203 - DNA, 22 bp, Homo sapiens
cctgttgtggaaaaagcctgat

SEQ ID NO: 6944204 - DNA, 22 bp, Homo sapiens
ttacctgtgtcagtatatgaga

SEQ ID NO: 6944205 - DNA, 22 bp, Homo sapiens
tgcacagatctggtggcaagga

SEQ ID NO: 6944206 - DNA, 22 bp, Homo sapiens
atgtattgtctcttttccttaa

SEQ ID NO: 6944207 - DNA, 22 bp, Homo sapiens
ggcacacagcttggcaggagat

SEQ ID NO: 6944208 - DNA, 22 bp, Homo sapiens
atacacatgtgtatgtgcatgc

SEQ ID NO: 6944209 - DNA, 22 bp, Homo sapiens
ctccccaactcagccgaggctt

SEQ ID NO: 6944210 - DNA, 22 bp, Homo sapiens
atgaaaacagcctcctgtgata

SEQ ID NO: 6944211 - DNA, 22 bp, Homo sapiens
ttcacagactgcagactttttg

SEQ ID NO: 6944212 - DNA, 22 bp, Homo sapiens
tgtgctctacctcagtgtcatt

SEQ ID NO: 6944213 - DNA, 22 bp, Homo sapiens
gtacacaaataataaagttaca

SEQ ID NO: 6944214 - DNA, 22 bp, Homo sapiens
gtaaagtctggctgaaacatgc

SEQ ID NO: 6944215 - DNA, 22 bp, Homo sapiens
tcccacagtgaagttcatgata

SEQ ID NO: 6944216 - DNA, 22 bp, Homo sapiens
cttggggacacagagcccaggg

SEQ ID NO: 6944217 - DNA, 22 bp, Homo sapiens
tattcagtgacagggtattatg

SEQ ID NO: 6944218 - DNA, 22 bp, Homo sapiens
taagcagatgctgtctgcacaa

SEQ ID NO: 6944219 - DNA, 22 bp, Homo sapiens
tcagtgtgcacatggtagcagt

SEQ ID NO: 6944220 - DNA, 22 bp, Homo sapiens
attctgtatttctaataagatc

SEQ ID NO: 6944221 - DNA, 21 bp, Homo sapiens
ttctgctgttcaccaccaccc

SEQ ID NO: 6944222 - DNA, 22 bp, Homo sapiens
tggacactgtctccaggataaa

SEQ ID NO: 6944223 - DNA, 22 bp, Homo sapiens
acctgcagtggccactcctaat

SEQ ID NO: 6944224 - DNA, 22 bp, Homo sapiens
tgaggtatgagtgtgccaggtg

SEQ ID NO: 6944225 - DNA, 22 bp, Homo sapiens
tccaagatctacagcagtttag

SEQ ID NO: 6944226 - DNA, 22 bp, Homo sapiens
ggaagatgagaagtggggctcc

SEQ ID NO: 6944227 - DNA, 22 bp, Homo sapiens
attacaaaagaagggagaaggt

SEQ ID NO: 6944228 - DNA, 22 bp, Homo sapiens
aaacaatgacaacacagctgcg

SEQ ID NO: 6944229 - DNA, 20 bp, Homo sapiens
cacaggccttgtgagcagac

SEQ ID NO: 6944230 - DNA, 22 bp, Homo sapiens
tgcaccatgtaagtggccacgt

SEQ ID NO: 6944231 - DNA, 22 bp, Homo sapiens
cctggcctcagacagagggtgg

SEQ ID NO: 6944232 - DNA, 22 bp, Homo sapiens
acagtgcttagcacagagtaga

SEQ ID NO: 6944233 - DNA, 22 bp, Homo sapiens
tgactgtgcctgttgaatgaat

SEQ ID NO: 6944234 - DNA, 19 bp, Homo sapiens
ccacagagcatgctgaggc

SEQ ID NO: 6944235 - DNA, 22 bp, Homo sapiens
tggtccatgcccacggaatgtg

SEQ ID NO: 6944236 - DNA, 22 bp, Homo sapiens
ggctccttcaaagcacctggct

SEQ ID NO: 6944237 - DNA, 22 bp, Homo sapiens
agcatatacaaactcatataca

SEQ ID NO: 6944238 - DNA, 22 bp, Homo sapiens
tgtaccactctactaagggttc

SEQ ID NO: 6944239 - DNA, 22 bp, Homo sapiens
taggtacacagtaagtgctcaa

SEQ ID NO: 6944240 - DNA, 22 bp, Homo sapiens
gttcacatcccagaaagagcat

SEQ ID NO: 6944241 - DNA, 22 bp, Homo sapiens
aaaactcctgaaattgtttccc

SEQ ID NO: 6944242 - DNA, 22 bp, Homo sapiens
ttgatgatgtttctgccttgcc

SEQ ID NO: 6944243 - DNA, 22 bp, Homo sapiens
aggcactgtgcttcttatatgt

SEQ ID NO: 6944244 - DNA, 22 bp, Homo sapiens
ccagggcctcgtgttctgagtg

SEQ ID NO: 6944245 - DNA, 22 bp, Homo sapiens
tttggattccatgctctccggg

SEQ ID NO: 6944246 - DNA, 22 bp, Homo sapiens
ctgtgtccaatggccttagcag

SEQ ID NO: 6944247 - DNA, 22 bp, Homo sapiens
gcgccctccacccacagcggct

SEQ ID NO: 6944248 - DNA, 23 bp, Homo sapiens
caagtgcaccagatatacaggtc

SEQ ID NO: 6944249 - DNA, 22 bp, Homo sapiens
tctgctttatggctcagagact

SEQ ID NO: 6944250 - DNA, 22 bp, Homo sapiens
tcatggcacatgccctccaggg

SEQ ID NO: 6944251 - DNA, 18 bp, Homo sapiens
acagtgctgtcactgctt

SEQ ID NO: 6944252 - DNA, 22 bp, Homo sapiens
gaacttgtgcactgctggtgat

SEQ ID NO: 6944253 - DNA, 22 bp, Homo sapiens
tcagggctgcatacaggagata

SEQ ID NO: 6944254 - DNA, 22 bp, Homo sapiens
tagtacagttttggcacatgga

SEQ ID NO: 6944255 - DNA, 22 bp, Homo sapiens
tgttaagagaagctctctctga

SEQ ID NO: 6944256 - DNA, 20 bp, Homo sapiens
ctctaattgctttatgtgtg

SEQ ID NO: 6944257 - DNA, 22 bp, Homo sapiens
aatgtctgccagaactgatcat

SEQ ID NO: 6944258 - DNA, 22 bp, Homo sapiens
tcaagatgaaagatgtagccat

SEQ ID NO: 6944259 - DNA, 22 bp, Homo sapiens
catgcttacctgccaaagcact

SEQ ID NO: 6944260 - DNA, 22 bp, Homo sapiens
tttggagaatgttttggtcaga

SEQ ID NO: 6944261 - DNA, 21 bp, Homo sapiens
agaaactgactcctagaggca

SEQ ID NO: 6944262 - DNA, 22 bp, Homo sapiens
acagtgaaaattctattgattt

SEQ ID NO: 6944263 - DNA, 22 bp, Homo sapiens
attggtggtgaggacatgccag

SEQ ID NO: 6944264 - DNA, 22 bp, Homo sapiens
gttacaaaggtcataaaagtgt

SEQ ID NO: 6944265 - DNA, 22 bp, Homo sapiens
ggcgagcagagccattgcctat

SEQ ID NO: 6944266 - DNA, 22 bp, Homo sapiens
catacaagcgttcaatagatgt

SEQ ID NO: 6944267 - DNA, 22 bp, Homo sapiens
attggagccccagaagcaaggt

SEQ ID NO: 6944268 - DNA, 20 bp, Homo sapiens
gggctccagctgtgattctt

SEQ ID NO: 6944269 - DNA, 22 bp, Homo sapiens
gtgcctgtaagttgtatgggct

SEQ ID NO: 6944270 - DNA, 22 bp, Homo sapiens
ggagtcaggatcctggggatgg

SEQ ID NO: 6944271 - DNA, 22 bp, Homo sapiens
tgtctcaggggcattgaaataa

SEQ ID NO: 6944272 - DNA, 22 bp, Homo sapiens
ccttggactcactgtctggctg

SEQ ID NO: 6944273 - DNA, 18 bp, Homo sapiens
gggtccccagctgcaggg

SEQ ID NO: 6944274 - DNA, 22 bp, Homo sapiens
tacttttcaagcagctggttat

SEQ ID NO: 6944275 - DNA, 22 bp, Homo sapiens
ttaggattaaaagttaatgcaa

SEQ ID NO: 6944276 - DNA, 22 bp, Homo sapiens
tgtagcacagagctttgacact

SEQ ID NO: 6944277 - DNA, 22 bp, Homo sapiens
acaaaggtgcgtcccttcagct

SEQ ID NO: 6944278 - DNA, 22 bp, Homo sapiens
tcttaaagcagcttgtaaaatg

SEQ ID NO: 6944279 - DNA, 22 bp, Homo sapiens
tagtgattcgatgtgggtaagt

SEQ ID NO: 6944280 - DNA, 22 bp, Homo sapiens
aggatgaggctggacacttctt

SEQ ID NO: 6944281 - DNA, 22 bp, Homo sapiens
aacagctgcaaaaggttgcctg

SEQ ID NO: 6944282 - DNA, 22 bp, Homo sapiens
ctgggctgatttagtcacgttt

SEQ ID NO: 6944283 - DNA, 22 bp, Homo sapiens
gaccctttctgcatgcttatct

SEQ ID NO: 6944284 - DNA, 22 bp, Homo sapiens
tgtacaatgccgagactaactc

SEQ ID NO: 6944285 - DNA, 22 bp, Homo sapiens
tcttctgttaccacagcgatga

SEQ ID NO: 6944286 - DNA, 22 bp, Homo sapiens
gcactgcctcatgctaataaat

SEQ ID NO: 6944287 - DNA, 23 bp, Homo sapiens
tttatattcctaatgtcttgagc

SEQ ID NO: 6944288 - DNA, 22 bp, Homo sapiens
tgcatttataaaatgttcgtgg

SEQ ID NO: 6944289 - DNA, 22 bp, Homo sapiens
agggacctgctcactgcctggc

SEQ ID NO: 6944290 - DNA, 20 bp, Homo sapiens
agtgccaaatgttgtttgtt

SEQ ID NO: 6944291 - DNA, 22 bp, Homo sapiens
ccagaggtggtcatagaaagca

SEQ ID NO: 6944292 - DNA, 22 bp, Homo sapiens
cagagagtggcagttactgaag

SEQ ID NO: 6944293 - DNA, 22 bp, Homo sapiens
ttgcctttgacggtgcagcagt

SEQ ID NO: 6944294 - DNA, 20 bp, Homo sapiens
gctgctttcaaatgacacgt

SEQ ID NO: 6944295 - DNA, 18 bp, Homo sapiens
ctggctttcttatccatc

SEQ ID NO: 6944296 - DNA, 22 bp, Homo sapiens
ttaggatttgaaaaggggcaga

SEQ ID NO: 6944297 - DNA, 17 bp, Homo sapiens
aggaagggcaagtttct

SEQ ID NO: 6944298 - DNA, 22 bp, Homo sapiens
ctgtttcatagagttgtgaatt

SEQ ID NO: 6944299 - DNA, 19 bp, Homo sapiens
agcagctcagggaggcacc

SEQ ID NO: 6944300 - DNA, 22 bp, Homo sapiens
tatttctgtttatttgtacatc

SEQ ID NO: 6944301 - DNA, 22 bp, Homo sapiens
gggaggagtgaagattcacctg

SEQ ID NO: 6944302 - DNA, 22 bp, Homo sapiens
tccccatgaggctgaattgggc

SEQ ID NO: 6944303 - DNA, 22 bp, Homo sapiens
atggtttactgatctttttggt

SEQ ID NO: 6944304 - DNA, 22 bp, Homo sapiens
agccccaggcccggacgcctct

SEQ ID NO: 6944305 - DNA, 22 bp, Homo sapiens
gttcaaattttctaggtgggtg

SEQ ID NO: 6944306 - DNA, 18 bp, Homo sapiens
ttccagtagctgtatcac

SEQ ID NO: 6944307 - DNA, 22 bp, Homo sapiens
aagccaggaagagagccttcac

SEQ ID NO: 6944308 - DNA, 22 bp, Homo sapiens
agtaatgtcccttaaatgtggt

SEQ ID NO: 6944309 - DNA, 22 bp, Homo sapiens
acagagaccagcatcttctgcc

SEQ ID NO: 6944310 - DNA, 22 bp, Homo sapiens
ctgtcccttcattattcactac

SEQ ID NO: 6944311 - DNA, 22 bp, Homo sapiens
cctaggcacccgagttatgttc

SEQ ID NO: 6944312 - DNA, 22 bp, Homo sapiens
tgccctctcaagttgagtcaga

SEQ ID NO: 6944313 - DNA, 22 bp, Homo sapiens
tttgtacacaacctgtggtagt

SEQ ID NO: 6944314 - DNA, 22 bp, Homo sapiens
tatgaatgatgcagcctggagt

SEQ ID NO: 6944315 - DNA, 20 bp, Homo sapiens
gtgctggagttaggaaaggt

SEQ ID NO: 6944316 - DNA, 22 bp, Homo sapiens
tgtctccaaaacaatctcagat

SEQ ID NO: 6944317 - DNA, 22 bp, Homo sapiens
taatggtgcttctgtgagataa

SEQ ID NO: 6944318 - DNA, 22 bp, Homo sapiens
tttcttatgagcaagactctat

SEQ ID NO: 6944319 - DNA, 22 bp, Homo sapiens
ctggtagagtgtttagggtcct

SEQ ID NO: 6944320 - DNA, 22 bp, Homo sapiens
taaaatggtaactttcatttgc

SEQ ID NO: 6944321 - DNA, 20 bp, Homo sapiens
atatgcttaatctcactaca

SEQ ID NO: 6944322 - DNA, 22 bp, Homo sapiens
tgtgtgtgcaggagagcaggtg

SEQ ID NO: 6944323 - DNA, 22 bp, Homo sapiens
agttcacattccgaggtactgg

SEQ ID NO: 6944324 - DNA, 22 bp, Homo sapiens
gggttggcagcaccagaggagg

SEQ ID NO: 6944325 - DNA, 22 bp, Homo sapiens
agagtttggtgaagcaatttga

SEQ ID NO: 6944326 - DNA, 22 bp, Homo sapiens
caggcttggcagggaggctggt

SEQ ID NO: 6944327 - DNA, 22 bp, Homo sapiens
actctgcaatgtggcaagaaca

SEQ ID NO: 6944328 - DNA, 22 bp, Homo sapiens
ttttcctgtccaggcaattatt

SEQ ID NO: 6944329 - DNA, 22 bp, Homo sapiens
ttgctttattcctagcccttgt

SEQ ID NO: 6944330 - DNA, 22 bp, Homo sapiens
catttgaatggcatttcacttt

SEQ ID NO: 6944331 - DNA, 22 bp, Homo sapiens
gtccatctagaatttatttcta

SEQ ID NO: 6944332 - DNA, 22 bp, Homo sapiens
gtggtgcaggccagcaggggcg

SEQ ID NO: 6944333 - DNA, 22 bp, Homo sapiens
atatgcatatgtcaaaacttat

SEQ ID NO: 6944334 - DNA, 22 bp, Homo sapiens
aactacagggggtggcaggcgg

SEQ ID NO: 6944335 - DNA, 22 bp, Homo sapiens
taaggaatatcataagaagtag

SEQ ID NO: 6944336 - DNA, 23 bp, Homo sapiens
tccttcaggctcttcccctggac

SEQ ID NO: 6944337 - DNA, 22 bp, Homo sapiens
ctgcaaaattgttctttgctcc

SEQ ID NO: 6944338 - DNA, 17 bp, Homo sapiens
gaagaaggaatctagaa

SEQ ID NO: 6944339 - DNA, 22 bp, Homo sapiens
aagtgctgtttctgatgaatgc

SEQ ID NO: 6944340 - DNA, 22 bp, Homo sapiens
ccctgctagaacctccaacatg

SEQ ID NO: 6944341 - DNA, 19 bp, Homo sapiens
tcctgcaggtggcttgcag

SEQ ID NO: 6944342 - DNA, 22 bp, Homo sapiens
tatcctgttttgcacaattata

SEQ ID NO: 6944343 - DNA, 22 bp, Homo sapiens
tgggaaatataatttagctgtg

SEQ ID NO: 6944344 - DNA, 22 bp, Homo sapiens
tgaccagtgatctactgggatt

SEQ ID NO: 6944345 - DNA, 22 bp, Homo sapiens
aaggtcttatctccaaatacag

SEQ ID NO: 6944346 - DNA, 22 bp, Homo sapiens
tgagcctgggtggtcgaggctg

SEQ ID NO: 6944347 - DNA, 22 bp, Homo sapiens
gaggcaggcactgttatcagca

SEQ ID NO: 6944348 - DNA, 22 bp, Homo sapiens
tccaggctggctcttcaaaatt

SEQ ID NO: 6944349 - DNA, 22 bp, Homo sapiens
attgacaattctatgcagagca

SEQ ID NO: 6944350 - DNA, 22 bp, Homo sapiens
taggaatgaaagtgttttgaaa

SEQ ID NO: 6944351 - DNA, 22 bp, Homo sapiens
gctgcacaggagaccccattta

SEQ ID NO: 6944352 - DNA, 18 bp, Homo sapiens
tgcagcctgtagtcttgt

SEQ ID NO: 6944353 - DNA, 22 bp, Homo sapiens
tggaggccagtgaaagtagatt

SEQ ID NO: 6944354 - DNA, 22 bp, Homo sapiens
taagaactttgtagcctgttct

SEQ ID NO: 6944355 - DNA, 22 bp, Homo sapiens
agctctgacattgattctcagc

SEQ ID NO: 6944356 - DNA, 22 bp, Homo sapiens
tgagcagttcgacttcttcccc

SEQ ID NO: 6944357 - DNA, 22 bp, Homo sapiens
ttcctcagtgatggattcaacg

SEQ ID NO: 6944358 - DNA, 22 bp, Homo sapiens
catttgcttcctgggtcttgaa

SEQ ID NO: 6944359 - DNA, 22 bp, Homo sapiens
ctaggcagggtgctgtgccatg

SEQ ID NO: 6944360 - DNA, 22 bp, Homo sapiens
tggaaacacccacgcatgcata

SEQ ID NO: 6944361 - DNA, 22 bp, Homo sapiens
atttggaacttataataagttt

SEQ ID NO: 6944362 - DNA, 22 bp, Homo sapiens
aaactgccacaagagggacatc

SEQ ID NO: 6944363 - DNA, 22 bp, Homo sapiens
aggagggtcatgttgaagtgta

SEQ ID NO: 6944364 - DNA, 22 bp, Homo sapiens
catcatcaaactggggggctgg

SEQ ID NO: 6944365 - DNA, 22 bp, Homo sapiens
tcctcatcaccattgcaatgta

SEQ ID NO: 6944366 - DNA, 22 bp, Homo sapiens
ctggctcccgtctggtggccat

SEQ ID NO: 6944367 - DNA, 22 bp, Homo sapiens
ttaagttgttatcaccatttat

SEQ ID NO: 6944368 - DNA, 20 bp, Homo sapiens
tgaaggccagcagcataggg

SEQ ID NO: 6944369 - DNA, 22 bp, Homo sapiens
ttcaggcaagatattaacttct

SEQ ID NO: 6944370 - DNA, 22 bp, Homo sapiens
tctgggagtgtgtctggccatc

SEQ ID NO: 6944371 - DNA, 22 bp, Homo sapiens
aaagtgttgggattacaggcat

SEQ ID NO: 6944372 - DNA, 22 bp, Homo sapiens
gaagaagtatttttgtcctgtt

SEQ ID NO: 6944373 - DNA, 22 bp, Homo sapiens
gcaaactgatttccaagtccgt

SEQ ID NO: 6944374 - DNA, 22 bp, Homo sapiens
ccaattctgtagagttgattaa

SEQ ID NO: 6944375 - DNA, 22 bp, Homo sapiens
aaaggcattggagaccctggct

SEQ ID NO: 6944376 - DNA, 22 bp, Homo sapiens
ccctctctcggttgctgtggtt

SEQ ID NO: 6944377 - DNA, 22 bp, Homo sapiens
tcactgaaccagggatctctag

SEQ ID NO: 6944378 - DNA, 22 bp, Homo sapiens
cactctgcagctgaagggctgg

SEQ ID NO: 6944379 - DNA, 22 bp, Homo sapiens
agaaggctaaagtaacttagta

SEQ ID NO: 6944380 - DNA, 22 bp, Homo sapiens
agcctcctgtagccctcaccca

SEQ ID NO: 6944381 - DNA, 22 bp, Homo sapiens
agagatctatttaatagtgtta

SEQ ID NO: 6944382 - DNA, 22 bp, Homo sapiens
tagagaggccgcgggtcccctc

SEQ ID NO: 6944383 - DNA, 22 bp, Homo sapiens
gtaatctgtagtaaagcaccat

SEQ ID NO: 6944384 - DNA, 22 bp, Homo sapiens
tcaagctattggctgaggctgc

SEQ ID NO: 6944385 - DNA, 22 bp, Homo sapiens
tcctgggcttaagtgatcctcc

SEQ ID NO: 6944386 - DNA, 22 bp, Homo sapiens
tctgcacacttttattgacctc

SEQ ID NO: 6944387 - DNA, 22 bp, Homo sapiens
attcagagattgttattcagac

SEQ ID NO: 6944388 - DNA, 22 bp, Homo sapiens
tgaaaaggagtccttgttttca

SEQ ID NO: 6944389 - DNA, 22 bp, Homo sapiens
ctgggaggcggaggttgcagtg

SEQ ID NO: 6944390 - DNA, 22 bp, Homo sapiens
caacaatttcccagtttcccat

SEQ ID NO: 6944391 - DNA, 19 bp, Homo sapiens
tccctgagttccagcccag

SEQ ID NO: 6944392 - DNA, 22 bp, Homo sapiens
gcattcatacatcaataagctt

SEQ ID NO: 6944393 - DNA, 22 bp, Homo sapiens
ataatgtttgattgagcagata

SEQ ID NO: 6944394 - DNA, 22 bp, Homo sapiens
cctgagcacacatcagaatcac

SEQ ID NO: 6944395 - DNA, 22 bp, Homo sapiens
ctccagctgctggtctgagact

SEQ ID NO: 6944396 - DNA, 22 bp, Homo sapiens
taggaacacagggacttgatga

SEQ ID NO: 6944397 - DNA, 21 bp, Homo sapiens
accattctgcacatgctgtca

SEQ ID NO: 6944398 - DNA, 22 bp, Homo sapiens
ttgtaattagtttttgatctgg

SEQ ID NO: 6944399 - DNA, 22 bp, Homo sapiens
atgactgaagggttttaaacag

SEQ ID NO: 6944400 - DNA, 22 bp, Homo sapiens
tcctcttgggaatacctttcta

SEQ ID NO: 6944401 - DNA, 22 bp, Homo sapiens
gtgcccagcagcagcgtccccg

SEQ ID NO: 6944402 - DNA, 22 bp, Homo sapiens
gtctgggcagcagcatttctta

SEQ ID NO: 6944403 - DNA, 22 bp, Homo sapiens
ggccagcagtcacagggtcaga

SEQ ID NO: 6944404 - DNA, 22 bp, Homo sapiens
catgcagtttctctatgcgtag

SEQ ID NO: 6944405 - DNA, 22 bp, Homo sapiens
atgtgcaggatccaggctccta

SEQ ID NO: 6944406 - DNA, 22 bp, Homo sapiens
tctgatctgtcagtcatgaagg

SEQ ID NO: 6944407 - DNA, 22 bp, Homo sapiens
taaacgattcctctggaggggc

SEQ ID NO: 6944408 - DNA, 22 bp, Homo sapiens
ctgtggaattgatgcttagtgt

SEQ ID NO: 6944409 - DNA, 22 bp, Homo sapiens
tgtctacttgggctctacagca

SEQ ID NO: 6944410 - DNA, 22 bp, Homo sapiens
actgaggttgtagtaggaattc

SEQ ID NO: 6944411 - DNA, 22 bp, Homo sapiens
ctgctgcctagtccaagacgtg

SEQ ID NO: 6944412 - DNA, 22 bp, Homo sapiens
acttgcctgttacatttctagt

SEQ ID NO: 6944413 - DNA, 23 bp, Homo sapiens
attttaaccttgactaacatgca

SEQ ID NO: 6944414 - DNA, 22 bp, Homo sapiens
gtggccagggcccacaggatga

SEQ ID NO: 6944415 - DNA, 22 bp, Homo sapiens
gtccagaagcagtgcacatcac

SEQ ID NO: 6944416 - DNA, 19 bp, Homo sapiens
aagtgggtagcacattcac

SEQ ID NO: 6944417 - DNA, 20 bp, Homo sapiens
ttgcaataaatgaaagacca

SEQ ID NO: 6944418 - DNA, 22 bp, Homo sapiens
tgtatttaattgtatcatcaca

SEQ ID NO: 6944419 - DNA, 22 bp, Homo sapiens
agctgctctgagccctgattct

SEQ ID NO: 6944420 - DNA, 22 bp, Homo sapiens
ctggtgagacggttgacaggag

SEQ ID NO: 6944421 - DNA, 22 bp, Homo sapiens
tgtaagatatgagtacatgtaa

SEQ ID NO: 6944422 - DNA, 22 bp, Homo sapiens
atttattggatgcttacttggg

SEQ ID NO: 6944423 - DNA, 21 bp, Homo sapiens
cgcagctgagaaatatacaga

SEQ ID NO: 6944424 - DNA, 22 bp, Homo sapiens
aaaatgatgctgtaatttggca

SEQ ID NO: 6944425 - DNA, 22 bp, Homo sapiens
tgtctacaagccttgttcggca

SEQ ID NO: 6944426 - DNA, 22 bp, Homo sapiens
tagattctctgctggctgacat

SEQ ID NO: 6944427 - DNA, 21 bp, Homo sapiens
agctatgtcccaccatgacac

SEQ ID NO: 6944428 - DNA, 18 bp, Homo sapiens
aattccaagccataggag

SEQ ID NO: 6944429 - DNA, 22 bp, Homo sapiens
ttaaggaaccacagcatgttag

SEQ ID NO: 6944430 - DNA, 22 bp, Homo sapiens
gtcctctgggagccttgagcct

SEQ ID NO: 6944431 - DNA, 22 bp, Homo sapiens
atctcccagccacagcattctt

SEQ ID NO: 6944432 - DNA, 22 bp, Homo sapiens
atgtccctgagggtctctctga

SEQ ID NO: 6944433 - DNA, 22 bp, Homo sapiens
gcaggcctcccctgctggagct

SEQ ID NO: 6944434 - DNA, 22 bp, Homo sapiens
caacagtcagaatgaagctgag

SEQ ID NO: 6944435 - DNA, 22 bp, Homo sapiens
ccttcattcagctatagcatcc

SEQ ID NO: 6944436 - DNA, 22 bp, Homo sapiens
ggcgctctggacctggctctcg

SEQ ID NO: 6944437 - DNA, 22 bp, Homo sapiens
aatcagtctcatttagcaggga

SEQ ID NO: 6944438 - DNA, 23 bp, Homo sapiens
tttcacatttactgttagatggc

SEQ ID NO: 6944439 - DNA, 23 bp, Homo sapiens
atgataatgccattaactttgat

SEQ ID NO: 6944440 - DNA, 19 bp, Homo sapiens
ctttccaggagatgctgag

SEQ ID NO: 6944441 - DNA, 19 bp, Homo sapiens
tggaggggtttgaatgtgg

SEQ ID NO: 6944442 - DNA, 22 bp, Homo sapiens
tctctatttgcctaggcttgtg

SEQ ID NO: 6944443 - DNA, 22 bp, Homo sapiens
caagagagatgcagctcactca

SEQ ID NO: 6944444 - DNA, 22 bp, Homo sapiens
gttcacaagagttacagacaga

SEQ ID NO: 6944445 - DNA, 22 bp, Homo sapiens
attgttgataatcgtgttgtca

SEQ ID NO: 6944446 - DNA, 22 bp, Homo sapiens
ttgcagtttgtggcaactttga

SEQ ID NO: 6944447 - DNA, 22 bp, Homo sapiens
tctcagagcatcattttcttag

SEQ ID NO: 6944448 - DNA, 22 bp, Homo sapiens
agagccctgaagcagagctaaa

SEQ ID NO: 6944449 - DNA, 22 bp, Homo sapiens
ggtcagggggatctgtgaggta

SEQ ID NO: 6944450 - DNA, 22 bp, Homo sapiens
atggcatcatctttcttcatta

SEQ ID NO: 6944451 - DNA, 22 bp, Homo sapiens
tcttaaatgactgataagagga

SEQ ID NO: 6944452 - DNA, 22 bp, Homo sapiens
caacaatatgctgagtttttca

SEQ ID NO: 6944453 - DNA, 22 bp, Homo sapiens
ttctagctttttgcaccaaggt

SEQ ID NO: 6944454 - DNA, 22 bp, Homo sapiens
caagtatttcctgatggcctgt

SEQ ID NO: 6944455 - DNA, 22 bp, Homo sapiens
tctgagcattttaggtggtatc

SEQ ID NO: 6944456 - DNA, 22 bp, Homo sapiens
tctggcaccactgagtctgcag

SEQ ID NO: 6944457 - DNA, 20 bp, Homo sapiens
aggcttggcttggcaggaac

SEQ ID NO: 6944458 - DNA, 22 bp, Homo sapiens
agacaacatctagtttggtgga

SEQ ID NO: 6944459 - DNA, 18 bp, Homo sapiens
gatgggagcaagagaaga

SEQ ID NO: 6944460 - DNA, 22 bp, Homo sapiens
gaaatgtagaattgcttaactg

SEQ ID NO: 6944461 - DNA, 18 bp, Homo sapiens
ctgaagacaaaatgtcca

SEQ ID NO: 6944462 - DNA, 22 bp, Homo sapiens
tagcccagagagccaggggctt

SEQ ID NO: 6944463 - DNA, 22 bp, Homo sapiens
tggaatgtcaagaagcagtaag

SEQ ID NO: 6944464 - DNA, 19 bp, Homo sapiens
cataatacagtggatctga

SEQ ID NO: 6944465 - DNA, 22 bp, Homo sapiens
ttgatacatgctctagagttga

SEQ ID NO: 6944466 - DNA, 22 bp, Homo sapiens
tgaggcctctgtgccatccagg

SEQ ID NO: 6944467 - DNA, 22 bp, Homo sapiens
cagggcctcatggccggggtgc

SEQ ID NO: 6944468 - DNA, 22 bp, Homo sapiens
acagagactgggagcaagaggc

SEQ ID NO: 6944469 - DNA, 22 bp, Homo sapiens
gctaggttggggaagttctcct

SEQ ID NO: 6944470 - DNA, 20 bp, Homo sapiens
acatatgaatgatagagcca

SEQ ID NO: 6944471 - DNA, 22 bp, Homo sapiens
cctgggctttgagggcaggatg

SEQ ID NO: 6944472 - DNA, 22 bp, Homo sapiens
gctcagagcccgaggcttgcat

SEQ ID NO: 6944473 - DNA, 22 bp, Homo sapiens
agatgtggtgaaatgcctccca

SEQ ID NO: 6944474 - DNA, 22 bp, Homo sapiens
ctgccccaggcctccttttctt

SEQ ID NO: 6944475 - DNA, 22 bp, Homo sapiens
agggcccacagttcctatggcc

SEQ ID NO: 6944476 - DNA, 22 bp, Homo sapiens
tcctggttcttgaggagccatg

SEQ ID NO: 6944477 - DNA, 22 bp, Homo sapiens
agtcacagggtacacaaggatt

SEQ ID NO: 6944478 - DNA, 22 bp, Homo sapiens
actggtggctttcagacagaaa

SEQ ID NO: 6944479 - DNA, 22 bp, Homo sapiens
agctggcattctccttgttatt

SEQ ID NO: 6944480 - DNA, 22 bp, Homo sapiens
ctctttggtgcaccttgcagtc

SEQ ID NO: 6944481 - DNA, 22 bp, Homo sapiens
ggcagactgtaataggagaatt

SEQ ID NO: 6944482 - DNA, 22 bp, Homo sapiens
ttgcatgtatgtgatctgttca

SEQ ID NO: 6944483 - DNA, 22 bp, Homo sapiens
agctggcatcgagcatttgaac

SEQ ID NO: 6944484 - DNA, 22 bp, Homo sapiens
atttcccaggactagaaatata

SEQ ID NO: 6944485 - DNA, 22 bp, Homo sapiens
agagctgggacttggactcaat

SEQ ID NO: 6944486 - DNA, 22 bp, Homo sapiens
ttaaggaattacgaaaatattt

SEQ ID NO: 6944487 - DNA, 22 bp, Homo sapiens
gggaaggcagtgtctggttgaa

SEQ ID NO: 6944488 - DNA, 22 bp, Homo sapiens
gtgcagatgttatgtttcaaaa

SEQ ID NO: 6944489 - DNA, 22 bp, Homo sapiens
ttcacagagcgggatgctggga

SEQ ID NO: 6944490 - DNA, 22 bp, Homo sapiens
tgcctgggccttcccacctctg

SEQ ID NO: 6944491 - DNA, 22 bp, Homo sapiens
tcacagaaagctgtgtcctgac

SEQ ID NO: 6944492 - DNA, 22 bp, Homo sapiens
ctgcttccacacaagcaaagct

SEQ ID NO: 6944493 - DNA, 22 bp, Homo sapiens
attctacacaaagcaagaagac

SEQ ID NO: 6944494 - DNA, 21 bp, Homo sapiens
cagagggtttctcaggtgttt

SEQ ID NO: 6944495 - DNA, 22 bp, Homo sapiens
aaggctcagctactcagcctgc

SEQ ID NO: 6944496 - DNA, 22 bp, Homo sapiens
gtgcttctgccaactaattaac

SEQ ID NO: 6944497 - DNA, 22 bp, Homo sapiens
tggcacttttcccagttttggt

SEQ ID NO: 6944498 - DNA, 22 bp, Homo sapiens
gctgctgctgaggatgcacctg

SEQ ID NO: 6944499 - DNA, 20 bp, Homo sapiens
actggagccatctcagccta

SEQ ID NO: 6944500 - DNA, 22 bp, Homo sapiens
actggccatgaacttgggatct

SEQ ID NO: 6944501 - DNA, 21 bp, Homo sapiens
cagcccagagcagtggggcca

SEQ ID NO: 6944502 - DNA, 22 bp, Homo sapiens
gcgtgtgtgatatgcctctgca

SEQ ID NO: 6944503 - DNA, 22 bp, Homo sapiens
ttggaaagcaacttttgagagt

SEQ ID NO: 6944504 - DNA, 22 bp, Homo sapiens
agtgccaacggggcaggagagg

SEQ ID NO: 6944505 - DNA, 20 bp, Homo sapiens
tcagccagctaacatgggga

SEQ ID NO: 6944506 - DNA, 22 bp, Homo sapiens
tctggcttggctggcatctctg

SEQ ID NO: 6944507 - DNA, 22 bp, Homo sapiens
gtagtagctgtagatatcagga

SEQ ID NO: 6944508 - DNA, 22 bp, Homo sapiens
gaatccgtgtgatgtggactag

SEQ ID NO: 6944509 - DNA, 18 bp, Homo sapiens
gtattagttttcagagag

SEQ ID NO: 6944510 - DNA, 22 bp, Homo sapiens
ccctgccttcttggcctttaaa

SEQ ID NO: 6944511 - DNA, 23 bp, Homo sapiens
aatcacacgtttggccaggatgc

SEQ ID NO: 6944512 - DNA, 23 bp, Homo sapiens
aacagccaactttagcgggtggc

SEQ ID NO: 6944513 - DNA, 22 bp, Homo sapiens
ttcttacagccctattactaaa

SEQ ID NO: 6944514 - DNA, 22 bp, Homo sapiens
ttgctgattcatgatttgagaa

SEQ ID NO: 6944515 - DNA, 22 bp, Homo sapiens
agctgcccccagggctgtgctt

SEQ ID NO: 6944516 - DNA, 22 bp, Homo sapiens
aaggtagggatgtattcagctt

SEQ ID NO: 6944517 - DNA, 22 bp, Homo sapiens
ctctgtgggaagctgggtgtga

SEQ ID NO: 6944518 - DNA, 22 bp, Homo sapiens
aggaattatttgtcttagtctt

SEQ ID NO: 6944519 - DNA, 21 bp, Homo sapiens
gtgttggcatatggtggttga

SEQ ID NO: 6944520 - DNA, 22 bp, Homo sapiens
gacaagatgacatcatggcttc

SEQ ID NO: 6944521 - DNA, 22 bp, Homo sapiens
gctctgtgttccctccaggctc

SEQ ID NO: 6944522 - DNA, 22 bp, Homo sapiens
aacacttggagggagagtggga

SEQ ID NO: 6944523 - DNA, 22 bp, Homo sapiens
gcacatatgctgtaagcacatg

SEQ ID NO: 6944524 - DNA, 22 bp, Homo sapiens
gagagataggttgcaggaagct

SEQ ID NO: 6944525 - DNA, 22 bp, Homo sapiens
atatacctcattctttgagtgc

SEQ ID NO: 6944526 - DNA, 22 bp, Homo sapiens
tcatgcaacgatcctccaaatg

SEQ ID NO: 6944527 - DNA, 22 bp, Homo sapiens
ccaggggctctcagggtgtgtg

SEQ ID NO: 6944528 - DNA, 22 bp, Homo sapiens
tcagaagccaccttttgttggg

SEQ ID NO: 6944529 - DNA, 22 bp, Homo sapiens
ccccatgaagtagggtctctga

SEQ ID NO: 6944530 - DNA, 22 bp, Homo sapiens
ctgagagtaattttctacttga

SEQ ID NO: 6944531 - DNA, 22 bp, Homo sapiens
tgcagctgattaaagggcagac

SEQ ID NO: 6944532 - DNA, 22 bp, Homo sapiens
gactgaggaggtaaggtttgaa

SEQ ID NO: 6944533 - DNA, 22 bp, Homo sapiens
tggggtgccgacagggagggca

SEQ ID NO: 6944534 - DNA, 22 bp, Homo sapiens
tatgaattctgttcattgatga

SEQ ID NO: 6944535 - DNA, 22 bp, Homo sapiens
tcagaggagctgcagaacgctg

SEQ ID NO: 6944536 - DNA, 22 bp, Homo sapiens
tgggaggtgattaaattatggg

SEQ ID NO: 6944537 - DNA, 22 bp, Homo sapiens
tccagctggcttcggaagtgga

SEQ ID NO: 6944538 - DNA, 22 bp, Homo sapiens
tgtcccagttgggtattgaatt

SEQ ID NO: 6944539 - DNA, 22 bp, Homo sapiens
atcaattttgaggatacaagaa

SEQ ID NO: 6944540 - DNA, 22 bp, Homo sapiens
taatacagtagcttttacacag

SEQ ID NO: 6944541 - DNA, 22 bp, Homo sapiens
tgcctttaacttaaagcatgac

SEQ ID NO: 6944542 - DNA, 22 bp, Homo sapiens
tctagagaaaaaactcaagtga

SEQ ID NO: 6944543 - DNA, 22 bp, Homo sapiens
aagtgaatgatgtgaagtgtaa

SEQ ID NO: 6944544 - DNA, 22 bp, Homo sapiens
aagaaactgttgcgtgacagcg

SEQ ID NO: 6944545 - DNA, 22 bp, Homo sapiens
ttacatgcaggtcagactgcat

SEQ ID NO: 6944546 - DNA, 22 bp, Homo sapiens
agacatttattgaacacctagc

SEQ ID NO: 6944547 - DNA, 18 bp, Homo sapiens
tccagcagcatagtttcc

SEQ ID NO: 6944548 - DNA, 22 bp, Homo sapiens
cagcaagaacagcctgatgtgc

SEQ ID NO: 6944549 - DNA, 22 bp, Homo sapiens
ttaataagtagtagttattgtt

SEQ ID NO: 6944550 - DNA, 22 bp, Homo sapiens
aagaggaactgggggctgagtc

SEQ ID NO: 6944551 - DNA, 22 bp, Homo sapiens
ctgggtctttttcttccattga

SEQ ID NO: 6944552 - DNA, 22 bp, Homo sapiens
ttcctatgaataaatattgagc

SEQ ID NO: 6944553 - DNA, 22 bp, Homo sapiens
agcccagctttcacccctctgg

SEQ ID NO: 6944554 - DNA, 22 bp, Homo sapiens
caggatatttacgttctgctac

SEQ ID NO: 6944555 - DNA, 22 bp, Homo sapiens
aacagtaatggcattgccatga

SEQ ID NO: 6944556 - DNA, 21 bp, Homo sapiens
acagtcacaaaaccaaggcag

SEQ ID NO: 6944557 - DNA, 22 bp, Homo sapiens
tagtttctcagggaggaaagaa

SEQ ID NO: 6944558 - DNA, 22 bp, Homo sapiens
tgggcagtggcgcaatctctgg

SEQ ID NO: 6944559 - DNA, 22 bp, Homo sapiens
tgtgtttgagtcctcacagtgc

SEQ ID NO: 6944560 - DNA, 22 bp, Homo sapiens
ccagagaatccggagagtccat

SEQ ID NO: 6944561 - DNA, 22 bp, Homo sapiens
attcttctgcctactttcatcc

SEQ ID NO: 6944562 - DNA, 18 bp, Homo sapiens
tccttttctcccacccac

SEQ ID NO: 6944563 - DNA, 17 bp, Homo sapiens
agctgggttctcaggaa

SEQ ID NO: 6944564 - DNA, 22 bp, Homo sapiens
cagaaaatagagtttctctgag

SEQ ID NO: 6944565 - DNA, 22 bp, Homo sapiens
agggtgcaggggaagctgccct

SEQ ID NO: 6944566 - DNA, 22 bp, Homo sapiens
agcactgtggggaactcacaga

SEQ ID NO: 6944567 - DNA, 22 bp, Homo sapiens
gatgctgattttactgttttct

SEQ ID NO: 6944568 - DNA, 22 bp, Homo sapiens
gtcacagatctcttgagtcaag

SEQ ID NO: 6944569 - DNA, 15 bp, Homo sapiens
cagtttctgcttgaa

SEQ ID NO: 6944570 - DNA, 22 bp, Homo sapiens
agaaaagtgctctagtgagagc

SEQ ID NO: 6944571 - DNA, 22 bp, Homo sapiens
ctgccacttactaggcatggtg

SEQ ID NO: 6944572 - DNA, 20 bp, Homo sapiens
ctgtaaactgcgtctgtaat

SEQ ID NO: 6944573 - DNA, 22 bp, Homo sapiens
taacacattttaagccatttta

SEQ ID NO: 6944574 - DNA, 22 bp, Homo sapiens
ataccttttagacatgtagttg

SEQ ID NO: 6944575 - DNA, 22 bp, Homo sapiens
tctaaagatgtttattgacata

SEQ ID NO: 6944576 - DNA, 22 bp, Homo sapiens
tttctagtcagccatatctagt

SEQ ID NO: 6944577 - DNA, 21 bp, Homo sapiens
agtgatttatgagagaatgac

SEQ ID NO: 6944578 - DNA, 22 bp, Homo sapiens
aggaatattctcaagtggtcgt

SEQ ID NO: 6944579 - DNA, 22 bp, Homo sapiens
tcttatacagaagatgtttaat

SEQ ID NO: 6944580 - DNA, 22 bp, Homo sapiens
gtctggggaagtcagggcatca

SEQ ID NO: 6944581 - DNA, 22 bp, Homo sapiens
gcctggagaaaggaaggtggga

SEQ ID NO: 6944582 - DNA, 22 bp, Homo sapiens
ccttgaggagtccatagtatca

SEQ ID NO: 6944583 - DNA, 22 bp, Homo sapiens
tagtttcttcacctgtaaaatg

SEQ ID NO: 6944584 - DNA, 22 bp, Homo sapiens
gggccttgccatggagcctgag

SEQ ID NO: 6944585 - DNA, 22 bp, Homo sapiens
cttaatttttgtagtagatgga

SEQ ID NO: 6944586 - DNA, 22 bp, Homo sapiens
tgtggggtagcagtttccgtgt

SEQ ID NO: 6944587 - DNA, 22 bp, Homo sapiens
tgagggtggcacaggcacaaag

SEQ ID NO: 6944588 - DNA, 22 bp, Homo sapiens
tggacatgtcttctccaagaaa

SEQ ID NO: 6944589 - DNA, 22 bp, Homo sapiens
gggagctgccaccacccctggg

SEQ ID NO: 6944590 - DNA, 22 bp, Homo sapiens
cttctgcccctgtagcctgagt

SEQ ID NO: 6944591 - DNA, 22 bp, Homo sapiens
gctgtatgtgaggccacagtga

SEQ ID NO: 6944592 - DNA, 22 bp, Homo sapiens
actctcccagctatatgtggtg

SEQ ID NO: 6944593 - DNA, 22 bp, Homo sapiens
tttaagaagttatgttataaat

SEQ ID NO: 6944594 - DNA, 22 bp, Homo sapiens
tgaagagatagaagtacatgct

SEQ ID NO: 6944595 - DNA, 22 bp, Homo sapiens
ggaaagaatagagactttatca

SEQ ID NO: 6944596 - DNA, 22 bp, Homo sapiens
tccctgaaccactagtgatgag

SEQ ID NO: 6944597 - DNA, 20 bp, Homo sapiens
tgtatttcatgcattcctgg

SEQ ID NO: 6944598 - DNA, 22 bp, Homo sapiens
gcaggctgtagacaccaaacta

SEQ ID NO: 6944599 - DNA, 22 bp, Homo sapiens
atggcccagactcagactggtg

SEQ ID NO: 6944600 - DNA, 22 bp, Homo sapiens
aacctgagggcaggaccccata

SEQ ID NO: 6944601 - DNA, 22 bp, Homo sapiens
agcactgttatgggatgactta

SEQ ID NO: 6944602 - DNA, 22 bp, Homo sapiens
acattcttggactccactctag

SEQ ID NO: 6944603 - DNA, 22 bp, Homo sapiens
gggtagtttaattaggaagaaa

SEQ ID NO: 6944604 - DNA, 22 bp, Homo sapiens
ttcccagtgattgaacatccct

SEQ ID NO: 6944605 - DNA, 22 bp, Homo sapiens
ctgaagtccctgttttgtttac

SEQ ID NO: 6944606 - DNA, 22 bp, Homo sapiens
tgtggtggtaatgagccagatg

SEQ ID NO: 6944607 - DNA, 22 bp, Homo sapiens
tggtcaagggacagagctgaac

SEQ ID NO: 6944608 - DNA, 22 bp, Homo sapiens
gcaccagctgcagggtggctga

SEQ ID NO: 6944609 - DNA, 22 bp, Homo sapiens
tctcagtgcagcttgacagaga

SEQ ID NO: 6944610 - DNA, 22 bp, Homo sapiens
aaggctgaggctggagaattac

SEQ ID NO: 6944611 - DNA, 19 bp, Homo sapiens
cacaacttcgcttgattcc

SEQ ID NO: 6944612 - DNA, 22 bp, Homo sapiens
agtgctgtctccttcccccggg

SEQ ID NO: 6944613 - DNA, 22 bp, Homo sapiens
gcaaggtgttttaacaggaaaa

SEQ ID NO: 6944614 - DNA, 22 bp, Homo sapiens
tttgtgctgacatttgggtcat

SEQ ID NO: 6944615 - DNA, 21 bp, Homo sapiens
cagagggccggcatgtggtct

SEQ ID NO: 6944616 - DNA, 22 bp, Homo sapiens
tattgaagagataagtgacaga

SEQ ID NO: 6944617 - DNA, 22 bp, Homo sapiens
tctctgagctggatttgttctt

SEQ ID NO: 6944618 - DNA, 22 bp, Homo sapiens
tgggctctctcacctggaggct

SEQ ID NO: 6944619 - DNA, 22 bp, Homo sapiens
tttattcttgagagtgagaaga

SEQ ID NO: 6944620 - DNA, 22 bp, Homo sapiens
ttcagaggtaagggtctcagaa

SEQ ID NO: 6944621 - DNA, 22 bp, Homo sapiens
ttggctgaaggttaagtgctgg

SEQ ID NO: 6944622 - DNA, 22 bp, Homo sapiens
aagaaataagacttctctgtcc

SEQ ID NO: 6944623 - DNA, 22 bp, Homo sapiens
agaagccagaatattcatggat

SEQ ID NO: 6944624 - DNA, 22 bp, Homo sapiens
tctgagcttctgcatttccaac

SEQ ID NO: 6944625 - DNA, 22 bp, Homo sapiens
tgcctgggtccaggccaagcct

SEQ ID NO: 6944626 - DNA, 22 bp, Homo sapiens
gaggccaaggtgggcagatcac

SEQ ID NO: 6944627 - DNA, 22 bp, Homo sapiens
tttcaaagcaactgaaaaggaa

SEQ ID NO: 6944628 - DNA, 22 bp, Homo sapiens
aggttctggagcttagagggag

SEQ ID NO: 6944629 - DNA, 22 bp, Homo sapiens
cctggcagaaagagttacacct

SEQ ID NO: 6944630 - DNA, 22 bp, Homo sapiens
atacactgttcactagatcttc

SEQ ID NO: 6944631 - DNA, 22 bp, Homo sapiens
ttcattggtcctgctcctggac

SEQ ID NO: 6944632 - DNA, 22 bp, Homo sapiens
caggactatgttcaacagatag

SEQ ID NO: 6944633 - DNA, 22 bp, Homo sapiens
tagttaattctttaagaacaag

SEQ ID NO: 6944634 - DNA, 22 bp, Homo sapiens
gcctgggagagggatagtgcag

SEQ ID NO: 6944635 - DNA, 22 bp, Homo sapiens
aggaggtgtagatttcctgtca

SEQ ID NO: 6944636 - DNA, 22 bp, Homo sapiens
cagccctgcacgctgcctccgc

SEQ ID NO: 6944637 - DNA, 22 bp, Homo sapiens
ttgaatggcttctaggttctcc

SEQ ID NO: 6944638 - DNA, 22 bp, Homo sapiens
tattttcatcttgtccttggat

SEQ ID NO: 6944639 - DNA, 22 bp, Homo sapiens
ttattgactgaaatgagagtga

SEQ ID NO: 6944640 - DNA, 22 bp, Homo sapiens
atctccagaatggcttgttaat

SEQ ID NO: 6944641 - DNA, 22 bp, Homo sapiens
ctcagggggaatcaggtcacag

SEQ ID NO: 6944642 - DNA, 22 bp, Homo sapiens
aaagcaagtctctacaaagtac

SEQ ID NO: 6944643 - DNA, 22 bp, Homo sapiens
ctgtttcaccactggctctttg

SEQ ID NO: 6944644 - DNA, 22 bp, Homo sapiens
tgaggccaaaatgactcaaatg

SEQ ID NO: 6944645 - DNA, 22 bp, Homo sapiens
ggaaagaaccctggatggctgg

SEQ ID NO: 6944646 - DNA, 22 bp, Homo sapiens
gtggtgcatgcatgcatatgta

SEQ ID NO: 6944647 - DNA, 22 bp, Homo sapiens
tcctctgctccatctttactgt

SEQ ID NO: 6944648 - DNA, 22 bp, Homo sapiens
tctaatgagttagataattttg

SEQ ID NO: 6944649 - DNA, 22 bp, Homo sapiens
tgagaatagtaataatttctgg

SEQ ID NO: 6944650 - DNA, 22 bp, Homo sapiens
taacttctctgctatcatagga

SEQ ID NO: 6944651 - DNA, 22 bp, Homo sapiens
gtggaagcagtaaggcaagttt

SEQ ID NO: 6944652 - DNA, 17 bp, Homo sapiens
tcaaatgtacagaacta

SEQ ID NO: 6944653 - DNA, 22 bp, Homo sapiens
gctgtaggtaaggatggcaaag

SEQ ID NO: 6944654 - DNA, 22 bp, Homo sapiens
ttcccatttgtggtagtgaatt

SEQ ID NO: 6944655 - DNA, 21 bp, Homo sapiens
tcagggcagtgggaggttcct

SEQ ID NO: 6944656 - DNA, 22 bp, Homo sapiens
cataatttttttaagtcagaac

SEQ ID NO: 6944657 - DNA, 22 bp, Homo sapiens
atggactagccataagagaact

SEQ ID NO: 6944658 - DNA, 22 bp, Homo sapiens
tggtctgaaggacttctgaggg

SEQ ID NO: 6944659 - DNA, 22 bp, Homo sapiens
aattgtgctatgattatgaaag

SEQ ID NO: 6944660 - DNA, 22 bp, Homo sapiens
cttgagtaaagaagtattttag

SEQ ID NO: 6944661 - DNA, 22 bp, Homo sapiens
agagtcagactaagccatggtg

SEQ ID NO: 6944662 - DNA, 22 bp, Homo sapiens
gcagacagaagctaagtagaca

SEQ ID NO: 6944663 - DNA, 22 bp, Homo sapiens
gggcttcaggagggtcagccca

SEQ ID NO: 6944664 - DNA, 22 bp, Homo sapiens
ggtcagtggacaaaggagtttc

SEQ ID NO: 6944665 - DNA, 22 bp, Homo sapiens
agtcatcatgtacagagagcaa

SEQ ID NO: 6944666 - DNA, 22 bp, Homo sapiens
gtgaggaagtctgagagccaca

SEQ ID NO: 6944667 - DNA, 22 bp, Homo sapiens
aatgactctgctgcagagacac

SEQ ID NO: 6944668 - DNA, 22 bp, Homo sapiens
aacacattttgcctaggcaata

SEQ ID NO: 6944669 - DNA, 22 bp, Homo sapiens
ttggccctgaggaggcagctgc

SEQ ID NO: 6944670 - DNA, 22 bp, Homo sapiens
tgtccaggtcagcagcagggac

SEQ ID NO: 6944671 - DNA, 22 bp, Homo sapiens
tcctgtatttgttcatctgtac

SEQ ID NO: 6944672 - DNA, 19 bp, Homo sapiens
ggctcagtcaactgactgt

SEQ ID NO: 6944673 - DNA, 21 bp, Homo sapiens
ttcagggtttcacaatactaa

SEQ ID NO: 6944674 - DNA, 22 bp, Homo sapiens
atgttacttagaataattctgg

SEQ ID NO: 6944675 - DNA, 22 bp, Homo sapiens
atcaagagcacagtgctggcat

SEQ ID NO: 6944676 - DNA, 22 bp, Homo sapiens
atggccagcccttcccgcagct

SEQ ID NO: 6944677 - DNA, 22 bp, Homo sapiens
tcacagtgctctgggtggcaga

SEQ ID NO: 6944678 - DNA, 22 bp, Homo sapiens
agacacagtttgggatgggttg

SEQ ID NO: 6944679 - DNA, 22 bp, Homo sapiens
atgcttccaacagttctgtgaa

SEQ ID NO: 6944680 - DNA, 22 bp, Homo sapiens
aaggtacaccaaagttcaagtt

SEQ ID NO: 6944681 - DNA, 22 bp, Homo sapiens
ctgtgcccaggcccctggggat

SEQ ID NO: 6944682 - DNA, 16 bp, Homo sapiens
aaactgagttcagttc

SEQ ID NO: 6944683 - DNA, 22 bp, Homo sapiens
attgtctttgtttaagggatac

SEQ ID NO: 6944684 - DNA, 22 bp, Homo sapiens
agactcttggtcattggcatta

SEQ ID NO: 6944685 - DNA, 22 bp, Homo sapiens
gtgagcatcttggcagatatga

SEQ ID NO: 6944686 - DNA, 22 bp, Homo sapiens
cagcttgttaccgagggagggt

SEQ ID NO: 6944687 - DNA, 20 bp, Homo sapiens
agtgggagagggcagactgc

SEQ ID NO: 6944688 - DNA, 22 bp, Homo sapiens
agtgtgggtgagggaggccctc

SEQ ID NO: 6944689 - DNA, 22 bp, Homo sapiens
acagtctgcaggcaagttctac

SEQ ID NO: 6944690 - DNA, 22 bp, Homo sapiens
ttagcttttctctatgttggct

SEQ ID NO: 6944691 - DNA, 19 bp, Homo sapiens
tcataaaaatggtaaccca

SEQ ID NO: 6944692 - DNA, 22 bp, Homo sapiens
tgggggattgttttaatgaata

SEQ ID NO: 6944693 - DNA, 22 bp, Homo sapiens
cgggggcacccacaaatgagga

SEQ ID NO: 6944694 - DNA, 23 bp, Homo sapiens
acaagatagggataaaaagataa

SEQ ID NO: 6944695 - DNA, 22 bp, Homo sapiens
atgccagacgtgtgttggccgg

SEQ ID NO: 6944696 - DNA, 22 bp, Homo sapiens
agatgtgtttctagttcctgca

SEQ ID NO: 6944697 - DNA, 22 bp, Homo sapiens
tcacatgactttttggtggcct

SEQ ID NO: 6944698 - DNA, 22 bp, Homo sapiens
ttgattctttgagaccgtgata

SEQ ID NO: 6944699 - DNA, 22 bp, Homo sapiens
tgactcttaaatatactgttga

SEQ ID NO: 6944700 - DNA, 22 bp, Homo sapiens
ataagcatttcacaggtgtgtt

SEQ ID NO: 6944701 - DNA, 22 bp, Homo sapiens
cagtaggggttctttaagttgt

SEQ ID NO: 6944702 - DNA, 22 bp, Homo sapiens
tggtaaggtcttcactcagatt

SEQ ID NO: 6944703 - DNA, 22 bp, Homo sapiens
agacacagtataagcacaacaa

SEQ ID NO: 6944704 - DNA, 22 bp, Homo sapiens
tgtggggcttacaaaggcagat

SEQ ID NO: 6944705 - DNA, 22 bp, Homo sapiens
agcagcagaggtcagaaaggta

SEQ ID NO: 6944706 - DNA, 22 bp, Homo sapiens
aacatttcagcacctgattcct

SEQ ID NO: 6944707 - DNA, 22 bp, Homo sapiens
ctacaggtcagtaagacctaga

SEQ ID NO: 6944708 - DNA, 22 bp, Homo sapiens
gcaaggagactgtagggccaag

SEQ ID NO: 6944709 - DNA, 22 bp, Homo sapiens
ccatcttaattctaaagacaaa

SEQ ID NO: 6944710 - DNA, 23 bp, Homo sapiens
cctccccttcccacagctgggtg

SEQ ID NO: 6944711 - DNA, 22 bp, Homo sapiens
gccctgggctccctgctccaca

SEQ ID NO: 6944712 - DNA, 22 bp, Homo sapiens
gctgggcccagatcccaggatc

SEQ ID NO: 6944713 - DNA, 22 bp, Homo sapiens
attcacagttcattagctgtaa

SEQ ID NO: 6944714 - DNA, 15 bp, Homo sapiens
ttggaggatgtagta

SEQ ID NO: 6944715 - DNA, 22 bp, Homo sapiens
aacagcatgctgggtaacattg

SEQ ID NO: 6944716 - DNA, 22 bp, Homo sapiens
cagttagttataaatgaggaag

SEQ ID NO: 6944717 - DNA, 22 bp, Homo sapiens
ttggccagtgaaccaggcctgg

SEQ ID NO: 6944718 - DNA, 22 bp, Homo sapiens
aactctctttagagagggacaa

SEQ ID NO: 6944719 - DNA, 22 bp, Homo sapiens
atcgtattacctttgggattag

SEQ ID NO: 6944720 - DNA, 22 bp, Homo sapiens
tatgtgcattattaccagtgga

SEQ ID NO: 6944721 - DNA, 23 bp, Homo sapiens
tggcttgcccaaatcctgcctgc

SEQ ID NO: 6944722 - DNA, 22 bp, Homo sapiens
tgagcagtcatccatttctcct

SEQ ID NO: 6944723 - DNA, 22 bp, Homo sapiens
ggccactgcctccgccatggct

SEQ ID NO: 6944724 - DNA, 22 bp, Homo sapiens
aatgaacaaaatatgctttgca

SEQ ID NO: 6944725 - DNA, 22 bp, Homo sapiens
tatggaaagggagtttaatttg

SEQ ID NO: 6944726 - DNA, 22 bp, Homo sapiens
tcttttcattgagaacacactg

SEQ ID NO: 6944727 - DNA, 19 bp, Homo sapiens
ctgaggcaagtggtggtca

SEQ ID NO: 6944728 - DNA, 22 bp, Homo sapiens
ttcacaaacttcatgatggcac

SEQ ID NO: 6944729 - DNA, 22 bp, Homo sapiens
agccccaggatgggccgcagga

SEQ ID NO: 6944730 - DNA, 22 bp, Homo sapiens
atttgttccatgagtaaggcta

SEQ ID NO: 6944731 - DNA, 22 bp, Homo sapiens
tgcttaatcaagaagcctattt

SEQ ID NO: 6944732 - DNA, 21 bp, Homo sapiens
gagtggaacgctcttcacacc

SEQ ID NO: 6944733 - DNA, 22 bp, Homo sapiens
caattgtgaagacaacagctta

SEQ ID NO: 6944734 - DNA, 22 bp, Homo sapiens
atcatcatcattgctaacatct

SEQ ID NO: 6944735 - DNA, 22 bp, Homo sapiens
gatcttctgaactggagtatct

SEQ ID NO: 6944736 - DNA, 22 bp, Homo sapiens
gacatttatgaaggagatatgc

SEQ ID NO: 6944737 - DNA, 22 bp, Homo sapiens
ttgtgtctggatttcagctttc

SEQ ID NO: 6944738 - DNA, 22 bp, Homo sapiens
tcaacatttatgaagctgtggc

SEQ ID NO: 6944739 - DNA, 22 bp, Homo sapiens
ttccaatgtatgatagacttag

SEQ ID NO: 6944740 - DNA, 22 bp, Homo sapiens
tttaagacttagatttattggg

SEQ ID NO: 6944741 - DNA, 22 bp, Homo sapiens
ctgaagcagggagtgatgaagt

SEQ ID NO: 6944742 - DNA, 22 bp, Homo sapiens
tagtcccggaactccttcaggt

SEQ ID NO: 6944743 - DNA, 22 bp, Homo sapiens
cttctacaaggttgtcctctat

SEQ ID NO: 6944744 - DNA, 22 bp, Homo sapiens
attgttgtctttacctgtattt

SEQ ID NO: 6944745 - DNA, 17 bp, Homo sapiens
gatgaaatgatgcacac

SEQ ID NO: 6944746 - DNA, 20 bp, Homo sapiens
agatgggttaaagctatggg

SEQ ID NO: 6944747 - DNA, 22 bp, Homo sapiens
aaaattttactggtgtttcctt

SEQ ID NO: 6944748 - DNA, 22 bp, Homo sapiens
tttgtgccctgtagatccccag

SEQ ID NO: 6944749 - DNA, 17 bp, Homo sapiens
caatttcataggttttg

SEQ ID NO: 6944750 - DNA, 22 bp, Homo sapiens
agtggtctccccagtagaataa

SEQ ID NO: 6944751 - DNA, 22 bp, Homo sapiens
gccagagaatgaaaatcagatt

SEQ ID NO: 6944752 - DNA, 22 bp, Homo sapiens
ctgtacagagttctgagtgtac

SEQ ID NO: 6944753 - DNA, 22 bp, Homo sapiens
ttctgggatgtgaatggtttaa

SEQ ID NO: 6944754 - DNA, 22 bp, Homo sapiens
cctgtggacattctgtgtggaa

SEQ ID NO: 6944755 - DNA, 22 bp, Homo sapiens
tgtgggtggagtgatattagct

SEQ ID NO: 6944756 - DNA, 22 bp, Homo sapiens
gaggagtctttttagggcctga

SEQ ID NO: 6944757 - DNA, 22 bp, Homo sapiens
tgggacacacaaggtcagctct

SEQ ID NO: 6944758 - DNA, 22 bp, Homo sapiens
tttagagagtgtaaaaatatat

SEQ ID NO: 6944759 - DNA, 22 bp, Homo sapiens
agtgcaacagaagcaggctggc

SEQ ID NO: 6944760 - DNA, 22 bp, Homo sapiens
gaacctctcagcagccatgatc

SEQ ID NO: 6944761 - DNA, 21 bp, Homo sapiens
tggaaacagcgccatctgccg

SEQ ID NO: 6944762 - DNA, 19 bp, Homo sapiens
aagagtcacaggcagccct

SEQ ID NO: 6944763 - DNA, 17 bp, Homo sapiens
tttggaaagtgatcatt

SEQ ID NO: 6944764 - DNA, 22 bp, Homo sapiens
cagaggtccagcatacatttcc

SEQ ID NO: 6944765 - DNA, 22 bp, Homo sapiens
ctcaggccattcttccagctgc

SEQ ID NO: 6944766 - DNA, 19 bp, Homo sapiens
caataagtcagtagtgggc

SEQ ID NO: 6944767 - DNA, 22 bp, Homo sapiens
tttgtcatattgaaggtgctta

SEQ ID NO: 6944768 - DNA, 22 bp, Homo sapiens
tcatagttttacttagtggtgt

SEQ ID NO: 6944769 - DNA, 22 bp, Homo sapiens
tctatgtcctttctcccattcc

SEQ ID NO: 6944770 - DNA, 22 bp, Homo sapiens
acagccaggcccagcacgcagg

SEQ ID NO: 6944771 - DNA, 22 bp, Homo sapiens
tatgtgtctttatctggctctt

SEQ ID NO: 6944772 - DNA, 22 bp, Homo sapiens
taactagatatagactttctac

SEQ ID NO: 6944773 - DNA, 23 bp, Homo sapiens
atccatgcttaagtaatcatttg

SEQ ID NO: 6944774 - DNA, 22 bp, Homo sapiens
cttcctgaagaggttggtcagg

SEQ ID NO: 6944775 - DNA, 22 bp, Homo sapiens
tctggcttcaactttactgaaa

SEQ ID NO: 6944776 - DNA, 22 bp, Homo sapiens
cacagaacaccaaagaaccttc

SEQ ID NO: 6944777 - DNA, 22 bp, Homo sapiens
agtactttacttcttacagttt

SEQ ID NO: 6944778 - DNA, 20 bp, Homo sapiens
agctcctgagggttactttc

SEQ ID NO: 6944779 - DNA, 19 bp, Homo sapiens
ttcaggattgaccctactg

SEQ ID NO: 6944780 - DNA, 22 bp, Homo sapiens
gattatgatgcgaggtcagagc

SEQ ID NO: 6944781 - DNA, 19 bp, Homo sapiens
ccctcttgcacaaagcaaa

SEQ ID NO: 6944782 - DNA, 22 bp, Homo sapiens
tgctttaaccatcttgtttgga

SEQ ID NO: 6944783 - DNA, 22 bp, Homo sapiens
tacagatatgttccatgcatcg

SEQ ID NO: 6944784 - DNA, 23 bp, Homo sapiens
aactgagataatgtatgtaaagc

SEQ ID NO: 6944785 - DNA, 22 bp, Homo sapiens
aaagccatgaatgttatagagg

SEQ ID NO: 6944786 - DNA, 22 bp, Homo sapiens
ttcaaggtatggtagctggtca

SEQ ID NO: 6944787 - DNA, 22 bp, Homo sapiens
atgatacaagcaaaactaatca

SEQ ID NO: 6944788 - DNA, 23 bp, Homo sapiens
tttcacattaatgtttagcagga

SEQ ID NO: 6944789 - DNA, 20 bp, Homo sapiens
tcagaacagtagaggagcta

SEQ ID NO: 6944790 - DNA, 22 bp, Homo sapiens
cctgagcattagacatccatca

SEQ ID NO: 6944791 - DNA, 22 bp, Homo sapiens
ctccagtggtgatggggaagaa

SEQ ID NO: 6944792 - DNA, 22 bp, Homo sapiens
gcaggagtcagccctaccttga

SEQ ID NO: 6944793 - DNA, 22 bp, Homo sapiens
gctcaggcctcactccatttgg

SEQ ID NO: 6944794 - DNA, 20 bp, Homo sapiens
aagagctacttagcctttcc

SEQ ID NO: 6944795 - DNA, 22 bp, Homo sapiens
gctctgtgtatgtggcaggtgc

SEQ ID NO: 6944796 - DNA, 18 bp, Homo sapiens
gaacagcaatttcatgtt

SEQ ID NO: 6944797 - DNA, 22 bp, Homo sapiens
ttgcattctgttaaaatgtatt

SEQ ID NO: 6944798 - DNA, 22 bp, Homo sapiens
gcccagcacatctggccttgaa

SEQ ID NO: 6944799 - DNA, 17 bp, Homo sapiens
aggctggccttcacagt

SEQ ID NO: 6944800 - DNA, 22 bp, Homo sapiens
ctcatctgactgtaaggtaatg

SEQ ID NO: 6944801 - DNA, 22 bp, Homo sapiens
ttgctggatggcgtccaccagg

SEQ ID NO: 6944802 - DNA, 22 bp, Homo sapiens
tctggagatcatgtggggtgga

SEQ ID NO: 6944803 - DNA, 22 bp, Homo sapiens
gatttcagagtttattaggtta

SEQ ID NO: 6944804 - DNA, 22 bp, Homo sapiens
agtatgaatggaaactacctat

SEQ ID NO: 6944805 - DNA, 22 bp, Homo sapiens
gttcatgctaccctttcctaat

SEQ ID NO: 6944806 - DNA, 20 bp, Homo sapiens
agcaggtaaggcacagcagt

SEQ ID NO: 6944807 - DNA, 22 bp, Homo sapiens
cttctggttccagcttctgttg

SEQ ID NO: 6944808 - DNA, 22 bp, Homo sapiens
ccaagctggacagcagcaagga

SEQ ID NO: 6944809 - DNA, 22 bp, Homo sapiens
tccaggtctaatttgtccttga

SEQ ID NO: 6944810 - DNA, 22 bp, Homo sapiens
agcaggcagccatttggaaggc

SEQ ID NO: 6944811 - DNA, 22 bp, Homo sapiens
ttctgtcttcccactgaggagc

SEQ ID NO: 6944812 - DNA, 22 bp, Homo sapiens
atgtctgtcatcttccaggaag

SEQ ID NO: 6944813 - DNA, 22 bp, Homo sapiens
tcaagatgcatgggtggcataa

SEQ ID NO: 6944814 - DNA, 22 bp, Homo sapiens
agtggcatccctttaacagggt

SEQ ID NO: 6944815 - DNA, 18 bp, Homo sapiens
atctgtcctttctctgcc

SEQ ID NO: 6944816 - DNA, 20 bp, Homo sapiens
ttcatgcagtggttgctgtg

SEQ ID NO: 6944817 - DNA, 22 bp, Homo sapiens
aacaagtgatatataatggaag

SEQ ID NO: 6944818 - DNA, 22 bp, Homo sapiens
tgtctctgccagctagcagaat

SEQ ID NO: 6944819 - DNA, 22 bp, Homo sapiens
cacagcttatgccactgattgg

SEQ ID NO: 6944820 - DNA, 23 bp, Homo sapiens
atttacagctgtgtgagcaagtt

SEQ ID NO: 6944821 - DNA, 22 bp, Homo sapiens
ggggagtgttttcatgggcttg

SEQ ID NO: 6944822 - DNA, 22 bp, Homo sapiens
ctttccaatgtcactatgaatc

SEQ ID NO: 6944823 - DNA, 22 bp, Homo sapiens
gctggaaatgaatggagaggtg

SEQ ID NO: 6944824 - DNA, 22 bp, Homo sapiens
agaagggtagggacttatccaa

SEQ ID NO: 6944825 - DNA, 22 bp, Homo sapiens
gaaatgaaacaggcttttaagg

SEQ ID NO: 6944826 - DNA, 20 bp, Homo sapiens
ggctttctgtgatcctcagt

SEQ ID NO: 6944827 - DNA, 22 bp, Homo sapiens
aagaaggcctggtagacgtctt

SEQ ID NO: 6944828 - DNA, 21 bp, Homo sapiens
tgtctgctgaaggctggtcac

SEQ ID NO: 6944829 - DNA, 23 bp, Homo sapiens
aatattcctgccattaatgactc

SEQ ID NO: 6944830 - DNA, 22 bp, Homo sapiens
atttggaaaatctggttataga

SEQ ID NO: 6944831 - DNA, 22 bp, Homo sapiens
agctgcttcctctttgatgtca

SEQ ID NO: 6944832 - DNA, 22 bp, Homo sapiens
ctttggtatcttactagtattt

SEQ ID NO: 6944833 - DNA, 22 bp, Homo sapiens
tgtaagtctggcttatagcttt

SEQ ID NO: 6944834 - DNA, 22 bp, Homo sapiens
aagtctgagtgtcagtgcaagt

SEQ ID NO: 6944835 - DNA, 22 bp, Homo sapiens
aggtggggcccaccaatttgca

SEQ ID NO: 6944836 - DNA, 22 bp, Homo sapiens
tgaatgatttcttaggcaattg

SEQ ID NO: 6944837 - DNA, 22 bp, Homo sapiens
gggcatccagagggatgcctgg

SEQ ID NO: 6944838 - DNA, 22 bp, Homo sapiens
ttaggcatattgtacaatctag

SEQ ID NO: 6944839 - DNA, 20 bp, Homo sapiens
cctgtggagctgcctcctcc

SEQ ID NO: 6944840 - DNA, 22 bp, Homo sapiens
agaaatctaagatgctcaagga

SEQ ID NO: 6944841 - DNA, 22 bp, Homo sapiens
cagaaactttggccctcaagcc

SEQ ID NO: 6944842 - DNA, 22 bp, Homo sapiens
tgcaaatgggaaacccagcagt

SEQ ID NO: 6944843 - DNA, 22 bp, Homo sapiens
cacatattgtagttcaccagga

SEQ ID NO: 6944844 - DNA, 22 bp, Homo sapiens
acatttagagttctttactcca

SEQ ID NO: 6944845 - DNA, 22 bp, Homo sapiens
ccctggaggcaaaggttgcagt

SEQ ID NO: 6944846 - DNA, 22 bp, Homo sapiens
agttgggacatgttctttcccc

SEQ ID NO: 6944847 - DNA, 22 bp, Homo sapiens
tgctttggctgacacgctcctg

SEQ ID NO: 6944848 - DNA, 22 bp, Homo sapiens
gatttcccagaaaagtgatctc

SEQ ID NO: 6944849 - DNA, 22 bp, Homo sapiens
gcagatgtctgtgcctgcaggg

SEQ ID NO: 6944850 - DNA, 19 bp, Homo sapiens
aaatgtgcactgttttcca

SEQ ID NO: 6944851 - DNA, 23 bp, Homo sapiens
tgcagtgtttaacaatgacttga

SEQ ID NO: 6944852 - DNA, 22 bp, Homo sapiens
agcagcagattatggtctacat

SEQ ID NO: 6944853 - DNA, 22 bp, Homo sapiens
ctgtttccctccagggggtgga

SEQ ID NO: 6944854 - DNA, 22 bp, Homo sapiens
atggagtgtggccaggcagtaa

SEQ ID NO: 6944855 - DNA, 22 bp, Homo sapiens
agaggattgatcaaacactgca

SEQ ID NO: 6944856 - DNA, 21 bp, Homo sapiens
gttcaagttcctgctctgtga

SEQ ID NO: 6944857 - DNA, 22 bp, Homo sapiens
atgcagtaaaataggaggtaat

SEQ ID NO: 6944858 - DNA, 22 bp, Homo sapiens
ttggttatcctgtcggtaattc

SEQ ID NO: 6944859 - DNA, 22 bp, Homo sapiens
gtagaatatatggttagtattg

SEQ ID NO: 6944860 - DNA, 22 bp, Homo sapiens
ggagtcacacagagaagataag

SEQ ID NO: 6944861 - DNA, 22 bp, Homo sapiens
tacagcacagcaaagaggacgg

SEQ ID NO: 6944862 - DNA, 22 bp, Homo sapiens
actggtcagattttacttccca

SEQ ID NO: 6944863 - DNA, 22 bp, Homo sapiens
ccaggtgcaaactcccagcagg

SEQ ID NO: 6944864 - DNA, 22 bp, Homo sapiens
ctcctgggaaatgaaggggcag

SEQ ID NO: 6944865 - DNA, 22 bp, Homo sapiens
ctgtttcacgtgtttaagccca

SEQ ID NO: 6944866 - DNA, 22 bp, Homo sapiens
acagtgctaatgatgccaagat

SEQ ID NO: 6944867 - DNA, 22 bp, Homo sapiens
aagtcccaaagtcactctgctt

SEQ ID NO: 6944868 - DNA, 22 bp, Homo sapiens
tctctgtgttgcaggaaaatct

SEQ ID NO: 6944869 - DNA, 22 bp, Homo sapiens
gaggctgctgttagccctgggc

SEQ ID NO: 6944870 - DNA, 22 bp, Homo sapiens
ttaaacctcagagtctttttca

SEQ ID NO: 6944871 - DNA, 22 bp, Homo sapiens
tatcattgctgatgtgctgaga

SEQ ID NO: 6944872 - DNA, 22 bp, Homo sapiens
ggaggaaatccttagtaaggca

SEQ ID NO: 6944873 - DNA, 22 bp, Homo sapiens
tcatgcaggacttacaagagat

SEQ ID NO: 6944874 - DNA, 22 bp, Homo sapiens
attttactttgtgaatattgac

SEQ ID NO: 6944875 - DNA, 22 bp, Homo sapiens
agtgtttctggcaaatgaaagt

SEQ ID NO: 6944876 - DNA, 22 bp, Homo sapiens
tttgtacaattagcagaggcta

SEQ ID NO: 6944877 - DNA, 22 bp, Homo sapiens
aacactggaagggacatcaagt

SEQ ID NO: 6944878 - DNA, 22 bp, Homo sapiens
tttacccatattagcatcaagt

SEQ ID NO: 6944879 - DNA, 22 bp, Homo sapiens
tttatataacagagactgctat

SEQ ID NO: 6944880 - DNA, 22 bp, Homo sapiens
cgagaggctggacagggctggg

SEQ ID NO: 6944881 - DNA, 22 bp, Homo sapiens
cttgctggagcggagcgggtgt

SEQ ID NO: 6944882 - DNA, 22 bp, Homo sapiens
tgcagaccacagctaggctgga

SEQ ID NO: 6944883 - DNA, 22 bp, Homo sapiens
agagtttgtactttaccctgag

SEQ ID NO: 6944884 - DNA, 22 bp, Homo sapiens
tgtcagtgtaactcttatagca

SEQ ID NO: 6944885 - DNA, 22 bp, Homo sapiens
gctgtttctgtggtgtatagcc

SEQ ID NO: 6944886 - DNA, 23 bp, Homo sapiens
gctctgctctgtttcatagacag

SEQ ID NO: 6944887 - DNA, 22 bp, Homo sapiens
gctgtgtcagaaactctgggga

SEQ ID NO: 6944888 - DNA, 22 bp, Homo sapiens
gttcagagaaagagacacctta

SEQ ID NO: 6944889 - DNA, 22 bp, Homo sapiens
agggcctgcatcaggagcttgg

SEQ ID NO: 6944890 - DNA, 22 bp, Homo sapiens
gcagcacaaagtccccagggac

SEQ ID NO: 6944891 - DNA, 23 bp, Homo sapiens
ctgatccaggaggtctgtcgtga

SEQ ID NO: 6944892 - DNA, 22 bp, Homo sapiens
gtccaagagaactgaaatagga

SEQ ID NO: 6944893 - DNA, 22 bp, Homo sapiens
tagcaaggcttccaatgaacag

SEQ ID NO: 6944894 - DNA, 21 bp, Homo sapiens
tgtgagctttgtgaaagcagg

SEQ ID NO: 6944895 - DNA, 22 bp, Homo sapiens
tgaggtaggcttgagatgggag

SEQ ID NO: 6944896 - DNA, 18 bp, Homo sapiens
agctcctggtctcaggga

SEQ ID NO: 6944897 - DNA, 22 bp, Homo sapiens
gctgtatgtttatttgggaatt

SEQ ID NO: 6944898 - DNA, 22 bp, Homo sapiens
ctctgctgcccaggcctgctag

SEQ ID NO: 6944899 - DNA, 22 bp, Homo sapiens
atgtttcagggtgatagaaggt

SEQ ID NO: 6944900 - DNA, 22 bp, Homo sapiens
agctgccacagagcctggccag

SEQ ID NO: 6944901 - DNA, 21 bp, Homo sapiens
gcagcgccctctgaccttgat

SEQ ID NO: 6944902 - DNA, 22 bp, Homo sapiens
tgagtctgctcctggtagcaga

SEQ ID NO: 6944903 - DNA, 22 bp, Homo sapiens
ttgaaatactgcattgttcagt

SEQ ID NO: 6944904 - DNA, 22 bp, Homo sapiens
gagcttcagaatttaacagact

SEQ ID NO: 6944905 - DNA, 22 bp, Homo sapiens
acttggttggtctcaccctgtt

SEQ ID NO: 6944906 - DNA, 22 bp, Homo sapiens
tctgccagacctgactcagtag

SEQ ID NO: 6944907 - DNA, 22 bp, Homo sapiens
ggcatctgtccatctctccagc

SEQ ID NO: 6944908 - DNA, 22 bp, Homo sapiens
tctggcagagtcagtgcacaca

SEQ ID NO: 6944909 - DNA, 22 bp, Homo sapiens
tggtccctttgactgcccgcca

SEQ ID NO: 6944910 - DNA, 20 bp, Homo sapiens
acctggagacagcactctgg

SEQ ID NO: 6944911 - DNA, 22 bp, Homo sapiens
atgttcatcaacacattacaag

SEQ ID NO: 6944912 - DNA, 21 bp, Homo sapiens
tcagtaaaaaaactacctaga

SEQ ID NO: 6944913 - DNA, 22 bp, Homo sapiens
acggagcccgtgtcaggtggga

SEQ ID NO: 6944914 - DNA, 22 bp, Homo sapiens
acagtgtccccagctctgtgag

SEQ ID NO: 6944915 - DNA, 22 bp, Homo sapiens
acagtgtagaatcctgtactta

SEQ ID NO: 6944916 - DNA, 22 bp, Homo sapiens
atctctctatgcactgaggact

SEQ ID NO: 6944917 - DNA, 22 bp, Homo sapiens
acaatagacccatgacacatac

SEQ ID NO: 6944918 - DNA, 22 bp, Homo sapiens
tgtccaggcggccttgcctgtt

SEQ ID NO: 6944919 - DNA, 23 bp, Homo sapiens
catcatgcaatcttgggatttct

SEQ ID NO: 6944920 - DNA, 22 bp, Homo sapiens
tacaatgactctcagtttggct

SEQ ID NO: 6944921 - DNA, 22 bp, Homo sapiens
ccctcccaggagtggccagaga

SEQ ID NO: 6944922 - DNA, 22 bp, Homo sapiens
tggatttccagacagcttaatt

SEQ ID NO: 6944923 - DNA, 22 bp, Homo sapiens
agaatttagctccttggtcata

SEQ ID NO: 6944924 - DNA, 22 bp, Homo sapiens
tggtgacagcatggaagaagtg

SEQ ID NO: 6944925 - DNA, 22 bp, Homo sapiens
agccacagagagggagctgcaa

SEQ ID NO: 6944926 - DNA, 22 bp, Homo sapiens
ttaacatttcttttccactcat

SEQ ID NO: 6944927 - DNA, 20 bp, Homo sapiens
acatcctggtgactagaact

SEQ ID NO: 6944928 - DNA, 22 bp, Homo sapiens
cctgtcactctgagccgctccg

SEQ ID NO: 6944929 - DNA, 18 bp, Homo sapiens
aatgtgaatatttacttc

SEQ ID NO: 6944930 - DNA, 22 bp, Homo sapiens
aatgcaaagagttgcttatcaa

SEQ ID NO: 6944931 - DNA, 22 bp, Homo sapiens
agcaaagtggctttccaaacca

SEQ ID NO: 6944932 - DNA, 15 bp, Homo sapiens
ctaaaatccctgggc

SEQ ID NO: 6944933 - DNA, 22 bp, Homo sapiens
gcggggccatgtccaacggcct

SEQ ID NO: 6944934 - DNA, 22 bp, Homo sapiens
ttattcagtctgtctagggagt

SEQ ID NO: 6944935 - DNA, 22 bp, Homo sapiens
atgcccagggctggtgaggtcc

SEQ ID NO: 6944936 - DNA, 20 bp, Homo sapiens
aggagcttaggaggttattg

SEQ ID NO: 6944937 - DNA, 22 bp, Homo sapiens
gctgccttgccctcttcccata

SEQ ID NO: 6944938 - DNA, 22 bp, Homo sapiens
ataaggcagtcccttaacaagg

SEQ ID NO: 6944939 - DNA, 19 bp, Homo sapiens
aggcccagcgctgggggct

SEQ ID NO: 6944940 - DNA, 22 bp, Homo sapiens
cttgtagacccctggactcacg

SEQ ID NO: 6944941 - DNA, 22 bp, Homo sapiens
ctcagattctgaataataaaca

SEQ ID NO: 6944942 - DNA, 22 bp, Homo sapiens
ttacagagcctcattttagaga

SEQ ID NO: 6944943 - DNA, 22 bp, Homo sapiens
cttttcctcaggaggagacgcg

SEQ ID NO: 6944944 - DNA, 22 bp, Homo sapiens
ttgcaacttctcccatcactct

SEQ ID NO: 6944945 - DNA, 22 bp, Homo sapiens
tctcaaactaacaatgattata

SEQ ID NO: 6944946 - DNA, 22 bp, Homo sapiens
atgttcagtgcagtggcctgag

SEQ ID NO: 6944947 - DNA, 22 bp, Homo sapiens
tccccatgggtggggacacata

SEQ ID NO: 6944948 - DNA, 22 bp, Homo sapiens
gatactcatttcagtgctttac

SEQ ID NO: 6944949 - DNA, 22 bp, Homo sapiens
atttcctagggtagatgtcaca

SEQ ID NO: 6944950 - DNA, 22 bp, Homo sapiens
attccagttagtggcagcttat

SEQ ID NO: 6944951 - DNA, 22 bp, Homo sapiens
catgaacaaattctgtttgagg

SEQ ID NO: 6944952 - DNA, 22 bp, Homo sapiens
gagtgggtgagagacttggcac

SEQ ID NO: 6944953 - DNA, 22 bp, Homo sapiens
tgtatttcctggtttagatcaa

SEQ ID NO: 6944954 - DNA, 22 bp, Homo sapiens
caggtgagttttcctccttggt

SEQ ID NO: 6944955 - DNA, 22 bp, Homo sapiens
ttcatttgggatgagtcagaag

SEQ ID NO: 6944956 - DNA, 22 bp, Homo sapiens
aggcttagaaagggtaagtgac

SEQ ID NO: 6944957 - DNA, 22 bp, Homo sapiens
atgttacagttgagtaaattaa

SEQ ID NO: 6944958 - DNA, 22 bp, Homo sapiens
cttgggatgtaacctttgttcc

SEQ ID NO: 6944959 - DNA, 19 bp, Homo sapiens
tggttgtgcacgggttggt

SEQ ID NO: 6944960 - DNA, 22 bp, Homo sapiens
tgagatggagtctcactctgtt

SEQ ID NO: 6944961 - DNA, 22 bp, Homo sapiens
agctgtgttattagaaacctgc

SEQ ID NO: 6944962 - DNA, 22 bp, Homo sapiens
acatgtggaggaggcgagggta

SEQ ID NO: 6944963 - DNA, 22 bp, Homo sapiens
gcagagccatgggaggtttttg

SEQ ID NO: 6944964 - DNA, 21 bp, Homo sapiens
tcagagggccctggaggctca

SEQ ID NO: 6944965 - DNA, 22 bp, Homo sapiens
gagtgttttactcaaagaaaga

SEQ ID NO: 6944966 - DNA, 22 bp, Homo sapiens
aaaattcatggcttgggaaaag

SEQ ID NO: 6944967 - DNA, 22 bp, Homo sapiens
ttgtagaatcattatttctagt

SEQ ID NO: 6944968 - DNA, 22 bp, Homo sapiens
ctctcctcagaacaggccctct

SEQ ID NO: 6944969 - DNA, 22 bp, Homo sapiens
cggcttctgcccattcagtcct

SEQ ID NO: 6944970 - DNA, 22 bp, Homo sapiens
tctgggaagtcctctgtcatgc

SEQ ID NO: 6944971 - DNA, 22 bp, Homo sapiens
tggtggagcctaggctaagtct

SEQ ID NO: 6944972 - DNA, 22 bp, Homo sapiens
ccagtaattagactttcaggca

SEQ ID NO: 6944973 - DNA, 22 bp, Homo sapiens
tgcattagtaagtaattttaat

SEQ ID NO: 6944974 - DNA, 22 bp, Homo sapiens
ccagggatgtggcagcaccata

SEQ ID NO: 6944975 - DNA, 22 bp, Homo sapiens
ggttatctaagacagtttggca

SEQ ID NO: 6944976 - DNA, 22 bp, Homo sapiens
gttctagatgactgagcagctg

SEQ ID NO: 6944977 - DNA, 21 bp, Homo sapiens
tgtggcagagacaatgctagt

SEQ ID NO: 6944978 - DNA, 22 bp, Homo sapiens
tcaggcttataggtagtggtta

SEQ ID NO: 6944979 - DNA, 22 bp, Homo sapiens
ttctccccgtctctctgaggcc

SEQ ID NO: 6944980 - DNA, 22 bp, Homo sapiens
cttcataaactcagaaggcagc

SEQ ID NO: 6944981 - DNA, 22 bp, Homo sapiens
ggaggactcaggtctggccatg

SEQ ID NO: 6944982 - DNA, 22 bp, Homo sapiens
aggagctctcccatgctgcaga

SEQ ID NO: 6944983 - DNA, 22 bp, Homo sapiens
tctgggtcggaagccccaggga

SEQ ID NO: 6944984 - DNA, 22 bp, Homo sapiens
aattccagcctcagttctatta

SEQ ID NO: 6944985 - DNA, 22 bp, Homo sapiens
taatacagacaacttgccaaat

SEQ ID NO: 6944986 - DNA, 22 bp, Homo sapiens
ctgatgtgttttagtttggtaa

SEQ ID NO: 6944987 - DNA, 22 bp, Homo sapiens
ctgaagcaattgagagatgttt

SEQ ID NO: 6944988 - DNA, 23 bp, Homo sapiens
aagcttccttcacgtctcctggg

SEQ ID NO: 6944989 - DNA, 22 bp, Homo sapiens
agtggctgctggagtggagatg

SEQ ID NO: 6944990 - DNA, 22 bp, Homo sapiens
gctggtaggaagtgctcctgcc

SEQ ID NO: 6944991 - DNA, 22 bp, Homo sapiens
aaagtatgttgtggcttttaaa

SEQ ID NO: 6944992 - DNA, 22 bp, Homo sapiens
aagagttatgaaagcaaggcat

SEQ ID NO: 6944993 - DNA, 22 bp, Homo sapiens
ctagggctccaaagctgagaag

SEQ ID NO: 6944994 - DNA, 22 bp, Homo sapiens
cctgctggcagagggggttact

SEQ ID NO: 6944995 - DNA, 22 bp, Homo sapiens
ttggcacagctccatggctttg

SEQ ID NO: 6944996 - DNA, 22 bp, Homo sapiens
ggtcagaggtcacaagctggca

SEQ ID NO: 6944997 - DNA, 22 bp, Homo sapiens
ggcaggcattagagattcccag

SEQ ID NO: 6944998 - DNA, 22 bp, Homo sapiens
tgtaatgttagaaacaattgct

SEQ ID NO: 6944999 - DNA, 18 bp, Homo sapiens
ccagggagcttattagga

SEQ ID NO: 6945000 - DNA, 22 bp, Homo sapiens
gtgcaaaagtaactgtggtttt

SEQ ID NO: 6945001 - DNA, 23 bp, Homo sapiens
aaatggccaaggttaaaaataca

SEQ ID NO: 6945002 - DNA, 22 bp, Homo sapiens
tgtgtatatgtaaatatagttg

SEQ ID NO: 6945003 - DNA, 22 bp, Homo sapiens
taccttgtgagatgtcagtgag

SEQ ID NO: 6945004 - DNA, 22 bp, Homo sapiens
ttgtacccatgctactaatgtc

SEQ ID NO: 6945005 - DNA, 22 bp, Homo sapiens
ggtagccacatggctgaaatcc

SEQ ID NO: 6945006 - DNA, 22 bp, Homo sapiens
tgggacttaatatgcccttgat

SEQ ID NO: 6945007 - DNA, 22 bp, Homo sapiens
tttgacttctatctagtaagaa

SEQ ID NO: 6945008 - DNA, 22 bp, Homo sapiens
atgattgcctgtgtgtgagaaa

SEQ ID NO: 6945009 - DNA, 19 bp, Homo sapiens
cttctccagcttctagaag

SEQ ID NO: 6945010 - DNA, 22 bp, Homo sapiens
aaggcatggcagggtttacaca

SEQ ID NO: 6945011 - DNA, 17 bp, Homo sapiens
tctctttccctttctgc

SEQ ID NO: 6945012 - DNA, 22 bp, Homo sapiens
tgggcgacagagcaagactccg

SEQ ID NO: 6945013 - DNA, 22 bp, Homo sapiens
ttctcagagcactgctgacaaa

SEQ ID NO: 6945014 - DNA, 22 bp, Homo sapiens
gcagcagggtgccagctttgca

SEQ ID NO: 6945015 - DNA, 22 bp, Homo sapiens
tgggtgacagagcaagactctg

SEQ ID NO: 6945016 - DNA, 22 bp, Homo sapiens
ggctgcttcacttttttgagcc

SEQ ID NO: 6945017 - DNA, 23 bp, Homo sapiens
ccactgaagaatccagggagttt

SEQ ID NO: 6945018 - DNA, 22 bp, Homo sapiens
catatttggtataacttaagca

SEQ ID NO: 6945019 - DNA, 22 bp, Homo sapiens
caagtttgtgttctatcattct

SEQ ID NO: 6945020 - DNA, 22 bp, Homo sapiens
tccagcttttattggatgagga

SEQ ID NO: 6945021 - DNA, 22 bp, Homo sapiens
taactcccaacatcatggctct

SEQ ID NO: 6945022 - DNA, 22 bp, Homo sapiens
ctgcagtcaagctcaccagttc

SEQ ID NO: 6945023 - DNA, 22 bp, Homo sapiens
ctggcagctgtgtgaagaactg

SEQ ID NO: 6945024 - DNA, 19 bp, Homo sapiens
tgagacagggattcaggtg

SEQ ID NO: 6945025 - DNA, 22 bp, Homo sapiens
attaggcattctgaatgaggtc

SEQ ID NO: 6945026 - DNA, 18 bp, Homo sapiens
aggcctgggaagctgagg

SEQ ID NO: 6945027 - DNA, 22 bp, Homo sapiens
taaacagaattcaggcaagata

SEQ ID NO: 6945028 - DNA, 22 bp, Homo sapiens
ttacagcacagtgcttttactg

SEQ ID NO: 6945029 - DNA, 22 bp, Homo sapiens
gagctgcacgcagcatccaaga

SEQ ID NO: 6945030 - DNA, 21 bp, Homo sapiens
cctctgctcgggcatgcgttt

SEQ ID NO: 6945031 - DNA, 21 bp, Homo sapiens
gcttgcttggagtttaggagt

SEQ ID NO: 6945032 - DNA, 22 bp, Homo sapiens
tgccaggcctcaggagtctcca

SEQ ID NO: 6945033 - DNA, 22 bp, Homo sapiens
ttgtaaagaggggggatggtag

SEQ ID NO: 6945034 - DNA, 22 bp, Homo sapiens
ctatgaaaggatttggagttgt

SEQ ID NO: 6945035 - DNA, 21 bp, Homo sapiens
tttctgtcctttccatcagct

SEQ ID NO: 6945036 - DNA, 22 bp, Homo sapiens
gggaatgtgcaggatcgtgggc

SEQ ID NO: 6945037 - DNA, 22 bp, Homo sapiens
taagtgggcgccttgaattact

SEQ ID NO: 6945038 - DNA, 22 bp, Homo sapiens
acaatactagccaaggttatta

SEQ ID NO: 6945039 - DNA, 22 bp, Homo sapiens
attaatatgagaaagtggcaga

SEQ ID NO: 6945040 - DNA, 22 bp, Homo sapiens
taggtctggccccatgcagcca

SEQ ID NO: 6945041 - DNA, 22 bp, Homo sapiens
tggtcagttgagcagaagggaa

SEQ ID NO: 6945042 - DNA, 22 bp, Homo sapiens
tgccatttctcaaatatgacta

SEQ ID NO: 6945043 - DNA, 22 bp, Homo sapiens
gactggtaaggaaattcactaa

SEQ ID NO: 6945044 - DNA, 22 bp, Homo sapiens
cacctttgttctcggccagagt

SEQ ID NO: 6945045 - DNA, 22 bp, Homo sapiens
gtcctcagatgctgctgaaatg

SEQ ID NO: 6945046 - DNA, 22 bp, Homo sapiens
attacagtagcaaaagaccgga

SEQ ID NO: 6945047 - DNA, 19 bp, Homo sapiens
tggctctgtttctctggag

SEQ ID NO: 6945048 - DNA, 22 bp, Homo sapiens
atgtacattttcctaatgtttt

SEQ ID NO: 6945049 - DNA, 22 bp, Homo sapiens
gcacttggaggtgcccacacag

SEQ ID NO: 6945050 - DNA, 22 bp, Homo sapiens
tgttcaatccccaggtcctgaa

SEQ ID NO: 6945051 - DNA, 22 bp, Homo sapiens
agtgtgacagtcctgctgcttt

SEQ ID NO: 6945052 - DNA, 22 bp, Homo sapiens
gtgcccttcagcggcctcatct

SEQ ID NO: 6945053 - DNA, 22 bp, Homo sapiens
cagcatgatttatcacaaccct

SEQ ID NO: 6945054 - DNA, 22 bp, Homo sapiens
tgaaatgcttttacaggatatt

SEQ ID NO: 6945055 - DNA, 22 bp, Homo sapiens
cctggctttgaccttgctgttt

SEQ ID NO: 6945056 - DNA, 18 bp, Homo sapiens
ctattacaatgcagtggt

SEQ ID NO: 6945057 - DNA, 22 bp, Homo sapiens
ataagtttgtctttgtaaagat

SEQ ID NO: 6945058 - DNA, 22 bp, Homo sapiens
ttctctcctacccagtatccat

SEQ ID NO: 6945059 - DNA, 22 bp, Homo sapiens
gtaactgggatttttcaatgtg

SEQ ID NO: 6945060 - DNA, 22 bp, Homo sapiens
agtgaaatgactgaatcagata

SEQ ID NO: 6945061 - DNA, 22 bp, Homo sapiens
tggccctgaggacccagtgtgg

SEQ ID NO: 6945062 - DNA, 22 bp, Homo sapiens
acagaagtttcaagtaagaagt

SEQ ID NO: 6945063 - DNA, 22 bp, Homo sapiens
tgttggcatctctgagagagtt

SEQ ID NO: 6945064 - DNA, 22 bp, Homo sapiens
caactgaggtctcagccaatta

SEQ ID NO: 6945065 - DNA, 22 bp, Homo sapiens
aagtgggtgcactcaactttat

SEQ ID NO: 6945066 - DNA, 22 bp, Homo sapiens
tagactctgcatttacctccca

SEQ ID NO: 6945067 - DNA, 22 bp, Homo sapiens
gtacattttgaggttaaaacaa

SEQ ID NO: 6945068 - DNA, 22 bp, Homo sapiens
aaaggcttggtattttggagtt

SEQ ID NO: 6945069 - DNA, 22 bp, Homo sapiens
aggagtgagtgtcctcagcaga

SEQ ID NO: 6945070 - DNA, 22 bp, Homo sapiens
tttggcggggcaattctgaagc

SEQ ID NO: 6945071 - DNA, 22 bp, Homo sapiens
atcagtgggagatgctggtttt

SEQ ID NO: 6945072 - DNA, 22 bp, Homo sapiens
cttggaatcaagtttttggaga

SEQ ID NO: 6945073 - DNA, 22 bp, Homo sapiens
tctggcttttattcagttggca

SEQ ID NO: 6945074 - DNA, 22 bp, Homo sapiens
agtctagatgatcctaggaata

SEQ ID NO: 6945075 - DNA, 22 bp, Homo sapiens
tctttgctgagtacatctccaa

SEQ ID NO: 6945076 - DNA, 22 bp, Homo sapiens
cctttctctatcgacccatcgc

SEQ ID NO: 6945077 - DNA, 22 bp, Homo sapiens
tcaggaacataatgtgagtcag

SEQ ID NO: 6945078 - DNA, 22 bp, Homo sapiens
ataggctgatctagcagcacag

SEQ ID NO: 6945079 - DNA, 22 bp, Homo sapiens
atgtccagtttctacacacata

SEQ ID NO: 6945080 - DNA, 22 bp, Homo sapiens
tagctgatgtttctgggagaat

SEQ ID NO: 6945081 - DNA, 22 bp, Homo sapiens
atttgcttgttcaccagtactt

SEQ ID NO: 6945082 - DNA, 22 bp, Homo sapiens
agttctgagcatctaggcagct

SEQ ID NO: 6945083 - DNA, 22 bp, Homo sapiens
agctgcaaaccaggccggcgcg

SEQ ID NO: 6945084 - DNA, 22 bp, Homo sapiens
attcagactatgaacacgtcag

SEQ ID NO: 6945085 - DNA, 22 bp, Homo sapiens
acattaatgaggtgatgacaca

SEQ ID NO: 6945086 - DNA, 22 bp, Homo sapiens
atattcactgggtactaaaaag

SEQ ID NO: 6945087 - DNA, 22 bp, Homo sapiens
aattttattagaaggcaagggg

SEQ ID NO: 6945088 - DNA, 22 bp, Homo sapiens
aatagcatcttccctggtaacc

SEQ ID NO: 6945089 - DNA, 22 bp, Homo sapiens
tttctactcatcctttggagaa

SEQ ID NO: 6945090 - DNA, 22 bp, Homo sapiens
acagtagtcttaatttcatgta

SEQ ID NO: 6945091 - DNA, 22 bp, Homo sapiens
gttatagcagcacaaagtggac

SEQ ID NO: 6945092 - DNA, 22 bp, Homo sapiens
cagcaataagccaggttagaca

SEQ ID NO: 6945093 - DNA, 22 bp, Homo sapiens
cagtcctttctgaaatcctata

SEQ ID NO: 6945094 - DNA, 20 bp, Homo sapiens
ctgtagggtgcagcaggctc

SEQ ID NO: 6945095 - DNA, 19 bp, Homo sapiens
acctggctggcgcacttgt

SEQ ID NO: 6945096 - DNA, 22 bp, Homo sapiens
tgcaggtgcctcttgagcttgt

SEQ ID NO: 6945097 - DNA, 22 bp, Homo sapiens
ctgatattaacaggcaagtgag

SEQ ID NO: 6945098 - DNA, 22 bp, Homo sapiens
gcaagtttagctaactggccca

SEQ ID NO: 6945099 - DNA, 22 bp, Homo sapiens
ggaaatattgattgctctgtat

SEQ ID NO: 6945100 - DNA, 22 bp, Homo sapiens
tctcaaattcccttttcctcct

SEQ ID NO: 6945101 - DNA, 22 bp, Homo sapiens
atgtattcaagccacatacatt

SEQ ID NO: 6945102 - DNA, 22 bp, Homo sapiens
ctccaggagctgtgtctttctt

SEQ ID NO: 6945103 - DNA, 18 bp, Homo sapiens
tggctcagatggctttaa

SEQ ID NO: 6945104 - DNA, 22 bp, Homo sapiens
tcaagtctggagatctggaact

SEQ ID NO: 6945105 - DNA, 22 bp, Homo sapiens
tagtgtcagggagtgataaatg

SEQ ID NO: 6945106 - DNA, 22 bp, Homo sapiens
agtctgagttagtggaaatgta

SEQ ID NO: 6945107 - DNA, 22 bp, Homo sapiens
gctgaagttttgcagagagtaa

SEQ ID NO: 6945108 - DNA, 22 bp, Homo sapiens
tgtggactttggcattggactt

SEQ ID NO: 6945109 - DNA, 22 bp, Homo sapiens
ttctcttatctggcattattgg

SEQ ID NO: 6945110 - DNA, 23 bp, Homo sapiens
actcagtgaagcaaacagatagt

SEQ ID NO: 6945111 - DNA, 22 bp, Homo sapiens
tttgtgcaatttatgtactata

SEQ ID NO: 6945112 - DNA, 22 bp, Homo sapiens
agcaaagaagacacaggcttca

SEQ ID NO: 6945113 - DNA, 22 bp, Homo sapiens
ggtcatggatagctggagcctt

SEQ ID NO: 6945114 - DNA, 22 bp, Homo sapiens
cagcatgatcccagttgattgc

SEQ ID NO: 6945115 - DNA, 22 bp, Homo sapiens
ctgtctgtggagcttctgatgt

SEQ ID NO: 6945116 - DNA, 22 bp, Homo sapiens
atgtccaatagaagggagaagc

SEQ ID NO: 6945117 - DNA, 22 bp, Homo sapiens
tgagagagtaattgagtggtaa

SEQ ID NO: 6945118 - DNA, 22 bp, Homo sapiens
ctgttattttataattcaagaa

SEQ ID NO: 6945119 - DNA, 22 bp, Homo sapiens
cagatcaaacaaaatgggttag

SEQ ID NO: 6945120 - DNA, 22 bp, Homo sapiens
gcaaagtattaaccaacaggat

SEQ ID NO: 6945121 - DNA, 22 bp, Homo sapiens
agttagtactgaggacccagac

SEQ ID NO: 6945122 - DNA, 22 bp, Homo sapiens
acccactgtcatctctgaccac

SEQ ID NO: 6945123 - DNA, 22 bp, Homo sapiens
gtctgcagacaacttagaagca

SEQ ID NO: 6945124 - DNA, 22 bp, Homo sapiens
tagcaaaaaaactggcatctcc

SEQ ID NO: 6945125 - DNA, 22 bp, Homo sapiens
tgaatgatatgtgaaaaggaac

SEQ ID NO: 6945126 - DNA, 22 bp, Homo sapiens
cttagaaatgcagattctcagg

SEQ ID NO: 6945127 - DNA, 22 bp, Homo sapiens
cagtttctatggctgggctctg

SEQ ID NO: 6945128 - DNA, 22 bp, Homo sapiens
gtatatgcatgtgtctgttcac

SEQ ID NO: 6945129 - DNA, 23 bp, Homo sapiens
gattgctgtatgcaggagcattc

SEQ ID NO: 6945130 - DNA, 22 bp, Homo sapiens
gacctcgtgatccgcccgcttt

SEQ ID NO: 6945131 - DNA, 21 bp, Homo sapiens
gtcagcagatccagcacttgt

SEQ ID NO: 6945132 - DNA, 22 bp, Homo sapiens
aagtgggttggacaaatgaccc

SEQ ID NO: 6945133 - DNA, 22 bp, Homo sapiens
attccaggactaaaggaacagc

SEQ ID NO: 6945134 - DNA, 22 bp, Homo sapiens
atgttcattttatggcgatgcc

SEQ ID NO: 6945135 - DNA, 23 bp, Homo sapiens
tgaatgattgtactgagctttta

SEQ ID NO: 6945136 - DNA, 22 bp, Homo sapiens
gctctgtgccagggctgggcca

SEQ ID NO: 6945137 - DNA, 22 bp, Homo sapiens
actgccttccacctatggatga

SEQ ID NO: 6945138 - DNA, 22 bp, Homo sapiens
atgtacatttagatcatttctg

SEQ ID NO: 6945139 - DNA, 22 bp, Homo sapiens
agttttgactaagatggcttgg

SEQ ID NO: 6945140 - DNA, 22 bp, Homo sapiens
agagatctgtggattcattgtc

SEQ ID NO: 6945141 - DNA, 22 bp, Homo sapiens
tctcttgtaatttaaaaaatct

SEQ ID NO: 6945142 - DNA, 22 bp, Homo sapiens
tggcctcaatctgtcctccagc

SEQ ID NO: 6945143 - DNA, 22 bp, Homo sapiens
tgctattttggtctacagcact

SEQ ID NO: 6945144 - DNA, 22 bp, Homo sapiens
tccagctggggacatgggcttc

SEQ ID NO: 6945145 - DNA, 22 bp, Homo sapiens
ctctgatttccttattctgtca

SEQ ID NO: 6945146 - DNA, 22 bp, Homo sapiens
tgcatttatggagcaaggcagt

SEQ ID NO: 6945147 - DNA, 22 bp, Homo sapiens
ttggcagaggggccacctgccc

SEQ ID NO: 6945148 - DNA, 22 bp, Homo sapiens
actgttacagggcactgaacat

SEQ ID NO: 6945149 - DNA, 22 bp, Homo sapiens
ccttggttttaccaggtgttca

SEQ ID NO: 6945150 - DNA, 21 bp, Homo sapiens
gctggctggctgaccggcctt

SEQ ID NO: 6945151 - DNA, 22 bp, Homo sapiens
tcagaagtgctgtccttatccc

SEQ ID NO: 6945152 - DNA, 22 bp, Homo sapiens
ttgcatcagaattacttggagg

SEQ ID NO: 6945153 - DNA, 22 bp, Homo sapiens
atgctgagataaggctttagtc

SEQ ID NO: 6945154 - DNA, 22 bp, Homo sapiens
gagaggggacctgtgtgtctag

SEQ ID NO: 6945155 - DNA, 22 bp, Homo sapiens
gtgcttcctgtattgattccat

SEQ ID NO: 6945156 - DNA, 16 bp, Homo sapiens
tcccaggccaggtgga

SEQ ID NO: 6945157 - DNA, 22 bp, Homo sapiens
gttcaaaggcctgtggaaaggg

SEQ ID NO: 6945158 - DNA, 22 bp, Homo sapiens
ctgggccagaagacatttagga

SEQ ID NO: 6945159 - DNA, 22 bp, Homo sapiens
tacttctgcaccaaccttaata

SEQ ID NO: 6945160 - DNA, 22 bp, Homo sapiens
ctattgcttttgtgtgctccca

SEQ ID NO: 6945161 - DNA, 22 bp, Homo sapiens
ggcttggagtcatactgagaat

SEQ ID NO: 6945162 - DNA, 22 bp, Homo sapiens
ctttttactctgttgtctcagc

SEQ ID NO: 6945163 - DNA, 22 bp, Homo sapiens
gtatgtctatagtttttaaata

SEQ ID NO: 6945164 - DNA, 22 bp, Homo sapiens
tcaagacagatgggtaacttgg

SEQ ID NO: 6945165 - DNA, 22 bp, Homo sapiens
acagctgctgcttctcactggg

SEQ ID NO: 6945166 - DNA, 22 bp, Homo sapiens
acattcatgcaccttcctatcc

SEQ ID NO: 6945167 - DNA, 22 bp, Homo sapiens
atggctgtccagtttctagaga

SEQ ID NO: 6945168 - DNA, 19 bp, Homo sapiens
atgctgcatatggttttct

SEQ ID NO: 6945169 - DNA, 22 bp, Homo sapiens
tcagttgctatgagaaataaat

SEQ ID NO: 6945170 - DNA, 22 bp, Homo sapiens
tcttgcaggcatgaaaggactc

SEQ ID NO: 6945171 - DNA, 22 bp, Homo sapiens
agagataccaaataggcagtta

SEQ ID NO: 6945172 - DNA, 22 bp, Homo sapiens
gaggaggctggcgccgcctgcc

SEQ ID NO: 6945173 - DNA, 19 bp, Homo sapiens
catgctgacctgctgtggt

SEQ ID NO: 6945174 - DNA, 22 bp, Homo sapiens
cagtttcttcatctgcagaatc

SEQ ID NO: 6945175 - DNA, 20 bp, Homo sapiens
ctccagactacagaagagcc

SEQ ID NO: 6945176 - DNA, 22 bp, Homo sapiens
cagtccctagtggagctcacag

SEQ ID NO: 6945177 - DNA, 22 bp, Homo sapiens
tatctaaaggatttaatttagt

SEQ ID NO: 6945178 - DNA, 22 bp, Homo sapiens
caatagctaggctggtaaagga

SEQ ID NO: 6945179 - DNA, 22 bp, Homo sapiens
tttgatgacctgtatctttttc

SEQ ID NO: 6945180 - DNA, 22 bp, Homo sapiens
aggtgcttccaggagacaaggt

SEQ ID NO: 6945181 - DNA, 19 bp, Homo sapiens
cagtcctttccgctttctc

SEQ ID NO: 6945182 - DNA, 21 bp, Homo sapiens
atatggctcagagctggtact

SEQ ID NO: 6945183 - DNA, 22 bp, Homo sapiens
aggctcaagcactgatattttt

SEQ ID NO: 6945184 - DNA, 22 bp, Homo sapiens
tggaaatatttgctcattatct

SEQ ID NO: 6945185 - DNA, 22 bp, Homo sapiens
gacatgtattagtcatgcacag

SEQ ID NO: 6945186 - DNA, 22 bp, Homo sapiens
gataacccccaagaaggtcttt

SEQ ID NO: 6945187 - DNA, 22 bp, Homo sapiens
agtggcatatcatagctctctt

SEQ ID NO: 6945188 - DNA, 19 bp, Homo sapiens
ttctttgagttcttctgag

SEQ ID NO: 6945189 - DNA, 22 bp, Homo sapiens
gttaaagagtttggctttcttc

SEQ ID NO: 6945190 - DNA, 21 bp, Homo sapiens
ctctacattcccagcaactct

SEQ ID NO: 6945191 - DNA, 21 bp, Homo sapiens
gaagccaagacaggatcaagg

SEQ ID NO: 6945192 - DNA, 22 bp, Homo sapiens
tgtgaggcctctgcaggagcag

SEQ ID NO: 6945193 - DNA, 22 bp, Homo sapiens
aggtctgagtagagaaaaggca

SEQ ID NO: 6945194 - DNA, 22 bp, Homo sapiens
tcttatgtcaagaatgaatatt

SEQ ID NO: 6945195 - DNA, 22 bp, Homo sapiens
tgagccaagttcacaccattgc

SEQ ID NO: 6945196 - DNA, 22 bp, Homo sapiens
caggcgcagtcaaagaaatact

SEQ ID NO: 6945197 - DNA, 22 bp, Homo sapiens
aggccagccttgtaaatgcctc

SEQ ID NO: 6945198 - DNA, 22 bp, Homo sapiens
cactgcactccagctgggtgac

SEQ ID NO: 6945199 - DNA, 22 bp, Homo sapiens
ggtcatgtgtccaggaggtagc

SEQ ID NO: 6945200 - DNA, 22 bp, Homo sapiens
gcattcttgtttttcctaccct

SEQ ID NO: 6945201 - DNA, 22 bp, Homo sapiens
caggctggagtgcagttgtgca

SEQ ID NO: 6945202 - DNA, 22 bp, Homo sapiens
gagggcctagaagctccatatg

SEQ ID NO: 6945203 - DNA, 22 bp, Homo sapiens
ctgcatcccagggagcaatggg

SEQ ID NO: 6945204 - DNA, 20 bp, Homo sapiens
cagtccaggctgcagcatct

SEQ ID NO: 6945205 - DNA, 22 bp, Homo sapiens
cagcattctactttgtgaactg

SEQ ID NO: 6945206 - DNA, 22 bp, Homo sapiens
gcatttgttgactgaccttccc

SEQ ID NO: 6945207 - DNA, 22 bp, Homo sapiens
tctctgcagtcttgggcaggca

SEQ ID NO: 6945208 - DNA, 22 bp, Homo sapiens
tatttacttttaaattgagaac

SEQ ID NO: 6945209 - DNA, 22 bp, Homo sapiens
tccaggtcctactggcccatag

SEQ ID NO: 6945210 - DNA, 22 bp, Homo sapiens
aataacagagaagggtggcttc

SEQ ID NO: 6945211 - DNA, 22 bp, Homo sapiens
tccagtgtacaaaagctatctt

SEQ ID NO: 6945212 - DNA, 19 bp, Homo sapiens
atgacagagttgataagtg

SEQ ID NO: 6945213 - DNA, 22 bp, Homo sapiens
tgaatgatgtataatattgaga

SEQ ID NO: 6945214 - DNA, 16 bp, Homo sapiens
aacccacagctcccga

SEQ ID NO: 6945215 - DNA, 22 bp, Homo sapiens
ctgaggatggtgtggtcttctc

SEQ ID NO: 6945216 - DNA, 22 bp, Homo sapiens
caagctttatccgccatgtagg

SEQ ID NO: 6945217 - DNA, 22 bp, Homo sapiens
cctcagagttggccacgagagc

SEQ ID NO: 6945218 - DNA, 22 bp, Homo sapiens
cagcaggataggtttctttgga

SEQ ID NO: 6945219 - DNA, 22 bp, Homo sapiens
gctcctctgtcaaatgagagtg

SEQ ID NO: 6945220 - DNA, 22 bp, Homo sapiens
gaggccttcacttatttaaggg

SEQ ID NO: 6945221 - DNA, 22 bp, Homo sapiens
tgacatctgtcaccctgctgac

SEQ ID NO: 6945222 - DNA, 22 bp, Homo sapiens
tcagatcacaaaagtttctatt

SEQ ID NO: 6945223 - DNA, 23 bp, Homo sapiens
ctgtggcaagtcctgcacctgcc

SEQ ID NO: 6945224 - DNA, 22 bp, Homo sapiens
gaggctcttcaataggtcaatg

SEQ ID NO: 6945225 - DNA, 22 bp, Homo sapiens
aattagaaccagaagccatatt

SEQ ID NO: 6945226 - DNA, 22 bp, Homo sapiens
ggcagctgaagaggaactttgg

SEQ ID NO: 6945227 - DNA, 21 bp, Homo sapiens
gttgctcttcaagaaaatccc

SEQ ID NO: 6945228 - DNA, 22 bp, Homo sapiens
ctaactacaagcggggcatcct

SEQ ID NO: 6945229 - DNA, 22 bp, Homo sapiens
gctgtcttgtatgttgtaggac

SEQ ID NO: 6945230 - DNA, 22 bp, Homo sapiens
tatgttgatcataggtaaaaga

SEQ ID NO: 6945231 - DNA, 22 bp, Homo sapiens
cgtcccgggttcacgccattct

SEQ ID NO: 6945232 - DNA, 22 bp, Homo sapiens
ccctggctggctctgcccggac

SEQ ID NO: 6945233 - DNA, 22 bp, Homo sapiens
cacccacccactgctcattggc

SEQ ID NO: 6945234 - DNA, 22 bp, Homo sapiens
cagcaggggaactgtgggccag

SEQ ID NO: 6945235 - DNA, 19 bp, Homo sapiens
actgagaacctgacccagg

SEQ ID NO: 6945236 - DNA, 22 bp, Homo sapiens
gaaggctgtttctggtagtgat

SEQ ID NO: 6945237 - DNA, 22 bp, Homo sapiens
actacttgtgagagattatctc

SEQ ID NO: 6945238 - DNA, 23 bp, Homo sapiens
ggagaggggtgtgggcatcttta

SEQ ID NO: 6945239 - DNA, 22 bp, Homo sapiens
tccagcagaggttgataatacc

SEQ ID NO: 6945240 - DNA, 22 bp, Homo sapiens
ggaaatgtgggctgtttctgta

SEQ ID NO: 6945241 - DNA, 22 bp, Homo sapiens
atgattctaggcattgaagata

SEQ ID NO: 6945242 - DNA, 22 bp, Homo sapiens
tcagctgtactgtgccatagct

SEQ ID NO: 6945243 - DNA, 22 bp, Homo sapiens
agaacgtctttactcttacgaa

SEQ ID NO: 6945244 - DNA, 22 bp, Homo sapiens
gggaggcttgagccatactgcc

SEQ ID NO: 6945245 - DNA, 22 bp, Homo sapiens
ggcatggcacgggaaacaccag

SEQ ID NO: 6945246 - DNA, 22 bp, Homo sapiens
tcttgctgtgccccagcagggc

SEQ ID NO: 6945247 - DNA, 22 bp, Homo sapiens
tggacatcttagtcatgtcaat

SEQ ID NO: 6945248 - DNA, 22 bp, Homo sapiens
ggctctgcactcagagtcattc

SEQ ID NO: 6945249 - DNA, 22 bp, Homo sapiens
gcccaggggagtagtcaattta

SEQ ID NO: 6945250 - DNA, 22 bp, Homo sapiens
aaaacccttctgcagactctga

SEQ ID NO: 6945251 - DNA, 22 bp, Homo sapiens
gctgacctgaatcattcggggt

SEQ ID NO: 6945252 - DNA, 22 bp, Homo sapiens
tagacaatctcagcaaacacac

SEQ ID NO: 6945253 - DNA, 16 bp, Homo sapiens
gagcagcctgggcctt

SEQ ID NO: 6945254 - DNA, 22 bp, Homo sapiens
atgccagtcaaagaagatgaca

SEQ ID NO: 6945255 - DNA, 22 bp, Homo sapiens
tggcatgtatacttgagtagga

SEQ ID NO: 6945256 - DNA, 22 bp, Homo sapiens
cttggttaggttatgaatgccc

SEQ ID NO: 6945257 - DNA, 22 bp, Homo sapiens
caagctgcttattctctgctct

SEQ ID NO: 6945258 - DNA, 19 bp, Homo sapiens
agactctgtgtgagacttt

SEQ ID NO: 6945259 - DNA, 22 bp, Homo sapiens
attgtgctcagaatctgtcgtg

SEQ ID NO: 6945260 - DNA, 22 bp, Homo sapiens
ctgctttcttgttgcatcttaa

SEQ ID NO: 6945261 - DNA, 22 bp, Homo sapiens
tctgcctgttgctagaatgtca

SEQ ID NO: 6945262 - DNA, 22 bp, Homo sapiens
ttctcttagtattgctagttta

SEQ ID NO: 6945263 - DNA, 22 bp, Homo sapiens
ttatgtcaaaatggttgagatt

SEQ ID NO: 6945264 - DNA, 22 bp, Homo sapiens
gaggtaggtgtaggaggcctgc

SEQ ID NO: 6945265 - DNA, 22 bp, Homo sapiens
ccaggacctggagctctatgaa

SEQ ID NO: 6945266 - DNA, 22 bp, Homo sapiens
aaatatgttttccagttgtcat

SEQ ID NO: 6945267 - DNA, 22 bp, Homo sapiens
agggcctgggtctgtactcctc

SEQ ID NO: 6945268 - DNA, 22 bp, Homo sapiens
gaggctcagagtggttaaataa

SEQ ID NO: 6945269 - DNA, 20 bp, Homo sapiens
gggctaggtagccatttggc

SEQ ID NO: 6945270 - DNA, 22 bp, Homo sapiens
ccatgaccatacctgggcctga

SEQ ID NO: 6945271 - DNA, 22 bp, Homo sapiens
acctggccagtggggccgcgct

SEQ ID NO: 6945272 - DNA, 22 bp, Homo sapiens
gatgtcctgcagaaacatgaga

SEQ ID NO: 6945273 - DNA, 22 bp, Homo sapiens
aggcagcaattgaaatcattgt

SEQ ID NO: 6945274 - DNA, 22 bp, Homo sapiens
gcacttggtaggacttcagtga

SEQ ID NO: 6945275 - DNA, 22 bp, Homo sapiens
tcacatctgttgatacagcatc

SEQ ID NO: 6945276 - DNA, 22 bp, Homo sapiens
tgaattcaagttgttgagccat

SEQ ID NO: 6945277 - DNA, 22 bp, Homo sapiens
tttgagtctgcttccattttca

SEQ ID NO: 6945278 - DNA, 22 bp, Homo sapiens
aatgttacaggacctaagatga

SEQ ID NO: 6945279 - DNA, 22 bp, Homo sapiens
aggtggtgatgacagaagacag

SEQ ID NO: 6945280 - DNA, 22 bp, Homo sapiens
aactgtgggagaaggcgatgtg

SEQ ID NO: 6945281 - DNA, 23 bp, Homo sapiens
tccctgagatgctgctctgtccc

SEQ ID NO: 6945282 - DNA, 22 bp, Homo sapiens
cctgccagcatcttcagcccct

SEQ ID NO: 6945283 - DNA, 22 bp, Homo sapiens
tgacccattggtccctagatcc

SEQ ID NO: 6945284 - DNA, 22 bp, Homo sapiens
tttagaggaattgggagaacgt

SEQ ID NO: 6945285 - DNA, 22 bp, Homo sapiens
ctcatatatttctgcattcaat

SEQ ID NO: 6945286 - DNA, 22 bp, Homo sapiens
tttctttccatgagcctatgta

SEQ ID NO: 6945287 - DNA, 22 bp, Homo sapiens
tgcagtgtgattttctggctga

SEQ ID NO: 6945288 - DNA, 22 bp, Homo sapiens
tgtctctgataagtagttcagt

SEQ ID NO: 6945289 - DNA, 22 bp, Homo sapiens
ttcctgctccatttgctgagct

SEQ ID NO: 6945290 - DNA, 22 bp, Homo sapiens
tgagagctgggaaatgttagct

SEQ ID NO: 6945291 - DNA, 22 bp, Homo sapiens
gcactggccgcacgcgtagggc

SEQ ID NO: 6945292 - DNA, 22 bp, Homo sapiens
cattgttggtcattgtcggttg

SEQ ID NO: 6945293 - DNA, 22 bp, Homo sapiens
cacagcagtctttcactaaata

SEQ ID NO: 6945294 - DNA, 22 bp, Homo sapiens
ctcaaaagacttaaacataaga

SEQ ID NO: 6945295 - DNA, 22 bp, Homo sapiens
tggaggcaggagacagggcaaa

SEQ ID NO: 6945296 - DNA, 22 bp, Homo sapiens
gccaggctggaaagaacagaca

SEQ ID NO: 6945297 - DNA, 22 bp, Homo sapiens
gaaagtattctccctgaatttt

SEQ ID NO: 6945298 - DNA, 21 bp, Homo sapiens
aggtcccaggtttgggcagca

SEQ ID NO: 6945299 - DNA, 22 bp, Homo sapiens
cattatattacagcactgttaa

SEQ ID NO: 6945300 - DNA, 21 bp, Homo sapiens
ttggttttctgagtctgtaca

SEQ ID NO: 6945301 - DNA, 22 bp, Homo sapiens
gtgcaaatgtaattgtgatttt

SEQ ID NO: 6945302 - DNA, 22 bp, Homo sapiens
attcacaactgatccttgctca

SEQ ID NO: 6945303 - DNA, 22 bp, Homo sapiens
tctcagagaaatgtgtcaccat

SEQ ID NO: 6945304 - DNA, 22 bp, Homo sapiens
ggcagccagagggcagctggat

SEQ ID NO: 6945305 - DNA, 19 bp, Homo sapiens
tgcccccagcacctccctg

SEQ ID NO: 6945306 - DNA, 22 bp, Homo sapiens
ctgccgttgaggagctgtcgat

SEQ ID NO: 6945307 - DNA, 22 bp, Homo sapiens
tctttggtgatatctctttggt

SEQ ID NO: 6945308 - DNA, 22 bp, Homo sapiens
tctatggggcctcacaggcact

SEQ ID NO: 6945309 - DNA, 22 bp, Homo sapiens
gaagcagctggtgagatggagc

SEQ ID NO: 6945310 - DNA, 21 bp, Homo sapiens
tgtctgagtgactgggtctgc

SEQ ID NO: 6945311 - DNA, 21 bp, Homo sapiens
atatttttgtttggactgtca

SEQ ID NO: 6945312 - DNA, 22 bp, Homo sapiens
atgacaaaagaagacatgaggt

SEQ ID NO: 6945313 - DNA, 16 bp, Homo sapiens
caggtgcctctcccga

SEQ ID NO: 6945314 - DNA, 22 bp, Homo sapiens
cagcacaggtcagttttttaag

SEQ ID NO: 6945315 - DNA, 19 bp, Homo sapiens
atgtctctgtagcacatac

SEQ ID NO: 6945316 - DNA, 22 bp, Homo sapiens
caggatgtgaggaggccatttg

SEQ ID NO: 6945317 - DNA, 22 bp, Homo sapiens
atgtggcacagcacagtaagag

SEQ ID NO: 6945318 - DNA, 22 bp, Homo sapiens
tagcagagatatgggcatagat

SEQ ID NO: 6945319 - DNA, 22 bp, Homo sapiens
tgctcatttgcccattagcatc

SEQ ID NO: 6945320 - DNA, 22 bp, Homo sapiens
gtcagtgtagcaggtgcaagcc

SEQ ID NO: 6945321 - DNA, 22 bp, Homo sapiens
gtctgagggttgtgctggagga

SEQ ID NO: 6945322 - DNA, 22 bp, Homo sapiens
ttgaagttctaagccccagtac

SEQ ID NO: 6945323 - DNA, 17 bp, Homo sapiens
agtgtcagggcccttcc

SEQ ID NO: 6945324 - DNA, 22 bp, Homo sapiens
aacctgagcgcgttgctttcta

SEQ ID NO: 6945325 - DNA, 22 bp, Homo sapiens
ctggctgatctcaatcatggct

SEQ ID NO: 6945326 - DNA, 22 bp, Homo sapiens
tggttttgctccagtataaata

SEQ ID NO: 6945327 - DNA, 22 bp, Homo sapiens
aattttactaatctgagtgtga

SEQ ID NO: 6945328 - DNA, 22 bp, Homo sapiens
ccagctcccctcagcaggtaat

SEQ ID NO: 6945329 - DNA, 22 bp, Homo sapiens
acattatagctttgagtttgga

SEQ ID NO: 6945330 - DNA, 22 bp, Homo sapiens
tactgcctggagatgaatcaat

SEQ ID NO: 6945331 - DNA, 22 bp, Homo sapiens
gagcagggcttgtcctcctcat

SEQ ID NO: 6945332 - DNA, 22 bp, Homo sapiens
gtccaagtacatgtgtgtacat

SEQ ID NO: 6945333 - DNA, 22 bp, Homo sapiens
tcttgcatacactatatgtaca

SEQ ID NO: 6945334 - DNA, 22 bp, Homo sapiens
acactttatgtctagatctggg

SEQ ID NO: 6945335 - DNA, 22 bp, Homo sapiens
ttctacatagtctcttggagct

SEQ ID NO: 6945336 - DNA, 18 bp, Homo sapiens
gcctgccatccccacagc

SEQ ID NO: 6945337 - DNA, 22 bp, Homo sapiens
gagggtccccatgcagagctca

SEQ ID NO: 6945338 - DNA, 22 bp, Homo sapiens
aagtttgttgtacatgttagta

SEQ ID NO: 6945339 - DNA, 22 bp, Homo sapiens
ttttaagtttattccagtacat

SEQ ID NO: 6945340 - DNA, 22 bp, Homo sapiens
tgcaaattggtgaggaccactt

SEQ ID NO: 6945341 - DNA, 22 bp, Homo sapiens
tcatgacaactatattattcca

SEQ ID NO: 6945342 - DNA, 22 bp, Homo sapiens
cattatgtgcgtacatgtatct

SEQ ID NO: 6945343 - DNA, 22 bp, Homo sapiens
tccatttagctggcaaacaatg

SEQ ID NO: 6945344 - DNA, 22 bp, Homo sapiens
ttgcttcctttacagatgggca

SEQ ID NO: 6945345 - DNA, 22 bp, Homo sapiens
cagaagcacatgtttacatgta

SEQ ID NO: 6945346 - DNA, 22 bp, Homo sapiens
ctgataatttcaaaaatcttca

SEQ ID NO: 6945347 - DNA, 22 bp, Homo sapiens
tggattagtgctgaaatgatgg

SEQ ID NO: 6945348 - DNA, 23 bp, Homo sapiens
gggctgctccaggccaaggctgg

SEQ ID NO: 6945349 - DNA, 22 bp, Homo sapiens
tctgagagctgccatctcattt

SEQ ID NO: 6945350 - DNA, 22 bp, Homo sapiens
ctttaacaaatgactcttgtct

SEQ ID NO: 6945351 - DNA, 21 bp, Homo sapiens
aacattagtaatttgactttt

SEQ ID NO: 6945352 - DNA, 22 bp, Homo sapiens
ttcctctcaacatgcctgccgg

SEQ ID NO: 6945353 - DNA, 22 bp, Homo sapiens
tttgacagtaataaagcacaag

SEQ ID NO: 6945354 - DNA, 22 bp, Homo sapiens
ccagctgtttctgatgctaggc

SEQ ID NO: 6945355 - DNA, 21 bp, Homo sapiens
actggccctgccttacaaata

SEQ ID NO: 6945356 - DNA, 22 bp, Homo sapiens
tgtgcctttcatcatgcttttg

SEQ ID NO: 6945357 - DNA, 22 bp, Homo sapiens
gcacagtatttagtagaatgag

SEQ ID NO: 6945358 - DNA, 22 bp, Homo sapiens
gcctaatgtctcattccctagt

SEQ ID NO: 6945359 - DNA, 22 bp, Homo sapiens
gaggtagacttcttggaagtag

SEQ ID NO: 6945360 - DNA, 22 bp, Homo sapiens
tgccctggcttcagctttggct

SEQ ID NO: 6945361 - DNA, 22 bp, Homo sapiens
ctctgcaggcacccagggtggg

SEQ ID NO: 6945362 - DNA, 22 bp, Homo sapiens
agccgagctctgagcagggcct

SEQ ID NO: 6945363 - DNA, 21 bp, Homo sapiens
tggcggggacttgtggctgcc

SEQ ID NO: 6945364 - DNA, 22 bp, Homo sapiens
agacctggatgtgagggaagta

SEQ ID NO: 6945365 - DNA, 22 bp, Homo sapiens
tggtcctggtcatctgggctgg

SEQ ID NO: 6945366 - DNA, 22 bp, Homo sapiens
tttcttctaagatttcaaacta

SEQ ID NO: 6945367 - DNA, 22 bp, Homo sapiens
ctaggctgagctgggctgagct

SEQ ID NO: 6945368 - DNA, 22 bp, Homo sapiens
attcaaagagctgccagaactg

SEQ ID NO: 6945369 - DNA, 22 bp, Homo sapiens
atgccctgctctcgggaaggga

SEQ ID NO: 6945370 - DNA, 22 bp, Homo sapiens
gagctttgtgctggtaggtggt

SEQ ID NO: 6945371 - DNA, 22 bp, Homo sapiens
ctctgggcttcctttgtgggtt

SEQ ID NO: 6945372 - DNA, 22 bp, Homo sapiens
agccctgcatagaagggaacac

SEQ ID NO: 6945373 - DNA, 22 bp, Homo sapiens
tcgaaatactgtttccccttta

SEQ ID NO: 6945374 - DNA, 22 bp, Homo sapiens
acatgttagctactattgttat

SEQ ID NO: 6945375 - DNA, 22 bp, Homo sapiens
gaccttgtgatccacccgcctt

SEQ ID NO: 6945376 - DNA, 18 bp, Homo sapiens
gctcctggagtctgactc

SEQ ID NO: 6945377 - DNA, 22 bp, Homo sapiens
cagcttccccccgggcttgaga

SEQ ID NO: 6945378 - DNA, 22 bp, Homo sapiens
tccctaggagaattgccgcagc

SEQ ID NO: 6945379 - DNA, 22 bp, Homo sapiens
atagtcttagaatcttgagtgt

SEQ ID NO: 6945380 - DNA, 22 bp, Homo sapiens
agctgctgggagaagtgagcca

SEQ ID NO: 6945381 - DNA, 22 bp, Homo sapiens
ggaatgttctggaacaccgctt

SEQ ID NO: 6945382 - DNA, 22 bp, Homo sapiens
agcagccacagcagatctgagt

SEQ ID NO: 6945383 - DNA, 18 bp, Homo sapiens
ctgtcttttttctctcca

SEQ ID NO: 6945384 - DNA, 22 bp, Homo sapiens
tggccacccctttctctgcact

SEQ ID NO: 6945385 - DNA, 22 bp, Homo sapiens
ttggagagggcttggatcacac

SEQ ID NO: 6945386 - DNA, 22 bp, Homo sapiens
ttgatgtaggtttatctattgt

SEQ ID NO: 6945387 - DNA, 19 bp, Homo sapiens
tccatgcccaggcaccaag

SEQ ID NO: 6945388 - DNA, 22 bp, Homo sapiens
caaagtgctgggattacaggct

SEQ ID NO: 6945389 - DNA, 22 bp, Homo sapiens
ggtcatgaggagggagaaggtt

SEQ ID NO: 6945390 - DNA, 20 bp, Homo sapiens
tctgagacttgtagtgtgga

SEQ ID NO: 6945391 - DNA, 22 bp, Homo sapiens
gggcattgcaactggtccagac

SEQ ID NO: 6945392 - DNA, 22 bp, Homo sapiens
ttatttgtatcaaggacggttg

SEQ ID NO: 6945393 - DNA, 22 bp, Homo sapiens
gggctggatctcacgtgagacc

SEQ ID NO: 6945394 - DNA, 22 bp, Homo sapiens
atatagaatacacagggaaagt

SEQ ID NO: 6945395 - DNA, 21 bp, Homo sapiens
ttgaaggatcacttctgtacc

SEQ ID NO: 6945396 - DNA, 22 bp, Homo sapiens
gttacagtgagaagatagccta

SEQ ID NO: 6945397 - DNA, 18 bp, Homo sapiens
attgagcatgacagacct

SEQ ID NO: 6945398 - DNA, 22 bp, Homo sapiens
gccatatacccactgtctccat

SEQ ID NO: 6945399 - DNA, 22 bp, Homo sapiens
tcagtaacttggccgaggtcat

SEQ ID NO: 6945400 - DNA, 22 bp, Homo sapiens
gtgaggagggctggtcccaggc

SEQ ID NO: 6945401 - DNA, 22 bp, Homo sapiens
ccttcctcatccatttctcttg

SEQ ID NO: 6945402 - DNA, 20 bp, Homo sapiens
tgtttcataagctgtcctat

SEQ ID NO: 6945403 - DNA, 22 bp, Homo sapiens
tgttctcttccacggcgctcgg

SEQ ID NO: 6945404 - DNA, 22 bp, Homo sapiens
atgcttcttgtatttggctgac

SEQ ID NO: 6945405 - DNA, 22 bp, Homo sapiens
gccttgttgctcctatttgttt

SEQ ID NO: 6945406 - DNA, 22 bp, Homo sapiens
tatgagaaattatacctaggtt

SEQ ID NO: 6945407 - DNA, 22 bp, Homo sapiens
cagttaaacgggccatgtgagt

SEQ ID NO: 6945408 - DNA, 22 bp, Homo sapiens
aagcatttgtgaaattcagatg

SEQ ID NO: 6945409 - DNA, 22 bp, Homo sapiens
gggggggtcttcagacctcaga

SEQ ID NO: 6945410 - DNA, 22 bp, Homo sapiens
ttcagggcttagggaaatagtg

SEQ ID NO: 6945411 - DNA, 22 bp, Homo sapiens
cctcccttggccatagccagcc

SEQ ID NO: 6945412 - DNA, 22 bp, Homo sapiens
ctctgaggtcctacagtgaccc

SEQ ID NO: 6945413 - DNA, 22 bp, Homo sapiens
aaagagttaagagtcttaagct

SEQ ID NO: 6945414 - DNA, 22 bp, Homo sapiens
agacagactggtttgaattggt

SEQ ID NO: 6945415 - DNA, 22 bp, Homo sapiens
aaattttcctggtaaagatgga

SEQ ID NO: 6945416 - DNA, 22 bp, Homo sapiens
cagtgagctcctgtctgtccct

SEQ ID NO: 6945417 - DNA, 22 bp, Homo sapiens
tcagaagtaggagacattcttg

SEQ ID NO: 6945418 - DNA, 22 bp, Homo sapiens
tctagttttggtatgagatgca

SEQ ID NO: 6945419 - DNA, 22 bp, Homo sapiens
caagcactgttaggttgcttgc

SEQ ID NO: 6945420 - DNA, 22 bp, Homo sapiens
taaacagaatgcgtaagaagtg

SEQ ID NO: 6945421 - DNA, 22 bp, Homo sapiens
gcttggcatttgctgggagctg

SEQ ID NO: 6945422 - DNA, 22 bp, Homo sapiens
agcttcttttacagctcatgct

SEQ ID NO: 6945423 - DNA, 22 bp, Homo sapiens
aggctacgacccaactgggcaa

SEQ ID NO: 6945424 - DNA, 23 bp, Homo sapiens
tggacagtagggtagacagtgcc

SEQ ID NO: 6945425 - DNA, 22 bp, Homo sapiens
atagttatgctctagacaagaa

SEQ ID NO: 6945426 - DNA, 22 bp, Homo sapiens
gattcagtgggctttgggacag

SEQ ID NO: 6945427 - DNA, 21 bp, Homo sapiens
tcctgcaccctccctgtggct

SEQ ID NO: 6945428 - DNA, 22 bp, Homo sapiens
atgtgcgaggtgcttgtcagca

SEQ ID NO: 6945429 - DNA, 22 bp, Homo sapiens
agaccagtgagtaggccttaga

SEQ ID NO: 6945430 - DNA, 20 bp, Homo sapiens
tcccaggctgggctccagct

SEQ ID NO: 6945431 - DNA, 22 bp, Homo sapiens
ttgtgtaccttgggtacttgct

SEQ ID NO: 6945432 - DNA, 22 bp, Homo sapiens
gtttattattcaacttcatgtt

SEQ ID NO: 6945433 - DNA, 22 bp, Homo sapiens
aactcagatatgatagcaggag

SEQ ID NO: 6945434 - DNA, 22 bp, Homo sapiens
gaagcctttgcctaaaacatta

SEQ ID NO: 6945435 - DNA, 22 bp, Homo sapiens
ctggcatgccttgggtgcctct

SEQ ID NO: 6945436 - DNA, 21 bp, Homo sapiens
ctgccacctgctccatcagca

SEQ ID NO: 6945437 - DNA, 22 bp, Homo sapiens
ctctggagtgtctggccagggt

SEQ ID NO: 6945438 - DNA, 22 bp, Homo sapiens
tagttaatggaaatgatggaaa

SEQ ID NO: 6945439 - DNA, 22 bp, Homo sapiens
actgcacaaggcctggacacac

SEQ ID NO: 6945440 - DNA, 22 bp, Homo sapiens
agcataattcctgacacacaag

SEQ ID NO: 6945441 - DNA, 22 bp, Homo sapiens
gactgaggtgacctaggactac

SEQ ID NO: 6945442 - DNA, 22 bp, Homo sapiens
aagggggcacagtcactgtaat

SEQ ID NO: 6945443 - DNA, 22 bp, Homo sapiens
catgtcaataaatataactgca

SEQ ID NO: 6945444 - DNA, 22 bp, Homo sapiens
atgggtaggagaacaaatataa

SEQ ID NO: 6945445 - DNA, 22 bp, Homo sapiens
ttgtatgctgatgacaccacct

SEQ ID NO: 6945446 - DNA, 22 bp, Homo sapiens
gcttctcctcccgctcccaggc

SEQ ID NO: 6945447 - DNA, 22 bp, Homo sapiens
agcctctgactgtcagcaaggt

SEQ ID NO: 6945448 - DNA, 20 bp, Homo sapiens
tctcacagacatcgtctcat

SEQ ID NO: 6945449 - DNA, 22 bp, Homo sapiens
acctttggaggactagggtcat

SEQ ID NO: 6945450 - DNA, 22 bp, Homo sapiens
gtctagaatggatgagcatttt

SEQ ID NO: 6945451 - DNA, 21 bp, Homo sapiens
agatgctgtgctccaggagca

SEQ ID NO: 6945452 - DNA, 22 bp, Homo sapiens
gctgagctagctatctcagtct

SEQ ID NO: 6945453 - DNA, 22 bp, Homo sapiens
ggcttctctgtctagtttctac

SEQ ID NO: 6945454 - DNA, 22 bp, Homo sapiens
ctgtgatggtcaggccctatct

SEQ ID NO: 6945455 - DNA, 18 bp, Homo sapiens
tataacctctgttactca

SEQ ID NO: 6945456 - DNA, 22 bp, Homo sapiens
atatactgtagtggtttagagc

SEQ ID NO: 6945457 - DNA, 22 bp, Homo sapiens
gaaacgttaaaccatatgtaat

SEQ ID NO: 6945458 - DNA, 19 bp, Homo sapiens
cagcaataatgccagatgg

SEQ ID NO: 6945459 - DNA, 22 bp, Homo sapiens
gaaggagctaaagggagccctg

SEQ ID NO: 6945460 - DNA, 22 bp, Homo sapiens
ttgacatatagcataaggataa

SEQ ID NO: 6945461 - DNA, 22 bp, Homo sapiens
tacatctgtctggctttccatt

SEQ ID NO: 6945462 - DNA, 22 bp, Homo sapiens
atagtgaaaatgctgtcagcat

SEQ ID NO: 6945463 - DNA, 22 bp, Homo sapiens
tcacaggagtcataattacagt

SEQ ID NO: 6945464 - DNA, 22 bp, Homo sapiens
atatgctattgctgtaatttaa

SEQ ID NO: 6945465 - DNA, 22 bp, Homo sapiens
aattaaaaaaggagagcttgct

SEQ ID NO: 6945466 - DNA, 20 bp, Homo sapiens
caggtccagcacgtgcacgg

SEQ ID NO: 6945467 - DNA, 22 bp, Homo sapiens
cagcgcctcctggacctcctct

SEQ ID NO: 6945468 - DNA, 22 bp, Homo sapiens
cacacagaaccgctcgccactt

SEQ ID NO: 6945469 - DNA, 22 bp, Homo sapiens
tgggtcctttttggacttcttc

SEQ ID NO: 6945470 - DNA, 22 bp, Homo sapiens
tatgacaccattttggtcagtg

SEQ ID NO: 6945471 - DNA, 22 bp, Homo sapiens
atatggaagagcctgggaattt

SEQ ID NO: 6945472 - DNA, 22 bp, Homo sapiens
ttagtgaaaagaaaatgagtgg

SEQ ID NO: 6945473 - DNA, 22 bp, Homo sapiens
aatggccagctgggagagttga

SEQ ID NO: 6945474 - DNA, 22 bp, Homo sapiens
caggcctgcttcttacccttca

SEQ ID NO: 6945475 - DNA, 22 bp, Homo sapiens
ggtttgctgcagtctcgtcatc

SEQ ID NO: 6945476 - DNA, 22 bp, Homo sapiens
agtgaaccaggctgcgtccctg

SEQ ID NO: 6945477 - DNA, 20 bp, Homo sapiens
ggtccctgccctctgtcatc

SEQ ID NO: 6945478 - DNA, 22 bp, Homo sapiens
gggggaaatagaaatgcttaga

SEQ ID NO: 6945479 - DNA, 22 bp, Homo sapiens
agctgggaggtgggcagtgaga

SEQ ID NO: 6945480 - DNA, 22 bp, Homo sapiens
tcagcagaatcttcctacacct

SEQ ID NO: 6945481 - DNA, 22 bp, Homo sapiens
tcatatttagttcacgctcaat

SEQ ID NO: 6945482 - DNA, 22 bp, Homo sapiens
ttggtcacttgctatgtgccaa

SEQ ID NO: 6945483 - DNA, 22 bp, Homo sapiens
cctgagcatcagcgcctcctta

SEQ ID NO: 6945484 - DNA, 22 bp, Homo sapiens
ttcaatcattgcaaagtaatgg

SEQ ID NO: 6945485 - DNA, 22 bp, Homo sapiens
tctagggggacagctggctgtg

SEQ ID NO: 6945486 - DNA, 22 bp, Homo sapiens
ttctgatgaggaggtctctaag

SEQ ID NO: 6945487 - DNA, 22 bp, Homo sapiens
ggagagaattcagcttaagatt

SEQ ID NO: 6945488 - DNA, 20 bp, Homo sapiens
ccactccgcccccagagggc

SEQ ID NO: 6945489 - DNA, 22 bp, Homo sapiens
agagttagtggcctcagcaggg

SEQ ID NO: 6945490 - DNA, 22 bp, Homo sapiens
ctcttagtttgtaaaaataatt

SEQ ID NO: 6945491 - DNA, 22 bp, Homo sapiens
tggagcagccttttctaagcaa

SEQ ID NO: 6945492 - DNA, 22 bp, Homo sapiens
tctcatctcggatcagaagtga

SEQ ID NO: 6945493 - DNA, 22 bp, Homo sapiens
gccggaagatgaagtttggtca

SEQ ID NO: 6945494 - DNA, 22 bp, Homo sapiens
gtgccctggctcacagtgtctc

SEQ ID NO: 6945495 - DNA, 22 bp, Homo sapiens
aggccagaagccagaaatgctt

SEQ ID NO: 6945496 - DNA, 22 bp, Homo sapiens
cagtcccagacccagaaggtgg

SEQ ID NO: 6945497 - DNA, 21 bp, Homo sapiens
tgcatattcttctggtggctg

SEQ ID NO: 6945498 - DNA, 22 bp, Homo sapiens
tgtgcaatttagagacttggga

SEQ ID NO: 6945499 - DNA, 22 bp, Homo sapiens
tccctgcagcccctgagccttc

SEQ ID NO: 6945500 - DNA, 22 bp, Homo sapiens
tctcattattatttgtatgggt

SEQ ID NO: 6945501 - DNA, 22 bp, Homo sapiens
ggatttgaattgttgaaatgat

SEQ ID NO: 6945502 - DNA, 22 bp, Homo sapiens
tgtgctggtacatgtgaggatg

SEQ ID NO: 6945503 - DNA, 22 bp, Homo sapiens
atatgccatactgtacaatact

SEQ ID NO: 6945504 - DNA, 22 bp, Homo sapiens
aggtctggtatttttctatact

SEQ ID NO: 6945505 - DNA, 22 bp, Homo sapiens
tcctcaggatgtggagtagaat

SEQ ID NO: 6945506 - DNA, 22 bp, Homo sapiens
tcaaagtttgtggcaatttatt

SEQ ID NO: 6945507 - DNA, 22 bp, Homo sapiens
tagagggccagctggacagcga

SEQ ID NO: 6945508 - DNA, 22 bp, Homo sapiens
gaggaaggaatgcagtgtatgc

SEQ ID NO: 6945509 - DNA, 22 bp, Homo sapiens
ctttcttcatctgtaatatgga

SEQ ID NO: 6945510 - DNA, 22 bp, Homo sapiens
taaggcaagaaactcctgtgta

SEQ ID NO: 6945511 - DNA, 19 bp, Homo sapiens
tgtgttcaaactccatctc

SEQ ID NO: 6945512 - DNA, 22 bp, Homo sapiens
gctcagcgtggacctggagctt

SEQ ID NO: 6945513 - DNA, 22 bp, Homo sapiens
cacagtcacatatctatgtgtg

SEQ ID NO: 6945514 - DNA, 22 bp, Homo sapiens
taagataaggaacattctgtga

SEQ ID NO: 6945515 - DNA, 22 bp, Homo sapiens
agcatcagtactaatctggcca

SEQ ID NO: 6945516 - DNA, 22 bp, Homo sapiens
tattatcattaactgttgaatt

SEQ ID NO: 6945517 - DNA, 19 bp, Homo sapiens
atgaccagttccatgccct

SEQ ID NO: 6945518 - DNA, 22 bp, Homo sapiens
ccaagggcccttctaaaattct

SEQ ID NO: 6945519 - DNA, 22 bp, Homo sapiens
cagtaacacaaccactccgtga

SEQ ID NO: 6945520 - DNA, 22 bp, Homo sapiens
caggttgggatcggttgcaatg

SEQ ID NO: 6945521 - DNA, 22 bp, Homo sapiens
gaatagatatccttgagggtct

SEQ ID NO: 6945522 - DNA, 22 bp, Homo sapiens
atatgtgtgccatttcagcagt

SEQ ID NO: 6945523 - DNA, 22 bp, Homo sapiens
agcaggaccaagaaggggaaaa

SEQ ID NO: 6945524 - DNA, 22 bp, Homo sapiens
tggctgagtgatatttgcaaag

SEQ ID NO: 6945525 - DNA, 22 bp, Homo sapiens
gaagcagtcagcagcacctttg

SEQ ID NO: 6945526 - DNA, 20 bp, Homo sapiens
ccaaagactgccccttccag

SEQ ID NO: 6945527 - DNA, 22 bp, Homo sapiens
cttggtcctgcagggtctcttg

SEQ ID NO: 6945528 - DNA, 22 bp, Homo sapiens
cagagccagtcagtcagaaact

SEQ ID NO: 6945529 - DNA, 22 bp, Homo sapiens
tcagcactgatgtttcagaaga

SEQ ID NO: 6945530 - DNA, 22 bp, Homo sapiens
ggtgaggggcacctctgcccgg

SEQ ID NO: 6945531 - DNA, 23 bp, Homo sapiens
tgagcctgctgatagacacaatt

SEQ ID NO: 6945532 - DNA, 22 bp, Homo sapiens
acagtggatgtgatgtccaggt

SEQ ID NO: 6945533 - DNA, 22 bp, Homo sapiens
cactatttcctggattttgacg

SEQ ID NO: 6945534 - DNA, 21 bp, Homo sapiens
ttctgggccatgctgcttctc

SEQ ID NO: 6945535 - DNA, 22 bp, Homo sapiens
cttcacaatcaccttttcggaa

SEQ ID NO: 6945536 - DNA, 22 bp, Homo sapiens
ctggaaagtcaggtcagaaact

SEQ ID NO: 6945537 - DNA, 22 bp, Homo sapiens
ttgcacaccagttttgatgtgg

SEQ ID NO: 6945538 - DNA, 22 bp, Homo sapiens
atggctggtgatactggagtga

SEQ ID NO: 6945539 - DNA, 22 bp, Homo sapiens
attgcccttgtcaggcacgggt

SEQ ID NO: 6945540 - DNA, 22 bp, Homo sapiens
actttctgcagtgttggaaatg

SEQ ID NO: 6945541 - DNA, 22 bp, Homo sapiens
agtagcaatgtttgagaagcac

SEQ ID NO: 6945542 - DNA, 22 bp, Homo sapiens
atttggtagtcctgataagatt

SEQ ID NO: 6945543 - DNA, 22 bp, Homo sapiens
aggatgtcagtcagcttggatt

SEQ ID NO: 6945544 - DNA, 22 bp, Homo sapiens
aattaccaggatttttcagtat

SEQ ID NO: 6945545 - DNA, 22 bp, Homo sapiens
tgaaatgttggtaattttatat

SEQ ID NO: 6945546 - DNA, 22 bp, Homo sapiens
aatgttgtatggtgccttcaga

SEQ ID NO: 6945547 - DNA, 22 bp, Homo sapiens
gggaaacaacaaagtatctatg

SEQ ID NO: 6945548 - DNA, 21 bp, Homo sapiens
tcctgatgtgtaaaaggcagg

SEQ ID NO: 6945549 - DNA, 22 bp, Homo sapiens
tagggctctgagagttcagcct

SEQ ID NO: 6945550 - DNA, 22 bp, Homo sapiens
gtatggcactatcctctctgat

SEQ ID NO: 6945551 - DNA, 23 bp, Homo sapiens
tctgctggtgacacggtcacatt

SEQ ID NO: 6945552 - DNA, 22 bp, Homo sapiens
cagaggctggatggacttgcct

SEQ ID NO: 6945553 - DNA, 22 bp, Homo sapiens
agctgaagttcagtccagagaa

SEQ ID NO: 6945554 - DNA, 22 bp, Homo sapiens
gggaacttgccccagaggaatt

SEQ ID NO: 6945555 - DNA, 22 bp, Homo sapiens
gttaagtgaatgtcatgtcagg

SEQ ID NO: 6945556 - DNA, 22 bp, Homo sapiens
tgagacatcacaaaatcctcaa

SEQ ID NO: 6945557 - DNA, 22 bp, Homo sapiens
agaaaatttattcatgttagtt

SEQ ID NO: 6945558 - DNA, 22 bp, Homo sapiens
gttcacagaaggccagatggta

SEQ ID NO: 6945559 - DNA, 22 bp, Homo sapiens
ttaattggtaacctctggacta

SEQ ID NO: 6945560 - DNA, 22 bp, Homo sapiens
aggtccagttttctgacaaggg

SEQ ID NO: 6945561 - DNA, 22 bp, Homo sapiens
tcacaaagctttgataagcaga

SEQ ID NO: 6945562 - DNA, 22 bp, Homo sapiens
cgcttctctactcccagccagt

SEQ ID NO: 6945563 - DNA, 22 bp, Homo sapiens
ttggtcagctaataaggacagg

SEQ ID NO: 6945564 - DNA, 22 bp, Homo sapiens
tttgacagaggttgtggtgtat

SEQ ID NO: 6945565 - DNA, 22 bp, Homo sapiens
gtctggccatttgcccattgtg

SEQ ID NO: 6945566 - DNA, 22 bp, Homo sapiens
tccagggagtcaaatgaactac

SEQ ID NO: 6945567 - DNA, 22 bp, Homo sapiens
aggactcatccctgcttgtcag

SEQ ID NO: 6945568 - DNA, 22 bp, Homo sapiens
ttgtgcattagggaaaggaact

SEQ ID NO: 6945569 - DNA, 22 bp, Homo sapiens
aatgtcagcctgaaagctattc

SEQ ID NO: 6945570 - DNA, 22 bp, Homo sapiens
ggagagcctgtgcagccgggtt

SEQ ID NO: 6945571 - DNA, 22 bp, Homo sapiens
ccacagaggacaactgcctggc

SEQ ID NO: 6945572 - DNA, 22 bp, Homo sapiens
gtccacagctggccagggcctc

SEQ ID NO: 6945573 - DNA, 22 bp, Homo sapiens
ggtggagctggaccaggagagg

SEQ ID NO: 6945574 - DNA, 22 bp, Homo sapiens
tcaggctttgggtcaggctctg

SEQ ID NO: 6945575 - DNA, 22 bp, Homo sapiens
agcagactcttctcctggggct

SEQ ID NO: 6945576 - DNA, 22 bp, Homo sapiens
cttccctggtgttagcccaatg

SEQ ID NO: 6945577 - DNA, 22 bp, Homo sapiens
tgtctgtgacctcttaggcaag

SEQ ID NO: 6945578 - DNA, 22 bp, Homo sapiens
gttaaatgcattttccaagcac

SEQ ID NO: 6945579 - DNA, 22 bp, Homo sapiens
acacactcaattgcataagcac

SEQ ID NO: 6945580 - DNA, 22 bp, Homo sapiens
taataaatgaaagtgctggcat

SEQ ID NO: 6945581 - DNA, 22 bp, Homo sapiens
ctatttgtcagtttggctttaa

SEQ ID NO: 6945582 - DNA, 22 bp, Homo sapiens
tgggaatgtgagcattcattca

SEQ ID NO: 6945583 - DNA, 22 bp, Homo sapiens
aagctggcatgtcacctgagaa

SEQ ID NO: 6945584 - DNA, 22 bp, Homo sapiens
tagagcagtgggtaccatggca

SEQ ID NO: 6945585 - DNA, 23 bp, Homo sapiens
ctgagcaaagggggaagctgctt

SEQ ID NO: 6945586 - DNA, 22 bp, Homo sapiens
agaggatgattttaaggacact

SEQ ID NO: 6945587 - DNA, 22 bp, Homo sapiens
gctttgtgtagaaggaggatgg

SEQ ID NO: 6945588 - DNA, 22 bp, Homo sapiens
aatatttctggtgcttctcact

SEQ ID NO: 6945589 - DNA, 22 bp, Homo sapiens
aatatgttcaaaatagatcact

SEQ ID NO: 6945590 - DNA, 22 bp, Homo sapiens
ttgtcatagcttcatgggtagc

SEQ ID NO: 6945591 - DNA, 22 bp, Homo sapiens
acatgcatgtctatgggcaggt

SEQ ID NO: 6945592 - DNA, 22 bp, Homo sapiens
tgtgaagctggatcctggagct

SEQ ID NO: 6945593 - DNA, 22 bp, Homo sapiens
tggctgtgtcatcatagctgtg

SEQ ID NO: 6945594 - DNA, 22 bp, Homo sapiens
cttctttcccaggcatgtttta

SEQ ID NO: 6945595 - DNA, 22 bp, Homo sapiens
aagcatctcacctgcccccacg

SEQ ID NO: 6945596 - DNA, 22 bp, Homo sapiens
gacagacactattggtatgcct

SEQ ID NO: 6945597 - DNA, 22 bp, Homo sapiens
tgcaagcaagtttttgaagtgg

SEQ ID NO: 6945598 - DNA, 22 bp, Homo sapiens
aatatctgtggccatacaattt

SEQ ID NO: 6945599 - DNA, 22 bp, Homo sapiens
cctgcacaggccaggcatctga

SEQ ID NO: 6945600 - DNA, 21 bp, Homo sapiens
gtggccctgccgcagtgtcca

SEQ ID NO: 6945601 - DNA, 22 bp, Homo sapiens
agttgaatatacttgctgttgc

SEQ ID NO: 6945602 - DNA, 20 bp, Homo sapiens
ccacccacgcgggctctgcc

SEQ ID NO: 6945603 - DNA, 22 bp, Homo sapiens
gcccactggctggagtgctggt

SEQ ID NO: 6945604 - DNA, 22 bp, Homo sapiens
aatgggctttcttggacaggag

SEQ ID NO: 6945605 - DNA, 22 bp, Homo sapiens
gacctgatgccactgcctgtca

SEQ ID NO: 6945606 - DNA, 22 bp, Homo sapiens
acagctatgacagatggataat

SEQ ID NO: 6945607 - DNA, 22 bp, Homo sapiens
ctaaggtgtccctcttgctgga

SEQ ID NO: 6945608 - DNA, 20 bp, Homo sapiens
cacaagaggagttccctgag

SEQ ID NO: 6945609 - DNA, 22 bp, Homo sapiens
aaggcactgtactagttagtta

SEQ ID NO: 6945610 - DNA, 22 bp, Homo sapiens
tcaggcagagttaatttgctcc

SEQ ID NO: 6945611 - DNA, 22 bp, Homo sapiens
tgtgaaattgagaaactttcac

SEQ ID NO: 6945612 - DNA, 20 bp, Homo sapiens
acaacaaacttgcttaagga

SEQ ID NO: 6945613 - DNA, 22 bp, Homo sapiens
atttgctggtgaatgtatagct

SEQ ID NO: 6945614 - DNA, 22 bp, Homo sapiens
agggagctgagagctactattt

SEQ ID NO: 6945615 - DNA, 22 bp, Homo sapiens
atttcaaggactacttttcaat

SEQ ID NO: 6945616 - DNA, 22 bp, Homo sapiens
agagccaggcggctgggcacct

SEQ ID NO: 6945617 - DNA, 22 bp, Homo sapiens
gtccctgcatcaccacgggact

SEQ ID NO: 6945618 - DNA, 22 bp, Homo sapiens
ctgagcatccagcaggtactgc

SEQ ID NO: 6945619 - DNA, 22 bp, Homo sapiens
agctgcctttgcatcactttaa

SEQ ID NO: 6945620 - DNA, 22 bp, Homo sapiens
tctgcagcttgcacaggcaggc

SEQ ID NO: 6945621 - DNA, 22 bp, Homo sapiens
actggaaaattcaaatggggtc

SEQ ID NO: 6945622 - DNA, 22 bp, Homo sapiens
ccagtgttacggcttgaactat

SEQ ID NO: 6945623 - DNA, 22 bp, Homo sapiens
ttcagccagtcatcagtcttgt

SEQ ID NO: 6945624 - DNA, 22 bp, Homo sapiens
actgtctgtacttcttgcaagg

SEQ ID NO: 6945625 - DNA, 21 bp, Homo sapiens
atgaggtaattcactaagcag

SEQ ID NO: 6945626 - DNA, 22 bp, Homo sapiens
ggctaagtacaagggatacagc

SEQ ID NO: 6945627 - DNA, 22 bp, Homo sapiens
ctccatgtccaaagtttccttg

SEQ ID NO: 6945628 - DNA, 22 bp, Homo sapiens
actacagtgtgataagaggggc

SEQ ID NO: 6945629 - DNA, 21 bp, Homo sapiens
gaagacacataacctctctcc

SEQ ID NO: 6945630 - DNA, 22 bp, Homo sapiens
tgctcagaaacgaggtgcagcc

SEQ ID NO: 6945631 - DNA, 22 bp, Homo sapiens
acagtatatatggttatctgat

SEQ ID NO: 6945632 - DNA, 22 bp, Homo sapiens
caatgtcatgattttccattag

SEQ ID NO: 6945633 - DNA, 22 bp, Homo sapiens
ccacagcttcgcagtctgctgc

SEQ ID NO: 6945634 - DNA, 22 bp, Homo sapiens
agcagctcaacagtgtctctat

SEQ ID NO: 6945635 - DNA, 22 bp, Homo sapiens
cctgtacatggccatctttacc

SEQ ID NO: 6945636 - DNA, 22 bp, Homo sapiens
atgtctaaaagataaagtttaa

SEQ ID NO: 6945637 - DNA, 19 bp, Homo sapiens
ttctgggcagcacatgaat

SEQ ID NO: 6945638 - DNA, 22 bp, Homo sapiens
gagcagccctagggcataagca

SEQ ID NO: 6945639 - DNA, 17 bp, Homo sapiens
gggagatgaagggatat

SEQ ID NO: 6945640 - DNA, 22 bp, Homo sapiens
cctcggagcgggtcagagaggg

SEQ ID NO: 6945641 - DNA, 22 bp, Homo sapiens
catttgaacctggatgttctta

SEQ ID NO: 6945642 - DNA, 23 bp, Homo sapiens
tcactgctactcagcctgagatt

SEQ ID NO: 6945643 - DNA, 22 bp, Homo sapiens
ggcccaaaccaagtacctcaaa

SEQ ID NO: 6945644 - DNA, 22 bp, Homo sapiens
ggtgaatagggaaaggttactt

SEQ ID NO: 6945645 - DNA, 22 bp, Homo sapiens
gtaaagttctatttgaatttag

SEQ ID NO: 6945646 - DNA, 22 bp, Homo sapiens
cctgaggtggctgcagcactgc

SEQ ID NO: 6945647 - DNA, 22 bp, Homo sapiens
agttacagtaagccagccagca

SEQ ID NO: 6945648 - DNA, 23 bp, Homo sapiens
tccagtcccctaaatctcactgt

SEQ ID NO: 6945649 - DNA, 22 bp, Homo sapiens
aaccacatgaaaagagtaatat

SEQ ID NO: 6945650 - DNA, 22 bp, Homo sapiens
ctcagagcaatgaacatgcaaa

SEQ ID NO: 6945651 - DNA, 16 bp, Homo sapiens
agccaggctgcctcgg

SEQ ID NO: 6945652 - DNA, 22 bp, Homo sapiens
ttatggaatggagaaagtctgc

SEQ ID NO: 6945653 - DNA, 22 bp, Homo sapiens
aagtgattgctggttttgccat

SEQ ID NO: 6945654 - DNA, 23 bp, Homo sapiens
tcttcctgaactatcaggcacat

SEQ ID NO: 6945655 - DNA, 22 bp, Homo sapiens
atacactggacatcattgcatt

SEQ ID NO: 6945656 - DNA, 22 bp, Homo sapiens
gctcattcagccagggcccggt

SEQ ID NO: 6945657 - DNA, 19 bp, Homo sapiens
tgtggtctctgttctcagg

SEQ ID NO: 6945658 - DNA, 20 bp, Homo sapiens
tacaggaatcaagactgcat

SEQ ID NO: 6945659 - DNA, 22 bp, Homo sapiens
atctcttatgtcacataaacca

SEQ ID NO: 6945660 - DNA, 23 bp, Homo sapiens
acagggctggcagctgcaagacc

SEQ ID NO: 6945661 - DNA, 22 bp, Homo sapiens
cagcctggcctgggactgctga

SEQ ID NO: 6945662 - DNA, 22 bp, Homo sapiens
attattgcaatttgacattcag

SEQ ID NO: 6945663 - DNA, 22 bp, Homo sapiens
tgtactgtattcatctttaact

SEQ ID NO: 6945664 - DNA, 22 bp, Homo sapiens
agcatagagaatctagatgcct

SEQ ID NO: 6945665 - DNA, 22 bp, Homo sapiens
ataggccaatactgtagagttt

SEQ ID NO: 6945666 - DNA, 22 bp, Homo sapiens
ccaaggccacaaacagcctggc

SEQ ID NO: 6945667 - DNA, 22 bp, Homo sapiens
tgttttctagaaacaatgccta

SEQ ID NO: 6945668 - DNA, 22 bp, Homo sapiens
agtgcatgaaagcatacaaggc

SEQ ID NO: 6945669 - DNA, 22 bp, Homo sapiens
atgccagaaggcagaatttatc

SEQ ID NO: 6945670 - DNA, 22 bp, Homo sapiens
agtcaaacaaatgtttattgag

SEQ ID NO: 6945671 - DNA, 22 bp, Homo sapiens
cattgctgcttccaggcacagg

SEQ ID NO: 6945672 - DNA, 22 bp, Homo sapiens
attcagaatggcaaacttctag

SEQ ID NO: 6945673 - DNA, 22 bp, Homo sapiens
agggatggaagacttgaagacc

SEQ ID NO: 6945674 - DNA, 22 bp, Homo sapiens
ttcatagagcagctcactgaat

SEQ ID NO: 6945675 - DNA, 22 bp, Homo sapiens
gctcagagcttgaagttccact

SEQ ID NO: 6945676 - DNA, 20 bp, Homo sapiens
tgtcatgcattagatgaaga

SEQ ID NO: 6945677 - DNA, 22 bp, Homo sapiens
tgcttaaacacatacatacata

SEQ ID NO: 6945678 - DNA, 22 bp, Homo sapiens
agtcacccaggtgtgatggatg

SEQ ID NO: 6945679 - DNA, 22 bp, Homo sapiens
aatgtgtaaaaggttttcttca

SEQ ID NO: 6945680 - DNA, 22 bp, Homo sapiens
agtgctttacctagataatgtt

SEQ ID NO: 6945681 - DNA, 22 bp, Homo sapiens
acgatggttcatcttttgggga

SEQ ID NO: 6945682 - DNA, 22 bp, Homo sapiens
agagtggcttctttgacatgct

SEQ ID NO: 6945683 - DNA, 22 bp, Homo sapiens
actgaatgaggggtgatctggg

SEQ ID NO: 6945684 - DNA, 22 bp, Homo sapiens
aaggtgtcatccaggatggtgg

SEQ ID NO: 6945685 - DNA, 22 bp, Homo sapiens
cccgtcccttttgcccgctggt

SEQ ID NO: 6945686 - DNA, 20 bp, Homo sapiens
gccaggcactgttctcaata

SEQ ID NO: 6945687 - DNA, 22 bp, Homo sapiens
ccactgttaccagtcaatcaca

SEQ ID NO: 6945688 - DNA, 22 bp, Homo sapiens
gaatcttatgtggtgttttcta

SEQ ID NO: 6945689 - DNA, 22 bp, Homo sapiens
ctcaccacaccgtcggcctcct

SEQ ID NO: 6945690 - DNA, 22 bp, Homo sapiens
ttgtgctcttattgtgcaggga

SEQ ID NO: 6945691 - DNA, 22 bp, Homo sapiens
tccagccccggcttccttacag

SEQ ID NO: 6945692 - DNA, 22 bp, Homo sapiens
ctgagcccgggtgctctacccc

SEQ ID NO: 6945693 - DNA, 22 bp, Homo sapiens
tctggccctatggcatgtacct

SEQ ID NO: 6945694 - DNA, 22 bp, Homo sapiens
tccagggcgtgtgtgaaggaaa

SEQ ID NO: 6945695 - DNA, 22 bp, Homo sapiens
atggcaggatgagacaacaatt

SEQ ID NO: 6945696 - DNA, 22 bp, Homo sapiens
agtctgaaataatgtcactaag

SEQ ID NO: 6945697 - DNA, 21 bp, Homo sapiens
ctgccctagatggctctggaa

SEQ ID NO: 6945698 - DNA, 22 bp, Homo sapiens
gagcagttatttttagacatga

SEQ ID NO: 6945699 - DNA, 22 bp, Homo sapiens
acccttccaaatgagcttatta

SEQ ID NO: 6945700 - DNA, 21 bp, Homo sapiens
gttcttagttatattctcaat

SEQ ID NO: 6945701 - DNA, 22 bp, Homo sapiens
tctgcacaccgccaggctgact

SEQ ID NO: 6945702 - DNA, 21 bp, Homo sapiens
ctgattgattgtcctgactct

SEQ ID NO: 6945703 - DNA, 22 bp, Homo sapiens
ttcacactgtcccgggtggaaa

SEQ ID NO: 6945704 - DNA, 22 bp, Homo sapiens
aagctgaatctgaaatagaatt

SEQ ID NO: 6945705 - DNA, 22 bp, Homo sapiens
caggctgatcagggctgggatg

SEQ ID NO: 6945706 - DNA, 18 bp, Homo sapiens
aaaataacaaagttggct

SEQ ID NO: 6945707 - DNA, 22 bp, Homo sapiens
ggttcacagctgtggggttccc

SEQ ID NO: 6945708 - DNA, 23 bp, Homo sapiens
acaggcaataaagggagtctcca

SEQ ID NO: 6945709 - DNA, 22 bp, Homo sapiens
gctgagtgtaatgatggcagag

SEQ ID NO: 6945710 - DNA, 22 bp, Homo sapiens
agtcagaagccggcctaaggga

SEQ ID NO: 6945711 - DNA, 22 bp, Homo sapiens
aaacattgagcacttgctattt

SEQ ID NO: 6945712 - DNA, 22 bp, Homo sapiens
actgtacacgtgtcatttacag

SEQ ID NO: 6945713 - DNA, 22 bp, Homo sapiens
caaaaaacacagatgtctgtgt

SEQ ID NO: 6945714 - DNA, 22 bp, Homo sapiens
gcagccattgagcgaaaaaatc

SEQ ID NO: 6945715 - DNA, 22 bp, Homo sapiens
tggagctggcttgtggaagttg

SEQ ID NO: 6945716 - DNA, 22 bp, Homo sapiens
gtccatccatgttgtattatgt

SEQ ID NO: 6945717 - DNA, 22 bp, Homo sapiens
ggcagtggcagagcttggtcta

SEQ ID NO: 6945718 - DNA, 22 bp, Homo sapiens
ttccagttctatgaattcaaga

SEQ ID NO: 6945719 - DNA, 22 bp, Homo sapiens
aaaggttttatgttttccactt

SEQ ID NO: 6945720 - DNA, 22 bp, Homo sapiens
ttctctgagtcttggtttctta

SEQ ID NO: 6945721 - DNA, 22 bp, Homo sapiens
ccaggaccacacgacaggagag

SEQ ID NO: 6945722 - DNA, 22 bp, Homo sapiens
agtcatctctgagatagaagct

SEQ ID NO: 6945723 - DNA, 22 bp, Homo sapiens
tagtaaacccatgaggcttaaa

SEQ ID NO: 6945724 - DNA, 22 bp, Homo sapiens
agctaaactaggtaaacagcag

SEQ ID NO: 6945725 - DNA, 23 bp, Homo sapiens
ctggaagtgcttttatagctttg

SEQ ID NO: 6945726 - DNA, 22 bp, Homo sapiens
ctgcctggctaaactcaagtcg

SEQ ID NO: 6945727 - DNA, 22 bp, Homo sapiens
gactctggatgatggctttttt

SEQ ID NO: 6945728 - DNA, 22 bp, Homo sapiens
tagatgattttcagtcaaagca

SEQ ID NO: 6945729 - DNA, 19 bp, Homo sapiens
tgggttgtatctctaatgg

SEQ ID NO: 6945730 - DNA, 22 bp, Homo sapiens
gaggatggtatgaggcaagcaa

SEQ ID NO: 6945731 - DNA, 22 bp, Homo sapiens
cagctcacagccacgccattcc

SEQ ID NO: 6945732 - DNA, 22 bp, Homo sapiens
tctagcaggtggcggccagcga

SEQ ID NO: 6945733 - DNA, 22 bp, Homo sapiens
tgctgaggcccaggagcacttt

SEQ ID NO: 6945734 - DNA, 22 bp, Homo sapiens
acccagggtcaccccgtagggt

SEQ ID NO: 6945735 - DNA, 22 bp, Homo sapiens
tgagatggggagggctgcagaa

SEQ ID NO: 6945736 - DNA, 22 bp, Homo sapiens
cagaagttttgctctcttgggt

SEQ ID NO: 6945737 - DNA, 22 bp, Homo sapiens
ctcagggatgggcagatgttaa

SEQ ID NO: 6945738 - DNA, 22 bp, Homo sapiens
gatttgtagcttttcagtctgt

SEQ ID NO: 6945739 - DNA, 22 bp, Homo sapiens
tggtggctcacgtctgtaatct

SEQ ID NO: 6945740 - DNA, 22 bp, Homo sapiens
gtctgcccggccttcctccacc

SEQ ID NO: 6945741 - DNA, 22 bp, Homo sapiens
cagaattgagagaggctgttct

SEQ ID NO: 6945742 - DNA, 22 bp, Homo sapiens
agtacagcccaggccaggctgg

SEQ ID NO: 6945743 - DNA, 22 bp, Homo sapiens
tcaggtgtgtggtggaaggcag

SEQ ID NO: 6945744 - DNA, 19 bp, Homo sapiens
atgcattgtttgaagttga

SEQ ID NO: 6945745 - DNA, 22 bp, Homo sapiens
tgggattcaccatgggcttcag

SEQ ID NO: 6945746 - DNA, 22 bp, Homo sapiens
gcactgagaactgttttctaga

SEQ ID NO: 6945747 - DNA, 22 bp, Homo sapiens
agccagagggatctttctaaga

SEQ ID NO: 6945748 - DNA, 22 bp, Homo sapiens
aatgctttctcagagtccttca

SEQ ID NO: 6945749 - DNA, 18 bp, Homo sapiens
acaatctgaaacctgtca

SEQ ID NO: 6945750 - DNA, 22 bp, Homo sapiens
agcaggcctgccacctcggggt

SEQ ID NO: 6945751 - DNA, 22 bp, Homo sapiens
tcagggcatggctgcacttggc

SEQ ID NO: 6945752 - DNA, 22 bp, Homo sapiens
tgcacagagcaggcaccagcgg

SEQ ID NO: 6945753 - DNA, 22 bp, Homo sapiens
taactttatgacatgtcttgct

SEQ ID NO: 6945754 - DNA, 22 bp, Homo sapiens
ttggctgaaagccatgagaccg

SEQ ID NO: 6945755 - DNA, 22 bp, Homo sapiens
tgagctgtcaaggtacagtgaa

SEQ ID NO: 6945756 - DNA, 22 bp, Homo sapiens
aatccacgagcagtaggtaatt

SEQ ID NO: 6945757 - DNA, 15 bp, Homo sapiens
gcatatcacattcat

SEQ ID NO: 6945758 - DNA, 22 bp, Homo sapiens
ggagggtccccagcagcatgaa

SEQ ID NO: 6945759 - DNA, 22 bp, Homo sapiens
agcccaaactcatggtcctttg

SEQ ID NO: 6945760 - DNA, 22 bp, Homo sapiens
catccaggctgaagtgcagtgg

SEQ ID NO: 6945761 - DNA, 22 bp, Homo sapiens
ttcagtatacattatctaattg

SEQ ID NO: 6945762 - DNA, 21 bp, Homo sapiens
agtttgatgcaatttctgaga

SEQ ID NO: 6945763 - DNA, 20 bp, Homo sapiens
tgatatggtttggctgtgtt

SEQ ID NO: 6945764 - DNA, 20 bp, Homo sapiens
catcattttaaaatctctcc

SEQ ID NO: 6945765 - DNA, 22 bp, Homo sapiens
taggctcagaaggcactgaaaa

SEQ ID NO: 6945766 - DNA, 22 bp, Homo sapiens
ggcagcagtccatggcccaagg

SEQ ID NO: 6945767 - DNA, 22 bp, Homo sapiens
tgcagctgctcttcatttcccc

SEQ ID NO: 6945768 - DNA, 22 bp, Homo sapiens
cctcaggctgggctgcccctgg

SEQ ID NO: 6945769 - DNA, 23 bp, Homo sapiens
agctttgaggactttaaaagata

SEQ ID NO: 6945770 - DNA, 22 bp, Homo sapiens
tgcttcgaattgggcttctgga

SEQ ID NO: 6945771 - DNA, 20 bp, Homo sapiens
tactcacaaatggtttagca

SEQ ID NO: 6945772 - DNA, 22 bp, Homo sapiens
ttctctaggttttagatgaaga

SEQ ID NO: 6945773 - DNA, 22 bp, Homo sapiens
ttatatgattgagcatcttggt

SEQ ID NO: 6945774 - DNA, 22 bp, Homo sapiens
agctgctgcaagtggtgctaac

SEQ ID NO: 6945775 - DNA, 23 bp, Homo sapiens
tggccacagggtgctccattgta

SEQ ID NO: 6945776 - DNA, 22 bp, Homo sapiens
taggaggaactttttgtttgga

SEQ ID NO: 6945777 - DNA, 21 bp, Homo sapiens
ttgaccaagggtgcgtgctcc

SEQ ID NO: 6945778 - DNA, 22 bp, Homo sapiens
tccgggaggcagaggttgcagt

SEQ ID NO: 6945779 - DNA, 22 bp, Homo sapiens
ctgcttcatatttcatagtgat

SEQ ID NO: 6945780 - DNA, 22 bp, Homo sapiens
catggcaggtgcagattctgtg

SEQ ID NO: 6945781 - DNA, 22 bp, Homo sapiens
aattcaggttatatttgcaact

SEQ ID NO: 6945782 - DNA, 22 bp, Homo sapiens
tagtaacacactggtatttgga

SEQ ID NO: 6945783 - DNA, 22 bp, Homo sapiens
cttattgtgattcctgcctctt

SEQ ID NO: 6945784 - DNA, 22 bp, Homo sapiens
catggctgggagacggctgagg

SEQ ID NO: 6945785 - DNA, 22 bp, Homo sapiens
tcagactttaaaggctaacagg

SEQ ID NO: 6945786 - DNA, 22 bp, Homo sapiens
ccctttaaggaaaggaaggatg

SEQ ID NO: 6945787 - DNA, 22 bp, Homo sapiens
gaaaattgaatcagtagctgat

SEQ ID NO: 6945788 - DNA, 22 bp, Homo sapiens
gccagtggatgaggacttaact

SEQ ID NO: 6945789 - DNA, 22 bp, Homo sapiens
aggcagatgtttggcattgctt

SEQ ID NO: 6945790 - DNA, 22 bp, Homo sapiens
tgttctctctccttttgaagtg

SEQ ID NO: 6945791 - DNA, 22 bp, Homo sapiens
agacctggaagttcaagagaaa

SEQ ID NO: 6945792 - DNA, 22 bp, Homo sapiens
gcagatagggtattaggagtaa

SEQ ID NO: 6945793 - DNA, 22 bp, Homo sapiens
gccgtggccagagcccagtctc

SEQ ID NO: 6945794 - DNA, 22 bp, Homo sapiens
acaactttaatgggtttcagct

SEQ ID NO: 6945795 - DNA, 22 bp, Homo sapiens
tgtatcactcagcaaagtgtct

SEQ ID NO: 6945796 - DNA, 22 bp, Homo sapiens
ccctgagagtgagtgccacctt

SEQ ID NO: 6945797 - DNA, 22 bp, Homo sapiens
tatgggtgttaatggtgagaga

SEQ ID NO: 6945798 - DNA, 22 bp, Homo sapiens
atcatgtgaagtggggggttga

SEQ ID NO: 6945799 - DNA, 22 bp, Homo sapiens
agacttctataaatttgggaat

SEQ ID NO: 6945800 - DNA, 22 bp, Homo sapiens
ctaaataatccctctggtctta

SEQ ID NO: 6945801 - DNA, 22 bp, Homo sapiens
ttctaggggacataatatgaaa

SEQ ID NO: 6945802 - DNA, 22 bp, Homo sapiens
cttgagaacatctccagctcac

SEQ ID NO: 6945803 - DNA, 22 bp, Homo sapiens
tctgcccaggacacctgccact

SEQ ID NO: 6945804 - DNA, 20 bp, Homo sapiens
agtaggcaaaggaaagatct

SEQ ID NO: 6945805 - DNA, 22 bp, Homo sapiens
tcccacatatgcaatcctgaat

SEQ ID NO: 6945806 - DNA, 22 bp, Homo sapiens
gttgtattcttcaatatcagag

SEQ ID NO: 6945807 - DNA, 22 bp, Homo sapiens
aaggataaaaaccacttctaat

SEQ ID NO: 6945808 - DNA, 22 bp, Homo sapiens
aggtgggcttggtgccaacatg

SEQ ID NO: 6945809 - DNA, 22 bp, Homo sapiens
atctgtgtgttgagttctcagc

SEQ ID NO: 6945810 - DNA, 22 bp, Homo sapiens
ctggagaaaatccatgtgtatg

SEQ ID NO: 6945811 - DNA, 22 bp, Homo sapiens
cacatctatgtagaggcttctg

SEQ ID NO: 6945812 - DNA, 22 bp, Homo sapiens
tctggcagtaataggggagaga

SEQ ID NO: 6945813 - DNA, 22 bp, Homo sapiens
gatggggttttgccaggctggt

SEQ ID NO: 6945814 - DNA, 22 bp, Homo sapiens
attatccagcaccaatgtcaga

SEQ ID NO: 6945815 - DNA, 22 bp, Homo sapiens
tggctcccaaggagctcctgcc

SEQ ID NO: 6945816 - DNA, 22 bp, Homo sapiens
tgggagatatccggcctccgtg

SEQ ID NO: 6945817 - DNA, 22 bp, Homo sapiens
gtcaaggcattaaaaaggaata

SEQ ID NO: 6945818 - DNA, 22 bp, Homo sapiens
tcttccttttgtaccttctgaa

SEQ ID NO: 6945819 - DNA, 22 bp, Homo sapiens
atcaagcacttctacatgacat

SEQ ID NO: 6945820 - DNA, 17 bp, Homo sapiens
tagctgccccgaatgct

SEQ ID NO: 6945821 - DNA, 17 bp, Homo sapiens
tggttttgtttaaaggc

SEQ ID NO: 6945822 - DNA, 22 bp, Homo sapiens
caggcacacagcacatggcctg

SEQ ID NO: 6945823 - DNA, 22 bp, Homo sapiens
gtttcttagacagacattatct

SEQ ID NO: 6945824 - DNA, 22 bp, Homo sapiens
gtcttcaacaaatggtagggtc

SEQ ID NO: 6945825 - DNA, 23 bp, Homo sapiens
atcaaatgattggccattcagtg

SEQ ID NO: 6945826 - DNA, 22 bp, Homo sapiens
cagtggttgcttgcatggctcc

SEQ ID NO: 6945827 - DNA, 22 bp, Homo sapiens
ctcagagaagatggatgaggta

SEQ ID NO: 6945828 - DNA, 22 bp, Homo sapiens
ggaatgcaattttacaattctg

SEQ ID NO: 6945829 - DNA, 22 bp, Homo sapiens
ttccctggtgggtgagaacctg

SEQ ID NO: 6945830 - DNA, 20 bp, Homo sapiens
ataaggctgtgatagtctga

SEQ ID NO: 6945831 - DNA, 22 bp, Homo sapiens
atatgtgtgtgtgagaaaagct

SEQ ID NO: 6945832 - DNA, 22 bp, Homo sapiens
atgctgtggatgccttgcccca

SEQ ID NO: 6945833 - DNA, 22 bp, Homo sapiens
accctttgcctagaggggcttt

SEQ ID NO: 6945834 - DNA, 22 bp, Homo sapiens
tgccaggccctgtgctggatgc

SEQ ID NO: 6945835 - DNA, 22 bp, Homo sapiens
aggctctgcagaccccagctgt

SEQ ID NO: 6945836 - DNA, 22 bp, Homo sapiens
aatgtataatatttaatgcttt

SEQ ID NO: 6945837 - DNA, 22 bp, Homo sapiens
ttcactatgcttggaaacttct

SEQ ID NO: 6945838 - DNA, 22 bp, Homo sapiens
agcagggtgtggtggccctgga

SEQ ID NO: 6945839 - DNA, 22 bp, Homo sapiens
atttggcataggcagaggccca

SEQ ID NO: 6945840 - DNA, 22 bp, Homo sapiens
ttgttataaagactaaatatgt

SEQ ID NO: 6945841 - DNA, 22 bp, Homo sapiens
ctttgacctctctgtgcccctc

SEQ ID NO: 6945842 - DNA, 18 bp, Homo sapiens
tccttagctgagcttgtc

SEQ ID NO: 6945843 - DNA, 22 bp, Homo sapiens
gaggcccagaggcccaggacgt

SEQ ID NO: 6945844 - DNA, 22 bp, Homo sapiens
aaaggtttatttgttgctcaca

SEQ ID NO: 6945845 - DNA, 22 bp, Homo sapiens
aaaccctgagacttggggccag

SEQ ID NO: 6945846 - DNA, 22 bp, Homo sapiens
gaaggccctgttttccctattt

SEQ ID NO: 6945847 - DNA, 22 bp, Homo sapiens
agacaggtaaatagagatgctg

SEQ ID NO: 6945848 - DNA, 23 bp, Homo sapiens
gtaggaattttcacttcctcttg

SEQ ID NO: 6945849 - DNA, 22 bp, Homo sapiens
acagataaagaaacaatcacag

SEQ ID NO: 6945850 - DNA, 22 bp, Homo sapiens
tagacagggtggcttagaaaca

SEQ ID NO: 6945851 - DNA, 22 bp, Homo sapiens
atcttacactgttgggtttctc

SEQ ID NO: 6945852 - DNA, 22 bp, Homo sapiens
tgatggagcatgtgtgcttcct

SEQ ID NO: 6945853 - DNA, 22 bp, Homo sapiens
gagagacccagacaccatgcat

SEQ ID NO: 6945854 - DNA, 22 bp, Homo sapiens
tcatgcataaccttgactttgt

SEQ ID NO: 6945855 - DNA, 20 bp, Homo sapiens
accaggagatggaggcaggg

SEQ ID NO: 6945856 - DNA, 22 bp, Homo sapiens
gctggctgggtccctgagaggc

SEQ ID NO: 6945857 - DNA, 22 bp, Homo sapiens
tgcttattaacatgtatatctc

SEQ ID NO: 6945858 - DNA, 22 bp, Homo sapiens
aatcacacaaaggcaacttttg

SEQ ID NO: 6945859 - DNA, 22 bp, Homo sapiens
ttcatgcatggccttactccct

SEQ ID NO: 6945860 - DNA, 22 bp, Homo sapiens
acaattgtggcaatttgtatgt

SEQ ID NO: 6945861 - DNA, 22 bp, Homo sapiens
ggtgaatttgcctcccgactga

SEQ ID NO: 6945862 - DNA, 22 bp, Homo sapiens
aggctggtgtctctgtcctgtc

SEQ ID NO: 6945863 - DNA, 22 bp, Homo sapiens
tgtggctgcaaaggaaggctgc

SEQ ID NO: 6945864 - DNA, 22 bp, Homo sapiens
ccctgctgtgcctgactgccat

SEQ ID NO: 6945865 - DNA, 22 bp, Homo sapiens
ctggctccaaattctgatgttc

SEQ ID NO: 6945866 - DNA, 22 bp, Homo sapiens
acattctattctgcaggacaag

SEQ ID NO: 6945867 - DNA, 20 bp, Homo sapiens
ctgactctccttggcttgga

SEQ ID NO: 6945868 - DNA, 22 bp, Homo sapiens
gatgtgtatttggaagacaaaa

SEQ ID NO: 6945869 - DNA, 22 bp, Homo sapiens
tttagcttgttggaacaattga

SEQ ID NO: 6945870 - DNA, 22 bp, Homo sapiens
tgctgcaaatgagaagagactg

SEQ ID NO: 6945871 - DNA, 23 bp, Homo sapiens
gagcaccagggcttttgagacat

SEQ ID NO: 6945872 - DNA, 22 bp, Homo sapiens
tagcagggtccaatgtgaggca

SEQ ID NO: 6945873 - DNA, 22 bp, Homo sapiens
ctttggtctgtggcttgggtct

SEQ ID NO: 6945874 - DNA, 22 bp, Homo sapiens
tttgtcttcatccttcgagctg

SEQ ID NO: 6945875 - DNA, 22 bp, Homo sapiens
aggaaaggtgagagcggccgcg

SEQ ID NO: 6945876 - DNA, 20 bp, Homo sapiens
tggggcacatgcagattggt

SEQ ID NO: 6945877 - DNA, 22 bp, Homo sapiens
cagctgaaggtaggaaccagga

SEQ ID NO: 6945878 - DNA, 22 bp, Homo sapiens
gtctgtaattattaaagaaagg

SEQ ID NO: 6945879 - DNA, 23 bp, Homo sapiens
tggagctcctgcccatcctggct

SEQ ID NO: 6945880 - DNA, 22 bp, Homo sapiens
agtggctacccttcctagcttt

SEQ ID NO: 6945881 - DNA, 20 bp, Homo sapiens
tccaggcccactcagctgaa

SEQ ID NO: 6945882 - DNA, 22 bp, Homo sapiens
gggtgctttggctcacgcctgt

SEQ ID NO: 6945883 - DNA, 22 bp, Homo sapiens
agctgcccttaataggcattca

SEQ ID NO: 6945884 - DNA, 22 bp, Homo sapiens
gtttttccttgctgaggacccg

SEQ ID NO: 6945885 - DNA, 22 bp, Homo sapiens
ctgccctgtatcttctcccaat

SEQ ID NO: 6945886 - DNA, 22 bp, Homo sapiens
tgctcagacttaagaagatcag

SEQ ID NO: 6945887 - DNA, 22 bp, Homo sapiens
tcagcaggtgaacatcatgcca

SEQ ID NO: 6945888 - DNA, 22 bp, Homo sapiens
tctgacaagtcaagtcttgact

SEQ ID NO: 6945889 - DNA, 23 bp, Homo sapiens
tcagttaactgtgttacctgtgc

SEQ ID NO: 6945890 - DNA, 22 bp, Homo sapiens
ccagaagtgtctatcaagatgt

SEQ ID NO: 6945891 - DNA, 22 bp, Homo sapiens
aaagcagcagttccatcacctg

SEQ ID NO: 6945892 - DNA, 19 bp, Homo sapiens
agcaattaagactgtgggc

SEQ ID NO: 6945893 - DNA, 22 bp, Homo sapiens
actgggaaatgaagtctggtgg

SEQ ID NO: 6945894 - DNA, 22 bp, Homo sapiens
ggagcagcactgattagcggtt

SEQ ID NO: 6945895 - DNA, 22 bp, Homo sapiens
cctgtggctggtcaggccagca

SEQ ID NO: 6945896 - DNA, 22 bp, Homo sapiens
agcagctcatggagtaggcact

SEQ ID NO: 6945897 - DNA, 22 bp, Homo sapiens
tgagaggtcattaggccatgag

SEQ ID NO: 6945898 - DNA, 22 bp, Homo sapiens
gtcatatacactgcatgtaatc

SEQ ID NO: 6945899 - DNA, 18 bp, Homo sapiens
tggtccagttcagatata

SEQ ID NO: 6945900 - DNA, 22 bp, Homo sapiens
tgtcattatggagcttccactg

SEQ ID NO: 6945901 - DNA, 17 bp, Homo sapiens
tgaaggccatgaccacg

SEQ ID NO: 6945902 - DNA, 22 bp, Homo sapiens
gtgcaaagcttaacattctgca

SEQ ID NO: 6945903 - DNA, 22 bp, Homo sapiens
tataacagtttaggtggtgtca

SEQ ID NO: 6945904 - DNA, 18 bp, Homo sapiens
ttctctggtggatgttat

SEQ ID NO: 6945905 - DNA, 22 bp, Homo sapiens
ctgcatctgttagattatcacc

SEQ ID NO: 6945906 - DNA, 22 bp, Homo sapiens
cagctgtctggggagtgctcgc

SEQ ID NO: 6945907 - DNA, 22 bp, Homo sapiens
ttcagctaaaaatgcccacttg

SEQ ID NO: 6945908 - DNA, 22 bp, Homo sapiens
ctatatttggtgagggatgtct

SEQ ID NO: 6945909 - DNA, 22 bp, Homo sapiens
gtctgctggtgcctggcctgcg

SEQ ID NO: 6945910 - DNA, 22 bp, Homo sapiens
gtttggtgacacatagtttgat

SEQ ID NO: 6945911 - DNA, 22 bp, Homo sapiens
tacttacttgtcataattctgg

SEQ ID NO: 6945912 - DNA, 22 bp, Homo sapiens
atgaggtctggcaatcagaaac

SEQ ID NO: 6945913 - DNA, 22 bp, Homo sapiens
taagtgttgttttcaagagata

SEQ ID NO: 6945914 - DNA, 20 bp, Homo sapiens
gaagccaccctcagattcca

SEQ ID NO: 6945915 - DNA, 22 bp, Homo sapiens
tgacaggtcatataagcttgca

SEQ ID NO: 6945916 - DNA, 22 bp, Homo sapiens
cacagctagactaattgctggg

SEQ ID NO: 6945917 - DNA, 22 bp, Homo sapiens
ggctggaaaagacaaagctatt

SEQ ID NO: 6945918 - DNA, 22 bp, Homo sapiens
aacttcttggtcctgagctgtt

SEQ ID NO: 6945919 - DNA, 22 bp, Homo sapiens
gggcctcaaatctcccgcttat

SEQ ID NO: 6945920 - DNA, 22 bp, Homo sapiens
gaaatgtaattctcttgaagat

SEQ ID NO: 6945921 - DNA, 22 bp, Homo sapiens
gggggctggactttcccacaca

SEQ ID NO: 6945922 - DNA, 22 bp, Homo sapiens
tcatctttcctcaaaagatcca

SEQ ID NO: 6945923 - DNA, 22 bp, Homo sapiens
tatgtagatggaattaactgat

SEQ ID NO: 6945924 - DNA, 18 bp, Homo sapiens
tattctgtcctatgaagc

SEQ ID NO: 6945925 - DNA, 22 bp, Homo sapiens
tgcagggccttgggatgtgtcc

SEQ ID NO: 6945926 - DNA, 22 bp, Homo sapiens
tccactcaaggccattgcacat

SEQ ID NO: 6945927 - DNA, 22 bp, Homo sapiens
ggccttggcctagccctccagg

SEQ ID NO: 6945928 - DNA, 22 bp, Homo sapiens
tcacagtatagagttattttgg

SEQ ID NO: 6945929 - DNA, 22 bp, Homo sapiens
tcactgggccctgaggtgggac

SEQ ID NO: 6945930 - DNA, 22 bp, Homo sapiens
tttctaatgttctcagggattg

SEQ ID NO: 6945931 - DNA, 22 bp, Homo sapiens
gagatccacacatttagggtgc

SEQ ID NO: 6945932 - DNA, 22 bp, Homo sapiens
tttgaacctgagcttctgcatg

SEQ ID NO: 6945933 - DNA, 22 bp, Homo sapiens
ctgaggcaccggcaatgttctg

SEQ ID NO: 6945934 - DNA, 22 bp, Homo sapiens
ctccaggcgcttaccaagcgct

SEQ ID NO: 6945935 - DNA, 22 bp, Homo sapiens
aatagcttggacccattgcttt

SEQ ID NO: 6945936 - DNA, 22 bp, Homo sapiens
gttggtgatgccacacatattt

SEQ ID NO: 6945937 - DNA, 22 bp, Homo sapiens
aaagtcctgtttgaaggacctg

SEQ ID NO: 6945938 - DNA, 22 bp, Homo sapiens
caggctgccgtgaagcaggcct

SEQ ID NO: 6945939 - DNA, 22 bp, Homo sapiens
tgtgtatatatgtttaagtcat

SEQ ID NO: 6945940 - DNA, 22 bp, Homo sapiens
acaattgctaatgcttctgttg

SEQ ID NO: 6945941 - DNA, 22 bp, Homo sapiens
tgctcaacagatatgtaacatg

SEQ ID NO: 6945942 - DNA, 22 bp, Homo sapiens
tttgcacttcctaatgtgtttt

SEQ ID NO: 6945943 - DNA, 22 bp, Homo sapiens
ttttcacaagggtccaactagt

SEQ ID NO: 6945944 - DNA, 22 bp, Homo sapiens
gccaggctcttggttatgtttt

SEQ ID NO: 6945945 - DNA, 22 bp, Homo sapiens
ctttcataattcagcacattga

SEQ ID NO: 6945946 - DNA, 22 bp, Homo sapiens
tcactgcagacaacctcagtca

SEQ ID NO: 6945947 - DNA, 22 bp, Homo sapiens
caaggatttcactggaaagcct

SEQ ID NO: 6945948 - DNA, 22 bp, Homo sapiens
tcacaaaagcttttgaatttgg

SEQ ID NO: 6945949 - DNA, 22 bp, Homo sapiens
cattgagaggctgcctgcctga

SEQ ID NO: 6945950 - DNA, 22 bp, Homo sapiens
aagtgattttcttcttagttat

SEQ ID NO: 6945951 - DNA, 22 bp, Homo sapiens
tttaggatcaatgagaaagtct

SEQ ID NO: 6945952 - DNA, 22 bp, Homo sapiens
ctggattctggattcttctcat

SEQ ID NO: 6945953 - DNA, 22 bp, Homo sapiens
cctctgagagaaggccttcagc

SEQ ID NO: 6945954 - DNA, 22 bp, Homo sapiens
cttggctgtctataggaaagag

SEQ ID NO: 6945955 - DNA, 22 bp, Homo sapiens
agcagccctagggattgctgtt

SEQ ID NO: 6945956 - DNA, 22 bp, Homo sapiens
catgggtaagactcttttgccc

SEQ ID NO: 6945957 - DNA, 22 bp, Homo sapiens
catctgggttctcagatggata

SEQ ID NO: 6945958 - DNA, 22 bp, Homo sapiens
taaacagagaagactttgagca

SEQ ID NO: 6945959 - DNA, 22 bp, Homo sapiens
tctccaggcacttggctgctac

SEQ ID NO: 6945960 - DNA, 22 bp, Homo sapiens
ggggcacttggcacctctgcag

SEQ ID NO: 6945961 - DNA, 20 bp, Homo sapiens
atttgctgagctttttctcc

SEQ ID NO: 6945962 - DNA, 22 bp, Homo sapiens
atgcaacagttcatagttttat

SEQ ID NO: 6945963 - DNA, 22 bp, Homo sapiens
tcagggctccggaagtggcctc

SEQ ID NO: 6945964 - DNA, 22 bp, Homo sapiens
caggccagcttcctgacatcct

SEQ ID NO: 6945965 - DNA, 23 bp, Homo sapiens
aatgatttcatgatgatagcagc

SEQ ID NO: 6945966 - DNA, 22 bp, Homo sapiens
tggctaaacttgggtcagatgt

SEQ ID NO: 6945967 - DNA, 22 bp, Homo sapiens
atgtacagtgataagagggcag

SEQ ID NO: 6945968 - DNA, 18 bp, Homo sapiens
ggacccagggcctcaccc

SEQ ID NO: 6945969 - DNA, 22 bp, Homo sapiens
cagcacagtgcagatgctgact

SEQ ID NO: 6945970 - DNA, 22 bp, Homo sapiens
tttctcatggaacatcgtttag

SEQ ID NO: 6945971 - DNA, 22 bp, Homo sapiens
tagtggagaggatgtggagaaa

SEQ ID NO: 6945972 - DNA, 22 bp, Homo sapiens
ttccactctacacactgctggc

SEQ ID NO: 6945973 - DNA, 22 bp, Homo sapiens
tccaggcaaagtgctgggctgc

SEQ ID NO: 6945974 - DNA, 22 bp, Homo sapiens
cttgttatctccgtgtccttgt

SEQ ID NO: 6945975 - DNA, 22 bp, Homo sapiens
cagtagcactagatatgtgtgg

SEQ ID NO: 6945976 - DNA, 19 bp, Homo sapiens
ctttgcaaagccctgtgta

SEQ ID NO: 6945977 - DNA, 22 bp, Homo sapiens
ttcatacacgaaaatgcatgca

SEQ ID NO: 6945978 - DNA, 22 bp, Homo sapiens
ttcttcctctgtaaaaggtgac

SEQ ID NO: 6945979 - DNA, 22 bp, Homo sapiens
ccactgtcttttccaggctgaa

SEQ ID NO: 6945980 - DNA, 22 bp, Homo sapiens
gtggctctttatgtgttattgg

SEQ ID NO: 6945981 - DNA, 22 bp, Homo sapiens
cttagagttatggaaatgttga

SEQ ID NO: 6945982 - DNA, 22 bp, Homo sapiens
gctgccagtagttggagctcca

SEQ ID NO: 6945983 - DNA, 22 bp, Homo sapiens
agcatgctgggtcatttttgcc

SEQ ID NO: 6945984 - DNA, 22 bp, Homo sapiens
atcaatatcagatcagacagga

SEQ ID NO: 6945985 - DNA, 20 bp, Homo sapiens
agggtctgatgtggtggccc

SEQ ID NO: 6945986 - DNA, 22 bp, Homo sapiens
ttgttaaaatattggagaaagg

SEQ ID NO: 6945987 - DNA, 22 bp, Homo sapiens
tagtttagagaattggggatga

SEQ ID NO: 6945988 - DNA, 22 bp, Homo sapiens
agcatagttaatacttttggta

SEQ ID NO: 6945989 - DNA, 22 bp, Homo sapiens
gtttacattgctgtttgtgtct

SEQ ID NO: 6945990 - DNA, 22 bp, Homo sapiens
tcctgccctaagatgttatatt

SEQ ID NO: 6945991 - DNA, 22 bp, Homo sapiens
ctgtgaaactggacagcacttg

SEQ ID NO: 6945992 - DNA, 22 bp, Homo sapiens
aaatgctaaatgcagcaagtag

SEQ ID NO: 6945993 - DNA, 22 bp, Homo sapiens
gttctcagggataacttccccc

SEQ ID NO: 6945994 - DNA, 22 bp, Homo sapiens
tcaagagaagtgctccacagta

SEQ ID NO: 6945995 - DNA, 22 bp, Homo sapiens
agtatgttgagttttgctttag

SEQ ID NO: 6945996 - DNA, 22 bp, Homo sapiens
tttctagacatttctatgtaca

SEQ ID NO: 6945997 - DNA, 20 bp, Homo sapiens
ggacaggaagacaacctacc

SEQ ID NO: 6945998 - DNA, 22 bp, Homo sapiens
tagcagttagagttgactgcaa

SEQ ID NO: 6945999 - DNA, 22 bp, Homo sapiens
gctgaccttcaaatccagcgag

SEQ ID NO: 6946000 - DNA, 20 bp, Homo sapiens
ctaagcactttgataaactg

SEQ ID NO: 6946001 - DNA, 21 bp, Homo sapiens
ggacagctgcgcgcagggctc

SEQ ID NO: 6946002 - DNA, 22 bp, Homo sapiens
tctccaggctttttgtgaattg

SEQ ID NO: 6946003 - DNA, 23 bp, Homo sapiens
tctgagagaacaatgcctcctat

SEQ ID NO: 6946004 - DNA, 22 bp, Homo sapiens
tagaaaggagcattttagacta

SEQ ID NO: 6946005 - DNA, 22 bp, Homo sapiens
ggcagctagaattgtgatgctg

SEQ ID NO: 6946006 - DNA, 22 bp, Homo sapiens
ggccttagcggtcatagcaaag

SEQ ID NO: 6946007 - DNA, 22 bp, Homo sapiens
atcttgtgctgacaaaacacat

SEQ ID NO: 6946008 - DNA, 22 bp, Homo sapiens
tgcaacaaggcctcatttcttg

SEQ ID NO: 6946009 - DNA, 22 bp, Homo sapiens
aaccctggagaaggctttggat

SEQ ID NO: 6946010 - DNA, 19 bp, Homo sapiens
ttacaatggtgattaggtt

SEQ ID NO: 6946011 - DNA, 22 bp, Homo sapiens
ttatggagcagacagctggtca

SEQ ID NO: 6946012 - DNA, 22 bp, Homo sapiens
acgttaaacatttagcatagta

SEQ ID NO: 6946013 - DNA, 19 bp, Homo sapiens
taggccctagctctgcagt

SEQ ID NO: 6946014 - DNA, 22 bp, Homo sapiens
atgcagtttgcttcgcagcagt

SEQ ID NO: 6946015 - DNA, 23 bp, Homo sapiens
agctctgaaatagggaaagagga

SEQ ID NO: 6946016 - DNA, 22 bp, Homo sapiens
agaattcagaatgcatttctaa

SEQ ID NO: 6946017 - DNA, 22 bp, Homo sapiens
gcctcatctaagagattccttc

SEQ ID NO: 6946018 - DNA, 22 bp, Homo sapiens
ttgtgacaatacagcatggaga

SEQ ID NO: 6946019 - DNA, 22 bp, Homo sapiens
gctccaaggtatccaccagggt

SEQ ID NO: 6946020 - DNA, 22 bp, Homo sapiens
atatataacctggataaggctt

SEQ ID NO: 6946021 - DNA, 22 bp, Homo sapiens
attgcagggaggcaggtagatg

SEQ ID NO: 6946022 - DNA, 22 bp, Homo sapiens
tgtctgtcagatattaagtttc

SEQ ID NO: 6946023 - DNA, 22 bp, Homo sapiens
agccctccatctgtgctcaggc

SEQ ID NO: 6946024 - DNA, 22 bp, Homo sapiens
tctgggctgctgtgcagtgacc

SEQ ID NO: 6946025 - DNA, 22 bp, Homo sapiens
ggcaccaggatcagtctgtcat

SEQ ID NO: 6946026 - DNA, 23 bp, Homo sapiens
tgtgtctgtttagggaggatgtg

SEQ ID NO: 6946027 - DNA, 22 bp, Homo sapiens
cagcccacgtcagggccactca

SEQ ID NO: 6946028 - DNA, 22 bp, Homo sapiens
aatacgtggttactctatagag

SEQ ID NO: 6946029 - DNA, 22 bp, Homo sapiens
tttctctttggaggggctgaat

SEQ ID NO: 6946030 - DNA, 22 bp, Homo sapiens
tgtctctgagatgactcccacc

SEQ ID NO: 6946031 - DNA, 22 bp, Homo sapiens
tctggagttactgctggctttg

SEQ ID NO: 6946032 - DNA, 22 bp, Homo sapiens
cagagataccattgctaaaatt

SEQ ID NO: 6946033 - DNA, 22 bp, Homo sapiens
ttcccagattggagggcagggg

SEQ ID NO: 6946034 - DNA, 22 bp, Homo sapiens
aactctggctgcttcccaggtc

SEQ ID NO: 6946035 - DNA, 22 bp, Homo sapiens
ctaaggaattggagcatgtgtt

SEQ ID NO: 6946036 - DNA, 22 bp, Homo sapiens
tggccagacagagaggctttgt

SEQ ID NO: 6946037 - DNA, 22 bp, Homo sapiens
tgtgtacaaatttagccagcag

SEQ ID NO: 6946038 - DNA, 22 bp, Homo sapiens
tgaaacaaaagtatgtagcttg

SEQ ID NO: 6946039 - DNA, 22 bp, Homo sapiens
gctcttggaagacaggatgtgt

SEQ ID NO: 6946040 - DNA, 22 bp, Homo sapiens
cagtaagaatatgaatcaggat

SEQ ID NO: 6946041 - DNA, 22 bp, Homo sapiens
tccaaagaacctggctactgtc

SEQ ID NO: 6946042 - DNA, 22 bp, Homo sapiens
atatgtgtgcacatatgtattt

SEQ ID NO: 6946043 - DNA, 22 bp, Homo sapiens
gaggtcttgctggccatgctca

SEQ ID NO: 6946044 - DNA, 23 bp, Homo sapiens
cttgtctaattcatggtgaaggc

SEQ ID NO: 6946045 - DNA, 22 bp, Homo sapiens
ctagagaaaatgatagcaggaa

SEQ ID NO: 6946046 - DNA, 19 bp, Homo sapiens
cgtccaggtgctggaagat

SEQ ID NO: 6946047 - DNA, 22 bp, Homo sapiens
tgtacaatgtgtttgttggctt

SEQ ID NO: 6946048 - DNA, 22 bp, Homo sapiens
tggcctgtggatcccagctctg

SEQ ID NO: 6946049 - DNA, 22 bp, Homo sapiens
ttcaccatgttggccaggctgg

SEQ ID NO: 6946050 - DNA, 22 bp, Homo sapiens
ctagaaatattttacagtcaag

SEQ ID NO: 6946051 - DNA, 22 bp, Homo sapiens
agcaaatggatttctgaaccta

SEQ ID NO: 6946052 - DNA, 22 bp, Homo sapiens
caaaagggagttctctggaagg

SEQ ID NO: 6946053 - DNA, 22 bp, Homo sapiens
gtttattccagcaatctgctta

SEQ ID NO: 6946054 - DNA, 18 bp, Homo sapiens
ctatgcatgcattgtatc

SEQ ID NO: 6946055 - DNA, 22 bp, Homo sapiens
tttaatatttctttcctgaagc

SEQ ID NO: 6946056 - DNA, 22 bp, Homo sapiens
tccaagaggagacactgggatg

SEQ ID NO: 6946057 - DNA, 22 bp, Homo sapiens
tcctgtcctgaggctccaggcc

SEQ ID NO: 6946058 - DNA, 22 bp, Homo sapiens
agaagctactgggatattaatt

SEQ ID NO: 6946059 - DNA, 22 bp, Homo sapiens
tgaccactgaatatgactgcct

SEQ ID NO: 6946060 - DNA, 22 bp, Homo sapiens
tttccaaggatgtgtctctcta

SEQ ID NO: 6946061 - DNA, 22 bp, Homo sapiens
catgtcccaaatgcaggcaaag

SEQ ID NO: 6946062 - DNA, 22 bp, Homo sapiens
acccaaagcaatattcatcagt

SEQ ID NO: 6946063 - DNA, 22 bp, Homo sapiens
gcactgcttttacctaggtgag

SEQ ID NO: 6946064 - DNA, 22 bp, Homo sapiens
ttcagtaagcacttctagagct

SEQ ID NO: 6946065 - DNA, 22 bp, Homo sapiens
ttgaatctcatcccaatgttgt

SEQ ID NO: 6946066 - DNA, 21 bp, Homo sapiens
gggcgaggcctgatgtggctc

SEQ ID NO: 6946067 - DNA, 22 bp, Homo sapiens
tttaatacagaacttgtcaggg

SEQ ID NO: 6946068 - DNA, 22 bp, Homo sapiens
agcggagctagtttttgtcctc

SEQ ID NO: 6946069 - DNA, 22 bp, Homo sapiens
tattcagaggtgaagtagggag

SEQ ID NO: 6946070 - DNA, 22 bp, Homo sapiens
tgtgtgcattagcattctaggg

SEQ ID NO: 6946071 - DNA, 22 bp, Homo sapiens
cgtgatgaatggtgagacccgc

SEQ ID NO: 6946072 - DNA, 22 bp, Homo sapiens
catgagaatgaagaagacttaa

SEQ ID NO: 6946073 - DNA, 22 bp, Homo sapiens
tccagggcaccagcgtccccct

SEQ ID NO: 6946074 - DNA, 22 bp, Homo sapiens
aggctgcctgttccaatctcct

SEQ ID NO: 6946075 - DNA, 23 bp, Homo sapiens
aaatgctgaatctttactgttta

SEQ ID NO: 6946076 - DNA, 22 bp, Homo sapiens
ctggctggtttttaaagctagg

SEQ ID NO: 6946077 - DNA, 22 bp, Homo sapiens
ccatttcactgggtagttgtgg

SEQ ID NO: 6946078 - DNA, 22 bp, Homo sapiens
gcctgtattcccagcactttgg

SEQ ID NO: 6946079 - DNA, 22 bp, Homo sapiens
ggagggagtttcattcctgccc

SEQ ID NO: 6946080 - DNA, 20 bp, Homo sapiens
ggtgcgaggccagagcagac

SEQ ID NO: 6946081 - DNA, 22 bp, Homo sapiens
aatttatggtggggtaagggga

SEQ ID NO: 6946082 - DNA, 22 bp, Homo sapiens
tgtgaaagagtcttatagtttc

SEQ ID NO: 6946083 - DNA, 22 bp, Homo sapiens
cttggccagacagggagctcca

SEQ ID NO: 6946084 - DNA, 22 bp, Homo sapiens
tagctactagtgaattttggta

SEQ ID NO: 6946085 - DNA, 19 bp, Homo sapiens
gtgctttttaagagctcag

SEQ ID NO: 6946086 - DNA, 22 bp, Homo sapiens
aaccagagagtcttcttcattg

SEQ ID NO: 6946087 - DNA, 22 bp, Homo sapiens
tgaataagtgatgtcatatata

SEQ ID NO: 6946088 - DNA, 22 bp, Homo sapiens
ttagccatggactgaattgact

SEQ ID NO: 6946089 - DNA, 19 bp, Homo sapiens
tcctccttacttcctcttg

SEQ ID NO: 6946090 - DNA, 22 bp, Homo sapiens
tgtgagacaggacctgttgact

SEQ ID NO: 6946091 - DNA, 22 bp, Homo sapiens
agaaacttcagctattcttttg

SEQ ID NO: 6946092 - DNA, 22 bp, Homo sapiens
gtcactcatctcatggaggggt

SEQ ID NO: 6946093 - DNA, 18 bp, Homo sapiens
tttgcaaaggaagtatgg

SEQ ID NO: 6946094 - DNA, 22 bp, Homo sapiens
gtcgtggtcagacaccagaaaa

SEQ ID NO: 6946095 - DNA, 22 bp, Homo sapiens
ggtctagagcttgattggcagc

SEQ ID NO: 6946096 - DNA, 22 bp, Homo sapiens
ggcttcccagcagagggcgcac

SEQ ID NO: 6946097 - DNA, 22 bp, Homo sapiens
caagaatgaattcaatgtgtgg

SEQ ID NO: 6946098 - DNA, 22 bp, Homo sapiens
atactgaaaaatgatttgctgt

SEQ ID NO: 6946099 - DNA, 22 bp, Homo sapiens
gaggagtctttccctaagtcct

SEQ ID NO: 6946100 - DNA, 22 bp, Homo sapiens
accaatttttcctgaagggcat

SEQ ID NO: 6946101 - DNA, 22 bp, Homo sapiens
ttctttcttggggaacacactc

SEQ ID NO: 6946102 - DNA, 21 bp, Homo sapiens
aactacagttgttccttcatt

SEQ ID NO: 6946103 - DNA, 22 bp, Homo sapiens
actgcaaggaggtggggtatca

SEQ ID NO: 6946104 - DNA, 22 bp, Homo sapiens
atggaataattgtttcacagaa

SEQ ID NO: 6946105 - DNA, 22 bp, Homo sapiens
ggcggtctcagcaccctcttgg

SEQ ID NO: 6946106 - DNA, 22 bp, Homo sapiens
ctgtctcctcctttgttcttaa

SEQ ID NO: 6946107 - DNA, 23 bp, Homo sapiens
acaaagtaattcctgcttccaaa

SEQ ID NO: 6946108 - DNA, 20 bp, Homo sapiens
accctgaggctccccagcct

SEQ ID NO: 6946109 - DNA, 22 bp, Homo sapiens
tgtcacaacagaggaactgaat

SEQ ID NO: 6946110 - DNA, 22 bp, Homo sapiens
ggggaggctgatgtgggcaaag

SEQ ID NO: 6946111 - DNA, 22 bp, Homo sapiens
tctctgaagagtcagacataac

SEQ ID NO: 6946112 - DNA, 22 bp, Homo sapiens
tgaattgtgacccctctgtatt

SEQ ID NO: 6946113 - DNA, 22 bp, Homo sapiens
gtaattacattagggtaaataa

SEQ ID NO: 6946114 - DNA, 22 bp, Homo sapiens
aattcaaagccgcttgggaatc

SEQ ID NO: 6946115 - DNA, 19 bp, Homo sapiens
tcctgggctgcgtcttgcc

SEQ ID NO: 6946116 - DNA, 22 bp, Homo sapiens
gtgtcccaaagattagaaatca

SEQ ID NO: 6946117 - DNA, 22 bp, Homo sapiens
tcaaggaatgactatatgagga

SEQ ID NO: 6946118 - DNA, 22 bp, Homo sapiens
ggccctcttttatccatcataa

SEQ ID NO: 6946119 - DNA, 22 bp, Homo sapiens
ggctctgcaaaagtagatactt

SEQ ID NO: 6946120 - DNA, 22 bp, Homo sapiens
ggttctgagaaactctcaccat

SEQ ID NO: 6946121 - DNA, 22 bp, Homo sapiens
ttttctcctttctaggtcacat

SEQ ID NO: 6946122 - DNA, 22 bp, Homo sapiens
atcactgaatgcaaagctggga

SEQ ID NO: 6946123 - DNA, 20 bp, Homo sapiens
tatgcagtatgtgtgtataa

SEQ ID NO: 6946124 - DNA, 22 bp, Homo sapiens
tattccaactgtcatagtcata

SEQ ID NO: 6946125 - DNA, 22 bp, Homo sapiens
cagcatgaatgtgttcgtaggg

SEQ ID NO: 6946126 - DNA, 22 bp, Homo sapiens
ctgactccaaagtttgggctct

SEQ ID NO: 6946127 - DNA, 22 bp, Homo sapiens
atctgcttgcaggctggccctt

SEQ ID NO: 6946128 - DNA, 22 bp, Homo sapiens
tagcactgagtctagctttgga

SEQ ID NO: 6946129 - DNA, 22 bp, Homo sapiens
tcacatctccatgtgttgttca

SEQ ID NO: 6946130 - DNA, 23 bp, Homo sapiens
tcagagaagttgtaggctgggga

SEQ ID NO: 6946131 - DNA, 22 bp, Homo sapiens
ctggaaggggcagtctttgggc

SEQ ID NO: 6946132 - DNA, 23 bp, Homo sapiens
aggagccaggtgcagcccttgtg

SEQ ID NO: 6946133 - DNA, 22 bp, Homo sapiens
agcagatggtgtcatgggatgg

SEQ ID NO: 6946134 - DNA, 22 bp, Homo sapiens
actggcagtagagggagcgcat

SEQ ID NO: 6946135 - DNA, 22 bp, Homo sapiens
gctcccaggcatggaggtaatt

SEQ ID NO: 6946136 - DNA, 22 bp, Homo sapiens
gataaacatgaagttctgtgta

SEQ ID NO: 6946137 - DNA, 22 bp, Homo sapiens
tagagttatatgatgtgctagt

SEQ ID NO: 6946138 - DNA, 22 bp, Homo sapiens
aagacaagcatcaaatcaggca

SEQ ID NO: 6946139 - DNA, 22 bp, Homo sapiens
caattgctttcttaccaagaga

SEQ ID NO: 6946140 - DNA, 22 bp, Homo sapiens
tcctttggacacattttttata

SEQ ID NO: 6946141 - DNA, 22 bp, Homo sapiens
actcattgaaacttaagatcta

SEQ ID NO: 6946142 - DNA, 20 bp, Homo sapiens
ggcagcaattcaccctatcc

SEQ ID NO: 6946143 - DNA, 22 bp, Homo sapiens
tgtctcttgagctgcctgatgc

SEQ ID NO: 6946144 - DNA, 22 bp, Homo sapiens
ttgcagaatacttattctgtat

SEQ ID NO: 6946145 - DNA, 22 bp, Homo sapiens
tgccaggccaattctatttgac

SEQ ID NO: 6946146 - DNA, 22 bp, Homo sapiens
taagaagtgctgaattgaatat

SEQ ID NO: 6946147 - DNA, 22 bp, Homo sapiens
gtgaagttcaagcttgccatct

SEQ ID NO: 6946148 - DNA, 22 bp, Homo sapiens
tgacatttcttgttgatataaa

SEQ ID NO: 6946149 - DNA, 23 bp, Homo sapiens
tttgttcatcattagagtctagc

SEQ ID NO: 6946150 - DNA, 22 bp, Homo sapiens
tcctcagtggggcattcattat

SEQ ID NO: 6946151 - DNA, 22 bp, Homo sapiens
gtgaccagcccatagagaggcg

SEQ ID NO: 6946152 - DNA, 22 bp, Homo sapiens
gacaggctaggttgctgtcctc

SEQ ID NO: 6946153 - DNA, 22 bp, Homo sapiens
catattgtctattgctgttttt

SEQ ID NO: 6946154 - DNA, 22 bp, Homo sapiens
tgtgaggatgtaaccagaagtc

SEQ ID NO: 6946155 - DNA, 22 bp, Homo sapiens
gctggcccagtgacccacagtg

SEQ ID NO: 6946156 - DNA, 22 bp, Homo sapiens
tcaagtccaggaaagcacagtc

SEQ ID NO: 6946157 - DNA, 22 bp, Homo sapiens
agcattggtggccagagtgcct

SEQ ID NO: 6946158 - DNA, 22 bp, Homo sapiens
acagctgctgtttttgaaggac

SEQ ID NO: 6946159 - DNA, 22 bp, Homo sapiens
ctttcacagcttgaaaagtatt

SEQ ID NO: 6946160 - DNA, 22 bp, Homo sapiens
tgcaaaccagttcaaccaatct

SEQ ID NO: 6946161 - DNA, 22 bp, Homo sapiens
tgcccaggctggagtacagtgg

SEQ ID NO: 6946162 - DNA, 22 bp, Homo sapiens
tggccaaatttggtgtaacttg

SEQ ID NO: 6946163 - DNA, 22 bp, Homo sapiens
gggcaatgtctgtggccactaa

SEQ ID NO: 6946164 - DNA, 22 bp, Homo sapiens
ttcctgtccgcaatggcctggg

SEQ ID NO: 6946165 - DNA, 22 bp, Homo sapiens
atcatagaggaaaatccacgtt

SEQ ID NO: 6946166 - DNA, 22 bp, Homo sapiens
tgattctcattatcttggggtg

SEQ ID NO: 6946167 - DNA, 22 bp, Homo sapiens
tccagtgtttttcttcacaggt

SEQ ID NO: 6946168 - DNA, 22 bp, Homo sapiens
gtggaagcaggttgctaacagg

SEQ ID NO: 6946169 - DNA, 22 bp, Homo sapiens
gttttcctgaaactgatggtgt

SEQ ID NO: 6946170 - DNA, 23 bp, Homo sapiens
atgcaacattgccagtatgggca

SEQ ID NO: 6946171 - DNA, 22 bp, Homo sapiens
cttgacttcttctagaaataag

SEQ ID NO: 6946172 - DNA, 22 bp, Homo sapiens
tccactggcctctgtctttcag

SEQ ID NO: 6946173 - DNA, 22 bp, Homo sapiens
cacaggttagcagcttgaaact

SEQ ID NO: 6946174 - DNA, 22 bp, Homo sapiens
tcaccttagctagaggaagaga

SEQ ID NO: 6946175 - DNA, 22 bp, Homo sapiens
tgaggtgggcttgtggatttgc

SEQ ID NO: 6946176 - DNA, 22 bp, Homo sapiens
tgttagagctaagataacatct

SEQ ID NO: 6946177 - DNA, 22 bp, Homo sapiens
tggctggctgtccagctgggca

SEQ ID NO: 6946178 - DNA, 22 bp, Homo sapiens
tgagggatggtgagagtctgat

SEQ ID NO: 6946179 - DNA, 22 bp, Homo sapiens
aaggaagccttgcctgaataca

SEQ ID NO: 6946180 - DNA, 22 bp, Homo sapiens
tggcctctcctggctgagtttc

SEQ ID NO: 6946181 - DNA, 22 bp, Homo sapiens
agatcatagtgcagctctggag

SEQ ID NO: 6946182 - DNA, 22 bp, Homo sapiens
gtatttgagggagaaaaggaag

SEQ ID NO: 6946183 - DNA, 22 bp, Homo sapiens
ttattgagagctgttttatggc

SEQ ID NO: 6946184 - DNA, 22 bp, Homo sapiens
tgttaaactgtattgcataagg

SEQ ID NO: 6946185 - DNA, 21 bp, Homo sapiens
tctgggaaattgggaaagaag

SEQ ID NO: 6946186 - DNA, 22 bp, Homo sapiens
aattttccatccaaagtaacat

SEQ ID NO: 6946187 - DNA, 22 bp, Homo sapiens
caggtggttccatgtttcatga

SEQ ID NO: 6946188 - DNA, 22 bp, Homo sapiens
agctgggtggtgctgagccttg

SEQ ID NO: 6946189 - DNA, 22 bp, Homo sapiens
ctgctgattcttaaatgtggtt

SEQ ID NO: 6946190 - DNA, 22 bp, Homo sapiens
ttccatgagtagcagtatttcc

SEQ ID NO: 6946191 - DNA, 22 bp, Homo sapiens
aaatggcaacagaagggagttc

SEQ ID NO: 6946192 - DNA, 16 bp, Homo sapiens
ggtggggtagttagaa

SEQ ID NO: 6946193 - DNA, 22 bp, Homo sapiens
aaaaattgctgagaacggaatt

SEQ ID NO: 6946194 - DNA, 22 bp, Homo sapiens
tctgtcacccagagtgcagtgg

SEQ ID NO: 6946195 - DNA, 22 bp, Homo sapiens
ccattggagagttttaagaagg

SEQ ID NO: 6946196 - DNA, 22 bp, Homo sapiens
agactgtagggatagaggtctt

SEQ ID NO: 6946197 - DNA, 22 bp, Homo sapiens
tgaacagatgtggaggtacctt

SEQ ID NO: 6946198 - DNA, 22 bp, Homo sapiens
tcactggaaatgcacagctgta

SEQ ID NO: 6946199 - DNA, 21 bp, Homo sapiens
tagcaaattgctattaaggca

SEQ ID NO: 6946200 - DNA, 20 bp, Homo sapiens
tcagtgtatcctcagtggct

SEQ ID NO: 6946201 - DNA, 20 bp, Homo sapiens
atttgcatctgaataactta

SEQ ID NO: 6946202 - DNA, 22 bp, Homo sapiens
ggaaatatcttgtactatgtga

SEQ ID NO: 6946203 - DNA, 22 bp, Homo sapiens
cctcggctgggccttggccact

SEQ ID NO: 6946204 - DNA, 22 bp, Homo sapiens
gttatataattcctgtggtagt

SEQ ID NO: 6946205 - DNA, 22 bp, Homo sapiens
ctgcagtcacattttctcacga

SEQ ID NO: 6946206 - DNA, 19 bp, Homo sapiens
agctaagacaagggacatc

SEQ ID NO: 6946207 - DNA, 22 bp, Homo sapiens
acctgcctcagtgcagctggat

SEQ ID NO: 6946208 - DNA, 22 bp, Homo sapiens
gttattttatctctgagaggtt

SEQ ID NO: 6946209 - DNA, 22 bp, Homo sapiens
gctgagcacagcaaagagacaa

SEQ ID NO: 6946210 - DNA, 22 bp, Homo sapiens
aagtcaaagctttcagaggaaa

SEQ ID NO: 6946211 - DNA, 22 bp, Homo sapiens
ttctagttactcttaaatgctg

SEQ ID NO: 6946212 - DNA, 22 bp, Homo sapiens
ccctgctgtgtagcggaggaac

SEQ ID NO: 6946213 - DNA, 22 bp, Homo sapiens
ttccccaggcggctttttcagc

SEQ ID NO: 6946214 - DNA, 20 bp, Homo sapiens
ctccagggaacagactggag

SEQ ID NO: 6946215 - DNA, 22 bp, Homo sapiens
gaaagctgaaccaggaaccatg

SEQ ID NO: 6946216 - DNA, 21 bp, Homo sapiens
ttttggtcctggcttaggagc

SEQ ID NO: 6946217 - DNA, 21 bp, Homo sapiens
gaccccagaccagcagacaca

SEQ ID NO: 6946218 - DNA, 22 bp, Homo sapiens
taaattctgatcaagttccttc

SEQ ID NO: 6946219 - DNA, 22 bp, Homo sapiens
gaagacatgtttttaatatgta

SEQ ID NO: 6946220 - DNA, 14 bp, Homo sapiens
gcaggcagaccacc

SEQ ID NO: 6946221 - DNA, 22 bp, Homo sapiens
tcttctccataatcaacactct

SEQ ID NO: 6946222 - DNA, 21 bp, Homo sapiens
ctggcattatgatagcgtcct

SEQ ID NO: 6946223 - DNA, 22 bp, Homo sapiens
ccttggaggactgctgcttctt

SEQ ID NO: 6946224 - DNA, 22 bp, Homo sapiens
ctctggctggctgggcctcagt

SEQ ID NO: 6946225 - DNA, 22 bp, Homo sapiens
aagggcttaagaatcttcaagg

SEQ ID NO: 6946226 - DNA, 22 bp, Homo sapiens
gttaagtgggaccagtgtcctt

SEQ ID NO: 6946227 - DNA, 22 bp, Homo sapiens
taggttcagtgtcttgttctgc

SEQ ID NO: 6946228 - DNA, 20 bp, Homo sapiens
tttgacaccttgggagagac

SEQ ID NO: 6946229 - DNA, 22 bp, Homo sapiens
actcatcaactgttacaaatgt

SEQ ID NO: 6946230 - DNA, 22 bp, Homo sapiens
aggctcccaagcactgacccca

SEQ ID NO: 6946231 - DNA, 22 bp, Homo sapiens
ctgagaaatttattggttggaa

SEQ ID NO: 6946232 - DNA, 22 bp, Homo sapiens
ggctggaagtccaagatcaaga

SEQ ID NO: 6946233 - DNA, 22 bp, Homo sapiens
gacgcactgaaggctggttacc

SEQ ID NO: 6946234 - DNA, 18 bp, Homo sapiens
tgatctttcatgattcca

SEQ ID NO: 6946235 - DNA, 22 bp, Homo sapiens
gcagtgaatctggcaagaattt

SEQ ID NO: 6946236 - DNA, 22 bp, Homo sapiens
ctggaggaataatctcctaccc

SEQ ID NO: 6946237 - DNA, 22 bp, Homo sapiens
tgagattcagttgattagtgat

SEQ ID NO: 6946238 - DNA, 22 bp, Homo sapiens
tctcagagtttgaatctggagt

SEQ ID NO: 6946239 - DNA, 22 bp, Homo sapiens
ctcactgcaatctccgtctccc

SEQ ID NO: 6946240 - DNA, 22 bp, Homo sapiens
ttatagttagtaggtcattaaa

SEQ ID NO: 6946241 - DNA, 22 bp, Homo sapiens
gtgagcttctgcctctcagtcc

SEQ ID NO: 6946242 - DNA, 22 bp, Homo sapiens
cctggcctttgaacgctagact

SEQ ID NO: 6946243 - DNA, 22 bp, Homo sapiens
ttcttttacattaagatttcag

SEQ ID NO: 6946244 - DNA, 22 bp, Homo sapiens
tggtaaccacaaccctccttgt

SEQ ID NO: 6946245 - DNA, 22 bp, Homo sapiens
aggaatgacttgtagctctgag

SEQ ID NO: 6946246 - DNA, 22 bp, Homo sapiens
agctagcctaggcagagtgcat

SEQ ID NO: 6946247 - DNA, 22 bp, Homo sapiens
ttcatgtgtctgtagcacatat

SEQ ID NO: 6946248 - DNA, 22 bp, Homo sapiens
atttggctgggtgttagaaaga

SEQ ID NO: 6946249 - DNA, 22 bp, Homo sapiens
agagcagcttttcggaaccact

SEQ ID NO: 6946250 - DNA, 22 bp, Homo sapiens
ggctgctgggaatatgccagct

SEQ ID NO: 6946251 - DNA, 22 bp, Homo sapiens
gggctagggcctgctatggttt

SEQ ID NO: 6946252 - DNA, 22 bp, Homo sapiens
ccactgggcgtttctgtccaat

SEQ ID NO: 6946253 - DNA, 22 bp, Homo sapiens
atttccctccagggaaagctta

SEQ ID NO: 6946254 - DNA, 20 bp, Homo sapiens
tgtgatgggttctttcctgg

SEQ ID NO: 6946255 - DNA, 22 bp, Homo sapiens
ggaaggcttgagttcccaggtc

SEQ ID NO: 6946256 - DNA, 22 bp, Homo sapiens
cagaactgacctctgattctag

SEQ ID NO: 6946257 - DNA, 22 bp, Homo sapiens
ccagggctgagctgtgaccatg

SEQ ID NO: 6946258 - DNA, 22 bp, Homo sapiens
attgagaattgtgagtttggag

SEQ ID NO: 6946259 - DNA, 22 bp, Homo sapiens
ttgaagataggccaggatgagc

SEQ ID NO: 6946260 - DNA, 22 bp, Homo sapiens
aggatccagccagggtggagtt

SEQ ID NO: 6946261 - DNA, 22 bp, Homo sapiens
gagccctcttgtctatatggta

SEQ ID NO: 6946262 - DNA, 22 bp, Homo sapiens
aacaatgtcctgtgagatgata

SEQ ID NO: 6946263 - DNA, 22 bp, Homo sapiens
acagataatttaattaatgcat

SEQ ID NO: 6946264 - DNA, 19 bp, Homo sapiens
gcttgctgctaggtaggga

SEQ ID NO: 6946265 - DNA, 22 bp, Homo sapiens
gataaaataactatggaatact

SEQ ID NO: 6946266 - DNA, 20 bp, Homo sapiens
tgttgaattcatggtgactt

SEQ ID NO: 6946267 - DNA, 22 bp, Homo sapiens
ttgaagagtgcattagcatatt

SEQ ID NO: 6946268 - DNA, 22 bp, Homo sapiens
gaggcaagaaaggactttctag

SEQ ID NO: 6946269 - DNA, 22 bp, Homo sapiens
agcattctcagaatgtcatttt

SEQ ID NO: 6946270 - DNA, 22 bp, Homo sapiens
agtgtcaactcggaataaggat

SEQ ID NO: 6946271 - DNA, 22 bp, Homo sapiens
ataggaatttcttcagcactga

SEQ ID NO: 6946272 - DNA, 22 bp, Homo sapiens
taggccaaatgacttgatgttt

SEQ ID NO: 6946273 - DNA, 22 bp, Homo sapiens
tctcagtgagcttttctatgtt

SEQ ID NO: 6946274 - DNA, 22 bp, Homo sapiens
catggaacttcaagaagaaagc

SEQ ID NO: 6946275 - DNA, 22 bp, Homo sapiens
catggcttgctagtggcccaag

SEQ ID NO: 6946276 - DNA, 22 bp, Homo sapiens
tcattgttaactcccagattca

SEQ ID NO: 6946277 - DNA, 22 bp, Homo sapiens
acccaggactctcttccagtag

SEQ ID NO: 6946278 - DNA, 22 bp, Homo sapiens
tgttctaagtgttttgttcatg

SEQ ID NO: 6946279 - DNA, 19 bp, Homo sapiens
cacaaatgatgaggacctg

SEQ ID NO: 6946280 - DNA, 21 bp, Homo sapiens
catctcagtgggttggtggat

SEQ ID NO: 6946281 - DNA, 22 bp, Homo sapiens
ggcgtaaggataatgatagctc

SEQ ID NO: 6946282 - DNA, 22 bp, Homo sapiens
gcgcacacgcgtgtgactcatc

SEQ ID NO: 6946283 - DNA, 22 bp, Homo sapiens
tttagtatataaaaagagaagt

SEQ ID NO: 6946284 - DNA, 23 bp, Homo sapiens
tgagcctgttaatactggctctg

SEQ ID NO: 6946285 - DNA, 22 bp, Homo sapiens
catgccatttggtggattgaga

SEQ ID NO: 6946286 - DNA, 22 bp, Homo sapiens
agttagcagcttattagaaaca

SEQ ID NO: 6946287 - DNA, 19 bp, Homo sapiens
tgagaaattccacaggatg

SEQ ID NO: 6946288 - DNA, 22 bp, Homo sapiens
tagtttctggttcttgctctgg

SEQ ID NO: 6946289 - DNA, 22 bp, Homo sapiens
agggctggcaagggattgaaat

SEQ ID NO: 6946290 - DNA, 22 bp, Homo sapiens
aggtgcagaaaaaagtccttta

SEQ ID NO: 6946291 - DNA, 22 bp, Homo sapiens
atggcagttgtatgggctgtat

SEQ ID NO: 6946292 - DNA, 22 bp, Homo sapiens
agcaggattttgaagtgcaagt

SEQ ID NO: 6946293 - DNA, 22 bp, Homo sapiens
gtgagcagcctcacctgagggt

SEQ ID NO: 6946294 - DNA, 22 bp, Homo sapiens
actgtttatagttttgagctga

SEQ ID NO: 6946295 - DNA, 22 bp, Homo sapiens
tacatgaacaaaatagcagaaa

SEQ ID NO: 6946296 - DNA, 22 bp, Homo sapiens
atttggagtagggcctgggtat

SEQ ID NO: 6946297 - DNA, 22 bp, Homo sapiens
tactctggaaaacagaaagttg

SEQ ID NO: 6946298 - DNA, 22 bp, Homo sapiens
gctgtgcaggtccccactgcct

SEQ ID NO: 6946299 - DNA, 22 bp, Homo sapiens
ttcagctcctttcttccaccag

SEQ ID NO: 6946300 - DNA, 22 bp, Homo sapiens
agcatagattctttcctttgcc

SEQ ID NO: 6946301 - DNA, 20 bp, Homo sapiens
ggaacatgaatgtgagtggc

SEQ ID NO: 6946302 - DNA, 22 bp, Homo sapiens
agccagtcggggccatgctggg

SEQ ID NO: 6946303 - DNA, 19 bp, Homo sapiens
aagctggcagaatattgcc

SEQ ID NO: 6946304 - DNA, 22 bp, Homo sapiens
gctttgcctgtagcattggcct

SEQ ID NO: 6946305 - DNA, 22 bp, Homo sapiens
tagcaagaccaatatgtagata

SEQ ID NO: 6946306 - DNA, 20 bp, Homo sapiens
gaaatgtacacattaccaca

SEQ ID NO: 6946307 - DNA, 22 bp, Homo sapiens
catggcaggtgtggggttttat

SEQ ID NO: 6946308 - DNA, 22 bp, Homo sapiens
gttttggtaggaaaagctaata

SEQ ID NO: 6946309 - DNA, 22 bp, Homo sapiens
ccaaggagctcatattcttgtt

SEQ ID NO: 6946310 - DNA, 22 bp, Homo sapiens
tccaggactataggaaagacac

SEQ ID NO: 6946311 - DNA, 22 bp, Homo sapiens
gacactttctcaggtaaagcat

SEQ ID NO: 6946312 - DNA, 22 bp, Homo sapiens
tcatgaggatttactagactag

SEQ ID NO: 6946313 - DNA, 22 bp, Homo sapiens
tctgcagccagaggcatgaaaa

SEQ ID NO: 6946314 - DNA, 22 bp, Homo sapiens
ggaatgaaacacttctgattct

SEQ ID NO: 6946315 - DNA, 22 bp, Homo sapiens
cagatttagagtggggcttgga

SEQ ID NO: 6946316 - DNA, 22 bp, Homo sapiens
aggtcaagggagctgagggcca

SEQ ID NO: 6946317 - DNA, 22 bp, Homo sapiens
cagtggcgtgatctctgctcac

SEQ ID NO: 6946318 - DNA, 22 bp, Homo sapiens
ttgaggcacagattttagtggc

SEQ ID NO: 6946319 - DNA, 22 bp, Homo sapiens
tgggagctcacaggcctggctc

SEQ ID NO: 6946320 - DNA, 22 bp, Homo sapiens
aaggctctgggtttcataggtg

SEQ ID NO: 6946321 - DNA, 22 bp, Homo sapiens
agtaacaaatgcatctgggcat

SEQ ID NO: 6946322 - DNA, 22 bp, Homo sapiens
gtgacactggtttaggtatgta

SEQ ID NO: 6946323 - DNA, 22 bp, Homo sapiens
tatggctttgggccaaatctac

SEQ ID NO: 6946324 - DNA, 22 bp, Homo sapiens
caattcattacattgcaaagac

SEQ ID NO: 6946325 - DNA, 22 bp, Homo sapiens
gaaatgacaaggacattcctgt

SEQ ID NO: 6946326 - DNA, 22 bp, Homo sapiens
acaaggctgctgtgattgggaa

SEQ ID NO: 6946327 - DNA, 22 bp, Homo sapiens
tttcttttccaatatccctact

SEQ ID NO: 6946328 - DNA, 22 bp, Homo sapiens
ctggctttggaacaaatcatag

SEQ ID NO: 6946329 - DNA, 20 bp, Homo sapiens
agaagtggctgcagacacta

SEQ ID NO: 6946330 - DNA, 22 bp, Homo sapiens
cagccaatctgcatatttcttt

SEQ ID NO: 6946331 - DNA, 22 bp, Homo sapiens
tagattctcagaattttagaaa

SEQ ID NO: 6946332 - DNA, 22 bp, Homo sapiens
gccaaaggattctatggagata

SEQ ID NO: 6946333 - DNA, 17 bp, Homo sapiens
agctgccagggagtgtg

SEQ ID NO: 6946334 - DNA, 21 bp, Homo sapiens
catgaagaatcaagacccttg

SEQ ID NO: 6946335 - DNA, 22 bp, Homo sapiens
aggcctggcctttatgttcaag

SEQ ID NO: 6946336 - DNA, 22 bp, Homo sapiens
tggaatgtagcaagtgttgtca

SEQ ID NO: 6946337 - DNA, 22 bp, Homo sapiens
cctccttctctttttgcagagc

SEQ ID NO: 6946338 - DNA, 22 bp, Homo sapiens
ttgcctattgttcttacatgtt

SEQ ID NO: 6946339 - DNA, 21 bp, Homo sapiens
atcagaagttttggtcagtag

SEQ ID NO: 6946340 - DNA, 22 bp, Homo sapiens
actaaacattcttgtctctcaa

SEQ ID NO: 6946341 - DNA, 23 bp, Homo sapiens
tagacataagctctgtcaccttc

SEQ ID NO: 6946342 - DNA, 22 bp, Homo sapiens
ccaggcctagcccctgagggta

SEQ ID NO: 6946343 - DNA, 22 bp, Homo sapiens
cctctgagccacatgcgtttgt

SEQ ID NO: 6946344 - DNA, 22 bp, Homo sapiens
aatggctgatgtttctgatgac

SEQ ID NO: 6946345 - DNA, 22 bp, Homo sapiens
gtgtgcgccgacacagccaggt

SEQ ID NO: 6946346 - DNA, 22 bp, Homo sapiens
tcagggaaatagcagggctgaa

SEQ ID NO: 6946347 - DNA, 22 bp, Homo sapiens
caggaatgatattcgaggagat

SEQ ID NO: 6946348 - DNA, 22 bp, Homo sapiens
taagttctgaagaggcgaggta

SEQ ID NO: 6946349 - DNA, 22 bp, Homo sapiens
cattctccctattgaaaaagta

SEQ ID NO: 6946350 - DNA, 22 bp, Homo sapiens
agctctttaatcttagccccag

SEQ ID NO: 6946351 - DNA, 22 bp, Homo sapiens
ccttgaatctctgctctagaac

SEQ ID NO: 6946352 - DNA, 22 bp, Homo sapiens
caagaagtgtcagctttttaaa

SEQ ID NO: 6946353 - DNA, 22 bp, Homo sapiens
ttggcactctccctgcactggt

SEQ ID NO: 6946354 - DNA, 22 bp, Homo sapiens
gatttctttagctcatcagatc

SEQ ID NO: 6946355 - DNA, 22 bp, Homo sapiens
ctggcatggtgtatttgttcaa

SEQ ID NO: 6946356 - DNA, 22 bp, Homo sapiens
tctagaattcccttttgacaat

SEQ ID NO: 6946357 - DNA, 22 bp, Homo sapiens
aattgatgtctaccacatgcct

SEQ ID NO: 6946358 - DNA, 22 bp, Homo sapiens
gaggtttcttatcaagaaagct

SEQ ID NO: 6946359 - DNA, 22 bp, Homo sapiens
tagcaccacaatcaagatacag

SEQ ID NO: 6946360 - DNA, 22 bp, Homo sapiens
tgaacagctatcttgtcagtgt

SEQ ID NO: 6946361 - DNA, 22 bp, Homo sapiens
agcaagatgaaggattcaagac

SEQ ID NO: 6946362 - DNA, 22 bp, Homo sapiens
tccagagagaaaaacaagcttt

SEQ ID NO: 6946363 - DNA, 22 bp, Homo sapiens
atacacttgacctggagtgaag

SEQ ID NO: 6946364 - DNA, 22 bp, Homo sapiens
atggctgcccacgttggtgctt

SEQ ID NO: 6946365 - DNA, 22 bp, Homo sapiens
gtgcccttataatagagaccca

SEQ ID NO: 6946366 - DNA, 22 bp, Homo sapiens
tgtgtgtcagcccaagggcctt

SEQ ID NO: 6946367 - DNA, 22 bp, Homo sapiens
gaggtgagtggatcacgaggtc

SEQ ID NO: 6946368 - DNA, 22 bp, Homo sapiens
gcattgaaggacttccattata

SEQ ID NO: 6946369 - DNA, 23 bp, Homo sapiens
gggcttcattttaattcagctgc

SEQ ID NO: 6946370 - DNA, 22 bp, Homo sapiens
tctccaggagcaagtcacccag

SEQ ID NO: 6946371 - DNA, 22 bp, Homo sapiens
gtcctgctggcttcaggagatt

SEQ ID NO: 6946372 - DNA, 22 bp, Homo sapiens
agcaggctaaataataatacat

SEQ ID NO: 6946373 - DNA, 22 bp, Homo sapiens
ctttggcttgcactattacact

SEQ ID NO: 6946374 - DNA, 22 bp, Homo sapiens
tgcatacacatgtgcacatacg

SEQ ID NO: 6946375 - DNA, 22 bp, Homo sapiens
tatcatgtgcgcttattgattt

SEQ ID NO: 6946376 - DNA, 22 bp, Homo sapiens
tggagactgataaaggctattg

SEQ ID NO: 6946377 - DNA, 22 bp, Homo sapiens
ttcaacaacttggttcaaatgg

SEQ ID NO: 6946378 - DNA, 22 bp, Homo sapiens
ctctgggcaagtatgatagaaa

SEQ ID NO: 6946379 - DNA, 22 bp, Homo sapiens
tcaaaatgccgagtgcccaggt

SEQ ID NO: 6946380 - DNA, 22 bp, Homo sapiens
ttctataatgcaagccactgca

SEQ ID NO: 6946381 - DNA, 22 bp, Homo sapiens
ttccactggctttcagtgatct

SEQ ID NO: 6946382 - DNA, 22 bp, Homo sapiens
atggcttcgagtatatacatag

SEQ ID NO: 6946383 - DNA, 22 bp, Homo sapiens
gccctagggggaaccgaggact

SEQ ID NO: 6946384 - DNA, 22 bp, Homo sapiens
aaatgtgtgtatgtacatatat

SEQ ID NO: 6946385 - DNA, 22 bp, Homo sapiens
tgtttagagtctctgtcaacat

SEQ ID NO: 6946386 - DNA, 22 bp, Homo sapiens
ggagatgctatgtagtttggtt

SEQ ID NO: 6946387 - DNA, 20 bp, Homo sapiens
tttagaagaatgagcacttt

SEQ ID NO: 6946388 - DNA, 22 bp, Homo sapiens
tcaaatgccagtggtgtggatc

SEQ ID NO: 6946389 - DNA, 22 bp, Homo sapiens
tctgaggaagcagcaggaagtg

SEQ ID NO: 6946390 - DNA, 22 bp, Homo sapiens
tagatacatgaaatggcagata

SEQ ID NO: 6946391 - DNA, 22 bp, Homo sapiens
tgggaaagtgttgaggtgtctt

SEQ ID NO: 6946392 - DNA, 22 bp, Homo sapiens
caggaatgttgcatgtgatctt

SEQ ID NO: 6946393 - DNA, 19 bp, Homo sapiens
atcagtgcatgagtgctgt

SEQ ID NO: 6946394 - DNA, 22 bp, Homo sapiens
ttctacattgtgaagttcttta

SEQ ID NO: 6946395 - DNA, 22 bp, Homo sapiens
tttgtatgggcagaaattagat

SEQ ID NO: 6946396 - DNA, 22 bp, Homo sapiens
acaatgtgtttttatacatttg

SEQ ID NO: 6946397 - DNA, 22 bp, Homo sapiens
ccactctgatttcaagggagat

SEQ ID NO: 6946398 - DNA, 22 bp, Homo sapiens
tgggagctaattactccggttg

SEQ ID NO: 6946399 - DNA, 19 bp, Homo sapiens
caacagttgcaacactgtc

SEQ ID NO: 6946400 - DNA, 22 bp, Homo sapiens
tggcatgcggcaacacgtcggt

SEQ ID NO: 6946401 - DNA, 22 bp, Homo sapiens
gtcctggcccactggcaggctg

SEQ ID NO: 6946402 - DNA, 22 bp, Homo sapiens
taccatttgagagagaacataa

SEQ ID NO: 6946403 - DNA, 20 bp, Homo sapiens
ttgctttatcagacatgata

SEQ ID NO: 6946404 - DNA, 22 bp, Homo sapiens
acttttggctatgtccaatacc

SEQ ID NO: 6946405 - DNA, 22 bp, Homo sapiens
atgttacaattcaaaatgctgc

SEQ ID NO: 6946406 - DNA, 21 bp, Homo sapiens
atgtagggtttgccttctcta

SEQ ID NO: 6946407 - DNA, 22 bp, Homo sapiens
tcctgggcagcgggacgctcag

SEQ ID NO: 6946408 - DNA, 22 bp, Homo sapiens
acatgcgttggagattattagt

SEQ ID NO: 6946409 - DNA, 20 bp, Homo sapiens
cctcagtgtcctggactggg

SEQ ID NO: 6946410 - DNA, 22 bp, Homo sapiens
agcagctgaccagtgagtcctg

SEQ ID NO: 6946411 - DNA, 22 bp, Homo sapiens
ttgcataaatgcttaaaatttg

SEQ ID NO: 6946412 - DNA, 22 bp, Homo sapiens
atcagaataattagatttcaga

SEQ ID NO: 6946413 - DNA, 22 bp, Homo sapiens
gtgagcagttgtataaagactt

SEQ ID NO: 6946414 - DNA, 22 bp, Homo sapiens
atcagagtagttgttgcccaga

SEQ ID NO: 6946415 - DNA, 22 bp, Homo sapiens
gacatgatggaaaaaaatgctc

SEQ ID NO: 6946416 - DNA, 22 bp, Homo sapiens
cttctggaaacttttccaattt

SEQ ID NO: 6946417 - DNA, 22 bp, Homo sapiens
agaaatcatgactaagagcagt

SEQ ID NO: 6946418 - DNA, 21 bp, Homo sapiens
gattttaaagagactgccaca

SEQ ID NO: 6946419 - DNA, 22 bp, Homo sapiens
tctgagaagcgggagcctgtga

SEQ ID NO: 6946420 - DNA, 22 bp, Homo sapiens
agctgctctcactggacgcctg

SEQ ID NO: 6946421 - DNA, 22 bp, Homo sapiens
ttgcacccagtagtttaaattc

SEQ ID NO: 6946422 - DNA, 19 bp, Homo sapiens
cattttctcattgtgcccc

SEQ ID NO: 6946423 - DNA, 22 bp, Homo sapiens
agtgcttcttaaacctttctac

SEQ ID NO: 6946424 - DNA, 22 bp, Homo sapiens
aacaggtagggttttccttaga

SEQ ID NO: 6946425 - DNA, 22 bp, Homo sapiens
tttgggaagaggaatctctgga

SEQ ID NO: 6946426 - DNA, 20 bp, Homo sapiens
tttacattttgaaacagtga

SEQ ID NO: 6946427 - DNA, 22 bp, Homo sapiens
gctgggagggaggctataccct

SEQ ID NO: 6946428 - DNA, 22 bp, Homo sapiens
caggcatgggccatgggaagtg

SEQ ID NO: 6946429 - DNA, 22 bp, Homo sapiens
caggcattgtgacgagtgttct

SEQ ID NO: 6946430 - DNA, 22 bp, Homo sapiens
tccaggctaggtttacaggaca

SEQ ID NO: 6946431 - DNA, 22 bp, Homo sapiens
agacatgcttggaggagaagga

SEQ ID NO: 6946432 - DNA, 22 bp, Homo sapiens
ttatcagagtccccaaaagaaa

SEQ ID NO: 6946433 - DNA, 22 bp, Homo sapiens
ttaagtcatttctgattataga

SEQ ID NO: 6946434 - DNA, 22 bp, Homo sapiens
atatacagttttacagggtttc

SEQ ID NO: 6946435 - DNA, 22 bp, Homo sapiens
gcgggcgggggttcccaggtct

SEQ ID NO: 6946436 - DNA, 20 bp, Homo sapiens
accaatttcagaggtgcaga

SEQ ID NO: 6946437 - DNA, 22 bp, Homo sapiens
atcacatcacaggttgagctag

SEQ ID NO: 6946438 - DNA, 20 bp, Homo sapiens
actggctgcctggaatgcgc

SEQ ID NO: 6946439 - DNA, 22 bp, Homo sapiens
cagagaagaaagtgactataat

SEQ ID NO: 6946440 - DNA, 23 bp, Homo sapiens
aatgacacctcataggtaacttc

SEQ ID NO: 6946441 - DNA, 22 bp, Homo sapiens
gtggctcttgcatggggtctct

SEQ ID NO: 6946442 - DNA, 22 bp, Homo sapiens
tcagtgcacagagatttttgtt

SEQ ID NO: 6946443 - DNA, 22 bp, Homo sapiens
ctcgccccggcacagtgtccgt

SEQ ID NO: 6946444 - DNA, 22 bp, Homo sapiens
ttattgctgatagtgtttataa

SEQ ID NO: 6946445 - DNA, 22 bp, Homo sapiens
ctggggctgcagcgatcttcat

SEQ ID NO: 6946446 - DNA, 22 bp, Homo sapiens
tgtaaactgtagaaaatacttt

SEQ ID NO: 6946447 - DNA, 22 bp, Homo sapiens
cagtacagtaaagcaagctgaa

SEQ ID NO: 6946448 - DNA, 22 bp, Homo sapiens
ggtggctcagggctccaagcat

SEQ ID NO: 6946449 - DNA, 22 bp, Homo sapiens
tctcagctgactgctttcctcg

SEQ ID NO: 6946450 - DNA, 22 bp, Homo sapiens
tgaattaaaggaattcgaattc

SEQ ID NO: 6946451 - DNA, 22 bp, Homo sapiens
attgcatgccacttgtgttggt

SEQ ID NO: 6946452 - DNA, 22 bp, Homo sapiens
tactcccaccatggctgatttc

SEQ ID NO: 6946453 - DNA, 22 bp, Homo sapiens
ggaagccccagacccagagtct

SEQ ID NO: 6946454 - DNA, 21 bp, Homo sapiens
ttgagcatgtaccctttgcct

SEQ ID NO: 6946455 - DNA, 21 bp, Homo sapiens
cactcagggtatgtgccaggc

SEQ ID NO: 6946456 - DNA, 22 bp, Homo sapiens
catccgcatgcaagtgctgtcc

SEQ ID NO: 6946457 - DNA, 22 bp, Homo sapiens
cagccctggccccaggtggtct

SEQ ID NO: 6946458 - DNA, 22 bp, Homo sapiens
cagaacattccatgtgccctgc

SEQ ID NO: 6946459 - DNA, 22 bp, Homo sapiens
aaggcaatgagggagatagagt

SEQ ID NO: 6946460 - DNA, 22 bp, Homo sapiens
aaatgcatttttaattagaccc

SEQ ID NO: 6946461 - DNA, 19 bp, Homo sapiens
cagatgagaaaagtgaggt

SEQ ID NO: 6946462 - DNA, 22 bp, Homo sapiens
aatcggttgaacccaggaagtg

SEQ ID NO: 6946463 - DNA, 22 bp, Homo sapiens
gagtccagctcattgtctggga

SEQ ID NO: 6946464 - DNA, 22 bp, Homo sapiens
ttaaactgcagactcagtgttc

SEQ ID NO: 6946465 - DNA, 22 bp, Homo sapiens
tgccttcgtacatgcaacatgc

SEQ ID NO: 6946466 - DNA, 22 bp, Homo sapiens
gactctcaagcacaagtccacc

SEQ ID NO: 6946467 - DNA, 22 bp, Homo sapiens
tccttaataagtacttcattgt

SEQ ID NO: 6946468 - DNA, 22 bp, Homo sapiens
ctggtggaatggcagagggaac

SEQ ID NO: 6946469 - DNA, 22 bp, Homo sapiens
atctgcctggctccaggtgagc

SEQ ID NO: 6946470 - DNA, 22 bp, Homo sapiens
tgaagcagaggggtcttgagct

SEQ ID NO: 6946471 - DNA, 22 bp, Homo sapiens
actggccagaactaagtcacat

SEQ ID NO: 6946472 - DNA, 22 bp, Homo sapiens
gtattcttaaggattgagcaaa

SEQ ID NO: 6946473 - DNA, 22 bp, Homo sapiens
aaagtgcaatcagttagaccat

SEQ ID NO: 6946474 - DNA, 22 bp, Homo sapiens
gtgaagcatatgcttctctgcc

SEQ ID NO: 6946475 - DNA, 22 bp, Homo sapiens
ttgggtgggtcaggactcggag

SEQ ID NO: 6946476 - DNA, 22 bp, Homo sapiens
tatcaacattaatattttctgg

SEQ ID NO: 6946477 - DNA, 22 bp, Homo sapiens
agcttcttcaaagcaggaggcc

SEQ ID NO: 6946478 - DNA, 22 bp, Homo sapiens
atgtatgttagtgtattatcta

SEQ ID NO: 6946479 - DNA, 22 bp, Homo sapiens
ggacacagggctcactctctct

SEQ ID NO: 6946480 - DNA, 22 bp, Homo sapiens
ttgtcctgtttagggataagga

SEQ ID NO: 6946481 - DNA, 22 bp, Homo sapiens
gcaataaagattttactgtcag

SEQ ID NO: 6946482 - DNA, 22 bp, Homo sapiens
tccacagtggttgaactagtaa

SEQ ID NO: 6946483 - DNA, 22 bp, Homo sapiens
agaaagctggagtcaagcagag

SEQ ID NO: 6946484 - DNA, 22 bp, Homo sapiens
agggccagtaaatgtttcctca

SEQ ID NO: 6946485 - DNA, 22 bp, Homo sapiens
agtggtgatgacagcagtttct

SEQ ID NO: 6946486 - DNA, 22 bp, Homo sapiens
ccacttgacattttcattaaga

SEQ ID NO: 6946487 - DNA, 18 bp, Homo sapiens
cagctgcaggctcaggac

SEQ ID NO: 6946488 - DNA, 22 bp, Homo sapiens
tctgctgtgggtctatatttta

SEQ ID NO: 6946489 - DNA, 22 bp, Homo sapiens
agaggccccatgggatggcggt

SEQ ID NO: 6946490 - DNA, 22 bp, Homo sapiens
attccaaagacagaagcagctg

SEQ ID NO: 6946491 - DNA, 22 bp, Homo sapiens
tggctggaatatgtggagacca

SEQ ID NO: 6946492 - DNA, 22 bp, Homo sapiens
agctcactgcaacctccgcctc

SEQ ID NO: 6946493 - DNA, 22 bp, Homo sapiens
catttcggtagcttgaacttta

SEQ ID NO: 6946494 - DNA, 22 bp, Homo sapiens
ctttgcagaaataaacttgatg

SEQ ID NO: 6946495 - DNA, 22 bp, Homo sapiens
ctaagcaagaatgagtgcaaca

SEQ ID NO: 6946496 - DNA, 22 bp, Homo sapiens
atagatccagaaaatttattat

SEQ ID NO: 6946497 - DNA, 22 bp, Homo sapiens
tggcacaaaagtaattgcagtt

SEQ ID NO: 6946498 - DNA, 23 bp, Homo sapiens
gtgtggcagcgctgtggttagct

SEQ ID NO: 6946499 - DNA, 22 bp, Homo sapiens
ttggggtgtgtgaaattatgtc

SEQ ID NO: 6946500 - DNA, 22 bp, Homo sapiens
ggtcccaagtgcttttcctgca

SEQ ID NO: 6946501 - DNA, 22 bp, Homo sapiens
agaggtctgactcagcagatta

SEQ ID NO: 6946502 - DNA, 22 bp, Homo sapiens
catccccaattagcgcccagct

SEQ ID NO: 6946503 - DNA, 17 bp, Homo sapiens
gaggtaggaagtgagtc

SEQ ID NO: 6946504 - DNA, 22 bp, Homo sapiens
gccctctggcacagagatgcag

SEQ ID NO: 6946505 - DNA, 22 bp, Homo sapiens
acctggccatccagctggcatc

SEQ ID NO: 6946506 - DNA, 22 bp, Homo sapiens
tctgaggactattgcaatactt

SEQ ID NO: 6946507 - DNA, 22 bp, Homo sapiens
tgtcctttactgattgcttctg

SEQ ID NO: 6946508 - DNA, 22 bp, Homo sapiens
atttcaggagcagtttcagtgg

SEQ ID NO: 6946509 - DNA, 22 bp, Homo sapiens
caatgtcagaattacagttgat

SEQ ID NO: 6946510 - DNA, 22 bp, Homo sapiens
ctcctggctcgcccccagctga

SEQ ID NO: 6946511 - DNA, 22 bp, Homo sapiens
ctgcttaaaatgcagattctgt

SEQ ID NO: 6946512 - DNA, 22 bp, Homo sapiens
gtgcagctgcccaagcctgagc

SEQ ID NO: 6946513 - DNA, 22 bp, Homo sapiens
caagctggtatcagctagagcg

SEQ ID NO: 6946514 - DNA, 22 bp, Homo sapiens
gccactcacatgtaccagatgc

SEQ ID NO: 6946515 - DNA, 22 bp, Homo sapiens
aaggtattttctaatgtatact

SEQ ID NO: 6946516 - DNA, 22 bp, Homo sapiens
ctgggttaccatgaggaaatga

SEQ ID NO: 6946517 - DNA, 21 bp, Homo sapiens
aggaatccagttcgcaggttt

SEQ ID NO: 6946518 - DNA, 22 bp, Homo sapiens
tgagggactcccggccctgcca

SEQ ID NO: 6946519 - DNA, 22 bp, Homo sapiens
gggatttgaatcttgagttgag

SEQ ID NO: 6946520 - DNA, 22 bp, Homo sapiens
ggtatggagtctgagtttctag

SEQ ID NO: 6946521 - DNA, 22 bp, Homo sapiens
gtccttgagtaagtcatggtgg

SEQ ID NO: 6946522 - DNA, 19 bp, Homo sapiens
gagttattgccagggcatg

SEQ ID NO: 6946523 - DNA, 21 bp, Homo sapiens
aacatttggctggcttttgtg

SEQ ID NO: 6946524 - DNA, 22 bp, Homo sapiens
gatggccacatacatggctggg

SEQ ID NO: 6946525 - DNA, 22 bp, Homo sapiens
ctctggtgtcctttagaattta

SEQ ID NO: 6946526 - DNA, 22 bp, Homo sapiens
ggaaccagtggaatgatatgct

SEQ ID NO: 6946527 - DNA, 22 bp, Homo sapiens
accagctctctagccctggtcc

SEQ ID NO: 6946528 - DNA, 22 bp, Homo sapiens
tggatatgcccagggcacccta

SEQ ID NO: 6946529 - DNA, 22 bp, Homo sapiens
ttctacacagtgcgggttaaca

SEQ ID NO: 6946530 - DNA, 22 bp, Homo sapiens
atagggaaattgatgtcccgag

SEQ ID NO: 6946531 - DNA, 22 bp, Homo sapiens
cacatgggcttagcaggcaggg

SEQ ID NO: 6946532 - DNA, 22 bp, Homo sapiens
gactttatgaagagatgaccaa

SEQ ID NO: 6946533 - DNA, 20 bp, Homo sapiens
tcagagagagggtgccactt

SEQ ID NO: 6946534 - DNA, 22 bp, Homo sapiens
tttagagtctttaggagaaatg

SEQ ID NO: 6946535 - DNA, 21 bp, Homo sapiens
ttagacttgggtttttcctgg

SEQ ID NO: 6946536 - DNA, 22 bp, Homo sapiens
tgggcctggggcagcccaaatc

SEQ ID NO: 6946537 - DNA, 22 bp, Homo sapiens
taagcctgcatgaaccatgaga

SEQ ID NO: 6946538 - DNA, 22 bp, Homo sapiens
gctgcgtcgagacagcctggca

SEQ ID NO: 6946539 - DNA, 22 bp, Homo sapiens
gttaacataggagtttgttgta

SEQ ID NO: 6946540 - DNA, 22 bp, Homo sapiens
tagctgaagagggtattgtagg

SEQ ID NO: 6946541 - DNA, 22 bp, Homo sapiens
catgtttgtaggtcctgcttgc

SEQ ID NO: 6946542 - DNA, 18 bp, Homo sapiens
caaattctcattgatttc

SEQ ID NO: 6946543 - DNA, 22 bp, Homo sapiens
gccagtctccctcagtcctctg

SEQ ID NO: 6946544 - DNA, 22 bp, Homo sapiens
ataccctagagttggacagaat

SEQ ID NO: 6946545 - DNA, 23 bp, Homo sapiens
accaggagaaaagctttgcggga

SEQ ID NO: 6946546 - DNA, 22 bp, Homo sapiens
agtgtcaaatcagcatctgggt

SEQ ID NO: 6946547 - DNA, 22 bp, Homo sapiens
atgtttctgtcctacgagataa

SEQ ID NO: 6946548 - DNA, 22 bp, Homo sapiens
atttgttcagcattgaatttgg

SEQ ID NO: 6946549 - DNA, 22 bp, Homo sapiens
ggcttctgtcctctggatctgt

SEQ ID NO: 6946550 - DNA, 22 bp, Homo sapiens
ctgaaactgtcttcctagccat

SEQ ID NO: 6946551 - DNA, 22 bp, Homo sapiens
agtggtcctgcaaacccgtgtg

SEQ ID NO: 6946552 - DNA, 22 bp, Homo sapiens
aagtgacacctcttccctttcc

SEQ ID NO: 6946553 - DNA, 22 bp, Homo sapiens
ctctgcatgccacatgagtgac

SEQ ID NO: 6946554 - DNA, 22 bp, Homo sapiens
gttagtaggttgcaaatttgga

SEQ ID NO: 6946555 - DNA, 22 bp, Homo sapiens
gtcagcaaggtgcaagcggctg

SEQ ID NO: 6946556 - DNA, 22 bp, Homo sapiens
gcttgagggtctgagatccact

SEQ ID NO: 6946557 - DNA, 22 bp, Homo sapiens
gcagggttttatagatctcttc

SEQ ID NO: 6946558 - DNA, 22 bp, Homo sapiens
tgcgagagtggaaaggaagcct

SEQ ID NO: 6946559 - DNA, 22 bp, Homo sapiens
gagcctcgtggcggccactgcg

SEQ ID NO: 6946560 - DNA, 22 bp, Homo sapiens
agatcatagcacaaaagtgaca

SEQ ID NO: 6946561 - DNA, 22 bp, Homo sapiens
cccaaggggtgttgatggagga

SEQ ID NO: 6946562 - DNA, 22 bp, Homo sapiens
tgggcctcctggaagaatgtgg

SEQ ID NO: 6946563 - DNA, 22 bp, Homo sapiens
aggcagttgtagagagggctct

SEQ ID NO: 6946564 - DNA, 23 bp, Homo sapiens
tccagagctcatgctctcaacca

SEQ ID NO: 6946565 - DNA, 22 bp, Homo sapiens
ttgcattgcttggtcttcaaga

SEQ ID NO: 6946566 - DNA, 22 bp, Homo sapiens
tgtgtccttctgggagtcccag

SEQ ID NO: 6946567 - DNA, 22 bp, Homo sapiens
gagtctaagtagaatgtgaaaa

SEQ ID NO: 6946568 - DNA, 16 bp, Homo sapiens
gtgcaaaagtgaggag

SEQ ID NO: 6946569 - DNA, 22 bp, Homo sapiens
aaaatgacattccagtgatatt

SEQ ID NO: 6946570 - DNA, 22 bp, Homo sapiens
ttttggaatcatttacagagca

SEQ ID NO: 6946571 - DNA, 20 bp, Homo sapiens
tggctctcaccctgtgcgat

SEQ ID NO: 6946572 - DNA, 22 bp, Homo sapiens
ctcagcagaggcagtattcagt

SEQ ID NO: 6946573 - DNA, 22 bp, Homo sapiens
ggtcagctctttgggctggtgg

SEQ ID NO: 6946574 - DNA, 23 bp, Homo sapiens
tggaggaaacacatcagaagacc

SEQ ID NO: 6946575 - DNA, 22 bp, Homo sapiens
cctctgagcctgtgtgcggcac

SEQ ID NO: 6946576 - DNA, 21 bp, Homo sapiens
ggtcttccaaataaggagaaa

SEQ ID NO: 6946577 - DNA, 22 bp, Homo sapiens
cactggataaaaatttggaagt

SEQ ID NO: 6946578 - DNA, 18 bp, Homo sapiens
gctgcgtgggatgtgacc

SEQ ID NO: 6946579 - DNA, 22 bp, Homo sapiens
ctggagcctaggttgacctggg

SEQ ID NO: 6946580 - DNA, 22 bp, Homo sapiens
aggcacctggatcttggaattc

SEQ ID NO: 6946581 - DNA, 22 bp, Homo sapiens
ctaataacatgaactactttct

SEQ ID NO: 6946582 - DNA, 22 bp, Homo sapiens
tatctttgtgtcccttttgatg

SEQ ID NO: 6946583 - DNA, 22 bp, Homo sapiens
ttggccaaggacctttttggag

SEQ ID NO: 6946584 - DNA, 22 bp, Homo sapiens
gtgcattacatgtaataaaata

SEQ ID NO: 6946585 - DNA, 22 bp, Homo sapiens
gatcaggacatagctataggct

SEQ ID NO: 6946586 - DNA, 22 bp, Homo sapiens
actgcatgtaaggcaatatgtt

SEQ ID NO: 6946587 - DNA, 22 bp, Homo sapiens
tctggatttgagctcagttgta

SEQ ID NO: 6946588 - DNA, 22 bp, Homo sapiens
tgtggaagaacttcttgcttgg

SEQ ID NO: 6946589 - DNA, 20 bp, Homo sapiens
cccttttcacgaaaaggaga

SEQ ID NO: 6946590 - DNA, 22 bp, Homo sapiens
agccctgggaggccagcttgta

SEQ ID NO: 6946591 - DNA, 22 bp, Homo sapiens
ctggtcaggctgaactgccaca

SEQ ID NO: 6946592 - DNA, 22 bp, Homo sapiens
tgcaaatgcccatttattttct

SEQ ID NO: 6946593 - DNA, 22 bp, Homo sapiens
atgtaattgtggtttttgccat

SEQ ID NO: 6946594 - DNA, 22 bp, Homo sapiens
taagtttggggaaaatgttaag

SEQ ID NO: 6946595 - DNA, 19 bp, Homo sapiens
gcaggtgagccgtggctcc

SEQ ID NO: 6946596 - DNA, 22 bp, Homo sapiens
aggtccaggcatttgggttggg

SEQ ID NO: 6946597 - DNA, 21 bp, Homo sapiens
acatggaagagaaattaacca

SEQ ID NO: 6946598 - DNA, 22 bp, Homo sapiens
taacctgttaagggctgaccca

SEQ ID NO: 6946599 - DNA, 22 bp, Homo sapiens
tgtatgcacatatataggtaca

SEQ ID NO: 6946600 - DNA, 22 bp, Homo sapiens
gctccagccacatggtagaagg

SEQ ID NO: 6946601 - DNA, 22 bp, Homo sapiens
ctcagctctgtcacttactagc

SEQ ID NO: 6946602 - DNA, 22 bp, Homo sapiens
ctggcacatagtaggtgcacag

SEQ ID NO: 6946603 - DNA, 22 bp, Homo sapiens
tccagctgacacttaaggggag

SEQ ID NO: 6946604 - DNA, 22 bp, Homo sapiens
aaattgcgcacatttctccgtt

SEQ ID NO: 6946605 - DNA, 22 bp, Homo sapiens
atggaaagccagtgttccatca

SEQ ID NO: 6946606 - DNA, 22 bp, Homo sapiens
gtggccaaggtgcagagcagct

SEQ ID NO: 6946607 - DNA, 22 bp, Homo sapiens
tgctgtgctggcggcagaggcc

SEQ ID NO: 6946608 - DNA, 22 bp, Homo sapiens
gaaggcaagcagcataaatgtc

SEQ ID NO: 6946609 - DNA, 20 bp, Homo sapiens
atgaaattcctgttttctga

SEQ ID NO: 6946610 - DNA, 22 bp, Homo sapiens
tgacccttggtcagagtgccct

SEQ ID NO: 6946611 - DNA, 22 bp, Homo sapiens
gcagcactaatgggccccagaa

SEQ ID NO: 6946612 - DNA, 22 bp, Homo sapiens
agcatattcatgccagactact

SEQ ID NO: 6946613 - DNA, 22 bp, Homo sapiens
aaggtggtaggctatatcagta

SEQ ID NO: 6946614 - DNA, 22 bp, Homo sapiens
attaaaagcttcccaagagtta

SEQ ID NO: 6946615 - DNA, 22 bp, Homo sapiens
ttcttagtagcatagctatatt

SEQ ID NO: 6946616 - DNA, 22 bp, Homo sapiens
acaagcatgtggtaaaaagacc

SEQ ID NO: 6946617 - DNA, 22 bp, Homo sapiens
cctgtctggggactccctgggt

SEQ ID NO: 6946618 - DNA, 22 bp, Homo sapiens
atgtatgctttgattttagatg

SEQ ID NO: 6946619 - DNA, 22 bp, Homo sapiens
tgcccagcagggagctacctgg

SEQ ID NO: 6946620 - DNA, 22 bp, Homo sapiens
agctggaggagtttctcctagc

SEQ ID NO: 6946621 - DNA, 22 bp, Homo sapiens
ataacagactgatttttaaatg

SEQ ID NO: 6946622 - DNA, 22 bp, Homo sapiens
caggctcagtcagaaaatgtat

SEQ ID NO: 6946623 - DNA, 19 bp, Homo sapiens
ccccacttccatgggctcc

SEQ ID NO: 6946624 - DNA, 22 bp, Homo sapiens
tttggcaccaaaggagaagatc

SEQ ID NO: 6946625 - DNA, 22 bp, Homo sapiens
atgcttaggttaaatttgtaat

SEQ ID NO: 6946626 - DNA, 19 bp, Homo sapiens
aggtcttgactctgttctt

SEQ ID NO: 6946627 - DNA, 22 bp, Homo sapiens
tggaaactagagagtttgtatt

SEQ ID NO: 6946628 - DNA, 22 bp, Homo sapiens
ttgtctgcttgatgccaagcat

SEQ ID NO: 6946629 - DNA, 22 bp, Homo sapiens
gggcctgtgtgttcaggagcct

SEQ ID NO: 6946630 - DNA, 22 bp, Homo sapiens
cactgtggaattagaataacct

SEQ ID NO: 6946631 - DNA, 22 bp, Homo sapiens
acagtggcatctacttaatctg

SEQ ID NO: 6946632 - DNA, 22 bp, Homo sapiens
ggtgggatgcctctggagaagt

SEQ ID NO: 6946633 - DNA, 20 bp, Homo sapiens
actgccttggttcagtaggt

SEQ ID NO: 6946634 - DNA, 22 bp, Homo sapiens
atcttgtgtgatgatgagaaag

SEQ ID NO: 6946635 - DNA, 22 bp, Homo sapiens
ctcacccatatctccatgactc

SEQ ID NO: 6946636 - DNA, 22 bp, Homo sapiens
aatgcctcttttctccagtcca

SEQ ID NO: 6946637 - DNA, 22 bp, Homo sapiens
ctattagaaagcatcttctata

SEQ ID NO: 6946638 - DNA, 22 bp, Homo sapiens
cactgtctgcttcgactcttca

SEQ ID NO: 6946639 - DNA, 22 bp, Homo sapiens
agcagccttgcaggggtcgcac

SEQ ID NO: 6946640 - DNA, 23 bp, Homo sapiens
tctgtcactttctgctgtggagt

SEQ ID NO: 6946641 - DNA, 20 bp, Homo sapiens
gcattgttgtagtagattgt

SEQ ID NO: 6946642 - DNA, 22 bp, Homo sapiens
tcctgtgtgggcaggatgagaa

SEQ ID NO: 6946643 - DNA, 19 bp, Homo sapiens
tttctgttagaaggataca

SEQ ID NO: 6946644 - DNA, 22 bp, Homo sapiens
ttgctggcttgaagatagagga

SEQ ID NO: 6946645 - DNA, 22 bp, Homo sapiens
tatctgtttctgaggatacatg

SEQ ID NO: 6946646 - DNA, 22 bp, Homo sapiens
ggattcagggtaaagtttcagt

SEQ ID NO: 6946647 - DNA, 22 bp, Homo sapiens
atctacccactgaacacaatat

SEQ ID NO: 6946648 - DNA, 22 bp, Homo sapiens
gtatgtgcaattcactgtgaga

SEQ ID NO: 6946649 - DNA, 22 bp, Homo sapiens
ctgctctgttaattaaactttg

SEQ ID NO: 6946650 - DNA, 20 bp, Homo sapiens
gccaaggaggagaaacaggc

SEQ ID NO: 6946651 - DNA, 22 bp, Homo sapiens
cttcaggagtagttacctagca

SEQ ID NO: 6946652 - DNA, 22 bp, Homo sapiens
tgtcaaatttttattgcagtat

SEQ ID NO: 6946653 - DNA, 22 bp, Homo sapiens
gagttagaagacagaatgtaaa

SEQ ID NO: 6946654 - DNA, 22 bp, Homo sapiens
gactatttataatgctgcagaa

SEQ ID NO: 6946655 - DNA, 22 bp, Homo sapiens
ctctgagtagatagggaacctg

SEQ ID NO: 6946656 - DNA, 22 bp, Homo sapiens
ttgcaaatgtggttagggcttt

SEQ ID NO: 6946657 - DNA, 20 bp, Homo sapiens
cagcagtggatgagagtttt

SEQ ID NO: 6946658 - DNA, 22 bp, Homo sapiens
tggtttaatttccatttccttg

SEQ ID NO: 6946659 - DNA, 22 bp, Homo sapiens
gaacaggctggagtagcacaga

SEQ ID NO: 6946660 - DNA, 22 bp, Homo sapiens
aaacagtctgatgccatctgcc

SEQ ID NO: 6946661 - DNA, 22 bp, Homo sapiens
tccttaacaagatggcatttgt

SEQ ID NO: 6946662 - DNA, 22 bp, Homo sapiens
acagatcacttgactaaaatga

SEQ ID NO: 6946663 - DNA, 22 bp, Homo sapiens
aattcaaggatctgttaaatct

SEQ ID NO: 6946664 - DNA, 22 bp, Homo sapiens
tgtcatggggaaaataacagac

SEQ ID NO: 6946665 - DNA, 22 bp, Homo sapiens
atatgtttcagtattcaagtca

SEQ ID NO: 6946666 - DNA, 22 bp, Homo sapiens
tggggcctgcacaggctgaatg

SEQ ID NO: 6946667 - DNA, 22 bp, Homo sapiens
catcacaaaatgattattccct

SEQ ID NO: 6946668 - DNA, 22 bp, Homo sapiens
aagggttgcaaggtcagaggaa

SEQ ID NO: 6946669 - DNA, 22 bp, Homo sapiens
aaaattattcatggcttttgga

SEQ ID NO: 6946670 - DNA, 22 bp, Homo sapiens
ggagccctcaccggcgagtgcc

SEQ ID NO: 6946671 - DNA, 22 bp, Homo sapiens
gcaggtagcattttttgacaaa

SEQ ID NO: 6946672 - DNA, 23 bp, Homo sapiens
aagttctattagtgctggtctag

SEQ ID NO: 6946673 - DNA, 22 bp, Homo sapiens
tcagataaaggagagcttagca

SEQ ID NO: 6946674 - DNA, 22 bp, Homo sapiens
cttacagagaagaaaatgtagt

SEQ ID NO: 6946675 - DNA, 22 bp, Homo sapiens
taggctttgtgttttgggaaca

SEQ ID NO: 6946676 - DNA, 22 bp, Homo sapiens
ctgagcagtgctttgcagtggg

SEQ ID NO: 6946677 - DNA, 22 bp, Homo sapiens
tgcttctgctcagcttcctact

SEQ ID NO: 6946678 - DNA, 22 bp, Homo sapiens
cttctcctgtaagaagatcaaa

SEQ ID NO: 6946679 - DNA, 22 bp, Homo sapiens
actttggatctgatgtaatcag

SEQ ID NO: 6946680 - DNA, 22 bp, Homo sapiens
gtgctggaactgtgctaagaga

SEQ ID NO: 6946681 - DNA, 22 bp, Homo sapiens
tctgcaggcatttttggttgtc

SEQ ID NO: 6946682 - DNA, 22 bp, Homo sapiens
aaaatatgactgtgctccttaa

SEQ ID NO: 6946683 - DNA, 22 bp, Homo sapiens
tccaatggggcctctctgtcag

SEQ ID NO: 6946684 - DNA, 22 bp, Homo sapiens
gattcctgctattcacagggct

SEQ ID NO: 6946685 - DNA, 22 bp, Homo sapiens
gaggccacttcctactggagga

SEQ ID NO: 6946686 - DNA, 22 bp, Homo sapiens
gctgggtcccaagcctggggag

SEQ ID NO: 6946687 - DNA, 22 bp, Homo sapiens
ctttagtttgctgtcccctggg

SEQ ID NO: 6946688 - DNA, 22 bp, Homo sapiens
acattcttccagctggctgttg

SEQ ID NO: 6946689 - DNA, 22 bp, Homo sapiens
ggccaaatcctccatggtggct

SEQ ID NO: 6946690 - DNA, 22 bp, Homo sapiens
caagcagaaatctagaactcca

SEQ ID NO: 6946691 - DNA, 22 bp, Homo sapiens
tggtcagagcaactttcctaga

SEQ ID NO: 6946692 - DNA, 22 bp, Homo sapiens
tcaagtaacatgaacacacaga

SEQ ID NO: 6946693 - DNA, 22 bp, Homo sapiens
gctgtccaggagtgcagagatt

SEQ ID NO: 6946694 - DNA, 22 bp, Homo sapiens
actgcacttcagcctgggtgtc

SEQ ID NO: 6946695 - DNA, 22 bp, Homo sapiens
gtcattgggggccatctcagag

SEQ ID NO: 6946696 - DNA, 22 bp, Homo sapiens
cgtcaggtgtgattatttttca

SEQ ID NO: 6946697 - DNA, 22 bp, Homo sapiens
agtgtttctaagtagatgtgaa

SEQ ID NO: 6946698 - DNA, 22 bp, Homo sapiens
ccacttttttctccatctctga

SEQ ID NO: 6946699 - DNA, 22 bp, Homo sapiens
aaatggtaagacaacacattat

SEQ ID NO: 6946700 - DNA, 22 bp, Homo sapiens
tgaagtgaagaagcatgaatag

SEQ ID NO: 6946701 - DNA, 22 bp, Homo sapiens
gcctcctggaagtcacatgttt

SEQ ID NO: 6946702 - DNA, 22 bp, Homo sapiens
tcagtgttcgctcagggactcc

SEQ ID NO: 6946703 - DNA, 21 bp, Homo sapiens
caggctctgctagaggagcct

SEQ ID NO: 6946704 - DNA, 22 bp, Homo sapiens
ttgccctgcgggtcctgcgcaa

SEQ ID NO: 6946705 - DNA, 22 bp, Homo sapiens
ttccttgttcctaggagatcaa

SEQ ID NO: 6946706 - DNA, 22 bp, Homo sapiens
attttggctgtcagggtattat

SEQ ID NO: 6946707 - DNA, 22 bp, Homo sapiens
gatctctgaatctgaagccttc

SEQ ID NO: 6946708 - DNA, 22 bp, Homo sapiens
gtttccatgaaaatgtttctgc

SEQ ID NO: 6946709 - DNA, 19 bp, Homo sapiens
tgcttgcctgcctttccca

SEQ ID NO: 6946710 - DNA, 22 bp, Homo sapiens
gtgtctactgatctgattcaga

SEQ ID NO: 6946711 - DNA, 22 bp, Homo sapiens
ctctgcacacaagtaatttcat

SEQ ID NO: 6946712 - DNA, 19 bp, Homo sapiens
agctgtggatgtgggattt

SEQ ID NO: 6946713 - DNA, 22 bp, Homo sapiens
agagacctttctcctgcctttc

SEQ ID NO: 6946714 - DNA, 22 bp, Homo sapiens
ctccagaggccctatcccacta

SEQ ID NO: 6946715 - DNA, 22 bp, Homo sapiens
cctgtacacaattccgaggata

SEQ ID NO: 6946716 - DNA, 22 bp, Homo sapiens
tgctgtatttatggccactgaa

SEQ ID NO: 6946717 - DNA, 22 bp, Homo sapiens
actagaaaattcctagaaacta

SEQ ID NO: 6946718 - DNA, 22 bp, Homo sapiens
aacagctgtatactgtagctgt

SEQ ID NO: 6946719 - DNA, 22 bp, Homo sapiens
atagttctcactcagaatttga

SEQ ID NO: 6946720 - DNA, 22 bp, Homo sapiens
tcagtggattgacatgaaaaag

SEQ ID NO: 6946721 - DNA, 22 bp, Homo sapiens
acaggcacaactgagtagactc

SEQ ID NO: 6946722 - DNA, 22 bp, Homo sapiens
tttcagttgtcctgttaatagc

SEQ ID NO: 6946723 - DNA, 22 bp, Homo sapiens
ccaggcctcctgtgagtggacc

SEQ ID NO: 6946724 - DNA, 22 bp, Homo sapiens
tgggcacaggggtaggaatgag

SEQ ID NO: 6946725 - DNA, 22 bp, Homo sapiens
tcagttaagcactataccctaa

SEQ ID NO: 6946726 - DNA, 22 bp, Homo sapiens
caaggcctgcctctggcagaaa

SEQ ID NO: 6946727 - DNA, 22 bp, Homo sapiens
agcccaggtctggcccagcctg

SEQ ID NO: 6946728 - DNA, 22 bp, Homo sapiens
tgcttcaaggacactgactttt

SEQ ID NO: 6946729 - DNA, 22 bp, Homo sapiens
aggtgcagtgtttaaaagtagc

SEQ ID NO: 6946730 - DNA, 22 bp, Homo sapiens
ttcaaacaaaactgttcccata

SEQ ID NO: 6946731 - DNA, 18 bp, Homo sapiens
tggttccttgaaggggca

SEQ ID NO: 6946732 - DNA, 22 bp, Homo sapiens
tttcaacttgaagaattgatac

SEQ ID NO: 6946733 - DNA, 19 bp, Homo sapiens
ctctccagctccagtagct

SEQ ID NO: 6946734 - DNA, 22 bp, Homo sapiens
aggctgtgggagttgagagtct

SEQ ID NO: 6946735 - DNA, 22 bp, Homo sapiens
attaatgaaactttggttaagc

SEQ ID NO: 6946736 - DNA, 23 bp, Homo sapiens
ccagtttatctttagtgtagatc

SEQ ID NO: 6946737 - DNA, 22 bp, Homo sapiens
agtgcacagcgtgatgtattgg

SEQ ID NO: 6946738 - DNA, 22 bp, Homo sapiens
ttaggctgggctacaacaactg

SEQ ID NO: 6946739 - DNA, 22 bp, Homo sapiens
ctggtttagctgtaaggttccc

SEQ ID NO: 6946740 - DNA, 22 bp, Homo sapiens
caggcttgattattcagacaat

SEQ ID NO: 6946741 - DNA, 22 bp, Homo sapiens
tcacaatgaaaaacactacata

SEQ ID NO: 6946742 - DNA, 22 bp, Homo sapiens
ccccaaagctgagttcccgcct

SEQ ID NO: 6946743 - DNA, 22 bp, Homo sapiens
cagagcagtgaggagttgtgta

SEQ ID NO: 6946744 - DNA, 22 bp, Homo sapiens
gtgcctctcagctgttcacaat

SEQ ID NO: 6946745 - DNA, 22 bp, Homo sapiens
acagtctcaagatggcctctct

SEQ ID NO: 6946746 - DNA, 23 bp, Homo sapiens
tgcatgctaacacagtgcacagg

SEQ ID NO: 6946747 - DNA, 22 bp, Homo sapiens
agatgctgccaggcccctcagt

SEQ ID NO: 6946748 - DNA, 22 bp, Homo sapiens
ggggcacacttttggtagatat

SEQ ID NO: 6946749 - DNA, 22 bp, Homo sapiens
tgtcttcagtaaaatacactat

SEQ ID NO: 6946750 - DNA, 22 bp, Homo sapiens
agcagaacctgcagacctgtct

SEQ ID NO: 6946751 - DNA, 22 bp, Homo sapiens
gggctctgcctggctgggagta

SEQ ID NO: 6946752 - DNA, 22 bp, Homo sapiens
tctggcatagtgagagctttta

SEQ ID NO: 6946753 - DNA, 22 bp, Homo sapiens
tcagacctggccgcctccatcc

SEQ ID NO: 6946754 - DNA, 22 bp, Homo sapiens
aagttcttagacaagcttgtgg

SEQ ID NO: 6946755 - DNA, 20 bp, Homo sapiens
gtcatcgccggcagcaaaga

SEQ ID NO: 6946756 - DNA, 20 bp, Homo sapiens
tgtttcttttaatgagcggc

SEQ ID NO: 6946757 - DNA, 23 bp, Homo sapiens
aggcaagaacgggttgttcaccc

SEQ ID NO: 6946758 - DNA, 22 bp, Homo sapiens
tccctggggcagtggctcggag

SEQ ID NO: 6946759 - DNA, 22 bp, Homo sapiens
tctctaataatggagagaagca

SEQ ID NO: 6946760 - DNA, 22 bp, Homo sapiens
cagatgtggaatgcagcaggct

SEQ ID NO: 6946761 - DNA, 18 bp, Homo sapiens
tccaggcgttgctttctc

SEQ ID NO: 6946762 - DNA, 22 bp, Homo sapiens
ggcatgctctgggggtcctccg

SEQ ID NO: 6946763 - DNA, 22 bp, Homo sapiens
aaagcatttcatgtctagaaag

SEQ ID NO: 6946764 - DNA, 19 bp, Homo sapiens
gcaggtggatgtggtcagc

SEQ ID NO: 6946765 - DNA, 22 bp, Homo sapiens
tcttctcatagctagttcttcc

SEQ ID NO: 6946766 - DNA, 22 bp, Homo sapiens
ttaggaagttatagtggaaatg

SEQ ID NO: 6946767 - DNA, 22 bp, Homo sapiens
gctggtcccaatgtgtttcctt

SEQ ID NO: 6946768 - DNA, 22 bp, Homo sapiens
ctgggcctaacccacagcgttt

SEQ ID NO: 6946769 - DNA, 22 bp, Homo sapiens
gcaaagtattaagtattaagtt

SEQ ID NO: 6946770 - DNA, 22 bp, Homo sapiens
tgcaagcactcaatgcaaacag

SEQ ID NO: 6946771 - DNA, 22 bp, Homo sapiens
tcacattttcatattctctgag

SEQ ID NO: 6946772 - DNA, 22 bp, Homo sapiens
tgcttccaattcaaatctgtgg

SEQ ID NO: 6946773 - DNA, 22 bp, Homo sapiens
tcagtgtcagtcttttagatat

SEQ ID NO: 6946774 - DNA, 22 bp, Homo sapiens
gaagttaggctttcctatgctt

SEQ ID NO: 6946775 - DNA, 22 bp, Homo sapiens
aggagacagaatttaaatttgg

SEQ ID NO: 6946776 - DNA, 22 bp, Homo sapiens
tgggttctttcacttctcagtt

SEQ ID NO: 6946777 - DNA, 22 bp, Homo sapiens
acaggtgtaaaacccaggatgg

SEQ ID NO: 6946778 - DNA, 22 bp, Homo sapiens
gctgtctccatagctgtgtgtc

SEQ ID NO: 6946779 - DNA, 22 bp, Homo sapiens
agttattgagtgcagagcaggg

SEQ ID NO: 6946780 - DNA, 22 bp, Homo sapiens
aagacattccaaagtggctaat

SEQ ID NO: 6946781 - DNA, 22 bp, Homo sapiens
atgaatattgaatgtcttatga

SEQ ID NO: 6946782 - DNA, 22 bp, Homo sapiens
acttatccatgtctatatgttg

SEQ ID NO: 6946783 - DNA, 22 bp, Homo sapiens
ttcagaggacaaccagccatct

SEQ ID NO: 6946784 - DNA, 22 bp, Homo sapiens
tctgagctgtggccattcttcc

SEQ ID NO: 6946785 - DNA, 22 bp, Homo sapiens
tcacactgtgaagagacaagca

SEQ ID NO: 6946786 - DNA, 22 bp, Homo sapiens
attcagtctcatcaaattcact

SEQ ID NO: 6946787 - DNA, 20 bp, Homo sapiens
acgatggtgatggtacatcc

SEQ ID NO: 6946788 - DNA, 22 bp, Homo sapiens
tttcttatgtgcagagtgagta

SEQ ID NO: 6946789 - DNA, 22 bp, Homo sapiens
taggaagggaaaggcttcaact

SEQ ID NO: 6946790 - DNA, 22 bp, Homo sapiens
agccaggccagactcacaccct

SEQ ID NO: 6946791 - DNA, 22 bp, Homo sapiens
ttaatatacaattttacgggct

SEQ ID NO: 6946792 - DNA, 22 bp, Homo sapiens
gcagaggtctcttcaaaataat

SEQ ID NO: 6946793 - DNA, 23 bp, Homo sapiens
agcataaacctctgtggctttag

SEQ ID NO: 6946794 - DNA, 16 bp, Homo sapiens
cctgtgtctatcaggt

SEQ ID NO: 6946795 - DNA, 19 bp, Homo sapiens
tcagtgtgtgggaggtggt

SEQ ID NO: 6946796 - DNA, 23 bp, Homo sapiens
atcccctgccttgggtgagtccc

SEQ ID NO: 6946797 - DNA, 22 bp, Homo sapiens
cggtgcggtgattgggtaggtc

SEQ ID NO: 6946798 - DNA, 22 bp, Homo sapiens
caggccctcaggcaagggctct

SEQ ID NO: 6946799 - DNA, 22 bp, Homo sapiens
ttgtactgcacccctgggaatg

SEQ ID NO: 6946800 - DNA, 22 bp, Homo sapiens
ttccttgggttctgatgtgttt

SEQ ID NO: 6946801 - DNA, 19 bp, Homo sapiens
tgagacagagaccagttct

SEQ ID NO: 6946802 - DNA, 22 bp, Homo sapiens
gagctttaggagaaggaggtca

SEQ ID NO: 6946803 - DNA, 22 bp, Homo sapiens
tcagcaagtggaccatcctggg

SEQ ID NO: 6946804 - DNA, 17 bp, Homo sapiens
tgcagctgctcccaggc

SEQ ID NO: 6946805 - DNA, 22 bp, Homo sapiens
tctgtccaggtcagcctacatt

SEQ ID NO: 6946806 - DNA, 21 bp, Homo sapiens
tgaaatgagaatgctgagcac

SEQ ID NO: 6946807 - DNA, 20 bp, Homo sapiens
gggcaaggaaacagccccca

SEQ ID NO: 6946808 - DNA, 22 bp, Homo sapiens
gtgagagatcccccactcatct

SEQ ID NO: 6946809 - DNA, 23 bp, Homo sapiens
gaggccacattcccctgcttgag

SEQ ID NO: 6946810 - DNA, 22 bp, Homo sapiens
ctgtggaacttagtgggagaca

SEQ ID NO: 6946811 - DNA, 22 bp, Homo sapiens
gtatgtcatctgttacccatca

SEQ ID NO: 6946812 - DNA, 22 bp, Homo sapiens
tgatgacaggcagggttaagtg

SEQ ID NO: 6946813 - DNA, 22 bp, Homo sapiens
agcttccctagcagttctaaac

SEQ ID NO: 6946814 - DNA, 22 bp, Homo sapiens
tctccatacttgcctttggcct

SEQ ID NO: 6946815 - DNA, 22 bp, Homo sapiens
tccacgtgagcttcgtgtgcag

SEQ ID NO: 6946816 - DNA, 20 bp, Homo sapiens
aggtcctgggactggcagag

SEQ ID NO: 6946817 - DNA, 22 bp, Homo sapiens
tctggagaagcccagggagctg

SEQ ID NO: 6946818 - DNA, 22 bp, Homo sapiens
cacaagagagtgcgcgttgcaa

SEQ ID NO: 6946819 - DNA, 22 bp, Homo sapiens
gctgtgctgtttccacctctct

SEQ ID NO: 6946820 - DNA, 22 bp, Homo sapiens
tgggaagctttaaatgggtgtc

SEQ ID NO: 6946821 - DNA, 22 bp, Homo sapiens
gcattgcaaaaagcagcttgat

SEQ ID NO: 6946822 - DNA, 22 bp, Homo sapiens
tcatgaacatctcaaataacca

SEQ ID NO: 6946823 - DNA, 22 bp, Homo sapiens
tacagacatttactccactcct

SEQ ID NO: 6946824 - DNA, 18 bp, Homo sapiens
tccccttccaggaagtca

SEQ ID NO: 6946825 - DNA, 22 bp, Homo sapiens
tctgcatctgtgttgagtgccc

SEQ ID NO: 6946826 - DNA, 22 bp, Homo sapiens
gtctggtgggattccaagtggc

SEQ ID NO: 6946827 - DNA, 22 bp, Homo sapiens
gtccttggaaagtctaatctct

SEQ ID NO: 6946828 - DNA, 22 bp, Homo sapiens
ttcaaaggaaaggcagtgtcaa

SEQ ID NO: 6946829 - DNA, 22 bp, Homo sapiens
tgtccttggccagtttctggtg

SEQ ID NO: 6946830 - DNA, 22 bp, Homo sapiens
tctagaactccagttaggcaat

SEQ ID NO: 6946831 - DNA, 22 bp, Homo sapiens
agtgtgcttcactgggaggtga

SEQ ID NO: 6946832 - DNA, 22 bp, Homo sapiens
atcagggtcttctttcagccta

SEQ ID NO: 6946833 - DNA, 22 bp, Homo sapiens
ggtccttgcttcggtccagtac

SEQ ID NO: 6946834 - DNA, 22 bp, Homo sapiens
agcctctctttctggtggctaa

SEQ ID NO: 6946835 - DNA, 22 bp, Homo sapiens
ttggtataacagatgacttacg

SEQ ID NO: 6946836 - DNA, 22 bp, Homo sapiens
ttcacaatctggcttagcattg

SEQ ID NO: 6946837 - DNA, 22 bp, Homo sapiens
cagcttctatttatctttgtgt

SEQ ID NO: 6946838 - DNA, 22 bp, Homo sapiens
taacactgccatgctggagtca

SEQ ID NO: 6946839 - DNA, 22 bp, Homo sapiens
ctgagtctcccggcagtggagg

SEQ ID NO: 6946840 - DNA, 22 bp, Homo sapiens
tgaagctgtaggcatgggcagc

SEQ ID NO: 6946841 - DNA, 22 bp, Homo sapiens
caatttctcgaactctaatcca

SEQ ID NO: 6946842 - DNA, 22 bp, Homo sapiens
actttggtctctgcccctggtg

SEQ ID NO: 6946843 - DNA, 22 bp, Homo sapiens
ggagtcagaggaaggcttgctc

SEQ ID NO: 6946844 - DNA, 22 bp, Homo sapiens
actgtattggttttctattgct

SEQ ID NO: 6946845 - DNA, 22 bp, Homo sapiens
ccaggctctgacatagatggga

SEQ ID NO: 6946846 - DNA, 22 bp, Homo sapiens
aggagtgtgaagagcctagatc

SEQ ID NO: 6946847 - DNA, 22 bp, Homo sapiens
acacaggttccatctccacctt

SEQ ID NO: 6946848 - DNA, 22 bp, Homo sapiens
agtccaaggagagacagcattt

SEQ ID NO: 6946849 - DNA, 22 bp, Homo sapiens
agggacgccgtgcgggaccgtg

SEQ ID NO: 6946850 - DNA, 22 bp, Homo sapiens
aagtgctcagtatcctcatgtg

SEQ ID NO: 6946851 - DNA, 22 bp, Homo sapiens
cctgggacctcgcgggaagcgg

SEQ ID NO: 6946852 - DNA, 22 bp, Homo sapiens
tgctgccttgacctcctgggct

SEQ ID NO: 6946853 - DNA, 22 bp, Homo sapiens
ttcatgtatgaggccaatcttt

SEQ ID NO: 6946854 - DNA, 22 bp, Homo sapiens
gtcttgaaaagtggccagtttg

SEQ ID NO: 6946855 - DNA, 22 bp, Homo sapiens
ggaggccatagtttgggagtca

SEQ ID NO: 6946856 - DNA, 23 bp, Homo sapiens
agcagcagtgagaggtgtcttac

SEQ ID NO: 6946857 - DNA, 22 bp, Homo sapiens
aacagagatcttaattcctgta

SEQ ID NO: 6946858 - DNA, 22 bp, Homo sapiens
gagtagcagtagtccaagccag

SEQ ID NO: 6946859 - DNA, 22 bp, Homo sapiens
tgaggtaggaatttgtattggg

SEQ ID NO: 6946860 - DNA, 22 bp, Homo sapiens
gctcttctaaagaatgtacagg

SEQ ID NO: 6946861 - DNA, 22 bp, Homo sapiens
gggagccaaggagagaggcctt

SEQ ID NO: 6946862 - DNA, 20 bp, Homo sapiens
gcctgagctattgccaggat

SEQ ID NO: 6946863 - DNA, 20 bp, Homo sapiens
tcttacaatcgttacatcca

SEQ ID NO: 6946864 - DNA, 20 bp, Homo sapiens
cctggtgtatttcctggggt

SEQ ID NO: 6946865 - DNA, 22 bp, Homo sapiens
taggctgggaagaaagattctc

SEQ ID NO: 6946866 - DNA, 22 bp, Homo sapiens
ttccttgaatgagtcatggaaa

SEQ ID NO: 6946867 - DNA, 20 bp, Homo sapiens
tctgagaagcaaacaatgtt

SEQ ID NO: 6946868 - DNA, 22 bp, Homo sapiens
ggcagctttcaatagggttatg

SEQ ID NO: 6946869 - DNA, 22 bp, Homo sapiens
actaaaacatagccagtcagtg

SEQ ID NO: 6946870 - DNA, 22 bp, Homo sapiens
cttcttccagttataagagctt

SEQ ID NO: 6946871 - DNA, 22 bp, Homo sapiens
gtctgtagatattcactccttc

SEQ ID NO: 6946872 - DNA, 22 bp, Homo sapiens
tgcagggattgttggcatccat

SEQ ID NO: 6946873 - DNA, 22 bp, Homo sapiens
acagcttagccagtcaagctct

SEQ ID NO: 6946874 - DNA, 22 bp, Homo sapiens
ttctatcagcatagttgaaata

SEQ ID NO: 6946875 - DNA, 19 bp, Homo sapiens
ggtgtgaagtgaggagtta

SEQ ID NO: 6946876 - DNA, 22 bp, Homo sapiens
aaattgctgtgaggtggtagta

SEQ ID NO: 6946877 - DNA, 22 bp, Homo sapiens
gaaggaaaggtctcatgccttt

SEQ ID NO: 6946878 - DNA, 22 bp, Homo sapiens
tcacaaatgaccatggttacta

SEQ ID NO: 6946879 - DNA, 22 bp, Homo sapiens
gtattttatggcctggggccta

SEQ ID NO: 6946880 - DNA, 22 bp, Homo sapiens
acaggtgaggggttctaggctg

SEQ ID NO: 6946881 - DNA, 22 bp, Homo sapiens
gagcttcctttttctgcatgac

SEQ ID NO: 6946882 - DNA, 22 bp, Homo sapiens
ttcacagcctctgccccaggca

SEQ ID NO: 6946883 - DNA, 22 bp, Homo sapiens
gggaaggcaggattctctggtg

SEQ ID NO: 6946884 - DNA, 22 bp, Homo sapiens
cagcacccctcctggctatgaa

SEQ ID NO: 6946885 - DNA, 22 bp, Homo sapiens
tgtagcacaaaaaggatcttgg

SEQ ID NO: 6946886 - DNA, 23 bp, Homo sapiens
agggttgtgtgcttcatgatcat

SEQ ID NO: 6946887 - DNA, 22 bp, Homo sapiens
aggcttcttagattggctggag

SEQ ID NO: 6946888 - DNA, 22 bp, Homo sapiens
ttcctgcaggccatagagcctg

SEQ ID NO: 6946889 - DNA, 22 bp, Homo sapiens
ggttacaaggatattcaggtaa

SEQ ID NO: 6946890 - DNA, 21 bp, Homo sapiens
ttcagaggatgccaaggtcca

SEQ ID NO: 6946891 - DNA, 22 bp, Homo sapiens
tgcattcagttggtcagctttt

SEQ ID NO: 6946892 - DNA, 22 bp, Homo sapiens
tgaatagactggggctgtgaag

SEQ ID NO: 6946893 - DNA, 22 bp, Homo sapiens
gtgctgtttgggagaaggttct

SEQ ID NO: 6946894 - DNA, 21 bp, Homo sapiens
tctggcaggaagacggatggg

SEQ ID NO: 6946895 - DNA, 22 bp, Homo sapiens
agtgactggtgtgaagttaaat

SEQ ID NO: 6946896 - DNA, 22 bp, Homo sapiens
caggcactgtgctgagctctgc

SEQ ID NO: 6946897 - DNA, 22 bp, Homo sapiens
gcagtagtgataaaaatgtatc

SEQ ID NO: 6946898 - DNA, 22 bp, Homo sapiens
gggagctgacctgcaggttccc

SEQ ID NO: 6946899 - DNA, 22 bp, Homo sapiens
gcctctgcatcttcgccgcact

SEQ ID NO: 6946900 - DNA, 22 bp, Homo sapiens
ccttctgctggtcatcccagtg

SEQ ID NO: 6946901 - DNA, 22 bp, Homo sapiens
gggctcagtcctggttctaccc

SEQ ID NO: 6946902 - DNA, 22 bp, Homo sapiens
actgtagtgatgataattaagt

SEQ ID NO: 6946903 - DNA, 22 bp, Homo sapiens
tcagtaaccctgctgttcagag

SEQ ID NO: 6946904 - DNA, 22 bp, Homo sapiens
aatcagagtcccaagatctgta

SEQ ID NO: 6946905 - DNA, 22 bp, Homo sapiens
tccacctagcattcacctccta

SEQ ID NO: 6946906 - DNA, 22 bp, Homo sapiens
acatgtgctcttgctgtacagc

SEQ ID NO: 6946907 - DNA, 22 bp, Homo sapiens
tcacagacacattaaacatgtg

SEQ ID NO: 6946908 - DNA, 22 bp, Homo sapiens
aagcagcacgctttgccaacaa

SEQ ID NO: 6946909 - DNA, 22 bp, Homo sapiens
agaagcacaccagtagacaggg

SEQ ID NO: 6946910 - DNA, 22 bp, Homo sapiens
agctggaagtgcatttctcact

SEQ ID NO: 6946911 - DNA, 22 bp, Homo sapiens
ggtacatttttctgtcactttg

SEQ ID NO: 6946912 - DNA, 22 bp, Homo sapiens
tgccatttctttcaatattctt

SEQ ID NO: 6946913 - DNA, 22 bp, Homo sapiens
tgggctctgctgcgtaccagtt

SEQ ID NO: 6946914 - DNA, 22 bp, Homo sapiens
taggaaagaaatgagtagtgat

SEQ ID NO: 6946915 - DNA, 22 bp, Homo sapiens
gtgggctggaccctcctgctcc

SEQ ID NO: 6946916 - DNA, 22 bp, Homo sapiens
atacaatgaagtatagatgaaa

SEQ ID NO: 6946917 - DNA, 22 bp, Homo sapiens
ggacccttggcttctgcagatt

SEQ ID NO: 6946918 - DNA, 22 bp, Homo sapiens
tcttccagcttctagaggatgc

SEQ ID NO: 6946919 - DNA, 23 bp, Homo sapiens
tgtgcacatctgacgggtgaagg

SEQ ID NO: 6946920 - DNA, 19 bp, Homo sapiens
atacaagactagcatttac

SEQ ID NO: 6946921 - DNA, 22 bp, Homo sapiens
tgaagtgtcatttacatttcta

SEQ ID NO: 6946922 - DNA, 22 bp, Homo sapiens
tcttcctcttctgctgagaagt

SEQ ID NO: 6946923 - DNA, 22 bp, Homo sapiens
aaatgaggccagatcatgcaga

SEQ ID NO: 6946924 - DNA, 22 bp, Homo sapiens
gcagctgaatgtccattgctgc

SEQ ID NO: 6946925 - DNA, 22 bp, Homo sapiens
gcagggagggcctttcatgaca

SEQ ID NO: 6946926 - DNA, 22 bp, Homo sapiens
gtttggcagttttagagtgcaa

SEQ ID NO: 6946927 - DNA, 22 bp, Homo sapiens
caataagtgcttttgtttagca

SEQ ID NO: 6946928 - DNA, 22 bp, Homo sapiens
agactgttgtgtgaagtagggt

SEQ ID NO: 6946929 - DNA, 22 bp, Homo sapiens
agagtttaggggtaagcatagt

SEQ ID NO: 6946930 - DNA, 23 bp, Homo sapiens
ctgtgctgggtcccatcttgggc

SEQ ID NO: 6946931 - DNA, 22 bp, Homo sapiens
tgaggcaggtggattacaaggt

SEQ ID NO: 6946932 - DNA, 22 bp, Homo sapiens
tttgcatggagtgaatggcgtg

SEQ ID NO: 6946933 - DNA, 17 bp, Homo sapiens
gcctactcctatactcc

SEQ ID NO: 6946934 - DNA, 22 bp, Homo sapiens
gacctcgtgatccgccctcctt

SEQ ID NO: 6946935 - DNA, 20 bp, Homo sapiens
gggcagctcccctcattctg

SEQ ID NO: 6946936 - DNA, 22 bp, Homo sapiens
gttaatgtgatataaagtattt

SEQ ID NO: 6946937 - DNA, 22 bp, Homo sapiens
gggggcaggtctggaactttga

SEQ ID NO: 6946938 - DNA, 22 bp, Homo sapiens
ctgggcacagtggctcacgcct

SEQ ID NO: 6946939 - DNA, 22 bp, Homo sapiens
tgaggccctctgggctggtcct

SEQ ID NO: 6946940 - DNA, 22 bp, Homo sapiens
gtcatgtcagcaaatatcatag

SEQ ID NO: 6946941 - DNA, 20 bp, Homo sapiens
atgtcaggaagggagtcagg

SEQ ID NO: 6946942 - DNA, 22 bp, Homo sapiens
tgtgggcaggcccgggtctgag

SEQ ID NO: 6946943 - DNA, 22 bp, Homo sapiens
aattcctagtccttttccctcc

SEQ ID NO: 6946944 - DNA, 22 bp, Homo sapiens
gtttaactgggagtgtgggaaa

SEQ ID NO: 6946945 - DNA, 22 bp, Homo sapiens
ttggaatcattcttaaaggtct

SEQ ID NO: 6946946 - DNA, 22 bp, Homo sapiens
tgccacaccaacatctttcagc

SEQ ID NO: 6946947 - DNA, 22 bp, Homo sapiens
tcctgccaggagtgctggccct

SEQ ID NO: 6946948 - DNA, 22 bp, Homo sapiens
agaggtggagctcttggcatca

SEQ ID NO: 6946949 - DNA, 22 bp, Homo sapiens
agccctgtttatgccacatcat

SEQ ID NO: 6946950 - DNA, 22 bp, Homo sapiens
gggtgtccttctgtggactctg

SEQ ID NO: 6946951 - DNA, 22 bp, Homo sapiens
gacagtatttaactagttcatt

SEQ ID NO: 6946952 - DNA, 22 bp, Homo sapiens
ttctgtatttagtttgaggaca

SEQ ID NO: 6946953 - DNA, 22 bp, Homo sapiens
gggatggacttggggactccag

SEQ ID NO: 6946954 - DNA, 22 bp, Homo sapiens
ccagttaaggaaacagcacgaa

SEQ ID NO: 6946955 - DNA, 22 bp, Homo sapiens
gtctgaaaatatgattttgcct

SEQ ID NO: 6946956 - DNA, 22 bp, Homo sapiens
tggtaggagggaaatgcgggtt

SEQ ID NO: 6946957 - DNA, 22 bp, Homo sapiens
ggtgaggcagagggagtaacct

SEQ ID NO: 6946958 - DNA, 22 bp, Homo sapiens
agccagctgtggctatggctcc

SEQ ID NO: 6946959 - DNA, 20 bp, Homo sapiens
ttgcaaatatctattgattg

SEQ ID NO: 6946960 - DNA, 19 bp, Homo sapiens
tctcatccagcattcaaga

SEQ ID NO: 6946961 - DNA, 22 bp, Homo sapiens
gaacctctttaaagaacagaat

SEQ ID NO: 6946962 - DNA, 22 bp, Homo sapiens
ccctctctgacttctgaacttg

SEQ ID NO: 6946963 - DNA, 21 bp, Homo sapiens
agatttgtcccttcccattta

SEQ ID NO: 6946964 - DNA, 19 bp, Homo sapiens
cagtgattaattcatctta

SEQ ID NO: 6946965 - DNA, 22 bp, Homo sapiens
ctgggactttaccctgtggccc

SEQ ID NO: 6946966 - DNA, 22 bp, Homo sapiens
tctgccagtgccagagtacata

SEQ ID NO: 6946967 - DNA, 22 bp, Homo sapiens
aggcttgtgccaggcggggtgg

SEQ ID NO: 6946968 - DNA, 22 bp, Homo sapiens
acaggcaattagcaagctgtta

SEQ ID NO: 6946969 - DNA, 22 bp, Homo sapiens
cacagtatcttttgagtaagca

SEQ ID NO: 6946970 - DNA, 22 bp, Homo sapiens
aagaatctctcaagtgtgacaa

SEQ ID NO: 6946971 - DNA, 22 bp, Homo sapiens
cttcagaggggactcaaagtca

SEQ ID NO: 6946972 - DNA, 22 bp, Homo sapiens
atcctgggctgcaccctcagcc

SEQ ID NO: 6946973 - DNA, 22 bp, Homo sapiens
ggctggcctcagggtcctcgct

SEQ ID NO: 6946974 - DNA, 22 bp, Homo sapiens
gccagagctgagtgaggttctt

SEQ ID NO: 6946975 - DNA, 22 bp, Homo sapiens
atttaacaagacagagaactgg

SEQ ID NO: 6946976 - DNA, 22 bp, Homo sapiens
ctgaaaagtgtctgttgagtta

SEQ ID NO: 6946977 - DNA, 22 bp, Homo sapiens
ctgggtgtgggtcaagcaacca

SEQ ID NO: 6946978 - DNA, 22 bp, Homo sapiens
gctgtgcccagccattctagat

SEQ ID NO: 6946979 - DNA, 22 bp, Homo sapiens
tgatcactttggaagttggggg

SEQ ID NO: 6946980 - DNA, 22 bp, Homo sapiens
ctgttttcctgggttccatgag

SEQ ID NO: 6946981 - DNA, 22 bp, Homo sapiens
aggagcagaactgattctgact

SEQ ID NO: 6946982 - DNA, 22 bp, Homo sapiens
acagaaattagcagtgagttta

SEQ ID NO: 6946983 - DNA, 22 bp, Homo sapiens
tggcagctgtgtccaggtagaa

SEQ ID NO: 6946984 - DNA, 22 bp, Homo sapiens
ttccataataacctgagagaaa

SEQ ID NO: 6946985 - DNA, 22 bp, Homo sapiens
gccacagacagagagtctagtg

SEQ ID NO: 6946986 - DNA, 22 bp, Homo sapiens
agagtgatcctaattgatttgg

SEQ ID NO: 6946987 - DNA, 22 bp, Homo sapiens
ttccaagtagaagcatttgcat

SEQ ID NO: 6946988 - DNA, 22 bp, Homo sapiens
agcttgatttctctgcagtgtg

SEQ ID NO: 6946989 - DNA, 22 bp, Homo sapiens
ggcaggcatggccactccctag

SEQ ID NO: 6946990 - DNA, 22 bp, Homo sapiens
ctttggcagcctctgctattga

SEQ ID NO: 6946991 - DNA, 22 bp, Homo sapiens
aacatgcatgaagaagttatat

SEQ ID NO: 6946992 - DNA, 22 bp, Homo sapiens
cctgataatattgacctacaga

SEQ ID NO: 6946993 - DNA, 22 bp, Homo sapiens
tccaggtgagtgcaggtgcaga

SEQ ID NO: 6946994 - DNA, 22 bp, Homo sapiens
gctcctcttatttcatcagggc

SEQ ID NO: 6946995 - DNA, 22 bp, Homo sapiens
tgaaacagtctccagacttgga

SEQ ID NO: 6946996 - DNA, 22 bp, Homo sapiens
aagactgatgtccagtcccatg

SEQ ID NO: 6946997 - DNA, 22 bp, Homo sapiens
gaggtgtctgttaggaataggc

SEQ ID NO: 6946998 - DNA, 22 bp, Homo sapiens
cctgaggagattgtggctgggg

SEQ ID NO: 6946999 - DNA, 20 bp, Homo sapiens
aggcccagtgaatatattgc

SEQ ID NO: 6947000 - DNA, 22 bp, Homo sapiens
tagtgtctgacatttaagagca

SEQ ID NO: 6947001 - DNA, 17 bp, Homo sapiens
agtgaggagattggaag

SEQ ID NO: 6947002 - DNA, 22 bp, Homo sapiens
agtgattcccagacttcctggg

SEQ ID NO: 6947003 - DNA, 20 bp, Homo sapiens
aggagtccctgtgctctctc

SEQ ID NO: 6947004 - DNA, 21 bp, Homo sapiens
tgactttatttgacagcccag

SEQ ID NO: 6947005 - DNA, 22 bp, Homo sapiens
tgctttggatctatttgctgag

SEQ ID NO: 6947006 - DNA, 22 bp, Homo sapiens
tcatataagagctttagagtca

SEQ ID NO: 6947007 - DNA, 22 bp, Homo sapiens
tctgtgcactgtgtcattaggt

SEQ ID NO: 6947008 - DNA, 22 bp, Homo sapiens
tgttagcctcatgcttaatagg

SEQ ID NO: 6947009 - DNA, 19 bp, Homo sapiens
aggcttggtgttgaatggg

SEQ ID NO: 6947010 - DNA, 22 bp, Homo sapiens
atggggctagacaaccagtgcc

SEQ ID NO: 6947011 - DNA, 22 bp, Homo sapiens
ttcctgcacagttaagtgctca

SEQ ID NO: 6947012 - DNA, 22 bp, Homo sapiens
aatggcctttgagatgaaaggg

SEQ ID NO: 6947013 - DNA, 22 bp, Homo sapiens
gctaaggccttaactcatggag

SEQ ID NO: 6947014 - DNA, 22 bp, Homo sapiens
tctctgggctaaaatcaaggtg

SEQ ID NO: 6947015 - DNA, 22 bp, Homo sapiens
gattgaatcatatgaaattgtg

SEQ ID NO: 6947016 - DNA, 22 bp, Homo sapiens
tgtgtataactcttaattcatt

SEQ ID NO: 6947017 - DNA, 22 bp, Homo sapiens
ggcctgaaataaagtagcagaa

SEQ ID NO: 6947018 - DNA, 22 bp, Homo sapiens
tggggtgtgctcagagcagggg

SEQ ID NO: 6947019 - DNA, 22 bp, Homo sapiens
cttccaggtaggcctaaggcag

SEQ ID NO: 6947020 - DNA, 22 bp, Homo sapiens
gagatggaaaactgctggtagt

SEQ ID NO: 6947021 - DNA, 22 bp, Homo sapiens
ccagttcatacacttagaaatt

SEQ ID NO: 6947022 - DNA, 22 bp, Homo sapiens
atgtcacatctgggatggccct

SEQ ID NO: 6947023 - DNA, 22 bp, Homo sapiens
gtgtccttaagtcggttctcct

SEQ ID NO: 6947024 - DNA, 22 bp, Homo sapiens
ggggagagtcctttccagttcc

SEQ ID NO: 6947025 - DNA, 22 bp, Homo sapiens
agccatttcctgaactctggac

SEQ ID NO: 6947026 - DNA, 22 bp, Homo sapiens
tgcatttatgtctcccaccagc

SEQ ID NO: 6947027 - DNA, 22 bp, Homo sapiens
cagagccctcaaggccgatgca

SEQ ID NO: 6947028 - DNA, 22 bp, Homo sapiens
tagtttgtcaaccactgtcaca

SEQ ID NO: 6947029 - DNA, 22 bp, Homo sapiens
atgcacagtatgtagggtctat

SEQ ID NO: 6947030 - DNA, 22 bp, Homo sapiens
caggtgaatcacttgagtccag

SEQ ID NO: 6947031 - DNA, 20 bp, Homo sapiens
tttcattgtcagaatcttat

SEQ ID NO: 6947032 - DNA, 19 bp, Homo sapiens
aggaaaggtggccttagca

SEQ ID NO: 6947033 - DNA, 22 bp, Homo sapiens
ttagatgtgtatatacatgtca

SEQ ID NO: 6947034 - DNA, 19 bp, Homo sapiens
gtgtacagctcagtgaatt

SEQ ID NO: 6947035 - DNA, 22 bp, Homo sapiens
gggggaaagtggaggttcgtga

SEQ ID NO: 6947036 - DNA, 22 bp, Homo sapiens
tatgcctggaacctttctcttt

SEQ ID NO: 6947037 - DNA, 22 bp, Homo sapiens
ttaaatgaggctgatgtagatt

SEQ ID NO: 6947038 - DNA, 19 bp, Homo sapiens
tctaagcctcaatgttttc

SEQ ID NO: 6947039 - DNA, 22 bp, Homo sapiens
tgttactgatttgatatacagt

SEQ ID NO: 6947040 - DNA, 22 bp, Homo sapiens
cagatataagaaagctattgtc

SEQ ID NO: 6947041 - DNA, 22 bp, Homo sapiens
cttcaagatccatagatattgc

SEQ ID NO: 6947042 - DNA, 22 bp, Homo sapiens
gctggcagaagagctggttcaa

SEQ ID NO: 6947043 - DNA, 22 bp, Homo sapiens
gctgcccattgcacgttgtggc

SEQ ID NO: 6947044 - DNA, 22 bp, Homo sapiens
cttgcctaggtgtatattaaat

SEQ ID NO: 6947045 - DNA, 22 bp, Homo sapiens
gaattacatttgtgttactgca

SEQ ID NO: 6947046 - DNA, 18 bp, Homo sapiens
agtatttctgcatgtctt

SEQ ID NO: 6947047 - DNA, 22 bp, Homo sapiens
tatgggctgggtatgagctggt

SEQ ID NO: 6947048 - DNA, 22 bp, Homo sapiens
ctccctgacaggccatgggctt

SEQ ID NO: 6947049 - DNA, 22 bp, Homo sapiens
cagcatgggttccgggggcctg

SEQ ID NO: 6947050 - DNA, 22 bp, Homo sapiens
tgccagcttcttacggctgcct

SEQ ID NO: 6947051 - DNA, 22 bp, Homo sapiens
agggggtgctacttccagagtt

SEQ ID NO: 6947052 - DNA, 20 bp, Homo sapiens
ttcatggtgtatttctttct

SEQ ID NO: 6947053 - DNA, 22 bp, Homo sapiens
tacaaagtcccattgccatgga

SEQ ID NO: 6947054 - DNA, 22 bp, Homo sapiens
agtttcatattaccatgtcacc

SEQ ID NO: 6947055 - DNA, 22 bp, Homo sapiens
gtgaaagcactgaacaaagtaa

SEQ ID NO: 6947056 - DNA, 22 bp, Homo sapiens
ctgtcctgtactttgaggccct

SEQ ID NO: 6947057 - DNA, 22 bp, Homo sapiens
caagataaaatcagcattccaa

SEQ ID NO: 6947058 - DNA, 22 bp, Homo sapiens
aaagattgatcatgaattgaca

SEQ ID NO: 6947059 - DNA, 22 bp, Homo sapiens
ttttacttaattcttggtcatg

SEQ ID NO: 6947060 - DNA, 22 bp, Homo sapiens
cagcttgctaattttgacttca

SEQ ID NO: 6947061 - DNA, 22 bp, Homo sapiens
tgacagggtgtttgtgagacta

SEQ ID NO: 6947062 - DNA, 23 bp, Homo sapiens
tcagcccacatctagtcattagc

SEQ ID NO: 6947063 - DNA, 23 bp, Homo sapiens
ttcttggccccagtgacttctac

SEQ ID NO: 6947064 - DNA, 22 bp, Homo sapiens
ctgcacaaattaatcagttaat

SEQ ID NO: 6947065 - DNA, 22 bp, Homo sapiens
gaattatgggcttgtttggaga

SEQ ID NO: 6947066 - DNA, 22 bp, Homo sapiens
tcctccagtgtctggggccttg

SEQ ID NO: 6947067 - DNA, 22 bp, Homo sapiens
tgtattttgagtccaatctcct

SEQ ID NO: 6947068 - DNA, 19 bp, Homo sapiens
accaggcttatggtcagtg

SEQ ID NO: 6947069 - DNA, 22 bp, Homo sapiens
ttctagagaactcgagtgcctt

SEQ ID NO: 6947070 - DNA, 23 bp, Homo sapiens
tccctgtgtacagcctgcatgag

SEQ ID NO: 6947071 - DNA, 22 bp, Homo sapiens
tgtgtggattcatctcaaagag

SEQ ID NO: 6947072 - DNA, 22 bp, Homo sapiens
aagggcttgatcatgttgaaga

SEQ ID NO: 6947073 - DNA, 22 bp, Homo sapiens
atggatggaaaagttgaggaga

SEQ ID NO: 6947074 - DNA, 22 bp, Homo sapiens
gctggccgaacggtgccctggc

SEQ ID NO: 6947075 - DNA, 22 bp, Homo sapiens
aaagtgcatcaaatgacttccc

SEQ ID NO: 6947076 - DNA, 22 bp, Homo sapiens
aggttcacacacacaaaaagat

SEQ ID NO: 6947077 - DNA, 22 bp, Homo sapiens
cttctggaggacactggcccca

SEQ ID NO: 6947078 - DNA, 22 bp, Homo sapiens
ctgaggagtcagttccactcag

SEQ ID NO: 6947079 - DNA, 22 bp, Homo sapiens
aacttccaggccttgaattatt

SEQ ID NO: 6947080 - DNA, 22 bp, Homo sapiens
cagtttctgccaggatgtgtta

SEQ ID NO: 6947081 - DNA, 22 bp, Homo sapiens
ggcactcagagattcaggctgt

SEQ ID NO: 6947082 - DNA, 22 bp, Homo sapiens
tgatggtgggtctgatctcata

SEQ ID NO: 6947083 - DNA, 22 bp, Homo sapiens
cagaggcaaaagaggtggaggt

SEQ ID NO: 6947084 - DNA, 22 bp, Homo sapiens
cctggacaatgagatgtcaggg

SEQ ID NO: 6947085 - DNA, 22 bp, Homo sapiens
tctctggggtagggcccaggac

SEQ ID NO: 6947086 - DNA, 22 bp, Homo sapiens
tgcaggctgctggcagtagctt

SEQ ID NO: 6947087 - DNA, 22 bp, Homo sapiens
atggctgccttaattcttcagc

SEQ ID NO: 6947088 - DNA, 22 bp, Homo sapiens
agtgttcttctggggtatgctc

SEQ ID NO: 6947089 - DNA, 22 bp, Homo sapiens
gggcactgctggaggctccctg

SEQ ID NO: 6947090 - DNA, 21 bp, Homo sapiens
tgatttctgccaagttcacta

SEQ ID NO: 6947091 - DNA, 22 bp, Homo sapiens
gaggcacagtgtttggtcagtg

SEQ ID NO: 6947092 - DNA, 22 bp, Homo sapiens
ctcgctggcttttccggttccc

SEQ ID NO: 6947093 - DNA, 22 bp, Homo sapiens
gctctgtgccacatgcagtgtt

SEQ ID NO: 6947094 - DNA, 22 bp, Homo sapiens
taggcactggggaggcagcatg

SEQ ID NO: 6947095 - DNA, 22 bp, Homo sapiens
attgggtacgattattttatgg

SEQ ID NO: 6947096 - DNA, 22 bp, Homo sapiens
agttgaatctgttaaattggga

SEQ ID NO: 6947097 - DNA, 22 bp, Homo sapiens
gtgttacttaattagaatctgc

SEQ ID NO: 6947098 - DNA, 22 bp, Homo sapiens
ccagatgttcccctggaggcct

SEQ ID NO: 6947099 - DNA, 23 bp, Homo sapiens
aaacaatgtcatcaggacttggt

SEQ ID NO: 6947100 - DNA, 22 bp, Homo sapiens
ctgggcagcacatcatcgtatc

SEQ ID NO: 6947101 - DNA, 21 bp, Homo sapiens
tccttttcaatcgggcccttt

SEQ ID NO: 6947102 - DNA, 22 bp, Homo sapiens
tccacagttttgccactagctg

SEQ ID NO: 6947103 - DNA, 22 bp, Homo sapiens
ctgatgcaaccagcatatggaa

SEQ ID NO: 6947104 - DNA, 22 bp, Homo sapiens
ctgtggaaagagcctttggagg

SEQ ID NO: 6947105 - DNA, 22 bp, Homo sapiens
agcagggcccactaggggagat

SEQ ID NO: 6947106 - DNA, 22 bp, Homo sapiens
ggcactgtgtacacacagagac

SEQ ID NO: 6947107 - DNA, 22 bp, Homo sapiens
ttgtcaccatatttcattttga

SEQ ID NO: 6947108 - DNA, 22 bp, Homo sapiens
catggcttttttattctgaatg

SEQ ID NO: 6947109 - DNA, 22 bp, Homo sapiens
tctggcatttcaggcatctata

SEQ ID NO: 6947110 - DNA, 18 bp, Homo sapiens
ggatgtgaaccagagata

SEQ ID NO: 6947111 - DNA, 22 bp, Homo sapiens
ggtgaagcgtatttgtggagct

SEQ ID NO: 6947112 - DNA, 19 bp, Homo sapiens
ctggaatgatagagacctc

SEQ ID NO: 6947113 - DNA, 22 bp, Homo sapiens
gtaagttttgtataggcatggg

SEQ ID NO: 6947114 - DNA, 22 bp, Homo sapiens
cacaattgtatcagaaaatagt

SEQ ID NO: 6947115 - DNA, 17 bp, Homo sapiens
cctcccacaccgccctg

SEQ ID NO: 6947116 - DNA, 22 bp, Homo sapiens
actgcctgtttggcatggcccc

SEQ ID NO: 6947117 - DNA, 22 bp, Homo sapiens
atacacatatcaggtgtataca

SEQ ID NO: 6947118 - DNA, 22 bp, Homo sapiens
tcttctttggatgaaagaatat

SEQ ID NO: 6947119 - DNA, 22 bp, Homo sapiens
gcccagctgtctggcagggatg

SEQ ID NO: 6947120 - DNA, 22 bp, Homo sapiens
aagagaaggattctgagcctgg

SEQ ID NO: 6947121 - DNA, 22 bp, Homo sapiens
agtctcttcctcatgcatatgt

SEQ ID NO: 6947122 - DNA, 22 bp, Homo sapiens
gtaatcatctgcatgacttgat

SEQ ID NO: 6947123 - DNA, 22 bp, Homo sapiens
cccaaaggataaggtaagaatg

SEQ ID NO: 6947124 - DNA, 22 bp, Homo sapiens
cagatgaagtttgcctagagct

SEQ ID NO: 6947125 - DNA, 22 bp, Homo sapiens
aacatgtgtcttgcatttcttg

SEQ ID NO: 6947126 - DNA, 22 bp, Homo sapiens
gttcacagaaattgtgtacctc

SEQ ID NO: 6947127 - DNA, 22 bp, Homo sapiens
ttctggaaccaacatgccagtt

SEQ ID NO: 6947128 - DNA, 22 bp, Homo sapiens
gctgcaccagctgcacccagta

SEQ ID NO: 6947129 - DNA, 22 bp, Homo sapiens
taagaccaatcctgtgtacctc

SEQ ID NO: 6947130 - DNA, 22 bp, Homo sapiens
acacagtgtccttctacttgcc

SEQ ID NO: 6947131 - DNA, 22 bp, Homo sapiens
tggccagtggactaagttctga

SEQ ID NO: 6947132 - DNA, 22 bp, Homo sapiens
attggtaaaattcttcccattt

SEQ ID NO: 6947133 - DNA, 22 bp, Homo sapiens
ttgtccagaaaaaagccaaggg

SEQ ID NO: 6947134 - DNA, 22 bp, Homo sapiens
tgctttgacagggatgacatga

SEQ ID NO: 6947135 - DNA, 22 bp, Homo sapiens
ttcaaccattgtgtaagacagt

SEQ ID NO: 6947136 - DNA, 22 bp, Homo sapiens
ggggcccctcggacacgtgcgg

SEQ ID NO: 6947137 - DNA, 22 bp, Homo sapiens
tttaaatttgtgtttagagggt

SEQ ID NO: 6947138 - DNA, 22 bp, Homo sapiens
aggacacaggcaggaggagatc

SEQ ID NO: 6947139 - DNA, 22 bp, Homo sapiens
tggggtcccactcagctcccct

SEQ ID NO: 6947140 - DNA, 22 bp, Homo sapiens
tagggccagttagggaagcttt

SEQ ID NO: 6947141 - DNA, 21 bp, Homo sapiens
tctctgtggtccaatcccagc

SEQ ID NO: 6947142 - DNA, 22 bp, Homo sapiens
gaactcaacgctttcttaggag

SEQ ID NO: 6947143 - DNA, 22 bp, Homo sapiens
ggctccttgccaccagctctgc

SEQ ID NO: 6947144 - DNA, 22 bp, Homo sapiens
cctcactgtcacttatagtggt

SEQ ID NO: 6947145 - DNA, 22 bp, Homo sapiens
gcagcagagaacacaatgatgg

SEQ ID NO: 6947146 - DNA, 22 bp, Homo sapiens
tcagacttcagtttttagttgt

SEQ ID NO: 6947147 - DNA, 22 bp, Homo sapiens
cagcagctgtttacggaacacc

SEQ ID NO: 6947148 - DNA, 22 bp, Homo sapiens
gagctataatagagcttcagtg

SEQ ID NO: 6947149 - DNA, 22 bp, Homo sapiens
ccccatgctgggatctgacacc

SEQ ID NO: 6947150 - DNA, 22 bp, Homo sapiens
gaccagaaatcaacacagaatg

SEQ ID NO: 6947151 - DNA, 22 bp, Homo sapiens
aagtgatctaaagaatattgaa

SEQ ID NO: 6947152 - DNA, 22 bp, Homo sapiens
gtggttttgccattacaagtaa

SEQ ID NO: 6947153 - DNA, 22 bp, Homo sapiens
tctgcaatgttttcccatcctg

SEQ ID NO: 6947154 - DNA, 22 bp, Homo sapiens
aaatattgttttggtaagcttc

SEQ ID NO: 6947155 - DNA, 22 bp, Homo sapiens
gtggtcctgcacccgcttggcc

SEQ ID NO: 6947156 - DNA, 22 bp, Homo sapiens
aggtcagctgctgataggcagc

SEQ ID NO: 6947157 - DNA, 22 bp, Homo sapiens
tcaaagtcacaactctctaatt

SEQ ID NO: 6947158 - DNA, 22 bp, Homo sapiens
aggggatgatcctcccgcagcg

SEQ ID NO: 6947159 - DNA, 22 bp, Homo sapiens
cagggctttgaacaggcatcaa

SEQ ID NO: 6947160 - DNA, 22 bp, Homo sapiens
agctgccacatggtgtcactgt

SEQ ID NO: 6947161 - DNA, 21 bp, Homo sapiens
agtggaacccttagggtcagg

SEQ ID NO: 6947162 - DNA, 22 bp, Homo sapiens
ataatccatgtctagagtaaag

SEQ ID NO: 6947163 - DNA, 22 bp, Homo sapiens
gctcttgaagtactgggtgttg

SEQ ID NO: 6947164 - DNA, 22 bp, Homo sapiens
ggcagctcactgattagcaatt

SEQ ID NO: 6947165 - DNA, 22 bp, Homo sapiens
agaggggtggtgctctcctgga

SEQ ID NO: 6947166 - DNA, 22 bp, Homo sapiens
atggcaccttccccagagctca

SEQ ID NO: 6947167 - DNA, 22 bp, Homo sapiens
aggccagctctacccttggact

SEQ ID NO: 6947168 - DNA, 22 bp, Homo sapiens
tgccttagaggatagtgaagcc

SEQ ID NO: 6947169 - DNA, 22 bp, Homo sapiens
ttctagctgttgctgtttatag

SEQ ID NO: 6947170 - DNA, 22 bp, Homo sapiens
cacatgtgggaaatggtgctta

SEQ ID NO: 6947171 - DNA, 22 bp, Homo sapiens
gcagaagggaataaggagcttt

SEQ ID NO: 6947172 - DNA, 22 bp, Homo sapiens
agagtggctctgctgggcacag

SEQ ID NO: 6947173 - DNA, 22 bp, Homo sapiens
cagacacacaccctggcctagc

SEQ ID NO: 6947174 - DNA, 22 bp, Homo sapiens
ctgctgtgcagacagactctct

SEQ ID NO: 6947175 - DNA, 22 bp, Homo sapiens
gctctgctgagatatctgggag

SEQ ID NO: 6947176 - DNA, 21 bp, Homo sapiens
tttaaagaataggaagggagg

SEQ ID NO: 6947177 - DNA, 22 bp, Homo sapiens
tacagtaatctggacatgattt

SEQ ID NO: 6947178 - DNA, 22 bp, Homo sapiens
aagctgcagcacagagaggtgg

SEQ ID NO: 6947179 - DNA, 22 bp, Homo sapiens
ctaattctgtacctggcacata

SEQ ID NO: 6947180 - DNA, 22 bp, Homo sapiens
ttctgagaagggtgggtctggc

SEQ ID NO: 6947181 - DNA, 22 bp, Homo sapiens
ttcctctcctcacatgagtcac

SEQ ID NO: 6947182 - DNA, 21 bp, Homo sapiens
agcagacacttgtgaccttcc

SEQ ID NO: 6947183 - DNA, 22 bp, Homo sapiens
ggtggcagcatggtcccagtgt

SEQ ID NO: 6947184 - DNA, 22 bp, Homo sapiens
ggggcagctaccggaagtaggg

SEQ ID NO: 6947185 - DNA, 22 bp, Homo sapiens
gctgccttttaaagcctcgctt

SEQ ID NO: 6947186 - DNA, 22 bp, Homo sapiens
gccagctgccctctgctggtcc

SEQ ID NO: 6947187 - DNA, 22 bp, Homo sapiens
ctcctgtcccggggaccgccga

SEQ ID NO: 6947188 - DNA, 22 bp, Homo sapiens
tctcagtgtttaaaaagatttc

SEQ ID NO: 6947189 - DNA, 22 bp, Homo sapiens
tttcattattcatgctagttat

SEQ ID NO: 6947190 - DNA, 22 bp, Homo sapiens
ggaagaaagcacacaaacttga

SEQ ID NO: 6947191 - DNA, 23 bp, Homo sapiens
gggcaccaggagcaccggacagg

SEQ ID NO: 6947192 - DNA, 22 bp, Homo sapiens
aggcctgcccgtgggacctgtg

SEQ ID NO: 6947193 - DNA, 22 bp, Homo sapiens
tctgttcttgtccccacttcag

SEQ ID NO: 6947194 - DNA, 22 bp, Homo sapiens
gagcaagagtgttggactttga

SEQ ID NO: 6947195 - DNA, 22 bp, Homo sapiens
gggcaactgaaaaattgtattc

SEQ ID NO: 6947196 - DNA, 18 bp, Homo sapiens
ctcagggtgaccaatgca

SEQ ID NO: 6947197 - DNA, 22 bp, Homo sapiens
ctgttcttatcgtcttaatatc

SEQ ID NO: 6947198 - DNA, 22 bp, Homo sapiens
ctgcctgcttctgagccagagg

SEQ ID NO: 6947199 - DNA, 22 bp, Homo sapiens
tcatgtcagtttcttctataaa

SEQ ID NO: 6947200 - DNA, 22 bp, Homo sapiens
tattgcacgatagtgtgggctt

SEQ ID NO: 6947201 - DNA, 22 bp, Homo sapiens
tagatatgtatacttgtttgag

SEQ ID NO: 6947202 - DNA, 22 bp, Homo sapiens
aaggaatgctctaggagggcag

SEQ ID NO: 6947203 - DNA, 22 bp, Homo sapiens
tactgcttcatatagggatgta

SEQ ID NO: 6947204 - DNA, 22 bp, Homo sapiens
catgtacaaaaggcaaatgcct

SEQ ID NO: 6947205 - DNA, 22 bp, Homo sapiens
agagaccagaatccagctgcct

SEQ ID NO: 6947206 - DNA, 18 bp, Homo sapiens
gttttgtggctagtagtg

SEQ ID NO: 6947207 - DNA, 22 bp, Homo sapiens
cagctcctgggccatctcctag

SEQ ID NO: 6947208 - DNA, 22 bp, Homo sapiens
agggagtgttacataatgggtt

SEQ ID NO: 6947209 - DNA, 22 bp, Homo sapiens
ttgccaggctggagtgcagtgg

SEQ ID NO: 6947210 - DNA, 22 bp, Homo sapiens
acacatgaggaaggcctcaccc

SEQ ID NO: 6947211 - DNA, 22 bp, Homo sapiens
ttgcaactaaaagaacttgaca

SEQ ID NO: 6947212 - DNA, 22 bp, Homo sapiens
tgtgtctcttggggtttaaagc

SEQ ID NO: 6947213 - DNA, 21 bp, Homo sapiens
gacacagtaatcttggggctt

SEQ ID NO: 6947214 - DNA, 22 bp, Homo sapiens
gaagaaggtggcccaggggtag

SEQ ID NO: 6947215 - DNA, 22 bp, Homo sapiens
tgtatgcaataataactatgtg

SEQ ID NO: 6947216 - DNA, 22 bp, Homo sapiens
tggttcattgagaagactgaag

SEQ ID NO: 6947217 - DNA, 22 bp, Homo sapiens
gctggaggctggagtgcagtgg

SEQ ID NO: 6947218 - DNA, 22 bp, Homo sapiens
tagcttatcccacagtgcccag

SEQ ID NO: 6947219 - DNA, 20 bp, Homo sapiens
agacctttataatacctcct

SEQ ID NO: 6947220 - DNA, 22 bp, Homo sapiens
ccagtttcttaagtaggaagaa

SEQ ID NO: 6947221 - DNA, 22 bp, Homo sapiens
gaaaggcttaaattgtaagggc

SEQ ID NO: 6947222 - DNA, 22 bp, Homo sapiens
tcatgcctggaatctcaccact

SEQ ID NO: 6947223 - DNA, 22 bp, Homo sapiens
tctgcatctcaggattcccttc

SEQ ID NO: 6947224 - DNA, 22 bp, Homo sapiens
catgaatcagaatcacctagag

SEQ ID NO: 6947225 - DNA, 21 bp, Homo sapiens
cagttacagccaggacaaggc

SEQ ID NO: 6947226 - DNA, 20 bp, Homo sapiens
atcaggattcttgctttgtt

SEQ ID NO: 6947227 - DNA, 22 bp, Homo sapiens
cctgaggcaaggacttggtggc

SEQ ID NO: 6947228 - DNA, 22 bp, Homo sapiens
ctggcatgcccagggtatgtgg

SEQ ID NO: 6947229 - DNA, 22 bp, Homo sapiens
ccacaaggcctgtggggctgct

SEQ ID NO: 6947230 - DNA, 22 bp, Homo sapiens
tgctttcagatatctgtttcaa

SEQ ID NO: 6947231 - DNA, 22 bp, Homo sapiens
attgcaaaattgtcctgtggaa

SEQ ID NO: 6947232 - DNA, 22 bp, Homo sapiens
taacacagagttttaaatgtgg

SEQ ID NO: 6947233 - DNA, 18 bp, Homo sapiens
cgatgtgtatgtgatttg

SEQ ID NO: 6947234 - DNA, 22 bp, Homo sapiens
agtttctttagatagaaagttc

SEQ ID NO: 6947235 - DNA, 22 bp, Homo sapiens
taaaacacctgtagtgtctgcc

SEQ ID NO: 6947236 - DNA, 22 bp, Homo sapiens
agctcagagctcgggaggatgg

SEQ ID NO: 6947237 - DNA, 22 bp, Homo sapiens
gtgctgagtgcggccgaattct

SEQ ID NO: 6947238 - DNA, 19 bp, Homo sapiens
gaagcctgaaataaagtga

SEQ ID NO: 6947239 - DNA, 22 bp, Homo sapiens
tacagcctcgaactcctgcatt

SEQ ID NO: 6947240 - DNA, 22 bp, Homo sapiens
gcgttatttcctgtctgatttc

SEQ ID NO: 6947241 - DNA, 22 bp, Homo sapiens
ggtcctggatgagacaggtagt

SEQ ID NO: 6947242 - DNA, 22 bp, Homo sapiens
tatttgactcttaggaagactc

SEQ ID NO: 6947243 - DNA, 22 bp, Homo sapiens
gtgctgtttgaagccacttcat

SEQ ID NO: 6947244 - DNA, 22 bp, Homo sapiens
ttattcttttctccagaatccc

SEQ ID NO: 6947245 - DNA, 22 bp, Homo sapiens
catgatacttgacatttgcgat

SEQ ID NO: 6947246 - DNA, 22 bp, Homo sapiens
ttaagtcacttatctaaagaca

SEQ ID NO: 6947247 - DNA, 22 bp, Homo sapiens
gaaggctgaattatttgttcct

SEQ ID NO: 6947248 - DNA, 22 bp, Homo sapiens
agttttatgcagtgttctgata

SEQ ID NO: 6947249 - DNA, 22 bp, Homo sapiens
ctggatgcaactgcttctctca

SEQ ID NO: 6947250 - DNA, 22 bp, Homo sapiens
cagaagctgaggagtgaggcaa

SEQ ID NO: 6947251 - DNA, 22 bp, Homo sapiens
acagtgattggggtatctgcag

SEQ ID NO: 6947252 - DNA, 20 bp, Homo sapiens
gggcagagccagccagtccc

SEQ ID NO: 6947253 - DNA, 22 bp, Homo sapiens
agagtgtgtggggctgaggtca

SEQ ID NO: 6947254 - DNA, 22 bp, Homo sapiens
tgacagaaaaatgtagctccat

SEQ ID NO: 6947255 - DNA, 22 bp, Homo sapiens
ccaccggtcaacctgcagattg

SEQ ID NO: 6947256 - DNA, 22 bp, Homo sapiens
cacaggaacaaagaagacaatt

SEQ ID NO: 6947257 - DNA, 22 bp, Homo sapiens
gagaacaaggaagagtcggcag

SEQ ID NO: 6947258 - DNA, 19 bp, Homo sapiens
cctggccagacttctgccc

SEQ ID NO: 6947259 - DNA, 22 bp, Homo sapiens
agcagggaggcccagggcactg

SEQ ID NO: 6947260 - DNA, 22 bp, Homo sapiens
tattacacagtgaaagcatgga

SEQ ID NO: 6947261 - DNA, 17 bp, Homo sapiens
atttacattgtcaccga

SEQ ID NO: 6947262 - DNA, 22 bp, Homo sapiens
ttgtccagcagctcagtctacg

SEQ ID NO: 6947263 - DNA, 22 bp, Homo sapiens
cacttggtttgggagtacataa

SEQ ID NO: 6947264 - DNA, 22 bp, Homo sapiens
cggctggagctttgaacctgat

SEQ ID NO: 6947265 - DNA, 22 bp, Homo sapiens
gatttatctggcttttgttact

SEQ ID NO: 6947266 - DNA, 22 bp, Homo sapiens
gtggtttttagatttctacagt

SEQ ID NO: 6947267 - DNA, 22 bp, Homo sapiens
tgggtccacttctgcactgtgg

SEQ ID NO: 6947268 - DNA, 22 bp, Homo sapiens
tcttgggaaatgtttgcgagct

SEQ ID NO: 6947269 - DNA, 22 bp, Homo sapiens
aagcacagagatgggcacgcct

SEQ ID NO: 6947270 - DNA, 22 bp, Homo sapiens
aaatggcaatttagtttattta

SEQ ID NO: 6947271 - DNA, 22 bp, Homo sapiens
ctttacacatgagacctgcaat

SEQ ID NO: 6947272 - DNA, 22 bp, Homo sapiens
gcacaagggtggtctctggagc

SEQ ID NO: 6947273 - DNA, 17 bp, Homo sapiens
tagcagcagtaattgtg

SEQ ID NO: 6947274 - DNA, 22 bp, Homo sapiens
caggctcagccacaggggaagg

SEQ ID NO: 6947275 - DNA, 22 bp, Homo sapiens
caatgtttgagtaggagcataa

SEQ ID NO: 6947276 - DNA, 22 bp, Homo sapiens
aagtcctagacttggatagttt

SEQ ID NO: 6947277 - DNA, 22 bp, Homo sapiens
gccgagcacagtgcagctgcct

SEQ ID NO: 6947278 - DNA, 22 bp, Homo sapiens
taagtcaaggtggcatttgaga

SEQ ID NO: 6947279 - DNA, 22 bp, Homo sapiens
gtggattacaagacagttgaga

SEQ ID NO: 6947280 - DNA, 19 bp, Homo sapiens
ccaccctgggagctcactc

SEQ ID NO: 6947281 - DNA, 22 bp, Homo sapiens
tccagcccgggggcaggtgacc

SEQ ID NO: 6947282 - DNA, 22 bp, Homo sapiens
gtgtttcctagtttaatgaatg

SEQ ID NO: 6947283 - DNA, 20 bp, Homo sapiens
ttgagcttttagtacagaca

SEQ ID NO: 6947284 - DNA, 23 bp, Homo sapiens
ccagtgattgcctggaaggaggt

SEQ ID NO: 6947285 - DNA, 22 bp, Homo sapiens
atgtggccttaatgacagcagc

SEQ ID NO: 6947286 - DNA, 22 bp, Homo sapiens
ataggcattaacccactccttt

SEQ ID NO: 6947287 - DNA, 22 bp, Homo sapiens
tggcaatttgtagagtaaatta

SEQ ID NO: 6947288 - DNA, 22 bp, Homo sapiens
tccaagaagtttatgttgtttc

SEQ ID NO: 6947289 - DNA, 22 bp, Homo sapiens
tttattattctctggagaatgt

SEQ ID NO: 6947290 - DNA, 22 bp, Homo sapiens
tctctacctgctccatagccat

SEQ ID NO: 6947291 - DNA, 22 bp, Homo sapiens
gggctcttctggcatgctgctc

SEQ ID NO: 6947292 - DNA, 22 bp, Homo sapiens
agaaagccttatgtacagaggc

SEQ ID NO: 6947293 - DNA, 22 bp, Homo sapiens
ttgggggaagaggatagacagt

SEQ ID NO: 6947294 - DNA, 23 bp, Homo sapiens
gtgagtcttgcctttgctgtgga

SEQ ID NO: 6947295 - DNA, 22 bp, Homo sapiens
ggtgtgtctgccaggaactgca

SEQ ID NO: 6947296 - DNA, 22 bp, Homo sapiens
cacacatggtcagtggctactc

SEQ ID NO: 6947297 - DNA, 22 bp, Homo sapiens
atttggaacaaatattagtaaa

SEQ ID NO: 6947298 - DNA, 22 bp, Homo sapiens
atggccatgccagtttacagcc

SEQ ID NO: 6947299 - DNA, 22 bp, Homo sapiens
tgcatgtgtgttaagatgcttt

SEQ ID NO: 6947300 - DNA, 22 bp, Homo sapiens
agtgttgcatgaggcagtacca

SEQ ID NO: 6947301 - DNA, 22 bp, Homo sapiens
gcaggctcccttgcagagcagg

SEQ ID NO: 6947302 - DNA, 22 bp, Homo sapiens
atgcctgtttgaaattggacct

SEQ ID NO: 6947303 - DNA, 22 bp, Homo sapiens
ataaactcatgccaagaaatga

SEQ ID NO: 6947304 - DNA, 22 bp, Homo sapiens
gagctgagatttgaagcaagtt

SEQ ID NO: 6947305 - DNA, 22 bp, Homo sapiens
atccacagtgggggtggcggaa

SEQ ID NO: 6947306 - DNA, 22 bp, Homo sapiens
caactatagatcaaatgagttt

SEQ ID NO: 6947307 - DNA, 22 bp, Homo sapiens
gtgacaaaaacactgattattt

SEQ ID NO: 6947308 - DNA, 22 bp, Homo sapiens
ttcctgggttgtgcattgtaca

SEQ ID NO: 6947309 - DNA, 22 bp, Homo sapiens
ctgtcctgtagctccatcagtc

SEQ ID NO: 6947310 - DNA, 22 bp, Homo sapiens
acagtataaactcctaaaagcc

SEQ ID NO: 6947311 - DNA, 22 bp, Homo sapiens
gctcatgactgtaatcccagca

SEQ ID NO: 6947312 - DNA, 22 bp, Homo sapiens
cccgtccctgtgcgtcgcgagc

SEQ ID NO: 6947313 - DNA, 22 bp, Homo sapiens
tctacactgtagaattataagg

SEQ ID NO: 6947314 - DNA, 22 bp, Homo sapiens
tgtcttcattccccatgaagtc

SEQ ID NO: 6947315 - DNA, 23 bp, Homo sapiens
tggcattttagttagcttcagtg

SEQ ID NO: 6947316 - DNA, 22 bp, Homo sapiens
tttgttcttgcaacagttatta

SEQ ID NO: 6947317 - DNA, 22 bp, Homo sapiens
aagcagctgtgtgacataatct

SEQ ID NO: 6947318 - DNA, 22 bp, Homo sapiens
cttctgtgcaattgtggaggag

SEQ ID NO: 6947319 - DNA, 22 bp, Homo sapiens
ttaatttaagaaacggcaggcc

SEQ ID NO: 6947320 - DNA, 22 bp, Homo sapiens
cagtcctctcactcaggccttt

SEQ ID NO: 6947321 - DNA, 20 bp, Homo sapiens
ctgtacatcaccaaggtgac

SEQ ID NO: 6947322 - DNA, 22 bp, Homo sapiens
ggatcaagtgcactctgaacac

SEQ ID NO: 6947323 - DNA, 22 bp, Homo sapiens
aggtctgtgcgctgttgataga

SEQ ID NO: 6947324 - DNA, 22 bp, Homo sapiens
acccaggagcaggctgggcagt

SEQ ID NO: 6947325 - DNA, 22 bp, Homo sapiens
atgctgaaaattggatttgaat

SEQ ID NO: 6947326 - DNA, 22 bp, Homo sapiens
agtgacaatatgtgctaggtat

SEQ ID NO: 6947327 - DNA, 22 bp, Homo sapiens
ggtgcaagggttgagttgagtg

SEQ ID NO: 6947328 - DNA, 22 bp, Homo sapiens
ctcctctttggggatttacaca

SEQ ID NO: 6947329 - DNA, 22 bp, Homo sapiens
tagggctcgggcacaggacagg

SEQ ID NO: 6947330 - DNA, 22 bp, Homo sapiens
agctccttgcaggttgccttgg

SEQ ID NO: 6947331 - DNA, 22 bp, Homo sapiens
tttttatctacagattctcagc

SEQ ID NO: 6947332 - DNA, 22 bp, Homo sapiens
gtagtaatagtacattagaatg

SEQ ID NO: 6947333 - DNA, 22 bp, Homo sapiens
gttaagtaaactatgatttatc

SEQ ID NO: 6947334 - DNA, 22 bp, Homo sapiens
ttgaagactaatttagataatg

SEQ ID NO: 6947335 - DNA, 22 bp, Homo sapiens
ctgttaatctgcttgcatgatg

SEQ ID NO: 6947336 - DNA, 23 bp, Homo sapiens
aggaatgtgcccacccatctcct

SEQ ID NO: 6947337 - DNA, 23 bp, Homo sapiens
agtacaataagtataattctttc

SEQ ID NO: 6947338 - DNA, 22 bp, Homo sapiens
tatgtgtacaaatcagtaagtg

SEQ ID NO: 6947339 - DNA, 22 bp, Homo sapiens
gcagtgacagacaactgtttga

SEQ ID NO: 6947340 - DNA, 22 bp, Homo sapiens
ttcattccttctgtaccttgcc

SEQ ID NO: 6947341 - DNA, 22 bp, Homo sapiens
gtactagagatgtgtgcgggta

SEQ ID NO: 6947342 - DNA, 22 bp, Homo sapiens
acatcattgtccgttgtcatga

SEQ ID NO: 6947343 - DNA, 22 bp, Homo sapiens
tacattagctcatctatttatt

SEQ ID NO: 6947344 - DNA, 22 bp, Homo sapiens
aagcctagcactgaggaaaaga

SEQ ID NO: 6947345 - DNA, 20 bp, Homo sapiens
tctgccactaattaggtgat

SEQ ID NO: 6947346 - DNA, 22 bp, Homo sapiens
ataatgagaatacagtaactat

SEQ ID NO: 6947347 - DNA, 22 bp, Homo sapiens
gtctgttacctccaagaccatt

SEQ ID NO: 6947348 - DNA, 22 bp, Homo sapiens
tggccaagccactgctgggtct

SEQ ID NO: 6947349 - DNA, 22 bp, Homo sapiens
agctagcaaatagcatgtagga

SEQ ID NO: 6947350 - DNA, 22 bp, Homo sapiens
agagttgccagcttatggccaa

SEQ ID NO: 6947351 - DNA, 22 bp, Homo sapiens
acagaagcctttggccatttga

SEQ ID NO: 6947352 - DNA, 22 bp, Homo sapiens
gaggctgttagggcctgaggta

SEQ ID NO: 6947353 - DNA, 22 bp, Homo sapiens
gcactgcctgtgagccctggtt

SEQ ID NO: 6947354 - DNA, 22 bp, Homo sapiens
ctcccagagagcaggtgggccg

SEQ ID NO: 6947355 - DNA, 20 bp, Homo sapiens
ccagctgcagttcttaatga

SEQ ID NO: 6947356 - DNA, 22 bp, Homo sapiens
tatgtgtggagccagcctggag

SEQ ID NO: 6947357 - DNA, 23 bp, Homo sapiens
ttgtttaccgtaggacttttaac

SEQ ID NO: 6947358 - DNA, 22 bp, Homo sapiens
tctcatgcctggaattatcatt

SEQ ID NO: 6947359 - DNA, 22 bp, Homo sapiens
tttagcacggtaacacataaag

SEQ ID NO: 6947360 - DNA, 22 bp, Homo sapiens
gcactctgtgatctgcagagcc

SEQ ID NO: 6947361 - DNA, 22 bp, Homo sapiens
ttatttgtaaaggtccatagta

SEQ ID NO: 6947362 - DNA, 22 bp, Homo sapiens
gggctgagctaagctgggttga

SEQ ID NO: 6947363 - DNA, 22 bp, Homo sapiens
gaatttcagggtctggtaggaa

SEQ ID NO: 6947364 - DNA, 22 bp, Homo sapiens
tgagctggggtcagctcccctg

SEQ ID NO: 6947365 - DNA, 22 bp, Homo sapiens
tgcatgcttcaggctggctctg

SEQ ID NO: 6947366 - DNA, 18 bp, Homo sapiens
tagagttaatgttccctg

SEQ ID NO: 6947367 - DNA, 22 bp, Homo sapiens
agagtcagttagcgaatactta

SEQ ID NO: 6947368 - DNA, 18 bp, Homo sapiens
ggtaggagccaggaatgt

SEQ ID NO: 6947369 - DNA, 23 bp, Homo sapiens
agtgtctgagtgcaggctgtgca

SEQ ID NO: 6947370 - DNA, 22 bp, Homo sapiens
aggcctcagctcagtgtgacag

SEQ ID NO: 6947371 - DNA, 22 bp, Homo sapiens
ttggccaattccagaggatcat

SEQ ID NO: 6947372 - DNA, 22 bp, Homo sapiens
agtgctcctcagaagagttgga

SEQ ID NO: 6947373 - DNA, 22 bp, Homo sapiens
agctgggagcagagccacagcc

SEQ ID NO: 6947374 - DNA, 22 bp, Homo sapiens
gcaaagcaagctgtcagcctca

SEQ ID NO: 6947375 - DNA, 22 bp, Homo sapiens
tctaagcagaactgaagctctg

SEQ ID NO: 6947376 - DNA, 22 bp, Homo sapiens
caaatccagatcccagtcgtag

SEQ ID NO: 6947377 - DNA, 22 bp, Homo sapiens
agctcctggaggtgcgcactcg

SEQ ID NO: 6947378 - DNA, 22 bp, Homo sapiens
tggagccagcgagccgaggcgg

SEQ ID NO: 6947379 - DNA, 20 bp, Homo sapiens
acatctgagaaacacttaaa

SEQ ID NO: 6947380 - DNA, 22 bp, Homo sapiens
tctggctttcctggagcaagaa

SEQ ID NO: 6947381 - DNA, 22 bp, Homo sapiens
caacacaggggttatgccatgg

SEQ ID NO: 6947382 - DNA, 22 bp, Homo sapiens
gcaggctgatgactggagttgg

SEQ ID NO: 6947383 - DNA, 22 bp, Homo sapiens
atctcccaattccctgataaat

SEQ ID NO: 6947384 - DNA, 22 bp, Homo sapiens
tgcatgcagcatatgaggcctc

SEQ ID NO: 6947385 - DNA, 22 bp, Homo sapiens
cagtatgtctactggacaaagt

SEQ ID NO: 6947386 - DNA, 22 bp, Homo sapiens
aggataaatgatctagattttc

SEQ ID NO: 6947387 - DNA, 22 bp, Homo sapiens
agcgccttggcatcgccagact

SEQ ID NO: 6947388 - DNA, 22 bp, Homo sapiens
gctcggagaactgggggctccg

SEQ ID NO: 6947389 - DNA, 22 bp, Homo sapiens
actgccttgattcatgctgatg

SEQ ID NO: 6947390 - DNA, 22 bp, Homo sapiens
ggctggaaactcaggtagggtt

SEQ ID NO: 6947391 - DNA, 22 bp, Homo sapiens
actagaaccagaggaggcaggt

SEQ ID NO: 6947392 - DNA, 22 bp, Homo sapiens
tgcataatacgtttcctataac

SEQ ID NO: 6947393 - DNA, 22 bp, Homo sapiens
cgcttaattttctatagaaaag

SEQ ID NO: 6947394 - DNA, 22 bp, Homo sapiens
ttctcaggcccctgcctggact

SEQ ID NO: 6947395 - DNA, 22 bp, Homo sapiens
aaaatcacacaagtagatgggg

SEQ ID NO: 6947396 - DNA, 22 bp, Homo sapiens
tctgagaactccgggttagatc

SEQ ID NO: 6947397 - DNA, 22 bp, Homo sapiens
tcctcacaagcaagcacaggta

SEQ ID NO: 6947398 - DNA, 22 bp, Homo sapiens
tctgtccatttggagttggaag

SEQ ID NO: 6947399 - DNA, 22 bp, Homo sapiens
ccactgagaagcacagcttgtc

SEQ ID NO: 6947400 - DNA, 22 bp, Homo sapiens
aggctccttcacagcactcgcc

SEQ ID NO: 6947401 - DNA, 21 bp, Homo sapiens
tcagtgacaggtgctgacctc

SEQ ID NO: 6947402 - DNA, 22 bp, Homo sapiens
cagcccttttttggtacaaccg

SEQ ID NO: 6947403 - DNA, 22 bp, Homo sapiens
gaggccatgaatggatgttcct

SEQ ID NO: 6947404 - DNA, 22 bp, Homo sapiens
tttgctgagttgaagtttgagg

SEQ ID NO: 6947405 - DNA, 22 bp, Homo sapiens
ggtggcactcattatcaggtgc

SEQ ID NO: 6947406 - DNA, 22 bp, Homo sapiens
gccagcagtggccaccaccagg

SEQ ID NO: 6947407 - DNA, 22 bp, Homo sapiens
tagcttcatgcttcaccacgct

SEQ ID NO: 6947408 - DNA, 23 bp, Homo sapiens
tgaggctgattgatttttgctca

SEQ ID NO: 6947409 - DNA, 18 bp, Homo sapiens
gggctcacacaggtcatc

SEQ ID NO: 6947410 - DNA, 22 bp, Homo sapiens
tcaaggaatgggtccttccctt

SEQ ID NO: 6947411 - DNA, 22 bp, Homo sapiens
cctgagaagctggacctggcag

SEQ ID NO: 6947412 - DNA, 22 bp, Homo sapiens
agcagaagaaagccacatgact

SEQ ID NO: 6947413 - DNA, 22 bp, Homo sapiens
tccctgtgaatcagaagcaggt

SEQ ID NO: 6947414 - DNA, 22 bp, Homo sapiens
gggggtgacgatggcagctggt

SEQ ID NO: 6947415 - DNA, 15 bp, Homo sapiens
cagtcccagggaccc

SEQ ID NO: 6947416 - DNA, 22 bp, Homo sapiens
gtggtcatggaaggtcctacct

SEQ ID NO: 6947417 - DNA, 22 bp, Homo sapiens
cctgggaagagctgacaggagg

SEQ ID NO: 6947418 - DNA, 22 bp, Homo sapiens
ctggaatgtatgggaacccaaa

SEQ ID NO: 6947419 - DNA, 22 bp, Homo sapiens
tagaaagagcatagtattataa

SEQ ID NO: 6947420 - DNA, 22 bp, Homo sapiens
tgttacagtactacaattctgc

SEQ ID NO: 6947421 - DNA, 22 bp, Homo sapiens
aggtctgttagcatgttgacta

SEQ ID NO: 6947422 - DNA, 22 bp, Homo sapiens
agaaacagaaccaggtgtcatt

SEQ ID NO: 6947423 - DNA, 22 bp, Homo sapiens
tatcatttgttattattagtgg

SEQ ID NO: 6947424 - DNA, 22 bp, Homo sapiens
gctgctctccaagcctccttga

SEQ ID NO: 6947425 - DNA, 21 bp, Homo sapiens
tatgtatctgcttggttcctc

SEQ ID NO: 6947426 - DNA, 22 bp, Homo sapiens
tacgtgcaaggtccctgcccct

SEQ ID NO: 6947427 - DNA, 22 bp, Homo sapiens
catccccagagcagttccacta

SEQ ID NO: 6947428 - DNA, 22 bp, Homo sapiens
aatctgttctactctattcaga

SEQ ID NO: 6947429 - DNA, 22 bp, Homo sapiens
ctcatctcccacctgcgtgcag

SEQ ID NO: 6947430 - DNA, 22 bp, Homo sapiens
aggttatttaggaaggtagagc

SEQ ID NO: 6947431 - DNA, 22 bp, Homo sapiens
gggtgtagaaagaaccctctgg

SEQ ID NO: 6947432 - DNA, 23 bp, Homo sapiens
ggagcctccggtgtgtgagaggc

SEQ ID NO: 6947433 - DNA, 19 bp, Homo sapiens
ggccaggctgactgtggtc

SEQ ID NO: 6947434 - DNA, 22 bp, Homo sapiens
ggctctgtgtctccacccaaat

SEQ ID NO: 6947435 - DNA, 22 bp, Homo sapiens
agtgttactggttcatgaatct

SEQ ID NO: 6947436 - DNA, 22 bp, Homo sapiens
tgtacacaacgtgcaggtttgt

SEQ ID NO: 6947437 - DNA, 22 bp, Homo sapiens
ttcaggatagtggtgagtggca

SEQ ID NO: 6947438 - DNA, 22 bp, Homo sapiens
cacagcaggtgcttaatgatta

SEQ ID NO: 6947439 - DNA, 22 bp, Homo sapiens
ctctgctgatctcagctgggct

SEQ ID NO: 6947440 - DNA, 22 bp, Homo sapiens
tctgtcatttcaatatggttaa

SEQ ID NO: 6947441 - DNA, 22 bp, Homo sapiens
tcttcaacagtaaacccacttt

SEQ ID NO: 6947442 - DNA, 22 bp, Homo sapiens
tctgaggaatcttgacacattt

SEQ ID NO: 6947443 - DNA, 22 bp, Homo sapiens
agcctctcagagtgctgggatt

SEQ ID NO: 6947444 - DNA, 22 bp, Homo sapiens
tcaagaaggagactccactgtg

SEQ ID NO: 6947445 - DNA, 22 bp, Homo sapiens
agtgtccttagttagctttggg

SEQ ID NO: 6947446 - DNA, 22 bp, Homo sapiens
ggctctggaatgtgtagtcagg

SEQ ID NO: 6947447 - DNA, 23 bp, Homo sapiens
actgagcattagtatttttataa

SEQ ID NO: 6947448 - DNA, 22 bp, Homo sapiens
gacatcttccggatcgccaccc

SEQ ID NO: 6947449 - DNA, 22 bp, Homo sapiens
cacatttctgtgagtcaatatt

SEQ ID NO: 6947450 - DNA, 22 bp, Homo sapiens
gtgagccagttcgactgtttct

SEQ ID NO: 6947451 - DNA, 22 bp, Homo sapiens
tgctgcagagaatgttttggcc

SEQ ID NO: 6947452 - DNA, 22 bp, Homo sapiens
caattcttcctgttggatatgc

SEQ ID NO: 6947453 - DNA, 22 bp, Homo sapiens
tcactgcaacctctgcctcccg

SEQ ID NO: 6947454 - DNA, 22 bp, Homo sapiens
aagtggtttgagcacagtgctg

SEQ ID NO: 6947455 - DNA, 22 bp, Homo sapiens
ctccatgaatttgagctttgtg

SEQ ID NO: 6947456 - DNA, 22 bp, Homo sapiens
tagaaagtcatgaattacacca

SEQ ID NO: 6947457 - DNA, 22 bp, Homo sapiens
tttcaggaaacatttaatggca

SEQ ID NO: 6947458 - DNA, 22 bp, Homo sapiens
tgagagcttgagtatcactggc

SEQ ID NO: 6947459 - DNA, 22 bp, Homo sapiens
ctttcaatgtcatctgtgaatg

SEQ ID NO: 6947460 - DNA, 22 bp, Homo sapiens
gatttggttgcaggaagtaatt

SEQ ID NO: 6947461 - DNA, 22 bp, Homo sapiens
cctgcacctgccatgtgagata

SEQ ID NO: 6947462 - DNA, 22 bp, Homo sapiens
atccatccacgtaacatgtatt

SEQ ID NO: 6947463 - DNA, 22 bp, Homo sapiens
aagcagaaggggaataatattt

SEQ ID NO: 6947464 - DNA, 22 bp, Homo sapiens
accaggccaaaatcatatttac

SEQ ID NO: 6947465 - DNA, 22 bp, Homo sapiens
agggaacaaaactctaaaattc

SEQ ID NO: 6947466 - DNA, 22 bp, Homo sapiens
ttgcattctggtgaggttgcct

SEQ ID NO: 6947467 - DNA, 22 bp, Homo sapiens
acttgcaggtgtctggagttag

SEQ ID NO: 6947468 - DNA, 22 bp, Homo sapiens
ttaaggttcagaaatcaatacc

SEQ ID NO: 6947469 - DNA, 22 bp, Homo sapiens
tgcaggtggtccttcctctgct

SEQ ID NO: 6947470 - DNA, 22 bp, Homo sapiens
atctgggtctgaagataatgat

SEQ ID NO: 6947471 - DNA, 21 bp, Homo sapiens
gctccctgctcagctcctggg

SEQ ID NO: 6947472 - DNA, 22 bp, Homo sapiens
gcagtgaatttaacactcagat

SEQ ID NO: 6947473 - DNA, 22 bp, Homo sapiens
tcctcctgtttctcaggcctgg

SEQ ID NO: 6947474 - DNA, 22 bp, Homo sapiens
gctccctgcctacacggacctt

SEQ ID NO: 6947475 - DNA, 22 bp, Homo sapiens
tctgccatgtgaggatatagga

SEQ ID NO: 6947476 - DNA, 22 bp, Homo sapiens
cctgcctgtaagatgggtacaa

SEQ ID NO: 6947477 - DNA, 22 bp, Homo sapiens
tttgtgttctgatccaaaggcc

SEQ ID NO: 6947478 - DNA, 22 bp, Homo sapiens
tccccagaggaatatgagattg

SEQ ID NO: 6947479 - DNA, 22 bp, Homo sapiens
taggaagtaaactttcttcagc

SEQ ID NO: 6947480 - DNA, 22 bp, Homo sapiens
ttattctgtctttggtctcaat

SEQ ID NO: 6947481 - DNA, 22 bp, Homo sapiens
ataattcaggttttctggcaca

SEQ ID NO: 6947482 - DNA, 22 bp, Homo sapiens
acagtgctgtgcagtctgccct

SEQ ID NO: 6947483 - DNA, 22 bp, Homo sapiens
caatagcagacctagaaagcaa

SEQ ID NO: 6947484 - DNA, 22 bp, Homo sapiens
atgtttaaagggttgagaaata

SEQ ID NO: 6947485 - DNA, 22 bp, Homo sapiens
tctcagtgcagagaggctatct

SEQ ID NO: 6947486 - DNA, 22 bp, Homo sapiens
agctgctgtttcttgcacgtat

SEQ ID NO: 6947487 - DNA, 22 bp, Homo sapiens
gctttgcctccaaagaaaaagt

SEQ ID NO: 6947488 - DNA, 22 bp, Homo sapiens
tggagagaaagttgaatggagg

SEQ ID NO: 6947489 - DNA, 18 bp, Homo sapiens
tttatgagctgtgggacc

SEQ ID NO: 6947490 - DNA, 22 bp, Homo sapiens
ctggagtcctgcatttgctctt

SEQ ID NO: 6947491 - DNA, 21 bp, Homo sapiens
ccaggggcaaattgtcgtttc

SEQ ID NO: 6947492 - DNA, 22 bp, Homo sapiens
tgctgtggcagtttatgtatag

SEQ ID NO: 6947493 - DNA, 22 bp, Homo sapiens
gaaggaagactggtttaaatgt

SEQ ID NO: 6947494 - DNA, 22 bp, Homo sapiens
cagtgtctggttggctctacgt

SEQ ID NO: 6947495 - DNA, 22 bp, Homo sapiens
ccacctgctggttttgctctcc

SEQ ID NO: 6947496 - DNA, 22 bp, Homo sapiens
tagcttctcttttcaacatctt

SEQ ID NO: 6947497 - DNA, 22 bp, Homo sapiens
atctgtcagcctgggattaggg

SEQ ID NO: 6947498 - DNA, 22 bp, Homo sapiens
tattagcttgtttggcaggatg

SEQ ID NO: 6947499 - DNA, 21 bp, Homo sapiens
acacaagcactcgtacatacg

SEQ ID NO: 6947500 - DNA, 22 bp, Homo sapiens
caggtgaggctgaacagatgaa

SEQ ID NO: 6947501 - DNA, 22 bp, Homo sapiens
tctggagtaggacctgaaaata

SEQ ID NO: 6947502 - DNA, 18 bp, Homo sapiens
gaggagccgtccctacta

SEQ ID NO: 6947503 - DNA, 20 bp, Homo sapiens
agagtgctggactgaggagc

SEQ ID NO: 6947504 - DNA, 22 bp, Homo sapiens
tcagctccatccctgcttttgc

SEQ ID NO: 6947505 - DNA, 22 bp, Homo sapiens
ccctgtggatttcagtttgtgt

SEQ ID NO: 6947506 - DNA, 22 bp, Homo sapiens
ggaggccttgaggccaggagct

SEQ ID NO: 6947507 - DNA, 22 bp, Homo sapiens
taatcctgcttcttctcccttt

SEQ ID NO: 6947508 - DNA, 22 bp, Homo sapiens
tgcacagtgacccctggtgact

SEQ ID NO: 6947509 - DNA, 22 bp, Homo sapiens
gaatgtaatagtcagtagaaca

SEQ ID NO: 6947510 - DNA, 22 bp, Homo sapiens
tatgaacattttggtatatatg

SEQ ID NO: 6947511 - DNA, 22 bp, Homo sapiens
tgtacacgtggccatctttaca

SEQ ID NO: 6947512 - DNA, 22 bp, Homo sapiens
atgcatgttgcttggcccactc

SEQ ID NO: 6947513 - DNA, 22 bp, Homo sapiens
ctgcctgactgataatctctga

SEQ ID NO: 6947514 - DNA, 22 bp, Homo sapiens
acacaatgtaccatatctccaa

SEQ ID NO: 6947515 - DNA, 22 bp, Homo sapiens
agggtggtggcgatgaggacat

SEQ ID NO: 6947516 - DNA, 22 bp, Homo sapiens
ttcagcttgctgactgcggcag

SEQ ID NO: 6947517 - DNA, 22 bp, Homo sapiens
agctatgttatagcatgtatca

SEQ ID NO: 6947518 - DNA, 22 bp, Homo sapiens
tatccgtgatgtttataaacca

SEQ ID NO: 6947519 - DNA, 22 bp, Homo sapiens
aggctgcctaggttcaacacct

SEQ ID NO: 6947520 - DNA, 22 bp, Homo sapiens
actgagaatacaatgttgcagg

SEQ ID NO: 6947521 - DNA, 22 bp, Homo sapiens
ctcactcagacatccagtgcag

SEQ ID NO: 6947522 - DNA, 22 bp, Homo sapiens
atttgtactcaggaattctgct

SEQ ID NO: 6947523 - DNA, 22 bp, Homo sapiens
ggctaaggaagaaggatcgtta

SEQ ID NO: 6947524 - DNA, 22 bp, Homo sapiens
taggtataatattttgaagaaa

SEQ ID NO: 6947525 - DNA, 22 bp, Homo sapiens
ctgaggccagctgcagagctct

SEQ ID NO: 6947526 - DNA, 22 bp, Homo sapiens
ggtgagtgtcaatggttagagt

SEQ ID NO: 6947527 - DNA, 22 bp, Homo sapiens
tagggtgcatgacaagatccct

SEQ ID NO: 6947528 - DNA, 22 bp, Homo sapiens
gacttttctgagacaatgcttt

SEQ ID NO: 6947529 - DNA, 22 bp, Homo sapiens
ttctgtacccaacatttttact

SEQ ID NO: 6947530 - DNA, 22 bp, Homo sapiens
tgttacttcttggtaaaggaga

SEQ ID NO: 6947531 - DNA, 22 bp, Homo sapiens
aagatttgtggatttaaggata

SEQ ID NO: 6947532 - DNA, 22 bp, Homo sapiens
aaatgtctgtctcatgaggaaa

SEQ ID NO: 6947533 - DNA, 22 bp, Homo sapiens
cctgaaacatcttctgtaaata

SEQ ID NO: 6947534 - DNA, 22 bp, Homo sapiens
tctatgaacaaagtggtttata

SEQ ID NO: 6947535 - DNA, 23 bp, Homo sapiens
tgcagcaaccttggaagcatttc

SEQ ID NO: 6947536 - DNA, 22 bp, Homo sapiens
ccgcgtggcaccctcctggagg

SEQ ID NO: 6947537 - DNA, 22 bp, Homo sapiens
cagaacacaggctaaactgaga

SEQ ID NO: 6947538 - DNA, 23 bp, Homo sapiens
cactggtggggtttaaaagaagc

SEQ ID NO: 6947539 - DNA, 22 bp, Homo sapiens
agacacaggattctgcatttct

SEQ ID NO: 6947540 - DNA, 22 bp, Homo sapiens
agtgagttgatggaaaactcag

SEQ ID NO: 6947541 - DNA, 22 bp, Homo sapiens
tctaacttagggaatactttag

SEQ ID NO: 6947542 - DNA, 22 bp, Homo sapiens
gagagtgaggcctgggaatcta

SEQ ID NO: 6947543 - DNA, 22 bp, Homo sapiens
aggccttgtaatggaggggaaa

SEQ ID NO: 6947544 - DNA, 22 bp, Homo sapiens
tgaattgctgccatcatatttc

SEQ ID NO: 6947545 - DNA, 22 bp, Homo sapiens
gtgggcagtcatgaaatctaga

SEQ ID NO: 6947546 - DNA, 22 bp, Homo sapiens
aaacatggccattcagactgtg

SEQ ID NO: 6947547 - DNA, 20 bp, Homo sapiens
gatgacatactcacttaggg

SEQ ID NO: 6947548 - DNA, 22 bp, Homo sapiens
ctagggaaagtggacatggctt

SEQ ID NO: 6947549 - DNA, 22 bp, Homo sapiens
tctgcttgtgtctgtccagcct

SEQ ID NO: 6947550 - DNA, 22 bp, Homo sapiens
agcaggcctcatgcaccagcta

SEQ ID NO: 6947551 - DNA, 22 bp, Homo sapiens
tctgcagaaggaatcagctgag

SEQ ID NO: 6947552 - DNA, 22 bp, Homo sapiens
tgtgaaattgaatgcccattgc

SEQ ID NO: 6947553 - DNA, 22 bp, Homo sapiens
aggtagcttggtgctttcattc

SEQ ID NO: 6947554 - DNA, 22 bp, Homo sapiens
tttctaagtgtgtttcatagga

SEQ ID NO: 6947555 - DNA, 22 bp, Homo sapiens
actgcactccaacctgggcaat

SEQ ID NO: 6947556 - DNA, 22 bp, Homo sapiens
tagcagcgactaatgaataagt

SEQ ID NO: 6947557 - DNA, 23 bp, Homo sapiens
tttttagttacacctctgccacc

SEQ ID NO: 6947558 - DNA, 22 bp, Homo sapiens
tcttgccgcgcaggcgcagttc

SEQ ID NO: 6947559 - DNA, 20 bp, Homo sapiens
caggtgattccctggggaat

SEQ ID NO: 6947560 - DNA, 22 bp, Homo sapiens
ggtgctgatgaagatgtagcct

SEQ ID NO: 6947561 - DNA, 23 bp, Homo sapiens
tgtaacaattcccagcctttgcc

SEQ ID NO: 6947562 - DNA, 22 bp, Homo sapiens
gaactgttccctcacaggctgg

SEQ ID NO: 6947563 - DNA, 22 bp, Homo sapiens
attgtggaccaggtagagcttt

SEQ ID NO: 6947564 - DNA, 20 bp, Homo sapiens
tacaaagagcccctctcttc

SEQ ID NO: 6947565 - DNA, 22 bp, Homo sapiens
gaaactgtgatcgtgttctggg

SEQ ID NO: 6947566 - DNA, 18 bp, Homo sapiens
agtgcatgctaggggaag

SEQ ID NO: 6947567 - DNA, 22 bp, Homo sapiens
ataggacagcagacaattagta

SEQ ID NO: 6947568 - DNA, 22 bp, Homo sapiens
aacaataggacctttatgttct

SEQ ID NO: 6947569 - DNA, 22 bp, Homo sapiens
tcacccctccattctctcatgt

SEQ ID NO: 6947570 - DNA, 22 bp, Homo sapiens
agggagcatgggtgaagcaggc

SEQ ID NO: 6947571 - DNA, 22 bp, Homo sapiens
tgcaggcttggatcacatctcc

SEQ ID NO: 6947572 - DNA, 22 bp, Homo sapiens
agttattttacatggaagtttg

SEQ ID NO: 6947573 - DNA, 22 bp, Homo sapiens
tcacattgaagaaattttaagt

SEQ ID NO: 6947574 - DNA, 22 bp, Homo sapiens
tctcagaggtcttcagcctctg

SEQ ID NO: 6947575 - DNA, 19 bp, Homo sapiens
ggacagggggagcttttat

SEQ ID NO: 6947576 - DNA, 22 bp, Homo sapiens
tcttttgtgaggacaaggtacg

SEQ ID NO: 6947577 - DNA, 22 bp, Homo sapiens
cttagacatggcagctccaagt

SEQ ID NO: 6947578 - DNA, 22 bp, Homo sapiens
cagaaactagatttagacacaa

SEQ ID NO: 6947579 - DNA, 22 bp, Homo sapiens
gatgtggggataatactggtac

SEQ ID NO: 6947580 - DNA, 22 bp, Homo sapiens
agcagggcatgaataagggttt

SEQ ID NO: 6947581 - DNA, 22 bp, Homo sapiens
ggagacactggaaagtattaca

SEQ ID NO: 6947582 - DNA, 22 bp, Homo sapiens
cacagatttcctaagcatcaat

SEQ ID NO: 6947583 - DNA, 22 bp, Homo sapiens
attcccataggcaatgcgtgat

SEQ ID NO: 6947584 - DNA, 18 bp, Homo sapiens
tccatcctctgctcttca

SEQ ID NO: 6947585 - DNA, 22 bp, Homo sapiens
gcaggatggtgccctttctgcc

SEQ ID NO: 6947586 - DNA, 22 bp, Homo sapiens
actcgatttcactagagtaact

SEQ ID NO: 6947587 - DNA, 22 bp, Homo sapiens
ggacagggttggggcatataaa

SEQ ID NO: 6947588 - DNA, 22 bp, Homo sapiens
ccagtgtgccaatttacagctg

SEQ ID NO: 6947589 - DNA, 22 bp, Homo sapiens
ggtcagaggaggaataggacat

SEQ ID NO: 6947590 - DNA, 22 bp, Homo sapiens
ggaccaggcaagctgaggcggg

SEQ ID NO: 6947591 - DNA, 22 bp, Homo sapiens
aactgctcatttgagagtatgc

SEQ ID NO: 6947592 - DNA, 22 bp, Homo sapiens
tcactgtatcatgttgcactta

SEQ ID NO: 6947593 - DNA, 22 bp, Homo sapiens
gatttccatgattgggccagaa

SEQ ID NO: 6947594 - DNA, 22 bp, Homo sapiens
ccagctcatattttatgtgcag

SEQ ID NO: 6947595 - DNA, 22 bp, Homo sapiens
tttttgtgatatgacactgtat

SEQ ID NO: 6947596 - DNA, 22 bp, Homo sapiens
taatttcacagttcaacgcaca

SEQ ID NO: 6947597 - DNA, 22 bp, Homo sapiens
attctaatggcagagactcctg

SEQ ID NO: 6947598 - DNA, 22 bp, Homo sapiens
cttggatgccagcggcctccta

SEQ ID NO: 6947599 - DNA, 22 bp, Homo sapiens
cgtaggatactcagtgctcatt

SEQ ID NO: 6947600 - DNA, 22 bp, Homo sapiens
atgacagttctacacttaatct

SEQ ID NO: 6947601 - DNA, 22 bp, Homo sapiens
ttacaatctgattgtctcatct

SEQ ID NO: 6947602 - DNA, 22 bp, Homo sapiens
ctgcatcctggaaatagctaag

SEQ ID NO: 6947603 - DNA, 22 bp, Homo sapiens
agagcctgagcctgatcttgaa

SEQ ID NO: 6947604 - DNA, 22 bp, Homo sapiens
ctgggccttgatcacacaggtg

SEQ ID NO: 6947605 - DNA, 22 bp, Homo sapiens
ggatcagaatctttgggtgtaa

SEQ ID NO: 6947606 - DNA, 22 bp, Homo sapiens
taggggcaggatcctttgagcc

SEQ ID NO: 6947607 - DNA, 22 bp, Homo sapiens
tgaacacgcttcatacagaggg

SEQ ID NO: 6947608 - DNA, 17 bp, Homo sapiens
aggtgggtggatcacct

SEQ ID NO: 6947609 - DNA, 22 bp, Homo sapiens
gactttgagggatacaaacatt

SEQ ID NO: 6947610 - DNA, 22 bp, Homo sapiens
tccatggggcccaggatgagag

SEQ ID NO: 6947611 - DNA, 22 bp, Homo sapiens
atggccctgccaggaggaacaa

SEQ ID NO: 6947612 - DNA, 22 bp, Homo sapiens
ctggtcctaaagccctactcca

SEQ ID NO: 6947613 - DNA, 19 bp, Homo sapiens
tgagtggagtgcaatgaag

SEQ ID NO: 6947614 - DNA, 22 bp, Homo sapiens
catttagacatttgatttgggg

SEQ ID NO: 6947615 - DNA, 22 bp, Homo sapiens
acatttctgagcagggagctgt

SEQ ID NO: 6947616 - DNA, 22 bp, Homo sapiens
tatgggtataaacaggtcctaa

SEQ ID NO: 6947617 - DNA, 19 bp, Homo sapiens
gggatcagcccagggctct

SEQ ID NO: 6947618 - DNA, 22 bp, Homo sapiens
agtcacttcctgcttgacctga

SEQ ID NO: 6947619 - DNA, 22 bp, Homo sapiens
gggctgagtgggcctcttactt

SEQ ID NO: 6947620 - DNA, 22 bp, Homo sapiens
aatcagactattaaagtctctt

SEQ ID NO: 6947621 - DNA, 23 bp, Homo sapiens
gctataggtagaaggaatctttt

SEQ ID NO: 6947622 - DNA, 22 bp, Homo sapiens
tgagtagatccaagactgtcct

SEQ ID NO: 6947623 - DNA, 22 bp, Homo sapiens
ctggaattgatagaagggagct

SEQ ID NO: 6947624 - DNA, 17 bp, Homo sapiens
agaaactgaggctcagt

SEQ ID NO: 6947625 - DNA, 22 bp, Homo sapiens
aatgtcttctcttgttgaattt

SEQ ID NO: 6947626 - DNA, 22 bp, Homo sapiens
atttactgaggtaaataaactg

SEQ ID NO: 6947627 - DNA, 22 bp, Homo sapiens
tggcagtggcgggactcagggc

SEQ ID NO: 6947628 - DNA, 22 bp, Homo sapiens
gcagtaccaaggagataagata

SEQ ID NO: 6947629 - DNA, 22 bp, Homo sapiens
gcagtgggcctgaggaagggtg

SEQ ID NO: 6947630 - DNA, 22 bp, Homo sapiens
gtgtgtccaaggcacggatgac

SEQ ID NO: 6947631 - DNA, 22 bp, Homo sapiens
tttcagtttttgctcgatgtat

SEQ ID NO: 6947632 - DNA, 21 bp, Homo sapiens
tgggacctatttcaactggat

SEQ ID NO: 6947633 - DNA, 22 bp, Homo sapiens
gtgtgcccaggtaaagcatttc

SEQ ID NO: 6947634 - DNA, 22 bp, Homo sapiens
acttcctggctgggtgacctgg

SEQ ID NO: 6947635 - DNA, 22 bp, Homo sapiens
aagcctttctctctgggaagga

SEQ ID NO: 6947636 - DNA, 22 bp, Homo sapiens
agccctctgctgttctagtctc

SEQ ID NO: 6947637 - DNA, 22 bp, Homo sapiens
tagctcatgtaatccgaacata

SEQ ID NO: 6947638 - DNA, 21 bp, Homo sapiens
tcgtgcagcagctgaggcttg

SEQ ID NO: 6947639 - DNA, 22 bp, Homo sapiens
tttgagctatgggcttggattt

SEQ ID NO: 6947640 - DNA, 22 bp, Homo sapiens
aatgcacatatatgtgtataca

SEQ ID NO: 6947641 - DNA, 22 bp, Homo sapiens
atgcagagcttccagtggcctg

SEQ ID NO: 6947642 - DNA, 22 bp, Homo sapiens
ctctgaggttccctgggtccca

SEQ ID NO: 6947643 - DNA, 22 bp, Homo sapiens
tactcaaactcactaagacaga

SEQ ID NO: 6947644 - DNA, 22 bp, Homo sapiens
attctgtcatttcaagaaaaac

SEQ ID NO: 6947645 - DNA, 22 bp, Homo sapiens
caaggacactgagctttgtaaa

SEQ ID NO: 6947646 - DNA, 20 bp, Homo sapiens
attctctgacaccgcccccg

SEQ ID NO: 6947647 - DNA, 22 bp, Homo sapiens
tacttacagaaggaagcaattg

SEQ ID NO: 6947648 - DNA, 22 bp, Homo sapiens
gctggcagagctctgggctggg

SEQ ID NO: 6947649 - DNA, 20 bp, Homo sapiens
agaagcattcaaagaaaact

SEQ ID NO: 6947650 - DNA, 22 bp, Homo sapiens
ctgtgctttcaaaagaagggtt

SEQ ID NO: 6947651 - DNA, 22 bp, Homo sapiens
aaacagccatgtcagctttgca

SEQ ID NO: 6947652 - DNA, 20 bp, Homo sapiens
tggctttactagtggcactc

SEQ ID NO: 6947653 - DNA, 22 bp, Homo sapiens
ttctaaacttcaattctaaatt

SEQ ID NO: 6947654 - DNA, 22 bp, Homo sapiens
tcacgagggccctgggcagctg

SEQ ID NO: 6947655 - DNA, 22 bp, Homo sapiens
gcagggaagatcttggagctgc

SEQ ID NO: 6947656 - DNA, 22 bp, Homo sapiens
tctgggtacttgcaagattttc

SEQ ID NO: 6947657 - DNA, 22 bp, Homo sapiens
gctaccctgggaatctccctca

SEQ ID NO: 6947658 - DNA, 22 bp, Homo sapiens
aggcgcattgaggccctgttgc

SEQ ID NO: 6947659 - DNA, 22 bp, Homo sapiens
tcagtaaagttctttcttgctg

SEQ ID NO: 6947660 - DNA, 22 bp, Homo sapiens
gtaaatgtgaatgtcatttagc

SEQ ID NO: 6947661 - DNA, 22 bp, Homo sapiens
caatgtcatttcactgggctta

SEQ ID NO: 6947662 - DNA, 22 bp, Homo sapiens
tttctgtgataggctgcgacgc

SEQ ID NO: 6947663 - DNA, 23 bp, Homo sapiens
ggcagcttgttcctttgcttcca

SEQ ID NO: 6947664 - DNA, 22 bp, Homo sapiens
cctgtctgtttgcccattcttg

SEQ ID NO: 6947665 - DNA, 22 bp, Homo sapiens
cccaactgaaatctccacctgc

SEQ ID NO: 6947666 - DNA, 19 bp, Homo sapiens
gggtcgggaagttgagaat

SEQ ID NO: 6947667 - DNA, 22 bp, Homo sapiens
aggctagcaatgggagatgagt

SEQ ID NO: 6947668 - DNA, 22 bp, Homo sapiens
ctggagccggaccagggacggt

SEQ ID NO: 6947669 - DNA, 22 bp, Homo sapiens
ttagctatagtatgtctgcttt

SEQ ID NO: 6947670 - DNA, 22 bp, Homo sapiens
cctcatgctgcatctctgaggt

SEQ ID NO: 6947671 - DNA, 22 bp, Homo sapiens
ttaaagagaactcaatgaatga

SEQ ID NO: 6947672 - DNA, 22 bp, Homo sapiens
gtttcaggttggacaacatgcc

SEQ ID NO: 6947673 - DNA, 22 bp, Homo sapiens
tgaatggattcagaaaatgtgt

SEQ ID NO: 6947674 - DNA, 22 bp, Homo sapiens
gtggaacagaactgtttattga

SEQ ID NO: 6947675 - DNA, 19 bp, Homo sapiens
aggcagcattctggggctt

SEQ ID NO: 6947676 - DNA, 22 bp, Homo sapiens
tcccaaggcacagggcagggac

SEQ ID NO: 6947677 - DNA, 22 bp, Homo sapiens
gtcctgttgtgagctgccttcc

SEQ ID NO: 6947678 - DNA, 22 bp, Homo sapiens
caggcagactttgagaatgatg

SEQ ID NO: 6947679 - DNA, 22 bp, Homo sapiens
aaaggttttgttcatcgatttt

SEQ ID NO: 6947680 - DNA, 22 bp, Homo sapiens
tctgcaagtgacccgggcccag

SEQ ID NO: 6947681 - DNA, 22 bp, Homo sapiens
tcgtctgtgaaattgggataag

SEQ ID NO: 6947682 - DNA, 22 bp, Homo sapiens
ctgccagaagagaacaccagtt

SEQ ID NO: 6947683 - DNA, 22 bp, Homo sapiens
ccacagtttgccaacacctact

SEQ ID NO: 6947684 - DNA, 22 bp, Homo sapiens
gttgctctatgtgtgttctatg

SEQ ID NO: 6947685 - DNA, 22 bp, Homo sapiens
tttggcagaaataagtggggca

SEQ ID NO: 6947686 - DNA, 22 bp, Homo sapiens
aaatcacagggtctctaagtat

SEQ ID NO: 6947687 - DNA, 16 bp, Homo sapiens
gcaactttggggttga

SEQ ID NO: 6947688 - DNA, 22 bp, Homo sapiens
ctgggagttgacgaggcttgta

SEQ ID NO: 6947689 - DNA, 22 bp, Homo sapiens
cttctggcaaaacaggcagaaa

SEQ ID NO: 6947690 - DNA, 22 bp, Homo sapiens
taatgcacatttattttacctt

SEQ ID NO: 6947691 - DNA, 22 bp, Homo sapiens
tgcttcagtgtgtcattattta

SEQ ID NO: 6947692 - DNA, 22 bp, Homo sapiens
atctgcttgccctcttaggacc

SEQ ID NO: 6947693 - DNA, 23 bp, Homo sapiens
agggcatgaagcagaggacgtgg

SEQ ID NO: 6947694 - DNA, 22 bp, Homo sapiens
tgtatttttaggaatgcgctat

SEQ ID NO: 6947695 - DNA, 20 bp, Homo sapiens
ttgaggtcaaggactaggcc

SEQ ID NO: 6947696 - DNA, 22 bp, Homo sapiens
gttctattctccagttacatat

SEQ ID NO: 6947697 - DNA, 22 bp, Homo sapiens
caggctcagatgccctgcgctg

SEQ ID NO: 6947698 - DNA, 22 bp, Homo sapiens
tcagccacttccctctggtcag

SEQ ID NO: 6947699 - DNA, 22 bp, Homo sapiens
ccttagatcaggctgtctaggg

SEQ ID NO: 6947700 - DNA, 22 bp, Homo sapiens
tacaaagtttggggtcctcaaa

SEQ ID NO: 6947701 - DNA, 22 bp, Homo sapiens
agctttacctgccttggggcac

SEQ ID NO: 6947702 - DNA, 22 bp, Homo sapiens
tgggctattaggaccaggccat

SEQ ID NO: 6947703 - DNA, 22 bp, Homo sapiens
gttatgtatgagggaatgatta

SEQ ID NO: 6947704 - DNA, 22 bp, Homo sapiens
tggcccagccctgctctagggc

SEQ ID NO: 6947705 - DNA, 22 bp, Homo sapiens
gagtcacattaatttaatttta

SEQ ID NO: 6947706 - DNA, 22 bp, Homo sapiens
tcatttcagttgttccctggtt

SEQ ID NO: 6947707 - DNA, 22 bp, Homo sapiens
tgactctgctgtgaaagcattt

SEQ ID NO: 6947708 - DNA, 18 bp, Homo sapiens
tcagacaagttagacagg

SEQ ID NO: 6947709 - DNA, 22 bp, Homo sapiens
ctaaagtgccaggaatacaggt

SEQ ID NO: 6947710 - DNA, 22 bp, Homo sapiens
ttcaacaattaagtatcagcct

SEQ ID NO: 6947711 - DNA, 19 bp, Homo sapiens
ggcaccttggctatgcctg

SEQ ID NO: 6947712 - DNA, 22 bp, Homo sapiens
tgtgtcgcaccctacacccagg

SEQ ID NO: 6947713 - DNA, 22 bp, Homo sapiens
tccaggcagtcattaatctcta

SEQ ID NO: 6947714 - DNA, 22 bp, Homo sapiens
agactctgaagtcattgcatga

SEQ ID NO: 6947715 - DNA, 22 bp, Homo sapiens
tttggaagtcctgaaatagagg

SEQ ID NO: 6947716 - DNA, 22 bp, Homo sapiens
ttgaagaggactttgcagctgt

SEQ ID NO: 6947717 - DNA, 22 bp, Homo sapiens
ggaatcttcagccatgccaaga

SEQ ID NO: 6947718 - DNA, 22 bp, Homo sapiens
gtgtaaatcagcttgtgtaata

SEQ ID NO: 6947719 - DNA, 22 bp, Homo sapiens
tttctagagttcatcatggtaa

SEQ ID NO: 6947720 - DNA, 22 bp, Homo sapiens
acaagagtctgcatttctaaca

SEQ ID NO: 6947721 - DNA, 19 bp, Homo sapiens
ttagccatccacagtgaaa

SEQ ID NO: 6947722 - DNA, 22 bp, Homo sapiens
ctgagctgtgtggtcctgggca

SEQ ID NO: 6947723 - DNA, 22 bp, Homo sapiens
attcccatctctgagtggaagg

SEQ ID NO: 6947724 - DNA, 22 bp, Homo sapiens
agagcagcacgttgtccccaca

SEQ ID NO: 6947725 - DNA, 22 bp, Homo sapiens
tctttccatggccacacagtct

SEQ ID NO: 6947726 - DNA, 17 bp, Homo sapiens
atctgcttcacccagca

SEQ ID NO: 6947727 - DNA, 22 bp, Homo sapiens
ctgtgcccaggctggagtgcag

SEQ ID NO: 6947728 - DNA, 22 bp, Homo sapiens
taatcatggcctcaaattttat

SEQ ID NO: 6947729 - DNA, 22 bp, Homo sapiens
aggccaagctcccagagaagct

SEQ ID NO: 6947730 - DNA, 23 bp, Homo sapiens
tgggtagagctgcaaggacactg

SEQ ID NO: 6947731 - DNA, 22 bp, Homo sapiens
tagtgtgtatggtaatgatgaa

SEQ ID NO: 6947732 - DNA, 22 bp, Homo sapiens
ccaaacttaacgatgtttttgt

SEQ ID NO: 6947733 - DNA, 22 bp, Homo sapiens
ttggccttctcttcccggtcct

SEQ ID NO: 6947734 - DNA, 22 bp, Homo sapiens
tcccgattcttcctatacagga

SEQ ID NO: 6947735 - DNA, 22 bp, Homo sapiens
caggtggcttctctgcagcctt

SEQ ID NO: 6947736 - DNA, 22 bp, Homo sapiens
atacagttagaaaaaaagcctt

SEQ ID NO: 6947737 - DNA, 22 bp, Homo sapiens
agctactggagaacacaaaacc

SEQ ID NO: 6947738 - DNA, 22 bp, Homo sapiens
aaacccagagactagaaagacc

SEQ ID NO: 6947739 - DNA, 22 bp, Homo sapiens
cagtgccagctgcttggcctac

SEQ ID NO: 6947740 - DNA, 22 bp, Homo sapiens
ccctgcacagcctggctctctt

SEQ ID NO: 6947741 - DNA, 22 bp, Homo sapiens
agcccaatcctagcactttgag

SEQ ID NO: 6947742 - DNA, 22 bp, Homo sapiens
tgctatgttgcccagggtggcc

SEQ ID NO: 6947743 - DNA, 22 bp, Homo sapiens
cagctgttcctggaaggagacc

SEQ ID NO: 6947744 - DNA, 22 bp, Homo sapiens
atagagctataagaattttgtg

SEQ ID NO: 6947745 - DNA, 22 bp, Homo sapiens
gtgatgtcacagaataagtgat

SEQ ID NO: 6947746 - DNA, 22 bp, Homo sapiens
tcttggctattcttgaattctg

SEQ ID NO: 6947747 - DNA, 22 bp, Homo sapiens
cctttgcaatgaattgttattg

SEQ ID NO: 6947748 - DNA, 21 bp, Homo sapiens
acatacattatctttttaaaa

SEQ ID NO: 6947749 - DNA, 22 bp, Homo sapiens
aagagtaaagcaaagcacttgt

SEQ ID NO: 6947750 - DNA, 22 bp, Homo sapiens
tcacagctgagtttccatttct

SEQ ID NO: 6947751 - DNA, 22 bp, Homo sapiens
gagcttttataccttctctcag

SEQ ID NO: 6947752 - DNA, 17 bp, Homo sapiens
catttgctggttggctc

SEQ ID NO: 6947753 - DNA, 22 bp, Homo sapiens
ttgtgcaatggtgtttaggttt

SEQ ID NO: 6947754 - DNA, 22 bp, Homo sapiens
caggagacagtgttattttatt

SEQ ID NO: 6947755 - DNA, 22 bp, Homo sapiens
cacagttttgcccagggcttct

SEQ ID NO: 6947756 - DNA, 22 bp, Homo sapiens
gctcccactgcagccctgagcc

SEQ ID NO: 6947757 - DNA, 22 bp, Homo sapiens
cacacaggcaggatcccttccc

SEQ ID NO: 6947758 - DNA, 22 bp, Homo sapiens
gttggtgtctgtcttgttcatt

SEQ ID NO: 6947759 - DNA, 22 bp, Homo sapiens
agctgctgcccataggtgacat

SEQ ID NO: 6947760 - DNA, 22 bp, Homo sapiens
tggtgctgtctactttgtgcag

SEQ ID NO: 6947761 - DNA, 22 bp, Homo sapiens
tccagctcaaattcagcttcca

SEQ ID NO: 6947762 - DNA, 22 bp, Homo sapiens
agaagtttaaccaggtgctact

SEQ ID NO: 6947763 - DNA, 22 bp, Homo sapiens
taacactatccagatatgataa

SEQ ID NO: 6947764 - DNA, 22 bp, Homo sapiens
gcagacacttttattctgcata

SEQ ID NO: 6947765 - DNA, 22 bp, Homo sapiens
atctgcacttaagcgaggcctg

SEQ ID NO: 6947766 - DNA, 22 bp, Homo sapiens
tgttttatgagccatataacct

SEQ ID NO: 6947767 - DNA, 22 bp, Homo sapiens
gttcataatttgaaggaatagg

SEQ ID NO: 6947768 - DNA, 22 bp, Homo sapiens
tttattccaaagcttgcacttt

SEQ ID NO: 6947769 - DNA, 18 bp, Homo sapiens
gagctgccatatttagtt

SEQ ID NO: 6947770 - DNA, 22 bp, Homo sapiens
atggctgaggctggaggtggca

SEQ ID NO: 6947771 - DNA, 22 bp, Homo sapiens
ctatggaagggatgcaaagaaa

SEQ ID NO: 6947772 - DNA, 22 bp, Homo sapiens
cccagcagatggctatgtgcta

SEQ ID NO: 6947773 - DNA, 22 bp, Homo sapiens
ctgtggctaggaagctgtggga

SEQ ID NO: 6947774 - DNA, 22 bp, Homo sapiens
actgtaaaatgagatatgtata

SEQ ID NO: 6947775 - DNA, 22 bp, Homo sapiens
aagtacagagcctcagtttgac

SEQ ID NO: 6947776 - DNA, 22 bp, Homo sapiens
catgagtgggattaatgacctt

SEQ ID NO: 6947777 - DNA, 22 bp, Homo sapiens
cactggcatctagtgggttgag

SEQ ID NO: 6947778 - DNA, 19 bp, Homo sapiens
cagagcagtggttcctgaa

SEQ ID NO: 6947779 - DNA, 22 bp, Homo sapiens
gagttgcctctaagtccctggt

SEQ ID NO: 6947780 - DNA, 22 bp, Homo sapiens
agctgggcctgagctggaagct

SEQ ID NO: 6947781 - DNA, 22 bp, Homo sapiens
ctgaggaagacagcagctgtgt

SEQ ID NO: 6947782 - DNA, 22 bp, Homo sapiens
catggccttcacctcccctgcc

SEQ ID NO: 6947783 - DNA, 21 bp, Homo sapiens
catattaaatcggtgccttta

SEQ ID NO: 6947784 - DNA, 22 bp, Homo sapiens
catcttgagacatgaaaggtgt

SEQ ID NO: 6947785 - DNA, 20 bp, Homo sapiens
caccctcccagcacctatgc

SEQ ID NO: 6947786 - DNA, 18 bp, Homo sapiens
taaattgcttcacctgag

SEQ ID NO: 6947787 - DNA, 22 bp, Homo sapiens
aggcgtggttgaggcgagcata

SEQ ID NO: 6947788 - DNA, 22 bp, Homo sapiens
tggagggatacaaagatgaaaa

SEQ ID NO: 6947789 - DNA, 22 bp, Homo sapiens
gagccaagggttgccatggaga

SEQ ID NO: 6947790 - DNA, 21 bp, Homo sapiens
ttcacagatgggaaaactgag

SEQ ID NO: 6947791 - DNA, 22 bp, Homo sapiens
gtatagaaacccagaaagatag

SEQ ID NO: 6947792 - DNA, 22 bp, Homo sapiens
aaggctggttccatccctggtg

SEQ ID NO: 6947793 - DNA, 22 bp, Homo sapiens
gctaggaggaagaatgtgaatt

SEQ ID NO: 6947794 - DNA, 22 bp, Homo sapiens
tttggtattgcacactgtcttc

SEQ ID NO: 6947795 - DNA, 22 bp, Homo sapiens
cagattgagtctgggaaaaggc

SEQ ID NO: 6947796 - DNA, 22 bp, Homo sapiens
tcaagtttaattgagatgttta

SEQ ID NO: 6947797 - DNA, 22 bp, Homo sapiens
tatttgcaggcttttgtcatgg

SEQ ID NO: 6947798 - DNA, 22 bp, Homo sapiens
agacagggagggagcgcggctg

SEQ ID NO: 6947799 - DNA, 22 bp, Homo sapiens
tgaaatgtcagtgttttataag

SEQ ID NO: 6947800 - DNA, 22 bp, Homo sapiens
agggagaggagggtcttgttga

SEQ ID NO: 6947801 - DNA, 22 bp, Homo sapiens
ggtgaagcagagtctattacta

SEQ ID NO: 6947802 - DNA, 22 bp, Homo sapiens
aaatggaagtgtatttagtgtt

SEQ ID NO: 6947803 - DNA, 22 bp, Homo sapiens
tgagtatttctaatattccagt

SEQ ID NO: 6947804 - DNA, 22 bp, Homo sapiens
ctctccagcctttagcccacgc

SEQ ID NO: 6947805 - DNA, 22 bp, Homo sapiens
tgactgaaatggcgacagtgaa

SEQ ID NO: 6947806 - DNA, 19 bp, Homo sapiens
ccaacagtactgaagcact

SEQ ID NO: 6947807 - DNA, 22 bp, Homo sapiens
ctagtttctccgttttctaccc

SEQ ID NO: 6947808 - DNA, 22 bp, Homo sapiens
aatcagaaattctacatcacaa

SEQ ID NO: 6947809 - DNA, 22 bp, Homo sapiens
tatcaattgggccaaatggtac

SEQ ID NO: 6947810 - DNA, 22 bp, Homo sapiens
tgtgcatgttctcatttctaac

SEQ ID NO: 6947811 - DNA, 22 bp, Homo sapiens
ctgcagttgggtgacccaatat

SEQ ID NO: 6947812 - DNA, 21 bp, Homo sapiens
ccagctgttcctcgtccgatg

SEQ ID NO: 6947813 - DNA, 22 bp, Homo sapiens
tgagggggttaattaggagagt

SEQ ID NO: 6947814 - DNA, 22 bp, Homo sapiens
cagggccagagagggctggctg

SEQ ID NO: 6947815 - DNA, 22 bp, Homo sapiens
tccctcactggttctgcatccc

SEQ ID NO: 6947816 - DNA, 22 bp, Homo sapiens
tcggaaggggccgcgctcggac

SEQ ID NO: 6947817 - DNA, 22 bp, Homo sapiens
cttcctttggttggagcgccgt

SEQ ID NO: 6947818 - DNA, 23 bp, Homo sapiens
aggcatcttctgagttaagagca

SEQ ID NO: 6947819 - DNA, 22 bp, Homo sapiens
aggcaggtgagtcaaaacagac

SEQ ID NO: 6947820 - DNA, 22 bp, Homo sapiens
aaggtaatccataatagttact

SEQ ID NO: 6947821 - DNA, 22 bp, Homo sapiens
caggtgctgtcctgcacatgtc

SEQ ID NO: 6947822 - DNA, 22 bp, Homo sapiens
tgacaagaggcagaatcagctg

SEQ ID NO: 6947823 - DNA, 22 bp, Homo sapiens
ttaaaactgcaaatcctactga

SEQ ID NO: 6947824 - DNA, 18 bp, Homo sapiens
gccagagggcccaaggtc

SEQ ID NO: 6947825 - DNA, 17 bp, Homo sapiens
cgagggcttgctggctc

SEQ ID NO: 6947826 - DNA, 22 bp, Homo sapiens
tggcagtcagcatttgtagtat

SEQ ID NO: 6947827 - DNA, 22 bp, Homo sapiens
ttagtcccattatatgacttct

SEQ ID NO: 6947828 - DNA, 22 bp, Homo sapiens
tcccattgtggaaggcagaaga

SEQ ID NO: 6947829 - DNA, 22 bp, Homo sapiens
gccctgagttgagccttccaaa

SEQ ID NO: 6947830 - DNA, 22 bp, Homo sapiens
agaggctgttacactcccagat

SEQ ID NO: 6947831 - DNA, 22 bp, Homo sapiens
tatactgtgttttcaccactgt

SEQ ID NO: 6947832 - DNA, 22 bp, Homo sapiens
gatttctgggctttatttcaga

SEQ ID NO: 6947833 - DNA, 22 bp, Homo sapiens
tctttaaggtgatttctgctac

SEQ ID NO: 6947834 - DNA, 19 bp, Homo sapiens
ccaggctttatgcaaatac

SEQ ID NO: 6947835 - DNA, 22 bp, Homo sapiens
gcgggggtggccagcaagacct

SEQ ID NO: 6947836 - DNA, 20 bp, Homo sapiens
tccagctcagtttttttgtc

SEQ ID NO: 6947837 - DNA, 22 bp, Homo sapiens
tccagctgacagttcaaaatga

SEQ ID NO: 6947838 - DNA, 22 bp, Homo sapiens
atgtgcaatggtgtcaccacat

SEQ ID NO: 6947839 - DNA, 22 bp, Homo sapiens
gaagccagtgtttgaagaattt

SEQ ID NO: 6947840 - DNA, 20 bp, Homo sapiens
accctttgccggatgccaag

SEQ ID NO: 6947841 - DNA, 22 bp, Homo sapiens
ctgtctgttgaccatagtttgc

SEQ ID NO: 6947842 - DNA, 22 bp, Homo sapiens
atgaagactgaattgtctgaaa

SEQ ID NO: 6947843 - DNA, 22 bp, Homo sapiens
tttcacatagaaagtgatttac

SEQ ID NO: 6947844 - DNA, 22 bp, Homo sapiens
ctcaaatatgtggtcagaaagc

SEQ ID NO: 6947845 - DNA, 22 bp, Homo sapiens
gcaaagtaaagggttccagata

SEQ ID NO: 6947846 - DNA, 17 bp, Homo sapiens
tccttcagggcctcaca

SEQ ID NO: 6947847 - DNA, 22 bp, Homo sapiens
tgaaatgtttaggaccactaga

SEQ ID NO: 6947848 - DNA, 22 bp, Homo sapiens
tcttgacattcaatcatgtata

SEQ ID NO: 6947849 - DNA, 22 bp, Homo sapiens
aaagtcattgtaatatatgcta

SEQ ID NO: 6947850 - DNA, 22 bp, Homo sapiens
aaagtctatcagttactaatca

SEQ ID NO: 6947851 - DNA, 22 bp, Homo sapiens
ttacagaatctactcgtggtga

SEQ ID NO: 6947852 - DNA, 21 bp, Homo sapiens
cctccaggagcagagccctga

SEQ ID NO: 6947853 - DNA, 22 bp, Homo sapiens
ttcaagttagagatatatttag

SEQ ID NO: 6947854 - DNA, 21 bp, Homo sapiens
aaatactgggcagtgacttga

SEQ ID NO: 6947855 - DNA, 22 bp, Homo sapiens
agtgttccacacatctggggaa

SEQ ID NO: 6947856 - DNA, 22 bp, Homo sapiens
tttgaatgttttaggtacttaa

SEQ ID NO: 6947857 - DNA, 22 bp, Homo sapiens
gtaatattcagctattgagttg

SEQ ID NO: 6947858 - DNA, 22 bp, Homo sapiens
ttcagtatgacagacgcattgg

SEQ ID NO: 6947859 - DNA, 18 bp, Homo sapiens
gtatggtatggaagcatg

SEQ ID NO: 6947860 - DNA, 21 bp, Homo sapiens
gggtgggtggaattaggagtg

SEQ ID NO: 6947861 - DNA, 22 bp, Homo sapiens
ctgctgatcagggcaaagcaaa

SEQ ID NO: 6947862 - DNA, 21 bp, Homo sapiens
tcgggcttggctgcggtgctg

SEQ ID NO: 6947863 - DNA, 22 bp, Homo sapiens
ttgctgtagctactatgtattc

SEQ ID NO: 6947864 - DNA, 20 bp, Homo sapiens
acagagatcctctctttatc

SEQ ID NO: 6947865 - DNA, 22 bp, Homo sapiens
agagccctctcattggcttatt

SEQ ID NO: 6947866 - DNA, 22 bp, Homo sapiens
gtctaaagtctatacttttgtg

SEQ ID NO: 6947867 - DNA, 22 bp, Homo sapiens
ccaggaggtctgagtgtggaca

SEQ ID NO: 6947868 - DNA, 22 bp, Homo sapiens
ggtcactccaccttctccacct

SEQ ID NO: 6947869 - DNA, 22 bp, Homo sapiens
ttctagatgcttataggcatat

SEQ ID NO: 6947870 - DNA, 22 bp, Homo sapiens
taggatctcaccatagaaggaa

SEQ ID NO: 6947871 - DNA, 21 bp, Homo sapiens
ataaagttttacaggaatgca

SEQ ID NO: 6947872 - DNA, 22 bp, Homo sapiens
ccctgacccaaaactgtcagaa

SEQ ID NO: 6947873 - DNA, 22 bp, Homo sapiens
caggccagagcgcgtggttggg

SEQ ID NO: 6947874 - DNA, 22 bp, Homo sapiens
gcacccctgcgtgccttccctt

SEQ ID NO: 6947875 - DNA, 22 bp, Homo sapiens
tgtctactcctgtgctagctcc

SEQ ID NO: 6947876 - DNA, 22 bp, Homo sapiens
gatatatcacagcttactgtca

SEQ ID NO: 6947877 - DNA, 22 bp, Homo sapiens
aggttatatgactgtcatgcct

SEQ ID NO: 6947878 - DNA, 22 bp, Homo sapiens
atgctattaatatccagtctga

SEQ ID NO: 6947879 - DNA, 19 bp, Homo sapiens
tgcttctggaaccatgatc

SEQ ID NO: 6947880 - DNA, 22 bp, Homo sapiens
tggaaggagctaaggacctggg

SEQ ID NO: 6947881 - DNA, 22 bp, Homo sapiens
atgcagggaaaagagatattat

SEQ ID NO: 6947882 - DNA, 16 bp, Homo sapiens
tctctctgtatttgct

SEQ ID NO: 6947883 - DNA, 22 bp, Homo sapiens
gtgctgcagagtctcgtgccgc

SEQ ID NO: 6947884 - DNA, 22 bp, Homo sapiens
tggaagcttttgagattgttgc

SEQ ID NO: 6947885 - DNA, 17 bp, Homo sapiens
ctctgggtgcctgtgtg

SEQ ID NO: 6947886 - DNA, 22 bp, Homo sapiens
aatgcacttaataactgtcctt

SEQ ID NO: 6947887 - DNA, 22 bp, Homo sapiens
tcagttactcctttccttaggt

SEQ ID NO: 6947888 - DNA, 22 bp, Homo sapiens
cctgaggtctagagtcagggtg

SEQ ID NO: 6947889 - DNA, 22 bp, Homo sapiens
gtcaggctgctggagcttgggt

SEQ ID NO: 6947890 - DNA, 22 bp, Homo sapiens
aaatacagattccagggtctta

SEQ ID NO: 6947891 - DNA, 21 bp, Homo sapiens
tggccaaggaatagaagctct

SEQ ID NO: 6947892 - DNA, 22 bp, Homo sapiens
ttggcttcttataatgcaatag

SEQ ID NO: 6947893 - DNA, 22 bp, Homo sapiens
tttagtatgtatttaatggact

SEQ ID NO: 6947894 - DNA, 22 bp, Homo sapiens
agttagcgatgtaaaataacaa

SEQ ID NO: 6947895 - DNA, 22 bp, Homo sapiens
agaagggctacacgggctctcc

SEQ ID NO: 6947896 - DNA, 22 bp, Homo sapiens
tggtttctgccctcagagctca

SEQ ID NO: 6947897 - DNA, 22 bp, Homo sapiens
tgactttccattctcacacagt

SEQ ID NO: 6947898 - DNA, 21 bp, Homo sapiens
ctggccttcaactgattggat

SEQ ID NO: 6947899 - DNA, 22 bp, Homo sapiens
tgctggggctctgaccactcca

SEQ ID NO: 6947900 - DNA, 22 bp, Homo sapiens
gagcaaagcttttagggccttt

SEQ ID NO: 6947901 - DNA, 22 bp, Homo sapiens
tttctgtggtgggtagttcaga

SEQ ID NO: 6947902 - DNA, 18 bp, Homo sapiens
ggcctgcagtgaagcaag

SEQ ID NO: 6947903 - DNA, 22 bp, Homo sapiens
ctcatagggtgaggataaaaga

SEQ ID NO: 6947904 - DNA, 22 bp, Homo sapiens
cagtcaccttgaggactcagac

SEQ ID NO: 6947905 - DNA, 22 bp, Homo sapiens
tattcacattctcaggcctggt

SEQ ID NO: 6947906 - DNA, 22 bp, Homo sapiens
agaaattcaattctaattagct

SEQ ID NO: 6947907 - DNA, 22 bp, Homo sapiens
tcttgaatctaatgcagtttct

SEQ ID NO: 6947908 - DNA, 22 bp, Homo sapiens
cagtcatcagagactcttgatt

SEQ ID NO: 6947909 - DNA, 22 bp, Homo sapiens
agacaggatgcatactcttggt

SEQ ID NO: 6947910 - DNA, 22 bp, Homo sapiens
ttccaaattaaaatgtacaatg

SEQ ID NO: 6947911 - DNA, 22 bp, Homo sapiens
gacaggaaacaagaaggcagga

SEQ ID NO: 6947912 - DNA, 22 bp, Homo sapiens
actcttgaaggtggtgggagtg

SEQ ID NO: 6947913 - DNA, 22 bp, Homo sapiens
tcagaggtcagcagcttgccca

SEQ ID NO: 6947914 - DNA, 22 bp, Homo sapiens
ggcacagagttggcagagctgc

SEQ ID NO: 6947915 - DNA, 22 bp, Homo sapiens
ggccccagggaagaaggtggtc

SEQ ID NO: 6947916 - DNA, 22 bp, Homo sapiens
ccaccctgccttgggccagtga

SEQ ID NO: 6947917 - DNA, 22 bp, Homo sapiens
gaggagctgttccctcacctct

SEQ ID NO: 6947918 - DNA, 20 bp, Homo sapiens
tgcagtgtcctcacttgtca

SEQ ID NO: 6947919 - DNA, 22 bp, Homo sapiens
aatctcaagctgtaaatacctc

SEQ ID NO: 6947920 - DNA, 22 bp, Homo sapiens
gtgccagaggcagtgaggagtt

SEQ ID NO: 6947921 - DNA, 22 bp, Homo sapiens
ctgggaggtgcagcaaaaatca

SEQ ID NO: 6947922 - DNA, 22 bp, Homo sapiens
gatggcttctctctagcttggt

SEQ ID NO: 6947923 - DNA, 20 bp, Homo sapiens
gtcaagtccctggggcagct

SEQ ID NO: 6947924 - DNA, 22 bp, Homo sapiens
catccagtggtcagggaagttg

SEQ ID NO: 6947925 - DNA, 22 bp, Homo sapiens
tattgcttcagcttcctgggct

SEQ ID NO: 6947926 - DNA, 22 bp, Homo sapiens
cttgctggtattttctctctca

SEQ ID NO: 6947927 - DNA, 22 bp, Homo sapiens
tatgtttgttatcacaactagg

SEQ ID NO: 6947928 - DNA, 22 bp, Homo sapiens
ataattatctcagacacttgtt

SEQ ID NO: 6947929 - DNA, 22 bp, Homo sapiens
gagcaaaataaattctgacaaa

SEQ ID NO: 6947930 - DNA, 22 bp, Homo sapiens
tggcagattctggttgatactt

SEQ ID NO: 6947931 - DNA, 22 bp, Homo sapiens
gttaggcagttttcttcattct

SEQ ID NO: 6947932 - DNA, 22 bp, Homo sapiens
agcatttatagataccctatgg

SEQ ID NO: 6947933 - DNA, 22 bp, Homo sapiens
tgagatttcgccgacagtattt

SEQ ID NO: 6947934 - DNA, 22 bp, Homo sapiens
gtagctttatagtgaataaacc

SEQ ID NO: 6947935 - DNA, 22 bp, Homo sapiens
ccaccccaaatgaagacctctc

SEQ ID NO: 6947936 - DNA, 19 bp, Homo sapiens
tgcacttgagatgtttgta

SEQ ID NO: 6947937 - DNA, 22 bp, Homo sapiens
ggggtagtcctggtgatggctg

SEQ ID NO: 6947938 - DNA, 22 bp, Homo sapiens
tgtctgaacgaagtaggtccac

SEQ ID NO: 6947939 - DNA, 22 bp, Homo sapiens
tttggacacattatttatcttc

SEQ ID NO: 6947940 - DNA, 22 bp, Homo sapiens
tctgggatgaagccagaaactt

SEQ ID NO: 6947941 - DNA, 22 bp, Homo sapiens
aaaaatagcttctcttgtccct

SEQ ID NO: 6947942 - DNA, 22 bp, Homo sapiens
ctgtgtttgatgagaagccacc

SEQ ID NO: 6947943 - DNA, 22 bp, Homo sapiens
tatgatttgtagacatttgatt

SEQ ID NO: 6947944 - DNA, 22 bp, Homo sapiens
agccagtgccagtcatgcctgc

SEQ ID NO: 6947945 - DNA, 16 bp, Homo sapiens
aggcgaaggttcattt

SEQ ID NO: 6947946 - DNA, 22 bp, Homo sapiens
tgggcagaaggaagagccacct

SEQ ID NO: 6947947 - DNA, 22 bp, Homo sapiens
tgcttaggctaacaaaaatagc

SEQ ID NO: 6947948 - DNA, 22 bp, Homo sapiens
agcacctgcttgtgactaggga

SEQ ID NO: 6947949 - DNA, 22 bp, Homo sapiens
atgtggggactctgagagaatt

SEQ ID NO: 6947950 - DNA, 22 bp, Homo sapiens
ggaactgattaagtcatgagaa

SEQ ID NO: 6947951 - DNA, 18 bp, Homo sapiens
ccaatgttggccccaagg

SEQ ID NO: 6947952 - DNA, 22 bp, Homo sapiens
ctggcccggctgcctggtcatt

SEQ ID NO: 6947953 - DNA, 22 bp, Homo sapiens
aggaggctctcaggtcctcccc

SEQ ID NO: 6947954 - DNA, 22 bp, Homo sapiens
tgtacatattcaagcacttcta

SEQ ID NO: 6947955 - DNA, 22 bp, Homo sapiens
ccaggcatcacgggcatgtggc

SEQ ID NO: 6947956 - DNA, 22 bp, Homo sapiens
tgtacagggtgcagcgagcgga

SEQ ID NO: 6947957 - DNA, 22 bp, Homo sapiens
cctaagatctggtatgtgacag

SEQ ID NO: 6947958 - DNA, 22 bp, Homo sapiens
catgaaggctgccagcaggcat

SEQ ID NO: 6947959 - DNA, 22 bp, Homo sapiens
gcagactggataggtttggtag

SEQ ID NO: 6947960 - DNA, 22 bp, Homo sapiens
acagacatttaataaatgctga

SEQ ID NO: 6947961 - DNA, 22 bp, Homo sapiens
gtggggtgggctgagttaggcc

SEQ ID NO: 6947962 - DNA, 20 bp, Homo sapiens
gcccactctaatccactgtc

SEQ ID NO: 6947963 - DNA, 22 bp, Homo sapiens
cattagagcagataatatgtgt

SEQ ID NO: 6947964 - DNA, 22 bp, Homo sapiens
ctgctgtccaacctgcactcgc

SEQ ID NO: 6947965 - DNA, 22 bp, Homo sapiens
aaatggtttaattatgtttaat

SEQ ID NO: 6947966 - DNA, 21 bp, Homo sapiens
agaaggcaccagcaaggactg

SEQ ID NO: 6947967 - DNA, 21 bp, Homo sapiens
aaatggatagggcaatggaag

SEQ ID NO: 6947968 - DNA, 22 bp, Homo sapiens
ttagaggggctgctgaatggga

SEQ ID NO: 6947969 - DNA, 22 bp, Homo sapiens
tgacaggtgaaatgtccttatt

SEQ ID NO: 6947970 - DNA, 18 bp, Homo sapiens
atcctgggagcagacagc

SEQ ID NO: 6947971 - DNA, 22 bp, Homo sapiens
aaagggcctccgcctgggcagg

SEQ ID NO: 6947972 - DNA, 22 bp, Homo sapiens
tcacatgctactgagccagacc

SEQ ID NO: 6947973 - DNA, 22 bp, Homo sapiens
agcagaactgatgagacttgag

SEQ ID NO: 6947974 - DNA, 22 bp, Homo sapiens
tttggtcttggatttatcagtg

SEQ ID NO: 6947975 - DNA, 22 bp, Homo sapiens
ccactgagaaggggttggggtc

SEQ ID NO: 6947976 - DNA, 22 bp, Homo sapiens
aagttacattttggtctaattg

SEQ ID NO: 6947977 - DNA, 22 bp, Homo sapiens
agagcctgttcggaggcgcccc

SEQ ID NO: 6947978 - DNA, 22 bp, Homo sapiens
cagggagcagcccctagaagta

SEQ ID NO: 6947979 - DNA, 22 bp, Homo sapiens
agaggaatatgggtgcactaga

SEQ ID NO: 6947980 - DNA, 22 bp, Homo sapiens
taggcttcacttccagttattc

SEQ ID NO: 6947981 - DNA, 22 bp, Homo sapiens
aaaggctttaaagaaccagaac

SEQ ID NO: 6947982 - DNA, 22 bp, Homo sapiens
aaggacaaagcagagctggatg

SEQ ID NO: 6947983 - DNA, 22 bp, Homo sapiens
gtccatgactgtgactcacatg

SEQ ID NO: 6947984 - DNA, 22 bp, Homo sapiens
ttctcttcacagggatcatcct

SEQ ID NO: 6947985 - DNA, 22 bp, Homo sapiens
gctgtttccagacaatgtcttt

SEQ ID NO: 6947986 - DNA, 22 bp, Homo sapiens
gtctagaaatcatgtactgtga

SEQ ID NO: 6947987 - DNA, 22 bp, Homo sapiens
ctggggaatagagctggagacc

SEQ ID NO: 6947988 - DNA, 22 bp, Homo sapiens
agagctggaatcagacctcagg

SEQ ID NO: 6947989 - DNA, 20 bp, Homo sapiens
acctggcttgggggaggagt

SEQ ID NO: 6947990 - DNA, 22 bp, Homo sapiens
agttagaatggatgttgagagc

SEQ ID NO: 6947991 - DNA, 22 bp, Homo sapiens
acagcattgctccatctcaaga

SEQ ID NO: 6947992 - DNA, 22 bp, Homo sapiens
tatccacactgggatgttttga

SEQ ID NO: 6947993 - DNA, 22 bp, Homo sapiens
aactttctctacggcatttgtt

SEQ ID NO: 6947994 - DNA, 22 bp, Homo sapiens
tgggctcactggggcagggacc

SEQ ID NO: 6947995 - DNA, 22 bp, Homo sapiens
tctgtgacttacaagaagggac

SEQ ID NO: 6947996 - DNA, 22 bp, Homo sapiens
gaagctccgtactatgactttt

SEQ ID NO: 6947997 - DNA, 22 bp, Homo sapiens
ctcagggccaaggatgctgttg

SEQ ID NO: 6947998 - DNA, 22 bp, Homo sapiens
gagcaggaactgaaaatgagac

SEQ ID NO: 6947999 - DNA, 22 bp, Homo sapiens
ctggcaccccacactgtccacg

SEQ ID NO: 6948000 - DNA, 20 bp, Homo sapiens
aaggagaatgacacggctgc

SEQ ID NO: 6948001 - DNA, 21 bp, Homo sapiens
agagtataataaaggcatgtc

SEQ ID NO: 6948002 - DNA, 22 bp, Homo sapiens
tgcccaggctggagtgcagagg

SEQ ID NO: 6948003 - DNA, 22 bp, Homo sapiens
gtgattgatgagaaaggcatag

SEQ ID NO: 6948004 - DNA, 21 bp, Homo sapiens
gccattgttttctacctggag

SEQ ID NO: 6948005 - DNA, 22 bp, Homo sapiens
agaggctccttcactctggcac

SEQ ID NO: 6948006 - DNA, 22 bp, Homo sapiens
cattgcaccacattgcatccct

SEQ ID NO: 6948007 - DNA, 22 bp, Homo sapiens
gcagctttgtggagaggcccat

SEQ ID NO: 6948008 - DNA, 22 bp, Homo sapiens
gctgctggaagcatgcgatgaa

SEQ ID NO: 6948009 - DNA, 22 bp, Homo sapiens
tggaaactaagactagagagac

SEQ ID NO: 6948010 - DNA, 22 bp, Homo sapiens
atacacaggcatgcttctgatt

SEQ ID NO: 6948011 - DNA, 22 bp, Homo sapiens
tcactgagaagagtaacagcag

SEQ ID NO: 6948012 - DNA, 22 bp, Homo sapiens
ccatgtggtagtgcttaacctt

SEQ ID NO: 6948013 - DNA, 22 bp, Homo sapiens
ctcaacatttaacagtgaaaaa

SEQ ID NO: 6948014 - DNA, 22 bp, Homo sapiens
ttgtgaagtgttctgagacagg

SEQ ID NO: 6948015 - DNA, 22 bp, Homo sapiens
gttggaatttgctcatccattt

SEQ ID NO: 6948016 - DNA, 22 bp, Homo sapiens
ccacagtgacacgggctggccc

SEQ ID NO: 6948017 - DNA, 22 bp, Homo sapiens
caccagtttaacaatcaaaaga

SEQ ID NO: 6948018 - DNA, 22 bp, Homo sapiens
ccatttttaaagagcttaagta

SEQ ID NO: 6948019 - DNA, 22 bp, Homo sapiens
gccaggtgagaggactgaggct

SEQ ID NO: 6948020 - DNA, 22 bp, Homo sapiens
aagtgctttataaacaatgaag

SEQ ID NO: 6948021 - DNA, 22 bp, Homo sapiens
tagcagaaccagtcagtgagcc

SEQ ID NO: 6948022 - DNA, 22 bp, Homo sapiens
actttcttggtcccatgtttga

SEQ ID NO: 6948023 - DNA, 19 bp, Homo sapiens
tttaatgtgtgctgcaatc

SEQ ID NO: 6948024 - DNA, 20 bp, Homo sapiens
tggacagaattagacacttt

SEQ ID NO: 6948025 - DNA, 22 bp, Homo sapiens
tttaggcacaactactcagcta

SEQ ID NO: 6948026 - DNA, 22 bp, Homo sapiens
agtctttagaaggtagttgagg

SEQ ID NO: 6948027 - DNA, 22 bp, Homo sapiens
tctgaattttgaaatcatggag

SEQ ID NO: 6948028 - DNA, 22 bp, Homo sapiens
atcagaattagccagtgaggct

SEQ ID NO: 6948029 - DNA, 22 bp, Homo sapiens
tcagctctggttcatgtggtct

SEQ ID NO: 6948030 - DNA, 22 bp, Homo sapiens
cagaggcctttctacagtgata

SEQ ID NO: 6948031 - DNA, 22 bp, Homo sapiens
tcagccaagaagggaactggtc

SEQ ID NO: 6948032 - DNA, 22 bp, Homo sapiens
aaggcttttaactactgtttta

SEQ ID NO: 6948033 - DNA, 22 bp, Homo sapiens
ttcataggaaaatgctggcccc

SEQ ID NO: 6948034 - DNA, 22 bp, Homo sapiens
aagtcctttctcatggaggaat

SEQ ID NO: 6948035 - DNA, 22 bp, Homo sapiens
ccagtttgaggaagaagtagat

SEQ ID NO: 6948036 - DNA, 22 bp, Homo sapiens
acagcctgtttgatctggtgct

SEQ ID NO: 6948037 - DNA, 22 bp, Homo sapiens
ttcatagtgacatgcattctgg

SEQ ID NO: 6948038 - DNA, 22 bp, Homo sapiens
actgggcccatatactcagtct

SEQ ID NO: 6948039 - DNA, 22 bp, Homo sapiens
actaaatctgcagagtttagtg

SEQ ID NO: 6948040 - DNA, 22 bp, Homo sapiens
tcacatttcacatgggaggagg

SEQ ID NO: 6948041 - DNA, 22 bp, Homo sapiens
gtacacaggcagcccagtgctg

SEQ ID NO: 6948042 - DNA, 22 bp, Homo sapiens
cagagcaggcccactgccctcc

SEQ ID NO: 6948043 - DNA, 19 bp, Homo sapiens
ttctttggtggtggtgacc

SEQ ID NO: 6948044 - DNA, 21 bp, Homo sapiens
acacactacacattcctagtt

SEQ ID NO: 6948045 - DNA, 22 bp, Homo sapiens
tgttataacatcggttgactaa

SEQ ID NO: 6948046 - DNA, 22 bp, Homo sapiens
taagggggaactcagttcagaa

SEQ ID NO: 6948047 - DNA, 22 bp, Homo sapiens
gagcatgcccctcacaggaaca

SEQ ID NO: 6948048 - DNA, 22 bp, Homo sapiens
aaatgcaacgggctttccttat

SEQ ID NO: 6948049 - DNA, 22 bp, Homo sapiens
ttctggagtgtattgggtctgc

SEQ ID NO: 6948050 - DNA, 20 bp, Homo sapiens
catacactattctgtatagt

SEQ ID NO: 6948051 - DNA, 22 bp, Homo sapiens
cttctaattttctttcccgcaa

SEQ ID NO: 6948052 - DNA, 22 bp, Homo sapiens
tactttgacgccggtgggaata

SEQ ID NO: 6948053 - DNA, 22 bp, Homo sapiens
acagcagaggaaaagtctgata

SEQ ID NO: 6948054 - DNA, 22 bp, Homo sapiens
tacacattacataatactatct

SEQ ID NO: 6948055 - DNA, 22 bp, Homo sapiens
ctgtctgttatctcaccagtcc

SEQ ID NO: 6948056 - DNA, 23 bp, Homo sapiens
tgtctggattcgactgtggttgg

SEQ ID NO: 6948057 - DNA, 22 bp, Homo sapiens
cagcacctccgcagttcacctg

SEQ ID NO: 6948058 - DNA, 22 bp, Homo sapiens
tgcagctctggggtaaggggtg

SEQ ID NO: 6948059 - DNA, 22 bp, Homo sapiens
cagcacaattttcaggagtcca

SEQ ID NO: 6948060 - DNA, 22 bp, Homo sapiens
gtagcttattagggataatagt

SEQ ID NO: 6948061 - DNA, 22 bp, Homo sapiens
ccatgctccatgtggtagattc

SEQ ID NO: 6948062 - DNA, 22 bp, Homo sapiens
gtccagctctcagatggctgca

SEQ ID NO: 6948063 - DNA, 22 bp, Homo sapiens
agagcctgagaggataatgggg

SEQ ID NO: 6948064 - DNA, 22 bp, Homo sapiens
tgcagaggcccagcggttcttc

SEQ ID NO: 6948065 - DNA, 22 bp, Homo sapiens
tctttggaattctctgcagccc

SEQ ID NO: 6948066 - DNA, 22 bp, Homo sapiens
cattctgagtcactctttagca

SEQ ID NO: 6948067 - DNA, 22 bp, Homo sapiens
gggcaggggtagcattccaagt

SEQ ID NO: 6948068 - DNA, 22 bp, Homo sapiens
tggcccaaagcagcccagcagg

SEQ ID NO: 6948069 - DNA, 22 bp, Homo sapiens
cagtttagcatttaccgtgatg

SEQ ID NO: 6948070 - DNA, 22 bp, Homo sapiens
ccccaggcagggcctaacagag

SEQ ID NO: 6948071 - DNA, 22 bp, Homo sapiens
tgcttaaaaacagtatggtagt

SEQ ID NO: 6948072 - DNA, 22 bp, Homo sapiens
cttcagatcctaatttgtcttt

SEQ ID NO: 6948073 - DNA, 22 bp, Homo sapiens
ttcaccatttcccactaaacca

SEQ ID NO: 6948074 - DNA, 22 bp, Homo sapiens
tctctgtagcagcttccttcct

SEQ ID NO: 6948075 - DNA, 22 bp, Homo sapiens
aaggtcattggttctgaattct

SEQ ID NO: 6948076 - DNA, 22 bp, Homo sapiens
ctaggcagttctagttctggaa

SEQ ID NO: 6948077 - DNA, 22 bp, Homo sapiens
tggcccaggggctcttggtgtt

SEQ ID NO: 6948078 - DNA, 21 bp, Homo sapiens
gtcaaacttgcaccagtgccc

SEQ ID NO: 6948079 - DNA, 22 bp, Homo sapiens
ctgactttgctcataggtcaaa

SEQ ID NO: 6948080 - DNA, 22 bp, Homo sapiens
gctgatgagagagacaaatgct

SEQ ID NO: 6948081 - DNA, 22 bp, Homo sapiens
attacatcagttgacatgtgag

SEQ ID NO: 6948082 - DNA, 22 bp, Homo sapiens
gctggcttaatagggatgggct

SEQ ID NO: 6948083 - DNA, 22 bp, Homo sapiens
cagcgctggggtaggagcacct

SEQ ID NO: 6948084 - DNA, 22 bp, Homo sapiens
tctgcctaggtttccaatgtgc

SEQ ID NO: 6948085 - DNA, 20 bp, Homo sapiens
cactggttggcacttaggga

SEQ ID NO: 6948086 - DNA, 22 bp, Homo sapiens
acctggagatccatggtgtcga

SEQ ID NO: 6948087 - DNA, 22 bp, Homo sapiens
ttctagttcttagagaattggt

SEQ ID NO: 6948088 - DNA, 22 bp, Homo sapiens
tgagttcagatcctggctctgc

SEQ ID NO: 6948089 - DNA, 22 bp, Homo sapiens
aggtattgaccacctccttgat

SEQ ID NO: 6948090 - DNA, 22 bp, Homo sapiens
ctggcagcagctggtaccttat

SEQ ID NO: 6948091 - DNA, 22 bp, Homo sapiens
agtatcttaacagcttccagga

SEQ ID NO: 6948092 - DNA, 22 bp, Homo sapiens
ctggagagggagctgttggaag

SEQ ID NO: 6948093 - DNA, 22 bp, Homo sapiens
gtgcctgcagcaatccatggca

SEQ ID NO: 6948094 - DNA, 22 bp, Homo sapiens
ggcagcttggttgcagaccatc

SEQ ID NO: 6948095 - DNA, 22 bp, Homo sapiens
gcacagcagccgaaatgccctt

SEQ ID NO: 6948096 - DNA, 22 bp, Homo sapiens
atgcttttaactcctttatccc

SEQ ID NO: 6948097 - DNA, 22 bp, Homo sapiens
aggtagtattcatgattaaatt

SEQ ID NO: 6948098 - DNA, 22 bp, Homo sapiens
actggggagttgaagcactttc

SEQ ID NO: 6948099 - DNA, 18 bp, Homo sapiens
cccccagccaaattctct

SEQ ID NO: 6948100 - DNA, 22 bp, Homo sapiens
gggctggcaggacctgggctga

SEQ ID NO: 6948101 - DNA, 22 bp, Homo sapiens
aagtcagaataatgtttctttt

SEQ ID NO: 6948102 - DNA, 22 bp, Homo sapiens
attgctgaaatgaaaggatatg

SEQ ID NO: 6948103 - DNA, 22 bp, Homo sapiens
ctggctgagttactccactgag

SEQ ID NO: 6948104 - DNA, 22 bp, Homo sapiens
tctgtggcagttctggttcatc

SEQ ID NO: 6948105 - DNA, 22 bp, Homo sapiens
atttgaagtcttcatgatttct

SEQ ID NO: 6948106 - DNA, 23 bp, Homo sapiens
ttcatttaggagttcataagagc

SEQ ID NO: 6948107 - DNA, 19 bp, Homo sapiens
ctgggactcctgatacctt

SEQ ID NO: 6948108 - DNA, 22 bp, Homo sapiens
tctgaggtcacagatttcaaga

SEQ ID NO: 6948109 - DNA, 22 bp, Homo sapiens
tttgcattgcctctgacttatg

SEQ ID NO: 6948110 - DNA, 22 bp, Homo sapiens
actttcaagcaagaacactttg

SEQ ID NO: 6948111 - DNA, 22 bp, Homo sapiens
gagacacagcagatattcaatc

SEQ ID NO: 6948112 - DNA, 22 bp, Homo sapiens
aaagagacaccaaagactctag

SEQ ID NO: 6948113 - DNA, 22 bp, Homo sapiens
aagccaggccattctctggttc

SEQ ID NO: 6948114 - DNA, 19 bp, Homo sapiens
agacactggatggaaaatg

SEQ ID NO: 6948115 - DNA, 22 bp, Homo sapiens
cccggtgttgtggaagatgcta

SEQ ID NO: 6948116 - DNA, 22 bp, Homo sapiens
tagctagaaggttgaaagcagg

SEQ ID NO: 6948117 - DNA, 20 bp, Homo sapiens
aagatagaatcctaactttg

SEQ ID NO: 6948118 - DNA, 22 bp, Homo sapiens
gccacgtagaagtgacaggaag

SEQ ID NO: 6948119 - DNA, 22 bp, Homo sapiens
ttccaaggccaggccctgaggt

SEQ ID NO: 6948120 - DNA, 22 bp, Homo sapiens
atcagtgcttcatagccctggt

SEQ ID NO: 6948121 - DNA, 22 bp, Homo sapiens
tatgttgaaattctgaccttca

SEQ ID NO: 6948122 - DNA, 22 bp, Homo sapiens
atgtgatactccttctagtgga

SEQ ID NO: 6948123 - DNA, 22 bp, Homo sapiens
gtgtgataacagggcatgacgg

SEQ ID NO: 6948124 - DNA, 22 bp, Homo sapiens
tttccttttaagcagtcggcct

SEQ ID NO: 6948125 - DNA, 22 bp, Homo sapiens
tctgtagcaagtgagaggcatt

SEQ ID NO: 6948126 - DNA, 22 bp, Homo sapiens
tggatcttgatgctccaagagt

SEQ ID NO: 6948127 - DNA, 22 bp, Homo sapiens
aaaagggaaagcagaatgactt

SEQ ID NO: 6948128 - DNA, 22 bp, Homo sapiens
aacagggacaaggatagagaaa

SEQ ID NO: 6948129 - DNA, 22 bp, Homo sapiens
aagctcttgaatgggatcaagg

SEQ ID NO: 6948130 - DNA, 22 bp, Homo sapiens
acagggaaagggacagcagcag

SEQ ID NO: 6948131 - DNA, 22 bp, Homo sapiens
tcacagaacacaaatgccactt

SEQ ID NO: 6948132 - DNA, 22 bp, Homo sapiens
accagcattggacttagaatgc

SEQ ID NO: 6948133 - DNA, 22 bp, Homo sapiens
ttggaagacagtgaaacagcac

SEQ ID NO: 6948134 - DNA, 21 bp, Homo sapiens
cctagcctcttacccagcttt

SEQ ID NO: 6948135 - DNA, 22 bp, Homo sapiens
aactacccacgtttctgtcctt

SEQ ID NO: 6948136 - DNA, 18 bp, Homo sapiens
ccactttgcagcctggcc

SEQ ID NO: 6948137 - DNA, 22 bp, Homo sapiens
tcagagacatcaggttgtagca

SEQ ID NO: 6948138 - DNA, 22 bp, Homo sapiens
gctcaagccatcttagtagccc

SEQ ID NO: 6948139 - DNA, 22 bp, Homo sapiens
tgtttcaactgttaagatatgc

SEQ ID NO: 6948140 - DNA, 22 bp, Homo sapiens
aagctttgcaatgcttcattat

SEQ ID NO: 6948141 - DNA, 22 bp, Homo sapiens
acaatatgaattcccttggtta

SEQ ID NO: 6948142 - DNA, 22 bp, Homo sapiens
caagtcaatgattataagagtc

SEQ ID NO: 6948143 - DNA, 22 bp, Homo sapiens
cactgaccatggccaattggca

SEQ ID NO: 6948144 - DNA, 22 bp, Homo sapiens
ctctgcttctgagatggaagct

SEQ ID NO: 6948145 - DNA, 22 bp, Homo sapiens
tagagtccttcattctgtgcag

SEQ ID NO: 6948146 - DNA, 22 bp, Homo sapiens
gtcagagcccttccctgatttt

SEQ ID NO: 6948147 - DNA, 22 bp, Homo sapiens
aaggaaatagatgcagatggta

SEQ ID NO: 6948148 - DNA, 22 bp, Homo sapiens
ccctggaggttgaggctgcagt

SEQ ID NO: 6948149 - DNA, 22 bp, Homo sapiens
gcgcgtgggccgcggctggtta

SEQ ID NO: 6948150 - DNA, 22 bp, Homo sapiens
ctgtgtcccagccaggataatg

SEQ ID NO: 6948151 - DNA, 22 bp, Homo sapiens
ttcctggcctcttccaccacca

SEQ ID NO: 6948152 - DNA, 22 bp, Homo sapiens
caggtgagctctatctagggag

SEQ ID NO: 6948153 - DNA, 22 bp, Homo sapiens
acaggctggtttgtaaaagatg

SEQ ID NO: 6948154 - DNA, 22 bp, Homo sapiens
gtcaagggtacagcacgcttct

SEQ ID NO: 6948155 - DNA, 22 bp, Homo sapiens
taaatgcctctgaatcttcata

SEQ ID NO: 6948156 - DNA, 21 bp, Homo sapiens
gcaggtgtggtatcagcttcc

SEQ ID NO: 6948157 - DNA, 21 bp, Homo sapiens
tgtttactccctgcaagcacg

SEQ ID NO: 6948158 - DNA, 19 bp, Homo sapiens
aggtcagtggctcaggcat

SEQ ID NO: 6948159 - DNA, 22 bp, Homo sapiens
agtattctggaattctatgtga

SEQ ID NO: 6948160 - DNA, 22 bp, Homo sapiens
aaaggttttattctgagctctg

SEQ ID NO: 6948161 - DNA, 22 bp, Homo sapiens
tttgcaaatttcgtctcctcag

SEQ ID NO: 6948162 - DNA, 22 bp, Homo sapiens
gtgcaggtggatttgggctcaa

SEQ ID NO: 6948163 - DNA, 22 bp, Homo sapiens
tcatcaaagcgcttggagtagg

SEQ ID NO: 6948164 - DNA, 22 bp, Homo sapiens
ttcagacaggcagctgggctgg

SEQ ID NO: 6948165 - DNA, 22 bp, Homo sapiens
catgcacatgcaatagtgcttt

SEQ ID NO: 6948166 - DNA, 22 bp, Homo sapiens
agtaataaactctttttatctc

SEQ ID NO: 6948167 - DNA, 22 bp, Homo sapiens
gaatcatagaacattaatagaa

SEQ ID NO: 6948168 - DNA, 22 bp, Homo sapiens
ccagcgtcccgtgatattctgc

SEQ ID NO: 6948169 - DNA, 22 bp, Homo sapiens
ggaagctagttgtgtttcagga

SEQ ID NO: 6948170 - DNA, 22 bp, Homo sapiens
cacccaggaggttgggaagggc

SEQ ID NO: 6948171 - DNA, 22 bp, Homo sapiens
tcaaatgcaggtctggtcttgg

SEQ ID NO: 6948172 - DNA, 22 bp, Homo sapiens
aaatgatgattaaaatgaggta

SEQ ID NO: 6948173 - DNA, 22 bp, Homo sapiens
tgggccccagcacgtctgggga

SEQ ID NO: 6948174 - DNA, 22 bp, Homo sapiens
cttcttggtgatggcttacctg

SEQ ID NO: 6948175 - DNA, 22 bp, Homo sapiens
attcaacttataagatattaat

SEQ ID NO: 6948176 - DNA, 17 bp, Homo sapiens
acagatgctgataagaa

SEQ ID NO: 6948177 - DNA, 22 bp, Homo sapiens
ttggttcaggacatatttgagt

SEQ ID NO: 6948178 - DNA, 23 bp, Homo sapiens
tgtggcctgcagctctggtttgg

SEQ ID NO: 6948179 - DNA, 19 bp, Homo sapiens
aacctttagatcattctcc

SEQ ID NO: 6948180 - DNA, 21 bp, Homo sapiens
ttctacaggatgaatgaaaac

SEQ ID NO: 6948181 - DNA, 20 bp, Homo sapiens
ggtagctgctgcagttggta

SEQ ID NO: 6948182 - DNA, 22 bp, Homo sapiens
tacagatatagagatttataga

SEQ ID NO: 6948183 - DNA, 22 bp, Homo sapiens
taaatctcagcctttctgctta

SEQ ID NO: 6948184 - DNA, 22 bp, Homo sapiens
tttgctaatgcctctgaaatca

SEQ ID NO: 6948185 - DNA, 22 bp, Homo sapiens
acaggtagaaattcatctatat

SEQ ID NO: 6948186 - DNA, 22 bp, Homo sapiens
ggctcagtgggaacaagctgag

SEQ ID NO: 6948187 - DNA, 20 bp, Homo sapiens
agaaatactttggtataatg

SEQ ID NO: 6948188 - DNA, 22 bp, Homo sapiens
atttgcagggaagggcagaagg

SEQ ID NO: 6948189 - DNA, 22 bp, Homo sapiens
ttgaagagtgccttccagacat

SEQ ID NO: 6948190 - DNA, 22 bp, Homo sapiens
atggggaagcaattggatttcc

SEQ ID NO: 6948191 - DNA, 22 bp, Homo sapiens
gctgccttgaacatcctaagta

SEQ ID NO: 6948192 - DNA, 18 bp, Homo sapiens
gaaagccatgcagcagtg

SEQ ID NO: 6948193 - DNA, 22 bp, Homo sapiens
gagaaataggcaatggtatcta

SEQ ID NO: 6948194 - DNA, 22 bp, Homo sapiens
ctttcagaggttactcaggaaa

SEQ ID NO: 6948195 - DNA, 23 bp, Homo sapiens
tcagagtagcaatttttctctcc

SEQ ID NO: 6948196 - DNA, 22 bp, Homo sapiens
taggcactggttgtggatagtt

SEQ ID NO: 6948197 - DNA, 22 bp, Homo sapiens
aggatcaaatgatcctcaggtc

SEQ ID NO: 6948198 - DNA, 22 bp, Homo sapiens
tggaatgtcttgatatagaggt

SEQ ID NO: 6948199 - DNA, 22 bp, Homo sapiens
caaggacagcgtcaggtgcaac

SEQ ID NO: 6948200 - DNA, 22 bp, Homo sapiens
gtttcatagctacgattttggg

SEQ ID NO: 6948201 - DNA, 22 bp, Homo sapiens
ttctctgtagttgcctggtgga

SEQ ID NO: 6948202 - DNA, 22 bp, Homo sapiens
atgagaaagttaatcatcatga

SEQ ID NO: 6948203 - DNA, 22 bp, Homo sapiens
ataaagtggaagtgttaaaggg

SEQ ID NO: 6948204 - DNA, 22 bp, Homo sapiens
caatagtatttattgaacacct

SEQ ID NO: 6948205 - DNA, 22 bp, Homo sapiens
tggcccaagacgttacctcctt

SEQ ID NO: 6948206 - DNA, 22 bp, Homo sapiens
tgggaaggaactgcctttagct

SEQ ID NO: 6948207 - DNA, 22 bp, Homo sapiens
aagttaaggaagtcatactatg

SEQ ID NO: 6948208 - DNA, 18 bp, Homo sapiens
gcctgcaggcacgggggt

SEQ ID NO: 6948209 - DNA, 22 bp, Homo sapiens
gaggagcacatgaggctgaggg

SEQ ID NO: 6948210 - DNA, 23 bp, Homo sapiens
tgattaggtctactcttggctcc

SEQ ID NO: 6948211 - DNA, 22 bp, Homo sapiens
gcatgcaggaagggcttgggga

SEQ ID NO: 6948212 - DNA, 22 bp, Homo sapiens
ccttggagacctgggtctgtgc

SEQ ID NO: 6948213 - DNA, 22 bp, Homo sapiens
catgcttatgatttgctaagcc

SEQ ID NO: 6948214 - DNA, 22 bp, Homo sapiens
aaggctctccaaatgatataat

SEQ ID NO: 6948215 - DNA, 22 bp, Homo sapiens
cttccacattatttaggaatcc

SEQ ID NO: 6948216 - DNA, 22 bp, Homo sapiens
tatctcagctggatcagtggaa

SEQ ID NO: 6948217 - DNA, 22 bp, Homo sapiens
tactaacttgtacacagcctaa

SEQ ID NO: 6948218 - DNA, 22 bp, Homo sapiens
gagcgcggtccccacggaggat

SEQ ID NO: 6948219 - DNA, 22 bp, Homo sapiens
ttgaaactgggaagcagggggt

SEQ ID NO: 6948220 - DNA, 22 bp, Homo sapiens
tcacattcttccctgacttctt

SEQ ID NO: 6948221 - DNA, 22 bp, Homo sapiens
agacagtgctatcccatctgtg

SEQ ID NO: 6948222 - DNA, 22 bp, Homo sapiens
tgcatgcaaaaaaatctgcatt

SEQ ID NO: 6948223 - DNA, 22 bp, Homo sapiens
tttaatcataagaaggaaaata

SEQ ID NO: 6948224 - DNA, 22 bp, Homo sapiens
ctctttggctttgactcccatt

SEQ ID NO: 6948225 - DNA, 22 bp, Homo sapiens
tggtttaacctgtctcttatta

SEQ ID NO: 6948226 - DNA, 22 bp, Homo sapiens
agaagtctattgatggcagtcc

SEQ ID NO: 6948227 - DNA, 22 bp, Homo sapiens
tcatagaagcactcagctccct

SEQ ID NO: 6948228 - DNA, 22 bp, Homo sapiens
gatagctgctgggatattttta

SEQ ID NO: 6948229 - DNA, 22 bp, Homo sapiens
gcctgctgccagaggcaaacac

SEQ ID NO: 6948230 - DNA, 22 bp, Homo sapiens
aagggagaaaacttgtggctta

SEQ ID NO: 6948231 - DNA, 22 bp, Homo sapiens
tattgtctgtttgaatgactat

SEQ ID NO: 6948232 - DNA, 22 bp, Homo sapiens
cagagacaggatctcgaagact

SEQ ID NO: 6948233 - DNA, 22 bp, Homo sapiens
tttaggatattaatgttcagag

SEQ ID NO: 6948234 - DNA, 22 bp, Homo sapiens
tgcagtcttccagctgcacaaa

SEQ ID NO: 6948235 - DNA, 22 bp, Homo sapiens
cagggctggcttccaagttgtt

SEQ ID NO: 6948236 - DNA, 22 bp, Homo sapiens
ccctgcagtcctttcttggctc

SEQ ID NO: 6948237 - DNA, 22 bp, Homo sapiens
ttagaaaggagcttatttcttt

SEQ ID NO: 6948238 - DNA, 22 bp, Homo sapiens
tcagtccaatgattgtaggaca

SEQ ID NO: 6948239 - DNA, 22 bp, Homo sapiens
ctgctgtacttaggaagaggaa

SEQ ID NO: 6948240 - DNA, 22 bp, Homo sapiens
tatgtatcttttgttttccctg

SEQ ID NO: 6948241 - DNA, 22 bp, Homo sapiens
catgctatataggaagagcact

SEQ ID NO: 6948242 - DNA, 22 bp, Homo sapiens
gcccaggaggagaggctgcagt

SEQ ID NO: 6948243 - DNA, 22 bp, Homo sapiens
atctggtatgaggttttgcttt

SEQ ID NO: 6948244 - DNA, 22 bp, Homo sapiens
cagaacctgtgaatgtgttatc

SEQ ID NO: 6948245 - DNA, 22 bp, Homo sapiens
agcatacaggtctgaaacagct

SEQ ID NO: 6948246 - DNA, 23 bp, Homo sapiens
gctctgagggcttatccctccca

SEQ ID NO: 6948247 - DNA, 22 bp, Homo sapiens
tttggcagagtgtgggcatttg

SEQ ID NO: 6948248 - DNA, 22 bp, Homo sapiens
tcaagaactgtgaagagtctga

SEQ ID NO: 6948249 - DNA, 22 bp, Homo sapiens
atgaagccatctcctccccttc

SEQ ID NO: 6948250 - DNA, 16 bp, Homo sapiens
cctttttctcttgctg

SEQ ID NO: 6948251 - DNA, 18 bp, Homo sapiens
ccagaggcccgggcaggc

SEQ ID NO: 6948252 - DNA, 22 bp, Homo sapiens
ctgtggccccaccctcttggcc

SEQ ID NO: 6948253 - DNA, 22 bp, Homo sapiens
agtcaactgttttgctaatgat

SEQ ID NO: 6948254 - DNA, 22 bp, Homo sapiens
atgtataggagttatctgttgt

SEQ ID NO: 6948255 - DNA, 22 bp, Homo sapiens
aaggcttttgggaattttcaac

SEQ ID NO: 6948256 - DNA, 22 bp, Homo sapiens
ctgagccaaaaagcagagcttg

SEQ ID NO: 6948257 - DNA, 22 bp, Homo sapiens
gattcaaaagtttgagctccaa

SEQ ID NO: 6948258 - DNA, 22 bp, Homo sapiens
gcagccagggctaagctgggga

SEQ ID NO: 6948259 - DNA, 22 bp, Homo sapiens
ccaagctggatttagctgcaca

SEQ ID NO: 6948260 - DNA, 22 bp, Homo sapiens
gcaggtggtcactcatccccag

SEQ ID NO: 6948261 - DNA, 22 bp, Homo sapiens
tcacatttgataatgcccattg

SEQ ID NO: 6948262 - DNA, 22 bp, Homo sapiens
tagtgcaattccccatactaac

SEQ ID NO: 6948263 - DNA, 22 bp, Homo sapiens
gcgagcagacagctgtcctgga

SEQ ID NO: 6948264 - DNA, 22 bp, Homo sapiens
gcatgtggaatctctccatggt

SEQ ID NO: 6948265 - DNA, 22 bp, Homo sapiens
agtcatcatctgccctcactgg

SEQ ID NO: 6948266 - DNA, 22 bp, Homo sapiens
aatatagtgccaagcctctgat

SEQ ID NO: 6948267 - DNA, 22 bp, Homo sapiens
gattatgattaagatggacctg

SEQ ID NO: 6948268 - DNA, 22 bp, Homo sapiens
atgagacattgcaagtccagaa

SEQ ID NO: 6948269 - DNA, 22 bp, Homo sapiens
gaacagtgccagcacacaataa

SEQ ID NO: 6948270 - DNA, 22 bp, Homo sapiens
agattgcaaaatgggtgattta

SEQ ID NO: 6948271 - DNA, 22 bp, Homo sapiens
tatttcaccagtaggaggctgt

SEQ ID NO: 6948272 - DNA, 22 bp, Homo sapiens
actgagggtttttatactcttt

SEQ ID NO: 6948273 - DNA, 22 bp, Homo sapiens
agtggccatccctcaggtaggc

SEQ ID NO: 6948274 - DNA, 19 bp, Homo sapiens
tttgatagggcataatata

SEQ ID NO: 6948275 - DNA, 22 bp, Homo sapiens
gctgctgttgatttagtccaat

SEQ ID NO: 6948276 - DNA, 22 bp, Homo sapiens
taacagaaattttagttagggg

SEQ ID NO: 6948277 - DNA, 22 bp, Homo sapiens
tgacagattttttctgagctaa

SEQ ID NO: 6948278 - DNA, 22 bp, Homo sapiens
gggcaggtgattttggctccat

SEQ ID NO: 6948279 - DNA, 22 bp, Homo sapiens
tgctgggcttcaactgcctgag

SEQ ID NO: 6948280 - DNA, 22 bp, Homo sapiens
agcaggcaggaaggcagcactg

SEQ ID NO: 6948281 - DNA, 22 bp, Homo sapiens
cggatgtctttgagggagagtc

SEQ ID NO: 6948282 - DNA, 22 bp, Homo sapiens
agttataatctgctactgatat

SEQ ID NO: 6948283 - DNA, 22 bp, Homo sapiens
ttagctctttgtagctatttct

SEQ ID NO: 6948284 - DNA, 22 bp, Homo sapiens
atagggcagtcaggccgccact

SEQ ID NO: 6948285 - DNA, 22 bp, Homo sapiens
cactggctaaagataagctcaa

SEQ ID NO: 6948286 - DNA, 22 bp, Homo sapiens
ataagcttcctgttagaaaccg

SEQ ID NO: 6948287 - DNA, 22 bp, Homo sapiens
gccagcagccacagaagtcact

SEQ ID NO: 6948288 - DNA, 22 bp, Homo sapiens
ccttgccttggtccttcgcagg

SEQ ID NO: 6948289 - DNA, 22 bp, Homo sapiens
cagccagggagggcaaatgaga

SEQ ID NO: 6948290 - DNA, 22 bp, Homo sapiens
gtgcagctgggcgctgaccttc

SEQ ID NO: 6948291 - DNA, 22 bp, Homo sapiens
agctgaggcatgatgctatcag

SEQ ID NO: 6948292 - DNA, 21 bp, Homo sapiens
tcagggttcaaaggaactgat

SEQ ID NO: 6948293 - DNA, 22 bp, Homo sapiens
aagaagctgtagggattaactc

SEQ ID NO: 6948294 - DNA, 22 bp, Homo sapiens
tttggaaaaagcctgaacatag

SEQ ID NO: 6948295 - DNA, 20 bp, Homo sapiens
acctgggaaaaccttttcct

SEQ ID NO: 6948296 - DNA, 22 bp, Homo sapiens
tgagcagcccttcctccggcca

SEQ ID NO: 6948297 - DNA, 22 bp, Homo sapiens
atggctgttcctgggagttcta

SEQ ID NO: 6948298 - DNA, 22 bp, Homo sapiens
aagtctaacctattccggtgtt

SEQ ID NO: 6948299 - DNA, 22 bp, Homo sapiens
ttgtttgaggtcactgatattt

SEQ ID NO: 6948300 - DNA, 22 bp, Homo sapiens
tggagagcactgtctcattttg

SEQ ID NO: 6948301 - DNA, 22 bp, Homo sapiens
tgtatagactagctttcacgat

SEQ ID NO: 6948302 - DNA, 20 bp, Homo sapiens
aatgtattgttttgtttcag

SEQ ID NO: 6948303 - DNA, 22 bp, Homo sapiens
aaaggcactggatagctgggga

SEQ ID NO: 6948304 - DNA, 18 bp, Homo sapiens
attgattgggagaggatt

SEQ ID NO: 6948305 - DNA, 22 bp, Homo sapiens
attgacagtggctagtgcccag

SEQ ID NO: 6948306 - DNA, 22 bp, Homo sapiens
ttgcttttgtctcgggtttgga

SEQ ID NO: 6948307 - DNA, 18 bp, Homo sapiens
tcaagtgattctcctgcc

SEQ ID NO: 6948308 - DNA, 22 bp, Homo sapiens
tctgtggagttagactggtatc

SEQ ID NO: 6948309 - DNA, 22 bp, Homo sapiens
gttgtttttgaacggtggtggc

SEQ ID NO: 6948310 - DNA, 22 bp, Homo sapiens
tgtcagtttggctctaaagttt

SEQ ID NO: 6948311 - DNA, 22 bp, Homo sapiens
atggatctgctaatgggaagca

SEQ ID NO: 6948312 - DNA, 22 bp, Homo sapiens
acgcatgccctcagtgaggcct

SEQ ID NO: 6948313 - DNA, 22 bp, Homo sapiens
caggctcccaccctcctgcagc

SEQ ID NO: 6948314 - DNA, 22 bp, Homo sapiens
tacttttattattgcccctcca

SEQ ID NO: 6948315 - DNA, 22 bp, Homo sapiens
tctgaggggccagggatctggg

SEQ ID NO: 6948316 - DNA, 22 bp, Homo sapiens
ccagggcatgtccaagacttag

SEQ ID NO: 6948317 - DNA, 22 bp, Homo sapiens
gctgggcttcacctccagagtt

SEQ ID NO: 6948318 - DNA, 22 bp, Homo sapiens
tgtctcatctcttaaccccact

SEQ ID NO: 6948319 - DNA, 22 bp, Homo sapiens
tgtgtcctcttacctctgaccc

SEQ ID NO: 6948320 - DNA, 22 bp, Homo sapiens
tgcttaggtgttatgtaatatc

SEQ ID NO: 6948321 - DNA, 22 bp, Homo sapiens
aattgtgctgtaggctcgttaa

SEQ ID NO: 6948322 - DNA, 22 bp, Homo sapiens
tttgtataaatgaagatgctgg

SEQ ID NO: 6948323 - DNA, 22 bp, Homo sapiens
tcagagtaactacagtatagac

SEQ ID NO: 6948324 - DNA, 16 bp, Homo sapiens
ttcagaatttgtagaa

SEQ ID NO: 6948325 - DNA, 19 bp, Homo sapiens
tggatttatattctttatc

SEQ ID NO: 6948326 - DNA, 22 bp, Homo sapiens
ggctgagccccctctgcgtagg

SEQ ID NO: 6948327 - DNA, 16 bp, Homo sapiens
cagatgcttgctggca

SEQ ID NO: 6948328 - DNA, 22 bp, Homo sapiens
ggcagctgcacgttgtcccgtc

SEQ ID NO: 6948329 - DNA, 22 bp, Homo sapiens
tgaactacaaaaatcaacattt

SEQ ID NO: 6948330 - DNA, 22 bp, Homo sapiens
agcagcagtgtgtggtcatgtt

SEQ ID NO: 6948331 - DNA, 22 bp, Homo sapiens
catcttaaaatgtgtcataact

SEQ ID NO: 6948332 - DNA, 22 bp, Homo sapiens
ctgcaggagcaaagcctctgct

SEQ ID NO: 6948333 - DNA, 22 bp, Homo sapiens
agttgtcccggtctagccactt

SEQ ID NO: 6948334 - DNA, 22 bp, Homo sapiens
gattcacctgaagcacttgtta

SEQ ID NO: 6948335 - DNA, 20 bp, Homo sapiens
cgctttgcacgcggcgggca

SEQ ID NO: 6948336 - DNA, 21 bp, Homo sapiens
attacatccctggtgatacat

SEQ ID NO: 6948337 - DNA, 22 bp, Homo sapiens
tctctgagctgcttcttgcata

SEQ ID NO: 6948338 - DNA, 22 bp, Homo sapiens
tagtgcataacatttaaaggtc

SEQ ID NO: 6948339 - DNA, 22 bp, Homo sapiens
aatgattgcaaacattgagaac

SEQ ID NO: 6948340 - DNA, 22 bp, Homo sapiens
tcaaagtattttaactgtatcc

SEQ ID NO: 6948341 - DNA, 22 bp, Homo sapiens
actggctggactctgacctctt

SEQ ID NO: 6948342 - DNA, 22 bp, Homo sapiens
aatagagagcagctttgcggtt

SEQ ID NO: 6948343 - DNA, 22 bp, Homo sapiens
ttagaagtgaaatgctgcagag

SEQ ID NO: 6948344 - DNA, 22 bp, Homo sapiens
tttgttcaacaggtgaaataga

SEQ ID NO: 6948345 - DNA, 19 bp, Homo sapiens
tccatggctcttcatcctt

SEQ ID NO: 6948346 - DNA, 22 bp, Homo sapiens
actgtcccatttatgtagacat

SEQ ID NO: 6948347 - DNA, 22 bp, Homo sapiens
ttggcctccacattttccaggt

SEQ ID NO: 6948348 - DNA, 19 bp, Homo sapiens
tccaatttctattcatgtt

SEQ ID NO: 6948349 - DNA, 22 bp, Homo sapiens
gggaaggtatttagctgctgaa

SEQ ID NO: 6948350 - DNA, 22 bp, Homo sapiens
gggctggcatcggttgctgaga

SEQ ID NO: 6948351 - DNA, 22 bp, Homo sapiens
caacatatgctttcatgaggta

SEQ ID NO: 6948352 - DNA, 22 bp, Homo sapiens
gtttccaggaagggttgggagg

SEQ ID NO: 6948353 - DNA, 22 bp, Homo sapiens
tctgtctgccttgtgagggcac

SEQ ID NO: 6948354 - DNA, 22 bp, Homo sapiens
tctttatcaggtgaagagggac

SEQ ID NO: 6948355 - DNA, 22 bp, Homo sapiens
tgccaaatatgcacgtgtatgc

SEQ ID NO: 6948356 - DNA, 22 bp, Homo sapiens
aaggtattggtctggtcttcct

SEQ ID NO: 6948357 - DNA, 22 bp, Homo sapiens
gggtgccctgggtaggtcagtt

SEQ ID NO: 6948358 - DNA, 22 bp, Homo sapiens
agtctgggatgtataaactgaa

SEQ ID NO: 6948359 - DNA, 22 bp, Homo sapiens
acactagtagaatagtgtttgc

SEQ ID NO: 6948360 - DNA, 22 bp, Homo sapiens
gcagggtctgaggccacagagg

SEQ ID NO: 6948361 - DNA, 22 bp, Homo sapiens
ggaggcctcatcttgccccgtg

SEQ ID NO: 6948362 - DNA, 22 bp, Homo sapiens
aggtgtgagaaacgtgaccagt

SEQ ID NO: 6948363 - DNA, 22 bp, Homo sapiens
cagcaagacaaggaacaaactg

SEQ ID NO: 6948364 - DNA, 22 bp, Homo sapiens
tctttttttcctgtgcagagct

SEQ ID NO: 6948365 - DNA, 22 bp, Homo sapiens
gggtttcatggttctcacaatg

SEQ ID NO: 6948366 - DNA, 20 bp, Homo sapiens
aagtgggtttattctttttc

SEQ ID NO: 6948367 - DNA, 22 bp, Homo sapiens
acaggaggggcatgaaagacgg

SEQ ID NO: 6948368 - DNA, 19 bp, Homo sapiens
gataagtttccaggtaact

SEQ ID NO: 6948369 - DNA, 22 bp, Homo sapiens
ggaggtgggagcctccagtggt

SEQ ID NO: 6948370 - DNA, 22 bp, Homo sapiens
ttctcatgaaactcgcttcctc

SEQ ID NO: 6948371 - DNA, 20 bp, Homo sapiens
gggagacagggccagtgtcc

SEQ ID NO: 6948372 - DNA, 22 bp, Homo sapiens
ccagcttttggggtgacaattt

SEQ ID NO: 6948373 - DNA, 22 bp, Homo sapiens
gtcgcttgaacccaggaagtgg

SEQ ID NO: 6948374 - DNA, 22 bp, Homo sapiens
tcaatgagaaagacacagtctt

SEQ ID NO: 6948375 - DNA, 22 bp, Homo sapiens
ctgtgctgctagacctggattc

SEQ ID NO: 6948376 - DNA, 22 bp, Homo sapiens
acatacacatgaatatattttt

SEQ ID NO: 6948377 - DNA, 22 bp, Homo sapiens
tggttttttgttccctactctg

SEQ ID NO: 6948378 - DNA, 22 bp, Homo sapiens
gtgtatctcatgttcttctctg

SEQ ID NO: 6948379 - DNA, 22 bp, Homo sapiens
atgtttcgtggaaaaagagtct

SEQ ID NO: 6948380 - DNA, 21 bp, Homo sapiens
aaagttacagtcagtgggtgc

SEQ ID NO: 6948381 - DNA, 22 bp, Homo sapiens
ttgaggagtagaagctttgaat

SEQ ID NO: 6948382 - DNA, 22 bp, Homo sapiens
gaggtgtcccgcagtccccaag

SEQ ID NO: 6948383 - DNA, 22 bp, Homo sapiens
tacactacacgaaggcattgca

SEQ ID NO: 6948384 - DNA, 22 bp, Homo sapiens
catgctggtcagccagtggatg

SEQ ID NO: 6948385 - DNA, 22 bp, Homo sapiens
agatggtgatagagctgggatt

SEQ ID NO: 6948386 - DNA, 22 bp, Homo sapiens
ctggaaaccaggcagttaagag

SEQ ID NO: 6948387 - DNA, 22 bp, Homo sapiens
tgctctagccattgacctagct

SEQ ID NO: 6948388 - DNA, 22 bp, Homo sapiens
aagtaacagagggggtgttgct

SEQ ID NO: 6948389 - DNA, 22 bp, Homo sapiens
ttctttcttctcaggctgggta

SEQ ID NO: 6948390 - DNA, 22 bp, Homo sapiens
tgacataataatccaaacatac

SEQ ID NO: 6948391 - DNA, 22 bp, Homo sapiens
tagtgctattaaggatacagag

SEQ ID NO: 6948392 - DNA, 22 bp, Homo sapiens
tcctgagccctactctagacga

SEQ ID NO: 6948393 - DNA, 22 bp, Homo sapiens
agtgggcccgagccagtggtct

SEQ ID NO: 6948394 - DNA, 22 bp, Homo sapiens
ccctttcattggcagagctctc

SEQ ID NO: 6948395 - DNA, 22 bp, Homo sapiens
tgcctgggtgccctctgctcct

SEQ ID NO: 6948396 - DNA, 22 bp, Homo sapiens
gaatgagactatgcgagtgtga

SEQ ID NO: 6948397 - DNA, 21 bp, Homo sapiens
ttgcattaaatccagactcaa

SEQ ID NO: 6948398 - DNA, 22 bp, Homo sapiens
acacaggacggccctgtggctt

SEQ ID NO: 6948399 - DNA, 22 bp, Homo sapiens
ataagtgctgattagctcttca

SEQ ID NO: 6948400 - DNA, 22 bp, Homo sapiens
aggacatgtgcctccagggcag

SEQ ID NO: 6948401 - DNA, 22 bp, Homo sapiens
tcacacagattggtagagctga

SEQ ID NO: 6948402 - DNA, 22 bp, Homo sapiens
attagctgacctctaaggagcc

SEQ ID NO: 6948403 - DNA, 22 bp, Homo sapiens
atgcagtactgatacatgccac

SEQ ID NO: 6948404 - DNA, 22 bp, Homo sapiens
tgtgcaaattaagtagattttc

SEQ ID NO: 6948405 - DNA, 21 bp, Homo sapiens
agtccttgaaactctttcttg

SEQ ID NO: 6948406 - DNA, 22 bp, Homo sapiens
accctggagcttttctggccct

SEQ ID NO: 6948407 - DNA, 22 bp, Homo sapiens
ggaaccactgtcttctaaagat

SEQ ID NO: 6948408 - DNA, 22 bp, Homo sapiens
ttaggaaagaagcagctaggag

SEQ ID NO: 6948409 - DNA, 22 bp, Homo sapiens
gtggggaaaggagtggggctca

SEQ ID NO: 6948410 - DNA, 18 bp, Homo sapiens
atgtgagagaatcttctt

SEQ ID NO: 6948411 - DNA, 22 bp, Homo sapiens
cagctattaatgtttttgctga

SEQ ID NO: 6948412 - DNA, 22 bp, Homo sapiens
acccggagtcggaggttgcagt

SEQ ID NO: 6948413 - DNA, 22 bp, Homo sapiens
accaggaggcctggagcacaaa

SEQ ID NO: 6948414 - DNA, 22 bp, Homo sapiens
ttattgctctattatggcctaa

SEQ ID NO: 6948415 - DNA, 22 bp, Homo sapiens
agaagattattagagactttgt

SEQ ID NO: 6948416 - DNA, 22 bp, Homo sapiens
taaactgtggaatgttctcttt

SEQ ID NO: 6948417 - DNA, 22 bp, Homo sapiens
tgggctgcccaaggtggccatg

SEQ ID NO: 6948418 - DNA, 22 bp, Homo sapiens
ctgctgtgtttctgctagaaaa

SEQ ID NO: 6948419 - DNA, 22 bp, Homo sapiens
gaatgctaagcatgtgggagtt

SEQ ID NO: 6948420 - DNA, 19 bp, Homo sapiens
tgagaacttttacttatgc

SEQ ID NO: 6948421 - DNA, 22 bp, Homo sapiens
tcctggattaatagggagctgt

SEQ ID NO: 6948422 - DNA, 22 bp, Homo sapiens
aagcttcagtgtgagcatgtaa

SEQ ID NO: 6948423 - DNA, 19 bp, Homo sapiens
acttaaacctagaaaatgc

SEQ ID NO: 6948424 - DNA, 22 bp, Homo sapiens
ccactgtataagcaaaatgaaa

SEQ ID NO: 6948425 - DNA, 19 bp, Homo sapiens
tgtcccagactccgtgtct

SEQ ID NO: 6948426 - DNA, 19 bp, Homo sapiens
agtcatattgttcatcttg

SEQ ID NO: 6948427 - DNA, 23 bp, Homo sapiens
ttctaggctctgattgggcttcc

SEQ ID NO: 6948428 - DNA, 22 bp, Homo sapiens
agtgcaaagccgaggtttcttg

SEQ ID NO: 6948429 - DNA, 22 bp, Homo sapiens
gataaacttgtggagttttggt

SEQ ID NO: 6948430 - DNA, 22 bp, Homo sapiens
ttttttccaggaagccactgga

SEQ ID NO: 6948431 - DNA, 22 bp, Homo sapiens
agcaatgaaatgaaatcagtct

SEQ ID NO: 6948432 - DNA, 22 bp, Homo sapiens
ccctttaacacacagaggctgc

SEQ ID NO: 6948433 - DNA, 20 bp, Homo sapiens
tggccctgttttctccaggc

SEQ ID NO: 6948434 - DNA, 19 bp, Homo sapiens
aggtcctgatcagcaagga

SEQ ID NO: 6948435 - DNA, 22 bp, Homo sapiens
aactggaaccttttattcagtc

SEQ ID NO: 6948436 - DNA, 22 bp, Homo sapiens
gcctctggagttgcttgtaaat

SEQ ID NO: 6948437 - DNA, 22 bp, Homo sapiens
gcagcatcctgggccacagtcc

SEQ ID NO: 6948438 - DNA, 22 bp, Homo sapiens
gcccaagtcagtgcttctggca

SEQ ID NO: 6948439 - DNA, 22 bp, Homo sapiens
cagctggatctgcctcgagcca

SEQ ID NO: 6948440 - DNA, 22 bp, Homo sapiens
tagatgttaagcttctagaagg

SEQ ID NO: 6948441 - DNA, 20 bp, Homo sapiens
attcacatataccagggagg

SEQ ID NO: 6948442 - DNA, 22 bp, Homo sapiens
aggtacaggaggttggggctac

SEQ ID NO: 6948443 - DNA, 22 bp, Homo sapiens
attgtcattggcttctatgtct

SEQ ID NO: 6948444 - DNA, 22 bp, Homo sapiens
atgtgcttttactccccagagt

SEQ ID NO: 6948445 - DNA, 22 bp, Homo sapiens
gcacagggaggctggcctggcc

SEQ ID NO: 6948446 - DNA, 22 bp, Homo sapiens
atggtggtgaagagcacagtga

SEQ ID NO: 6948447 - DNA, 22 bp, Homo sapiens
ggatgtagtgcaaggagtgaat

SEQ ID NO: 6948448 - DNA, 19 bp, Homo sapiens
tgaagcaggcagagaagat

SEQ ID NO: 6948449 - DNA, 22 bp, Homo sapiens
cacaggaaaataaaagatctaa

SEQ ID NO: 6948450 - DNA, 22 bp, Homo sapiens
acacagtattacaataggtgct

SEQ ID NO: 6948451 - DNA, 22 bp, Homo sapiens
atttcaggtacctgtgggatcc

SEQ ID NO: 6948452 - DNA, 22 bp, Homo sapiens
ccacctcctcggccatgtgacg

SEQ ID NO: 6948453 - DNA, 22 bp, Homo sapiens
tgccagcagtagcagtaggcca

SEQ ID NO: 6948454 - DNA, 22 bp, Homo sapiens
aaatgtgtttcgaaaactggtg

SEQ ID NO: 6948455 - DNA, 22 bp, Homo sapiens
aactctgcttatagtttgtcca

SEQ ID NO: 6948456 - DNA, 22 bp, Homo sapiens
agaaccttcagattaggaggtg

SEQ ID NO: 6948457 - DNA, 22 bp, Homo sapiens
ggagtggcctctcctgtgcagg

SEQ ID NO: 6948458 - DNA, 22 bp, Homo sapiens
ttggcctttgtcatcaagatca

SEQ ID NO: 6948459 - DNA, 22 bp, Homo sapiens
aaagtgaattgatttaagggga

SEQ ID NO: 6948460 - DNA, 22 bp, Homo sapiens
tgtgaaggagcatgcagagggg

SEQ ID NO: 6948461 - DNA, 22 bp, Homo sapiens
tttacagctactgtcctatttc

SEQ ID NO: 6948462 - DNA, 22 bp, Homo sapiens
agccttcggccagagggtggcc

SEQ ID NO: 6948463 - DNA, 19 bp, Homo sapiens
ttgtcacaattcatcaggt

SEQ ID NO: 6948464 - DNA, 23 bp, Homo sapiens
attgaccagctgtctcattttca

SEQ ID NO: 6948465 - DNA, 20 bp, Homo sapiens
acatagctatagaaagtcga

SEQ ID NO: 6948466 - DNA, 22 bp, Homo sapiens
aagcttcctgcatgggactgct

SEQ ID NO: 6948467 - DNA, 22 bp, Homo sapiens
tcctgggagtggccatgtaatg

SEQ ID NO: 6948468 - DNA, 22 bp, Homo sapiens
agtcagtctgctagcctgtgga

SEQ ID NO: 6948469 - DNA, 22 bp, Homo sapiens
agtgtttatattatggaaatat

SEQ ID NO: 6948470 - DNA, 22 bp, Homo sapiens
ggcagctgggtgcctaataatg

SEQ ID NO: 6948471 - DNA, 22 bp, Homo sapiens
catgtacatgcatgggcactgt

SEQ ID NO: 6948472 - DNA, 22 bp, Homo sapiens
agtgacattattttgtgtacta

SEQ ID NO: 6948473 - DNA, 22 bp, Homo sapiens
tagaaatgcagtgtactgtgtc

SEQ ID NO: 6948474 - DNA, 22 bp, Homo sapiens
actgaagcttgggtggaactta

SEQ ID NO: 6948475 - DNA, 22 bp, Homo sapiens
tctgaaatgcaggcaatttgct

SEQ ID NO: 6948476 - DNA, 22 bp, Homo sapiens
tattcatgtcggctgaaaaagc

SEQ ID NO: 6948477 - DNA, 22 bp, Homo sapiens
tacagcagcatcgcagtgacct

SEQ ID NO: 6948478 - DNA, 22 bp, Homo sapiens
tggtgctgacagttctgagtgc

SEQ ID NO: 6948479 - DNA, 22 bp, Homo sapiens
cttcctggccattgccatggca

SEQ ID NO: 6948480 - DNA, 22 bp, Homo sapiens
ctttagttctagaaagtgaaac

SEQ ID NO: 6948481 - DNA, 22 bp, Homo sapiens
ttactgtttgggtctgaggtca

SEQ ID NO: 6948482 - DNA, 22 bp, Homo sapiens
gaactacaggtgcagcaagtga

SEQ ID NO: 6948483 - DNA, 22 bp, Homo sapiens
aactagtttagctttttaagac

SEQ ID NO: 6948484 - DNA, 22 bp, Homo sapiens
tggctggaagtcagaaatggga

SEQ ID NO: 6948485 - DNA, 22 bp, Homo sapiens
ggcctgagtcccacctggctgt

SEQ ID NO: 6948486 - DNA, 22 bp, Homo sapiens
ttctgtcatttagcattgtcat

SEQ ID NO: 6948487 - DNA, 22 bp, Homo sapiens
cagcgtctcgttgtgggcctcg

SEQ ID NO: 6948488 - DNA, 22 bp, Homo sapiens
gggcttctctcaggggcatgag

SEQ ID NO: 6948489 - DNA, 22 bp, Homo sapiens
tcagaagaagagactccacagc

SEQ ID NO: 6948490 - DNA, 22 bp, Homo sapiens
tgggtggtcttgcttcccagga

SEQ ID NO: 6948491 - DNA, 19 bp, Homo sapiens
atatatgtatacaatgtgg

SEQ ID NO: 6948492 - DNA, 22 bp, Homo sapiens
cagaagcaagggccaaagtctt

SEQ ID NO: 6948493 - DNA, 22 bp, Homo sapiens
ttgtatgtctcaatatcctgtc

SEQ ID NO: 6948494 - DNA, 22 bp, Homo sapiens
gggaaagaccttcctggggtgt

SEQ ID NO: 6948495 - DNA, 16 bp, Homo sapiens
ggcagcagctccgtgc

SEQ ID NO: 6948496 - DNA, 22 bp, Homo sapiens
agcttcttttaccaggaagttg

SEQ ID NO: 6948497 - DNA, 22 bp, Homo sapiens
ttgtagacatctgtatcatttt

SEQ ID NO: 6948498 - DNA, 22 bp, Homo sapiens
gcctccctgttcttccacaata

SEQ ID NO: 6948499 - DNA, 22 bp, Homo sapiens
atcctgtttggttgtctgcctt

SEQ ID NO: 6948500 - DNA, 22 bp, Homo sapiens
ttcttagtgttcaagtagcgct

SEQ ID NO: 6948501 - DNA, 21 bp, Homo sapiens
aaagaacaggcagatgttctt

SEQ ID NO: 6948502 - DNA, 22 bp, Homo sapiens
tcctagagagtaatacagtttt

SEQ ID NO: 6948503 - DNA, 22 bp, Homo sapiens
tgaattcttaatgaaatctact

SEQ ID NO: 6948504 - DNA, 22 bp, Homo sapiens
agaatgctttggatatattgga

SEQ ID NO: 6948505 - DNA, 22 bp, Homo sapiens
aatcaccatctctcttgtcccc

SEQ ID NO: 6948506 - DNA, 22 bp, Homo sapiens
tccagtgtgagaagcagcatga

SEQ ID NO: 6948507 - DNA, 21 bp, Homo sapiens
cagtgggctgctgcgctccag

SEQ ID NO: 6948508 - DNA, 22 bp, Homo sapiens
gtgcccagctccacctcacaga

SEQ ID NO: 6948509 - DNA, 22 bp, Homo sapiens
ggtagaaagatggaacgttgaa

SEQ ID NO: 6948510 - DNA, 22 bp, Homo sapiens
tccagcagtaaggaaagtacat

SEQ ID NO: 6948511 - DNA, 22 bp, Homo sapiens
cagagcttttagatgttgaaca

SEQ ID NO: 6948512 - DNA, 20 bp, Homo sapiens
tgggagtacaatcatgagca

SEQ ID NO: 6948513 - DNA, 22 bp, Homo sapiens
gagcaacagggcgaggagaact

SEQ ID NO: 6948514 - DNA, 20 bp, Homo sapiens
ggcatttatgaaccaagcct

SEQ ID NO: 6948515 - DNA, 22 bp, Homo sapiens
ttttctcaggtgcttatctaag

SEQ ID NO: 6948516 - DNA, 22 bp, Homo sapiens
agcagagctgcagtggcctgct

SEQ ID NO: 6948517 - DNA, 22 bp, Homo sapiens
gccaggagttcagatgcatgtt

SEQ ID NO: 6948518 - DNA, 15 bp, Homo sapiens
tccctcagctaaaga

SEQ ID NO: 6948519 - DNA, 21 bp, Homo sapiens
ttcgcattccctcctctctac

SEQ ID NO: 6948520 - DNA, 22 bp, Homo sapiens
atcagaaagttcatcatgtttg

SEQ ID NO: 6948521 - DNA, 22 bp, Homo sapiens
accccaagacagtagaagagaa

SEQ ID NO: 6948522 - DNA, 22 bp, Homo sapiens
gtgcgtcctgggggctgggtcg

SEQ ID NO: 6948523 - DNA, 22 bp, Homo sapiens
gatttgtttcaagttagcatct

SEQ ID NO: 6948524 - DNA, 22 bp, Homo sapiens
tgtagggaggaaagggctcttg

SEQ ID NO: 6948525 - DNA, 22 bp, Homo sapiens
gattgaaaggaaaaccagagtg

SEQ ID NO: 6948526 - DNA, 22 bp, Homo sapiens
ggagctcggtcccctcctccaa

SEQ ID NO: 6948527 - DNA, 22 bp, Homo sapiens
taagtagtcagacataccccat

SEQ ID NO: 6948528 - DNA, 22 bp, Homo sapiens
agcagtgaaacagctgcatatg

SEQ ID NO: 6948529 - DNA, 22 bp, Homo sapiens
caggaactcaaggtttgtaaca

SEQ ID NO: 6948530 - DNA, 22 bp, Homo sapiens
aaactgcaggtcatgacccatt

SEQ ID NO: 6948531 - DNA, 22 bp, Homo sapiens
acctggcactacaggcacctgt

SEQ ID NO: 6948532 - DNA, 22 bp, Homo sapiens
tttacgagtgctaatgatattg

SEQ ID NO: 6948533 - DNA, 21 bp, Homo sapiens
tcttgtattggatctgtgtgt

SEQ ID NO: 6948534 - DNA, 22 bp, Homo sapiens
atgtgctcttattaccctgtcg

SEQ ID NO: 6948535 - DNA, 22 bp, Homo sapiens
tcaggagttgaaggggatcctg

SEQ ID NO: 6948536 - DNA, 22 bp, Homo sapiens
atgacttcacctctgtgaagca

SEQ ID NO: 6948537 - DNA, 22 bp, Homo sapiens
tttaacctctaatttagttctc

SEQ ID NO: 6948538 - DNA, 19 bp, Homo sapiens
tctgcagaaggcatacatg

SEQ ID NO: 6948539 - DNA, 22 bp, Homo sapiens
aatctggcatgtaagcttagag

SEQ ID NO: 6948540 - DNA, 22 bp, Homo sapiens
ccaggaggctctgcccatccca

SEQ ID NO: 6948541 - DNA, 22 bp, Homo sapiens
gggccttggcgaagtgtggtgg

SEQ ID NO: 6948542 - DNA, 23 bp, Homo sapiens
tctctgtacagatgaggacacac

SEQ ID NO: 6948543 - DNA, 21 bp, Homo sapiens
aaggcagaagcatggaatgag

SEQ ID NO: 6948544 - DNA, 22 bp, Homo sapiens
ctttccccaagcaccacagtgc

SEQ ID NO: 6948545 - DNA, 22 bp, Homo sapiens
agtcagtatttattacttagct

SEQ ID NO: 6948546 - DNA, 22 bp, Homo sapiens
ctccaagggtcttccaccagga

SEQ ID NO: 6948547 - DNA, 22 bp, Homo sapiens
agtgaagctaacctgctgattt

SEQ ID NO: 6948548 - DNA, 22 bp, Homo sapiens
tcatttggtattaattttcaga

SEQ ID NO: 6948549 - DNA, 22 bp, Homo sapiens
aactttgcaagggggccctgcg

SEQ ID NO: 6948550 - DNA, 20 bp, Homo sapiens
aatacatgagcacactttca

SEQ ID NO: 6948551 - DNA, 22 bp, Homo sapiens
tttacagagaatgtacataaag

SEQ ID NO: 6948552 - DNA, 22 bp, Homo sapiens
tagtttatgctgctgcagtgag

SEQ ID NO: 6948553 - DNA, 22 bp, Homo sapiens
ctcggaagcctgaagattttaa

SEQ ID NO: 6948554 - DNA, 22 bp, Homo sapiens
cagcttgttttatttggggacc

SEQ ID NO: 6948555 - DNA, 22 bp, Homo sapiens
tgcctagggcctaaccagagcc

SEQ ID NO: 6948556 - DNA, 22 bp, Homo sapiens
atgtgcaacttttctgtctttt

SEQ ID NO: 6948557 - DNA, 22 bp, Homo sapiens
tgccttcaccaggccttcagcc

SEQ ID NO: 6948558 - DNA, 22 bp, Homo sapiens
accctcaagatggaagcagttt

SEQ ID NO: 6948559 - DNA, 22 bp, Homo sapiens
tcattaataagtctaactctcc

SEQ ID NO: 6948560 - DNA, 22 bp, Homo sapiens
tccttaaatccttcagagatta

SEQ ID NO: 6948561 - DNA, 22 bp, Homo sapiens
gagcaacaggtgatggggctgt

SEQ ID NO: 6948562 - DNA, 22 bp, Homo sapiens
tctgaggggctggaagggctgc

SEQ ID NO: 6948563 - DNA, 22 bp, Homo sapiens
acaaagacgggataaggtttgg

SEQ ID NO: 6948564 - DNA, 22 bp, Homo sapiens
ctgtggatttacttgagaagct

SEQ ID NO: 6948565 - DNA, 22 bp, Homo sapiens
aggcctgggacgggagccgtga

SEQ ID NO: 6948566 - DNA, 22 bp, Homo sapiens
aggcctgtcccagctgaggacg

SEQ ID NO: 6948567 - DNA, 22 bp, Homo sapiens
acttgggctggagtgccgagga

SEQ ID NO: 6948568 - DNA, 22 bp, Homo sapiens
tgctggcctgggctgcaccttg

SEQ ID NO: 6948569 - DNA, 22 bp, Homo sapiens
ttccttggagtcaaacagggag

SEQ ID NO: 6948570 - DNA, 22 bp, Homo sapiens
cctcagtgagatgctcagcgaa

SEQ ID NO: 6948571 - DNA, 21 bp, Homo sapiens
atgatactgaagcacaactat

SEQ ID NO: 6948572 - DNA, 22 bp, Homo sapiens
agggagaaaattggatgcacaa

SEQ ID NO: 6948573 - DNA, 22 bp, Homo sapiens
ctaagcttttcaaaaacatgtt

SEQ ID NO: 6948574 - DNA, 22 bp, Homo sapiens
gctgctgggtccctctgtgcca

SEQ ID NO: 6948575 - DNA, 22 bp, Homo sapiens
gctggtcagagagaaaggaggc

SEQ ID NO: 6948576 - DNA, 22 bp, Homo sapiens
ggcctcgagcaatactcccatc

SEQ ID NO: 6948577 - DNA, 19 bp, Homo sapiens
actgtcacataaaggaagg

SEQ ID NO: 6948578 - DNA, 22 bp, Homo sapiens
gcagtcaggttaaggccttccc

SEQ ID NO: 6948579 - DNA, 18 bp, Homo sapiens
gtaagcaaagactttata

SEQ ID NO: 6948580 - DNA, 22 bp, Homo sapiens
cttgagaaggaggaagggcttt

SEQ ID NO: 6948581 - DNA, 22 bp, Homo sapiens
ggtcaacttgagaagctagtac

SEQ ID NO: 6948582 - DNA, 22 bp, Homo sapiens
tgtagcactatgcactacacat

SEQ ID NO: 6948583 - DNA, 22 bp, Homo sapiens
aactcatttgcatttttcctgt

SEQ ID NO: 6948584 - DNA, 22 bp, Homo sapiens
acatttattttcagctgggaaa

SEQ ID NO: 6948585 - DNA, 22 bp, Homo sapiens
tgaagcaagatagaaagctgct

SEQ ID NO: 6948586 - DNA, 22 bp, Homo sapiens
cagatggctgccaagatgggct

SEQ ID NO: 6948587 - DNA, 22 bp, Homo sapiens
gcgtgtaaattagacattcagc

SEQ ID NO: 6948588 - DNA, 22 bp, Homo sapiens
ggcttccagctgggccttggag

SEQ ID NO: 6948589 - DNA, 22 bp, Homo sapiens
agaaccttcagcttgcaacaag

SEQ ID NO: 6948590 - DNA, 22 bp, Homo sapiens
atgtacatgtttaagtgaagga

SEQ ID NO: 6948591 - DNA, 22 bp, Homo sapiens
ttccagaaagttctggaactgg

SEQ ID NO: 6948592 - DNA, 22 bp, Homo sapiens
gttctaagggcttgaaatgtat

SEQ ID NO: 6948593 - DNA, 22 bp, Homo sapiens
tcacaatatgggtgtgggaact

SEQ ID NO: 6948594 - DNA, 22 bp, Homo sapiens
agatgttcctagatgcgtgggc

SEQ ID NO: 6948595 - DNA, 21 bp, Homo sapiens
ggtattctgtgtcacctttgg

SEQ ID NO: 6948596 - DNA, 22 bp, Homo sapiens
ttcatttaatttgtgtattaac

SEQ ID NO: 6948597 - DNA, 22 bp, Homo sapiens
gtgggagctgcggaggcctggg

SEQ ID NO: 6948598 - DNA, 22 bp, Homo sapiens
aacatctactaagtgccaggca

SEQ ID NO: 6948599 - DNA, 22 bp, Homo sapiens
ggtggcctagaagataagggga

SEQ ID NO: 6948600 - DNA, 22 bp, Homo sapiens
aaggtggtaatagtgcaggatt

SEQ ID NO: 6948601 - DNA, 22 bp, Homo sapiens
ccagccttggctttcctagccc

SEQ ID NO: 6948602 - DNA, 22 bp, Homo sapiens
acagctttatctcagggatcag

SEQ ID NO: 6948603 - DNA, 22 bp, Homo sapiens
tagagctggaatttgcagcaag

SEQ ID NO: 6948604 - DNA, 22 bp, Homo sapiens
ccacttgtgaaataatcaaata

SEQ ID NO: 6948605 - DNA, 22 bp, Homo sapiens
cccagcactcagcaggctcata

SEQ ID NO: 6948606 - DNA, 22 bp, Homo sapiens
ttggaagctactttaatgtaat

SEQ ID NO: 6948607 - DNA, 22 bp, Homo sapiens
aataaaatggtcagttttctca

SEQ ID NO: 6948608 - DNA, 22 bp, Homo sapiens
tttccaaagttgccataagctt

SEQ ID NO: 6948609 - DNA, 22 bp, Homo sapiens
aggcgggtaccctggctcgaaa

SEQ ID NO: 6948610 - DNA, 22 bp, Homo sapiens
taatggagccagaagatcttga

SEQ ID NO: 6948611 - DNA, 22 bp, Homo sapiens
cttctccctggcttctgcacac

SEQ ID NO: 6948612 - DNA, 20 bp, Homo sapiens
tgtgtgctaggactacagtg

SEQ ID NO: 6948613 - DNA, 21 bp, Homo sapiens
ctggcccagggatctgcattt

SEQ ID NO: 6948614 - DNA, 19 bp, Homo sapiens
aaacaggccgagtgcctaa

SEQ ID NO: 6948615 - DNA, 22 bp, Homo sapiens
tctgggctgggcttaggaaccc

SEQ ID NO: 6948616 - DNA, 20 bp, Homo sapiens
aagtcctgacctagtctaaa

SEQ ID NO: 6948617 - DNA, 22 bp, Homo sapiens
attgtacagacatgggaaacaa

SEQ ID NO: 6948618 - DNA, 22 bp, Homo sapiens
cagctagaaatgggattggtat

SEQ ID NO: 6948619 - DNA, 22 bp, Homo sapiens
tattctggtttccggatctcta

SEQ ID NO: 6948620 - DNA, 17 bp, Homo sapiens
tttctagattatcctct

SEQ ID NO: 6948621 - DNA, 22 bp, Homo sapiens
aatgctgtccaataggaacata

SEQ ID NO: 6948622 - DNA, 22 bp, Homo sapiens
gatccagatatttgggctggta

SEQ ID NO: 6948623 - DNA, 22 bp, Homo sapiens
aagcaggccctgggccagggga

SEQ ID NO: 6948624 - DNA, 22 bp, Homo sapiens
aaagcattactagactggattt

SEQ ID NO: 6948625 - DNA, 22 bp, Homo sapiens
gcaagaaaagagccttcagtgg

SEQ ID NO: 6948626 - DNA, 22 bp, Homo sapiens
gacttgcctgcactgagcctat

SEQ ID NO: 6948627 - DNA, 22 bp, Homo sapiens
tagctactgatgcaagagtttg

SEQ ID NO: 6948628 - DNA, 22 bp, Homo sapiens
cagaggaaggctctgggaatgt

SEQ ID NO: 6948629 - DNA, 22 bp, Homo sapiens
tcactaagttacatttagtatt

SEQ ID NO: 6948630 - DNA, 22 bp, Homo sapiens
tacacatccttctgaacaacct

SEQ ID NO: 6948631 - DNA, 22 bp, Homo sapiens
aaaggccttgagctgggtgcca

SEQ ID NO: 6948632 - DNA, 22 bp, Homo sapiens
ccagagtcaggagctcatgtga

SEQ ID NO: 6948633 - DNA, 22 bp, Homo sapiens
tatgcactccacacggcctcca

SEQ ID NO: 6948634 - DNA, 22 bp, Homo sapiens
tcaattcttattggtgttctgc

SEQ ID NO: 6948635 - DNA, 22 bp, Homo sapiens
tgtcacattatatgtgaggata

SEQ ID NO: 6948636 - DNA, 22 bp, Homo sapiens
caaatgaatatttccatgggtt

SEQ ID NO: 6948637 - DNA, 22 bp, Homo sapiens
caggatcatgctgaatctggca

SEQ ID NO: 6948638 - DNA, 22 bp, Homo sapiens
gctgggaagtggcagagctgga

SEQ ID NO: 6948639 - DNA, 23 bp, Homo sapiens
atgttttatgtctctagctgcca

SEQ ID NO: 6948640 - DNA, 22 bp, Homo sapiens
aagatcctcagccagtgaggcg

SEQ ID NO: 6948641 - DNA, 22 bp, Homo sapiens
ttagaggacaagaggcctggct

SEQ ID NO: 6948642 - DNA, 22 bp, Homo sapiens
cagctctttactctgcaatgat

SEQ ID NO: 6948643 - DNA, 22 bp, Homo sapiens
ctgaacatcatagagtgtactt

SEQ ID NO: 6948644 - DNA, 22 bp, Homo sapiens
tctcagagtaattctttaaggt

SEQ ID NO: 6948645 - DNA, 22 bp, Homo sapiens
ctagaaacgcctttagcacaac

SEQ ID NO: 6948646 - DNA, 22 bp, Homo sapiens
tacagtttctgtccttgtggag

SEQ ID NO: 6948647 - DNA, 22 bp, Homo sapiens
atgaacttccagagcttggtga

SEQ ID NO: 6948648 - DNA, 22 bp, Homo sapiens
ggacagaaattcttgttggaca

SEQ ID NO: 6948649 - DNA, 22 bp, Homo sapiens
gttttctgcctgaaggtgacca

SEQ ID NO: 6948650 - DNA, 22 bp, Homo sapiens
aagggaaactttcacaatgtcc

SEQ ID NO: 6948651 - DNA, 22 bp, Homo sapiens
actagtattgcctactgtacat

SEQ ID NO: 6948652 - DNA, 22 bp, Homo sapiens
cctcttctaggtttcagcctgc

SEQ ID NO: 6948653 - DNA, 22 bp, Homo sapiens
gggaggcatgtgttatccactt

SEQ ID NO: 6948654 - DNA, 20 bp, Homo sapiens
acaaagactggaaaagcaag

SEQ ID NO: 6948655 - DNA, 22 bp, Homo sapiens
caggaggagccagcgcccttca

SEQ ID NO: 6948656 - DNA, 22 bp, Homo sapiens
catgtcgagtgggtctctgttc

SEQ ID NO: 6948657 - DNA, 22 bp, Homo sapiens
agtttctagcctcactgtttag

SEQ ID NO: 6948658 - DNA, 21 bp, Homo sapiens
ctggagcttggtgagaagtgt

SEQ ID NO: 6948659 - DNA, 22 bp, Homo sapiens
tagcaaagagaaaaattatgct

SEQ ID NO: 6948660 - DNA, 19 bp, Homo sapiens
agcttccatattctctagt

SEQ ID NO: 6948661 - DNA, 22 bp, Homo sapiens
ctttagtggttagtttaggcca

SEQ ID NO: 6948662 - DNA, 22 bp, Homo sapiens
tctgcctggaccctggtgagct

SEQ ID NO: 6948663 - DNA, 22 bp, Homo sapiens
ctggacttctcttcaaagacag

SEQ ID NO: 6948664 - DNA, 22 bp, Homo sapiens
gtcccaggcagagtcaggaggg

SEQ ID NO: 6948665 - DNA, 22 bp, Homo sapiens
aaacaggagttgaccaagtaca

SEQ ID NO: 6948666 - DNA, 22 bp, Homo sapiens
tctggctgaaaggggctgtgcc

SEQ ID NO: 6948667 - DNA, 22 bp, Homo sapiens
ttcagactagacacatttcaag

SEQ ID NO: 6948668 - DNA, 19 bp, Homo sapiens
agtcagttctgaggaggaa

SEQ ID NO: 6948669 - DNA, 22 bp, Homo sapiens
aggcctggctttggtttgctga

SEQ ID NO: 6948670 - DNA, 22 bp, Homo sapiens
aagtaagtttctctctccaaga

SEQ ID NO: 6948671 - DNA, 22 bp, Homo sapiens
ccctttaagtagaatatattat

SEQ ID NO: 6948672 - DNA, 22 bp, Homo sapiens
tagtgattataaaacagttttt

SEQ ID NO: 6948673 - DNA, 22 bp, Homo sapiens
ctctaattaatatttattaggt

SEQ ID NO: 6948674 - DNA, 22 bp, Homo sapiens
gcagtgttacctcttcagtggg

SEQ ID NO: 6948675 - DNA, 22 bp, Homo sapiens
atatggcaaaggggaattaagg

SEQ ID NO: 6948676 - DNA, 22 bp, Homo sapiens
ctggctggcagatgctcttgct

SEQ ID NO: 6948677 - DNA, 22 bp, Homo sapiens
agtagcataaatagtggtagta

SEQ ID NO: 6948678 - DNA, 22 bp, Homo sapiens
aggcaggcagctgtcaccactc

SEQ ID NO: 6948679 - DNA, 22 bp, Homo sapiens
agacactgaaatgtattgaaga

SEQ ID NO: 6948680 - DNA, 22 bp, Homo sapiens
agttagaatataattatgttaa

SEQ ID NO: 6948681 - DNA, 22 bp, Homo sapiens
agcattacagtggtacccaggg

SEQ ID NO: 6948682 - DNA, 22 bp, Homo sapiens
aagacattgtggagatgttgct

SEQ ID NO: 6948683 - DNA, 22 bp, Homo sapiens
tgttagcaaggataattatgat

SEQ ID NO: 6948684 - DNA, 22 bp, Homo sapiens
gtcacggttctctaaaacagga

SEQ ID NO: 6948685 - DNA, 22 bp, Homo sapiens
aacaagttctacctcacaaggt

SEQ ID NO: 6948686 - DNA, 22 bp, Homo sapiens
gaggaaatcattccagaaaagg

SEQ ID NO: 6948687 - DNA, 22 bp, Homo sapiens
tcccaagcttagggctctcagt

SEQ ID NO: 6948688 - DNA, 22 bp, Homo sapiens
ctgcaatgatgtatttgtcctg

SEQ ID NO: 6948689 - DNA, 22 bp, Homo sapiens
attgtctttccactgagaagtt

SEQ ID NO: 6948690 - DNA, 22 bp, Homo sapiens
tccctgtgcctatatgtgctga

SEQ ID NO: 6948691 - DNA, 19 bp, Homo sapiens
cctcctgctagatatgcaa

SEQ ID NO: 6948692 - DNA, 22 bp, Homo sapiens
tggcatgttctcttagcagctc

SEQ ID NO: 6948693 - DNA, 22 bp, Homo sapiens
gaggggctggcacgatggctgc

SEQ ID NO: 6948694 - DNA, 22 bp, Homo sapiens
gctgcccaggagaggtggggct

SEQ ID NO: 6948695 - DNA, 22 bp, Homo sapiens
gaggaatgggtgtctcgtgatt

SEQ ID NO: 6948696 - DNA, 23 bp, Homo sapiens
attcagttgtgagagaagacaca

SEQ ID NO: 6948697 - DNA, 22 bp, Homo sapiens
gctgcagacctcatgcaggtgg

SEQ ID NO: 6948698 - DNA, 22 bp, Homo sapiens
aatgttcattgttttccatatg

SEQ ID NO: 6948699 - DNA, 22 bp, Homo sapiens
tgtcaagctctggacatttgag

SEQ ID NO: 6948700 - DNA, 17 bp, Homo sapiens
tgaggccatggcaccat

SEQ ID NO: 6948701 - DNA, 23 bp, Homo sapiens
agcagctgtggtttaccttagta

SEQ ID NO: 6948702 - DNA, 22 bp, Homo sapiens
tacaagtagctcaggttttctg

SEQ ID NO: 6948703 - DNA, 22 bp, Homo sapiens
ttcagtttcttccctgtgaaat

SEQ ID NO: 6948704 - DNA, 22 bp, Homo sapiens
gaggcataaatcacagtgttca

SEQ ID NO: 6948705 - DNA, 23 bp, Homo sapiens
gaaagctctctcctcaggacctt

SEQ ID NO: 6948706 - DNA, 22 bp, Homo sapiens
tagagtctagagtgggaccgag

SEQ ID NO: 6948707 - DNA, 22 bp, Homo sapiens
agcagaggacagttcttaggaa

SEQ ID NO: 6948708 - DNA, 22 bp, Homo sapiens
attgccaactgcattacagtcc

SEQ ID NO: 6948709 - DNA, 22 bp, Homo sapiens
aggaactggtgaagtgtagtga

SEQ ID NO: 6948710 - DNA, 22 bp, Homo sapiens
cctgcctggcccaccttgccac

SEQ ID NO: 6948711 - DNA, 22 bp, Homo sapiens
gagagctttcatgttgggaatg

SEQ ID NO: 6948712 - DNA, 22 bp, Homo sapiens
actttgaaaagacagtagctct

SEQ ID NO: 6948713 - DNA, 22 bp, Homo sapiens
ggcatagcggctcagcgtccag

SEQ ID NO: 6948714 - DNA, 22 bp, Homo sapiens
aggtggatcacctgacgtcagg

SEQ ID NO: 6948715 - DNA, 20 bp, Homo sapiens
aatgtactgtttgtgggggc

SEQ ID NO: 6948716 - DNA, 22 bp, Homo sapiens
aatcatcttcatcttacacaga

SEQ ID NO: 6948717 - DNA, 22 bp, Homo sapiens
ataatgaaatatgaggaaggtc

SEQ ID NO: 6948718 - DNA, 22 bp, Homo sapiens
aaggcatatgctgtgtacagtt

SEQ ID NO: 6948719 - DNA, 22 bp, Homo sapiens
gaggtgtctgctgtgttcaaag

SEQ ID NO: 6948720 - DNA, 23 bp, Homo sapiens
cagacctggcagtcatcctcaac

SEQ ID NO: 6948721 - DNA, 22 bp, Homo sapiens
cctgcatccgaaagtgatcata

SEQ ID NO: 6948722 - DNA, 17 bp, Homo sapiens
aatctcagtggcttaag

SEQ ID NO: 6948723 - DNA, 22 bp, Homo sapiens
atgcttttcctaaaatgatgcc

SEQ ID NO: 6948724 - DNA, 22 bp, Homo sapiens
tacgagcgctcttgctggccaa

SEQ ID NO: 6948725 - DNA, 22 bp, Homo sapiens
ttctttgaatagatgttcccag

SEQ ID NO: 6948726 - DNA, 22 bp, Homo sapiens
cctcagtgacctattgcattca

SEQ ID NO: 6948727 - DNA, 23 bp, Homo sapiens
cacagtcatttactttgccatca

SEQ ID NO: 6948728 - DNA, 22 bp, Homo sapiens
gtcacacacatttctttggtgc

SEQ ID NO: 6948729 - DNA, 22 bp, Homo sapiens
ggtctctgtcactgagtggccc

SEQ ID NO: 6948730 - DNA, 22 bp, Homo sapiens
attgtactacaccatagtactg

SEQ ID NO: 6948731 - DNA, 22 bp, Homo sapiens
tgggaagttaggatgccaggga

SEQ ID NO: 6948732 - DNA, 22 bp, Homo sapiens
gacagacatttcctgatccaat

SEQ ID NO: 6948733 - DNA, 23 bp, Homo sapiens
atgagcacaaacagcaaaaggga

SEQ ID NO: 6948734 - DNA, 22 bp, Homo sapiens
agggacactgatgagaaattct

SEQ ID NO: 6948735 - DNA, 22 bp, Homo sapiens
cagtttatatataagcacattg

SEQ ID NO: 6948736 - DNA, 17 bp, Homo sapiens
tgttttttccctgttct

SEQ ID NO: 6948737 - DNA, 22 bp, Homo sapiens
actgttctgccaagatcaacgt

SEQ ID NO: 6948738 - DNA, 22 bp, Homo sapiens
tgagaatgaatcttttgctttc

SEQ ID NO: 6948739 - DNA, 22 bp, Homo sapiens
cacagtggaaacagctaagcct

SEQ ID NO: 6948740 - DNA, 22 bp, Homo sapiens
tttagtgtgacagtccccagta

SEQ ID NO: 6948741 - DNA, 22 bp, Homo sapiens
ggcttaaatcacagtgactttt

SEQ ID NO: 6948742 - DNA, 22 bp, Homo sapiens
tagctgggaattatctggttgc

SEQ ID NO: 6948743 - DNA, 22 bp, Homo sapiens
atctgcctgagtctaggttttc

SEQ ID NO: 6948744 - DNA, 22 bp, Homo sapiens
aacattgcattctctatgagat

SEQ ID NO: 6948745 - DNA, 22 bp, Homo sapiens
gcagcagatgctttcatggaca

SEQ ID NO: 6948746 - DNA, 22 bp, Homo sapiens
tgagtgtatatcaggagagagc

SEQ ID NO: 6948747 - DNA, 22 bp, Homo sapiens
tagacgcaactataacacttca

SEQ ID NO: 6948748 - DNA, 22 bp, Homo sapiens
tctgctcagtgcttatctctaa

SEQ ID NO: 6948749 - DNA, 22 bp, Homo sapiens
tggactgaattgaagcaggaag

SEQ ID NO: 6948750 - DNA, 22 bp, Homo sapiens
agcccgagcgcacctgtggaaa

SEQ ID NO: 6948751 - DNA, 18 bp, Homo sapiens
ggaacagctcagggcagc

SEQ ID NO: 6948752 - DNA, 22 bp, Homo sapiens
tctaccactaagtgtgctttga

SEQ ID NO: 6948753 - DNA, 22 bp, Homo sapiens
gcttcttgcctgtgtagagaat

SEQ ID NO: 6948754 - DNA, 22 bp, Homo sapiens
tgggccttggatcgctaagctg

SEQ ID NO: 6948755 - DNA, 22 bp, Homo sapiens
tgcatgtggatcatatgtccta

SEQ ID NO: 6948756 - DNA, 21 bp, Homo sapiens
cagcccagcttcttccccagt

SEQ ID NO: 6948757 - DNA, 22 bp, Homo sapiens
atctcttctagctctgaaatta

SEQ ID NO: 6948758 - DNA, 22 bp, Homo sapiens
cgaaatcaaacttgggcttctg

SEQ ID NO: 6948759 - DNA, 22 bp, Homo sapiens
gtgaagttgattgttatcgtca

SEQ ID NO: 6948760 - DNA, 22 bp, Homo sapiens
tgtgctgacaagatcagaaggt

SEQ ID NO: 6948761 - DNA, 22 bp, Homo sapiens
tggtaaggacttagttatcaat

SEQ ID NO: 6948762 - DNA, 22 bp, Homo sapiens
tgacagggccatgctgcactgc

SEQ ID NO: 6948763 - DNA, 22 bp, Homo sapiens
aatatttccaaggcctgtcagg

SEQ ID NO: 6948764 - DNA, 22 bp, Homo sapiens
tcagggacttacaaaccagaag

SEQ ID NO: 6948765 - DNA, 22 bp, Homo sapiens
atgaaataaatacccacacata

SEQ ID NO: 6948766 - DNA, 22 bp, Homo sapiens
ctgactcactgtggctcttaat

SEQ ID NO: 6948767 - DNA, 22 bp, Homo sapiens
ttgggcagtagcctcttggtgt

SEQ ID NO: 6948768 - DNA, 22 bp, Homo sapiens
ttaaagcactaaatgatgaggg

SEQ ID NO: 6948769 - DNA, 22 bp, Homo sapiens
aattgcttgttttcggtcataa

SEQ ID NO: 6948770 - DNA, 22 bp, Homo sapiens
cacatagataggcagaagaaca

SEQ ID NO: 6948771 - DNA, 22 bp, Homo sapiens
ccaggcctcacctgcccaccta

SEQ ID NO: 6948772 - DNA, 22 bp, Homo sapiens
tgggtttaaactcaactctaaa

SEQ ID NO: 6948773 - DNA, 22 bp, Homo sapiens
tgatttgattcttcttggagta

SEQ ID NO: 6948774 - DNA, 22 bp, Homo sapiens
agtctttattcactattgataa

SEQ ID NO: 6948775 - DNA, 22 bp, Homo sapiens
acacatgcgatagagaggtagg

SEQ ID NO: 6948776 - DNA, 22 bp, Homo sapiens
tctgtctctcaagggccgtcct

SEQ ID NO: 6948777 - DNA, 22 bp, Homo sapiens
gttgggcttcagatgagggtca

SEQ ID NO: 6948778 - DNA, 19 bp, Homo sapiens
gcagggctctcccagatgc

SEQ ID NO: 6948779 - DNA, 22 bp, Homo sapiens
cccagtaacttgcctaagttgc

SEQ ID NO: 6948780 - DNA, 22 bp, Homo sapiens
gcaggcacctcgtggagtggaa

SEQ ID NO: 6948781 - DNA, 22 bp, Homo sapiens
ggcagtggaggaccctgtgtct

SEQ ID NO: 6948782 - DNA, 22 bp, Homo sapiens
ggccctctccaactctgttcca

SEQ ID NO: 6948783 - DNA, 22 bp, Homo sapiens
tggctgcagatctgtgggacac

SEQ ID NO: 6948784 - DNA, 22 bp, Homo sapiens
attgagaatattgtgacagtgt

SEQ ID NO: 6948785 - DNA, 22 bp, Homo sapiens
ctccggaggggcgctcatgctt

SEQ ID NO: 6948786 - DNA, 22 bp, Homo sapiens
tagggcttcaggtgtgaggcag

SEQ ID NO: 6948787 - DNA, 22 bp, Homo sapiens
ttaggaagtttcagaaaatgca

SEQ ID NO: 6948788 - DNA, 22 bp, Homo sapiens
tgatttcaagtagtgacatgct

SEQ ID NO: 6948789 - DNA, 22 bp, Homo sapiens
cacgttttatgacagaagaagc

SEQ ID NO: 6948790 - DNA, 17 bp, Homo sapiens
cccaggccgccgggagc

SEQ ID NO: 6948791 - DNA, 22 bp, Homo sapiens
gtgaaggctaattaaacaagtt

SEQ ID NO: 6948792 - DNA, 22 bp, Homo sapiens
atcgaggaaaggacagttcctt

SEQ ID NO: 6948793 - DNA, 22 bp, Homo sapiens
tatgttgagcattcagtgatct

SEQ ID NO: 6948794 - DNA, 22 bp, Homo sapiens
ccacagtgtggcataaactgta

SEQ ID NO: 6948795 - DNA, 20 bp, Homo sapiens
tctgaacaaaatgtaatgtc

SEQ ID NO: 6948796 - DNA, 22 bp, Homo sapiens
atgtgagggaaatcagtcagaa

SEQ ID NO: 6948797 - DNA, 22 bp, Homo sapiens
ggcagagtggagtgcggcctcc

SEQ ID NO: 6948798 - DNA, 22 bp, Homo sapiens
acatccttgattatgtaaggat

SEQ ID NO: 6948799 - DNA, 22 bp, Homo sapiens
tgaggagtatggtggggtcatt

SEQ ID NO: 6948800 - DNA, 22 bp, Homo sapiens
aacagcaggcaccaaggctatg

SEQ ID NO: 6948801 - DNA, 20 bp, Homo sapiens
tggaacctaggcagagctgg

SEQ ID NO: 6948802 - DNA, 22 bp, Homo sapiens
ttcagagagtacagttgctggc

SEQ ID NO: 6948803 - DNA, 22 bp, Homo sapiens
agggatgagtgagtaaacaata

SEQ ID NO: 6948804 - DNA, 22 bp, Homo sapiens
ctgtctagttaggatgccagca

SEQ ID NO: 6948805 - DNA, 23 bp, Homo sapiens
tgcagctgcctctggcgggccgg

SEQ ID NO: 6948806 - DNA, 22 bp, Homo sapiens
aagtaaaattcaatcttcactg

SEQ ID NO: 6948807 - DNA, 21 bp, Homo sapiens
ttcttcaaagaagaaggcaca

SEQ ID NO: 6948808 - DNA, 22 bp, Homo sapiens
tttatagcagcatgatttataa

SEQ ID NO: 6948809 - DNA, 22 bp, Homo sapiens
tgtaatgatgtacttagaagga

SEQ ID NO: 6948810 - DNA, 20 bp, Homo sapiens
agctctttttagctaaggta

SEQ ID NO: 6948811 - DNA, 22 bp, Homo sapiens
taaggtgtggtagtttagttct

SEQ ID NO: 6948812 - DNA, 22 bp, Homo sapiens
ggtttccattattttatgggtg

SEQ ID NO: 6948813 - DNA, 22 bp, Homo sapiens
gcttgggatatgctgatgtaaa

SEQ ID NO: 6948814 - DNA, 22 bp, Homo sapiens
gcatgaaatgagcgaatataat

SEQ ID NO: 6948815 - DNA, 22 bp, Homo sapiens
accaaggagtttggtattttag

SEQ ID NO: 6948816 - DNA, 22 bp, Homo sapiens
agtgcattctctaattacaggt

SEQ ID NO: 6948817 - DNA, 22 bp, Homo sapiens
tctgtcaccgagggcatccaaa

SEQ ID NO: 6948818 - DNA, 22 bp, Homo sapiens
cacctgcctggtccttagggct

SEQ ID NO: 6948819 - DNA, 22 bp, Homo sapiens
ctggcccagtctcagagtgtca

SEQ ID NO: 6948820 - DNA, 22 bp, Homo sapiens
actcaggcactcagccctcgcc

SEQ ID NO: 6948821 - DNA, 22 bp, Homo sapiens
gaattctggttttgaaatgaat

SEQ ID NO: 6948822 - DNA, 22 bp, Homo sapiens
gagtcaggtttctgcctataga

SEQ ID NO: 6948823 - DNA, 23 bp, Homo sapiens
gtctctagagtgtggagcaaaga

SEQ ID NO: 6948824 - DNA, 22 bp, Homo sapiens
tctcagtttcctcatatgtaaa

SEQ ID NO: 6948825 - DNA, 22 bp, Homo sapiens
aggagagcaggccagccgtccc

SEQ ID NO: 6948826 - DNA, 22 bp, Homo sapiens
agaaacgcctgtgaaattatct

SEQ ID NO: 6948827 - DNA, 22 bp, Homo sapiens
gtcatctctttacttttgctga

SEQ ID NO: 6948828 - DNA, 22 bp, Homo sapiens
gtctcacacagagtagattttg

SEQ ID NO: 6948829 - DNA, 22 bp, Homo sapiens
ggagtggccacgactgggagat

SEQ ID NO: 6948830 - DNA, 22 bp, Homo sapiens
gtctggaaaggggcttttatct

SEQ ID NO: 6948831 - DNA, 22 bp, Homo sapiens
aactttggtaatttactgggaa

SEQ ID NO: 6948832 - DNA, 22 bp, Homo sapiens
ttcctggtcctattatatacac

SEQ ID NO: 6948833 - DNA, 22 bp, Homo sapiens
cctattgacaattctcttctcc

SEQ ID NO: 6948834 - DNA, 22 bp, Homo sapiens
aacagctttgtgctcagatttg

SEQ ID NO: 6948835 - DNA, 22 bp, Homo sapiens
catttcattcctttgaaagtgg

SEQ ID NO: 6948836 - DNA, 22 bp, Homo sapiens
atgcagtcatggaatgctctca

SEQ ID NO: 6948837 - DNA, 22 bp, Homo sapiens
atgtcgataggagtgccatcgg

SEQ ID NO: 6948838 - DNA, 22 bp, Homo sapiens
tgctctggagtggcttgtgcac

SEQ ID NO: 6948839 - DNA, 20 bp, Homo sapiens
ttcctggggaatgatagaag

SEQ ID NO: 6948840 - DNA, 22 bp, Homo sapiens
tacacgtgcaaattcaatgtat

SEQ ID NO: 6948841 - DNA, 20 bp, Homo sapiens
agaaataccacatttggcaa

SEQ ID NO: 6948842 - DNA, 22 bp, Homo sapiens
ctgagctgggagtggatagtgg

SEQ ID NO: 6948843 - DNA, 22 bp, Homo sapiens
ctgtgtccatttatcattgtca

SEQ ID NO: 6948844 - DNA, 22 bp, Homo sapiens
tgatgcctatgaattgtaatgt

SEQ ID NO: 6948845 - DNA, 18 bp, Homo sapiens
tagtattggattggggac

SEQ ID NO: 6948846 - DNA, 22 bp, Homo sapiens
ttccactctactctggccagtc

SEQ ID NO: 6948847 - DNA, 22 bp, Homo sapiens
ttagctgaaaaaattcatgcaa

SEQ ID NO: 6948848 - DNA, 22 bp, Homo sapiens
ttggtaaatccccttacacaaa

SEQ ID NO: 6948849 - DNA, 22 bp, Homo sapiens
tgggcctcggagcacaggagac

SEQ ID NO: 6948850 - DNA, 22 bp, Homo sapiens
gtttctcacttccagtagccaa

SEQ ID NO: 6948851 - DNA, 22 bp, Homo sapiens
tggcagtcctcttcctcgggcg

SEQ ID NO: 6948852 - DNA, 22 bp, Homo sapiens
acttccttgtactgactccatt

SEQ ID NO: 6948853 - DNA, 22 bp, Homo sapiens
aataatgagacagcttatttaa

SEQ ID NO: 6948854 - DNA, 22 bp, Homo sapiens
aaacatctgacttgctttttca

SEQ ID NO: 6948855 - DNA, 22 bp, Homo sapiens
ttcacagtttaatggcaaggat

SEQ ID NO: 6948856 - DNA, 22 bp, Homo sapiens
agactgttgcctgaacttagcc

SEQ ID NO: 6948857 - DNA, 22 bp, Homo sapiens
aagggagccaagaaagcagggc

SEQ ID NO: 6948858 - DNA, 22 bp, Homo sapiens
ctagtcacgtctttcagttacc

SEQ ID NO: 6948859 - DNA, 22 bp, Homo sapiens
tgcttaaagtgttaaccctgtt

SEQ ID NO: 6948860 - DNA, 22 bp, Homo sapiens
actgggcaccatcatgagatgg

SEQ ID NO: 6948861 - DNA, 22 bp, Homo sapiens
gctctattactttcaataaaaa

SEQ ID NO: 6948862 - DNA, 22 bp, Homo sapiens
aagatttctgcttttggaggca

SEQ ID NO: 6948863 - DNA, 22 bp, Homo sapiens
tttgcattgcattaagtattct

SEQ ID NO: 6948864 - DNA, 22 bp, Homo sapiens
ccactgaaggtcaacatagagc

SEQ ID NO: 6948865 - DNA, 22 bp, Homo sapiens
aagaggtggaacagcaattcgt

SEQ ID NO: 6948866 - DNA, 22 bp, Homo sapiens
aggaggcactcactctcagggt

SEQ ID NO: 6948867 - DNA, 22 bp, Homo sapiens
tctcagaaaagagcttcagaaa

SEQ ID NO: 6948868 - DNA, 22 bp, Homo sapiens
aaactctatgaaccttctacca

SEQ ID NO: 6948869 - DNA, 22 bp, Homo sapiens
tttagtgtaagcataaagaaca

SEQ ID NO: 6948870 - DNA, 19 bp, Homo sapiens
gttctttcatagtaagagc

SEQ ID NO: 6948871 - DNA, 22 bp, Homo sapiens
ttcagttccttgtgcgaattcc

SEQ ID NO: 6948872 - DNA, 22 bp, Homo sapiens
ctccagaggatgcaggtgaggg

SEQ ID NO: 6948873 - DNA, 22 bp, Homo sapiens
ctattctagattacagtataaa

SEQ ID NO: 6948874 - DNA, 22 bp, Homo sapiens
gaaatgtgacctacttccttgt

SEQ ID NO: 6948875 - DNA, 22 bp, Homo sapiens
ctcaggacccggtccaggtggg

SEQ ID NO: 6948876 - DNA, 22 bp, Homo sapiens
ctaggaaagtgattcttcaatt

SEQ ID NO: 6948877 - DNA, 22 bp, Homo sapiens
tcagtcctgggccggcatcctc

SEQ ID NO: 6948878 - DNA, 22 bp, Homo sapiens
agaatcctcttcagtaaattct

SEQ ID NO: 6948879 - DNA, 22 bp, Homo sapiens
gcagaataatagaaaggcacac

SEQ ID NO: 6948880 - DNA, 22 bp, Homo sapiens
agaaatgaaaccaaagcctaga

SEQ ID NO: 6948881 - DNA, 22 bp, Homo sapiens
ggccaggtccagtggaaggccc

SEQ ID NO: 6948882 - DNA, 23 bp, Homo sapiens
cagaccctcaatccacttgtttt

SEQ ID NO: 6948883 - DNA, 22 bp, Homo sapiens
aaggtacaaagttatacagcgt

SEQ ID NO: 6948884 - DNA, 23 bp, Homo sapiens
tggcccgggctcagaggcagtgc

SEQ ID NO: 6948885 - DNA, 22 bp, Homo sapiens
tgtatcaatcatgtaatttggt

SEQ ID NO: 6948886 - DNA, 23 bp, Homo sapiens
ctgagggctggtctgaagtctgc

SEQ ID NO: 6948887 - DNA, 22 bp, Homo sapiens
cagcaaaacagccgttgcctgg

SEQ ID NO: 6948888 - DNA, 22 bp, Homo sapiens
ctattttcccatatggttgaca

SEQ ID NO: 6948889 - DNA, 22 bp, Homo sapiens
gcaatgtctagtctgagggctt

SEQ ID NO: 6948890 - DNA, 22 bp, Homo sapiens
aaggtattggggaatatttgac

SEQ ID NO: 6948891 - DNA, 22 bp, Homo sapiens
taatgtctgtgtttcagtgcag

SEQ ID NO: 6948892 - DNA, 22 bp, Homo sapiens
attggtgtgccacaactagttt

SEQ ID NO: 6948893 - DNA, 22 bp, Homo sapiens
tgaccagtggcgctgggtgcaa

SEQ ID NO: 6948894 - DNA, 22 bp, Homo sapiens
aaggcagccagatcctttgggt

SEQ ID NO: 6948895 - DNA, 22 bp, Homo sapiens
aaactttaagacagtcctcaag

SEQ ID NO: 6948896 - DNA, 22 bp, Homo sapiens
aggcctcatgtcaaagcagcaa

SEQ ID NO: 6948897 - DNA, 22 bp, Homo sapiens
taggcactagacatggttacca

SEQ ID NO: 6948898 - DNA, 22 bp, Homo sapiens
atgctctgggcttttgaagtgg

SEQ ID NO: 6948899 - DNA, 19 bp, Homo sapiens
ccttccagctccttttcag

SEQ ID NO: 6948900 - DNA, 22 bp, Homo sapiens
attgttctaagggtttaattaa

SEQ ID NO: 6948901 - DNA, 22 bp, Homo sapiens
gggcacagtctaaagttgggcc

SEQ ID NO: 6948902 - DNA, 22 bp, Homo sapiens
tgtgcgatgggtacatgagagt

SEQ ID NO: 6948903 - DNA, 21 bp, Homo sapiens
tcctcctgtagagggtcctgg

SEQ ID NO: 6948904 - DNA, 22 bp, Homo sapiens
acttgctggtggcatttacagt

SEQ ID NO: 6948905 - DNA, 19 bp, Homo sapiens
atgtatgaggtcttctgct

SEQ ID NO: 6948906 - DNA, 22 bp, Homo sapiens
ttagtgattacagatatataaa

SEQ ID NO: 6948907 - DNA, 22 bp, Homo sapiens
tagaaacattcagttgcagtcc

SEQ ID NO: 6948908 - DNA, 22 bp, Homo sapiens
tcaccatcaggataaaatctca

SEQ ID NO: 6948909 - DNA, 22 bp, Homo sapiens
gggctagaatccgcgtctcttg

SEQ ID NO: 6948910 - DNA, 19 bp, Homo sapiens
gtgtggcagagagtgacca

SEQ ID NO: 6948911 - DNA, 22 bp, Homo sapiens
aatgtgagccaatgcccgtggg

SEQ ID NO: 6948912 - DNA, 22 bp, Homo sapiens
aagtagatgatctttctgcata

SEQ ID NO: 6948913 - DNA, 22 bp, Homo sapiens
cccttgagcctggaggagctct

SEQ ID NO: 6948914 - DNA, 22 bp, Homo sapiens
aatggaattctccattagatgt

SEQ ID NO: 6948915 - DNA, 22 bp, Homo sapiens
ttcagttccatttcaggtgggt

SEQ ID NO: 6948916 - DNA, 22 bp, Homo sapiens
agggtgtgttctcctatgagaa

SEQ ID NO: 6948917 - DNA, 22 bp, Homo sapiens
catgcccattgagaagggcctc

SEQ ID NO: 6948918 - DNA, 22 bp, Homo sapiens
aggaaacaacttggcatgagcc

SEQ ID NO: 6948919 - DNA, 22 bp, Homo sapiens
ctgggtcccaaattctattttc

SEQ ID NO: 6948920 - DNA, 22 bp, Homo sapiens
gtccttggagctcccctctgta

SEQ ID NO: 6948921 - DNA, 22 bp, Homo sapiens
tttataagtactttgtctgctt

SEQ ID NO: 6948922 - DNA, 22 bp, Homo sapiens
tccagagcctatatgttcaact

SEQ ID NO: 6948923 - DNA, 22 bp, Homo sapiens
ggctgggtcccagctgggagga

SEQ ID NO: 6948924 - DNA, 22 bp, Homo sapiens
ctgccagtgaaattgtgtcagt

SEQ ID NO: 6948925 - DNA, 21 bp, Homo sapiens
caataaactgcacattgagac

SEQ ID NO: 6948926 - DNA, 22 bp, Homo sapiens
attttggctgttgggaattatt

SEQ ID NO: 6948927 - DNA, 22 bp, Homo sapiens
gtgttctctctacaggaattta

SEQ ID NO: 6948928 - DNA, 22 bp, Homo sapiens
aacatgaagttttctatagtga

SEQ ID NO: 6948929 - DNA, 22 bp, Homo sapiens
gggcctcagagatggtcagtga

SEQ ID NO: 6948930 - DNA, 22 bp, Homo sapiens
aaacagttttgccaaaaggaca

SEQ ID NO: 6948931 - DNA, 22 bp, Homo sapiens
gtgcccagtcctgccttgacag

SEQ ID NO: 6948932 - DNA, 22 bp, Homo sapiens
gctggcctgaccagccacaggc

SEQ ID NO: 6948933 - DNA, 22 bp, Homo sapiens
aagccaggtttgaaatatccca

SEQ ID NO: 6948934 - DNA, 22 bp, Homo sapiens
actgggctgtaaagagaggcaa

SEQ ID NO: 6948935 - DNA, 22 bp, Homo sapiens
gctgcttcctttcctgctgacc

SEQ ID NO: 6948936 - DNA, 22 bp, Homo sapiens
agtcaccctccaactctccact

SEQ ID NO: 6948937 - DNA, 22 bp, Homo sapiens
gtgcttttaaaggcaattagta

SEQ ID NO: 6948938 - DNA, 22 bp, Homo sapiens
atcccaggcggcacaggttgca

SEQ ID NO: 6948939 - DNA, 22 bp, Homo sapiens
gttgaagtttatatgagtgctt

SEQ ID NO: 6948940 - DNA, 22 bp, Homo sapiens
aatttacagttgctgatggtac

SEQ ID NO: 6948941 - DNA, 23 bp, Homo sapiens
tggtataaaaacagtacctacct

SEQ ID NO: 6948942 - DNA, 22 bp, Homo sapiens
actgtcttccaggtctggaggt

SEQ ID NO: 6948943 - DNA, 22 bp, Homo sapiens
cttggcagagggctgggctcag

SEQ ID NO: 6948944 - DNA, 21 bp, Homo sapiens
tggcatggaggtagcagtgtg

SEQ ID NO: 6948945 - DNA, 22 bp, Homo sapiens
atccagccagtgtggatgactt

SEQ ID NO: 6948946 - DNA, 22 bp, Homo sapiens
tcagtcgtgtagaagttgatcc

SEQ ID NO: 6948947 - DNA, 22 bp, Homo sapiens
tagctgtgcccagggaagttgt

SEQ ID NO: 6948948 - DNA, 22 bp, Homo sapiens
tcctcacatggtgagccacaca

SEQ ID NO: 6948949 - DNA, 22 bp, Homo sapiens
ctctcagtttcctcaactgtaa

SEQ ID NO: 6948950 - DNA, 22 bp, Homo sapiens
gtttgtttgtagggaagccgtg

SEQ ID NO: 6948951 - DNA, 22 bp, Homo sapiens
acacagtgtcttaggtagtgtc

SEQ ID NO: 6948952 - DNA, 22 bp, Homo sapiens
atgtgggaaatacaagctaaaa

SEQ ID NO: 6948953 - DNA, 23 bp, Homo sapiens
cctgctcaggcgtgtgccctgct

SEQ ID NO: 6948954 - DNA, 21 bp, Homo sapiens
tggtttctaagctgtcagtct

SEQ ID NO: 6948955 - DNA, 19 bp, Homo sapiens
tctccagctttgggctttt

SEQ ID NO: 6948956 - DNA, 22 bp, Homo sapiens
caaggataggtactatgtaata

SEQ ID NO: 6948957 - DNA, 22 bp, Homo sapiens
aacctggagtgctggtttcact

SEQ ID NO: 6948958 - DNA, 22 bp, Homo sapiens
ttcagaagagacactgtgacag

SEQ ID NO: 6948959 - DNA, 22 bp, Homo sapiens
tcagaggctcactgtctacttt

SEQ ID NO: 6948960 - DNA, 22 bp, Homo sapiens
ttttaaactgcagaatttagaa

SEQ ID NO: 6948961 - DNA, 22 bp, Homo sapiens
aatgaagcagtccatctgctct

SEQ ID NO: 6948962 - DNA, 21 bp, Homo sapiens
ggaaaactttccttgtctgaa

SEQ ID NO: 6948963 - DNA, 22 bp, Homo sapiens
gaggctcccaaggggctaggcc

SEQ ID NO: 6948964 - DNA, 22 bp, Homo sapiens
ttctgagacaattgagagtcta

SEQ ID NO: 6948965 - DNA, 22 bp, Homo sapiens
tcaggctgataggaggaactga

SEQ ID NO: 6948966 - DNA, 22 bp, Homo sapiens
gaggcagaggttgcagtgagct

SEQ ID NO: 6948967 - DNA, 22 bp, Homo sapiens
ttttacaggtcataggtatagt

SEQ ID NO: 6948968 - DNA, 21 bp, Homo sapiens
gtccttcattatcaagtcaaa

SEQ ID NO: 6948969 - DNA, 22 bp, Homo sapiens
atgtgtatacttgtgcttactc

SEQ ID NO: 6948970 - DNA, 22 bp, Homo sapiens
tttaagatctatcccattttgt

SEQ ID NO: 6948971 - DNA, 22 bp, Homo sapiens
ttcaactgcaacatcctgcctc

SEQ ID NO: 6948972 - DNA, 22 bp, Homo sapiens
agatttgaaacttgcttcataa

SEQ ID NO: 6948973 - DNA, 22 bp, Homo sapiens
atttgggaatgtgcattatact

SEQ ID NO: 6948974 - DNA, 22 bp, Homo sapiens
acagcagacattgggtgattga

SEQ ID NO: 6948975 - DNA, 22 bp, Homo sapiens
tggtcaaaccagttatctgtaa

SEQ ID NO: 6948976 - DNA, 22 bp, Homo sapiens
tgcaaatgagttgcagatcagg

SEQ ID NO: 6948977 - DNA, 22 bp, Homo sapiens
gggctggggctcaataatttgt

SEQ ID NO: 6948978 - DNA, 23 bp, Homo sapiens
gtacacatagtgtagttatattt

SEQ ID NO: 6948979 - DNA, 22 bp, Homo sapiens
acatttgaaatgccatgtgagg

SEQ ID NO: 6948980 - DNA, 22 bp, Homo sapiens
tattttgcgttgagtcagattt

SEQ ID NO: 6948981 - DNA, 22 bp, Homo sapiens
gccctagcccgggccacctgtt

SEQ ID NO: 6948982 - DNA, 22 bp, Homo sapiens
tcaccataggaacacagtcaga

SEQ ID NO: 6948983 - DNA, 22 bp, Homo sapiens
tagcaatatttggtgaaggtta

SEQ ID NO: 6948984 - DNA, 22 bp, Homo sapiens
catgcatagctttggagctagg

SEQ ID NO: 6948985 - DNA, 22 bp, Homo sapiens
tggtaggatagtgacttatatg

SEQ ID NO: 6948986 - DNA, 22 bp, Homo sapiens
cctctgagaacacctggcgtcc

SEQ ID NO: 6948987 - DNA, 22 bp, Homo sapiens
caggagccagctgtcccaacca

SEQ ID NO: 6948988 - DNA, 22 bp, Homo sapiens
ctgcctcttgacagatcgtggc

SEQ ID NO: 6948989 - DNA, 22 bp, Homo sapiens
gaggccactgtccctgccttcc

SEQ ID NO: 6948990 - DNA, 22 bp, Homo sapiens
tatccacactcaaggggagggg

SEQ ID NO: 6948991 - DNA, 22 bp, Homo sapiens
ctagttagttctgggtcatcct

SEQ ID NO: 6948992 - DNA, 22 bp, Homo sapiens
tatttctgattgctcatgaggc

SEQ ID NO: 6948993 - DNA, 22 bp, Homo sapiens
aagcccctcgggtgcgcacgcg

SEQ ID NO: 6948994 - DNA, 22 bp, Homo sapiens
ttttgatatcatgatgaacaga

SEQ ID NO: 6948995 - DNA, 22 bp, Homo sapiens
gttcagcaatagatctagaggc

SEQ ID NO: 6948996 - DNA, 22 bp, Homo sapiens
gtgaggcagagatgccaaaact

SEQ ID NO: 6948997 - DNA, 22 bp, Homo sapiens
aataatgtttatttgtattctc

SEQ ID NO: 6948998 - DNA, 22 bp, Homo sapiens
accaatttcttggcttccaaat

SEQ ID NO: 6948999 - DNA, 22 bp, Homo sapiens
tattgtgccaggtaatgtgttc

SEQ ID NO: 6949000 - DNA, 23 bp, Homo sapiens
tgagtcttgagctttggattctg

SEQ ID NO: 6949001 - DNA, 22 bp, Homo sapiens
gtcatgagcaccgaacccatgt

SEQ ID NO: 6949002 - DNA, 22 bp, Homo sapiens
ctttggaatcattgcttattca

SEQ ID NO: 6949003 - DNA, 22 bp, Homo sapiens
tcaggagagaaagaatacaatt

SEQ ID NO: 6949004 - DNA, 22 bp, Homo sapiens
aacagtggtctggggagtggag

SEQ ID NO: 6949005 - DNA, 22 bp, Homo sapiens
caggagtctgttcctcatttgt

SEQ ID NO: 6949006 - DNA, 20 bp, Homo sapiens
tctagggtttggttatcatc

SEQ ID NO: 6949007 - DNA, 22 bp, Homo sapiens
agatcttatgatgcacagggca

SEQ ID NO: 6949008 - DNA, 18 bp, Homo sapiens
gatgtcaaggactggaca

SEQ ID NO: 6949009 - DNA, 21 bp, Homo sapiens
ttacaggtaacacttcctttc

SEQ ID NO: 6949010 - DNA, 22 bp, Homo sapiens
cagctctgaggaacactccttt

SEQ ID NO: 6949011 - DNA, 21 bp, Homo sapiens
tcagaatgaaaaggcaatctg

SEQ ID NO: 6949012 - DNA, 19 bp, Homo sapiens
cctctgcgctgtcctgctc

SEQ ID NO: 6949013 - DNA, 22 bp, Homo sapiens
aaacaacatggtgggtgtgtag

SEQ ID NO: 6949014 - DNA, 22 bp, Homo sapiens
gattcctttggtgaactgccga

SEQ ID NO: 6949015 - DNA, 23 bp, Homo sapiens
gagctcaggtagggctcgcccgc

SEQ ID NO: 6949016 - DNA, 22 bp, Homo sapiens
attcacaatagcagcttgcatg

SEQ ID NO: 6949017 - DNA, 21 bp, Homo sapiens
tgcatgctcataggaaaatag

SEQ ID NO: 6949018 - DNA, 22 bp, Homo sapiens
actgtagtctaaatatagtctt

SEQ ID NO: 6949019 - DNA, 22 bp, Homo sapiens
gtcatgcatgggctctgaagaa

SEQ ID NO: 6949020 - DNA, 22 bp, Homo sapiens
gcgggggcggcgcagacctcag

SEQ ID NO: 6949021 - DNA, 22 bp, Homo sapiens
tcttccagcccttctaatggta

SEQ ID NO: 6949022 - DNA, 22 bp, Homo sapiens
aggaatattactttgcttttat

SEQ ID NO: 6949023 - DNA, 22 bp, Homo sapiens
tttggctaaggaaaaggagcta

SEQ ID NO: 6949024 - DNA, 22 bp, Homo sapiens
tagcagggaagatgatcagaat

SEQ ID NO: 6949025 - DNA, 22 bp, Homo sapiens
tctttccaagtaatacttccca

SEQ ID NO: 6949026 - DNA, 22 bp, Homo sapiens
ttgctgagtctgaattcatact

SEQ ID NO: 6949027 - DNA, 22 bp, Homo sapiens
cctttgcaacagaaagacctga

SEQ ID NO: 6949028 - DNA, 22 bp, Homo sapiens
acaggagtttctgacagagaca

SEQ ID NO: 6949029 - DNA, 22 bp, Homo sapiens
tcagaaagaacacaggcagtag

SEQ ID NO: 6949030 - DNA, 22 bp, Homo sapiens
ttcttctcctaaggagagtcct

SEQ ID NO: 6949031 - DNA, 22 bp, Homo sapiens
ctgccgtgagctttcgcgagcc

SEQ ID NO: 6949032 - DNA, 22 bp, Homo sapiens
gctgctttttggatttggcaca

SEQ ID NO: 6949033 - DNA, 22 bp, Homo sapiens
aagtgtcaatatttttgtaggt

SEQ ID NO: 6949034 - DNA, 22 bp, Homo sapiens
atgatgtacagccacggtgcta

SEQ ID NO: 6949035 - DNA, 21 bp, Homo sapiens
ggcctgaaaaagtgaatgctt

SEQ ID NO: 6949036 - DNA, 22 bp, Homo sapiens
aggctgtgaaatgtggcaagga

SEQ ID NO: 6949037 - DNA, 22 bp, Homo sapiens
aagcccaggtaagtggctcatg

SEQ ID NO: 6949038 - DNA, 22 bp, Homo sapiens
tgtgtcatagagagcacaaatc

SEQ ID NO: 6949039 - DNA, 22 bp, Homo sapiens
ggctggacttggtcctgttttg

SEQ ID NO: 6949040 - DNA, 22 bp, Homo sapiens
tagctctgtggatctttttaag

SEQ ID NO: 6949041 - DNA, 22 bp, Homo sapiens
gtcttctggggccaggcccgct

SEQ ID NO: 6949042 - DNA, 22 bp, Homo sapiens
agcaacagcaacgacatttctc

SEQ ID NO: 6949043 - DNA, 22 bp, Homo sapiens
attcatgtgccactggtgaaca

SEQ ID NO: 6949044 - DNA, 22 bp, Homo sapiens
tgcattttacttacctgttagt

SEQ ID NO: 6949045 - DNA, 22 bp, Homo sapiens
agggcctctgagccagttctgg

SEQ ID NO: 6949046 - DNA, 22 bp, Homo sapiens
tgaacactgtccagagccatta

SEQ ID NO: 6949047 - DNA, 19 bp, Homo sapiens
acattcccatcagcaatgt

SEQ ID NO: 6949048 - DNA, 22 bp, Homo sapiens
gccatttggcaaaactgacttc

SEQ ID NO: 6949049 - DNA, 22 bp, Homo sapiens
ctcagagaaatgtcacaacaat

SEQ ID NO: 6949050 - DNA, 22 bp, Homo sapiens
ggcttccctaaacctttccact

SEQ ID NO: 6949051 - DNA, 22 bp, Homo sapiens
gcctcaggcctatagctgctgt

SEQ ID NO: 6949052 - DNA, 18 bp, Homo sapiens
actctgcggaggccccag

SEQ ID NO: 6949053 - DNA, 22 bp, Homo sapiens
ggcctgacttgatcggctctct

SEQ ID NO: 6949054 - DNA, 22 bp, Homo sapiens
tttcagtcaggaggatctctca

SEQ ID NO: 6949055 - DNA, 22 bp, Homo sapiens
cccaaggaagacgcttgtgata

SEQ ID NO: 6949056 - DNA, 22 bp, Homo sapiens
agacacagcagtgcctgcctca

SEQ ID NO: 6949057 - DNA, 22 bp, Homo sapiens
gcctggcaggcctgttggggct

SEQ ID NO: 6949058 - DNA, 22 bp, Homo sapiens
tggtatggatggtgtggctttc

SEQ ID NO: 6949059 - DNA, 22 bp, Homo sapiens
gtcaatcagaaatcatgttaca

SEQ ID NO: 6949060 - DNA, 22 bp, Homo sapiens
cttgaccgaatatgatcacttc

SEQ ID NO: 6949061 - DNA, 22 bp, Homo sapiens
agctttagaatgatgcttttgc

SEQ ID NO: 6949062 - DNA, 23 bp, Homo sapiens
tactgcctggggccagagagcgg

SEQ ID NO: 6949063 - DNA, 22 bp, Homo sapiens
agctcgcccctccctcttattt

SEQ ID NO: 6949064 - DNA, 22 bp, Homo sapiens
tttgtcttgaggctggggaagt

SEQ ID NO: 6949065 - DNA, 22 bp, Homo sapiens
cctcacagcccttggcccagga

SEQ ID NO: 6949066 - DNA, 22 bp, Homo sapiens
aaaaccacaattatttttgcac

SEQ ID NO: 6949067 - DNA, 21 bp, Homo sapiens
tggaaggctgctctgccaggg

SEQ ID NO: 6949068 - DNA, 22 bp, Homo sapiens
ggcaagaacctcaattaccttt

SEQ ID NO: 6949069 - DNA, 23 bp, Homo sapiens
gaagccacacaaaggtcgccaag

SEQ ID NO: 6949070 - DNA, 22 bp, Homo sapiens
ctgctctaactgcattagtttt

SEQ ID NO: 6949071 - DNA, 22 bp, Homo sapiens
tggaggtcgcgcgggtgctgca

SEQ ID NO: 6949072 - DNA, 22 bp, Homo sapiens
agagctataacagcactgtaca

SEQ ID NO: 6949073 - DNA, 22 bp, Homo sapiens
ttatcctggctctctcaggatg

SEQ ID NO: 6949074 - DNA, 22 bp, Homo sapiens
ccaagggagactgtgagacctc

SEQ ID NO: 6949075 - DNA, 22 bp, Homo sapiens
tgggcctgagtttgggaactgg

SEQ ID NO: 6949076 - DNA, 22 bp, Homo sapiens
atgcactttgtaatctgttcaa

SEQ ID NO: 6949077 - DNA, 22 bp, Homo sapiens
tgtacagctgccttttttactt

SEQ ID NO: 6949078 - DNA, 22 bp, Homo sapiens
ggtcatgctgtgaatcagtgct

SEQ ID NO: 6949079 - DNA, 19 bp, Homo sapiens
cttatttctggttttgggt

SEQ ID NO: 6949080 - DNA, 22 bp, Homo sapiens
gagagtgagatcctcctgggga

SEQ ID NO: 6949081 - DNA, 22 bp, Homo sapiens
actgggcctgattgggtcggag

SEQ ID NO: 6949082 - DNA, 22 bp, Homo sapiens
aattcacaaaaccagattgctt

SEQ ID NO: 6949083 - DNA, 22 bp, Homo sapiens
tactgtctgggttcccaagcaa

SEQ ID NO: 6949084 - DNA, 22 bp, Homo sapiens
atcacaatgtacgttaaaatgt

SEQ ID NO: 6949085 - DNA, 22 bp, Homo sapiens
ctgctttatctgagacaagtca

SEQ ID NO: 6949086 - DNA, 22 bp, Homo sapiens
ctgtcctgtgtcagcctgaaat

SEQ ID NO: 6949087 - DNA, 19 bp, Homo sapiens
agggccacggggaggtatt

SEQ ID NO: 6949088 - DNA, 22 bp, Homo sapiens
tccttggcatgccgtcttctcc

SEQ ID NO: 6949089 - DNA, 23 bp, Homo sapiens
cttctgtgcaagagggagggaaa

SEQ ID NO: 6949090 - DNA, 22 bp, Homo sapiens
actcatttgacactttaaactg

SEQ ID NO: 6949091 - DNA, 22 bp, Homo sapiens
acaacaatctaccctagcttct

SEQ ID NO: 6949092 - DNA, 19 bp, Homo sapiens
taggaatgtagaatcctag

SEQ ID NO: 6949093 - DNA, 22 bp, Homo sapiens
ctggccatctcctgccagcggt

SEQ ID NO: 6949094 - DNA, 22 bp, Homo sapiens
tggtggtccacaaatgggtaca

SEQ ID NO: 6949095 - DNA, 22 bp, Homo sapiens
aagcaaatatttctagagactg

SEQ ID NO: 6949096 - DNA, 22 bp, Homo sapiens
actgaggcttaaagagattagg

SEQ ID NO: 6949097 - DNA, 22 bp, Homo sapiens
cacgctatatttatgcataggt

SEQ ID NO: 6949098 - DNA, 22 bp, Homo sapiens
tctttgggagatgttatttata

SEQ ID NO: 6949099 - DNA, 18 bp, Homo sapiens
ctaacagggaaaatagaa

SEQ ID NO: 6949100 - DNA, 21 bp, Homo sapiens
actgtgccaggcacaaaaaca

SEQ ID NO: 6949101 - DNA, 21 bp, Homo sapiens
ttggaatttgggagctatgtg

SEQ ID NO: 6949102 - DNA, 22 bp, Homo sapiens
atgtgtctttcaaggtatagaa

SEQ ID NO: 6949103 - DNA, 22 bp, Homo sapiens
agcagcagtcatgcctatgctc

SEQ ID NO: 6949104 - DNA, 22 bp, Homo sapiens
tgcatgcgttagttggcgtgtt

SEQ ID NO: 6949105 - DNA, 22 bp, Homo sapiens
gaacatgaaaagtcttacacgc

SEQ ID NO: 6949106 - DNA, 20 bp, Homo sapiens
ggcacagtttttgcacctgc

SEQ ID NO: 6949107 - DNA, 22 bp, Homo sapiens
cattgcccagtaggatcaccag

SEQ ID NO: 6949108 - DNA, 22 bp, Homo sapiens
tgggctctattcagagtttttc

SEQ ID NO: 6949109 - DNA, 22 bp, Homo sapiens
aggaattttgtatggatactgt

SEQ ID NO: 6949110 - DNA, 22 bp, Homo sapiens
cttctggggatggagcccagaa

SEQ ID NO: 6949111 - DNA, 22 bp, Homo sapiens
tgggttcagatcccagctctgt

SEQ ID NO: 6949112 - DNA, 22 bp, Homo sapiens
gtggttccgaatatttatttct

SEQ ID NO: 6949113 - DNA, 22 bp, Homo sapiens
tcataagtaatttaaacattcc

SEQ ID NO: 6949114 - DNA, 22 bp, Homo sapiens
caatactattcggaccatctct

SEQ ID NO: 6949115 - DNA, 22 bp, Homo sapiens
ctacccagcacctaggctgcct

SEQ ID NO: 6949116 - DNA, 22 bp, Homo sapiens
ctctcctctgaagtggtgaccc

SEQ ID NO: 6949117 - DNA, 17 bp, Homo sapiens
tgccagcctgtcccagg

SEQ ID NO: 6949118 - DNA, 22 bp, Homo sapiens
caggtccagaaaccaaaggatt

SEQ ID NO: 6949119 - DNA, 20 bp, Homo sapiens
ctcacttacctttttctata

SEQ ID NO: 6949120 - DNA, 22 bp, Homo sapiens
ataaggaagttgcagaagtgga

SEQ ID NO: 6949121 - DNA, 22 bp, Homo sapiens
tgtgtattaatgtttgtatatg

SEQ ID NO: 6949122 - DNA, 22 bp, Homo sapiens
aaaattgtgaaggtttctgaaa

SEQ ID NO: 6949123 - DNA, 22 bp, Homo sapiens
aatctgcacccactgaaaatgc

SEQ ID NO: 6949124 - DNA, 18 bp, Homo sapiens
ttaagagctgaaagggga

SEQ ID NO: 6949125 - DNA, 22 bp, Homo sapiens
gtggaggtcccgggcaggagca

SEQ ID NO: 6949126 - DNA, 19 bp, Homo sapiens
ttctctattatgtcttctc

SEQ ID NO: 6949127 - DNA, 22 bp, Homo sapiens
aagagctggagctgctacagga

SEQ ID NO: 6949128 - DNA, 19 bp, Homo sapiens
ccaaaagcaattccaagta

SEQ ID NO: 6949129 - DNA, 22 bp, Homo sapiens
tagaaaagaattttatttgata

SEQ ID NO: 6949130 - DNA, 22 bp, Homo sapiens
caatttgacttttgaggttgta

SEQ ID NO: 6949131 - DNA, 22 bp, Homo sapiens
tacaagtactgtggctttgaat

SEQ ID NO: 6949132 - DNA, 22 bp, Homo sapiens
ttaaagtccctgccttaattcc

SEQ ID NO: 6949133 - DNA, 19 bp, Homo sapiens
tgcagcccctaccacattc

SEQ ID NO: 6949134 - DNA, 19 bp, Homo sapiens
ggtgtcctagagataagag

SEQ ID NO: 6949135 - DNA, 23 bp, Homo sapiens
tgtgcagcatttcttgctatagg

SEQ ID NO: 6949136 - DNA, 22 bp, Homo sapiens
gcccagcttttcacttccacac

SEQ ID NO: 6949137 - DNA, 22 bp, Homo sapiens
aagggtgggcaccgccaggtca

SEQ ID NO: 6949138 - DNA, 22 bp, Homo sapiens
attaggcagtgccattgtacgg

SEQ ID NO: 6949139 - DNA, 19 bp, Homo sapiens
cccaggagtctggctggtt

SEQ ID NO: 6949140 - DNA, 22 bp, Homo sapiens
agcttctgcatcttttcttccc

SEQ ID NO: 6949141 - DNA, 22 bp, Homo sapiens
gccagcagtatgtcctggcagt

SEQ ID NO: 6949142 - DNA, 22 bp, Homo sapiens
aatgattactgatcgcatagga

SEQ ID NO: 6949143 - DNA, 22 bp, Homo sapiens
cagcttggcttccgctttactg

SEQ ID NO: 6949144 - DNA, 22 bp, Homo sapiens
ctctgtgcctcagttttcttct

SEQ ID NO: 6949145 - DNA, 22 bp, Homo sapiens
gctggcacttgggacaaaatct

SEQ ID NO: 6949146 - DNA, 22 bp, Homo sapiens
gagccacagactgtatttggga

SEQ ID NO: 6949147 - DNA, 22 bp, Homo sapiens
cagaagtttgaatgagagcctg

SEQ ID NO: 6949148 - DNA, 22 bp, Homo sapiens
ttgccatgttgccaaggctggt

SEQ ID NO: 6949149 - DNA, 22 bp, Homo sapiens
ttctcagggccctgtgttagct

SEQ ID NO: 6949150 - DNA, 22 bp, Homo sapiens
tgctgggcctttacctccaggg

SEQ ID NO: 6949151 - DNA, 22 bp, Homo sapiens
ctatttgagaacaatggctgaa

SEQ ID NO: 6949152 - DNA, 22 bp, Homo sapiens
agcaggctgccttccaaagcct

SEQ ID NO: 6949153 - DNA, 22 bp, Homo sapiens
caggagctctcatcgtcagggc

SEQ ID NO: 6949154 - DNA, 21 bp, Homo sapiens
acagctgtcttagcttgggct

SEQ ID NO: 6949155 - DNA, 22 bp, Homo sapiens
tctccattttatagataatgaa

SEQ ID NO: 6949156 - DNA, 22 bp, Homo sapiens
aaggcctttcaggattttgctc

SEQ ID NO: 6949157 - DNA, 22 bp, Homo sapiens
tagaaaatgttccactgccatt

SEQ ID NO: 6949158 - DNA, 22 bp, Homo sapiens
tgtcatttattttgctgtctgt

SEQ ID NO: 6949159 - DNA, 22 bp, Homo sapiens
agtgtttactccctgccctcca

SEQ ID NO: 6949160 - DNA, 22 bp, Homo sapiens
agttctcaggtcagctgagtct

SEQ ID NO: 6949161 - DNA, 22 bp, Homo sapiens
cttgaagtggagcttttgaaat

SEQ ID NO: 6949162 - DNA, 22 bp, Homo sapiens
ggaaggatctggctgaaatcca

SEQ ID NO: 6949163 - DNA, 22 bp, Homo sapiens
tagaaactctcaatctgggatg

SEQ ID NO: 6949164 - DNA, 22 bp, Homo sapiens
aagacagtgtgtcaggcaggtg

SEQ ID NO: 6949165 - DNA, 22 bp, Homo sapiens
ggagtctgagcttgtgtcctgg

SEQ ID NO: 6949166 - DNA, 22 bp, Homo sapiens
ggaaggctttgaggggtgctgg

SEQ ID NO: 6949167 - DNA, 22 bp, Homo sapiens
ctgcaatgcatgaattataaat

SEQ ID NO: 6949168 - DNA, 22 bp, Homo sapiens
tggaagtgccttgctggctgtg

SEQ ID NO: 6949169 - DNA, 22 bp, Homo sapiens
tgagaacaaagttgaaagtttg

SEQ ID NO: 6949170 - DNA, 21 bp, Homo sapiens
agactgccattgttcttttgg

SEQ ID NO: 6949171 - DNA, 22 bp, Homo sapiens
gggtgtgttacaatgatgccga

SEQ ID NO: 6949172 - DNA, 20 bp, Homo sapiens
ctttagttacacgtttcctc

SEQ ID NO: 6949173 - DNA, 22 bp, Homo sapiens
ttctgttagaattgagctttat

SEQ ID NO: 6949174 - DNA, 22 bp, Homo sapiens
aataattttagctcagagttgt

SEQ ID NO: 6949175 - DNA, 22 bp, Homo sapiens
aggggtgatttgggacaggaca

SEQ ID NO: 6949176 - DNA, 22 bp, Homo sapiens
gtattagggccaaaggcaggaa

SEQ ID NO: 6949177 - DNA, 22 bp, Homo sapiens
aggagggaataagaaagagtca

SEQ ID NO: 6949178 - DNA, 22 bp, Homo sapiens
catgtgacaataagtgtgagct

SEQ ID NO: 6949179 - DNA, 22 bp, Homo sapiens
ccctggtgccctgggtcagcct

SEQ ID NO: 6949180 - DNA, 22 bp, Homo sapiens
agtgccaggagcaaggagctcc

SEQ ID NO: 6949181 - DNA, 22 bp, Homo sapiens
gttctgtctgagcaccacagga

SEQ ID NO: 6949182 - DNA, 22 bp, Homo sapiens
tgtcagatgagtaggttgcgaa

SEQ ID NO: 6949183 - DNA, 22 bp, Homo sapiens
ttcacagaatggcaagttatgg

SEQ ID NO: 6949184 - DNA, 14 bp, Homo sapiens
tccagagctttccg

SEQ ID NO: 6949185 - DNA, 19 bp, Homo sapiens
ggccccagccagggtatca

SEQ ID NO: 6949186 - DNA, 22 bp, Homo sapiens
ctgcctttggaagtccagagct

SEQ ID NO: 6949187 - DNA, 22 bp, Homo sapiens
tgctgccatggtcgctggtgtc

SEQ ID NO: 6949188 - DNA, 22 bp, Homo sapiens
gaagtatataaatcctttcaga

SEQ ID NO: 6949189 - DNA, 20 bp, Homo sapiens
cccagggacctgagctccat

SEQ ID NO: 6949190 - DNA, 22 bp, Homo sapiens
gaacatctgccttgtggctgcc

SEQ ID NO: 6949191 - DNA, 22 bp, Homo sapiens
tggctcagctttccccatctgg

SEQ ID NO: 6949192 - DNA, 22 bp, Homo sapiens
tcagagcattagaggtttgtat

SEQ ID NO: 6949193 - DNA, 22 bp, Homo sapiens
aggcccttaggacccctgcgtg

SEQ ID NO: 6949194 - DNA, 22 bp, Homo sapiens
attcctgattaacgacctttca

SEQ ID NO: 6949195 - DNA, 21 bp, Homo sapiens
aatggaagtttaaaggtatcc

SEQ ID NO: 6949196 - DNA, 23 bp, Homo sapiens
agctgggcaaggatccgggctcc

SEQ ID NO: 6949197 - DNA, 22 bp, Homo sapiens
tgcactactgtgatacacagcc

SEQ ID NO: 6949198 - DNA, 22 bp, Homo sapiens
ctttagttatttagactacagt

SEQ ID NO: 6949199 - DNA, 22 bp, Homo sapiens
gtttcctgaccctggcccagca

SEQ ID NO: 6949200 - DNA, 21 bp, Homo sapiens
gggtcctgggatgggatccag

SEQ ID NO: 6949201 - DNA, 22 bp, Homo sapiens
gcacagcagctgggggccctgg

SEQ ID NO: 6949202 - DNA, 19 bp, Homo sapiens
aactgtaattaatacccta

SEQ ID NO: 6949203 - DNA, 22 bp, Homo sapiens
cttaaattttcatctacaagaa

SEQ ID NO: 6949204 - DNA, 23 bp, Homo sapiens
tggagtcaccttagttccaaaag

SEQ ID NO: 6949205 - DNA, 22 bp, Homo sapiens
ttcctcttatatagccttggcc

SEQ ID NO: 6949206 - DNA, 22 bp, Homo sapiens
tgccccctggtggccagagccg

SEQ ID NO: 6949207 - DNA, 22 bp, Homo sapiens
ttggctgttttatctcctggtg

SEQ ID NO: 6949208 - DNA, 22 bp, Homo sapiens
agtctggtgttctcacactagt

SEQ ID NO: 6949209 - DNA, 22 bp, Homo sapiens
tgtctgggatgttggcagccac

SEQ ID NO: 6949210 - DNA, 19 bp, Homo sapiens
agtagcagaaagtgcagtg

SEQ ID NO: 6949211 - DNA, 22 bp, Homo sapiens
gcaggcatggtcgctgccaggt

SEQ ID NO: 6949212 - DNA, 22 bp, Homo sapiens
ccttgcagcatatagagtccct

SEQ ID NO: 6949213 - DNA, 22 bp, Homo sapiens
ctctggcttggtaaaaacttct

SEQ ID NO: 6949214 - DNA, 22 bp, Homo sapiens
gccattctaaattatgctgtgt

SEQ ID NO: 6949215 - DNA, 22 bp, Homo sapiens
caggcctgagacatctgagata

SEQ ID NO: 6949216 - DNA, 22 bp, Homo sapiens
gatacagtatttaaagagcaac

SEQ ID NO: 6949217 - DNA, 22 bp, Homo sapiens
tgggtggtttatgagtgggttt

SEQ ID NO: 6949218 - DNA, 22 bp, Homo sapiens
agataagagcctgtgtttggaa

SEQ ID NO: 6949219 - DNA, 20 bp, Homo sapiens
tgtgtatctcagatcccatt

SEQ ID NO: 6949220 - DNA, 22 bp, Homo sapiens
acaatacaggcttctggactta

SEQ ID NO: 6949221 - DNA, 22 bp, Homo sapiens
ctgggcccacgagggctctggg

SEQ ID NO: 6949222 - DNA, 22 bp, Homo sapiens
cccttgtttttgagtacaatag

SEQ ID NO: 6949223 - DNA, 22 bp, Homo sapiens
tgcttgattctgtccctttatt

SEQ ID NO: 6949224 - DNA, 22 bp, Homo sapiens
gaggaaggatttagtttgaggg

SEQ ID NO: 6949225 - DNA, 22 bp, Homo sapiens
tcaggtgggagtagaatgctag

SEQ ID NO: 6949226 - DNA, 22 bp, Homo sapiens
ttctctggagggctgcccggcc

SEQ ID NO: 6949227 - DNA, 21 bp, Homo sapiens
ttctgctgtgccatgcctctg

SEQ ID NO: 6949228 - DNA, 22 bp, Homo sapiens
agttacaaccatgacacaagca

SEQ ID NO: 6949229 - DNA, 22 bp, Homo sapiens
gagacaaaagttggagtgcaag

SEQ ID NO: 6949230 - DNA, 23 bp, Homo sapiens
atgaaactcaagccagatccaag

SEQ ID NO: 6949231 - DNA, 22 bp, Homo sapiens
tgttccgaccgtggggtttgat

SEQ ID NO: 6949232 - DNA, 22 bp, Homo sapiens
ggtggaaggcctggaaggaggc

SEQ ID NO: 6949233 - DNA, 22 bp, Homo sapiens
ttcctgaatgctgttgtgctgt

SEQ ID NO: 6949234 - DNA, 22 bp, Homo sapiens
caagtcattgtttagtcatgtt

SEQ ID NO: 6949235 - DNA, 22 bp, Homo sapiens
tgcttccactaatgagctgtgt

SEQ ID NO: 6949236 - DNA, 22 bp, Homo sapiens
tgctgcagacgaagcccatgcc

SEQ ID NO: 6949237 - DNA, 19 bp, Homo sapiens
tacaggaggcctgcaatct

SEQ ID NO: 6949238 - DNA, 22 bp, Homo sapiens
acaatgcaataggagctagaaa

SEQ ID NO: 6949239 - DNA, 22 bp, Homo sapiens
tatgtaccggatgccatacaaa

SEQ ID NO: 6949240 - DNA, 22 bp, Homo sapiens
tgtactaggggtgtggaaggta

SEQ ID NO: 6949241 - DNA, 22 bp, Homo sapiens
gctggatcctgattcgtctttg

SEQ ID NO: 6949242 - DNA, 22 bp, Homo sapiens
tgacccctatatcctgtttctt

SEQ ID NO: 6949243 - DNA, 22 bp, Homo sapiens
tatattgctagtggtactgtaa

SEQ ID NO: 6949244 - DNA, 22 bp, Homo sapiens
tcttgagatcaagacacaggga

SEQ ID NO: 6949245 - DNA, 23 bp, Homo sapiens
gcagaggttatgttttttaggct

SEQ ID NO: 6949246 - DNA, 22 bp, Homo sapiens
cagctgaacctttccctggagc

SEQ ID NO: 6949247 - DNA, 23 bp, Homo sapiens
aatcaagttttgatgaggaagcc

SEQ ID NO: 6949248 - DNA, 22 bp, Homo sapiens
cttcatgcctgtttttaaattt

SEQ ID NO: 6949249 - DNA, 22 bp, Homo sapiens
tctcaaatggacaatattgtgg

SEQ ID NO: 6949250 - DNA, 22 bp, Homo sapiens
tttaccaagctttaattacata

SEQ ID NO: 6949251 - DNA, 22 bp, Homo sapiens
aggctcctgcaggtgaggtgct

SEQ ID NO: 6949252 - DNA, 22 bp, Homo sapiens
tccagtttattatgcatttaca

SEQ ID NO: 6949253 - DNA, 22 bp, Homo sapiens
ctagttctgccattcagtgtca

SEQ ID NO: 6949254 - DNA, 22 bp, Homo sapiens
gtagtacagtgagacaatgttt

SEQ ID NO: 6949255 - DNA, 22 bp, Homo sapiens
gatgatgggttgatgtgaaggg

SEQ ID NO: 6949256 - DNA, 22 bp, Homo sapiens
aggtcctctgtgcctgctggcg

SEQ ID NO: 6949257 - DNA, 22 bp, Homo sapiens
actcctgggttgcagtcctcaa

SEQ ID NO: 6949258 - DNA, 22 bp, Homo sapiens
gcagggaggtttgctgacctgg

SEQ ID NO: 6949259 - DNA, 22 bp, Homo sapiens
atctgtgagtatttttgtttat

SEQ ID NO: 6949260 - DNA, 20 bp, Homo sapiens
aaatgatgggaataatctat

SEQ ID NO: 6949261 - DNA, 21 bp, Homo sapiens
attctctgtgatgggattagg

SEQ ID NO: 6949262 - DNA, 22 bp, Homo sapiens
ctgccccaggcctcgggaggag

SEQ ID NO: 6949263 - DNA, 22 bp, Homo sapiens
ggacaacatgttttaattaagg

SEQ ID NO: 6949264 - DNA, 22 bp, Homo sapiens
aggacccagaaggtgcagcaga

SEQ ID NO: 6949265 - DNA, 22 bp, Homo sapiens
taaggcacccttctgagtagag

SEQ ID NO: 6949266 - DNA, 22 bp, Homo sapiens
ggctcagccccgtaacacagca

SEQ ID NO: 6949267 - DNA, 22 bp, Homo sapiens
taagttactagtaccaggcccc

SEQ ID NO: 6949268 - DNA, 22 bp, Homo sapiens
agccttttggagttattctggg

SEQ ID NO: 6949269 - DNA, 22 bp, Homo sapiens
tgggccagctgaagtgccgccc

SEQ ID NO: 6949270 - DNA, 22 bp, Homo sapiens
gcagcctctgcagttcaggagg

SEQ ID NO: 6949271 - DNA, 22 bp, Homo sapiens
aaacttgatctgtgaccttgct

SEQ ID NO: 6949272 - DNA, 22 bp, Homo sapiens
cggagttagggaattgcattct

SEQ ID NO: 6949273 - DNA, 22 bp, Homo sapiens
tggggcagggatgggaaactat

SEQ ID NO: 6949274 - DNA, 23 bp, Homo sapiens
caaagatgattggaacatggctt

SEQ ID NO: 6949275 - DNA, 22 bp, Homo sapiens
aattttgttttagtggaggctg

SEQ ID NO: 6949276 - DNA, 22 bp, Homo sapiens
aggcaggaggatcatggatgca

SEQ ID NO: 6949277 - DNA, 22 bp, Homo sapiens
atggaattgaagacagcatagg

SEQ ID NO: 6949278 - DNA, 21 bp, Homo sapiens
ccagctgcctgcactttggac

SEQ ID NO: 6949279 - DNA, 22 bp, Homo sapiens
agggagcagcagccacaggatg

SEQ ID NO: 6949280 - DNA, 22 bp, Homo sapiens
atcttccaagctccctggtgta

SEQ ID NO: 6949281 - DNA, 22 bp, Homo sapiens
ctttatgaaaacctgaattatg

SEQ ID NO: 6949282 - DNA, 22 bp, Homo sapiens
actttgcacttcaatataactt

SEQ ID NO: 6949283 - DNA, 22 bp, Homo sapiens
gcacctttctatattcagtggc

SEQ ID NO: 6949284 - DNA, 22 bp, Homo sapiens
acctgtttacctgcacctgttt

SEQ ID NO: 6949285 - DNA, 22 bp, Homo sapiens
gggacctgccattgctcacagg

SEQ ID NO: 6949286 - DNA, 21 bp, Homo sapiens
acattgtgtatgcgagagttt

SEQ ID NO: 6949287 - DNA, 22 bp, Homo sapiens
gcccagatctcctgaccctcag

SEQ ID NO: 6949288 - DNA, 17 bp, Homo sapiens
gtcctgggaggagagag

SEQ ID NO: 6949289 - DNA, 21 bp, Homo sapiens
ccatccatctccctttgctgg

SEQ ID NO: 6949290 - DNA, 22 bp, Homo sapiens
gaggccaccctatgggtcccag

SEQ ID NO: 6949291 - DNA, 22 bp, Homo sapiens
ctgctgaagttgttggtctttt

SEQ ID NO: 6949292 - DNA, 23 bp, Homo sapiens
agaggccaacttcttgcccctcc

SEQ ID NO: 6949293 - DNA, 22 bp, Homo sapiens
agttctcttctcatcacccagg

SEQ ID NO: 6949294 - DNA, 22 bp, Homo sapiens
aaaagtaattgtggtttttgcc

SEQ ID NO: 6949295 - DNA, 22 bp, Homo sapiens
caatactttagtaaaatggccc

SEQ ID NO: 6949296 - DNA, 22 bp, Homo sapiens
gatgtaaaacctatggagctga

SEQ ID NO: 6949297 - DNA, 22 bp, Homo sapiens
atttttccatgatacttatctg

SEQ ID NO: 6949298 - DNA, 22 bp, Homo sapiens
ctgttctgtaagctgctgttgt

SEQ ID NO: 6949299 - DNA, 22 bp, Homo sapiens
tccaagaagcttacaatctaat

SEQ ID NO: 6949300 - DNA, 22 bp, Homo sapiens
agccttggatgagctttatcat

SEQ ID NO: 6949301 - DNA, 22 bp, Homo sapiens
gattcacagtttaggctgggct

SEQ ID NO: 6949302 - DNA, 22 bp, Homo sapiens
taagaaacttaactgggaacta

SEQ ID NO: 6949303 - DNA, 19 bp, Homo sapiens
tcaaatgccaatgtcacag

SEQ ID NO: 6949304 - DNA, 22 bp, Homo sapiens
attacaactgttcccactgtct

SEQ ID NO: 6949305 - DNA, 17 bp, Homo sapiens
cagtcgaggaggacctg

SEQ ID NO: 6949306 - DNA, 22 bp, Homo sapiens
taggaaagcagtagagccagga

SEQ ID NO: 6949307 - DNA, 21 bp, Homo sapiens
atcagaaaatgtaatggagca

SEQ ID NO: 6949308 - DNA, 22 bp, Homo sapiens
gaaggcaagatctcagtggagg

SEQ ID NO: 6949309 - DNA, 22 bp, Homo sapiens
ttgcactaggaaaaggcagcca

SEQ ID NO: 6949310 - DNA, 20 bp, Homo sapiens
tcatacacatgagcatgcag

SEQ ID NO: 6949311 - DNA, 22 bp, Homo sapiens
gtacacttgtcttgaacagcct

SEQ ID NO: 6949312 - DNA, 22 bp, Homo sapiens
tgggcacctgaggcctggcagg

SEQ ID NO: 6949313 - DNA, 22 bp, Homo sapiens
ttctgagaggtttgcattttca

SEQ ID NO: 6949314 - DNA, 22 bp, Homo sapiens
atattcttgaagggagattata

SEQ ID NO: 6949315 - DNA, 15 bp, Homo sapiens
ggaatctctctgacc

SEQ ID NO: 6949316 - DNA, 22 bp, Homo sapiens
tagaactggcggctagaccact

SEQ ID NO: 6949317 - DNA, 22 bp, Homo sapiens
cagaacattcttgccagtacat

SEQ ID NO: 6949318 - DNA, 22 bp, Homo sapiens
caaaatgttctggcacctttaa

SEQ ID NO: 6949319 - DNA, 22 bp, Homo sapiens
tcctcagagatgggcatctaag

SEQ ID NO: 6949320 - DNA, 22 bp, Homo sapiens
tctgctgagtaccgccatgtct

SEQ ID NO: 6949321 - DNA, 22 bp, Homo sapiens
ggtgatccaccagcctcggcct

SEQ ID NO: 6949322 - DNA, 22 bp, Homo sapiens
ttgcaaatattgtttacctttc

SEQ ID NO: 6949323 - DNA, 22 bp, Homo sapiens
gcctctgcaccagtactgtgcc

SEQ ID NO: 6949324 - DNA, 22 bp, Homo sapiens
tccaggagacacaaggtacata

SEQ ID NO: 6949325 - DNA, 22 bp, Homo sapiens
tgtccatttatacgccctcact

SEQ ID NO: 6949326 - DNA, 22 bp, Homo sapiens
acagaggcctcgtaggtacaac

SEQ ID NO: 6949327 - DNA, 22 bp, Homo sapiens
gagagggccgggggccagctcc

SEQ ID NO: 6949328 - DNA, 22 bp, Homo sapiens
acttctcagattgttgaacatc

SEQ ID NO: 6949329 - DNA, 22 bp, Homo sapiens
ctgcagaaacctttcctgattt

SEQ ID NO: 6949330 - DNA, 20 bp, Homo sapiens
ggctctggaatctggtgggc

SEQ ID NO: 6949331 - DNA, 20 bp, Homo sapiens
aggcagctggccaggcaggt

SEQ ID NO: 6949332 - DNA, 22 bp, Homo sapiens
gcccccaggctctggagaacct

SEQ ID NO: 6949333 - DNA, 22 bp, Homo sapiens
tacaacttccagctttcagccc

SEQ ID NO: 6949334 - DNA, 22 bp, Homo sapiens
tccccacactttcactcctggc

SEQ ID NO: 6949335 - DNA, 22 bp, Homo sapiens
ttctacagtgactgcagccata

SEQ ID NO: 6949336 - DNA, 20 bp, Homo sapiens
attcacaggcacaaaaccct

SEQ ID NO: 6949337 - DNA, 22 bp, Homo sapiens
gaacacatttctctgactgtag

SEQ ID NO: 6949338 - DNA, 20 bp, Homo sapiens
cagaaagaaggtagattttt

SEQ ID NO: 6949339 - DNA, 22 bp, Homo sapiens
tttacagttaagaaatgttacc

SEQ ID NO: 6949340 - DNA, 22 bp, Homo sapiens
gaaaggttgtaacaagactctt

SEQ ID NO: 6949341 - DNA, 22 bp, Homo sapiens
tgtggtgtatcaggaagccaat

SEQ ID NO: 6949342 - DNA, 22 bp, Homo sapiens
ctcaaggaaagtctggagaaga

SEQ ID NO: 6949343 - DNA, 22 bp, Homo sapiens
ccaggacttattacagtataac

SEQ ID NO: 6949344 - DNA, 22 bp, Homo sapiens
cagagccactgcattttacagc

SEQ ID NO: 6949345 - DNA, 21 bp, Homo sapiens
ttcagcagtcctctagagata

SEQ ID NO: 6949346 - DNA, 22 bp, Homo sapiens
gtaaggcaatagtaaggagtcc

SEQ ID NO: 6949347 - DNA, 22 bp, Homo sapiens
ggttgcaaactcctgggatcaa

SEQ ID NO: 6949348 - DNA, 22 bp, Homo sapiens
gaataatagcagaaattagcag

SEQ ID NO: 6949349 - DNA, 22 bp, Homo sapiens
gtgtgcagtctgctaggcaggg

SEQ ID NO: 6949350 - DNA, 21 bp, Homo sapiens
catactcagtgtataacttct

SEQ ID NO: 6949351 - DNA, 23 bp, Homo sapiens
gtcagggctggggtcagagtgac

SEQ ID NO: 6949352 - DNA, 22 bp, Homo sapiens
tgggcactatggctctgtgcac

SEQ ID NO: 6949353 - DNA, 22 bp, Homo sapiens
tgcatgcagctggtgataagaa

SEQ ID NO: 6949354 - DNA, 22 bp, Homo sapiens
aattttacaagaaggcctcgta

SEQ ID NO: 6949355 - DNA, 22 bp, Homo sapiens
cagcggtggcaaggtgactgtg

SEQ ID NO: 6949356 - DNA, 22 bp, Homo sapiens
tttaatgttaaatttgtagatg

SEQ ID NO: 6949357 - DNA, 22 bp, Homo sapiens
gctcaaatgtcatggggagcct

SEQ ID NO: 6949358 - DNA, 22 bp, Homo sapiens
agacctttatttcatgatagga

SEQ ID NO: 6949359 - DNA, 22 bp, Homo sapiens
acataaaggtgactaacatctt

SEQ ID NO: 6949360 - DNA, 22 bp, Homo sapiens
ccatggatctggatctatcttt

SEQ ID NO: 6949361 - DNA, 22 bp, Homo sapiens
ctcagaaaacctctttcttgat

SEQ ID NO: 6949362 - DNA, 22 bp, Homo sapiens
tccttggcacactcggatctga

SEQ ID NO: 6949363 - DNA, 22 bp, Homo sapiens
taactggtttggctcagggtct

SEQ ID NO: 6949364 - DNA, 22 bp, Homo sapiens
ccactgcacttcagcctgggtg

SEQ ID NO: 6949365 - DNA, 22 bp, Homo sapiens
ctggattttgatgagcagtttt

SEQ ID NO: 6949366 - DNA, 22 bp, Homo sapiens
atggctttctctaatgtggtat

SEQ ID NO: 6949367 - DNA, 22 bp, Homo sapiens
ggaggtgactggatcatgggca

SEQ ID NO: 6949368 - DNA, 21 bp, Homo sapiens
gcccagagtcctcccactcca

SEQ ID NO: 6949369 - DNA, 22 bp, Homo sapiens
tgttatctggttgtctgattac

SEQ ID NO: 6949370 - DNA, 17 bp, Homo sapiens
ctctgtacaggaaagag

SEQ ID NO: 6949371 - DNA, 22 bp, Homo sapiens
gatgtaaatggtctttggcaga

SEQ ID NO: 6949372 - DNA, 20 bp, Homo sapiens
cttgaactgattctatttcc

SEQ ID NO: 6949373 - DNA, 22 bp, Homo sapiens
agtatcaaagggcatgtggtta

SEQ ID NO: 6949374 - DNA, 22 bp, Homo sapiens
gtgttagcagtggagtggacac

SEQ ID NO: 6949375 - DNA, 22 bp, Homo sapiens
atctggaagtcagaggtttgca

SEQ ID NO: 6949376 - DNA, 22 bp, Homo sapiens
ctgctggaggttggagcatgca

SEQ ID NO: 6949377 - DNA, 22 bp, Homo sapiens
aggaattcctgggaaggcacag

SEQ ID NO: 6949378 - DNA, 22 bp, Homo sapiens
tatgctgtgctagatacaatat

SEQ ID NO: 6949379 - DNA, 21 bp, Homo sapiens
ttgctgccctccctttcctca

SEQ ID NO: 6949380 - DNA, 22 bp, Homo sapiens
aacaagtgaaagtccttttcga

SEQ ID NO: 6949381 - DNA, 22 bp, Homo sapiens
atagtcttccaggtcttctact

SEQ ID NO: 6949382 - DNA, 22 bp, Homo sapiens
cattagggccaccataacaaaa

SEQ ID NO: 6949383 - DNA, 22 bp, Homo sapiens
agaggcttctttctgatttgcg

SEQ ID NO: 6949384 - DNA, 22 bp, Homo sapiens
gtgcaatattgccatgttcttg

SEQ ID NO: 6949385 - DNA, 22 bp, Homo sapiens
tgcagcagccaaggttctgtgc

SEQ ID NO: 6949386 - DNA, 22 bp, Homo sapiens
aattctgctcttaacataatgt

SEQ ID NO: 6949387 - DNA, 22 bp, Homo sapiens
atgtttctagttgtatgtcact

SEQ ID NO: 6949388 - DNA, 22 bp, Homo sapiens
agtggctgtactattttttcat

SEQ ID NO: 6949389 - DNA, 22 bp, Homo sapiens
aggctctggagttagccaggca

SEQ ID NO: 6949390 - DNA, 22 bp, Homo sapiens
ataaaacttattagaattgtgt

SEQ ID NO: 6949391 - DNA, 22 bp, Homo sapiens
tcagcttggacagcttggttga

SEQ ID NO: 6949392 - DNA, 22 bp, Homo sapiens
cagcaaatactactagttttta

SEQ ID NO: 6949393 - DNA, 22 bp, Homo sapiens
tccatctgggtggggagaagga

SEQ ID NO: 6949394 - DNA, 22 bp, Homo sapiens
tatttctctcacggttgcctgg

SEQ ID NO: 6949395 - DNA, 21 bp, Homo sapiens
tccagaggaggacagactcag

SEQ ID NO: 6949396 - DNA, 22 bp, Homo sapiens
ctgtggctcaggcctgtaagcc

SEQ ID NO: 6949397 - DNA, 22 bp, Homo sapiens
agaacagtcgtggtgagagaaa

SEQ ID NO: 6949398 - DNA, 22 bp, Homo sapiens
atacatgtgccatgttggtgta

SEQ ID NO: 6949399 - DNA, 21 bp, Homo sapiens
tatttccaaccctttatcctt

SEQ ID NO: 6949400 - DNA, 22 bp, Homo sapiens
aagttgaatcagtaacacagtt

SEQ ID NO: 6949401 - DNA, 22 bp, Homo sapiens
gcctgggattcccagaggggca

SEQ ID NO: 6949402 - DNA, 22 bp, Homo sapiens
ttcccagactccacactgaggc

SEQ ID NO: 6949403 - DNA, 22 bp, Homo sapiens
aagactgagtggcttaagaaaa

SEQ ID NO: 6949404 - DNA, 22 bp, Homo sapiens
tgattaaaatttaacttagtta

SEQ ID NO: 6949405 - DNA, 20 bp, Homo sapiens
tctcttctggggagataaaa

SEQ ID NO: 6949406 - DNA, 22 bp, Homo sapiens
aagggctgaaagaccttgggca

SEQ ID NO: 6949407 - DNA, 22 bp, Homo sapiens
gttaaattcgatgatggataaa

SEQ ID NO: 6949408 - DNA, 22 bp, Homo sapiens
acaattctgtggttgtctgtgg

SEQ ID NO: 6949409 - DNA, 22 bp, Homo sapiens
agaaatacaaagtactaagata

SEQ ID NO: 6949410 - DNA, 20 bp, Homo sapiens
caggcacactcattcctgct

SEQ ID NO: 6949411 - DNA, 22 bp, Homo sapiens
ttctgcatctatttttctgctg

SEQ ID NO: 6949412 - DNA, 22 bp, Homo sapiens
aatggtatttgtcaagcatagt

SEQ ID NO: 6949413 - DNA, 21 bp, Homo sapiens
tctctttctggaagcttccct

SEQ ID NO: 6949414 - DNA, 22 bp, Homo sapiens
aagcaaattctggaggtgaggt

SEQ ID NO: 6949415 - DNA, 22 bp, Homo sapiens
gggtacagagagatgaggtaac

SEQ ID NO: 6949416 - DNA, 22 bp, Homo sapiens
agaaaggcagggatgaggattg

SEQ ID NO: 6949417 - DNA, 22 bp, Homo sapiens
tgtatttaagctttacctaaaa

SEQ ID NO: 6949418 - DNA, 22 bp, Homo sapiens
atgtttccgtgagcatccttga

SEQ ID NO: 6949419 - DNA, 22 bp, Homo sapiens
gctttggttcaaccaggcaatt

SEQ ID NO: 6949420 - DNA, 22 bp, Homo sapiens
ctagggtcaggggcctgcgtcg

SEQ ID NO: 6949421 - DNA, 22 bp, Homo sapiens
tgcagtgtggccatgtcagcta

SEQ ID NO: 6949422 - DNA, 22 bp, Homo sapiens
ttccaaggccagacagggcagt

SEQ ID NO: 6949423 - DNA, 22 bp, Homo sapiens
ccaggtgtgtcaccattgccca

SEQ ID NO: 6949424 - DNA, 22 bp, Homo sapiens
ttcagagacagcaaccaggaca

SEQ ID NO: 6949425 - DNA, 22 bp, Homo sapiens
caaagatgtcattggtaagaca

SEQ ID NO: 6949426 - DNA, 22 bp, Homo sapiens
gaaagaccagaattatggactc

SEQ ID NO: 6949427 - DNA, 22 bp, Homo sapiens
tggcacttattcatatcatgga

SEQ ID NO: 6949428 - DNA, 21 bp, Homo sapiens
aaggggcaaacccaggacacc

SEQ ID NO: 6949429 - DNA, 22 bp, Homo sapiens
ctcctccagtgggtccctcagg

SEQ ID NO: 6949430 - DNA, 22 bp, Homo sapiens
cagagctcagagctgccaggca

SEQ ID NO: 6949431 - DNA, 23 bp, Homo sapiens
tacatgctataatttcaccctca

SEQ ID NO: 6949432 - DNA, 22 bp, Homo sapiens
gtaggaactctgagactttgga

SEQ ID NO: 6949433 - DNA, 21 bp, Homo sapiens
aagatgatattttatctgtag

SEQ ID NO: 6949434 - DNA, 22 bp, Homo sapiens
agtcccaacagcttacaaggaa

SEQ ID NO: 6949435 - DNA, 22 bp, Homo sapiens
ctgtggccagatggtgccagtt

SEQ ID NO: 6949436 - DNA, 22 bp, Homo sapiens
ccaagattaagaaaccccttgt

SEQ ID NO: 6949437 - DNA, 22 bp, Homo sapiens
tcctggctcgattgctaccaat

SEQ ID NO: 6949438 - DNA, 22 bp, Homo sapiens
ctgaggtagctgtgaatgttct

SEQ ID NO: 6949439 - DNA, 22 bp, Homo sapiens
tccaccatgatttagcactggc

SEQ ID NO: 6949440 - DNA, 22 bp, Homo sapiens
atcagtttgataataaggcttg

SEQ ID NO: 6949441 - DNA, 22 bp, Homo sapiens
tctggattcaagtccctgtttt

SEQ ID NO: 6949442 - DNA, 18 bp, Homo sapiens
tgagctgctctgtgaaga

SEQ ID NO: 6949443 - DNA, 22 bp, Homo sapiens
catttgtacatgttgtcttctt

SEQ ID NO: 6949444 - DNA, 22 bp, Homo sapiens
agttgggagttatagactctat

SEQ ID NO: 6949445 - DNA, 20 bp, Homo sapiens
aagtcacttaagatgggcag

SEQ ID NO: 6949446 - DNA, 22 bp, Homo sapiens
ttgtaacagctgtttatatagt

SEQ ID NO: 6949447 - DNA, 22 bp, Homo sapiens
agtggcagtggaaagcacacgg

SEQ ID NO: 6949448 - DNA, 22 bp, Homo sapiens
tgtgacttataacatagaattt

SEQ ID NO: 6949449 - DNA, 22 bp, Homo sapiens
aggaaactaaagcccagagagg

SEQ ID NO: 6949450 - DNA, 22 bp, Homo sapiens
cacactgactggaatcaaggat

SEQ ID NO: 6949451 - DNA, 22 bp, Homo sapiens
aagacagctcaggacagattca

SEQ ID NO: 6949452 - DNA, 22 bp, Homo sapiens
gcacaaaaggtacttcatgtag

SEQ ID NO: 6949453 - DNA, 22 bp, Homo sapiens
agaatcttgtttcttgtgtgtt

SEQ ID NO: 6949454 - DNA, 22 bp, Homo sapiens
ttctgccaaaggctttgttttg

SEQ ID NO: 6949455 - DNA, 22 bp, Homo sapiens
agcctggagttcccaggagaag

SEQ ID NO: 6949456 - DNA, 22 bp, Homo sapiens
gcctgagcaggcgtggaccatg

SEQ ID NO: 6949457 - DNA, 22 bp, Homo sapiens
gcaggggcaggagatctcaggc

SEQ ID NO: 6949458 - DNA, 22 bp, Homo sapiens
acctgctgaggagggggaatta

SEQ ID NO: 6949459 - DNA, 22 bp, Homo sapiens
cccctcttggcattgagtgcca

SEQ ID NO: 6949460 - DNA, 22 bp, Homo sapiens
tgctgccaaatgcgagctctgt

SEQ ID NO: 6949461 - DNA, 22 bp, Homo sapiens
attccaggagctaactgtggtc

SEQ ID NO: 6949462 - DNA, 23 bp, Homo sapiens
attacagttaattacaacatctt

SEQ ID NO: 6949463 - DNA, 22 bp, Homo sapiens
ttacactgacagctgaaaagca

SEQ ID NO: 6949464 - DNA, 22 bp, Homo sapiens
tctttcttattatgctcaatgt

SEQ ID NO: 6949465 - DNA, 22 bp, Homo sapiens
tgcccagcgcccacattctgtc

SEQ ID NO: 6949466 - DNA, 22 bp, Homo sapiens
tttaatttgaaatgagtaaccc

SEQ ID NO: 6949467 - DNA, 22 bp, Homo sapiens
ctgcagagcagccagtccccca

SEQ ID NO: 6949468 - DNA, 22 bp, Homo sapiens
aggatctgtgcctcaacccaga

SEQ ID NO: 6949469 - DNA, 22 bp, Homo sapiens
taacctttttatcttacctcca

SEQ ID NO: 6949470 - DNA, 22 bp, Homo sapiens
acagagatgtggatgagggatt

SEQ ID NO: 6949471 - DNA, 22 bp, Homo sapiens
attctagccattgtattcttcc

SEQ ID NO: 6949472 - DNA, 22 bp, Homo sapiens
agaaatgcattagcacatatag

SEQ ID NO: 6949473 - DNA, 22 bp, Homo sapiens
cagtggaaactatgctgctgga

SEQ ID NO: 6949474 - DNA, 23 bp, Homo sapiens
ttattaccactccttgggggcct

SEQ ID NO: 6949475 - DNA, 22 bp, Homo sapiens
catctcttgccaaagtttgacc

SEQ ID NO: 6949476 - DNA, 22 bp, Homo sapiens
taagtagtttgtagccccatag

SEQ ID NO: 6949477 - DNA, 22 bp, Homo sapiens
ataaagcatttcccctgtgtgg

SEQ ID NO: 6949478 - DNA, 22 bp, Homo sapiens
tgtctgctaaattactattaca

SEQ ID NO: 6949479 - DNA, 22 bp, Homo sapiens
gtccagaagctcaagttgaact

SEQ ID NO: 6949480 - DNA, 22 bp, Homo sapiens
tctgcatcttcaatagccttcc

SEQ ID NO: 6949481 - DNA, 22 bp, Homo sapiens
ctgagcagtagagggtctcttt

SEQ ID NO: 6949482 - DNA, 22 bp, Homo sapiens
cagagtgattatggaggattgc

SEQ ID NO: 6949483 - DNA, 22 bp, Homo sapiens
agtccacagctcatagtttttt

SEQ ID NO: 6949484 - DNA, 19 bp, Homo sapiens
aaggctggagaaggcctct

SEQ ID NO: 6949485 - DNA, 22 bp, Homo sapiens
gaggcccaggtcaagcagccac

SEQ ID NO: 6949486 - DNA, 22 bp, Homo sapiens
tgctagcggcaaccagagccat

SEQ ID NO: 6949487 - DNA, 23 bp, Homo sapiens
agatccaacattgtccatttttt

SEQ ID NO: 6949488 - DNA, 22 bp, Homo sapiens
gaaaatgcctctggcattaaac

SEQ ID NO: 6949489 - DNA, 22 bp, Homo sapiens
tgttattgtcgctgcactggga

SEQ ID NO: 6949490 - DNA, 22 bp, Homo sapiens
ctccagtgcgcaggacagcccc

SEQ ID NO: 6949491 - DNA, 22 bp, Homo sapiens
aagctgagccagtggcaagtgc

SEQ ID NO: 6949492 - DNA, 22 bp, Homo sapiens
agagctcctcacttcgggttca

SEQ ID NO: 6949493 - DNA, 22 bp, Homo sapiens
tctattggtaggggctgaggca

SEQ ID NO: 6949494 - DNA, 22 bp, Homo sapiens
tttgtagatagaaaaatgatta

SEQ ID NO: 6949495 - DNA, 22 bp, Homo sapiens
ggctgctcctttaccctggcag

SEQ ID NO: 6949496 - DNA, 22 bp, Homo sapiens
atttcctatggatacaggcaga

SEQ ID NO: 6949497 - DNA, 22 bp, Homo sapiens
gcttctcaattctcaccctcca

SEQ ID NO: 6949498 - DNA, 22 bp, Homo sapiens
catgatcagaaagagaagctag

SEQ ID NO: 6949499 - DNA, 22 bp, Homo sapiens
ttgcttcagtagctctttaaag

SEQ ID NO: 6949500 - DNA, 20 bp, Homo sapiens
agtcacatgcatacacaagt

SEQ ID NO: 6949501 - DNA, 21 bp, Homo sapiens
tccctgtgagcagctcttcct

SEQ ID NO: 6949502 - DNA, 22 bp, Homo sapiens
tcttcacattttagtggtttgt

SEQ ID NO: 6949503 - DNA, 22 bp, Homo sapiens
tgggacagattataagtctgca

SEQ ID NO: 6949504 - DNA, 22 bp, Homo sapiens
agatactaaaaggggaagctcc

SEQ ID NO: 6949505 - DNA, 22 bp, Homo sapiens
tgaagcaggcattgactgatga

SEQ ID NO: 6949506 - DNA, 22 bp, Homo sapiens
tgagcccaggagtatgaggctg

SEQ ID NO: 6949507 - DNA, 22 bp, Homo sapiens
tagtagcaaaactcatctcttt

SEQ ID NO: 6949508 - DNA, 22 bp, Homo sapiens
ttcctcagccaaggctgggatc

SEQ ID NO: 6949509 - DNA, 22 bp, Homo sapiens
tatgagaatttgctaattggct

SEQ ID NO: 6949510 - DNA, 22 bp, Homo sapiens
gtggctggtttcctgcatgcaa

SEQ ID NO: 6949511 - DNA, 18 bp, Homo sapiens
tgttcctgcctttctctg

SEQ ID NO: 6949512 - DNA, 22 bp, Homo sapiens
agttggtcttcttggatctcag

SEQ ID NO: 6949513 - DNA, 22 bp, Homo sapiens
gaagcaaaatgtctgcacatat

SEQ ID NO: 6949514 - DNA, 22 bp, Homo sapiens
gaactttaggattttcacaggt

SEQ ID NO: 6949515 - DNA, 22 bp, Homo sapiens
cctgaacaaatggcatagccaa

SEQ ID NO: 6949516 - DNA, 22 bp, Homo sapiens
gcaggctggggtagccccactt

SEQ ID NO: 6949517 - DNA, 22 bp, Homo sapiens
gcctgggtgaatttgatcctaa

SEQ ID NO: 6949518 - DNA, 22 bp, Homo sapiens
gagtccttccagcaggcattta

SEQ ID NO: 6949519 - DNA, 22 bp, Homo sapiens
gactcagagatccctggaggtc

SEQ ID NO: 6949520 - DNA, 22 bp, Homo sapiens
gcagctctgattggttcagcct

SEQ ID NO: 6949521 - DNA, 22 bp, Homo sapiens
ttctaactctgttatgtgtttc

SEQ ID NO: 6949522 - DNA, 22 bp, Homo sapiens
tcacaggtacagctaatgctac

SEQ ID NO: 6949523 - DNA, 22 bp, Homo sapiens
aagggaaaatagttgatgacca

SEQ ID NO: 6949524 - DNA, 22 bp, Homo sapiens
acacatgaaagacattaaggtg

SEQ ID NO: 6949525 - DNA, 19 bp, Homo sapiens
gactacagggggaagaagt

SEQ ID NO: 6949526 - DNA, 22 bp, Homo sapiens
tgttggggtcaggagctagcct

SEQ ID NO: 6949527 - DNA, 22 bp, Homo sapiens
gacatcaatattctgcagggat

SEQ ID NO: 6949528 - DNA, 22 bp, Homo sapiens
catgcaggtctggagcttgggg

SEQ ID NO: 6949529 - DNA, 22 bp, Homo sapiens
agtgcttctggtgggcgtgagg

SEQ ID NO: 6949530 - DNA, 22 bp, Homo sapiens
cagaaatattccaagtactgca

SEQ ID NO: 6949531 - DNA, 22 bp, Homo sapiens
gtgcagcagggggaagacagtg

SEQ ID NO: 6949532 - DNA, 22 bp, Homo sapiens
gctctggttctcttagagtagt

SEQ ID NO: 6949533 - DNA, 22 bp, Homo sapiens
aagatgtgcagttcatggcagg

SEQ ID NO: 6949534 - DNA, 22 bp, Homo sapiens
ggaagtgtgcaatattgggctg

SEQ ID NO: 6949535 - DNA, 22 bp, Homo sapiens
ttctacaaatatttactgttcc

SEQ ID NO: 6949536 - DNA, 22 bp, Homo sapiens
gcccaggagttgaatgcagcag

SEQ ID NO: 6949537 - DNA, 22 bp, Homo sapiens
ggattgcaacaagctagtttag

SEQ ID NO: 6949538 - DNA, 22 bp, Homo sapiens
gtgtcctgcattggctctgccc

SEQ ID NO: 6949539 - DNA, 22 bp, Homo sapiens
tgcccactgtgtcaaagaaata

SEQ ID NO: 6949540 - DNA, 22 bp, Homo sapiens
ctccttcagctgaatccctgct

SEQ ID NO: 6949541 - DNA, 22 bp, Homo sapiens
gaggcactgctgggcccctgta

SEQ ID NO: 6949542 - DNA, 22 bp, Homo sapiens
aaatagcataaaataggaagct

SEQ ID NO: 6949543 - DNA, 22 bp, Homo sapiens
ctgtattttttaagaatatctc

SEQ ID NO: 6949544 - DNA, 18 bp, Homo sapiens
tctcttgcatcttctgta

SEQ ID NO: 6949545 - DNA, 22 bp, Homo sapiens
actctgagccaccagatcccca

SEQ ID NO: 6949546 - DNA, 22 bp, Homo sapiens
gctctggttccagcgcgcccga

SEQ ID NO: 6949547 - DNA, 22 bp, Homo sapiens
tatgtgatagagttactttata

SEQ ID NO: 6949548 - DNA, 22 bp, Homo sapiens
tacttcaaccttctctattaga

SEQ ID NO: 6949549 - DNA, 22 bp, Homo sapiens
gagctcctgctgcatcctgcct

SEQ ID NO: 6949550 - DNA, 22 bp, Homo sapiens
gtcagactgcactcaaggacag

SEQ ID NO: 6949551 - DNA, 22 bp, Homo sapiens
gacttttagaatggtgaggaat

SEQ ID NO: 6949552 - DNA, 22 bp, Homo sapiens
atggaatgtttatacacagttg

SEQ ID NO: 6949553 - DNA, 22 bp, Homo sapiens
tctggaagacattaatttggtt

SEQ ID NO: 6949554 - DNA, 22 bp, Homo sapiens
actggggcagtgggcagtggtt

SEQ ID NO: 6949555 - DNA, 22 bp, Homo sapiens
aggaagccaagcctgacactca

SEQ ID NO: 6949556 - DNA, 22 bp, Homo sapiens
ctgcagctctagcttttgacct

SEQ ID NO: 6949557 - DNA, 20 bp, Homo sapiens
tttcaacaatttcccttcca

SEQ ID NO: 6949558 - DNA, 22 bp, Homo sapiens
tgccctggctcctcccacgctg

SEQ ID NO: 6949559 - DNA, 22 bp, Homo sapiens
ctggcctgcagatcccagggtc

SEQ ID NO: 6949560 - DNA, 22 bp, Homo sapiens
caactttgtgtgacctagatag

SEQ ID NO: 6949561 - DNA, 22 bp, Homo sapiens
ttggaaggccagcaccttgagt

SEQ ID NO: 6949562 - DNA, 22 bp, Homo sapiens
tgctcccaaacctgacaggctc

SEQ ID NO: 6949563 - DNA, 22 bp, Homo sapiens
aatgcaagatcaaatctaacac

SEQ ID NO: 6949564 - DNA, 22 bp, Homo sapiens
aaactctagctactaggataac

SEQ ID NO: 6949565 - DNA, 22 bp, Homo sapiens
cggagaggacctgcaactcgct

SEQ ID NO: 6949566 - DNA, 22 bp, Homo sapiens
gggcactgacagggtcccaact

SEQ ID NO: 6949567 - DNA, 22 bp, Homo sapiens
gcctggagttgaaactattatt

SEQ ID NO: 6949568 - DNA, 22 bp, Homo sapiens
tctggagaagaaacttgctctg

SEQ ID NO: 6949569 - DNA, 20 bp, Homo sapiens
tgttcagaaatgcagagagg

SEQ ID NO: 6949570 - DNA, 22 bp, Homo sapiens
agcagggcttgccgcttgtcct

SEQ ID NO: 6949571 - DNA, 22 bp, Homo sapiens
aagggactttgtcagctttcca

SEQ ID NO: 6949572 - DNA, 23 bp, Homo sapiens
ttggaaacctgttttagctgttt

SEQ ID NO: 6949573 - DNA, 22 bp, Homo sapiens
caaagctcgccacctctgaggg

SEQ ID NO: 6949574 - DNA, 22 bp, Homo sapiens
acattctcttcctaaatatact

SEQ ID NO: 6949575 - DNA, 22 bp, Homo sapiens
aaacagttttttaagtctctag

SEQ ID NO: 6949576 - DNA, 22 bp, Homo sapiens
tggccctatttggaaatagagc

SEQ ID NO: 6949577 - DNA, 22 bp, Homo sapiens
tgtcatctacccgttaggcttt

SEQ ID NO: 6949578 - DNA, 22 bp, Homo sapiens
tcctggctagttttgctgaaat

SEQ ID NO: 6949579 - DNA, 22 bp, Homo sapiens
gagatgttgtgggtagttttgg

SEQ ID NO: 6949580 - DNA, 22 bp, Homo sapiens
tcctggtcagtgccaaactggt

SEQ ID NO: 6949581 - DNA, 22 bp, Homo sapiens
cctttcttgcttagtggctcat

SEQ ID NO: 6949582 - DNA, 22 bp, Homo sapiens
tacaaagataaaatctcaccat

SEQ ID NO: 6949583 - DNA, 22 bp, Homo sapiens
agagattaatactctataattt

SEQ ID NO: 6949584 - DNA, 22 bp, Homo sapiens
ggagcctgtggctgcttgaagc

SEQ ID NO: 6949585 - DNA, 22 bp, Homo sapiens
atgcatgcatccacaagttaaa

SEQ ID NO: 6949586 - DNA, 22 bp, Homo sapiens
agtcagggttgtaggctcaccc

SEQ ID NO: 6949587 - DNA, 22 bp, Homo sapiens
gcagggcagctcactgtggttc

SEQ ID NO: 6949588 - DNA, 22 bp, Homo sapiens
gccaagcttatatgatgcttga

SEQ ID NO: 6949589 - DNA, 22 bp, Homo sapiens
ttctctgggcttttcggatccg

SEQ ID NO: 6949590 - DNA, 21 bp, Homo sapiens
attggcacaccttttattgga

SEQ ID NO: 6949591 - DNA, 22 bp, Homo sapiens
tggaagaccacaagcccttaac

SEQ ID NO: 6949592 - DNA, 22 bp, Homo sapiens
aagagcatggcaagaaaagggt

SEQ ID NO: 6949593 - DNA, 22 bp, Homo sapiens
agtgttttattagaacacagcc

SEQ ID NO: 6949594 - DNA, 22 bp, Homo sapiens
tcaaacaccatctgaccttatg

SEQ ID NO: 6949595 - DNA, 22 bp, Homo sapiens
cactggttttgagagtagtcat

SEQ ID NO: 6949596 - DNA, 22 bp, Homo sapiens
actgaggtctatcatgagccag

SEQ ID NO: 6949597 - DNA, 22 bp, Homo sapiens
gctcaagagccagcgtctcctg

SEQ ID NO: 6949598 - DNA, 22 bp, Homo sapiens
gggctctgcacgttctggcgtc

SEQ ID NO: 6949599 - DNA, 22 bp, Homo sapiens
gtcagttttgctacagttgctg

SEQ ID NO: 6949600 - DNA, 22 bp, Homo sapiens
tttaaacatatctgttgaggga

SEQ ID NO: 6949601 - DNA, 22 bp, Homo sapiens
gttaatgtggtagtgcatatct

SEQ ID NO: 6949602 - DNA, 22 bp, Homo sapiens
gtggtcagtggtacagtttgaa

SEQ ID NO: 6949603 - DNA, 22 bp, Homo sapiens
agctgtttttccagtctctgga

SEQ ID NO: 6949604 - DNA, 22 bp, Homo sapiens
ggaattctctatgctctgttcc

SEQ ID NO: 6949605 - DNA, 22 bp, Homo sapiens
cctggccagcgccggctgctcg

SEQ ID NO: 6949606 - DNA, 19 bp, Homo sapiens
tttttagcagggtacacct

SEQ ID NO: 6949607 - DNA, 22 bp, Homo sapiens
ggttttattaactttaacatca

SEQ ID NO: 6949608 - DNA, 22 bp, Homo sapiens
tccttcagattcctgcttctgg

SEQ ID NO: 6949609 - DNA, 22 bp, Homo sapiens
tggtcttctttgttgctattat

SEQ ID NO: 6949610 - DNA, 21 bp, Homo sapiens
ctgatctaattgaagagcgtg

SEQ ID NO: 6949611 - DNA, 22 bp, Homo sapiens
gaattaaaatagttttggtcga

SEQ ID NO: 6949612 - DNA, 22 bp, Homo sapiens
agtttctaacatatagcattgg

SEQ ID NO: 6949613 - DNA, 22 bp, Homo sapiens
attcctgtcccttcattgttga

SEQ ID NO: 6949614 - DNA, 22 bp, Homo sapiens
cagcttgggtcaggtgcctgct

SEQ ID NO: 6949615 - DNA, 22 bp, Homo sapiens
tcgatgtggtgacaaggtacgt

SEQ ID NO: 6949616 - DNA, 22 bp, Homo sapiens
tttgcagagtacctgaagagga

SEQ ID NO: 6949617 - DNA, 22 bp, Homo sapiens
ttccaaggcgatggcgcagaac

SEQ ID NO: 6949618 - DNA, 22 bp, Homo sapiens
tgtctagacattagcttcagct

SEQ ID NO: 6949619 - DNA, 22 bp, Homo sapiens
gacagacacagggccatgattg

SEQ ID NO: 6949620 - DNA, 22 bp, Homo sapiens
aacactgaagaccaggtaattt

SEQ ID NO: 6949621 - DNA, 22 bp, Homo sapiens
gtcctgttaagatgcagagtcc

SEQ ID NO: 6949622 - DNA, 22 bp, Homo sapiens
taggacagagttccctgatggc

SEQ ID NO: 6949623 - DNA, 22 bp, Homo sapiens
atcagtttcacttgcttgcaaa

SEQ ID NO: 6949624 - DNA, 22 bp, Homo sapiens
taatctgtgtaccttcatcgga

SEQ ID NO: 6949625 - DNA, 23 bp, Homo sapiens
aattaccatgcaacttgtgaaac

SEQ ID NO: 6949626 - DNA, 22 bp, Homo sapiens
actgatctgttttcagattctg

SEQ ID NO: 6949627 - DNA, 22 bp, Homo sapiens
tctctagtgccatgaaagtcct

SEQ ID NO: 6949628 - DNA, 21 bp, Homo sapiens
aggctcccagaaatgggcatc

SEQ ID NO: 6949629 - DNA, 22 bp, Homo sapiens
gaggtgtggtcctcagccccca

SEQ ID NO: 6949630 - DNA, 22 bp, Homo sapiens
tgcacacacacgtagagaaaag

SEQ ID NO: 6949631 - DNA, 23 bp, Homo sapiens
tgggatggattcaccagtgtgct

SEQ ID NO: 6949632 - DNA, 22 bp, Homo sapiens
cagaggcctcacttccagccag

SEQ ID NO: 6949633 - DNA, 22 bp, Homo sapiens
ctgccaccatgccccagcagag

SEQ ID NO: 6949634 - DNA, 22 bp, Homo sapiens
ggccttggagtcctccactgga

SEQ ID NO: 6949635 - DNA, 22 bp, Homo sapiens
tggcagtgatgcttatggtttg

SEQ ID NO: 6949636 - DNA, 16 bp, Homo sapiens
ccccaggacttggcac

SEQ ID NO: 6949637 - DNA, 19 bp, Homo sapiens
ttcacagctctgtgtcagt

SEQ ID NO: 6949638 - DNA, 22 bp, Homo sapiens
gtgtaacttgctggaaaaacta

SEQ ID NO: 6949639 - DNA, 21 bp, Homo sapiens
tgccagctgctgcatctgtct

SEQ ID NO: 6949640 - DNA, 22 bp, Homo sapiens
cctgagtgtaataatgaaggca

SEQ ID NO: 6949641 - DNA, 22 bp, Homo sapiens
cctgggtcttcagtctgctggt

SEQ ID NO: 6949642 - DNA, 22 bp, Homo sapiens
agcatagaataagctgaagtca

SEQ ID NO: 6949643 - DNA, 22 bp, Homo sapiens
ttggcttttatgcagcttaggt

SEQ ID NO: 6949644 - DNA, 23 bp, Homo sapiens
tactacagggtcttgctatgaat

SEQ ID NO: 6949645 - DNA, 22 bp, Homo sapiens
tcctggctcaggcccctggtgc

SEQ ID NO: 6949646 - DNA, 22 bp, Homo sapiens
cggcttgttcgaggcctaatat

SEQ ID NO: 6949647 - DNA, 22 bp, Homo sapiens
gaacctgagcccaggtggcatt

SEQ ID NO: 6949648 - DNA, 22 bp, Homo sapiens
tttggaagatagttcggcagtt

SEQ ID NO: 6949649 - DNA, 19 bp, Homo sapiens
tgagtgtcacgtcagtgcc

SEQ ID NO: 6949650 - DNA, 20 bp, Homo sapiens
aggctcagggtgtttaggaa

SEQ ID NO: 6949651 - DNA, 22 bp, Homo sapiens
ttggggaggttgccacattcca

SEQ ID NO: 6949652 - DNA, 22 bp, Homo sapiens
gagctgggaagatagcttgagc

SEQ ID NO: 6949653 - DNA, 21 bp, Homo sapiens
taaggccaagtctatttctgt

SEQ ID NO: 6949654 - DNA, 22 bp, Homo sapiens
gaggacaagctgtgagtggggt

SEQ ID NO: 6949655 - DNA, 22 bp, Homo sapiens
agagagaacaccctcggcatgg

SEQ ID NO: 6949656 - DNA, 21 bp, Homo sapiens
caggccgggtgagcaggcagc

SEQ ID NO: 6949657 - DNA, 22 bp, Homo sapiens
aggagctgcatggatacctggt

SEQ ID NO: 6949658 - DNA, 22 bp, Homo sapiens
gcctggctccctctgcagctcc

SEQ ID NO: 6949659 - DNA, 22 bp, Homo sapiens
agtttcacagtctgtcattgtt

SEQ ID NO: 6949660 - DNA, 18 bp, Homo sapiens
agtgttctcgttttataa

SEQ ID NO: 6949661 - DNA, 22 bp, Homo sapiens
tcttcatacaatttcagacatc

SEQ ID NO: 6949662 - DNA, 22 bp, Homo sapiens
ttctaaattttggaagatgcag

SEQ ID NO: 6949663 - DNA, 22 bp, Homo sapiens
tttccaatttggtagtcatcgg

SEQ ID NO: 6949664 - DNA, 22 bp, Homo sapiens
gctttagagaagaaaggttgct

SEQ ID NO: 6949665 - DNA, 22 bp, Homo sapiens
cagggtgggcacccagcctcca

SEQ ID NO: 6949666 - DNA, 22 bp, Homo sapiens
tgctgaaacaataacatactgg

SEQ ID NO: 6949667 - DNA, 22 bp, Homo sapiens
agggcagagcactgaattggga

SEQ ID NO: 6949668 - DNA, 20 bp, Homo sapiens
acaggatgcctgccatttca

SEQ ID NO: 6949669 - DNA, 22 bp, Homo sapiens
taaagaccaaacacagtgcaga

SEQ ID NO: 6949670 - DNA, 22 bp, Homo sapiens
gagagagaaggcctgtgggtgt

SEQ ID NO: 6949671 - DNA, 22 bp, Homo sapiens
ttaaaatctaaagcagttgtct

SEQ ID NO: 6949672 - DNA, 22 bp, Homo sapiens
atgtcacagcaggagtattctt

SEQ ID NO: 6949673 - DNA, 22 bp, Homo sapiens
aagggctggtctagaaagggag

SEQ ID NO: 6949674 - DNA, 22 bp, Homo sapiens
acaggtgtccaacatttacctt

SEQ ID NO: 6949675 - DNA, 22 bp, Homo sapiens
cacaggaccaattcacattcca

SEQ ID NO: 6949676 - DNA, 22 bp, Homo sapiens
gatgtcttctcaactgtagacc

SEQ ID NO: 6949677 - DNA, 22 bp, Homo sapiens
caatactgagtttacattcatc

SEQ ID NO: 6949678 - DNA, 21 bp, Homo sapiens
ggcaggatggcagtggacccc

SEQ ID NO: 6949679 - DNA, 22 bp, Homo sapiens
ctggatgcttcctctctgctag

SEQ ID NO: 6949680 - DNA, 22 bp, Homo sapiens
tgtctcctcatactgtcatatt

SEQ ID NO: 6949681 - DNA, 17 bp, Homo sapiens
tccttcagtgcctctgc

SEQ ID NO: 6949682 - DNA, 20 bp, Homo sapiens
agcaagaaggttgtgggagc

SEQ ID NO: 6949683 - DNA, 18 bp, Homo sapiens
tcaaactgtcattggtga

SEQ ID NO: 6949684 - DNA, 22 bp, Homo sapiens
catttgatcctcacaacaatct

SEQ ID NO: 6949685 - DNA, 20 bp, Homo sapiens
ctcatctctgagcctcctgg

SEQ ID NO: 6949686 - DNA, 23 bp, Homo sapiens
aagaataaatgacattaaaggtg

SEQ ID NO: 6949687 - DNA, 22 bp, Homo sapiens
acatttcttccctttagcagaa

SEQ ID NO: 6949688 - DNA, 22 bp, Homo sapiens
gtggcatggccctcattccagt

SEQ ID NO: 6949689 - DNA, 22 bp, Homo sapiens
gctcaggcaggagtgcagtggc

SEQ ID NO: 6949690 - DNA, 22 bp, Homo sapiens
gaggcctttatgtacatctagt

SEQ ID NO: 6949691 - DNA, 22 bp, Homo sapiens
gcctgctgccaccctggctccg

SEQ ID NO: 6949692 - DNA, 22 bp, Homo sapiens
ttccctctcacttaaagcttgg

SEQ ID NO: 6949693 - DNA, 22 bp, Homo sapiens
aggagctgtcagagtgccagag

SEQ ID NO: 6949694 - DNA, 22 bp, Homo sapiens
ggcagagtcagaggtggttctg

SEQ ID NO: 6949695 - DNA, 19 bp, Homo sapiens
gcaattcagaagcacctgt

SEQ ID NO: 6949696 - DNA, 22 bp, Homo sapiens
ggtggggcctgctccagcggcc

SEQ ID NO: 6949697 - DNA, 22 bp, Homo sapiens
gtgctgatggccacccctgttc

SEQ ID NO: 6949698 - DNA, 22 bp, Homo sapiens
cagaatgaaatgtaagaacacc

SEQ ID NO: 6949699 - DNA, 22 bp, Homo sapiens
cagctcccgccatcgggaggca

SEQ ID NO: 6949700 - DNA, 20 bp, Homo sapiens
agaaatcagcatgtcctctg

SEQ ID NO: 6949701 - DNA, 22 bp, Homo sapiens
tgcagcattgaaatagctaggc

SEQ ID NO: 6949702 - DNA, 22 bp, Homo sapiens
tcctgggaggctgtgcctggct

SEQ ID NO: 6949703 - DNA, 22 bp, Homo sapiens
gttcatatttaactaagatagg

SEQ ID NO: 6949704 - DNA, 22 bp, Homo sapiens
tttcactggaattttaacattt

SEQ ID NO: 6949705 - DNA, 22 bp, Homo sapiens
gcttctcttcgcctaggtcctt

SEQ ID NO: 6949706 - DNA, 22 bp, Homo sapiens
agtcagctgctgcacacagcag

SEQ ID NO: 6949707 - DNA, 23 bp, Homo sapiens
tcacataatccttcatccacagg

SEQ ID NO: 6949708 - DNA, 22 bp, Homo sapiens
ctctccctatgcctcccaggag

SEQ ID NO: 6949709 - DNA, 22 bp, Homo sapiens
agctgccctggcggagctgctc

SEQ ID NO: 6949710 - DNA, 22 bp, Homo sapiens
tggccagccacaatataaagta

SEQ ID NO: 6949711 - DNA, 22 bp, Homo sapiens
acttccaggaggtgtcactgaa

SEQ ID NO: 6949712 - DNA, 22 bp, Homo sapiens
acactgagtattgagtagggta

SEQ ID NO: 6949713 - DNA, 21 bp, Homo sapiens
ctcgtacctgctttccttcta

SEQ ID NO: 6949714 - DNA, 22 bp, Homo sapiens
acattacactgtggtcctgttc

SEQ ID NO: 6949715 - DNA, 22 bp, Homo sapiens
agagttatattggttgagaatt

SEQ ID NO: 6949716 - DNA, 22 bp, Homo sapiens
tgccagggagccctgctgacca

SEQ ID NO: 6949717 - DNA, 22 bp, Homo sapiens
tagtcagttgggtctagtggca

SEQ ID NO: 6949718 - DNA, 22 bp, Homo sapiens
ctagggaatataatgtatgcca

SEQ ID NO: 6949719 - DNA, 22 bp, Homo sapiens
tctttgatgtggttaattatga

SEQ ID NO: 6949720 - DNA, 22 bp, Homo sapiens
gtctctcaaaactagaagagaa

SEQ ID NO: 6949721 - DNA, 22 bp, Homo sapiens
tcagtatagctaaaagtttgtc

SEQ ID NO: 6949722 - DNA, 22 bp, Homo sapiens
gaatttcaggacaactggaagg

SEQ ID NO: 6949723 - DNA, 22 bp, Homo sapiens
cgcccaggctggagagcagtgg

SEQ ID NO: 6949724 - DNA, 22 bp, Homo sapiens
aagaggagggcagattcaaggc

SEQ ID NO: 6949725 - DNA, 22 bp, Homo sapiens
ggtatttactgagagccactct

SEQ ID NO: 6949726 - DNA, 22 bp, Homo sapiens
actattgcaatacgtgtcagca

SEQ ID NO: 6949727 - DNA, 22 bp, Homo sapiens
ttcttgagtatctgcacagtgc

SEQ ID NO: 6949728 - DNA, 20 bp, Homo sapiens
attttgtttatgttcctctc

SEQ ID NO: 6949729 - DNA, 22 bp, Homo sapiens
ttctaatcccagctctactact

SEQ ID NO: 6949730 - DNA, 22 bp, Homo sapiens
ggaagctggtaattgttgggac

SEQ ID NO: 6949731 - DNA, 22 bp, Homo sapiens
aacagatggccaagtgcatggg

SEQ ID NO: 6949732 - DNA, 23 bp, Homo sapiens
atttggtgttggttctgccaccc

SEQ ID NO: 6949733 - DNA, 22 bp, Homo sapiens
tgcattgcagttaactcagtat

SEQ ID NO: 6949734 - DNA, 22 bp, Homo sapiens
ttcccagtgattaaggcagtgg

SEQ ID NO: 6949735 - DNA, 17 bp, Homo sapiens
acttcccacccctccag

SEQ ID NO: 6949736 - DNA, 22 bp, Homo sapiens
ccctcggggcctcagtttccct

SEQ ID NO: 6949737 - DNA, 22 bp, Homo sapiens
tgcagggatcctagctgaagag

SEQ ID NO: 6949738 - DNA, 22 bp, Homo sapiens
tgttacaaatgcggagtttgtg

SEQ ID NO: 6949739 - DNA, 22 bp, Homo sapiens
actagcagaaactgatcatggc

SEQ ID NO: 6949740 - DNA, 22 bp, Homo sapiens
cagatgtaatctgacagctgga

SEQ ID NO: 6949741 - DNA, 22 bp, Homo sapiens
tctgtaatcccagctactcagg

SEQ ID NO: 6949742 - DNA, 17 bp, Homo sapiens
gctgagaggcagcacag

SEQ ID NO: 6949743 - DNA, 22 bp, Homo sapiens
cacaaggacatgtatatttatg

SEQ ID NO: 6949744 - DNA, 22 bp, Homo sapiens
ttgtacagtttaagtgggtgaa

SEQ ID NO: 6949745 - DNA, 22 bp, Homo sapiens
gagcttggacaccttggcaggt

SEQ ID NO: 6949746 - DNA, 22 bp, Homo sapiens
tgcaaacagaaaagctactttg

SEQ ID NO: 6949747 - DNA, 22 bp, Homo sapiens
ttttacaaatgaggagctggag

SEQ ID NO: 6949748 - DNA, 22 bp, Homo sapiens
aagggctgtagacaagattgct

SEQ ID NO: 6949749 - DNA, 22 bp, Homo sapiens
acttgcatcttagagactcacc

SEQ ID NO: 6949750 - DNA, 22 bp, Homo sapiens
aaatcatgaggacattatgcca

SEQ ID NO: 6949751 - DNA, 22 bp, Homo sapiens
ccagtgctcttaaaggtcataa

SEQ ID NO: 6949752 - DNA, 22 bp, Homo sapiens
ggcagaatttgccattcaagct

SEQ ID NO: 6949753 - DNA, 19 bp, Homo sapiens
atctacaattattctcagt

SEQ ID NO: 6949754 - DNA, 22 bp, Homo sapiens
gccaggcctgcaagtgctggtg

SEQ ID NO: 6949755 - DNA, 22 bp, Homo sapiens
aatttggagagaaacaagtagg

SEQ ID NO: 6949756 - DNA, 22 bp, Homo sapiens
tagatgcttatagggtggttaa

SEQ ID NO: 6949757 - DNA, 22 bp, Homo sapiens
acaggcgctggcagagagaaaa

SEQ ID NO: 6949758 - DNA, 22 bp, Homo sapiens
tgtaacaatgaatatagtgact

SEQ ID NO: 6949759 - DNA, 19 bp, Homo sapiens
tacaggcagtttctacaat

SEQ ID NO: 6949760 - DNA, 22 bp, Homo sapiens
cctgctcacctgatgtggcaac

SEQ ID NO: 6949761 - DNA, 22 bp, Homo sapiens
agctttgggggaggtagtctgt

SEQ ID NO: 6949762 - DNA, 23 bp, Homo sapiens
cggcagcgtccggctacgggagg

SEQ ID NO: 6949763 - DNA, 22 bp, Homo sapiens
agagttgctgagtatataccca

SEQ ID NO: 6949764 - DNA, 22 bp, Homo sapiens
ctgtcattgagcctgtcagggc

SEQ ID NO: 6949765 - DNA, 23 bp, Homo sapiens
aaagtgcttggcacgacacctgg

SEQ ID NO: 6949766 - DNA, 22 bp, Homo sapiens
ccagctgtgccggggacctggg

SEQ ID NO: 6949767 - DNA, 22 bp, Homo sapiens
tctttgggagaaggggtcccag

SEQ ID NO: 6949768 - DNA, 22 bp, Homo sapiens
attataaacctttgagggtggg

SEQ ID NO: 6949769 - DNA, 22 bp, Homo sapiens
ctttacataaggataaacctgg

SEQ ID NO: 6949770 - DNA, 22 bp, Homo sapiens
ttgaaatggaagtgaaaattct

SEQ ID NO: 6949771 - DNA, 21 bp, Homo sapiens
ggcctctgtcatcctgggaag

SEQ ID NO: 6949772 - DNA, 22 bp, Homo sapiens
gtgtgaaagcttgtcctctgta

SEQ ID NO: 6949773 - DNA, 22 bp, Homo sapiens
aagcattttgttttaagaatga

SEQ ID NO: 6949774 - DNA, 22 bp, Homo sapiens
tgaccaaaaaattccctgtgag

SEQ ID NO: 6949775 - DNA, 22 bp, Homo sapiens
aataattacccatctttttgta

SEQ ID NO: 6949776 - DNA, 22 bp, Homo sapiens
cttgagaatcttgatgtctacc

SEQ ID NO: 6949777 - DNA, 23 bp, Homo sapiens
agcaggataattttattatgccc

SEQ ID NO: 6949778 - DNA, 22 bp, Homo sapiens
cctcagggtcatcctagtaata

SEQ ID NO: 6949779 - DNA, 22 bp, Homo sapiens
taaatgtgttagtcatggtttt

SEQ ID NO: 6949780 - DNA, 22 bp, Homo sapiens
tacgattggtttgttcagatct

SEQ ID NO: 6949781 - DNA, 22 bp, Homo sapiens
atcctgaaaattgaatggaagg

SEQ ID NO: 6949782 - DNA, 22 bp, Homo sapiens
tttgattcaatgtttatataaa

SEQ ID NO: 6949783 - DNA, 22 bp, Homo sapiens
agctgaagtgttggtggtttca

SEQ ID NO: 6949784 - DNA, 22 bp, Homo sapiens
tgctgaggagggcacccggggg

SEQ ID NO: 6949785 - DNA, 22 bp, Homo sapiens
ggcttctccaggtactgagcat

SEQ ID NO: 6949786 - DNA, 22 bp, Homo sapiens
gcaggagcagtcaggggcagct

SEQ ID NO: 6949787 - DNA, 22 bp, Homo sapiens
ttgttgctcttgttgccacatg

SEQ ID NO: 6949788 - DNA, 22 bp, Homo sapiens
gggccccagtcctcccacgtgg

SEQ ID NO: 6949789 - DNA, 22 bp, Homo sapiens
tatatttgctaaatgtgtgcaa

SEQ ID NO: 6949790 - DNA, 22 bp, Homo sapiens
tctgggagagagttgataaagg

SEQ ID NO: 6949791 - DNA, 22 bp, Homo sapiens
ttggtacattacagtttgattg

SEQ ID NO: 6949792 - DNA, 22 bp, Homo sapiens
ggtgaggaaagatggtgacagt

SEQ ID NO: 6949793 - DNA, 22 bp, Homo sapiens
tcagtttaagatgactaacaat

SEQ ID NO: 6949794 - DNA, 20 bp, Homo sapiens
gtacacatatatgtatgtgt

SEQ ID NO: 6949795 - DNA, 22 bp, Homo sapiens
ataccatttatcaagtacagtg

SEQ ID NO: 6949796 - DNA, 22 bp, Homo sapiens
atgtagaagctgacagtgctgt

SEQ ID NO: 6949797 - DNA, 22 bp, Homo sapiens
ctgagccctctgttttccctct

SEQ ID NO: 6949798 - DNA, 20 bp, Homo sapiens
tcaaggactccctgggaaga

SEQ ID NO: 6949799 - DNA, 22 bp, Homo sapiens
atatgcttatgatgtctcaagt

SEQ ID NO: 6949800 - DNA, 22 bp, Homo sapiens
atgagctaagcagaaagcacac

SEQ ID NO: 6949801 - DNA, 22 bp, Homo sapiens
cccatttaagtaatgataaact

SEQ ID NO: 6949802 - DNA, 22 bp, Homo sapiens
gctggtggttaccgtgctaatg

SEQ ID NO: 6949803 - DNA, 17 bp, Homo sapiens
agccaggcatatgaagt

SEQ ID NO: 6949804 - DNA, 22 bp, Homo sapiens
gttggaaatggtttctatccct

SEQ ID NO: 6949805 - DNA, 22 bp, Homo sapiens
gtcatttctgtttcttcagtgc

SEQ ID NO: 6949806 - DNA, 22 bp, Homo sapiens
ttatttaggagaaggaaccctg

SEQ ID NO: 6949807 - DNA, 21 bp, Homo sapiens
ctctctgcttatgaatagtga

SEQ ID NO: 6949808 - DNA, 22 bp, Homo sapiens
atccagagactggggctgggat

SEQ ID NO: 6949809 - DNA, 22 bp, Homo sapiens
gtgtccttgcagtttgaagaaa

SEQ ID NO: 6949810 - DNA, 22 bp, Homo sapiens
ctaagcataatggtgctttaag

SEQ ID NO: 6949811 - DNA, 22 bp, Homo sapiens
taagcattcaatgcttagcact

SEQ ID NO: 6949812 - DNA, 22 bp, Homo sapiens
tctcttcacactacccctgtgt

SEQ ID NO: 6949813 - DNA, 22 bp, Homo sapiens
gcagccttccgtggacctggac

SEQ ID NO: 6949814 - DNA, 15 bp, Homo sapiens
tggcaagtgctagta

SEQ ID NO: 6949815 - DNA, 22 bp, Homo sapiens
agtcataactgtcctgggtgag

SEQ ID NO: 6949816 - DNA, 22 bp, Homo sapiens
agctctggacctgacatctggt

SEQ ID NO: 6949817 - DNA, 22 bp, Homo sapiens
caaatactacgattcttgcagt

SEQ ID NO: 6949818 - DNA, 22 bp, Homo sapiens
acactttactcttacaccattg

SEQ ID NO: 6949819 - DNA, 22 bp, Homo sapiens
tccagctttgagattttatgga

SEQ ID NO: 6949820 - DNA, 22 bp, Homo sapiens
cagccagaaagtctgttaggga

SEQ ID NO: 6949821 - DNA, 22 bp, Homo sapiens
aatgaacaggtgaatgtcagat

SEQ ID NO: 6949822 - DNA, 22 bp, Homo sapiens
aggagctcattgaagtggatga

SEQ ID NO: 6949823 - DNA, 20 bp, Homo sapiens
ggtgtcagggccatgcctgg

SEQ ID NO: 6949824 - DNA, 22 bp, Homo sapiens
tacagagagtacagcatccaca

SEQ ID NO: 6949825 - DNA, 22 bp, Homo sapiens
ggtagtttaagaaataattgtt

SEQ ID NO: 6949826 - DNA, 22 bp, Homo sapiens
tgtgaccataatttgtaaataa

SEQ ID NO: 6949827 - DNA, 22 bp, Homo sapiens
aacagcaatagcactattcatt

SEQ ID NO: 6949828 - DNA, 22 bp, Homo sapiens
ttctgacatttgtcaaaatgat

SEQ ID NO: 6949829 - DNA, 22 bp, Homo sapiens
tagatttgtgtttgggatgaga

SEQ ID NO: 6949830 - DNA, 22 bp, Homo sapiens
atgaatgatgcaaaagacactg

SEQ ID NO: 6949831 - DNA, 22 bp, Homo sapiens
aggctgaggggcgagggaccct

SEQ ID NO: 6949832 - DNA, 22 bp, Homo sapiens
caggggacattaaagctccata

SEQ ID NO: 6949833 - DNA, 22 bp, Homo sapiens
atagaagaggaaactgaggttg

SEQ ID NO: 6949834 - DNA, 22 bp, Homo sapiens
ctgctctggcgtactcggcatc

SEQ ID NO: 6949835 - DNA, 17 bp, Homo sapiens
gaatttcttggtcaaaa

SEQ ID NO: 6949836 - DNA, 22 bp, Homo sapiens
ctctgagcagcggtgccgaagt

SEQ ID NO: 6949837 - DNA, 17 bp, Homo sapiens
tgtgcgcttgtgtgagg

SEQ ID NO: 6949838 - DNA, 22 bp, Homo sapiens
atccagggataaaagtaaggtt

SEQ ID NO: 6949839 - DNA, 22 bp, Homo sapiens
tgacatttcagatatggtattt

SEQ ID NO: 6949840 - DNA, 22 bp, Homo sapiens
catcgtatggccgaatgtacat

SEQ ID NO: 6949841 - DNA, 19 bp, Homo sapiens
tgcatacatgttaacatgt

SEQ ID NO: 6949842 - DNA, 22 bp, Homo sapiens
tcttgtatttgattccttccaa

SEQ ID NO: 6949843 - DNA, 22 bp, Homo sapiens
tgaaagtaaccaagggaaggtc

SEQ ID NO: 6949844 - DNA, 22 bp, Homo sapiens
ctgtgcataaatggacatggat

SEQ ID NO: 6949845 - DNA, 22 bp, Homo sapiens
gtctgtatttatgcaatgaggg

SEQ ID NO: 6949846 - DNA, 20 bp, Homo sapiens
tgctggaaattgttctagga

SEQ ID NO: 6949847 - DNA, 22 bp, Homo sapiens
cttcacatgatgtccgtgctgt

SEQ ID NO: 6949848 - DNA, 22 bp, Homo sapiens
aagtgattttcctacttgctaa

SEQ ID NO: 6949849 - DNA, 22 bp, Homo sapiens
tcccctccaactccaactatgg

SEQ ID NO: 6949850 - DNA, 22 bp, Homo sapiens
ctcagtttctggataagctggg

SEQ ID NO: 6949851 - DNA, 22 bp, Homo sapiens
aatcaggagctagggggcaatg

SEQ ID NO: 6949852 - DNA, 22 bp, Homo sapiens
aacactgatggaaagtatgttt

SEQ ID NO: 6949853 - DNA, 22 bp, Homo sapiens
tttttagccaagccataggtct

SEQ ID NO: 6949854 - DNA, 20 bp, Homo sapiens
ctcttggcagattacctgtc

SEQ ID NO: 6949855 - DNA, 22 bp, Homo sapiens
ttttcattgagcacctgagtaa

SEQ ID NO: 6949856 - DNA, 22 bp, Homo sapiens
cctgagaggttggcctgtccag

SEQ ID NO: 6949857 - DNA, 22 bp, Homo sapiens
gtgagacacccaagagtcagat

SEQ ID NO: 6949858 - DNA, 22 bp, Homo sapiens
ctttcccagagtagttgatgct

SEQ ID NO: 6949859 - DNA, 22 bp, Homo sapiens
gttgtgcagaagtgcctcagta

SEQ ID NO: 6949860 - DNA, 22 bp, Homo sapiens
atagtgattattattgctattg

SEQ ID NO: 6949861 - DNA, 21 bp, Homo sapiens
cggccaaattcctcctaggga

SEQ ID NO: 6949862 - DNA, 22 bp, Homo sapiens
catgcagaggtgccacgaggct

SEQ ID NO: 6949863 - DNA, 22 bp, Homo sapiens
gacaatggtggatacatgtcat

SEQ ID NO: 6949864 - DNA, 18 bp, Homo sapiens
gctgccctagctcccctc

SEQ ID NO: 6949865 - DNA, 22 bp, Homo sapiens
cctctgaccctggtggtggcca

SEQ ID NO: 6949866 - DNA, 22 bp, Homo sapiens
ctgggccatctctctgcaagtg

SEQ ID NO: 6949867 - DNA, 22 bp, Homo sapiens
tgtgtcctcactgtatgcaagg

SEQ ID NO: 6949868 - DNA, 22 bp, Homo sapiens
tggggttacctacaagtctgag

SEQ ID NO: 6949869 - DNA, 22 bp, Homo sapiens
ggaaagggagttttgcttatga

SEQ ID NO: 6949870 - DNA, 20 bp, Homo sapiens
aggctcctccaggatgtgtg

SEQ ID NO: 6949871 - DNA, 22 bp, Homo sapiens
actttcctgccaaggccagagt

SEQ ID NO: 6949872 - DNA, 22 bp, Homo sapiens
ggaagggcaaaagagatgaact

SEQ ID NO: 6949873 - DNA, 22 bp, Homo sapiens
caggaagcagtagaacttttcc

SEQ ID NO: 6949874 - DNA, 22 bp, Homo sapiens
gacatttactgaatactgatta

SEQ ID NO: 6949875 - DNA, 22 bp, Homo sapiens
agatgctggatggaaaatgatc

SEQ ID NO: 6949876 - DNA, 22 bp, Homo sapiens
ttgaggagtacaaagcatgctt

SEQ ID NO: 6949877 - DNA, 20 bp, Homo sapiens
atttgcttaccttgtttcta

SEQ ID NO: 6949878 - DNA, 22 bp, Homo sapiens
tgaaggaatgagtatactgttt

SEQ ID NO: 6949879 - DNA, 22 bp, Homo sapiens
aggtcagggtattcacgtctgt

SEQ ID NO: 6949880 - DNA, 18 bp, Homo sapiens
agggatctagatggagtc

SEQ ID NO: 6949881 - DNA, 20 bp, Homo sapiens
cagaggagtacatatgttca

SEQ ID NO: 6949882 - DNA, 22 bp, Homo sapiens
cactgtatcttttccaaagtct

SEQ ID NO: 6949883 - DNA, 22 bp, Homo sapiens
aggcttcccagctgagctcagc

SEQ ID NO: 6949884 - DNA, 22 bp, Homo sapiens
ggctgtgggatgcataggagct

SEQ ID NO: 6949885 - DNA, 22 bp, Homo sapiens
cttggactttagtctctctcca

SEQ ID NO: 6949886 - DNA, 22 bp, Homo sapiens
atgatcagcagttttcagtgtt

SEQ ID NO: 6949887 - DNA, 22 bp, Homo sapiens
gtgattgagcaaaggaacagaa

SEQ ID NO: 6949888 - DNA, 22 bp, Homo sapiens
gagaattagggcgtaattcaga

SEQ ID NO: 6949889 - DNA, 22 bp, Homo sapiens
agattccagggggacattggag

SEQ ID NO: 6949890 - DNA, 22 bp, Homo sapiens
aggaagctccatgaaggcagag

SEQ ID NO: 6949891 - DNA, 22 bp, Homo sapiens
agttacatgtgaatagaaagta

SEQ ID NO: 6949892 - DNA, 22 bp, Homo sapiens
ctgctgctgtaaggcagaatta

SEQ ID NO: 6949893 - DNA, 22 bp, Homo sapiens
taggacatggacatcttcggtg

SEQ ID NO: 6949894 - DNA, 22 bp, Homo sapiens
ctggctgcattggcaagtcaat

SEQ ID NO: 6949895 - DNA, 22 bp, Homo sapiens
ctgaaatagtttcatagaactt

SEQ ID NO: 6949896 - DNA, 22 bp, Homo sapiens
gctggctgtggcttaagcaaac

SEQ ID NO: 6949897 - DNA, 22 bp, Homo sapiens
cagtgcctcaggccagcctgca

SEQ ID NO: 6949898 - DNA, 22 bp, Homo sapiens
atgctgtgcctggaaagcggct

SEQ ID NO: 6949899 - DNA, 22 bp, Homo sapiens
gctgtctttcccctgctccaga

SEQ ID NO: 6949900 - DNA, 22 bp, Homo sapiens
cacccacatggaaattcacagt

SEQ ID NO: 6949901 - DNA, 22 bp, Homo sapiens
ttcaggatgaaagtgtgcaaca

SEQ ID NO: 6949902 - DNA, 22 bp, Homo sapiens
taaagttcagtgcatgaatgtg

SEQ ID NO: 6949903 - DNA, 22 bp, Homo sapiens
cccagtaagaagctggcaccag

SEQ ID NO: 6949904 - DNA, 22 bp, Homo sapiens
ttgcatttttgagcacgaagtt

SEQ ID NO: 6949905 - DNA, 22 bp, Homo sapiens
tacaccttaatcatatgtgtct

SEQ ID NO: 6949906 - DNA, 22 bp, Homo sapiens
gttgtgcagggcgaggacctga

SEQ ID NO: 6949907 - DNA, 22 bp, Homo sapiens
agagttgcatagtgcttttaag

SEQ ID NO: 6949908 - DNA, 22 bp, Homo sapiens
agtcttaatagagaaaaactgt

SEQ ID NO: 6949909 - DNA, 22 bp, Homo sapiens
atttccttcagtgtttaatact

SEQ ID NO: 6949910 - DNA, 22 bp, Homo sapiens
ctgaaaggcagtgggtagtgtg

SEQ ID NO: 6949911 - DNA, 22 bp, Homo sapiens
cagggctgttagctgctgctct

SEQ ID NO: 6949912 - DNA, 22 bp, Homo sapiens
aaaggcccacagtcagtctacc

SEQ ID NO: 6949913 - DNA, 22 bp, Homo sapiens
ccctggacacacacttttattc

SEQ ID NO: 6949914 - DNA, 22 bp, Homo sapiens
aatttagtccttacagtgcaga

SEQ ID NO: 6949915 - DNA, 22 bp, Homo sapiens
cagcttctaccatcaggaaatt

SEQ ID NO: 6949916 - DNA, 23 bp, Homo sapiens
ttggtttacaggaataagcaggg

SEQ ID NO: 6949917 - DNA, 23 bp, Homo sapiens
ccagatttgccacgagagaggct

SEQ ID NO: 6949918 - DNA, 22 bp, Homo sapiens
gggacatgaagcatcggaggca

SEQ ID NO: 6949919 - DNA, 22 bp, Homo sapiens
ttgacagctattttgctttgat

SEQ ID NO: 6949920 - DNA, 22 bp, Homo sapiens
gcagtataagtggattatgtcc

SEQ ID NO: 6949921 - DNA, 22 bp, Homo sapiens
tgacaattgtgggcagtttgtg

SEQ ID NO: 6949922 - DNA, 22 bp, Homo sapiens
gaaagtcatggatgaacactac

SEQ ID NO: 6949923 - DNA, 22 bp, Homo sapiens
gccttggaaagctggagcagtt

SEQ ID NO: 6949924 - DNA, 21 bp, Homo sapiens
aggcaattcgaagttgcagac

SEQ ID NO: 6949925 - DNA, 22 bp, Homo sapiens
atatatcatgagtaaaacttga

SEQ ID NO: 6949926 - DNA, 22 bp, Homo sapiens
tggagagtctcaaggcaggaaa

SEQ ID NO: 6949927 - DNA, 22 bp, Homo sapiens
taaggacaatttgtcgcttgca

SEQ ID NO: 6949928 - DNA, 22 bp, Homo sapiens
gcgcactgggcgcacgcgtagg

SEQ ID NO: 6949929 - DNA, 22 bp, Homo sapiens
cgttgtgagcttggtagacact

SEQ ID NO: 6949930 - DNA, 22 bp, Homo sapiens
atttggctagcttatggttata

SEQ ID NO: 6949931 - DNA, 22 bp, Homo sapiens
agaaacaacttgtttctcttgc

SEQ ID NO: 6949932 - DNA, 22 bp, Homo sapiens
ctgaggtgtgaaatggtggcaa

SEQ ID NO: 6949933 - DNA, 22 bp, Homo sapiens
tctgaggtgtcacaaggccagg

SEQ ID NO: 6949934 - DNA, 22 bp, Homo sapiens
cagagctttttacattaatgat

SEQ ID NO: 6949935 - DNA, 18 bp, Homo sapiens
tgaactttggtgtctctc

SEQ ID NO: 6949936 - DNA, 22 bp, Homo sapiens
ttcaacagatatttattgagca

SEQ ID NO: 6949937 - DNA, 22 bp, Homo sapiens
cagctggcttgtttgttcttga

SEQ ID NO: 6949938 - DNA, 22 bp, Homo sapiens
actgtgtctcacagtggtacca

SEQ ID NO: 6949939 - DNA, 22 bp, Homo sapiens
gcagtaaaaaaggatatgtgca

SEQ ID NO: 6949940 - DNA, 22 bp, Homo sapiens
cctggctctgggatcttcgctt

SEQ ID NO: 6949941 - DNA, 23 bp, Homo sapiens
tcctgaggaatggcatctcacat

SEQ ID NO: 6949942 - DNA, 22 bp, Homo sapiens
tcctgccatcccacccggctca

SEQ ID NO: 6949943 - DNA, 21 bp, Homo sapiens
ggaagcagtggcggcaactcc

SEQ ID NO: 6949944 - DNA, 22 bp, Homo sapiens
gccaatctttgactatatgtgt

SEQ ID NO: 6949945 - DNA, 22 bp, Homo sapiens
ggcagtgttatttttcagaaat

SEQ ID NO: 6949946 - DNA, 22 bp, Homo sapiens
tctagcaagctcgtgctcaagg

SEQ ID NO: 6949947 - DNA, 22 bp, Homo sapiens
gagctggtcagtttcaggagag

SEQ ID NO: 6949948 - DNA, 22 bp, Homo sapiens
tgggaagggccgatggagcctc

SEQ ID NO: 6949949 - DNA, 22 bp, Homo sapiens
atcctgggcaaagtatgctgtc

SEQ ID NO: 6949950 - DNA, 22 bp, Homo sapiens
tttcttgtttcatggtgtctca

SEQ ID NO: 6949951 - DNA, 21 bp, Homo sapiens
ttattgagacatttgtggaaa

SEQ ID NO: 6949952 - DNA, 22 bp, Homo sapiens
tctgcaccatcgtatgcttaat

SEQ ID NO: 6949953 - DNA, 22 bp, Homo sapiens
catgcattgtaatttttagtct

SEQ ID NO: 6949954 - DNA, 22 bp, Homo sapiens
ttcctttgggttaagacatctg

SEQ ID NO: 6949955 - DNA, 20 bp, Homo sapiens
ccccgtgtttagcatatcat

SEQ ID NO: 6949956 - DNA, 22 bp, Homo sapiens
catctgtaaagtaggaatattg

SEQ ID NO: 6949957 - DNA, 22 bp, Homo sapiens
gtgggcagattatagatgatgc

SEQ ID NO: 6949958 - DNA, 22 bp, Homo sapiens
caggcacagtggggtcctctct

SEQ ID NO: 6949959 - DNA, 22 bp, Homo sapiens
ccagctggaagagtgcagaact

SEQ ID NO: 6949960 - DNA, 20 bp, Homo sapiens
acatcaactagtcacagaca

SEQ ID NO: 6949961 - DNA, 19 bp, Homo sapiens
catgagctgctcacttccc

SEQ ID NO: 6949962 - DNA, 21 bp, Homo sapiens
gcttggagtagcttgaaggag

SEQ ID NO: 6949963 - DNA, 22 bp, Homo sapiens
ataacaagtatttattgagcat

SEQ ID NO: 6949964 - DNA, 22 bp, Homo sapiens
cagctttgattctttctgccat

SEQ ID NO: 6949965 - DNA, 23 bp, Homo sapiens
ctagggcagtatttcacagacac

SEQ ID NO: 6949966 - DNA, 22 bp, Homo sapiens
gaggagggagctggaagctctt

SEQ ID NO: 6949967 - DNA, 23 bp, Homo sapiens
agagtggcctactcacactcatt

SEQ ID NO: 6949968 - DNA, 22 bp, Homo sapiens
caaggtcacataacttgtcaaa

SEQ ID NO: 6949969 - DNA, 22 bp, Homo sapiens
tctttcaatgagcattctttcc

SEQ ID NO: 6949970 - DNA, 22 bp, Homo sapiens
ctgcaatatgatgtctgagaaa

SEQ ID NO: 6949971 - DNA, 22 bp, Homo sapiens
aacatagagacaggaagtgctt

SEQ ID NO: 6949972 - DNA, 22 bp, Homo sapiens
tgtgctatttgactgtttgcta

SEQ ID NO: 6949973 - DNA, 22 bp, Homo sapiens
aaatcagtgctcatttgaaagg

SEQ ID NO: 6949974 - DNA, 22 bp, Homo sapiens
gctcaccaagcagagactctgg

SEQ ID NO: 6949975 - DNA, 22 bp, Homo sapiens
tctcagagattttgtttccctt

SEQ ID NO: 6949976 - DNA, 22 bp, Homo sapiens
tacagagatttattgctaaggc

SEQ ID NO: 6949977 - DNA, 22 bp, Homo sapiens
gtttgaaacatgcacctggagg

SEQ ID NO: 6949978 - DNA, 22 bp, Homo sapiens
acatttccacagactgaggtca

SEQ ID NO: 6949979 - DNA, 22 bp, Homo sapiens
ggggaggccagtggaccgtccc

SEQ ID NO: 6949980 - DNA, 22 bp, Homo sapiens
tccttaatatggaagagttctc

SEQ ID NO: 6949981 - DNA, 22 bp, Homo sapiens
tctggagccttggatgggaaag

SEQ ID NO: 6949982 - DNA, 22 bp, Homo sapiens
tctgtcttcttcattgcctata

SEQ ID NO: 6949983 - DNA, 22 bp, Homo sapiens
gaatagctgtaggctagtgtct

SEQ ID NO: 6949984 - DNA, 22 bp, Homo sapiens
cttcagaagcctgcagcctttg

SEQ ID NO: 6949985 - DNA, 22 bp, Homo sapiens
tctgaaattccttccagacttt

SEQ ID NO: 6949986 - DNA, 21 bp, Homo sapiens
tcctgtaagcttgggtggctc

SEQ ID NO: 6949987 - DNA, 22 bp, Homo sapiens
ccagtactttgtgcaacaaatg

SEQ ID NO: 6949988 - DNA, 22 bp, Homo sapiens
agaggggctcaagcagtggtct

SEQ ID NO: 6949989 - DNA, 22 bp, Homo sapiens
ttgactgtgatgggctcagctg

SEQ ID NO: 6949990 - DNA, 22 bp, Homo sapiens
cataacatgtacatataaatgc

SEQ ID NO: 6949991 - DNA, 22 bp, Homo sapiens
gtgtgtagatgtgagaggactg

SEQ ID NO: 6949992 - DNA, 22 bp, Homo sapiens
actcatcttccctcctggaggg

SEQ ID NO: 6949993 - DNA, 22 bp, Homo sapiens
ctgaggccggagcactgaagag

SEQ ID NO: 6949994 - DNA, 22 bp, Homo sapiens
accttagaaaatcaaaattaga

SEQ ID NO: 6949995 - DNA, 17 bp, Homo sapiens
tcaggctgtgcctggta

SEQ ID NO: 6949996 - DNA, 22 bp, Homo sapiens
accatgatgcatccttaaggaa

SEQ ID NO: 6949997 - DNA, 22 bp, Homo sapiens
tctcagttcttctcattccaga

SEQ ID NO: 6949998 - DNA, 22 bp, Homo sapiens
ccattaaacttgtggacccagt

SEQ ID NO: 6949999 - DNA, 22 bp, Homo sapiens
ttccaggactcgttctggctca

SEQ ID NO: 6950000 - DNA, 17 bp, Homo sapiens
gtcctacccatggtcta

SEQ ID NO: 6950001 - DNA, 22 bp, Homo sapiens
tgtcaaatagtagaaagatggc

SEQ ID NO: 6950002 - DNA, 23 bp, Homo sapiens
tctcaggacacacatgtctatca

SEQ ID NO: 6950003 - DNA, 22 bp, Homo sapiens
tagcaacctatggatagagaag

SEQ ID NO: 6950004 - DNA, 22 bp, Homo sapiens
tctgtagtctgtgccatagctg

SEQ ID NO: 6950005 - DNA, 22 bp, Homo sapiens
tacaagtgtaagcttgtgagac

SEQ ID NO: 6950006 - DNA, 22 bp, Homo sapiens
cagaagttcctatttacctcct

SEQ ID NO: 6950007 - DNA, 22 bp, Homo sapiens
tcaagttaggtggttgttagga

SEQ ID NO: 6950008 - DNA, 22 bp, Homo sapiens
tctgtaggcttacgcggcttct

SEQ ID NO: 6950009 - DNA, 20 bp, Homo sapiens
acatggtggggactcagagc

SEQ ID NO: 6950010 - DNA, 22 bp, Homo sapiens
atgacaaaattcacaggtgtga

SEQ ID NO: 6950011 - DNA, 22 bp, Homo sapiens
atacaagttgcccaaatgatta

SEQ ID NO: 6950012 - DNA, 22 bp, Homo sapiens
cactctgcctgatgttacatgg

SEQ ID NO: 6950013 - DNA, 22 bp, Homo sapiens
ttagttcagcctagttaagtac

SEQ ID NO: 6950014 - DNA, 22 bp, Homo sapiens
cgggctcagccagcccattctt

SEQ ID NO: 6950015 - DNA, 20 bp, Homo sapiens
cttagctagtaagaagctgt

SEQ ID NO: 6950016 - DNA, 22 bp, Homo sapiens
cttctcttcctttgtcaactga

SEQ ID NO: 6950017 - DNA, 16 bp, Homo sapiens
atgctgctattagagg

SEQ ID NO: 6950018 - DNA, 22 bp, Homo sapiens
gcagtgttaggaataaaaatga

SEQ ID NO: 6950019 - DNA, 22 bp, Homo sapiens
acagatcctggttacagccatt

SEQ ID NO: 6950020 - DNA, 22 bp, Homo sapiens
aaagccttttatgatcagttaa

SEQ ID NO: 6950021 - DNA, 22 bp, Homo sapiens
aatttaactgagagtactttta

SEQ ID NO: 6950022 - DNA, 22 bp, Homo sapiens
tcacagctgttttgtccattaa

SEQ ID NO: 6950023 - DNA, 22 bp, Homo sapiens
tgctcaatgtcttatgagactg

SEQ ID NO: 6950024 - DNA, 22 bp, Homo sapiens
cacagaacatccttagctcatg

SEQ ID NO: 6950025 - DNA, 22 bp, Homo sapiens
agtcaccattttcacctgcctc

SEQ ID NO: 6950026 - DNA, 22 bp, Homo sapiens
tgcaccttccacaagaactacc

SEQ ID NO: 6950027 - DNA, 22 bp, Homo sapiens
tagctttaaaaatcatcaaagc

SEQ ID NO: 6950028 - DNA, 16 bp, Homo sapiens
cacagttatgggtgtg

SEQ ID NO: 6950029 - DNA, 22 bp, Homo sapiens
ggaggagacggagtgattagtg

SEQ ID NO: 6950030 - DNA, 22 bp, Homo sapiens
gagttatttgtagggattatat

SEQ ID NO: 6950031 - DNA, 22 bp, Homo sapiens
tagctgttcatgtggctttatg

SEQ ID NO: 6950032 - DNA, 23 bp, Homo sapiens
caggaaatcaattcttccagcat

SEQ ID NO: 6950033 - DNA, 19 bp, Homo sapiens
cactgtcctagtcgaggcc

SEQ ID NO: 6950034 - DNA, 22 bp, Homo sapiens
tctgtgtgccctaaagcctgct

SEQ ID NO: 6950035 - DNA, 22 bp, Homo sapiens
ggcactggcaaagcaaagtctg

SEQ ID NO: 6950036 - DNA, 22 bp, Homo sapiens
tatattataagccctttcagaa

SEQ ID NO: 6950037 - DNA, 22 bp, Homo sapiens
tctcctaattaaatgctcttat

SEQ ID NO: 6950038 - DNA, 22 bp, Homo sapiens
gcacagcatgaagagaggaagc

SEQ ID NO: 6950039 - DNA, 22 bp, Homo sapiens
tacccagatatactttatgtta

SEQ ID NO: 6950040 - DNA, 22 bp, Homo sapiens
tatttcagggagaataaatttg

SEQ ID NO: 6950041 - DNA, 22 bp, Homo sapiens
ggacatcttggttgcttccaag

SEQ ID NO: 6950042 - DNA, 22 bp, Homo sapiens
ttgtcctgtgatttcagggcct

SEQ ID NO: 6950043 - DNA, 20 bp, Homo sapiens
ttcatttgggaaaatctgcg

SEQ ID NO: 6950044 - DNA, 22 bp, Homo sapiens
ttctggaaggatgtttctatct

SEQ ID NO: 6950045 - DNA, 22 bp, Homo sapiens
ccctctggctgtgtgttcttag

SEQ ID NO: 6950046 - DNA, 22 bp, Homo sapiens
atcagcattcccaaatgatgtg

SEQ ID NO: 6950047 - DNA, 22 bp, Homo sapiens
aggagcagattggtaagatcat

SEQ ID NO: 6950048 - DNA, 22 bp, Homo sapiens
tctacaagttgtgacttgatac

SEQ ID NO: 6950049 - DNA, 22 bp, Homo sapiens
tgggctcatgctggagatgaga

SEQ ID NO: 6950050 - DNA, 22 bp, Homo sapiens
tattgcatgtgatagaggcagg

SEQ ID NO: 6950051 - DNA, 22 bp, Homo sapiens
tccctttgatcactaacagaac

SEQ ID NO: 6950052 - DNA, 22 bp, Homo sapiens
tttgccagtattttattgatga

SEQ ID NO: 6950053 - DNA, 22 bp, Homo sapiens
ttctggaatgcctgttctaatt

SEQ ID NO: 6950054 - DNA, 22 bp, Homo sapiens
ttcttttcggcctgtgagaagg

SEQ ID NO: 6950055 - DNA, 22 bp, Homo sapiens
tctgattagcagtttagggaaa

SEQ ID NO: 6950056 - DNA, 22 bp, Homo sapiens
tcagaacctgcaagtctaacct

SEQ ID NO: 6950057 - DNA, 22 bp, Homo sapiens
atacatgttcgtgtacatgttc

SEQ ID NO: 6950058 - DNA, 22 bp, Homo sapiens
ggggggtgctgatcagtggagc

SEQ ID NO: 6950059 - DNA, 22 bp, Homo sapiens
ctggccagtgcctgtgggcccc

SEQ ID NO: 6950060 - DNA, 22 bp, Homo sapiens
cacgcatttattcacgtattcg

SEQ ID NO: 6950061 - DNA, 22 bp, Homo sapiens
cttgcacatttcacacaatagg

SEQ ID NO: 6950062 - DNA, 22 bp, Homo sapiens
taacatttaaatttttcacata

SEQ ID NO: 6950063 - DNA, 22 bp, Homo sapiens
caggatgggtgtcggccagcac

SEQ ID NO: 6950064 - DNA, 22 bp, Homo sapiens
aaggtgcctgtctgcaaacctg

SEQ ID NO: 6950065 - DNA, 22 bp, Homo sapiens
agaatatgatggttggagaatt

SEQ ID NO: 6950066 - DNA, 22 bp, Homo sapiens
gcctccccaagcagcagggatt

SEQ ID NO: 6950067 - DNA, 22 bp, Homo sapiens
tcacagtactgtgtgacttgag

SEQ ID NO: 6950068 - DNA, 22 bp, Homo sapiens
aggctctggctactacagagct

SEQ ID NO: 6950069 - DNA, 22 bp, Homo sapiens
ggcggggtctgagcgccgcgcc

SEQ ID NO: 6950070 - DNA, 22 bp, Homo sapiens
gactccatccaatctgtgttct

SEQ ID NO: 6950071 - DNA, 22 bp, Homo sapiens
accatgcacagctgttctatta

SEQ ID NO: 6950072 - DNA, 22 bp, Homo sapiens
aaataaactgaagcacagagag

SEQ ID NO: 6950073 - DNA, 22 bp, Homo sapiens
agtgtcaaggttgagaaaccct

SEQ ID NO: 6950074 - DNA, 19 bp, Homo sapiens
tgggcagctccctctgtcc

SEQ ID NO: 6950075 - DNA, 22 bp, Homo sapiens
ctcttgcttgcaagtggggata

SEQ ID NO: 6950076 - DNA, 22 bp, Homo sapiens
ataagcacacaaatacatatat

SEQ ID NO: 6950077 - DNA, 22 bp, Homo sapiens
cagagtttcggtaagcatagaa

SEQ ID NO: 6950078 - DNA, 22 bp, Homo sapiens
ttggccagatctgaggatactg

SEQ ID NO: 6950079 - DNA, 22 bp, Homo sapiens
tgggctctctttacctcataac

SEQ ID NO: 6950080 - DNA, 22 bp, Homo sapiens
tcttagaaatgaagttctttct

SEQ ID NO: 6950081 - DNA, 20 bp, Homo sapiens
tcagctctgtgcctgggatg

SEQ ID NO: 6950082 - DNA, 22 bp, Homo sapiens
ggatgctctcctcggcgtgacc

SEQ ID NO: 6950083 - DNA, 22 bp, Homo sapiens
aactgcaataacttgtgcacca

SEQ ID NO: 6950084 - DNA, 22 bp, Homo sapiens
cctctcccacgtggcagaggct

SEQ ID NO: 6950085 - DNA, 22 bp, Homo sapiens
gaggtggcctcaagcagtcttc

SEQ ID NO: 6950086 - DNA, 22 bp, Homo sapiens
cctgttcatgaaactgctttcc

SEQ ID NO: 6950087 - DNA, 17 bp, Homo sapiens
ctgatttattagcagac

SEQ ID NO: 6950088 - DNA, 22 bp, Homo sapiens
atgaaatgagtcaatgcgacta

SEQ ID NO: 6950089 - DNA, 22 bp, Homo sapiens
catgcagtgtgtatctacttaa

SEQ ID NO: 6950090 - DNA, 22 bp, Homo sapiens
tcctggcttccacacctgtcat

SEQ ID NO: 6950091 - DNA, 22 bp, Homo sapiens
ctgtaactctgccaagaaggct

SEQ ID NO: 6950092 - DNA, 22 bp, Homo sapiens
ctggcagcagcttctggatcga

SEQ ID NO: 6950093 - DNA, 22 bp, Homo sapiens
gtttccagccaatcccctcagg

SEQ ID NO: 6950094 - DNA, 20 bp, Homo sapiens
aaatccagtgtgtattttac

SEQ ID NO: 6950095 - DNA, 20 bp, Homo sapiens
gctgaagaagtagcatgtac

SEQ ID NO: 6950096 - DNA, 22 bp, Homo sapiens
ctgttctgctgcataaaaactt

SEQ ID NO: 6950097 - DNA, 22 bp, Homo sapiens
aaatgcttgctcttgattattt

SEQ ID NO: 6950098 - DNA, 22 bp, Homo sapiens
gctcttctcagattgtacactc

SEQ ID NO: 6950099 - DNA, 22 bp, Homo sapiens
ccttgggttccaagtcactgaa

SEQ ID NO: 6950100 - DNA, 17 bp, Homo sapiens
caggtcccagggtctct

SEQ ID NO: 6950101 - DNA, 22 bp, Homo sapiens
tgcagggccagactgggttgga

SEQ ID NO: 6950102 - DNA, 22 bp, Homo sapiens
agccatgggctcccagtccttt

SEQ ID NO: 6950103 - DNA, 22 bp, Homo sapiens
gcttgtcattactggtttctcg

SEQ ID NO: 6950104 - DNA, 20 bp, Homo sapiens
agccacctcatttccctacc

SEQ ID NO: 6950105 - DNA, 22 bp, Homo sapiens
caagcccccggcaagtgtgtat

SEQ ID NO: 6950106 - DNA, 22 bp, Homo sapiens
tgaggggcagagaggtgtccag

SEQ ID NO: 6950107 - DNA, 22 bp, Homo sapiens
atatgcatataaagcttttagt

SEQ ID NO: 6950108 - DNA, 22 bp, Homo sapiens
taattgtactccctgtgggaaa

SEQ ID NO: 6950109 - DNA, 22 bp, Homo sapiens
tcatccagttgtggagagggaa

SEQ ID NO: 6950110 - DNA, 22 bp, Homo sapiens
tctgacattagattaattggaa

SEQ ID NO: 6950111 - DNA, 23 bp, Homo sapiens
tgattctgctttgagaatcatgg

SEQ ID NO: 6950112 - DNA, 22 bp, Homo sapiens
tttcagaatatcgattcagtga

SEQ ID NO: 6950113 - DNA, 22 bp, Homo sapiens
cagatctgtttgccagatcagc

SEQ ID NO: 6950114 - DNA, 19 bp, Homo sapiens
gagaaagcaggcacagcac

SEQ ID NO: 6950115 - DNA, 22 bp, Homo sapiens
gagggctgcaatgagacagaga

SEQ ID NO: 6950116 - DNA, 22 bp, Homo sapiens
tgtataacacgcagttgagagg

SEQ ID NO: 6950117 - DNA, 22 bp, Homo sapiens
gagtataatgattttcattcac

SEQ ID NO: 6950118 - DNA, 22 bp, Homo sapiens
gctgctgcatgaacagcggtca

SEQ ID NO: 6950119 - DNA, 22 bp, Homo sapiens
ataggcatcaattttccttaag

SEQ ID NO: 6950120 - DNA, 22 bp, Homo sapiens
tcagtgtcccgtctcttaactc

SEQ ID NO: 6950121 - DNA, 22 bp, Homo sapiens
acacagtttaaacgattagtac

SEQ ID NO: 6950122 - DNA, 22 bp, Homo sapiens
tgcagaagaatgagcttggagt

SEQ ID NO: 6950123 - DNA, 23 bp, Homo sapiens
acctgcaaatttggtcctcttct

SEQ ID NO: 6950124 - DNA, 22 bp, Homo sapiens
tagcagaggcaaggatgtgaat

SEQ ID NO: 6950125 - DNA, 22 bp, Homo sapiens
ttattgtgtcttggtttatctt

SEQ ID NO: 6950126 - DNA, 22 bp, Homo sapiens
gagcacacactttgaaattagg

SEQ ID NO: 6950127 - DNA, 22 bp, Homo sapiens
gggtgacatttcccaatgagcc

SEQ ID NO: 6950128 - DNA, 22 bp, Homo sapiens
gtcctcttgctcattggggcag

SEQ ID NO: 6950129 - DNA, 22 bp, Homo sapiens
ttgacagcaaagattgtgccta

SEQ ID NO: 6950130 - DNA, 22 bp, Homo sapiens
gctgtctgtctctgtcccacca

SEQ ID NO: 6950131 - DNA, 22 bp, Homo sapiens
tcagctgcagtttcacaagcac

SEQ ID NO: 6950132 - DNA, 22 bp, Homo sapiens
tcagaggtcacacagcaagttt

SEQ ID NO: 6950133 - DNA, 21 bp, Homo sapiens
tttcgcatgtgttaactgtga

SEQ ID NO: 6950134 - DNA, 22 bp, Homo sapiens
gaagttctgaccatatggccaa

SEQ ID NO: 6950135 - DNA, 22 bp, Homo sapiens
aggcattcaggctatttgatca

SEQ ID NO: 6950136 - DNA, 21 bp, Homo sapiens
gtgctgaggatacagtagtaa

SEQ ID NO: 6950137 - DNA, 22 bp, Homo sapiens
aagttggaatctggaactgatc

SEQ ID NO: 6950138 - DNA, 22 bp, Homo sapiens
tactgtgtcttaggatgtggaa

SEQ ID NO: 6950139 - DNA, 20 bp, Homo sapiens
tgccctgtggaggggaaagg

SEQ ID NO: 6950140 - DNA, 22 bp, Homo sapiens
tggcagagaacacggctgatct

SEQ ID NO: 6950141 - DNA, 22 bp, Homo sapiens
atttttgccctgcagtacataa

SEQ ID NO: 6950142 - DNA, 22 bp, Homo sapiens
cgagtccagggttaggagtccg

SEQ ID NO: 6950143 - DNA, 22 bp, Homo sapiens
atggaggtgtttgataatttgg

SEQ ID NO: 6950144 - DNA, 22 bp, Homo sapiens
tccacatcaagggcagagaggt

SEQ ID NO: 6950145 - DNA, 22 bp, Homo sapiens
gtggctagttggcagagaacag

SEQ ID NO: 6950146 - DNA, 22 bp, Homo sapiens
tcaggaatgaggataaacattg

SEQ ID NO: 6950147 - DNA, 22 bp, Homo sapiens
gatgattttgatgcagtaaaga

SEQ ID NO: 6950148 - DNA, 22 bp, Homo sapiens
aagtgttttggcttctgtacac

SEQ ID NO: 6950149 - DNA, 20 bp, Homo sapiens
taggatgaaagtggtttctg

SEQ ID NO: 6950150 - DNA, 22 bp, Homo sapiens
ttagcacaattatttcagttgt

SEQ ID NO: 6950151 - DNA, 22 bp, Homo sapiens
taggccagcccttagtcctgtc

SEQ ID NO: 6950152 - DNA, 22 bp, Homo sapiens
acaatgcacctattttaaaact

SEQ ID NO: 6950153 - DNA, 22 bp, Homo sapiens
gctctagcaaggctggcctggg

SEQ ID NO: 6950154 - DNA, 19 bp, Homo sapiens
tgcataaattatatacttt

SEQ ID NO: 6950155 - DNA, 22 bp, Homo sapiens
tatgtgtctcagttgtgattga

SEQ ID NO: 6950156 - DNA, 22 bp, Homo sapiens
cattctctgatcttcacatacc

SEQ ID NO: 6950157 - DNA, 22 bp, Homo sapiens
atctttgatgtgtgcccattca

SEQ ID NO: 6950158 - DNA, 22 bp, Homo sapiens
tctgctgccatgcagagcagta

SEQ ID NO: 6950159 - DNA, 22 bp, Homo sapiens
tatttcacctaaaagtgtcaaa

SEQ ID NO: 6950160 - DNA, 22 bp, Homo sapiens
ccttttataaagttgtattgaa

SEQ ID NO: 6950161 - DNA, 22 bp, Homo sapiens
gtggctgggctccgagcggctt

SEQ ID NO: 6950162 - DNA, 22 bp, Homo sapiens
gtacattctgtggacttggaca

SEQ ID NO: 6950163 - DNA, 22 bp, Homo sapiens
ttctaatagctgcctatgtatt

SEQ ID NO: 6950164 - DNA, 22 bp, Homo sapiens
aagagagtcagtctgagcacca

SEQ ID NO: 6950165 - DNA, 19 bp, Homo sapiens
ggtcagctgggctagaggc

SEQ ID NO: 6950166 - DNA, 22 bp, Homo sapiens
agtgcctggaccccatgacata

SEQ ID NO: 6950167 - DNA, 22 bp, Homo sapiens
gcctgggtgctctgtgtaaggg

SEQ ID NO: 6950168 - DNA, 22 bp, Homo sapiens
tctgccaggtggggagaggcca

SEQ ID NO: 6950169 - DNA, 22 bp, Homo sapiens
gaatgcattctcttagcatcta

SEQ ID NO: 6950170 - DNA, 22 bp, Homo sapiens
tccaccatgtaacaagctctgt

SEQ ID NO: 6950171 - DNA, 21 bp, Homo sapiens
tttctttctggctctcacagt

SEQ ID NO: 6950172 - DNA, 22 bp, Homo sapiens
aaccagagaagaattatattgt

SEQ ID NO: 6950173 - DNA, 19 bp, Homo sapiens
tccaaaggacccacctcca

SEQ ID NO: 6950174 - DNA, 22 bp, Homo sapiens
agtcatccaagagcctgggcag

SEQ ID NO: 6950175 - DNA, 23 bp, Homo sapiens
gcagatgcttagcaggtcctctc

SEQ ID NO: 6950176 - DNA, 22 bp, Homo sapiens
gggagctggatgattgaggcaa

SEQ ID NO: 6950177 - DNA, 22 bp, Homo sapiens
aaggtgaggattttgttctgct

SEQ ID NO: 6950178 - DNA, 22 bp, Homo sapiens
tcccgcccttgtacttgccgag

SEQ ID NO: 6950179 - DNA, 20 bp, Homo sapiens
catgctgcctccattgatgc

SEQ ID NO: 6950180 - DNA, 22 bp, Homo sapiens
cctgtgcattgagtttgcaccc

SEQ ID NO: 6950181 - DNA, 19 bp, Homo sapiens
actgggaaaaaggcactgg

SEQ ID NO: 6950182 - DNA, 22 bp, Homo sapiens
agggctggcatctctaatgctg

SEQ ID NO: 6950183 - DNA, 22 bp, Homo sapiens
ctttgcataatgaatgatcata

SEQ ID NO: 6950184 - DNA, 22 bp, Homo sapiens
aggggacatttagcaatgacta

SEQ ID NO: 6950185 - DNA, 22 bp, Homo sapiens
tctaaacataactttgtgtgat

SEQ ID NO: 6950186 - DNA, 22 bp, Homo sapiens
tgggcactcagagttttcaaga

SEQ ID NO: 6950187 - DNA, 22 bp, Homo sapiens
aagtttgtgtagtttagcatcc

SEQ ID NO: 6950188 - DNA, 22 bp, Homo sapiens
ctgcatttcacatttaaacttt

SEQ ID NO: 6950189 - DNA, 17 bp, Homo sapiens
cacaggtgtggtttgag

SEQ ID NO: 6950190 - DNA, 22 bp, Homo sapiens
attgtggccacagagatccaat

SEQ ID NO: 6950191 - DNA, 22 bp, Homo sapiens
gcaggcttcccccacacctacg

SEQ ID NO: 6950192 - DNA, 22 bp, Homo sapiens
tcttctgtggctctcaccaccc

SEQ ID NO: 6950193 - DNA, 22 bp, Homo sapiens
tattagggtaaatttgacatgc

SEQ ID NO: 6950194 - DNA, 22 bp, Homo sapiens
tggaaggcagtgatattgttga

SEQ ID NO: 6950195 - DNA, 22 bp, Homo sapiens
tagcgttttgtaatcaagtatg

SEQ ID NO: 6950196 - DNA, 22 bp, Homo sapiens
tgccattgggcagtcattgaag

SEQ ID NO: 6950197 - DNA, 22 bp, Homo sapiens
gtgttaaacatgttcacagcat

SEQ ID NO: 6950198 - DNA, 22 bp, Homo sapiens
atttgctctagctgcagtgaat

SEQ ID NO: 6950199 - DNA, 22 bp, Homo sapiens
gttttcattactgctgtgattt

SEQ ID NO: 6950200 - DNA, 22 bp, Homo sapiens
tccaggctcagtcaagcacttc

SEQ ID NO: 6950201 - DNA, 22 bp, Homo sapiens
attattcatggtcttccacaat

SEQ ID NO: 6950202 - DNA, 22 bp, Homo sapiens
tttggcaaaactgtgtctatct

SEQ ID NO: 6950203 - DNA, 22 bp, Homo sapiens
tttctcggcagagatgatgggc

SEQ ID NO: 6950204 - DNA, 22 bp, Homo sapiens
tagtcaaatggcagggatattt

SEQ ID NO: 6950205 - DNA, 22 bp, Homo sapiens
ttttagaaggaatgctatggtg

SEQ ID NO: 6950206 - DNA, 18 bp, Homo sapiens
cttcctcatcgctctccc

SEQ ID NO: 6950207 - DNA, 22 bp, Homo sapiens
tggggacaggagacttacagct

SEQ ID NO: 6950208 - DNA, 22 bp, Homo sapiens
gatattgcatattggatgagtt

SEQ ID NO: 6950209 - DNA, 22 bp, Homo sapiens
ttgtgaatagtgctgcaataaa

SEQ ID NO: 6950210 - DNA, 22 bp, Homo sapiens
gcagcatttgtggaatgggccc

SEQ ID NO: 6950211 - DNA, 22 bp, Homo sapiens
tgggaaggaatggtgattaata

SEQ ID NO: 6950212 - DNA, 22 bp, Homo sapiens
agctcccagcagagctggccac

SEQ ID NO: 6950213 - DNA, 20 bp, Homo sapiens
aggggtctagcagcagtgct

SEQ ID NO: 6950214 - DNA, 23 bp, Homo sapiens
gcatcgcaggtctaagattagct

SEQ ID NO: 6950215 - DNA, 22 bp, Homo sapiens
cttctgtgatttggttaggata

SEQ ID NO: 6950216 - DNA, 22 bp, Homo sapiens
tggctcagagttcatcttttag

SEQ ID NO: 6950217 - DNA, 22 bp, Homo sapiens
gctgtaggtttttccaggagtt

SEQ ID NO: 6950218 - DNA, 22 bp, Homo sapiens
ttgctaatagaagatttgggaa

SEQ ID NO: 6950219 - DNA, 20 bp, Homo sapiens
ggaagccagcatccttgagg

SEQ ID NO: 6950220 - DNA, 22 bp, Homo sapiens
actgagaagattctcactctta

SEQ ID NO: 6950221 - DNA, 22 bp, Homo sapiens
acaagagtatctttgactttag

SEQ ID NO: 6950222 - DNA, 19 bp, Homo sapiens
taagtactttacaagtact

SEQ ID NO: 6950223 - DNA, 22 bp, Homo sapiens
atctttggccacttgtgctgca

SEQ ID NO: 6950224 - DNA, 22 bp, Homo sapiens
gccaggctgaggctctggaaga

SEQ ID NO: 6950225 - DNA, 22 bp, Homo sapiens
aatgaggctggctatggattaa

SEQ ID NO: 6950226 - DNA, 22 bp, Homo sapiens
tttcgggaaaaactggtaagac

SEQ ID NO: 6950227 - DNA, 22 bp, Homo sapiens
tgagtatacactcctaagggta

SEQ ID NO: 6950228 - DNA, 22 bp, Homo sapiens
gctacacaaaaggagagtgagt

SEQ ID NO: 6950229 - DNA, 22 bp, Homo sapiens
tcaaaggaaacgtggtcctggc

SEQ ID NO: 6950230 - DNA, 19 bp, Homo sapiens
gagaaaccccgtctttagg

SEQ ID NO: 6950231 - DNA, 22 bp, Homo sapiens
cagcttctgtttctagcccctg

SEQ ID NO: 6950232 - DNA, 22 bp, Homo sapiens
aacatcatcatgaacaactaat

SEQ ID NO: 6950233 - DNA, 19 bp, Homo sapiens
gccttaacctgttaagggg

SEQ ID NO: 6950234 - DNA, 22 bp, Homo sapiens
gctgtccttcctggctggggtg

SEQ ID NO: 6950235 - DNA, 18 bp, Homo sapiens
gcctgggaggaggaaatg

SEQ ID NO: 6950236 - DNA, 23 bp, Homo sapiens
aaactacatttatagtttttctc

SEQ ID NO: 6950237 - DNA, 20 bp, Homo sapiens
tggcggggatgagggagtta

SEQ ID NO: 6950238 - DNA, 22 bp, Homo sapiens
tgtgtcatattagtattgagag

SEQ ID NO: 6950239 - DNA, 22 bp, Homo sapiens
ggagttgatcagagtaggaggt

SEQ ID NO: 6950240 - DNA, 23 bp, Homo sapiens
tgtcattgtgactacagaaccag

SEQ ID NO: 6950241 - DNA, 22 bp, Homo sapiens
tcagtatccacaaatgctcaaa

SEQ ID NO: 6950242 - DNA, 23 bp, Homo sapiens
ttctggagaaaggaccatagctt

SEQ ID NO: 6950243 - DNA, 22 bp, Homo sapiens
gaacttcttctttaagagactc

SEQ ID NO: 6950244 - DNA, 22 bp, Homo sapiens
agaggcacccagttaagctgca

SEQ ID NO: 6950245 - DNA, 22 bp, Homo sapiens
tggtaaatgtctaacaatcact

SEQ ID NO: 6950246 - DNA, 19 bp, Homo sapiens
tgtgtctctgtgtagcctg

SEQ ID NO: 6950247 - DNA, 22 bp, Homo sapiens
ccaatcttgctgtccacttggt

SEQ ID NO: 6950248 - DNA, 22 bp, Homo sapiens
agttcccaaattacaggccaca

SEQ ID NO: 6950249 - DNA, 18 bp, Homo sapiens
tcctgggaaaggcataca

SEQ ID NO: 6950250 - DNA, 22 bp, Homo sapiens
tttcacaagtttcaggattctg

SEQ ID NO: 6950251 - DNA, 22 bp, Homo sapiens
tgctctggctggagcaatgact

SEQ ID NO: 6950252 - DNA, 22 bp, Homo sapiens
gtgcttcctaggtaagtaggta

SEQ ID NO: 6950253 - DNA, 22 bp, Homo sapiens
agatgaagatgccactaagacc

SEQ ID NO: 6950254 - DNA, 22 bp, Homo sapiens
aagttcaatcagatgaaaaagc

SEQ ID NO: 6950255 - DNA, 22 bp, Homo sapiens
atccattatctatcaacaggga

SEQ ID NO: 6950256 - DNA, 22 bp, Homo sapiens
gcagtccgctcacccgcattgg

SEQ ID NO: 6950257 - DNA, 22 bp, Homo sapiens
atagcaaaacccactgcattac

SEQ ID NO: 6950258 - DNA, 22 bp, Homo sapiens
cacccaggctggagagcagtgg

SEQ ID NO: 6950259 - DNA, 22 bp, Homo sapiens
taagtagtcctgatttaacctt

SEQ ID NO: 6950260 - DNA, 21 bp, Homo sapiens
tctgtactttgcttccatgct

SEQ ID NO: 6950261 - DNA, 22 bp, Homo sapiens
agggagagtagatatcaggtgt

SEQ ID NO: 6950262 - DNA, 22 bp, Homo sapiens
ccagaagtcaggaatgagtctt

SEQ ID NO: 6950263 - DNA, 22 bp, Homo sapiens
aaagccttcttgtatcgagcca

SEQ ID NO: 6950264 - DNA, 22 bp, Homo sapiens
tggcagatacccaggcaaatgg

SEQ ID NO: 6950265 - DNA, 22 bp, Homo sapiens
caagggacatttctcataggag

SEQ ID NO: 6950266 - DNA, 22 bp, Homo sapiens
atgtcctgttaaatagattgta

SEQ ID NO: 6950267 - DNA, 22 bp, Homo sapiens
ttgaacaatcaaaagaattcat

SEQ ID NO: 6950268 - DNA, 22 bp, Homo sapiens
ccttgcaggggaacaggcagtg

SEQ ID NO: 6950269 - DNA, 22 bp, Homo sapiens
attgcatatgcagcacatcagg

SEQ ID NO: 6950270 - DNA, 22 bp, Homo sapiens
gaaccatgagaaattgctattt

SEQ ID NO: 6950271 - DNA, 22 bp, Homo sapiens
gatgctgaagtgaagtgatctt

SEQ ID NO: 6950272 - DNA, 22 bp, Homo sapiens
ttcaaacaactcatttatgcaa

SEQ ID NO: 6950273 - DNA, 23 bp, Homo sapiens
tcagtagtgcattgaataagtgc

SEQ ID NO: 6950274 - DNA, 22 bp, Homo sapiens
aaatatgagagtaggagtttgg

SEQ ID NO: 6950275 - DNA, 22 bp, Homo sapiens
cctggcagcattggtagagatt

SEQ ID NO: 6950276 - DNA, 22 bp, Homo sapiens
gcttccatgtatgctcttgaca

SEQ ID NO: 6950277 - DNA, 22 bp, Homo sapiens
tgtttataaattttcttgccat

SEQ ID NO: 6950278 - DNA, 22 bp, Homo sapiens
agtgcagtggttaggagccagg

SEQ ID NO: 6950279 - DNA, 22 bp, Homo sapiens
catttgctggagatggaccaca

SEQ ID NO: 6950280 - DNA, 22 bp, Homo sapiens
gggctcactcatgcaactgcag

SEQ ID NO: 6950281 - DNA, 22 bp, Homo sapiens
tgcctgctgccactgctgttac

SEQ ID NO: 6950282 - DNA, 22 bp, Homo sapiens
tagcaagaaaacacaagaatta

SEQ ID NO: 6950283 - DNA, 22 bp, Homo sapiens
tcattgagcggttcttaaccca

SEQ ID NO: 6950284 - DNA, 22 bp, Homo sapiens
caagggctcttttgaggaatgt

SEQ ID NO: 6950285 - DNA, 22 bp, Homo sapiens
agctttcacgatttggaacagg

SEQ ID NO: 6950286 - DNA, 22 bp, Homo sapiens
atgcttggttcctacttctggc

SEQ ID NO: 6950287 - DNA, 22 bp, Homo sapiens
aggaaggctgatcactgcttgt

SEQ ID NO: 6950288 - DNA, 22 bp, Homo sapiens
aataaagccttattgattttac

SEQ ID NO: 6950289 - DNA, 22 bp, Homo sapiens
caacctgaattctgctttggca

SEQ ID NO: 6950290 - DNA, 22 bp, Homo sapiens
gtggcagtgtgaggatcctgct

SEQ ID NO: 6950291 - DNA, 22 bp, Homo sapiens
tggggctggctattgtctccct

SEQ ID NO: 6950292 - DNA, 22 bp, Homo sapiens
atggaatggcctgtcataatct

SEQ ID NO: 6950293 - DNA, 22 bp, Homo sapiens
ggtacacattgtgactgtatta

SEQ ID NO: 6950294 - DNA, 22 bp, Homo sapiens
ctctctggacctcaactatttt

SEQ ID NO: 6950295 - DNA, 22 bp, Homo sapiens
gtctgagaggagccaagtattg

SEQ ID NO: 6950296 - DNA, 22 bp, Homo sapiens
taattgctatttaatgtggtga

SEQ ID NO: 6950297 - DNA, 22 bp, Homo sapiens
gtatttcatcttgaaaaccagt

SEQ ID NO: 6950298 - DNA, 22 bp, Homo sapiens
atacatgatgggtgtatagttt

SEQ ID NO: 6950299 - DNA, 22 bp, Homo sapiens
tttttctcttctgtaaagtggt

SEQ ID NO: 6950300 - DNA, 22 bp, Homo sapiens
caagaagttgacagccaggtga

SEQ ID NO: 6950301 - DNA, 22 bp, Homo sapiens
ctcccagattcctgctgtggga

SEQ ID NO: 6950302 - DNA, 19 bp, Homo sapiens
agtgggtaatagaggctcc

SEQ ID NO: 6950303 - DNA, 22 bp, Homo sapiens
agctgtttccattcttgagtag

SEQ ID NO: 6950304 - DNA, 22 bp, Homo sapiens
caaatagattgttcaatcctga

SEQ ID NO: 6950305 - DNA, 22 bp, Homo sapiens
tggatttctccagctctccatt

SEQ ID NO: 6950306 - DNA, 22 bp, Homo sapiens
cagaaccttggtggtagggaca

SEQ ID NO: 6950307 - DNA, 22 bp, Homo sapiens
atcgagatgaaacgcatgtttt

SEQ ID NO: 6950308 - DNA, 19 bp, Homo sapiens
ctttgccactgataggagt

SEQ ID NO: 6950309 - DNA, 22 bp, Homo sapiens
tcaggaggacagataaggatag

SEQ ID NO: 6950310 - DNA, 22 bp, Homo sapiens
tggggtagggaaaagaagtcga

SEQ ID NO: 6950311 - DNA, 17 bp, Homo sapiens
ttattgctataagctga

SEQ ID NO: 6950312 - DNA, 22 bp, Homo sapiens
gagaggcagaggcctgaaaccg

SEQ ID NO: 6950313 - DNA, 22 bp, Homo sapiens
aagcagcattgtggtaggggag

SEQ ID NO: 6950314 - DNA, 22 bp, Homo sapiens
tattctgtgtgatatgtaaatg

SEQ ID NO: 6950315 - DNA, 22 bp, Homo sapiens
acacttggagcaacacttatgg

SEQ ID NO: 6950316 - DNA, 22 bp, Homo sapiens
gaaggaagtcattagtgcagac

SEQ ID NO: 6950317 - DNA, 22 bp, Homo sapiens
ttgtgagagtttaccttgacca

SEQ ID NO: 6950318 - DNA, 22 bp, Homo sapiens
acagagactaagcttttcatca

SEQ ID NO: 6950319 - DNA, 22 bp, Homo sapiens
ctagtattacatttttgtgtgt

SEQ ID NO: 6950320 - DNA, 19 bp, Homo sapiens
acactgtagatatagctat

SEQ ID NO: 6950321 - DNA, 22 bp, Homo sapiens
tctatgaagtgcgaagaggcac

SEQ ID NO: 6950322 - DNA, 22 bp, Homo sapiens
tctgggctcacgagtctggaca

SEQ ID NO: 6950323 - DNA, 22 bp, Homo sapiens
cactaagtaagctcctctacaa

SEQ ID NO: 6950324 - DNA, 22 bp, Homo sapiens
cgtcctgggtctgggaaggcat

SEQ ID NO: 6950325 - DNA, 22 bp, Homo sapiens
aagcaataagccagatttggat

SEQ ID NO: 6950326 - DNA, 22 bp, Homo sapiens
gcattttgaggctgggggagca

SEQ ID NO: 6950327 - DNA, 22 bp, Homo sapiens
ttagagtcaagctgcatgttct

SEQ ID NO: 6950328 - DNA, 22 bp, Homo sapiens
gctggtggtgggccagttctgt

SEQ ID NO: 6950329 - DNA, 22 bp, Homo sapiens
aggcagcagtcatgaggaaaga

SEQ ID NO: 6950330 - DNA, 17 bp, Homo sapiens
ggtctggggccattggc

SEQ ID NO: 6950331 - DNA, 22 bp, Homo sapiens
aggataagtttgattcttgcca

SEQ ID NO: 6950332 - DNA, 22 bp, Homo sapiens
gcactggattttgatctgcaag

SEQ ID NO: 6950333 - DNA, 21 bp, Homo sapiens
gcaggggatagaaatggtctg

SEQ ID NO: 6950334 - DNA, 22 bp, Homo sapiens
cttgatgtataagttgatatgt

SEQ ID NO: 6950335 - DNA, 22 bp, Homo sapiens
tgcagcctggcttcgcgcctcc

SEQ ID NO: 6950336 - DNA, 21 bp, Homo sapiens
cactccacttagaacagggtt

SEQ ID NO: 6950337 - DNA, 22 bp, Homo sapiens
tctgtctcctgccagtgcctct

SEQ ID NO: 6950338 - DNA, 22 bp, Homo sapiens
cttcttaatgcataaactgtgt

SEQ ID NO: 6950339 - DNA, 22 bp, Homo sapiens
gcagacaaagcagcatgcctat

SEQ ID NO: 6950340 - DNA, 22 bp, Homo sapiens
aatcacttagaacccaggaagt

SEQ ID NO: 6950341 - DNA, 22 bp, Homo sapiens
ttatgtgtgtgtatacatacaa

SEQ ID NO: 6950342 - DNA, 23 bp, Homo sapiens
gctgaatgtaatgttctttgggt

SEQ ID NO: 6950343 - DNA, 22 bp, Homo sapiens
ggcagccaggagggtgtagttt

SEQ ID NO: 6950344 - DNA, 22 bp, Homo sapiens
ctcccagggccatcgagtcact

SEQ ID NO: 6950345 - DNA, 22 bp, Homo sapiens
gcacaagcagcccactgacatt

SEQ ID NO: 6950346 - DNA, 22 bp, Homo sapiens
caggaagtggctgggctgggtt

SEQ ID NO: 6950347 - DNA, 22 bp, Homo sapiens
ccttccttgtctacaaaagctc

SEQ ID NO: 6950348 - DNA, 22 bp, Homo sapiens
agctatgtcatttggggctctg

SEQ ID NO: 6950349 - DNA, 22 bp, Homo sapiens
ggtcccatgaaagagggaggcc

SEQ ID NO: 6950350 - DNA, 22 bp, Homo sapiens
tgagcaggtgagtctagggcag

SEQ ID NO: 6950351 - DNA, 22 bp, Homo sapiens
ctgagagtagctggagaacatt

SEQ ID NO: 6950352 - DNA, 20 bp, Homo sapiens
ctttgcctattctctgcctg

SEQ ID NO: 6950353 - DNA, 22 bp, Homo sapiens
ttcagcaagtgtctctactgtc

SEQ ID NO: 6950354 - DNA, 22 bp, Homo sapiens
gctttagaaatgagtaaattag

SEQ ID NO: 6950355 - DNA, 22 bp, Homo sapiens
ttccaaggcagttttctctctg

SEQ ID NO: 6950356 - DNA, 22 bp, Homo sapiens
ttctagatagcacttttgagct

SEQ ID NO: 6950357 - DNA, 22 bp, Homo sapiens
gtggaggcagtgacacagtagc

SEQ ID NO: 6950358 - DNA, 22 bp, Homo sapiens
aaatgcctcccaaacagcacaa

SEQ ID NO: 6950359 - DNA, 22 bp, Homo sapiens
tttaccattattaaaattaagt

SEQ ID NO: 6950360 - DNA, 22 bp, Homo sapiens
ctattttctgtctctatagagt

SEQ ID NO: 6950361 - DNA, 22 bp, Homo sapiens
tggcatgcaagaggaggctccc

SEQ ID NO: 6950362 - DNA, 17 bp, Homo sapiens
tggtacaggctgaggga

SEQ ID NO: 6950363 - DNA, 22 bp, Homo sapiens
tggggtcctctcacttggaggg

SEQ ID NO: 6950364 - DNA, 22 bp, Homo sapiens
acgtgtaatgatcaccacaatc

SEQ ID NO: 6950365 - DNA, 22 bp, Homo sapiens
tcaggcagagtggaagctgcaa

SEQ ID NO: 6950366 - DNA, 22 bp, Homo sapiens
tttgcctctcagagtctacaca

SEQ ID NO: 6950367 - DNA, 22 bp, Homo sapiens
acatctcagaactgagtaaccg

SEQ ID NO: 6950368 - DNA, 22 bp, Homo sapiens
gagaacaggctctggagtcaga

SEQ ID NO: 6950369 - DNA, 22 bp, Homo sapiens
actttacccgcactcagacaca

SEQ ID NO: 6950370 - DNA, 22 bp, Homo sapiens
tttagcaaggagaaataatcct

SEQ ID NO: 6950371 - DNA, 22 bp, Homo sapiens
agtaatctgattttatagctat

SEQ ID NO: 6950372 - DNA, 19 bp, Homo sapiens
accttctgggaaacattcc

SEQ ID NO: 6950373 - DNA, 22 bp, Homo sapiens
gagtccttttgtgccacaggga

SEQ ID NO: 6950374 - DNA, 22 bp, Homo sapiens
agagctgtttattgatgtcaca

SEQ ID NO: 6950375 - DNA, 22 bp, Homo sapiens
gtgcagagcaagggctgagggc

SEQ ID NO: 6950376 - DNA, 17 bp, Homo sapiens
atctggctgcttctaga

SEQ ID NO: 6950377 - DNA, 22 bp, Homo sapiens
aagccctttttcctggtagttt

SEQ ID NO: 6950378 - DNA, 22 bp, Homo sapiens
ttgttctttatcctggaagcct

SEQ ID NO: 6950379 - DNA, 22 bp, Homo sapiens
tcctcagttttctagtatggca

SEQ ID NO: 6950380 - DNA, 22 bp, Homo sapiens
ctgaagaggctccgcccacaag

SEQ ID NO: 6950381 - DNA, 22 bp, Homo sapiens
ttagcattctctgtgtgcataa

SEQ ID NO: 6950382 - DNA, 20 bp, Homo sapiens
aaaaagacaaaacgagttgg

SEQ ID NO: 6950383 - DNA, 20 bp, Homo sapiens
gtgcaatggcaccatctcag

SEQ ID NO: 6950384 - DNA, 22 bp, Homo sapiens
cccagctgaacttgcattccaa

SEQ ID NO: 6950385 - DNA, 21 bp, Homo sapiens
taggactttacaatttaggaa

SEQ ID NO: 6950386 - DNA, 22 bp, Homo sapiens
acagcaggcccatactggaagg

SEQ ID NO: 6950387 - DNA, 22 bp, Homo sapiens
tgcaaggctgcagagggtgcta

SEQ ID NO: 6950388 - DNA, 22 bp, Homo sapiens
agggcatctctaacagtctcct

SEQ ID NO: 6950389 - DNA, 22 bp, Homo sapiens
gagctgcatgcaactgtttaaa

SEQ ID NO: 6950390 - DNA, 22 bp, Homo sapiens
actttcaagaacttctttaatg

SEQ ID NO: 6950391 - DNA, 22 bp, Homo sapiens
ccctgtgagtagggactggtgg

SEQ ID NO: 6950392 - DNA, 22 bp, Homo sapiens
aggcagatttaggagaaaagaa

SEQ ID NO: 6950393 - DNA, 22 bp, Homo sapiens
aggctggcggtgactgctctga

SEQ ID NO: 6950394 - DNA, 22 bp, Homo sapiens
aaagaaggtagggctggtgact

SEQ ID NO: 6950395 - DNA, 22 bp, Homo sapiens
cgtctagacagtttccaaaaga

SEQ ID NO: 6950396 - DNA, 22 bp, Homo sapiens
ctggctgaatcctagtctcata

SEQ ID NO: 6950397 - DNA, 22 bp, Homo sapiens
cactggttgaagttctgtatgg

SEQ ID NO: 6950398 - DNA, 22 bp, Homo sapiens
gccagctgtttcagagcccagt

SEQ ID NO: 6950399 - DNA, 22 bp, Homo sapiens
tggtccctaggaaagcagtgtt

SEQ ID NO: 6950400 - DNA, 22 bp, Homo sapiens
tactctggagttgagatgcgag

SEQ ID NO: 6950401 - DNA, 22 bp, Homo sapiens
ctggcacacagcaggctctcag

SEQ ID NO: 6950402 - DNA, 22 bp, Homo sapiens
cttagtgaggaatgaatttgtt

SEQ ID NO: 6950403 - DNA, 22 bp, Homo sapiens
tcactttgccctgtaccttggg

SEQ ID NO: 6950404 - DNA, 22 bp, Homo sapiens
ggtggcaccttgatcttggact

SEQ ID NO: 6950405 - DNA, 22 bp, Homo sapiens
ctgtggctggcctgtctgacat

SEQ ID NO: 6950406 - DNA, 22 bp, Homo sapiens
tatttccaggccccactctaga

SEQ ID NO: 6950407 - DNA, 22 bp, Homo sapiens
aaactactatgggaatgtactt

SEQ ID NO: 6950408 - DNA, 22 bp, Homo sapiens
taataaactgctacgcttagtt

SEQ ID NO: 6950409 - DNA, 22 bp, Homo sapiens
gtaggcagtgcttgattttcca

SEQ ID NO: 6950410 - DNA, 22 bp, Homo sapiens
accctcagagtaggcactgctg

SEQ ID NO: 6950411 - DNA, 22 bp, Homo sapiens
tctgataactctggccccaggc

SEQ ID NO: 6950412 - DNA, 22 bp, Homo sapiens
gcttagaagtacacatgccttt

SEQ ID NO: 6950413 - DNA, 22 bp, Homo sapiens
ctggttccaggatggatctttc

SEQ ID NO: 6950414 - DNA, 18 bp, Homo sapiens
aaggcttcaaagagtaga

SEQ ID NO: 6950415 - DNA, 22 bp, Homo sapiens
caagttacagcgctgacagcag

SEQ ID NO: 6950416 - DNA, 22 bp, Homo sapiens
gccttctgatcgctggactgac

SEQ ID NO: 6950417 - DNA, 22 bp, Homo sapiens
ttgcccttgtggagtttacatg

SEQ ID NO: 6950418 - DNA, 22 bp, Homo sapiens
ggagactcgggttctagccttg

SEQ ID NO: 6950419 - DNA, 22 bp, Homo sapiens
aaattccagcaacaccttttta

SEQ ID NO: 6950420 - DNA, 22 bp, Homo sapiens
tctggactaacagcagcctcag

SEQ ID NO: 6950421 - DNA, 22 bp, Homo sapiens
ggcctctgcttatgctgatgac

SEQ ID NO: 6950422 - DNA, 22 bp, Homo sapiens
gcactgggtgtgaggcagcgtc

SEQ ID NO: 6950423 - DNA, 21 bp, Homo sapiens
gcagttaatagcagagcacac

SEQ ID NO: 6950424 - DNA, 22 bp, Homo sapiens
ctcttgggtgggcagtgggcct

SEQ ID NO: 6950425 - DNA, 22 bp, Homo sapiens
tgtaaagttacttttgaaagga

SEQ ID NO: 6950426 - DNA, 22 bp, Homo sapiens
aggtctgcctcactcacttctg

SEQ ID NO: 6950427 - DNA, 22 bp, Homo sapiens
gggctggagagtcccacgtggg

SEQ ID NO: 6950428 - DNA, 22 bp, Homo sapiens
tggcctgctttcatttgatgct

SEQ ID NO: 6950429 - DNA, 22 bp, Homo sapiens
agaggctttctctgcttaggca

SEQ ID NO: 6950430 - DNA, 22 bp, Homo sapiens
acattaaacttgcttggctgta

SEQ ID NO: 6950431 - DNA, 22 bp, Homo sapiens
agactccaaaagtttggtggaa

SEQ ID NO: 6950432 - DNA, 22 bp, Homo sapiens
gtggccctctgatagggtcagg

SEQ ID NO: 6950433 - DNA, 18 bp, Homo sapiens
cctgttacacactggggt

SEQ ID NO: 6950434 - DNA, 22 bp, Homo sapiens
catcttgcttcatctgctgtgt

SEQ ID NO: 6950435 - DNA, 22 bp, Homo sapiens
atctggaggcctgtcttatccc

SEQ ID NO: 6950436 - DNA, 22 bp, Homo sapiens
gggtctgggcaggcgcttcctc

SEQ ID NO: 6950437 - DNA, 22 bp, Homo sapiens
tggcagtgtgtgagctgttatt

SEQ ID NO: 6950438 - DNA, 22 bp, Homo sapiens
agtagcatgtgcacagtaattt

SEQ ID NO: 6950439 - DNA, 22 bp, Homo sapiens
actgcaaacatagtacttgagc

SEQ ID NO: 6950440 - DNA, 22 bp, Homo sapiens
tacactgaatactagttttcct

SEQ ID NO: 6950441 - DNA, 22 bp, Homo sapiens
tagttctactcaaagtgtgatc

SEQ ID NO: 6950442 - DNA, 22 bp, Homo sapiens
tagttgaaagggattattgtgg

SEQ ID NO: 6950443 - DNA, 22 bp, Homo sapiens
tatatctaaatatgctgatcac

SEQ ID NO: 6950444 - DNA, 22 bp, Homo sapiens
ttccttagtgttagattctgtg

SEQ ID NO: 6950445 - DNA, 22 bp, Homo sapiens
tcctgcagagacagaggcctca

SEQ ID NO: 6950446 - DNA, 22 bp, Homo sapiens
gcgcgtcctccctcggctgctg

SEQ ID NO: 6950447 - DNA, 22 bp, Homo sapiens
cagatgcaggtctgctcacctg

SEQ ID NO: 6950448 - DNA, 22 bp, Homo sapiens
acagcttgtatcccaatggagc

SEQ ID NO: 6950449 - DNA, 22 bp, Homo sapiens
tagctttgacagttgcaggcag

SEQ ID NO: 6950450 - DNA, 21 bp, Homo sapiens
tagagaaaagaagctgttcct

SEQ ID NO: 6950451 - DNA, 22 bp, Homo sapiens
cagtttgcaaatgacttacaga

SEQ ID NO: 6950452 - DNA, 23 bp, Homo sapiens
tggggagggaagtcatttctgta

SEQ ID NO: 6950453 - DNA, 20 bp, Homo sapiens
tgatttgagaagctgctggt

SEQ ID NO: 6950454 - DNA, 22 bp, Homo sapiens
cagttctctttccactggaggc

SEQ ID NO: 6950455 - DNA, 22 bp, Homo sapiens
atccatttcctccactataaag

SEQ ID NO: 6950456 - DNA, 22 bp, Homo sapiens
gctgtttgaggcacatgattaa

SEQ ID NO: 6950457 - DNA, 22 bp, Homo sapiens
atccccagaaaataggtgccta

SEQ ID NO: 6950458 - DNA, 19 bp, Homo sapiens
cgtggcctgcactcgcagc

SEQ ID NO: 6950459 - DNA, 22 bp, Homo sapiens
atccaacacgtatttgctggcc

SEQ ID NO: 6950460 - DNA, 22 bp, Homo sapiens
cagggcaagtttgagattattt

SEQ ID NO: 6950461 - DNA, 22 bp, Homo sapiens
tgaggggaaggcatgataaata

SEQ ID NO: 6950462 - DNA, 22 bp, Homo sapiens
agcagcaggctgggatgagtct

SEQ ID NO: 6950463 - DNA, 22 bp, Homo sapiens
tgctggctgccaggttccctgt

SEQ ID NO: 6950464 - DNA, 20 bp, Homo sapiens
gggatgagagtcctagctct

SEQ ID NO: 6950465 - DNA, 22 bp, Homo sapiens
tccaggcataagccttgagtgt

SEQ ID NO: 6950466 - DNA, 22 bp, Homo sapiens
tattgctggaaaatggtgtgat

SEQ ID NO: 6950467 - DNA, 22 bp, Homo sapiens
ctttggtacgctttacatgttt

SEQ ID NO: 6950468 - DNA, 20 bp, Homo sapiens
gacaacacagcttcaggtcc

SEQ ID NO: 6950469 - DNA, 22 bp, Homo sapiens
gatgattttatgtcttgtcatt

SEQ ID NO: 6950470 - DNA, 18 bp, Homo sapiens
tcagggaagagaatatga

SEQ ID NO: 6950471 - DNA, 22 bp, Homo sapiens
tctctctgagttgagcaggagt

SEQ ID NO: 6950472 - DNA, 22 bp, Homo sapiens
agtctccacccatgacagtaca

SEQ ID NO: 6950473 - DNA, 22 bp, Homo sapiens
tgctctatctttgcttgaggga

SEQ ID NO: 6950474 - DNA, 22 bp, Homo sapiens
tgaaatgtttatctctcctgct

SEQ ID NO: 6950475 - DNA, 22 bp, Homo sapiens
ctgttggagtcattccttccag

SEQ ID NO: 6950476 - DNA, 22 bp, Homo sapiens
tggaacaatcccggtttagctc

SEQ ID NO: 6950477 - DNA, 22 bp, Homo sapiens
gtccctggtttgcccaggacca

SEQ ID NO: 6950478 - DNA, 18 bp, Homo sapiens
tcattcattaaacttggc

SEQ ID NO: 6950479 - DNA, 22 bp, Homo sapiens
cagagtggagaaagcatttagt

SEQ ID NO: 6950480 - DNA, 22 bp, Homo sapiens
acgttatatctgaaaaaagtga

SEQ ID NO: 6950481 - DNA, 22 bp, Homo sapiens
gatacattgagggtggaggacc

SEQ ID NO: 6950482 - DNA, 22 bp, Homo sapiens
tcatggaagatgtagggtcagg

SEQ ID NO: 6950483 - DNA, 22 bp, Homo sapiens
gcagtgcttgctcaggcttcat

SEQ ID NO: 6950484 - DNA, 22 bp, Homo sapiens
aagcttgcagggcataatttgc

SEQ ID NO: 6950485 - DNA, 22 bp, Homo sapiens
cagagtatctaactgatgggta

SEQ ID NO: 6950486 - DNA, 22 bp, Homo sapiens
tggccctgtctgcacacaggat

SEQ ID NO: 6950487 - DNA, 22 bp, Homo sapiens
cttttcacaggaggataagccc

SEQ ID NO: 6950488 - DNA, 22 bp, Homo sapiens
gcatgacatggcctgacttagg

SEQ ID NO: 6950489 - DNA, 22 bp, Homo sapiens
ctgggacagagcagcagtgggg

SEQ ID NO: 6950490 - DNA, 22 bp, Homo sapiens
atgtgaaaatccaatggcagca

SEQ ID NO: 6950491 - DNA, 22 bp, Homo sapiens
taactgaacagcctaattcttt

SEQ ID NO: 6950492 - DNA, 22 bp, Homo sapiens
ctggctcccggggatcgagcac

SEQ ID NO: 6950493 - DNA, 16 bp, Homo sapiens
acatggtagctctttg

SEQ ID NO: 6950494 - DNA, 22 bp, Homo sapiens
tcaggctctcagaccaacagca

SEQ ID NO: 6950495 - DNA, 22 bp, Homo sapiens
attgtcactggaagttctaaat

SEQ ID NO: 6950496 - DNA, 22 bp, Homo sapiens
aaatgtcagaaaacatggagtg

SEQ ID NO: 6950497 - DNA, 22 bp, Homo sapiens
agtaaaattaatggatcagaag

SEQ ID NO: 6950498 - DNA, 22 bp, Homo sapiens
ttccctgagtctccctgagtct

SEQ ID NO: 6950499 - DNA, 22 bp, Homo sapiens
gagcaggatgggagctggggcc

SEQ ID NO: 6950500 - DNA, 22 bp, Homo sapiens
acagatcacctgttagccaaaa

SEQ ID NO: 6950501 - DNA, 21 bp, Homo sapiens
gtatatgcatcctcgcttttc

SEQ ID NO: 6950502 - DNA, 22 bp, Homo sapiens
acagtacaaaacccaccagagg

SEQ ID NO: 6950503 - DNA, 22 bp, Homo sapiens
tttctagtctcgatctcttaat

SEQ ID NO: 6950504 - DNA, 22 bp, Homo sapiens
agctgagattgtttccatttct

SEQ ID NO: 6950505 - DNA, 22 bp, Homo sapiens
gtgggggtttcattaagacaat

SEQ ID NO: 6950506 - DNA, 22 bp, Homo sapiens
agctcctggcaaggtcatggtg

SEQ ID NO: 6950507 - DNA, 22 bp, Homo sapiens
tcttggggtagacctgagaatt

SEQ ID NO: 6950508 - DNA, 22 bp, Homo sapiens
agtctttatgattgtcaaagta

SEQ ID NO: 6950509 - DNA, 22 bp, Homo sapiens
agagtttgttgaatttacttgg

SEQ ID NO: 6950510 - DNA, 22 bp, Homo sapiens
attgtcttacatactgtggagg

SEQ ID NO: 6950511 - DNA, 22 bp, Homo sapiens
ggcatagatttctttaggttta

SEQ ID NO: 6950512 - DNA, 22 bp, Homo sapiens
taagggggaagatcatatttta

SEQ ID NO: 6950513 - DNA, 21 bp, Homo sapiens
tcaattatggatgtgtgcaaa

SEQ ID NO: 6950514 - DNA, 22 bp, Homo sapiens
tgctctgttcagtgtatcttgt

SEQ ID NO: 6950515 - DNA, 22 bp, Homo sapiens
tgctccatctctcgtggttcca

SEQ ID NO: 6950516 - DNA, 21 bp, Homo sapiens
aagcccttgaaatagatatat

SEQ ID NO: 6950517 - DNA, 22 bp, Homo sapiens
cagagcccttcctcccacgggg

SEQ ID NO: 6950518 - DNA, 22 bp, Homo sapiens
catgcacactgcaacaaggact

SEQ ID NO: 6950519 - DNA, 22 bp, Homo sapiens
aagagccagctagtgaagaggc

SEQ ID NO: 6950520 - DNA, 22 bp, Homo sapiens
tctgtgaatgtgaccttatttg

SEQ ID NO: 6950521 - DNA, 19 bp, Homo sapiens
cacagatgattgacacata

SEQ ID NO: 6950522 - DNA, 22 bp, Homo sapiens
cagagggttgatgtgaggctta

SEQ ID NO: 6950523 - DNA, 22 bp, Homo sapiens
tactcaatttcttatgggtttc

SEQ ID NO: 6950524 - DNA, 22 bp, Homo sapiens
tggaaagtgagacatatttata

SEQ ID NO: 6950525 - DNA, 22 bp, Homo sapiens
ggacacaggcagctgggtgggt

SEQ ID NO: 6950526 - DNA, 22 bp, Homo sapiens
cccaggctcactgtccgcttcc

SEQ ID NO: 6950527 - DNA, 22 bp, Homo sapiens
tgagacagcctctgcactcatg

SEQ ID NO: 6950528 - DNA, 22 bp, Homo sapiens
ggcctcagaaatagagtaaaat

SEQ ID NO: 6950529 - DNA, 22 bp, Homo sapiens
aggctctgggctctagattttg

SEQ ID NO: 6950530 - DNA, 22 bp, Homo sapiens
atgcattgtcaggcaatttcat

SEQ ID NO: 6950531 - DNA, 22 bp, Homo sapiens
cttagcaatttaactgactcta

SEQ ID NO: 6950532 - DNA, 22 bp, Homo sapiens
ctggagtgaagtctggcagctt

SEQ ID NO: 6950533 - DNA, 22 bp, Homo sapiens
gacattcattaagcctttctgt

SEQ ID NO: 6950534 - DNA, 22 bp, Homo sapiens
aatagaggtggcatgttataga

SEQ ID NO: 6950535 - DNA, 22 bp, Homo sapiens
cagttgcctactacatggcagg

SEQ ID NO: 6950536 - DNA, 22 bp, Homo sapiens
gcagggactgtgatctcacaga

SEQ ID NO: 6950537 - DNA, 22 bp, Homo sapiens
ttatatactgtggtagtactgt

SEQ ID NO: 6950538 - DNA, 22 bp, Homo sapiens
atgaattgtccgatgttgtgca

SEQ ID NO: 6950539 - DNA, 22 bp, Homo sapiens
tgagattcccattaattttata

SEQ ID NO: 6950540 - DNA, 22 bp, Homo sapiens
ggtttgacagcttggggctgtc

SEQ ID NO: 6950541 - DNA, 22 bp, Homo sapiens
agtggcagatctctggtctgga

SEQ ID NO: 6950542 - DNA, 22 bp, Homo sapiens
ttgagaagaaatagtttgcaat

SEQ ID NO: 6950543 - DNA, 22 bp, Homo sapiens
ggcagcttgtccttcaggagag

SEQ ID NO: 6950544 - DNA, 22 bp, Homo sapiens
tcactctgctgcccgagggctg

SEQ ID NO: 6950545 - DNA, 22 bp, Homo sapiens
gaaactgatattaactcagtgt

SEQ ID NO: 6950546 - DNA, 22 bp, Homo sapiens
tgctgcgggacccactgtgggc

SEQ ID NO: 6950547 - DNA, 22 bp, Homo sapiens
gcaggcaagaatttgggtctga

SEQ ID NO: 6950548 - DNA, 22 bp, Homo sapiens
atcaaaaccacctggagggctc

SEQ ID NO: 6950549 - DNA, 22 bp, Homo sapiens
tcctggttttcctgggacaggg

SEQ ID NO: 6950550 - DNA, 22 bp, Homo sapiens
gctgagtgattcatacgctgct

SEQ ID NO: 6950551 - DNA, 22 bp, Homo sapiens
tgttgctgacaagagaggagca

SEQ ID NO: 6950552 - DNA, 21 bp, Homo sapiens
tcagagtgtgttacagcaagc

SEQ ID NO: 6950553 - DNA, 22 bp, Homo sapiens
ctgcagggattgcttctgtata

SEQ ID NO: 6950554 - DNA, 22 bp, Homo sapiens
aagacacaatgtagcccagcac

SEQ ID NO: 6950555 - DNA, 22 bp, Homo sapiens
aatgatgacaggataaagaaca

SEQ ID NO: 6950556 - DNA, 22 bp, Homo sapiens
attggtcagagtaaatttattt

SEQ ID NO: 6950557 - DNA, 22 bp, Homo sapiens
tggaagacagtgactggttgtg

SEQ ID NO: 6950558 - DNA, 22 bp, Homo sapiens
tgggtcagaggacctcgtggcc

SEQ ID NO: 6950559 - DNA, 22 bp, Homo sapiens
taccttgagccgttgctgatga

SEQ ID NO: 6950560 - DNA, 22 bp, Homo sapiens
ttgagctttgaagttcaatatt

SEQ ID NO: 6950561 - DNA, 22 bp, Homo sapiens
ggtgtgattatgacatgtgact

SEQ ID NO: 6950562 - DNA, 22 bp, Homo sapiens
gataatgtgccgataatttcta

SEQ ID NO: 6950563 - DNA, 22 bp, Homo sapiens
ctctggagtcctgtatcactcc

SEQ ID NO: 6950564 - DNA, 22 bp, Homo sapiens
gaaccacacagtgcagtcagga

SEQ ID NO: 6950565 - DNA, 19 bp, Homo sapiens
atgctttatgttatttctt

SEQ ID NO: 6950566 - DNA, 22 bp, Homo sapiens
tcagtcttcaaatctgagtcgt

SEQ ID NO: 6950567 - DNA, 22 bp, Homo sapiens
cagctggtaggtagcagatttg

SEQ ID NO: 6950568 - DNA, 17 bp, Homo sapiens
ttttctctcttggattc

SEQ ID NO: 6950569 - DNA, 22 bp, Homo sapiens
agagtggcaccttacctgagac

SEQ ID NO: 6950570 - DNA, 22 bp, Homo sapiens
agtttagagttcaaattagttc

SEQ ID NO: 6950571 - DNA, 22 bp, Homo sapiens
aaagtgttgggattataggcgt

SEQ ID NO: 6950572 - DNA, 22 bp, Homo sapiens
ggcgagcagagcactgccagga

SEQ ID NO: 6950573 - DNA, 21 bp, Homo sapiens
agtgtgtgtggaatgagaata

SEQ ID NO: 6950574 - DNA, 22 bp, Homo sapiens
ggctctggagacatgtggagag

SEQ ID NO: 6950575 - DNA, 22 bp, Homo sapiens
tttagcttgatggcccggaata

SEQ ID NO: 6950576 - DNA, 22 bp, Homo sapiens
tgttactctggggttgtggtga

SEQ ID NO: 6950577 - DNA, 22 bp, Homo sapiens
tggcatgcattgtgggtaatta

SEQ ID NO: 6950578 - DNA, 22 bp, Homo sapiens
gcagcactgtcttgtcttagga

SEQ ID NO: 6950579 - DNA, 22 bp, Homo sapiens
atttcaacattctcagttgtag

SEQ ID NO: 6950580 - DNA, 22 bp, Homo sapiens
gtgcttcaagttcttaatgttt

SEQ ID NO: 6950581 - DNA, 22 bp, Homo sapiens
ttcaacattacacaggcaattc

SEQ ID NO: 6950582 - DNA, 22 bp, Homo sapiens
ggagggtgcagaccctttgcaa

SEQ ID NO: 6950583 - DNA, 22 bp, Homo sapiens
ctcctctgggtcctggtggcca

SEQ ID NO: 6950584 - DNA, 22 bp, Homo sapiens
tgcccagtctccgggccagccc

SEQ ID NO: 6950585 - DNA, 22 bp, Homo sapiens
gttggcaagtgttccttcctct

SEQ ID NO: 6950586 - DNA, 22 bp, Homo sapiens
gcggaggaaactgaggcaagag

SEQ ID NO: 6950587 - DNA, 22 bp, Homo sapiens
aagagagaccatgggggacagg

SEQ ID NO: 6950588 - DNA, 22 bp, Homo sapiens
atctgctatgttatttcccact

SEQ ID NO: 6950589 - DNA, 22 bp, Homo sapiens
atgtctgtttatccttcaagat

SEQ ID NO: 6950590 - DNA, 19 bp, Homo sapiens
ctgctttaggccttaaaag

SEQ ID NO: 6950591 - DNA, 22 bp, Homo sapiens
ggttttggctagaaatgcttaa

SEQ ID NO: 6950592 - DNA, 22 bp, Homo sapiens
tcttgtttctgtatataatgac

SEQ ID NO: 6950593 - DNA, 18 bp, Homo sapiens
tgctctgtttaatgattt

SEQ ID NO: 6950594 - DNA, 21 bp, Homo sapiens
gctcaaagggcttgccatgct

SEQ ID NO: 6950595 - DNA, 22 bp, Homo sapiens
gtatcctcagcaatcaacaaca

SEQ ID NO: 6950596 - DNA, 18 bp, Homo sapiens
ctgagggcagcccctggg

SEQ ID NO: 6950597 - DNA, 22 bp, Homo sapiens
aagtttgcatagattaagcatt

SEQ ID NO: 6950598 - DNA, 22 bp, Homo sapiens
tccttggaaatttcatcagaca

SEQ ID NO: 6950599 - DNA, 22 bp, Homo sapiens
aaacctctgaatactgttggca

SEQ ID NO: 6950600 - DNA, 22 bp, Homo sapiens
acaggaagctggagacccttga

SEQ ID NO: 6950601 - DNA, 22 bp, Homo sapiens
caacaccttgatcttggacttc

SEQ ID NO: 6950602 - DNA, 22 bp, Homo sapiens
tgacacagaatttggctatcac

SEQ ID NO: 6950603 - DNA, 22 bp, Homo sapiens
ttactgtgtttggctttagatg

SEQ ID NO: 6950604 - DNA, 22 bp, Homo sapiens
cagtaagtcaacaaacatgggg

SEQ ID NO: 6950605 - DNA, 23 bp, Homo sapiens
agtggctggacagactttcctgg

SEQ ID NO: 6950606 - DNA, 22 bp, Homo sapiens
gctgctgttccggctacagccc

SEQ ID NO: 6950607 - DNA, 22 bp, Homo sapiens
aagccagagtttttgagaactt

SEQ ID NO: 6950608 - DNA, 20 bp, Homo sapiens
agcttctgctgcctttcggc

SEQ ID NO: 6950609 - DNA, 22 bp, Homo sapiens
catcatatatttctacaagtgc

SEQ ID NO: 6950610 - DNA, 22 bp, Homo sapiens
tcaaatctcatcttgaattgta

SEQ ID NO: 6950611 - DNA, 22 bp, Homo sapiens
gacagctggacagacactgatg

SEQ ID NO: 6950612 - DNA, 22 bp, Homo sapiens
tggcgaggccaggccagggcct

SEQ ID NO: 6950613 - DNA, 22 bp, Homo sapiens
tttggtttttaatacaaagtac

SEQ ID NO: 6950614 - DNA, 22 bp, Homo sapiens
gcaaacagaaatgcaggacgct

SEQ ID NO: 6950615 - DNA, 23 bp, Homo sapiens
agtacatttgacccaaataagct

SEQ ID NO: 6950616 - DNA, 22 bp, Homo sapiens
cctggctcattatgtgccccca

SEQ ID NO: 6950617 - DNA, 22 bp, Homo sapiens
tgaaacaagggaccgtcctttc

SEQ ID NO: 6950618 - DNA, 22 bp, Homo sapiens
tcacaactctttccatttaata

SEQ ID NO: 6950619 - DNA, 22 bp, Homo sapiens
aagatgactatttatctgtaag

SEQ ID NO: 6950620 - DNA, 22 bp, Homo sapiens
ggcagctgtgaagtgcctcaca

SEQ ID NO: 6950621 - DNA, 22 bp, Homo sapiens
tgaatgtaccttgaaggtgtaa

SEQ ID NO: 6950622 - DNA, 22 bp, Homo sapiens
ttacagttactggtactgttaa

SEQ ID NO: 6950623 - DNA, 22 bp, Homo sapiens
cactgcactccagcctgggaga

SEQ ID NO: 6950624 - DNA, 22 bp, Homo sapiens
tttgaagtgcctcttgtggatt

SEQ ID NO: 6950625 - DNA, 22 bp, Homo sapiens
tctcttgggaggaaagagagaa

SEQ ID NO: 6950626 - DNA, 22 bp, Homo sapiens
gcagaggagcaagttgctacag

SEQ ID NO: 6950627 - DNA, 22 bp, Homo sapiens
tccacctgagtttcagttattt

SEQ ID NO: 6950628 - DNA, 22 bp, Homo sapiens
tgtggcatacacatgaggtggt

SEQ ID NO: 6950629 - DNA, 16 bp, Homo sapiens
acttttccaccttttt

SEQ ID NO: 6950630 - DNA, 22 bp, Homo sapiens
aggcttaacttaactttagagc

SEQ ID NO: 6950631 - DNA, 22 bp, Homo sapiens
aaagctctaagagaggtaggta

SEQ ID NO: 6950632 - DNA, 22 bp, Homo sapiens
ttcagtatctgcaaaatgggga

SEQ ID NO: 6950633 - DNA, 22 bp, Homo sapiens
tatgggtagaagtggcccaagc

SEQ ID NO: 6950634 - DNA, 22 bp, Homo sapiens
catggcagaaacctgagctgct

SEQ ID NO: 6950635 - DNA, 22 bp, Homo sapiens
aagtatacttaggcataatggt

SEQ ID NO: 6950636 - DNA, 22 bp, Homo sapiens
gattggtctactcaacagcaga

SEQ ID NO: 6950637 - DNA, 22 bp, Homo sapiens
ctgctatccttggtggtgacct

SEQ ID NO: 6950638 - DNA, 22 bp, Homo sapiens
aagcagcagccatcccccaagg

SEQ ID NO: 6950639 - DNA, 22 bp, Homo sapiens
atggccttattcaaggaagact

SEQ ID NO: 6950640 - DNA, 22 bp, Homo sapiens
ttctgtgtcttcttgttctgtg

SEQ ID NO: 6950641 - DNA, 22 bp, Homo sapiens
tagtttaggatccaatctaaga

SEQ ID NO: 6950642 - DNA, 22 bp, Homo sapiens
ttgaaacttagaaattgagctg

SEQ ID NO: 6950643 - DNA, 22 bp, Homo sapiens
tagaggtgttgacgccaaggta

SEQ ID NO: 6950644 - DNA, 22 bp, Homo sapiens
gagcacagaaggagaaatatgg

SEQ ID NO: 6950645 - DNA, 22 bp, Homo sapiens
ttccagaggctctaggggagaa

SEQ ID NO: 6950646 - DNA, 22 bp, Homo sapiens
ggagtgggcagcactgccctgt

SEQ ID NO: 6950647 - DNA, 22 bp, Homo sapiens
caaagtcagctgccagtcccaa

SEQ ID NO: 6950648 - DNA, 22 bp, Homo sapiens
tctgaacatgatgtcatctgga

SEQ ID NO: 6950649 - DNA, 23 bp, Homo sapiens
tcgttgaatagcaatagcacaac

SEQ ID NO: 6950650 - DNA, 22 bp, Homo sapiens
aagggcaggtgggcatttctgg

SEQ ID NO: 6950651 - DNA, 22 bp, Homo sapiens
tcagttttctcatctgtaattt

SEQ ID NO: 6950652 - DNA, 22 bp, Homo sapiens
tctagggtgtataaggaagcct

SEQ ID NO: 6950653 - DNA, 22 bp, Homo sapiens
agcaagcagaaatgccatggca

SEQ ID NO: 6950654 - DNA, 22 bp, Homo sapiens
gtttgacactgagataaataaa

SEQ ID NO: 6950655 - DNA, 22 bp, Homo sapiens
aggaattttacatctcagagag

SEQ ID NO: 6950656 - DNA, 22 bp, Homo sapiens
gtcagctaatagggtgtgtgtc

SEQ ID NO: 6950657 - DNA, 22 bp, Homo sapiens
acagaggctgatcttcaagccc

SEQ ID NO: 6950658 - DNA, 22 bp, Homo sapiens
tcactgtgtcctttctgcgtag

SEQ ID NO: 6950659 - DNA, 22 bp, Homo sapiens
gaataatattgactttgcaggc

SEQ ID NO: 6950660 - DNA, 22 bp, Homo sapiens
tatagttagtttcataatcatg

SEQ ID NO: 6950661 - DNA, 22 bp, Homo sapiens
tgggtgctctgcttccctgcac

SEQ ID NO: 6950662 - DNA, 22 bp, Homo sapiens
gggctgagacgatggggtcttc

SEQ ID NO: 6950663 - DNA, 22 bp, Homo sapiens
ttaaacaggtttttgaatggcc

SEQ ID NO: 6950664 - DNA, 22 bp, Homo sapiens
tccacatagtcattaatttctg

SEQ ID NO: 6950665 - DNA, 22 bp, Homo sapiens
aactgcaattacttttgcgcca

SEQ ID NO: 6950666 - DNA, 22 bp, Homo sapiens
gctccagatgaatgcacttgtt

SEQ ID NO: 6950667 - DNA, 22 bp, Homo sapiens
tctcacatgcaaacagtccaca

SEQ ID NO: 6950668 - DNA, 22 bp, Homo sapiens
tggagttcttgttctatgcaag

SEQ ID NO: 6950669 - DNA, 22 bp, Homo sapiens
gtttcatatatagtaactgaaa

SEQ ID NO: 6950670 - DNA, 22 bp, Homo sapiens
cgagatccttcagagcgcggac

SEQ ID NO: 6950671 - DNA, 21 bp, Homo sapiens
attgttatcattgtgctgtgt

SEQ ID NO: 6950672 - DNA, 22 bp, Homo sapiens
agggtggccccactttggttgg

SEQ ID NO: 6950673 - DNA, 22 bp, Homo sapiens
cagcctgagccttctgtagcaa

SEQ ID NO: 6950674 - DNA, 22 bp, Homo sapiens
ggcaggtgcttgtcgaaggcct

SEQ ID NO: 6950675 - DNA, 19 bp, Homo sapiens
tccagctgttttgagtcac

SEQ ID NO: 6950676 - DNA, 22 bp, Homo sapiens
attgaagatcagggaaagattc

SEQ ID NO: 6950677 - DNA, 22 bp, Homo sapiens
tggtgtcatggacctggtgcct

SEQ ID NO: 6950678 - DNA, 22 bp, Homo sapiens
gtgtcatgggagtcagaagtga

SEQ ID NO: 6950679 - DNA, 22 bp, Homo sapiens
ggttacatagtaaggtcctatt

SEQ ID NO: 6950680 - DNA, 22 bp, Homo sapiens
gagggtgtctggatgctagact

SEQ ID NO: 6950681 - DNA, 22 bp, Homo sapiens
atcaggatgactataaggctgc

SEQ ID NO: 6950682 - DNA, 22 bp, Homo sapiens
gaagttcactggctacattcca

SEQ ID NO: 6950683 - DNA, 22 bp, Homo sapiens
gggtagtgtggtctctgggctg

SEQ ID NO: 6950684 - DNA, 22 bp, Homo sapiens
tagcgatcaggattaaagtcca

SEQ ID NO: 6950685 - DNA, 22 bp, Homo sapiens
caatgtaaatattttctaatca

SEQ ID NO: 6950686 - DNA, 22 bp, Homo sapiens
actttctgttagatgaatggat

SEQ ID NO: 6950687 - DNA, 22 bp, Homo sapiens
tgggtgagcggctgcacacccg

SEQ ID NO: 6950688 - DNA, 22 bp, Homo sapiens
tctccgtgccgtgggaggctcc

SEQ ID NO: 6950689 - DNA, 22 bp, Homo sapiens
ctggctgtttcaggcagtgtcc

SEQ ID NO: 6950690 - DNA, 22 bp, Homo sapiens
gcactttatagtagaaagagca

SEQ ID NO: 6950691 - DNA, 17 bp, Homo sapiens
ctggtcccaccaagccc

SEQ ID NO: 6950692 - DNA, 22 bp, Homo sapiens
tgtctccattttcaagtagcag

SEQ ID NO: 6950693 - DNA, 22 bp, Homo sapiens
actgctttatctgagaagtcct

SEQ ID NO: 6950694 - DNA, 22 bp, Homo sapiens
gagggccagcagcctcagcatg

SEQ ID NO: 6950695 - DNA, 22 bp, Homo sapiens
acactacaatctcagaactata

SEQ ID NO: 6950696 - DNA, 22 bp, Homo sapiens
aattagggaagtatttagtagt

SEQ ID NO: 6950697 - DNA, 22 bp, Homo sapiens
acactgttcctgaaattgttat

SEQ ID NO: 6950698 - DNA, 22 bp, Homo sapiens
tcaggaagattagtttcctacc

SEQ ID NO: 6950699 - DNA, 22 bp, Homo sapiens
gacttcaacttctggggagcaa

SEQ ID NO: 6950700 - DNA, 20 bp, Homo sapiens
tggccacctgcgtcccagcc

SEQ ID NO: 6950701 - DNA, 22 bp, Homo sapiens
ctgcaaggagttgacattgtct

SEQ ID NO: 6950702 - DNA, 22 bp, Homo sapiens
gcttgctggtgcctgcaggctc

SEQ ID NO: 6950703 - DNA, 22 bp, Homo sapiens
gctacacaatagcgttcactta

SEQ ID NO: 6950704 - DNA, 22 bp, Homo sapiens
ttagttcactgctatatcatca

SEQ ID NO: 6950705 - DNA, 22 bp, Homo sapiens
aacaggccctaggaattgggcc

SEQ ID NO: 6950706 - DNA, 22 bp, Homo sapiens
aggcctcctgcagggatgagtg

SEQ ID NO: 6950707 - DNA, 23 bp, Homo sapiens
tcaaatcccagctctaccacttc

SEQ ID NO: 6950708 - DNA, 22 bp, Homo sapiens
aagcagtcttggctgggttcag

SEQ ID NO: 6950709 - DNA, 22 bp, Homo sapiens
gaagcagctcagattgactgaa

SEQ ID NO: 6950710 - DNA, 19 bp, Homo sapiens
acagagtgatgaggataga

SEQ ID NO: 6950711 - DNA, 22 bp, Homo sapiens
attgaaagatatactgttctca

SEQ ID NO: 6950712 - DNA, 22 bp, Homo sapiens
gctctctccctaggcaagtgag

SEQ ID NO: 6950713 - DNA, 22 bp, Homo sapiens
cctggctgtttatttcggggct

SEQ ID NO: 6950714 - DNA, 22 bp, Homo sapiens
tacactgtgtaaaatgcacttt

SEQ ID NO: 6950715 - DNA, 15 bp, Homo sapiens
accatacaattctat

SEQ ID NO: 6950716 - DNA, 20 bp, Homo sapiens
cagtcctgcaggcgggagaa

SEQ ID NO: 6950717 - DNA, 22 bp, Homo sapiens
agggaagccctggctgagaccc

SEQ ID NO: 6950718 - DNA, 22 bp, Homo sapiens
ggggcccctgtggcttgatgcc

SEQ ID NO: 6950719 - DNA, 22 bp, Homo sapiens
aggcagcagaggttgaggaaag

SEQ ID NO: 6950720 - DNA, 21 bp, Homo sapiens
ggagttctgcgtttaaagggg

SEQ ID NO: 6950721 - DNA, 22 bp, Homo sapiens
gaagctggctgaagttcagcta

SEQ ID NO: 6950722 - DNA, 22 bp, Homo sapiens
tgaagatctgtcaaccccatat

SEQ ID NO: 6950723 - DNA, 22 bp, Homo sapiens
ttactttgcatttgtggtagtc

SEQ ID NO: 6950724 - DNA, 22 bp, Homo sapiens
aaggcctgggaggcctctcttc

SEQ ID NO: 6950725 - DNA, 22 bp, Homo sapiens
taagaatagtccctagatgtgt

SEQ ID NO: 6950726 - DNA, 22 bp, Homo sapiens
agaaccatgagtttgagtatct

SEQ ID NO: 6950727 - DNA, 22 bp, Homo sapiens
tccttgggtcagtgagtgaggt

SEQ ID NO: 6950728 - DNA, 22 bp, Homo sapiens
gtagaataaatgtacacatctg

SEQ ID NO: 6950729 - DNA, 22 bp, Homo sapiens
gaccaggagatttgagctaggc

SEQ ID NO: 6950730 - DNA, 19 bp, Homo sapiens
tggtgcgcccggcccttct

SEQ ID NO: 6950731 - DNA, 20 bp, Homo sapiens
ctaggaactatggtctggct

SEQ ID NO: 6950732 - DNA, 22 bp, Homo sapiens
aaggtcttaagaactgctacat

SEQ ID NO: 6950733 - DNA, 22 bp, Homo sapiens
tccaggagtttgagactgcagt

SEQ ID NO: 6950734 - DNA, 22 bp, Homo sapiens
gggtcgctgccgctgctggacc

SEQ ID NO: 6950735 - DNA, 18 bp, Homo sapiens
tgtatttctaacagctaa

SEQ ID NO: 6950736 - DNA, 22 bp, Homo sapiens
ccatgcagtgctggagctgatt

SEQ ID NO: 6950737 - DNA, 22 bp, Homo sapiens
tgctcaagtgtttgttgaatgg

SEQ ID NO: 6950738 - DNA, 22 bp, Homo sapiens
aacttgttagaaatgcagaatc

SEQ ID NO: 6950739 - DNA, 22 bp, Homo sapiens
tcctgcagctctgagaagcatc

SEQ ID NO: 6950740 - DNA, 22 bp, Homo sapiens
tttttggcccttagctctgtat

SEQ ID NO: 6950741 - DNA, 22 bp, Homo sapiens
tggccttgttctctctcccatc

SEQ ID NO: 6950742 - DNA, 22 bp, Homo sapiens
gtagtgggtggaaatgactaca

SEQ ID NO: 6950743 - DNA, 22 bp, Homo sapiens
tagctttgcctgaagtaatcag

SEQ ID NO: 6950744 - DNA, 22 bp, Homo sapiens
ctggaggaccacagaagctggt

SEQ ID NO: 6950745 - DNA, 22 bp, Homo sapiens
atatgtgtatttggttagccta

SEQ ID NO: 6950746 - DNA, 19 bp, Homo sapiens
gcagggtggcagagctctt

SEQ ID NO: 6950747 - DNA, 22 bp, Homo sapiens
aaggcatacatattgttatagg

SEQ ID NO: 6950748 - DNA, 22 bp, Homo sapiens
taagtcacttattccacaagat

SEQ ID NO: 6950749 - DNA, 22 bp, Homo sapiens
ctgggagcaagaggctgcaaat

SEQ ID NO: 6950750 - DNA, 22 bp, Homo sapiens
taactgatgttcccttactgta

SEQ ID NO: 6950751 - DNA, 22 bp, Homo sapiens
acattgttgtttgcagcacagg

SEQ ID NO: 6950752 - DNA, 22 bp, Homo sapiens
ctggataatcacagaggagcat

SEQ ID NO: 6950753 - DNA, 22 bp, Homo sapiens
aatcagcaaaggtcagctctaa

SEQ ID NO: 6950754 - DNA, 22 bp, Homo sapiens
tatcatgtgactccaatgtgga

SEQ ID NO: 6950755 - DNA, 22 bp, Homo sapiens
accactgcccatggtgaaaact

SEQ ID NO: 6950756 - DNA, 22 bp, Homo sapiens
taatagctgtgggaaataaaag

SEQ ID NO: 6950757 - DNA, 22 bp, Homo sapiens
gtctttggaggcactgttgagt

SEQ ID NO: 6950758 - DNA, 22 bp, Homo sapiens
tgtaacagttataacaatgtgg

SEQ ID NO: 6950759 - DNA, 22 bp, Homo sapiens
ggaatactttgttgtcttccaa

SEQ ID NO: 6950760 - DNA, 21 bp, Homo sapiens
ttgttacattcttatggcata

SEQ ID NO: 6950761 - DNA, 22 bp, Homo sapiens
gcatgtcatgtcatgtaggaat

SEQ ID NO: 6950762 - DNA, 22 bp, Homo sapiens
tctaggaggcacacaagtagtt

SEQ ID NO: 6950763 - DNA, 22 bp, Homo sapiens
aagacacaaagcttcccttttc

SEQ ID NO: 6950764 - DNA, 22 bp, Homo sapiens
acttgtctaccatgaatattta

SEQ ID NO: 6950765 - DNA, 22 bp, Homo sapiens
tttcatatgggcattggcaata

SEQ ID NO: 6950766 - DNA, 22 bp, Homo sapiens
cctcctggtgacaaggcaaagc

SEQ ID NO: 6950767 - DNA, 22 bp, Homo sapiens
ttgtggctcatcttcagctccc

SEQ ID NO: 6950768 - DNA, 22 bp, Homo sapiens
tcaatatttttatgagcataga

SEQ ID NO: 6950769 - DNA, 22 bp, Homo sapiens
tcttccagagcctccatcccta

SEQ ID NO: 6950770 - DNA, 22 bp, Homo sapiens
cagcctgtcggctccttcattc

SEQ ID NO: 6950771 - DNA, 22 bp, Homo sapiens
agggctcagttgcctggagccc

SEQ ID NO: 6950772 - DNA, 22 bp, Homo sapiens
aggatgtctctggaccaggatg

SEQ ID NO: 6950773 - DNA, 22 bp, Homo sapiens
gtatctacgtttgtgtgtacct

SEQ ID NO: 6950774 - DNA, 22 bp, Homo sapiens
tcagcagacctgttatttggat

SEQ ID NO: 6950775 - DNA, 22 bp, Homo sapiens
agtgcataatgaaggagcttga

SEQ ID NO: 6950776 - DNA, 22 bp, Homo sapiens
tgctgctgtagctaggctttct

SEQ ID NO: 6950777 - DNA, 22 bp, Homo sapiens
gtgctcaggaagctgttcctgc

SEQ ID NO: 6950778 - DNA, 22 bp, Homo sapiens
cagtaagagttgacaatggcca

SEQ ID NO: 6950779 - DNA, 22 bp, Homo sapiens
agtaaagctactcactgtgggc

SEQ ID NO: 6950780 - DNA, 22 bp, Homo sapiens
ttcaccttgaatatgtcttaaa

SEQ ID NO: 6950781 - DNA, 22 bp, Homo sapiens
tttaggcagtcattgaacaagt

SEQ ID NO: 6950782 - DNA, 22 bp, Homo sapiens
tgattctgtctccttcactccg

SEQ ID NO: 6950783 - DNA, 22 bp, Homo sapiens
tcttgatttgtaaaagaaggat

SEQ ID NO: 6950784 - DNA, 22 bp, Homo sapiens
ctttatcagaaaacacattagg

SEQ ID NO: 6950785 - DNA, 22 bp, Homo sapiens
actaaatatttgagaggtgtag

SEQ ID NO: 6950786 - DNA, 22 bp, Homo sapiens
ggaatcagagcagaggctgtta

SEQ ID NO: 6950787 - DNA, 22 bp, Homo sapiens
ggcgagggaagtttactgtgag

SEQ ID NO: 6950788 - DNA, 22 bp, Homo sapiens
aatcaagaaaatgaggattctt

SEQ ID NO: 6950789 - DNA, 21 bp, Homo sapiens
tgaggatttcagtagatgcct

SEQ ID NO: 6950790 - DNA, 22 bp, Homo sapiens
tggagtcccactgggaactggg

SEQ ID NO: 6950791 - DNA, 22 bp, Homo sapiens
acatgtctgtaattattttagg

SEQ ID NO: 6950792 - DNA, 22 bp, Homo sapiens
tctttgttattgtgaatagggt

SEQ ID NO: 6950793 - DNA, 22 bp, Homo sapiens
ccaggagcgggaaaaggaagaa

SEQ ID NO: 6950794 - DNA, 22 bp, Homo sapiens
agtcttcatttagttgatccag

SEQ ID NO: 6950795 - DNA, 22 bp, Homo sapiens
taatgtcttcttttaatttggc

SEQ ID NO: 6950796 - DNA, 21 bp, Homo sapiens
tagcttcttgaggcttggccg

SEQ ID NO: 6950797 - DNA, 22 bp, Homo sapiens
ttgaaaactttctagaccaaga

SEQ ID NO: 6950798 - DNA, 22 bp, Homo sapiens
ttctggagaaaattctgtcatt

SEQ ID NO: 6950799 - DNA, 20 bp, Homo sapiens
gcttgctttgtctgatgggc

SEQ ID NO: 6950800 - DNA, 21 bp, Homo sapiens
tgtataacaactatgcaatgt

SEQ ID NO: 6950801 - DNA, 21 bp, Homo sapiens
agccagggtggacactgtatg

SEQ ID NO: 6950802 - DNA, 22 bp, Homo sapiens
ctccagtgctgtcatcccttcc

SEQ ID NO: 6950803 - DNA, 22 bp, Homo sapiens
ctgtgactggaatctggctctt

SEQ ID NO: 6950804 - DNA, 23 bp, Homo sapiens
agctgggaattttctgaagcttt

SEQ ID NO: 6950805 - DNA, 22 bp, Homo sapiens
gcttctatgcttcaagagagag

SEQ ID NO: 6950806 - DNA, 22 bp, Homo sapiens
aagtctttcataagtctcttat

SEQ ID NO: 6950807 - DNA, 22 bp, Homo sapiens
aggaaggaagagacaccatttg

SEQ ID NO: 6950808 - DNA, 22 bp, Homo sapiens
ccattttattagtgacatttag

SEQ ID NO: 6950809 - DNA, 22 bp, Homo sapiens
tcagggaccaccactcacccag

SEQ ID NO: 6950810 - DNA, 22 bp, Homo sapiens
ggttttattaccccttaaacac

SEQ ID NO: 6950811 - DNA, 22 bp, Homo sapiens
agccatgggagactgtgggaga

SEQ ID NO: 6950812 - DNA, 22 bp, Homo sapiens
taattgctaatcctgccttcta

SEQ ID NO: 6950813 - DNA, 22 bp, Homo sapiens
agcctggaggaggagttgagca

SEQ ID NO: 6950814 - DNA, 22 bp, Homo sapiens
tcatctgtcatccacaaagctg

SEQ ID NO: 6950815 - DNA, 22 bp, Homo sapiens
attatctaggaattgacagaag

SEQ ID NO: 6950816 - DNA, 18 bp, Homo sapiens
aaagttcagggagagttg

SEQ ID NO: 6950817 - DNA, 22 bp, Homo sapiens
caggcagagaccctctcctaaa

SEQ ID NO: 6950818 - DNA, 22 bp, Homo sapiens
tgctcgccccacatgccctcat

SEQ ID NO: 6950819 - DNA, 22 bp, Homo sapiens
tgtgagcactatggctaggctc

SEQ ID NO: 6950820 - DNA, 22 bp, Homo sapiens
acctctgcagtagggctgtgcc

SEQ ID NO: 6950821 - DNA, 22 bp, Homo sapiens
actagtattcttggtcttgtat

SEQ ID NO: 6950822 - DNA, 22 bp, Homo sapiens
aaggcttccactttgttgggtc

SEQ ID NO: 6950823 - DNA, 22 bp, Homo sapiens
aatagaacaataattgtaaact

SEQ ID NO: 6950824 - DNA, 22 bp, Homo sapiens
atctggaagattgaaggggagt

SEQ ID NO: 6950825 - DNA, 22 bp, Homo sapiens
tcacagcctggtcactctgccc

SEQ ID NO: 6950826 - DNA, 22 bp, Homo sapiens
ttacaggtacttgctgctgaaa

SEQ ID NO: 6950827 - DNA, 22 bp, Homo sapiens
gttgattccggggccatttcaa

SEQ ID NO: 6950828 - DNA, 22 bp, Homo sapiens
ttgagagtcgattttgaactag

SEQ ID NO: 6950829 - DNA, 22 bp, Homo sapiens
aagaacatgatggccatgtgca

SEQ ID NO: 6950830 - DNA, 22 bp, Homo sapiens
tttgtgtggtggatactgggta

SEQ ID NO: 6950831 - DNA, 22 bp, Homo sapiens
aaagactgaggggaaagtgatg

SEQ ID NO: 6950832 - DNA, 21 bp, Homo sapiens
tgcttccctgggccacactga

SEQ ID NO: 6950833 - DNA, 21 bp, Homo sapiens
aggcttagcaatttcctatgg

SEQ ID NO: 6950834 - DNA, 22 bp, Homo sapiens
actcccttggtggagaatgcaa

SEQ ID NO: 6950835 - DNA, 22 bp, Homo sapiens
atgtttaaaggagtcagagact

SEQ ID NO: 6950836 - DNA, 22 bp, Homo sapiens
tagccgcgcttacctcgccgtg

SEQ ID NO: 6950837 - DNA, 21 bp, Homo sapiens
ggctttaaagcagaggagtga

SEQ ID NO: 6950838 - DNA, 19 bp, Homo sapiens
tggaggagaggaaaagtca

SEQ ID NO: 6950839 - DNA, 22 bp, Homo sapiens
tctctggacttccacctctatt

SEQ ID NO: 6950840 - DNA, 22 bp, Homo sapiens
ctgtggagttccatcaggggag

SEQ ID NO: 6950841 - DNA, 22 bp, Homo sapiens
atctgtatgttgacctcctaga

SEQ ID NO: 6950842 - DNA, 22 bp, Homo sapiens
tcagccccacggggtcagccaa

SEQ ID NO: 6950843 - DNA, 19 bp, Homo sapiens
ggctcagtgacataggtgc

SEQ ID NO: 6950844 - DNA, 22 bp, Homo sapiens
ctttggaaagtaagcagctaga

SEQ ID NO: 6950845 - DNA, 22 bp, Homo sapiens
tcagtaaatctctaattggcat

SEQ ID NO: 6950846 - DNA, 21 bp, Homo sapiens
tagtgtagctgcagcagcaga

SEQ ID NO: 6950847 - DNA, 22 bp, Homo sapiens
tggcagcattaattattcaggt

SEQ ID NO: 6950848 - DNA, 22 bp, Homo sapiens
aggtaggaaagtctccttgtat

SEQ ID NO: 6950849 - DNA, 20 bp, Homo sapiens
ctctggagttggggaacatt

SEQ ID NO: 6950850 - DNA, 22 bp, Homo sapiens
cttctgatctggattcctaact

SEQ ID NO: 6950851 - DNA, 22 bp, Homo sapiens
tttgtacatttcactccattgt

SEQ ID NO: 6950852 - DNA, 22 bp, Homo sapiens
tgtttcctaagtgtctctgaag

SEQ ID NO: 6950853 - DNA, 22 bp, Homo sapiens
ggttctttgtatatatcacttt

SEQ ID NO: 6950854 - DNA, 22 bp, Homo sapiens
ctgagcatttgtgcagcttctc

SEQ ID NO: 6950855 - DNA, 22 bp, Homo sapiens
ttggtctgtgttacatcattta

SEQ ID NO: 6950856 - DNA, 22 bp, Homo sapiens
tctttacatcacaattgtatgg

SEQ ID NO: 6950857 - DNA, 22 bp, Homo sapiens
ctgagtgatcagcttgggtccg

SEQ ID NO: 6950858 - DNA, 22 bp, Homo sapiens
agtgagtttagggtgcaggtgt

SEQ ID NO: 6950859 - DNA, 22 bp, Homo sapiens
tcccaggatgttggcggcaggt

SEQ ID NO: 6950860 - DNA, 22 bp, Homo sapiens
tgtatgtatacacatagatacg

SEQ ID NO: 6950861 - DNA, 22 bp, Homo sapiens
taaaagtggataagctgtagga

SEQ ID NO: 6950862 - DNA, 22 bp, Homo sapiens
gccctcgcttcttcctaggggt

SEQ ID NO: 6950863 - DNA, 22 bp, Homo sapiens
tgatgaatgtcatacataatga

SEQ ID NO: 6950864 - DNA, 16 bp, Homo sapiens
taggaaactgcatgtg

SEQ ID NO: 6950865 - DNA, 22 bp, Homo sapiens
tggaggatgagtgtgggctctg

SEQ ID NO: 6950866 - DNA, 22 bp, Homo sapiens
atgttcagttagcactgaagtc

SEQ ID NO: 6950867 - DNA, 22 bp, Homo sapiens
acagcactggtcccgcaagcct

SEQ ID NO: 6950868 - DNA, 22 bp, Homo sapiens
catctccaggtttagggagcac

SEQ ID NO: 6950869 - DNA, 22 bp, Homo sapiens
agccactgtgtgaccagctgtc

SEQ ID NO: 6950870 - DNA, 22 bp, Homo sapiens
aaaggctatgatagtccagtgg

SEQ ID NO: 6950871 - DNA, 22 bp, Homo sapiens
atggtcagttgcagctaatgtt

SEQ ID NO: 6950872 - DNA, 22 bp, Homo sapiens
ctctcagggcaggtggcctttc

SEQ ID NO: 6950873 - DNA, 22 bp, Homo sapiens
ctgttatttgctggaagagttt

SEQ ID NO: 6950874 - DNA, 18 bp, Homo sapiens
tgattggctcaaggctgt

SEQ ID NO: 6950875 - DNA, 19 bp, Homo sapiens
ttcataagtttagtgaggg

SEQ ID NO: 6950876 - DNA, 22 bp, Homo sapiens
tactgtctatacacttgattac

SEQ ID NO: 6950877 - DNA, 22 bp, Homo sapiens
ctgagaaatacccaagtctggt

SEQ ID NO: 6950878 - DNA, 22 bp, Homo sapiens
aaagctattcaacacgaacatg

SEQ ID NO: 6950879 - DNA, 22 bp, Homo sapiens
gccatgagaagaaatgaagggc

SEQ ID NO: 6950880 - DNA, 19 bp, Homo sapiens
gacctggccaagttactta

SEQ ID NO: 6950881 - DNA, 22 bp, Homo sapiens
ggggtgagatcaaggaagccct

SEQ ID NO: 6950882 - DNA, 22 bp, Homo sapiens
gaggctggaatattagaaatgt

SEQ ID NO: 6950883 - DNA, 22 bp, Homo sapiens
tgcagggaagcaagggtggctc

SEQ ID NO: 6950884 - DNA, 22 bp, Homo sapiens
taggaatgtttttatcaactta

SEQ ID NO: 6950885 - DNA, 22 bp, Homo sapiens
aggtaaaatagatagtatttct

SEQ ID NO: 6950886 - DNA, 22 bp, Homo sapiens
tccctctaaactgtaagattct

SEQ ID NO: 6950887 - DNA, 22 bp, Homo sapiens
tggggcagtggcttttcaccct

SEQ ID NO: 6950888 - DNA, 22 bp, Homo sapiens
agctgccatctgaagaactgca

SEQ ID NO: 6950889 - DNA, 22 bp, Homo sapiens
gctgtttccatttaagtgaatc

SEQ ID NO: 6950890 - DNA, 22 bp, Homo sapiens
ttgtgttttcttatggcataaa

SEQ ID NO: 6950891 - DNA, 22 bp, Homo sapiens
agatatgatgcatgtaaacatt

SEQ ID NO: 6950892 - DNA, 22 bp, Homo sapiens
tcacccctggcccagtcttgga

SEQ ID NO: 6950893 - DNA, 22 bp, Homo sapiens
catgtgcattggggccagggag

SEQ ID NO: 6950894 - DNA, 22 bp, Homo sapiens
gaaaatttctgccacatgtgtg

SEQ ID NO: 6950895 - DNA, 22 bp, Homo sapiens
ggtgctggacacgtggcactcc

SEQ ID NO: 6950896 - DNA, 22 bp, Homo sapiens
tgatcagacagttatgtgcatg

SEQ ID NO: 6950897 - DNA, 17 bp, Homo sapiens
tgaggcctgcatcagtg

SEQ ID NO: 6950898 - DNA, 22 bp, Homo sapiens
caacatattgtgggatgagaga

SEQ ID NO: 6950899 - DNA, 22 bp, Homo sapiens
ctgaggccgttggtgggcctta

SEQ ID NO: 6950900 - DNA, 22 bp, Homo sapiens
tctttgcacacatcccttcccg

SEQ ID NO: 6950901 - DNA, 22 bp, Homo sapiens
cattgttgttaaacatagtaat

SEQ ID NO: 6950902 - DNA, 22 bp, Homo sapiens
actctggcaagcttccacttcc

SEQ ID NO: 6950903 - DNA, 22 bp, Homo sapiens
cacagcctttagggtacacaca

SEQ ID NO: 6950904 - DNA, 22 bp, Homo sapiens
gcttctggaagcatatgcaaga

SEQ ID NO: 6950905 - DNA, 22 bp, Homo sapiens
tgaaatgtatattgccagtgta

SEQ ID NO: 6950906 - DNA, 22 bp, Homo sapiens
actgcctgccttccaggtactg

SEQ ID NO: 6950907 - DNA, 22 bp, Homo sapiens
taaatccagcttctaatttaga

SEQ ID NO: 6950908 - DNA, 22 bp, Homo sapiens
ggaacctttgtgaagggagagg

SEQ ID NO: 6950909 - DNA, 22 bp, Homo sapiens
ctgcaaataggaaaagggcata

SEQ ID NO: 6950910 - DNA, 22 bp, Homo sapiens
tttagagatgggagacaggaaa

SEQ ID NO: 6950911 - DNA, 22 bp, Homo sapiens
aggacagcagccattggcagtc

SEQ ID NO: 6950912 - DNA, 22 bp, Homo sapiens
tctgcacaggagggccgtggtg

SEQ ID NO: 6950913 - DNA, 22 bp, Homo sapiens
agagatctagcacctgctggtc

SEQ ID NO: 6950914 - DNA, 22 bp, Homo sapiens
tggcagataaacatgtgataaa

SEQ ID NO: 6950915 - DNA, 22 bp, Homo sapiens
ttcctatccttttatgtttatg

SEQ ID NO: 6950916 - DNA, 21 bp, Homo sapiens
agcctgttggtttactgctca

SEQ ID NO: 6950917 - DNA, 22 bp, Homo sapiens
ccctctgcctctgagtaggaca

SEQ ID NO: 6950918 - DNA, 22 bp, Homo sapiens
gaacagacttggaggagtgatc

SEQ ID NO: 6950919 - DNA, 22 bp, Homo sapiens
gctgtgttcattttgcatatgt

SEQ ID NO: 6950920 - DNA, 22 bp, Homo sapiens
ttcttaagcgtatgataatgaa

SEQ ID NO: 6950921 - DNA, 22 bp, Homo sapiens
gcagagacaggataatgggttc

SEQ ID NO: 6950922 - DNA, 22 bp, Homo sapiens
tgggcaggcaagtgaatacctt

SEQ ID NO: 6950923 - DNA, 22 bp, Homo sapiens
gtagttagttaagatgagttta

SEQ ID NO: 6950924 - DNA, 22 bp, Homo sapiens
cattcttctggatagttagttg

SEQ ID NO: 6950925 - DNA, 22 bp, Homo sapiens
agtctcagaaaatatgcttttt

SEQ ID NO: 6950926 - DNA, 22 bp, Homo sapiens
taggttcaggagatattgcaca

SEQ ID NO: 6950927 - DNA, 22 bp, Homo sapiens
attgtgctttgtatttggctag

SEQ ID NO: 6950928 - DNA, 22 bp, Homo sapiens
attcttctcccttagggcccag

SEQ ID NO: 6950929 - DNA, 22 bp, Homo sapiens
gcctgggtccactgatcatgct

SEQ ID NO: 6950930 - DNA, 22 bp, Homo sapiens
tgcaagagcccaaactatatac

SEQ ID NO: 6950931 - DNA, 22 bp, Homo sapiens
tgtcatgaccatgataactaag

SEQ ID NO: 6950932 - DNA, 22 bp, Homo sapiens
caggatggtgtgagtgtgagga

SEQ ID NO: 6950933 - DNA, 22 bp, Homo sapiens
ttgtgtaatgaagttatcatgt

SEQ ID NO: 6950934 - DNA, 17 bp, Homo sapiens
ttgtcacaggtggtggt

SEQ ID NO: 6950935 - DNA, 22 bp, Homo sapiens
ctgagccaccggcagggacatc

SEQ ID NO: 6950936 - DNA, 22 bp, Homo sapiens
tttatgggcatccagggggtat

SEQ ID NO: 6950937 - DNA, 22 bp, Homo sapiens
agggaggtctggctgccctgag

SEQ ID NO: 6950938 - DNA, 22 bp, Homo sapiens
gctgctattagtcttctattca

SEQ ID NO: 6950939 - DNA, 22 bp, Homo sapiens
attctctctctatgaaaactga

SEQ ID NO: 6950940 - DNA, 22 bp, Homo sapiens
tatgcattatacattaatttct

SEQ ID NO: 6950941 - DNA, 22 bp, Homo sapiens
ctcactggcaagactacaggtg

SEQ ID NO: 6950942 - DNA, 22 bp, Homo sapiens
cagggcctctgtgggctctctc

SEQ ID NO: 6950943 - DNA, 22 bp, Homo sapiens
tggcacagacagatcaggagtc

SEQ ID NO: 6950944 - DNA, 22 bp, Homo sapiens
accttggggtgatgctgaaaga

SEQ ID NO: 6950945 - DNA, 22 bp, Homo sapiens
tacaacgtgggactttgtttct

SEQ ID NO: 6950946 - DNA, 22 bp, Homo sapiens
tgtcatgtgttcttaaatacat

SEQ ID NO: 6950947 - DNA, 22 bp, Homo sapiens
gagggtcctggctaagtctgac

SEQ ID NO: 6950948 - DNA, 18 bp, Homo sapiens
agacccttcccaggcttg

SEQ ID NO: 6950949 - DNA, 22 bp, Homo sapiens
aacctaggactatagatatcat

SEQ ID NO: 6950950 - DNA, 21 bp, Homo sapiens
agtgtcattcccaagctgtga

SEQ ID NO: 6950951 - DNA, 22 bp, Homo sapiens
gcagccctccctgggtgtgtct

SEQ ID NO: 6950952 - DNA, 22 bp, Homo sapiens
tttagagacacactggcatttg

SEQ ID NO: 6950953 - DNA, 22 bp, Homo sapiens
acacccagcttttgaatgccct

SEQ ID NO: 6950954 - DNA, 22 bp, Homo sapiens
tctgaggacctactgaagagtt

SEQ ID NO: 6950955 - DNA, 22 bp, Homo sapiens
tgtatgtgtcctaattcaagca

SEQ ID NO: 6950956 - DNA, 22 bp, Homo sapiens
gtaagcctggaatttttgactt

SEQ ID NO: 6950957 - DNA, 22 bp, Homo sapiens
attctgcctcacaggcagctgg

SEQ ID NO: 6950958 - DNA, 22 bp, Homo sapiens
gctgaagacctccctctccatg

SEQ ID NO: 6950959 - DNA, 22 bp, Homo sapiens
agtctcaaagtcagtgtcatgg

SEQ ID NO: 6950960 - DNA, 20 bp, Homo sapiens
tgtactgcttgataaatggt

SEQ ID NO: 6950961 - DNA, 22 bp, Homo sapiens
ttgctgatttgtttctattcca

SEQ ID NO: 6950962 - DNA, 22 bp, Homo sapiens
caaggttccagaattatgctct

SEQ ID NO: 6950963 - DNA, 22 bp, Homo sapiens
ttttcttcctggattttggcat

SEQ ID NO: 6950964 - DNA, 22 bp, Homo sapiens
tgtagggaggaagggttggaaa

SEQ ID NO: 6950965 - DNA, 22 bp, Homo sapiens
aagccaggaagggagctgtccc

SEQ ID NO: 6950966 - DNA, 22 bp, Homo sapiens
gagcacaggctgctgtgaactg

SEQ ID NO: 6950967 - DNA, 22 bp, Homo sapiens
cctccaaggctgagttaatgaa

SEQ ID NO: 6950968 - DNA, 22 bp, Homo sapiens
ttttctgtttacagagggacct

SEQ ID NO: 6950969 - DNA, 22 bp, Homo sapiens
tacatgtctacagccatgtctg

SEQ ID NO: 6950970 - DNA, 22 bp, Homo sapiens
caaattctcaaggtttatccca

SEQ ID NO: 6950971 - DNA, 20 bp, Homo sapiens
tgtgtataaatatatgtttc

SEQ ID NO: 6950972 - DNA, 17 bp, Homo sapiens
aaggagctgagagatgg

SEQ ID NO: 6950973 - DNA, 22 bp, Homo sapiens
acagtgttacttgatagtgtat

SEQ ID NO: 6950974 - DNA, 22 bp, Homo sapiens
tttgtctaattgcaaggcaagt

SEQ ID NO: 6950975 - DNA, 22 bp, Homo sapiens
gagggccaatgtgtccctgagc

SEQ ID NO: 6950976 - DNA, 22 bp, Homo sapiens
gccctgagggacctcaccccat

SEQ ID NO: 6950977 - DNA, 22 bp, Homo sapiens
gcaggtggcagaggtgggatct

SEQ ID NO: 6950978 - DNA, 22 bp, Homo sapiens
ctgtaattctctagttcggagt

SEQ ID NO: 6950979 - DNA, 22 bp, Homo sapiens
tgtctctgaagccccctccttt

SEQ ID NO: 6950980 - DNA, 22 bp, Homo sapiens
tctgtggattttagtgttcatg

SEQ ID NO: 6950981 - DNA, 22 bp, Homo sapiens
tctccagggcccccgagcgttg

SEQ ID NO: 6950982 - DNA, 22 bp, Homo sapiens
ccgagcccggagaggagctctt

SEQ ID NO: 6950983 - DNA, 19 bp, Homo sapiens
cttgcctgttcctacagct

SEQ ID NO: 6950984 - DNA, 22 bp, Homo sapiens
gacaaatgtacccctagagtct

SEQ ID NO: 6950985 - DNA, 22 bp, Homo sapiens
tggcaattcccttggtcaacag

SEQ ID NO: 6950986 - DNA, 22 bp, Homo sapiens
gtgtataactatctatctagta

SEQ ID NO: 6950987 - DNA, 22 bp, Homo sapiens
ttgtgtccctgtaagacaaagc

SEQ ID NO: 6950988 - DNA, 22 bp, Homo sapiens
ggaggccatgggcagaatcttt

SEQ ID NO: 6950989 - DNA, 22 bp, Homo sapiens
atataattgttctgaagtgttt

SEQ ID NO: 6950990 - DNA, 22 bp, Homo sapiens
gctgtccagcccttgttcacct

SEQ ID NO: 6950991 - DNA, 22 bp, Homo sapiens
ttgaactagaagctttggaact

SEQ ID NO: 6950992 - DNA, 22 bp, Homo sapiens
cagtatctccacatgtaaagtg

SEQ ID NO: 6950993 - DNA, 22 bp, Homo sapiens
gcagagtgatggaatgtgggtg

SEQ ID NO: 6950994 - DNA, 22 bp, Homo sapiens
ctgtgtgcaacttgcagttttg

SEQ ID NO: 6950995 - DNA, 22 bp, Homo sapiens
ttggaggtttgaaaatatgtgt

SEQ ID NO: 6950996 - DNA, 20 bp, Homo sapiens
agttgaatcctaaggtattg

SEQ ID NO: 6950997 - DNA, 22 bp, Homo sapiens
actttactcttcatatgtgaca

SEQ ID NO: 6950998 - DNA, 22 bp, Homo sapiens
tgcaatttcaggcatatattgt

SEQ ID NO: 6950999 - DNA, 19 bp, Homo sapiens
tggatggagcctgtggttg

SEQ ID NO: 6951000 - DNA, 22 bp, Homo sapiens
tggtgtcctaagtggaaggaca

SEQ ID NO: 6951001 - DNA, 21 bp, Homo sapiens
gcattcctaggaggtaagcat

SEQ ID NO: 6951002 - DNA, 22 bp, Homo sapiens
ctgcagctgtctctactgggca

SEQ ID NO: 6951003 - DNA, 22 bp, Homo sapiens
tatgtgttgaatttgaacgtta

SEQ ID NO: 6951004 - DNA, 22 bp, Homo sapiens
gagggtgctctgagcccttttg

SEQ ID NO: 6951005 - DNA, 22 bp, Homo sapiens
tgtctggacagagattctcaat

SEQ ID NO: 6951006 - DNA, 22 bp, Homo sapiens
agaaggcggctcctctggcgcc

SEQ ID NO: 6951007 - DNA, 21 bp, Homo sapiens
cccaccccataaggcagaacc

SEQ ID NO: 6951008 - DNA, 22 bp, Homo sapiens
acattgctgatatcaatttttg

SEQ ID NO: 6951009 - DNA, 22 bp, Homo sapiens
tgaggatttctatggttctttc

SEQ ID NO: 6951010 - DNA, 22 bp, Homo sapiens
agatttagactgccttaatcat

SEQ ID NO: 6951011 - DNA, 22 bp, Homo sapiens
gggctccagttgtccccaggat

SEQ ID NO: 6951012 - DNA, 22 bp, Homo sapiens
tgccaatctggtgggtgcaaat

SEQ ID NO: 6951013 - DNA, 22 bp, Homo sapiens
agctaggagattttgtgaggct

SEQ ID NO: 6951014 - DNA, 22 bp, Homo sapiens
tggtcaacaggcagggatgaaa

SEQ ID NO: 6951015 - DNA, 21 bp, Homo sapiens
gctgctcgagatccagtgctt

SEQ ID NO: 6951016 - DNA, 22 bp, Homo sapiens
ttctctggcgcgctgtgctatg

SEQ ID NO: 6951017 - DNA, 22 bp, Homo sapiens
cacagaaattattaggatgctt

SEQ ID NO: 6951018 - DNA, 22 bp, Homo sapiens
ccaggcagggctcaaggaacct

SEQ ID NO: 6951019 - DNA, 22 bp, Homo sapiens
tctgagttttctgagaagctta

SEQ ID NO: 6951020 - DNA, 22 bp, Homo sapiens
ctctgccactcgaagtcaagga

SEQ ID NO: 6951021 - DNA, 22 bp, Homo sapiens
tcgcgccctcctcaccaacgtg

SEQ ID NO: 6951022 - DNA, 22 bp, Homo sapiens
tgaattctaatgggtgagatcc

SEQ ID NO: 6951023 - DNA, 22 bp, Homo sapiens
tgtgtgtgttcctcctcagcta

SEQ ID NO: 6951024 - DNA, 22 bp, Homo sapiens
tgtcagtggtaaggttgggagt

SEQ ID NO: 6951025 - DNA, 22 bp, Homo sapiens
catccctgggcgggacactctt

SEQ ID NO: 6951026 - DNA, 20 bp, Homo sapiens
ttctccacagggtggaggag

SEQ ID NO: 6951027 - DNA, 22 bp, Homo sapiens
aaagattatggcattgaaatac

SEQ ID NO: 6951028 - DNA, 22 bp, Homo sapiens
ggcagctagtttaagaaagagg

SEQ ID NO: 6951029 - DNA, 22 bp, Homo sapiens
agggcaccctctctgcagtacc

SEQ ID NO: 6951030 - DNA, 22 bp, Homo sapiens
tcacaggcttgtgaacattgca

SEQ ID NO: 6951031 - DNA, 22 bp, Homo sapiens
agaaagtgcttccctttggtga

SEQ ID NO: 6951032 - DNA, 22 bp, Homo sapiens
aaccagagtgacactctacaga

SEQ ID NO: 6951033 - DNA, 22 bp, Homo sapiens
ttagtcttcttccttatatgtt

SEQ ID NO: 6951034 - DNA, 22 bp, Homo sapiens
tattgcattatggtaggaaagg

SEQ ID NO: 6951035 - DNA, 22 bp, Homo sapiens
aactctacttgggactcctctg

SEQ ID NO: 6951036 - DNA, 22 bp, Homo sapiens
gattgtgatacctagagcagca

SEQ ID NO: 6951037 - DNA, 22 bp, Homo sapiens
gttggtccaggagagtcacttc

SEQ ID NO: 6951038 - DNA, 22 bp, Homo sapiens
ctagagaaaggcagtggagcaa

SEQ ID NO: 6951039 - DNA, 20 bp, Homo sapiens
gtaatgaatgtaaacagtaa

SEQ ID NO: 6951040 - DNA, 22 bp, Homo sapiens
catttgtagtatctgtttatat

SEQ ID NO: 6951041 - DNA, 22 bp, Homo sapiens
tcattacacagttcagtggaaa

SEQ ID NO: 6951042 - DNA, 22 bp, Homo sapiens
ctcccagggtctaggctgctgg

SEQ ID NO: 6951043 - DNA, 22 bp, Homo sapiens
tctcaaggactttgggcactaa

SEQ ID NO: 6951044 - DNA, 22 bp, Homo sapiens
tatgtcaaagttaagaaatagg

SEQ ID NO: 6951045 - DNA, 22 bp, Homo sapiens
aacactttcttccttgctcagg

SEQ ID NO: 6951046 - DNA, 22 bp, Homo sapiens
ctggggactttggttctccatg

SEQ ID NO: 6951047 - DNA, 19 bp, Homo sapiens
agagaccacagagctgcct

SEQ ID NO: 6951048 - DNA, 22 bp, Homo sapiens
gctgttctctgtaacatgcatt

SEQ ID NO: 6951049 - DNA, 22 bp, Homo sapiens
aagcagattggggatttccatg

SEQ ID NO: 6951050 - DNA, 22 bp, Homo sapiens
atgctaattgattgtcgtgtct

SEQ ID NO: 6951051 - DNA, 22 bp, Homo sapiens
aatctggctcagaagaagatga

SEQ ID NO: 6951052 - DNA, 22 bp, Homo sapiens
tagcaggcttgtgaatggagcc

SEQ ID NO: 6951053 - DNA, 22 bp, Homo sapiens
gcccttctgctgttaggtagcc

SEQ ID NO: 6951054 - DNA, 23 bp, Homo sapiens
ctcaacatccattcttgcccttc

SEQ ID NO: 6951055 - DNA, 22 bp, Homo sapiens
ctgaggctaacctcgagagaca

SEQ ID NO: 6951056 - DNA, 22 bp, Homo sapiens
atcatgttccagaaacagtgat

SEQ ID NO: 6951057 - DNA, 22 bp, Homo sapiens
aagcgcccatgcctgagagcgt

SEQ ID NO: 6951058 - DNA, 22 bp, Homo sapiens
cacaaagtgggtggaaaactaa

SEQ ID NO: 6951059 - DNA, 22 bp, Homo sapiens
tcacaggtgtcatgctatgcac

SEQ ID NO: 6951060 - DNA, 22 bp, Homo sapiens
ctttgatctactcactaaacaa

SEQ ID NO: 6951061 - DNA, 22 bp, Homo sapiens
tgtcaggtttcagttaatggtt

SEQ ID NO: 6951062 - DNA, 23 bp, Homo sapiens
gcagtgtgaatccagtgtttcag

SEQ ID NO: 6951063 - DNA, 22 bp, Homo sapiens
aggcaggttggggaaaagcact

SEQ ID NO: 6951064 - DNA, 22 bp, Homo sapiens
acaatttctaatatagatctta

SEQ ID NO: 6951065 - DNA, 22 bp, Homo sapiens
acctgagacttgggatgggaat

SEQ ID NO: 6951066 - DNA, 22 bp, Homo sapiens
tcatatttaggcctttaattca

SEQ ID NO: 6951067 - DNA, 22 bp, Homo sapiens
ctgtggctggaataataaatgt

SEQ ID NO: 6951068 - DNA, 22 bp, Homo sapiens
aaggagtgatatatgggtgcta

SEQ ID NO: 6951069 - DNA, 22 bp, Homo sapiens
acctccctaagggtccagctta

SEQ ID NO: 6951070 - DNA, 22 bp, Homo sapiens
tgagatctctgcctatatggat

SEQ ID NO: 6951071 - DNA, 21 bp, Homo sapiens
aaggaagtgactttagtggtt

SEQ ID NO: 6951072 - DNA, 23 bp, Homo sapiens
aggagaagagatttccacatgca

SEQ ID NO: 6951073 - DNA, 22 bp, Homo sapiens
acagtggagaagcaaatgcagt

SEQ ID NO: 6951074 - DNA, 20 bp, Homo sapiens
agaagccaagtgacatgttt

SEQ ID NO: 6951075 - DNA, 22 bp, Homo sapiens
cctctgcaccatagccttcagc

SEQ ID NO: 6951076 - DNA, 22 bp, Homo sapiens
gaggctgtaagtgtggagccta

SEQ ID NO: 6951077 - DNA, 22 bp, Homo sapiens
actcacagggcctcagttttcc

SEQ ID NO: 6951078 - DNA, 22 bp, Homo sapiens
tgggcctgactcacctgcctcc

SEQ ID NO: 6951079 - DNA, 22 bp, Homo sapiens
ccagcagagggtcttggccatt

SEQ ID NO: 6951080 - DNA, 22 bp, Homo sapiens
ttcccacacaattaagtcattt

SEQ ID NO: 6951081 - DNA, 22 bp, Homo sapiens
tggccttgagagatcaaaaggt

SEQ ID NO: 6951082 - DNA, 22 bp, Homo sapiens
gttgtatagagggcatgaatct

SEQ ID NO: 6951083 - DNA, 22 bp, Homo sapiens
cttccagtcttttcagtggagt

SEQ ID NO: 6951084 - DNA, 22 bp, Homo sapiens
gcacttctcgggggcgctgtct

SEQ ID NO: 6951085 - DNA, 22 bp, Homo sapiens
cagcaggcccagagtttcatgg

SEQ ID NO: 6951086 - DNA, 22 bp, Homo sapiens
ttagaaaggcttatggtgcctt

SEQ ID NO: 6951087 - DNA, 22 bp, Homo sapiens
tctggctgaagcttttgcagct

SEQ ID NO: 6951088 - DNA, 22 bp, Homo sapiens
tgaaatgatgtacaagaaggca

SEQ ID NO: 6951089 - DNA, 22 bp, Homo sapiens
gcataacaacagactctgtgtt

SEQ ID NO: 6951090 - DNA, 22 bp, Homo sapiens
agaaacatcattggaacacaag

SEQ ID NO: 6951091 - DNA, 23 bp, Homo sapiens
aacaatagagataaagtgagatc

SEQ ID NO: 6951092 - DNA, 22 bp, Homo sapiens
agctgggcgcagtggctggtga

SEQ ID NO: 6951093 - DNA, 22 bp, Homo sapiens
ggtagcaagcgcttgccctgcg

SEQ ID NO: 6951094 - DNA, 22 bp, Homo sapiens
taggaacaagtttccttgctgt

SEQ ID NO: 6951095 - DNA, 20 bp, Homo sapiens
ttgttagaggaatgccatag

SEQ ID NO: 6951096 - DNA, 22 bp, Homo sapiens
ttgtgggggctgccctgtacgg

SEQ ID NO: 6951097 - DNA, 22 bp, Homo sapiens
atgcttcccctctcatttcagc

SEQ ID NO: 6951098 - DNA, 22 bp, Homo sapiens
ctgcactgagaccctctttgct

SEQ ID NO: 6951099 - DNA, 22 bp, Homo sapiens
gagatggggtcttgctatgttg

SEQ ID NO: 6951100 - DNA, 22 bp, Homo sapiens
aaggtgagagggaaattttcca

SEQ ID NO: 6951101 - DNA, 23 bp, Homo sapiens
tctgggcatatctagtcacatcg

SEQ ID NO: 6951102 - DNA, 22 bp, Homo sapiens
tataaccttttctttatcctcc

SEQ ID NO: 6951103 - DNA, 22 bp, Homo sapiens
tgtgtgttggctggagagggct

SEQ ID NO: 6951104 - DNA, 22 bp, Homo sapiens
cacagctagatggatagataga

SEQ ID NO: 6951105 - DNA, 23 bp, Homo sapiens
tggttcaagtgagaagtaatgtt

SEQ ID NO: 6951106 - DNA, 22 bp, Homo sapiens
caataagtaataggcatctaat

SEQ ID NO: 6951107 - DNA, 22 bp, Homo sapiens
gttcgtatttatgtcgcagaag

SEQ ID NO: 6951108 - DNA, 22 bp, Homo sapiens
tacaaccagatcctctaagtca

SEQ ID NO: 6951109 - DNA, 22 bp, Homo sapiens
ccctctggctcttctcaggccg

SEQ ID NO: 6951110 - DNA, 21 bp, Homo sapiens
tgcccctttatgggctcccta

SEQ ID NO: 6951111 - DNA, 22 bp, Homo sapiens
agtcttctagctgggtttggtt

SEQ ID NO: 6951112 - DNA, 22 bp, Homo sapiens
attgacacacttccaggaccag

SEQ ID NO: 6951113 - DNA, 22 bp, Homo sapiens
tcagtgcacccaattctctcca

SEQ ID NO: 6951114 - DNA, 22 bp, Homo sapiens
ttagtacattgattcattatgt

SEQ ID NO: 6951115 - DNA, 22 bp, Homo sapiens
tgtgtcttacataattacatgt

SEQ ID NO: 6951116 - DNA, 22 bp, Homo sapiens
agtgtcttagtccatttgggct

SEQ ID NO: 6951117 - DNA, 22 bp, Homo sapiens
tattgtgacttttactgagtaa

SEQ ID NO: 6951118 - DNA, 22 bp, Homo sapiens
atgaaaacggaccagagctatt

SEQ ID NO: 6951119 - DNA, 21 bp, Homo sapiens
ccacaattctagttacatatg

SEQ ID NO: 6951120 - DNA, 22 bp, Homo sapiens
agggctgtgtccctaggggagc

SEQ ID NO: 6951121 - DNA, 22 bp, Homo sapiens
ccctattagtgaccacatcata

SEQ ID NO: 6951122 - DNA, 22 bp, Homo sapiens
acattcctgaggaaatacattc

SEQ ID NO: 6951123 - DNA, 22 bp, Homo sapiens
ctgaatatcatttatcattggc

SEQ ID NO: 6951124 - DNA, 22 bp, Homo sapiens
agtgaggataccaatgtgtaga

SEQ ID NO: 6951125 - DNA, 22 bp, Homo sapiens
agtctattttgcttattctatg

SEQ ID NO: 6951126 - DNA, 22 bp, Homo sapiens
gaaagttttctcacacagtaat

SEQ ID NO: 6951127 - DNA, 22 bp, Homo sapiens
aagtttgagagcctttagtata

SEQ ID NO: 6951128 - DNA, 22 bp, Homo sapiens
atcaacaggtatggatgagatt

SEQ ID NO: 6951129 - DNA, 22 bp, Homo sapiens
tctattttatactcaaatcttc

SEQ ID NO: 6951130 - DNA, 22 bp, Homo sapiens
gaggggtccaggaggcacttac

SEQ ID NO: 6951131 - DNA, 22 bp, Homo sapiens
ggcatttacataatcttattta

SEQ ID NO: 6951132 - DNA, 22 bp, Homo sapiens
cacagctgtcagctgacctagg

SEQ ID NO: 6951133 - DNA, 20 bp, Homo sapiens
gtgcagatgtcctttcacac

SEQ ID NO: 6951134 - DNA, 22 bp, Homo sapiens
agagaacagcattgcagctttg

SEQ ID NO: 6951135 - DNA, 22 bp, Homo sapiens
tgttgactggtaactttaaaca

SEQ ID NO: 6951136 - DNA, 22 bp, Homo sapiens
gcagaggtcaaatacctcattt

SEQ ID NO: 6951137 - DNA, 22 bp, Homo sapiens
gtggcgcagagggtggcagaga

SEQ ID NO: 6951138 - DNA, 22 bp, Homo sapiens
cttagtaggcttcacccctctc

SEQ ID NO: 6951139 - DNA, 22 bp, Homo sapiens
tcatcaaaagccttctgggtta

SEQ ID NO: 6951140 - DNA, 21 bp, Homo sapiens
tatacatgtgtgcatacgtgt

SEQ ID NO: 6951141 - DNA, 22 bp, Homo sapiens
tatcagatggtgatacatatca

SEQ ID NO: 6951142 - DNA, 22 bp, Homo sapiens
ttcttcattcccttacttccga

SEQ ID NO: 6951143 - DNA, 22 bp, Homo sapiens
gctggctgccaatttcagagct

SEQ ID NO: 6951144 - DNA, 22 bp, Homo sapiens
agctacagggaactaaaagcta

SEQ ID NO: 6951145 - DNA, 22 bp, Homo sapiens
gtccccaaaattacaagacaca

SEQ ID NO: 6951146 - DNA, 22 bp, Homo sapiens
tagtgaatgttggctattaata

SEQ ID NO: 6951147 - DNA, 22 bp, Homo sapiens
tttaagacagtgcaagctgaat

SEQ ID NO: 6951148 - DNA, 22 bp, Homo sapiens
agccaggttaaaccacagtcaa

SEQ ID NO: 6951149 - DNA, 22 bp, Homo sapiens
tgacactatgtgtgcagccaga

SEQ ID NO: 6951150 - DNA, 22 bp, Homo sapiens
caggccttgagttttgggcttt

SEQ ID NO: 6951151 - DNA, 22 bp, Homo sapiens
tacccacagcctctcttcaaaa

SEQ ID NO: 6951152 - DNA, 22 bp, Homo sapiens
tctgatatttgaagaccattag

SEQ ID NO: 6951153 - DNA, 22 bp, Homo sapiens
ctttattgtccttcttaggtgg

SEQ ID NO: 6951154 - DNA, 18 bp, Homo sapiens
cacaatagacaccgataa

SEQ ID NO: 6951155 - DNA, 22 bp, Homo sapiens
gagaggaactcccagtgcctgg

SEQ ID NO: 6951156 - DNA, 20 bp, Homo sapiens
gccctgtgatgtcttgacct

SEQ ID NO: 6951157 - DNA, 22 bp, Homo sapiens
tcactggaaagacagcactctt

SEQ ID NO: 6951158 - DNA, 22 bp, Homo sapiens
gccagctttggcacagggtggt

SEQ ID NO: 6951159 - DNA, 22 bp, Homo sapiens
tgcacttattgacatagaaaaa

SEQ ID NO: 6951160 - DNA, 22 bp, Homo sapiens
tcttcagactccaaatgtttta

SEQ ID NO: 6951161 - DNA, 22 bp, Homo sapiens
tgcttgtctctctgtgcccact

SEQ ID NO: 6951162 - DNA, 22 bp, Homo sapiens
tgtcagttcatcagttggctaa

SEQ ID NO: 6951163 - DNA, 22 bp, Homo sapiens
acaatgaatactaagcaccagg

SEQ ID NO: 6951164 - DNA, 20 bp, Homo sapiens
gctctgggtggtaaatgact

SEQ ID NO: 6951165 - DNA, 17 bp, Homo sapiens
ttttctcctgcccattc

SEQ ID NO: 6951166 - DNA, 22 bp, Homo sapiens
gtgtctgtgtcattactaatag

SEQ ID NO: 6951167 - DNA, 22 bp, Homo sapiens
atcctgtgtccactgctctgtg

SEQ ID NO: 6951168 - DNA, 22 bp, Homo sapiens
tcgtgctcctggtgaggctctg

SEQ ID NO: 6951169 - DNA, 22 bp, Homo sapiens
ccagggcaacgctgtctcagag

SEQ ID NO: 6951170 - DNA, 22 bp, Homo sapiens
aaagtcctttttgccatgcaag

SEQ ID NO: 6951171 - DNA, 22 bp, Homo sapiens
ctgcatcactggccaagggtgt

SEQ ID NO: 6951172 - DNA, 22 bp, Homo sapiens
gaactgcattgtggtatatgtt

SEQ ID NO: 6951173 - DNA, 22 bp, Homo sapiens
ccaggacaggagttggcttcgc

SEQ ID NO: 6951174 - DNA, 22 bp, Homo sapiens
cacagcagcgttcctccgtgtg

SEQ ID NO: 6951175 - DNA, 23 bp, Homo sapiens
gtccagaacccaggctggggtgg

SEQ ID NO: 6951176 - DNA, 22 bp, Homo sapiens
ttgaacattagaataagtaatt

SEQ ID NO: 6951177 - DNA, 22 bp, Homo sapiens
ttcccaggctgtgctaccagag

SEQ ID NO: 6951178 - DNA, 21 bp, Homo sapiens
ctgtctggccgcgggctccgc

SEQ ID NO: 6951179 - DNA, 22 bp, Homo sapiens
ctcagaattacatcccatttta

SEQ ID NO: 6951180 - DNA, 22 bp, Homo sapiens
tttgcaaatgaagctctgagga

SEQ ID NO: 6951181 - DNA, 22 bp, Homo sapiens
catggccaaggatgctcaacca

SEQ ID NO: 6951182 - DNA, 22 bp, Homo sapiens
gctatgtattccttagccgctt

SEQ ID NO: 6951183 - DNA, 22 bp, Homo sapiens
attacaataaggtttatttgta

SEQ ID NO: 6951184 - DNA, 23 bp, Homo sapiens
ccaaagtcgaagtctagtccaga

SEQ ID NO: 6951185 - DNA, 22 bp, Homo sapiens
gttcctgaagggactggtgcag

SEQ ID NO: 6951186 - DNA, 22 bp, Homo sapiens
ctgaaactgctcccagccccat

SEQ ID NO: 6951187 - DNA, 22 bp, Homo sapiens
cctttcaaagttttgccatgct

SEQ ID NO: 6951188 - DNA, 22 bp, Homo sapiens
tttcaacactgcatcctcccta

SEQ ID NO: 6951189 - DNA, 22 bp, Homo sapiens
tccagcttccagtggctggctg

SEQ ID NO: 6951190 - DNA, 22 bp, Homo sapiens
acacattgtcatttccatacta

SEQ ID NO: 6951191 - DNA, 17 bp, Homo sapiens
caggtgacctggtgatg

SEQ ID NO: 6951192 - DNA, 22 bp, Homo sapiens
tataagccatccagcctgtggt

SEQ ID NO: 6951193 - DNA, 22 bp, Homo sapiens
gcacagggagacagccgtggcc

SEQ ID NO: 6951194 - DNA, 22 bp, Homo sapiens
gctatctctttagtactagatt

SEQ ID NO: 6951195 - DNA, 22 bp, Homo sapiens
cagcaggtgtccttttggtgga

SEQ ID NO: 6951196 - DNA, 22 bp, Homo sapiens
atacagtaagtgtccctgaaac

SEQ ID NO: 6951197 - DNA, 22 bp, Homo sapiens
tggctctgtgtctcccagcagc

SEQ ID NO: 6951198 - DNA, 20 bp, Homo sapiens
agggcctggagtacagcagg

SEQ ID NO: 6951199 - DNA, 21 bp, Homo sapiens
tccccacatttctaaacagac

SEQ ID NO: 6951200 - DNA, 22 bp, Homo sapiens
gcagtggggcgctgggagttgg

SEQ ID NO: 6951201 - DNA, 22 bp, Homo sapiens
agctcagagataatcaagagac

SEQ ID NO: 6951202 - DNA, 22 bp, Homo sapiens
cagggttgcatgcatctgtggg

SEQ ID NO: 6951203 - DNA, 23 bp, Homo sapiens
tctgacctcgtttgctgtgttct

SEQ ID NO: 6951204 - DNA, 22 bp, Homo sapiens
aaatgtttctacttgtgagcat

SEQ ID NO: 6951205 - DNA, 19 bp, Homo sapiens
gtgggacagacattacata

SEQ ID NO: 6951206 - DNA, 22 bp, Homo sapiens
gtgtcatggggtttgttataca

SEQ ID NO: 6951207 - DNA, 22 bp, Homo sapiens
tgtgaaagcaagtctagttctc

SEQ ID NO: 6951208 - DNA, 22 bp, Homo sapiens
ctgtggtcatctcagagtggcc

SEQ ID NO: 6951209 - DNA, 22 bp, Homo sapiens
tacttgttaggaatttctacta

SEQ ID NO: 6951210 - DNA, 22 bp, Homo sapiens
taagaccagtatgcattttcac

SEQ ID NO: 6951211 - DNA, 22 bp, Homo sapiens
ctgcagcaggaggctcctgcag

SEQ ID NO: 6951212 - DNA, 20 bp, Homo sapiens
ccttgggaaacaaagtagag

SEQ ID NO: 6951213 - DNA, 22 bp, Homo sapiens
gattagaatatgtcagtcataa

SEQ ID NO: 6951214 - DNA, 22 bp, Homo sapiens
ttctacactcacccagctgtaa

SEQ ID NO: 6951215 - DNA, 22 bp, Homo sapiens
aaccagtttaagcaaataactg

SEQ ID NO: 6951216 - DNA, 22 bp, Homo sapiens
tctgagagatacaaggaggcaa

SEQ ID NO: 6951217 - DNA, 22 bp, Homo sapiens
ctgaacatcccgcagtgcacga

SEQ ID NO: 6951218 - DNA, 22 bp, Homo sapiens
tactttgtccatttgcaggcag

SEQ ID NO: 6951219 - DNA, 22 bp, Homo sapiens
catccaaactctcattatctgt

SEQ ID NO: 6951220 - DNA, 22 bp, Homo sapiens
tgtagcctttatgtgagaagga

SEQ ID NO: 6951221 - DNA, 22 bp, Homo sapiens
tctattcattcaatttagctct

SEQ ID NO: 6951222 - DNA, 22 bp, Homo sapiens
tcaggaaggcacttggtgtgtt

SEQ ID NO: 6951223 - DNA, 22 bp, Homo sapiens
tcagcagtggctctcatgcagt

SEQ ID NO: 6951224 - DNA, 22 bp, Homo sapiens
agctctgccgcctttcaggctg

SEQ ID NO: 6951225 - DNA, 22 bp, Homo sapiens
tgaagtatcccaagatttacag

SEQ ID NO: 6951226 - DNA, 22 bp, Homo sapiens
tggcttccccggagtgacatgt

SEQ ID NO: 6951227 - DNA, 22 bp, Homo sapiens
tgtgtgctcgatggccctgcag

SEQ ID NO: 6951228 - DNA, 22 bp, Homo sapiens
gctaggcttcaaaatctccctg

SEQ ID NO: 6951229 - DNA, 18 bp, Homo sapiens
agctggccctggctgccg

SEQ ID NO: 6951230 - DNA, 22 bp, Homo sapiens
tcagaggctttcaatgtgtttt

SEQ ID NO: 6951231 - DNA, 22 bp, Homo sapiens
tccctcgctagaaggccgggaa

SEQ ID NO: 6951232 - DNA, 22 bp, Homo sapiens
ttagccatatagaaaaagagct

SEQ ID NO: 6951233 - DNA, 22 bp, Homo sapiens
acattgtgaagataccactgca

SEQ ID NO: 6951234 - DNA, 22 bp, Homo sapiens
gctgctggccgcccagcttctc

SEQ ID NO: 6951235 - DNA, 19 bp, Homo sapiens
tcagcagcactgtgatttc

SEQ ID NO: 6951236 - DNA, 22 bp, Homo sapiens
atctgttaacaaagaagacagc

SEQ ID NO: 6951237 - DNA, 21 bp, Homo sapiens
ggctggactgtgctttccttc

SEQ ID NO: 6951238 - DNA, 22 bp, Homo sapiens
tgtgacataaaaacagcaatca

SEQ ID NO: 6951239 - DNA, 22 bp, Homo sapiens
caggcatgatcataggagttta

SEQ ID NO: 6951240 - DNA, 20 bp, Homo sapiens
aggccaggaaatgtagttct

SEQ ID NO: 6951241 - DNA, 22 bp, Homo sapiens
gctgtacattctgcacaggccc

SEQ ID NO: 6951242 - DNA, 22 bp, Homo sapiens
tgcccgctgctgctcagtctgt

SEQ ID NO: 6951243 - DNA, 16 bp, Homo sapiens
atctaagatgtgcatt

SEQ ID NO: 6951244 - DNA, 22 bp, Homo sapiens
tttcagtttgtcggccttggac

SEQ ID NO: 6951245 - DNA, 22 bp, Homo sapiens
tacatctagccttacaattatt

SEQ ID NO: 6951246 - DNA, 22 bp, Homo sapiens
tgtgccatctgatataagagcc

SEQ ID NO: 6951247 - DNA, 22 bp, Homo sapiens
acagatgaggtgtttggagagc

SEQ ID NO: 6951248 - DNA, 22 bp, Homo sapiens
tttgcatttccagagtagcaga

SEQ ID NO: 6951249 - DNA, 22 bp, Homo sapiens
agaggctggattgagcatagac

SEQ ID NO: 6951250 - DNA, 22 bp, Homo sapiens
gaagaaagattggcatgcttca

SEQ ID NO: 6951251 - DNA, 22 bp, Homo sapiens
cagcatatctgagttgaaagag

SEQ ID NO: 6951252 - DNA, 22 bp, Homo sapiens
ctgagctcacgccattctcctt

SEQ ID NO: 6951253 - DNA, 22 bp, Homo sapiens
tttctgaaggttaaggaattag

SEQ ID NO: 6951254 - DNA, 22 bp, Homo sapiens
actgtacctcaaactctggaac

SEQ ID NO: 6951255 - DNA, 22 bp, Homo sapiens
gctctggtctgcttatatctat

SEQ ID NO: 6951256 - DNA, 22 bp, Homo sapiens
ggtgaatgaatgcagttctctg

SEQ ID NO: 6951257 - DNA, 22 bp, Homo sapiens
accagctcataattttcaaaac

SEQ ID NO: 6951258 - DNA, 22 bp, Homo sapiens
agtctggaggtggcaggtgtgt

SEQ ID NO: 6951259 - DNA, 22 bp, Homo sapiens
aagagtggagaataaaatagga

SEQ ID NO: 6951260 - DNA, 22 bp, Homo sapiens
agcagcctgcagatattggtct

SEQ ID NO: 6951261 - DNA, 22 bp, Homo sapiens
gagggctgatgcttacttattt

SEQ ID NO: 6951262 - DNA, 22 bp, Homo sapiens
atttaatgggtagacattgtta

SEQ ID NO: 6951263 - DNA, 22 bp, Homo sapiens
gctgggaatgattttggagagg

SEQ ID NO: 6951264 - DNA, 22 bp, Homo sapiens
agacaacttacctgatgtatgt

SEQ ID NO: 6951265 - DNA, 22 bp, Homo sapiens
cctgctggccagtggagggctg

SEQ ID NO: 6951266 - DNA, 22 bp, Homo sapiens
gctggagagataggcatggggt

SEQ ID NO: 6951267 - DNA, 22 bp, Homo sapiens
tattcagaaaataaattggatt

SEQ ID NO: 6951268 - DNA, 19 bp, Homo sapiens
gctctgccagtggtaacat

SEQ ID NO: 6951269 - DNA, 23 bp, Homo sapiens
tctgagctgtcttttcagcagaa

SEQ ID NO: 6951270 - DNA, 22 bp, Homo sapiens
ggcagggtaaaccgaggtaagt

SEQ ID NO: 6951271 - DNA, 22 bp, Homo sapiens
gccacagtcactgctgcagggg

SEQ ID NO: 6951272 - DNA, 22 bp, Homo sapiens
ttgagcaaatcagaagtttaga

SEQ ID NO: 6951273 - DNA, 22 bp, Homo sapiens
gttctgcttaaattattgatcc

SEQ ID NO: 6951274 - DNA, 22 bp, Homo sapiens
cagctcaggaaggaaggccggc

SEQ ID NO: 6951275 - DNA, 22 bp, Homo sapiens
tgcattgggttgacatactaaa

SEQ ID NO: 6951276 - DNA, 22 bp, Homo sapiens
actcgcggcggacggcggccag

SEQ ID NO: 6951277 - DNA, 22 bp, Homo sapiens
caggaagctggtcagatcctgt

SEQ ID NO: 6951278 - DNA, 22 bp, Homo sapiens
tcatccaagggctctgaggcaa

SEQ ID NO: 6951279 - DNA, 21 bp, Homo sapiens
ttacaatgcattttctttggc

SEQ ID NO: 6951280 - DNA, 22 bp, Homo sapiens
ctgtggctctttagttgagcac

SEQ ID NO: 6951281 - DNA, 22 bp, Homo sapiens
agaaatgtccagggctaggatc

SEQ ID NO: 6951282 - DNA, 22 bp, Homo sapiens
tggggtacttgtatcaaagcac

SEQ ID NO: 6951283 - DNA, 22 bp, Homo sapiens
ttgcagaagcctgttgttcctg

SEQ ID NO: 6951284 - DNA, 22 bp, Homo sapiens
aatttcacctatcacttaagcc

SEQ ID NO: 6951285 - DNA, 22 bp, Homo sapiens
ggaggctcttgagaggggagta

SEQ ID NO: 6951286 - DNA, 22 bp, Homo sapiens
gcctgcagttctgtgctaggca

SEQ ID NO: 6951287 - DNA, 23 bp, Homo sapiens
tatttgctactggtaattctgga

SEQ ID NO: 6951288 - DNA, 22 bp, Homo sapiens
ccactgattctgccaggtctct

SEQ ID NO: 6951289 - DNA, 22 bp, Homo sapiens
tgacacctcgatcttggacttc

SEQ ID NO: 6951290 - DNA, 15 bp, Homo sapiens
gctaaggcattggta

SEQ ID NO: 6951291 - DNA, 20 bp, Homo sapiens
cagtggctgataacaaatta

SEQ ID NO: 6951292 - DNA, 22 bp, Homo sapiens
taagacatcattaaacagcaat

SEQ ID NO: 6951293 - DNA, 22 bp, Homo sapiens
ccacagtaggaacaagttgtcg

SEQ ID NO: 6951294 - DNA, 22 bp, Homo sapiens
tactagtttttaggaaaagtga

SEQ ID NO: 6951295 - DNA, 22 bp, Homo sapiens
tagcagcaaagcaggatctgct

SEQ ID NO: 6951296 - DNA, 22 bp, Homo sapiens
atgaatgggtcattatttgatc

SEQ ID NO: 6951297 - DNA, 22 bp, Homo sapiens
atgtttgtgggataaacaaatg

SEQ ID NO: 6951298 - DNA, 22 bp, Homo sapiens
ctgtgagaaaggtgatggaggt

SEQ ID NO: 6951299 - DNA, 22 bp, Homo sapiens
cctgggcagggagaccaggctc

SEQ ID NO: 6951300 - DNA, 22 bp, Homo sapiens
tgtgtcctgtgcaaggggatga

SEQ ID NO: 6951301 - DNA, 22 bp, Homo sapiens
aagacaagccttgtttttctgc

SEQ ID NO: 6951302 - DNA, 22 bp, Homo sapiens
gcacatttgccactgagctcct

SEQ ID NO: 6951303 - DNA, 22 bp, Homo sapiens
accatgatctgctctggtgttt

SEQ ID NO: 6951304 - DNA, 22 bp, Homo sapiens
ggcagtgttccagaccttcacc

SEQ ID NO: 6951305 - DNA, 22 bp, Homo sapiens
taaggaagtacccattcttagg

SEQ ID NO: 6951306 - DNA, 22 bp, Homo sapiens
tcacagtgtgaaggtcagtcac

SEQ ID NO: 6951307 - DNA, 22 bp, Homo sapiens
atgttactgtgatcatgatact

SEQ ID NO: 6951308 - DNA, 22 bp, Homo sapiens
tagctcttttataggaactctg

SEQ ID NO: 6951309 - DNA, 18 bp, Homo sapiens
agaagcaggtaaaattct

SEQ ID NO: 6951310 - DNA, 22 bp, Homo sapiens
aagaagcattctttcattggtt

SEQ ID NO: 6951311 - DNA, 22 bp, Homo sapiens
agtaaagcggtgtcacagaatg

SEQ ID NO: 6951312 - DNA, 22 bp, Homo sapiens
taggacagagatttgttttatg

SEQ ID NO: 6951313 - DNA, 22 bp, Homo sapiens
tagctctggcattctttccaaa

SEQ ID NO: 6951314 - DNA, 19 bp, Homo sapiens
gctttttgttgtcaaaggt

SEQ ID NO: 6951315 - DNA, 22 bp, Homo sapiens
tgtgttccttaaaggatgggca

SEQ ID NO: 6951316 - DNA, 22 bp, Homo sapiens
cttgcttacctagttagctcca

SEQ ID NO: 6951317 - DNA, 22 bp, Homo sapiens
aaagtttgttgcttacaaagaa

SEQ ID NO: 6951318 - DNA, 18 bp, Homo sapiens
agcagagcccatgcattc

SEQ ID NO: 6951319 - DNA, 23 bp, Homo sapiens
ctccaaggcccaactgtctaggc

SEQ ID NO: 6951320 - DNA, 22 bp, Homo sapiens
aagatgcatgctgaagctggct

SEQ ID NO: 6951321 - DNA, 22 bp, Homo sapiens
agagcctgcagtggagaccttg

SEQ ID NO: 6951322 - DNA, 22 bp, Homo sapiens
gtggccagtcccgatgcttgtt

SEQ ID NO: 6951323 - DNA, 22 bp, Homo sapiens
aaaggccaccaacatgaagcat

SEQ ID NO: 6951324 - DNA, 22 bp, Homo sapiens
caaatgatacctattactaggc

SEQ ID NO: 6951325 - DNA, 22 bp, Homo sapiens
caatcactccacaatatggttc

SEQ ID NO: 6951326 - DNA, 22 bp, Homo sapiens
tttacaattggttttctctaat

SEQ ID NO: 6951327 - DNA, 22 bp, Homo sapiens
aagttctggggtaatgagaatt

SEQ ID NO: 6951328 - DNA, 22 bp, Homo sapiens
aagtataatcaaagcagggcta

SEQ ID NO: 6951329 - DNA, 22 bp, Homo sapiens
ttcctgcacagcccttcctgag

SEQ ID NO: 6951330 - DNA, 22 bp, Homo sapiens
aagaatgcatcaaaagtcagag

SEQ ID NO: 6951331 - DNA, 22 bp, Homo sapiens
ttgttgacgacttgactttctc

SEQ ID NO: 6951332 - DNA, 22 bp, Homo sapiens
gagtaattttcttaaaacatca

SEQ ID NO: 6951333 - DNA, 22 bp, Homo sapiens
acaagcgagcggcttctggccg

SEQ ID NO: 6951334 - DNA, 22 bp, Homo sapiens
tcagagaactggcatgtttaga

SEQ ID NO: 6951335 - DNA, 22 bp, Homo sapiens
ggccttctgcctttcagcaatg

SEQ ID NO: 6951336 - DNA, 22 bp, Homo sapiens
tttctctaaatagggaggctta

SEQ ID NO: 6951337 - DNA, 22 bp, Homo sapiens
aagtgatgctacgactttgaca

SEQ ID NO: 6951338 - DNA, 23 bp, Homo sapiens
aagactaattcttaattgcttag

SEQ ID NO: 6951339 - DNA, 23 bp, Homo sapiens
tcagcctcttaggacttctcacc

SEQ ID NO: 6951340 - DNA, 15 bp, Homo sapiens
tccctgctggtcaaa

SEQ ID NO: 6951341 - DNA, 22 bp, Homo sapiens
gccactgcactccagcccaggc

SEQ ID NO: 6951342 - DNA, 22 bp, Homo sapiens
gtgctgaggatacagctgtgaa

SEQ ID NO: 6951343 - DNA, 22 bp, Homo sapiens
aggagtgttcagcgtggggatg

SEQ ID NO: 6951344 - DNA, 22 bp, Homo sapiens
acaggcttcagatgtattaact

SEQ ID NO: 6951345 - DNA, 22 bp, Homo sapiens
tttcctcttccgagggggaggc

SEQ ID NO: 6951346 - DNA, 22 bp, Homo sapiens
cagctcagtctggagagatgca

SEQ ID NO: 6951347 - DNA, 22 bp, Homo sapiens
gacatgtgagcaagcgtgcggc

SEQ ID NO: 6951348 - DNA, 22 bp, Homo sapiens
cttgggtataaaacttggctat

SEQ ID NO: 6951349 - DNA, 22 bp, Homo sapiens
acacaagattgtgtattgaatt

SEQ ID NO: 6951350 - DNA, 22 bp, Homo sapiens
cacatctgcgctctgcctcata

SEQ ID NO: 6951351 - DNA, 22 bp, Homo sapiens
ccctccagagcctggacattct

SEQ ID NO: 6951352 - DNA, 22 bp, Homo sapiens
tttgtaaggaatattcttggtg

SEQ ID NO: 6951353 - DNA, 19 bp, Homo sapiens
gccaggcctggacctgcag

SEQ ID NO: 6951354 - DNA, 22 bp, Homo sapiens
caagtatgagaaagctattacc

SEQ ID NO: 6951355 - DNA, 22 bp, Homo sapiens
tcagtcaatgccttcctgggca

SEQ ID NO: 6951356 - DNA, 22 bp, Homo sapiens
gcagccagggttaattatattt

SEQ ID NO: 6951357 - DNA, 22 bp, Homo sapiens
gagccattgtccaagcctgttt

SEQ ID NO: 6951358 - DNA, 19 bp, Homo sapiens
tgagatttcttaggtgatt

SEQ ID NO: 6951359 - DNA, 23 bp, Homo sapiens
gctgtctgtcatctctgcgggag

SEQ ID NO: 6951360 - DNA, 22 bp, Homo sapiens
aaaagtcttgtcaaggttccca

SEQ ID NO: 6951361 - DNA, 22 bp, Homo sapiens
gcaaggagcacctttctggaac

SEQ ID NO: 6951362 - DNA, 22 bp, Homo sapiens
ggcctggcctcccttcctagcg

SEQ ID NO: 6951363 - DNA, 22 bp, Homo sapiens
agccttaaatgctagattcata

SEQ ID NO: 6951364 - DNA, 22 bp, Homo sapiens
cagctgacttcataggaagaca

SEQ ID NO: 6951365 - DNA, 21 bp, Homo sapiens
cagctgcgtgtcctcccaccc

SEQ ID NO: 6951366 - DNA, 22 bp, Homo sapiens
tagctgccagaccattcttact

SEQ ID NO: 6951367 - DNA, 22 bp, Homo sapiens
caagcctgtctcaccagtgcta

SEQ ID NO: 6951368 - DNA, 19 bp, Homo sapiens
aaagcagaggagcatctga

SEQ ID NO: 6951369 - DNA, 22 bp, Homo sapiens
cgctttaacgtgagaagaaggg

SEQ ID NO: 6951370 - DNA, 22 bp, Homo sapiens
aagcagatgcgttggagcagtt

SEQ ID NO: 6951371 - DNA, 22 bp, Homo sapiens
gaatgctctcattttccaacat

SEQ ID NO: 6951372 - DNA, 22 bp, Homo sapiens
agcagtgcccattctgccccct

SEQ ID NO: 6951373 - DNA, 22 bp, Homo sapiens
cagggcccaagacacaatgagg

SEQ ID NO: 6951374 - DNA, 22 bp, Homo sapiens
ctagcagggtcgacgtctggcg

SEQ ID NO: 6951375 - DNA, 22 bp, Homo sapiens
agcaaactaattgcagttctgg

SEQ ID NO: 6951376 - DNA, 22 bp, Homo sapiens
agctgagggttcggtgtccaca

SEQ ID NO: 6951377 - DNA, 22 bp, Homo sapiens
agccagttgatgggtttccaat

SEQ ID NO: 6951378 - DNA, 22 bp, Homo sapiens
aatctgttaagaacagaaatgt

SEQ ID NO: 6951379 - DNA, 22 bp, Homo sapiens
gctaaaaggagcactagagatt

SEQ ID NO: 6951380 - DNA, 22 bp, Homo sapiens
tgtagatgtagacacaggtcta

SEQ ID NO: 6951381 - DNA, 22 bp, Homo sapiens
ccctgagcccatagttgacatt

SEQ ID NO: 6951382 - DNA, 22 bp, Homo sapiens
tgagtgctgtctgtctagcctc

SEQ ID NO: 6951383 - DNA, 22 bp, Homo sapiens
tctggcctcctccaccagggaa

SEQ ID NO: 6951384 - DNA, 22 bp, Homo sapiens
tggcatttgagctggaaggatg

SEQ ID NO: 6951385 - DNA, 20 bp, Homo sapiens
ccctggactcctgagcaaac

SEQ ID NO: 6951386 - DNA, 22 bp, Homo sapiens
aggccacattgtgattcccgca

SEQ ID NO: 6951387 - DNA, 21 bp, Homo sapiens
tccaaacctgtctctggctct

SEQ ID NO: 6951388 - DNA, 22 bp, Homo sapiens
tctggacaggtcaaagcccatg

SEQ ID NO: 6951389 - DNA, 20 bp, Homo sapiens
attaacactgagctatgggt

SEQ ID NO: 6951390 - DNA, 22 bp, Homo sapiens
cactgaaatcgaaaaatgtagg

SEQ ID NO: 6951391 - DNA, 22 bp, Homo sapiens
taaaagaccctctagagtccca

SEQ ID NO: 6951392 - DNA, 22 bp, Homo sapiens
aaaagttattgatgcaggacaa

SEQ ID NO: 6951393 - DNA, 22 bp, Homo sapiens
tgctttgctctcactgtaaggt

SEQ ID NO: 6951394 - DNA, 23 bp, Homo sapiens
ttgggcaaatcactaacgtctcc

SEQ ID NO: 6951395 - DNA, 22 bp, Homo sapiens
taatgcacatagaagtacttag

SEQ ID NO: 6951396 - DNA, 22 bp, Homo sapiens
tggcacagtgctggatggtgct

SEQ ID NO: 6951397 - DNA, 22 bp, Homo sapiens
tttctcccaaagtgcaaccaca

SEQ ID NO: 6951398 - DNA, 22 bp, Homo sapiens
acagtctcttggaattttcaga

SEQ ID NO: 6951399 - DNA, 22 bp, Homo sapiens
atctggttcttcttaggcatca

SEQ ID NO: 6951400 - DNA, 22 bp, Homo sapiens
agtgcagtaaatgggcattatg

SEQ ID NO: 6951401 - DNA, 17 bp, Homo sapiens
ctgttaattcatttccc

SEQ ID NO: 6951402 - DNA, 22 bp, Homo sapiens
ttgagctgtaaggtgggatgtg

SEQ ID NO: 6951403 - DNA, 22 bp, Homo sapiens
tcctggcaggtctgagaggtct

SEQ ID NO: 6951404 - DNA, 22 bp, Homo sapiens
agaagtcaccctgttgctgtga

SEQ ID NO: 6951405 - DNA, 20 bp, Homo sapiens
gcagagctgttctgtgggga

SEQ ID NO: 6951406 - DNA, 20 bp, Homo sapiens
gaggcccagagaggtgaagc

SEQ ID NO: 6951407 - DNA, 20 bp, Homo sapiens
gcccttatgcagtgatggga

SEQ ID NO: 6951408 - DNA, 22 bp, Homo sapiens
aattcacaatgtgtagtcatgc

SEQ ID NO: 6951409 - DNA, 21 bp, Homo sapiens
acctccctcgagcaaccagca

SEQ ID NO: 6951410 - DNA, 22 bp, Homo sapiens
agtgtattagttgtccagcagt

SEQ ID NO: 6951411 - DNA, 22 bp, Homo sapiens
tgcatcagctgtgcttcttgac

SEQ ID NO: 6951412 - DNA, 19 bp, Homo sapiens
gcgagaacagagcttactg

SEQ ID NO: 6951413 - DNA, 22 bp, Homo sapiens
tgacgttttaggtgttaaatcg

SEQ ID NO: 6951414 - DNA, 22 bp, Homo sapiens
tcttttgttgcctacttattaa

SEQ ID NO: 6951415 - DNA, 22 bp, Homo sapiens
tgaaacctacggagttcccaga

SEQ ID NO: 6951416 - DNA, 22 bp, Homo sapiens
agaggctgtgcccaccaggcaa

SEQ ID NO: 6951417 - DNA, 22 bp, Homo sapiens
tggccccacagggccttttcag

SEQ ID NO: 6951418 - DNA, 22 bp, Homo sapiens
tggagccttttacccacaggag

SEQ ID NO: 6951419 - DNA, 22 bp, Homo sapiens
actcaggctacaggggcagaag

SEQ ID NO: 6951420 - DNA, 22 bp, Homo sapiens
tggatttgctaccttctgatat

SEQ ID NO: 6951421 - DNA, 22 bp, Homo sapiens
tttgaagaagctgacctatttt

SEQ ID NO: 6951422 - DNA, 22 bp, Homo sapiens
ccctggctgccagtcaccagac

SEQ ID NO: 6951423 - DNA, 22 bp, Homo sapiens
cgggctctactggtatactgca

SEQ ID NO: 6951424 - DNA, 22 bp, Homo sapiens
tctgagctacgatgcctgtcac

SEQ ID NO: 6951425 - DNA, 22 bp, Homo sapiens
ctgtgtctctacctccccatcc

SEQ ID NO: 6951426 - DNA, 22 bp, Homo sapiens
ccaatgaaaggtcaattctata

SEQ ID NO: 6951427 - DNA, 22 bp, Homo sapiens
gtgggcctcttgagggtggcta

SEQ ID NO: 6951428 - DNA, 22 bp, Homo sapiens
gtagctgatcctgaggacaggg

SEQ ID NO: 6951429 - DNA, 22 bp, Homo sapiens
tactggagagccttgtccacat

SEQ ID NO: 6951430 - DNA, 22 bp, Homo sapiens
ttcaatatgatattagctgtgg

SEQ ID NO: 6951431 - DNA, 22 bp, Homo sapiens
cactgtggcaacctgtgcccaa

SEQ ID NO: 6951432 - DNA, 22 bp, Homo sapiens
caaggcttcacgtccccagtgc

SEQ ID NO: 6951433 - DNA, 22 bp, Homo sapiens
aggtctgggcaccactggctgc

SEQ ID NO: 6951434 - DNA, 20 bp, Homo sapiens
ctgtccccgaggtcaccagg

SEQ ID NO: 6951435 - DNA, 22 bp, Homo sapiens
ctgcatgagctgtcagtggagg

SEQ ID NO: 6951436 - DNA, 18 bp, Homo sapiens
ttttccttccaccttgaa

SEQ ID NO: 6951437 - DNA, 22 bp, Homo sapiens
cttccagagttgcgttctcggt

SEQ ID NO: 6951438 - DNA, 22 bp, Homo sapiens
gaaggaagtgctcatactagtt

SEQ ID NO: 6951439 - DNA, 22 bp, Homo sapiens
agctgcctgtaaaatgtgtgat

SEQ ID NO: 6951440 - DNA, 22 bp, Homo sapiens
ctgataccttgaccttggactt

SEQ ID NO: 6951441 - DNA, 22 bp, Homo sapiens
tgaggcaattggaaattttaac

SEQ ID NO: 6951442 - DNA, 22 bp, Homo sapiens
ctgaggagtttcttatatgtgt

SEQ ID NO: 6951443 - DNA, 22 bp, Homo sapiens
taaactacagtggtaatgtctc

SEQ ID NO: 6951444 - DNA, 22 bp, Homo sapiens
tactgtgtgcccagccgagctg

SEQ ID NO: 6951445 - DNA, 22 bp, Homo sapiens
atgtcctttgttctgagggagt

SEQ ID NO: 6951446 - DNA, 22 bp, Homo sapiens
gctggccagggctgctcgcgga

SEQ ID NO: 6951447 - DNA, 22 bp, Homo sapiens
tggctcagataattcaaggggc

SEQ ID NO: 6951448 - DNA, 22 bp, Homo sapiens
aacgtccacgtcaggctctggg

SEQ ID NO: 6951449 - DNA, 22 bp, Homo sapiens
tgcctgcatcttggaggcccca

SEQ ID NO: 6951450 - DNA, 22 bp, Homo sapiens
ggggatggtagaccggtgacgt

SEQ ID NO: 6951451 - DNA, 22 bp, Homo sapiens
tgcttaatattgtgatgtaata

SEQ ID NO: 6951452 - DNA, 19 bp, Homo sapiens
tgcaatcagctacccaggt

SEQ ID NO: 6951453 - DNA, 22 bp, Homo sapiens
tctgtggcatagtgcttgggaa

SEQ ID NO: 6951454 - DNA, 22 bp, Homo sapiens
atgtctgtgttatctgtagaat

SEQ ID NO: 6951455 - DNA, 22 bp, Homo sapiens
cctaggtattttgtaaaggtaa

SEQ ID NO: 6951456 - DNA, 22 bp, Homo sapiens
agacatggtttattttaatggt

SEQ ID NO: 6951457 - DNA, 22 bp, Homo sapiens
tgtgtgccagcctacgaggagc

SEQ ID NO: 6951458 - DNA, 22 bp, Homo sapiens
tgagtgactccactggggcaga

SEQ ID NO: 6951459 - DNA, 22 bp, Homo sapiens
atgtgtttataattactcaatc

SEQ ID NO: 6951460 - DNA, 22 bp, Homo sapiens
tgcaggagccttggacttgaaa

SEQ ID NO: 6951461 - DNA, 22 bp, Homo sapiens
atggccaccatttaatgaagct

SEQ ID NO: 6951462 - DNA, 22 bp, Homo sapiens
gacatatttgaaaccaagagaa

SEQ ID NO: 6951463 - DNA, 22 bp, Homo sapiens
cctgcaccaggcccagcatggt

SEQ ID NO: 6951464 - DNA, 19 bp, Homo sapiens
caggtggtaatctgagcct

SEQ ID NO: 6951465 - DNA, 22 bp, Homo sapiens
attccagatgaattgcatagtt

SEQ ID NO: 6951466 - DNA, 20 bp, Homo sapiens
tcttctggatttcctttagg

SEQ ID NO: 6951467 - DNA, 22 bp, Homo sapiens
aaggtccagaggtcccgtcacc

SEQ ID NO: 6951468 - DNA, 22 bp, Homo sapiens
acagtgttgtatttagtttgat

SEQ ID NO: 6951469 - DNA, 22 bp, Homo sapiens
ctggttccagaattgcctgtgg

SEQ ID NO: 6951470 - DNA, 22 bp, Homo sapiens
agctgtttaataaatgtctgtt

SEQ ID NO: 6951471 - DNA, 21 bp, Homo sapiens
gacactgcttactctgaccta

SEQ ID NO: 6951472 - DNA, 22 bp, Homo sapiens
attctagagtttcaatccaagg

SEQ ID NO: 6951473 - DNA, 22 bp, Homo sapiens
aaagtgttgatatgtgacatcc

SEQ ID NO: 6951474 - DNA, 22 bp, Homo sapiens
gggcaatgggcttttctgtaag

SEQ ID NO: 6951475 - DNA, 22 bp, Homo sapiens
tcaggcagaattatcaaaagat

SEQ ID NO: 6951476 - DNA, 22 bp, Homo sapiens
aagtgtcttctgatggggtgtg

SEQ ID NO: 6951477 - DNA, 21 bp, Homo sapiens
ctctgggccattttcttccac

SEQ ID NO: 6951478 - DNA, 22 bp, Homo sapiens
gcagctggcccctttccttgtt

SEQ ID NO: 6951479 - DNA, 22 bp, Homo sapiens
ctcagggaattgaatctccttg

SEQ ID NO: 6951480 - DNA, 22 bp, Homo sapiens
gccctggatgctcatggcatca

SEQ ID NO: 6951481 - DNA, 22 bp, Homo sapiens
tgcatcgagggtattttatttg

SEQ ID NO: 6951482 - DNA, 22 bp, Homo sapiens
caggcaccacactaggggctga

SEQ ID NO: 6951483 - DNA, 22 bp, Homo sapiens
agtaatcaatttttcggtggat

SEQ ID NO: 6951484 - DNA, 21 bp, Homo sapiens
ctgcagagcatgcaaaatgtt

SEQ ID NO: 6951485 - DNA, 22 bp, Homo sapiens
tctgccactgtggccatgggag

SEQ ID NO: 6951486 - DNA, 22 bp, Homo sapiens
tattattgacatttacttggtg

SEQ ID NO: 6951487 - DNA, 22 bp, Homo sapiens
cagagccctgcatgctccatct

SEQ ID NO: 6951488 - DNA, 22 bp, Homo sapiens
tcacagttaattgttggaatgt

SEQ ID NO: 6951489 - DNA, 22 bp, Homo sapiens
tgacaaaccagtagcaataaag

SEQ ID NO: 6951490 - DNA, 22 bp, Homo sapiens
agagagcattgaggaaatcttc

SEQ ID NO: 6951491 - DNA, 22 bp, Homo sapiens
ggaagcggccctgagcgcaggg

SEQ ID NO: 6951492 - DNA, 19 bp, Homo sapiens
agtgttaacccagtgttgg

SEQ ID NO: 6951493 - DNA, 22 bp, Homo sapiens
ggctctgcccagatgaagagga

SEQ ID NO: 6951494 - DNA, 22 bp, Homo sapiens
ataggcacatagtgtccggaac

SEQ ID NO: 6951495 - DNA, 23 bp, Homo sapiens
taatggagtgtggctgcttcgag

SEQ ID NO: 6951496 - DNA, 22 bp, Homo sapiens
ggggcaaagggagagtccctac

SEQ ID NO: 6951497 - DNA, 22 bp, Homo sapiens
ggtctgaaatgtgacttttgaa

SEQ ID NO: 6951498 - DNA, 22 bp, Homo sapiens
tggctacagcaagaggaaagaa

SEQ ID NO: 6951499 - DNA, 22 bp, Homo sapiens
ggtggcatacatttctgtcttg

SEQ ID NO: 6951500 - DNA, 22 bp, Homo sapiens
atgaggagccctcatttaggtt

SEQ ID NO: 6951501 - DNA, 20 bp, Homo sapiens
ctgcctggaggcctctacct

SEQ ID NO: 6951502 - DNA, 22 bp, Homo sapiens
gtggcctgtgctgtctccccaa

SEQ ID NO: 6951503 - DNA, 22 bp, Homo sapiens
cagctagagggatgctgtgtga

SEQ ID NO: 6951504 - DNA, 22 bp, Homo sapiens
ggccacctctgccctactgagt

SEQ ID NO: 6951505 - DNA, 22 bp, Homo sapiens
attctattttttaagaagtagt

SEQ ID NO: 6951506 - DNA, 22 bp, Homo sapiens
tttacaatagggtctgaatgaa

SEQ ID NO: 6951507 - DNA, 22 bp, Homo sapiens
tgttctatgctctttaaggtga

SEQ ID NO: 6951508 - DNA, 22 bp, Homo sapiens
gagctttctgtgttccagttgc

SEQ ID NO: 6951509 - DNA, 22 bp, Homo sapiens
tgtgctctgcccctgactgttt

SEQ ID NO: 6951510 - DNA, 22 bp, Homo sapiens
gaggaggcttccgggaggcacg

SEQ ID NO: 6951511 - DNA, 22 bp, Homo sapiens
tgggagaggctgccatcttgca

SEQ ID NO: 6951512 - DNA, 22 bp, Homo sapiens
tgcctactagtactattttgtg

SEQ ID NO: 6951513 - DNA, 22 bp, Homo sapiens
tcattccatttccagctctgaa

SEQ ID NO: 6951514 - DNA, 22 bp, Homo sapiens
actgaattttcacttattttag

SEQ ID NO: 6951515 - DNA, 22 bp, Homo sapiens
tgggccgtggagcactctgaga

SEQ ID NO: 6951516 - DNA, 22 bp, Homo sapiens
acttcatgtagtccatcaggtt

SEQ ID NO: 6951517 - DNA, 22 bp, Homo sapiens
aaatagatttcctagcattgga

SEQ ID NO: 6951518 - DNA, 21 bp, Homo sapiens
cctcagtctccctgctccact

SEQ ID NO: 6951519 - DNA, 22 bp, Homo sapiens
tgtctctgaggtgagggtcagc

SEQ ID NO: 6951520 - DNA, 22 bp, Homo sapiens
cacagcaatagctaactgatac

SEQ ID NO: 6951521 - DNA, 22 bp, Homo sapiens
gctggagtaggaccatgcttga

SEQ ID NO: 6951522 - DNA, 22 bp, Homo sapiens
tatcttgtaataggtccacttg

SEQ ID NO: 6951523 - DNA, 22 bp, Homo sapiens
taggaatgaagaagtatgatat

SEQ ID NO: 6951524 - DNA, 22 bp, Homo sapiens
agcaactttgagatagacttag

SEQ ID NO: 6951525 - DNA, 22 bp, Homo sapiens
caaggcctatgcacacctagga

SEQ ID NO: 6951526 - DNA, 22 bp, Homo sapiens
ctgaggcagtttaatttttgaa

SEQ ID NO: 6951527 - DNA, 22 bp, Homo sapiens
ttctgttactgttggtcataac

SEQ ID NO: 6951528 - DNA, 22 bp, Homo sapiens
tcacctgtattaatacagaact

SEQ ID NO: 6951529 - DNA, 22 bp, Homo sapiens
caggagcaaatccaaaagaatt

SEQ ID NO: 6951530 - DNA, 22 bp, Homo sapiens
gctcctgggccctgggctaact

SEQ ID NO: 6951531 - DNA, 22 bp, Homo sapiens
tcagtcaggttctgatttctgg

SEQ ID NO: 6951532 - DNA, 20 bp, Homo sapiens
gagtccttatgggctgaggt

SEQ ID NO: 6951533 - DNA, 22 bp, Homo sapiens
aatgacagtggcacagtcactt

SEQ ID NO: 6951534 - DNA, 22 bp, Homo sapiens
cctaagtaagttgactttcaga

SEQ ID NO: 6951535 - DNA, 22 bp, Homo sapiens
agttgtgtggttggcggctgcg

SEQ ID NO: 6951536 - DNA, 22 bp, Homo sapiens
cctgagcctcttgcacgctcag

SEQ ID NO: 6951537 - DNA, 22 bp, Homo sapiens
gtctcaggttcgagcctcctta

SEQ ID NO: 6951538 - DNA, 22 bp, Homo sapiens
gtgacgtttaatagtgacatgg

SEQ ID NO: 6951539 - DNA, 23 bp, Homo sapiens
gttaccatctacatttgtgttgc

SEQ ID NO: 6951540 - DNA, 22 bp, Homo sapiens
ggaggagcatgagagggtagtg

SEQ ID NO: 6951541 - DNA, 22 bp, Homo sapiens
ctgctgccattagggcacagac

SEQ ID NO: 6951542 - DNA, 22 bp, Homo sapiens
cccagagaagtgaagtgacttg

SEQ ID NO: 6951543 - DNA, 22 bp, Homo sapiens
tgccctatgaatttattattgg

SEQ ID NO: 6951544 - DNA, 22 bp, Homo sapiens
atgacaatatagctttgatttt

SEQ ID NO: 6951545 - DNA, 22 bp, Homo sapiens
aggtcaaaatgcttttcaggtc

SEQ ID NO: 6951546 - DNA, 22 bp, Homo sapiens
ttagaagtgggcctatagtcct

SEQ ID NO: 6951547 - DNA, 22 bp, Homo sapiens
cagcaaatgagtggcagggcag

SEQ ID NO: 6951548 - DNA, 22 bp, Homo sapiens
atagacatagccgtaatttatt

SEQ ID NO: 6951549 - DNA, 22 bp, Homo sapiens
tcactgtagtgagcagaatata

SEQ ID NO: 6951550 - DNA, 22 bp, Homo sapiens
tttacaacctcatattctgatg

SEQ ID NO: 6951551 - DNA, 22 bp, Homo sapiens
aggaggtggcctgagcgtgccc

SEQ ID NO: 6951552 - DNA, 22 bp, Homo sapiens
agtctccgctctcggagtcggc

SEQ ID NO: 6951553 - DNA, 22 bp, Homo sapiens
aagcagtaatgaggtactattt

SEQ ID NO: 6951554 - DNA, 22 bp, Homo sapiens
tgtacagtatatttcaaagcca

SEQ ID NO: 6951555 - DNA, 23 bp, Homo sapiens
ccctggagctagtctgagcagag

SEQ ID NO: 6951556 - DNA, 22 bp, Homo sapiens
cacatgttaatgaaaggttttt

SEQ ID NO: 6951557 - DNA, 22 bp, Homo sapiens
catttgtacagaacagctttat

SEQ ID NO: 6951558 - DNA, 22 bp, Homo sapiens
gaaccaagtaggatacaaggag

SEQ ID NO: 6951559 - DNA, 22 bp, Homo sapiens
cagatgcacattctcatcagca

SEQ ID NO: 6951560 - DNA, 23 bp, Homo sapiens
tgacaggccagaagagcagctgg

SEQ ID NO: 6951561 - DNA, 22 bp, Homo sapiens
agccattgaatttagtgccttt

SEQ ID NO: 6951562 - DNA, 22 bp, Homo sapiens
caggatggagggagggctgtta

SEQ ID NO: 6951563 - DNA, 22 bp, Homo sapiens
ttgctacatggtttcaaagctg

SEQ ID NO: 6951564 - DNA, 22 bp, Homo sapiens
ctgtgcctccagtctcgcttct

SEQ ID NO: 6951565 - DNA, 22 bp, Homo sapiens
gctgcccaatggtagtgtcttt

SEQ ID NO: 6951566 - DNA, 22 bp, Homo sapiens
gaagattaaatggctcccatat

SEQ ID NO: 6951567 - DNA, 22 bp, Homo sapiens
aactgtttaccatacacagtga

SEQ ID NO: 6951568 - DNA, 22 bp, Homo sapiens
ttctgccatttacaaatttcat

SEQ ID NO: 6951569 - DNA, 22 bp, Homo sapiens
ccaggacacgatttttagtctg

SEQ ID NO: 6951570 - DNA, 22 bp, Homo sapiens
tctgtctttgtcaggaccagag

SEQ ID NO: 6951571 - DNA, 22 bp, Homo sapiens
caggcacgggggcatggcctct

SEQ ID NO: 6951572 - DNA, 22 bp, Homo sapiens
tcaggatacctcagttttagct

SEQ ID NO: 6951573 - DNA, 22 bp, Homo sapiens
gcttcagaaatatcatcattat

SEQ ID NO: 6951574 - DNA, 22 bp, Homo sapiens
ctggagtgactttgttcctttt

SEQ ID NO: 6951575 - DNA, 18 bp, Homo sapiens
gcttcatggaagggttgt

SEQ ID NO: 6951576 - DNA, 22 bp, Homo sapiens
aagccctgtccggggggaagaa

SEQ ID NO: 6951577 - DNA, 22 bp, Homo sapiens
tctcagaataaattcctaactt

SEQ ID NO: 6951578 - DNA, 22 bp, Homo sapiens
taatggattaacgtccctgtcg

SEQ ID NO: 6951579 - DNA, 22 bp, Homo sapiens
cataatcctgtcctggattctt

SEQ ID NO: 6951580 - DNA, 23 bp, Homo sapiens
gataggctggttagtgtatctgt

SEQ ID NO: 6951581 - DNA, 22 bp, Homo sapiens
ctggccaagatggtgaaacccc

SEQ ID NO: 6951582 - DNA, 22 bp, Homo sapiens
caggattgagcaaatggattat

SEQ ID NO: 6951583 - DNA, 22 bp, Homo sapiens
ggccagcttattagctcagagg

SEQ ID NO: 6951584 - DNA, 22 bp, Homo sapiens
tttcacagcttccacttaagga

SEQ ID NO: 6951585 - DNA, 22 bp, Homo sapiens
tccaggccattgactgcatcct

SEQ ID NO: 6951586 - DNA, 22 bp, Homo sapiens
cagtaatagagtgccagggatg

SEQ ID NO: 6951587 - DNA, 23 bp, Homo sapiens
ccacagagctgccaattcctgtg

SEQ ID NO: 6951588 - DNA, 22 bp, Homo sapiens
taaggccttgaaaggatgtcct

SEQ ID NO: 6951589 - DNA, 17 bp, Homo sapiens
aagaatcattagagaag

SEQ ID NO: 6951590 - DNA, 22 bp, Homo sapiens
ggcaagtgtgagaagggactgg

SEQ ID NO: 6951591 - DNA, 22 bp, Homo sapiens
ttccatatctgttgcatatcat

SEQ ID NO: 6951592 - DNA, 22 bp, Homo sapiens
cctggctgccgagtgtgcagcg

SEQ ID NO: 6951593 - DNA, 20 bp, Homo sapiens
tcagagctgcaggagagaaa

SEQ ID NO: 6951594 - DNA, 22 bp, Homo sapiens
ccttggagcggtcagcactggt

SEQ ID NO: 6951595 - DNA, 22 bp, Homo sapiens
gcctgtgtgtttagctctgggg

SEQ ID NO: 6951596 - DNA, 22 bp, Homo sapiens
gcagctctatgtgatggtaaat

SEQ ID NO: 6951597 - DNA, 22 bp, Homo sapiens
aggtatgccaattaggtcaagt

SEQ ID NO: 6951598 - DNA, 22 bp, Homo sapiens
tttcaaaggtggaagagtgaat

SEQ ID NO: 6951599 - DNA, 22 bp, Homo sapiens
gttcagcaagaatgtttctatt

SEQ ID NO: 6951600 - DNA, 22 bp, Homo sapiens
ttccttccacttcaggattttg

SEQ ID NO: 6951601 - DNA, 22 bp, Homo sapiens
acatgatttcagggaattctca

SEQ ID NO: 6951602 - DNA, 22 bp, Homo sapiens
gagttagggccccgcggccgtg

SEQ ID NO: 6951603 - DNA, 22 bp, Homo sapiens
ttactgttcatgttgtacactt

SEQ ID NO: 6951604 - DNA, 23 bp, Homo sapiens
agagtccacaagattttccagtg

SEQ ID NO: 6951605 - DNA, 22 bp, Homo sapiens
tctctgatgctgccagggaaaa

SEQ ID NO: 6951606 - DNA, 22 bp, Homo sapiens
ctcctcttctgagtaccaggga

SEQ ID NO: 6951607 - DNA, 17 bp, Homo sapiens
cccagggaccactgctt

SEQ ID NO: 6951608 - DNA, 22 bp, Homo sapiens
tatgtacatgatttcatttgct

SEQ ID NO: 6951609 - DNA, 22 bp, Homo sapiens
gagggaggcatcatgaatccag

SEQ ID NO: 6951610 - DNA, 22 bp, Homo sapiens
cctttgtggtggcccagtgtgg

SEQ ID NO: 6951611 - DNA, 22 bp, Homo sapiens
aagtattcataaggacatatgt

SEQ ID NO: 6951612 - DNA, 22 bp, Homo sapiens
gaatcttagtctcctaacggct

SEQ ID NO: 6951613 - DNA, 22 bp, Homo sapiens
gggaacagcctcaccagccctg

SEQ ID NO: 6951614 - DNA, 22 bp, Homo sapiens
tcttctcagtttctctaggatg

SEQ ID NO: 6951615 - DNA, 22 bp, Homo sapiens
atttcccatgtgaatcaattgg

SEQ ID NO: 6951616 - DNA, 22 bp, Homo sapiens
agtgaaataaagctgcctatgg

SEQ ID NO: 6951617 - DNA, 21 bp, Homo sapiens
gttcagagattattgagtcat

SEQ ID NO: 6951618 - DNA, 22 bp, Homo sapiens
aatgtctgtctgcacgttgctt

SEQ ID NO: 6951619 - DNA, 22 bp, Homo sapiens
gcagagatcggacactcagtaa

SEQ ID NO: 6951620 - DNA, 22 bp, Homo sapiens
tatgtagagataaaatccaaat

SEQ ID NO: 6951621 - DNA, 19 bp, Homo sapiens
cccagctgttcttccacca

SEQ ID NO: 6951622 - DNA, 22 bp, Homo sapiens
gagagaccttgctaagtgcctt

SEQ ID NO: 6951623 - DNA, 18 bp, Homo sapiens
cggatcatgcgctgaggc

SEQ ID NO: 6951624 - DNA, 22 bp, Homo sapiens
gtggccagaggatttgttcagt

SEQ ID NO: 6951625 - DNA, 22 bp, Homo sapiens
cctgctgagaaatcaagggagt

SEQ ID NO: 6951626 - DNA, 22 bp, Homo sapiens
aagaatcattgtaaagttctgt

SEQ ID NO: 6951627 - DNA, 22 bp, Homo sapiens
ttcctaacctctagctgcatat

SEQ ID NO: 6951628 - DNA, 22 bp, Homo sapiens
agtggaggcactaattggattt

SEQ ID NO: 6951629 - DNA, 22 bp, Homo sapiens
acatggagaccagatggaagta

SEQ ID NO: 6951630 - DNA, 22 bp, Homo sapiens
ttgccaggctctggttccagcc

SEQ ID NO: 6951631 - DNA, 20 bp, Homo sapiens
gcttctcagggcttctctga

SEQ ID NO: 6951632 - DNA, 22 bp, Homo sapiens
tacgggagagggcgcctgagtg

SEQ ID NO: 6951633 - DNA, 22 bp, Homo sapiens
aaagtaagatttgcatttcaga

SEQ ID NO: 6951634 - DNA, 22 bp, Homo sapiens
ggatggctccagaaagcagggt

SEQ ID NO: 6951635 - DNA, 22 bp, Homo sapiens
gaggcctggtttgcatgagaat

SEQ ID NO: 6951636 - DNA, 22 bp, Homo sapiens
cagggttgtcagtgtttcaggt

SEQ ID NO: 6951637 - DNA, 22 bp, Homo sapiens
gatgtacatgcaagcacttaga

SEQ ID NO: 6951638 - DNA, 22 bp, Homo sapiens
agcagtgagccataagtgctag

SEQ ID NO: 6951639 - DNA, 18 bp, Homo sapiens
agctgcttttggcttaaa

SEQ ID NO: 6951640 - DNA, 22 bp, Homo sapiens
cacgtgttccaggcatggttct

SEQ ID NO: 6951641 - DNA, 22 bp, Homo sapiens
cccgtttcagtgttccttgctt

SEQ ID NO: 6951642 - DNA, 20 bp, Homo sapiens
agcagtgtggggagactgtg

SEQ ID NO: 6951643 - DNA, 20 bp, Homo sapiens
gctccaagcccctttagagg

SEQ ID NO: 6951644 - DNA, 22 bp, Homo sapiens
tatcttcatagatttttacacc

SEQ ID NO: 6951645 - DNA, 22 bp, Homo sapiens
ctgggaagccacagggtgtggg

SEQ ID NO: 6951646 - DNA, 20 bp, Homo sapiens
agccctgtaaatcccctgga

SEQ ID NO: 6951647 - DNA, 22 bp, Homo sapiens
gtgattcaaatgtaactaatta

SEQ ID NO: 6951648 - DNA, 23 bp, Homo sapiens
atcagtcttggtagctgtgccca

SEQ ID NO: 6951649 - DNA, 22 bp, Homo sapiens
ggtgggccacggcataacgggc

SEQ ID NO: 6951650 - DNA, 22 bp, Homo sapiens
tgggtcctggaaggcgacaggt

SEQ ID NO: 6951651 - DNA, 22 bp, Homo sapiens
aatgaggtgaggaaggcctcag

SEQ ID NO: 6951652 - DNA, 23 bp, Homo sapiens
gcaggagttcctggactccagga

SEQ ID NO: 6951653 - DNA, 22 bp, Homo sapiens
aagtgtctagcacctggatgca

SEQ ID NO: 6951654 - DNA, 22 bp, Homo sapiens
tgatttacccgtaactatttct

SEQ ID NO: 6951655 - DNA, 22 bp, Homo sapiens
aggagggagatgcccatcctgg

SEQ ID NO: 6951656 - DNA, 22 bp, Homo sapiens
agcaaggctgggtctaatgggg

SEQ ID NO: 6951657 - DNA, 18 bp, Homo sapiens
ggcaggggtgaaccacag

SEQ ID NO: 6951658 - DNA, 22 bp, Homo sapiens
agaggcacggaggctgcatgga

SEQ ID NO: 6951659 - DNA, 22 bp, Homo sapiens
tgggcagattaatgcagtggct

SEQ ID NO: 6951660 - DNA, 20 bp, Homo sapiens
tttggcatcattttgggagc

SEQ ID NO: 6951661 - DNA, 22 bp, Homo sapiens
atatgcataatacaaagagtat

SEQ ID NO: 6951662 - DNA, 22 bp, Homo sapiens
acattttgagaaatgacaagct

SEQ ID NO: 6951663 - DNA, 22 bp, Homo sapiens
ccttcttcaccagtttacctga

SEQ ID NO: 6951664 - DNA, 22 bp, Homo sapiens
ttctggaagccctaagggagaa

SEQ ID NO: 6951665 - DNA, 22 bp, Homo sapiens
gacctgcccactctgaggacat

SEQ ID NO: 6951666 - DNA, 17 bp, Homo sapiens
aaagagcttggagtgtt

SEQ ID NO: 6951667 - DNA, 22 bp, Homo sapiens
cctgcaagactatttagttcca

SEQ ID NO: 6951668 - DNA, 19 bp, Homo sapiens
caggacagtttgccaagaa

SEQ ID NO: 6951669 - DNA, 22 bp, Homo sapiens
tgatggaagtgactgtcagttc

SEQ ID NO: 6951670 - DNA, 22 bp, Homo sapiens
ggagtcctggactccatctcac

SEQ ID NO: 6951671 - DNA, 18 bp, Homo sapiens
tcacattataatgtaaca

SEQ ID NO: 6951672 - DNA, 22 bp, Homo sapiens
cagggctgctggccgtgccctc

SEQ ID NO: 6951673 - DNA, 22 bp, Homo sapiens
caatagctgaaagttatggtag

SEQ ID NO: 6951674 - DNA, 22 bp, Homo sapiens
tttcagtgcacgtagtttattt

SEQ ID NO: 6951675 - DNA, 22 bp, Homo sapiens
aatgcaggcacgtgcaagcaag

SEQ ID NO: 6951676 - DNA, 22 bp, Homo sapiens
caagtattctgtaaaaagtcaa

SEQ ID NO: 6951677 - DNA, 22 bp, Homo sapiens
attgccacctgttgctatggag

SEQ ID NO: 6951678 - DNA, 18 bp, Homo sapiens
cctgagccctgcttactt

SEQ ID NO: 6951679 - DNA, 22 bp, Homo sapiens
caggtggggcagctgtgggagc

SEQ ID NO: 6951680 - DNA, 22 bp, Homo sapiens
ctgctagcccaggatgcaggga

SEQ ID NO: 6951681 - DNA, 22 bp, Homo sapiens
ttggcaatcaattctgacgtct

SEQ ID NO: 6951682 - DNA, 21 bp, Homo sapiens
gccaggagtagattacattta

SEQ ID NO: 6951683 - DNA, 22 bp, Homo sapiens
tttccaaaggaggaaccagttt

SEQ ID NO: 6951684 - DNA, 22 bp, Homo sapiens
ttctttatcagttactcatagg

SEQ ID NO: 6951685 - DNA, 22 bp, Homo sapiens
tggaatactgtaaagaaaaatc

SEQ ID NO: 6951686 - DNA, 22 bp, Homo sapiens
ttgtcacccctagaggaattct

SEQ ID NO: 6951687 - DNA, 22 bp, Homo sapiens
aagctaagggtgtttaagcagg

SEQ ID NO: 6951688 - DNA, 22 bp, Homo sapiens
gtcatggtgctagcgggaatgt

SEQ ID NO: 6951689 - DNA, 22 bp, Homo sapiens
agggcctccagggcagcagtgg

SEQ ID NO: 6951690 - DNA, 22 bp, Homo sapiens
ctggaaagttcaagataaagct

SEQ ID NO: 6951691 - DNA, 22 bp, Homo sapiens
ctaggctagatagtatattggt

SEQ ID NO: 6951692 - DNA, 22 bp, Homo sapiens
atgcttcctttttcccttaagg

SEQ ID NO: 6951693 - DNA, 22 bp, Homo sapiens
agccggctggtgccctcgggga

SEQ ID NO: 6951694 - DNA, 22 bp, Homo sapiens
tgggtgagtgggaaaagcccag

SEQ ID NO: 6951695 - DNA, 22 bp, Homo sapiens
caaatttaagtgaggtctttgt

SEQ ID NO: 6951696 - DNA, 22 bp, Homo sapiens
ctgcagcctcaacctcctgagc

SEQ ID NO: 6951697 - DNA, 23 bp, Homo sapiens
tcagttttggctgttcagtgttg

SEQ ID NO: 6951698 - DNA, 22 bp, Homo sapiens
atctctaatttaaaaagtaaca

SEQ ID NO: 6951699 - DNA, 22 bp, Homo sapiens
agtcggaagctgtgcgtaaatc

SEQ ID NO: 6951700 - DNA, 22 bp, Homo sapiens
gcagggtcttgagaggcagcca

SEQ ID NO: 6951701 - DNA, 22 bp, Homo sapiens
tctgaattcttagaattaaagg

SEQ ID NO: 6951702 - DNA, 22 bp, Homo sapiens
ctgcagcaagagaagtgctgac

SEQ ID NO: 6951703 - DNA, 22 bp, Homo sapiens
gcagatgttgttgctgggagtt

SEQ ID NO: 6951704 - DNA, 22 bp, Homo sapiens
tgccctcattataagaggctca

SEQ ID NO: 6951705 - DNA, 22 bp, Homo sapiens
agtttagcatttgaagttattc

SEQ ID NO: 6951706 - DNA, 22 bp, Homo sapiens
tccaggcctgactataaatgta

SEQ ID NO: 6951707 - DNA, 22 bp, Homo sapiens
gcagtggggaatgctggggaga

SEQ ID NO: 6951708 - DNA, 22 bp, Homo sapiens
ttgttgcaacagacaccatatg

SEQ ID NO: 6951709 - DNA, 22 bp, Homo sapiens
gggctaagcagagtgggaacag

SEQ ID NO: 6951710 - DNA, 22 bp, Homo sapiens
gggcttcattcaggcagaattt

SEQ ID NO: 6951711 - DNA, 22 bp, Homo sapiens
tgctggcccatgaagacgcagt

SEQ ID NO: 6951712 - DNA, 22 bp, Homo sapiens
cagttgcagaggcagagtgcta

SEQ ID NO: 6951713 - DNA, 22 bp, Homo sapiens
tatccataccactacttccctt

SEQ ID NO: 6951714 - DNA, 22 bp, Homo sapiens
ttctgagaggcagagcttgtga

SEQ ID NO: 6951715 - DNA, 21 bp, Homo sapiens
gccaattccagctgagttagc

SEQ ID NO: 6951716 - DNA, 22 bp, Homo sapiens
actgccctcccatctattgcaa

SEQ ID NO: 6951717 - DNA, 22 bp, Homo sapiens
agggtgcaggtgtggagtctag

SEQ ID NO: 6951718 - DNA, 22 bp, Homo sapiens
aacaagtaagtttatatatatt

SEQ ID NO: 6951719 - DNA, 22 bp, Homo sapiens
gttggagcagagtagctgctca

SEQ ID NO: 6951720 - DNA, 22 bp, Homo sapiens
acactgtaggagaaaggagttt

SEQ ID NO: 6951721 - DNA, 22 bp, Homo sapiens
ttattgtttgggtataatttga

SEQ ID NO: 6951722 - DNA, 22 bp, Homo sapiens
ccatgcaacagaatccagattt

SEQ ID NO: 6951723 - DNA, 22 bp, Homo sapiens
ctgtggtctgtaggagtgatgg

SEQ ID NO: 6951724 - DNA, 22 bp, Homo sapiens
ttttctgtgtatccaggcttcc

SEQ ID NO: 6951725 - DNA, 22 bp, Homo sapiens
atgctgagatcctcaggccaga

SEQ ID NO: 6951726 - DNA, 15 bp, Homo sapiens
ccaggctgggtgagc

SEQ ID NO: 6951727 - DNA, 22 bp, Homo sapiens
caggttcattctttcttgtatt

SEQ ID NO: 6951728 - DNA, 22 bp, Homo sapiens
aaggccagacaggaccacatct

SEQ ID NO: 6951729 - DNA, 22 bp, Homo sapiens
gtgttcattgtatggaatgggt

SEQ ID NO: 6951730 - DNA, 22 bp, Homo sapiens
ttattagctgggcttcagggtg

SEQ ID NO: 6951731 - DNA, 22 bp, Homo sapiens
tctcagagacctgaactccctg

SEQ ID NO: 6951732 - DNA, 22 bp, Homo sapiens
aaggcacatattgcagatcttg

SEQ ID NO: 6951733 - DNA, 21 bp, Homo sapiens
ccctgtgttccacagcagaca

SEQ ID NO: 6951734 - DNA, 22 bp, Homo sapiens
catgaaatatgctacctgtctt

SEQ ID NO: 6951735 - DNA, 22 bp, Homo sapiens
tcagtggattgtagaaggctta

SEQ ID NO: 6951736 - DNA, 22 bp, Homo sapiens
ggaccatggacaaatttctaga

SEQ ID NO: 6951737 - DNA, 22 bp, Homo sapiens
accttcgtttcccactttgtaa

SEQ ID NO: 6951738 - DNA, 20 bp, Homo sapiens
gggctgttgctcttggtttg

SEQ ID NO: 6951739 - DNA, 22 bp, Homo sapiens
gggcagcatcaggaggggcttt

SEQ ID NO: 6951740 - DNA, 22 bp, Homo sapiens
agtacagcaccatgagcacagg

SEQ ID NO: 6951741 - DNA, 22 bp, Homo sapiens
aggcctgtttccttgggttgct

SEQ ID NO: 6951742 - DNA, 22 bp, Homo sapiens
tgtacagaggtgtacatatgat

SEQ ID NO: 6951743 - DNA, 22 bp, Homo sapiens
ttgtttacaagttactcagtct

SEQ ID NO: 6951744 - DNA, 22 bp, Homo sapiens
ctattttcattcttacattgtc

SEQ ID NO: 6951745 - DNA, 22 bp, Homo sapiens
tggaaccatcaaagagatcctg

SEQ ID NO: 6951746 - DNA, 20 bp, Homo sapiens
tctgttcaaatcttagttcc

SEQ ID NO: 6951747 - DNA, 22 bp, Homo sapiens
ttagagtttttgtaagtacaat

SEQ ID NO: 6951748 - DNA, 22 bp, Homo sapiens
ataatgcatttagaataattca

SEQ ID NO: 6951749 - DNA, 22 bp, Homo sapiens
cttgatgaaatttttcaattgt

SEQ ID NO: 6951750 - DNA, 22 bp, Homo sapiens
caatagatacctttgtcccaat

SEQ ID NO: 6951751 - DNA, 20 bp, Homo sapiens
gctctttgtaagggaatttg

SEQ ID NO: 6951752 - DNA, 18 bp, Homo sapiens
ggcacctctcttgcctta

SEQ ID NO: 6951753 - DNA, 22 bp, Homo sapiens
ctccaaatacaatattgttgtt

SEQ ID NO: 6951754 - DNA, 22 bp, Homo sapiens
gggtgcggtccccacagcccgt

SEQ ID NO: 6951755 - DNA, 22 bp, Homo sapiens
tctgggtccccgaggaaggaga

SEQ ID NO: 6951756 - DNA, 22 bp, Homo sapiens
agccaggatggtctcgatcggc

SEQ ID NO: 6951757 - DNA, 22 bp, Homo sapiens
ggtctggcaggtgaggactcag

SEQ ID NO: 6951758 - DNA, 22 bp, Homo sapiens
ggcctgctggctccagcgcccg

SEQ ID NO: 6951759 - DNA, 22 bp, Homo sapiens
gcccggcagtcacacacccagg

SEQ ID NO: 6951760 - DNA, 22 bp, Homo sapiens
agatacacagccctgccatcac

SEQ ID NO: 6951761 - DNA, 22 bp, Homo sapiens
tgctataagaattatattactc

SEQ ID NO: 6951762 - DNA, 22 bp, Homo sapiens
gggaggggttgcatgtttgagt

SEQ ID NO: 6951763 - DNA, 22 bp, Homo sapiens
tgacacataccgaaaatatttg

SEQ ID NO: 6951764 - DNA, 22 bp, Homo sapiens
aaatgcaggttcttgagccaag

SEQ ID NO: 6951765 - DNA, 22 bp, Homo sapiens
caattgaacagatgagttaaat

SEQ ID NO: 6951766 - DNA, 22 bp, Homo sapiens
agttaaactttgccagatggga

SEQ ID NO: 6951767 - DNA, 19 bp, Homo sapiens
ccaggtctggggccagatt

SEQ ID NO: 6951768 - DNA, 22 bp, Homo sapiens
atccttgagaaaataaatgacc

SEQ ID NO: 6951769 - DNA, 22 bp, Homo sapiens
ccagccataaacccagatgact

SEQ ID NO: 6951770 - DNA, 22 bp, Homo sapiens
aagtcctgttcctcatacttcc

SEQ ID NO: 6951771 - DNA, 22 bp, Homo sapiens
agaaatcaggaacagtaaggag

SEQ ID NO: 6951772 - DNA, 22 bp, Homo sapiens
ggctatgcatgaatgctctttg

SEQ ID NO: 6951773 - DNA, 22 bp, Homo sapiens
ttcagcaaatggactgttcagg

SEQ ID NO: 6951774 - DNA, 22 bp, Homo sapiens
tcctgtgctttggaggatgttc

SEQ ID NO: 6951775 - DNA, 22 bp, Homo sapiens
agggggcatcaggtcctggctc

SEQ ID NO: 6951776 - DNA, 22 bp, Homo sapiens
ctcagccatgcaacatgctggg

SEQ ID NO: 6951777 - DNA, 22 bp, Homo sapiens
gccctcctggcaggcagtgatg

SEQ ID NO: 6951778 - DNA, 22 bp, Homo sapiens
ggggcaatgtccaagtcagttg

SEQ ID NO: 6951779 - DNA, 22 bp, Homo sapiens
tggcaaattttggcaagctgaa

SEQ ID NO: 6951780 - DNA, 22 bp, Homo sapiens
accagtgtcttattgaccatct

SEQ ID NO: 6951781 - DNA, 22 bp, Homo sapiens
ctgaggagggaagtccccaaag

SEQ ID NO: 6951782 - DNA, 20 bp, Homo sapiens
gacaacatgcagaaagtata

SEQ ID NO: 6951783 - DNA, 22 bp, Homo sapiens
tggggagaggtatcattgagat

SEQ ID NO: 6951784 - DNA, 22 bp, Homo sapiens
attctatagacagaaggtcaat

SEQ ID NO: 6951785 - DNA, 22 bp, Homo sapiens
ctgtgtgcctagagggtggccg

SEQ ID NO: 6951786 - DNA, 16 bp, Homo sapiens
taaatctgtgatcaca

SEQ ID NO: 6951787 - DNA, 22 bp, Homo sapiens
ccttgcagagcataggagccct

SEQ ID NO: 6951788 - DNA, 22 bp, Homo sapiens
agctggcctcactgcagaatgc

SEQ ID NO: 6951789 - DNA, 22 bp, Homo sapiens
aactgttttttactagaggact

SEQ ID NO: 6951790 - DNA, 22 bp, Homo sapiens
ccagcgcttcccatcagggagg

SEQ ID NO: 6951791 - DNA, 22 bp, Homo sapiens
cccaggccagaacttggttgct

SEQ ID NO: 6951792 - DNA, 22 bp, Homo sapiens
tgtctgtctgttgattcagaaa

SEQ ID NO: 6951793 - DNA, 22 bp, Homo sapiens
tcagatgcttagtgactacaca

SEQ ID NO: 6951794 - DNA, 22 bp, Homo sapiens
gatgggtagcctttcaatagca

SEQ ID NO: 6951795 - DNA, 22 bp, Homo sapiens
gctcagtgaatttttgcccatg

SEQ ID NO: 6951796 - DNA, 22 bp, Homo sapiens
tcccagattgttgatggcttaa

SEQ ID NO: 6951797 - DNA, 22 bp, Homo sapiens
cctggccagggtctgggctgct

SEQ ID NO: 6951798 - DNA, 22 bp, Homo sapiens
atgcaaatgtcaccacttctaa

SEQ ID NO: 6951799 - DNA, 22 bp, Homo sapiens
ggacttctaagtgccagacact

SEQ ID NO: 6951800 - DNA, 22 bp, Homo sapiens
actgtcatgcattatggcatgt

SEQ ID NO: 6951801 - DNA, 22 bp, Homo sapiens
ccaggactcaattaacctcact

SEQ ID NO: 6951802 - DNA, 22 bp, Homo sapiens
gtgtgttcccgtttccttcact

SEQ ID NO: 6951803 - DNA, 22 bp, Homo sapiens
atagtggggacaggatggttgg

SEQ ID NO: 6951804 - DNA, 22 bp, Homo sapiens
cagtttacctatatgtaaattt

SEQ ID NO: 6951805 - DNA, 22 bp, Homo sapiens
ctgggcactgcagggtgttgag

SEQ ID NO: 6951806 - DNA, 22 bp, Homo sapiens
ttgcttcagaagttctgcttgt

SEQ ID NO: 6951807 - DNA, 22 bp, Homo sapiens
attttcaagggagaggcctctg

SEQ ID NO: 6951808 - DNA, 22 bp, Homo sapiens
ttttgggtgaatttgccagtta

SEQ ID NO: 6951809 - DNA, 22 bp, Homo sapiens
tcaaagtactactcagttcagc

SEQ ID NO: 6951810 - DNA, 22 bp, Homo sapiens
catgccctccttgccttcactg

SEQ ID NO: 6951811 - DNA, 22 bp, Homo sapiens
gccttccctggctaggcaagca

SEQ ID NO: 6951812 - DNA, 22 bp, Homo sapiens
tatgaggctaagatgttcagtg

SEQ ID NO: 6951813 - DNA, 22 bp, Homo sapiens
ttctaggaagggaagcatggca

SEQ ID NO: 6951814 - DNA, 21 bp, Homo sapiens
attggcagatctctggattgt

SEQ ID NO: 6951815 - DNA, 22 bp, Homo sapiens
caggcacagtgttgctgttcaa

SEQ ID NO: 6951816 - DNA, 22 bp, Homo sapiens
tctggccactaataggtctcac

SEQ ID NO: 6951817 - DNA, 18 bp, Homo sapiens
tgtttcctcctggaggct

SEQ ID NO: 6951818 - DNA, 22 bp, Homo sapiens
tttcagaggaaatctcattgag

SEQ ID NO: 6951819 - DNA, 22 bp, Homo sapiens
gtgtcctgtttccctgtctata

SEQ ID NO: 6951820 - DNA, 22 bp, Homo sapiens
ggtcgtctgccctgtccaacgt

SEQ ID NO: 6951821 - DNA, 22 bp, Homo sapiens
gttaacaaggtgtagaggtttt

SEQ ID NO: 6951822 - DNA, 22 bp, Homo sapiens
tttctttatcctcctttgcaca

SEQ ID NO: 6951823 - DNA, 22 bp, Homo sapiens
ttgaggaggtatgactaggtac

SEQ ID NO: 6951824 - DNA, 22 bp, Homo sapiens
atagtgtctttcttcacaggca

SEQ ID NO: 6951825 - DNA, 22 bp, Homo sapiens
aggacacacccagctcacgggg

SEQ ID NO: 6951826 - DNA, 22 bp, Homo sapiens
gatctctgctggaagggacacc

SEQ ID NO: 6951827 - DNA, 22 bp, Homo sapiens
tttcccaagtgaagtgaagcca

SEQ ID NO: 6951828 - DNA, 22 bp, Homo sapiens
cagtatatgctctttcatcaaa

SEQ ID NO: 6951829 - DNA, 22 bp, Homo sapiens
ggtaacaaggccgatagaaaca

SEQ ID NO: 6951830 - DNA, 23 bp, Homo sapiens
cctcagggtctagcagagagaag

SEQ ID NO: 6951831 - DNA, 22 bp, Homo sapiens
ccccatcttccctgagggattt

SEQ ID NO: 6951832 - DNA, 22 bp, Homo sapiens
ggtccagtctttcccttctaga

SEQ ID NO: 6951833 - DNA, 22 bp, Homo sapiens
caagcccttccgggaacagttg

SEQ ID NO: 6951834 - DNA, 22 bp, Homo sapiens
agtgaaaagatgcatttctctg

SEQ ID NO: 6951835 - DNA, 22 bp, Homo sapiens
tagaggaaccaggcaggctgag

SEQ ID NO: 6951836 - DNA, 19 bp, Homo sapiens
cctaggcattgtccaaggg

SEQ ID NO: 6951837 - DNA, 22 bp, Homo sapiens
gacagtgtttgtataattcctg

SEQ ID NO: 6951838 - DNA, 22 bp, Homo sapiens
cttattcatatattctcggtag

SEQ ID NO: 6951839 - DNA, 20 bp, Homo sapiens
tgcgtacctggaagaagata

SEQ ID NO: 6951840 - DNA, 22 bp, Homo sapiens
agagcagatggccagggggcct

SEQ ID NO: 6951841 - DNA, 22 bp, Homo sapiens
tgacatctcattttgttgttgt

SEQ ID NO: 6951842 - DNA, 22 bp, Homo sapiens
aaagaagatggagacctgacta

SEQ ID NO: 6951843 - DNA, 22 bp, Homo sapiens
aagtcctggatattaaattgat

SEQ ID NO: 6951844 - DNA, 22 bp, Homo sapiens
gtctctgtcatttcaccttccc

SEQ ID NO: 6951845 - DNA, 22 bp, Homo sapiens
aagcagggagaaatttttcttc

SEQ ID NO: 6951846 - DNA, 22 bp, Homo sapiens
tgtgtaggatttcctggagcct

SEQ ID NO: 6951847 - DNA, 22 bp, Homo sapiens
agtgctctctccccagtgctac

SEQ ID NO: 6951848 - DNA, 22 bp, Homo sapiens
ttgggtcttatggctggagtag

SEQ ID NO: 6951849 - DNA, 22 bp, Homo sapiens
atagcatagtcagcttcgctga

SEQ ID NO: 6951850 - DNA, 22 bp, Homo sapiens
atttaactttcagcccctcttc

SEQ ID NO: 6951851 - DNA, 22 bp, Homo sapiens
gtggtcagggagcagagccatg

SEQ ID NO: 6951852 - DNA, 21 bp, Homo sapiens
ttcagcaagcactctggacac

SEQ ID NO: 6951853 - DNA, 22 bp, Homo sapiens
gtttctcacaaggctgcaatcc

SEQ ID NO: 6951854 - DNA, 22 bp, Homo sapiens
gaattctagtcacacacattca

SEQ ID NO: 6951855 - DNA, 22 bp, Homo sapiens
ctgcctcctgccgtgcagcttc

SEQ ID NO: 6951856 - DNA, 22 bp, Homo sapiens
agttgaagtcctcatcaaatat

SEQ ID NO: 6951857 - DNA, 22 bp, Homo sapiens
ggctggtcacaccactgcaggg

SEQ ID NO: 6951858 - DNA, 22 bp, Homo sapiens
ctggctccaggtcatgcactca

SEQ ID NO: 6951859 - DNA, 22 bp, Homo sapiens
tggagttgcagctaccagacat

SEQ ID NO: 6951860 - DNA, 22 bp, Homo sapiens
tctgggtcatgactcagcgtga

SEQ ID NO: 6951861 - DNA, 22 bp, Homo sapiens
aaaagttccctggttagaaaag

SEQ ID NO: 6951862 - DNA, 22 bp, Homo sapiens
cagccttcaaggcttagctcag

SEQ ID NO: 6951863 - DNA, 22 bp, Homo sapiens
tcctgtgtgtcagatgcacagt

SEQ ID NO: 6951864 - DNA, 20 bp, Homo sapiens
cttcttcagtagtttgttct

SEQ ID NO: 6951865 - DNA, 22 bp, Homo sapiens
taggccatgcagcaaagaggct

SEQ ID NO: 6951866 - DNA, 22 bp, Homo sapiens
agctacctcatctgttaaacgg

SEQ ID NO: 6951867 - DNA, 22 bp, Homo sapiens
aacagcaggcatttcttagctc

SEQ ID NO: 6951868 - DNA, 22 bp, Homo sapiens
tagctgtgtgatgggaaacctt

SEQ ID NO: 6951869 - DNA, 18 bp, Homo sapiens
ggctttggctcttaccgc

SEQ ID NO: 6951870 - DNA, 22 bp, Homo sapiens
tggctgcttgttttagtgaggc

SEQ ID NO: 6951871 - DNA, 22 bp, Homo sapiens
ttggaatgcacactgagcctgc

SEQ ID NO: 6951872 - DNA, 22 bp, Homo sapiens
tccctgcagtaggcagccctcc

SEQ ID NO: 6951873 - DNA, 20 bp, Homo sapiens
gtgctaagtactgtgaaggg

SEQ ID NO: 6951874 - DNA, 22 bp, Homo sapiens
accctgccaaggatggccccga

SEQ ID NO: 6951875 - DNA, 22 bp, Homo sapiens
gttcacaagctgggtttctgca

SEQ ID NO: 6951876 - DNA, 22 bp, Homo sapiens
ataaagtcatggcagctagaat

SEQ ID NO: 6951877 - DNA, 22 bp, Homo sapiens
agtcaccttgaaatgtcttgaa

SEQ ID NO: 6951878 - DNA, 22 bp, Homo sapiens
aaggaagcagccagagaccctc

SEQ ID NO: 6951879 - DNA, 19 bp, Homo sapiens
atggaggtctttatatctt

SEQ ID NO: 6951880 - DNA, 22 bp, Homo sapiens
ctattgtagtaagggaaagcca

SEQ ID NO: 6951881 - DNA, 22 bp, Homo sapiens
agtcccagctcagaaccactag

SEQ ID NO: 6951882 - DNA, 22 bp, Homo sapiens
acccagggtagagtgcagtggc

SEQ ID NO: 6951883 - DNA, 22 bp, Homo sapiens
gctgcagctcgccttccggcct

SEQ ID NO: 6951884 - DNA, 22 bp, Homo sapiens
tcttctaatggttcagatatat

SEQ ID NO: 6951885 - DNA, 22 bp, Homo sapiens
aactttctgaaaagcttgatca

SEQ ID NO: 6951886 - DNA, 19 bp, Homo sapiens
aggtgatgtgactctagaa

SEQ ID NO: 6951887 - DNA, 22 bp, Homo sapiens
ctatgcagaatttagtgactta

SEQ ID NO: 6951888 - DNA, 22 bp, Homo sapiens
aagtccagtgatactggcagga

SEQ ID NO: 6951889 - DNA, 22 bp, Homo sapiens
ccggggtaggccctgaggcagc

SEQ ID NO: 6951890 - DNA, 22 bp, Homo sapiens
tgaccgtcttcccactttctgt

SEQ ID NO: 6951891 - DNA, 22 bp, Homo sapiens
agccagagagccccaggttcta

SEQ ID NO: 6951892 - DNA, 22 bp, Homo sapiens
agttgctttggatataacttct

SEQ ID NO: 6951893 - DNA, 22 bp, Homo sapiens
ctgatattctattttgcttgct

SEQ ID NO: 6951894 - DNA, 22 bp, Homo sapiens
ccacatttactggatgctcagg

SEQ ID NO: 6951895 - DNA, 22 bp, Homo sapiens
catgggaggcctgctgctggtg

SEQ ID NO: 6951896 - DNA, 22 bp, Homo sapiens
aagtccagtatttctagatctt

SEQ ID NO: 6951897 - DNA, 22 bp, Homo sapiens
aagattccctgaatggttcacc

SEQ ID NO: 6951898 - DNA, 21 bp, Homo sapiens
aatgcattaacataaagctga

SEQ ID NO: 6951899 - DNA, 22 bp, Homo sapiens
gtgcagggcagccgaatgggct

SEQ ID NO: 6951900 - DNA, 22 bp, Homo sapiens
tagtgtttttcattggcagagg

SEQ ID NO: 6951901 - DNA, 22 bp, Homo sapiens
tttaaagtttttgcacattctg

SEQ ID NO: 6951902 - DNA, 22 bp, Homo sapiens
attgctgaacttataaatgaat

SEQ ID NO: 6951903 - DNA, 18 bp, Homo sapiens
gcctgagggtcaagtgtg

SEQ ID NO: 6951904 - DNA, 22 bp, Homo sapiens
caaaggcttccactgcatcctt

SEQ ID NO: 6951905 - DNA, 22 bp, Homo sapiens
ttcaaagtagggtagggggtcc

SEQ ID NO: 6951906 - DNA, 21 bp, Homo sapiens
acctgccacattgcagacttg

SEQ ID NO: 6951907 - DNA, 22 bp, Homo sapiens
tgggctcagtctgcacctgcgg

SEQ ID NO: 6951908 - DNA, 22 bp, Homo sapiens
tttaacttagaagagatatcct

SEQ ID NO: 6951909 - DNA, 22 bp, Homo sapiens
tgagaacctcgaagattttgcc

SEQ ID NO: 6951910 - DNA, 22 bp, Homo sapiens
tgtcttttggagcatctttctt

SEQ ID NO: 6951911 - DNA, 21 bp, Homo sapiens
actttacaatttacatagtga

SEQ ID NO: 6951912 - DNA, 22 bp, Homo sapiens
gatgtgtccctttcaactcaga

SEQ ID NO: 6951913 - DNA, 22 bp, Homo sapiens
atgaggaacagacttgctggat

SEQ ID NO: 6951914 - DNA, 22 bp, Homo sapiens
aggctctggttggcaagtaaag

SEQ ID NO: 6951915 - DNA, 22 bp, Homo sapiens
atacagcagtgaataagataaa

SEQ ID NO: 6951916 - DNA, 22 bp, Homo sapiens
agactattttgtgataactaat

SEQ ID NO: 6951917 - DNA, 22 bp, Homo sapiens
gctctgtgttgtcagaggcacc

SEQ ID NO: 6951918 - DNA, 22 bp, Homo sapiens
ggaagctggctcttataaatat

SEQ ID NO: 6951919 - DNA, 22 bp, Homo sapiens
tacaggagcacaaaagagttga

SEQ ID NO: 6951920 - DNA, 22 bp, Homo sapiens
tgtctggatcagtgggtgcttg

SEQ ID NO: 6951921 - DNA, 22 bp, Homo sapiens
agtagtattctacagagggtgc

SEQ ID NO: 6951922 - DNA, 22 bp, Homo sapiens
aggatcaggccctctagggtag

SEQ ID NO: 6951923 - DNA, 22 bp, Homo sapiens
ctgccacaagctggccctgtgt

SEQ ID NO: 6951924 - DNA, 22 bp, Homo sapiens
accatcttagtggccagctctc

SEQ ID NO: 6951925 - DNA, 22 bp, Homo sapiens
cagaggtattttgataaacgcc

SEQ ID NO: 6951926 - DNA, 18 bp, Homo sapiens
cttcctcttctggagaaa

SEQ ID NO: 6951927 - DNA, 22 bp, Homo sapiens
taggcaagtctctttgtttata

SEQ ID NO: 6951928 - DNA, 22 bp, Homo sapiens
gccatcaaggtgaagccctgag

SEQ ID NO: 6951929 - DNA, 22 bp, Homo sapiens
gaggggcctggcactgagctgg

SEQ ID NO: 6951930 - DNA, 22 bp, Homo sapiens
aaatcatggtggaagaaacaga

SEQ ID NO: 6951931 - DNA, 22 bp, Homo sapiens
atgtatgtgagctttgagatca

SEQ ID NO: 6951932 - DNA, 22 bp, Homo sapiens
tcactagtcatcaacttccatt

SEQ ID NO: 6951933 - DNA, 22 bp, Homo sapiens
tttgagaaaaccagaaagatct

SEQ ID NO: 6951934 - DNA, 22 bp, Homo sapiens
attctgtatggaaaagcactat

SEQ ID NO: 6951935 - DNA, 22 bp, Homo sapiens
atgcacatcactctgaagaaaa

SEQ ID NO: 6951936 - DNA, 22 bp, Homo sapiens
caccatcttggcaaaggttcgc

SEQ ID NO: 6951937 - DNA, 22 bp, Homo sapiens
tggcttcttgacttcttggctg

SEQ ID NO: 6951938 - DNA, 22 bp, Homo sapiens
ggccttggtaatgggggactgt

SEQ ID NO: 6951939 - DNA, 22 bp, Homo sapiens
tgctgcttgttttgtaaataaa

SEQ ID NO: 6951940 - DNA, 22 bp, Homo sapiens
gtggccctatttgaggacccca

SEQ ID NO: 6951941 - DNA, 22 bp, Homo sapiens
cactgaaaggcaatgctgacag

SEQ ID NO: 6951942 - DNA, 22 bp, Homo sapiens
acagaaattgggcaaatggaag

SEQ ID NO: 6951943 - DNA, 22 bp, Homo sapiens
atggctgctttcccttagcacc

SEQ ID NO: 6951944 - DNA, 22 bp, Homo sapiens
tggccacacccacctagaggag

SEQ ID NO: 6951945 - DNA, 22 bp, Homo sapiens
tgccctggcgctgtctctatgg

SEQ ID NO: 6951946 - DNA, 22 bp, Homo sapiens
accctgcttggccccacttcta

SEQ ID NO: 6951947 - DNA, 22 bp, Homo sapiens
aaaggtttattgattctgctct

SEQ ID NO: 6951948 - DNA, 18 bp, Homo sapiens
tttgattgctgtcatcca

SEQ ID NO: 6951949 - DNA, 22 bp, Homo sapiens
atgttttccccaaatgatcttc

SEQ ID NO: 6951950 - DNA, 17 bp, Homo sapiens
gagagctgctgcttccg

SEQ ID NO: 6951951 - DNA, 22 bp, Homo sapiens
atggtgtatgatgttttcaatt

SEQ ID NO: 6951952 - DNA, 22 bp, Homo sapiens
tggaagcggtgctggcccatgg

SEQ ID NO: 6951953 - DNA, 22 bp, Homo sapiens
ggacacagctgcagccacaccc

SEQ ID NO: 6951954 - DNA, 22 bp, Homo sapiens
actgcacatagtgggctggcct

SEQ ID NO: 6951955 - DNA, 22 bp, Homo sapiens
tcctagctggcctctcaccagc

SEQ ID NO: 6951956 - DNA, 22 bp, Homo sapiens
agatgtaaactctcatgtcatt

SEQ ID NO: 6951957 - DNA, 23 bp, Homo sapiens
aagaggaggccctgctcccgtcc

SEQ ID NO: 6951958 - DNA, 22 bp, Homo sapiens
ctggtgaatattggaggcattg

SEQ ID NO: 6951959 - DNA, 22 bp, Homo sapiens
tagaccaggttgaccaggtagg

SEQ ID NO: 6951960 - DNA, 22 bp, Homo sapiens
tgtctctgaaatatgtggctcc

SEQ ID NO: 6951961 - DNA, 22 bp, Homo sapiens
aaatttaaaaagcagcattgca

SEQ ID NO: 6951962 - DNA, 22 bp, Homo sapiens
aagtgaatggggcagacttcag

SEQ ID NO: 6951963 - DNA, 22 bp, Homo sapiens
tgtggctctgccccctggtaag

SEQ ID NO: 6951964 - DNA, 22 bp, Homo sapiens
gtagtccaaagctggcatgatg

SEQ ID NO: 6951965 - DNA, 22 bp, Homo sapiens
caagatgggtgttgtgatggtt

SEQ ID NO: 6951966 - DNA, 22 bp, Homo sapiens
gtttaaataattaggggcctgt

SEQ ID NO: 6951967 - DNA, 22 bp, Homo sapiens
aatggcacccgtaataccaaag

SEQ ID NO: 6951968 - DNA, 22 bp, Homo sapiens
aggaacctaagagcctgcagtc

SEQ ID NO: 6951969 - DNA, 22 bp, Homo sapiens
acaatgaaagcaagaagacggc

SEQ ID NO: 6951970 - DNA, 22 bp, Homo sapiens
atgcatcatggaaaactcagtt

SEQ ID NO: 6951971 - DNA, 22 bp, Homo sapiens
gatctggaatctgaaggctgag

SEQ ID NO: 6951972 - DNA, 22 bp, Homo sapiens
ttggtagaatgaacattcattg

SEQ ID NO: 6951973 - DNA, 22 bp, Homo sapiens
cctcagggacgggatcacttgg

SEQ ID NO: 6951974 - DNA, 22 bp, Homo sapiens
gatgcttttcttttcagcaaga

SEQ ID NO: 6951975 - DNA, 22 bp, Homo sapiens
aaggtctggccaatagacagcc

SEQ ID NO: 6951976 - DNA, 22 bp, Homo sapiens
cccctgctggtcgaaacaattt

SEQ ID NO: 6951977 - DNA, 22 bp, Homo sapiens
tgacaactttacaaaattcttc

SEQ ID NO: 6951978 - DNA, 22 bp, Homo sapiens
tgagccctggagccctctgtta

SEQ ID NO: 6951979 - DNA, 22 bp, Homo sapiens
caaaccagtaggaagtctatta

SEQ ID NO: 6951980 - DNA, 22 bp, Homo sapiens
ccaggctgcagtcaaggggcat

SEQ ID NO: 6951981 - DNA, 22 bp, Homo sapiens
tgcagctttaagctttcatcag

SEQ ID NO: 6951982 - DNA, 22 bp, Homo sapiens
ggaggcacttcatgctgacccg

SEQ ID NO: 6951983 - DNA, 22 bp, Homo sapiens
ttggtggagtcattggcatatg

SEQ ID NO: 6951984 - DNA, 22 bp, Homo sapiens
agagccactgggagacagagca

SEQ ID NO: 6951985 - DNA, 22 bp, Homo sapiens
aggggagcccctggtcctggtg

SEQ ID NO: 6951986 - DNA, 22 bp, Homo sapiens
cagagcagggtgcaccttgggc

SEQ ID NO: 6951987 - DNA, 22 bp, Homo sapiens
aggctttacgtcttcccctggg

SEQ ID NO: 6951988 - DNA, 22 bp, Homo sapiens
taaaagagaatggataacagag

SEQ ID NO: 6951989 - DNA, 23 bp, Homo sapiens
ttctggctccgagctccatcttc

SEQ ID NO: 6951990 - DNA, 19 bp, Homo sapiens
cccaggggacccagcccta

SEQ ID NO: 6951991 - DNA, 22 bp, Homo sapiens
caaactttgcaaaacttacagt

SEQ ID NO: 6951992 - DNA, 22 bp, Homo sapiens
acctggacacctgctgtcatct

SEQ ID NO: 6951993 - DNA, 21 bp, Homo sapiens
ggccacgttaacactggactt

SEQ ID NO: 6951994 - DNA, 22 bp, Homo sapiens
aggtggggtgagctgcagacta

SEQ ID NO: 6951995 - DNA, 21 bp, Homo sapiens
tcacgtggtcacatgagcttt

SEQ ID NO: 6951996 - DNA, 22 bp, Homo sapiens
ccagaataggagtaataaaacc

SEQ ID NO: 6951997 - DNA, 22 bp, Homo sapiens
gagtcctagaagtggctttatt

SEQ ID NO: 6951998 - DNA, 22 bp, Homo sapiens
cagatacaggtttttgttagat

SEQ ID NO: 6951999 - DNA, 22 bp, Homo sapiens
cactaagttggtgttaattagt

SEQ ID NO: 6952000 - DNA, 22 bp, Homo sapiens
atcagtcatatccaaattagca

SEQ ID NO: 6952001 - DNA, 22 bp, Homo sapiens
tatgcatataaatgtgtgaatt

SEQ ID NO: 6952002 - DNA, 22 bp, Homo sapiens
agggcactggcttgcaaactca

SEQ ID NO: 6952003 - DNA, 22 bp, Homo sapiens
attgagggctgagaagggccct

SEQ ID NO: 6952004 - DNA, 22 bp, Homo sapiens
tttacagcagcatgatttataa

SEQ ID NO: 6952005 - DNA, 20 bp, Homo sapiens
ggcagatacctgtgtttaag

SEQ ID NO: 6952006 - DNA, 22 bp, Homo sapiens
cactgcatggctgtgaggcagc

SEQ ID NO: 6952007 - DNA, 22 bp, Homo sapiens
actcacagcatgagcttggcag

SEQ ID NO: 6952008 - DNA, 22 bp, Homo sapiens
cagagctggcctgtgatttttg

SEQ ID NO: 6952009 - DNA, 21 bp, Homo sapiens
ctctgtgttgagggtgttgag

SEQ ID NO: 6952010 - DNA, 22 bp, Homo sapiens
ccaggtgtggtggcatacacct

SEQ ID NO: 6952011 - DNA, 22 bp, Homo sapiens
tctggcttgggtaggtagttca

SEQ ID NO: 6952012 - DNA, 22 bp, Homo sapiens
aagtgagttgtctgaccctttc

SEQ ID NO: 6952013 - DNA, 22 bp, Homo sapiens
tctagaattttgccatatagct

SEQ ID NO: 6952014 - DNA, 22 bp, Homo sapiens
taattgtccctgcagttaggat

SEQ ID NO: 6952015 - DNA, 22 bp, Homo sapiens
gaagcgtcatgaaagaaaggct

SEQ ID NO: 6952016 - DNA, 22 bp, Homo sapiens
tcagaggtggcccctgccctca

SEQ ID NO: 6952017 - DNA, 22 bp, Homo sapiens
tctgtctgccccagcaagtcac

SEQ ID NO: 6952018 - DNA, 22 bp, Homo sapiens
ttgatgaaggtagatttgaaat

SEQ ID NO: 6952019 - DNA, 22 bp, Homo sapiens
acttggtgtattagctctcact

SEQ ID NO: 6952020 - DNA, 22 bp, Homo sapiens
ctgccagctcaccggctcagac

SEQ ID NO: 6952021 - DNA, 22 bp, Homo sapiens
taggattccagaacagtgctgc

SEQ ID NO: 6952022 - DNA, 22 bp, Homo sapiens
cccgtgtggacagcgtgccagt

SEQ ID NO: 6952023 - DNA, 22 bp, Homo sapiens
tctaccactttgacctctctgt

SEQ ID NO: 6952024 - DNA, 22 bp, Homo sapiens
agggcagagaaatgtagttgag

SEQ ID NO: 6952025 - DNA, 23 bp, Homo sapiens
aaacaagccctaatgaagagtcc

SEQ ID NO: 6952026 - DNA, 22 bp, Homo sapiens
ctatgtgtcttgaaacaagact

SEQ ID NO: 6952027 - DNA, 22 bp, Homo sapiens
tcagcaaccaggggcacagtcc

SEQ ID NO: 6952028 - DNA, 22 bp, Homo sapiens
gcctgtgtccttcccagtgggg

SEQ ID NO: 6952029 - DNA, 22 bp, Homo sapiens
gggtccctcgcaggcgtcgccg

SEQ ID NO: 6952030 - DNA, 22 bp, Homo sapiens
agggagatcgaccgtgttatat

SEQ ID NO: 6952031 - DNA, 22 bp, Homo sapiens
agtaaacatttcagatttattt

SEQ ID NO: 6952032 - DNA, 22 bp, Homo sapiens
atttcatggtacatcgtgactt

SEQ ID NO: 6952033 - DNA, 22 bp, Homo sapiens
ctggaggggccatccacagtct

SEQ ID NO: 6952034 - DNA, 22 bp, Homo sapiens
aaagtctccactgggaaccaaa

SEQ ID NO: 6952035 - DNA, 22 bp, Homo sapiens
aaaccttagctagagtgtgtca

SEQ ID NO: 6952036 - DNA, 22 bp, Homo sapiens
cgggcagtgcccagcggggcag

SEQ ID NO: 6952037 - DNA, 22 bp, Homo sapiens
gtctgaggcctgaggccctggg

SEQ ID NO: 6952038 - DNA, 22 bp, Homo sapiens
tctgtcaacatgtcaaagggct

SEQ ID NO: 6952039 - DNA, 22 bp, Homo sapiens
gttagaggttcagtcgctataa

SEQ ID NO: 6952040 - DNA, 22 bp, Homo sapiens
ttcatctgctggtttttggcat

SEQ ID NO: 6952041 - DNA, 22 bp, Homo sapiens
gctcttgatttccaggagctag

SEQ ID NO: 6952042 - DNA, 18 bp, Homo sapiens
ggcagacgcgaggggcgg

SEQ ID NO: 6952043 - DNA, 22 bp, Homo sapiens
caagatgacaaggctggaggct

SEQ ID NO: 6952044 - DNA, 22 bp, Homo sapiens
tttagggaagaagcccatggcc

SEQ ID NO: 6952045 - DNA, 22 bp, Homo sapiens
gcgtccacgctgccgctcagga

SEQ ID NO: 6952046 - DNA, 21 bp, Homo sapiens
aattcgtttgcaacactgata

SEQ ID NO: 6952047 - DNA, 22 bp, Homo sapiens
agggtcagtgatgagggagccc

SEQ ID NO: 6952048 - DNA, 22 bp, Homo sapiens
agcctgggaatttagagttcgg

SEQ ID NO: 6952049 - DNA, 22 bp, Homo sapiens
gcttgcattaggagttatgact

SEQ ID NO: 6952050 - DNA, 22 bp, Homo sapiens
tgtagaggaggaaactgaggct

SEQ ID NO: 6952051 - DNA, 22 bp, Homo sapiens
taaaggaggagttaatgagact

SEQ ID NO: 6952052 - DNA, 22 bp, Homo sapiens
tctttattttatgcttgtgcaa

SEQ ID NO: 6952053 - DNA, 22 bp, Homo sapiens
aagagacaatgacacttgggag

SEQ ID NO: 6952054 - DNA, 22 bp, Homo sapiens
cacacagtgggaaaacctgaag

SEQ ID NO: 6952055 - DNA, 22 bp, Homo sapiens
taaagtgcagactcccggaaac

SEQ ID NO: 6952056 - DNA, 22 bp, Homo sapiens
ggccatgctcgtggctggactg

SEQ ID NO: 6952057 - DNA, 22 bp, Homo sapiens
aggctgggaaacctgaagttgt

SEQ ID NO: 6952058 - DNA, 22 bp, Homo sapiens
tcagaataaacatgggcatggg

SEQ ID NO: 6952059 - DNA, 22 bp, Homo sapiens
tgacccattaaccactttccct

SEQ ID NO: 6952060 - DNA, 22 bp, Homo sapiens
caggaaaaatgccaggagtcag

SEQ ID NO: 6952061 - DNA, 23 bp, Homo sapiens
atctgaaaagcatttgcagtttg

SEQ ID NO: 6952062 - DNA, 22 bp, Homo sapiens
aggaagtggataaaatagcttt

SEQ ID NO: 6952063 - DNA, 22 bp, Homo sapiens
gcacagacagaatccctactcc

SEQ ID NO: 6952064 - DNA, 19 bp, Homo sapiens
ctttagacacacctggaca

SEQ ID NO: 6952065 - DNA, 22 bp, Homo sapiens
tagttttacttgcgatgataat

SEQ ID NO: 6952066 - DNA, 22 bp, Homo sapiens
gctcaggcaaatttctggtgaa

SEQ ID NO: 6952067 - DNA, 22 bp, Homo sapiens
ggccagagttgatggcatcttg

SEQ ID NO: 6952068 - DNA, 22 bp, Homo sapiens
ctctccagatctgctgagccag

SEQ ID NO: 6952069 - DNA, 17 bp, Homo sapiens
agtctgggacctgcgtg

SEQ ID NO: 6952070 - DNA, 22 bp, Homo sapiens
gtgtgtgtgtaaaaatccagag

SEQ ID NO: 6952071 - DNA, 21 bp, Homo sapiens
gcttggttttggttacttgcc

SEQ ID NO: 6952072 - DNA, 22 bp, Homo sapiens
taaggctccctttgccacttgt

SEQ ID NO: 6952073 - DNA, 21 bp, Homo sapiens
tgcagctgggttctggtttgc

SEQ ID NO: 6952074 - DNA, 22 bp, Homo sapiens
aatagtgctgctgtggacatgg

SEQ ID NO: 6952075 - DNA, 22 bp, Homo sapiens
gggcatgacttttggagtggga

SEQ ID NO: 6952076 - DNA, 22 bp, Homo sapiens
tgagttattgcagcttcctcct

SEQ ID NO: 6952077 - DNA, 22 bp, Homo sapiens
aggagagtcttgagtcactggt

SEQ ID NO: 6952078 - DNA, 22 bp, Homo sapiens
tatctgttccaggcactcagct

SEQ ID NO: 6952079 - DNA, 22 bp, Homo sapiens
agctctatcacctgtcagttgc

SEQ ID NO: 6952080 - DNA, 22 bp, Homo sapiens
actctaaaccccactctgctgg

SEQ ID NO: 6952081 - DNA, 20 bp, Homo sapiens
atatgctgagtgaaggcaga

SEQ ID NO: 6952082 - DNA, 22 bp, Homo sapiens
agcagtggctgacagacttacc

SEQ ID NO: 6952083 - DNA, 20 bp, Homo sapiens
tcatccaggacaggagtggc

SEQ ID NO: 6952084 - DNA, 22 bp, Homo sapiens
cagctcccagagtgaccagcag

SEQ ID NO: 6952085 - DNA, 22 bp, Homo sapiens
acaggagctctagggacagcac

SEQ ID NO: 6952086 - DNA, 22 bp, Homo sapiens
tcagacaccgtctattttgcct

SEQ ID NO: 6952087 - DNA, 22 bp, Homo sapiens
ccagctcatctcagtgaaatgc

SEQ ID NO: 6952088 - DNA, 22 bp, Homo sapiens
tatagaagtaagcattgtgatg

SEQ ID NO: 6952089 - DNA, 22 bp, Homo sapiens
gggtgggccccaggtatctgta

SEQ ID NO: 6952090 - DNA, 21 bp, Homo sapiens
atttcacaccctcctttttct

SEQ ID NO: 6952091 - DNA, 22 bp, Homo sapiens
gcataattaaacaggcaagatt

SEQ ID NO: 6952092 - DNA, 22 bp, Homo sapiens
tatattaacttgtgatcctgga

SEQ ID NO: 6952093 - DNA, 16 bp, Homo sapiens
acaggtaccttctgga

SEQ ID NO: 6952094 - DNA, 22 bp, Homo sapiens
acttagcacctatggcattttt

SEQ ID NO: 6952095 - DNA, 22 bp, Homo sapiens
actgccaggatggcactagagg

SEQ ID NO: 6952096 - DNA, 22 bp, Homo sapiens
ctgggctgggtttaccctcttc

SEQ ID NO: 6952097 - DNA, 22 bp, Homo sapiens
aatgagttctgacacttcacga

SEQ ID NO: 6952098 - DNA, 22 bp, Homo sapiens
gtgattttgagacctatatagt

SEQ ID NO: 6952099 - DNA, 22 bp, Homo sapiens
cagagtctgcgagcagaggggc

SEQ ID NO: 6952100 - DNA, 22 bp, Homo sapiens
catgctaattcccaggccccaa

SEQ ID NO: 6952101 - DNA, 22 bp, Homo sapiens
acagagtcgccttgtagctggc

SEQ ID NO: 6952102 - DNA, 22 bp, Homo sapiens
ctggaaggagaaggaggctgtg

SEQ ID NO: 6952103 - DNA, 22 bp, Homo sapiens
agcgcctgcaccactctgcggc

SEQ ID NO: 6952104 - DNA, 20 bp, Homo sapiens
atttgacttggagagagaaa

SEQ ID NO: 6952105 - DNA, 22 bp, Homo sapiens
tttcttcattgatgtcaggtgg

SEQ ID NO: 6952106 - DNA, 23 bp, Homo sapiens
aaagttctcttgcgtgtgggaaa

SEQ ID NO: 6952107 - DNA, 22 bp, Homo sapiens
gcaggagagccagcaggcttcc

SEQ ID NO: 6952108 - DNA, 22 bp, Homo sapiens
cctcccaccatttagagagagc

SEQ ID NO: 6952109 - DNA, 22 bp, Homo sapiens
gaagtgtctccgtttttaaagg

SEQ ID NO: 6952110 - DNA, 22 bp, Homo sapiens
tcacccttcccagctgtccgcc

SEQ ID NO: 6952111 - DNA, 22 bp, Homo sapiens
ctccaggaaagtcaggcttaga

SEQ ID NO: 6952112 - DNA, 19 bp, Homo sapiens
tacaaaggaggatgtaaaa

SEQ ID NO: 6952113 - DNA, 22 bp, Homo sapiens
gctctatgttgaccttcagtgg

SEQ ID NO: 6952114 - DNA, 22 bp, Homo sapiens
actggacaggttcatggtttta

SEQ ID NO: 6952115 - DNA, 22 bp, Homo sapiens
tttaggttaatcaacaaacatt

SEQ ID NO: 6952116 - DNA, 22 bp, Homo sapiens
aagcatttttgaaatggtagga

SEQ ID NO: 6952117 - DNA, 23 bp, Homo sapiens
tcctttaatgctggaatggctag

SEQ ID NO: 6952118 - DNA, 22 bp, Homo sapiens
tgatttctagtgaggttgaaca

SEQ ID NO: 6952119 - DNA, 21 bp, Homo sapiens
atctgaaaggttagtgttgag

SEQ ID NO: 6952120 - DNA, 17 bp, Homo sapiens
gctcctgcaggtcagga

SEQ ID NO: 6952121 - DNA, 22 bp, Homo sapiens
tgtgggtcctcctgtgtgcccg

SEQ ID NO: 6952122 - DNA, 22 bp, Homo sapiens
gggtgggatctgtggagcctca

SEQ ID NO: 6952123 - DNA, 22 bp, Homo sapiens
aaagcatgttctgggaatagta

SEQ ID NO: 6952124 - DNA, 22 bp, Homo sapiens
cattaagtctgttaactggaga

SEQ ID NO: 6952125 - DNA, 22 bp, Homo sapiens
tctggcttgaacaattaggtaa

SEQ ID NO: 6952126 - DNA, 22 bp, Homo sapiens
cttcaacatacacagagagagg

SEQ ID NO: 6952127 - DNA, 22 bp, Homo sapiens
ccttccagtatgttaagatggt

SEQ ID NO: 6952128 - DNA, 22 bp, Homo sapiens
tagatacttattcgttgtttac

SEQ ID NO: 6952129 - DNA, 18 bp, Homo sapiens
cagcattagcagcttcca

SEQ ID NO: 6952130 - DNA, 22 bp, Homo sapiens
agttttgaaatgaaatgtagtt

SEQ ID NO: 6952131 - DNA, 22 bp, Homo sapiens
atccaagtcagggatagtttga

SEQ ID NO: 6952132 - DNA, 22 bp, Homo sapiens
caaacattcaagtacaagtctt

SEQ ID NO: 6952133 - DNA, 22 bp, Homo sapiens
tttgagaagcatggctgtattc

SEQ ID NO: 6952134 - DNA, 22 bp, Homo sapiens
gggctttagattgcagaggatt

SEQ ID NO: 6952135 - DNA, 22 bp, Homo sapiens
ggagctcaggcccagcaaggcc

SEQ ID NO: 6952136 - DNA, 22 bp, Homo sapiens
cagtgccatgatgcagagcaat

SEQ ID NO: 6952137 - DNA, 22 bp, Homo sapiens
aaggaagctgttagacatgcat

SEQ ID NO: 6952138 - DNA, 22 bp, Homo sapiens
agacaggcagcagatggagtgt

SEQ ID NO: 6952139 - DNA, 22 bp, Homo sapiens
agtcttagaactacagtgccta

SEQ ID NO: 6952140 - DNA, 21 bp, Homo sapiens
ggagtctgtggatgctgtttc

SEQ ID NO: 6952141 - DNA, 22 bp, Homo sapiens
gaggttgggaagtccaagctgg

SEQ ID NO: 6952142 - DNA, 22 bp, Homo sapiens
ctagcacagcccattcagtcta

SEQ ID NO: 6952143 - DNA, 21 bp, Homo sapiens
actgccaggagagtaggggga

SEQ ID NO: 6952144 - DNA, 22 bp, Homo sapiens
tcctgcggttcatgctcattct

SEQ ID NO: 6952145 - DNA, 22 bp, Homo sapiens
caaggagataaaatgttgagct

SEQ ID NO: 6952146 - DNA, 22 bp, Homo sapiens
agtgtgtcagttgaaagagatt

SEQ ID NO: 6952147 - DNA, 22 bp, Homo sapiens
tttatagtagcatgatttataa

SEQ ID NO: 6952148 - DNA, 18 bp, Homo sapiens
tgctttatgcttatataa

SEQ ID NO: 6952149 - DNA, 22 bp, Homo sapiens
tcctcagcattagcacagacat

SEQ ID NO: 6952150 - DNA, 23 bp, Homo sapiens
ttacaactatttgccatgttgtt

SEQ ID NO: 6952151 - DNA, 22 bp, Homo sapiens
ccctgatgacacgggcatcagg

SEQ ID NO: 6952152 - DNA, 22 bp, Homo sapiens
cttcttcccagcttccctcacc

SEQ ID NO: 6952153 - DNA, 20 bp, Homo sapiens
ctggatgctaaaacacacac

SEQ ID NO: 6952154 - DNA, 22 bp, Homo sapiens
actgtaaagttacgatcaagtt

SEQ ID NO: 6952155 - DNA, 22 bp, Homo sapiens
catgcttcacacactgaatgac

SEQ ID NO: 6952156 - DNA, 22 bp, Homo sapiens
ccatgcatgcctgaaattgctg

SEQ ID NO: 6952157 - DNA, 22 bp, Homo sapiens
caggctcttttggtggcaagga

SEQ ID NO: 6952158 - DNA, 22 bp, Homo sapiens
ttggccaatcctattgggtggg

SEQ ID NO: 6952159 - DNA, 22 bp, Homo sapiens
tcagaattgattttcaaaacag

SEQ ID NO: 6952160 - DNA, 22 bp, Homo sapiens
tagcagcaaaatgaccttctaa

SEQ ID NO: 6952161 - DNA, 22 bp, Homo sapiens
tgaagattttcgggtacttgat

SEQ ID NO: 6952162 - DNA, 22 bp, Homo sapiens
cctggaattgtaggtttggcca

SEQ ID NO: 6952163 - DNA, 22 bp, Homo sapiens
attcagttctgctggttctgct

SEQ ID NO: 6952164 - DNA, 22 bp, Homo sapiens
gcctaagattgtgttttcctga

SEQ ID NO: 6952165 - DNA, 21 bp, Homo sapiens
acacttcagtttttaaaggga

SEQ ID NO: 6952166 - DNA, 22 bp, Homo sapiens
cgtgatatttgtggtggatgaa

SEQ ID NO: 6952167 - DNA, 22 bp, Homo sapiens
taaagcagtggttctcaaactt

SEQ ID NO: 6952168 - DNA, 22 bp, Homo sapiens
gcaggtgagggtgtctgaatag

SEQ ID NO: 6952169 - DNA, 22 bp, Homo sapiens
acaacgtatgatctgaaagtat

SEQ ID NO: 6952170 - DNA, 22 bp, Homo sapiens
ttctgctggtgttttgtgaggc

SEQ ID NO: 6952171 - DNA, 22 bp, Homo sapiens
attgtacaatgctgaggtttgg

SEQ ID NO: 6952172 - DNA, 22 bp, Homo sapiens
gcacctgcctgggactgaagat

SEQ ID NO: 6952173 - DNA, 22 bp, Homo sapiens
gggccaaggggagctggaaggg

SEQ ID NO: 6952174 - DNA, 22 bp, Homo sapiens
gtgcacagatttaattttattc

SEQ ID NO: 6952175 - DNA, 22 bp, Homo sapiens
atcattctagctgttgtgttga

SEQ ID NO: 6952176 - DNA, 22 bp, Homo sapiens
ctgggtcaaggaatgctggtgg

SEQ ID NO: 6952177 - DNA, 22 bp, Homo sapiens
tcagtgtgtctctgcatttggg

SEQ ID NO: 6952178 - DNA, 23 bp, Homo sapiens
gtatttcagcattctcagttaaa

SEQ ID NO: 6952179 - DNA, 22 bp, Homo sapiens
ccactgggggctgctcccaggt

SEQ ID NO: 6952180 - DNA, 22 bp, Homo sapiens
ggaactgaggaacgaactggga

SEQ ID NO: 6952181 - DNA, 22 bp, Homo sapiens
agctgcctcagtcactcatggc

SEQ ID NO: 6952182 - DNA, 22 bp, Homo sapiens
gaaggtggcgagcggattgctg

SEQ ID NO: 6952183 - DNA, 22 bp, Homo sapiens
aaagagtctggcgttttaatgg

SEQ ID NO: 6952184 - DNA, 22 bp, Homo sapiens
gatatttttagtatttctgcct

SEQ ID NO: 6952185 - DNA, 22 bp, Homo sapiens
tggtgctgcaggtgggcacagt

SEQ ID NO: 6952186 - DNA, 22 bp, Homo sapiens
taactaagtgactcaagtgatc

SEQ ID NO: 6952187 - DNA, 22 bp, Homo sapiens
aggcttcttgcttccaaatgca

SEQ ID NO: 6952188 - DNA, 22 bp, Homo sapiens
gtgtacagtaagtgaatctagg

SEQ ID NO: 6952189 - DNA, 22 bp, Homo sapiens
accccacagcatacaaaggcac

SEQ ID NO: 6952190 - DNA, 22 bp, Homo sapiens
actgaacatccataagattttt

SEQ ID NO: 6952191 - DNA, 22 bp, Homo sapiens
gagcactgaggaaagctggtta

SEQ ID NO: 6952192 - DNA, 22 bp, Homo sapiens
attgaactgttggagaggtttt

SEQ ID NO: 6952193 - DNA, 22 bp, Homo sapiens
actgagaagctcgcagtgatgc

SEQ ID NO: 6952194 - DNA, 22 bp, Homo sapiens
aatgttcagtctcaagagtgat

SEQ ID NO: 6952195 - DNA, 22 bp, Homo sapiens
agcacagatggatgtattcatt

SEQ ID NO: 6952196 - DNA, 22 bp, Homo sapiens
gaaatggtgtgctgtgcaatga

SEQ ID NO: 6952197 - DNA, 22 bp, Homo sapiens
ggtctgtgctctggagcctctg

SEQ ID NO: 6952198 - DNA, 22 bp, Homo sapiens
atggtggaggtgtattctggat

SEQ ID NO: 6952199 - DNA, 22 bp, Homo sapiens
tttgttcccagatttgctggca

SEQ ID NO: 6952200 - DNA, 22 bp, Homo sapiens
gtttgttgatatgcccctttgt

SEQ ID NO: 6952201 - DNA, 22 bp, Homo sapiens
atctgcatgggtaataacacag

SEQ ID NO: 6952202 - DNA, 22 bp, Homo sapiens
cttgcacgtcagatcttcctca

SEQ ID NO: 6952203 - DNA, 22 bp, Homo sapiens
ctcaggctaagaaggccaagtg

SEQ ID NO: 6952204 - DNA, 22 bp, Homo sapiens
gaggaacagagacgggatcgct

SEQ ID NO: 6952205 - DNA, 22 bp, Homo sapiens
gcagcatcaggttcactgcgtg

SEQ ID NO: 6952206 - DNA, 22 bp, Homo sapiens
gctggagaaactgcagctgagg

SEQ ID NO: 6952207 - DNA, 19 bp, Homo sapiens
agataggctgtcttagagt

SEQ ID NO: 6952208 - DNA, 22 bp, Homo sapiens
ggctgaggcggcgatgcccttg

SEQ ID NO: 6952209 - DNA, 22 bp, Homo sapiens
tagggctctgctcatcagttgt

SEQ ID NO: 6952210 - DNA, 17 bp, Homo sapiens
tacaactgttgtttata

SEQ ID NO: 6952211 - DNA, 22 bp, Homo sapiens
ctttacaaactataaagtgcgg

SEQ ID NO: 6952212 - DNA, 22 bp, Homo sapiens
gctgtttaaatttaagtgtttc

SEQ ID NO: 6952213 - DNA, 22 bp, Homo sapiens
ggctctgaaattctcactttta

SEQ ID NO: 6952214 - DNA, 22 bp, Homo sapiens
aaccaatttaaatataaagact

SEQ ID NO: 6952215 - DNA, 19 bp, Homo sapiens
gcctgggatgggcagaact

SEQ ID NO: 6952216 - DNA, 22 bp, Homo sapiens
gaagaactttagggcagaattt

SEQ ID NO: 6952217 - DNA, 22 bp, Homo sapiens
cctcaaattgtcaaataagaat

SEQ ID NO: 6952218 - DNA, 22 bp, Homo sapiens
gctcagtgcatcattccaggct

SEQ ID NO: 6952219 - DNA, 22 bp, Homo sapiens
atcttggcttatgcacaagtaa

SEQ ID NO: 6952220 - DNA, 22 bp, Homo sapiens
ctcactgccctgaagttgggtt

SEQ ID NO: 6952221 - DNA, 22 bp, Homo sapiens
catgctgttgaatatgacattg

SEQ ID NO: 6952222 - DNA, 22 bp, Homo sapiens
cttccctcctggattccagact

SEQ ID NO: 6952223 - DNA, 22 bp, Homo sapiens
cagtttctacgaaggtcaaccc

SEQ ID NO: 6952224 - DNA, 22 bp, Homo sapiens
gtccatctccaccatctgggag

SEQ ID NO: 6952225 - DNA, 22 bp, Homo sapiens
aaagttgtttcctaaggtctaa

SEQ ID NO: 6952226 - DNA, 23 bp, Homo sapiens
cttgtgagtttgctagggctgcc

SEQ ID NO: 6952227 - DNA, 22 bp, Homo sapiens
taggcagggattagggttgatt

SEQ ID NO: 6952228 - DNA, 22 bp, Homo sapiens
cctgtgcaggctccataataga

SEQ ID NO: 6952229 - DNA, 22 bp, Homo sapiens
aacctttccaagcatttctgtt

SEQ ID NO: 6952230 - DNA, 22 bp, Homo sapiens
ctacaagatttttaaaactgta

SEQ ID NO: 6952231 - DNA, 22 bp, Homo sapiens
caaagggcggctgtcggagggt

SEQ ID NO: 6952232 - DNA, 22 bp, Homo sapiens
actctgctgtttactctctata

SEQ ID NO: 6952233 - DNA, 22 bp, Homo sapiens
gatggtcatctcctatttggtt

SEQ ID NO: 6952234 - DNA, 22 bp, Homo sapiens
gccactggagacagtggggaag

SEQ ID NO: 6952235 - DNA, 22 bp, Homo sapiens
gtagaactctttcctgcgtggg

SEQ ID NO: 6952236 - DNA, 22 bp, Homo sapiens
aagacaattttgagtatgcaca

SEQ ID NO: 6952237 - DNA, 22 bp, Homo sapiens
aatcagaaagaggtcatgttgc

SEQ ID NO: 6952238 - DNA, 22 bp, Homo sapiens
cagaagacagctgtttcactcg

SEQ ID NO: 6952239 - DNA, 22 bp, Homo sapiens
cacagggcagtgattgtccaca

SEQ ID NO: 6952240 - DNA, 22 bp, Homo sapiens
tccattttagaagaaaatccac

SEQ ID NO: 6952241 - DNA, 20 bp, Homo sapiens
tgtggcaggatgagggcgga

SEQ ID NO: 6952242 - DNA, 22 bp, Homo sapiens
tacatttgatttccactcatct

SEQ ID NO: 6952243 - DNA, 22 bp, Homo sapiens
gtgctctaggctacagggatgc

SEQ ID NO: 6952244 - DNA, 15 bp, Homo sapiens
tggcccacccgttga

SEQ ID NO: 6952245 - DNA, 22 bp, Homo sapiens
tagaacaatgaatttctggagg

SEQ ID NO: 6952246 - DNA, 22 bp, Homo sapiens
acacttgtggcctttctagtaa

SEQ ID NO: 6952247 - DNA, 22 bp, Homo sapiens
cctggccagccagggctggggt

SEQ ID NO: 6952248 - DNA, 22 bp, Homo sapiens
gccagctccgcaggatggcgcg

SEQ ID NO: 6952249 - DNA, 22 bp, Homo sapiens
tggtctaagagcctaactgctg

SEQ ID NO: 6952250 - DNA, 22 bp, Homo sapiens
aacaagtgtattaatggaaata

SEQ ID NO: 6952251 - DNA, 22 bp, Homo sapiens
tggcaaattccaaagttaattc

SEQ ID NO: 6952252 - DNA, 22 bp, Homo sapiens
gtggcattaggccaggtgcata

SEQ ID NO: 6952253 - DNA, 22 bp, Homo sapiens
agagcctggggattggcaaggg

SEQ ID NO: 6952254 - DNA, 22 bp, Homo sapiens
agaagaacttagctttctatct

SEQ ID NO: 6952255 - DNA, 22 bp, Homo sapiens
tcaaaccagccttgcatcccag

SEQ ID NO: 6952256 - DNA, 22 bp, Homo sapiens
agcaggtgggatcaagctggca

SEQ ID NO: 6952257 - DNA, 22 bp, Homo sapiens
tgggtgagtggagggcattcta

SEQ ID NO: 6952258 - DNA, 22 bp, Homo sapiens
aaagctgttgtatggcccttgg

SEQ ID NO: 6952259 - DNA, 20 bp, Homo sapiens
atataataaattttggttac

SEQ ID NO: 6952260 - DNA, 22 bp, Homo sapiens
aaaggcttggttctttgatgac

SEQ ID NO: 6952261 - DNA, 22 bp, Homo sapiens
acagtgtgttggaggagactgt

SEQ ID NO: 6952262 - DNA, 22 bp, Homo sapiens
tatgcatgttcatcagctcatt

SEQ ID NO: 6952263 - DNA, 22 bp, Homo sapiens
tatgcatatatcacgtgcatgc

SEQ ID NO: 6952264 - DNA, 22 bp, Homo sapiens
tggctggagggacccactcaga

SEQ ID NO: 6952265 - DNA, 21 bp, Homo sapiens
aggcttgggtaaaaaggtcat

SEQ ID NO: 6952266 - DNA, 22 bp, Homo sapiens
gtacatttctcccaacactaaa

SEQ ID NO: 6952267 - DNA, 22 bp, Homo sapiens
atgagagctctatatatagtaa

SEQ ID NO: 6952268 - DNA, 22 bp, Homo sapiens
gtagaaatatttatctctgaga

SEQ ID NO: 6952269 - DNA, 22 bp, Homo sapiens
gctgtctgctgtgcactgagca

SEQ ID NO: 6952270 - DNA, 22 bp, Homo sapiens
ccagcattcacactggttcctt

SEQ ID NO: 6952271 - DNA, 22 bp, Homo sapiens
agcctccctatgcaccttcagg

SEQ ID NO: 6952272 - DNA, 22 bp, Homo sapiens
ttcacagactttccatagattg

SEQ ID NO: 6952273 - DNA, 22 bp, Homo sapiens
ggcccctaacatctctcaccaa

SEQ ID NO: 6952274 - DNA, 22 bp, Homo sapiens
acactggaggagagctgttgct

SEQ ID NO: 6952275 - DNA, 22 bp, Homo sapiens
tttgaatatcacaaactttcaa

SEQ ID NO: 6952276 - DNA, 22 bp, Homo sapiens
attgacaattagcccttaggtg

SEQ ID NO: 6952277 - DNA, 21 bp, Homo sapiens
ttgtgaaagtccaggaacaac

SEQ ID NO: 6952278 - DNA, 22 bp, Homo sapiens
acatgctaaatctgagatgctt

SEQ ID NO: 6952279 - DNA, 22 bp, Homo sapiens
aagagggaaattgttggctgct

SEQ ID NO: 6952280 - DNA, 22 bp, Homo sapiens
gtgcttttaattctggtgagta

SEQ ID NO: 6952281 - DNA, 22 bp, Homo sapiens
ccaggattggaggctgtggtga

SEQ ID NO: 6952282 - DNA, 22 bp, Homo sapiens
ttgctaatcatatttcatcact

SEQ ID NO: 6952283 - DNA, 18 bp, Homo sapiens
atttttcccagatggata

SEQ ID NO: 6952284 - DNA, 22 bp, Homo sapiens
tcagttatagatacttttacca

SEQ ID NO: 6952285 - DNA, 22 bp, Homo sapiens
taactttaggaataggtaatct

SEQ ID NO: 6952286 - DNA, 21 bp, Homo sapiens
agggcctctcatttgtgccag

SEQ ID NO: 6952287 - DNA, 22 bp, Homo sapiens
ggagtctgtcacctgtttctct

SEQ ID NO: 6952288 - DNA, 22 bp, Homo sapiens
ccttgagtcaaataccctttat

SEQ ID NO: 6952289 - DNA, 22 bp, Homo sapiens
actttggaagatggctgtattt

SEQ ID NO: 6952290 - DNA, 22 bp, Homo sapiens
gctctatgggcacagccagtgt

SEQ ID NO: 6952291 - DNA, 22 bp, Homo sapiens
tattatggggggaacatcactc

SEQ ID NO: 6952292 - DNA, 22 bp, Homo sapiens
tttataattatctctactctta

SEQ ID NO: 6952293 - DNA, 21 bp, Homo sapiens
tgctccagggcagcttccagc

SEQ ID NO: 6952294 - DNA, 22 bp, Homo sapiens
atcagctgctacattggcctct

SEQ ID NO: 6952295 - DNA, 22 bp, Homo sapiens
gtaaaccaatgaaatgtgtgca

SEQ ID NO: 6952296 - DNA, 21 bp, Homo sapiens
cctcaagtgcctcctgctgct

SEQ ID NO: 6952297 - DNA, 22 bp, Homo sapiens
tcagtccagccatcatttattc

SEQ ID NO: 6952298 - DNA, 22 bp, Homo sapiens
cagaggcagaggtcatctctgg

SEQ ID NO: 6952299 - DNA, 22 bp, Homo sapiens
agctgaagctcagcccagtagt

SEQ ID NO: 6952300 - DNA, 22 bp, Homo sapiens
ctgcctggcccagggatgggcc

SEQ ID NO: 6952301 - DNA, 22 bp, Homo sapiens
caagattcagccctcctgacct

SEQ ID NO: 6952302 - DNA, 22 bp, Homo sapiens
cttatgtataatgttccacata

SEQ ID NO: 6952303 - DNA, 21 bp, Homo sapiens
ccttggctggcatctagcacc

SEQ ID NO: 6952304 - DNA, 22 bp, Homo sapiens
ttgggcttggtcggtttgaggc

SEQ ID NO: 6952305 - DNA, 22 bp, Homo sapiens
tggtggcagtctcctggctgtg

SEQ ID NO: 6952306 - DNA, 22 bp, Homo sapiens
cctagttttcattcagcagcct

SEQ ID NO: 6952307 - DNA, 22 bp, Homo sapiens
agctttatatttaatgaattct

SEQ ID NO: 6952308 - DNA, 22 bp, Homo sapiens
agatgggcgcgctgctctgatg

SEQ ID NO: 6952309 - DNA, 22 bp, Homo sapiens
gaagcctgtggataggggcatc

SEQ ID NO: 6952310 - DNA, 16 bp, Homo sapiens
ctccaggcaagaatgg

SEQ ID NO: 6952311 - DNA, 21 bp, Homo sapiens
agaagcctgatgaggtctgct

SEQ ID NO: 6952312 - DNA, 22 bp, Homo sapiens
gctgtgcttttggtagatccca

SEQ ID NO: 6952313 - DNA, 22 bp, Homo sapiens
ggctctggtggcaattgactgg

SEQ ID NO: 6952314 - DNA, 19 bp, Homo sapiens
cagtcccaaattcttgtca

SEQ ID NO: 6952315 - DNA, 22 bp, Homo sapiens
aggatcatataagctccagcta

SEQ ID NO: 6952316 - DNA, 22 bp, Homo sapiens
aagagcaccgcagcagcccaac

SEQ ID NO: 6952317 - DNA, 22 bp, Homo sapiens
tctgaggcctgaagcagcagag

SEQ ID NO: 6952318 - DNA, 22 bp, Homo sapiens
ctgcacagctggccagggagag

SEQ ID NO: 6952319 - DNA, 22 bp, Homo sapiens
tctagggtccacagggtcagcc

SEQ ID NO: 6952320 - DNA, 20 bp, Homo sapiens
gcctggaggcaatgggaaga

SEQ ID NO: 6952321 - DNA, 20 bp, Homo sapiens
tgtttgtgccagctttgtca

SEQ ID NO: 6952322 - DNA, 20 bp, Homo sapiens
tgggagaagaacactggaac

SEQ ID NO: 6952323 - DNA, 22 bp, Homo sapiens
cacattcaattacacagatagg

SEQ ID NO: 6952324 - DNA, 22 bp, Homo sapiens
cctgagattggctagtatgagt

SEQ ID NO: 6952325 - DNA, 22 bp, Homo sapiens
cttttcttctcacggctgtcag

SEQ ID NO: 6952326 - DNA, 22 bp, Homo sapiens
ctaatgtaaaacagacttgcat

SEQ ID NO: 6952327 - DNA, 21 bp, Homo sapiens
aaactgaccttgcctgagaca

SEQ ID NO: 6952328 - DNA, 22 bp, Homo sapiens
agatgacaatgaggttgttatt

SEQ ID NO: 6952329 - DNA, 22 bp, Homo sapiens
caaggcagctattgtctccata

SEQ ID NO: 6952330 - DNA, 22 bp, Homo sapiens
cttaaatccatcatttctaatc

SEQ ID NO: 6952331 - DNA, 22 bp, Homo sapiens
agcttgtgtttttctaagtatc

SEQ ID NO: 6952332 - DNA, 22 bp, Homo sapiens
ctttgtttatatttctcctcga

SEQ ID NO: 6952333 - DNA, 22 bp, Homo sapiens
atggagatttttagaattacag

SEQ ID NO: 6952334 - DNA, 22 bp, Homo sapiens
tatgagaaaggagaatgacttt

SEQ ID NO: 6952335 - DNA, 22 bp, Homo sapiens
ttaaccagtacttattgagcac

SEQ ID NO: 6952336 - DNA, 22 bp, Homo sapiens
ggcagaggtagctggaaccagg

SEQ ID NO: 6952337 - DNA, 22 bp, Homo sapiens
cagtggctcatgcctataatcc

SEQ ID NO: 6952338 - DNA, 22 bp, Homo sapiens
ccccttgaggggaatggctgga

SEQ ID NO: 6952339 - DNA, 22 bp, Homo sapiens
gacaggcagacctgtgccctgg

SEQ ID NO: 6952340 - DNA, 22 bp, Homo sapiens
cgtgtatgtgcctgcattcaca

SEQ ID NO: 6952341 - DNA, 21 bp, Homo sapiens
ctacacagctttctataggaa

SEQ ID NO: 6952342 - DNA, 22 bp, Homo sapiens
agagctgaattcaagtgctggc

SEQ ID NO: 6952343 - DNA, 22 bp, Homo sapiens
tgttaacatagtggcgcatctg

SEQ ID NO: 6952344 - DNA, 22 bp, Homo sapiens
cactgaaacaggtattgctggt

SEQ ID NO: 6952345 - DNA, 22 bp, Homo sapiens
aaagcagactgatttgcatcac

SEQ ID NO: 6952346 - DNA, 22 bp, Homo sapiens
gatgcttcagtaagaatgcatt

SEQ ID NO: 6952347 - DNA, 22 bp, Homo sapiens
ggaccctgcagccacccgacat

SEQ ID NO: 6952348 - DNA, 22 bp, Homo sapiens
gcagttcacccaagtgcagaga

SEQ ID NO: 6952349 - DNA, 22 bp, Homo sapiens
cactttggtagctgttttggga

SEQ ID NO: 6952350 - DNA, 22 bp, Homo sapiens
agctctccatctatctgtgatg

SEQ ID NO: 6952351 - DNA, 21 bp, Homo sapiens
tcttatacagcaatagatctg

SEQ ID NO: 6952352 - DNA, 22 bp, Homo sapiens
aagtttatctttgctgggtact

SEQ ID NO: 6952353 - DNA, 22 bp, Homo sapiens
gttatcttccctttgatgattt

SEQ ID NO: 6952354 - DNA, 22 bp, Homo sapiens
gagaggagtaggctgatggtgc

SEQ ID NO: 6952355 - DNA, 22 bp, Homo sapiens
acccagggtttgagctctgcag

SEQ ID NO: 6952356 - DNA, 22 bp, Homo sapiens
agcctgggagacactaagttgt

SEQ ID NO: 6952357 - DNA, 22 bp, Homo sapiens
tctggaccaacatagcttctgg

SEQ ID NO: 6952358 - DNA, 23 bp, Homo sapiens
ttggcaaagcctatgaagtcctc

SEQ ID NO: 6952359 - DNA, 22 bp, Homo sapiens
tatgacattttgccagcattgc

SEQ ID NO: 6952360 - DNA, 22 bp, Homo sapiens
tgccatctcttcctcgtgctgc

SEQ ID NO: 6952361 - DNA, 22 bp, Homo sapiens
aaatcctaaaagtttgacttaa

SEQ ID NO: 6952362 - DNA, 22 bp, Homo sapiens
tgctaatatctagaagtttgtt

SEQ ID NO: 6952363 - DNA, 22 bp, Homo sapiens
atggccttagtgatgattaata

SEQ ID NO: 6952364 - DNA, 22 bp, Homo sapiens
tgtgtggcgttgcgtggctagg

SEQ ID NO: 6952365 - DNA, 20 bp, Homo sapiens
tagtccaatacttagtccat

SEQ ID NO: 6952366 - DNA, 22 bp, Homo sapiens
aagagcattttagtctcccttt

SEQ ID NO: 6952367 - DNA, 22 bp, Homo sapiens
gcccatttgtttatatactgtc

SEQ ID NO: 6952368 - DNA, 22 bp, Homo sapiens
tcagatgagtgctttcagctgc

SEQ ID NO: 6952369 - DNA, 22 bp, Homo sapiens
gacagaggctggagcacctcct

SEQ ID NO: 6952370 - DNA, 22 bp, Homo sapiens
tgcaaagatttatctttctcca

SEQ ID NO: 6952371 - DNA, 22 bp, Homo sapiens
cagacagcgagcggaggggctt

SEQ ID NO: 6952372 - DNA, 22 bp, Homo sapiens
ggctcctgttttaaaaggtgaa

SEQ ID NO: 6952373 - DNA, 22 bp, Homo sapiens
attgacatgtaggctacaagga

SEQ ID NO: 6952374 - DNA, 22 bp, Homo sapiens
tcatgggcagctactggttccc

SEQ ID NO: 6952375 - DNA, 22 bp, Homo sapiens
cactgctattattagacaatgt

SEQ ID NO: 6952376 - DNA, 22 bp, Homo sapiens
tgtacaatggctataataccct

SEQ ID NO: 6952377 - DNA, 22 bp, Homo sapiens
aaccagatctgggatgtagcta

SEQ ID NO: 6952378 - DNA, 21 bp, Homo sapiens
cagaggggctagcctggctgc

SEQ ID NO: 6952379 - DNA, 22 bp, Homo sapiens
caagctgaacactgtcttcaag

SEQ ID NO: 6952380 - DNA, 22 bp, Homo sapiens
tgtactacatgattattgacca

SEQ ID NO: 6952381 - DNA, 22 bp, Homo sapiens
gggctcatgatgtaggctggta

SEQ ID NO: 6952382 - DNA, 22 bp, Homo sapiens
gtgggctgcatgtttactattc

SEQ ID NO: 6952383 - DNA, 22 bp, Homo sapiens
tcacatttatactccatttgca

SEQ ID NO: 6952384 - DNA, 22 bp, Homo sapiens
atgagcaagagctatgtacaga

SEQ ID NO: 6952385 - DNA, 22 bp, Homo sapiens
gggagctatttatagaggctga

SEQ ID NO: 6952386 - DNA, 22 bp, Homo sapiens
tccactcatgagatctggctga

SEQ ID NO: 6952387 - DNA, 22 bp, Homo sapiens
tagaacttaaatatgttttccc

SEQ ID NO: 6952388 - DNA, 22 bp, Homo sapiens
agctggtgatgtggtccctcac

SEQ ID NO: 6952389 - DNA, 22 bp, Homo sapiens
cagggccacacggaagggaaca

SEQ ID NO: 6952390 - DNA, 22 bp, Homo sapiens
ttgaatgatcctatctagcaca

SEQ ID NO: 6952391 - DNA, 22 bp, Homo sapiens
aaacttggggctttcttacatt

SEQ ID NO: 6952392 - DNA, 22 bp, Homo sapiens
gtgctttccatcctccctgctg

SEQ ID NO: 6952393 - DNA, 22 bp, Homo sapiens
cagtttcttaagactgagatct

SEQ ID NO: 6952394 - DNA, 22 bp, Homo sapiens
aaaagagccacttatgacctca

SEQ ID NO: 6952395 - DNA, 22 bp, Homo sapiens
tgggagtccaaggtttttatag

SEQ ID NO: 6952396 - DNA, 22 bp, Homo sapiens
caggaacaggggagtgaacctg

SEQ ID NO: 6952397 - DNA, 23 bp, Homo sapiens
tgatgggaaggaacgactaccac

SEQ ID NO: 6952398 - DNA, 22 bp, Homo sapiens
gcgcaggacgcccagttgcctt

SEQ ID NO: 6952399 - DNA, 22 bp, Homo sapiens
acatgcagacgggatcctggca

SEQ ID NO: 6952400 - DNA, 22 bp, Homo sapiens
aatccattcagaaattgggaat

SEQ ID NO: 6952401 - DNA, 22 bp, Homo sapiens
atgaaatatttcagagcagagt

SEQ ID NO: 6952402 - DNA, 22 bp, Homo sapiens
gcttctaacctgcttcctgtag

SEQ ID NO: 6952403 - DNA, 23 bp, Homo sapiens
tgcatggggctatactgctgttc

SEQ ID NO: 6952404 - DNA, 22 bp, Homo sapiens
ccttggagaagacagtgccagg

SEQ ID NO: 6952405 - DNA, 21 bp, Homo sapiens
gccaggaccagcagaccactt

SEQ ID NO: 6952406 - DNA, 22 bp, Homo sapiens
gtgcctgggcatgagcttgttg

SEQ ID NO: 6952407 - DNA, 22 bp, Homo sapiens
tgcaatccactattctaaagcc

SEQ ID NO: 6952408 - DNA, 22 bp, Homo sapiens
caggctccctgcaggccagtga

SEQ ID NO: 6952409 - DNA, 22 bp, Homo sapiens
gatggcggtcgtcgacggtcct

SEQ ID NO: 6952410 - DNA, 22 bp, Homo sapiens
atgtggcttttcctgggttcct

SEQ ID NO: 6952411 - DNA, 18 bp, Homo sapiens
cattatgtggttatagaa

SEQ ID NO: 6952412 - DNA, 21 bp, Homo sapiens
aagtttgggattcagtttcca

SEQ ID NO: 6952413 - DNA, 22 bp, Homo sapiens
catctaaccagtcgtttttgga

SEQ ID NO: 6952414 - DNA, 22 bp, Homo sapiens
atttctcactcacagtccatgt

SEQ ID NO: 6952415 - DNA, 22 bp, Homo sapiens
tccagagaacgatgaaagctgg

SEQ ID NO: 6952416 - DNA, 22 bp, Homo sapiens
atttgcttctagtcagttccat

SEQ ID NO: 6952417 - DNA, 22 bp, Homo sapiens
ataggctttttaactctccaaa

SEQ ID NO: 6952418 - DNA, 23 bp, Homo sapiens
agttcactgaggttgaccactgg

SEQ ID NO: 6952419 - DNA, 22 bp, Homo sapiens
ctgctgagcatcagggctgccc

SEQ ID NO: 6952420 - DNA, 22 bp, Homo sapiens
tgcagcagagtgggcctgggtg

SEQ ID NO: 6952421 - DNA, 22 bp, Homo sapiens
tgtctttagagtcacaaaacca

SEQ ID NO: 6952422 - DNA, 19 bp, Homo sapiens
tcccttcctgtcgggctcc

SEQ ID NO: 6952423 - DNA, 22 bp, Homo sapiens
actatgtattgtatgggctggt

SEQ ID NO: 6952424 - DNA, 22 bp, Homo sapiens
taaatgtgcacaggttagaagg

SEQ ID NO: 6952425 - DNA, 22 bp, Homo sapiens
ctgtgttcccctgctgctgagg

SEQ ID NO: 6952426 - DNA, 22 bp, Homo sapiens
gctgaagatttttgctagcccc

SEQ ID NO: 6952427 - DNA, 20 bp, Homo sapiens
tcttatacagaaaacatttt

SEQ ID NO: 6952428 - DNA, 22 bp, Homo sapiens
gtcacactcttccctccacatg

SEQ ID NO: 6952429 - DNA, 23 bp, Homo sapiens
tgaatgtttattctcggtgcaga

SEQ ID NO: 6952430 - DNA, 22 bp, Homo sapiens
aatggtttttgcatattcaggt

SEQ ID NO: 6952431 - DNA, 22 bp, Homo sapiens
cagaggatatatggtttgtatg

SEQ ID NO: 6952432 - DNA, 22 bp, Homo sapiens
tttatttggcatctctgccaag

SEQ ID NO: 6952433 - DNA, 22 bp, Homo sapiens
tgctggaaatatatttgtttat

SEQ ID NO: 6952434 - DNA, 22 bp, Homo sapiens
atcatgcatggtactcttgtgc

SEQ ID NO: 6952435 - DNA, 22 bp, Homo sapiens
atctgggagacccttgcgggaa

SEQ ID NO: 6952436 - DNA, 22 bp, Homo sapiens
gtctcctgaggcatccattgaa

SEQ ID NO: 6952437 - DNA, 22 bp, Homo sapiens
agcaggagagcagtgcgtggtc

SEQ ID NO: 6952438 - DNA, 22 bp, Homo sapiens
gtatgaagttggactgtataaa

SEQ ID NO: 6952439 - DNA, 22 bp, Homo sapiens
cacaggcttgtcagcatgaggc

SEQ ID NO: 6952440 - DNA, 22 bp, Homo sapiens
cagcttgctcaaggttatagat

SEQ ID NO: 6952441 - DNA, 22 bp, Homo sapiens
tgagaaacatatgagagatttg

SEQ ID NO: 6952442 - DNA, 22 bp, Homo sapiens
cattctgagctaatatgcttat

SEQ ID NO: 6952443 - DNA, 22 bp, Homo sapiens
gtgcacacatacatgaacgctg

SEQ ID NO: 6952444 - DNA, 22 bp, Homo sapiens
ggccacagcagatgcttcagat

SEQ ID NO: 6952445 - DNA, 22 bp, Homo sapiens
tgcattgatcatatccttcctg

SEQ ID NO: 6952446 - DNA, 22 bp, Homo sapiens
cctcagcatcctcctgctcagt

SEQ ID NO: 6952447 - DNA, 22 bp, Homo sapiens
gtgttcatggatgtcaatttga

SEQ ID NO: 6952448 - DNA, 22 bp, Homo sapiens
tcctggcccactatgccagcat

SEQ ID NO: 6952449 - DNA, 22 bp, Homo sapiens
agggaacagtgaaaggcatcag

SEQ ID NO: 6952450 - DNA, 22 bp, Homo sapiens
ctcttagaaactatagagatta

SEQ ID NO: 6952451 - DNA, 22 bp, Homo sapiens
tcatcctgtctcactttttgct

SEQ ID NO: 6952452 - DNA, 22 bp, Homo sapiens
gtccagagatggacgagcagat

SEQ ID NO: 6952453 - DNA, 22 bp, Homo sapiens
tggacctgagcctggccctgcc

SEQ ID NO: 6952454 - DNA, 22 bp, Homo sapiens
gaatgtgtgactctattgagca

SEQ ID NO: 6952455 - DNA, 22 bp, Homo sapiens
aatgcacatgttgtaataaata

SEQ ID NO: 6952456 - DNA, 22 bp, Homo sapiens
ctgacaaacttaattttctgaa

SEQ ID NO: 6952457 - DNA, 22 bp, Homo sapiens
aggtgctgttggcagcgggcag

SEQ ID NO: 6952458 - DNA, 22 bp, Homo sapiens
tcaccccttgtgaatgctgctc

SEQ ID NO: 6952459 - DNA, 22 bp, Homo sapiens
ccagggagtttccaatctgaga

SEQ ID NO: 6952460 - DNA, 22 bp, Homo sapiens
taggcaaggagatttctaagca

SEQ ID NO: 6952461 - DNA, 22 bp, Homo sapiens
tatgagtggcgtagaggtaggg

SEQ ID NO: 6952462 - DNA, 22 bp, Homo sapiens
agagttgcaaacagatacctac

SEQ ID NO: 6952463 - DNA, 22 bp, Homo sapiens
aagtttctgttcgctttaataa

SEQ ID NO: 6952464 - DNA, 20 bp, Homo sapiens
gtacacttcatgtttcacct

SEQ ID NO: 6952465 - DNA, 22 bp, Homo sapiens
ccagtggacaatttctgaggaa

SEQ ID NO: 6952466 - DNA, 22 bp, Homo sapiens
tgctgaatgggatatgttgagc

SEQ ID NO: 6952467 - DNA, 22 bp, Homo sapiens
gggtcagggctgcctgggctca

SEQ ID NO: 6952468 - DNA, 22 bp, Homo sapiens
attgcactccagcctgggggac

SEQ ID NO: 6952469 - DNA, 22 bp, Homo sapiens
cagctattgttctgtataatga

SEQ ID NO: 6952470 - DNA, 22 bp, Homo sapiens
cactgaacaacaaatagtgaat

SEQ ID NO: 6952471 - DNA, 22 bp, Homo sapiens
ttggtcaagctgtcttctttgc

SEQ ID NO: 6952472 - DNA, 22 bp, Homo sapiens
ttggaatctgcaatttaacaaa

SEQ ID NO: 6952473 - DNA, 22 bp, Homo sapiens
gctagaggcaacaactttatag

SEQ ID NO: 6952474 - DNA, 22 bp, Homo sapiens
ggcaagttctaatgattagaat

SEQ ID NO: 6952475 - DNA, 22 bp, Homo sapiens
aaaggcaggactgcagcatagg

SEQ ID NO: 6952476 - DNA, 22 bp, Homo sapiens
gcttctgggcacctgaacagga

SEQ ID NO: 6952477 - DNA, 22 bp, Homo sapiens
gcctgttctccagcatccaggt

SEQ ID NO: 6952478 - DNA, 22 bp, Homo sapiens
tgcttgtattcatatcacagct

SEQ ID NO: 6952479 - DNA, 22 bp, Homo sapiens
aatgccatcagagaaaactctt

SEQ ID NO: 6952480 - DNA, 22 bp, Homo sapiens
ccagggctggtggctgcagagg

SEQ ID NO: 6952481 - DNA, 22 bp, Homo sapiens
gaatgaagcaggtcacacagtt

SEQ ID NO: 6952482 - DNA, 22 bp, Homo sapiens
aggatttgcactggtgtttgag

SEQ ID NO: 6952483 - DNA, 22 bp, Homo sapiens
cacagaaaaaggcttgaaaatc

SEQ ID NO: 6952484 - DNA, 22 bp, Homo sapiens
acagggcttttaatcagtagtt

SEQ ID NO: 6952485 - DNA, 21 bp, Homo sapiens
agttacatgtatagataaagt

SEQ ID NO: 6952486 - DNA, 22 bp, Homo sapiens
tttcagttgttttagctctgtg

SEQ ID NO: 6952487 - DNA, 19 bp, Homo sapiens
aagcattagccaaagcatt

SEQ ID NO: 6952488 - DNA, 22 bp, Homo sapiens
gaaatcattagcaaagatatgt

SEQ ID NO: 6952489 - DNA, 22 bp, Homo sapiens
atccaggctgctatgaggatga

SEQ ID NO: 6952490 - DNA, 22 bp, Homo sapiens
atacatctatgcctttctgaca

SEQ ID NO: 6952491 - DNA, 22 bp, Homo sapiens
tgtttcaaattacttgaggatt

SEQ ID NO: 6952492 - DNA, 22 bp, Homo sapiens
gcagactctgagagtgagtgcc

SEQ ID NO: 6952493 - DNA, 22 bp, Homo sapiens
gctgcaagtccttccctctctt

SEQ ID NO: 6952494 - DNA, 22 bp, Homo sapiens
ttcattcatctctaaaatgcct

SEQ ID NO: 6952495 - DNA, 22 bp, Homo sapiens
catgcagtgaaattgatatcca

SEQ ID NO: 6952496 - DNA, 22 bp, Homo sapiens
caaggctggctcacaataatga

SEQ ID NO: 6952497 - DNA, 23 bp, Homo sapiens
cctggcttcattctcttagggtg

SEQ ID NO: 6952498 - DNA, 22 bp, Homo sapiens
tctgaaatggcagcgggaatga

SEQ ID NO: 6952499 - DNA, 22 bp, Homo sapiens
tagaggccaaaatacccggcga

SEQ ID NO: 6952500 - DNA, 22 bp, Homo sapiens
gaatctgtgtgaaattcacaca

SEQ ID NO: 6952501 - DNA, 22 bp, Homo sapiens
agctgttgctgggaggagagaa

SEQ ID NO: 6952502 - DNA, 22 bp, Homo sapiens
agaggccggccgagcccatggg

SEQ ID NO: 6952503 - DNA, 22 bp, Homo sapiens
taagtcgtggatgattcttcgg

SEQ ID NO: 6952504 - DNA, 22 bp, Homo sapiens
ctgagatggtagatggatgtta

SEQ ID NO: 6952505 - DNA, 22 bp, Homo sapiens
caagaatcaacattatttagtg

SEQ ID NO: 6952506 - DNA, 22 bp, Homo sapiens
ccagaatagaatgaaagaaggg

SEQ ID NO: 6952507 - DNA, 22 bp, Homo sapiens
aaggaacctctaagcctctgtt

SEQ ID NO: 6952508 - DNA, 22 bp, Homo sapiens
cattgcaacttcaaactcctgg

SEQ ID NO: 6952509 - DNA, 22 bp, Homo sapiens
ataggtccaaggagaggtcttt

SEQ ID NO: 6952510 - DNA, 22 bp, Homo sapiens
acaaggagagcacacatgggga

SEQ ID NO: 6952511 - DNA, 22 bp, Homo sapiens
tgggagagaattctggtgactg

SEQ ID NO: 6952512 - DNA, 23 bp, Homo sapiens
tggcatccatttttgtacaacct

SEQ ID NO: 6952513 - DNA, 22 bp, Homo sapiens
gagagaagggggatatgagcct

SEQ ID NO: 6952514 - DNA, 22 bp, Homo sapiens
atttccaccggctcaggaagtt

SEQ ID NO: 6952515 - DNA, 22 bp, Homo sapiens
gtgtgtctcccaagaaggccca

SEQ ID NO: 6952516 - DNA, 18 bp, Homo sapiens
ggagggctttggggactg

SEQ ID NO: 6952517 - DNA, 22 bp, Homo sapiens
aaaggtatcatgtccatacagt

SEQ ID NO: 6952518 - DNA, 22 bp, Homo sapiens
agctttgaaaatccaaattaca

SEQ ID NO: 6952519 - DNA, 22 bp, Homo sapiens
tgcagtgctttggaacaaagtc

SEQ ID NO: 6952520 - DNA, 22 bp, Homo sapiens
aatcctcagtttaagaatctgt

SEQ ID NO: 6952521 - DNA, 22 bp, Homo sapiens
ggtgggatggaggatcttagac

SEQ ID NO: 6952522 - DNA, 22 bp, Homo sapiens
attacagtgggtaaacagaatt

SEQ ID NO: 6952523 - DNA, 21 bp, Homo sapiens
tctcatctcctgacctgtgcc

SEQ ID NO: 6952524 - DNA, 22 bp, Homo sapiens
gactagaagggcaagagtccct

SEQ ID NO: 6952525 - DNA, 19 bp, Homo sapiens
gtctagaccaggctcctta

SEQ ID NO: 6952526 - DNA, 22 bp, Homo sapiens
agcagtggtgtgaggagggctc

SEQ ID NO: 6952527 - DNA, 22 bp, Homo sapiens
tgtccacatcactcacttgtca

SEQ ID NO: 6952528 - DNA, 19 bp, Homo sapiens
gctcagagggccctgtgct

SEQ ID NO: 6952529 - DNA, 22 bp, Homo sapiens
atacattagtgaacaaaagaga

SEQ ID NO: 6952530 - DNA, 22 bp, Homo sapiens
tacagctaggcaaaaatgacat

SEQ ID NO: 6952531 - DNA, 22 bp, Homo sapiens
ccaggtagccaaggggtctggg

SEQ ID NO: 6952532 - DNA, 22 bp, Homo sapiens
ttgctcagtggcagggctggta

SEQ ID NO: 6952533 - DNA, 22 bp, Homo sapiens
agaagcattggaccaggggccc

SEQ ID NO: 6952534 - DNA, 22 bp, Homo sapiens
ctttagacatctcattgtgtaa

SEQ ID NO: 6952535 - DNA, 22 bp, Homo sapiens
gctgggaggcagcacctttagc

SEQ ID NO: 6952536 - DNA, 22 bp, Homo sapiens
ctggtgggtagagggcatcagg

SEQ ID NO: 6952537 - DNA, 22 bp, Homo sapiens
aggtctaggagtctgaaagtat

SEQ ID NO: 6952538 - DNA, 22 bp, Homo sapiens
caggagaaatgtggctgctacc

SEQ ID NO: 6952539 - DNA, 20 bp, Homo sapiens
gctcagggcctgggtctgga

SEQ ID NO: 6952540 - DNA, 22 bp, Homo sapiens
cgcctgctctcactggacagct

SEQ ID NO: 6952541 - DNA, 22 bp, Homo sapiens
cttcagaatccagaatcagaat

SEQ ID NO: 6952542 - DNA, 22 bp, Homo sapiens
tgctggacagggcacggcccat

SEQ ID NO: 6952543 - DNA, 22 bp, Homo sapiens
acagtttatgtaaagctgccaa

SEQ ID NO: 6952544 - DNA, 22 bp, Homo sapiens
tcataaagctcttccaaatgta

SEQ ID NO: 6952545 - DNA, 22 bp, Homo sapiens
aggctgtggcatcacatcagga

SEQ ID NO: 6952546 - DNA, 22 bp, Homo sapiens
agctgaaagcttgactggggct

SEQ ID NO: 6952547 - DNA, 22 bp, Homo sapiens
cagcactttagcggaggcatca

SEQ ID NO: 6952548 - DNA, 22 bp, Homo sapiens
aagccattcatctaatgtcctg

SEQ ID NO: 6952549 - DNA, 22 bp, Homo sapiens
gacacagaaggtcacatgttca

SEQ ID NO: 6952550 - DNA, 22 bp, Homo sapiens
tgcacagagctggactccgcgg

SEQ ID NO: 6952551 - DNA, 22 bp, Homo sapiens
tgtcaggttcaaatcttggtcc

SEQ ID NO: 6952552 - DNA, 21 bp, Homo sapiens
gtttctcatgtggccttatgg

SEQ ID NO: 6952553 - DNA, 22 bp, Homo sapiens
atatgtgtcgtgctactgccca

SEQ ID NO: 6952554 - DNA, 22 bp, Homo sapiens
gaggcttttggctaataactgt

SEQ ID NO: 6952555 - DNA, 22 bp, Homo sapiens
aaagtatgattggggattattt

SEQ ID NO: 6952556 - DNA, 22 bp, Homo sapiens
taaataagttcttcattgtttg

SEQ ID NO: 6952557 - DNA, 22 bp, Homo sapiens
tacaaagatggaaggttatgtt

SEQ ID NO: 6952558 - DNA, 22 bp, Homo sapiens
ttggccttcttccccctgcact

SEQ ID NO: 6952559 - DNA, 22 bp, Homo sapiens
gctgcacaaagtgttggttaag

SEQ ID NO: 6952560 - DNA, 22 bp, Homo sapiens
tagttcaacgagttggggttgc

SEQ ID NO: 6952561 - DNA, 20 bp, Homo sapiens
tgattttctgaaacagcaca

SEQ ID NO: 6952562 - DNA, 22 bp, Homo sapiens
aaagtctgaaagatgctaacat

SEQ ID NO: 6952563 - DNA, 22 bp, Homo sapiens
aaaggtgctactgtgttcctca

SEQ ID NO: 6952564 - DNA, 22 bp, Homo sapiens
acagtgcaaaccctcgggaaag

SEQ ID NO: 6952565 - DNA, 19 bp, Homo sapiens
cagaggtgatatatgccca

SEQ ID NO: 6952566 - DNA, 22 bp, Homo sapiens
aagagactatggtgtctatgaa

SEQ ID NO: 6952567 - DNA, 22 bp, Homo sapiens
actgagatgctggatgaccctg

SEQ ID NO: 6952568 - DNA, 21 bp, Homo sapiens
tctgtacatcattgagtcccc

SEQ ID NO: 6952569 - DNA, 22 bp, Homo sapiens
ccatgaattcactccatgctag

SEQ ID NO: 6952570 - DNA, 20 bp, Homo sapiens
agatgttttgaagtcttgga

SEQ ID NO: 6952571 - DNA, 22 bp, Homo sapiens
gaaatgaactgattatcattgc

SEQ ID NO: 6952572 - DNA, 22 bp, Homo sapiens
acagtaccaggccaaaccatga

SEQ ID NO: 6952573 - DNA, 22 bp, Homo sapiens
agagccaggatgtcttctgggg

SEQ ID NO: 6952574 - DNA, 22 bp, Homo sapiens
agtcctgtgaggggtgcagctt

SEQ ID NO: 6952575 - DNA, 22 bp, Homo sapiens
tttccttaaatctgtttctagt

SEQ ID NO: 6952576 - DNA, 22 bp, Homo sapiens
agaaggccccatgaacactgca

SEQ ID NO: 6952577 - DNA, 22 bp, Homo sapiens
aatccccatcaaattaatacgt

SEQ ID NO: 6952578 - DNA, 22 bp, Homo sapiens
ctgtgggagcacatgacagata

SEQ ID NO: 6952579 - DNA, 22 bp, Homo sapiens
tatcctaaatgttgaactgtga

SEQ ID NO: 6952580 - DNA, 22 bp, Homo sapiens
aatgtatgtgcatcatttacat

SEQ ID NO: 6952581 - DNA, 22 bp, Homo sapiens
cccctgggtccaggcttctctg

SEQ ID NO: 6952582 - DNA, 22 bp, Homo sapiens
cccaggctcctagaggcccaga

SEQ ID NO: 6952583 - DNA, 20 bp, Homo sapiens
ttggcagcagctcagccacc

SEQ ID NO: 6952584 - DNA, 22 bp, Homo sapiens
tcagtaaaattacagatctaca

SEQ ID NO: 6952585 - DNA, 22 bp, Homo sapiens
actcagagtagaaaataggttc

SEQ ID NO: 6952586 - DNA, 22 bp, Homo sapiens
cctgagctcaagaaggtgacca

SEQ ID NO: 6952587 - DNA, 22 bp, Homo sapiens
acatttctttgctagacagcag

SEQ ID NO: 6952588 - DNA, 21 bp, Homo sapiens
gcatgtgtgggactggatcct

SEQ ID NO: 6952589 - DNA, 22 bp, Homo sapiens
gcacaggatgatgggttgaggg

SEQ ID NO: 6952590 - DNA, 21 bp, Homo sapiens
acagatgtgatatgcagtctt

SEQ ID NO: 6952591 - DNA, 22 bp, Homo sapiens
gcaggggtagtgtcttcctgag

SEQ ID NO: 6952592 - DNA, 22 bp, Homo sapiens
agggcatcaggtattttatgct

SEQ ID NO: 6952593 - DNA, 22 bp, Homo sapiens
agcctctccagagcctggcaga

SEQ ID NO: 6952594 - DNA, 22 bp, Homo sapiens
gaattgtatgcagttacttgga

SEQ ID NO: 6952595 - DNA, 22 bp, Homo sapiens
agcattgcatagaaccacacac

SEQ ID NO: 6952596 - DNA, 23 bp, Homo sapiens
gcgtgcatgcatatcacatttcc

SEQ ID NO: 6952597 - DNA, 22 bp, Homo sapiens
tgctgagggcagatgaattaga

SEQ ID NO: 6952598 - DNA, 22 bp, Homo sapiens
ttattaaaatgcggatttggct

SEQ ID NO: 6952599 - DNA, 22 bp, Homo sapiens
tttatgattaatccaattctgt

SEQ ID NO: 6952600 - DNA, 22 bp, Homo sapiens
ccagatggtgcctgtcagaagg

SEQ ID NO: 6952601 - DNA, 22 bp, Homo sapiens
gtctggaaggaggagatggagc

SEQ ID NO: 6952602 - DNA, 22 bp, Homo sapiens
ttcacagagcactgccaagtac

SEQ ID NO: 6952603 - DNA, 22 bp, Homo sapiens
atacagatgttaaagcaatttc

SEQ ID NO: 6952604 - DNA, 22 bp, Homo sapiens
gggacagccatgtgcagatgcc

SEQ ID NO: 6952605 - DNA, 22 bp, Homo sapiens
tgagatctgtgcatgttagtta

SEQ ID NO: 6952606 - DNA, 22 bp, Homo sapiens
ctggggaccgagcaagctctgg

SEQ ID NO: 6952607 - DNA, 22 bp, Homo sapiens
ctcagctggcaattctggctcc

SEQ ID NO: 6952608 - DNA, 22 bp, Homo sapiens
tgtatttattcttctggtgttt

SEQ ID NO: 6952609 - DNA, 22 bp, Homo sapiens
acaaacttccatcatgaatttt

SEQ ID NO: 6952610 - DNA, 22 bp, Homo sapiens
cacatccctggagttacccagt

SEQ ID NO: 6952611 - DNA, 22 bp, Homo sapiens
ggcccagcctcagacatgccct

SEQ ID NO: 6952612 - DNA, 22 bp, Homo sapiens
taggaatggtgctcagcagaaa

SEQ ID NO: 6952613 - DNA, 22 bp, Homo sapiens
acagtgtggttgtttctggtta

SEQ ID NO: 6952614 - DNA, 22 bp, Homo sapiens
tgctttatagacaaggaagtag

SEQ ID NO: 6952615 - DNA, 22 bp, Homo sapiens
tctgtcactctagagatggcag

SEQ ID NO: 6952616 - DNA, 22 bp, Homo sapiens
caggggcggtggctcacgcctg

SEQ ID NO: 6952617 - DNA, 22 bp, Homo sapiens
ctgaggagcaaccccgtgccct

SEQ ID NO: 6952618 - DNA, 22 bp, Homo sapiens
ctgcaaatgccgtgagagcagg

SEQ ID NO: 6952619 - DNA, 19 bp, Homo sapiens
gcctgagccagccatgcaa

SEQ ID NO: 6952620 - DNA, 22 bp, Homo sapiens
gaaacagctagaaagccattgg

SEQ ID NO: 6952621 - DNA, 22 bp, Homo sapiens
aaactcaagtttcttaatgtca

SEQ ID NO: 6952622 - DNA, 22 bp, Homo sapiens
aggaatatggatttgctcagct

SEQ ID NO: 6952623 - DNA, 22 bp, Homo sapiens
aagaatctctgatcaggcttta

SEQ ID NO: 6952624 - DNA, 22 bp, Homo sapiens
tgtaggcacatgtatatatccc

SEQ ID NO: 6952625 - DNA, 22 bp, Homo sapiens
ttcagagagaaaccagtgggaa

SEQ ID NO: 6952626 - DNA, 22 bp, Homo sapiens
tgtatataagcatttacttgtt

SEQ ID NO: 6952627 - DNA, 22 bp, Homo sapiens
tatttccagaggagtatagaag

SEQ ID NO: 6952628 - DNA, 22 bp, Homo sapiens
ccagcttgctcctctgcaatgg

SEQ ID NO: 6952629 - DNA, 22 bp, Homo sapiens
tgaagtgggggaacgagagttc

SEQ ID NO: 6952630 - DNA, 20 bp, Homo sapiens
ccacatggaagtttgagacc

SEQ ID NO: 6952631 - DNA, 22 bp, Homo sapiens
aagggccttgccaggtgaagag

SEQ ID NO: 6952632 - DNA, 22 bp, Homo sapiens
ctcatctgtatatagtgaatga

SEQ ID NO: 6952633 - DNA, 22 bp, Homo sapiens
aggccctgtaaggtgtggagat

SEQ ID NO: 6952634 - DNA, 22 bp, Homo sapiens
aacttaatccaacacgggcatc

SEQ ID NO: 6952635 - DNA, 22 bp, Homo sapiens
ctgtggctgagttccttatgtt

SEQ ID NO: 6952636 - DNA, 22 bp, Homo sapiens
gctggagtccagtggtatgatc

SEQ ID NO: 6952637 - DNA, 21 bp, Homo sapiens
tttgtccacctgtgttcacca

SEQ ID NO: 6952638 - DNA, 22 bp, Homo sapiens
agatattctgcctaacaggttt

SEQ ID NO: 6952639 - DNA, 22 bp, Homo sapiens
ttttctgaagtttaagacattt

SEQ ID NO: 6952640 - DNA, 22 bp, Homo sapiens
atgaatcaaactgtacactgag

SEQ ID NO: 6952641 - DNA, 22 bp, Homo sapiens
ttcaagtttgtatttctgtatt

SEQ ID NO: 6952642 - DNA, 22 bp, Homo sapiens
aattgcacatttcagtgttctg

SEQ ID NO: 6952643 - DNA, 23 bp, Homo sapiens
ttcagcatgaagagtgaaggctg

SEQ ID NO: 6952644 - DNA, 22 bp, Homo sapiens
tgcccaagattcttacatcatg

SEQ ID NO: 6952645 - DNA, 22 bp, Homo sapiens
taaggctaggaattctctgaag

SEQ ID NO: 6952646 - DNA, 22 bp, Homo sapiens
tgtctgggagggacagggctac

SEQ ID NO: 6952647 - DNA, 22 bp, Homo sapiens
cctgggagagccatctgtggcc

SEQ ID NO: 6952648 - DNA, 22 bp, Homo sapiens
gtctcaaactcctaggctaaag

SEQ ID NO: 6952649 - DNA, 22 bp, Homo sapiens
atttgtcactgagagagttaga

SEQ ID NO: 6952650 - DNA, 22 bp, Homo sapiens
aacactctacgtgcagctccta

SEQ ID NO: 6952651 - DNA, 22 bp, Homo sapiens
tgcaagtaacttgtttgggagg

SEQ ID NO: 6952652 - DNA, 19 bp, Homo sapiens
tttgtcctgccctttctca

SEQ ID NO: 6952653 - DNA, 22 bp, Homo sapiens
tgactctgcccagccgcttgtc

SEQ ID NO: 6952654 - DNA, 22 bp, Homo sapiens
gttctcagtgatctgtgattcg

SEQ ID NO: 6952655 - DNA, 22 bp, Homo sapiens
ctgggctgcaggcactaattgg

SEQ ID NO: 6952656 - DNA, 22 bp, Homo sapiens
acaccattcaccatcagtacct

SEQ ID NO: 6952657 - DNA, 22 bp, Homo sapiens
gcccagcactaaaagctttgct

SEQ ID NO: 6952658 - DNA, 22 bp, Homo sapiens
gccaggcatgggcttctgggcg

SEQ ID NO: 6952659 - DNA, 22 bp, Homo sapiens
ggacactaaatggaagtgtctg

SEQ ID NO: 6952660 - DNA, 22 bp, Homo sapiens
gctgagagcacatagaaggggc

SEQ ID NO: 6952661 - DNA, 22 bp, Homo sapiens
taaatcaggaaggaaacttgga

SEQ ID NO: 6952662 - DNA, 22 bp, Homo sapiens
tcactctgggccagcgcaggta

SEQ ID NO: 6952663 - DNA, 22 bp, Homo sapiens
aagtgattatgtccaggagaac

SEQ ID NO: 6952664 - DNA, 22 bp, Homo sapiens
tcctgggcctgtactccatccg

SEQ ID NO: 6952665 - DNA, 22 bp, Homo sapiens
tctgcagaggtaatttacagat

SEQ ID NO: 6952666 - DNA, 20 bp, Homo sapiens
agtttgagaggaagtcagtg

SEQ ID NO: 6952667 - DNA, 22 bp, Homo sapiens
atcctggcgggggaactgccca

SEQ ID NO: 6952668 - DNA, 22 bp, Homo sapiens
ccagtctcagttcacgttggta

SEQ ID NO: 6952669 - DNA, 22 bp, Homo sapiens
tcaggctggaatgcagtggggc

SEQ ID NO: 6952670 - DNA, 22 bp, Homo sapiens
atcattcagtctctgggacagt

SEQ ID NO: 6952671 - DNA, 22 bp, Homo sapiens
gggaccagaggctgtgcacaat

SEQ ID NO: 6952672 - DNA, 22 bp, Homo sapiens
gcgacgctcgggctccgatgcc

SEQ ID NO: 6952673 - DNA, 22 bp, Homo sapiens
atgaatgctatgctctaccagc

SEQ ID NO: 6952674 - DNA, 22 bp, Homo sapiens
aatcacagtttcaagtaatgca

SEQ ID NO: 6952675 - DNA, 20 bp, Homo sapiens
ccctcccagatgcttcccaa

SEQ ID NO: 6952676 - DNA, 22 bp, Homo sapiens
tggcagctgcaggcctcctgag

SEQ ID NO: 6952677 - DNA, 22 bp, Homo sapiens
gcttttgtggctgtcttcattg

SEQ ID NO: 6952678 - DNA, 22 bp, Homo sapiens
tgcagtggaacaatttcaacag

SEQ ID NO: 6952679 - DNA, 22 bp, Homo sapiens
tacatttacagagccttctctg

SEQ ID NO: 6952680 - DNA, 22 bp, Homo sapiens
tggctggacctgggctggaatt

SEQ ID NO: 6952681 - DNA, 21 bp, Homo sapiens
tgaaagaggatgtggtcattc

SEQ ID NO: 6952682 - DNA, 22 bp, Homo sapiens
aaagtgctaggattacaagcgt

SEQ ID NO: 6952683 - DNA, 22 bp, Homo sapiens
cagcatcttgaagggtaaacca

SEQ ID NO: 6952684 - DNA, 22 bp, Homo sapiens
attgtaaatagtgccacaataa

SEQ ID NO: 6952685 - DNA, 22 bp, Homo sapiens
tccttgcagcaggaacccactt

SEQ ID NO: 6952686 - DNA, 22 bp, Homo sapiens
gagctttgagattcttatggta

SEQ ID NO: 6952687 - DNA, 22 bp, Homo sapiens
ggagcgtgcagcatgagctcat

SEQ ID NO: 6952688 - DNA, 22 bp, Homo sapiens
aaacaatgttgctgggtgcggt

SEQ ID NO: 6952689 - DNA, 22 bp, Homo sapiens
atggtcactttttgactgttca

SEQ ID NO: 6952690 - DNA, 22 bp, Homo sapiens
actgtgactgtgtcttctgggc

SEQ ID NO: 6952691 - DNA, 22 bp, Homo sapiens
ggcctgtgagccttagtttata

SEQ ID NO: 6952692 - DNA, 22 bp, Homo sapiens
tcctgccctgaaaagtcagtct

SEQ ID NO: 6952693 - DNA, 22 bp, Homo sapiens
tttctgctcgctctcaatcagg

SEQ ID NO: 6952694 - DNA, 22 bp, Homo sapiens
cgcctttaaattgttttacact

SEQ ID NO: 6952695 - DNA, 22 bp, Homo sapiens
tggcttctttgtgacagctctt

SEQ ID NO: 6952696 - DNA, 22 bp, Homo sapiens
actcttcagtacaataatatct

SEQ ID NO: 6952697 - DNA, 22 bp, Homo sapiens
atactttagagctagattgcct

SEQ ID NO: 6952698 - DNA, 22 bp, Homo sapiens
gaggcagtgtcggtggcaggat

SEQ ID NO: 6952699 - DNA, 22 bp, Homo sapiens
acactgtgtttacatagagaat

SEQ ID NO: 6952700 - DNA, 22 bp, Homo sapiens
ttgagaaataagcatgtctaga

SEQ ID NO: 6952701 - DNA, 22 bp, Homo sapiens
ttcaggacaaagggtaacaact

SEQ ID NO: 6952702 - DNA, 22 bp, Homo sapiens
ggtcatacaggtatctggtact

SEQ ID NO: 6952703 - DNA, 22 bp, Homo sapiens
acagtggatgacatccttttgc

SEQ ID NO: 6952704 - DNA, 22 bp, Homo sapiens
gtgaaacaccctccaatgcaca

SEQ ID NO: 6952705 - DNA, 21 bp, Homo sapiens
attaacttgttaacctaaagt

SEQ ID NO: 6952706 - DNA, 22 bp, Homo sapiens
gtcagcttccctttggtttatt

SEQ ID NO: 6952707 - DNA, 22 bp, Homo sapiens
gaaatgatgtctgtgctgccac

SEQ ID NO: 6952708 - DNA, 22 bp, Homo sapiens
catttacacacagaggtgtgct

SEQ ID NO: 6952709 - DNA, 22 bp, Homo sapiens
aggactaatttcaggggatata

SEQ ID NO: 6952710 - DNA, 22 bp, Homo sapiens
tggggttttaacatgttgccag

SEQ ID NO: 6952711 - DNA, 22 bp, Homo sapiens
taaagtgcctcaggtcctgggt

SEQ ID NO: 6952712 - DNA, 22 bp, Homo sapiens
gggtgtggctgcgtgccaataa

SEQ ID NO: 6952713 - DNA, 22 bp, Homo sapiens
gctcagtgtgttcaagggctca

SEQ ID NO: 6952714 - DNA, 22 bp, Homo sapiens
ggacaggataagagacactgcc

SEQ ID NO: 6952715 - DNA, 22 bp, Homo sapiens
actggtttgtctattgtcattc

SEQ ID NO: 6952716 - DNA, 22 bp, Homo sapiens
gttctttgactccaagaaagta

SEQ ID NO: 6952717 - DNA, 22 bp, Homo sapiens
caggtacattcgtagacccatt

SEQ ID NO: 6952718 - DNA, 22 bp, Homo sapiens
ttgcatttactgcaccgtgagt

SEQ ID NO: 6952719 - DNA, 22 bp, Homo sapiens
tgctatttctctgctgtaaaat

SEQ ID NO: 6952720 - DNA, 22 bp, Homo sapiens
gaggccacagtgtctgggggcc

SEQ ID NO: 6952721 - DNA, 22 bp, Homo sapiens
gaggtctcactatgttgcccag

SEQ ID NO: 6952722 - DNA, 22 bp, Homo sapiens
acagtttggcgtgattgatagt

SEQ ID NO: 6952723 - DNA, 23 bp, Homo sapiens
tgggcttctgagaaagcacctaa

SEQ ID NO: 6952724 - DNA, 22 bp, Homo sapiens
ccatgcccacgttgtggctcag

SEQ ID NO: 6952725 - DNA, 22 bp, Homo sapiens
gataatattagaagatacaaat

SEQ ID NO: 6952726 - DNA, 22 bp, Homo sapiens
acttggctcagataccatgccc

SEQ ID NO: 6952727 - DNA, 22 bp, Homo sapiens
aaaggaggccacatggctagga

SEQ ID NO: 6952728 - DNA, 22 bp, Homo sapiens
cttctgtggatatgttctctct

SEQ ID NO: 6952729 - DNA, 22 bp, Homo sapiens
atgtttctacagcgtccactga

SEQ ID NO: 6952730 - DNA, 22 bp, Homo sapiens
gccagcttggcatgtgaggagt

SEQ ID NO: 6952731 - DNA, 21 bp, Homo sapiens
tcagacttgagctcttctaca

SEQ ID NO: 6952732 - DNA, 22 bp, Homo sapiens
ggtgactaatgtgtcccagttt

SEQ ID NO: 6952733 - DNA, 22 bp, Homo sapiens
agttattgggttaaaattgcat

SEQ ID NO: 6952734 - DNA, 22 bp, Homo sapiens
gagctgcatgcggaaacctgtt

SEQ ID NO: 6952735 - DNA, 19 bp, Homo sapiens
gtcttgtaacacataagtg

SEQ ID NO: 6952736 - DNA, 22 bp, Homo sapiens
taatgactaagcaatcatgaat

SEQ ID NO: 6952737 - DNA, 22 bp, Homo sapiens
aaggcccttcggcttcctcagc

SEQ ID NO: 6952738 - DNA, 22 bp, Homo sapiens
gcagtattcattgtttccctga

SEQ ID NO: 6952739 - DNA, 22 bp, Homo sapiens
gttggagattaaagagtggggt

SEQ ID NO: 6952740 - DNA, 16 bp, Homo sapiens
cccaaggagctccagg

SEQ ID NO: 6952741 - DNA, 22 bp, Homo sapiens
ctgagagtgctctttgatgtca

SEQ ID NO: 6952742 - DNA, 22 bp, Homo sapiens
atggagcaaatggggctgcagg

SEQ ID NO: 6952743 - DNA, 22 bp, Homo sapiens
cctgagagccagtgcctgccca

SEQ ID NO: 6952744 - DNA, 22 bp, Homo sapiens
gccagctcccaagtgagcccct

SEQ ID NO: 6952745 - DNA, 22 bp, Homo sapiens
gtcacccgtttgactatccacc

SEQ ID NO: 6952746 - DNA, 22 bp, Homo sapiens
agctgtggtcttcaagttgcct

SEQ ID NO: 6952747 - DNA, 22 bp, Homo sapiens
attcagaaagggttgcctggtt

SEQ ID NO: 6952748 - DNA, 22 bp, Homo sapiens
tcttgaaggtctatcgccttga

SEQ ID NO: 6952749 - DNA, 22 bp, Homo sapiens
ctggaggctgagttgggtctcc

SEQ ID NO: 6952750 - DNA, 22 bp, Homo sapiens
gtgagagattgattgtagcggc

SEQ ID NO: 6952751 - DNA, 22 bp, Homo sapiens
aatttcagaggtagagattcta

SEQ ID NO: 6952752 - DNA, 22 bp, Homo sapiens
tttcttttgctgagaggggcac

SEQ ID NO: 6952753 - DNA, 22 bp, Homo sapiens
cctggattcaagtgtctattcc

SEQ ID NO: 6952754 - DNA, 17 bp, Homo sapiens
actcctggtctgaaggg

SEQ ID NO: 6952755 - DNA, 22 bp, Homo sapiens
tagccctcatctgctcaaaagg

SEQ ID NO: 6952756 - DNA, 22 bp, Homo sapiens
cctttggctgcatagggaaggg

SEQ ID NO: 6952757 - DNA, 22 bp, Homo sapiens
gcctgggatagaggcaatgcat

SEQ ID NO: 6952758 - DNA, 22 bp, Homo sapiens
tgctgacactattctaaaaagc

SEQ ID NO: 6952759 - DNA, 22 bp, Homo sapiens
ctcatgagactgatgtattaaa

SEQ ID NO: 6952760 - DNA, 22 bp, Homo sapiens
aaattcaatgatcactggctca

SEQ ID NO: 6952761 - DNA, 22 bp, Homo sapiens
ttcagcttggctgtaggtttta

SEQ ID NO: 6952762 - DNA, 22 bp, Homo sapiens
aatttgtgttagtccacgttca

SEQ ID NO: 6952763 - DNA, 20 bp, Homo sapiens
agtgcatggagggagagggc

SEQ ID NO: 6952764 - DNA, 22 bp, Homo sapiens
gtgcatccactagggctctccc

SEQ ID NO: 6952765 - DNA, 21 bp, Homo sapiens
attgttctggaggaaaggatt

SEQ ID NO: 6952766 - DNA, 20 bp, Homo sapiens
ttgcagcagtgaggtgaagg

SEQ ID NO: 6952767 - DNA, 22 bp, Homo sapiens
aggaccatttgctgagtgctgg

SEQ ID NO: 6952768 - DNA, 22 bp, Homo sapiens
ccaggtggataaggtttctgga

SEQ ID NO: 6952769 - DNA, 22 bp, Homo sapiens
tgtgcgtcctgtgcgcacactg

SEQ ID NO: 6952770 - DNA, 22 bp, Homo sapiens
gatgtgtctccgtttcaaggca

SEQ ID NO: 6952771 - DNA, 22 bp, Homo sapiens
aggctgtggtgatgattgggtc

SEQ ID NO: 6952772 - DNA, 22 bp, Homo sapiens
tctgcattattggaaagtcctt

SEQ ID NO: 6952773 - DNA, 22 bp, Homo sapiens
aggccttgggccatagtctcct

SEQ ID NO: 6952774 - DNA, 22 bp, Homo sapiens
atgtttatgcaaacatgtgagt

SEQ ID NO: 6952775 - DNA, 22 bp, Homo sapiens
caaatagactctagaatttatt

SEQ ID NO: 6952776 - DNA, 22 bp, Homo sapiens
ccagctgtcttgagaggaggca

SEQ ID NO: 6952777 - DNA, 22 bp, Homo sapiens
agagtctgatgtcaacagttct

SEQ ID NO: 6952778 - DNA, 22 bp, Homo sapiens
cacatttaggaggtggggaagc

SEQ ID NO: 6952779 - DNA, 22 bp, Homo sapiens
aatttctctctcatgcttcatg

SEQ ID NO: 6952780 - DNA, 22 bp, Homo sapiens
aagtcttacagacaagctgaag

SEQ ID NO: 6952781 - DNA, 22 bp, Homo sapiens
ctcagtgctgaggaaagttgaa

SEQ ID NO: 6952782 - DNA, 22 bp, Homo sapiens
gtagaactaggacttcaggtat

SEQ ID NO: 6952783 - DNA, 22 bp, Homo sapiens
cagcaataatgtctacaaatct

SEQ ID NO: 6952784 - DNA, 22 bp, Homo sapiens
ttggaaggagcctaaaagagac

SEQ ID NO: 6952785 - DNA, 22 bp, Homo sapiens
tccaggcatgttgggaagatga

SEQ ID NO: 6952786 - DNA, 22 bp, Homo sapiens
tcagcagactaggcagattact

SEQ ID NO: 6952787 - DNA, 22 bp, Homo sapiens
ggagatagtccaggtgaaggga

SEQ ID NO: 6952788 - DNA, 22 bp, Homo sapiens
atttaaatgcttaagagggttt

SEQ ID NO: 6952789 - DNA, 22 bp, Homo sapiens
aagctgcagatgtgcctgtgga

SEQ ID NO: 6952790 - DNA, 22 bp, Homo sapiens
acttctggatagagtcagcttt

SEQ ID NO: 6952791 - DNA, 22 bp, Homo sapiens
cctggctgaggggccaaggacc

SEQ ID NO: 6952792 - DNA, 22 bp, Homo sapiens
gcaccattgctgggctagttcc

SEQ ID NO: 6952793 - DNA, 22 bp, Homo sapiens
ctgccagcactgcctcctgagg

SEQ ID NO: 6952794 - DNA, 22 bp, Homo sapiens
atagtagaaggcatatttggaa

SEQ ID NO: 6952795 - DNA, 22 bp, Homo sapiens
cagggtgcagagctagggtagt

SEQ ID NO: 6952796 - DNA, 22 bp, Homo sapiens
atgcatattcttagcccctcct

SEQ ID NO: 6952797 - DNA, 22 bp, Homo sapiens
gagaatgttaatgttgaagtat

SEQ ID NO: 6952798 - DNA, 22 bp, Homo sapiens
ggagtcagaacccaggcttcta

SEQ ID NO: 6952799 - DNA, 22 bp, Homo sapiens
ttggccagaggtttctctcatg

SEQ ID NO: 6952800 - DNA, 22 bp, Homo sapiens
ttgatatctctgctgtgttagg

SEQ ID NO: 6952801 - DNA, 22 bp, Homo sapiens
ccctgagcaacaaactgaatac

SEQ ID NO: 6952802 - DNA, 22 bp, Homo sapiens
ctccttcccttcaagtgttcct

SEQ ID NO: 6952803 - DNA, 22 bp, Homo sapiens
atgcacataggccaaatcattt

SEQ ID NO: 6952804 - DNA, 22 bp, Homo sapiens
tcaaagagctattcagttgtgg

SEQ ID NO: 6952805 - DNA, 22 bp, Homo sapiens
tacaactgtcagatgttttgag

SEQ ID NO: 6952806 - DNA, 22 bp, Homo sapiens
cacaagtgaaccatgtgtcctt

SEQ ID NO: 6952807 - DNA, 22 bp, Homo sapiens
cccaggaaggtggtctgtggct

SEQ ID NO: 6952808 - DNA, 22 bp, Homo sapiens
cctgtgatggtgttacactgtt

SEQ ID NO: 6952809 - DNA, 19 bp, Homo sapiens
attcattggccagggtggt

SEQ ID NO: 6952810 - DNA, 22 bp, Homo sapiens
cctgttgtcatggaataagtta

SEQ ID NO: 6952811 - DNA, 20 bp, Homo sapiens
gaatgtttcacttgctccat

SEQ ID NO: 6952812 - DNA, 22 bp, Homo sapiens
agtctggttgattcctttgcac

SEQ ID NO: 6952813 - DNA, 17 bp, Homo sapiens
agttggcagccgttgct

SEQ ID NO: 6952814 - DNA, 22 bp, Homo sapiens
agttcaaagctgcagtaatgga

SEQ ID NO: 6952815 - DNA, 22 bp, Homo sapiens
gtgtaaagatgccaggaatctt

SEQ ID NO: 6952816 - DNA, 22 bp, Homo sapiens
agaagctataacaacaattata

SEQ ID NO: 6952817 - DNA, 22 bp, Homo sapiens
tccggtgctgaaggcccaggtg

SEQ ID NO: 6952818 - DNA, 22 bp, Homo sapiens
ggttggtgcccaggccatactg

SEQ ID NO: 6952819 - DNA, 19 bp, Homo sapiens
cctgtgctaggagctgacc

SEQ ID NO: 6952820 - DNA, 20 bp, Homo sapiens
aagtttctggtttatatctt

SEQ ID NO: 6952821 - DNA, 22 bp, Homo sapiens
agcaacatttttcaattaacat

SEQ ID NO: 6952822 - DNA, 22 bp, Homo sapiens
tgtctacacaaatcaaagcttc

SEQ ID NO: 6952823 - DNA, 22 bp, Homo sapiens
gaagttagtgtggatgcaggga

SEQ ID NO: 6952824 - DNA, 22 bp, Homo sapiens
tgctaagctcacatggctctag

SEQ ID NO: 6952825 - DNA, 22 bp, Homo sapiens
ggaggtgctgatcccagtcaac

SEQ ID NO: 6952826 - DNA, 22 bp, Homo sapiens
tgctgaagttcttcccctaatg

SEQ ID NO: 6952827 - DNA, 22 bp, Homo sapiens
aattcagttgacagctaatgcc

SEQ ID NO: 6952828 - DNA, 22 bp, Homo sapiens
tctgtgggttttgcagagttgc

SEQ ID NO: 6952829 - DNA, 22 bp, Homo sapiens
cacttagatactagatcacaaa

SEQ ID NO: 6952830 - DNA, 22 bp, Homo sapiens
ccatctgactgccacccaggcc

SEQ ID NO: 6952831 - DNA, 22 bp, Homo sapiens
atatgtccacctgtatgctaaa

SEQ ID NO: 6952832 - DNA, 22 bp, Homo sapiens
gcactgaaattatatgcatttg

SEQ ID NO: 6952833 - DNA, 22 bp, Homo sapiens
agaagagaactgccaaacactt

SEQ ID NO: 6952834 - DNA, 19 bp, Homo sapiens
tattcaggatgatggcaca

SEQ ID NO: 6952835 - DNA, 22 bp, Homo sapiens
gtgcagatcctgattgcagttc

SEQ ID NO: 6952836 - DNA, 22 bp, Homo sapiens
ttctgggaggctggctgtcata

SEQ ID NO: 6952837 - DNA, 22 bp, Homo sapiens
tgtaaatagttagcttgcctct

SEQ ID NO: 6952838 - DNA, 22 bp, Homo sapiens
ggagctctgtgtctctcctgcc

SEQ ID NO: 6952839 - DNA, 22 bp, Homo sapiens
catctagaaaaaagacctgttg

SEQ ID NO: 6952840 - DNA, 22 bp, Homo sapiens
cttgccaaattaacatacagaa

SEQ ID NO: 6952841 - DNA, 22 bp, Homo sapiens
gactgcttccctgggattgctc

SEQ ID NO: 6952842 - DNA, 22 bp, Homo sapiens
cagctttgccctttgcccaatc

SEQ ID NO: 6952843 - DNA, 22 bp, Homo sapiens
cagtgtgtgactctgggggtac

SEQ ID NO: 6952844 - DNA, 22 bp, Homo sapiens
ttggaatagggaatcaaagttt

SEQ ID NO: 6952845 - DNA, 22 bp, Homo sapiens
ctgctgcaactctttagagggt

SEQ ID NO: 6952846 - DNA, 22 bp, Homo sapiens
ttcatagatctcaattttgagg

SEQ ID NO: 6952847 - DNA, 22 bp, Homo sapiens
ttcactgttggctttgcttgtc

SEQ ID NO: 6952848 - DNA, 19 bp, Homo sapiens
tgttatgactttgcctttt

SEQ ID NO: 6952849 - DNA, 22 bp, Homo sapiens
caggtggtttgataggataact

SEQ ID NO: 6952850 - DNA, 22 bp, Homo sapiens
atctctgcatccctcaaggttg

SEQ ID NO: 6952851 - DNA, 22 bp, Homo sapiens
aatcttaagctgaattctctcc

SEQ ID NO: 6952852 - DNA, 22 bp, Homo sapiens
caatgcttcaggctccttatag

SEQ ID NO: 6952853 - DNA, 18 bp, Homo sapiens
tggcttctgctagctgga

SEQ ID NO: 6952854 - DNA, 22 bp, Homo sapiens
ctgctgagagctgaaggctgta

SEQ ID NO: 6952855 - DNA, 22 bp, Homo sapiens
cactgagacccgaatacttcca

SEQ ID NO: 6952856 - DNA, 22 bp, Homo sapiens
tgagccaaacttctccttggtc

SEQ ID NO: 6952857 - DNA, 22 bp, Homo sapiens
attaaggagggctgggcatgat

SEQ ID NO: 6952858 - DNA, 23 bp, Homo sapiens
taagagtgaggtcataaattttc

SEQ ID NO: 6952859 - DNA, 22 bp, Homo sapiens
agaagaatacttgatgttcatg

SEQ ID NO: 6952860 - DNA, 22 bp, Homo sapiens
tgtcaggtctctgtgatggtaa

SEQ ID NO: 6952861 - DNA, 21 bp, Homo sapiens
actgcccaccagttaacgctg

SEQ ID NO: 6952862 - DNA, 22 bp, Homo sapiens
ctgctgtgtgaccatggacagg

SEQ ID NO: 6952863 - DNA, 22 bp, Homo sapiens
tccctgtgggcagaggctgcct

SEQ ID NO: 6952864 - DNA, 22 bp, Homo sapiens
tagccaaagaccttttcaaccc

SEQ ID NO: 6952865 - DNA, 22 bp, Homo sapiens
gactttctgagtcaaagaaagg

SEQ ID NO: 6952866 - DNA, 22 bp, Homo sapiens
ttaaggaacaattctacacacc

SEQ ID NO: 6952867 - DNA, 22 bp, Homo sapiens
gtaacacttggctgcaacctgg

SEQ ID NO: 6952868 - DNA, 22 bp, Homo sapiens
accaggaatattttgctcattt

SEQ ID NO: 6952869 - DNA, 22 bp, Homo sapiens
cacaagggagcttagaaaacat

SEQ ID NO: 6952870 - DNA, 20 bp, Homo sapiens
ggctctgccccaccccgtcc

SEQ ID NO: 6952871 - DNA, 22 bp, Homo sapiens
gtgcatgaacaggagcctaagc

SEQ ID NO: 6952872 - DNA, 21 bp, Homo sapiens
tctccccattcttattcccat

SEQ ID NO: 6952873 - DNA, 22 bp, Homo sapiens
ggatatgacgagtttggtgatt

SEQ ID NO: 6952874 - DNA, 22 bp, Homo sapiens
aatcccttcccttctctgggac

SEQ ID NO: 6952875 - DNA, 22 bp, Homo sapiens
ctatattggtggccatttggaa

SEQ ID NO: 6952876 - DNA, 22 bp, Homo sapiens
tcctgcagctgataaatacagt

SEQ ID NO: 6952877 - DNA, 21 bp, Homo sapiens
tcagttgccaaagtgatgtca

SEQ ID NO: 6952878 - DNA, 22 bp, Homo sapiens
ctagtgcaatgatgaatacaag

SEQ ID NO: 6952879 - DNA, 22 bp, Homo sapiens
gcaggatgggtgtagcccagca

SEQ ID NO: 6952880 - DNA, 22 bp, Homo sapiens
agcagcttcctgtttgcaggca

SEQ ID NO: 6952881 - DNA, 22 bp, Homo sapiens
tctgaaggttacttctgctcag

SEQ ID NO: 6952882 - DNA, 22 bp, Homo sapiens
aggcacctcttaggctgctact

SEQ ID NO: 6952883 - DNA, 22 bp, Homo sapiens
atgccctgaaagattcaaaggc

SEQ ID NO: 6952884 - DNA, 22 bp, Homo sapiens
tacatactttttcttgcaagca

SEQ ID NO: 6952885 - DNA, 22 bp, Homo sapiens
tggcttcattctgtagttaaaa

SEQ ID NO: 6952886 - DNA, 22 bp, Homo sapiens
agttatcccaaatgcaaaatgg

SEQ ID NO: 6952887 - DNA, 22 bp, Homo sapiens
tagtagcaggaatctgaaggta

SEQ ID NO: 6952888 - DNA, 22 bp, Homo sapiens
aacatggctcatgagagatttg

SEQ ID NO: 6952889 - DNA, 22 bp, Homo sapiens
agtaatcgtgatcgagagatca

SEQ ID NO: 6952890 - DNA, 22 bp, Homo sapiens
tttgaatatgtgcttgttaaat

SEQ ID NO: 6952891 - DNA, 22 bp, Homo sapiens
ggcaatgagcttgacctcctgg

SEQ ID NO: 6952892 - DNA, 22 bp, Homo sapiens
gtgcttgggggaagtaacagac

SEQ ID NO: 6952893 - DNA, 22 bp, Homo sapiens
caagtaaagaatcacatttctt

SEQ ID NO: 6952894 - DNA, 22 bp, Homo sapiens
cctctgactccagaaactccag

SEQ ID NO: 6952895 - DNA, 22 bp, Homo sapiens
atgttacaatccaacaaaatta

SEQ ID NO: 6952896 - DNA, 22 bp, Homo sapiens
tgtctgaaaggctttttctcac

SEQ ID NO: 6952897 - DNA, 23 bp, Homo sapiens
taattagatgttgattcctgaga

SEQ ID NO: 6952898 - DNA, 22 bp, Homo sapiens
acaacttttctatcatgtggaa

SEQ ID NO: 6952899 - DNA, 22 bp, Homo sapiens
tgaaacataaagttatcttcag

SEQ ID NO: 6952900 - DNA, 22 bp, Homo sapiens
gagcccaggcagaggttgcagt

SEQ ID NO: 6952901 - DNA, 22 bp, Homo sapiens
caggagaggaggctacttctta

SEQ ID NO: 6952902 - DNA, 22 bp, Homo sapiens
ggccattattttttatcagtgt

SEQ ID NO: 6952903 - DNA, 22 bp, Homo sapiens
aagaatgttcaacgcttttttg

SEQ ID NO: 6952904 - DNA, 22 bp, Homo sapiens
cattcagtcatgctggttttga

SEQ ID NO: 6952905 - DNA, 22 bp, Homo sapiens
caggccttttttcctgcagtgt

SEQ ID NO: 6952906 - DNA, 22 bp, Homo sapiens
tcagtttcattatccataaaat

SEQ ID NO: 6952907 - DNA, 22 bp, Homo sapiens
cgtgtcatctgagccttgggcg

SEQ ID NO: 6952908 - DNA, 22 bp, Homo sapiens
cccagctgcacctctatggcct

SEQ ID NO: 6952909 - DNA, 22 bp, Homo sapiens
gcatcctctgagagctctagat

SEQ ID NO: 6952910 - DNA, 22 bp, Homo sapiens
ctcatgtgtctggtaggagctt

SEQ ID NO: 6952911 - DNA, 22 bp, Homo sapiens
gctcctctattccccacatttt

SEQ ID NO: 6952912 - DNA, 22 bp, Homo sapiens
aagacagagggaagcaatgatg

SEQ ID NO: 6952913 - DNA, 22 bp, Homo sapiens
aaacccatctgtctgtctgcag

SEQ ID NO: 6952914 - DNA, 22 bp, Homo sapiens
aatgaagtgttatttagtttca

SEQ ID NO: 6952915 - DNA, 22 bp, Homo sapiens
tggatttccccctgcattgtcc

SEQ ID NO: 6952916 - DNA, 22 bp, Homo sapiens
tttccaaagctgagttgagcaa

SEQ ID NO: 6952917 - DNA, 22 bp, Homo sapiens
tcttgaagcagctctgctcaaa

SEQ ID NO: 6952918 - DNA, 22 bp, Homo sapiens
agcttactcttcaagaacaagc

SEQ ID NO: 6952919 - DNA, 22 bp, Homo sapiens
tgccagggccatagggagtcta

SEQ ID NO: 6952920 - DNA, 22 bp, Homo sapiens
tccacagtggtggaattgttca

SEQ ID NO: 6952921 - DNA, 22 bp, Homo sapiens
gatgatggtggacagctggtta

SEQ ID NO: 6952922 - DNA, 21 bp, Homo sapiens
acagattagcacaatgcaggc

SEQ ID NO: 6952923 - DNA, 22 bp, Homo sapiens
gtccagaaagggcagtgatttg

SEQ ID NO: 6952924 - DNA, 22 bp, Homo sapiens
tgtacattttctcagagtttat

SEQ ID NO: 6952925 - DNA, 22 bp, Homo sapiens
agttggcaaaggtaggtattct

SEQ ID NO: 6952926 - DNA, 22 bp, Homo sapiens
atttgaccaggaaaggaggatg

SEQ ID NO: 6952927 - DNA, 22 bp, Homo sapiens
ttctcttgtgccaagttgttgc

SEQ ID NO: 6952928 - DNA, 22 bp, Homo sapiens
actgtgggaaccactgaatcag

SEQ ID NO: 6952929 - DNA, 22 bp, Homo sapiens
cagatacagctagctccgtggc

SEQ ID NO: 6952930 - DNA, 22 bp, Homo sapiens
cgaggaaaggcgatggctctcg

SEQ ID NO: 6952931 - DNA, 17 bp, Homo sapiens
acctggagaccaagtcc

SEQ ID NO: 6952932 - DNA, 22 bp, Homo sapiens
cttgtgttgtacattctatggg

SEQ ID NO: 6952933 - DNA, 22 bp, Homo sapiens
gggagagcgcgctagggccgag

SEQ ID NO: 6952934 - DNA, 22 bp, Homo sapiens
aaaatggcttaataggcaataa

SEQ ID NO: 6952935 - DNA, 22 bp, Homo sapiens
aatcacagccagcttccgctat

SEQ ID NO: 6952936 - DNA, 20 bp, Homo sapiens
taggtgagggcagatagagg

SEQ ID NO: 6952937 - DNA, 22 bp, Homo sapiens
agcctgtggaaactgggtgcag

SEQ ID NO: 6952938 - DNA, 22 bp, Homo sapiens
agccctgttaactgttttgaag

SEQ ID NO: 6952939 - DNA, 22 bp, Homo sapiens
atgattcagcaattttatatct

SEQ ID NO: 6952940 - DNA, 22 bp, Homo sapiens
acatgacagtgactttataaga

SEQ ID NO: 6952941 - DNA, 22 bp, Homo sapiens
tggttgtgctgagtttagtgca

SEQ ID NO: 6952942 - DNA, 22 bp, Homo sapiens
atctacataaaacgaatacata

SEQ ID NO: 6952943 - DNA, 22 bp, Homo sapiens
tacagcgaaaatttagcttgat

SEQ ID NO: 6952944 - DNA, 22 bp, Homo sapiens
tcccccactctaaaggagcctt

SEQ ID NO: 6952945 - DNA, 22 bp, Homo sapiens
tgactgccatgagggtgagggc

SEQ ID NO: 6952946 - DNA, 22 bp, Homo sapiens
ctgagggcagtgatgaaggtga

SEQ ID NO: 6952947 - DNA, 22 bp, Homo sapiens
gccaggtcccctcatggctcct

SEQ ID NO: 6952948 - DNA, 22 bp, Homo sapiens
ggcgccctggtgccgcaccgcg

SEQ ID NO: 6952949 - DNA, 22 bp, Homo sapiens
tccaggcagcccttcctgactc

SEQ ID NO: 6952950 - DNA, 22 bp, Homo sapiens
ttctgagaagtaaaatggcgtt

SEQ ID NO: 6952951 - DNA, 22 bp, Homo sapiens
attctactttgtgtaattatct

SEQ ID NO: 6952952 - DNA, 22 bp, Homo sapiens
aaggccacagagcctcagagag

SEQ ID NO: 6952953 - DNA, 22 bp, Homo sapiens
tctggcacactaggtctcaggt

SEQ ID NO: 6952954 - DNA, 22 bp, Homo sapiens
agtgttgaagaggggatgttaa

SEQ ID NO: 6952955 - DNA, 18 bp, Homo sapiens
tcaggctgggcctccttc

SEQ ID NO: 6952956 - DNA, 21 bp, Homo sapiens
gcctggctagaagctcctagc

SEQ ID NO: 6952957 - DNA, 22 bp, Homo sapiens
ctgcatccatctcctagcacag

SEQ ID NO: 6952958 - DNA, 22 bp, Homo sapiens
accacatttctgaatagcataa

SEQ ID NO: 6952959 - DNA, 21 bp, Homo sapiens
ctcacagtctgttttccttgc

SEQ ID NO: 6952960 - DNA, 21 bp, Homo sapiens
tgctggaggacagggtttcat

SEQ ID NO: 6952961 - DNA, 22 bp, Homo sapiens
gggctctgtttagatcagagat

SEQ ID NO: 6952962 - DNA, 22 bp, Homo sapiens
cacattgcagcttcttttggct

SEQ ID NO: 6952963 - DNA, 22 bp, Homo sapiens
cagaataatattggtctcatag

SEQ ID NO: 6952964 - DNA, 18 bp, Homo sapiens
ctggtctcccttcgcttt

SEQ ID NO: 6952965 - DNA, 22 bp, Homo sapiens
tgcagcaaggggccctgatagg

SEQ ID NO: 6952966 - DNA, 22 bp, Homo sapiens
agggtcagttctgtgaggtgtt

SEQ ID NO: 6952967 - DNA, 17 bp, Homo sapiens
ggcagctgtgtgcatgc

SEQ ID NO: 6952968 - DNA, 22 bp, Homo sapiens
gagcactctggcatgtaacctt

SEQ ID NO: 6952969 - DNA, 22 bp, Homo sapiens
aaactctactgaggaaataaga

SEQ ID NO: 6952970 - DNA, 21 bp, Homo sapiens
atgccaagtcttaatgagggc

SEQ ID NO: 6952971 - DNA, 22 bp, Homo sapiens
gtacagggcccctcagcagggc

SEQ ID NO: 6952972 - DNA, 22 bp, Homo sapiens
cgcaggctttagaatctgctac

SEQ ID NO: 6952973 - DNA, 18 bp, Homo sapiens
agtaggcactgtggggtt

SEQ ID NO: 6952974 - DNA, 22 bp, Homo sapiens
tcagcactgtcttttatttgaa

SEQ ID NO: 6952975 - DNA, 22 bp, Homo sapiens
gagctgctggaagtggagccct

SEQ ID NO: 6952976 - DNA, 22 bp, Homo sapiens
atgcctgagactgttaattggc

SEQ ID NO: 6952977 - DNA, 22 bp, Homo sapiens
gtttcataattcaatcaaatga

SEQ ID NO: 6952978 - DNA, 22 bp, Homo sapiens
agccctctaagcaagagaggaa

SEQ ID NO: 6952979 - DNA, 22 bp, Homo sapiens
aactaaaccatgacattatatt

SEQ ID NO: 6952980 - DNA, 22 bp, Homo sapiens
aaccagtactttacacagctct

SEQ ID NO: 6952981 - DNA, 22 bp, Homo sapiens
gttgcctaggctggtcttgaac

SEQ ID NO: 6952982 - DNA, 22 bp, Homo sapiens
gtttcttaggtaaattctttga

SEQ ID NO: 6952983 - DNA, 22 bp, Homo sapiens
ataacattttgacaactggtga

SEQ ID NO: 6952984 - DNA, 22 bp, Homo sapiens
ttcaagtctgcccagagtcagc

SEQ ID NO: 6952985 - DNA, 22 bp, Homo sapiens
gatgctccttggtgatagaata

SEQ ID NO: 6952986 - DNA, 22 bp, Homo sapiens
ctctgcccagtgcccacaggag

SEQ ID NO: 6952987 - DNA, 22 bp, Homo sapiens
tatttatattctgccttctgct

SEQ ID NO: 6952988 - DNA, 22 bp, Homo sapiens
caggctctaggttagtaggaga

SEQ ID NO: 6952989 - DNA, 22 bp, Homo sapiens
agagccaggtgctgctgtttga

SEQ ID NO: 6952990 - DNA, 19 bp, Homo sapiens
ggactgttgccaggcctct

SEQ ID NO: 6952991 - DNA, 22 bp, Homo sapiens
aggtgaagttgaggaggcagaa

SEQ ID NO: 6952992 - DNA, 22 bp, Homo sapiens
caggtaagagacggattggccc

SEQ ID NO: 6952993 - DNA, 22 bp, Homo sapiens
actggaaaggctctgaatggga

SEQ ID NO: 6952994 - DNA, 22 bp, Homo sapiens
atttctcatcaagtgccaactc

SEQ ID NO: 6952995 - DNA, 22 bp, Homo sapiens
ctcaggcacgggtcagtgagcg

SEQ ID NO: 6952996 - DNA, 22 bp, Homo sapiens
cccaggaaagtggaggcggctg

SEQ ID NO: 6952997 - DNA, 22 bp, Homo sapiens
ccaaataatatttcagaaccat

SEQ ID NO: 6952998 - DNA, 22 bp, Homo sapiens
ctttaaataatacaaggtccag

SEQ ID NO: 6952999 - DNA, 22 bp, Homo sapiens
ctagagcagattgcagagtagg

SEQ ID NO: 6953000 - DNA, 22 bp, Homo sapiens
gggttccaatgatgagcaagag

SEQ ID NO: 6953001 - DNA, 22 bp, Homo sapiens
ctggagagaatgtggaatgatt

SEQ ID NO: 6953002 - DNA, 22 bp, Homo sapiens
tggcatggcaaccctgcaggga

SEQ ID NO: 6953003 - DNA, 22 bp, Homo sapiens
catacttttgccctgacattct

SEQ ID NO: 6953004 - DNA, 22 bp, Homo sapiens
ggccctctggtgagtatcacat

SEQ ID NO: 6953005 - DNA, 22 bp, Homo sapiens
atacagaactctcagttgtata

SEQ ID NO: 6953006 - DNA, 22 bp, Homo sapiens
tgctttatcaaagctatagtga

SEQ ID NO: 6953007 - DNA, 22 bp, Homo sapiens
ggatggctccacagtttctccc

SEQ ID NO: 6953008 - DNA, 20 bp, Homo sapiens
tcagatgggagtgagccatc

SEQ ID NO: 6953009 - DNA, 18 bp, Homo sapiens
tttctttctgcctggggc

SEQ ID NO: 6953010 - DNA, 22 bp, Homo sapiens
agaggcactcgggagtctgtgg

SEQ ID NO: 6953011 - DNA, 22 bp, Homo sapiens
taatctagtcccacatggaatt

SEQ ID NO: 6953012 - DNA, 22 bp, Homo sapiens
ttcaatatcattgtttagtctc

SEQ ID NO: 6953013 - DNA, 18 bp, Homo sapiens
tgctgccagatctatttc

SEQ ID NO: 6953014 - DNA, 22 bp, Homo sapiens
gccgttattctgctggccccgg

SEQ ID NO: 6953015 - DNA, 22 bp, Homo sapiens
ggctgcacagcaaagaagcctt

SEQ ID NO: 6953016 - DNA, 22 bp, Homo sapiens
caacagacctggattcaaaaac

SEQ ID NO: 6953017 - DNA, 22 bp, Homo sapiens
atctgcatgtccccatggatcc

SEQ ID NO: 6953018 - DNA, 22 bp, Homo sapiens
tttaggcaagggcaagattatc

SEQ ID NO: 6953019 - DNA, 22 bp, Homo sapiens
caggtacacaggacaaagtact

SEQ ID NO: 6953020 - DNA, 22 bp, Homo sapiens
cacatgcctattaaccaaacga

SEQ ID NO: 6953021 - DNA, 22 bp, Homo sapiens
cattagcatggtagccaggtca

SEQ ID NO: 6953022 - DNA, 22 bp, Homo sapiens
caacctctgtaatgttctagga

SEQ ID NO: 6953023 - DNA, 22 bp, Homo sapiens
tacaagcttttgtgtataaatg

SEQ ID NO: 6953024 - DNA, 22 bp, Homo sapiens
ccctaggggcaatgatggtgct

SEQ ID NO: 6953025 - DNA, 22 bp, Homo sapiens
tccagggaaggtgtgaggctgg

SEQ ID NO: 6953026 - DNA, 22 bp, Homo sapiens
gaacttcttcaacataatggac

SEQ ID NO: 6953027 - DNA, 22 bp, Homo sapiens
tgcccagcccctatccctggga

SEQ ID NO: 6953028 - DNA, 22 bp, Homo sapiens
aggtatagaattgaaagggttt

SEQ ID NO: 6953029 - DNA, 21 bp, Homo sapiens
ttctgagactcatttgaactc

SEQ ID NO: 6953030 - DNA, 22 bp, Homo sapiens
catgctgtcctgaaaagatatt

SEQ ID NO: 6953031 - DNA, 22 bp, Homo sapiens
attaggcactagaatgtcaatt

SEQ ID NO: 6953032 - DNA, 22 bp, Homo sapiens
ctctgccagccaaagtcatcac

SEQ ID NO: 6953033 - DNA, 22 bp, Homo sapiens
gcgagtagatgatgaaagtgag

SEQ ID NO: 6953034 - DNA, 22 bp, Homo sapiens
cagtttcttcatcagttaagca

SEQ ID NO: 6953035 - DNA, 22 bp, Homo sapiens
tggagtccacattcttttacaa

SEQ ID NO: 6953036 - DNA, 22 bp, Homo sapiens
gtttccttttggaattagagct

SEQ ID NO: 6953037 - DNA, 22 bp, Homo sapiens
ggctgcaggttggttggcagct

SEQ ID NO: 6953038 - DNA, 22 bp, Homo sapiens
agtgggtgataagaccaaggag

SEQ ID NO: 6953039 - DNA, 20 bp, Homo sapiens
aatgtatatgtgaccccaaa

SEQ ID NO: 6953040 - DNA, 22 bp, Homo sapiens
ctatgtttatctgtatttctgt

SEQ ID NO: 6953041 - DNA, 20 bp, Homo sapiens
ctcttaattgctcacattag

SEQ ID NO: 6953042 - DNA, 20 bp, Homo sapiens
ttgaaaatgcattgtgcagt

SEQ ID NO: 6953043 - DNA, 22 bp, Homo sapiens
atagtttgggcaaagaggacct

SEQ ID NO: 6953044 - DNA, 23 bp, Homo sapiens
tgttattccaggttaatgtactt

SEQ ID NO: 6953045 - DNA, 22 bp, Homo sapiens
tctgtagcttcttgagaggcca

SEQ ID NO: 6953046 - DNA, 22 bp, Homo sapiens
agctggcagtcggccttgatgc

SEQ ID NO: 6953047 - DNA, 22 bp, Homo sapiens
ataacatgacctgtgcttcaca

SEQ ID NO: 6953048 - DNA, 22 bp, Homo sapiens
ccagccaccgcttgtttgcact

SEQ ID NO: 6953049 - DNA, 22 bp, Homo sapiens
tagtggatgattatcagatcat

SEQ ID NO: 6953050 - DNA, 19 bp, Homo sapiens
agtcttgtatttttcaagc

SEQ ID NO: 6953051 - DNA, 22 bp, Homo sapiens
aatctgtttagttctgcgtatg

SEQ ID NO: 6953052 - DNA, 22 bp, Homo sapiens
tttcagggagcctagaagagct

SEQ ID NO: 6953053 - DNA, 22 bp, Homo sapiens
tggcacagaccttatcttctct

SEQ ID NO: 6953054 - DNA, 22 bp, Homo sapiens
ttcgctttgcccgttgtcattt

SEQ ID NO: 6953055 - DNA, 22 bp, Homo sapiens
aataggcagttggatatgcaag

SEQ ID NO: 6953056 - DNA, 22 bp, Homo sapiens
gaggcctgtagtcatggatgta

SEQ ID NO: 6953057 - DNA, 22 bp, Homo sapiens
tggaaatattgggtaatagttg

SEQ ID NO: 6953058 - DNA, 22 bp, Homo sapiens
tccttccccctcaagagaactt

SEQ ID NO: 6953059 - DNA, 19 bp, Homo sapiens
tacattccacacaatctct

SEQ ID NO: 6953060 - DNA, 22 bp, Homo sapiens
gaccctttcacagctgctgggg

SEQ ID NO: 6953061 - DNA, 21 bp, Homo sapiens
tgacccttgccgagctacatt

SEQ ID NO: 6953062 - DNA, 22 bp, Homo sapiens
attagctttaaagactttgatt

SEQ ID NO: 6953063 - DNA, 22 bp, Homo sapiens
tctgccagaactccattagaaa

SEQ ID NO: 6953064 - DNA, 23 bp, Homo sapiens
gtgcaaagatataccacatggct

SEQ ID NO: 6953065 - DNA, 22 bp, Homo sapiens
gcagctgttcagctggccagat

SEQ ID NO: 6953066 - DNA, 22 bp, Homo sapiens
atgccagaagccaaaaaatatt

SEQ ID NO: 6953067 - DNA, 22 bp, Homo sapiens
tcgtgaggctctgcatcgcaca

SEQ ID NO: 6953068 - DNA, 22 bp, Homo sapiens
ggcttctctccagtatgcattc

SEQ ID NO: 6953069 - DNA, 22 bp, Homo sapiens
aagatgtttagatttatacaat

SEQ ID NO: 6953070 - DNA, 22 bp, Homo sapiens
gtgtttccctggcacaagaacc

SEQ ID NO: 6953071 - DNA, 22 bp, Homo sapiens
ggccaggagcagaatcgcctgc

SEQ ID NO: 6953072 - DNA, 22 bp, Homo sapiens
ccactttctgagggaacagcag

SEQ ID NO: 6953073 - DNA, 22 bp, Homo sapiens
agggtcaaaggaaaggcccaca

SEQ ID NO: 6953074 - DNA, 22 bp, Homo sapiens
ggtacagtggcttgcactagct

SEQ ID NO: 6953075 - DNA, 22 bp, Homo sapiens
gccctgtgtgatctgctgttag

SEQ ID NO: 6953076 - DNA, 17 bp, Homo sapiens
gcagttaaattaagatg

SEQ ID NO: 6953077 - DNA, 22 bp, Homo sapiens
tatttggagcctatccatagat

SEQ ID NO: 6953078 - DNA, 22 bp, Homo sapiens
ataaatgtttgttgaatgaata

SEQ ID NO: 6953079 - DNA, 22 bp, Homo sapiens
tcagagagttacacaaattgtt

SEQ ID NO: 6953080 - DNA, 22 bp, Homo sapiens
tggctctgtgcttctagtatct

SEQ ID NO: 6953081 - DNA, 22 bp, Homo sapiens
cagtatgagagttgaatcaagg

SEQ ID NO: 6953082 - DNA, 22 bp, Homo sapiens
gaaagcttccattttgtacatt

SEQ ID NO: 6953083 - DNA, 22 bp, Homo sapiens
ttaggcaaataaaatgtttcca

SEQ ID NO: 6953084 - DNA, 22 bp, Homo sapiens
ctttactgccatgcatttataa

SEQ ID NO: 6953085 - DNA, 22 bp, Homo sapiens
catcaacagtgtcagatgatgc

SEQ ID NO: 6953086 - DNA, 22 bp, Homo sapiens
taagagaaggatctgttccagg

SEQ ID NO: 6953087 - DNA, 22 bp, Homo sapiens
gaggttctgggggtctgcctgg

SEQ ID NO: 6953088 - DNA, 22 bp, Homo sapiens
agcagcagtatccttccccggc

SEQ ID NO: 6953089 - DNA, 22 bp, Homo sapiens
gaattgatttacgtggctctct

SEQ ID NO: 6953090 - DNA, 22 bp, Homo sapiens
tttgaagtcagatggtctgagt

SEQ ID NO: 6953091 - DNA, 21 bp, Homo sapiens
tggccagctgctcgtctcctc

SEQ ID NO: 6953092 - DNA, 22 bp, Homo sapiens
ttagtgtgttatataccaagct

SEQ ID NO: 6953093 - DNA, 22 bp, Homo sapiens
ctgggagtgttctaggtcacat

SEQ ID NO: 6953094 - DNA, 20 bp, Homo sapiens
cttgattctttgatgaggta

SEQ ID NO: 6953095 - DNA, 22 bp, Homo sapiens
ttgcacgcctgatctgtcctat

SEQ ID NO: 6953096 - DNA, 22 bp, Homo sapiens
tctggctggctcggccgggagt

SEQ ID NO: 6953097 - DNA, 22 bp, Homo sapiens
agacttcttgagctggcacttc

SEQ ID NO: 6953098 - DNA, 21 bp, Homo sapiens
gatctagacttgggcccagta

SEQ ID NO: 6953099 - DNA, 22 bp, Homo sapiens
gcaggagtgtgtctaatactca

SEQ ID NO: 6953100 - DNA, 22 bp, Homo sapiens
tacaggtaaatgcaaacagctc

SEQ ID NO: 6953101 - DNA, 22 bp, Homo sapiens
atctctaaagtctgttcagctc

SEQ ID NO: 6953102 - DNA, 22 bp, Homo sapiens
agccctgggcacctgtgagggg

SEQ ID NO: 6953103 - DNA, 22 bp, Homo sapiens
tcacagtgagaaatttgttggc

SEQ ID NO: 6953104 - DNA, 22 bp, Homo sapiens
tacacaattagttgcaaagtga

SEQ ID NO: 6953105 - DNA, 22 bp, Homo sapiens
gtcacagtgcctgaagctctga

SEQ ID NO: 6953106 - DNA, 22 bp, Homo sapiens
tggcctggggacctgtgagacc

SEQ ID NO: 6953107 - DNA, 22 bp, Homo sapiens
gacctgaaagtgtgggcgacct

SEQ ID NO: 6953108 - DNA, 22 bp, Homo sapiens
tctaggaaagcctttcacaact

SEQ ID NO: 6953109 - DNA, 22 bp, Homo sapiens
tttgactcaagccctcatgtta

SEQ ID NO: 6953110 - DNA, 20 bp, Homo sapiens
ttcatttgttgagcaccttc

SEQ ID NO: 6953111 - DNA, 22 bp, Homo sapiens
acctgccagctgagaagggtgt

SEQ ID NO: 6953112 - DNA, 22 bp, Homo sapiens
tctcagagcttcagaaagcacc

SEQ ID NO: 6953113 - DNA, 22 bp, Homo sapiens
cagacatctgtacccagcctgt

SEQ ID NO: 6953114 - DNA, 22 bp, Homo sapiens
ggggatggattccgggtccctg

SEQ ID NO: 6953115 - DNA, 22 bp, Homo sapiens
aatggcaaaaggagttagttga

SEQ ID NO: 6953116 - DNA, 22 bp, Homo sapiens
aggtgagtgtggctccacttcc

SEQ ID NO: 6953117 - DNA, 22 bp, Homo sapiens
aataatgttatgtcattcttct

SEQ ID NO: 6953118 - DNA, 22 bp, Homo sapiens
gctccagggtcagctcagaact

SEQ ID NO: 6953119 - DNA, 22 bp, Homo sapiens
gtttctgagagccacacacagc

SEQ ID NO: 6953120 - DNA, 22 bp, Homo sapiens
ctaatcttgcctcatcaagtct

SEQ ID NO: 6953121 - DNA, 22 bp, Homo sapiens
acagtgtgggacattaggaaat

SEQ ID NO: 6953122 - DNA, 22 bp, Homo sapiens
tgcccctcagggaacgggtatc

SEQ ID NO: 6953123 - DNA, 20 bp, Homo sapiens
tgggatcgaatcaagtctgt

SEQ ID NO: 6953124 - DNA, 22 bp, Homo sapiens
ttgttgggcatgcagtggctgt

SEQ ID NO: 6953125 - DNA, 22 bp, Homo sapiens
gagcccaggatggtgtatggct

SEQ ID NO: 6953126 - DNA, 22 bp, Homo sapiens
agccttgaaccaattgtttagc

SEQ ID NO: 6953127 - DNA, 22 bp, Homo sapiens
agactggggttctggcaaggag

SEQ ID NO: 6953128 - DNA, 22 bp, Homo sapiens
acaaaagtgagtgtgtctcaga

SEQ ID NO: 6953129 - DNA, 22 bp, Homo sapiens
gaactagaatgttctgatggag

SEQ ID NO: 6953130 - DNA, 22 bp, Homo sapiens
tagccaggctggaagcaaaagg

SEQ ID NO: 6953131 - DNA, 22 bp, Homo sapiens
gaccctgtttctacaaataatt

SEQ ID NO: 6953132 - DNA, 22 bp, Homo sapiens
cttagcagtcactgttctaagt

SEQ ID NO: 6953133 - DNA, 21 bp, Homo sapiens
gggcacccttagcctcctctg

SEQ ID NO: 6953134 - DNA, 22 bp, Homo sapiens
ttcctggccaagcagagtggaa

SEQ ID NO: 6953135 - DNA, 22 bp, Homo sapiens
ggaaccttacctaccagtggag

SEQ ID NO: 6953136 - DNA, 22 bp, Homo sapiens
aaacagctccttagtttccatc

SEQ ID NO: 6953137 - DNA, 17 bp, Homo sapiens
gcatccagtaacatgcc

SEQ ID NO: 6953138 - DNA, 22 bp, Homo sapiens
atgtgttttggtggatcattca

SEQ ID NO: 6953139 - DNA, 22 bp, Homo sapiens
agtagaaatgtaagaaggatta

SEQ ID NO: 6953140 - DNA, 22 bp, Homo sapiens
ggccctgtgatggatgtattag

SEQ ID NO: 6953141 - DNA, 22 bp, Homo sapiens
aatcctggaatgagtttgctga

SEQ ID NO: 6953142 - DNA, 22 bp, Homo sapiens
cacagtgctttatgagagatct

SEQ ID NO: 6953143 - DNA, 22 bp, Homo sapiens
taaatgagatgtacataactca

SEQ ID NO: 6953144 - DNA, 22 bp, Homo sapiens
tagttttataatgttaacatct

SEQ ID NO: 6953145 - DNA, 22 bp, Homo sapiens
taggcagcttaggttagaagtg

SEQ ID NO: 6953146 - DNA, 22 bp, Homo sapiens
ccctgtgcctcagtttcctcat

SEQ ID NO: 6953147 - DNA, 22 bp, Homo sapiens
acttacaagctagggaagcttg

SEQ ID NO: 6953148 - DNA, 22 bp, Homo sapiens
tggctagtccgttagaggcgtg

SEQ ID NO: 6953149 - DNA, 22 bp, Homo sapiens
gcttcccaatgtgctagtttct

SEQ ID NO: 6953150 - DNA, 22 bp, Homo sapiens
aagcctgtgtttctgctagtct

SEQ ID NO: 6953151 - DNA, 22 bp, Homo sapiens
ttatttcatataatgttatcaa

SEQ ID NO: 6953152 - DNA, 22 bp, Homo sapiens
ggtccagtgggttcctccaata

SEQ ID NO: 6953153 - DNA, 22 bp, Homo sapiens
tcctctgctcagcattcctcac

SEQ ID NO: 6953154 - DNA, 22 bp, Homo sapiens
tctcccaggctgccctgtggac

SEQ ID NO: 6953155 - DNA, 23 bp, Homo sapiens
attgactctaagagattcttgaa

SEQ ID NO: 6953156 - DNA, 22 bp, Homo sapiens
agagccaggactgtgtctcact

SEQ ID NO: 6953157 - DNA, 23 bp, Homo sapiens
tgctcagtctaaagaagaataac

SEQ ID NO: 6953158 - DNA, 22 bp, Homo sapiens
caattcaagttgagtacagctt

SEQ ID NO: 6953159 - DNA, 22 bp, Homo sapiens
tgaggctttatgtaagggtgca

SEQ ID NO: 6953160 - DNA, 22 bp, Homo sapiens
aatgatgtgagtttttattctc

SEQ ID NO: 6953161 - DNA, 18 bp, Homo sapiens
gcctccaccatggagggt

SEQ ID NO: 6953162 - DNA, 22 bp, Homo sapiens
accctgggaactggaaactgga

SEQ ID NO: 6953163 - DNA, 21 bp, Homo sapiens
cattacaagatttccaatttg

SEQ ID NO: 6953164 - DNA, 22 bp, Homo sapiens
caggaagtagagttggccagcc

SEQ ID NO: 6953165 - DNA, 22 bp, Homo sapiens
atataccctgttcgagtcccag

SEQ ID NO: 6953166 - DNA, 19 bp, Homo sapiens
ttaagctaagatactagta

SEQ ID NO: 6953167 - DNA, 22 bp, Homo sapiens
cattcatttgcccagtaagtca

SEQ ID NO: 6953168 - DNA, 22 bp, Homo sapiens
cagtgtgcctgaatcaagtgtt

SEQ ID NO: 6953169 - DNA, 22 bp, Homo sapiens
ctggccagcatggctgaagtac

SEQ ID NO: 6953170 - DNA, 22 bp, Homo sapiens
ggcagggcttgtctctgtgatg

SEQ ID NO: 6953171 - DNA, 22 bp, Homo sapiens
tctctcagaaagcccatgtctg

SEQ ID NO: 6953172 - DNA, 22 bp, Homo sapiens
gctgctttgaaagaggagcttt

SEQ ID NO: 6953173 - DNA, 22 bp, Homo sapiens
aagtgtgtctggcggcccagtg

SEQ ID NO: 6953174 - DNA, 22 bp, Homo sapiens
ttgtaaagatgcttcccattct

SEQ ID NO: 6953175 - DNA, 22 bp, Homo sapiens
agttctttgcatagatttggct

SEQ ID NO: 6953176 - DNA, 22 bp, Homo sapiens
gttcttcagtcacatcacagaa

SEQ ID NO: 6953177 - DNA, 22 bp, Homo sapiens
gcttgggaaacgtagttcctag

SEQ ID NO: 6953178 - DNA, 22 bp, Homo sapiens
attagcttctgtgcatggactt

SEQ ID NO: 6953179 - DNA, 22 bp, Homo sapiens
ccacatctgcatttaatgtata

SEQ ID NO: 6953180 - DNA, 22 bp, Homo sapiens
catgaggtgataaagctgggat

SEQ ID NO: 6953181 - DNA, 17 bp, Homo sapiens
atgctccattcagaagc

SEQ ID NO: 6953182 - DNA, 22 bp, Homo sapiens
gttgaataattcatagaagcta

SEQ ID NO: 6953183 - DNA, 22 bp, Homo sapiens
tgtgtttgttagactaatgtta

SEQ ID NO: 6953184 - DNA, 22 bp, Homo sapiens
ccagtgttagagactgatacag

SEQ ID NO: 6953185 - DNA, 22 bp, Homo sapiens
ccagagccggctccctcagctt

SEQ ID NO: 6953186 - DNA, 22 bp, Homo sapiens
ttggaatttagggaatattcat

SEQ ID NO: 6953187 - DNA, 22 bp, Homo sapiens
gagatcctgtaggcagctaaga

SEQ ID NO: 6953188 - DNA, 22 bp, Homo sapiens
ccagtcccaggcagaaatccag

SEQ ID NO: 6953189 - DNA, 22 bp, Homo sapiens
aatggcagaatgggccagaagc

SEQ ID NO: 6953190 - DNA, 22 bp, Homo sapiens
agctctggtttagaaggggaaa

SEQ ID NO: 6953191 - DNA, 20 bp, Homo sapiens
ggaagctgtgggtccccagg

SEQ ID NO: 6953192 - DNA, 22 bp, Homo sapiens
aagggaggccagaggttttgca

SEQ ID NO: 6953193 - DNA, 22 bp, Homo sapiens
gaggcatggcctgaggctagga

SEQ ID NO: 6953194 - DNA, 22 bp, Homo sapiens
aaagcagagatcatggcttgta

SEQ ID NO: 6953195 - DNA, 22 bp, Homo sapiens
ccacaattccacagcaacttgc

SEQ ID NO: 6953196 - DNA, 22 bp, Homo sapiens
tccagctggcctaacttcaggg

SEQ ID NO: 6953197 - DNA, 22 bp, Homo sapiens
ttcaacaggaaagcactttaca

SEQ ID NO: 6953198 - DNA, 22 bp, Homo sapiens
cagagctgcacattctatgatg

SEQ ID NO: 6953199 - DNA, 23 bp, Homo sapiens
agcacacttgtacaatgccctag

SEQ ID NO: 6953200 - DNA, 22 bp, Homo sapiens
gctttactgagatgacacaggg

SEQ ID NO: 6953201 - DNA, 22 bp, Homo sapiens
gacatctccaaggcaacctgtt

SEQ ID NO: 6953202 - DNA, 22 bp, Homo sapiens
ttgcaaaaccatcctaagtaaa

SEQ ID NO: 6953203 - DNA, 22 bp, Homo sapiens
tgtggccaggcccctgatggtg

SEQ ID NO: 6953204 - DNA, 22 bp, Homo sapiens
aatgtgtgaacttcagagcatc

SEQ ID NO: 6953205 - DNA, 22 bp, Homo sapiens
cagctacaggacgggcatctgc

SEQ ID NO: 6953206 - DNA, 22 bp, Homo sapiens
acatgtaaaaattaaggtaaga

SEQ ID NO: 6953207 - DNA, 22 bp, Homo sapiens
ttcataggatcaaaagctgttt

SEQ ID NO: 6953208 - DNA, 22 bp, Homo sapiens
ttgcctttaacccctgaaaggc

SEQ ID NO: 6953209 - DNA, 22 bp, Homo sapiens
tgggggaaattcagccagatat

SEQ ID NO: 6953210 - DNA, 22 bp, Homo sapiens
caggcccacgaggcacacagag

SEQ ID NO: 6953211 - DNA, 22 bp, Homo sapiens
ccctgcagatcagtgagaactt

SEQ ID NO: 6953212 - DNA, 20 bp, Homo sapiens
tgcatagttgctgcagttga

SEQ ID NO: 6953213 - DNA, 22 bp, Homo sapiens
tggctcagagccttgagagctg

SEQ ID NO: 6953214 - DNA, 22 bp, Homo sapiens
ctttttatctcttaatgatgtt

SEQ ID NO: 6953215 - DNA, 22 bp, Homo sapiens
gcagactgcgagcgtgctggtg

SEQ ID NO: 6953216 - DNA, 22 bp, Homo sapiens
acaggcttggcagctatcattt

SEQ ID NO: 6953217 - DNA, 22 bp, Homo sapiens
ttagaaaatttgcttctttgga

SEQ ID NO: 6953218 - DNA, 22 bp, Homo sapiens
tagcaccaggaaggtttaggat

SEQ ID NO: 6953219 - DNA, 22 bp, Homo sapiens
acttccgattttcagcacacat

SEQ ID NO: 6953220 - DNA, 19 bp, Homo sapiens
ccaggagcagtggtgagct

SEQ ID NO: 6953221 - DNA, 22 bp, Homo sapiens
ttctgtcacttaggaggtcata

SEQ ID NO: 6953222 - DNA, 18 bp, Homo sapiens
tcttgcctgcaccctctc

SEQ ID NO: 6953223 - DNA, 22 bp, Homo sapiens
acttattagacatcttcattgt

SEQ ID NO: 6953224 - DNA, 22 bp, Homo sapiens
ttctgtctctgtgtttacatta

SEQ ID NO: 6953225 - DNA, 22 bp, Homo sapiens
tcaccagtctttcttaccattg

SEQ ID NO: 6953226 - DNA, 22 bp, Homo sapiens
gaaaggagagggttaaggagct

SEQ ID NO: 6953227 - DNA, 22 bp, Homo sapiens
cttctttcttttgatcacaggt

SEQ ID NO: 6953228 - DNA, 22 bp, Homo sapiens
attacagaaatatggtcaaaga

SEQ ID NO: 6953229 - DNA, 22 bp, Homo sapiens
caggcttcatgaattatgcacc

SEQ ID NO: 6953230 - DNA, 22 bp, Homo sapiens
tgacagttgagcatgtaagaga

SEQ ID NO: 6953231 - DNA, 22 bp, Homo sapiens
tgtcacataggcaaaatgtttt

SEQ ID NO: 6953232 - DNA, 22 bp, Homo sapiens
tatattgaccagtacaattggt

SEQ ID NO: 6953233 - DNA, 22 bp, Homo sapiens
tctgcagaactttatgagcaaa

SEQ ID NO: 6953234 - DNA, 22 bp, Homo sapiens
agccagctgtgtggtcaggcaa

SEQ ID NO: 6953235 - DNA, 22 bp, Homo sapiens
gcctcagtgtcctcctccatgt

SEQ ID NO: 6953236 - DNA, 20 bp, Homo sapiens
cctcaggccagttttaaagt

SEQ ID NO: 6953237 - DNA, 22 bp, Homo sapiens
agtacttcagaggctgcccagg

SEQ ID NO: 6953238 - DNA, 22 bp, Homo sapiens
gcagtgacatacctggagggca

SEQ ID NO: 6953239 - DNA, 22 bp, Homo sapiens
aatttgttagcatactctagtt

SEQ ID NO: 6953240 - DNA, 22 bp, Homo sapiens
agatgacaggtttttttggctt

SEQ ID NO: 6953241 - DNA, 22 bp, Homo sapiens
gagcttggtgatgcctcctggt

SEQ ID NO: 6953242 - DNA, 22 bp, Homo sapiens
aattgttgggccctaccccaga

SEQ ID NO: 6953243 - DNA, 22 bp, Homo sapiens
cctggaaagaggaaggaagcct

SEQ ID NO: 6953244 - DNA, 22 bp, Homo sapiens
agaggccagctagcgggccatc

SEQ ID NO: 6953245 - DNA, 22 bp, Homo sapiens
ccatgatttcccctgctgcaca

SEQ ID NO: 6953246 - DNA, 22 bp, Homo sapiens
tatgtcctaggcatttctctta

SEQ ID NO: 6953247 - DNA, 22 bp, Homo sapiens
tcagatgggttttgaaggatgt

SEQ ID NO: 6953248 - DNA, 19 bp, Homo sapiens
ggaaggcagaggggctgtg

SEQ ID NO: 6953249 - DNA, 22 bp, Homo sapiens
tctttgcatgcattttccctta

SEQ ID NO: 6953250 - DNA, 22 bp, Homo sapiens
gtccagtgtcttctacataaca

SEQ ID NO: 6953251 - DNA, 22 bp, Homo sapiens
tcgtgtgtattccctctccttc

SEQ ID NO: 6953252 - DNA, 22 bp, Homo sapiens
ctggaataaacgatcttcagca

SEQ ID NO: 6953253 - DNA, 22 bp, Homo sapiens
atctggtttggggatccttgtg

SEQ ID NO: 6953254 - DNA, 22 bp, Homo sapiens
gagcaaggcggcatctctctga

SEQ ID NO: 6953255 - DNA, 22 bp, Homo sapiens
aaattgcattcttgtcttgata

SEQ ID NO: 6953256 - DNA, 22 bp, Homo sapiens
ttggcaattagttatatctgca

SEQ ID NO: 6953257 - DNA, 22 bp, Homo sapiens
gctcaaatcccagcgggctcct

SEQ ID NO: 6953258 - DNA, 22 bp, Homo sapiens
tttagagtttctaaatggaatt

SEQ ID NO: 6953259 - DNA, 22 bp, Homo sapiens
tgggctcagtgggagaaagggc

SEQ ID NO: 6953260 - DNA, 22 bp, Homo sapiens
agctatgtgggagggtgagagc

SEQ ID NO: 6953261 - DNA, 22 bp, Homo sapiens
tgttagattcctgatgaattta

SEQ ID NO: 6953262 - DNA, 22 bp, Homo sapiens
aagggctggagactgggtcttc

SEQ ID NO: 6953263 - DNA, 22 bp, Homo sapiens
tagcacatctggcgcttatagg

SEQ ID NO: 6953264 - DNA, 22 bp, Homo sapiens
agtctgtgtatattcactgccc

SEQ ID NO: 6953265 - DNA, 22 bp, Homo sapiens
aggaatggtgctcagcagaaat

SEQ ID NO: 6953266 - DNA, 22 bp, Homo sapiens
gatgtatattctgtgccaggat

SEQ ID NO: 6953267 - DNA, 22 bp, Homo sapiens
tgacaacatcatttttgtgtgg

SEQ ID NO: 6953268 - DNA, 22 bp, Homo sapiens
ggctatgtgtgtccagtgtatt

SEQ ID NO: 6953269 - DNA, 22 bp, Homo sapiens
tgggctcctcgtcactcgctgt

SEQ ID NO: 6953270 - DNA, 22 bp, Homo sapiens
ttcaggattatactctcttccc

SEQ ID NO: 6953271 - DNA, 22 bp, Homo sapiens
actcatgtcctaggagtaaagc

SEQ ID NO: 6953272 - DNA, 19 bp, Homo sapiens
gctcctggatgacctgtgg

SEQ ID NO: 6953273 - DNA, 22 bp, Homo sapiens
ctctttagtttgaaatccacat

SEQ ID NO: 6953274 - DNA, 22 bp, Homo sapiens
ggagccagagtctgcagtgtaa

SEQ ID NO: 6953275 - DNA, 22 bp, Homo sapiens
ctggatgtttatgaaggaccca

SEQ ID NO: 6953276 - DNA, 19 bp, Homo sapiens
actatgcatttatttgttt

SEQ ID NO: 6953277 - DNA, 22 bp, Homo sapiens
agggttttggctgaagttcagc

SEQ ID NO: 6953278 - DNA, 21 bp, Homo sapiens
tcactgaagcctaagatgttt

SEQ ID NO: 6953279 - DNA, 22 bp, Homo sapiens
aaggtcctgtagccacagagcc

SEQ ID NO: 6953280 - DNA, 22 bp, Homo sapiens
aacaaatggaacacaaatcttt

SEQ ID NO: 6953281 - DNA, 22 bp, Homo sapiens
ccagtgcagtccccctgaactg

SEQ ID NO: 6953282 - DNA, 22 bp, Homo sapiens
gctgagtggagcagtcagcgct

SEQ ID NO: 6953283 - DNA, 21 bp, Homo sapiens
tcatttattgagaaatgactg

SEQ ID NO: 6953284 - DNA, 22 bp, Homo sapiens
tatttcttttcgtgacttattg

SEQ ID NO: 6953285 - DNA, 22 bp, Homo sapiens
ggtgccctcggccaccttcctg

SEQ ID NO: 6953286 - DNA, 22 bp, Homo sapiens
catctcatgggcatgccaagct

SEQ ID NO: 6953287 - DNA, 22 bp, Homo sapiens
ctgcctataaactgcctcaaat

SEQ ID NO: 6953288 - DNA, 22 bp, Homo sapiens
atagatcagcagcccctcatct

SEQ ID NO: 6953289 - DNA, 22 bp, Homo sapiens
tttacagtaaggtggatggtac

SEQ ID NO: 6953290 - DNA, 22 bp, Homo sapiens
gcagtagttctgattggaactt

SEQ ID NO: 6953291 - DNA, 23 bp, Homo sapiens
ccattcatctcagtcattgcttt

SEQ ID NO: 6953292 - DNA, 22 bp, Homo sapiens
attctttattgctgatggttat

SEQ ID NO: 6953293 - DNA, 22 bp, Homo sapiens
agtctctctcctcgtggtaacc

SEQ ID NO: 6953294 - DNA, 22 bp, Homo sapiens
agctctggggcctgtcccacat

SEQ ID NO: 6953295 - DNA, 22 bp, Homo sapiens
aggaaatgggaatagatggtat

SEQ ID NO: 6953296 - DNA, 22 bp, Homo sapiens
ttgaaacagtagctcatagacc

SEQ ID NO: 6953297 - DNA, 22 bp, Homo sapiens
cgcagagggcaggcagtgctgg

SEQ ID NO: 6953298 - DNA, 22 bp, Homo sapiens
atggctgtgttgttcctctgaa

SEQ ID NO: 6953299 - DNA, 22 bp, Homo sapiens
ggaagccacccagctttgatag

SEQ ID NO: 6953300 - DNA, 22 bp, Homo sapiens
agttcagaaatgtctttgcaaa

SEQ ID NO: 6953301 - DNA, 22 bp, Homo sapiens
tcagttgctgtgtaatgttttc

SEQ ID NO: 6953302 - DNA, 21 bp, Homo sapiens
tgcttgtctgcctagaggctt

SEQ ID NO: 6953303 - DNA, 22 bp, Homo sapiens
agtgtacactaaatgaatacaa

SEQ ID NO: 6953304 - DNA, 22 bp, Homo sapiens
ttccttccctcagtggctgaag

SEQ ID NO: 6953305 - DNA, 22 bp, Homo sapiens
tctgagcccctagaactgagcg

SEQ ID NO: 6953306 - DNA, 22 bp, Homo sapiens
aagcagcaacaaactggataaa

SEQ ID NO: 6953307 - DNA, 16 bp, Homo sapiens
tgacagaaagatctat

SEQ ID NO: 6953308 - DNA, 22 bp, Homo sapiens
cagctgacccagtgaggaggca

SEQ ID NO: 6953309 - DNA, 19 bp, Homo sapiens
gaaggctgaaatgaagcac

SEQ ID NO: 6953310 - DNA, 22 bp, Homo sapiens
cctaggaaggagtatagtaaat

SEQ ID NO: 6953311 - DNA, 22 bp, Homo sapiens
aactggtgagataaattattta

SEQ ID NO: 6953312 - DNA, 22 bp, Homo sapiens
ccatccacagtcttgattattt

SEQ ID NO: 6953313 - DNA, 22 bp, Homo sapiens
agtgggaggcggctgacgggcg

SEQ ID NO: 6953314 - DNA, 20 bp, Homo sapiens
tcctaacgaggcccattgca

SEQ ID NO: 6953315 - DNA, 22 bp, Homo sapiens
gactatttaaaaagaactactg

SEQ ID NO: 6953316 - DNA, 18 bp, Homo sapiens
tggcttctcaaagcccag

SEQ ID NO: 6953317 - DNA, 22 bp, Homo sapiens
gccaggctgactcccccggcct

SEQ ID NO: 6953318 - DNA, 22 bp, Homo sapiens
cttaggatgagtttttgcgttt

SEQ ID NO: 6953319 - DNA, 22 bp, Homo sapiens
tgagaaaatccagaggctagtt

SEQ ID NO: 6953320 - DNA, 22 bp, Homo sapiens
gaagatttataaggaccttatt

SEQ ID NO: 6953321 - DNA, 22 bp, Homo sapiens
tccaggtatgacaggccactcc

SEQ ID NO: 6953322 - DNA, 22 bp, Homo sapiens
tggttacatatcctttggagcc

SEQ ID NO: 6953323 - DNA, 22 bp, Homo sapiens
cctcagtgttaggataagagaa

SEQ ID NO: 6953324 - DNA, 20 bp, Homo sapiens
taaacagtatttactaggag

SEQ ID NO: 6953325 - DNA, 22 bp, Homo sapiens
tttagtgcttaggaaatgggga

SEQ ID NO: 6953326 - DNA, 22 bp, Homo sapiens
taaggtgaaaacacaagttgct

SEQ ID NO: 6953327 - DNA, 22 bp, Homo sapiens
tctggagtgggactttgcatct

SEQ ID NO: 6953328 - DNA, 20 bp, Homo sapiens
cctgtcatcccagcattttg

SEQ ID NO: 6953329 - DNA, 22 bp, Homo sapiens
ggtttgtggagctggaaacact

SEQ ID NO: 6953330 - DNA, 22 bp, Homo sapiens
agaagagccctttaagggggaa

SEQ ID NO: 6953331 - DNA, 22 bp, Homo sapiens
tctaacatttatggccactgga

SEQ ID NO: 6953332 - DNA, 22 bp, Homo sapiens
aatttcagatattaaagaatga

SEQ ID NO: 6953333 - DNA, 22 bp, Homo sapiens
tcagtatcaatagcgtcacaat

SEQ ID NO: 6953334 - DNA, 22 bp, Homo sapiens
caaatggagaattagcagtttg

SEQ ID NO: 6953335 - DNA, 22 bp, Homo sapiens
ttcttaagtttagcaacttgtg

SEQ ID NO: 6953336 - DNA, 22 bp, Homo sapiens
cctttggtgttattgggagaca

SEQ ID NO: 6953337 - DNA, 22 bp, Homo sapiens
gagtttatttgactggattctc

SEQ ID NO: 6953338 - DNA, 22 bp, Homo sapiens
attccttggcattctggacttg

SEQ ID NO: 6953339 - DNA, 22 bp, Homo sapiens
gccagcagctgtggggtggcca

SEQ ID NO: 6953340 - DNA, 18 bp, Homo sapiens
tcactgggagaagatatt

SEQ ID NO: 6953341 - DNA, 22 bp, Homo sapiens
atttattaagcatctgctatgt

SEQ ID NO: 6953342 - DNA, 22 bp, Homo sapiens
aatttatttcctgccagtacac

SEQ ID NO: 6953343 - DNA, 23 bp, Homo sapiens
tggacagggtaactggtggtttt

SEQ ID NO: 6953344 - DNA, 22 bp, Homo sapiens
tcctgagatccttttagggatc

SEQ ID NO: 6953345 - DNA, 22 bp, Homo sapiens
ctcaagtcccgcagtgttcctc

SEQ ID NO: 6953346 - DNA, 22 bp, Homo sapiens
acttgtgttaccaaggtttggt

SEQ ID NO: 6953347 - DNA, 22 bp, Homo sapiens
ggaaggggccttgagcaaactg

SEQ ID NO: 6953348 - DNA, 22 bp, Homo sapiens
actgccctccagcctgggtgac

SEQ ID NO: 6953349 - DNA, 22 bp, Homo sapiens
ggcatcaggacagggtttctag

SEQ ID NO: 6953350 - DNA, 22 bp, Homo sapiens
ggctgtagttacctgatgaaat

SEQ ID NO: 6953351 - DNA, 22 bp, Homo sapiens
ctgtcattgtacatgttataca

SEQ ID NO: 6953352 - DNA, 21 bp, Homo sapiens
catgtcttccacactgtagta

SEQ ID NO: 6953353 - DNA, 22 bp, Homo sapiens
atgtgcttatggtctctggttg

SEQ ID NO: 6953354 - DNA, 22 bp, Homo sapiens
gccttccagaatacacatagca

SEQ ID NO: 6953355 - DNA, 21 bp, Homo sapiens
tcattgatagaatgtgatgag

SEQ ID NO: 6953356 - DNA, 22 bp, Homo sapiens
gaatcaattatccaggctgttg

SEQ ID NO: 6953357 - DNA, 22 bp, Homo sapiens
tctgcctcgctaacagcagcca

SEQ ID NO: 6953358 - DNA, 22 bp, Homo sapiens
tctggcagcaagtctgtttctc

SEQ ID NO: 6953359 - DNA, 22 bp, Homo sapiens
ctctgaaaatgtggtggggaaa

SEQ ID NO: 6953360 - DNA, 22 bp, Homo sapiens
cacagaggactgtagcggggag

SEQ ID NO: 6953361 - DNA, 22 bp, Homo sapiens
aggcacagtggccctgtttggg

SEQ ID NO: 6953362 - DNA, 22 bp, Homo sapiens
gctgtcagtcacattgttacag

SEQ ID NO: 6953363 - DNA, 22 bp, Homo sapiens
tagtgtcagcatctcattgagc

SEQ ID NO: 6953364 - DNA, 22 bp, Homo sapiens
tagcactgttctagcatgtttt

SEQ ID NO: 6953365 - DNA, 22 bp, Homo sapiens
tgtcaaaaataagagagattgt

SEQ ID NO: 6953366 - DNA, 22 bp, Homo sapiens
cagaagttagtcttaattataa

SEQ ID NO: 6953367 - DNA, 22 bp, Homo sapiens
tggaaatagctccagttaagca

SEQ ID NO: 6953368 - DNA, 22 bp, Homo sapiens
agaggaggaagagctttaaaat

SEQ ID NO: 6953369 - DNA, 22 bp, Homo sapiens
taggactttgagaattgttatt

SEQ ID NO: 6953370 - DNA, 22 bp, Homo sapiens
ctgagtgttttcagccacggcc

SEQ ID NO: 6953371 - DNA, 22 bp, Homo sapiens
tggctgacaaataggtgcagtt

SEQ ID NO: 6953372 - DNA, 22 bp, Homo sapiens
agaaactctggaagaactttta

SEQ ID NO: 6953373 - DNA, 22 bp, Homo sapiens
agttcctggatttggggttgca

SEQ ID NO: 6953374 - DNA, 22 bp, Homo sapiens
gtgggctggagcaatgatttca

SEQ ID NO: 6953375 - DNA, 22 bp, Homo sapiens
tattgcaagcaattccaaaagg

SEQ ID NO: 6953376 - DNA, 22 bp, Homo sapiens
gaggtcattacactttgtttgt

SEQ ID NO: 6953377 - DNA, 22 bp, Homo sapiens
ggtctcttagtgcaacatacta

SEQ ID NO: 6953378 - DNA, 22 bp, Homo sapiens
ttcagactgctggtgcttccct

SEQ ID NO: 6953379 - DNA, 22 bp, Homo sapiens
ctgcctggtactttaggcactt

SEQ ID NO: 6953380 - DNA, 23 bp, Homo sapiens
agcaacagtgggtgagtgttgct

SEQ ID NO: 6953381 - DNA, 22 bp, Homo sapiens
gggcagctgccactccgcttgc

SEQ ID NO: 6953382 - DNA, 22 bp, Homo sapiens
aggtatgcatttttactttagg

SEQ ID NO: 6953383 - DNA, 22 bp, Homo sapiens
gagagcaggctctcgggggcca

SEQ ID NO: 6953384 - DNA, 21 bp, Homo sapiens
ccaggcagagctgtgagttct

SEQ ID NO: 6953385 - DNA, 22 bp, Homo sapiens
atacatgtgtccctgatttatt

SEQ ID NO: 6953386 - DNA, 23 bp, Homo sapiens
gcactggaaaaatgaagattact

SEQ ID NO: 6953387 - DNA, 23 bp, Homo sapiens
cctgtgtctgttgctgaataatg

SEQ ID NO: 6953388 - DNA, 22 bp, Homo sapiens
attggcctaaagaaatgacaga

SEQ ID NO: 6953389 - DNA, 22 bp, Homo sapiens
ctagagctattcaaggttttat

SEQ ID NO: 6953390 - DNA, 22 bp, Homo sapiens
acagcaactcctgcttctgagt

SEQ ID NO: 6953391 - DNA, 20 bp, Homo sapiens
tgagccttgaggagtgactg

SEQ ID NO: 6953392 - DNA, 22 bp, Homo sapiens
ctcaaggacttattcatgcctg

SEQ ID NO: 6953393 - DNA, 22 bp, Homo sapiens
gctccctggtattgctgccact

SEQ ID NO: 6953394 - DNA, 22 bp, Homo sapiens
gcagtcatatcattccaacagg

SEQ ID NO: 6953395 - DNA, 22 bp, Homo sapiens
tgtggcctttcaaggatggaat

SEQ ID NO: 6953396 - DNA, 22 bp, Homo sapiens
atgaaattttaattatacctct

SEQ ID NO: 6953397 - DNA, 22 bp, Homo sapiens
gtgtcacaagagcccaggaaac

SEQ ID NO: 6953398 - DNA, 22 bp, Homo sapiens
ggctaggggaataatctgtggt

SEQ ID NO: 6953399 - DNA, 22 bp, Homo sapiens
agctttgaatgagtgcattgca

SEQ ID NO: 6953400 - DNA, 22 bp, Homo sapiens
gcagccacactgttacagaatg

SEQ ID NO: 6953401 - DNA, 22 bp, Homo sapiens
gggacatttatcagatgaccat

SEQ ID NO: 6953402 - DNA, 22 bp, Homo sapiens
gttgaaatgagggattaatcag

SEQ ID NO: 6953403 - DNA, 22 bp, Homo sapiens
ggcagcacgacaggagtggaag

SEQ ID NO: 6953404 - DNA, 22 bp, Homo sapiens
tggaatagaggtgctgatatta

SEQ ID NO: 6953405 - DNA, 20 bp, Homo sapiens
tgtgtgaattagggcatgtt

SEQ ID NO: 6953406 - DNA, 22 bp, Homo sapiens
tgttttgttagcactctgggaa

SEQ ID NO: 6953407 - DNA, 22 bp, Homo sapiens
ccttttgttggggtgtattcaa

SEQ ID NO: 6953408 - DNA, 22 bp, Homo sapiens
atgggacatagatccttgaggt

SEQ ID NO: 6953409 - DNA, 22 bp, Homo sapiens
ggccatctgcctcaatgtgtgc

SEQ ID NO: 6953410 - DNA, 22 bp, Homo sapiens
ctgtgccagtgtattcctgtga

SEQ ID NO: 6953411 - DNA, 21 bp, Homo sapiens
agctggaatctggctgtgctt

SEQ ID NO: 6953412 - DNA, 23 bp, Homo sapiens
ccaagtccctctccaagcctttg

SEQ ID NO: 6953413 - DNA, 23 bp, Homo sapiens
acatcagagttagttcaatcagg

SEQ ID NO: 6953414 - DNA, 22 bp, Homo sapiens
tgcaggtaggcctgacttccag

SEQ ID NO: 6953415 - DNA, 22 bp, Homo sapiens
tggtaatatatgccagataaaa

SEQ ID NO: 6953416 - DNA, 23 bp, Homo sapiens
tgtcttcgactcctgcgtgcttc

SEQ ID NO: 6953417 - DNA, 22 bp, Homo sapiens
ctggaatgggaatcaggaaaga

SEQ ID NO: 6953418 - DNA, 22 bp, Homo sapiens
gctatgtgtatctgttagagag

SEQ ID NO: 6953419 - DNA, 22 bp, Homo sapiens
accacaggacccatgagtcagt

SEQ ID NO: 6953420 - DNA, 22 bp, Homo sapiens
caggtgttctggaaatcagcag

SEQ ID NO: 6953421 - DNA, 22 bp, Homo sapiens
gtttagactccttggtcttctg

SEQ ID NO: 6953422 - DNA, 22 bp, Homo sapiens
acccagggttcctgggtcccag

SEQ ID NO: 6953423 - DNA, 22 bp, Homo sapiens
gaatcatggctgtgtcttcagc

SEQ ID NO: 6953424 - DNA, 22 bp, Homo sapiens
tgtaatggttctgagcaggttt

SEQ ID NO: 6953425 - DNA, 22 bp, Homo sapiens
tgcaccattaatttatgtgaga

SEQ ID NO: 6953426 - DNA, 22 bp, Homo sapiens
aggcactttacaatgtgtgaca

SEQ ID NO: 6953427 - DNA, 22 bp, Homo sapiens
tgctccactgtgcgtggccata

SEQ ID NO: 6953428 - DNA, 22 bp, Homo sapiens
catttaatgcacggatgtagcc

SEQ ID NO: 6953429 - DNA, 17 bp, Homo sapiens
agcaggcacgtcagcac

SEQ ID NO: 6953430 - DNA, 22 bp, Homo sapiens
atgcccccatctctgttggctc

SEQ ID NO: 6953431 - DNA, 22 bp, Homo sapiens
cagcagtgtgcaggtgtgctgg

SEQ ID NO: 6953432 - DNA, 22 bp, Homo sapiens
gaatatgtgttcctggacaaga

SEQ ID NO: 6953433 - DNA, 22 bp, Homo sapiens
aacacttaaggagagatcaaat

SEQ ID NO: 6953434 - DNA, 19 bp, Homo sapiens
aaccttagcttctcaggcc

SEQ ID NO: 6953435 - DNA, 22 bp, Homo sapiens
tcacattttgttcaaggctagt

SEQ ID NO: 6953436 - DNA, 22 bp, Homo sapiens
gaggctcaacccacaggggttg

SEQ ID NO: 6953437 - DNA, 22 bp, Homo sapiens
aggtgcaggagctgtgcaggga

SEQ ID NO: 6953438 - DNA, 22 bp, Homo sapiens
catctttgcccatccacttcca

SEQ ID NO: 6953439 - DNA, 22 bp, Homo sapiens
tcttataagcaaactgctgaga

SEQ ID NO: 6953440 - DNA, 22 bp, Homo sapiens
tggatcatgtgatgtcaggagt

SEQ ID NO: 6953441 - DNA, 22 bp, Homo sapiens
cccagcctgatctcggccagct

SEQ ID NO: 6953442 - DNA, 21 bp, Homo sapiens
gattgaaaccatggcagtgag

SEQ ID NO: 6953443 - DNA, 21 bp, Homo sapiens
tttgggcaaaattaaatgaga

SEQ ID NO: 6953444 - DNA, 22 bp, Homo sapiens
tattgatctggatatttagaca

SEQ ID NO: 6953445 - DNA, 22 bp, Homo sapiens
aggggcttcccttcctgggtag

SEQ ID NO: 6953446 - DNA, 23 bp, Homo sapiens
acacaggatacatacggaagcaa

SEQ ID NO: 6953447 - DNA, 20 bp, Homo sapiens
ggtgctctgcaaatgtctcc

SEQ ID NO: 6953448 - DNA, 22 bp, Homo sapiens
aagccaggtgttgtggtaagag

SEQ ID NO: 6953449 - DNA, 22 bp, Homo sapiens
caggcttgggagcagagccact

SEQ ID NO: 6953450 - DNA, 22 bp, Homo sapiens
gagctctgccatggctcccacc

SEQ ID NO: 6953451 - DNA, 19 bp, Homo sapiens
agccagccagcaggtatgc

SEQ ID NO: 6953452 - DNA, 22 bp, Homo sapiens
ataaggaacctgggcttaagag

SEQ ID NO: 6953453 - DNA, 18 bp, Homo sapiens
ctgtgcagcaaactgagc

SEQ ID NO: 6953454 - DNA, 22 bp, Homo sapiens
ctcggaagaagcgttctcagag

SEQ ID NO: 6953455 - DNA, 22 bp, Homo sapiens
gaagatcagagtaagcttttta

SEQ ID NO: 6953456 - DNA, 22 bp, Homo sapiens
agtgttgtctaaatgaatgcta

SEQ ID NO: 6953457 - DNA, 22 bp, Homo sapiens
gcagacatgggatctattcaca

SEQ ID NO: 6953458 - DNA, 21 bp, Homo sapiens
tgagtcttttgcacaaggaat

SEQ ID NO: 6953459 - DNA, 22 bp, Homo sapiens
tcttcagcaactccccaatctg

SEQ ID NO: 6953460 - DNA, 22 bp, Homo sapiens
gcccagcccctgggtggacgtg

SEQ ID NO: 6953461 - DNA, 22 bp, Homo sapiens
tagaggatgatccttccttgcc

SEQ ID NO: 6953462 - DNA, 23 bp, Homo sapiens
cccaggctacaaattatgctctg

SEQ ID NO: 6953463 - DNA, 22 bp, Homo sapiens
aatctgttaggatgaggatacg

SEQ ID NO: 6953464 - DNA, 22 bp, Homo sapiens
atctgtgtatgtgaccttatct

SEQ ID NO: 6953465 - DNA, 21 bp, Homo sapiens
gtggcaagagtaggcattcat

SEQ ID NO: 6953466 - DNA, 22 bp, Homo sapiens
gaactggtgaagtgaagggcag

SEQ ID NO: 6953467 - DNA, 22 bp, Homo sapiens
aaccatttgcagttactgagac

SEQ ID NO: 6953468 - DNA, 22 bp, Homo sapiens
ccatggaactcagtaaattata

SEQ ID NO: 6953469 - DNA, 22 bp, Homo sapiens
gcagcaacgcggccctactgct

SEQ ID NO: 6953470 - DNA, 22 bp, Homo sapiens
atcattatcctcctatttgcct

SEQ ID NO: 6953471 - DNA, 22 bp, Homo sapiens
tcagggaatgatgcacacagtt

SEQ ID NO: 6953472 - DNA, 22 bp, Homo sapiens
ttcccacactccatataattca

SEQ ID NO: 6953473 - DNA, 22 bp, Homo sapiens
tgttcttaagactggaagttac

SEQ ID NO: 6953474 - DNA, 22 bp, Homo sapiens
cagttttaggacatgtggatgt

SEQ ID NO: 6953475 - DNA, 22 bp, Homo sapiens
attgggaagatttagatccact

SEQ ID NO: 6953476 - DNA, 22 bp, Homo sapiens
aggcaccttgagagcaggagct

SEQ ID NO: 6953477 - DNA, 22 bp, Homo sapiens
tgagatttgggttgtttaacat

SEQ ID NO: 6953478 - DNA, 22 bp, Homo sapiens
atgtcagttgctgcttgaggta

SEQ ID NO: 6953479 - DNA, 22 bp, Homo sapiens
aaaaccacagttacttttgcac

SEQ ID NO: 6953480 - DNA, 22 bp, Homo sapiens
ccagtgcctatctcctctggga

SEQ ID NO: 6953481 - DNA, 22 bp, Homo sapiens
tcagcaactatttatcaaattc

SEQ ID NO: 6953482 - DNA, 22 bp, Homo sapiens
tctggactcgggtgggtgacac

SEQ ID NO: 6953483 - DNA, 22 bp, Homo sapiens
ctggctcaataaatattagctg

SEQ ID NO: 6953484 - DNA, 22 bp, Homo sapiens
ggtggcctagaggttaaagtag

SEQ ID NO: 6953485 - DNA, 22 bp, Homo sapiens
ctagaacagtcaaagtgagctc

SEQ ID NO: 6953486 - DNA, 23 bp, Homo sapiens
aggaagcttggcaataaggtttg

SEQ ID NO: 6953487 - DNA, 22 bp, Homo sapiens
cactgaggactcccacgtaggt

SEQ ID NO: 6953488 - DNA, 22 bp, Homo sapiens
ctctgggtgttaatgtcagtgt

SEQ ID NO: 6953489 - DNA, 22 bp, Homo sapiens
tcaaaattagtgaccaaaggca

SEQ ID NO: 6953490 - DNA, 22 bp, Homo sapiens
ttagagctgggatggattttcc

SEQ ID NO: 6953491 - DNA, 22 bp, Homo sapiens
tcatttactgtaggcaaaaatt

SEQ ID NO: 6953492 - DNA, 22 bp, Homo sapiens
gcagagtgccagtatttgttgt

SEQ ID NO: 6953493 - DNA, 22 bp, Homo sapiens
aatcttcatgtcctctctaatt

SEQ ID NO: 6953494 - DNA, 20 bp, Homo sapiens
tacaggctctgagagatgat

SEQ ID NO: 6953495 - DNA, 22 bp, Homo sapiens
agagcctgtaacatctttctta

SEQ ID NO: 6953496 - DNA, 20 bp, Homo sapiens
agttactaagtgctggaacc

SEQ ID NO: 6953497 - DNA, 22 bp, Homo sapiens
tcatcttgctgccattgcttta

SEQ ID NO: 6953498 - DNA, 22 bp, Homo sapiens
atgaggcaaggctggccgtgtt

SEQ ID NO: 6953499 - DNA, 22 bp, Homo sapiens
tgctccttcccttcccagtgag

SEQ ID NO: 6953500 - DNA, 19 bp, Homo sapiens
tgccgctcgaggctctggg

SEQ ID NO: 6953501 - DNA, 22 bp, Homo sapiens
tccattttctcttccggaggtg

SEQ ID NO: 6953502 - DNA, 22 bp, Homo sapiens
atttcagagaatgaacctaatc

SEQ ID NO: 6953503 - DNA, 22 bp, Homo sapiens
ttctgagagttgtagtgtatcc

SEQ ID NO: 6953504 - DNA, 22 bp, Homo sapiens
ctgggcagttcgctttcgtttt

SEQ ID NO: 6953505 - DNA, 22 bp, Homo sapiens
acgtgctggagaagagctcgcc

SEQ ID NO: 6953506 - DNA, 17 bp, Homo sapiens
gtgagggcagaggatgg

SEQ ID NO: 6953507 - DNA, 22 bp, Homo sapiens
gacatctgaggccctcagagcc

SEQ ID NO: 6953508 - DNA, 22 bp, Homo sapiens
tcagagatctggagtacaactg

SEQ ID NO: 6953509 - DNA, 22 bp, Homo sapiens
gcttcctacatgtgtctgcgag

SEQ ID NO: 6953510 - DNA, 22 bp, Homo sapiens
acattctgtttccccaaagaga

SEQ ID NO: 6953511 - DNA, 22 bp, Homo sapiens
agtcagacataattctaacatt

SEQ ID NO: 6953512 - DNA, 17 bp, Homo sapiens
cgtgagcagcaggtgcc

SEQ ID NO: 6953513 - DNA, 22 bp, Homo sapiens
aagggcctcctggggagcctgg

SEQ ID NO: 6953514 - DNA, 22 bp, Homo sapiens
aattgtacataaaccatttggc

SEQ ID NO: 6953515 - DNA, 22 bp, Homo sapiens
ctacatcacttaattcttagaa

SEQ ID NO: 6953516 - DNA, 22 bp, Homo sapiens
aagttcctgggccaagtccagg

SEQ ID NO: 6953517 - DNA, 22 bp, Homo sapiens
ttggggtacgcaggtctgggag

SEQ ID NO: 6953518 - DNA, 22 bp, Homo sapiens
cagctctgacacagtacaaaat

SEQ ID NO: 6953519 - DNA, 22 bp, Homo sapiens
taagaagcttctgctaatgcct

SEQ ID NO: 6953520 - DNA, 21 bp, Homo sapiens
tgaacacagatttgtctgatt

SEQ ID NO: 6953521 - DNA, 22 bp, Homo sapiens
ggcatctgtggagccttttcca

SEQ ID NO: 6953522 - DNA, 22 bp, Homo sapiens
gccattcattcagaattccaga

SEQ ID NO: 6953523 - DNA, 22 bp, Homo sapiens
ctcaggcagttctgtagcctcc

SEQ ID NO: 6953524 - DNA, 22 bp, Homo sapiens
atttattgagagggaggggaat

SEQ ID NO: 6953525 - DNA, 22 bp, Homo sapiens
agctatgtttgacagaaagtga

SEQ ID NO: 6953526 - DNA, 22 bp, Homo sapiens
ggtctcaaggaatataatgagt

SEQ ID NO: 6953527 - DNA, 22 bp, Homo sapiens
ctgtgcccggcccagggccctg

SEQ ID NO: 6953528 - DNA, 22 bp, Homo sapiens
aggaaaatgaaacagcaactgt

SEQ ID NO: 6953529 - DNA, 22 bp, Homo sapiens
aaatttgtcaacttcatatgtt

SEQ ID NO: 6953530 - DNA, 22 bp, Homo sapiens
gactgcagtgaaggcacatggg

SEQ ID NO: 6953531 - DNA, 22 bp, Homo sapiens
atgcagataagaatcaggtttg

SEQ ID NO: 6953532 - DNA, 22 bp, Homo sapiens
ttcacaataatgtccatcctct

SEQ ID NO: 6953533 - DNA, 22 bp, Homo sapiens
tgtgcttcttgcagctcctgta

SEQ ID NO: 6953534 - DNA, 22 bp, Homo sapiens
tggctgaggctggagtgcagtg

SEQ ID NO: 6953535 - DNA, 22 bp, Homo sapiens
taggaagtggtagaggccagga

SEQ ID NO: 6953536 - DNA, 22 bp, Homo sapiens
aggagctcagctaagttggaga

SEQ ID NO: 6953537 - DNA, 22 bp, Homo sapiens
gtccttaaccacttgtgtttat

SEQ ID NO: 6953538 - DNA, 22 bp, Homo sapiens
ccagtaaaccaagtgtttacta

SEQ ID NO: 6953539 - DNA, 22 bp, Homo sapiens
gttttctcatctcctcaatggt

SEQ ID NO: 6953540 - DNA, 22 bp, Homo sapiens
gtttcaagggaactgttttggt

SEQ ID NO: 6953541 - DNA, 19 bp, Homo sapiens
aacttgctttaaaaccata

SEQ ID NO: 6953542 - DNA, 22 bp, Homo sapiens
cacagtgactggcacatagtaa

SEQ ID NO: 6953543 - DNA, 22 bp, Homo sapiens
tccaggctagaagtcacaggcc

SEQ ID NO: 6953544 - DNA, 22 bp, Homo sapiens
gctgtttcttgaggctactcct

SEQ ID NO: 6953545 - DNA, 22 bp, Homo sapiens
gcccatggacacccaagtgcca

SEQ ID NO: 6953546 - DNA, 22 bp, Homo sapiens
aggaagggagcagtttgttgtt

SEQ ID NO: 6953547 - DNA, 22 bp, Homo sapiens
agtttttctcccctggcttcat

SEQ ID NO: 6953548 - DNA, 22 bp, Homo sapiens
gcaggagcaatggcctatcaga

SEQ ID NO: 6953549 - DNA, 22 bp, Homo sapiens
ttacttgaatgctgtgatctca

SEQ ID NO: 6953550 - DNA, 22 bp, Homo sapiens
ctggctttaaccctacaaacct

SEQ ID NO: 6953551 - DNA, 22 bp, Homo sapiens
tcctgcagagccgccctcaggt

SEQ ID NO: 6953552 - DNA, 22 bp, Homo sapiens
agccctgggcgttactgggatg

SEQ ID NO: 6953553 - DNA, 22 bp, Homo sapiens
tcccctcctctcctgatatggg

SEQ ID NO: 6953554 - DNA, 22 bp, Homo sapiens
ttactttatctcctagattcca

SEQ ID NO: 6953555 - DNA, 22 bp, Homo sapiens
cgtggctctgggctcctttgcc

SEQ ID NO: 6953556 - DNA, 22 bp, Homo sapiens
gcacctgctcacacatgtgact

SEQ ID NO: 6953557 - DNA, 21 bp, Homo sapiens
ttcatgagataaccagctgta

SEQ ID NO: 6953558 - DNA, 22 bp, Homo sapiens
aagatgaagaacatgagcacac

SEQ ID NO: 6953559 - DNA, 22 bp, Homo sapiens
agtcaggacagattttctgggg

SEQ ID NO: 6953560 - DNA, 22 bp, Homo sapiens
ttgattacaaagtagatacatt

SEQ ID NO: 6953561 - DNA, 22 bp, Homo sapiens
gaggtgattttcaaaagaactt

SEQ ID NO: 6953562 - DNA, 21 bp, Homo sapiens
tgatcacatgaaaaccatgca

SEQ ID NO: 6953563 - DNA, 22 bp, Homo sapiens
tggatcatatggataggcagta

SEQ ID NO: 6953564 - DNA, 21 bp, Homo sapiens
gcagggacaaagcttcaggag

SEQ ID NO: 6953565 - DNA, 20 bp, Homo sapiens
agctttctccttggagctcc

SEQ ID NO: 6953566 - DNA, 22 bp, Homo sapiens
agacatttggagccaactttcc

SEQ ID NO: 6953567 - DNA, 22 bp, Homo sapiens
tgtcattaaaatgcttctcaaa

SEQ ID NO: 6953568 - DNA, 22 bp, Homo sapiens
agccacatgagtgagccatctt

SEQ ID NO: 6953569 - DNA, 22 bp, Homo sapiens
gtgggagccctcagggaggtgc

SEQ ID NO: 6953570 - DNA, 22 bp, Homo sapiens
aatctacatgcaatatttttag

SEQ ID NO: 6953571 - DNA, 22 bp, Homo sapiens
atctaataccctctttatttct

SEQ ID NO: 6953572 - DNA, 22 bp, Homo sapiens
gtggagtggcctggccctgaga

SEQ ID NO: 6953573 - DNA, 22 bp, Homo sapiens
cttggaaaggttttacaaagcg

SEQ ID NO: 6953574 - DNA, 22 bp, Homo sapiens
cagataataatatgacttcact

SEQ ID NO: 6953575 - DNA, 22 bp, Homo sapiens
tctaaacattggtatggagcag

SEQ ID NO: 6953576 - DNA, 22 bp, Homo sapiens
aggctggccctactggctgcct

SEQ ID NO: 6953577 - DNA, 22 bp, Homo sapiens
agatggggcagaatggagccat

SEQ ID NO: 6953578 - DNA, 22 bp, Homo sapiens
attttcatggcttctgctcagt

SEQ ID NO: 6953579 - DNA, 22 bp, Homo sapiens
actgtccgcatgtgtgccacct

SEQ ID NO: 6953580 - DNA, 22 bp, Homo sapiens
cctagttttggacattcctgca

SEQ ID NO: 6953581 - DNA, 22 bp, Homo sapiens
cagtaccagtcaccacattgat

SEQ ID NO: 6953582 - DNA, 22 bp, Homo sapiens
aaggaagaagactctttactcc

SEQ ID NO: 6953583 - DNA, 20 bp, Homo sapiens
acaaatgcattctgtgacat

SEQ ID NO: 6953584 - DNA, 22 bp, Homo sapiens
ggaatgtttgctcccttcaggg

SEQ ID NO: 6953585 - DNA, 19 bp, Homo sapiens
cagtttaactaattttatc

SEQ ID NO: 6953586 - DNA, 22 bp, Homo sapiens
ttacatctaaactgtgaacaat

SEQ ID NO: 6953587 - DNA, 19 bp, Homo sapiens
tctatgtggcagtgatggc

SEQ ID NO: 6953588 - DNA, 22 bp, Homo sapiens
agtatgaatacagattttctct

SEQ ID NO: 6953589 - DNA, 22 bp, Homo sapiens
aatgagaactgggagttggtgg

SEQ ID NO: 6953590 - DNA, 22 bp, Homo sapiens
aattacctcatacccggactat

SEQ ID NO: 6953591 - DNA, 22 bp, Homo sapiens
caggaaatagttcagtcaaact

SEQ ID NO: 6953592 - DNA, 22 bp, Homo sapiens
aacagcagggggacctgctggt

SEQ ID NO: 6953593 - DNA, 22 bp, Homo sapiens
acattgaaagcatattatctcc

SEQ ID NO: 6953594 - DNA, 23 bp, Homo sapiens
cagtctgcagcccacttgggcag

SEQ ID NO: 6953595 - DNA, 23 bp, Homo sapiens
tggcaggtggttagatgttttgt

SEQ ID NO: 6953596 - DNA, 20 bp, Homo sapiens
tttattggcctttcaggaac

SEQ ID NO: 6953597 - DNA, 22 bp, Homo sapiens
caagccagtcagctcagtagat

SEQ ID NO: 6953598 - DNA, 22 bp, Homo sapiens
gcccagagtggccacttggctc

SEQ ID NO: 6953599 - DNA, 22 bp, Homo sapiens
atcatcttaaatctagaatgtg

SEQ ID NO: 6953600 - DNA, 22 bp, Homo sapiens
tatacagtcttttgctatattc

SEQ ID NO: 6953601 - DNA, 22 bp, Homo sapiens
ttggcatcagtgtaggacctgt

SEQ ID NO: 6953602 - DNA, 22 bp, Homo sapiens
ggctggctggcttagcagagga

SEQ ID NO: 6953603 - DNA, 22 bp, Homo sapiens
gaaagttctgctctgattggct

SEQ ID NO: 6953604 - DNA, 22 bp, Homo sapiens
gttgtcctgaatttggagactt

SEQ ID NO: 6953605 - DNA, 22 bp, Homo sapiens
cttgagcttaggttcaggattg

SEQ ID NO: 6953606 - DNA, 22 bp, Homo sapiens
gaggaacctcctgaaaagtata

SEQ ID NO: 6953607 - DNA, 22 bp, Homo sapiens
cagctgcccaggccacctggag

SEQ ID NO: 6953608 - DNA, 22 bp, Homo sapiens
gacagggtccaaaggcagggga

SEQ ID NO: 6953609 - DNA, 22 bp, Homo sapiens
ctcagagagggcaccagggcca

SEQ ID NO: 6953610 - DNA, 22 bp, Homo sapiens
ggctgtgccctcacatggggca

SEQ ID NO: 6953611 - DNA, 22 bp, Homo sapiens
aaagtacttacagtatgcttgg

SEQ ID NO: 6953612 - DNA, 22 bp, Homo sapiens
gtgcgcaccctcccggcatccc

SEQ ID NO: 6953613 - DNA, 22 bp, Homo sapiens
ttcagagaaagcagatttactc

SEQ ID NO: 6953614 - DNA, 22 bp, Homo sapiens
actgagatgaatagatggcaag

SEQ ID NO: 6953615 - DNA, 22 bp, Homo sapiens
ttcattgaaatgtttctagctg

SEQ ID NO: 6953616 - DNA, 21 bp, Homo sapiens
aaacatctctgcttttgtgtc

SEQ ID NO: 6953617 - DNA, 22 bp, Homo sapiens
tgtttgtcatcattgtgagaga

SEQ ID NO: 6953618 - DNA, 22 bp, Homo sapiens
cattctctctacttgttttcaa

SEQ ID NO: 6953619 - DNA, 22 bp, Homo sapiens
atcagactctgcattgcagtct

SEQ ID NO: 6953620 - DNA, 22 bp, Homo sapiens
cttccttccttccccgaaatgc

SEQ ID NO: 6953621 - DNA, 22 bp, Homo sapiens
ggtggcctgaattagctcaggg

SEQ ID NO: 6953622 - DNA, 22 bp, Homo sapiens
tccctgggactcagacatggaa

SEQ ID NO: 6953623 - DNA, 22 bp, Homo sapiens
ggaatgtttttcattgctctct

SEQ ID NO: 6953624 - DNA, 22 bp, Homo sapiens
agctgcttgttgaaatccaaac

SEQ ID NO: 6953625 - DNA, 22 bp, Homo sapiens
ttcctgtgtgctctcatttagt

SEQ ID NO: 6953626 - DNA, 22 bp, Homo sapiens
acattacataagattgtaacct

SEQ ID NO: 6953627 - DNA, 20 bp, Homo sapiens
agccaagaacaggcagaacc

SEQ ID NO: 6953628 - DNA, 22 bp, Homo sapiens
tagcagtatattttaaggaagc

SEQ ID NO: 6953629 - DNA, 22 bp, Homo sapiens
cacccagttgactacaaagggg

SEQ ID NO: 6953630 - DNA, 21 bp, Homo sapiens
tttctgggtggctgcatagtg

SEQ ID NO: 6953631 - DNA, 22 bp, Homo sapiens
aagcccttggcagagttcccca

SEQ ID NO: 6953632 - DNA, 22 bp, Homo sapiens
tgggacaggaggcctctggaga

SEQ ID NO: 6953633 - DNA, 22 bp, Homo sapiens
actcagagaaacagcagggtgt

SEQ ID NO: 6953634 - DNA, 22 bp, Homo sapiens
aatcagctaaataaactagtca

SEQ ID NO: 6953635 - DNA, 22 bp, Homo sapiens
tctccacagtcccacctcgctt

SEQ ID NO: 6953636 - DNA, 22 bp, Homo sapiens
cacaatattggccgggctggtc

SEQ ID NO: 6953637 - DNA, 22 bp, Homo sapiens
tgcattgtttagaactctttgg

SEQ ID NO: 6953638 - DNA, 22 bp, Homo sapiens
tgtcccagtttatctgggactg

SEQ ID NO: 6953639 - DNA, 22 bp, Homo sapiens
tatgcgtatatgtatgtgcagt

SEQ ID NO: 6953640 - DNA, 22 bp, Homo sapiens
tgggtcagtttgggggccagcc

SEQ ID NO: 6953641 - DNA, 22 bp, Homo sapiens
tgctgcccgtacctgtgcactt

SEQ ID NO: 6953642 - DNA, 22 bp, Homo sapiens
taattgcagggtgtcagaatac

SEQ ID NO: 6953643 - DNA, 22 bp, Homo sapiens
aggagacataactatgatgaga

SEQ ID NO: 6953644 - DNA, 22 bp, Homo sapiens
tcaactttagtgtagctattta

SEQ ID NO: 6953645 - DNA, 22 bp, Homo sapiens
tgcagagtcctctggagggact

SEQ ID NO: 6953646 - DNA, 22 bp, Homo sapiens
agctgttccaggcctcattgct

SEQ ID NO: 6953647 - DNA, 22 bp, Homo sapiens
tgagatgtaaggtatgcttact

SEQ ID NO: 6953648 - DNA, 22 bp, Homo sapiens
tgtacagataaagactgtaaat

SEQ ID NO: 6953649 - DNA, 22 bp, Homo sapiens
acatctgtaatctagtcaaccc

SEQ ID NO: 6953650 - DNA, 22 bp, Homo sapiens
atttattgaacactgactatgt

SEQ ID NO: 6953651 - DNA, 22 bp, Homo sapiens
cagtgtgctgcagagaacattt

SEQ ID NO: 6953652 - DNA, 22 bp, Homo sapiens
ctgggccacaaaaaactcctgt

SEQ ID NO: 6953653 - DNA, 22 bp, Homo sapiens
catcctgactgtaactaagaga

SEQ ID NO: 6953654 - DNA, 22 bp, Homo sapiens
gaacagaattaccgaagatctg

SEQ ID NO: 6953655 - DNA, 22 bp, Homo sapiens
tggcagagttcgctcctattca

SEQ ID NO: 6953656 - DNA, 22 bp, Homo sapiens
cccaggctcctgctgtgttgac

SEQ ID NO: 6953657 - DNA, 22 bp, Homo sapiens
atctgtggaaattggcaagtgc

SEQ ID NO: 6953658 - DNA, 22 bp, Homo sapiens
tattgtctgcaaaggtttataa

SEQ ID NO: 6953659 - DNA, 22 bp, Homo sapiens
agctaatgatgagatacagata

SEQ ID NO: 6953660 - DNA, 22 bp, Homo sapiens
tgtattgaattgtgttatatct

SEQ ID NO: 6953661 - DNA, 22 bp, Homo sapiens
gtgcatatatgtgcagcatcaa

SEQ ID NO: 6953662 - DNA, 22 bp, Homo sapiens
gggaaggacattctgggctcag

SEQ ID NO: 6953663 - DNA, 22 bp, Homo sapiens
aggaccagaggccagagtcagc

SEQ ID NO: 6953664 - DNA, 22 bp, Homo sapiens
tgttctgttttatggtagggaa

SEQ ID NO: 6953665 - DNA, 22 bp, Homo sapiens
actatacattgaatgttaaggt

SEQ ID NO: 6953666 - DNA, 22 bp, Homo sapiens
aaacaatttccacctctcctga

SEQ ID NO: 6953667 - DNA, 22 bp, Homo sapiens
gcctccagtttttttctgaact

SEQ ID NO: 6953668 - DNA, 22 bp, Homo sapiens
gagtcagattgcagacagggct

SEQ ID NO: 6953669 - DNA, 22 bp, Homo sapiens
caggtccaactatttatctgtg

SEQ ID NO: 6953670 - DNA, 22 bp, Homo sapiens
tggccagctgagatttagcaca

SEQ ID NO: 6953671 - DNA, 22 bp, Homo sapiens
agggaccaggggtagctgagat

SEQ ID NO: 6953672 - DNA, 22 bp, Homo sapiens
gaacacagcagggataaccact

SEQ ID NO: 6953673 - DNA, 22 bp, Homo sapiens
cagcccctggcgcacgccgagc

SEQ ID NO: 6953674 - DNA, 22 bp, Homo sapiens
tctatgaaacgttgcaggaggg

SEQ ID NO: 6953675 - DNA, 22 bp, Homo sapiens
gccagagcatcgcaccctccat

SEQ ID NO: 6953676 - DNA, 22 bp, Homo sapiens
cctcggaggcggaggctgcagt

SEQ ID NO: 6953677 - DNA, 22 bp, Homo sapiens
ttggaagcctagttaagatgaa

SEQ ID NO: 6953678 - DNA, 19 bp, Homo sapiens
atgggaagcggccagcgga

SEQ ID NO: 6953679 - DNA, 22 bp, Homo sapiens
acctgcctatggagccacatgg

SEQ ID NO: 6953680 - DNA, 22 bp, Homo sapiens
agggcagcaatttggttcctgg

SEQ ID NO: 6953681 - DNA, 20 bp, Homo sapiens
gctctccgttttattgcctg

SEQ ID NO: 6953682 - DNA, 22 bp, Homo sapiens
agggctcctccccggcctccac

SEQ ID NO: 6953683 - DNA, 22 bp, Homo sapiens
tcagataagttttgagttttaa

SEQ ID NO: 6953684 - DNA, 22 bp, Homo sapiens
tttttgcaccaacctaatagaa

SEQ ID NO: 6953685 - DNA, 22 bp, Homo sapiens
tcccaagtactaccaatctaat

SEQ ID NO: 6953686 - DNA, 22 bp, Homo sapiens
cttgctcacagtacctggcttg

SEQ ID NO: 6953687 - DNA, 22 bp, Homo sapiens
gtggtcctcttcttctgtttgg

SEQ ID NO: 6953688 - DNA, 22 bp, Homo sapiens
taactgcaacctccatcttgtg

SEQ ID NO: 6953689 - DNA, 22 bp, Homo sapiens
ccacagtgagtgtcatacttgg

SEQ ID NO: 6953690 - DNA, 22 bp, Homo sapiens
atatacactgtttcagttgaag

SEQ ID NO: 6953691 - DNA, 22 bp, Homo sapiens
acatgtacatacacatatgtaa

SEQ ID NO: 6953692 - DNA, 22 bp, Homo sapiens
ttgccaggcttgtttctaggct

SEQ ID NO: 6953693 - DNA, 22 bp, Homo sapiens
ttgctgatggtattatgctagt

SEQ ID NO: 6953694 - DNA, 22 bp, Homo sapiens
tggtcccattgttctgcccagg

SEQ ID NO: 6953695 - DNA, 22 bp, Homo sapiens
agagctgatttgattacagtgc

SEQ ID NO: 6953696 - DNA, 22 bp, Homo sapiens
tcatttttagcgcgcaaaagtt

SEQ ID NO: 6953697 - DNA, 22 bp, Homo sapiens
taaatgtactgaggcaacagga

SEQ ID NO: 6953698 - DNA, 22 bp, Homo sapiens
caggagcaaggagcagtgggat

SEQ ID NO: 6953699 - DNA, 22 bp, Homo sapiens
cagcagaagtccgactccagtc

SEQ ID NO: 6953700 - DNA, 22 bp, Homo sapiens
tcattatagagttgtattttag

SEQ ID NO: 6953701 - DNA, 22 bp, Homo sapiens
agtacagatttagacacgatag

SEQ ID NO: 6953702 - DNA, 22 bp, Homo sapiens
gttggggtccaatgaagcgagc

SEQ ID NO: 6953703 - DNA, 22 bp, Homo sapiens
tgtctctggtattaggtgaaaa

SEQ ID NO: 6953704 - DNA, 23 bp, Homo sapiens
aggctgctgagatgggtgtgtca

SEQ ID NO: 6953705 - DNA, 22 bp, Homo sapiens
ggcaggtggtaaggatttcata

SEQ ID NO: 6953706 - DNA, 22 bp, Homo sapiens
ttgtttactaagaacctggtca

SEQ ID NO: 6953707 - DNA, 22 bp, Homo sapiens
caggagctcactgtctaatggg

SEQ ID NO: 6953708 - DNA, 22 bp, Homo sapiens
tgggttaatagaatcattaact

SEQ ID NO: 6953709 - DNA, 22 bp, Homo sapiens
gctccacaaataatggaacctg

SEQ ID NO: 6953710 - DNA, 22 bp, Homo sapiens
agagtaaataggagatgacagc

SEQ ID NO: 6953711 - DNA, 22 bp, Homo sapiens
gtggtcatcacggaaggaagat

SEQ ID NO: 6953712 - DNA, 22 bp, Homo sapiens
ttggtgagcctcttagcagcag

SEQ ID NO: 6953713 - DNA, 23 bp, Homo sapiens
gctcagaggtttttctctggatg

SEQ ID NO: 6953714 - DNA, 22 bp, Homo sapiens
acactgaatgctgtttagaaat

SEQ ID NO: 6953715 - DNA, 21 bp, Homo sapiens
gcattaaaagcagttgttggt

SEQ ID NO: 6953716 - DNA, 19 bp, Homo sapiens
ttccatctatcttcttact

SEQ ID NO: 6953717 - DNA, 22 bp, Homo sapiens
gcttttattgtctttacgacga

SEQ ID NO: 6953718 - DNA, 22 bp, Homo sapiens
agtgcagcagctgctccttaac

SEQ ID NO: 6953719 - DNA, 23 bp, Homo sapiens
tactatggttattatccctctcc

SEQ ID NO: 6953720 - DNA, 22 bp, Homo sapiens
agtcaggattttggattattcg

SEQ ID NO: 6953721 - DNA, 22 bp, Homo sapiens
tctgcctgtacctcttttttgc

SEQ ID NO: 6953722 - DNA, 22 bp, Homo sapiens
tgggcagtgagaaaggtcaggt

SEQ ID NO: 6953723 - DNA, 22 bp, Homo sapiens
ttcaggagtgtcaggagtgcct

SEQ ID NO: 6953724 - DNA, 22 bp, Homo sapiens
ccagaggaggggggtctttctg

SEQ ID NO: 6953725 - DNA, 22 bp, Homo sapiens
gactgctttgaccaatagcaca

SEQ ID NO: 6953726 - DNA, 22 bp, Homo sapiens
gggctactgagctggaactggg

SEQ ID NO: 6953727 - DNA, 22 bp, Homo sapiens
gtgaatgatagcttctctttgg

SEQ ID NO: 6953728 - DNA, 22 bp, Homo sapiens
tgtgctcagccaggggcaggcc

SEQ ID NO: 6953729 - DNA, 22 bp, Homo sapiens
cttctcctaaggtcagaattgc

SEQ ID NO: 6953730 - DNA, 22 bp, Homo sapiens
tgtggatgagggagtgaacaaa

SEQ ID NO: 6953731 - DNA, 22 bp, Homo sapiens
cagggcaggacagatacattac

SEQ ID NO: 6953732 - DNA, 22 bp, Homo sapiens
tataatttatcatgtcacagtt

SEQ ID NO: 6953733 - DNA, 22 bp, Homo sapiens
taacacatatttcaagagtagt

SEQ ID NO: 6953734 - DNA, 22 bp, Homo sapiens
gaatgtctatgtaaccgagggg

SEQ ID NO: 6953735 - DNA, 22 bp, Homo sapiens
gggagtcatgtggctaaatctc

SEQ ID NO: 6953736 - DNA, 22 bp, Homo sapiens
aagtatgctattacagtgtcat

SEQ ID NO: 6953737 - DNA, 22 bp, Homo sapiens
ttgtccttacctcaatctggaa

SEQ ID NO: 6953738 - DNA, 22 bp, Homo sapiens
aatagcaattacatttgcacca

SEQ ID NO: 6953739 - DNA, 22 bp, Homo sapiens
tctcacatcttcttggctttat

SEQ ID NO: 6953740 - DNA, 22 bp, Homo sapiens
ttaatggatgcggctgcgtgac

SEQ ID NO: 6953741 - DNA, 22 bp, Homo sapiens
tgatgttattagatacaaacca

SEQ ID NO: 6953742 - DNA, 22 bp, Homo sapiens
ccatgcccttgtcatctccagg

SEQ ID NO: 6953743 - DNA, 22 bp, Homo sapiens
cagaggctaagagtgtccaaag

SEQ ID NO: 6953744 - DNA, 22 bp, Homo sapiens
ctgtggaaggtttagataggta

SEQ ID NO: 6953745 - DNA, 22 bp, Homo sapiens
gttcaaccccttgatggtacag

SEQ ID NO: 6953746 - DNA, 22 bp, Homo sapiens
caaactgttctctgtgggattc

SEQ ID NO: 6953747 - DNA, 22 bp, Homo sapiens
tgtgatcacatctgggctgaag

SEQ ID NO: 6953748 - DNA, 19 bp, Homo sapiens
aagcatggtgcctcacctc

SEQ ID NO: 6953749 - DNA, 22 bp, Homo sapiens
atgtccagtacttctaaatggt

SEQ ID NO: 6953750 - DNA, 22 bp, Homo sapiens
tttgatatcctatacaagtaaa

SEQ ID NO: 6953751 - DNA, 22 bp, Homo sapiens
ttcttgttctggttctgttagc

SEQ ID NO: 6953752 - DNA, 22 bp, Homo sapiens
ttctggagggcatgctgctgcc

SEQ ID NO: 6953753 - DNA, 22 bp, Homo sapiens
gcactgtttatctaagtcttga

SEQ ID NO: 6953754 - DNA, 22 bp, Homo sapiens
agagctagaaggaagcatttct

SEQ ID NO: 6953755 - DNA, 21 bp, Homo sapiens
ttggagaagtgctatcagtat

SEQ ID NO: 6953756 - DNA, 22 bp, Homo sapiens
tggcaaaagttttaggttattt

SEQ ID NO: 6953757 - DNA, 22 bp, Homo sapiens
aaggcaggtattgatgccacag

SEQ ID NO: 6953758 - DNA, 22 bp, Homo sapiens
cccatggagtgcctgagggcca

SEQ ID NO: 6953759 - DNA, 22 bp, Homo sapiens
ctggatgtccttcccctgaagc

SEQ ID NO: 6953760 - DNA, 22 bp, Homo sapiens
gtgcctgtgcggactcagggaa

SEQ ID NO: 6953761 - DNA, 22 bp, Homo sapiens
attgaatgtcctttagtaaaaa

SEQ ID NO: 6953762 - DNA, 22 bp, Homo sapiens
aggtggctgaagagtgggtgag

SEQ ID NO: 6953763 - DNA, 22 bp, Homo sapiens
tagaacttccaattcagggctg

SEQ ID NO: 6953764 - DNA, 22 bp, Homo sapiens
aaaaagggatttgtgatccagg

SEQ ID NO: 6953765 - DNA, 22 bp, Homo sapiens
gtcaaggcagcagggcctgtgg

SEQ ID NO: 6953766 - DNA, 22 bp, Homo sapiens
tttactaagtacttgtatccct

SEQ ID NO: 6953767 - DNA, 22 bp, Homo sapiens
caagataatttattctgagttt

SEQ ID NO: 6953768 - DNA, 22 bp, Homo sapiens
tgtcacctttacccttttatag

SEQ ID NO: 6953769 - DNA, 22 bp, Homo sapiens
attcttgggatgggtgtcacaa

SEQ ID NO: 6953770 - DNA, 22 bp, Homo sapiens
aatgattgaggttatcgcagta

SEQ ID NO: 6953771 - DNA, 22 bp, Homo sapiens
ggcctcacccatcggtgccttt

SEQ ID NO: 6953772 - DNA, 22 bp, Homo sapiens
cctcctggttgcaatgaaatgg

SEQ ID NO: 6953773 - DNA, 22 bp, Homo sapiens
tagtacagtgctctgtaagttt

SEQ ID NO: 6953774 - DNA, 22 bp, Homo sapiens
aggcttcatgtagatggttccc

SEQ ID NO: 6953775 - DNA, 22 bp, Homo sapiens
agcactttgggagataaagctg

SEQ ID NO: 6953776 - DNA, 22 bp, Homo sapiens
gccagccaggaagaaagtaaga

SEQ ID NO: 6953777 - DNA, 22 bp, Homo sapiens
tctgaaatgacctttccccact

SEQ ID NO: 6953778 - DNA, 22 bp, Homo sapiens
atcccattttataccataagag

SEQ ID NO: 6953779 - DNA, 22 bp, Homo sapiens
agacacagctaccataatacca

SEQ ID NO: 6953780 - DNA, 22 bp, Homo sapiens
gctaggtgcagcagacagctta

SEQ ID NO: 6953781 - DNA, 21 bp, Homo sapiens
gggcatcctttcccaccctgc

SEQ ID NO: 6953782 - DNA, 22 bp, Homo sapiens
tagacaactggagatagtctga

SEQ ID NO: 6953783 - DNA, 22 bp, Homo sapiens
gccaggtcacctcactcatcca

SEQ ID NO: 6953784 - DNA, 20 bp, Homo sapiens
ctctgggctgcgttgcaaac

SEQ ID NO: 6953785 - DNA, 22 bp, Homo sapiens
ttggatctcatctaagtgcgtg

SEQ ID NO: 6953786 - DNA, 22 bp, Homo sapiens
gagtgtagttcattccgtccta

SEQ ID NO: 6953787 - DNA, 22 bp, Homo sapiens
ttcatgaaaaggtctatttctt

SEQ ID NO: 6953788 - DNA, 22 bp, Homo sapiens
ccagaagggctattgcagtgac

SEQ ID NO: 6953789 - DNA, 22 bp, Homo sapiens
attccagatgttactgaaaggc

SEQ ID NO: 6953790 - DNA, 22 bp, Homo sapiens
cttattcagatacagactcttg

SEQ ID NO: 6953791 - DNA, 22 bp, Homo sapiens
cacaggtgtttgttatactcag

SEQ ID NO: 6953792 - DNA, 22 bp, Homo sapiens
cagcttctcgggagcgcatgtg

SEQ ID NO: 6953793 - DNA, 22 bp, Homo sapiens
agagaaaagagttcaggctttg

SEQ ID NO: 6953794 - DNA, 22 bp, Homo sapiens
agattggtttcccacatagctg

SEQ ID NO: 6953795 - DNA, 22 bp, Homo sapiens
gggcagactggttatacacggg

SEQ ID NO: 6953796 - DNA, 20 bp, Homo sapiens
tggaggcagagccagaggga

SEQ ID NO: 6953797 - DNA, 22 bp, Homo sapiens
atgtggctagggaataaaatat

SEQ ID NO: 6953798 - DNA, 22 bp, Homo sapiens
tccaggctaattttgcattgtt

SEQ ID NO: 6953799 - DNA, 22 bp, Homo sapiens
aatcttgagtgttactctcatt

SEQ ID NO: 6953800 - DNA, 22 bp, Homo sapiens
gttccacaaagattgtctctct

SEQ ID NO: 6953801 - DNA, 22 bp, Homo sapiens
caagatgttaaaaccacccttg

SEQ ID NO: 6953802 - DNA, 22 bp, Homo sapiens
agaactattgcaataacaagaa

SEQ ID NO: 6953803 - DNA, 22 bp, Homo sapiens
cttacccttcatcagattttgg

SEQ ID NO: 6953804 - DNA, 22 bp, Homo sapiens
gttttgtgaggcacccacaggt

SEQ ID NO: 6953805 - DNA, 22 bp, Homo sapiens
cccagaggctgagttgggagca

SEQ ID NO: 6953806 - DNA, 22 bp, Homo sapiens
tgatggaaatttgggaagcttt

SEQ ID NO: 6953807 - DNA, 22 bp, Homo sapiens
cagtgctataatccagtgtcgt

SEQ ID NO: 6953808 - DNA, 22 bp, Homo sapiens
agccagggaaggataacaagaa

SEQ ID NO: 6953809 - DNA, 22 bp, Homo sapiens
agggttcagtccagggcctggg

SEQ ID NO: 6953810 - DNA, 22 bp, Homo sapiens
tgttatacagacacgatggtat

SEQ ID NO: 6953811 - DNA, 21 bp, Homo sapiens
tggaaaacatttaaatagcaa

SEQ ID NO: 6953812 - DNA, 22 bp, Homo sapiens
taactgatattgaaaaacatca

SEQ ID NO: 6953813 - DNA, 22 bp, Homo sapiens
ctttacacttggacccacactt

SEQ ID NO: 6953814 - DNA, 20 bp, Homo sapiens
acagccagaggaggcagaca

SEQ ID NO: 6953815 - DNA, 22 bp, Homo sapiens
gagttgttcaacgtgtgtgaaa

SEQ ID NO: 6953816 - DNA, 22 bp, Homo sapiens
gctcagggccatggaccagcag

SEQ ID NO: 6953817 - DNA, 22 bp, Homo sapiens
tactgttttctataatggctgt

SEQ ID NO: 6953818 - DNA, 16 bp, Homo sapiens
tggtggccatagttat

SEQ ID NO: 6953819 - DNA, 22 bp, Homo sapiens
tcattcaagatttcaatagatt

SEQ ID NO: 6953820 - DNA, 18 bp, Homo sapiens
ctttcagatggatatgct

SEQ ID NO: 6953821 - DNA, 22 bp, Homo sapiens
tgacatttgagagagatataca

SEQ ID NO: 6953822 - DNA, 22 bp, Homo sapiens
atttatgacgtgttcggtcaat

SEQ ID NO: 6953823 - DNA, 22 bp, Homo sapiens
caggagcaggcccaaggacaca

SEQ ID NO: 6953824 - DNA, 22 bp, Homo sapiens
tgacaggcactgctgtagtgct

SEQ ID NO: 6953825 - DNA, 22 bp, Homo sapiens
tcgtgctggatatagggctcta

SEQ ID NO: 6953826 - DNA, 22 bp, Homo sapiens
cagacctggggcctgggagccc

SEQ ID NO: 6953827 - DNA, 22 bp, Homo sapiens
aatgtcattgagctccaatcct

SEQ ID NO: 6953828 - DNA, 22 bp, Homo sapiens
agctatagtacttggcttttct

SEQ ID NO: 6953829 - DNA, 22 bp, Homo sapiens
agactttcgtgttatgttgcct

SEQ ID NO: 6953830 - DNA, 22 bp, Homo sapiens
gctggcagggttctcactgaaa

SEQ ID NO: 6953831 - DNA, 22 bp, Homo sapiens
gtaaatttcccgggccatttaa

SEQ ID NO: 6953832 - DNA, 22 bp, Homo sapiens
gtgggtccgcttggttccggtg

SEQ ID NO: 6953833 - DNA, 22 bp, Homo sapiens
tgcctgtgccctttgctgggag

SEQ ID NO: 6953834 - DNA, 19 bp, Homo sapiens
tctttggcttctggatcag

SEQ ID NO: 6953835 - DNA, 22 bp, Homo sapiens
tcctgtgagcagcacagagaca

SEQ ID NO: 6953836 - DNA, 22 bp, Homo sapiens
ttagaacaatattctccctaca

SEQ ID NO: 6953837 - DNA, 22 bp, Homo sapiens
gaaacagggagtagtaatttac

SEQ ID NO: 6953838 - DNA, 22 bp, Homo sapiens
tctgggtctatcccatgccttt

SEQ ID NO: 6953839 - DNA, 23 bp, Homo sapiens
tcaaaggaggcatcgttctgcag

SEQ ID NO: 6953840 - DNA, 22 bp, Homo sapiens
attcttaattgccatgctgtat

SEQ ID NO: 6953841 - DNA, 22 bp, Homo sapiens
gcctggctgccggccttggcaa

SEQ ID NO: 6953842 - DNA, 19 bp, Homo sapiens
tcaagcagtctgatttagg

SEQ ID NO: 6953843 - DNA, 18 bp, Homo sapiens
tggagggcttgctgcagc

SEQ ID NO: 6953844 - DNA, 22 bp, Homo sapiens
ccctgctcttagtgcctgtgtg

SEQ ID NO: 6953845 - DNA, 22 bp, Homo sapiens
tggccacccagctgacgccttc

SEQ ID NO: 6953846 - DNA, 22 bp, Homo sapiens
ggaagttgtatgatcggggaat

SEQ ID NO: 6953847 - DNA, 22 bp, Homo sapiens
gactttaaaagtttgtgcttgg

SEQ ID NO: 6953848 - DNA, 22 bp, Homo sapiens
cactgcaggtctgagatggggg

SEQ ID NO: 6953849 - DNA, 22 bp, Homo sapiens
tgagataactctgatttatgtt

SEQ ID NO: 6953850 - DNA, 19 bp, Homo sapiens
ctctgcttggtccatatgc

SEQ ID NO: 6953851 - DNA, 21 bp, Homo sapiens
ttacaaagctacagatgttgc

SEQ ID NO: 6953852 - DNA, 18 bp, Homo sapiens
gagaggagccagaatttt

SEQ ID NO: 6953853 - DNA, 22 bp, Homo sapiens
tcatgtaagagcttttgtgtca

SEQ ID NO: 6953854 - DNA, 22 bp, Homo sapiens
tatttctgtcagccagatatgg

SEQ ID NO: 6953855 - DNA, 22 bp, Homo sapiens
atcctgtgcaatgactgcatct

SEQ ID NO: 6953856 - DNA, 22 bp, Homo sapiens
tttactttctcaagtatatagg

SEQ ID NO: 6953857 - DNA, 22 bp, Homo sapiens
tgttctaaatttgcatggtcca

SEQ ID NO: 6953858 - DNA, 22 bp, Homo sapiens
ccacgctccctgatccctgctt

SEQ ID NO: 6953859 - DNA, 22 bp, Homo sapiens
atgcacccagtgtctggactat

SEQ ID NO: 6953860 - DNA, 22 bp, Homo sapiens
ccaggatactgctctctgctgc

SEQ ID NO: 6953861 - DNA, 22 bp, Homo sapiens
tgcaatatttggcactgagatg

SEQ ID NO: 6953862 - DNA, 22 bp, Homo sapiens
tgtagtcacaaaaactgtaagc

SEQ ID NO: 6953863 - DNA, 22 bp, Homo sapiens
gaggtatttttgcatgcctgat

SEQ ID NO: 6953864 - DNA, 19 bp, Homo sapiens
ctcctcagtcccagaggtc

SEQ ID NO: 6953865 - DNA, 22 bp, Homo sapiens
gctgttctaggagctgtgagca

SEQ ID NO: 6953866 - DNA, 22 bp, Homo sapiens
tgggatgggatctcgctgtgtc

SEQ ID NO: 6953867 - DNA, 22 bp, Homo sapiens
ggcccaaggcccaggtcgagct

SEQ ID NO: 6953868 - DNA, 22 bp, Homo sapiens
agttaggacccacacccaccag

SEQ ID NO: 6953869 - DNA, 22 bp, Homo sapiens
aggtcctgaagattttactaga

SEQ ID NO: 6953870 - DNA, 22 bp, Homo sapiens
ggctgggcagcagctgttaagc

SEQ ID NO: 6953871 - DNA, 21 bp, Homo sapiens
tacaaagggaaattctggctc

SEQ ID NO: 6953872 - DNA, 22 bp, Homo sapiens
tttccacactcactgcactcat

SEQ ID NO: 6953873 - DNA, 22 bp, Homo sapiens
tagtttgagaattgaaatagaa

SEQ ID NO: 6953874 - DNA, 22 bp, Homo sapiens
tgtgtcagaatttttgtggcaa

SEQ ID NO: 6953875 - DNA, 22 bp, Homo sapiens
ataagacacgcaaataggtacg

SEQ ID NO: 6953876 - DNA, 22 bp, Homo sapiens
gtttctaagggagagctgccag

SEQ ID NO: 6953877 - DNA, 22 bp, Homo sapiens
cgactctgcagggatccgggag

SEQ ID NO: 6953878 - DNA, 22 bp, Homo sapiens
catcaagatggaagagcaaata

SEQ ID NO: 6953879 - DNA, 22 bp, Homo sapiens
tgctgtcagttggcaggatgag

SEQ ID NO: 6953880 - DNA, 22 bp, Homo sapiens
caactgagcagtagcgtctgga

SEQ ID NO: 6953881 - DNA, 22 bp, Homo sapiens
ggttccccaggcggcccttgga

SEQ ID NO: 6953882 - DNA, 22 bp, Homo sapiens
agacgcttttataaagactcag

SEQ ID NO: 6953883 - DNA, 22 bp, Homo sapiens
ttaaagttcattaaatgagcca

SEQ ID NO: 6953884 - DNA, 22 bp, Homo sapiens
atggccttcatgatagaaggta

SEQ ID NO: 6953885 - DNA, 18 bp, Homo sapiens
gcctgctctgctctcccc

SEQ ID NO: 6953886 - DNA, 22 bp, Homo sapiens
atggctgctctggatggagtcc

SEQ ID NO: 6953887 - DNA, 22 bp, Homo sapiens
ttcatcaaaaggctgaggggaa

SEQ ID NO: 6953888 - DNA, 22 bp, Homo sapiens
tttatgctcatccaaggaaggt

SEQ ID NO: 6953889 - DNA, 22 bp, Homo sapiens
tctctgcatgacccaaggctga

SEQ ID NO: 6953890 - DNA, 22 bp, Homo sapiens
tggaaacctactgatacaggag

SEQ ID NO: 6953891 - DNA, 22 bp, Homo sapiens
ggctggtgagttcagagaaccc

SEQ ID NO: 6953892 - DNA, 23 bp, Homo sapiens
cctgtcaacaaggccccactgta

SEQ ID NO: 6953893 - DNA, 22 bp, Homo sapiens
acacattatctcattaaatact

SEQ ID NO: 6953894 - DNA, 22 bp, Homo sapiens
cttccagtagtatcattctcat

SEQ ID NO: 6953895 - DNA, 22 bp, Homo sapiens
tttctgatatactgtagaatcc

SEQ ID NO: 6953896 - DNA, 22 bp, Homo sapiens
tcagctgtgatccatctatcta

SEQ ID NO: 6953897 - DNA, 22 bp, Homo sapiens
tacaaacttgttttaagtaagt

SEQ ID NO: 6953898 - DNA, 17 bp, Homo sapiens
aaatcactgtcagttca

SEQ ID NO: 6953899 - DNA, 17 bp, Homo sapiens
agtaagtgtgtcacttc

SEQ ID NO: 6953900 - DNA, 22 bp, Homo sapiens
tgtgcggggaagggctcactca

SEQ ID NO: 6953901 - DNA, 22 bp, Homo sapiens
cagtccaagagagataaaatgg

SEQ ID NO: 6953902 - DNA, 19 bp, Homo sapiens
ctgacccaggacaccacgg

SEQ ID NO: 6953903 - DNA, 17 bp, Homo sapiens
ttctgaccctagagctc

SEQ ID NO: 6953904 - DNA, 22 bp, Homo sapiens
attggcagagctttacaggcta

SEQ ID NO: 6953905 - DNA, 22 bp, Homo sapiens
tgctgcttgcatccaccctggg

SEQ ID NO: 6953906 - DNA, 21 bp, Homo sapiens
agagtctgagtgtgcaagggc

SEQ ID NO: 6953907 - DNA, 22 bp, Homo sapiens
tctcagtgttgttctgcagatg

SEQ ID NO: 6953908 - DNA, 22 bp, Homo sapiens
gctgtctgtctctgtgacttaa

SEQ ID NO: 6953909 - DNA, 22 bp, Homo sapiens
caggatagaaaggccatggagt

SEQ ID NO: 6953910 - DNA, 22 bp, Homo sapiens
tctgagctaatcctgttgccga

SEQ ID NO: 6953911 - DNA, 22 bp, Homo sapiens
ctctgctagggctgaggtgttc

SEQ ID NO: 6953912 - DNA, 22 bp, Homo sapiens
cacagagacagaagcacttatg

SEQ ID NO: 6953913 - DNA, 22 bp, Homo sapiens
agatatatttaaggtaataagt

SEQ ID NO: 6953914 - DNA, 22 bp, Homo sapiens
caaatgatactgtttttagtct

SEQ ID NO: 6953915 - DNA, 22 bp, Homo sapiens
aatttcaagtcttgaagaagta

SEQ ID NO: 6953916 - DNA, 22 bp, Homo sapiens
tgcctttactataaaggatctg

SEQ ID NO: 6953917 - DNA, 21 bp, Homo sapiens
tctgtcatttgttagatgcaa

SEQ ID NO: 6953918 - DNA, 22 bp, Homo sapiens
aagggagcaaatggacagacgg

SEQ ID NO: 6953919 - DNA, 22 bp, Homo sapiens
tcgcagaccgcggtgcacgtgg

SEQ ID NO: 6953920 - DNA, 22 bp, Homo sapiens
aaggagctcttaaaatcagaga

SEQ ID NO: 6953921 - DNA, 22 bp, Homo sapiens
gaatgtctttttggtacttata

SEQ ID NO: 6953922 - DNA, 22 bp, Homo sapiens
tattggaatgcactgggagaga

SEQ ID NO: 6953923 - DNA, 22 bp, Homo sapiens
gtatttgatcattagaatgatt

SEQ ID NO: 6953924 - DNA, 22 bp, Homo sapiens
tgctgtttgagcttattttcag

SEQ ID NO: 6953925 - DNA, 22 bp, Homo sapiens
tttgagaagctgtcttgggctc

SEQ ID NO: 6953926 - DNA, 22 bp, Homo sapiens
gcctgggtggagaggggtgaca

SEQ ID NO: 6953927 - DNA, 22 bp, Homo sapiens
agagctttgtttgattgtcaga

SEQ ID NO: 6953928 - DNA, 22 bp, Homo sapiens
ccaggctagagagcagtggcat

SEQ ID NO: 6953929 - DNA, 22 bp, Homo sapiens
ggaaactaaatcaagctggctt

SEQ ID NO: 6953930 - DNA, 20 bp, Homo sapiens
tggtcctcacatgccatctt

SEQ ID NO: 6953931 - DNA, 22 bp, Homo sapiens
agttttaaatgatggtggtggt

SEQ ID NO: 6953932 - DNA, 18 bp, Homo sapiens
ggcagcctggacatgctc

SEQ ID NO: 6953933 - DNA, 22 bp, Homo sapiens
caaatcctgcagggcttagatg

SEQ ID NO: 6953934 - DNA, 22 bp, Homo sapiens
catacttactgtgtaccaggtg

SEQ ID NO: 6953935 - DNA, 21 bp, Homo sapiens
aattcccagaaacagcacaag

SEQ ID NO: 6953936 - DNA, 22 bp, Homo sapiens
tacacatgtttggcaagtatgt

SEQ ID NO: 6953937 - DNA, 22 bp, Homo sapiens
ctgtccagcttggctcctgggg

SEQ ID NO: 6953938 - DNA, 22 bp, Homo sapiens
ccccagtggttgcaacagcaga

SEQ ID NO: 6953939 - DNA, 22 bp, Homo sapiens
ctctgggtgtcttaggagctca

SEQ ID NO: 6953940 - DNA, 22 bp, Homo sapiens
gagtccaggatttgagctctgt

SEQ ID NO: 6953941 - DNA, 22 bp, Homo sapiens
ctgtgggagcactggggaccga

SEQ ID NO: 6953942 - DNA, 22 bp, Homo sapiens
tgccttgcttaacaagatggca

SEQ ID NO: 6953943 - DNA, 22 bp, Homo sapiens
tcccacccatcctgcatctctt

SEQ ID NO: 6953944 - DNA, 22 bp, Homo sapiens
gaattctgggagagatctgaca

SEQ ID NO: 6953945 - DNA, 22 bp, Homo sapiens
gtgctcaggaccaaatgaacca

SEQ ID NO: 6953946 - DNA, 22 bp, Homo sapiens
gaaaggctgcatctcgcctcag

SEQ ID NO: 6953947 - DNA, 22 bp, Homo sapiens
accataattacttggctttttc

SEQ ID NO: 6953948 - DNA, 22 bp, Homo sapiens
aaattttagtaaggaagttgag

SEQ ID NO: 6953949 - DNA, 22 bp, Homo sapiens
gccaccctgacgccgcagaccc

SEQ ID NO: 6953950 - DNA, 22 bp, Homo sapiens
caggagccccaggctgacaata

SEQ ID NO: 6953951 - DNA, 22 bp, Homo sapiens
ccatgctggagtccctagctgt

SEQ ID NO: 6953952 - DNA, 22 bp, Homo sapiens
ctcagactagcctgtaccgaca

SEQ ID NO: 6953953 - DNA, 18 bp, Homo sapiens
gctctggttccttcaacc

SEQ ID NO: 6953954 - DNA, 22 bp, Homo sapiens
gtggttgggatcatgggctatg

SEQ ID NO: 6953955 - DNA, 22 bp, Homo sapiens
tttgtactgttgaaattgctgg

SEQ ID NO: 6953956 - DNA, 22 bp, Homo sapiens
ctgggccctgaagacagtcagg

SEQ ID NO: 6953957 - DNA, 22 bp, Homo sapiens
tggcaaagtgactccttggggc

SEQ ID NO: 6953958 - DNA, 22 bp, Homo sapiens
atgaactacatgatcctgaaat

SEQ ID NO: 6953959 - DNA, 18 bp, Homo sapiens
agaggctggacaggggat

SEQ ID NO: 6953960 - DNA, 22 bp, Homo sapiens
aaacttttggtcctcatgggtt

SEQ ID NO: 6953961 - DNA, 22 bp, Homo sapiens
atctagcagtgttataattgga

SEQ ID NO: 6953962 - DNA, 22 bp, Homo sapiens
ggcactttgattttgagatgca

SEQ ID NO: 6953963 - DNA, 22 bp, Homo sapiens
caaagtcagccagctagtaggt

SEQ ID NO: 6953964 - DNA, 22 bp, Homo sapiens
agttacttgagacgtttatgaa

SEQ ID NO: 6953965 - DNA, 22 bp, Homo sapiens
ggcaggacattgactacagtga

SEQ ID NO: 6953966 - DNA, 22 bp, Homo sapiens
tgatttcctgtgcgcccttagg

SEQ ID NO: 6953967 - DNA, 22 bp, Homo sapiens
tcaggcttttcttccctcagtg

SEQ ID NO: 6953968 - DNA, 22 bp, Homo sapiens
acaggacagtctagtaacagta

SEQ ID NO: 6953969 - DNA, 22 bp, Homo sapiens
tataacaccatgttctacagat

SEQ ID NO: 6953970 - DNA, 22 bp, Homo sapiens
tgccatggattaagtgggtggc

SEQ ID NO: 6953971 - DNA, 22 bp, Homo sapiens
tgagggagcacacactgaagtg

SEQ ID NO: 6953972 - DNA, 22 bp, Homo sapiens
tgcagggcttcctcttggagtt

SEQ ID NO: 6953973 - DNA, 20 bp, Homo sapiens
gggatcttccaggctctcct

SEQ ID NO: 6953974 - DNA, 22 bp, Homo sapiens
atttcctgatctgtaaaatagc

SEQ ID NO: 6953975 - DNA, 23 bp, Homo sapiens
tggggttgaattgtagctgtgcc

SEQ ID NO: 6953976 - DNA, 23 bp, Homo sapiens
attgtttttggctctcagggaat

SEQ ID NO: 6953977 - DNA, 22 bp, Homo sapiens
gatttcaaaagtagatccatca

SEQ ID NO: 6953978 - DNA, 22 bp, Homo sapiens
taatagtcacatttaagtttgg

SEQ ID NO: 6953979 - DNA, 22 bp, Homo sapiens
ttcacaattaactttatactta

SEQ ID NO: 6953980 - DNA, 22 bp, Homo sapiens
agatggagtggagatgagtaaa

SEQ ID NO: 6953981 - DNA, 22 bp, Homo sapiens
tagatatgatgagtcacttgag

SEQ ID NO: 6953982 - DNA, 22 bp, Homo sapiens
aagttacagttacagaatggag

SEQ ID NO: 6953983 - DNA, 22 bp, Homo sapiens
agtgaggtggggtcacagggac

SEQ ID NO: 6953984 - DNA, 22 bp, Homo sapiens
atgtgcttggacattctaggaa

SEQ ID NO: 6953985 - DNA, 22 bp, Homo sapiens
aattcagagactcattctggag

SEQ ID NO: 6953986 - DNA, 22 bp, Homo sapiens
ttggagtcacaggagaagaatg

SEQ ID NO: 6953987 - DNA, 22 bp, Homo sapiens
tctttaagagttcatttgcatg

SEQ ID NO: 6953988 - DNA, 19 bp, Homo sapiens
gctgctggctctggctgga

SEQ ID NO: 6953989 - DNA, 22 bp, Homo sapiens
ctacatttggagagtataggaa

SEQ ID NO: 6953990 - DNA, 22 bp, Homo sapiens
tgaggatatagtggtaaacagt

SEQ ID NO: 6953991 - DNA, 22 bp, Homo sapiens
tgacagagtccagaagtagtgt

SEQ ID NO: 6953992 - DNA, 22 bp, Homo sapiens
ttacaaagtgttatgataaaca

SEQ ID NO: 6953993 - DNA, 21 bp, Homo sapiens
gggatctgaggcaagtctcct

SEQ ID NO: 6953994 - DNA, 22 bp, Homo sapiens
atgtgggccgtgcgggtgtcct

SEQ ID NO: 6953995 - DNA, 22 bp, Homo sapiens
tctatagatcagtaaatatctc

SEQ ID NO: 6953996 - DNA, 20 bp, Homo sapiens
aaagcagtatgcaagtagag

SEQ ID NO: 6953997 - DNA, 22 bp, Homo sapiens
atgttacagaaagcaaagatga

SEQ ID NO: 6953998 - DNA, 22 bp, Homo sapiens
tgacccaagtagtgccttttct

SEQ ID NO: 6953999 - DNA, 22 bp, Homo sapiens
tacctaggctctgatctcctgg

SEQ ID NO: 6954000 - DNA, 22 bp, Homo sapiens
gtgctggctgccaggaggctgc

SEQ ID NO: 6954001 - DNA, 22 bp, Homo sapiens
gccagctggctgcaggtcccag

SEQ ID NO: 6954002 - DNA, 22 bp, Homo sapiens
gcatggccttgctgtagtggta

SEQ ID NO: 6954003 - DNA, 22 bp, Homo sapiens
tatatgtgcagcatttttaatt

SEQ ID NO: 6954004 - DNA, 22 bp, Homo sapiens
gtttgcagggagagatgtggtg

SEQ ID NO: 6954005 - DNA, 22 bp, Homo sapiens
tctggccacccgaggcccctgc

SEQ ID NO: 6954006 - DNA, 22 bp, Homo sapiens
gtcctgctctggcccaggtttg

SEQ ID NO: 6954007 - DNA, 22 bp, Homo sapiens
cagccactgacaggaatggtcc

SEQ ID NO: 6954008 - DNA, 22 bp, Homo sapiens
gtttacacataactcctatcaa

SEQ ID NO: 6954009 - DNA, 22 bp, Homo sapiens
ttccttagcctgccttccaggg

SEQ ID NO: 6954010 - DNA, 22 bp, Homo sapiens
ggcattagacggggacatctgc

SEQ ID NO: 6954011 - DNA, 22 bp, Homo sapiens
attttctaagcctgtcagactt

SEQ ID NO: 6954012 - DNA, 22 bp, Homo sapiens
ttgcagatcagctttcattgtc

SEQ ID NO: 6954013 - DNA, 22 bp, Homo sapiens
ttgcttcctggatgtgactttg

SEQ ID NO: 6954014 - DNA, 21 bp, Homo sapiens
cctggctctgtgtttattatg

SEQ ID NO: 6954015 - DNA, 22 bp, Homo sapiens
gccagctagctagttgctgggt

SEQ ID NO: 6954016 - DNA, 22 bp, Homo sapiens
tctgaataatgtccttgtatca

SEQ ID NO: 6954017 - DNA, 22 bp, Homo sapiens
taaggccaagttcatatacaac

SEQ ID NO: 6954018 - DNA, 22 bp, Homo sapiens
cagaaaacctgactctagaact

SEQ ID NO: 6954019 - DNA, 22 bp, Homo sapiens
gcagtggggcaatcatagctca

SEQ ID NO: 6954020 - DNA, 22 bp, Homo sapiens
gcagtggcccagcttgcaggct

SEQ ID NO: 6954021 - DNA, 22 bp, Homo sapiens
agccctctccaccttcgaaaaa

SEQ ID NO: 6954022 - DNA, 22 bp, Homo sapiens
tctactgcactggtgtctcatc

SEQ ID NO: 6954023 - DNA, 23 bp, Homo sapiens
gggaagtgaggagcccctcagcc

SEQ ID NO: 6954024 - DNA, 22 bp, Homo sapiens
acctgggagtatgcagtggtga

SEQ ID NO: 6954025 - DNA, 22 bp, Homo sapiens
agctggaagctgatgagcacag

SEQ ID NO: 6954026 - DNA, 22 bp, Homo sapiens
aacaattactaccaaggcctgt

SEQ ID NO: 6954027 - DNA, 22 bp, Homo sapiens
acagccagggtctcaggaggcg

SEQ ID NO: 6954028 - DNA, 22 bp, Homo sapiens
acattgaaccagtagacacaaa

SEQ ID NO: 6954029 - DNA, 22 bp, Homo sapiens
tggagccactcactatctgagt

SEQ ID NO: 6954030 - DNA, 22 bp, Homo sapiens
ttctgtatattgaggttatagt

SEQ ID NO: 6954031 - DNA, 22 bp, Homo sapiens
tgggatgctcagggcctggagc

SEQ ID NO: 6954032 - DNA, 22 bp, Homo sapiens
aacagtttatgagatatgctat

SEQ ID NO: 6954033 - DNA, 22 bp, Homo sapiens
gggagctggcggattccccagg

SEQ ID NO: 6954034 - DNA, 21 bp, Homo sapiens
acagggcatgcagctggctgt

SEQ ID NO: 6954035 - DNA, 22 bp, Homo sapiens
ggcaggcatcatgtggtcatta

SEQ ID NO: 6954036 - DNA, 22 bp, Homo sapiens
ttgtgtgtactggttatgggca

SEQ ID NO: 6954037 - DNA, 21 bp, Homo sapiens
gccagggagttaaagagtctt

SEQ ID NO: 6954038 - DNA, 22 bp, Homo sapiens
gctgggccagagcagcagcact

SEQ ID NO: 6954039 - DNA, 22 bp, Homo sapiens
tctggcagctctcctcggcgga

SEQ ID NO: 6954040 - DNA, 22 bp, Homo sapiens
tgtggcatggttgcaaggacaa

SEQ ID NO: 6954041 - DNA, 22 bp, Homo sapiens
tttttctgagcggtaatcatca

SEQ ID NO: 6954042 - DNA, 22 bp, Homo sapiens
catggccaggccaagagagtac

SEQ ID NO: 6954043 - DNA, 22 bp, Homo sapiens
gggcctgttctgattggcagat

SEQ ID NO: 6954044 - DNA, 22 bp, Homo sapiens
acagccttgtagcatcttagcc

SEQ ID NO: 6954045 - DNA, 22 bp, Homo sapiens
tctttacttgtgtattgtatat

SEQ ID NO: 6954046 - DNA, 22 bp, Homo sapiens
gctggaaatgattaaatggtga

SEQ ID NO: 6954047 - DNA, 22 bp, Homo sapiens
tggtcgtgccctcagctctcta

SEQ ID NO: 6954048 - DNA, 23 bp, Homo sapiens
cccatttgctcacaggacagcag

SEQ ID NO: 6954049 - DNA, 22 bp, Homo sapiens
actggctctgtgatctatgatt

SEQ ID NO: 6954050 - DNA, 22 bp, Homo sapiens
aactgcagttaacaagtcttca

SEQ ID NO: 6954051 - DNA, 22 bp, Homo sapiens
ttccaaggattgaaatgtagtc

SEQ ID NO: 6954052 - DNA, 22 bp, Homo sapiens
acacatatatacatatttgtgc

SEQ ID NO: 6954053 - DNA, 22 bp, Homo sapiens
actggctgagtttatgttcaca

SEQ ID NO: 6954054 - DNA, 22 bp, Homo sapiens
tggcttctttccactgtcctgt

SEQ ID NO: 6954055 - DNA, 22 bp, Homo sapiens
ctggggctgcggacgggagccc

SEQ ID NO: 6954056 - DNA, 19 bp, Homo sapiens
tgtgtgcaaatggaagcca

SEQ ID NO: 6954057 - DNA, 22 bp, Homo sapiens
ttcattggctaaagacctggga

SEQ ID NO: 6954058 - DNA, 22 bp, Homo sapiens
cggctgagcagtgctgatggaa

SEQ ID NO: 6954059 - DNA, 22 bp, Homo sapiens
aaacactgatggatatttttcc

SEQ ID NO: 6954060 - DNA, 23 bp, Homo sapiens
tgccttagttagcacatttctaa

SEQ ID NO: 6954061 - DNA, 22 bp, Homo sapiens
tttgctttgtttaaaagtggta

SEQ ID NO: 6954062 - DNA, 22 bp, Homo sapiens
acagaatattggttactgttgc

SEQ ID NO: 6954063 - DNA, 22 bp, Homo sapiens
ctctggaggttgagcccagcaa

SEQ ID NO: 6954064 - DNA, 22 bp, Homo sapiens
tgacatacttttagatagatgg

SEQ ID NO: 6954065 - DNA, 22 bp, Homo sapiens
ggagggtggcagcgtcctgggc

SEQ ID NO: 6954066 - DNA, 22 bp, Homo sapiens
tcacatgtcagaataagtgcat

SEQ ID NO: 6954067 - DNA, 23 bp, Homo sapiens
ttctacagcttcttcagttaagg

SEQ ID NO: 6954068 - DNA, 22 bp, Homo sapiens
ctgcttaatttaatagttgcaa

SEQ ID NO: 6954069 - DNA, 22 bp, Homo sapiens
ttgggaagtaatatggtggtct

SEQ ID NO: 6954070 - DNA, 22 bp, Homo sapiens
atgcgtagaaagaaggtggcct

SEQ ID NO: 6954071 - DNA, 22 bp, Homo sapiens
ttgctcaggctggtgtgcagtg

SEQ ID NO: 6954072 - DNA, 22 bp, Homo sapiens
tgtccagttttctataaggttc

SEQ ID NO: 6954073 - DNA, 22 bp, Homo sapiens
tccaggaggaggaaggctgcca

SEQ ID NO: 6954074 - DNA, 22 bp, Homo sapiens
ttcattcattcatgaatgttaa

SEQ ID NO: 6954075 - DNA, 22 bp, Homo sapiens
agatgccttttatttattgtca

SEQ ID NO: 6954076 - DNA, 22 bp, Homo sapiens
tggagagctatttggacctcca

SEQ ID NO: 6954077 - DNA, 22 bp, Homo sapiens
tttattaagatgcgaatgctga

SEQ ID NO: 6954078 - DNA, 22 bp, Homo sapiens
gcagaatagtgactttccttaa

SEQ ID NO: 6954079 - DNA, 22 bp, Homo sapiens
tagagcttgattggattcaggg

SEQ ID NO: 6954080 - DNA, 22 bp, Homo sapiens
ttattcagcagggacttccttt

SEQ ID NO: 6954081 - DNA, 22 bp, Homo sapiens
tgaggcctggactctgcatgga

SEQ ID NO: 6954082 - DNA, 21 bp, Homo sapiens
aggatggaaaggactaggggt

SEQ ID NO: 6954083 - DNA, 20 bp, Homo sapiens
ggcagttaaggcacagtcat

SEQ ID NO: 6954084 - DNA, 22 bp, Homo sapiens
atggctgcttcagtaccagttc

SEQ ID NO: 6954085 - DNA, 22 bp, Homo sapiens
gaatgttattgaactacgagct

SEQ ID NO: 6954086 - DNA, 20 bp, Homo sapiens
cctgtgtggccagctgaggc

SEQ ID NO: 6954087 - DNA, 22 bp, Homo sapiens
agtttgatttgtctatcttcat

SEQ ID NO: 6954088 - DNA, 22 bp, Homo sapiens
tgtgtgtgtttacagtttctca

SEQ ID NO: 6954089 - DNA, 22 bp, Homo sapiens
ctgggagaggctgctccgctct

SEQ ID NO: 6954090 - DNA, 22 bp, Homo sapiens
taatacaaggcaggaagcagta

SEQ ID NO: 6954091 - DNA, 22 bp, Homo sapiens
tgtatctgtttagcacccagcc

SEQ ID NO: 6954092 - DNA, 22 bp, Homo sapiens
atttcaacacttttggaattag

SEQ ID NO: 6954093 - DNA, 22 bp, Homo sapiens
tcaggaagctactgccagcagc

SEQ ID NO: 6954094 - DNA, 22 bp, Homo sapiens
ccttttatatggctcatcacag

SEQ ID NO: 6954095 - DNA, 22 bp, Homo sapiens
tggcagtagatccagtctctct

SEQ ID NO: 6954096 - DNA, 22 bp, Homo sapiens
aggcatctgcagagcttggtga

SEQ ID NO: 6954097 - DNA, 22 bp, Homo sapiens
cagtccttagattttactgcca

SEQ ID NO: 6954098 - DNA, 22 bp, Homo sapiens
tctaccatgtgctgtgcattgg

SEQ ID NO: 6954099 - DNA, 21 bp, Homo sapiens
agacagagtgcagtctacata

SEQ ID NO: 6954100 - DNA, 22 bp, Homo sapiens
gagcagttgggctctaggaagt

SEQ ID NO: 6954101 - DNA, 22 bp, Homo sapiens
tttaggcagaagccctgctgat

SEQ ID NO: 6954102 - DNA, 22 bp, Homo sapiens
gcagcagcccagggctctcaga

SEQ ID NO: 6954103 - DNA, 22 bp, Homo sapiens
tgccaggcatgtagtagacttg

SEQ ID NO: 6954104 - DNA, 21 bp, Homo sapiens
ttggcctttgtctcagacact

SEQ ID NO: 6954105 - DNA, 22 bp, Homo sapiens
gcctggcactgggctcctggcc

SEQ ID NO: 6954106 - DNA, 22 bp, Homo sapiens
agcaacccgtccttgggggact

SEQ ID NO: 6954107 - DNA, 22 bp, Homo sapiens
tgcatggtgtaattctaatgct

SEQ ID NO: 6954108 - DNA, 22 bp, Homo sapiens
agctattgtgtgcccagcagga

SEQ ID NO: 6954109 - DNA, 15 bp, Homo sapiens
agctctttcagctac

SEQ ID NO: 6954110 - DNA, 22 bp, Homo sapiens
ttgagaaacagattggcaccgt

SEQ ID NO: 6954111 - DNA, 22 bp, Homo sapiens
tcaccgaggctggagtgcagtg

SEQ ID NO: 6954112 - DNA, 22 bp, Homo sapiens
tcttgattcatgttccctgcat

SEQ ID NO: 6954113 - DNA, 22 bp, Homo sapiens
acagctttagtgtgggtggtgc

SEQ ID NO: 6954114 - DNA, 22 bp, Homo sapiens
gacagtgattagttactataaa

SEQ ID NO: 6954115 - DNA, 20 bp, Homo sapiens
attttggtgaacacagcttc

SEQ ID NO: 6954116 - DNA, 22 bp, Homo sapiens
tctgtctgtccagggcccccgc

SEQ ID NO: 6954117 - DNA, 22 bp, Homo sapiens
agccgcgccccatctgagtggg

SEQ ID NO: 6954118 - DNA, 22 bp, Homo sapiens
ccctggaagagcctgggcatgg

SEQ ID NO: 6954119 - DNA, 22 bp, Homo sapiens
tgtccatccagatgggaggaga

SEQ ID NO: 6954120 - DNA, 22 bp, Homo sapiens
aacaaagccctgcccaagagct

SEQ ID NO: 6954121 - DNA, 22 bp, Homo sapiens
tgcaaatacaaaatggtacagc

SEQ ID NO: 6954122 - DNA, 22 bp, Homo sapiens
cagctgcaggctgtgcaggaag

SEQ ID NO: 6954123 - DNA, 22 bp, Homo sapiens
ggcaggtgggaaccctccccac

SEQ ID NO: 6954124 - DNA, 22 bp, Homo sapiens
ggctggcttgccaagctcaggg

SEQ ID NO: 6954125 - DNA, 22 bp, Homo sapiens
ccctgaggggagtggtgaggtg

SEQ ID NO: 6954126 - DNA, 22 bp, Homo sapiens
cctggtgggcaggagtgagacc

SEQ ID NO: 6954127 - DNA, 22 bp, Homo sapiens
aagccttcctgagtgcaaggcc

SEQ ID NO: 6954128 - DNA, 22 bp, Homo sapiens
tagtgttctaagaacatccatg

SEQ ID NO: 6954129 - DNA, 22 bp, Homo sapiens
tagtgtatccagtcattcaagg

SEQ ID NO: 6954130 - DNA, 22 bp, Homo sapiens
ggctctgctcacagcccgcagc

SEQ ID NO: 6954131 - DNA, 22 bp, Homo sapiens
cagctgagagtagaaatggagg

SEQ ID NO: 6954132 - DNA, 22 bp, Homo sapiens
gctgctctcagagctcatgctg

SEQ ID NO: 6954133 - DNA, 22 bp, Homo sapiens
ctgcatgtggtgcaggtgcccc

SEQ ID NO: 6954134 - DNA, 22 bp, Homo sapiens
gggagctggatcgcgcgcccgg

SEQ ID NO: 6954135 - DNA, 22 bp, Homo sapiens
caaggctagaagtccaacatca

SEQ ID NO: 6954136 - DNA, 22 bp, Homo sapiens
tcccagcccagatttgtgtgac

SEQ ID NO: 6954137 - DNA, 22 bp, Homo sapiens
tgtgtcctactgaggagctcct

SEQ ID NO: 6954138 - DNA, 16 bp, Homo sapiens
gggtccagatctgctc

SEQ ID NO: 6954139 - DNA, 22 bp, Homo sapiens
tggcagcagacaaaaggccatt

SEQ ID NO: 6954140 - DNA, 22 bp, Homo sapiens
ctgcacacatatggcttctctc

SEQ ID NO: 6954141 - DNA, 22 bp, Homo sapiens
gtgatgtcagcaagaataggaa

SEQ ID NO: 6954142 - DNA, 18 bp, Homo sapiens
tctgtctctgtccttgct

SEQ ID NO: 6954143 - DNA, 22 bp, Homo sapiens
ggtccctgaagaggcctggggt

SEQ ID NO: 6954144 - DNA, 22 bp, Homo sapiens
tggaggcatgacagtgtctgga

SEQ ID NO: 6954145 - DNA, 20 bp, Homo sapiens
tctgtgcattgcctgctggt

SEQ ID NO: 6954146 - DNA, 22 bp, Homo sapiens
aacaggaatgaggagaaaaggt

SEQ ID NO: 6954147 - DNA, 22 bp, Homo sapiens
ccttgtcctctggtttcctgtt

SEQ ID NO: 6954148 - DNA, 22 bp, Homo sapiens
gcattctagacagctacagaaa

SEQ ID NO: 6954149 - DNA, 22 bp, Homo sapiens
tgtctgtctccctgtgggcccc

SEQ ID NO: 6954150 - DNA, 22 bp, Homo sapiens
actctctggtattggcaagttt

SEQ ID NO: 6954151 - DNA, 22 bp, Homo sapiens
tcaggagtactggtgtctacag

SEQ ID NO: 6954152 - DNA, 22 bp, Homo sapiens
caaggcatactcctttctcagc

SEQ ID NO: 6954153 - DNA, 22 bp, Homo sapiens
attctagaaaccagggaggcat

SEQ ID NO: 6954154 - DNA, 22 bp, Homo sapiens
ttcttagagatggttaaaaata

SEQ ID NO: 6954155 - DNA, 22 bp, Homo sapiens
aacagcataccaatgtacatat

SEQ ID NO: 6954156 - DNA, 22 bp, Homo sapiens
tcatggaatagagcagtggcaa

SEQ ID NO: 6954157 - DNA, 22 bp, Homo sapiens
gttatctagaccaaaagcctaa

SEQ ID NO: 6954158 - DNA, 22 bp, Homo sapiens
gccccgcgcctggctccaggtg

SEQ ID NO: 6954159 - DNA, 22 bp, Homo sapiens
tttggtccctccctgcagctca

SEQ ID NO: 6954160 - DNA, 19 bp, Homo sapiens
tggaggccaggacacaggt

SEQ ID NO: 6954161 - DNA, 22 bp, Homo sapiens
cttggcccggagccccatgaag

SEQ ID NO: 6954162 - DNA, 22 bp, Homo sapiens
ctctcaaatgtcattcctctat

SEQ ID NO: 6954163 - DNA, 18 bp, Homo sapiens
tccaaaggtcccctccca

SEQ ID NO: 6954164 - DNA, 22 bp, Homo sapiens
tcctcaaagttgtataaatatt

SEQ ID NO: 6954165 - DNA, 22 bp, Homo sapiens
ggctgtttttatagagtccata

SEQ ID NO: 6954166 - DNA, 22 bp, Homo sapiens
agatctgagtatgatttgcctg

SEQ ID NO: 6954167 - DNA, 22 bp, Homo sapiens
ccaaggcatatggctgaaacca

SEQ ID NO: 6954168 - DNA, 22 bp, Homo sapiens
catgtctttctcatcacatcta

SEQ ID NO: 6954169 - DNA, 22 bp, Homo sapiens
atgcctgcttactccaggtgct

SEQ ID NO: 6954170 - DNA, 22 bp, Homo sapiens
ggatttacaagtttaactctca

SEQ ID NO: 6954171 - DNA, 22 bp, Homo sapiens
tcatctgtggctgcttttgtgc

SEQ ID NO: 6954172 - DNA, 22 bp, Homo sapiens
agcactttagaatttagagttg

SEQ ID NO: 6954173 - DNA, 22 bp, Homo sapiens
tgggcagactgagccctgtccc

SEQ ID NO: 6954174 - DNA, 22 bp, Homo sapiens
cctgcctgcggcccgcggggag

SEQ ID NO: 6954175 - DNA, 23 bp, Homo sapiens
tctccctcatgcctaggcctggg

SEQ ID NO: 6954176 - DNA, 22 bp, Homo sapiens
tgtaattcattcaactgaagaa

SEQ ID NO: 6954177 - DNA, 22 bp, Homo sapiens
aggcggctggtgtcctgcaggt

SEQ ID NO: 6954178 - DNA, 22 bp, Homo sapiens
atacaggtggacttcagttagt

SEQ ID NO: 6954179 - DNA, 17 bp, Homo sapiens
ccaggagagatgcttgt

SEQ ID NO: 6954180 - DNA, 22 bp, Homo sapiens
ttcagaggggctaagtacttgc

SEQ ID NO: 6954181 - DNA, 22 bp, Homo sapiens
gagtaaatgtcactgttgctgt

SEQ ID NO: 6954182 - DNA, 22 bp, Homo sapiens
gtattagcaagagttgtgattt

SEQ ID NO: 6954183 - DNA, 22 bp, Homo sapiens
actagaaattactcagaataaa

SEQ ID NO: 6954184 - DNA, 22 bp, Homo sapiens
aagagttatataatgtgtagtt

SEQ ID NO: 6954185 - DNA, 22 bp, Homo sapiens
tgaaacagattgatggtttcta

SEQ ID NO: 6954186 - DNA, 22 bp, Homo sapiens
gtcctctgagggggctgcacgc

SEQ ID NO: 6954187 - DNA, 22 bp, Homo sapiens
atcctgtggggcggctgcaggg

SEQ ID NO: 6954188 - DNA, 22 bp, Homo sapiens
acaaagtaagggctaatgagca

SEQ ID NO: 6954189 - DNA, 22 bp, Homo sapiens
tcatttgttctcattctctact

SEQ ID NO: 6954190 - DNA, 22 bp, Homo sapiens
tgagtgctttaaatgttatttt

SEQ ID NO: 6954191 - DNA, 22 bp, Homo sapiens
ataaagcatctagtctgtcact

SEQ ID NO: 6954192 - DNA, 22 bp, Homo sapiens
tgtgtgctaatgtatgctctaa

SEQ ID NO: 6954193 - DNA, 22 bp, Homo sapiens
agaaatgaagagagtcaaggtt

SEQ ID NO: 6954194 - DNA, 22 bp, Homo sapiens
aggcatcaggagtatagccaga

SEQ ID NO: 6954195 - DNA, 22 bp, Homo sapiens
ttaagcatttattatgtgccag

SEQ ID NO: 6954196 - DNA, 22 bp, Homo sapiens
ggggttaacagtattgctcatg

SEQ ID NO: 6954197 - DNA, 22 bp, Homo sapiens
cctcatggccttgagctgaggg

SEQ ID NO: 6954198 - DNA, 22 bp, Homo sapiens
gggtgctatccgtcctccctcc

SEQ ID NO: 6954199 - DNA, 22 bp, Homo sapiens
atgagcatgtgactcaaaccaa

SEQ ID NO: 6954200 - DNA, 22 bp, Homo sapiens
tggctctggtaacattgggtag

SEQ ID NO: 6954201 - DNA, 22 bp, Homo sapiens
tagatttgcctgggaaagctca

SEQ ID NO: 6954202 - DNA, 22 bp, Homo sapiens
tgttatttatctgagcatttat

SEQ ID NO: 6954203 - DNA, 22 bp, Homo sapiens
cctgctgtctctgggcaggcag

SEQ ID NO: 6954204 - DNA, 22 bp, Homo sapiens
ggagaaagtacagcaggcaaca

SEQ ID NO: 6954205 - DNA, 22 bp, Homo sapiens
ccatgcattcctgctctgcgca

SEQ ID NO: 6954206 - DNA, 22 bp, Homo sapiens
tgaattcaggggctattatatt

SEQ ID NO: 6954207 - DNA, 22 bp, Homo sapiens
ttagtctccagcttagggtttg

SEQ ID NO: 6954208 - DNA, 22 bp, Homo sapiens
tcatcctggagaagctccttcg

SEQ ID NO: 6954209 - DNA, 22 bp, Homo sapiens
ggtctcagaggtttctgctcag

SEQ ID NO: 6954210 - DNA, 22 bp, Homo sapiens
aatagacattatttctctatga

SEQ ID NO: 6954211 - DNA, 22 bp, Homo sapiens
tgagaatttgcatttctaacaa

SEQ ID NO: 6954212 - DNA, 22 bp, Homo sapiens
gacagaatcatctcctgggact

SEQ ID NO: 6954213 - DNA, 22 bp, Homo sapiens
attaacagcagcatccccagcc

SEQ ID NO: 6954214 - DNA, 22 bp, Homo sapiens
caggacattgatccattggcac

SEQ ID NO: 6954215 - DNA, 22 bp, Homo sapiens
agaagggaactcagagatgatt

SEQ ID NO: 6954216 - DNA, 22 bp, Homo sapiens
gcagaggctgtagggaaggttg

SEQ ID NO: 6954217 - DNA, 22 bp, Homo sapiens
tttggctcatctcagtcctagg

SEQ ID NO: 6954218 - DNA, 22 bp, Homo sapiens
cacccttcagctttcttagctc

SEQ ID NO: 6954219 - DNA, 22 bp, Homo sapiens
tatatgactgtattatgctttt

SEQ ID NO: 6954220 - DNA, 22 bp, Homo sapiens
ctgggtcctgctctccctaaga

SEQ ID NO: 6954221 - DNA, 22 bp, Homo sapiens
agtttaactttgtaaacgtgag

SEQ ID NO: 6954222 - DNA, 22 bp, Homo sapiens
tggcagtcattatcgctgagtc

SEQ ID NO: 6954223 - DNA, 20 bp, Homo sapiens
caaggggagtagtatgggcc

SEQ ID NO: 6954224 - DNA, 22 bp, Homo sapiens
tgaggcagcattcttcaagaca

SEQ ID NO: 6954225 - DNA, 22 bp, Homo sapiens
catttctatggcaatgggaaaa

SEQ ID NO: 6954226 - DNA, 22 bp, Homo sapiens
aacttccagctttctgtctaat

SEQ ID NO: 6954227 - DNA, 22 bp, Homo sapiens
agtgtctgcctgggaggagcat

SEQ ID NO: 6954228 - DNA, 20 bp, Homo sapiens
agtcacagtatcagtcttag

SEQ ID NO: 6954229 - DNA, 22 bp, Homo sapiens
gctctgagtcacactgccctgt

SEQ ID NO: 6954230 - DNA, 22 bp, Homo sapiens
caggggagttttatgcaacaga

SEQ ID NO: 6954231 - DNA, 22 bp, Homo sapiens
ggcttcctgggcatgtgttcta

SEQ ID NO: 6954232 - DNA, 21 bp, Homo sapiens
ccctggaatcctgagtgccag

SEQ ID NO: 6954233 - DNA, 17 bp, Homo sapiens
acacatacatgggccat

SEQ ID NO: 6954234 - DNA, 22 bp, Homo sapiens
gaagcagcgaagtggaagggac

SEQ ID NO: 6954235 - DNA, 22 bp, Homo sapiens
atctggctatttctggtcgggg

SEQ ID NO: 6954236 - DNA, 22 bp, Homo sapiens
atgcatacagatttaaaatttt

SEQ ID NO: 6954237 - DNA, 22 bp, Homo sapiens
agctgccaagttggagtagcaa

SEQ ID NO: 6954238 - DNA, 22 bp, Homo sapiens
gcagccaggtttgaggaccact

SEQ ID NO: 6954239 - DNA, 22 bp, Homo sapiens
tatattcaatgattagtatcag

SEQ ID NO: 6954240 - DNA, 22 bp, Homo sapiens
tttggttgtatcattctatgaa

SEQ ID NO: 6954241 - DNA, 22 bp, Homo sapiens
agtacatgcagaactaacagat

SEQ ID NO: 6954242 - DNA, 22 bp, Homo sapiens
cgattttgtggcaaattcttct

SEQ ID NO: 6954243 - DNA, 22 bp, Homo sapiens
gggtcagggctggctgtcgtca

SEQ ID NO: 6954244 - DNA, 22 bp, Homo sapiens
tgttttggaacaaaagctattc

SEQ ID NO: 6954245 - DNA, 22 bp, Homo sapiens
atgtgtatttccatcgatcagc

SEQ ID NO: 6954246 - DNA, 22 bp, Homo sapiens
tcttagcagacttggctactgt

SEQ ID NO: 6954247 - DNA, 22 bp, Homo sapiens
gtgtttgtttagtgcagagaga

SEQ ID NO: 6954248 - DNA, 22 bp, Homo sapiens
agtccgtttctccttgaaggca

SEQ ID NO: 6954249 - DNA, 22 bp, Homo sapiens
acagttatctttgaaatagaga

SEQ ID NO: 6954250 - DNA, 22 bp, Homo sapiens
tagagctactggcagcctcttc

SEQ ID NO: 6954251 - DNA, 22 bp, Homo sapiens
gcttcacaacttcttaattctt

SEQ ID NO: 6954252 - DNA, 22 bp, Homo sapiens
ccagtgatgataggaagaccct

SEQ ID NO: 6954253 - DNA, 22 bp, Homo sapiens
ggcagtgaacagaaatgcagaa

SEQ ID NO: 6954254 - DNA, 21 bp, Homo sapiens
aaagatgtttcatctgagaaa

SEQ ID NO: 6954255 - DNA, 22 bp, Homo sapiens
aattagactaattttacaaggg

SEQ ID NO: 6954256 - DNA, 22 bp, Homo sapiens
cgtccagattcagcccctagag

SEQ ID NO: 6954257 - DNA, 22 bp, Homo sapiens
gctgtctgagaacatggtggaa

SEQ ID NO: 6954258 - DNA, 22 bp, Homo sapiens
agtttccactggagacactgtg

SEQ ID NO: 6954259 - DNA, 22 bp, Homo sapiens
catcagtgtgttgccttgctca

SEQ ID NO: 6954260 - DNA, 22 bp, Homo sapiens
cttacaacttgtatgtgattgt

SEQ ID NO: 6954261 - DNA, 23 bp, Homo sapiens
tctgatgttctcttatgctgtag

SEQ ID NO: 6954262 - DNA, 22 bp, Homo sapiens
tggccggggctgatggacagtg

SEQ ID NO: 6954263 - DNA, 22 bp, Homo sapiens
gtgcacatatttgtgcatgcat

SEQ ID NO: 6954264 - DNA, 22 bp, Homo sapiens
tacattcacttgttgaaggtgg

SEQ ID NO: 6954265 - DNA, 22 bp, Homo sapiens
acatattggcttagctctgtga

SEQ ID NO: 6954266 - DNA, 22 bp, Homo sapiens
aaatgctttggtgctggtacag

SEQ ID NO: 6954267 - DNA, 22 bp, Homo sapiens
ctcctgtcaataggctcctggc

SEQ ID NO: 6954268 - DNA, 22 bp, Homo sapiens
agtcctgcatccagttacatct

SEQ ID NO: 6954269 - DNA, 22 bp, Homo sapiens
catctttgccatatgatgtaat

SEQ ID NO: 6954270 - DNA, 22 bp, Homo sapiens
taagacacatgcgtacaagata

SEQ ID NO: 6954271 - DNA, 22 bp, Homo sapiens
ttctgacacattactacatgga

SEQ ID NO: 6954272 - DNA, 22 bp, Homo sapiens
tccacagcattattagaaggat

SEQ ID NO: 6954273 - DNA, 22 bp, Homo sapiens
tctttactggaatggaactttc

SEQ ID NO: 6954274 - DNA, 19 bp, Homo sapiens
acatgacaacaggggaggc

SEQ ID NO: 6954275 - DNA, 21 bp, Homo sapiens
ttaagacacacagattaagga

SEQ ID NO: 6954276 - DNA, 22 bp, Homo sapiens
caagaagctttccctgcttgca

SEQ ID NO: 6954277 - DNA, 22 bp, Homo sapiens
acatctgaaagggattgcagaa

SEQ ID NO: 6954278 - DNA, 22 bp, Homo sapiens
aagtgtattaagcaacgttatt

SEQ ID NO: 6954279 - DNA, 22 bp, Homo sapiens
actgtggggttcctggtacttg

SEQ ID NO: 6954280 - DNA, 22 bp, Homo sapiens
gtggctccgcaggctccattct

SEQ ID NO: 6954281 - DNA, 22 bp, Homo sapiens
aagttgtagatgaagtaattca

SEQ ID NO: 6954282 - DNA, 22 bp, Homo sapiens
tcttcagactgttgttcttttg

SEQ ID NO: 6954283 - DNA, 22 bp, Homo sapiens
agagtcaacatcgagccactgg

SEQ ID NO: 6954284 - DNA, 22 bp, Homo sapiens
gtggagatcctgagtgcatctg

SEQ ID NO: 6954285 - DNA, 22 bp, Homo sapiens
tgtgagaaatataggccgtgct

SEQ ID NO: 6954286 - DNA, 22 bp, Homo sapiens
tgtcagcaggacattaaaagct

SEQ ID NO: 6954287 - DNA, 22 bp, Homo sapiens
ggacctgttcttgggcagaact

SEQ ID NO: 6954288 - DNA, 22 bp, Homo sapiens
tgacctccaatacctttcttcc

SEQ ID NO: 6954289 - DNA, 22 bp, Homo sapiens
gcagagataagtagacaggatg

SEQ ID NO: 6954290 - DNA, 22 bp, Homo sapiens
atttgaggatagttgggtactc

SEQ ID NO: 6954291 - DNA, 22 bp, Homo sapiens
ttctccagaccctcctgcagac

SEQ ID NO: 6954292 - DNA, 22 bp, Homo sapiens
agagcagctggggcagagacca

SEQ ID NO: 6954293 - DNA, 20 bp, Homo sapiens
agcagagtgcccatcccgga

SEQ ID NO: 6954294 - DNA, 22 bp, Homo sapiens
tggaatgtaaactctgtgaggg

SEQ ID NO: 6954295 - DNA, 22 bp, Homo sapiens
caggccggccggccccagctct

SEQ ID NO: 6954296 - DNA, 23 bp, Homo sapiens
acagaggcttaaatgagtggcag

SEQ ID NO: 6954297 - DNA, 22 bp, Homo sapiens
tgagtccaggtgcttacctgga

SEQ ID NO: 6954298 - DNA, 22 bp, Homo sapiens
ttggccaaggtcactgggtgag

SEQ ID NO: 6954299 - DNA, 22 bp, Homo sapiens
agggtcaacattctaaaatctg

SEQ ID NO: 6954300 - DNA, 22 bp, Homo sapiens
gcagcgacaggcactggtcagg

SEQ ID NO: 6954301 - DNA, 22 bp, Homo sapiens
tagaagatcttaaaagctgact

SEQ ID NO: 6954302 - DNA, 21 bp, Homo sapiens
ttctctggtcaagcacacata

SEQ ID NO: 6954303 - DNA, 22 bp, Homo sapiens
atttatgactggtgaatagaac

SEQ ID NO: 6954304 - DNA, 22 bp, Homo sapiens
tctttggcttgtctcctcagtt

SEQ ID NO: 6954305 - DNA, 21 bp, Homo sapiens
cactcagtacctgcccgctgc

SEQ ID NO: 6954306 - DNA, 22 bp, Homo sapiens
gggctggatgtttgatgacgaa

SEQ ID NO: 6954307 - DNA, 22 bp, Homo sapiens
tcctggagtatttctgtggtgt

SEQ ID NO: 6954308 - DNA, 22 bp, Homo sapiens
ttagtgcaccatcctgaggtgt

SEQ ID NO: 6954309 - DNA, 22 bp, Homo sapiens
catctgcctaagtggccctgtt

SEQ ID NO: 6954310 - DNA, 22 bp, Homo sapiens
agctggcaggggttcacactgc

SEQ ID NO: 6954311 - DNA, 22 bp, Homo sapiens
aaaaatgctgtggtagctgtgt

SEQ ID NO: 6954312 - DNA, 22 bp, Homo sapiens
tgctgcacccctaagtgtctct

SEQ ID NO: 6954313 - DNA, 22 bp, Homo sapiens
gacatgttatctctggcttcaa

SEQ ID NO: 6954314 - DNA, 22 bp, Homo sapiens
ttgatgtgtttccaggatttgt

SEQ ID NO: 6954315 - DNA, 22 bp, Homo sapiens
acaatagtcaatgcacgtcatt

SEQ ID NO: 6954316 - DNA, 22 bp, Homo sapiens
caagtgtgactattttttcata

SEQ ID NO: 6954317 - DNA, 22 bp, Homo sapiens
tattgtatcttaccacatgtat

SEQ ID NO: 6954318 - DNA, 22 bp, Homo sapiens
caagccaggtgaacataacaag

SEQ ID NO: 6954319 - DNA, 22 bp, Homo sapiens
agctgaaagtgctttgaggact

SEQ ID NO: 6954320 - DNA, 22 bp, Homo sapiens
agagcacatggttcctgtgtcc

SEQ ID NO: 6954321 - DNA, 22 bp, Homo sapiens
gggcaagttgagaagaatgcta

SEQ ID NO: 6954322 - DNA, 22 bp, Homo sapiens
gactggatgtttaatcaacaga

SEQ ID NO: 6954323 - DNA, 22 bp, Homo sapiens
ttgcaaatgtgagtttagactg

SEQ ID NO: 6954324 - DNA, 22 bp, Homo sapiens
aagacagcactggcattttcaa

SEQ ID NO: 6954325 - DNA, 22 bp, Homo sapiens
tagagcttagtatcctgttaag

SEQ ID NO: 6954326 - DNA, 22 bp, Homo sapiens
aggatcagagctttgtttctga

SEQ ID NO: 6954327 - DNA, 22 bp, Homo sapiens
tagctgctgcagcacagggagg

SEQ ID NO: 6954328 - DNA, 22 bp, Homo sapiens
tggctttcccccagcccagttg

SEQ ID NO: 6954329 - DNA, 22 bp, Homo sapiens
tcaagggcaaatgctacctata

SEQ ID NO: 6954330 - DNA, 22 bp, Homo sapiens
aggcaacaagggtagtcagtga

SEQ ID NO: 6954331 - DNA, 22 bp, Homo sapiens
tctcactgggtataaatgagta

SEQ ID NO: 6954332 - DNA, 22 bp, Homo sapiens
ctggtgcacatgaaagagaagg

SEQ ID NO: 6954333 - DNA, 22 bp, Homo sapiens
gcagggcgcgtttgagcgggct

SEQ ID NO: 6954334 - DNA, 22 bp, Homo sapiens
gggaaaacaaattaggttggct

SEQ ID NO: 6954335 - DNA, 20 bp, Homo sapiens
cagacctgcacccacttcga

SEQ ID NO: 6954336 - DNA, 22 bp, Homo sapiens
actggagtacagtggcgtgaac

SEQ ID NO: 6954337 - DNA, 22 bp, Homo sapiens
ggcacagctacttgctcactct

SEQ ID NO: 6954338 - DNA, 22 bp, Homo sapiens
tggctccatgatagttcttaca

SEQ ID NO: 6954339 - DNA, 22 bp, Homo sapiens
ctgttctgaccagtgcagggat

SEQ ID NO: 6954340 - DNA, 22 bp, Homo sapiens
tgccatttctcaggctatttca

SEQ ID NO: 6954341 - DNA, 22 bp, Homo sapiens
ccctttggcatttccaggatat

SEQ ID NO: 6954342 - DNA, 22 bp, Homo sapiens
aggacagcattttcagcatctc

SEQ ID NO: 6954343 - DNA, 22 bp, Homo sapiens
tcatttagttctttcatgtcca

SEQ ID NO: 6954344 - DNA, 22 bp, Homo sapiens
atcaggatccaccttgagcctg

SEQ ID NO: 6954345 - DNA, 22 bp, Homo sapiens
atcaggatgaagctgtagcgaa

SEQ ID NO: 6954346 - DNA, 22 bp, Homo sapiens
taaggcagatgtggaatcaatt

SEQ ID NO: 6954347 - DNA, 22 bp, Homo sapiens
tgagacttgtgagtccttctag

SEQ ID NO: 6954348 - DNA, 22 bp, Homo sapiens
caggctgggactgacccctgct

SEQ ID NO: 6954349 - DNA, 22 bp, Homo sapiens
tgaaacttctaatatgaatagt

SEQ ID NO: 6954350 - DNA, 22 bp, Homo sapiens
tgtccttacaaggtccctttcg

SEQ ID NO: 6954351 - DNA, 22 bp, Homo sapiens
ctgggacccacacctggaatct

SEQ ID NO: 6954352 - DNA, 22 bp, Homo sapiens
aatactatgtagccaaaataat

SEQ ID NO: 6954353 - DNA, 22 bp, Homo sapiens
accctgcttctggattaatcca

SEQ ID NO: 6954354 - DNA, 22 bp, Homo sapiens
accttgaacacaagaattattg

SEQ ID NO: 6954355 - DNA, 22 bp, Homo sapiens
tttatatagagatttgtgcatg

SEQ ID NO: 6954356 - DNA, 22 bp, Homo sapiens
tcgggtgcttttagatatgtag

SEQ ID NO: 6954357 - DNA, 22 bp, Homo sapiens
ggaacatttcctggcagagagg

SEQ ID NO: 6954358 - DNA, 22 bp, Homo sapiens
tttgtactggaagaacatgcaa

SEQ ID NO: 6954359 - DNA, 22 bp, Homo sapiens
agctctgggccaggaaccctaa

SEQ ID NO: 6954360 - DNA, 20 bp, Homo sapiens
actgggcctaggggaggcat

SEQ ID NO: 6954361 - DNA, 22 bp, Homo sapiens
gtccatccctatctgcattgct

SEQ ID NO: 6954362 - DNA, 22 bp, Homo sapiens
tggaggagaactccctggctac

SEQ ID NO: 6954363 - DNA, 22 bp, Homo sapiens
agcgaggttttgcagatacagc

SEQ ID NO: 6954364 - DNA, 22 bp, Homo sapiens
aggtcctgtccttggtctctga

SEQ ID NO: 6954365 - DNA, 22 bp, Homo sapiens
cctgtaccattttccctagtct

SEQ ID NO: 6954366 - DNA, 20 bp, Homo sapiens
cacaggcttacagtttagat

SEQ ID NO: 6954367 - DNA, 21 bp, Homo sapiens
gcacaactctcacattcttct

SEQ ID NO: 6954368 - DNA, 22 bp, Homo sapiens
tgagtctcggtttcccctccaa

SEQ ID NO: 6954369 - DNA, 22 bp, Homo sapiens
atgagcaaccttctcctccagc

SEQ ID NO: 6954370 - DNA, 22 bp, Homo sapiens
tccctgatgccaaagaagcatg

SEQ ID NO: 6954371 - DNA, 22 bp, Homo sapiens
caccactgcttcctgccatctg

SEQ ID NO: 6954372 - DNA, 22 bp, Homo sapiens
caggccagtgggaaatagggat

SEQ ID NO: 6954373 - DNA, 22 bp, Homo sapiens
cagagctggggactgttggatg

SEQ ID NO: 6954374 - DNA, 22 bp, Homo sapiens
tgccttgggagccagcatgcca

SEQ ID NO: 6954375 - DNA, 22 bp, Homo sapiens
ccttgccccatctgggaatccc

SEQ ID NO: 6954376 - DNA, 22 bp, Homo sapiens
ttaagagccaacttatccatct

SEQ ID NO: 6954377 - DNA, 22 bp, Homo sapiens
ggggaaggatatgattagacta

SEQ ID NO: 6954378 - DNA, 22 bp, Homo sapiens
tcacattttatctgagattgac

SEQ ID NO: 6954379 - DNA, 23 bp, Homo sapiens
tcagatgaggaatgcatactaat

SEQ ID NO: 6954380 - DNA, 22 bp, Homo sapiens
gctcaaggcaggcagacatgag

SEQ ID NO: 6954381 - DNA, 22 bp, Homo sapiens
acatgcaatattgagactttct

SEQ ID NO: 6954382 - DNA, 22 bp, Homo sapiens
gtcttctggaagagagccagct

SEQ ID NO: 6954383 - DNA, 22 bp, Homo sapiens
gtgcaagaggacagtaagggtg

SEQ ID NO: 6954384 - DNA, 18 bp, Homo sapiens
cccatgttgccagtcagc

SEQ ID NO: 6954385 - DNA, 22 bp, Homo sapiens
ttgaggaaagagtgcaaagagg

SEQ ID NO: 6954386 - DNA, 22 bp, Homo sapiens
tcatccaaggattttattgcat

SEQ ID NO: 6954387 - DNA, 22 bp, Homo sapiens
tttcagacaggctcagagccgt

SEQ ID NO: 6954388 - DNA, 22 bp, Homo sapiens
gatctttggaatctgtgtatca

SEQ ID NO: 6954389 - DNA, 22 bp, Homo sapiens
aatgaagtgtttagaagtttta

SEQ ID NO: 6954390 - DNA, 23 bp, Homo sapiens
tctagaaaatgaaagaatgcagt

SEQ ID NO: 6954391 - DNA, 22 bp, Homo sapiens
gggcaagtaactctcgtgcggg

SEQ ID NO: 6954392 - DNA, 22 bp, Homo sapiens
acagcagagccagtggctctag

SEQ ID NO: 6954393 - DNA, 22 bp, Homo sapiens
atccttagttaagaacaggagt

SEQ ID NO: 6954394 - DNA, 22 bp, Homo sapiens
ccaggatctgatattgggctcc

SEQ ID NO: 6954395 - DNA, 22 bp, Homo sapiens
atgggtggccccgtgtgcagtc

SEQ ID NO: 6954396 - DNA, 22 bp, Homo sapiens
catgcctgtaatcccagcactt

SEQ ID NO: 6954397 - DNA, 18 bp, Homo sapiens
caccctccgcggctgccc

SEQ ID NO: 6954398 - DNA, 22 bp, Homo sapiens
ggcttggctgtctcccagccca

SEQ ID NO: 6954399 - DNA, 22 bp, Homo sapiens
ctgcctgtgggtacaagtggaa

SEQ ID NO: 6954400 - DNA, 16 bp, Homo sapiens
tcccaggaggcggaac

SEQ ID NO: 6954401 - DNA, 22 bp, Homo sapiens
ttgatcttcatcgaaatattgt

SEQ ID NO: 6954402 - DNA, 22 bp, Homo sapiens
attgatttttgaggactggtat

SEQ ID NO: 6954403 - DNA, 22 bp, Homo sapiens
aagcaccaagttcaacattccc

SEQ ID NO: 6954404 - DNA, 22 bp, Homo sapiens
tttcacaatgcaatcctacttc

SEQ ID NO: 6954405 - DNA, 22 bp, Homo sapiens
cctcctgcactgcaagcttgag

SEQ ID NO: 6954406 - DNA, 22 bp, Homo sapiens
tttcagacctgctgtgctatct

SEQ ID NO: 6954407 - DNA, 17 bp, Homo sapiens
gcagtatgatcctctgg

SEQ ID NO: 6954408 - DNA, 22 bp, Homo sapiens
gcacctcattttgcaggtagaa

SEQ ID NO: 6954409 - DNA, 22 bp, Homo sapiens
aagtccaggtcccgggctctgg

SEQ ID NO: 6954410 - DNA, 22 bp, Homo sapiens
gaggctctgtgatgtgccaggc

SEQ ID NO: 6954411 - DNA, 22 bp, Homo sapiens
tggcctggaacctggcagggac

SEQ ID NO: 6954412 - DNA, 22 bp, Homo sapiens
acatttaaatatgccttatatt

SEQ ID NO: 6954413 - DNA, 22 bp, Homo sapiens
agagacatgcagttgttgtgaa

SEQ ID NO: 6954414 - DNA, 22 bp, Homo sapiens
aaagctgcccttgtgaaacaag

SEQ ID NO: 6954415 - DNA, 22 bp, Homo sapiens
gacacagagctcacagtctcct

SEQ ID NO: 6954416 - DNA, 22 bp, Homo sapiens
cagtatgattgccagttctatc

SEQ ID NO: 6954417 - DNA, 22 bp, Homo sapiens
catagtaagtgcataataaatg

SEQ ID NO: 6954418 - DNA, 22 bp, Homo sapiens
ggcagctggcctcctcgcccac

SEQ ID NO: 6954419 - DNA, 22 bp, Homo sapiens
gctctctgtcgttatgcttcat

SEQ ID NO: 6954420 - DNA, 18 bp, Homo sapiens
ataaagtgctaataatgg

SEQ ID NO: 6954421 - DNA, 22 bp, Homo sapiens
ttgcagatgaagaaactgaagc

SEQ ID NO: 6954422 - DNA, 22 bp, Homo sapiens
cgggagcacgggaggcggagct

SEQ ID NO: 6954423 - DNA, 22 bp, Homo sapiens
catcactgtcctcagcattcca

SEQ ID NO: 6954424 - DNA, 22 bp, Homo sapiens
ttagatcaatagttctcaactc

SEQ ID NO: 6954425 - DNA, 22 bp, Homo sapiens
gtcttggcatattttcaccaag

SEQ ID NO: 6954426 - DNA, 22 bp, Homo sapiens
aagttactttatgtagaagaaa

SEQ ID NO: 6954427 - DNA, 20 bp, Homo sapiens
gtcttctattcccagaaagt

SEQ ID NO: 6954428 - DNA, 22 bp, Homo sapiens
tgcaacctgcactctgtcttta

SEQ ID NO: 6954429 - DNA, 22 bp, Homo sapiens
actccagggttttgcacctgga

SEQ ID NO: 6954430 - DNA, 22 bp, Homo sapiens
aaatacaaaaattagccaggca

SEQ ID NO: 6954431 - DNA, 22 bp, Homo sapiens
gtctggaggcccgtcagcccta

SEQ ID NO: 6954432 - DNA, 22 bp, Homo sapiens
ggcctgactgacctgattctaa

SEQ ID NO: 6954433 - DNA, 22 bp, Homo sapiens
aacagtcttacagaagtagcca

SEQ ID NO: 6954434 - DNA, 22 bp, Homo sapiens
ctcggctgtgtgggtcccgggc

SEQ ID NO: 6954435 - DNA, 22 bp, Homo sapiens
tatgtacagggatagaacttga

SEQ ID NO: 6954436 - DNA, 20 bp, Homo sapiens
tggggagttgagcacgagca

SEQ ID NO: 6954437 - DNA, 22 bp, Homo sapiens
cacctgagactcctcaccatga

SEQ ID NO: 6954438 - DNA, 22 bp, Homo sapiens
tgcatgcttcccttctcccagc

SEQ ID NO: 6954439 - DNA, 22 bp, Homo sapiens
gtctaaggatctgttagctttt

SEQ ID NO: 6954440 - DNA, 22 bp, Homo sapiens
cagctgacaaactctgagctta

SEQ ID NO: 6954441 - DNA, 22 bp, Homo sapiens
ctgctccacaccgtccatactc

SEQ ID NO: 6954442 - DNA, 22 bp, Homo sapiens
aggaatgttaggagatgagtct

SEQ ID NO: 6954443 - DNA, 22 bp, Homo sapiens
ttaacaatagagtttcttcagg

SEQ ID NO: 6954444 - DNA, 22 bp, Homo sapiens
acagtctggcaggtgttgaaag

SEQ ID NO: 6954445 - DNA, 22 bp, Homo sapiens
gaagacatcatggagaggatag

SEQ ID NO: 6954446 - DNA, 22 bp, Homo sapiens
tattaggttggtgcaacagtaa

SEQ ID NO: 6954447 - DNA, 22 bp, Homo sapiens
gcttagcatcttacaatgctga

SEQ ID NO: 6954448 - DNA, 22 bp, Homo sapiens
tctcagaggcccgacgttctcc

SEQ ID NO: 6954449 - DNA, 22 bp, Homo sapiens
ggcgggtgtaagtaggacagcg

SEQ ID NO: 6954450 - DNA, 22 bp, Homo sapiens
tggcatctcaaacaggcagatt

SEQ ID NO: 6954451 - DNA, 22 bp, Homo sapiens
tggcttccagtaatcaggattt

SEQ ID NO: 6954452 - DNA, 22 bp, Homo sapiens
caattcttggagaagaagcata

SEQ ID NO: 6954453 - DNA, 22 bp, Homo sapiens
taactagtcatgtcataacacc

SEQ ID NO: 6954454 - DNA, 22 bp, Homo sapiens
acaggctgtacttctaatcatc

SEQ ID NO: 6954455 - DNA, 22 bp, Homo sapiens
gcagcagctcagttctgggagg

SEQ ID NO: 6954456 - DNA, 23 bp, Homo sapiens
gccagcatagatcattctgagta

SEQ ID NO: 6954457 - DNA, 22 bp, Homo sapiens
atgcaaattaacatatagtaga

SEQ ID NO: 6954458 - DNA, 22 bp, Homo sapiens
gggcattcctaagcgagaagag

SEQ ID NO: 6954459 - DNA, 22 bp, Homo sapiens
ttgttctagcctcctgttttga

SEQ ID NO: 6954460 - DNA, 22 bp, Homo sapiens
ggctactagactttgatactag

SEQ ID NO: 6954461 - DNA, 22 bp, Homo sapiens
gcaggggttttctgacttgagt

SEQ ID NO: 6954462 - DNA, 22 bp, Homo sapiens
ttcacaaaaatgctgaacagtt

SEQ ID NO: 6954463 - DNA, 22 bp, Homo sapiens
aactgttgtcatatggtcttaa

SEQ ID NO: 6954464 - DNA, 22 bp, Homo sapiens
actggcagaggatagcactaat

SEQ ID NO: 6954465 - DNA, 20 bp, Homo sapiens
caatttcatcatttcctgtg

SEQ ID NO: 6954466 - DNA, 22 bp, Homo sapiens
aggccagtgcctttccagggct

SEQ ID NO: 6954467 - DNA, 22 bp, Homo sapiens
aggtctgagtatggcctgagaa

SEQ ID NO: 6954468 - DNA, 18 bp, Homo sapiens
tgttaaggatccagtagt

SEQ ID NO: 6954469 - DNA, 22 bp, Homo sapiens
gtagcaactgtagcccaaattc

SEQ ID NO: 6954470 - DNA, 22 bp, Homo sapiens
gcccacacagcagatcctttgg

SEQ ID NO: 6954471 - DNA, 17 bp, Homo sapiens
tgtcttctgaagagagc

SEQ ID NO: 6954472 - DNA, 22 bp, Homo sapiens
tctgtctttagaggcctgtgct

SEQ ID NO: 6954473 - DNA, 19 bp, Homo sapiens
agaatcatcttgaagtgat

SEQ ID NO: 6954474 - DNA, 22 bp, Homo sapiens
catggtgcaggagagaaggcag

SEQ ID NO: 6954475 - DNA, 23 bp, Homo sapiens
atgcacaagccagcaggggacag

SEQ ID NO: 6954476 - DNA, 22 bp, Homo sapiens
tgtcattaagtagggatttgtg

SEQ ID NO: 6954477 - DNA, 22 bp, Homo sapiens
tagaactgctctcatacttgct

SEQ ID NO: 6954478 - DNA, 22 bp, Homo sapiens
actcagaagatataatgactca

SEQ ID NO: 6954479 - DNA, 22 bp, Homo sapiens
gagcacagctggaggtagcatt

SEQ ID NO: 6954480 - DNA, 22 bp, Homo sapiens
ctctgcaatctgagcacttgta

SEQ ID NO: 6954481 - DNA, 22 bp, Homo sapiens
ataggacaagactgaccctggt

SEQ ID NO: 6954482 - DNA, 22 bp, Homo sapiens
ggtgagggtaaatataggcaaa

SEQ ID NO: 6954483 - DNA, 22 bp, Homo sapiens
cttatagagttcagtgattttc

SEQ ID NO: 6954484 - DNA, 22 bp, Homo sapiens
cctgagtggccaggcagctgtg

SEQ ID NO: 6954485 - DNA, 22 bp, Homo sapiens
acattctttctcttcaggaaac

SEQ ID NO: 6954486 - DNA, 22 bp, Homo sapiens
atgcagcagctacttgggaagg

SEQ ID NO: 6954487 - DNA, 22 bp, Homo sapiens
caactcatttattcaattttct

SEQ ID NO: 6954488 - DNA, 22 bp, Homo sapiens
ttggaggatgcaatgagggagt

SEQ ID NO: 6954489 - DNA, 22 bp, Homo sapiens
cctgcctcaggactctgcatat

SEQ ID NO: 6954490 - DNA, 22 bp, Homo sapiens
agggcctcgggctcagtgggtc

SEQ ID NO: 6954491 - DNA, 22 bp, Homo sapiens
ccttgcccgctgcctctgagtt

SEQ ID NO: 6954492 - DNA, 22 bp, Homo sapiens
aagcttgtactgtagtttgttg

SEQ ID NO: 6954493 - DNA, 22 bp, Homo sapiens
cctggtttttcaaacatacaag

SEQ ID NO: 6954494 - DNA, 22 bp, Homo sapiens
acagggaacaggaatatacaaa

SEQ ID NO: 6954495 - DNA, 22 bp, Homo sapiens
tgctgcttttagttggatagaa

SEQ ID NO: 6954496 - DNA, 22 bp, Homo sapiens
ctgtccatggtccttattacca

SEQ ID NO: 6954497 - DNA, 22 bp, Homo sapiens
tggaggtggcatctgacagctg

SEQ ID NO: 6954498 - DNA, 22 bp, Homo sapiens
agctaggacaggtagagatggg

SEQ ID NO: 6954499 - DNA, 22 bp, Homo sapiens
gtgccaattccacacccaatac

SEQ ID NO: 6954500 - DNA, 22 bp, Homo sapiens
agatggttttgtctttatgatt

SEQ ID NO: 6954501 - DNA, 20 bp, Homo sapiens
ctctcacagctccctcagcc

SEQ ID NO: 6954502 - DNA, 22 bp, Homo sapiens
cagaagttgatcctgcgtttcc

SEQ ID NO: 6954503 - DNA, 22 bp, Homo sapiens
aaatgcagttggtggggatatg

SEQ ID NO: 6954504 - DNA, 23 bp, Homo sapiens
ctcagaggcctgtccagggtggt

SEQ ID NO: 6954505 - DNA, 22 bp, Homo sapiens
gttgtttttgttctctatagct

SEQ ID NO: 6954506 - DNA, 22 bp, Homo sapiens
attctctcatttatctgtccta

SEQ ID NO: 6954507 - DNA, 21 bp, Homo sapiens
ctgtgatgttgccggggtagg

SEQ ID NO: 6954508 - DNA, 22 bp, Homo sapiens
tcgtgcaaacctgacacagcca

SEQ ID NO: 6954509 - DNA, 22 bp, Homo sapiens
aatttaatcaagttctgctctg

SEQ ID NO: 6954510 - DNA, 22 bp, Homo sapiens
ctccagattctggatgactggg

SEQ ID NO: 6954511 - DNA, 22 bp, Homo sapiens
taggtagctttggcgtttcttg

SEQ ID NO: 6954512 - DNA, 22 bp, Homo sapiens
attgaaagtcctatctaaggga

SEQ ID NO: 6954513 - DNA, 22 bp, Homo sapiens
tctgataaatgccatctttttg

SEQ ID NO: 6954514 - DNA, 22 bp, Homo sapiens
cagaggacctgtgtggccagag

SEQ ID NO: 6954515 - DNA, 22 bp, Homo sapiens
ctctttctcgccgcccgcagtc

SEQ ID NO: 6954516 - DNA, 22 bp, Homo sapiens
tctgtcatgccacaggacttgg

SEQ ID NO: 6954517 - DNA, 22 bp, Homo sapiens
tcccactgagcatatgcagatg

SEQ ID NO: 6954518 - DNA, 22 bp, Homo sapiens
tgagatagtatatggaaagagt

SEQ ID NO: 6954519 - DNA, 22 bp, Homo sapiens
aagctcatgggtgctgtacttt

SEQ ID NO: 6954520 - DNA, 22 bp, Homo sapiens
agtaagtgagtcactgtgctgg

SEQ ID NO: 6954521 - DNA, 22 bp, Homo sapiens
cagagaccctaggcaggtgaca

SEQ ID NO: 6954522 - DNA, 22 bp, Homo sapiens
cctggtttatgccagatcctgt

SEQ ID NO: 6954523 - DNA, 23 bp, Homo sapiens
acatacatggagataaagtgatg

SEQ ID NO: 6954524 - DNA, 22 bp, Homo sapiens
tccctgggcaagtttactcttc

SEQ ID NO: 6954525 - DNA, 16 bp, Homo sapiens
gagaagagcccggcag

SEQ ID NO: 6954526 - DNA, 22 bp, Homo sapiens
agtctggaaaatgcatgtttca

SEQ ID NO: 6954527 - DNA, 22 bp, Homo sapiens
accccaggaagtggaggtcatg

SEQ ID NO: 6954528 - DNA, 22 bp, Homo sapiens
tagaagattcatttcctctgaa

SEQ ID NO: 6954529 - DNA, 22 bp, Homo sapiens
ttgttttgctaaagggtcatca

SEQ ID NO: 6954530 - DNA, 22 bp, Homo sapiens
gtttcctgatgtgggagatctt

SEQ ID NO: 6954531 - DNA, 17 bp, Homo sapiens
tggcaagaatggaaatg

SEQ ID NO: 6954532 - DNA, 22 bp, Homo sapiens
gctccagctccggctccgaagc

SEQ ID NO: 6954533 - DNA, 22 bp, Homo sapiens
gctcaaagcaccctggaataag

SEQ ID NO: 6954534 - DNA, 22 bp, Homo sapiens
gaaggcctaggaaggaagcctt

SEQ ID NO: 6954535 - DNA, 22 bp, Homo sapiens
gagtcaggcatgaaggtaatta

SEQ ID NO: 6954536 - DNA, 22 bp, Homo sapiens
gctgagtcttgcctgtgctgtc

SEQ ID NO: 6954537 - DNA, 22 bp, Homo sapiens
tctactatgtatgctttatgcg

SEQ ID NO: 6954538 - DNA, 22 bp, Homo sapiens
aattatattgaagttgaatgtc

SEQ ID NO: 6954539 - DNA, 20 bp, Homo sapiens
agtggaatttcagatacccc

SEQ ID NO: 6954540 - DNA, 22 bp, Homo sapiens
taaggaaagtgccatgatttct

SEQ ID NO: 6954541 - DNA, 22 bp, Homo sapiens
gtcaggcagcctggagattcag

SEQ ID NO: 6954542 - DNA, 22 bp, Homo sapiens
tagaaggcaagcttggtacagg

SEQ ID NO: 6954543 - DNA, 22 bp, Homo sapiens
gcctctggggtggagcccagca

SEQ ID NO: 6954544 - DNA, 22 bp, Homo sapiens
ctttctcctactgggcgcggga

SEQ ID NO: 6954545 - DNA, 22 bp, Homo sapiens
ggctgggagccccacagagtca

SEQ ID NO: 6954546 - DNA, 22 bp, Homo sapiens
ttgctgtagctcatttcactct

SEQ ID NO: 6954547 - DNA, 22 bp, Homo sapiens
agaaggctagagacttgcccaa

SEQ ID NO: 6954548 - DNA, 22 bp, Homo sapiens
ttccagccactttatactgcta

SEQ ID NO: 6954549 - DNA, 22 bp, Homo sapiens
accagggcacaggagtctgaag

SEQ ID NO: 6954550 - DNA, 22 bp, Homo sapiens
acacaaactgctagaaaattgg

SEQ ID NO: 6954551 - DNA, 22 bp, Homo sapiens
ctggtccctgagtagttatgca

SEQ ID NO: 6954552 - DNA, 22 bp, Homo sapiens
cagggagctttgtcttctcatt

SEQ ID NO: 6954553 - DNA, 22 bp, Homo sapiens
gaggccacagtcagtgttcatc

SEQ ID NO: 6954554 - DNA, 22 bp, Homo sapiens
tacaggttccaggaattaggac

SEQ ID NO: 6954555 - DNA, 22 bp, Homo sapiens
aggtaggttaaatttctttatc

SEQ ID NO: 6954556 - DNA, 22 bp, Homo sapiens
tacatagagggtaatagcatca

SEQ ID NO: 6954557 - DNA, 22 bp, Homo sapiens
ttccatctgctaggtaaatgaa

SEQ ID NO: 6954558 - DNA, 22 bp, Homo sapiens
gctacaaagtggtaggaggtca

SEQ ID NO: 6954559 - DNA, 22 bp, Homo sapiens
catcttcaggtgttttccatca

SEQ ID NO: 6954560 - DNA, 22 bp, Homo sapiens
ccacagtttcttcatctataaa

SEQ ID NO: 6954561 - DNA, 22 bp, Homo sapiens
tccaaatattcatctacttctg

SEQ ID NO: 6954562 - DNA, 22 bp, Homo sapiens
ttgactgtgaatctaagttact

SEQ ID NO: 6954563 - DNA, 22 bp, Homo sapiens
tgttttagttctgtcttgcatg

SEQ ID NO: 6954564 - DNA, 22 bp, Homo sapiens
gcttggtttctaacttttcata

SEQ ID NO: 6954565 - DNA, 22 bp, Homo sapiens
acagcagctgccttcaggctct

SEQ ID NO: 6954566 - DNA, 15 bp, Homo sapiens
attactgagtggtca

SEQ ID NO: 6954567 - DNA, 22 bp, Homo sapiens
taggaaatttcatttgaggtct

SEQ ID NO: 6954568 - DNA, 22 bp, Homo sapiens
aggcagggtgatgataatgatt

SEQ ID NO: 6954569 - DNA, 20 bp, Homo sapiens
tgtgggctttgaaatgtgtg

SEQ ID NO: 6954570 - DNA, 22 bp, Homo sapiens
ttcacagggcagatcatttctg

SEQ ID NO: 6954571 - DNA, 22 bp, Homo sapiens
aggggcttatgtttctccaggc

SEQ ID NO: 6954572 - DNA, 22 bp, Homo sapiens
tattccaagcacagcaacccag

SEQ ID NO: 6954573 - DNA, 22 bp, Homo sapiens
gcccttccaacccagagggcaa

SEQ ID NO: 6954574 - DNA, 22 bp, Homo sapiens
acagcagcatcctatttcactc

SEQ ID NO: 6954575 - DNA, 22 bp, Homo sapiens
gagcttggctggacctcacgga

SEQ ID NO: 6954576 - DNA, 21 bp, Homo sapiens
tctgttcaaggaactacggat

SEQ ID NO: 6954577 - DNA, 22 bp, Homo sapiens
ctggagccttcaccaggggaaa

SEQ ID NO: 6954578 - DNA, 22 bp, Homo sapiens
aagggctcttctatttatggcc

SEQ ID NO: 6954579 - DNA, 22 bp, Homo sapiens
tgcctctggttatctggtacct

SEQ ID NO: 6954580 - DNA, 22 bp, Homo sapiens
ctggctctgcaacccccacaca

SEQ ID NO: 6954581 - DNA, 22 bp, Homo sapiens
cttctctgacagtctgtttcac

SEQ ID NO: 6954582 - DNA, 22 bp, Homo sapiens
tatgccaaggatcaatatgtat

SEQ ID NO: 6954583 - DNA, 22 bp, Homo sapiens
ctaaggctaagaaattgtgtgt

SEQ ID NO: 6954584 - DNA, 22 bp, Homo sapiens
gaagtcctcaatgcattgtctt

SEQ ID NO: 6954585 - DNA, 22 bp, Homo sapiens
tcttatgcatattcataacaca

SEQ ID NO: 6954586 - DNA, 22 bp, Homo sapiens
acaattagcaaggggaagattt

SEQ ID NO: 6954587 - DNA, 22 bp, Homo sapiens
tatctgtttattgttactgtca

SEQ ID NO: 6954588 - DNA, 18 bp, Homo sapiens
tccagtcccaaggccagc

SEQ ID NO: 6954589 - DNA, 22 bp, Homo sapiens
tttacgagtgtgattaaggtaa

SEQ ID NO: 6954590 - DNA, 22 bp, Homo sapiens
atccctctctgcatgactgtgt

SEQ ID NO: 6954591 - DNA, 22 bp, Homo sapiens
caacaacatgggattcatttct

SEQ ID NO: 6954592 - DNA, 22 bp, Homo sapiens
tttcagagaaagcccaaagact

SEQ ID NO: 6954593 - DNA, 22 bp, Homo sapiens
aaaagtaattgcggtttttgct

SEQ ID NO: 6954594 - DNA, 22 bp, Homo sapiens
tcagtgcaaaaaatgggctaga

SEQ ID NO: 6954595 - DNA, 22 bp, Homo sapiens
ctgccaggcctggggtgctgtc

SEQ ID NO: 6954596 - DNA, 22 bp, Homo sapiens
aggtaaatgtcagagcctttaa

SEQ ID NO: 6954597 - DNA, 22 bp, Homo sapiens
attattcagtcttgtaaggagt

SEQ ID NO: 6954598 - DNA, 22 bp, Homo sapiens
taatccgtacattattctgaac

SEQ ID NO: 6954599 - DNA, 22 bp, Homo sapiens
agtccaaggccatacagttgtg

SEQ ID NO: 6954600 - DNA, 22 bp, Homo sapiens
cagctgcccctccagggctggg

SEQ ID NO: 6954601 - DNA, 22 bp, Homo sapiens
aaagtacatgtttggccatttg

SEQ ID NO: 6954602 - DNA, 22 bp, Homo sapiens
ttttcttcggtgctgggttgat

SEQ ID NO: 6954603 - DNA, 22 bp, Homo sapiens
aggatacaagtctcagaatgct

SEQ ID NO: 6954604 - DNA, 22 bp, Homo sapiens
atctgggtttaaatctcagctt

SEQ ID NO: 6954605 - DNA, 22 bp, Homo sapiens
agataaattcctaagatttcag

SEQ ID NO: 6954606 - DNA, 22 bp, Homo sapiens
attgctgaaagtattttatgac

SEQ ID NO: 6954607 - DNA, 22 bp, Homo sapiens
gtgaatttctgactaaaagtgc

SEQ ID NO: 6954608 - DNA, 18 bp, Homo sapiens
tgcatgcttttgtttcca

SEQ ID NO: 6954609 - DNA, 21 bp, Homo sapiens
tataggcttccatatgaaggg

SEQ ID NO: 6954610 - DNA, 22 bp, Homo sapiens
tcaaagacatctggtagctgag

SEQ ID NO: 6954611 - DNA, 22 bp, Homo sapiens
tcacagtaaaagcatggaagag

SEQ ID NO: 6954612 - DNA, 22 bp, Homo sapiens
gggaggaatgcaacttatttag

SEQ ID NO: 6954613 - DNA, 22 bp, Homo sapiens
gcaagagttttttctctcttga

SEQ ID NO: 6954614 - DNA, 22 bp, Homo sapiens
tggggctgtcccggtttggcga

SEQ ID NO: 6954615 - DNA, 23 bp, Homo sapiens
tgtctggagcctgagcaggtgct

SEQ ID NO: 6954616 - DNA, 22 bp, Homo sapiens
ctctgcctgccactgttcaggc

SEQ ID NO: 6954617 - DNA, 22 bp, Homo sapiens
aagtaacaatgctgttgaattg

SEQ ID NO: 6954618 - DNA, 21 bp, Homo sapiens
ggtgctcgctgatgaggagtg

SEQ ID NO: 6954619 - DNA, 22 bp, Homo sapiens
agagcacaggctctggagtcta

SEQ ID NO: 6954620 - DNA, 22 bp, Homo sapiens
tctagaatcactgtttccatct

SEQ ID NO: 6954621 - DNA, 19 bp, Homo sapiens
tttgatatctgaattatgc

SEQ ID NO: 6954622 - DNA, 22 bp, Homo sapiens
taggtacagtttctggtgtctt

SEQ ID NO: 6954623 - DNA, 22 bp, Homo sapiens
ttgaccatagaacatgcgctat

SEQ ID NO: 6954624 - DNA, 22 bp, Homo sapiens
gcagctggatttcaagagggag

SEQ ID NO: 6954625 - DNA, 22 bp, Homo sapiens
agctttctatatatgagttgct

SEQ ID NO: 6954626 - DNA, 22 bp, Homo sapiens
ttattcaggctctctttggcta

SEQ ID NO: 6954627 - DNA, 22 bp, Homo sapiens
tgcacacagatggtacatgcat

SEQ ID NO: 6954628 - DNA, 22 bp, Homo sapiens
gttaacacatgcaattgcactt

SEQ ID NO: 6954629 - DNA, 22 bp, Homo sapiens
ttgtcccttcagtaagagtgga

SEQ ID NO: 6954630 - DNA, 22 bp, Homo sapiens
tttctcagaggagccagacggt

SEQ ID NO: 6954631 - DNA, 20 bp, Homo sapiens
tcttggagctctttgtcctc

SEQ ID NO: 6954632 - DNA, 22 bp, Homo sapiens
agctgtgtgactctaagcaagt

SEQ ID NO: 6954633 - DNA, 22 bp, Homo sapiens
acagatataaactatagtagtg

SEQ ID NO: 6954634 - DNA, 20 bp, Homo sapiens
ccacagtggagactggagac

SEQ ID NO: 6954635 - DNA, 22 bp, Homo sapiens
agcaggaaggctttgggggttc

SEQ ID NO: 6954636 - DNA, 22 bp, Homo sapiens
tcacttgcctagcccagttcag

SEQ ID NO: 6954637 - DNA, 22 bp, Homo sapiens
ctgctgttccacctctgaatgc

SEQ ID NO: 6954638 - DNA, 22 bp, Homo sapiens
ttgttaaaggcaaaacaagcac

SEQ ID NO: 6954639 - DNA, 22 bp, Homo sapiens
taaattatgttccatgtccttt

SEQ ID NO: 6954640 - DNA, 22 bp, Homo sapiens
ccctggagtgtgacgaggcatt

SEQ ID NO: 6954641 - DNA, 22 bp, Homo sapiens
ggtcatctcaggtgtgcttgat

SEQ ID NO: 6954642 - DNA, 22 bp, Homo sapiens
agcctgccaggcgctgcctgga

SEQ ID NO: 6954643 - DNA, 22 bp, Homo sapiens
cccccaggggctccgcctcgtg

SEQ ID NO: 6954644 - DNA, 22 bp, Homo sapiens
ctcaggatccatctcctgccct

SEQ ID NO: 6954645 - DNA, 22 bp, Homo sapiens
caagggcttcaagtggccaaga

SEQ ID NO: 6954646 - DNA, 22 bp, Homo sapiens
atgctatgtttggtgttggaga

SEQ ID NO: 6954647 - DNA, 19 bp, Homo sapiens
gtcaggtcgttcctgccgg

SEQ ID NO: 6954648 - DNA, 22 bp, Homo sapiens
aagccctgcagtctctgccaca

SEQ ID NO: 6954649 - DNA, 22 bp, Homo sapiens
aagaagcagagctgtgggtgtt

SEQ ID NO: 6954650 - DNA, 22 bp, Homo sapiens
acatgagatttgggtggtgata

SEQ ID NO: 6954651 - DNA, 22 bp, Homo sapiens
gtcacagtcaaggccatgggca

SEQ ID NO: 6954652 - DNA, 22 bp, Homo sapiens
acacagtgtcagggcaggggcc

SEQ ID NO: 6954653 - DNA, 22 bp, Homo sapiens
atagatcaaagtttcatagcca

SEQ ID NO: 6954654 - DNA, 22 bp, Homo sapiens
tgacttcctgcactcaggtgat

SEQ ID NO: 6954655 - DNA, 22 bp, Homo sapiens
tccttggagcccaggagtagca

SEQ ID NO: 6954656 - DNA, 22 bp, Homo sapiens
ttcccagaatgaatggatggag

SEQ ID NO: 6954657 - DNA, 20 bp, Homo sapiens
gtctcaagtatctcacagtc

SEQ ID NO: 6954658 - DNA, 22 bp, Homo sapiens
gcgcaggcccgggtcagggccg

SEQ ID NO: 6954659 - DNA, 19 bp, Homo sapiens
ttctggaggttaccctgag

SEQ ID NO: 6954660 - DNA, 22 bp, Homo sapiens
agagcctgctacctcattccag

SEQ ID NO: 6954661 - DNA, 22 bp, Homo sapiens
ctttgtatctaaatatcttgaa

SEQ ID NO: 6954662 - DNA, 20 bp, Homo sapiens
gctgctctccacggtctgca

SEQ ID NO: 6954663 - DNA, 21 bp, Homo sapiens
cagctttgtctgtcttcgggg

SEQ ID NO: 6954664 - DNA, 22 bp, Homo sapiens
aggttctggtaagctgttgctt

SEQ ID NO: 6954665 - DNA, 21 bp, Homo sapiens
acttcccaggacctactcaga

SEQ ID NO: 6954666 - DNA, 22 bp, Homo sapiens
agggggcccttgcaggtgagcg

SEQ ID NO: 6954667 - DNA, 22 bp, Homo sapiens
tggagtgaagtaaagaggacaa

SEQ ID NO: 6954668 - DNA, 22 bp, Homo sapiens
cacagtgtgactgaccttcagc

SEQ ID NO: 6954669 - DNA, 22 bp, Homo sapiens
ctggaggggctggcatggtagc

SEQ ID NO: 6954670 - DNA, 22 bp, Homo sapiens
gaggacacaaagtggctgagat

SEQ ID NO: 6954671 - DNA, 22 bp, Homo sapiens
gcttggcacacttggacctgag

SEQ ID NO: 6954672 - DNA, 22 bp, Homo sapiens
acaagagcattgcaggtgtgtt

SEQ ID NO: 6954673 - DNA, 22 bp, Homo sapiens
gtgaagcacatgggcgttgggt

SEQ ID NO: 6954674 - DNA, 22 bp, Homo sapiens
agtttctgcaaatcatttttat

SEQ ID NO: 6954675 - DNA, 22 bp, Homo sapiens
gctgtcagccccaaagacaaag

SEQ ID NO: 6954676 - DNA, 22 bp, Homo sapiens
acccaggctagagtgcagtggt

SEQ ID NO: 6954677 - DNA, 22 bp, Homo sapiens
ctgaggcccctctcttgagctt

SEQ ID NO: 6954678 - DNA, 22 bp, Homo sapiens
ggatgtctagggtttatgtgcc

SEQ ID NO: 6954679 - DNA, 22 bp, Homo sapiens
ttccagggctaggtaatgggta

SEQ ID NO: 6954680 - DNA, 22 bp, Homo sapiens
tgtcattggtacaaattgattg

SEQ ID NO: 6954681 - DNA, 22 bp, Homo sapiens
atgagtatatgatatggtttgg

SEQ ID NO: 6954682 - DNA, 22 bp, Homo sapiens
aaatgccagcacacgtctgtgg

SEQ ID NO: 6954683 - DNA, 20 bp, Homo sapiens
aatgactactatatccatgg

SEQ ID NO: 6954684 - DNA, 22 bp, Homo sapiens
cacaactgccagccaggaaagg

SEQ ID NO: 6954685 - DNA, 22 bp, Homo sapiens
tgacggctgggggcagtggtca

SEQ ID NO: 6954686 - DNA, 22 bp, Homo sapiens
acctatttatgcaattatgaaa

SEQ ID NO: 6954687 - DNA, 22 bp, Homo sapiens
tgacttcaaggttcagcacctt

SEQ ID NO: 6954688 - DNA, 22 bp, Homo sapiens
atgctggtctcattgggttagg

SEQ ID NO: 6954689 - DNA, 22 bp, Homo sapiens
tgtgttgtgtcacctatcatgc

SEQ ID NO: 6954690 - DNA, 22 bp, Homo sapiens
ttaaggctgataagtcagatat

SEQ ID NO: 6954691 - DNA, 22 bp, Homo sapiens
agctatgtgtgcagggacagga

SEQ ID NO: 6954692 - DNA, 22 bp, Homo sapiens
accctccactttatctgtcttt

SEQ ID NO: 6954693 - DNA, 22 bp, Homo sapiens
tcatctctcaggataccagcag

SEQ ID NO: 6954694 - DNA, 22 bp, Homo sapiens
tgaattatcttgtaattttgaa

SEQ ID NO: 6954695 - DNA, 22 bp, Homo sapiens
atgaatggtgaagtctgataag

SEQ ID NO: 6954696 - DNA, 22 bp, Homo sapiens
cttacaagaccaaagaaaggat

SEQ ID NO: 6954697 - DNA, 22 bp, Homo sapiens
tgccctgctaaatataggtagc

SEQ ID NO: 6954698 - DNA, 22 bp, Homo sapiens
tctgaatagttctattttaaag

SEQ ID NO: 6954699 - DNA, 22 bp, Homo sapiens
tgcattgggagagattagggca

SEQ ID NO: 6954700 - DNA, 19 bp, Homo sapiens
ggcagtctcaagcagcaca

SEQ ID NO: 6954701 - DNA, 22 bp, Homo sapiens
caggaggttgagggtgcagtga

SEQ ID NO: 6954702 - DNA, 22 bp, Homo sapiens
agtcagttaaactttgtaaagt

SEQ ID NO: 6954703 - DNA, 22 bp, Homo sapiens
atttggtcaagcaaacccccat

SEQ ID NO: 6954704 - DNA, 22 bp, Homo sapiens
gcaggctccaaggcctgggaga

SEQ ID NO: 6954705 - DNA, 22 bp, Homo sapiens
tttagacaagatccttctgaat

SEQ ID NO: 6954706 - DNA, 22 bp, Homo sapiens
aagtcagacagctgagctgcct

SEQ ID NO: 6954707 - DNA, 20 bp, Homo sapiens
gcttccttcccagcccccac

SEQ ID NO: 6954708 - DNA, 18 bp, Homo sapiens
gtgtcctttgcaagaaac

SEQ ID NO: 6954709 - DNA, 20 bp, Homo sapiens
tcaggatgtgctgagtgaag

SEQ ID NO: 6954710 - DNA, 22 bp, Homo sapiens
actcttgattgatttagtcttt

SEQ ID NO: 6954711 - DNA, 22 bp, Homo sapiens
gggttggcatcagggttctgtg

SEQ ID NO: 6954712 - DNA, 22 bp, Homo sapiens
agtatttggtgtggtattgacc

SEQ ID NO: 6954713 - DNA, 22 bp, Homo sapiens
tgtcacaaacatacattataga

SEQ ID NO: 6954714 - DNA, 22 bp, Homo sapiens
taacaatgattagtgactacag

SEQ ID NO: 6954715 - DNA, 22 bp, Homo sapiens
ctgttaaaaagaccaatggatt

SEQ ID NO: 6954716 - DNA, 21 bp, Homo sapiens
gttgaatatccatgtatgtgt

SEQ ID NO: 6954717 - DNA, 22 bp, Homo sapiens
cagtgattaagatacccaggct

SEQ ID NO: 6954718 - DNA, 22 bp, Homo sapiens
agggctctggggtggcagagat

SEQ ID NO: 6954719 - DNA, 22 bp, Homo sapiens
tataattttaagtggtaaatta

SEQ ID NO: 6954720 - DNA, 22 bp, Homo sapiens
catcgatggaagtagtataggg

SEQ ID NO: 6954721 - DNA, 22 bp, Homo sapiens
aggccctcacagtctattgtga

SEQ ID NO: 6954722 - DNA, 20 bp, Homo sapiens
ggcctggtgaatgagagaat

SEQ ID NO: 6954723 - DNA, 22 bp, Homo sapiens
tattttacagactactttagat

SEQ ID NO: 6954724 - DNA, 22 bp, Homo sapiens
aagggctgatctcactttcttt

SEQ ID NO: 6954725 - DNA, 20 bp, Homo sapiens
tgggtgcctgccacggggcc

SEQ ID NO: 6954726 - DNA, 22 bp, Homo sapiens
ggcccatccatgctgctggtct

SEQ ID NO: 6954727 - DNA, 22 bp, Homo sapiens
attagtcagtatttgtttgcca

SEQ ID NO: 6954728 - DNA, 22 bp, Homo sapiens
tttagataatgctcaagcaatt

SEQ ID NO: 6954729 - DNA, 23 bp, Homo sapiens
ggttatttgcatcctgtaattat

SEQ ID NO: 6954730 - DNA, 22 bp, Homo sapiens
taatgcagtaagcaatggtgaa

SEQ ID NO: 6954731 - DNA, 22 bp, Homo sapiens
aagggctcggtagcagtcctga

SEQ ID NO: 6954732 - DNA, 22 bp, Homo sapiens
gtggttttattcgttcctctgt

SEQ ID NO: 6954733 - DNA, 22 bp, Homo sapiens
tcacagaagaagtagattgcat

SEQ ID NO: 6954734 - DNA, 22 bp, Homo sapiens
tggcggcgtgtggactgaggac

SEQ ID NO: 6954735 - DNA, 22 bp, Homo sapiens
ggaagccaggccaatgagaaca

SEQ ID NO: 6954736 - DNA, 22 bp, Homo sapiens
tcaggctgcatctgtaagggtg

SEQ ID NO: 6954737 - DNA, 22 bp, Homo sapiens
ttacatcagaaggaaacagcgt

SEQ ID NO: 6954738 - DNA, 19 bp, Homo sapiens
ctgtccacacactcgcttc

SEQ ID NO: 6954739 - DNA, 22 bp, Homo sapiens
gccctggatggcaggagccatc

SEQ ID NO: 6954740 - DNA, 20 bp, Homo sapiens
cgctccaccctggacctggc

SEQ ID NO: 6954741 - DNA, 22 bp, Homo sapiens
tggctgctgagaaggcagctgt

SEQ ID NO: 6954742 - DNA, 22 bp, Homo sapiens
agtaacacaagaggtccttgcg

SEQ ID NO: 6954743 - DNA, 22 bp, Homo sapiens
acagctgcacttgaagcaggtt

SEQ ID NO: 6954744 - DNA, 22 bp, Homo sapiens
ctgaggctctgggtgtcactgt

SEQ ID NO: 6954745 - DNA, 22 bp, Homo sapiens
tagggtcctgcctacagagaca

SEQ ID NO: 6954746 - DNA, 22 bp, Homo sapiens
tgattccaagacctattctatt

SEQ ID NO: 6954747 - DNA, 22 bp, Homo sapiens
taagtgagctagcagaagtgac

SEQ ID NO: 6954748 - DNA, 22 bp, Homo sapiens
tgctaatgtttcatttttagat

SEQ ID NO: 6954749 - DNA, 20 bp, Homo sapiens
agtgattttgatatggtctt

SEQ ID NO: 6954750 - DNA, 22 bp, Homo sapiens
taagtccaagggtatgagttgg

SEQ ID NO: 6954751 - DNA, 22 bp, Homo sapiens
ttcaggagaaagttcagtactt

SEQ ID NO: 6954752 - DNA, 22 bp, Homo sapiens
ttgttacagatcacatttctgc

SEQ ID NO: 6954753 - DNA, 19 bp, Homo sapiens
tgagagtgaggaaggcttc

SEQ ID NO: 6954754 - DNA, 18 bp, Homo sapiens
ttgaattcttctacatgt

SEQ ID NO: 6954755 - DNA, 22 bp, Homo sapiens
atctgggtcagtatgttcttgg

SEQ ID NO: 6954756 - DNA, 22 bp, Homo sapiens
tcaggatggcttctgcatcaaa

SEQ ID NO: 6954757 - DNA, 22 bp, Homo sapiens
aatctttcattcattcatacat

SEQ ID NO: 6954758 - DNA, 22 bp, Homo sapiens
tgttatgtgccacacttgaggg

SEQ ID NO: 6954759 - DNA, 22 bp, Homo sapiens
ggggggcagctgtcctggccat

SEQ ID NO: 6954760 - DNA, 22 bp, Homo sapiens
tgatctttgggccattaataaa

SEQ ID NO: 6954761 - DNA, 18 bp, Homo sapiens
gatatggaaggccatgcc

SEQ ID NO: 6954762 - DNA, 22 bp, Homo sapiens
acatagttagcttagagatact

SEQ ID NO: 6954763 - DNA, 22 bp, Homo sapiens
taggacacattgaagtgaaggc

SEQ ID NO: 6954764 - DNA, 22 bp, Homo sapiens
gggctgacaaccatctgacaag

SEQ ID NO: 6954765 - DNA, 22 bp, Homo sapiens
tgttactgggcatctagtgggt

SEQ ID NO: 6954766 - DNA, 22 bp, Homo sapiens
agagcctggacctgagctacaa

SEQ ID NO: 6954767 - DNA, 22 bp, Homo sapiens
atggaaatgatggaacattaaa

SEQ ID NO: 6954768 - DNA, 22 bp, Homo sapiens
ctccctggtgtcccctccagga

SEQ ID NO: 6954769 - DNA, 22 bp, Homo sapiens
tagaaatggggaagtagttagg

SEQ ID NO: 6954770 - DNA, 22 bp, Homo sapiens
ttacaagtgtcaggtactggca

SEQ ID NO: 6954771 - DNA, 22 bp, Homo sapiens
aggccagctcaccctggctcct

SEQ ID NO: 6954772 - DNA, 22 bp, Homo sapiens
tcatacatcttgtatatctatc

SEQ ID NO: 6954773 - DNA, 22 bp, Homo sapiens
ggcagctgtaagatgagtgaat

SEQ ID NO: 6954774 - DNA, 22 bp, Homo sapiens
gggatggggtcgggaccctgct

SEQ ID NO: 6954775 - DNA, 20 bp, Homo sapiens
gggctctggccaatgctttg

SEQ ID NO: 6954776 - DNA, 22 bp, Homo sapiens
ggcctgtgcacatgtgcaggaa

SEQ ID NO: 6954777 - DNA, 22 bp, Homo sapiens
tataatattccttgttgtaggt

SEQ ID NO: 6954778 - DNA, 22 bp, Homo sapiens
ctaccttatcagagtggtaagg

SEQ ID NO: 6954779 - DNA, 22 bp, Homo sapiens
ctacagagaactcagctgccct

SEQ ID NO: 6954780 - DNA, 22 bp, Homo sapiens
gcagtccttaggagaggaagta

SEQ ID NO: 6954781 - DNA, 22 bp, Homo sapiens
acagttgacagggagagggtta

SEQ ID NO: 6954782 - DNA, 19 bp, Homo sapiens
gcatgcttggtggcttctg

SEQ ID NO: 6954783 - DNA, 22 bp, Homo sapiens
ttactagctgagggaacttggg

SEQ ID NO: 6954784 - DNA, 21 bp, Homo sapiens
ttctcctgttttgcaccacag

SEQ ID NO: 6954785 - DNA, 22 bp, Homo sapiens
tgagatcacttacgtggctgca

SEQ ID NO: 6954786 - DNA, 22 bp, Homo sapiens
gtgctttttataaggcagactg

SEQ ID NO: 6954787 - DNA, 22 bp, Homo sapiens
actgttcttcatttagcaaaga

SEQ ID NO: 6954788 - DNA, 22 bp, Homo sapiens
gatgcttttccagtatgagagt

SEQ ID NO: 6954789 - DNA, 22 bp, Homo sapiens
tctaattgaatctaagcatgtt

SEQ ID NO: 6954790 - DNA, 22 bp, Homo sapiens
tgcagcagactgagtatgagaa

SEQ ID NO: 6954791 - DNA, 22 bp, Homo sapiens
taaggcacacagttgctgcatg

SEQ ID NO: 6954792 - DNA, 22 bp, Homo sapiens
tcagggctcaccagcctctgcc

SEQ ID NO: 6954793 - DNA, 22 bp, Homo sapiens
aactggcatatgaacttgttct

SEQ ID NO: 6954794 - DNA, 22 bp, Homo sapiens
tagctaagtacacattgaataa

SEQ ID NO: 6954795 - DNA, 22 bp, Homo sapiens
acctgaaactcaactttatctc

SEQ ID NO: 6954796 - DNA, 17 bp, Homo sapiens
gctccctgaggacagct

SEQ ID NO: 6954797 - DNA, 22 bp, Homo sapiens
ttcagtgtacagtgaagggatt

SEQ ID NO: 6954798 - DNA, 17 bp, Homo sapiens
aattgtcagcagtagct

SEQ ID NO: 6954799 - DNA, 22 bp, Homo sapiens
ctctggttcgtggtagatttta

SEQ ID NO: 6954800 - DNA, 22 bp, Homo sapiens
ctgtttttcagaaggtaaggga

SEQ ID NO: 6954801 - DNA, 19 bp, Homo sapiens
ggcagcaagctctgaaggc

SEQ ID NO: 6954802 - DNA, 22 bp, Homo sapiens
ttgcaaggtcatcatgcattgg

SEQ ID NO: 6954803 - DNA, 22 bp, Homo sapiens
ttgagtactcattttggtgctg

SEQ ID NO: 6954804 - DNA, 22 bp, Homo sapiens
ttccatgaaatgtgttatgctt

SEQ ID NO: 6954805 - DNA, 22 bp, Homo sapiens
tgcaaataaatttctgttcatt

SEQ ID NO: 6954806 - DNA, 22 bp, Homo sapiens
tctacacatttgtaaaggcatt

SEQ ID NO: 6954807 - DNA, 22 bp, Homo sapiens
tttcctctgctgccattgcccc

SEQ ID NO: 6954808 - DNA, 22 bp, Homo sapiens
atgttaagttactgaaatgaga

SEQ ID NO: 6954809 - DNA, 22 bp, Homo sapiens
atatgcagtctcttgcccttct

SEQ ID NO: 6954810 - DNA, 22 bp, Homo sapiens
cgctgcgaggcgcccttgttgc

SEQ ID NO: 6954811 - DNA, 18 bp, Homo sapiens
aagctgggaaggagacag

SEQ ID NO: 6954812 - DNA, 22 bp, Homo sapiens
tgaccacacgtctggaattgtg

SEQ ID NO: 6954813 - DNA, 22 bp, Homo sapiens
caagtagttgacatttatggag

SEQ ID NO: 6954814 - DNA, 22 bp, Homo sapiens
tcttgcattccattctcgtgcc

SEQ ID NO: 6954815 - DNA, 22 bp, Homo sapiens
cactcagggatcaggtaaattc

SEQ ID NO: 6954816 - DNA, 22 bp, Homo sapiens
agacattttacattcttccatt

SEQ ID NO: 6954817 - DNA, 22 bp, Homo sapiens
cctggcatccctctccttacgc

SEQ ID NO: 6954818 - DNA, 22 bp, Homo sapiens
cacagtacttaattctctaaat

SEQ ID NO: 6954819 - DNA, 22 bp, Homo sapiens
cagagctgacccaaggattgaa

SEQ ID NO: 6954820 - DNA, 22 bp, Homo sapiens
gcatacttcttgctgctttcag

SEQ ID NO: 6954821 - DNA, 22 bp, Homo sapiens
aagctgttgccctgctctttct

SEQ ID NO: 6954822 - DNA, 22 bp, Homo sapiens
tagaaatgattttgatgcttca

SEQ ID NO: 6954823 - DNA, 22 bp, Homo sapiens
atgcacagcagtgagttcagtg

SEQ ID NO: 6954824 - DNA, 22 bp, Homo sapiens
tagttttacatcagccattgtt

SEQ ID NO: 6954825 - DNA, 22 bp, Homo sapiens
ttgcatgtacgtacagagagag

SEQ ID NO: 6954826 - DNA, 22 bp, Homo sapiens
ccaggaccctgcaaaccctgtt

SEQ ID NO: 6954827 - DNA, 22 bp, Homo sapiens
aagcatttatagataagaattt

SEQ ID NO: 6954828 - DNA, 22 bp, Homo sapiens
aggacacttaggttattcaact

SEQ ID NO: 6954829 - DNA, 22 bp, Homo sapiens
aaagtgccacaactggacaacc

SEQ ID NO: 6954830 - DNA, 22 bp, Homo sapiens
gtccccgacgtttggcttgatg

SEQ ID NO: 6954831 - DNA, 22 bp, Homo sapiens
attggaaaatatggtttctgga

SEQ ID NO: 6954832 - DNA, 22 bp, Homo sapiens
agagtacactgtacacacaatt

SEQ ID NO: 6954833 - DNA, 22 bp, Homo sapiens
taatgagatcatatcttctgag

SEQ ID NO: 6954834 - DNA, 22 bp, Homo sapiens
tatcttcaatttattcaaggag

SEQ ID NO: 6954835 - DNA, 22 bp, Homo sapiens
gtccaggctaagtcccttctgc

SEQ ID NO: 6954836 - DNA, 22 bp, Homo sapiens
tgaacccttaggattttatttg

SEQ ID NO: 6954837 - DNA, 22 bp, Homo sapiens
gcagcaggaataggataagcaa

SEQ ID NO: 6954838 - DNA, 22 bp, Homo sapiens
tggcaaagtttatcaggaatat

SEQ ID NO: 6954839 - DNA, 22 bp, Homo sapiens
atgccttttcgggtacttctct

SEQ ID NO: 6954840 - DNA, 22 bp, Homo sapiens
agactggaggcattttgctcct

SEQ ID NO: 6954841 - DNA, 23 bp, Homo sapiens
tggcaagtttgactttcctttac

SEQ ID NO: 6954842 - DNA, 22 bp, Homo sapiens
tgaaaggaaagtacagtgatgc

SEQ ID NO: 6954843 - DNA, 23 bp, Homo sapiens
catgccagtttgtgcaggcagat

SEQ ID NO: 6954844 - DNA, 22 bp, Homo sapiens
ttcctccagccatgattgtaaa

SEQ ID NO: 6954845 - DNA, 22 bp, Homo sapiens
acagagagctgtgattgagtta

SEQ ID NO: 6954846 - DNA, 22 bp, Homo sapiens
atctgcatcagactttgcatga

SEQ ID NO: 6954847 - DNA, 22 bp, Homo sapiens
atatctgtggagggcttacaaa

SEQ ID NO: 6954848 - DNA, 22 bp, Homo sapiens
gaacagtaactgtctgctgtgt

SEQ ID NO: 6954849 - DNA, 23 bp, Homo sapiens
ggcagatttggtttgttttaata

SEQ ID NO: 6954850 - DNA, 22 bp, Homo sapiens
tgttaaattgattcacctttct

SEQ ID NO: 6954851 - DNA, 22 bp, Homo sapiens
aagcaactggctcattgtctca

SEQ ID NO: 6954852 - DNA, 22 bp, Homo sapiens
atttaatttacatttgacagag

SEQ ID NO: 6954853 - DNA, 22 bp, Homo sapiens
cagtattcatctaaggagcttg

SEQ ID NO: 6954854 - DNA, 22 bp, Homo sapiens
ggcagcgagtcgccaagtctcg

SEQ ID NO: 6954855 - DNA, 22 bp, Homo sapiens
ttggccaaataatcttgcagat

SEQ ID NO: 6954856 - DNA, 22 bp, Homo sapiens
ctcatggatataagaactgttt

SEQ ID NO: 6954857 - DNA, 22 bp, Homo sapiens
gaggaagaattggttattggag

SEQ ID NO: 6954858 - DNA, 22 bp, Homo sapiens
ctgtcctgatggtgccactggt

SEQ ID NO: 6954859 - DNA, 22 bp, Homo sapiens
aaggtggtttgctaatcccaac

SEQ ID NO: 6954860 - DNA, 22 bp, Homo sapiens
aaaattgaggccagtatgccat

SEQ ID NO: 6954861 - DNA, 22 bp, Homo sapiens
ctaatctggctgtgtcccgggc

SEQ ID NO: 6954862 - DNA, 22 bp, Homo sapiens
cccattcatcctcgcttccttc

SEQ ID NO: 6954863 - DNA, 22 bp, Homo sapiens
ttgccttcctgcccagcttctg

SEQ ID NO: 6954864 - DNA, 19 bp, Homo sapiens
tcctggtgaccctgaaatt

SEQ ID NO: 6954865 - DNA, 22 bp, Homo sapiens
tcagtttgaatgttagcacagt

SEQ ID NO: 6954866 - DNA, 22 bp, Homo sapiens
atttcttatgaatattgactgt

SEQ ID NO: 6954867 - DNA, 22 bp, Homo sapiens
cttcagctacctctgatgcaag

SEQ ID NO: 6954868 - DNA, 22 bp, Homo sapiens
agggaggatagtagtcagttta

SEQ ID NO: 6954869 - DNA, 22 bp, Homo sapiens
aaagtagcagtaattatgaaat

SEQ ID NO: 6954870 - DNA, 22 bp, Homo sapiens
agttctgttgtctagggaagcc

SEQ ID NO: 6954871 - DNA, 22 bp, Homo sapiens
gagtgggcttggggagagtttg

SEQ ID NO: 6954872 - DNA, 22 bp, Homo sapiens
ggaaaatttccttcaaaatgtg

SEQ ID NO: 6954873 - DNA, 22 bp, Homo sapiens
tgaatatggcacctctgtgtaa

SEQ ID NO: 6954874 - DNA, 22 bp, Homo sapiens
gtctcagggctgagggcagtgg

SEQ ID NO: 6954875 - DNA, 22 bp, Homo sapiens
cattgcactccatcttgggcaa

SEQ ID NO: 6954876 - DNA, 22 bp, Homo sapiens
gccaggaaaaacgtggtgggag

SEQ ID NO: 6954877 - DNA, 22 bp, Homo sapiens
tagcaggaattggctgcagctg

SEQ ID NO: 6954878 - DNA, 20 bp, Homo sapiens
tcatggctgctgagaggttc

SEQ ID NO: 6954879 - DNA, 18 bp, Homo sapiens
agttccttaaattggtgt

SEQ ID NO: 6954880 - DNA, 22 bp, Homo sapiens
tccagggatctttagagtcttt

SEQ ID NO: 6954881 - DNA, 22 bp, Homo sapiens
tgctaaagcaaactgtgctact

SEQ ID NO: 6954882 - DNA, 22 bp, Homo sapiens
agactctgagacatgaaccatc

SEQ ID NO: 6954883 - DNA, 22 bp, Homo sapiens
agttcatcttacttagagtaca

SEQ ID NO: 6954884 - DNA, 22 bp, Homo sapiens
tttttaagctcctttgatgtca

SEQ ID NO: 6954885 - DNA, 22 bp, Homo sapiens
tgtcttcctcttggcttgagct

SEQ ID NO: 6954886 - DNA, 22 bp, Homo sapiens
ggcatagatgcaggcaaagtgg

SEQ ID NO: 6954887 - DNA, 22 bp, Homo sapiens
aattaccttttccacttaggcc

SEQ ID NO: 6954888 - DNA, 22 bp, Homo sapiens
agttgctctaggtgaggtcttt

SEQ ID NO: 6954889 - DNA, 22 bp, Homo sapiens
ttgaagtctttagaacgacctc

SEQ ID NO: 6954890 - DNA, 22 bp, Homo sapiens
gaagatgggaatgatgagtggg

SEQ ID NO: 6954891 - DNA, 22 bp, Homo sapiens
taatgcaggtgcccttgggttt

SEQ ID NO: 6954892 - DNA, 22 bp, Homo sapiens
gcaatactgagattattgtact

SEQ ID NO: 6954893 - DNA, 22 bp, Homo sapiens
ggcaattacgtattagtcatgt

SEQ ID NO: 6954894 - DNA, 17 bp, Homo sapiens
gaccaaatcgcttggca

SEQ ID NO: 6954895 - DNA, 22 bp, Homo sapiens
ggagaggagctattgggggctc

SEQ ID NO: 6954896 - DNA, 22 bp, Homo sapiens
aatgggcatttgtttgtggtac

SEQ ID NO: 6954897 - DNA, 22 bp, Homo sapiens
agtctacaccccaggctccggg

SEQ ID NO: 6954898 - DNA, 22 bp, Homo sapiens
atcagtttttattaatgtagct

SEQ ID NO: 6954899 - DNA, 22 bp, Homo sapiens
gtggcttcatcaactgtgctta

SEQ ID NO: 6954900 - DNA, 22 bp, Homo sapiens
atatatattgcccaggctggtt

SEQ ID NO: 6954901 - DNA, 22 bp, Homo sapiens
ctggggaaggcggtgactgcgc

SEQ ID NO: 6954902 - DNA, 22 bp, Homo sapiens
aaacctttgtgtgtctgtgcct

SEQ ID NO: 6954903 - DNA, 22 bp, Homo sapiens
agagaagagtcttgtcaaatta

SEQ ID NO: 6954904 - DNA, 22 bp, Homo sapiens
aagttctttcagcttagagccc

SEQ ID NO: 6954905 - DNA, 22 bp, Homo sapiens
aagcagacatcccatacttttg

SEQ ID NO: 6954906 - DNA, 22 bp, Homo sapiens
tcctgggacaccccaatatgag

SEQ ID NO: 6954907 - DNA, 22 bp, Homo sapiens
ctttgtattcagttgggctgtg

SEQ ID NO: 6954908 - DNA, 21 bp, Homo sapiens
cagagccagactgctgaattt

SEQ ID NO: 6954909 - DNA, 22 bp, Homo sapiens
tgtgaggcctagacagcctggg

SEQ ID NO: 6954910 - DNA, 22 bp, Homo sapiens
catgaaatgtgttaatctcttg

SEQ ID NO: 6954911 - DNA, 22 bp, Homo sapiens
aagagatgttgaagtttattag

SEQ ID NO: 6954912 - DNA, 21 bp, Homo sapiens
actagcaaaagcctattatcc

SEQ ID NO: 6954913 - DNA, 22 bp, Homo sapiens
ttatttggttattgtaattggg

SEQ ID NO: 6954914 - DNA, 22 bp, Homo sapiens
cctagaggctgcaaggagaggc

SEQ ID NO: 6954915 - DNA, 20 bp, Homo sapiens
ctcctcagttccatgggagg

SEQ ID NO: 6954916 - DNA, 22 bp, Homo sapiens
tgccttgcggtgtatttctggg

SEQ ID NO: 6954917 - DNA, 22 bp, Homo sapiens
gagtatttatatgtaagtacct

SEQ ID NO: 6954918 - DNA, 22 bp, Homo sapiens
atgtattttaagatttgcctca

SEQ ID NO: 6954919 - DNA, 22 bp, Homo sapiens
gaagagcttagacagaatcaaa

SEQ ID NO: 6954920 - DNA, 22 bp, Homo sapiens
cttccagagctgggctgacctt

SEQ ID NO: 6954921 - DNA, 22 bp, Homo sapiens
ttcacaatagctggcatcatct

SEQ ID NO: 6954922 - DNA, 22 bp, Homo sapiens
aaactgcaattatgtttgcaga

SEQ ID NO: 6954923 - DNA, 22 bp, Homo sapiens
gcacagtggtgaaagcatgggt

SEQ ID NO: 6954924 - DNA, 17 bp, Homo sapiens
aggcaactagttccctc

SEQ ID NO: 6954925 - DNA, 22 bp, Homo sapiens
aagcatgcactccaaacagctt

SEQ ID NO: 6954926 - DNA, 22 bp, Homo sapiens
ttcattcttgggatcagagagt

SEQ ID NO: 6954927 - DNA, 22 bp, Homo sapiens
tacagaggcacatgcaattttc

SEQ ID NO: 6954928 - DNA, 22 bp, Homo sapiens
cgggctggctgcagctgctgga

SEQ ID NO: 6954929 - DNA, 22 bp, Homo sapiens
atttggaaacatgctgaccatg

SEQ ID NO: 6954930 - DNA, 22 bp, Homo sapiens
acgtcactgtctggcttgggct

SEQ ID NO: 6954931 - DNA, 22 bp, Homo sapiens
aacaaaacatttgtcttgtttc

SEQ ID NO: 6954932 - DNA, 22 bp, Homo sapiens
tcattacaagatttccaatttg

SEQ ID NO: 6954933 - DNA, 22 bp, Homo sapiens
cactagatagtggctgcttgga

SEQ ID NO: 6954934 - DNA, 22 bp, Homo sapiens
gttgctggaagctatggtccag

SEQ ID NO: 6954935 - DNA, 22 bp, Homo sapiens
gaggccttgggatgtgccacgg

SEQ ID NO: 6954936 - DNA, 22 bp, Homo sapiens
acattctagaagagcttcactt

SEQ ID NO: 6954937 - DNA, 22 bp, Homo sapiens
ccatcagctccagtatcttctg

SEQ ID NO: 6954938 - DNA, 22 bp, Homo sapiens
agagaagcagggagtcatctgt

SEQ ID NO: 6954939 - DNA, 22 bp, Homo sapiens
cgggtaggaacaaagagctgca

SEQ ID NO: 6954940 - DNA, 22 bp, Homo sapiens
tgggcctgggtctttgctgcca

SEQ ID NO: 6954941 - DNA, 22 bp, Homo sapiens
gaggctgaggcaggaggatcac

SEQ ID NO: 6954942 - DNA, 22 bp, Homo sapiens
tagttaactcttggtaataggt

SEQ ID NO: 6954943 - DNA, 22 bp, Homo sapiens
tattgagaaccctcaggaggca

SEQ ID NO: 6954944 - DNA, 22 bp, Homo sapiens
ctgggatgggaactgagaatca

SEQ ID NO: 6954945 - DNA, 22 bp, Homo sapiens
tcaagcagggtagcaagctggt

SEQ ID NO: 6954946 - DNA, 22 bp, Homo sapiens
tagcagcaattacacagtccgt

SEQ ID NO: 6954947 - DNA, 22 bp, Homo sapiens
agatttacaaaggatttgcttt

SEQ ID NO: 6954948 - DNA, 22 bp, Homo sapiens
cttgaagtaagacagctctgga

SEQ ID NO: 6954949 - DNA, 22 bp, Homo sapiens
attgtgctttagatcacagtct

SEQ ID NO: 6954950 - DNA, 22 bp, Homo sapiens
aatctcttgtatttcctttgac

SEQ ID NO: 6954951 - DNA, 22 bp, Homo sapiens
gaaagtaacatttcttgaatta

SEQ ID NO: 6954952 - DNA, 22 bp, Homo sapiens
catgcggctctttccaaaccgg

SEQ ID NO: 6954953 - DNA, 22 bp, Homo sapiens
gtctccagaagcctagacagcc

SEQ ID NO: 6954954 - DNA, 22 bp, Homo sapiens
gctgctgtccttcaagtctgcg

SEQ ID NO: 6954955 - DNA, 22 bp, Homo sapiens
ggaatacaaatctttgttctct

SEQ ID NO: 6954956 - DNA, 22 bp, Homo sapiens
ttcccagagataagacgtctta

SEQ ID NO: 6954957 - DNA, 22 bp, Homo sapiens
tctgtgcagacatggggaagcc

SEQ ID NO: 6954958 - DNA, 22 bp, Homo sapiens
ctctctgttcattgagtcaaaa

SEQ ID NO: 6954959 - DNA, 22 bp, Homo sapiens
gcaatagagcagctaatggaaa

SEQ ID NO: 6954960 - DNA, 22 bp, Homo sapiens
gctgcaagcatgtcatcctcac

SEQ ID NO: 6954961 - DNA, 22 bp, Homo sapiens
gaccagctggtcctgtcctggg

SEQ ID NO: 6954962 - DNA, 22 bp, Homo sapiens
atccagagacccaaggacagaa

SEQ ID NO: 6954963 - DNA, 22 bp, Homo sapiens
tcagcatctcaaccttctctac

SEQ ID NO: 6954964 - DNA, 22 bp, Homo sapiens
acagctgtgaagcaagcactct

SEQ ID NO: 6954965 - DNA, 20 bp, Homo sapiens
ctggggaggaggatgtgttc

SEQ ID NO: 6954966 - DNA, 22 bp, Homo sapiens
gcagaggaggacccaggaatta

SEQ ID NO: 6954967 - DNA, 19 bp, Homo sapiens
agcatccagtcatgggatc

SEQ ID NO: 6954968 - DNA, 22 bp, Homo sapiens
attaaggctgcactggccttaa

SEQ ID NO: 6954969 - DNA, 22 bp, Homo sapiens
cctaggaacccccaggcttctg

SEQ ID NO: 6954970 - DNA, 22 bp, Homo sapiens
caggggcttaagtgacagaagg

SEQ ID NO: 6954971 - DNA, 23 bp, Homo sapiens
tggagaattcttccttccactgt

SEQ ID NO: 6954972 - DNA, 22 bp, Homo sapiens
gctgccttgccaggggcagaaa

SEQ ID NO: 6954973 - DNA, 18 bp, Homo sapiens
atccaaaaagatggaagt

SEQ ID NO: 6954974 - DNA, 23 bp, Homo sapiens
ggctccctcctagctttcccaat

SEQ ID NO: 6954975 - DNA, 22 bp, Homo sapiens
ccatgtacatgaacacggcggc

SEQ ID NO: 6954976 - DNA, 22 bp, Homo sapiens
aacccgggaggcggaggttgtg

SEQ ID NO: 6954977 - DNA, 22 bp, Homo sapiens
ttgagggagaaagttggagtag

SEQ ID NO: 6954978 - DNA, 21 bp, Homo sapiens
cctgtggtgccagatcgccag

SEQ ID NO: 6954979 - DNA, 22 bp, Homo sapiens
gaggaggtcgctgctgagcccc

SEQ ID NO: 6954980 - DNA, 22 bp, Homo sapiens
aagccaagttggaagactgaat

SEQ ID NO: 6954981 - DNA, 17 bp, Homo sapiens
aaggcacagggcactgg

SEQ ID NO: 6954982 - DNA, 17 bp, Homo sapiens
tctgaggcctctaggag

SEQ ID NO: 6954983 - DNA, 17 bp, Homo sapiens
gagattttcgtcctgaa

SEQ ID NO: 6954984 - DNA, 22 bp, Homo sapiens
cccagctctctcagttctgctt

SEQ ID NO: 6954985 - DNA, 22 bp, Homo sapiens
atgaactcttctggttattttt

SEQ ID NO: 6954986 - DNA, 22 bp, Homo sapiens
acagattatggatatatgtgga

SEQ ID NO: 6954987 - DNA, 22 bp, Homo sapiens
cagcccttgatgataatttatc

SEQ ID NO: 6954988 - DNA, 22 bp, Homo sapiens
tggagacatgggcgaatctaag

SEQ ID NO: 6954989 - DNA, 22 bp, Homo sapiens
agtgtcaatgctctgttaaaaa

SEQ ID NO: 6954990 - DNA, 22 bp, Homo sapiens
gtcagggatccactgctcttct

SEQ ID NO: 6954991 - DNA, 22 bp, Homo sapiens
tatgcaacagcattattacaat

SEQ ID NO: 6954992 - DNA, 22 bp, Homo sapiens
atgctcagggcacactctggac

SEQ ID NO: 6954993 - DNA, 22 bp, Homo sapiens
ataggagactgttcttggcttc

SEQ ID NO: 6954994 - DNA, 22 bp, Homo sapiens
tgtcattttctggttagttaat

SEQ ID NO: 6954995 - DNA, 18 bp, Homo sapiens
tgttgcgagcataatgga

SEQ ID NO: 6954996 - DNA, 22 bp, Homo sapiens
ctgagctgaaacttgagaggct

SEQ ID NO: 6954997 - DNA, 22 bp, Homo sapiens
attatttagaaatcgattgaaa

SEQ ID NO: 6954998 - DNA, 22 bp, Homo sapiens
caacctcatagaaagaaaatgt

SEQ ID NO: 6954999 - DNA, 22 bp, Homo sapiens
catatgtatttctcataattag

SEQ ID NO: 6955000 - DNA, 22 bp, Homo sapiens
ttcagcccccaaagcctcattc

SEQ ID NO: 6955001 - DNA, 22 bp, Homo sapiens
tgtgccctcctgccaggggctg

SEQ ID NO: 6955002 - DNA, 22 bp, Homo sapiens
acctggagcttccaactcaact

SEQ ID NO: 6955003 - DNA, 22 bp, Homo sapiens
aggttcgggcacttacaaatgg

SEQ ID NO: 6955004 - DNA, 22 bp, Homo sapiens
acacttaatcttactgaggatc

SEQ ID NO: 6955005 - DNA, 22 bp, Homo sapiens
gatgttgctcagcgttcttggg

SEQ ID NO: 6955006 - DNA, 22 bp, Homo sapiens
agctctggagccggaggatttc

SEQ ID NO: 6955007 - DNA, 22 bp, Homo sapiens
ggatatatgcatgttatcattt

SEQ ID NO: 6955008 - DNA, 19 bp, Homo sapiens
gtcctgcaactggctctcc

SEQ ID NO: 6955009 - DNA, 17 bp, Homo sapiens
attctgtaaggttggat

SEQ ID NO: 6955010 - DNA, 22 bp, Homo sapiens
cacagctatggggctgtagcct

SEQ ID NO: 6955011 - DNA, 18 bp, Homo sapiens
gtcagttttgaagccaga

SEQ ID NO: 6955012 - DNA, 22 bp, Homo sapiens
ctggtattgagttgttgcttcc

SEQ ID NO: 6955013 - DNA, 22 bp, Homo sapiens
cagcatgcaagtccagatgtgg

SEQ ID NO: 6955014 - DNA, 22 bp, Homo sapiens
cacctggatatgtttcagcttg

SEQ ID NO: 6955015 - DNA, 22 bp, Homo sapiens
ctgtttcagaacttcttaaaaa

SEQ ID NO: 6955016 - DNA, 22 bp, Homo sapiens
gcagaacaacgtaggagtggag

SEQ ID NO: 6955017 - DNA, 22 bp, Homo sapiens
gaagaatatataatgattttgt

SEQ ID NO: 6955018 - DNA, 21 bp, Homo sapiens
cagggcaaccaagtccagaga

SEQ ID NO: 6955019 - DNA, 22 bp, Homo sapiens
cccaaagcagggtcattgggcc

SEQ ID NO: 6955020 - DNA, 22 bp, Homo sapiens
gtgggtgtgagtgacggcgtcc

SEQ ID NO: 6955021 - DNA, 22 bp, Homo sapiens
tagccagtgagacccagaaata

SEQ ID NO: 6955022 - DNA, 22 bp, Homo sapiens
acacactgggcatggtttatgc

SEQ ID NO: 6955023 - DNA, 22 bp, Homo sapiens
actttaattaatgaactgtggc

SEQ ID NO: 6955024 - DNA, 22 bp, Homo sapiens
ttccctctctccagggctgcct

SEQ ID NO: 6955025 - DNA, 22 bp, Homo sapiens
tcagtaaataactcagatgctc

SEQ ID NO: 6955026 - DNA, 22 bp, Homo sapiens
gcatgtgtcatctgcctttcgt

SEQ ID NO: 6955027 - DNA, 22 bp, Homo sapiens
caactgggataaagagctaaag

SEQ ID NO: 6955028 - DNA, 22 bp, Homo sapiens
agagctatttcttaaaagctgt

SEQ ID NO: 6955029 - DNA, 22 bp, Homo sapiens
tcagagtcctttggcctgacag

SEQ ID NO: 6955030 - DNA, 22 bp, Homo sapiens
tgcactattttcaggctttgtg

SEQ ID NO: 6955031 - DNA, 22 bp, Homo sapiens
aggcagttgagtggctttttca

SEQ ID NO: 6955032 - DNA, 22 bp, Homo sapiens
tggtatttccaggcttatggta

SEQ ID NO: 6955033 - DNA, 22 bp, Homo sapiens
tagggtccaagccttataatta

SEQ ID NO: 6955034 - DNA, 22 bp, Homo sapiens
gcagcttagaaaaatgaaattg

SEQ ID NO: 6955035 - DNA, 19 bp, Homo sapiens
ggaacttggcctttaccca

SEQ ID NO: 6955036 - DNA, 22 bp, Homo sapiens
atgggcaacagcagtcacaatg

SEQ ID NO: 6955037 - DNA, 22 bp, Homo sapiens
agttgaaattaagagagagttt

SEQ ID NO: 6955038 - DNA, 22 bp, Homo sapiens
tttcacaggtaagcaatacagg

SEQ ID NO: 6955039 - DNA, 21 bp, Homo sapiens
tcacatttctcatgggtaaat

SEQ ID NO: 6955040 - DNA, 22 bp, Homo sapiens
tcctagcctggtgagaaactgt

SEQ ID NO: 6955041 - DNA, 22 bp, Homo sapiens
tctatacacacaaagaatgctt

SEQ ID NO: 6955042 - DNA, 22 bp, Homo sapiens
cagacagtgttagagtcaagct

SEQ ID NO: 6955043 - DNA, 22 bp, Homo sapiens
ttccatgctaagacacgcaggg

SEQ ID NO: 6955044 - DNA, 22 bp, Homo sapiens
cagctgaatcagtgagtggaaa

SEQ ID NO: 6955045 - DNA, 22 bp, Homo sapiens
tctcgctgaagaagctgcacat

SEQ ID NO: 6955046 - DNA, 22 bp, Homo sapiens
agggcactgaacagctgtagca

SEQ ID NO: 6955047 - DNA, 22 bp, Homo sapiens
tgtcagttctctgcattgtctc

SEQ ID NO: 6955048 - DNA, 22 bp, Homo sapiens
gatcatgctggctgccctgttg

SEQ ID NO: 6955049 - DNA, 22 bp, Homo sapiens
gctcagtgcagcctttctgtat

SEQ ID NO: 6955050 - DNA, 22 bp, Homo sapiens
caagttacattagaaatcatgc

SEQ ID NO: 6955051 - DNA, 22 bp, Homo sapiens
atcagcccgtttctgccttcta

SEQ ID NO: 6955052 - DNA, 22 bp, Homo sapiens
cttcaaaccacatgctgaaaat

SEQ ID NO: 6955053 - DNA, 22 bp, Homo sapiens
atacagtaaccacattctatag

SEQ ID NO: 6955054 - DNA, 22 bp, Homo sapiens
ggctgctcggagcctcctgtga

SEQ ID NO: 6955055 - DNA, 22 bp, Homo sapiens
taagtgagatctgaaatgaaat

SEQ ID NO: 6955056 - DNA, 22 bp, Homo sapiens
ttgagagttttcaatagattgg

SEQ ID NO: 6955057 - DNA, 22 bp, Homo sapiens
gggaagggtgttgtcttatctt

SEQ ID NO: 6955058 - DNA, 20 bp, Homo sapiens
aggtcttccaatcagctcct

SEQ ID NO: 6955059 - DNA, 17 bp, Homo sapiens
tgctgacagctgtgtgt

SEQ ID NO: 6955060 - DNA, 22 bp, Homo sapiens
ttgatgctgtctttcagaatca

SEQ ID NO: 6955061 - DNA, 22 bp, Homo sapiens
aggctggctcggcttttctgtc

SEQ ID NO: 6955062 - DNA, 18 bp, Homo sapiens
ccaggccatgaacctctg

SEQ ID NO: 6955063 - DNA, 22 bp, Homo sapiens
cagcatgaaaagtgttgctatc

SEQ ID NO: 6955064 - DNA, 22 bp, Homo sapiens
cttgtcagcactttgccgaaaa

SEQ ID NO: 6955065 - DNA, 22 bp, Homo sapiens
atttccatgaattcccactcat

SEQ ID NO: 6955066 - DNA, 22 bp, Homo sapiens
cccaaggaataggatcccagga

SEQ ID NO: 6955067 - DNA, 22 bp, Homo sapiens
cagaggttacctagagcaagaa

SEQ ID NO: 6955068 - DNA, 22 bp, Homo sapiens
atgttcaaactttttacacacc

SEQ ID NO: 6955069 - DNA, 23 bp, Homo sapiens
ctgtcctgccatccacagcggcc

SEQ ID NO: 6955070 - DNA, 22 bp, Homo sapiens
tctgggccagatctagggatct

SEQ ID NO: 6955071 - DNA, 22 bp, Homo sapiens
ttaggctagggtgcaatggtgc

SEQ ID NO: 6955072 - DNA, 22 bp, Homo sapiens
ttagctaaaccacagagattct

SEQ ID NO: 6955073 - DNA, 22 bp, Homo sapiens
tctctaaagatagctgcctcga

SEQ ID NO: 6955074 - DNA, 23 bp, Homo sapiens
ctgaagcagttccctctctgccc

SEQ ID NO: 6955075 - DNA, 22 bp, Homo sapiens
gaggcttctgtaaccctgtcct

SEQ ID NO: 6955076 - DNA, 22 bp, Homo sapiens
cataatgttgtaacacatagag

SEQ ID NO: 6955077 - DNA, 22 bp, Homo sapiens
ccagagagtatcatggagagta

SEQ ID NO: 6955078 - DNA, 22 bp, Homo sapiens
attgtcctatctcagtgccatg

SEQ ID NO: 6955079 - DNA, 22 bp, Homo sapiens
acaaggtttaaatagccatcag

SEQ ID NO: 6955080 - DNA, 22 bp, Homo sapiens
actactgaatattagttctgaa

SEQ ID NO: 6955081 - DNA, 22 bp, Homo sapiens
atttcagtattatacaactgct

SEQ ID NO: 6955082 - DNA, 22 bp, Homo sapiens
agaaagcagtcccttccgaccg

SEQ ID NO: 6955083 - DNA, 22 bp, Homo sapiens
gtaatgtgtgtgtcttctctag

SEQ ID NO: 6955084 - DNA, 22 bp, Homo sapiens
aaggcacttttcctgagatgat

SEQ ID NO: 6955085 - DNA, 22 bp, Homo sapiens
aggccacagcctgggaggtgac

SEQ ID NO: 6955086 - DNA, 22 bp, Homo sapiens
cggctggaagctggacaggccg

SEQ ID NO: 6955087 - DNA, 22 bp, Homo sapiens
tcatctcaaaattatgctgcac

SEQ ID NO: 6955088 - DNA, 22 bp, Homo sapiens
gcacagccactgagtgagaacc

SEQ ID NO: 6955089 - DNA, 22 bp, Homo sapiens
agtgaaaggaaaaactgatatt

SEQ ID NO: 6955090 - DNA, 22 bp, Homo sapiens
gccaatttcctgaggtaaagct

SEQ ID NO: 6955091 - DNA, 22 bp, Homo sapiens
atctacaggaagagaaagggcc

SEQ ID NO: 6955092 - DNA, 21 bp, Homo sapiens
cccttcttactcaagctcatt

SEQ ID NO: 6955093 - DNA, 22 bp, Homo sapiens
aacattcaagttctggtttatg

SEQ ID NO: 6955094 - DNA, 22 bp, Homo sapiens
atgcagtacagataattctaca

SEQ ID NO: 6955095 - DNA, 22 bp, Homo sapiens
tacatgacctagacttgctaaa

SEQ ID NO: 6955096 - DNA, 22 bp, Homo sapiens
taggccttagaggaccaggatt

SEQ ID NO: 6955097 - DNA, 22 bp, Homo sapiens
tctggggtgcagcctggacata

SEQ ID NO: 6955098 - DNA, 22 bp, Homo sapiens
tagattgtaagctccttgaggg

SEQ ID NO: 6955099 - DNA, 22 bp, Homo sapiens
ctacagtagaggttgtcaggga

SEQ ID NO: 6955100 - DNA, 22 bp, Homo sapiens
tcccatctccaacatttttctt

SEQ ID NO: 6955101 - DNA, 22 bp, Homo sapiens
agggatgttcattttgtggctg

SEQ ID NO: 6955102 - DNA, 22 bp, Homo sapiens
aatgggcacacttagagagtaa

SEQ ID NO: 6955103 - DNA, 22 bp, Homo sapiens
ttgtacagaaactgcatttgga

SEQ ID NO: 6955104 - DNA, 22 bp, Homo sapiens
gtgggcaaggtccctgccagct

SEQ ID NO: 6955105 - DNA, 23 bp, Homo sapiens
ttctggacattgggcaatagcag

SEQ ID NO: 6955106 - DNA, 19 bp, Homo sapiens
cctaaagtttgaaccctgg

SEQ ID NO: 6955107 - DNA, 22 bp, Homo sapiens
ccagaatcatcatctgaagcct

SEQ ID NO: 6955108 - DNA, 22 bp, Homo sapiens
gaaggcatcacagaggctgtga

SEQ ID NO: 6955109 - DNA, 22 bp, Homo sapiens
gtacataaaatactgccatgta

SEQ ID NO: 6955110 - DNA, 22 bp, Homo sapiens
ggctgtgcgggcagccgtggga

SEQ ID NO: 6955111 - DNA, 22 bp, Homo sapiens
ctgggctgccaggtaggcacac

SEQ ID NO: 6955112 - DNA, 21 bp, Homo sapiens
tttctaagtaactggcagcat

SEQ ID NO: 6955113 - DNA, 22 bp, Homo sapiens
gattccagtccgtgactattct

SEQ ID NO: 6955114 - DNA, 22 bp, Homo sapiens
atataggcagaaaggaaggcaa

SEQ ID NO: 6955115 - DNA, 22 bp, Homo sapiens
gggctgctataacaagatacct

SEQ ID NO: 6955116 - DNA, 22 bp, Homo sapiens
tggacgattgaaagatgctctg

SEQ ID NO: 6955117 - DNA, 22 bp, Homo sapiens
ttcatgccaccccttgaggagt

SEQ ID NO: 6955118 - DNA, 22 bp, Homo sapiens
ttaatgccaacaaagtgatttt

SEQ ID NO: 6955119 - DNA, 22 bp, Homo sapiens
ttggagaatgttttcctgcagt

SEQ ID NO: 6955120 - DNA, 22 bp, Homo sapiens
gaagattttctcctttaaatga

SEQ ID NO: 6955121 - DNA, 22 bp, Homo sapiens
acagaatttgcttgggcaatgg

SEQ ID NO: 6955122 - DNA, 19 bp, Homo sapiens
ttactagtctcagttatgg

SEQ ID NO: 6955123 - DNA, 22 bp, Homo sapiens
tgaagtttcctctgaggccagt

SEQ ID NO: 6955124 - DNA, 18 bp, Homo sapiens
ctagagaaggttactatg

SEQ ID NO: 6955125 - DNA, 22 bp, Homo sapiens
gctgtcctctgatctctggagg

SEQ ID NO: 6955126 - DNA, 22 bp, Homo sapiens
gattccttggctctgtctcagg

SEQ ID NO: 6955127 - DNA, 22 bp, Homo sapiens
cctcatggacctcagactgtcc

SEQ ID NO: 6955128 - DNA, 22 bp, Homo sapiens
cactgtttgaggccctagttga

SEQ ID NO: 6955129 - DNA, 22 bp, Homo sapiens
tttatttcttagtttgccacag

SEQ ID NO: 6955130 - DNA, 22 bp, Homo sapiens
tgtgcctctgaagggcggacgg

SEQ ID NO: 6955131 - DNA, 22 bp, Homo sapiens
tggctcttggtgctagtttctg

SEQ ID NO: 6955132 - DNA, 22 bp, Homo sapiens
tggtgagctctggcagtctgtg

SEQ ID NO: 6955133 - DNA, 22 bp, Homo sapiens
ccaggcaatgttctaagtgatt

SEQ ID NO: 6955134 - DNA, 22 bp, Homo sapiens
agtagacagacccatggcttta

SEQ ID NO: 6955135 - DNA, 22 bp, Homo sapiens
ctgaaaatgttacacaggaaga

SEQ ID NO: 6955136 - DNA, 21 bp, Homo sapiens
tgggcaagtttgggggtcctc

SEQ ID NO: 6955137 - DNA, 22 bp, Homo sapiens
tcaggccacttcacaggtgatt

SEQ ID NO: 6955138 - DNA, 22 bp, Homo sapiens
tgcttctcaaaaggaggtaggt

SEQ ID NO: 6955139 - DNA, 22 bp, Homo sapiens
aggcaccttgcggtccagtgaa

SEQ ID NO: 6955140 - DNA, 22 bp, Homo sapiens
aaggaagaatcatcacgttggg

SEQ ID NO: 6955141 - DNA, 22 bp, Homo sapiens
gggcacagaagtctaagacatc

SEQ ID NO: 6955142 - DNA, 22 bp, Homo sapiens
tgcggaaggcagcgcagggtgg

SEQ ID NO: 6955143 - DNA, 22 bp, Homo sapiens
ttctacactgagttttttccct

SEQ ID NO: 6955144 - DNA, 22 bp, Homo sapiens
aattaaatgacaggggaagatg

SEQ ID NO: 6955145 - DNA, 22 bp, Homo sapiens
gtgtcctcttattgctcttggc

SEQ ID NO: 6955146 - DNA, 22 bp, Homo sapiens
gcgcagagtgaagatctccgtg

SEQ ID NO: 6955147 - DNA, 20 bp, Homo sapiens
ctctgaggtatctgtaaagt

SEQ ID NO: 6955148 - DNA, 22 bp, Homo sapiens
tctagcatctaattatggaatc

SEQ ID NO: 6955149 - DNA, 23 bp, Homo sapiens
aagaatgcttctgaagagctgcc

SEQ ID NO: 6955150 - DNA, 20 bp, Homo sapiens
agagccttgaggaagatgat

SEQ ID NO: 6955151 - DNA, 22 bp, Homo sapiens
gtttcccagtctgcagagttct

SEQ ID NO: 6955152 - DNA, 22 bp, Homo sapiens
gctgctgggagggatcgtaaat

SEQ ID NO: 6955153 - DNA, 22 bp, Homo sapiens
tatcagaaggcacatggagtct

SEQ ID NO: 6955154 - DNA, 22 bp, Homo sapiens
agctctagggaagaaaggcaca

SEQ ID NO: 6955155 - DNA, 23 bp, Homo sapiens
caggcaggatgaggactacactc

SEQ ID NO: 6955156 - DNA, 22 bp, Homo sapiens
attccaccttctacctgggaga

SEQ ID NO: 6955157 - DNA, 22 bp, Homo sapiens
acagacatgctgtttgggtggt

SEQ ID NO: 6955158 - DNA, 22 bp, Homo sapiens
tcaggtcaggaaaataagattg

SEQ ID NO: 6955159 - DNA, 22 bp, Homo sapiens
ttgtgcctggcttgtattcaca

SEQ ID NO: 6955160 - DNA, 22 bp, Homo sapiens
catggcttgtcttgtcttctga

SEQ ID NO: 6955161 - DNA, 22 bp, Homo sapiens
atttccattatcatgacaaatt

SEQ ID NO: 6955162 - DNA, 22 bp, Homo sapiens
agccagaggaagcctggccctc

SEQ ID NO: 6955163 - DNA, 22 bp, Homo sapiens
ttccagaggggaggtggcagcc

SEQ ID NO: 6955164 - DNA, 21 bp, Homo sapiens
tgcacagggcccaggagagcc

SEQ ID NO: 6955165 - DNA, 21 bp, Homo sapiens
cactatttatatatgccagct

SEQ ID NO: 6955166 - DNA, 21 bp, Homo sapiens
ttcagccctgtttgaggctac

SEQ ID NO: 6955167 - DNA, 22 bp, Homo sapiens
gattttacaaactgcaggaccc

SEQ ID NO: 6955168 - DNA, 22 bp, Homo sapiens
ctgaagtcagatggcacaaggt

SEQ ID NO: 6955169 - DNA, 22 bp, Homo sapiens
gagtgtctgtggggcatggaca

SEQ ID NO: 6955170 - DNA, 22 bp, Homo sapiens
ttggcagatgagaccaggggtt

SEQ ID NO: 6955171 - DNA, 22 bp, Homo sapiens
cagcaccctttccactgccttg

SEQ ID NO: 6955172 - DNA, 22 bp, Homo sapiens
agagctagcaaatagagcttca

SEQ ID NO: 6955173 - DNA, 22 bp, Homo sapiens
tccctctggaggctctagggga

SEQ ID NO: 6955174 - DNA, 22 bp, Homo sapiens
tctggacatttggtaggataga

SEQ ID NO: 6955175 - DNA, 22 bp, Homo sapiens
cacattaagaataatgagacta

SEQ ID NO: 6955176 - DNA, 22 bp, Homo sapiens
aatgctggaagcctcagtagat

SEQ ID NO: 6955177 - DNA, 22 bp, Homo sapiens
tactgagctggtccactgaggt

SEQ ID NO: 6955178 - DNA, 22 bp, Homo sapiens
tagaacctccagagtggccccc

SEQ ID NO: 6955179 - DNA, 22 bp, Homo sapiens
atcatgtagcactggaacatgg

SEQ ID NO: 6955180 - DNA, 22 bp, Homo sapiens
gctggctttgcactgggtgcat

SEQ ID NO: 6955181 - DNA, 22 bp, Homo sapiens
ccctgtggttgctagggcacag

SEQ ID NO: 6955182 - DNA, 22 bp, Homo sapiens
ccggctcggcgaccaggctgaa

SEQ ID NO: 6955183 - DNA, 22 bp, Homo sapiens
tagcttaatatgaaacacataa

SEQ ID NO: 6955184 - DNA, 22 bp, Homo sapiens
gagtcctgatccttagctctcc

SEQ ID NO: 6955185 - DNA, 22 bp, Homo sapiens
cttgggccacctggagggactg

SEQ ID NO: 6955186 - DNA, 22 bp, Homo sapiens
tgtcctgggaatgggatgcagt

SEQ ID NO: 6955187 - DNA, 22 bp, Homo sapiens
tccactccttatgccagacggt

SEQ ID NO: 6955188 - DNA, 22 bp, Homo sapiens
ttctagcttgagtgaataaagg

SEQ ID NO: 6955189 - DNA, 22 bp, Homo sapiens
ttggaacatgccggggtccagg

SEQ ID NO: 6955190 - DNA, 22 bp, Homo sapiens
ttcatatgcagattaacaaata

SEQ ID NO: 6955191 - DNA, 22 bp, Homo sapiens
cctggagcaggagctgcagagg

SEQ ID NO: 6955192 - DNA, 19 bp, Homo sapiens
atagcagctatacccagat

SEQ ID NO: 6955193 - DNA, 22 bp, Homo sapiens
atagatcttttcactacatatg

SEQ ID NO: 6955194 - DNA, 22 bp, Homo sapiens
gcactgagcaccagccacagat

SEQ ID NO: 6955195 - DNA, 22 bp, Homo sapiens
tttccaaataaggtcacattct

SEQ ID NO: 6955196 - DNA, 22 bp, Homo sapiens
tctaggccctttttccctccaa

SEQ ID NO: 6955197 - DNA, 22 bp, Homo sapiens
aaagtgtactatgtcatgaaca

SEQ ID NO: 6955198 - DNA, 22 bp, Homo sapiens
gccactcatgggaggtgtgcaa

SEQ ID NO: 6955199 - DNA, 22 bp, Homo sapiens
aggccagttgttcagtgggccg

SEQ ID NO: 6955200 - DNA, 19 bp, Homo sapiens
tgctcaggccaaggagccc

SEQ ID NO: 6955201 - DNA, 22 bp, Homo sapiens
tccagctggcccggccatgaat

SEQ ID NO: 6955202 - DNA, 20 bp, Homo sapiens
tcttttattggcagatcctg

SEQ ID NO: 6955203 - DNA, 22 bp, Homo sapiens
tgcatgtacgcgtgtgcacata

SEQ ID NO: 6955204 - DNA, 22 bp, Homo sapiens
taggtggtagagcctggcttgc

SEQ ID NO: 6955205 - DNA, 18 bp, Homo sapiens
tcctcagcctcacctagc

SEQ ID NO: 6955206 - DNA, 22 bp, Homo sapiens
gtggtacagctgaaaggcttgc

SEQ ID NO: 6955207 - DNA, 23 bp, Homo sapiens
agttggacctgggtaagaaaatg

SEQ ID NO: 6955208 - DNA, 22 bp, Homo sapiens
tgtgattttcgttatggcttgg

SEQ ID NO: 6955209 - DNA, 18 bp, Homo sapiens
acagtaaagaaaggaatt

SEQ ID NO: 6955210 - DNA, 22 bp, Homo sapiens
tttgtactagtcagtaaatagt

SEQ ID NO: 6955211 - DNA, 22 bp, Homo sapiens
ggaaggtgctccctggacagag

SEQ ID NO: 6955212 - DNA, 21 bp, Homo sapiens
taggcagaggagcaggtatct

SEQ ID NO: 6955213 - DNA, 22 bp, Homo sapiens
gaaatgtgtgacaagtttcaat

SEQ ID NO: 6955214 - DNA, 22 bp, Homo sapiens
aatcctaatgtgggtccagttt

SEQ ID NO: 6955215 - DNA, 22 bp, Homo sapiens
gagttattgagtatagaatgta

SEQ ID NO: 6955216 - DNA, 22 bp, Homo sapiens
gcagactgtacctggaagaggg

SEQ ID NO: 6955217 - DNA, 22 bp, Homo sapiens
gcctcagaaagcttttattcat

SEQ ID NO: 6955218 - DNA, 22 bp, Homo sapiens
agcaccaggcaccaaagggcct

SEQ ID NO: 6955219 - DNA, 22 bp, Homo sapiens
ccagtgcattgccgtgtctagg

SEQ ID NO: 6955220 - DNA, 22 bp, Homo sapiens
acatttctcagggagttttgct

SEQ ID NO: 6955221 - DNA, 22 bp, Homo sapiens
tattgagaccagtgcttgctta

SEQ ID NO: 6955222 - DNA, 22 bp, Homo sapiens
acattctcaaatatttgtggaa

SEQ ID NO: 6955223 - DNA, 22 bp, Homo sapiens
atttaatgtcgagctattgtag

SEQ ID NO: 6955224 - DNA, 22 bp, Homo sapiens
tattaacatgaactgacttttc

SEQ ID NO: 6955225 - DNA, 19 bp, Homo sapiens
cagggatgggtagggactc

SEQ ID NO: 6955226 - DNA, 22 bp, Homo sapiens
actgaacaccatttataacatt

SEQ ID NO: 6955227 - DNA, 20 bp, Homo sapiens
actgttggaagtggagaatg

SEQ ID NO: 6955228 - DNA, 22 bp, Homo sapiens
caatgcttctcattagccaatg

SEQ ID NO: 6955229 - DNA, 22 bp, Homo sapiens
cacagagcaggtgctgggaaga

SEQ ID NO: 6955230 - DNA, 22 bp, Homo sapiens
ccagctatggctattcaaggtc

SEQ ID NO: 6955231 - DNA, 22 bp, Homo sapiens
tactcagtttatgatttcaagt

SEQ ID NO: 6955232 - DNA, 22 bp, Homo sapiens
gaagctaatgagataaatgcca

SEQ ID NO: 6955233 - DNA, 22 bp, Homo sapiens
ggccacctaggagccacagtga

SEQ ID NO: 6955234 - DNA, 22 bp, Homo sapiens
ttactgagggtgtatcttagtg

SEQ ID NO: 6955235 - DNA, 22 bp, Homo sapiens
atattaattatttacacatgag

SEQ ID NO: 6955236 - DNA, 23 bp, Homo sapiens
gtctaagaaaggcatcaggatga

SEQ ID NO: 6955237 - DNA, 22 bp, Homo sapiens
tagacattggccattcctgtgg

SEQ ID NO: 6955238 - DNA, 22 bp, Homo sapiens
ggctagagtggaactggagcgg

SEQ ID NO: 6955239 - DNA, 22 bp, Homo sapiens
cttcttcaatagcaagcgcata

SEQ ID NO: 6955240 - DNA, 22 bp, Homo sapiens
acaaactgggataggatcctgt

SEQ ID NO: 6955241 - DNA, 22 bp, Homo sapiens
ctgtagcagacagaccctaggt

SEQ ID NO: 6955242 - DNA, 22 bp, Homo sapiens
tgaccctggcctggtggcggaa

SEQ ID NO: 6955243 - DNA, 22 bp, Homo sapiens
ggcccagtgctgttcacccagt

SEQ ID NO: 6955244 - DNA, 21 bp, Homo sapiens
ggctgctgtcaccgctgtcac

SEQ ID NO: 6955245 - DNA, 22 bp, Homo sapiens
ctgtgagagtggtggcctaggc

SEQ ID NO: 6955246 - DNA, 22 bp, Homo sapiens
tgagcacctactagaatgctaa

SEQ ID NO: 6955247 - DNA, 22 bp, Homo sapiens
agggaatgtagcaagatgccaa

SEQ ID NO: 6955248 - DNA, 22 bp, Homo sapiens
ctgctggcaccgatgaaagaca

SEQ ID NO: 6955249 - DNA, 22 bp, Homo sapiens
ggctttcttgttaaatgtccat

SEQ ID NO: 6955250 - DNA, 22 bp, Homo sapiens
aggcagtgagcagggtgtcatg

SEQ ID NO: 6955251 - DNA, 21 bp, Homo sapiens
aggcagcgattttcatattgc

SEQ ID NO: 6955252 - DNA, 22 bp, Homo sapiens
aggaagcccaagtctcatcttc

SEQ ID NO: 6955253 - DNA, 22 bp, Homo sapiens
cagcccttgtttctaaagctgc

SEQ ID NO: 6955254 - DNA, 20 bp, Homo sapiens
aggccctccccactgttgct

SEQ ID NO: 6955255 - DNA, 22 bp, Homo sapiens
ggtttaattggtccaggatggg

SEQ ID NO: 6955256 - DNA, 22 bp, Homo sapiens
ctaggaatggtacctcttacaa

SEQ ID NO: 6955257 - DNA, 22 bp, Homo sapiens
aacttagagctctcctaaatga

SEQ ID NO: 6955258 - DNA, 22 bp, Homo sapiens
tgcaatctcggcactttgggag

SEQ ID NO: 6955259 - DNA, 22 bp, Homo sapiens
tgggtgtgaagtctgttggcct

SEQ ID NO: 6955260 - DNA, 22 bp, Homo sapiens
tctcagtgacactcttcataca

SEQ ID NO: 6955261 - DNA, 22 bp, Homo sapiens
attgcttttccttaacacatgc

SEQ ID NO: 6955262 - DNA, 22 bp, Homo sapiens
tttgccttctctgaacctattt

SEQ ID NO: 6955263 - DNA, 22 bp, Homo sapiens
ttaggctcacatgctagatttg

SEQ ID NO: 6955264 - DNA, 22 bp, Homo sapiens
ctaatagataccacattggaca

SEQ ID NO: 6955265 - DNA, 22 bp, Homo sapiens
ggagttatttgcaggaggggca

SEQ ID NO: 6955266 - DNA, 22 bp, Homo sapiens
aatgcaaatgtaagggtgggat

SEQ ID NO: 6955267 - DNA, 23 bp, Homo sapiens
cagttcccactgtctgtcacaag

SEQ ID NO: 6955268 - DNA, 22 bp, Homo sapiens
tggctaacagttaagatttcat

SEQ ID NO: 6955269 - DNA, 22 bp, Homo sapiens
ttttccagcataggtacatata

SEQ ID NO: 6955270 - DNA, 22 bp, Homo sapiens
tgtacaggaggccacattggaa

SEQ ID NO: 6955271 - DNA, 22 bp, Homo sapiens
tagtcttttgagaagtatatct

SEQ ID NO: 6955272 - DNA, 17 bp, Homo sapiens
ttccagcatgttactaa

SEQ ID NO: 6955273 - DNA, 22 bp, Homo sapiens
gctggcagggacagctgcgtgt

SEQ ID NO: 6955274 - DNA, 22 bp, Homo sapiens
gtctggcacataagaggagctc

SEQ ID NO: 6955275 - DNA, 22 bp, Homo sapiens
agctctttagagtctcccttct

SEQ ID NO: 6955276 - DNA, 22 bp, Homo sapiens
ggctggcactctgtccagtgtc

SEQ ID NO: 6955277 - DNA, 22 bp, Homo sapiens
taaaagtaggaatgaaacgcat

SEQ ID NO: 6955278 - DNA, 22 bp, Homo sapiens
ttgaagtcaccaaaaattggtg

SEQ ID NO: 6955279 - DNA, 22 bp, Homo sapiens
aatcattgttcttcagatttga

SEQ ID NO: 6955280 - DNA, 22 bp, Homo sapiens
aatgtgtgtatttctaggcgag

SEQ ID NO: 6955281 - DNA, 22 bp, Homo sapiens
gggcagctcctgtggaatccac

SEQ ID NO: 6955282 - DNA, 22 bp, Homo sapiens
aaggtattattgtctatgtact

SEQ ID NO: 6955283 - DNA, 22 bp, Homo sapiens
ctggccctcagactcatgggca

SEQ ID NO: 6955284 - DNA, 22 bp, Homo sapiens
taaagagcacgcttttctctct

SEQ ID NO: 6955285 - DNA, 22 bp, Homo sapiens
ataagtgagaacaaaaattaga

SEQ ID NO: 6955286 - DNA, 22 bp, Homo sapiens
gtaacacatgatgggttccagt

SEQ ID NO: 6955287 - DNA, 22 bp, Homo sapiens
ggctcatgtttcagaaagtgga

SEQ ID NO: 6955288 - DNA, 20 bp, Homo sapiens
tttcaagtcggtagagtcta

SEQ ID NO: 6955289 - DNA, 22 bp, Homo sapiens
agggggagacatgtgtgtgttt

SEQ ID NO: 6955290 - DNA, 22 bp, Homo sapiens
tgtctgaagcactgggcgttgc

SEQ ID NO: 6955291 - DNA, 22 bp, Homo sapiens
cagaagttcatttagcctctct

SEQ ID NO: 6955292 - DNA, 22 bp, Homo sapiens
tcagagcactggtgctaccttg

SEQ ID NO: 6955293 - DNA, 22 bp, Homo sapiens
ttatgtacctctttctgcttca

SEQ ID NO: 6955294 - DNA, 22 bp, Homo sapiens
tctctgcccaagtttctcaagt

SEQ ID NO: 6955295 - DNA, 22 bp, Homo sapiens
gggctgaaaggccgcctcagat

SEQ ID NO: 6955296 - DNA, 22 bp, Homo sapiens
aaactctaatcaaatatagcat

SEQ ID NO: 6955297 - DNA, 22 bp, Homo sapiens
ttcttttgggaattacgtatgc

SEQ ID NO: 6955298 - DNA, 22 bp, Homo sapiens
tgcaggagctgctgtcctgctc

SEQ ID NO: 6955299 - DNA, 22 bp, Homo sapiens
gtgcatatgtacctgtgatcat

SEQ ID NO: 6955300 - DNA, 22 bp, Homo sapiens
aagggcggacagggcacatttc

SEQ ID NO: 6955301 - DNA, 22 bp, Homo sapiens
agctttgcttcttttccatagc

SEQ ID NO: 6955302 - DNA, 22 bp, Homo sapiens
tcctgggagagtgggactgtat

SEQ ID NO: 6955303 - DNA, 22 bp, Homo sapiens
attttgttgatggtggagtagc

SEQ ID NO: 6955304 - DNA, 20 bp, Homo sapiens
tttcagagtgtctttccatt

SEQ ID NO: 6955305 - DNA, 22 bp, Homo sapiens
actagacaggttgtactattgg

SEQ ID NO: 6955306 - DNA, 22 bp, Homo sapiens
gcctgtcctgctaatgacacgt

SEQ ID NO: 6955307 - DNA, 22 bp, Homo sapiens
ctactttaacatggaggcactt

SEQ ID NO: 6955308 - DNA, 22 bp, Homo sapiens
tcatttctctgagtctgataat

SEQ ID NO: 6955309 - DNA, 22 bp, Homo sapiens
ccaggagacaaagatgactgct

SEQ ID NO: 6955310 - DNA, 22 bp, Homo sapiens
tctaattccattaaattgatgt

SEQ ID NO: 6955311 - DNA, 22 bp, Homo sapiens
cactgaatttaacttgtatccc

SEQ ID NO: 6955312 - DNA, 22 bp, Homo sapiens
ctgtaaaatgaacctagtcatc

SEQ ID NO: 6955313 - DNA, 22 bp, Homo sapiens
gcttccagagagccccgcctgg

SEQ ID NO: 6955314 - DNA, 22 bp, Homo sapiens
tatcatgatcagcaactaatca

SEQ ID NO: 6955315 - DNA, 22 bp, Homo sapiens
atgtttgttgatcatttatgaa

SEQ ID NO: 6955316 - DNA, 22 bp, Homo sapiens
ttctagatagagtgcaaattat

SEQ ID NO: 6955317 - DNA, 22 bp, Homo sapiens
atcaaatcattgcattaatgtt

SEQ ID NO: 6955318 - DNA, 22 bp, Homo sapiens
tgtcatggcactggtaggagtg

SEQ ID NO: 6955319 - DNA, 22 bp, Homo sapiens
cagaaggttccacaagatagaa

SEQ ID NO: 6955320 - DNA, 22 bp, Homo sapiens
gcagtaggagaagaggatgctt

SEQ ID NO: 6955321 - DNA, 22 bp, Homo sapiens
tggagcaggtgccaggtgtgtg

SEQ ID NO: 6955322 - DNA, 22 bp, Homo sapiens
ggaccatgaggagatgggcctc

SEQ ID NO: 6955323 - DNA, 22 bp, Homo sapiens
ctctgaggcttgttctatgtat

SEQ ID NO: 6955324 - DNA, 22 bp, Homo sapiens
agatgagtaaatggagtcttcc

SEQ ID NO: 6955325 - DNA, 22 bp, Homo sapiens
tacaagatgacaggtgcatgat

SEQ ID NO: 6955326 - DNA, 22 bp, Homo sapiens
aggctgttgcatgccacagata

SEQ ID NO: 6955327 - DNA, 23 bp, Homo sapiens
tggcaactccttagcacctgtgg

SEQ ID NO: 6955328 - DNA, 22 bp, Homo sapiens
cagggcagttttacttctctct

SEQ ID NO: 6955329 - DNA, 20 bp, Homo sapiens
tctctgtaaatcttctttta

SEQ ID NO: 6955330 - DNA, 22 bp, Homo sapiens
tgttttgggtcactttccttgg

SEQ ID NO: 6955331 - DNA, 22 bp, Homo sapiens
catgtgtaggtataacttgtga

SEQ ID NO: 6955332 - DNA, 23 bp, Homo sapiens
aggttatgattatagagcgagga

SEQ ID NO: 6955333 - DNA, 22 bp, Homo sapiens
aattttctaaggtgatgatctg

SEQ ID NO: 6955334 - DNA, 21 bp, Homo sapiens
ttctgggccggagaaggggcg

SEQ ID NO: 6955335 - DNA, 22 bp, Homo sapiens
tgctgcaacattttataactca

SEQ ID NO: 6955336 - DNA, 22 bp, Homo sapiens
ccagaagctatgttttagataa

SEQ ID NO: 6955337 - DNA, 22 bp, Homo sapiens
aggtcagacagggtgtctttct

SEQ ID NO: 6955338 - DNA, 22 bp, Homo sapiens
tgggtgaccccagaagaggatc

SEQ ID NO: 6955339 - DNA, 22 bp, Homo sapiens
ggacattatagcttccagattg

SEQ ID NO: 6955340 - DNA, 22 bp, Homo sapiens
aggggcagcctcacaatcctct

SEQ ID NO: 6955341 - DNA, 22 bp, Homo sapiens
tctgaggttccctcaactacct

SEQ ID NO: 6955342 - DNA, 22 bp, Homo sapiens
gcactggttaccctgagtggct

SEQ ID NO: 6955343 - DNA, 22 bp, Homo sapiens
atcagcaagcatttattgagtg

SEQ ID NO: 6955344 - DNA, 22 bp, Homo sapiens
ttgggcaccagtgcactgacag

SEQ ID NO: 6955345 - DNA, 22 bp, Homo sapiens
acactgttctttgcactgagaa

SEQ ID NO: 6955346 - DNA, 22 bp, Homo sapiens
cctgggcctctcaaagtgctgg

SEQ ID NO: 6955347 - DNA, 22 bp, Homo sapiens
accttcaattatttttgttcca

SEQ ID NO: 6955348 - DNA, 19 bp, Homo sapiens
ttcactaggtcacaaggtc

SEQ ID NO: 6955349 - DNA, 22 bp, Homo sapiens
gcaagacatgtctaaggtttaa

SEQ ID NO: 6955350 - DNA, 22 bp, Homo sapiens
ctgttcacacacttgtactctc

SEQ ID NO: 6955351 - DNA, 22 bp, Homo sapiens
tcttcatgtatactcatggtac

SEQ ID NO: 6955352 - DNA, 22 bp, Homo sapiens
tgtggtctggccattcagggac

SEQ ID NO: 6955353 - DNA, 22 bp, Homo sapiens
ccaggcctgcattccctctcag

SEQ ID NO: 6955354 - DNA, 22 bp, Homo sapiens
gagtccttgacacatagtaggt

SEQ ID NO: 6955355 - DNA, 22 bp, Homo sapiens
taagcaaataatgcatcaaggg

SEQ ID NO: 6955356 - DNA, 22 bp, Homo sapiens
atgtaaggctgcctatgacact

SEQ ID NO: 6955357 - DNA, 22 bp, Homo sapiens
tttgtcaataactaccaacagg

SEQ ID NO: 6955358 - DNA, 20 bp, Homo sapiens
actgaggttagataacaggt

SEQ ID NO: 6955359 - DNA, 22 bp, Homo sapiens
tagccatgagcagatcactata

SEQ ID NO: 6955360 - DNA, 22 bp, Homo sapiens
ccggcgccttcacggggcttag

SEQ ID NO: 6955361 - DNA, 22 bp, Homo sapiens
cttaaggagtagtggtgatggc

SEQ ID NO: 6955362 - DNA, 22 bp, Homo sapiens
caatttcatggataaaagatgt

SEQ ID NO: 6955363 - DNA, 22 bp, Homo sapiens
ttgtgacattgattaaactatg

SEQ ID NO: 6955364 - DNA, 22 bp, Homo sapiens
catttattggcatgtagtaggt

SEQ ID NO: 6955365 - DNA, 22 bp, Homo sapiens
atgagcacactgataagcccct

SEQ ID NO: 6955366 - DNA, 22 bp, Homo sapiens
aggcagacaagtccagaactgg

SEQ ID NO: 6955367 - DNA, 22 bp, Homo sapiens
ctttgttctgccaatggcccat

SEQ ID NO: 6955368 - DNA, 22 bp, Homo sapiens
ggggaagaaccgggattcccat

SEQ ID NO: 6955369 - DNA, 22 bp, Homo sapiens
gtctgaaaatgccctacgattg

SEQ ID NO: 6955370 - DNA, 22 bp, Homo sapiens
gtggccaggagaccttgggcat

SEQ ID NO: 6955371 - DNA, 22 bp, Homo sapiens
tgacattgtgtgcatttaaagt

SEQ ID NO: 6955372 - DNA, 19 bp, Homo sapiens
tttactctccaaggtgagt

SEQ ID NO: 6955373 - DNA, 22 bp, Homo sapiens
ttcatgttggattcactgtgag

SEQ ID NO: 6955374 - DNA, 23 bp, Homo sapiens
tctgtaggcagcatgccactctc

SEQ ID NO: 6955375 - DNA, 22 bp, Homo sapiens
ctctctgttatgctttcatgaa

SEQ ID NO: 6955376 - DNA, 22 bp, Homo sapiens
ctcccgaggcggccccggctcg

SEQ ID NO: 6955377 - DNA, 22 bp, Homo sapiens
cattttatgtttatggagtgct

SEQ ID NO: 6955378 - DNA, 22 bp, Homo sapiens
agatgagtaggtagcattagta

SEQ ID NO: 6955379 - DNA, 22 bp, Homo sapiens
cttgtgcaaatcctcgagcaca

SEQ ID NO: 6955380 - DNA, 22 bp, Homo sapiens
tggaatctgtatgtatgtataa

SEQ ID NO: 6955381 - DNA, 22 bp, Homo sapiens
atgtgtaatgtggtattttaat

SEQ ID NO: 6955382 - DNA, 22 bp, Homo sapiens
taggaccaggcttggagatagg

SEQ ID NO: 6955383 - DNA, 20 bp, Homo sapiens
ctgtggtgagcaggagagta

SEQ ID NO: 6955384 - DNA, 22 bp, Homo sapiens
tctcagaatcaggacctacttc

SEQ ID NO: 6955385 - DNA, 22 bp, Homo sapiens
agtgtcaactgtctacagggag

SEQ ID NO: 6955386 - DNA, 19 bp, Homo sapiens
ggtaaaagtgagcttcagg

SEQ ID NO: 6955387 - DNA, 22 bp, Homo sapiens
ttcatatttctttaaggacttt

SEQ ID NO: 6955388 - DNA, 22 bp, Homo sapiens
aaagtcatttgtatataccctt

SEQ ID NO: 6955389 - DNA, 22 bp, Homo sapiens
tcatgataatacaggccttcta

SEQ ID NO: 6955390 - DNA, 22 bp, Homo sapiens
atatgtctatagagcctgtggg

SEQ ID NO: 6955391 - DNA, 22 bp, Homo sapiens
tgggtgagccacaggagttgtc

SEQ ID NO: 6955392 - DNA, 22 bp, Homo sapiens
tcctggcttttcttggctcatc

SEQ ID NO: 6955393 - DNA, 22 bp, Homo sapiens
ggagatgcttcttgtgtttatt

SEQ ID NO: 6955394 - DNA, 22 bp, Homo sapiens
ctcttgctgtcaaagcagggta

SEQ ID NO: 6955395 - DNA, 22 bp, Homo sapiens
tactggacacgtatatatagat

SEQ ID NO: 6955396 - DNA, 22 bp, Homo sapiens
gattatggagaagaacaatgaa

SEQ ID NO: 6955397 - DNA, 22 bp, Homo sapiens
ttgcattgtgattacagaggtg

SEQ ID NO: 6955398 - DNA, 22 bp, Homo sapiens
gcatttcctgtgcttggcatat

SEQ ID NO: 6955399 - DNA, 23 bp, Homo sapiens
aacaataggttttggcagaatag

SEQ ID NO: 6955400 - DNA, 22 bp, Homo sapiens
ccccaccatgtagaaactgaga

SEQ ID NO: 6955401 - DNA, 22 bp, Homo sapiens
aagtgaatagcctatttactag

SEQ ID NO: 6955402 - DNA, 18 bp, Homo sapiens
gctagggcatgcatggtg

SEQ ID NO: 6955403 - DNA, 22 bp, Homo sapiens
aaaagctctttctgctgtagat

SEQ ID NO: 6955404 - DNA, 22 bp, Homo sapiens
tatctaagaattccagagaaag

SEQ ID NO: 6955405 - DNA, 22 bp, Homo sapiens
gttggtccagcattgcctcact

SEQ ID NO: 6955406 - DNA, 22 bp, Homo sapiens
aatgatgtatgtgtgcacgcat

SEQ ID NO: 6955407 - DNA, 22 bp, Homo sapiens
tatattagtggaatgatatgaa

SEQ ID NO: 6955408 - DNA, 22 bp, Homo sapiens
ttctaagattcatgaggacagg

SEQ ID NO: 6955409 - DNA, 22 bp, Homo sapiens
cttctcaactgcacttgccagg

SEQ ID NO: 6955410 - DNA, 22 bp, Homo sapiens
ttagaatttctgctcactttga

SEQ ID NO: 6955411 - DNA, 22 bp, Homo sapiens
gctgaagagacttctgttcgaa

SEQ ID NO: 6955412 - DNA, 22 bp, Homo sapiens
actgtgggagcgcagtggcagc

SEQ ID NO: 6955413 - DNA, 19 bp, Homo sapiens
tccaggctgagagtcagct

SEQ ID NO: 6955414 - DNA, 21 bp, Homo sapiens
actcaggcaccaggggatggc

SEQ ID NO: 6955415 - DNA, 22 bp, Homo sapiens
tcattcttgatcactagttagt

SEQ ID NO: 6955416 - DNA, 22 bp, Homo sapiens
tgtatcaagatcagcagctgtt

SEQ ID NO: 6955417 - DNA, 22 bp, Homo sapiens
atggtccaagtcatctttgtgt

SEQ ID NO: 6955418 - DNA, 22 bp, Homo sapiens
acttctctttagtactaaatgt

SEQ ID NO: 6955419 - DNA, 22 bp, Homo sapiens
gaggcaaagcatgtggctcagg

SEQ ID NO: 6955420 - DNA, 22 bp, Homo sapiens
aaacattgtacattctgtagct

SEQ ID NO: 6955421 - DNA, 22 bp, Homo sapiens
cactgcccaggcacccatcttg

SEQ ID NO: 6955422 - DNA, 22 bp, Homo sapiens
attacactagctattcttatgg

SEQ ID NO: 6955423 - DNA, 22 bp, Homo sapiens
ttttgagatggagtcttgctct

SEQ ID NO: 6955424 - DNA, 22 bp, Homo sapiens
gaggaacttgggttttggattg

SEQ ID NO: 6955425 - DNA, 22 bp, Homo sapiens
gaggcaagcccagtgggtctaa

SEQ ID NO: 6955426 - DNA, 21 bp, Homo sapiens
ttccccaaggcctcaggggca

SEQ ID NO: 6955427 - DNA, 22 bp, Homo sapiens
acaaatgattatcacagaggag

SEQ ID NO: 6955428 - DNA, 22 bp, Homo sapiens
ctgagctgtttaatcccagata

SEQ ID NO: 6955429 - DNA, 22 bp, Homo sapiens
aaggcagcaggatttggtgact

SEQ ID NO: 6955430 - DNA, 22 bp, Homo sapiens
ttctgatatagtgattgattta

SEQ ID NO: 6955431 - DNA, 22 bp, Homo sapiens
gtccagccaggcctgtctctgg

SEQ ID NO: 6955432 - DNA, 22 bp, Homo sapiens
ccatttgggaatcttccatgga

SEQ ID NO: 6955433 - DNA, 19 bp, Homo sapiens
gactcaaggaagctctgat

SEQ ID NO: 6955434 - DNA, 22 bp, Homo sapiens
atgaggcacgtgttactggcct

SEQ ID NO: 6955435 - DNA, 22 bp, Homo sapiens
agctactctgcagtgcccatgg

SEQ ID NO: 6955436 - DNA, 22 bp, Homo sapiens
gctggggcctctgtgaggttaa

SEQ ID NO: 6955437 - DNA, 22 bp, Homo sapiens
atgaagtctctttttcatgaga

SEQ ID NO: 6955438 - DNA, 22 bp, Homo sapiens
tggagtgagctctaagaaactt

SEQ ID NO: 6955439 - DNA, 22 bp, Homo sapiens
atttaatgaggctgggggtgga

SEQ ID NO: 6955440 - DNA, 21 bp, Homo sapiens
agctttgaggctctggggccc

SEQ ID NO: 6955441 - DNA, 22 bp, Homo sapiens
catttcaatgccttcaacatag

SEQ ID NO: 6955442 - DNA, 19 bp, Homo sapiens
gcctggcagtgtacaaggc

SEQ ID NO: 6955443 - DNA, 22 bp, Homo sapiens
agaatcctgttttacttcatca

SEQ ID NO: 6955444 - DNA, 22 bp, Homo sapiens
tggcctcccctaacagcctctt

SEQ ID NO: 6955445 - DNA, 23 bp, Homo sapiens
tggctctctcagtgctgcagagg

SEQ ID NO: 6955446 - DNA, 22 bp, Homo sapiens
tactgttagagcgatttgtcct

SEQ ID NO: 6955447 - DNA, 22 bp, Homo sapiens
tctccccaaaggactcactctc

SEQ ID NO: 6955448 - DNA, 22 bp, Homo sapiens
gtgtgggtgtactgttctagat

SEQ ID NO: 6955449 - DNA, 22 bp, Homo sapiens
cactctgatggtttctgttcaa

SEQ ID NO: 6955450 - DNA, 22 bp, Homo sapiens
tgtgacagtcgttaggagctca

SEQ ID NO: 6955451 - DNA, 22 bp, Homo sapiens
tactttgagatgatgctgatcg

SEQ ID NO: 6955452 - DNA, 21 bp, Homo sapiens
accttcagtgttctcagctgc

SEQ ID NO: 6955453 - DNA, 19 bp, Homo sapiens
gctggcagaattttgaacc

SEQ ID NO: 6955454 - DNA, 22 bp, Homo sapiens
aggtatttcaaagcccacttcc

SEQ ID NO: 6955455 - DNA, 22 bp, Homo sapiens
cccaatatgactgtatttgaag

SEQ ID NO: 6955456 - DNA, 22 bp, Homo sapiens
aatcttaggtttggcttcatct

SEQ ID NO: 6955457 - DNA, 20 bp, Homo sapiens
tcaggctggtgggctttccc

SEQ ID NO: 6955458 - DNA, 22 bp, Homo sapiens
ctgcctgttcctgatcattcta

SEQ ID NO: 6955459 - DNA, 22 bp, Homo sapiens
cactgcaacctcagactcctgg

SEQ ID NO: 6955460 - DNA, 22 bp, Homo sapiens
gcccaggatctgctcagatcat

SEQ ID NO: 6955461 - DNA, 22 bp, Homo sapiens
ttaattctgcctttcatgtaac

SEQ ID NO: 6955462 - DNA, 22 bp, Homo sapiens
ctggctttggtcatgtgatcat

SEQ ID NO: 6955463 - DNA, 22 bp, Homo sapiens
tcttcaggaagggaaatcatcc

SEQ ID NO: 6955464 - DNA, 22 bp, Homo sapiens
aacctagggcatgaggatggtt

SEQ ID NO: 6955465 - DNA, 22 bp, Homo sapiens
ctgggctgagcctgggctgtgt

SEQ ID NO: 6955466 - DNA, 21 bp, Homo sapiens
tggttagttattggcagtgcc

SEQ ID NO: 6955467 - DNA, 22 bp, Homo sapiens
tgatggaaaataaatcttattc

SEQ ID NO: 6955468 - DNA, 19 bp, Homo sapiens
atgaatgcattgcatggat

SEQ ID NO: 6955469 - DNA, 22 bp, Homo sapiens
tcaggtttaggaatttggaaag

SEQ ID NO: 6955470 - DNA, 22 bp, Homo sapiens
ggtgtctggacagtgagccagg

SEQ ID NO: 6955471 - DNA, 22 bp, Homo sapiens
ggctcagatggtttgttctaga

SEQ ID NO: 6955472 - DNA, 22 bp, Homo sapiens
tctctagggtttagcacagata

SEQ ID NO: 6955473 - DNA, 22 bp, Homo sapiens
ccagcagagcatggggaggaag

SEQ ID NO: 6955474 - DNA, 22 bp, Homo sapiens
ataaagtttaaaagtcaatagt

SEQ ID NO: 6955475 - DNA, 22 bp, Homo sapiens
ttctgtttataatttgcagttg

SEQ ID NO: 6955476 - DNA, 22 bp, Homo sapiens
tgtcttgattagaatgatgggc

SEQ ID NO: 6955477 - DNA, 22 bp, Homo sapiens
cattccaaggccaagtctaaga

SEQ ID NO: 6955478 - DNA, 22 bp, Homo sapiens
tcaaagggtccttaacatgaga

SEQ ID NO: 6955479 - DNA, 22 bp, Homo sapiens
tctgctttttcattgactgaaa

SEQ ID NO: 6955480 - DNA, 22 bp, Homo sapiens
tggcatgaagtcagcagctggg

SEQ ID NO: 6955481 - DNA, 21 bp, Homo sapiens
gcctgagcatgtcttcaggtc

SEQ ID NO: 6955482 - DNA, 22 bp, Homo sapiens
gcccagagagatgctgtagacc

SEQ ID NO: 6955483 - DNA, 22 bp, Homo sapiens
ccagtgttgcataggatgggga

SEQ ID NO: 6955484 - DNA, 22 bp, Homo sapiens
ggccatttgctttattcacttc

SEQ ID NO: 6955485 - DNA, 22 bp, Homo sapiens
tttaggcatacttttgggagaa

SEQ ID NO: 6955486 - DNA, 22 bp, Homo sapiens
tcctgtgcaggctggttgtaga

SEQ ID NO: 6955487 - DNA, 22 bp, Homo sapiens
gtattaggaggtggagcctttg

SEQ ID NO: 6955488 - DNA, 22 bp, Homo sapiens
cttatgatctagaactaggtat

SEQ ID NO: 6955489 - DNA, 22 bp, Homo sapiens
tgagttcacatgaggtctggtc

SEQ ID NO: 6955490 - DNA, 22 bp, Homo sapiens
atggaacagacagctgagacaa

SEQ ID NO: 6955491 - DNA, 22 bp, Homo sapiens
caaagactgcataacacatgaa

SEQ ID NO: 6955492 - DNA, 22 bp, Homo sapiens
agtctgaagatattcttgcagg

SEQ ID NO: 6955493 - DNA, 22 bp, Homo sapiens
catgttgtattctttggctggt

SEQ ID NO: 6955494 - DNA, 22 bp, Homo sapiens
aaagtcctagcgatccacagaa

SEQ ID NO: 6955495 - DNA, 22 bp, Homo sapiens
agctgaccaaatgcctacagtt

SEQ ID NO: 6955496 - DNA, 22 bp, Homo sapiens
tctgtggcctgtgtccaagtgc

SEQ ID NO: 6955497 - DNA, 22 bp, Homo sapiens
tggtaaagaaggctagatctga

SEQ ID NO: 6955498 - DNA, 20 bp, Homo sapiens
ggtcatcttccaatcccagg

SEQ ID NO: 6955499 - DNA, 22 bp, Homo sapiens
ctggcagatatttgcagacatg

SEQ ID NO: 6955500 - DNA, 22 bp, Homo sapiens
taggctgtaagagagggcagag

SEQ ID NO: 6955501 - DNA, 22 bp, Homo sapiens
gctctctcgtgaacaggtggtt

SEQ ID NO: 6955502 - DNA, 22 bp, Homo sapiens
tgttatcagagagaggtgctgt

SEQ ID NO: 6955503 - DNA, 22 bp, Homo sapiens
aaactcaaagtcagatcagaga

SEQ ID NO: 6955504 - DNA, 22 bp, Homo sapiens
ttgttacagcagtgatttcaga

SEQ ID NO: 6955505 - DNA, 22 bp, Homo sapiens
tattacatccacttttattgca

SEQ ID NO: 6955506 - DNA, 22 bp, Homo sapiens
ggccagaggacctctcatagcc

SEQ ID NO: 6955507 - DNA, 22 bp, Homo sapiens
agtgtttaagttacacacatat

SEQ ID NO: 6955508 - DNA, 20 bp, Homo sapiens
ccttgccagtagggctggga

SEQ ID NO: 6955509 - DNA, 22 bp, Homo sapiens
gtggaattatgcatttcttcac

SEQ ID NO: 6955510 - DNA, 22 bp, Homo sapiens
gtaccatgagcatcatgttttt

SEQ ID NO: 6955511 - DNA, 22 bp, Homo sapiens
aaaaagacttccaactcaggag

SEQ ID NO: 6955512 - DNA, 22 bp, Homo sapiens
aagagattaaagtaacttgcct

SEQ ID NO: 6955513 - DNA, 22 bp, Homo sapiens
actctgggaatcctcaccttcc

SEQ ID NO: 6955514 - DNA, 22 bp, Homo sapiens
ttacagacaaactgtgttaagt

SEQ ID NO: 6955515 - DNA, 22 bp, Homo sapiens
gtggcagcaggtactcacgcac

SEQ ID NO: 6955516 - DNA, 22 bp, Homo sapiens
ctgctgtaataggagcgttttg

SEQ ID NO: 6955517 - DNA, 22 bp, Homo sapiens
cctgagtgacctgaggtctagt

SEQ ID NO: 6955518 - DNA, 22 bp, Homo sapiens
gacaggcatgctttcaggacta

SEQ ID NO: 6955519 - DNA, 19 bp, Homo sapiens
tcatgcatttctaagtgca

SEQ ID NO: 6955520 - DNA, 22 bp, Homo sapiens
gtggccatacatgtccatatta

SEQ ID NO: 6955521 - DNA, 22 bp, Homo sapiens
ttttccacagcaccataagatt

SEQ ID NO: 6955522 - DNA, 22 bp, Homo sapiens
gcactgggtgggagatctgaat

SEQ ID NO: 6955523 - DNA, 22 bp, Homo sapiens
acatggtgagcggcaggcctat

SEQ ID NO: 6955524 - DNA, 22 bp, Homo sapiens
tacatacacaaatatactgttt

SEQ ID NO: 6955525 - DNA, 22 bp, Homo sapiens
tggctggtgggcctcagcctgc

SEQ ID NO: 6955526 - DNA, 22 bp, Homo sapiens
gctggcagctggaagttgggct

SEQ ID NO: 6955527 - DNA, 22 bp, Homo sapiens
gagtgtcacttgatgcagggca

SEQ ID NO: 6955528 - DNA, 22 bp, Homo sapiens
taaaggcttcggagtgcacact

SEQ ID NO: 6955529 - DNA, 22 bp, Homo sapiens
tcaaagatgatgctgaagttat

SEQ ID NO: 6955530 - DNA, 22 bp, Homo sapiens
atttgcttgtgctatgaaagtt

SEQ ID NO: 6955531 - DNA, 17 bp, Homo sapiens
gcagtacctactttcta

SEQ ID NO: 6955532 - DNA, 22 bp, Homo sapiens
ctgcagtgaggattcttaggtg

SEQ ID NO: 6955533 - DNA, 22 bp, Homo sapiens
tacctgtcaaaagacatggaga

SEQ ID NO: 6955534 - DNA, 22 bp, Homo sapiens
gagccctgcggagccccgaggc

SEQ ID NO: 6955535 - DNA, 22 bp, Homo sapiens
actgaccagatatgtcatacct

SEQ ID NO: 6955536 - DNA, 22 bp, Homo sapiens
tagcattatctgtcttatcatt

SEQ ID NO: 6955537 - DNA, 22 bp, Homo sapiens
gaaagttcaaattatagaaggt

SEQ ID NO: 6955538 - DNA, 22 bp, Homo sapiens
aaataagaaattcttctttgca

SEQ ID NO: 6955539 - DNA, 22 bp, Homo sapiens
ttgtactgatatgaagaatcaa

SEQ ID NO: 6955540 - DNA, 23 bp, Homo sapiens
tttctgaagttgagatggacttt

SEQ ID NO: 6955541 - DNA, 19 bp, Homo sapiens
ggcccaagtactgagtgcc

SEQ ID NO: 6955542 - DNA, 22 bp, Homo sapiens
tgccagcacttctggctgtctg

SEQ ID NO: 6955543 - DNA, 22 bp, Homo sapiens
atttgatttgtagatagtgtag

SEQ ID NO: 6955544 - DNA, 22 bp, Homo sapiens
gagtttgggtggaaggagggta

SEQ ID NO: 6955545 - DNA, 22 bp, Homo sapiens
gctggtccattggcactgctca

SEQ ID NO: 6955546 - DNA, 22 bp, Homo sapiens
caggacagacagaatgcctaac

SEQ ID NO: 6955547 - DNA, 22 bp, Homo sapiens
gctctcaagtccttttgctcag

SEQ ID NO: 6955548 - DNA, 22 bp, Homo sapiens
actgatcaagggtttaatttta

SEQ ID NO: 6955549 - DNA, 22 bp, Homo sapiens
atctgaagctatctgcacttca

SEQ ID NO: 6955550 - DNA, 22 bp, Homo sapiens
ccttcatgtcattggacacctt

SEQ ID NO: 6955551 - DNA, 22 bp, Homo sapiens
atggaatgtttcctcttttatt

SEQ ID NO: 6955552 - DNA, 22 bp, Homo sapiens
gctgtgagtggaggaggctgag

SEQ ID NO: 6955553 - DNA, 22 bp, Homo sapiens
ctgtggagtgtagatgctgggt

SEQ ID NO: 6955554 - DNA, 22 bp, Homo sapiens
tggaatcattggagagctgtaa

SEQ ID NO: 6955555 - DNA, 22 bp, Homo sapiens
tgtgtttcagaaccttctttca

SEQ ID NO: 6955556 - DNA, 23 bp, Homo sapiens
tctaatgcaattagaaattaggg

SEQ ID NO: 6955557 - DNA, 23 bp, Homo sapiens
ctccctgaacatgacacaccaga

SEQ ID NO: 6955558 - DNA, 22 bp, Homo sapiens
tgggctctcacacatgttctga

SEQ ID NO: 6955559 - DNA, 22 bp, Homo sapiens
gtgattaatgctgttggagata

SEQ ID NO: 6955560 - DNA, 22 bp, Homo sapiens
tgctgatatattctagttttct

SEQ ID NO: 6955561 - DNA, 22 bp, Homo sapiens
tggaacaaattttggggacctt

SEQ ID NO: 6955562 - DNA, 18 bp, Homo sapiens
ttcctaggaactaagctt

SEQ ID NO: 6955563 - DNA, 22 bp, Homo sapiens
tcagcttcagatcagctagaga

SEQ ID NO: 6955564 - DNA, 23 bp, Homo sapiens
ttcatgttccctccttctggtga

SEQ ID NO: 6955565 - DNA, 22 bp, Homo sapiens
cttctcagatctcagctttgag

SEQ ID NO: 6955566 - DNA, 22 bp, Homo sapiens
cacttatactttggatgtggat

SEQ ID NO: 6955567 - DNA, 22 bp, Homo sapiens
cccaggagaatatttttgggtc

SEQ ID NO: 6955568 - DNA, 22 bp, Homo sapiens
atgcaggatgtcaacgcatcct

SEQ ID NO: 6955569 - DNA, 22 bp, Homo sapiens
tggcaagtggcaccggctgtgg

SEQ ID NO: 6955570 - DNA, 22 bp, Homo sapiens
agacttctctccttgacttgca

SEQ ID NO: 6955571 - DNA, 22 bp, Homo sapiens
aggcagtgctcaagacagcagc

SEQ ID NO: 6955572 - DNA, 22 bp, Homo sapiens
ctgttaggcatgtgtgcgtgca

SEQ ID NO: 6955573 - DNA, 22 bp, Homo sapiens
agggccctagggaatgagacat

SEQ ID NO: 6955574 - DNA, 22 bp, Homo sapiens
gaacactgaggacactgagaat

SEQ ID NO: 6955575 - DNA, 22 bp, Homo sapiens
aagtactgtatcacttactcct

SEQ ID NO: 6955576 - DNA, 22 bp, Homo sapiens
tcatatgattgtaatgagaata

SEQ ID NO: 6955577 - DNA, 22 bp, Homo sapiens
acagcatgagagatgaacattc

SEQ ID NO: 6955578 - DNA, 22 bp, Homo sapiens
gggagatgaatcagaagtgatc

SEQ ID NO: 6955579 - DNA, 22 bp, Homo sapiens
acctgttttcctatctagattg

SEQ ID NO: 6955580 - DNA, 22 bp, Homo sapiens
tcttccagatacttcctgactt

SEQ ID NO: 6955581 - DNA, 19 bp, Homo sapiens
tcacatgaagcctagagaa

SEQ ID NO: 6955582 - DNA, 21 bp, Homo sapiens
ggtgacacgtggccccgctct

SEQ ID NO: 6955583 - DNA, 22 bp, Homo sapiens
ctgggtcaggagcggctgcccg

SEQ ID NO: 6955584 - DNA, 22 bp, Homo sapiens
acatggtaaaagttttggcaat

SEQ ID NO: 6955585 - DNA, 22 bp, Homo sapiens
ctgtacatcccaagatatttct

SEQ ID NO: 6955586 - DNA, 16 bp, Homo sapiens
gtagccgtggccgctg

SEQ ID NO: 6955587 - DNA, 22 bp, Homo sapiens
ctggccagtgtggctctgatct

SEQ ID NO: 6955588 - DNA, 22 bp, Homo sapiens
tattgaggtgcttagctggggg

SEQ ID NO: 6955589 - DNA, 20 bp, Homo sapiens
cctgctgggaaccctctgaa

SEQ ID NO: 6955590 - DNA, 22 bp, Homo sapiens
gataaacatgggagaaaggaat

SEQ ID NO: 6955591 - DNA, 22 bp, Homo sapiens
ttgctttggtagcagctataga

SEQ ID NO: 6955592 - DNA, 22 bp, Homo sapiens
ttctgcatctcacagccagtgc

SEQ ID NO: 6955593 - DNA, 22 bp, Homo sapiens
atgaatgaagaacatctgtgcc

SEQ ID NO: 6955594 - DNA, 22 bp, Homo sapiens
caagtccatcagataagcaaga

SEQ ID NO: 6955595 - DNA, 22 bp, Homo sapiens
agggctcactgggaggctataa

SEQ ID NO: 6955596 - DNA, 22 bp, Homo sapiens
tgactattacggccacgaattt

SEQ ID NO: 6955597 - DNA, 22 bp, Homo sapiens
tttggccaacaacatggaagct

SEQ ID NO: 6955598 - DNA, 23 bp, Homo sapiens
caggtgttttacatatggtagtt

SEQ ID NO: 6955599 - DNA, 22 bp, Homo sapiens
ctggtgacatttccggctgcca

SEQ ID NO: 6955600 - DNA, 22 bp, Homo sapiens
ggcagggtctggactgaaagct

SEQ ID NO: 6955601 - DNA, 22 bp, Homo sapiens
ctttgtaatcattcccttggtt

SEQ ID NO: 6955602 - DNA, 18 bp, Homo sapiens
attgtgctaatggtttcc

SEQ ID NO: 6955603 - DNA, 22 bp, Homo sapiens
gagtttattgtcttccaggctt

SEQ ID NO: 6955604 - DNA, 22 bp, Homo sapiens
agccagcccctgactgtgtcct

SEQ ID NO: 6955605 - DNA, 22 bp, Homo sapiens
ctcctcagagagcagcttgggg

SEQ ID NO: 6955606 - DNA, 22 bp, Homo sapiens
aggtagtggtcatgctggggag

SEQ ID NO: 6955607 - DNA, 22 bp, Homo sapiens
taatgcttcaatttccttgatt

SEQ ID NO: 6955608 - DNA, 22 bp, Homo sapiens
gaggcagagactccaccttcag

SEQ ID NO: 6955609 - DNA, 22 bp, Homo sapiens
tttgtcttggcctcagttttct

SEQ ID NO: 6955610 - DNA, 22 bp, Homo sapiens
acagaaggcggggacaaggcgg

SEQ ID NO: 6955611 - DNA, 22 bp, Homo sapiens
tttcaccctgtctgaatcgttc

SEQ ID NO: 6955612 - DNA, 22 bp, Homo sapiens
cctgggaaggtgaggccctgga

SEQ ID NO: 6955613 - DNA, 22 bp, Homo sapiens
cacagagaatactgctcttgct

SEQ ID NO: 6955614 - DNA, 22 bp, Homo sapiens
atgcaacaggtcagccaggaag

SEQ ID NO: 6955615 - DNA, 22 bp, Homo sapiens
agcactgctttagagcctctgc

SEQ ID NO: 6955616 - DNA, 23 bp, Homo sapiens
aggtgcccagaccccaccctctt

SEQ ID NO: 6955617 - DNA, 22 bp, Homo sapiens
gccaccagtgggggcctgggca

SEQ ID NO: 6955618 - DNA, 20 bp, Homo sapiens
ttcatgtacaggaaaggaga

SEQ ID NO: 6955619 - DNA, 22 bp, Homo sapiens
cttttgatagttgctgagcagg

SEQ ID NO: 6955620 - DNA, 22 bp, Homo sapiens
gcaaattcaacagcacattctc

SEQ ID NO: 6955621 - DNA, 22 bp, Homo sapiens
tgaattctcacaagcctggaag

SEQ ID NO: 6955622 - DNA, 22 bp, Homo sapiens
gcagtcctcgtaaaggtcgaag

SEQ ID NO: 6955623 - DNA, 22 bp, Homo sapiens
aagttacaagactaaatggaag

SEQ ID NO: 6955624 - DNA, 22 bp, Homo sapiens
gcaaacaagctgcctgaagatt

SEQ ID NO: 6955625 - DNA, 22 bp, Homo sapiens
cacaagggctttgtaggctttg

SEQ ID NO: 6955626 - DNA, 22 bp, Homo sapiens
tgaaggcctaacttccagtgct

SEQ ID NO: 6955627 - DNA, 22 bp, Homo sapiens
agtaagttttgatagcattagg

SEQ ID NO: 6955628 - DNA, 22 bp, Homo sapiens
gacacactgtttggactagggt

SEQ ID NO: 6955629 - DNA, 22 bp, Homo sapiens
gcctgtgcctcaattttctact

SEQ ID NO: 6955630 - DNA, 22 bp, Homo sapiens
agctatcagtaggaccatgttc

SEQ ID NO: 6955631 - DNA, 22 bp, Homo sapiens
aatgcactgtcagtattgttga

SEQ ID NO: 6955632 - DNA, 22 bp, Homo sapiens
tgagctaggtgtgcagatatga

SEQ ID NO: 6955633 - DNA, 22 bp, Homo sapiens
cacaatgtatatgtatatcaaa

SEQ ID NO: 6955634 - DNA, 22 bp, Homo sapiens
tgtgatgctggagtgcgaatat

SEQ ID NO: 6955635 - DNA, 22 bp, Homo sapiens
ctaagtctgcagaaataaatgt

SEQ ID NO: 6955636 - DNA, 22 bp, Homo sapiens
tttgaggacattttagaaagtt

SEQ ID NO: 6955637 - DNA, 22 bp, Homo sapiens
gtgcccttattagatgtcatca

SEQ ID NO: 6955638 - DNA, 22 bp, Homo sapiens
gacatgcataacaagattggaa

SEQ ID NO: 6955639 - DNA, 22 bp, Homo sapiens
ctcaggagttggaggctacagt

SEQ ID NO: 6955640 - DNA, 22 bp, Homo sapiens
tcctgggaagtggctggctgag

SEQ ID NO: 6955641 - DNA, 23 bp, Homo sapiens
ataaactgtcaaaagccagccct

SEQ ID NO: 6955642 - DNA, 22 bp, Homo sapiens
ggctctgctgcacccttggctc

SEQ ID NO: 6955643 - DNA, 22 bp, Homo sapiens
tgtatcacatgactctgcacta

SEQ ID NO: 6955644 - DNA, 22 bp, Homo sapiens
tcaggctgctggccagcaggct

SEQ ID NO: 6955645 - DNA, 22 bp, Homo sapiens
tgagtaccttctatgtgcttgg

SEQ ID NO: 6955646 - DNA, 22 bp, Homo sapiens
tgtacagaaggcactaaggtca

SEQ ID NO: 6955647 - DNA, 22 bp, Homo sapiens
gctctgccagcccaaggcgcag

SEQ ID NO: 6955648 - DNA, 22 bp, Homo sapiens
actctcaaatattaatctttgg

SEQ ID NO: 6955649 - DNA, 22 bp, Homo sapiens
tagaatgtgcaaatgtgcacac

SEQ ID NO: 6955650 - DNA, 20 bp, Homo sapiens
gctgttctgaagcagaaggc

SEQ ID NO: 6955651 - DNA, 22 bp, Homo sapiens
ttaagctatacattgttagagt

SEQ ID NO: 6955652 - DNA, 22 bp, Homo sapiens
gggaggaaagagaagtggtcca

SEQ ID NO: 6955653 - DNA, 22 bp, Homo sapiens
ttggctttggtctggatgccag

SEQ ID NO: 6955654 - DNA, 22 bp, Homo sapiens
ctttcctggctggcagttgtgg

SEQ ID NO: 6955655 - DNA, 22 bp, Homo sapiens
agcttcctcacctcagaggtct

SEQ ID NO: 6955656 - DNA, 22 bp, Homo sapiens
gtggtcagttaggcaatcatgt

SEQ ID NO: 6955657 - DNA, 22 bp, Homo sapiens
tactgtaaactgtaacttcctt

SEQ ID NO: 6955658 - DNA, 20 bp, Homo sapiens
ttcctgtaaccggcagctgc

SEQ ID NO: 6955659 - DNA, 22 bp, Homo sapiens
gtcagaaaaagcaaggctgggc

SEQ ID NO: 6955660 - DNA, 21 bp, Homo sapiens
tagctttaatattcccacatt

SEQ ID NO: 6955661 - DNA, 22 bp, Homo sapiens
tacagtttgtatggtcaggaat

SEQ ID NO: 6955662 - DNA, 22 bp, Homo sapiens
ctggcccaggctcctggggcac

SEQ ID NO: 6955663 - DNA, 22 bp, Homo sapiens
gtccccttaaacatgctctctt

SEQ ID NO: 6955664 - DNA, 22 bp, Homo sapiens
gatccgttttaacaatgggagt

SEQ ID NO: 6955665 - DNA, 22 bp, Homo sapiens
ctgcagtatctgctttgggtag

SEQ ID NO: 6955666 - DNA, 22 bp, Homo sapiens
ggctgggaggccgtgctgacct

SEQ ID NO: 6955667 - DNA, 22 bp, Homo sapiens
ggtagggcaaagtagggcacct

SEQ ID NO: 6955668 - DNA, 22 bp, Homo sapiens
agtgtcctggcaagggtttcag

SEQ ID NO: 6955669 - DNA, 17 bp, Homo sapiens
aggcaatgactgtggtt

SEQ ID NO: 6955670 - DNA, 22 bp, Homo sapiens
gtctagaattgcttggcagatg

SEQ ID NO: 6955671 - DNA, 16 bp, Homo sapiens
ggcaggcgcggagccc

SEQ ID NO: 6955672 - DNA, 21 bp, Homo sapiens
atttccaaataaggtcacatt

SEQ ID NO: 6955673 - DNA, 20 bp, Homo sapiens
aggttccagccacaaccagc

SEQ ID NO: 6955674 - DNA, 22 bp, Homo sapiens
gctggccaggaagagtctcaga

SEQ ID NO: 6955675 - DNA, 22 bp, Homo sapiens
aagacactgggttaggcacgtg

SEQ ID NO: 6955676 - DNA, 22 bp, Homo sapiens
gaagaaggaagatcatgcttga

SEQ ID NO: 6955677 - DNA, 22 bp, Homo sapiens
ctgcctggacagctcttacctt

SEQ ID NO: 6955678 - DNA, 22 bp, Homo sapiens
acacatggattgcttagctgga

SEQ ID NO: 6955679 - DNA, 22 bp, Homo sapiens
tctgagccataagagtacagga

SEQ ID NO: 6955680 - DNA, 22 bp, Homo sapiens
ccggcctataggtgcaaacatc

SEQ ID NO: 6955681 - DNA, 22 bp, Homo sapiens
gctcacagccggctggcagggg

SEQ ID NO: 6955682 - DNA, 22 bp, Homo sapiens
aaacttcagtgaatgacttatg

SEQ ID NO: 6955683 - DNA, 22 bp, Homo sapiens
tccaggcctaggccaagtgatt

SEQ ID NO: 6955684 - DNA, 22 bp, Homo sapiens
agtcatttggagcaccttatta

SEQ ID NO: 6955685 - DNA, 22 bp, Homo sapiens
tctgataaataacatttggaaa

SEQ ID NO: 6955686 - DNA, 22 bp, Homo sapiens
atgcttggcgtttcacttcctg

SEQ ID NO: 6955687 - DNA, 22 bp, Homo sapiens
agtccagccttcaatcttagtg

SEQ ID NO: 6955688 - DNA, 22 bp, Homo sapiens
aaaaaagattgatggtggatgc

SEQ ID NO: 6955689 - DNA, 22 bp, Homo sapiens
tgagcagaacacgggatccatg

SEQ ID NO: 6955690 - DNA, 22 bp, Homo sapiens
ttgtagattggagagtgtgtga

SEQ ID NO: 6955691 - DNA, 22 bp, Homo sapiens
tgaagatttccaccaaatcaca

SEQ ID NO: 6955692 - DNA, 22 bp, Homo sapiens
aggcttgactgctgattttgcc

SEQ ID NO: 6955693 - DNA, 22 bp, Homo sapiens
atttagcacctccatctcaaca

SEQ ID NO: 6955694 - DNA, 22 bp, Homo sapiens
atggctcatttatcttgcagcc

SEQ ID NO: 6955695 - DNA, 22 bp, Homo sapiens
gactgtcttttgaataaaaatg

SEQ ID NO: 6955696 - DNA, 22 bp, Homo sapiens
gcatggccttcagggacagctg

SEQ ID NO: 6955697 - DNA, 22 bp, Homo sapiens
caatttcagacctttccttgga

SEQ ID NO: 6955698 - DNA, 21 bp, Homo sapiens
agaatccaagatgccattggc

SEQ ID NO: 6955699 - DNA, 22 bp, Homo sapiens
atgtttagtcattcagctcctt

SEQ ID NO: 6955700 - DNA, 22 bp, Homo sapiens
gaggtaggctgtgaaagggggt

SEQ ID NO: 6955701 - DNA, 18 bp, Homo sapiens
tggcagtgaggtaggcat

SEQ ID NO: 6955702 - DNA, 22 bp, Homo sapiens
tggctgccccctcccgtggaca

SEQ ID NO: 6955703 - DNA, 22 bp, Homo sapiens
ttctatgtagtagcagagccaa

SEQ ID NO: 6955704 - DNA, 22 bp, Homo sapiens
atacccattccttgtgttcagt

SEQ ID NO: 6955705 - DNA, 23 bp, Homo sapiens
gctcatctagaatggtttcagct

SEQ ID NO: 6955706 - DNA, 22 bp, Homo sapiens
aaagtctttctcatagtcacgc

SEQ ID NO: 6955707 - DNA, 22 bp, Homo sapiens
acatatttccatgcagcatgtc

SEQ ID NO: 6955708 - DNA, 22 bp, Homo sapiens
gagcagctcaggcacttagcca

SEQ ID NO: 6955709 - DNA, 22 bp, Homo sapiens
tctgtgaagctctgaacagcag

SEQ ID NO: 6955710 - DNA, 22 bp, Homo sapiens
tctgggagggagcctcagaatc

SEQ ID NO: 6955711 - DNA, 22 bp, Homo sapiens
attgtactccagcctgggtgac

SEQ ID NO: 6955712 - DNA, 22 bp, Homo sapiens
catctttaacaatttacaatgt

SEQ ID NO: 6955713 - DNA, 19 bp, Homo sapiens
agattatagggttatggga

SEQ ID NO: 6955714 - DNA, 22 bp, Homo sapiens
gggcctgaggcccagacactgg

SEQ ID NO: 6955715 - DNA, 20 bp, Homo sapiens
tttgacatatacagttcagg

SEQ ID NO: 6955716 - DNA, 23 bp, Homo sapiens
tctagcctgtcatcagcctctcc

SEQ ID NO: 6955717 - DNA, 22 bp, Homo sapiens
gccttcagcggccgctcgctgc

SEQ ID NO: 6955718 - DNA, 22 bp, Homo sapiens
ttatgaacagtatccaaaatgt

SEQ ID NO: 6955719 - DNA, 22 bp, Homo sapiens
tgtggactgtgctgccacagtg

SEQ ID NO: 6955720 - DNA, 23 bp, Homo sapiens
aacagcaggatgatagaggaggt

SEQ ID NO: 6955721 - DNA, 22 bp, Homo sapiens
gaatatgagtgtccctgaggtc

SEQ ID NO: 6955722 - DNA, 22 bp, Homo sapiens
ggagagctggtatatgaagaca

SEQ ID NO: 6955723 - DNA, 22 bp, Homo sapiens
ttgcaggaagcacaagtctgag

SEQ ID NO: 6955724 - DNA, 22 bp, Homo sapiens
taaattgatcgtttgggatgaa

SEQ ID NO: 6955725 - DNA, 22 bp, Homo sapiens
acaaacttatgtttcatatgta

SEQ ID NO: 6955726 - DNA, 22 bp, Homo sapiens
tggagccttttgttctgggaca

SEQ ID NO: 6955727 - DNA, 22 bp, Homo sapiens
tatgtcatgggtcaaaatgaag

SEQ ID NO: 6955728 - DNA, 22 bp, Homo sapiens
gtagtaattgttttaagccacc

SEQ ID NO: 6955729 - DNA, 22 bp, Homo sapiens
atgaagtctagcaagcattgaa

SEQ ID NO: 6955730 - DNA, 22 bp, Homo sapiens
gagggagctggagcagacgccg

SEQ ID NO: 6955731 - DNA, 22 bp, Homo sapiens
ggctctgggaaatggtcttcct

SEQ ID NO: 6955732 - DNA, 22 bp, Homo sapiens
cgctggggctttttgcttgaga

SEQ ID NO: 6955733 - DNA, 18 bp, Homo sapiens
aacaggatcctccacttc

SEQ ID NO: 6955734 - DNA, 22 bp, Homo sapiens
tagcaccttaactctgctgcgt

SEQ ID NO: 6955735 - DNA, 22 bp, Homo sapiens
gcattgaagatcttagactagg

SEQ ID NO: 6955736 - DNA, 22 bp, Homo sapiens
agctcaagttttcaaatattat

SEQ ID NO: 6955737 - DNA, 23 bp, Homo sapiens
agagcatcatctatggagtgagg

SEQ ID NO: 6955738 - DNA, 22 bp, Homo sapiens
accagagagagacagggttgtg

SEQ ID NO: 6955739 - DNA, 22 bp, Homo sapiens
ttctgagagtgccagaagttct

SEQ ID NO: 6955740 - DNA, 22 bp, Homo sapiens
attagtcttcacctctctttgg

SEQ ID NO: 6955741 - DNA, 22 bp, Homo sapiens
tgcttctgggtcccagcctggc

SEQ ID NO: 6955742 - DNA, 22 bp, Homo sapiens
atgggcagtaacagtggcagtc

SEQ ID NO: 6955743 - DNA, 22 bp, Homo sapiens
aatggtaaatgtaacagcattc

SEQ ID NO: 6955744 - DNA, 22 bp, Homo sapiens
cagagccaaatgctgtggttat

SEQ ID NO: 6955745 - DNA, 22 bp, Homo sapiens
cagagtggcgaccccctcagct

SEQ ID NO: 6955746 - DNA, 22 bp, Homo sapiens
cttaaaatctggcagttagcta

SEQ ID NO: 6955747 - DNA, 21 bp, Homo sapiens
ctcaaagaccaaaagtgtaga

SEQ ID NO: 6955748 - DNA, 21 bp, Homo sapiens
tcctctgctctcataccacaa

SEQ ID NO: 6955749 - DNA, 22 bp, Homo sapiens
aaactgtcattggatgcatttg

SEQ ID NO: 6955750 - DNA, 22 bp, Homo sapiens
tatggaaagtgttttcttctgt

SEQ ID NO: 6955751 - DNA, 22 bp, Homo sapiens
tgacaaaggtgttgccagaggg

SEQ ID NO: 6955752 - DNA, 16 bp, Homo sapiens
tagctttgtgttgtgg

SEQ ID NO: 6955753 - DNA, 18 bp, Homo sapiens
agaactgcacctctcctg

SEQ ID NO: 6955754 - DNA, 22 bp, Homo sapiens
ctgatccagagccaaccaaggc

SEQ ID NO: 6955755 - DNA, 22 bp, Homo sapiens
agtctctgaggttcagatgcct

SEQ ID NO: 6955756 - DNA, 19 bp, Homo sapiens
tcaggaagttgatgaggtg

SEQ ID NO: 6955757 - DNA, 22 bp, Homo sapiens
tggcccagggcacagcagggag

SEQ ID NO: 6955758 - DNA, 22 bp, Homo sapiens
acactcaaagcagggagtgttc

SEQ ID NO: 6955759 - DNA, 22 bp, Homo sapiens
gtatggcttctgcagaagagct

SEQ ID NO: 6955760 - DNA, 22 bp, Homo sapiens
cagtgctgctctctgtaagaga

SEQ ID NO: 6955761 - DNA, 22 bp, Homo sapiens
aagtttgcggggaaagaacaca

SEQ ID NO: 6955762 - DNA, 23 bp, Homo sapiens
tcactaaagtgtttagtgcagat

SEQ ID NO: 6955763 - DNA, 22 bp, Homo sapiens
agctgtgtgacctagggcaagc

SEQ ID NO: 6955764 - DNA, 22 bp, Homo sapiens
aaaagcaattgcgggttttgcc

SEQ ID NO: 6955765 - DNA, 22 bp, Homo sapiens
tgtgttcatgttgattcatagc

SEQ ID NO: 6955766 - DNA, 22 bp, Homo sapiens
tatactgtaggtgcagaaagaa

SEQ ID NO: 6955767 - DNA, 22 bp, Homo sapiens
gagcctcctcctggtgtgccga

SEQ ID NO: 6955768 - DNA, 22 bp, Homo sapiens
gctcagcttgggagcgcccggt

SEQ ID NO: 6955769 - DNA, 22 bp, Homo sapiens
agctgtggagtagggggttgga

SEQ ID NO: 6955770 - DNA, 22 bp, Homo sapiens
tcattgaagcattttgtgtatt

SEQ ID NO: 6955771 - DNA, 22 bp, Homo sapiens
cattcattacactcataaggtt

SEQ ID NO: 6955772 - DNA, 19 bp, Homo sapiens
ggagatcccgctgcagatg

SEQ ID NO: 6955773 - DNA, 22 bp, Homo sapiens
tgcagcccctgaaaatggcagc

SEQ ID NO: 6955774 - DNA, 22 bp, Homo sapiens
taagcagaaaaagtgggagtta

SEQ ID NO: 6955775 - DNA, 21 bp, Homo sapiens
cggctcagtgcctgctccttc

SEQ ID NO: 6955776 - DNA, 22 bp, Homo sapiens
gcagggacctgccactgctgtc

SEQ ID NO: 6955777 - DNA, 22 bp, Homo sapiens
gtttcaaaagtcaggctattct

SEQ ID NO: 6955778 - DNA, 22 bp, Homo sapiens
acaggagttaaccatgggaagt

SEQ ID NO: 6955779 - DNA, 19 bp, Homo sapiens
tcagtgtgacttggtcagt

SEQ ID NO: 6955780 - DNA, 22 bp, Homo sapiens
taaaactagaccgtgagtctaa

SEQ ID NO: 6955781 - DNA, 22 bp, Homo sapiens
agcagtgttggtgggagcatct

SEQ ID NO: 6955782 - DNA, 22 bp, Homo sapiens
tctgaattgtgcaaagagccac

SEQ ID NO: 6955783 - DNA, 22 bp, Homo sapiens
aaactgtagtgcttcgatctga

SEQ ID NO: 6955784 - DNA, 22 bp, Homo sapiens
agtaaggcaatgccactaagat

SEQ ID NO: 6955785 - DNA, 22 bp, Homo sapiens
cagcagcctgccttgggagctt

SEQ ID NO: 6955786 - DNA, 22 bp, Homo sapiens
gcctggagaagatggaactagc

SEQ ID NO: 6955787 - DNA, 22 bp, Homo sapiens
agggtagggtaaatgatgcatc

SEQ ID NO: 6955788 - DNA, 22 bp, Homo sapiens
ctctgttaagtctggaatgaaa

SEQ ID NO: 6955789 - DNA, 22 bp, Homo sapiens
agagtacattcagagctaccta

SEQ ID NO: 6955790 - DNA, 22 bp, Homo sapiens
tgacaccttcatcttggacttc

SEQ ID NO: 6955791 - DNA, 22 bp, Homo sapiens
gtggggtctgtcctcttctggg

SEQ ID NO: 6955792 - DNA, 22 bp, Homo sapiens
gaggggcgtcctgagtgggcct

SEQ ID NO: 6955793 - DNA, 22 bp, Homo sapiens
ctgttatattggtatatttaca

SEQ ID NO: 6955794 - DNA, 22 bp, Homo sapiens
ggaggatttgtcatctgaagat

SEQ ID NO: 6955795 - DNA, 22 bp, Homo sapiens
tatctacatgtaggtatgtatg

SEQ ID NO: 6955796 - DNA, 22 bp, Homo sapiens
tacaatttagtggtgtgtggtt

SEQ ID NO: 6955797 - DNA, 22 bp, Homo sapiens
tgcagcaattttttaggcattc

SEQ ID NO: 6955798 - DNA, 22 bp, Homo sapiens
acccaggataatctgtgtatct

SEQ ID NO: 6955799 - DNA, 22 bp, Homo sapiens
tctgttatgcataagcatcagt

SEQ ID NO: 6955800 - DNA, 22 bp, Homo sapiens
gaagtgatgacgctgtgttttt

SEQ ID NO: 6955801 - DNA, 22 bp, Homo sapiens
aagttcaagctctgcctaaaat

SEQ ID NO: 6955802 - DNA, 22 bp, Homo sapiens
cttgcaggcccagccttacaag

SEQ ID NO: 6955803 - DNA, 22 bp, Homo sapiens
actgtctctctagcagttcagg

SEQ ID NO: 6955804 - DNA, 22 bp, Homo sapiens
tcttgggaccatttacacatac

SEQ ID NO: 6955805 - DNA, 22 bp, Homo sapiens
tgtgctctggagttgccttcac

SEQ ID NO: 6955806 - DNA, 22 bp, Homo sapiens
agacctttgctgcttcttatag

SEQ ID NO: 6955807 - DNA, 22 bp, Homo sapiens
tatcttcagcacagatcctgtg

SEQ ID NO: 6955808 - DNA, 22 bp, Homo sapiens
tcctgccatctgctgttgatct

SEQ ID NO: 6955809 - DNA, 22 bp, Homo sapiens
ttcgggaggcggagcttgcagt

SEQ ID NO: 6955810 - DNA, 22 bp, Homo sapiens
tgtctagggtctgccccaccag

SEQ ID NO: 6955811 - DNA, 19 bp, Homo sapiens
tctgggaagccgggctcca

SEQ ID NO: 6955812 - DNA, 22 bp, Homo sapiens
tgaagcaaacgcttctgttcct

SEQ ID NO: 6955813 - DNA, 22 bp, Homo sapiens
gatctgtttcattcacagtctg

SEQ ID NO: 6955814 - DNA, 22 bp, Homo sapiens
cactgtcctagtcttcctggag

SEQ ID NO: 6955815 - DNA, 22 bp, Homo sapiens
caattcaaatgcatagttcaca

SEQ ID NO: 6955816 - DNA, 22 bp, Homo sapiens
ctgctttagagctgagcctcag

SEQ ID NO: 6955817 - DNA, 22 bp, Homo sapiens
actggtcctctgccagcagctg

SEQ ID NO: 6955818 - DNA, 22 bp, Homo sapiens
agcacatgagctgatggtgggc

SEQ ID NO: 6955819 - DNA, 22 bp, Homo sapiens
tcaggtggtcctaagtgccatc

SEQ ID NO: 6955820 - DNA, 19 bp, Homo sapiens
tgtggccatggttcagctg

SEQ ID NO: 6955821 - DNA, 22 bp, Homo sapiens
aggtgtgggaaacgggtgacct

SEQ ID NO: 6955822 - DNA, 22 bp, Homo sapiens
tgggcctatatatggctgagag

SEQ ID NO: 6955823 - DNA, 22 bp, Homo sapiens
gcacatggacaatggaggtgca

SEQ ID NO: 6955824 - DNA, 22 bp, Homo sapiens
attcatgtcatagcaggatttc

SEQ ID NO: 6955825 - DNA, 22 bp, Homo sapiens
gcagaaggatccgcaggtgcaa

SEQ ID NO: 6955826 - DNA, 22 bp, Homo sapiens
tccagcagaaaagaggtaggga

SEQ ID NO: 6955827 - DNA, 22 bp, Homo sapiens
tgagggacaccagggctggagc

SEQ ID NO: 6955828 - DNA, 21 bp, Homo sapiens
ttctgggaaatgagctggggc

SEQ ID NO: 6955829 - DNA, 22 bp, Homo sapiens
ccacagagcattagatttcaga

SEQ ID NO: 6955830 - DNA, 22 bp, Homo sapiens
gtgattctcaaattgtgatatc

SEQ ID NO: 6955831 - DNA, 18 bp, Homo sapiens
ggtgggaagccagggcct

SEQ ID NO: 6955832 - DNA, 17 bp, Homo sapiens
ctgccagtggggaggca

SEQ ID NO: 6955833 - DNA, 21 bp, Homo sapiens
tcatccaggtcctgcttcttc

SEQ ID NO: 6955834 - DNA, 22 bp, Homo sapiens
gtgaccagccagtgctgtctgt

SEQ ID NO: 6955835 - DNA, 22 bp, Homo sapiens
gcatgacagtcgaaaggttaac

SEQ ID NO: 6955836 - DNA, 22 bp, Homo sapiens
ttctgatactggaatcgatgcc

SEQ ID NO: 6955837 - DNA, 18 bp, Homo sapiens
actggagcattagcagct

SEQ ID NO: 6955838 - DNA, 22 bp, Homo sapiens
ttgaagagtctagattggttat

SEQ ID NO: 6955839 - DNA, 20 bp, Homo sapiens
aacttgtcttcctgtttggc

SEQ ID NO: 6955840 - DNA, 22 bp, Homo sapiens
tgaccttgataaaggctaagtt

SEQ ID NO: 6955841 - DNA, 23 bp, Homo sapiens
ttggagagggtgagtagtgtcag

SEQ ID NO: 6955842 - DNA, 22 bp, Homo sapiens
ataatgaatcagcatagggtga

SEQ ID NO: 6955843 - DNA, 22 bp, Homo sapiens
gggggccttgttagtggatgga

SEQ ID NO: 6955844 - DNA, 22 bp, Homo sapiens
aaagaatcagaagtctcaaaca

SEQ ID NO: 6955845 - DNA, 21 bp, Homo sapiens
aaagagcttttgtgctagtta

SEQ ID NO: 6955846 - DNA, 19 bp, Homo sapiens
ttcacattggaagaagtag

SEQ ID NO: 6955847 - DNA, 22 bp, Homo sapiens
gactgtggggggcggacacaag

SEQ ID NO: 6955848 - DNA, 22 bp, Homo sapiens
gtaatctcagctacttgggagg

SEQ ID NO: 6955849 - DNA, 22 bp, Homo sapiens
tggaggattaatctggaaagat

SEQ ID NO: 6955850 - DNA, 22 bp, Homo sapiens
cagagatgggtcgcagagatgg

SEQ ID NO: 6955851 - DNA, 22 bp, Homo sapiens
tactgagtaccaagcattgtgt

SEQ ID NO: 6955852 - DNA, 22 bp, Homo sapiens
aggcacaggaggtggtaagaag

SEQ ID NO: 6955853 - DNA, 22 bp, Homo sapiens
gtacatgattccccataaaaag

SEQ ID NO: 6955854 - DNA, 23 bp, Homo sapiens
ctttcattgtggtttcacagagc

SEQ ID NO: 6955855 - DNA, 19 bp, Homo sapiens
ctggcaaatgctttggcca

SEQ ID NO: 6955856 - DNA, 22 bp, Homo sapiens
caggcattcctctatgaatatt

SEQ ID NO: 6955857 - DNA, 22 bp, Homo sapiens
agcccagccggattcccagttc

SEQ ID NO: 6955858 - DNA, 22 bp, Homo sapiens
tgcctcagagttgtccctacca

SEQ ID NO: 6955859 - DNA, 22 bp, Homo sapiens
gaagagctgacagtgtcatcct

SEQ ID NO: 6955860 - DNA, 22 bp, Homo sapiens
accccaggcccagggaagaggc

SEQ ID NO: 6955861 - DNA, 22 bp, Homo sapiens
gttaagtaccagattgtctgaa

SEQ ID NO: 6955862 - DNA, 22 bp, Homo sapiens
ggatgctgctatcaggcttcga

SEQ ID NO: 6955863 - DNA, 22 bp, Homo sapiens
ggtgctcagagttagaccagga

SEQ ID NO: 6955864 - DNA, 22 bp, Homo sapiens
ttctctcctcctagaggctttt

SEQ ID NO: 6955865 - DNA, 22 bp, Homo sapiens
actggcttggcaggaggaagat

SEQ ID NO: 6955866 - DNA, 22 bp, Homo sapiens
agatctcacctctgtgtattat

SEQ ID NO: 6955867 - DNA, 22 bp, Homo sapiens
tgagccctgaggatctgttcgg

SEQ ID NO: 6955868 - DNA, 22 bp, Homo sapiens
atcaacatgtgagagcaccagt

SEQ ID NO: 6955869 - DNA, 22 bp, Homo sapiens
ccagtgtggccaggtcttctgg

SEQ ID NO: 6955870 - DNA, 22 bp, Homo sapiens
acagaagtgagtggcaagaact

SEQ ID NO: 6955871 - DNA, 22 bp, Homo sapiens
tagttgtatcattggtgggaag

SEQ ID NO: 6955872 - DNA, 22 bp, Homo sapiens
aggtgataagtgttaaataaag

SEQ ID NO: 6955873 - DNA, 22 bp, Homo sapiens
tgagcctgctgtcgctggaccc

SEQ ID NO: 6955874 - DNA, 22 bp, Homo sapiens
ccctccagagcttgacctgctg

SEQ ID NO: 6955875 - DNA, 22 bp, Homo sapiens
tagcacccacctcgtggggttt

SEQ ID NO: 6955876 - DNA, 22 bp, Homo sapiens
gcctggtgctatgagggccagc

SEQ ID NO: 6955877 - DNA, 22 bp, Homo sapiens
agtcagagcaaactggacagac

SEQ ID NO: 6955878 - DNA, 22 bp, Homo sapiens
gccaccttccaaaataatcaca

SEQ ID NO: 6955879 - DNA, 22 bp, Homo sapiens
ttcttcaagggtaaaggcaacg

SEQ ID NO: 6955880 - DNA, 22 bp, Homo sapiens
gcggggggcaggcagtacgttg

SEQ ID NO: 6955881 - DNA, 22 bp, Homo sapiens
gagaggcctgggcccgtgagct

SEQ ID NO: 6955882 - DNA, 22 bp, Homo sapiens
tgaccatggtgtgccctgtgcg

SEQ ID NO: 6955883 - DNA, 16 bp, Homo sapiens
gggcaggaatcagggt

SEQ ID NO: 6955884 - DNA, 22 bp, Homo sapiens
atcatcagggacatttctgtgc

SEQ ID NO: 6955885 - DNA, 22 bp, Homo sapiens
tgggggagagaggcattctttc

SEQ ID NO: 6955886 - DNA, 22 bp, Homo sapiens
gggcttcaatagcagaggcgtg

SEQ ID NO: 6955887 - DNA, 22 bp, Homo sapiens
ttctgacatgtgagattttgtt

SEQ ID NO: 6955888 - DNA, 22 bp, Homo sapiens
aacaaagtcgttgcctagaaga

SEQ ID NO: 6955889 - DNA, 22 bp, Homo sapiens
aaggctggacctggatgaatct

SEQ ID NO: 6955890 - DNA, 20 bp, Homo sapiens
gcatctccagggctgtctcc

SEQ ID NO: 6955891 - DNA, 22 bp, Homo sapiens
tctgagggctgtactatgcacg

SEQ ID NO: 6955892 - DNA, 22 bp, Homo sapiens
agaggtttcttaggggcttcct

SEQ ID NO: 6955893 - DNA, 22 bp, Homo sapiens
ttagcaattgattctcataagc

SEQ ID NO: 6955894 - DNA, 22 bp, Homo sapiens
ggccctctgctcacttcctatt

SEQ ID NO: 6955895 - DNA, 22 bp, Homo sapiens
agttagagcgcatattttatta

SEQ ID NO: 6955896 - DNA, 22 bp, Homo sapiens
atatggcattttaatgtatgag

SEQ ID NO: 6955897 - DNA, 22 bp, Homo sapiens
tggggatgtagaaatgaacaac

SEQ ID NO: 6955898 - DNA, 22 bp, Homo sapiens
tggccctgaggggctgtgcccc

SEQ ID NO: 6955899 - DNA, 22 bp, Homo sapiens
aggaaggactgcagcatttggt

SEQ ID NO: 6955900 - DNA, 23 bp, Homo sapiens
aagccctgaaggtttcaggccct

SEQ ID NO: 6955901 - DNA, 22 bp, Homo sapiens
gctttctgtgcagtgaacacta

SEQ ID NO: 6955902 - DNA, 22 bp, Homo sapiens
aggtgtcttcagggtgagacag

SEQ ID NO: 6955903 - DNA, 22 bp, Homo sapiens
tttggacatgttgagtctgata

SEQ ID NO: 6955904 - DNA, 22 bp, Homo sapiens
ctgagcattatcttggattttg

SEQ ID NO: 6955905 - DNA, 22 bp, Homo sapiens
cctgtggccgcgtcgggcggcg

SEQ ID NO: 6955906 - DNA, 22 bp, Homo sapiens
ctggcagctggaggctagaggc

SEQ ID NO: 6955907 - DNA, 22 bp, Homo sapiens
tgtccctgctgtacttagagca

SEQ ID NO: 6955908 - DNA, 22 bp, Homo sapiens
tcagtaactgggttgaagctag

SEQ ID NO: 6955909 - DNA, 22 bp, Homo sapiens
ggcaggaaaacaatgagccagg

SEQ ID NO: 6955910 - DNA, 22 bp, Homo sapiens
tgcagaagacacaaggtaacgt

SEQ ID NO: 6955911 - DNA, 22 bp, Homo sapiens
tttaacagatgctatgtctacc

SEQ ID NO: 6955912 - DNA, 22 bp, Homo sapiens
caagccatactgggtgaaatca

SEQ ID NO: 6955913 - DNA, 22 bp, Homo sapiens
caagaatcagacctgtcagggt

SEQ ID NO: 6955914 - DNA, 22 bp, Homo sapiens
taagtgtctctcgaattatgct

SEQ ID NO: 6955915 - DNA, 22 bp, Homo sapiens
caagcagagaagtctctaggct

SEQ ID NO: 6955916 - DNA, 22 bp, Homo sapiens
ttagcactttgattcatgcaga

SEQ ID NO: 6955917 - DNA, 22 bp, Homo sapiens
atctggcttgactttgcgactt

SEQ ID NO: 6955918 - DNA, 22 bp, Homo sapiens
aaaggtgcctcttacaaggctt

SEQ ID NO: 6955919 - DNA, 22 bp, Homo sapiens
tttcctatgatattctatgtgt

SEQ ID NO: 6955920 - DNA, 22 bp, Homo sapiens
tctcttgttgggtatatgaaat

SEQ ID NO: 6955921 - DNA, 22 bp, Homo sapiens
ttttagaagttcatgtgggatt

SEQ ID NO: 6955922 - DNA, 22 bp, Homo sapiens
actgtggcactaggcaccttac

SEQ ID NO: 6955923 - DNA, 22 bp, Homo sapiens
agtctcaagggatgtctctata

SEQ ID NO: 6955924 - DNA, 22 bp, Homo sapiens
tggcatccagccatgtgatttt

SEQ ID NO: 6955925 - DNA, 22 bp, Homo sapiens
tggttattaaggcctctttcag

SEQ ID NO: 6955926 - DNA, 22 bp, Homo sapiens
tcaacagacatttttaagcact

SEQ ID NO: 6955927 - DNA, 22 bp, Homo sapiens
cttcctctcttgcccataagag

SEQ ID NO: 6955928 - DNA, 22 bp, Homo sapiens
tattttgttttgtatccactgt

SEQ ID NO: 6955929 - DNA, 22 bp, Homo sapiens
aggcaggtctgtatctagtctc

SEQ ID NO: 6955930 - DNA, 22 bp, Homo sapiens
gggctagaagttagctagagaa

SEQ ID NO: 6955931 - DNA, 22 bp, Homo sapiens
gtgctgagtagaatgaatgcct

SEQ ID NO: 6955932 - DNA, 22 bp, Homo sapiens
cagggctcaggaaatcagacgt

SEQ ID NO: 6955933 - DNA, 22 bp, Homo sapiens
ttagttagagccctatgttagg

SEQ ID NO: 6955934 - DNA, 22 bp, Homo sapiens
tgccaggaagtgtgtgggcctg

SEQ ID NO: 6955935 - DNA, 22 bp, Homo sapiens
gagacacaagaagacatgcaca

SEQ ID NO: 6955936 - DNA, 22 bp, Homo sapiens
tattgagtaattattacttcaa

SEQ ID NO: 6955937 - DNA, 22 bp, Homo sapiens
taacatgatttgctatttagat

SEQ ID NO: 6955938 - DNA, 22 bp, Homo sapiens
gctccaagccttctttgttact

SEQ ID NO: 6955939 - DNA, 22 bp, Homo sapiens
aatgtttcatttagttgtctcc

SEQ ID NO: 6955940 - DNA, 22 bp, Homo sapiens
ctgcagctcccctgagatcaag

SEQ ID NO: 6955941 - DNA, 22 bp, Homo sapiens
ggacagcatatcagcagggcag

SEQ ID NO: 6955942 - DNA, 22 bp, Homo sapiens
attgactttcccttctcctcat

SEQ ID NO: 6955943 - DNA, 22 bp, Homo sapiens
gtggctctgtaaaatgcctgca

SEQ ID NO: 6955944 - DNA, 22 bp, Homo sapiens
cttggcacttgggcagtgagca

SEQ ID NO: 6955945 - DNA, 22 bp, Homo sapiens
actttgcaggtacatgagcatc

SEQ ID NO: 6955946 - DNA, 22 bp, Homo sapiens
ttgctgatttagccatacacat

SEQ ID NO: 6955947 - DNA, 22 bp, Homo sapiens
aatgcatgtttcctctcagcag

SEQ ID NO: 6955948 - DNA, 19 bp, Homo sapiens
agctggcagcttccacttc

SEQ ID NO: 6955949 - DNA, 22 bp, Homo sapiens
tggctgtgggatgagagcctca

SEQ ID NO: 6955950 - DNA, 22 bp, Homo sapiens
cttatctcatttaatcatcaca

SEQ ID NO: 6955951 - DNA, 22 bp, Homo sapiens
ccaggaaggcctggatgccccc

SEQ ID NO: 6955952 - DNA, 22 bp, Homo sapiens
attcaaagtagatgaagtttca

SEQ ID NO: 6955953 - DNA, 22 bp, Homo sapiens
gggcggggcttccgtcctccac

SEQ ID NO: 6955954 - DNA, 22 bp, Homo sapiens
agcactgtccggtaagatgctc

SEQ ID NO: 6955955 - DNA, 22 bp, Homo sapiens
agtatggaggatggaatttgct

SEQ ID NO: 6955956 - DNA, 22 bp, Homo sapiens
tatgctaagtgagaaaagacag

SEQ ID NO: 6955957 - DNA, 22 bp, Homo sapiens
tagctggccctgggactcccgg

SEQ ID NO: 6955958 - DNA, 23 bp, Homo sapiens
agactggggcataagaagatggc

SEQ ID NO: 6955959 - DNA, 22 bp, Homo sapiens
aggcctgtaatcccagcacttt

SEQ ID NO: 6955960 - DNA, 22 bp, Homo sapiens
tgagttccacacctaggaagtc

SEQ ID NO: 6955961 - DNA, 22 bp, Homo sapiens
tggctgaggcttttcttaaaga

SEQ ID NO: 6955962 - DNA, 22 bp, Homo sapiens
tgattaaaggtggaaggcaggt

SEQ ID NO: 6955963 - DNA, 22 bp, Homo sapiens
tccctgggcggacattctccca

SEQ ID NO: 6955964 - DNA, 22 bp, Homo sapiens
atggaaatcaggttcatccaag

SEQ ID NO: 6955965 - DNA, 22 bp, Homo sapiens
attcaagattaattctatgtca

SEQ ID NO: 6955966 - DNA, 22 bp, Homo sapiens
aggaggtctcactatgttgccc

SEQ ID NO: 6955967 - DNA, 22 bp, Homo sapiens
taagcaagatttattgaatttt

SEQ ID NO: 6955968 - DNA, 22 bp, Homo sapiens
agcatggccacgggggtaggta

SEQ ID NO: 6955969 - DNA, 22 bp, Homo sapiens
cagggctttgtgtgcctgggga

SEQ ID NO: 6955970 - DNA, 22 bp, Homo sapiens
acatgttgctaaatccaatggt

SEQ ID NO: 6955971 - DNA, 22 bp, Homo sapiens
aaaattctgtcattaaattgtg

SEQ ID NO: 6955972 - DNA, 22 bp, Homo sapiens
ttgtgccataaccaccctgact

SEQ ID NO: 6955973 - DNA, 22 bp, Homo sapiens
atctaactgggctattttattg

SEQ ID NO: 6955974 - DNA, 22 bp, Homo sapiens
gggcatttcttgtcaatgtagg

SEQ ID NO: 6955975 - DNA, 22 bp, Homo sapiens
gattgcaccttttaaaatgtga

SEQ ID NO: 6955976 - DNA, 22 bp, Homo sapiens
tacattgtgtctctatctagtc

SEQ ID NO: 6955977 - DNA, 22 bp, Homo sapiens
agagaaattctcagtggaagat

SEQ ID NO: 6955978 - DNA, 22 bp, Homo sapiens
tgctgggtagaagtattagtct

SEQ ID NO: 6955979 - DNA, 22 bp, Homo sapiens
cattcaaagcaggaaaggcctt

SEQ ID NO: 6955980 - DNA, 22 bp, Homo sapiens
aagcaggcaaggttgtggggca

SEQ ID NO: 6955981 - DNA, 22 bp, Homo sapiens
caggcctgaccctgagcttcac

SEQ ID NO: 6955982 - DNA, 22 bp, Homo sapiens
tatggactattgtatgacagag

SEQ ID NO: 6955983 - DNA, 22 bp, Homo sapiens
atgtgaaatagctggatatgaa

SEQ ID NO: 6955984 - DNA, 22 bp, Homo sapiens
tagtcacacaattgtgtacatt

SEQ ID NO: 6955985 - DNA, 18 bp, Homo sapiens
taactgtccaagattgaa

SEQ ID NO: 6955986 - DNA, 22 bp, Homo sapiens
ttcctatttccatgaaacacaa

SEQ ID NO: 6955987 - DNA, 22 bp, Homo sapiens
aaaggtttccgagctttaattt

SEQ ID NO: 6955988 - DNA, 22 bp, Homo sapiens
ggagtctgacccttagagatga

SEQ ID NO: 6955989 - DNA, 22 bp, Homo sapiens
taaagtcagggagattgaggct

SEQ ID NO: 6955990 - DNA, 20 bp, Homo sapiens
gcttcatttgcaagtctagt

SEQ ID NO: 6955991 - DNA, 21 bp, Homo sapiens
tttgaactagaggtaaattcc

SEQ ID NO: 6955992 - DNA, 22 bp, Homo sapiens
aaatggtgaagtgtaatttagc

SEQ ID NO: 6955993 - DNA, 22 bp, Homo sapiens
agcagctggaactaatagtggt

SEQ ID NO: 6955994 - DNA, 22 bp, Homo sapiens
atgcatctattcccaagggcag

SEQ ID NO: 6955995 - DNA, 22 bp, Homo sapiens
ttggcagatggattcaacatta

SEQ ID NO: 6955996 - DNA, 18 bp, Homo sapiens
agcaggttctcacagcca

SEQ ID NO: 6955997 - DNA, 22 bp, Homo sapiens
ttggccttgtctggtcttctcc

SEQ ID NO: 6955998 - DNA, 22 bp, Homo sapiens
ggcccagccggcgagtctcgcg

SEQ ID NO: 6955999 - DNA, 22 bp, Homo sapiens
ggatctgggctctgccaatcag

SEQ ID NO: 6956000 - DNA, 22 bp, Homo sapiens
aagacaatttgatactagttgc

SEQ ID NO: 6956001 - DNA, 20 bp, Homo sapiens
agctggttatcttaattctt

SEQ ID NO: 6956002 - DNA, 22 bp, Homo sapiens
cttgggatttgagatctggata

SEQ ID NO: 6956003 - DNA, 22 bp, Homo sapiens
ggtggcctttcagtggatcagg

SEQ ID NO: 6956004 - DNA, 22 bp, Homo sapiens
aatgtcttggatacagaggttg

SEQ ID NO: 6956005 - DNA, 18 bp, Homo sapiens
atcccaaaagacaaggaa

SEQ ID NO: 6956006 - DNA, 22 bp, Homo sapiens
ctctggttcagggctccctggc

SEQ ID NO: 6956007 - DNA, 22 bp, Homo sapiens
gccaggtgcacctgccctggcc

SEQ ID NO: 6956008 - DNA, 22 bp, Homo sapiens
aactctttggtctcaggaaagg

SEQ ID NO: 6956009 - DNA, 22 bp, Homo sapiens
ctctgggttcagaacagcaagc

SEQ ID NO: 6956010 - DNA, 22 bp, Homo sapiens
cagcctgtagtctggtccaggt

SEQ ID NO: 6956011 - DNA, 22 bp, Homo sapiens
atgctaattccatgagcacagg

SEQ ID NO: 6956012 - DNA, 22 bp, Homo sapiens
atgtgccctcttagagtctctg

SEQ ID NO: 6956013 - DNA, 22 bp, Homo sapiens
tggtcctcaccctacccagctg

SEQ ID NO: 6956014 - DNA, 22 bp, Homo sapiens
gctggcctctacaggccggcca

SEQ ID NO: 6956015 - DNA, 22 bp, Homo sapiens
agtttttgacaaactgtagttg

SEQ ID NO: 6956016 - DNA, 20 bp, Homo sapiens
tctgctggccaaaacttcac

SEQ ID NO: 6956017 - DNA, 23 bp, Homo sapiens
tgctttgccagagcaaaagtcta

SEQ ID NO: 6956018 - DNA, 22 bp, Homo sapiens
ctcagcttcatttgttccatga

SEQ ID NO: 6956019 - DNA, 22 bp, Homo sapiens
caggcacctttgtgcatgggca

SEQ ID NO: 6956020 - DNA, 22 bp, Homo sapiens
tagatcagagttcaggaagttt

SEQ ID NO: 6956021 - DNA, 22 bp, Homo sapiens
tctggctagattgatgagtccc

SEQ ID NO: 6956022 - DNA, 22 bp, Homo sapiens
agactctggcatgctaactagt

SEQ ID NO: 6956023 - DNA, 22 bp, Homo sapiens
agccttgctgcaattgttaaaa

SEQ ID NO: 6956024 - DNA, 22 bp, Homo sapiens
tgcctgctttctcctcaactca

SEQ ID NO: 6956025 - DNA, 22 bp, Homo sapiens
attgtatttgtacaagacatgt

SEQ ID NO: 6956026 - DNA, 22 bp, Homo sapiens
atgtccttggaacacctgaggt

SEQ ID NO: 6956027 - DNA, 22 bp, Homo sapiens
tttgaaccccgaccaaacactg

SEQ ID NO: 6956028 - DNA, 22 bp, Homo sapiens
gctctgtgttcctctggattgc

SEQ ID NO: 6956029 - DNA, 22 bp, Homo sapiens
gaattaggtaatagaactagta

SEQ ID NO: 6956030 - DNA, 22 bp, Homo sapiens
gtgcaaagtgcatggggaaggg

SEQ ID NO: 6956031 - DNA, 22 bp, Homo sapiens
agtgcccttcatgaagcaagag

SEQ ID NO: 6956032 - DNA, 22 bp, Homo sapiens
tgtaacagtagttactattctt

SEQ ID NO: 6956033 - DNA, 22 bp, Homo sapiens
cgtggctggggaggtcagccag

SEQ ID NO: 6956034 - DNA, 22 bp, Homo sapiens
gaggaacccaagctcaccgtca

SEQ ID NO: 6956035 - DNA, 22 bp, Homo sapiens
attgaaattgatgaaattcttg

SEQ ID NO: 6956036 - DNA, 21 bp, Homo sapiens
gtctggatgcccttctcttgg

SEQ ID NO: 6956037 - DNA, 22 bp, Homo sapiens
ccctggagctagtctgagcaga

SEQ ID NO: 6956038 - DNA, 22 bp, Homo sapiens
ggccttccatctgcctctgttt

SEQ ID NO: 6956039 - DNA, 22 bp, Homo sapiens
gcagccctgcaggcagctccag

SEQ ID NO: 6956040 - DNA, 22 bp, Homo sapiens
acagataataggatgtaccctg

SEQ ID NO: 6956041 - DNA, 22 bp, Homo sapiens
tccggggcttccccgcagtgcc

SEQ ID NO: 6956042 - DNA, 22 bp, Homo sapiens
tttcaaagggaagttatgaagt

SEQ ID NO: 6956043 - DNA, 21 bp, Homo sapiens
ttcattgaactatttgtggag

SEQ ID NO: 6956044 - DNA, 22 bp, Homo sapiens
ggagtgctgggccgctgccaac

SEQ ID NO: 6956045 - DNA, 22 bp, Homo sapiens
aaagcagcagcacgtggaagag

SEQ ID NO: 6956046 - DNA, 22 bp, Homo sapiens
gaactgtgtttgtttctaggtc

SEQ ID NO: 6956047 - DNA, 22 bp, Homo sapiens
tgctcagcagatctcaggagat

SEQ ID NO: 6956048 - DNA, 21 bp, Homo sapiens
tgggagagcgttgctgtcctc

SEQ ID NO: 6956049 - DNA, 22 bp, Homo sapiens
tatgaatgctccagtaactttc

SEQ ID NO: 6956050 - DNA, 22 bp, Homo sapiens
actgctgattttaggactgtta

SEQ ID NO: 6956051 - DNA, 22 bp, Homo sapiens
tagacatagtttttatgactta

SEQ ID NO: 6956052 - DNA, 17 bp, Homo sapiens
gaccaggagaaaccagg

SEQ ID NO: 6956053 - DNA, 22 bp, Homo sapiens
aggagtgttagagtagagctgg

SEQ ID NO: 6956054 - DNA, 22 bp, Homo sapiens
aaccagtttagtcatgctgtaa

SEQ ID NO: 6956055 - DNA, 22 bp, Homo sapiens
ctttatcatggaggtaaatatg

SEQ ID NO: 6956056 - DNA, 20 bp, Homo sapiens
ggggttgaccctcttggact

SEQ ID NO: 6956057 - DNA, 22 bp, Homo sapiens
ctcacacttcccaccctcctgg

SEQ ID NO: 6956058 - DNA, 22 bp, Homo sapiens
gagtccttaatacactggtgga

SEQ ID NO: 6956059 - DNA, 22 bp, Homo sapiens
cccaggtcccggggccagctgc

SEQ ID NO: 6956060 - DNA, 22 bp, Homo sapiens
cagatttggggtctcctgttag

SEQ ID NO: 6956061 - DNA, 22 bp, Homo sapiens
ttagtatctagctggaaccagg

SEQ ID NO: 6956062 - DNA, 22 bp, Homo sapiens
cgtccatattcatgagctgagt

SEQ ID NO: 6956063 - DNA, 22 bp, Homo sapiens
gcaaagtctcaagacccaagtg

SEQ ID NO: 6956064 - DNA, 22 bp, Homo sapiens
gtcccaggcaggccactggcag

SEQ ID NO: 6956065 - DNA, 22 bp, Homo sapiens
gagggcacaaaggcaacattca

SEQ ID NO: 6956066 - DNA, 23 bp, Homo sapiens
ctggctccgaagactccaggatc

SEQ ID NO: 6956067 - DNA, 22 bp, Homo sapiens
agacactgcggaggtcgggtgg

SEQ ID NO: 6956068 - DNA, 22 bp, Homo sapiens
ccagcactcgctgattttagga

SEQ ID NO: 6956069 - DNA, 22 bp, Homo sapiens
ggaagtttctggtgaggacgag

SEQ ID NO: 6956070 - DNA, 19 bp, Homo sapiens
atcatacatgttacactct

SEQ ID NO: 6956071 - DNA, 22 bp, Homo sapiens
ttagttaaaattctgctgacat

SEQ ID NO: 6956072 - DNA, 22 bp, Homo sapiens
catttggtggctacagagtaac

SEQ ID NO: 6956073 - DNA, 22 bp, Homo sapiens
gggtcgagggtctcgcccttcc

SEQ ID NO: 6956074 - DNA, 22 bp, Homo sapiens
gtggcagtgtggagggaggagt

SEQ ID NO: 6956075 - DNA, 22 bp, Homo sapiens
ttggaggaaagaaggttgatat

SEQ ID NO: 6956076 - DNA, 22 bp, Homo sapiens
tctggaagttagaggaggaaag

SEQ ID NO: 6956077 - DNA, 22 bp, Homo sapiens
agcatgctatattgattgtagt

SEQ ID NO: 6956078 - DNA, 22 bp, Homo sapiens
aagccagggtcagaatttgggc

SEQ ID NO: 6956079 - DNA, 22 bp, Homo sapiens
tcagttaatggtaagggtgaaa

SEQ ID NO: 6956080 - DNA, 22 bp, Homo sapiens
cagccttttccatgtattgttg

SEQ ID NO: 6956081 - DNA, 22 bp, Homo sapiens
tgaacttttgcacagaggattt

SEQ ID NO: 6956082 - DNA, 23 bp, Homo sapiens
tggctggcgcctgcctcaccctg

SEQ ID NO: 6956083 - DNA, 23 bp, Homo sapiens
gagcagagcgggcgggggtcctg

SEQ ID NO: 6956084 - DNA, 21 bp, Homo sapiens
agatgtttcccccttggcttc

SEQ ID NO: 6956085 - DNA, 22 bp, Homo sapiens
gcctccggagtcacagtgtctt

SEQ ID NO: 6956086 - DNA, 22 bp, Homo sapiens
tcctcatctcggaacctgccac

SEQ ID NO: 6956087 - DNA, 22 bp, Homo sapiens
tcatccagcctcatcaggagct

SEQ ID NO: 6956088 - DNA, 22 bp, Homo sapiens
acaagtaccaaatgctcaagta

SEQ ID NO: 6956089 - DNA, 16 bp, Homo sapiens
aactgcatgagtgggt

SEQ ID NO: 6956090 - DNA, 22 bp, Homo sapiens
cccaacactcacctccggatta

SEQ ID NO: 6956091 - DNA, 22 bp, Homo sapiens
gacaataaaatgatcttacagt

SEQ ID NO: 6956092 - DNA, 22 bp, Homo sapiens
tttgcttaaagttctttctggt

SEQ ID NO: 6956093 - DNA, 22 bp, Homo sapiens
ttcctggcacccttgttagcct

SEQ ID NO: 6956094 - DNA, 22 bp, Homo sapiens
tagtgtgtccctggggagtgtt

SEQ ID NO: 6956095 - DNA, 22 bp, Homo sapiens
gtttcctaggcttatacagctg

SEQ ID NO: 6956096 - DNA, 22 bp, Homo sapiens
caattttcaattccttcagata

SEQ ID NO: 6956097 - DNA, 22 bp, Homo sapiens
gtgaggatacttaagagaacac

SEQ ID NO: 6956098 - DNA, 22 bp, Homo sapiens
cagctgacactttgacctagag

SEQ ID NO: 6956099 - DNA, 22 bp, Homo sapiens
gtttctaattggaactttgagg

SEQ ID NO: 6956100 - DNA, 22 bp, Homo sapiens
cccaggcacatccactctgtga

SEQ ID NO: 6956101 - DNA, 22 bp, Homo sapiens
ggcctgcaaatggcaccttttt

SEQ ID NO: 6956102 - DNA, 22 bp, Homo sapiens
tctgcctgaatctcttagaaca

SEQ ID NO: 6956103 - DNA, 22 bp, Homo sapiens
atgatagctaccgtttatgctg

SEQ ID NO: 6956104 - DNA, 22 bp, Homo sapiens
tgtacacatttttatgttaaca

SEQ ID NO: 6956105 - DNA, 22 bp, Homo sapiens
acatctgtgcacgccctccttg

SEQ ID NO: 6956106 - DNA, 22 bp, Homo sapiens
ttacttggaggcctgttaccag

SEQ ID NO: 6956107 - DNA, 22 bp, Homo sapiens
ttgaaaggtgctgtgtgctgat

SEQ ID NO: 6956108 - DNA, 22 bp, Homo sapiens
tttctagatgcggggcttgtgc

SEQ ID NO: 6956109 - DNA, 22 bp, Homo sapiens
ttcaaaggtgactttgggccag

SEQ ID NO: 6956110 - DNA, 23 bp, Homo sapiens
tagaggaggatgtgatgcatatt

SEQ ID NO: 6956111 - DNA, 22 bp, Homo sapiens
cgactactaactactgtagaaa

SEQ ID NO: 6956112 - DNA, 22 bp, Homo sapiens
gtcactgtgctaggtgctgaat

SEQ ID NO: 6956113 - DNA, 22 bp, Homo sapiens
tccaaatacatttactgtattt

SEQ ID NO: 6956114 - DNA, 22 bp, Homo sapiens
cctcaggttctggagaagggcc

SEQ ID NO: 6956115 - DNA, 22 bp, Homo sapiens
tggcagtgccccttgaccagtg

SEQ ID NO: 6956116 - DNA, 22 bp, Homo sapiens
aactaaaggctgttgcagggaa

SEQ ID NO: 6956117 - DNA, 22 bp, Homo sapiens
gagcctttgcacttgctgtgtt

SEQ ID NO: 6956118 - DNA, 22 bp, Homo sapiens
ctctgacctctagccagctctg

SEQ ID NO: 6956119 - DNA, 22 bp, Homo sapiens
gggggagctgttattggcaggg

SEQ ID NO: 6956120 - DNA, 22 bp, Homo sapiens
aggctggagtgtgcagtggcgc

SEQ ID NO: 6956121 - DNA, 22 bp, Homo sapiens
cagaagcctgcctcagatgcac

SEQ ID NO: 6956122 - DNA, 22 bp, Homo sapiens
gcactgtagtgggggagaaatg

SEQ ID NO: 6956123 - DNA, 22 bp, Homo sapiens
ttgtggggtgatttgccacggg

SEQ ID NO: 6956124 - DNA, 22 bp, Homo sapiens
gccaggcaggtgtcggagccct

SEQ ID NO: 6956125 - DNA, 22 bp, Homo sapiens
tcacattttccttggtatctgt

SEQ ID NO: 6956126 - DNA, 19 bp, Homo sapiens
gagttcctgcaaggcctcc

SEQ ID NO: 6956127 - DNA, 20 bp, Homo sapiens
acaaggaaccaggaggtggc

SEQ ID NO: 6956128 - DNA, 17 bp, Homo sapiens
ggccagaggcggggctg

SEQ ID NO: 6956129 - DNA, 22 bp, Homo sapiens
tgtgtttctctgaggggtccct

SEQ ID NO: 6956130 - DNA, 22 bp, Homo sapiens
ctgccctctagggatgcactgg

SEQ ID NO: 6956131 - DNA, 22 bp, Homo sapiens
aaacatgagcatttctgtttaa

SEQ ID NO: 6956132 - DNA, 22 bp, Homo sapiens
tacacaatctgtttttccattt

SEQ ID NO: 6956133 - DNA, 22 bp, Homo sapiens
aagggcagggagtttgtgtcta

SEQ ID NO: 6956134 - DNA, 22 bp, Homo sapiens
gtcaacaagtggttattgggat

SEQ ID NO: 6956135 - DNA, 22 bp, Homo sapiens
tactaaatagtttaattcctca

SEQ ID NO: 6956136 - DNA, 22 bp, Homo sapiens
tttgctctgacagtgccagaga

SEQ ID NO: 6956137 - DNA, 22 bp, Homo sapiens
acttggtcttcaaatgcatgat

SEQ ID NO: 6956138 - DNA, 22 bp, Homo sapiens
gctccagaaatgccgtgatcct

SEQ ID NO: 6956139 - DNA, 22 bp, Homo sapiens
agccctccaaaggttgggggag

SEQ ID NO: 6956140 - DNA, 22 bp, Homo sapiens
gagggttggtgcaaatgggatg

SEQ ID NO: 6956141 - DNA, 22 bp, Homo sapiens
actgttcttcccatttatattg

SEQ ID NO: 6956142 - DNA, 22 bp, Homo sapiens
agagcaaatagagaagccagct

SEQ ID NO: 6956143 - DNA, 22 bp, Homo sapiens
taaggccaattacatatgttca

SEQ ID NO: 6956144 - DNA, 22 bp, Homo sapiens
cagggctgaactgagcttgtga

SEQ ID NO: 6956145 - DNA, 22 bp, Homo sapiens
agcttgttttgttgaatactta

SEQ ID NO: 6956146 - DNA, 22 bp, Homo sapiens
gccatgcttggtatgctgtgag

SEQ ID NO: 6956147 - DNA, 22 bp, Homo sapiens
cagattagttgtgctatggcct

SEQ ID NO: 6956148 - DNA, 22 bp, Homo sapiens
ctttgcagaagaaacctacaaa

SEQ ID NO: 6956149 - DNA, 22 bp, Homo sapiens
agcacctccagagcttgaagct

SEQ ID NO: 6956150 - DNA, 21 bp, Homo sapiens
gcctggcaaaaaccggccctg

SEQ ID NO: 6956151 - DNA, 22 bp, Homo sapiens
tagggcagctgcatcaggcact

SEQ ID NO: 6956152 - DNA, 22 bp, Homo sapiens
ttctagcagagggcatctgctg

SEQ ID NO: 6956153 - DNA, 22 bp, Homo sapiens
agtaataatagctgtaaagtgc

SEQ ID NO: 6956154 - DNA, 22 bp, Homo sapiens
tcaagtatttatttctgctggc

SEQ ID NO: 6956155 - DNA, 22 bp, Homo sapiens
gaaaacatccagagatagacct

SEQ ID NO: 6956156 - DNA, 22 bp, Homo sapiens
accagagggagacttcctcttc

SEQ ID NO: 6956157 - DNA, 21 bp, Homo sapiens
gtcaggcccatagcagtgcct

SEQ ID NO: 6956158 - DNA, 22 bp, Homo sapiens
ctggctgcctatagtctccctt

SEQ ID NO: 6956159 - DNA, 22 bp, Homo sapiens
ggtggcctcggtggtgcacagg

SEQ ID NO: 6956160 - DNA, 22 bp, Homo sapiens
gtgaggactagtgggtttgtgc

SEQ ID NO: 6956161 - DNA, 22 bp, Homo sapiens
caacatttgtgatgagcaaact

SEQ ID NO: 6956162 - DNA, 22 bp, Homo sapiens
ataaacagtagagaaaggtggt

SEQ ID NO: 6956163 - DNA, 18 bp, Homo sapiens
agatgttcaatatttctc

SEQ ID NO: 6956164 - DNA, 22 bp, Homo sapiens
tttttctagaccttaaaggcca

SEQ ID NO: 6956165 - DNA, 22 bp, Homo sapiens
tcctgggagcacatggtcctgc

SEQ ID NO: 6956166 - DNA, 22 bp, Homo sapiens
tgagaactgcctgtatttatct

SEQ ID NO: 6956167 - DNA, 22 bp, Homo sapiens
tgtgcagctagtcctggacttg

SEQ ID NO: 6956168 - DNA, 23 bp, Homo sapiens
gcccatggagtctggatctggcc

SEQ ID NO: 6956169 - DNA, 21 bp, Homo sapiens
gccacctcaatcttctagcgc

SEQ ID NO: 6956170 - DNA, 22 bp, Homo sapiens
ctcttcaactgccaggcagtct

SEQ ID NO: 6956171 - DNA, 22 bp, Homo sapiens
gctctgagaaccaggaacacag

SEQ ID NO: 6956172 - DNA, 22 bp, Homo sapiens
agcaactgttacaagaacaaca

SEQ ID NO: 6956173 - DNA, 22 bp, Homo sapiens
ttgaagtcagagttttcaagca

SEQ ID NO: 6956174 - DNA, 22 bp, Homo sapiens
tcctgaggtgctcagccaggaa

SEQ ID NO: 6956175 - DNA, 22 bp, Homo sapiens
ctgtggcttctaggtccccgat

SEQ ID NO: 6956176 - DNA, 22 bp, Homo sapiens
aggaggaggctggagtacaccc

SEQ ID NO: 6956177 - DNA, 20 bp, Homo sapiens
gtctccactgggggttaacc

SEQ ID NO: 6956178 - DNA, 22 bp, Homo sapiens
caaggagaaaacggcttctgaa

SEQ ID NO: 6956179 - DNA, 22 bp, Homo sapiens
tgggctgaaatgctgtggacta

SEQ ID NO: 6956180 - DNA, 22 bp, Homo sapiens
gtggacactggcagcagctcag

SEQ ID NO: 6956181 - DNA, 22 bp, Homo sapiens
agtggtcttagcttgctgggct

SEQ ID NO: 6956182 - DNA, 22 bp, Homo sapiens
ctaggactgtcagcctgagttg

SEQ ID NO: 6956183 - DNA, 22 bp, Homo sapiens
ttcttatagaagcaaccattgt

SEQ ID NO: 6956184 - DNA, 22 bp, Homo sapiens
gccagaagactggagtcagctg

SEQ ID NO: 6956185 - DNA, 22 bp, Homo sapiens
gagtggctacaggcagcttaca

SEQ ID NO: 6956186 - DNA, 20 bp, Homo sapiens
ttcttgagccaaaaggcata

SEQ ID NO: 6956187 - DNA, 22 bp, Homo sapiens
gagaggatccacaaaccaggaa

SEQ ID NO: 6956188 - DNA, 22 bp, Homo sapiens
tctgagccacctgagcccatgg

SEQ ID NO: 6956189 - DNA, 22 bp, Homo sapiens
atcatgctgacacagtttatct

SEQ ID NO: 6956190 - DNA, 22 bp, Homo sapiens
ggaggctcccacgcagctcaca

SEQ ID NO: 6956191 - DNA, 22 bp, Homo sapiens
gtccatggcatttccgtcacat

SEQ ID NO: 6956192 - DNA, 22 bp, Homo sapiens
ccctgtcctggatgggagcact

SEQ ID NO: 6956193 - DNA, 22 bp, Homo sapiens
gctgtgaaacctcagtgatagt

SEQ ID NO: 6956194 - DNA, 22 bp, Homo sapiens
ctcagtgcttagtgtgttttgg

SEQ ID NO: 6956195 - DNA, 22 bp, Homo sapiens
agtttggggcaagaggacagat

SEQ ID NO: 6956196 - DNA, 22 bp, Homo sapiens
aatgagaaaacacagaggaggt

SEQ ID NO: 6956197 - DNA, 21 bp, Homo sapiens
aagtaaatcagagaaataacc

SEQ ID NO: 6956198 - DNA, 22 bp, Homo sapiens
gcagtttagtagatgacattat

SEQ ID NO: 6956199 - DNA, 22 bp, Homo sapiens
tggcttagttctagaaatttgg

SEQ ID NO: 6956200 - DNA, 22 bp, Homo sapiens
ttggacagcacagacatagaat

SEQ ID NO: 6956201 - DNA, 22 bp, Homo sapiens
ctgcaggaatctgtgctaggtg

SEQ ID NO: 6956202 - DNA, 23 bp, Homo sapiens
ctgaggtctgcaattctagtagt

SEQ ID NO: 6956203 - DNA, 22 bp, Homo sapiens
gtggatctcattcaccatggct

SEQ ID NO: 6956204 - DNA, 22 bp, Homo sapiens
aagtttgggcataaggctgtct

SEQ ID NO: 6956205 - DNA, 22 bp, Homo sapiens
gtcaacaaagaaaattgttaat

SEQ ID NO: 6956206 - DNA, 22 bp, Homo sapiens
tctgaccaggctcagccaaggc

SEQ ID NO: 6956207 - DNA, 22 bp, Homo sapiens
tcacccaggtaatagcagtttg

SEQ ID NO: 6956208 - DNA, 22 bp, Homo sapiens
caacccaaggttagttggtctt

SEQ ID NO: 6956209 - DNA, 20 bp, Homo sapiens
ttcctcacaagtccctcggc

SEQ ID NO: 6956210 - DNA, 22 bp, Homo sapiens
tgtcaacaacagcattttctat

SEQ ID NO: 6956211 - DNA, 22 bp, Homo sapiens
gtgtacacttccttcacacggt

SEQ ID NO: 6956212 - DNA, 22 bp, Homo sapiens
tttctgcccccgagggcggtgc

SEQ ID NO: 6956213 - DNA, 22 bp, Homo sapiens
tttgtgttttcccatactattg

SEQ ID NO: 6956214 - DNA, 22 bp, Homo sapiens
cagaggtattgcaaaagcctag

SEQ ID NO: 6956215 - DNA, 22 bp, Homo sapiens
caaatgcaggtcataacctgag

SEQ ID NO: 6956216 - DNA, 22 bp, Homo sapiens
tctgcaaaagtgttcataaaga

SEQ ID NO: 6956217 - DNA, 22 bp, Homo sapiens
ctttggcttttagatatccatt

SEQ ID NO: 6956218 - DNA, 22 bp, Homo sapiens
tgtgacaggaactatgtggatg

SEQ ID NO: 6956219 - DNA, 22 bp, Homo sapiens
ccccaggagaaatcttaaacta

SEQ ID NO: 6956220 - DNA, 21 bp, Homo sapiens
gctgttcggcggccctcgcgc

SEQ ID NO: 6956221 - DNA, 22 bp, Homo sapiens
tgtagggacttggcgatcactt

SEQ ID NO: 6956222 - DNA, 22 bp, Homo sapiens
ggaggtagcctcaaaagcagct

SEQ ID NO: 6956223 - DNA, 17 bp, Homo sapiens
ctcagctgaaccccaga

SEQ ID NO: 6956224 - DNA, 22 bp, Homo sapiens
acatctgttgattgatgttaca

SEQ ID NO: 6956225 - DNA, 22 bp, Homo sapiens
tgtcttcacatgataagccatt

SEQ ID NO: 6956226 - DNA, 22 bp, Homo sapiens
tctgtgactcatatctgtagat

SEQ ID NO: 6956227 - DNA, 22 bp, Homo sapiens
tatgtgtaggaggaggacaggg

SEQ ID NO: 6956228 - DNA, 22 bp, Homo sapiens
aggctgaaaacgagatggcaat

SEQ ID NO: 6956229 - DNA, 22 bp, Homo sapiens
gtgcaaaagtacttgcggattt

SEQ ID NO: 6956230 - DNA, 22 bp, Homo sapiens
gctgcctgttgaagggtctgtg

SEQ ID NO: 6956231 - DNA, 22 bp, Homo sapiens
agcatgcttggcatttgtcaga

SEQ ID NO: 6956232 - DNA, 22 bp, Homo sapiens
acagtctaatcttgtgttctgt

SEQ ID NO: 6956233 - DNA, 22 bp, Homo sapiens
gtatatgctgatgtgatcggtt

SEQ ID NO: 6956234 - DNA, 22 bp, Homo sapiens
ggtttctcaccttcagcactac

SEQ ID NO: 6956235 - DNA, 20 bp, Homo sapiens
actcatctactccagaccct

SEQ ID NO: 6956236 - DNA, 22 bp, Homo sapiens
cacagaggctcaaagccaggtg

SEQ ID NO: 6956237 - DNA, 22 bp, Homo sapiens
gtgtcaggagaattagggcttt

SEQ ID NO: 6956238 - DNA, 22 bp, Homo sapiens
ttggtgggcacaggggagaagt

SEQ ID NO: 6956239 - DNA, 22 bp, Homo sapiens
cccatcggcaaggtaggtgatt

SEQ ID NO: 6956240 - DNA, 22 bp, Homo sapiens
agcaaagctgctcccttttgtc

SEQ ID NO: 6956241 - DNA, 22 bp, Homo sapiens
atggcctgatgcacctgtccca

SEQ ID NO: 6956242 - DNA, 22 bp, Homo sapiens
ctgaggcttctctagttcagct

SEQ ID NO: 6956243 - DNA, 20 bp, Homo sapiens
ggagagcagggaagacagta

SEQ ID NO: 6956244 - DNA, 18 bp, Homo sapiens
gacagtaaacttccccat

SEQ ID NO: 6956245 - DNA, 22 bp, Homo sapiens
gtctcaggtattgaatgggaac

SEQ ID NO: 6956246 - DNA, 20 bp, Homo sapiens
agtctctgcaacatagtgca

SEQ ID NO: 6956247 - DNA, 22 bp, Homo sapiens
gagcacaggctttggtggacac

SEQ ID NO: 6956248 - DNA, 22 bp, Homo sapiens
attgaacagcccaggtttacct

SEQ ID NO: 6956249 - DNA, 22 bp, Homo sapiens
agctcattgaagtcatgacctg

SEQ ID NO: 6956250 - DNA, 17 bp, Homo sapiens
ctttgcagcagacatgt

SEQ ID NO: 6956251 - DNA, 22 bp, Homo sapiens
catcagacctgccagactaggt

SEQ ID NO: 6956252 - DNA, 22 bp, Homo sapiens
gaggaggagtatatattagaat

SEQ ID NO: 6956253 - DNA, 22 bp, Homo sapiens
ggcttggcctgataaatgcatg

SEQ ID NO: 6956254 - DNA, 22 bp, Homo sapiens
gagaacacgaggaggcccagcg

SEQ ID NO: 6956255 - DNA, 22 bp, Homo sapiens
tgcaacttgtttggagagaaag

SEQ ID NO: 6956256 - DNA, 22 bp, Homo sapiens
agacttgggacctaggaatgga

SEQ ID NO: 6956257 - DNA, 22 bp, Homo sapiens
agaacttaattcagtgacttaa

SEQ ID NO: 6956258 - DNA, 22 bp, Homo sapiens
ttgtagaggaaagggaatggat

SEQ ID NO: 6956259 - DNA, 22 bp, Homo sapiens
gaggcagcggctcacagagaaa

SEQ ID NO: 6956260 - DNA, 22 bp, Homo sapiens
ctttagaatttcatgtttggtc

SEQ ID NO: 6956261 - DNA, 22 bp, Homo sapiens
cttggaaactttccctgggcac

SEQ ID NO: 6956262 - DNA, 22 bp, Homo sapiens
ctccttttcctactcatactat

SEQ ID NO: 6956263 - DNA, 21 bp, Homo sapiens
ggtaccaaagggggtgctccc

SEQ ID NO: 6956264 - DNA, 22 bp, Homo sapiens
gctgctggcttcctgctgtttt

SEQ ID NO: 6956265 - DNA, 22 bp, Homo sapiens
ggattgaagggaacctcagaat

SEQ ID NO: 6956266 - DNA, 22 bp, Homo sapiens
caagtccatcctactgccttct

SEQ ID NO: 6956267 - DNA, 22 bp, Homo sapiens
actgagagtcttagaaacacat

SEQ ID NO: 6956268 - DNA, 22 bp, Homo sapiens
tgtactattaagaggcctaaat

SEQ ID NO: 6956269 - DNA, 22 bp, Homo sapiens
agattccagatcccaaaaatga

SEQ ID NO: 6956270 - DNA, 22 bp, Homo sapiens
gaacatttatgatgcaatacct

SEQ ID NO: 6956271 - DNA, 22 bp, Homo sapiens
agtctaggtaggacaccccagg

SEQ ID NO: 6956272 - DNA, 22 bp, Homo sapiens
gtctctgggtgtgtgatgccaa

SEQ ID NO: 6956273 - DNA, 22 bp, Homo sapiens
aatggtttaacatatgcttgag

SEQ ID NO: 6956274 - DNA, 22 bp, Homo sapiens
ttcagaaggatgacaccagttg

SEQ ID NO: 6956275 - DNA, 22 bp, Homo sapiens
ggttcacactaagcttaagtgg

SEQ ID NO: 6956276 - DNA, 22 bp, Homo sapiens
aaacacagggatatatattcca

SEQ ID NO: 6956277 - DNA, 21 bp, Homo sapiens
ggcactgagccagatggactc

SEQ ID NO: 6956278 - DNA, 22 bp, Homo sapiens
atggagcaacagacctatcaca

SEQ ID NO: 6956279 - DNA, 20 bp, Homo sapiens
ctggggagcctcgcggtggc

SEQ ID NO: 6956280 - DNA, 18 bp, Homo sapiens
gtgtggctgagatgaggc

SEQ ID NO: 6956281 - DNA, 22 bp, Homo sapiens
tgggctcttcagctttgatcag

SEQ ID NO: 6956282 - DNA, 22 bp, Homo sapiens
tcacttattttctaaccaaagg

SEQ ID NO: 6956283 - DNA, 22 bp, Homo sapiens
ctttcacaagatttgagatgct

SEQ ID NO: 6956284 - DNA, 22 bp, Homo sapiens
tcctctgtggaccgggctttgg

SEQ ID NO: 6956285 - DNA, 23 bp, Homo sapiens
ttctctagatgaggtgaagatgg

SEQ ID NO: 6956286 - DNA, 22 bp, Homo sapiens
ctcggggatccatccacgtggc

SEQ ID NO: 6956287 - DNA, 22 bp, Homo sapiens
gatttgaccttctcccgtcttt

SEQ ID NO: 6956288 - DNA, 22 bp, Homo sapiens
acagatggtactaaacccatat

SEQ ID NO: 6956289 - DNA, 22 bp, Homo sapiens
aggacctgacattgtgttttct

SEQ ID NO: 6956290 - DNA, 22 bp, Homo sapiens
ctctctttgatgtataaataat

SEQ ID NO: 6956291 - DNA, 22 bp, Homo sapiens
cccaaacagttcctgtggtact

SEQ ID NO: 6956292 - DNA, 22 bp, Homo sapiens
agcctctgtagaaagcagtgtg

SEQ ID NO: 6956293 - DNA, 22 bp, Homo sapiens
taggtgtaccagccataccctg

SEQ ID NO: 6956294 - DNA, 22 bp, Homo sapiens
cagcaggtgctgcctgtcaccc

SEQ ID NO: 6956295 - DNA, 22 bp, Homo sapiens
tcagaggaaacaatctttagta

SEQ ID NO: 6956296 - DNA, 23 bp, Homo sapiens
agcagggccagaatacttgctgt

SEQ ID NO: 6956297 - DNA, 22 bp, Homo sapiens
ggtagccagcaactagcccagg

SEQ ID NO: 6956298 - DNA, 22 bp, Homo sapiens
cagggattcagctgaaggaggc

SEQ ID NO: 6956299 - DNA, 22 bp, Homo sapiens
tccagaaaattttacagtgcct

SEQ ID NO: 6956300 - DNA, 19 bp, Homo sapiens
tcctccctttggtgtcctg

SEQ ID NO: 6956301 - DNA, 22 bp, Homo sapiens
aggttccaggtctgggttatgt

SEQ ID NO: 6956302 - DNA, 22 bp, Homo sapiens
aaggtcagagtgagctgtggcc

SEQ ID NO: 6956303 - DNA, 22 bp, Homo sapiens
aggaagttggcattttgtttca

SEQ ID NO: 6956304 - DNA, 22 bp, Homo sapiens
gaaaaggccactcctaggagct

SEQ ID NO: 6956305 - DNA, 22 bp, Homo sapiens
gtgccactgcactctagcctag

SEQ ID NO: 6956306 - DNA, 22 bp, Homo sapiens
aagtgctgggattacaggcatg

SEQ ID NO: 6956307 - DNA, 22 bp, Homo sapiens
ggtgacatcagtaaccgtggtt

SEQ ID NO: 6956308 - DNA, 22 bp, Homo sapiens
agtgtccttgttattactgctc

SEQ ID NO: 6956309 - DNA, 21 bp, Homo sapiens
agtggtctttttcacccagtg

SEQ ID NO: 6956310 - DNA, 22 bp, Homo sapiens
tctcaggcactgggtgccaact

SEQ ID NO: 6956311 - DNA, 22 bp, Homo sapiens
acttgtctttgtaaaatagaaa

SEQ ID NO: 6956312 - DNA, 22 bp, Homo sapiens
acactggagggtccagggatgt

SEQ ID NO: 6956313 - DNA, 22 bp, Homo sapiens
gtggcactcacctgtagtttca

SEQ ID NO: 6956314 - DNA, 22 bp, Homo sapiens
atgtggccttaggttctagtgg

SEQ ID NO: 6956315 - DNA, 22 bp, Homo sapiens
tgcctgggactctgttatcttg

SEQ ID NO: 6956316 - DNA, 22 bp, Homo sapiens
tgcaggtagcaggtacggttgt

SEQ ID NO: 6956317 - DNA, 19 bp, Homo sapiens
tgtgccttatactcacatt

SEQ ID NO: 6956318 - DNA, 22 bp, Homo sapiens
tggaggcataggcctgggccct

SEQ ID NO: 6956319 - DNA, 22 bp, Homo sapiens
gagagtgtctggaggaagctaa

SEQ ID NO: 6956320 - DNA, 22 bp, Homo sapiens
aactggaatgaaatttacgatg

SEQ ID NO: 6956321 - DNA, 23 bp, Homo sapiens
tgtctttgaatgggctgtagaca

SEQ ID NO: 6956322 - DNA, 22 bp, Homo sapiens
agcagcagggtcattgctcttt

SEQ ID NO: 6956323 - DNA, 22 bp, Homo sapiens
aggatgtgtgtaggctggttaa

SEQ ID NO: 6956324 - DNA, 22 bp, Homo sapiens
gagcagatctcaggccttctgt

SEQ ID NO: 6956325 - DNA, 22 bp, Homo sapiens
gagcagctcagaggactagtgt

SEQ ID NO: 6956326 - DNA, 22 bp, Homo sapiens
cttcataggcttacttgagaaa

SEQ ID NO: 6956327 - DNA, 22 bp, Homo sapiens
gctcaggggaatgggctgccgt

SEQ ID NO: 6956328 - DNA, 22 bp, Homo sapiens
acacagttcatgcatgaggtct

SEQ ID NO: 6956329 - DNA, 22 bp, Homo sapiens
aatggctttcagcaaggataga

SEQ ID NO: 6956330 - DNA, 22 bp, Homo sapiens
tgtgtgtgtgcgcgcacgcata

SEQ ID NO: 6956331 - DNA, 22 bp, Homo sapiens
agcaggttaccattgatttcct

SEQ ID NO: 6956332 - DNA, 22 bp, Homo sapiens
cagagccttagttctcctagaa

SEQ ID NO: 6956333 - DNA, 22 bp, Homo sapiens
gatgacaagcatatgacacgtc

SEQ ID NO: 6956334 - DNA, 22 bp, Homo sapiens
ggctaggcgggcacatggtgga

SEQ ID NO: 6956335 - DNA, 22 bp, Homo sapiens
gagagtggaaagcaagctgagt

SEQ ID NO: 6956336 - DNA, 22 bp, Homo sapiens
atcctgaggtactgcagggccg

SEQ ID NO: 6956337 - DNA, 22 bp, Homo sapiens
tatgcgtgcctctgtctgtctg

SEQ ID NO: 6956338 - DNA, 23 bp, Homo sapiens
agccaatctatgctgggttcaaa

SEQ ID NO: 6956339 - DNA, 22 bp, Homo sapiens
gggtgaagctcctgcaggggcc

SEQ ID NO: 6956340 - DNA, 22 bp, Homo sapiens
tgggctgcaccctcagcctctg

SEQ ID NO: 6956341 - DNA, 22 bp, Homo sapiens
tactggccaagagaatgcagta

SEQ ID NO: 6956342 - DNA, 22 bp, Homo sapiens
tacatagtgttttgaagaatta

SEQ ID NO: 6956343 - DNA, 22 bp, Homo sapiens
ccctgtgcagatggcagctggg

SEQ ID NO: 6956344 - DNA, 19 bp, Homo sapiens
ctgtttctgagcttgcttt

SEQ ID NO: 6956345 - DNA, 22 bp, Homo sapiens
tggcaactcctgactctactca

SEQ ID NO: 6956346 - DNA, 22 bp, Homo sapiens
ctgtcatttaagacattctgga

SEQ ID NO: 6956347 - DNA, 18 bp, Homo sapiens
taaaattcaaggcagggt

SEQ ID NO: 6956348 - DNA, 22 bp, Homo sapiens
atgccttattgtaatctttcca

SEQ ID NO: 6956349 - DNA, 21 bp, Homo sapiens
tgagaagtatgtcttcagcca

SEQ ID NO: 6956350 - DNA, 22 bp, Homo sapiens
gcagcagtgtgggctgaaccta

SEQ ID NO: 6956351 - DNA, 22 bp, Homo sapiens
gctcagagaaagattagtccct

SEQ ID NO: 6956352 - DNA, 22 bp, Homo sapiens
attcagttctaaggtcagtgcc

SEQ ID NO: 6956353 - DNA, 22 bp, Homo sapiens
ggctgagagtggatcccaggga

SEQ ID NO: 6956354 - DNA, 22 bp, Homo sapiens
ttccttctctgtggggaaggca

SEQ ID NO: 6956355 - DNA, 21 bp, Homo sapiens
actgttattcccattttcacc

SEQ ID NO: 6956356 - DNA, 22 bp, Homo sapiens
aacctgttttgattaacaagta

SEQ ID NO: 6956357 - DNA, 19 bp, Homo sapiens
ccatttcatatgtattgtg

SEQ ID NO: 6956358 - DNA, 22 bp, Homo sapiens
attctttgcatctctgggtggc

SEQ ID NO: 6956359 - DNA, 22 bp, Homo sapiens
tgtccccacctaaatcttatct

SEQ ID NO: 6956360 - DNA, 22 bp, Homo sapiens
cgtaccagcataaactgaaggt

SEQ ID NO: 6956361 - DNA, 22 bp, Homo sapiens
atgtgttagtttgtgattatac

SEQ ID NO: 6956362 - DNA, 22 bp, Homo sapiens
tctctttgtggccaggagagga

SEQ ID NO: 6956363 - DNA, 22 bp, Homo sapiens
tgtggaggattctgatgccagc

SEQ ID NO: 6956364 - DNA, 22 bp, Homo sapiens
cgctcagactcatgatatgctg

SEQ ID NO: 6956365 - DNA, 22 bp, Homo sapiens
tgttggatgaccttgtaattat

SEQ ID NO: 6956366 - DNA, 22 bp, Homo sapiens
ttccagttgtcataaagctagg

SEQ ID NO: 6956367 - DNA, 22 bp, Homo sapiens
atctgtaacatcagtagcagaa

SEQ ID NO: 6956368 - DNA, 22 bp, Homo sapiens
ctgctgtctcactggtgtggtt

SEQ ID NO: 6956369 - DNA, 22 bp, Homo sapiens
agtcaatattcaagtgtaaata

SEQ ID NO: 6956370 - DNA, 22 bp, Homo sapiens
gagatggctctcagatctttga

SEQ ID NO: 6956371 - DNA, 22 bp, Homo sapiens
tttcagttactgctatatcatt

SEQ ID NO: 6956372 - DNA, 22 bp, Homo sapiens
gctgacaggctctgtgtatgct

SEQ ID NO: 6956373 - DNA, 22 bp, Homo sapiens
tgtcatcttcatcataagtaaa

SEQ ID NO: 6956374 - DNA, 22 bp, Homo sapiens
ctggcttccctgtcttatggaa

SEQ ID NO: 6956375 - DNA, 22 bp, Homo sapiens
acatttgattgatgaatcaaat

SEQ ID NO: 6956376 - DNA, 22 bp, Homo sapiens
ccaggtaaattacctactgaat

SEQ ID NO: 6956377 - DNA, 22 bp, Homo sapiens
aattaagagagagttgaagcaa

SEQ ID NO: 6956378 - DNA, 21 bp, Homo sapiens
gtacttaagaaactctatgac

SEQ ID NO: 6956379 - DNA, 20 bp, Homo sapiens
gcacagtttgggaaccatgg

SEQ ID NO: 6956380 - DNA, 22 bp, Homo sapiens
tggctaggactcatcctgtttc

SEQ ID NO: 6956381 - DNA, 22 bp, Homo sapiens
tgaaacaggatgcagaggagga

SEQ ID NO: 6956382 - DNA, 22 bp, Homo sapiens
tgccaggagtcaggccaggcag

SEQ ID NO: 6956383 - DNA, 22 bp, Homo sapiens
tctgccctcagggtaatgatca

SEQ ID NO: 6956384 - DNA, 22 bp, Homo sapiens
gtctggacaggactatttctaa

SEQ ID NO: 6956385 - DNA, 22 bp, Homo sapiens
aggaggagcagctttttgtctc

SEQ ID NO: 6956386 - DNA, 22 bp, Homo sapiens
gacatcatggagaggataaata

SEQ ID NO: 6956387 - DNA, 22 bp, Homo sapiens
taaaggcagtaattcctgagtt

SEQ ID NO: 6956388 - DNA, 22 bp, Homo sapiens
tctaataaataaatgctctagg

SEQ ID NO: 6956389 - DNA, 22 bp, Homo sapiens
aggagccaggaaacctgctctg

SEQ ID NO: 6956390 - DNA, 22 bp, Homo sapiens
cagcagccagacaagatacatc

SEQ ID NO: 6956391 - DNA, 22 bp, Homo sapiens
gagcacttagatgctatgaatg

SEQ ID NO: 6956392 - DNA, 22 bp, Homo sapiens
accatcaagaccttatctagtt

SEQ ID NO: 6956393 - DNA, 22 bp, Homo sapiens
cctttagatgatctcttggaca

SEQ ID NO: 6956394 - DNA, 22 bp, Homo sapiens
tgtctcttgagtttgttttaat

SEQ ID NO: 6956395 - DNA, 22 bp, Homo sapiens
tggtcctgagaatcctgtcctc

SEQ ID NO: 6956396 - DNA, 22 bp, Homo sapiens
tgacaaattcatatttcagagg

SEQ ID NO: 6956397 - DNA, 22 bp, Homo sapiens
tcacatactgaaagtccagtga

SEQ ID NO: 6956398 - DNA, 18 bp, Homo sapiens
gtacactacatgtctaac

SEQ ID NO: 6956399 - DNA, 22 bp, Homo sapiens
actgaggctagattgctgttct

SEQ ID NO: 6956400 - DNA, 22 bp, Homo sapiens
ttatttttaaaagttcacacag

SEQ ID NO: 6956401 - DNA, 22 bp, Homo sapiens
ggcatgcttctgagatgtctcc

SEQ ID NO: 6956402 - DNA, 18 bp, Homo sapiens
ttagtataactgcctgtg

SEQ ID NO: 6956403 - DNA, 22 bp, Homo sapiens
ttcaggatccccttgatgggct

SEQ ID NO: 6956404 - DNA, 22 bp, Homo sapiens
tcctggcttccactcctctgtt

SEQ ID NO: 6956405 - DNA, 22 bp, Homo sapiens
aggaagcttagatttccagatc

SEQ ID NO: 6956406 - DNA, 22 bp, Homo sapiens
tccctgggcctatcttagctcc

SEQ ID NO: 6956407 - DNA, 22 bp, Homo sapiens
gcagagcagtgcttgcccagcg

SEQ ID NO: 6956408 - DNA, 22 bp, Homo sapiens
attgatgagcattactctctaa

SEQ ID NO: 6956409 - DNA, 22 bp, Homo sapiens
ttgggctggataagtctttgtt

SEQ ID NO: 6956410 - DNA, 22 bp, Homo sapiens
gatcatcatctttcaggcaagt

SEQ ID NO: 6956411 - DNA, 22 bp, Homo sapiens
gactggagtgcctccaggaaag

SEQ ID NO: 6956412 - DNA, 23 bp, Homo sapiens
atctgtgtgtgggtagggatgat

SEQ ID NO: 6956413 - DNA, 22 bp, Homo sapiens
gcagtctctcaggatttaagct

SEQ ID NO: 6956414 - DNA, 22 bp, Homo sapiens
tcttcacgccaagtgcccctca

SEQ ID NO: 6956415 - DNA, 22 bp, Homo sapiens
gtctcctatagctgcactgaat

SEQ ID NO: 6956416 - DNA, 22 bp, Homo sapiens
taaggtagattacttgtttgga

SEQ ID NO: 6956417 - DNA, 22 bp, Homo sapiens
gaggctgaggcggatggatcac

SEQ ID NO: 6956418 - DNA, 22 bp, Homo sapiens
tggaccagcagccccagtgcct

SEQ ID NO: 6956419 - DNA, 22 bp, Homo sapiens
aagtgtttcttggaatgttgcg

SEQ ID NO: 6956420 - DNA, 22 bp, Homo sapiens
tctgagcttccctctgaggcag

SEQ ID NO: 6956421 - DNA, 22 bp, Homo sapiens
tagctgtggagcagaggtctcc

SEQ ID NO: 6956422 - DNA, 22 bp, Homo sapiens
agttacacataaacattaaagg

SEQ ID NO: 6956423 - DNA, 20 bp, Homo sapiens
gcccaggaatttgcatttct

SEQ ID NO: 6956424 - DNA, 22 bp, Homo sapiens
tgtaactggttataatttttga

SEQ ID NO: 6956425 - DNA, 22 bp, Homo sapiens
gcacacagggatttttgaatgg

SEQ ID NO: 6956426 - DNA, 22 bp, Homo sapiens
gtgctgctcaagggacaggaca

SEQ ID NO: 6956427 - DNA, 22 bp, Homo sapiens
acctgcccttaacactgtgtgc

SEQ ID NO: 6956428 - DNA, 22 bp, Homo sapiens
ctcctgggaggatgcggacccg

SEQ ID NO: 6956429 - DNA, 22 bp, Homo sapiens
aggactgaaaatgagttcttct

SEQ ID NO: 6956430 - DNA, 22 bp, Homo sapiens
atgcaggcagacactgtgggca

SEQ ID NO: 6956431 - DNA, 22 bp, Homo sapiens
cagcacagtgaccagacccact

SEQ ID NO: 6956432 - DNA, 22 bp, Homo sapiens
cctgtcccaagcagggctggcc

SEQ ID NO: 6956433 - DNA, 22 bp, Homo sapiens
ttgagggtctggatctgctgct

SEQ ID NO: 6956434 - DNA, 22 bp, Homo sapiens
gtttcattcggcagctcataag

SEQ ID NO: 6956435 - DNA, 21 bp, Homo sapiens
gcccagagggagccaagccca

SEQ ID NO: 6956436 - DNA, 22 bp, Homo sapiens
gagcgcgggtcgagggaacggc

SEQ ID NO: 6956437 - DNA, 22 bp, Homo sapiens
agtgttagattcttactcagtt

SEQ ID NO: 6956438 - DNA, 22 bp, Homo sapiens
cgggcactccatatccacactg

SEQ ID NO: 6956439 - DNA, 22 bp, Homo sapiens
tggaagttgaatctcagtcatg

SEQ ID NO: 6956440 - DNA, 22 bp, Homo sapiens
tttgcaacagactcatcattga

SEQ ID NO: 6956441 - DNA, 22 bp, Homo sapiens
tgacagaactcattctcaccaa

SEQ ID NO: 6956442 - DNA, 22 bp, Homo sapiens
agacttaggtgagatgtttgta

SEQ ID NO: 6956443 - DNA, 22 bp, Homo sapiens
gggcactggcgttttgttaaac

SEQ ID NO: 6956444 - DNA, 22 bp, Homo sapiens
tgtctgaattttggaatcaagt

SEQ ID NO: 6956445 - DNA, 22 bp, Homo sapiens
ttgacaagaacaccggtttgag

SEQ ID NO: 6956446 - DNA, 17 bp, Homo sapiens
gcttctggagcttctgt

SEQ ID NO: 6956447 - DNA, 22 bp, Homo sapiens
tttgctcttgctggaaaagttg

SEQ ID NO: 6956448 - DNA, 21 bp, Homo sapiens
aaataaggatagatggtttgg

SEQ ID NO: 6956449 - DNA, 19 bp, Homo sapiens
tgatctggaaggaaccagg

SEQ ID NO: 6956450 - DNA, 21 bp, Homo sapiens
tatgagatatacttattcttt

SEQ ID NO: 6956451 - DNA, 22 bp, Homo sapiens
gtggacagagctagaaaatgtg

SEQ ID NO: 6956452 - DNA, 22 bp, Homo sapiens
gcttgagttttgggacaaagcc

SEQ ID NO: 6956453 - DNA, 19 bp, Homo sapiens
ttggcagctgagatcctgc

SEQ ID NO: 6956454 - DNA, 20 bp, Homo sapiens
gttattggaaatattgtgtg

SEQ ID NO: 6956455 - DNA, 22 bp, Homo sapiens
acagagttacataacttgtcca

SEQ ID NO: 6956456 - DNA, 22 bp, Homo sapiens
tggagaggttgaataacttgtc

SEQ ID NO: 6956457 - DNA, 22 bp, Homo sapiens
tgaggccaatgaccctgggcag

SEQ ID NO: 6956458 - DNA, 21 bp, Homo sapiens
acttggcagaacgcagaaggc

SEQ ID NO: 6956459 - DNA, 22 bp, Homo sapiens
ccctgcagcttttgcatagtca

SEQ ID NO: 6956460 - DNA, 22 bp, Homo sapiens
agagacccattgccggaatcac

SEQ ID NO: 6956461 - DNA, 22 bp, Homo sapiens
tcaggcctcagaaattgcactg

SEQ ID NO: 6956462 - DNA, 22 bp, Homo sapiens
tgctgattttgcctactgatcc

SEQ ID NO: 6956463 - DNA, 22 bp, Homo sapiens
actctccctgagagggaggcat

SEQ ID NO: 6956464 - DNA, 20 bp, Homo sapiens
ttcaagttgggtctctggct

SEQ ID NO: 6956465 - DNA, 22 bp, Homo sapiens
aagacatgcagtttgttccatt

SEQ ID NO: 6956466 - DNA, 22 bp, Homo sapiens
ctggccaatatagggaaatctt

SEQ ID NO: 6956467 - DNA, 22 bp, Homo sapiens
ttactgatggtggagctggtat

SEQ ID NO: 6956468 - DNA, 22 bp, Homo sapiens
attacacatagacattcgttca

SEQ ID NO: 6956469 - DNA, 22 bp, Homo sapiens
gtcaccttgaacaggctactca

SEQ ID NO: 6956470 - DNA, 22 bp, Homo sapiens
catctttgttttggatataatc

SEQ ID NO: 6956471 - DNA, 22 bp, Homo sapiens
cggaggcaaactcacctggctc

SEQ ID NO: 6956472 - DNA, 22 bp, Homo sapiens
tttagcactgaaagtccaggaa

SEQ ID NO: 6956473 - DNA, 22 bp, Homo sapiens
ccaggccagcgctggctggagg

SEQ ID NO: 6956474 - DNA, 22 bp, Homo sapiens
tcttggtgcctcagaccttgtg

SEQ ID NO: 6956475 - DNA, 22 bp, Homo sapiens
catggcttttgcttttgcccat

SEQ ID NO: 6956476 - DNA, 23 bp, Homo sapiens
actgattaggcattacctggaag

SEQ ID NO: 6956477 - DNA, 18 bp, Homo sapiens
gagtttaggttgtagaat

SEQ ID NO: 6956478 - DNA, 22 bp, Homo sapiens
attctgggccccatcccagacc

SEQ ID NO: 6956479 - DNA, 22 bp, Homo sapiens
cctgcccactccaggagcaact

SEQ ID NO: 6956480 - DNA, 22 bp, Homo sapiens
gacctttagtgtcatgttatat

SEQ ID NO: 6956481 - DNA, 22 bp, Homo sapiens
ttgatctttataatagttttga

SEQ ID NO: 6956482 - DNA, 22 bp, Homo sapiens
tagggtggagactggaagcagg

SEQ ID NO: 6956483 - DNA, 22 bp, Homo sapiens
actttgtaaattgttgtgactc

SEQ ID NO: 6956484 - DNA, 22 bp, Homo sapiens
ggtgcaaagatggcagttgcaa

SEQ ID NO: 6956485 - DNA, 22 bp, Homo sapiens
tggagatgaacatggtgatgtt

SEQ ID NO: 6956486 - DNA, 22 bp, Homo sapiens
ccctggttgacaagccagctca

SEQ ID NO: 6956487 - DNA, 18 bp, Homo sapiens
gtgacgttttggatgatt

SEQ ID NO: 6956488 - DNA, 22 bp, Homo sapiens
aggtatctggtaagaggcagac

SEQ ID NO: 6956489 - DNA, 22 bp, Homo sapiens
ctgtgcttgcgggtgtggagcc

SEQ ID NO: 6956490 - DNA, 22 bp, Homo sapiens
acacagagtttgacacatggga

SEQ ID NO: 6956491 - DNA, 22 bp, Homo sapiens
acatgagatcacaaagataaat

SEQ ID NO: 6956492 - DNA, 22 bp, Homo sapiens
tgctagaattaggttaaacaaa

SEQ ID NO: 6956493 - DNA, 22 bp, Homo sapiens
agacagctgctcgcagagctat

SEQ ID NO: 6956494 - DNA, 22 bp, Homo sapiens
gctcttgaatatgggtttcatg

SEQ ID NO: 6956495 - DNA, 22 bp, Homo sapiens
tgtacagtaggaacttgttatt

SEQ ID NO: 6956496 - DNA, 22 bp, Homo sapiens
ggattagcttttgttcttgact

SEQ ID NO: 6956497 - DNA, 22 bp, Homo sapiens
aggtgcttggctcgtgcacaca

SEQ ID NO: 6956498 - DNA, 22 bp, Homo sapiens
gctcttttcacagtccaaaatg

SEQ ID NO: 6956499 - DNA, 23 bp, Homo sapiens
gctgaggtacatttacaggaaga

SEQ ID NO: 6956500 - DNA, 22 bp, Homo sapiens
gagcctgcccagccctgtccac

SEQ ID NO: 6956501 - DNA, 22 bp, Homo sapiens
tggaaggctgagagtcctgggg

SEQ ID NO: 6956502 - DNA, 22 bp, Homo sapiens
ggtcaggggctgctctacagag

SEQ ID NO: 6956503 - DNA, 22 bp, Homo sapiens
ttactcgtgacaatgtccttga

SEQ ID NO: 6956504 - DNA, 22 bp, Homo sapiens
ctggagctcagcccaggttcca

SEQ ID NO: 6956505 - DNA, 22 bp, Homo sapiens
acatttaaccaaactgtttaat

SEQ ID NO: 6956506 - DNA, 22 bp, Homo sapiens
tttggtcagggtaggacagttg

SEQ ID NO: 6956507 - DNA, 22 bp, Homo sapiens
gctttgctggcttgaaatgctg

SEQ ID NO: 6956508 - DNA, 22 bp, Homo sapiens
tttgacagatagatgttatgtt

SEQ ID NO: 6956509 - DNA, 22 bp, Homo sapiens
gacaaatgagtctcatacccgg

SEQ ID NO: 6956510 - DNA, 22 bp, Homo sapiens
ccccttccacagtgcttcctaa

SEQ ID NO: 6956511 - DNA, 20 bp, Homo sapiens
ctcttaaatgtaaagtaggc

SEQ ID NO: 6956512 - DNA, 22 bp, Homo sapiens
aacatgagcattcttgtgcttg

SEQ ID NO: 6956513 - DNA, 22 bp, Homo sapiens
tgtgtctccatagccagctagc

SEQ ID NO: 6956514 - DNA, 22 bp, Homo sapiens
ctgctcagcggaaggaagagcg

SEQ ID NO: 6956515 - DNA, 22 bp, Homo sapiens
atcaccactacaaacatcattg

SEQ ID NO: 6956516 - DNA, 21 bp, Homo sapiens
ctttggtcaacagtccctgaa

SEQ ID NO: 6956517 - DNA, 22 bp, Homo sapiens
ttctttgtggcagtgagctggg

SEQ ID NO: 6956518 - DNA, 22 bp, Homo sapiens
gcgaggctgggccctgcaggcg

SEQ ID NO: 6956519 - DNA, 22 bp, Homo sapiens
aaggctcctttgtagttctttt

SEQ ID NO: 6956520 - DNA, 22 bp, Homo sapiens
aagtccaggctggcgtagagtc

SEQ ID NO: 6956521 - DNA, 22 bp, Homo sapiens
agctcaggcaactctgggcccc

SEQ ID NO: 6956522 - DNA, 22 bp, Homo sapiens
aacatgcagtgagccgatgagg

SEQ ID NO: 6956523 - DNA, 22 bp, Homo sapiens
ccacagtgagttctgtactctg

SEQ ID NO: 6956524 - DNA, 22 bp, Homo sapiens
taactttggggacacttctctt

SEQ ID NO: 6956525 - DNA, 22 bp, Homo sapiens
tccacatctctcgccaaccaat

SEQ ID NO: 6956526 - DNA, 22 bp, Homo sapiens
catttgaagaagaaacgtacta

SEQ ID NO: 6956527 - DNA, 22 bp, Homo sapiens
caccccttccgccactgccttc

SEQ ID NO: 6956528 - DNA, 22 bp, Homo sapiens
gctccctgcagctgagagttcc

SEQ ID NO: 6956529 - DNA, 22 bp, Homo sapiens
gcacagctcctggtaagctggg

SEQ ID NO: 6956530 - DNA, 22 bp, Homo sapiens
gaagagctgctcagaacatgat

SEQ ID NO: 6956531 - DNA, 22 bp, Homo sapiens
agatgtgattcctgctgagctg

SEQ ID NO: 6956532 - DNA, 22 bp, Homo sapiens
ggaaaaacagtctttattattt

SEQ ID NO: 6956533 - DNA, 22 bp, Homo sapiens
cagctgcagatcatgtttacag

SEQ ID NO: 6956534 - DNA, 22 bp, Homo sapiens
gtatgcatttggcatattgtcc

SEQ ID NO: 6956535 - DNA, 22 bp, Homo sapiens
gaaatcttccaatggtcacatc

SEQ ID NO: 6956536 - DNA, 22 bp, Homo sapiens
aaaagaggttaaccaggtgtgt

SEQ ID NO: 6956537 - DNA, 22 bp, Homo sapiens
tggctcacaggactctctgggc

SEQ ID NO: 6956538 - DNA, 22 bp, Homo sapiens
acctgcccacacttccttccca

SEQ ID NO: 6956539 - DNA, 22 bp, Homo sapiens
actcacatttcatcaggccaag

SEQ ID NO: 6956540 - DNA, 22 bp, Homo sapiens
ccagtcctagaagaggagtcga

SEQ ID NO: 6956541 - DNA, 23 bp, Homo sapiens
agggtggcttgctttgcttcctt

SEQ ID NO: 6956542 - DNA, 22 bp, Homo sapiens
tgagggagtgtggatacagtag

SEQ ID NO: 6956543 - DNA, 22 bp, Homo sapiens
tttgttcatgaaaacctagatc

SEQ ID NO: 6956544 - DNA, 22 bp, Homo sapiens
ggctacagcggggtggagacgg

SEQ ID NO: 6956545 - DNA, 22 bp, Homo sapiens
tggcagctgaatggctggatgg

SEQ ID NO: 6956546 - DNA, 22 bp, Homo sapiens
gagaggtccattcccctgtcag

SEQ ID NO: 6956547 - DNA, 22 bp, Homo sapiens
gtccagtttcagggtctgcgct

SEQ ID NO: 6956548 - DNA, 22 bp, Homo sapiens
ctcaggagacagtgtccacatg

SEQ ID NO: 6956549 - DNA, 22 bp, Homo sapiens
ctggatgttcttctgcaattat

SEQ ID NO: 6956550 - DNA, 22 bp, Homo sapiens
cagcagctgcaaatggaaacag

SEQ ID NO: 6956551 - DNA, 20 bp, Homo sapiens
tcagacagtcgcagttctgg

SEQ ID NO: 6956552 - DNA, 22 bp, Homo sapiens
atgtggcttgtcgatattagca

SEQ ID NO: 6956553 - DNA, 22 bp, Homo sapiens
tgtgtgaactctctgatgtaca

SEQ ID NO: 6956554 - DNA, 22 bp, Homo sapiens
tctgcaggctctagatgaggtt

SEQ ID NO: 6956555 - DNA, 22 bp, Homo sapiens
tgccctgtcgctcactcccacc

SEQ ID NO: 6956556 - DNA, 23 bp, Homo sapiens
atcttagcatagacttgagtccc

SEQ ID NO: 6956557 - DNA, 22 bp, Homo sapiens
agtatttagctgactcgctaca

SEQ ID NO: 6956558 - DNA, 22 bp, Homo sapiens
attgacaatctactatgttctg

SEQ ID NO: 6956559 - DNA, 22 bp, Homo sapiens
cccagagggaagggaatgaggt

SEQ ID NO: 6956560 - DNA, 22 bp, Homo sapiens
ctatcttttgttcattttgagt

SEQ ID NO: 6956561 - DNA, 22 bp, Homo sapiens
tcagcttgcgttctgggattta

SEQ ID NO: 6956562 - DNA, 22 bp, Homo sapiens
cctggcaggcccctcctggatt

SEQ ID NO: 6956563 - DNA, 22 bp, Homo sapiens
tctgacagaggtggtagataca

SEQ ID NO: 6956564 - DNA, 22 bp, Homo sapiens
agagtgtggttcttgcccgcat

SEQ ID NO: 6956565 - DNA, 22 bp, Homo sapiens
agagctgttcagcagccaggtt

SEQ ID NO: 6956566 - DNA, 21 bp, Homo sapiens
ttaatgctatgcagaaaatct

SEQ ID NO: 6956567 - DNA, 22 bp, Homo sapiens
tgtggcagaaggctaaggtgtc

SEQ ID NO: 6956568 - DNA, 20 bp, Homo sapiens
gtcggctctacccagactgt

SEQ ID NO: 6956569 - DNA, 22 bp, Homo sapiens
ggaggcggacacaggtagtgtt

SEQ ID NO: 6956570 - DNA, 22 bp, Homo sapiens
ggacacttgtttggttaggcct

SEQ ID NO: 6956571 - DNA, 20 bp, Homo sapiens
gtacattttcaggaggggat

SEQ ID NO: 6956572 - DNA, 22 bp, Homo sapiens
cctgcgtcgtgtgggcagtgac

SEQ ID NO: 6956573 - DNA, 22 bp, Homo sapiens
tggcaagggattgtggagaact

SEQ ID NO: 6956574 - DNA, 22 bp, Homo sapiens
ttgcattgatgttccttcttgc

SEQ ID NO: 6956575 - DNA, 22 bp, Homo sapiens
gctggcagagagctggtgagga

SEQ ID NO: 6956576 - DNA, 22 bp, Homo sapiens
ctttacagtgaacttgcttgtc

SEQ ID NO: 6956577 - DNA, 22 bp, Homo sapiens
aaacagtcgtcttaatagtatt

SEQ ID NO: 6956578 - DNA, 22 bp, Homo sapiens
gcacccagaataaggacaggac

SEQ ID NO: 6956579 - DNA, 22 bp, Homo sapiens
acatgtaagactagcttaaagt

SEQ ID NO: 6956580 - DNA, 22 bp, Homo sapiens
agccccttctgtctccaggatc

SEQ ID NO: 6956581 - DNA, 22 bp, Homo sapiens
atgttagttttggtgagagtac

SEQ ID NO: 6956582 - DNA, 22 bp, Homo sapiens
catgcacacacagttctaatta

SEQ ID NO: 6956583 - DNA, 23 bp, Homo sapiens
tggagaatttagagtctctagga

SEQ ID NO: 6956584 - DNA, 22 bp, Homo sapiens
aatctgcttttgtcatttatga

SEQ ID NO: 6956585 - DNA, 22 bp, Homo sapiens
actaaatttgtcaatgacactt

SEQ ID NO: 6956586 - DNA, 22 bp, Homo sapiens
ggggtagggcgattgctgcttt

SEQ ID NO: 6956587 - DNA, 22 bp, Homo sapiens
ttgttttaacctagtgtttatg

SEQ ID NO: 6956588 - DNA, 22 bp, Homo sapiens
gtaaatgagtcaaatgggggaa

SEQ ID NO: 6956589 - DNA, 22 bp, Homo sapiens
tgccaagtggagctcaggaatc

SEQ ID NO: 6956590 - DNA, 22 bp, Homo sapiens
acaatgcataagtttctcccag

SEQ ID NO: 6956591 - DNA, 22 bp, Homo sapiens
aaggcactgctttgctgcgccc

SEQ ID NO: 6956592 - DNA, 22 bp, Homo sapiens
ttgatctgcctcattcttgttc

SEQ ID NO: 6956593 - DNA, 22 bp, Homo sapiens
gggccatgagaggttcatcaac

SEQ ID NO: 6956594 - DNA, 22 bp, Homo sapiens
agacaagagctgaggacatatt

SEQ ID NO: 6956595 - DNA, 22 bp, Homo sapiens
aagaggctggcattgatggtag

SEQ ID NO: 6956596 - DNA, 22 bp, Homo sapiens
acccaggagagagctataaaat

SEQ ID NO: 6956597 - DNA, 22 bp, Homo sapiens
ttcttctgcctcccacctgata

SEQ ID NO: 6956598 - DNA, 22 bp, Homo sapiens
aattcttcagtttctgggactc

SEQ ID NO: 6956599 - DNA, 22 bp, Homo sapiens
actgccagaggaggtatctgaa

SEQ ID NO: 6956600 - DNA, 22 bp, Homo sapiens
gaacacagtgtgatcgtatgtc

SEQ ID NO: 6956601 - DNA, 22 bp, Homo sapiens
gctgtggagtacagagctggtt

SEQ ID NO: 6956602 - DNA, 22 bp, Homo sapiens
cagctccagccaccggggggtg

SEQ ID NO: 6956603 - DNA, 22 bp, Homo sapiens
agcagagtgtgaaggcagggct

SEQ ID NO: 6956604 - DNA, 22 bp, Homo sapiens
aagagtttaattttgtctagac

SEQ ID NO: 6956605 - DNA, 22 bp, Homo sapiens
tgcttgtcacatacaggagcat

SEQ ID NO: 6956606 - DNA, 22 bp, Homo sapiens
tccttataaatgaggccctggg

SEQ ID NO: 6956607 - DNA, 22 bp, Homo sapiens
ggacagcattctactgtaggca

SEQ ID NO: 6956608 - DNA, 22 bp, Homo sapiens
gctccttctggctcccttttgg

SEQ ID NO: 6956609 - DNA, 22 bp, Homo sapiens
caagagggaacctaagatgtat

SEQ ID NO: 6956610 - DNA, 22 bp, Homo sapiens
ccaggaaacctgcgccatccag

SEQ ID NO: 6956611 - DNA, 22 bp, Homo sapiens
agcagttaccaaggaacctggt

SEQ ID NO: 6956612 - DNA, 18 bp, Homo sapiens
gctttatttcttggggaa

SEQ ID NO: 6956613 - DNA, 22 bp, Homo sapiens
actttggtcccatgtgtgtaaa

SEQ ID NO: 6956614 - DNA, 22 bp, Homo sapiens
tctctgagcacctaagatatat

SEQ ID NO: 6956615 - DNA, 22 bp, Homo sapiens
tagtggggaaggaggacaagaa

SEQ ID NO: 6956616 - DNA, 22 bp, Homo sapiens
gaacgcaacggaaaagatttca

SEQ ID NO: 6956617 - DNA, 22 bp, Homo sapiens
cagcaggctgtggaaatcctgg

SEQ ID NO: 6956618 - DNA, 22 bp, Homo sapiens
atgtagaaagttattgtcactg

SEQ ID NO: 6956619 - DNA, 22 bp, Homo sapiens
acccagccacagcattgaggga

SEQ ID NO: 6956620 - DNA, 20 bp, Homo sapiens
tcccaaaattctactttatc

SEQ ID NO: 6956621 - DNA, 22 bp, Homo sapiens
tgcacacatgtatgtatatgtg

SEQ ID NO: 6956622 - DNA, 22 bp, Homo sapiens
ttaccattcaagttctctcctt

SEQ ID NO: 6956623 - DNA, 22 bp, Homo sapiens
ggctccatgctccgcttcttgt

SEQ ID NO: 6956624 - DNA, 22 bp, Homo sapiens
ctgctttagtgtggtgttagag

SEQ ID NO: 6956625 - DNA, 22 bp, Homo sapiens
gctgggctgagaagttaagcaa

SEQ ID NO: 6956626 - DNA, 20 bp, Homo sapiens
tagttgccaaaatgccctgc

SEQ ID NO: 6956627 - DNA, 22 bp, Homo sapiens
acagcagagcaccagggccact

SEQ ID NO: 6956628 - DNA, 23 bp, Homo sapiens
aaagtgtagccaggttaagaacc

SEQ ID NO: 6956629 - DNA, 22 bp, Homo sapiens
ccagaagaccccgtccacctcc

SEQ ID NO: 6956630 - DNA, 18 bp, Homo sapiens
acccaggctcatggtcct

SEQ ID NO: 6956631 - DNA, 22 bp, Homo sapiens
cttgcctttgtcttcaaaggct

SEQ ID NO: 6956632 - DNA, 22 bp, Homo sapiens
ttggtcctcagtttccctatct

SEQ ID NO: 6956633 - DNA, 22 bp, Homo sapiens
acacatttgctaaaatgagctc

SEQ ID NO: 6956634 - DNA, 22 bp, Homo sapiens
tctcaagagggaggcaatcatg

SEQ ID NO: 6956635 - DNA, 22 bp, Homo sapiens
actacaatactcttagtaaaag

SEQ ID NO: 6956636 - DNA, 22 bp, Homo sapiens
tggtaaggggtggaaccagagc

SEQ ID NO: 6956637 - DNA, 22 bp, Homo sapiens
agaccaggggttgagtcctagc

SEQ ID NO: 6956638 - DNA, 22 bp, Homo sapiens
attcaagttcttctgtctttgc

SEQ ID NO: 6956639 - DNA, 22 bp, Homo sapiens
cagggtgcatacccatgcatac

SEQ ID NO: 6956640 - DNA, 22 bp, Homo sapiens
taggtagatttaaagattttct

SEQ ID NO: 6956641 - DNA, 22 bp, Homo sapiens
tcagctttccttgctttagatt

SEQ ID NO: 6956642 - DNA, 22 bp, Homo sapiens
ggtccatctcttgagcccacat

SEQ ID NO: 6956643 - DNA, 22 bp, Homo sapiens
cttccctttagcatatagtagt

SEQ ID NO: 6956644 - DNA, 22 bp, Homo sapiens
ttcctgtgcttattcttctctg

SEQ ID NO: 6956645 - DNA, 22 bp, Homo sapiens
ttacagtgactcacattaacaa

SEQ ID NO: 6956646 - DNA, 22 bp, Homo sapiens
gtgcagggcaggtgtccttcca

SEQ ID NO: 6956647 - DNA, 22 bp, Homo sapiens
taactttagtgtatgaggtaag

SEQ ID NO: 6956648 - DNA, 22 bp, Homo sapiens
atgaacatgtgactcagacctg

SEQ ID NO: 6956649 - DNA, 22 bp, Homo sapiens
ttagtgctcacgtgttagaaag

SEQ ID NO: 6956650 - DNA, 22 bp, Homo sapiens
gccctgtgcgctgagttcaggg

SEQ ID NO: 6956651 - DNA, 22 bp, Homo sapiens
attacaagtagactaactttca

SEQ ID NO: 6956652 - DNA, 22 bp, Homo sapiens
gctatcttcctcaatgtcagct

SEQ ID NO: 6956653 - DNA, 22 bp, Homo sapiens
aaggggagatgtcatgggccct

SEQ ID NO: 6956654 - DNA, 22 bp, Homo sapiens
taacctttcaggcatgtaggtt

SEQ ID NO: 6956655 - DNA, 22 bp, Homo sapiens
aatgatcctacacatggaattc

SEQ ID NO: 6956656 - DNA, 22 bp, Homo sapiens
gtcctgagattggaaccataaa

SEQ ID NO: 6956657 - DNA, 22 bp, Homo sapiens
agttttctgacccctgctctat

SEQ ID NO: 6956658 - DNA, 22 bp, Homo sapiens
ttagcttttaagtgtgctacat

SEQ ID NO: 6956659 - DNA, 22 bp, Homo sapiens
tttcagtgtcagtaatgcagca

SEQ ID NO: 6956660 - DNA, 22 bp, Homo sapiens
tatgtcggggtttcttctggca

SEQ ID NO: 6956661 - DNA, 22 bp, Homo sapiens
atattcaagtgaggatggctaa

SEQ ID NO: 6956662 - DNA, 22 bp, Homo sapiens
tgagttatggagaataaagtca

SEQ ID NO: 6956663 - DNA, 22 bp, Homo sapiens
gctggctttatggggcttgtgg

SEQ ID NO: 6956664 - DNA, 22 bp, Homo sapiens
cagtcccagacatagtaaggga

SEQ ID NO: 6956665 - DNA, 22 bp, Homo sapiens
gcccctccgggcgcgtcatagc

SEQ ID NO: 6956666 - DNA, 22 bp, Homo sapiens
ggtcctgagtacctatgtttat

SEQ ID NO: 6956667 - DNA, 22 bp, Homo sapiens
ttgaggaggtagtacagagtat

SEQ ID NO: 6956668 - DNA, 22 bp, Homo sapiens
gggagctgatgatgtaagtccc

SEQ ID NO: 6956669 - DNA, 21 bp, Homo sapiens
gggattaagtgacttgcctga

SEQ ID NO: 6956670 - DNA, 22 bp, Homo sapiens
tgaccatggcacatgtttgcct

SEQ ID NO: 6956671 - DNA, 19 bp, Homo sapiens
tcaacagtggtgctgtgga

SEQ ID NO: 6956672 - DNA, 22 bp, Homo sapiens
tttgagaaccctgtattttaag

SEQ ID NO: 6956673 - DNA, 22 bp, Homo sapiens
catgtctttcaaaccacacagt

SEQ ID NO: 6956674 - DNA, 22 bp, Homo sapiens
ggggcctctgggaacccctgtg

SEQ ID NO: 6956675 - DNA, 22 bp, Homo sapiens
atggttatttcatggaaaaatt

SEQ ID NO: 6956676 - DNA, 22 bp, Homo sapiens
ccctggagtcctggcagttgat

SEQ ID NO: 6956677 - DNA, 22 bp, Homo sapiens
agcccagagacaatgctcagta

SEQ ID NO: 6956678 - DNA, 22 bp, Homo sapiens
gaaggccacaagagaagttaag

SEQ ID NO: 6956679 - DNA, 22 bp, Homo sapiens
tcacacttatcccactcagtca

SEQ ID NO: 6956680 - DNA, 22 bp, Homo sapiens
gggctctggggtgccctggcat

SEQ ID NO: 6956681 - DNA, 22 bp, Homo sapiens
agcagctgagccccagctgtga

SEQ ID NO: 6956682 - DNA, 22 bp, Homo sapiens
cagacaggctagccagactcac

SEQ ID NO: 6956683 - DNA, 22 bp, Homo sapiens
tatgcttttctcttggaatgtg

SEQ ID NO: 6956684 - DNA, 22 bp, Homo sapiens
tctaaacactaagtcttgatgc

SEQ ID NO: 6956685 - DNA, 22 bp, Homo sapiens
agtggctggagccccaggctgg

SEQ ID NO: 6956686 - DNA, 22 bp, Homo sapiens
atctgaaagtttagaattcttg

SEQ ID NO: 6956687 - DNA, 22 bp, Homo sapiens
taagatgtaagatcagagcttg

SEQ ID NO: 6956688 - DNA, 22 bp, Homo sapiens
gtcagcattttacatgtgtcat

SEQ ID NO: 6956689 - DNA, 22 bp, Homo sapiens
tttctggaaacgggttcaagct

SEQ ID NO: 6956690 - DNA, 22 bp, Homo sapiens
cttgtggcaggtggatggtgcc

SEQ ID NO: 6956691 - DNA, 22 bp, Homo sapiens
ttaagaatgtgccttttggttg

SEQ ID NO: 6956692 - DNA, 22 bp, Homo sapiens
tctgtacaacaaagggatgaga

SEQ ID NO: 6956693 - DNA, 22 bp, Homo sapiens
ttcacattcagaaaaagcccgt

SEQ ID NO: 6956694 - DNA, 22 bp, Homo sapiens
ccaagaggttgtgaggcaggca

SEQ ID NO: 6956695 - DNA, 22 bp, Homo sapiens
aggcagtttatccccagagcct

SEQ ID NO: 6956696 - DNA, 22 bp, Homo sapiens
aagcacattatagctatctagg

SEQ ID NO: 6956697 - DNA, 22 bp, Homo sapiens
agtctttattgtcgtcactaga

SEQ ID NO: 6956698 - DNA, 22 bp, Homo sapiens
tggttttctggtggtggcagtg

SEQ ID NO: 6956699 - DNA, 16 bp, Homo sapiens
actgtcaaagtgatga

SEQ ID NO: 6956700 - DNA, 22 bp, Homo sapiens
cacagaagtttcatagtctcga

SEQ ID NO: 6956701 - DNA, 22 bp, Homo sapiens
aggattgtttggcttcaaaggc

SEQ ID NO: 6956702 - DNA, 22 bp, Homo sapiens
ctgcatggttcaaatgagctaa

SEQ ID NO: 6956703 - DNA, 22 bp, Homo sapiens
gcctgcaaacaaggacttctga

SEQ ID NO: 6956704 - DNA, 21 bp, Homo sapiens
tgacagcatagagcagggagg

SEQ ID NO: 6956705 - DNA, 19 bp, Homo sapiens
ggcaggtagagggccagtc

SEQ ID NO: 6956706 - DNA, 22 bp, Homo sapiens
gtgctttctgcatggttcctac

SEQ ID NO: 6956707 - DNA, 22 bp, Homo sapiens
gctcaggatttcatccatgtgt

SEQ ID NO: 6956708 - DNA, 22 bp, Homo sapiens
ttagcgggaatgttcagaagct

SEQ ID NO: 6956709 - DNA, 22 bp, Homo sapiens
ccgggagcaggcgccaccgcca

SEQ ID NO: 6956710 - DNA, 22 bp, Homo sapiens
acttccaaataccatcacattg

SEQ ID NO: 6956711 - DNA, 22 bp, Homo sapiens
agctgtgtaagtcatgtaggtg

SEQ ID NO: 6956712 - DNA, 22 bp, Homo sapiens
tgtggcacttacatcctagttt

SEQ ID NO: 6956713 - DNA, 22 bp, Homo sapiens
aggctgctggcaggcgtggacg

SEQ ID NO: 6956714 - DNA, 20 bp, Homo sapiens
gggccctgggattcagagca

SEQ ID NO: 6956715 - DNA, 19 bp, Homo sapiens
ttctactttgtttccccct

SEQ ID NO: 6956716 - DNA, 22 bp, Homo sapiens
gggatcagcaagccactgcacc

SEQ ID NO: 6956717 - DNA, 22 bp, Homo sapiens
gcctctggaagaattacatcca

SEQ ID NO: 6956718 - DNA, 22 bp, Homo sapiens
cagtaaagagccttcattaaat

SEQ ID NO: 6956719 - DNA, 22 bp, Homo sapiens
atcctgtctctacccatcggct

SEQ ID NO: 6956720 - DNA, 22 bp, Homo sapiens
ttctgagcctcattcatgaggc

SEQ ID NO: 6956721 - DNA, 22 bp, Homo sapiens
tagtgaatagtccaatcccgca

SEQ ID NO: 6956722 - DNA, 22 bp, Homo sapiens
agctatggaacagagtggctgt

SEQ ID NO: 6956723 - DNA, 22 bp, Homo sapiens
aggtatcaacagcagagtctga

SEQ ID NO: 6956724 - DNA, 22 bp, Homo sapiens
aagcttcaggcccacccatgtc

SEQ ID NO: 6956725 - DNA, 22 bp, Homo sapiens
ccagaggcggaggtttgcagtg

SEQ ID NO: 6956726 - DNA, 22 bp, Homo sapiens
acaggttttggactccagattt

SEQ ID NO: 6956727 - DNA, 22 bp, Homo sapiens
aagagggaggtgcgggtgcaga

SEQ ID NO: 6956728 - DNA, 22 bp, Homo sapiens
tcatcagagctcccccaaacgt

SEQ ID NO: 6956729 - DNA, 22 bp, Homo sapiens
tgaggtgccacccaagagcctt

SEQ ID NO: 6956730 - DNA, 22 bp, Homo sapiens
atgcgctttgtgtgaagcagtg

SEQ ID NO: 6956731 - DNA, 22 bp, Homo sapiens
gtcttcattcaacaaatattca

SEQ ID NO: 6956732 - DNA, 22 bp, Homo sapiens
taggacaggatcatgatgctgg

SEQ ID NO: 6956733 - DNA, 22 bp, Homo sapiens
ggttggaggtgggaatagctag

SEQ ID NO: 6956734 - DNA, 22 bp, Homo sapiens
gccctgctaatttcgtactttt

SEQ ID NO: 6956735 - DNA, 22 bp, Homo sapiens
tagttacagtgcatagcaagat

SEQ ID NO: 6956736 - DNA, 22 bp, Homo sapiens
aagtaccctcgggcttaggagt

SEQ ID NO: 6956737 - DNA, 22 bp, Homo sapiens
tgggaaatatggcattgggcct

SEQ ID NO: 6956738 - DNA, 22 bp, Homo sapiens
ccttgattcctaagagggggca

SEQ ID NO: 6956739 - DNA, 22 bp, Homo sapiens
acaaaaagctccattactgtcc

SEQ ID NO: 6956740 - DNA, 22 bp, Homo sapiens
tagaaagtagccacttacagag

SEQ ID NO: 6956741 - DNA, 21 bp, Homo sapiens
tgggcctgtccctcttggagg

SEQ ID NO: 6956742 - DNA, 22 bp, Homo sapiens
tttctgtattttgtcataacct

SEQ ID NO: 6956743 - DNA, 21 bp, Homo sapiens
atctgaagtttgagaggaaag

SEQ ID NO: 6956744 - DNA, 22 bp, Homo sapiens
acagtgcattattgctgaatgc

SEQ ID NO: 6956745 - DNA, 19 bp, Homo sapiens
taaggtttaccagcaaaat

SEQ ID NO: 6956746 - DNA, 20 bp, Homo sapiens
gctttctatgagatggactg

SEQ ID NO: 6956747 - DNA, 22 bp, Homo sapiens
aagtgatacgtgtttatttcca

SEQ ID NO: 6956748 - DNA, 22 bp, Homo sapiens
ggcttttgtttcagctctgcta

SEQ ID NO: 6956749 - DNA, 22 bp, Homo sapiens
gtacataattttcagccagttt

SEQ ID NO: 6956750 - DNA, 22 bp, Homo sapiens
ggctgggctcgctgattggctg

SEQ ID NO: 6956751 - DNA, 22 bp, Homo sapiens
ctgtgcaagcccaagataaaac

SEQ ID NO: 6956752 - DNA, 22 bp, Homo sapiens
caggtcagctggtgccccaggt

SEQ ID NO: 6956753 - DNA, 22 bp, Homo sapiens
ccatgagcttcaactgacacag

SEQ ID NO: 6956754 - DNA, 22 bp, Homo sapiens
taacatgctaatttgcagatag

SEQ ID NO: 6956755 - DNA, 22 bp, Homo sapiens
tccctcagtccctggacaggca

SEQ ID NO: 6956756 - DNA, 22 bp, Homo sapiens
tggttgtgagcgatggatggag

SEQ ID NO: 6956757 - DNA, 22 bp, Homo sapiens
attgacagaaaattggatggca

SEQ ID NO: 6956758 - DNA, 22 bp, Homo sapiens
acaggatagtttttaatcttcc

SEQ ID NO: 6956759 - DNA, 22 bp, Homo sapiens
aagtttagttaagtaaactctt

SEQ ID NO: 6956760 - DNA, 22 bp, Homo sapiens
tgattctgccacgtactggctg

SEQ ID NO: 6956761 - DNA, 22 bp, Homo sapiens
ctacagcagagctacactaact

SEQ ID NO: 6956762 - DNA, 22 bp, Homo sapiens
gggcggatcacctgaggtcagg

SEQ ID NO: 6956763 - DNA, 22 bp, Homo sapiens
cacatggggcgctgcattggcc

SEQ ID NO: 6956764 - DNA, 22 bp, Homo sapiens
ctgtaacttagcatggttacta

SEQ ID NO: 6956765 - DNA, 22 bp, Homo sapiens
caagtaattctgcaagaaacca

SEQ ID NO: 6956766 - DNA, 22 bp, Homo sapiens
tagaggaggcaaggccctccct

SEQ ID NO: 6956767 - DNA, 22 bp, Homo sapiens
cgccagtggcagctggaacagg

SEQ ID NO: 6956768 - DNA, 22 bp, Homo sapiens
tcctttgcttctgtcattctcc

SEQ ID NO: 6956769 - DNA, 22 bp, Homo sapiens
cttcctagtgtctactttggag

SEQ ID NO: 6956770 - DNA, 22 bp, Homo sapiens
tatgttttaggaattaattgtt

SEQ ID NO: 6956771 - DNA, 22 bp, Homo sapiens
aggtgagttacaggaggaggtc

SEQ ID NO: 6956772 - DNA, 22 bp, Homo sapiens
cattgaataatgtccttgcaaa

SEQ ID NO: 6956773 - DNA, 22 bp, Homo sapiens
tgttttcgatcatttcacagta

SEQ ID NO: 6956774 - DNA, 22 bp, Homo sapiens
gcttacagataatgaggagact

SEQ ID NO: 6956775 - DNA, 22 bp, Homo sapiens
tccttcagtgtcccgctcaggt

SEQ ID NO: 6956776 - DNA, 22 bp, Homo sapiens
tttttgtgaaatctccagacat

SEQ ID NO: 6956777 - DNA, 22 bp, Homo sapiens
cccctctgcaaatagccaggct

SEQ ID NO: 6956778 - DNA, 20 bp, Homo sapiens
gcagtgatctcatcggtctg

SEQ ID NO: 6956779 - DNA, 22 bp, Homo sapiens
tcctaggaatactgcctgaaat

SEQ ID NO: 6956780 - DNA, 22 bp, Homo sapiens
cagttctcttgatcgtctcttg

SEQ ID NO: 6956781 - DNA, 22 bp, Homo sapiens
atattgcttgaggccaggaggt

SEQ ID NO: 6956782 - DNA, 22 bp, Homo sapiens
tgcttctgcattcaatgttgga

SEQ ID NO: 6956783 - DNA, 22 bp, Homo sapiens
agtggctgatgtaggcagtggg

SEQ ID NO: 6956784 - DNA, 22 bp, Homo sapiens
gcagacacttgaggtgggcttt

SEQ ID NO: 6956785 - DNA, 22 bp, Homo sapiens
ttgtttccataattaagtgtga

SEQ ID NO: 6956786 - DNA, 22 bp, Homo sapiens
tcagtgctaaaagagctggtgt

SEQ ID NO: 6956787 - DNA, 22 bp, Homo sapiens
gtatgcatgcatgtgtatgtac

SEQ ID NO: 6956788 - DNA, 22 bp, Homo sapiens
ttagttttctcatctatctcac

SEQ ID NO: 6956789 - DNA, 22 bp, Homo sapiens
gctggcctgtctagagccttac

SEQ ID NO: 6956790 - DNA, 22 bp, Homo sapiens
attagcagtgccttgcctgtct

SEQ ID NO: 6956791 - DNA, 22 bp, Homo sapiens
tgtgggcctcagcaggactcca

SEQ ID NO: 6956792 - DNA, 22 bp, Homo sapiens
actgacaaatatagcttcgtct

SEQ ID NO: 6956793 - DNA, 22 bp, Homo sapiens
aacattctgtcaattgatgacc

SEQ ID NO: 6956794 - DNA, 22 bp, Homo sapiens
tgcattgttgaccagttgtgca

SEQ ID NO: 6956795 - DNA, 23 bp, Homo sapiens
ttgcatagacatcctcatagatt

SEQ ID NO: 6956796 - DNA, 22 bp, Homo sapiens
cccaagggtgcccagcagagga

SEQ ID NO: 6956797 - DNA, 21 bp, Homo sapiens
agttgctgctgctgcaggtga

SEQ ID NO: 6956798 - DNA, 22 bp, Homo sapiens
aggaaaggcctcagcagaaacc

SEQ ID NO: 6956799 - DNA, 22 bp, Homo sapiens
ttgtagaaaattctcttggata

SEQ ID NO: 6956800 - DNA, 22 bp, Homo sapiens
caggccttgaaggcctgcggga

SEQ ID NO: 6956801 - DNA, 22 bp, Homo sapiens
cagctttatttcacgtgtttgt

SEQ ID NO: 6956802 - DNA, 22 bp, Homo sapiens
aggacacacttctgaggtcttt

SEQ ID NO: 6956803 - DNA, 22 bp, Homo sapiens
attgtgtatcacagagcagctg

SEQ ID NO: 6956804 - DNA, 22 bp, Homo sapiens
ctgagcacctgctgtgtgccag

SEQ ID NO: 6956805 - DNA, 23 bp, Homo sapiens
cttcacaatcaaaatcagttctg

SEQ ID NO: 6956806 - DNA, 22 bp, Homo sapiens
agcccttcaagagctctgtcct

SEQ ID NO: 6956807 - DNA, 22 bp, Homo sapiens
gtttctatggtttatattactg

SEQ ID NO: 6956808 - DNA, 22 bp, Homo sapiens
ttggaaggctgaatggcctctc

SEQ ID NO: 6956809 - DNA, 22 bp, Homo sapiens
atctttgaatcaatgaatcagt

SEQ ID NO: 6956810 - DNA, 22 bp, Homo sapiens
tttctagaaaccaagatattgt

SEQ ID NO: 6956811 - DNA, 22 bp, Homo sapiens
ccacaggggtctctgtagctga

SEQ ID NO: 6956812 - DNA, 22 bp, Homo sapiens
ctctgagaatataagactattt

SEQ ID NO: 6956813 - DNA, 22 bp, Homo sapiens
aaactttcatgtatctctttca

SEQ ID NO: 6956814 - DNA, 22 bp, Homo sapiens
acttagctgtgtgatttccatt

SEQ ID NO: 6956815 - DNA, 22 bp, Homo sapiens
tccagagataactatttaggag

SEQ ID NO: 6956816 - DNA, 22 bp, Homo sapiens
cataagttgggtaatataatga

SEQ ID NO: 6956817 - DNA, 22 bp, Homo sapiens
tggtagcaggtgtgatagaaat

SEQ ID NO: 6956818 - DNA, 22 bp, Homo sapiens
gtggtgcaggaagcatctggct

SEQ ID NO: 6956819 - DNA, 22 bp, Homo sapiens
aattgcataaaattcaactctg

SEQ ID NO: 6956820 - DNA, 23 bp, Homo sapiens
tctgaattatctcattttcagag

SEQ ID NO: 6956821 - DNA, 19 bp, Homo sapiens
ttcattctcttattgttgt

SEQ ID NO: 6956822 - DNA, 22 bp, Homo sapiens
tcacatatttaagaaagttaaa

SEQ ID NO: 6956823 - DNA, 22 bp, Homo sapiens
ggccactgctctccagcctggg

SEQ ID NO: 6956824 - DNA, 17 bp, Homo sapiens
aaggaccaacaggaaat

SEQ ID NO: 6956825 - DNA, 22 bp, Homo sapiens
ttaaacagagtctgaaatgtaa

SEQ ID NO: 6956826 - DNA, 22 bp, Homo sapiens
tgtattacaaagaagaggctgg

SEQ ID NO: 6956827 - DNA, 22 bp, Homo sapiens
ggtcagagatgaggtctaaagt

SEQ ID NO: 6956828 - DNA, 22 bp, Homo sapiens
agcagctggaacatatgaagaa

SEQ ID NO: 6956829 - DNA, 22 bp, Homo sapiens
gtcctgcttgttaggcctagtc

SEQ ID NO: 6956830 - DNA, 19 bp, Homo sapiens
ccagatgagcagctgagat

SEQ ID NO: 6956831 - DNA, 22 bp, Homo sapiens
gtaacagaaagtcatgctcatt

SEQ ID NO: 6956832 - DNA, 22 bp, Homo sapiens
aagcccagatgggagcatttca

SEQ ID NO: 6956833 - DNA, 22 bp, Homo sapiens
tgcagctgcaagtccaggtcag

SEQ ID NO: 6956834 - DNA, 22 bp, Homo sapiens
aggtaccaaaagcctttttctg

SEQ ID NO: 6956835 - DNA, 22 bp, Homo sapiens
gaggctgaggttgcagtgagct

SEQ ID NO: 6956836 - DNA, 22 bp, Homo sapiens
atgtacaatctatcacaagaag

SEQ ID NO: 6956837 - DNA, 22 bp, Homo sapiens
catttacttaaatctttacaag

SEQ ID NO: 6956838 - DNA, 22 bp, Homo sapiens
tctgaaatggcgatggccgttg

SEQ ID NO: 6956839 - DNA, 20 bp, Homo sapiens
atataggcatagtaaaatga

SEQ ID NO: 6956840 - DNA, 22 bp, Homo sapiens
ctggcagtggaggaagaaaact

SEQ ID NO: 6956841 - DNA, 23 bp, Homo sapiens
agaggctcagcgtccacctctac

SEQ ID NO: 6956842 - DNA, 22 bp, Homo sapiens
gagcttttactgctgtattgaa

SEQ ID NO: 6956843 - DNA, 22 bp, Homo sapiens
gagatgttttgctgagaatggg

SEQ ID NO: 6956844 - DNA, 22 bp, Homo sapiens
gttaggcaatacctcttacacc

SEQ ID NO: 6956845 - DNA, 22 bp, Homo sapiens
tattgccaaatgtctgctggaa

SEQ ID NO: 6956846 - DNA, 22 bp, Homo sapiens
tctaccagggtcacagaggccc

SEQ ID NO: 6956847 - DNA, 22 bp, Homo sapiens
taaagctatgcttaatttatca

SEQ ID NO: 6956848 - DNA, 21 bp, Homo sapiens
tcagttctctgcctgtgcttg

SEQ ID NO: 6956849 - DNA, 22 bp, Homo sapiens
ctgattctaggcgttcctctca

SEQ ID NO: 6956850 - DNA, 22 bp, Homo sapiens
ttggctgccgagcgcatcccgg

SEQ ID NO: 6956851 - DNA, 22 bp, Homo sapiens
cccaagggagtgcctggtcaac

SEQ ID NO: 6956852 - DNA, 22 bp, Homo sapiens
ggggatggtgggaaggcaatct

SEQ ID NO: 6956853 - DNA, 22 bp, Homo sapiens
cccagttagttgcttccacatc

SEQ ID NO: 6956854 - DNA, 22 bp, Homo sapiens
tgacagcataacactggtcttg

SEQ ID NO: 6956855 - DNA, 22 bp, Homo sapiens
gataattttagtctgaaaattg

SEQ ID NO: 6956856 - DNA, 22 bp, Homo sapiens
aatcattgagacaaattagctt

SEQ ID NO: 6956857 - DNA, 22 bp, Homo sapiens
catgtgagaaacagtgatgtcg

SEQ ID NO: 6956858 - DNA, 22 bp, Homo sapiens
ttctctttctgctgggctggaa

SEQ ID NO: 6956859 - DNA, 20 bp, Homo sapiens
gttggaaagttcactctgct

SEQ ID NO: 6956860 - DNA, 22 bp, Homo sapiens
ttcattgtagcttgactaatta

SEQ ID NO: 6956861 - DNA, 22 bp, Homo sapiens
ggtcagaaggcctcggcaggaa

SEQ ID NO: 6956862 - DNA, 22 bp, Homo sapiens
atgcttccctcacatatcctgg

SEQ ID NO: 6956863 - DNA, 20 bp, Homo sapiens
cagatatcagaagcacagcc

SEQ ID NO: 6956864 - DNA, 22 bp, Homo sapiens
atacaaagacaaatctcaatct

SEQ ID NO: 6956865 - DNA, 22 bp, Homo sapiens
aaatggtccatcctaaagaagt

SEQ ID NO: 6956866 - DNA, 22 bp, Homo sapiens
ggggcagcctccaggaaagctg

SEQ ID NO: 6956867 - DNA, 22 bp, Homo sapiens
gacggggcagccagctggtggc

SEQ ID NO: 6956868 - DNA, 22 bp, Homo sapiens
tcctggccaggatgacctaaca

SEQ ID NO: 6956869 - DNA, 21 bp, Homo sapiens
ctgcaaatgcaaggtgaccag

SEQ ID NO: 6956870 - DNA, 22 bp, Homo sapiens
attcacagttactgctgaacca

SEQ ID NO: 6956871 - DNA, 23 bp, Homo sapiens
aggggtggtcagtacccgcagtg

SEQ ID NO: 6956872 - DNA, 22 bp, Homo sapiens
ttaaacagtgaagttgggagga

SEQ ID NO: 6956873 - DNA, 22 bp, Homo sapiens
tccaagggcagcagccatagcc

SEQ ID NO: 6956874 - DNA, 22 bp, Homo sapiens
tccccaagcaggcaatctcccg

SEQ ID NO: 6956875 - DNA, 22 bp, Homo sapiens
tactttctttctgatccttatg

SEQ ID NO: 6956876 - DNA, 22 bp, Homo sapiens
ttggcttccaggggcttttaca

SEQ ID NO: 6956877 - DNA, 22 bp, Homo sapiens
tgcagcattgcactccagcctg

SEQ ID NO: 6956878 - DNA, 22 bp, Homo sapiens
tggtccctattgtggtaagtgg

SEQ ID NO: 6956879 - DNA, 22 bp, Homo sapiens
gagggcgatggtttcagtttct

SEQ ID NO: 6956880 - DNA, 22 bp, Homo sapiens
catttgtactgttcaatgtcat

SEQ ID NO: 6956881 - DNA, 22 bp, Homo sapiens
tacattgactctctgtccctaa

SEQ ID NO: 6956882 - DNA, 22 bp, Homo sapiens
catttaatcctcacaagcctat

SEQ ID NO: 6956883 - DNA, 22 bp, Homo sapiens
tttggtaagtacccacctgggt

SEQ ID NO: 6956884 - DNA, 22 bp, Homo sapiens
aaacaagtttagaataatgaat

SEQ ID NO: 6956885 - DNA, 22 bp, Homo sapiens
cccaggagttggaggctacggt

SEQ ID NO: 6956886 - DNA, 22 bp, Homo sapiens
caccaaagtcgcttctgtcgtc

SEQ ID NO: 6956887 - DNA, 22 bp, Homo sapiens
aagctcttttacaatcctaggc

SEQ ID NO: 6956888 - DNA, 22 bp, Homo sapiens
gtagaataggggtattgcttca

SEQ ID NO: 6956889 - DNA, 22 bp, Homo sapiens
ttcctcatctagcacagaaatt

SEQ ID NO: 6956890 - DNA, 22 bp, Homo sapiens
aatgcctttccactgggtatca

SEQ ID NO: 6956891 - DNA, 22 bp, Homo sapiens
gagtgggtaccggagcaggtgc

SEQ ID NO: 6956892 - DNA, 22 bp, Homo sapiens
ggggaagaatggcagaaaacat

SEQ ID NO: 6956893 - DNA, 20 bp, Homo sapiens
tgctgctgcctccgcctctg

SEQ ID NO: 6956894 - DNA, 22 bp, Homo sapiens
actgacactgactaagacagca

SEQ ID NO: 6956895 - DNA, 22 bp, Homo sapiens
tctgccagaagttctgagagta

SEQ ID NO: 6956896 - DNA, 22 bp, Homo sapiens
tgacagggcaggcttactggtt

SEQ ID NO: 6956897 - DNA, 22 bp, Homo sapiens
tgggtcccaatctgaaatgtca

SEQ ID NO: 6956898 - DNA, 22 bp, Homo sapiens
gagggagctatgaatagaagaa

SEQ ID NO: 6956899 - DNA, 22 bp, Homo sapiens
caatttggttacttccttagaa

SEQ ID NO: 6956900 - DNA, 22 bp, Homo sapiens
agatggctctttgaaggggaat

SEQ ID NO: 6956901 - DNA, 22 bp, Homo sapiens
aatggcatgacttgcccaaggc

SEQ ID NO: 6956902 - DNA, 22 bp, Homo sapiens
tgtcacattctgatgtgaggtg

SEQ ID NO: 6956903 - DNA, 22 bp, Homo sapiens
gaatgcacacgtgtgtgcatgc

SEQ ID NO: 6956904 - DNA, 22 bp, Homo sapiens
tgagccgtggtctctgagggtg

SEQ ID NO: 6956905 - DNA, 22 bp, Homo sapiens
gcagtgaagatttgggctctgg

SEQ ID NO: 6956906 - DNA, 22 bp, Homo sapiens
agatgtagtagtgggtctttta

SEQ ID NO: 6956907 - DNA, 22 bp, Homo sapiens
tacagtgcttggtatctagtaa

SEQ ID NO: 6956908 - DNA, 22 bp, Homo sapiens
ttcaaacactgctttgagaggg

SEQ ID NO: 6956909 - DNA, 23 bp, Homo sapiens
ccagctcatccattacctctctt

SEQ ID NO: 6956910 - DNA, 22 bp, Homo sapiens
ggcctcttctgctcatactttc

SEQ ID NO: 6956911 - DNA, 20 bp, Homo sapiens
accaatgttagcttagtact

SEQ ID NO: 6956912 - DNA, 22 bp, Homo sapiens
ttccatattagactatgtgggg

SEQ ID NO: 6956913 - DNA, 22 bp, Homo sapiens
tgaatgagtcaatcatttagct

SEQ ID NO: 6956914 - DNA, 22 bp, Homo sapiens
tcctgaaggcagatggggatca

SEQ ID NO: 6956915 - DNA, 22 bp, Homo sapiens
tcccttcaagatttggggaaat

SEQ ID NO: 6956916 - DNA, 22 bp, Homo sapiens
tgaaggctgttggatggggaag

SEQ ID NO: 6956917 - DNA, 22 bp, Homo sapiens
gaatgttctgaggaatcagaga

SEQ ID NO: 6956918 - DNA, 22 bp, Homo sapiens
acacacgtgctcaacacgctcc

SEQ ID NO: 6956919 - DNA, 22 bp, Homo sapiens
ccagcaggggaatatttttagg

SEQ ID NO: 6956920 - DNA, 22 bp, Homo sapiens
tctttcaaagcaaaatgaggct

SEQ ID NO: 6956921 - DNA, 19 bp, Homo sapiens
ggctgatgtagacagtgtc

SEQ ID NO: 6956922 - DNA, 17 bp, Homo sapiens
agacactgagccaagta

SEQ ID NO: 6956923 - DNA, 17 bp, Homo sapiens
acttccaagcattgctg

SEQ ID NO: 6956924 - DNA, 22 bp, Homo sapiens
taatggtgtttttctgtaattt

SEQ ID NO: 6956925 - DNA, 22 bp, Homo sapiens
aatgaacttcagtgatttctgg

SEQ ID NO: 6956926 - DNA, 22 bp, Homo sapiens
agaacaggaggaagccagctcc

SEQ ID NO: 6956927 - DNA, 22 bp, Homo sapiens
gccttggctgatgtgcgaatga

SEQ ID NO: 6956928 - DNA, 22 bp, Homo sapiens
caggaacaggctgatgggcagg

SEQ ID NO: 6956929 - DNA, 22 bp, Homo sapiens
cagagccagctgtccttggcat

SEQ ID NO: 6956930 - DNA, 22 bp, Homo sapiens
agatcacagttctctattcgta

SEQ ID NO: 6956931 - DNA, 22 bp, Homo sapiens
ctctggagcaccgggctatcca

SEQ ID NO: 6956932 - DNA, 22 bp, Homo sapiens
gagcaggacagcagcttcctgg

SEQ ID NO: 6956933 - DNA, 22 bp, Homo sapiens
acaacaaaatgaggaagtggtc

SEQ ID NO: 6956934 - DNA, 20 bp, Homo sapiens
tcacaatatgagctcataca

SEQ ID NO: 6956935 - DNA, 22 bp, Homo sapiens
caactcagactggattaaataa

SEQ ID NO: 6956936 - DNA, 22 bp, Homo sapiens
tgtggccagcaggtggctgtgt

SEQ ID NO: 6956937 - DNA, 23 bp, Homo sapiens
caagtcatggattggagtttcag

SEQ ID NO: 6956938 - DNA, 17 bp, Homo sapiens
ccaggtctccttgcttt

SEQ ID NO: 6956939 - DNA, 22 bp, Homo sapiens
taatgaggaaatagagggaatg

SEQ ID NO: 6956940 - DNA, 22 bp, Homo sapiens
cattgcactttgggtccaggac

SEQ ID NO: 6956941 - DNA, 22 bp, Homo sapiens
tgaaatggaattaatttgtatt

SEQ ID NO: 6956942 - DNA, 22 bp, Homo sapiens
agtctcttttggttccaaaaat

SEQ ID NO: 6956943 - DNA, 22 bp, Homo sapiens
ggagatggcaagaagttattag

SEQ ID NO: 6956944 - DNA, 22 bp, Homo sapiens
tggctctgagtctgcccttggc

SEQ ID NO: 6956945 - DNA, 22 bp, Homo sapiens
gagaggctgactggctgtcctg

SEQ ID NO: 6956946 - DNA, 22 bp, Homo sapiens
atgatgaggtcccaagatctca

SEQ ID NO: 6956947 - DNA, 22 bp, Homo sapiens
aggttctgattctctgggtatg

SEQ ID NO: 6956948 - DNA, 17 bp, Homo sapiens
caggtctgaggccaggc

SEQ ID NO: 6956949 - DNA, 22 bp, Homo sapiens
aactctgggaatgggatttaga

SEQ ID NO: 6956950 - DNA, 22 bp, Homo sapiens
tgaggaagttgatctcatcagt

SEQ ID NO: 6956951 - DNA, 22 bp, Homo sapiens
aagagtttaccagtgctgcttc

SEQ ID NO: 6956952 - DNA, 22 bp, Homo sapiens
cagcacaggcccctctctccca

SEQ ID NO: 6956953 - DNA, 22 bp, Homo sapiens
gctggcctgggctcaagaccag

SEQ ID NO: 6956954 - DNA, 22 bp, Homo sapiens
tggcttcccatagcttgctagt

SEQ ID NO: 6956955 - DNA, 22 bp, Homo sapiens
gacactggaaatattgaattgg

SEQ ID NO: 6956956 - DNA, 22 bp, Homo sapiens
gctgcctgcagtgttttcccag

SEQ ID NO: 6956957 - DNA, 22 bp, Homo sapiens
agctttgaatctggtgtttgca

SEQ ID NO: 6956958 - DNA, 22 bp, Homo sapiens
gagctttaccttaggttctgtt

SEQ ID NO: 6956959 - DNA, 22 bp, Homo sapiens
tcagtgccagtttgctccttct

SEQ ID NO: 6956960 - DNA, 22 bp, Homo sapiens
aggttcagtaaatgttagttga

SEQ ID NO: 6956961 - DNA, 22 bp, Homo sapiens
tttagtatcctatctcatttaa

SEQ ID NO: 6956962 - DNA, 22 bp, Homo sapiens
taaatgctcagaccttattcca

SEQ ID NO: 6956963 - DNA, 22 bp, Homo sapiens
ttgaagcaaattctgtgcagta

SEQ ID NO: 6956964 - DNA, 22 bp, Homo sapiens
tggtccaagtgaggtggcctct

SEQ ID NO: 6956965 - DNA, 22 bp, Homo sapiens
cctactctgagcgcctccgcat

SEQ ID NO: 6956966 - DNA, 22 bp, Homo sapiens
tattgcaattggcagagtgcta

SEQ ID NO: 6956967 - DNA, 22 bp, Homo sapiens
gatttcaagcccccagagattc

SEQ ID NO: 6956968 - DNA, 22 bp, Homo sapiens
tgggggtgctgagaagacagga

SEQ ID NO: 6956969 - DNA, 22 bp, Homo sapiens
tgaggaattgtgttgtagtgga

SEQ ID NO: 6956970 - DNA, 22 bp, Homo sapiens
atacatcttccttttaaaatgc

SEQ ID NO: 6956971 - DNA, 22 bp, Homo sapiens
ctagcagaagctccttgagggt

SEQ ID NO: 6956972 - DNA, 22 bp, Homo sapiens
aggagttatggcagaatcaaat

SEQ ID NO: 6956973 - DNA, 22 bp, Homo sapiens
ttggtgggagaagactctggtt

SEQ ID NO: 6956974 - DNA, 22 bp, Homo sapiens
cagctggtactcagttcttgtc

SEQ ID NO: 6956975 - DNA, 19 bp, Homo sapiens
ccacgaggttagcagccac

SEQ ID NO: 6956976 - DNA, 21 bp, Homo sapiens
tccagtggggatctctgatat

SEQ ID NO: 6956977 - DNA, 23 bp, Homo sapiens
taacaagaacctcatgtgacttt

SEQ ID NO: 6956978 - DNA, 22 bp, Homo sapiens
gggagcatttattttccgttag

SEQ ID NO: 6956979 - DNA, 22 bp, Homo sapiens
tccaggtgccggggactgaggc

SEQ ID NO: 6956980 - DNA, 22 bp, Homo sapiens
tgcagcttcttgtcctgtgatt

SEQ ID NO: 6956981 - DNA, 22 bp, Homo sapiens
ggagtgcagctcacaggacatc

SEQ ID NO: 6956982 - DNA, 21 bp, Homo sapiens
gtacacacaggtggatgggct

SEQ ID NO: 6956983 - DNA, 22 bp, Homo sapiens
ttcctgtgtgttggtggcagaa

SEQ ID NO: 6956984 - DNA, 22 bp, Homo sapiens
aggtggcagaggactcctcctg

SEQ ID NO: 6956985 - DNA, 19 bp, Homo sapiens
ctgagtcaaaggttgtggg

SEQ ID NO: 6956986 - DNA, 22 bp, Homo sapiens
tgattccagataatagtactga

SEQ ID NO: 6956987 - DNA, 22 bp, Homo sapiens
ttcaagataataggaatgaaaa

SEQ ID NO: 6956988 - DNA, 22 bp, Homo sapiens
aggcttggtttatagaagtaat

SEQ ID NO: 6956989 - DNA, 22 bp, Homo sapiens
acacaatgtcatcataatgtca

SEQ ID NO: 6956990 - DNA, 22 bp, Homo sapiens
ctggacacaaacatctcctctg

SEQ ID NO: 6956991 - DNA, 21 bp, Homo sapiens
ctggtgtagcactcaggtgct

SEQ ID NO: 6956992 - DNA, 22 bp, Homo sapiens
cagctcctgcagctggctccca

SEQ ID NO: 6956993 - DNA, 22 bp, Homo sapiens
ttcaatgagcccggggccatag

SEQ ID NO: 6956994 - DNA, 22 bp, Homo sapiens
ttgcctccttttaaggaaatca

SEQ ID NO: 6956995 - DNA, 22 bp, Homo sapiens
gtgcaggagtaggagagggctt

SEQ ID NO: 6956996 - DNA, 22 bp, Homo sapiens
gcccaatggctgacccggcgct

SEQ ID NO: 6956997 - DNA, 19 bp, Homo sapiens
tttgggaagcccagagtgt

SEQ ID NO: 6956998 - DNA, 22 bp, Homo sapiens
tggaaaatgtgactattctaaa

SEQ ID NO: 6956999 - DNA, 21 bp, Homo sapiens
acacgtgtgtgtaaacacaca

SEQ ID NO: 6957000 - DNA, 22 bp, Homo sapiens
aagccaatgagagaggcctcag

SEQ ID NO: 6957001 - DNA, 22 bp, Homo sapiens
acaggtactttgtaatgaagga

SEQ ID NO: 6957002 - DNA, 22 bp, Homo sapiens
aagatcatggtttatctgggag

SEQ ID NO: 6957003 - DNA, 22 bp, Homo sapiens
agagaccttttgccttctagtt

SEQ ID NO: 6957004 - DNA, 22 bp, Homo sapiens
aagcacagacacaaaaggcttt

SEQ ID NO: 6957005 - DNA, 22 bp, Homo sapiens
tatgtcttcgtcacctatctca

SEQ ID NO: 6957006 - DNA, 22 bp, Homo sapiens
tgctggaattttgctcttgcaa

SEQ ID NO: 6957007 - DNA, 22 bp, Homo sapiens
tgctgcagttattgaaactatg

SEQ ID NO: 6957008 - DNA, 22 bp, Homo sapiens
acctacatacggaaatatttac

SEQ ID NO: 6957009 - DNA, 22 bp, Homo sapiens
acagcttcttgtttcccaggag

SEQ ID NO: 6957010 - DNA, 21 bp, Homo sapiens
gaggggcagctcttagcatta

SEQ ID NO: 6957011 - DNA, 22 bp, Homo sapiens
ctgtaattcactagggtcagcg

SEQ ID NO: 6957012 - DNA, 22 bp, Homo sapiens
agtgtattcagaatgtagcaaa

SEQ ID NO: 6957013 - DNA, 22 bp, Homo sapiens
ctggggacttgcagacacaatt

SEQ ID NO: 6957014 - DNA, 22 bp, Homo sapiens
tatttgcttgaagcctggttct

SEQ ID NO: 6957015 - DNA, 20 bp, Homo sapiens
tgctttatgctatactttgt

SEQ ID NO: 6957016 - DNA, 21 bp, Homo sapiens
ctctgcagtgcccaccttgcc

SEQ ID NO: 6957017 - DNA, 22 bp, Homo sapiens
gagctgttgtaagtattagaag

SEQ ID NO: 6957018 - DNA, 22 bp, Homo sapiens
cccccaaagtttgcacggataa

SEQ ID NO: 6957019 - DNA, 22 bp, Homo sapiens
cctggaaggtgatggtacagca

SEQ ID NO: 6957020 - DNA, 22 bp, Homo sapiens
tggcccagcagttctgccccag

SEQ ID NO: 6957021 - DNA, 22 bp, Homo sapiens
gttagtaggaggtggtatcttg

SEQ ID NO: 6957022 - DNA, 22 bp, Homo sapiens
gtggctatatttgaggatacgt

SEQ ID NO: 6957023 - DNA, 18 bp, Homo sapiens
tctgcccaggacttggac

SEQ ID NO: 6957024 - DNA, 22 bp, Homo sapiens
atgggccaagtaaacattctca

SEQ ID NO: 6957025 - DNA, 22 bp, Homo sapiens
tcactgtttcatccctagcact

SEQ ID NO: 6957026 - DNA, 22 bp, Homo sapiens
ttcctcaacaacttccctacag

SEQ ID NO: 6957027 - DNA, 22 bp, Homo sapiens
ttataacactgccttgtcacca

SEQ ID NO: 6957028 - DNA, 21 bp, Homo sapiens
atcagagtacgcatgcgctga

SEQ ID NO: 6957029 - DNA, 22 bp, Homo sapiens
acatccactatccttgcttgtt

SEQ ID NO: 6957030 - DNA, 22 bp, Homo sapiens
ggcttcagaagactggacaggt

SEQ ID NO: 6957031 - DNA, 22 bp, Homo sapiens
caaggctaagctttggctttct

SEQ ID NO: 6957032 - DNA, 22 bp, Homo sapiens
tatccaaagagattcatgttct

SEQ ID NO: 6957033 - DNA, 22 bp, Homo sapiens
aattagggaaaacatttgcttt

SEQ ID NO: 6957034 - DNA, 22 bp, Homo sapiens
tgccctcagaattgctccctgc

SEQ ID NO: 6957035 - DNA, 20 bp, Homo sapiens
tcaaggccacactgccgtgc

SEQ ID NO: 6957036 - DNA, 18 bp, Homo sapiens
cagaggagagacattcag

SEQ ID NO: 6957037 - DNA, 22 bp, Homo sapiens
agtcagcactcctgaggatcac

SEQ ID NO: 6957038 - DNA, 22 bp, Homo sapiens
atcaagcatctctctcccaatg

SEQ ID NO: 6957039 - DNA, 22 bp, Homo sapiens
gcctgtcccgcaccggagcccg

SEQ ID NO: 6957040 - DNA, 22 bp, Homo sapiens
ccttgaaaccacatcttagaaa

SEQ ID NO: 6957041 - DNA, 22 bp, Homo sapiens
cagctattctctgaaatgaata

SEQ ID NO: 6957042 - DNA, 22 bp, Homo sapiens
taatggaagttaaatatggtat

SEQ ID NO: 6957043 - DNA, 22 bp, Homo sapiens
gccttccacctaggcctctgct

SEQ ID NO: 6957044 - DNA, 23 bp, Homo sapiens
aagaactgcgaatggagaaagta

SEQ ID NO: 6957045 - DNA, 22 bp, Homo sapiens
ctttacaccaagcagatctttc

SEQ ID NO: 6957046 - DNA, 22 bp, Homo sapiens
gccacagccgaacccttgggcc

SEQ ID NO: 6957047 - DNA, 22 bp, Homo sapiens
aaggtcaaagacagtaactttt

SEQ ID NO: 6957048 - DNA, 22 bp, Homo sapiens
tcatccatctttgatttcatag

SEQ ID NO: 6957049 - DNA, 22 bp, Homo sapiens
cgttaataggtgcaaggtaagg

SEQ ID NO: 6957050 - DNA, 17 bp, Homo sapiens
agataagcttcagagct

SEQ ID NO: 6957051 - DNA, 20 bp, Homo sapiens
tgaggcaggagaatggcatg

SEQ ID NO: 6957052 - DNA, 22 bp, Homo sapiens
gggcagcagagccctgccgagt

SEQ ID NO: 6957053 - DNA, 22 bp, Homo sapiens
gaaatagaagctgccaatttct

SEQ ID NO: 6957054 - DNA, 22 bp, Homo sapiens
cctgaagctcttaagaccttta

SEQ ID NO: 6957055 - DNA, 22 bp, Homo sapiens
ggcctctctggcatggctgccc

SEQ ID NO: 6957056 - DNA, 22 bp, Homo sapiens
aacatttgtttcgttatgtgaa

SEQ ID NO: 6957057 - DNA, 22 bp, Homo sapiens
aatctgtaacattcaataaaga

SEQ ID NO: 6957058 - DNA, 22 bp, Homo sapiens
tggcaagtggcatagaatagcc

SEQ ID NO: 6957059 - DNA, 22 bp, Homo sapiens
agaggcggagcttgcagtgagc

SEQ ID NO: 6957060 - DNA, 22 bp, Homo sapiens
atctttagcattactttattca

SEQ ID NO: 6957061 - DNA, 22 bp, Homo sapiens
atgttagttttatatttgtggg

SEQ ID NO: 6957062 - DNA, 22 bp, Homo sapiens
ttctttcctcccagcctttgga

SEQ ID NO: 6957063 - DNA, 22 bp, Homo sapiens
tgttagggacacttggagagga

SEQ ID NO: 6957064 - DNA, 22 bp, Homo sapiens
tatccatgcctttgtgccttag

SEQ ID NO: 6957065 - DNA, 22 bp, Homo sapiens
ccagaagcaaaacagacagttt

SEQ ID NO: 6957066 - DNA, 22 bp, Homo sapiens
aagccttgcctatttgatgaca

SEQ ID NO: 6957067 - DNA, 22 bp, Homo sapiens
cacagtggcaaaggggcttggg

SEQ ID NO: 6957068 - DNA, 22 bp, Homo sapiens
ttctatatttatgggcatcacc

SEQ ID NO: 6957069 - DNA, 22 bp, Homo sapiens
aaatcagtaaatgttcattaac

SEQ ID NO: 6957070 - DNA, 22 bp, Homo sapiens
tgggaactgcaggtgttacata

SEQ ID NO: 6957071 - DNA, 22 bp, Homo sapiens
aagtctctttacctctccaggc

SEQ ID NO: 6957072 - DNA, 22 bp, Homo sapiens
atttggaaggtttacaaagaga

SEQ ID NO: 6957073 - DNA, 22 bp, Homo sapiens
ttatgtagtcactgtggtcttg

SEQ ID NO: 6957074 - DNA, 22 bp, Homo sapiens
tgcaggtggctccagggactgc

SEQ ID NO: 6957075 - DNA, 23 bp, Homo sapiens
ggcctcagtgatgatgggttaaa

SEQ ID NO: 6957076 - DNA, 22 bp, Homo sapiens
atgtaagactttaagaacctaa

SEQ ID NO: 6957077 - DNA, 22 bp, Homo sapiens
gtttccatgggagaagacagtg

SEQ ID NO: 6957078 - DNA, 22 bp, Homo sapiens
tctaggaggcctattgtaaaca

SEQ ID NO: 6957079 - DNA, 22 bp, Homo sapiens
tcagaggagaagttgggaaaat

SEQ ID NO: 6957080 - DNA, 19 bp, Homo sapiens
agggtccaggccctgtgga

SEQ ID NO: 6957081 - DNA, 22 bp, Homo sapiens
agtgtctgagtaaatttctcat

SEQ ID NO: 6957082 - DNA, 22 bp, Homo sapiens
ctctgtgtggtagattccatta

SEQ ID NO: 6957083 - DNA, 22 bp, Homo sapiens
ggcaggtgccagttggcttggg

SEQ ID NO: 6957084 - DNA, 22 bp, Homo sapiens
taggaagcctaaattaagtggt

SEQ ID NO: 6957085 - DNA, 22 bp, Homo sapiens
aaatgcaaggcacattcctttt

SEQ ID NO: 6957086 - DNA, 22 bp, Homo sapiens
ccagagatggacagggaatttg

SEQ ID NO: 6957087 - DNA, 22 bp, Homo sapiens
cgcagcgaactgtccctcggtc

SEQ ID NO: 6957088 - DNA, 22 bp, Homo sapiens
tgtgcatcttgcctggatgttt

SEQ ID NO: 6957089 - DNA, 22 bp, Homo sapiens
caggaggcccggccacagccca

SEQ ID NO: 6957090 - DNA, 22 bp, Homo sapiens
agtggggcggacaggaccagga

SEQ ID NO: 6957091 - DNA, 22 bp, Homo sapiens
tgaaaggtgtccaatatttctc

SEQ ID NO: 6957092 - DNA, 22 bp, Homo sapiens
tgtggctctcctcctgctgccc

SEQ ID NO: 6957093 - DNA, 22 bp, Homo sapiens
tgcaaatgatgaaactaacttt

SEQ ID NO: 6957094 - DNA, 22 bp, Homo sapiens
gaacccagaggatatgggaaag

SEQ ID NO: 6957095 - DNA, 22 bp, Homo sapiens
ggcactaggagacctgggggtc

SEQ ID NO: 6957096 - DNA, 22 bp, Homo sapiens
gccagctgcaaagtatgttgaa

SEQ ID NO: 6957097 - DNA, 22 bp, Homo sapiens
agtacctttgcatggatttttt

SEQ ID NO: 6957098 - DNA, 22 bp, Homo sapiens
cacattgataattaaggcctcc

SEQ ID NO: 6957099 - DNA, 22 bp, Homo sapiens
tttgtcaccagtggctttggta

SEQ ID NO: 6957100 - DNA, 22 bp, Homo sapiens
ctgcaggggcagtccacttcct

SEQ ID NO: 6957101 - DNA, 21 bp, Homo sapiens
ttggtagatgcagcaccagta

SEQ ID NO: 6957102 - DNA, 22 bp, Homo sapiens
ccctcacttcacgctctgcaga

SEQ ID NO: 6957103 - DNA, 22 bp, Homo sapiens
ctgaagatagtgtctgatcatg

SEQ ID NO: 6957104 - DNA, 22 bp, Homo sapiens
ggagtgaaaggtaagttgagct

SEQ ID NO: 6957105 - DNA, 22 bp, Homo sapiens
atctttcatctctattatttga

SEQ ID NO: 6957106 - DNA, 22 bp, Homo sapiens
cctgcgggctgtgctgaagcct

SEQ ID NO: 6957107 - DNA, 22 bp, Homo sapiens
gccagccaagattgagaaggta

SEQ ID NO: 6957108 - DNA, 22 bp, Homo sapiens
ttcatgccagccctgtgtggta

SEQ ID NO: 6957109 - DNA, 20 bp, Homo sapiens
tctcattatatccaagaggc

SEQ ID NO: 6957110 - DNA, 22 bp, Homo sapiens
agaggctctttgagctgggaga

SEQ ID NO: 6957111 - DNA, 22 bp, Homo sapiens
taaggattaaataagaatattt

SEQ ID NO: 6957112 - DNA, 22 bp, Homo sapiens
gaccagctggtgaaaaccaatt

SEQ ID NO: 6957113 - DNA, 22 bp, Homo sapiens
gtcagattttctctggtttgtt

SEQ ID NO: 6957114 - DNA, 21 bp, Homo sapiens
tgaggcaagtccttttatagc

SEQ ID NO: 6957115 - DNA, 22 bp, Homo sapiens
ctgtggttggagtgcagtgaga

SEQ ID NO: 6957116 - DNA, 22 bp, Homo sapiens
agcccatgcagaccttcccaga

SEQ ID NO: 6957117 - DNA, 19 bp, Homo sapiens
ggctaatgtctttgaaata

SEQ ID NO: 6957118 - DNA, 22 bp, Homo sapiens
atcatttaaaacaagtctctat

SEQ ID NO: 6957119 - DNA, 22 bp, Homo sapiens
ctgctgtgccttaaaatgcaag

SEQ ID NO: 6957120 - DNA, 22 bp, Homo sapiens
ttgagcttgctggccttcagct

SEQ ID NO: 6957121 - DNA, 18 bp, Homo sapiens
ttgataaacaatttcatt

SEQ ID NO: 6957122 - DNA, 22 bp, Homo sapiens
aacaagttagattttgtgtctt

SEQ ID NO: 6957123 - DNA, 19 bp, Homo sapiens
atagaaagggttaaagaca

SEQ ID NO: 6957124 - DNA, 20 bp, Homo sapiens
gggagtctggatgaaagatg

SEQ ID NO: 6957125 - DNA, 22 bp, Homo sapiens
ggttaaggctttacagtcaaac

SEQ ID NO: 6957126 - DNA, 22 bp, Homo sapiens
tccagcctcctatttaccctaa

SEQ ID NO: 6957127 - DNA, 22 bp, Homo sapiens
ttggaaacgtcaccttttcctt

SEQ ID NO: 6957128 - DNA, 22 bp, Homo sapiens
aaggcggaggttgcagtgagct

SEQ ID NO: 6957129 - DNA, 22 bp, Homo sapiens
accacccagccagcttctccct

SEQ ID NO: 6957130 - DNA, 22 bp, Homo sapiens
ggcagatactaagctgcttcct

SEQ ID NO: 6957131 - DNA, 22 bp, Homo sapiens
ggaggaagggcccaggctttat

SEQ ID NO: 6957132 - DNA, 21 bp, Homo sapiens
tgaaacactctttccatgaga

SEQ ID NO: 6957133 - DNA, 22 bp, Homo sapiens
cctgtcagatgaagtaattgtg

SEQ ID NO: 6957134 - DNA, 21 bp, Homo sapiens
ggcggcgcagagctgcggctc

SEQ ID NO: 6957135 - DNA, 22 bp, Homo sapiens
aaatattattgcttaaggggag

SEQ ID NO: 6957136 - DNA, 21 bp, Homo sapiens
agcttccagagcacattccat

SEQ ID NO: 6957137 - DNA, 22 bp, Homo sapiens
ctcacctataagtctcacagtc

SEQ ID NO: 6957138 - DNA, 22 bp, Homo sapiens
taatgcttcctatatagcactc

SEQ ID NO: 6957139 - DNA, 22 bp, Homo sapiens
acaaattgaccgcaagattcat

SEQ ID NO: 6957140 - DNA, 22 bp, Homo sapiens
tcatgacagaggagctggaatg

SEQ ID NO: 6957141 - DNA, 20 bp, Homo sapiens
acctctgcatcaatcctttg

SEQ ID NO: 6957142 - DNA, 22 bp, Homo sapiens
cagggcctctcatcccacgggc

SEQ ID NO: 6957143 - DNA, 22 bp, Homo sapiens
tgcttaaatagctggaggctac

SEQ ID NO: 6957144 - DNA, 22 bp, Homo sapiens
aacacttgaatgtgtagcagct

SEQ ID NO: 6957145 - DNA, 22 bp, Homo sapiens
tattgtgctcaccattacatcc

SEQ ID NO: 6957146 - DNA, 23 bp, Homo sapiens
tcacagttacttttgcatcaacc

SEQ ID NO: 6957147 - DNA, 22 bp, Homo sapiens
ccttttaagggagactagagat

SEQ ID NO: 6957148 - DNA, 22 bp, Homo sapiens
ggacacagtggaagacagcttg

SEQ ID NO: 6957149 - DNA, 22 bp, Homo sapiens
ctatttgtacagcattagtaat

SEQ ID NO: 6957150 - DNA, 22 bp, Homo sapiens
aatagctcacggttagtgtagg

SEQ ID NO: 6957151 - DNA, 22 bp, Homo sapiens
gacaggtgctaagggacctggc

SEQ ID NO: 6957152 - DNA, 22 bp, Homo sapiens
aagtacagaaatagcaggtgca

SEQ ID NO: 6957153 - DNA, 22 bp, Homo sapiens
aacactttttatatattgtatc

SEQ ID NO: 6957154 - DNA, 22 bp, Homo sapiens
attcatgttagcccacatgtag

SEQ ID NO: 6957155 - DNA, 22 bp, Homo sapiens
caggcctcaggggctcaggctg

SEQ ID NO: 6957156 - DNA, 22 bp, Homo sapiens
tctgcctgagggagctgaggaa

SEQ ID NO: 6957157 - DNA, 22 bp, Homo sapiens
aaacaaatttcaagctgtgaca

SEQ ID NO: 6957158 - DNA, 22 bp, Homo sapiens
atctaagattttgctaagatca

SEQ ID NO: 6957159 - DNA, 22 bp, Homo sapiens
ctgcagtcagtgctaatgggta

SEQ ID NO: 6957160 - DNA, 22 bp, Homo sapiens
tggaatgttttcctaaatcaga

SEQ ID NO: 6957161 - DNA, 22 bp, Homo sapiens
tgtctgaattccacatcgttct

SEQ ID NO: 6957162 - DNA, 22 bp, Homo sapiens
tgtgctccatcatccataatct

SEQ ID NO: 6957163 - DNA, 22 bp, Homo sapiens
agtgtctgtgaggggaattcct

SEQ ID NO: 6957164 - DNA, 22 bp, Homo sapiens
tttaacctgtcaatttgcatgc

SEQ ID NO: 6957165 - DNA, 22 bp, Homo sapiens
tcataaatagttgtgcctgaat

SEQ ID NO: 6957166 - DNA, 22 bp, Homo sapiens
tccctgtatagagaatcccttt

SEQ ID NO: 6957167 - DNA, 22 bp, Homo sapiens
tggtttcatgagatgagaattt

SEQ ID NO: 6957168 - DNA, 22 bp, Homo sapiens
acctgggaaagccgtggaaagg

SEQ ID NO: 6957169 - DNA, 22 bp, Homo sapiens
gctgctccgtctgagctctggt

SEQ ID NO: 6957170 - DNA, 19 bp, Homo sapiens
tgtgatattgttagtaata

SEQ ID NO: 6957171 - DNA, 22 bp, Homo sapiens
tataaatgcacttttgaaatat

SEQ ID NO: 6957172 - DNA, 22 bp, Homo sapiens
ggcaccaggacatgactcccag

SEQ ID NO: 6957173 - DNA, 22 bp, Homo sapiens
agctctttctacaagcaggcag

SEQ ID NO: 6957174 - DNA, 22 bp, Homo sapiens
tttggagagcagctaggccctt

SEQ ID NO: 6957175 - DNA, 19 bp, Homo sapiens
agtgtgagtaattggagtt

SEQ ID NO: 6957176 - DNA, 22 bp, Homo sapiens
cacttgatggaagagcagaaga

SEQ ID NO: 6957177 - DNA, 22 bp, Homo sapiens
tacaggtagaatgggtgtacag

SEQ ID NO: 6957178 - DNA, 22 bp, Homo sapiens
cagtgagttgtgctgaggacca

SEQ ID NO: 6957179 - DNA, 22 bp, Homo sapiens
tgagctctaagatcccctcaag

SEQ ID NO: 6957180 - DNA, 22 bp, Homo sapiens
ggctgcctaacccttaagtgtc

SEQ ID NO: 6957181 - DNA, 22 bp, Homo sapiens
cttaatttcaaactgctagtga

SEQ ID NO: 6957182 - DNA, 22 bp, Homo sapiens
tgtggacaggcagttggtggga

SEQ ID NO: 6957183 - DNA, 20 bp, Homo sapiens
gttttatgccagttctgtgt

SEQ ID NO: 6957184 - DNA, 22 bp, Homo sapiens
cttgtaaatgcagattctgatt

SEQ ID NO: 6957185 - DNA, 22 bp, Homo sapiens
gagcatttggttatagtaattt

SEQ ID NO: 6957186 - DNA, 22 bp, Homo sapiens
ttatgtagtgactgactgttag

SEQ ID NO: 6957187 - DNA, 20 bp, Homo sapiens
agttctcttccttgggcctg

SEQ ID NO: 6957188 - DNA, 22 bp, Homo sapiens
tgattgaattcaaatgcaatct

SEQ ID NO: 6957189 - DNA, 22 bp, Homo sapiens
tctgaggatagaggcaatagga

SEQ ID NO: 6957190 - DNA, 22 bp, Homo sapiens
actattcaagtgctcattcaga

SEQ ID NO: 6957191 - DNA, 22 bp, Homo sapiens
tgggctaattctttgattgttt

SEQ ID NO: 6957192 - DNA, 22 bp, Homo sapiens
ctctttagtcacagggcttcat

SEQ ID NO: 6957193 - DNA, 22 bp, Homo sapiens
tgcaaggtgctttttggtgtca

SEQ ID NO: 6957194 - DNA, 22 bp, Homo sapiens
ttggacagtgcagatctacacg

SEQ ID NO: 6957195 - DNA, 22 bp, Homo sapiens
ttcacactgtttttcatagtgg

SEQ ID NO: 6957196 - DNA, 22 bp, Homo sapiens
aacagaggctccctgcacttgt

SEQ ID NO: 6957197 - DNA, 22 bp, Homo sapiens
ggcagctcacgggcatggggtg

SEQ ID NO: 6957198 - DNA, 22 bp, Homo sapiens
tggagctgagaagtggagctct

SEQ ID NO: 6957199 - DNA, 22 bp, Homo sapiens
ggctgcatgcctcagtgtaaga

SEQ ID NO: 6957200 - DNA, 18 bp, Homo sapiens
ctcggggacaagggcggc

SEQ ID NO: 6957201 - DNA, 22 bp, Homo sapiens
aagttcacagaagattccaatt

SEQ ID NO: 6957202 - DNA, 22 bp, Homo sapiens
tgccttcctgctttgagttctg

SEQ ID NO: 6957203 - DNA, 22 bp, Homo sapiens
ctgacttcagggataaaaagta

SEQ ID NO: 6957204 - DNA, 22 bp, Homo sapiens
tgtgaaggcagagccagtgaaa

SEQ ID NO: 6957205 - DNA, 22 bp, Homo sapiens
aggacacagactgattgcagca

SEQ ID NO: 6957206 - DNA, 22 bp, Homo sapiens
agctatctgcatgttttgctag

SEQ ID NO: 6957207 - DNA, 22 bp, Homo sapiens
tgtctattaacacaagaaagga

SEQ ID NO: 6957208 - DNA, 22 bp, Homo sapiens
gctttagaagacactctgtttt

SEQ ID NO: 6957209 - DNA, 22 bp, Homo sapiens
cttcagggtgacgcaggctgca

SEQ ID NO: 6957210 - DNA, 22 bp, Homo sapiens
gagaggggcgcgcagctcgcga

SEQ ID NO: 6957211 - DNA, 22 bp, Homo sapiens
ttatggaatttgcaaaaggtta

SEQ ID NO: 6957212 - DNA, 22 bp, Homo sapiens
ggctctgtaaagtgacacctgc

SEQ ID NO: 6957213 - DNA, 22 bp, Homo sapiens
tatggcaagagaatcaactgaa

SEQ ID NO: 6957214 - DNA, 22 bp, Homo sapiens
caaggcattaccatggctagag

SEQ ID NO: 6957215 - DNA, 22 bp, Homo sapiens
gtgaggtgactagcaggtgggg

SEQ ID NO: 6957216 - DNA, 22 bp, Homo sapiens
attgatgtagtttcagatttca

SEQ ID NO: 6957217 - DNA, 22 bp, Homo sapiens
gccagtaagtggtagagttgag

SEQ ID NO: 6957218 - DNA, 22 bp, Homo sapiens
caaacttacgtagtcttactac

SEQ ID NO: 6957219 - DNA, 22 bp, Homo sapiens
ctcatgcattctttttgtgtgt

SEQ ID NO: 6957220 - DNA, 22 bp, Homo sapiens
ggaaaggagatattggagagtg

SEQ ID NO: 6957221 - DNA, 22 bp, Homo sapiens
ctgcctgccacgttcagctgta

SEQ ID NO: 6957222 - DNA, 22 bp, Homo sapiens
cattttgtgcacacgtggagtt

SEQ ID NO: 6957223 - DNA, 22 bp, Homo sapiens
ggccctgtggttttgcaaagtc

SEQ ID NO: 6957224 - DNA, 22 bp, Homo sapiens
tgatttcctaggtctggagaag

SEQ ID NO: 6957225 - DNA, 22 bp, Homo sapiens
gccagtgttggtgataagctct

SEQ ID NO: 6957226 - DNA, 22 bp, Homo sapiens
ggcttggaaactagagtgtgca

SEQ ID NO: 6957227 - DNA, 22 bp, Homo sapiens
ctgcaggatttcatgggctgac

SEQ ID NO: 6957228 - DNA, 22 bp, Homo sapiens
ttatttagtctagatgaatttt

SEQ ID NO: 6957229 - DNA, 22 bp, Homo sapiens
atatccaagaaacaattaattc

SEQ ID NO: 6957230 - DNA, 22 bp, Homo sapiens
tttttgaaggctgatgtgatta

SEQ ID NO: 6957231 - DNA, 22 bp, Homo sapiens
atggctgcatcatcctggttga

SEQ ID NO: 6957232 - DNA, 22 bp, Homo sapiens
ctcaagatgtcagggcacctgc

SEQ ID NO: 6957233 - DNA, 22 bp, Homo sapiens
gggcaggtggcaaagccagagg

SEQ ID NO: 6957234 - DNA, 16 bp, Homo sapiens
gcctggagtggcaggg

SEQ ID NO: 6957235 - DNA, 22 bp, Homo sapiens
agacagagatactatgttgtca

SEQ ID NO: 6957236 - DNA, 22 bp, Homo sapiens
cccagagtatttgtgatgttag

SEQ ID NO: 6957237 - DNA, 22 bp, Homo sapiens
attggtgctctggcacattcct

SEQ ID NO: 6957238 - DNA, 22 bp, Homo sapiens
atccagttcttggaagcacagg

SEQ ID NO: 6957239 - DNA, 22 bp, Homo sapiens
cctctgggtatctgtggaagta

SEQ ID NO: 6957240 - DNA, 22 bp, Homo sapiens
agccagaaaaacaccaagagga

SEQ ID NO: 6957241 - DNA, 22 bp, Homo sapiens
agagatggagagcactggggct

SEQ ID NO: 6957242 - DNA, 22 bp, Homo sapiens
ttctcaaggacaaaatgacatg

SEQ ID NO: 6957243 - DNA, 22 bp, Homo sapiens
agaaatgttgaatacacaaaat

SEQ ID NO: 6957244 - DNA, 22 bp, Homo sapiens
tgggaatacaagttattcacct

SEQ ID NO: 6957245 - DNA, 22 bp, Homo sapiens
cagacagacctgcaagggcaca

SEQ ID NO: 6957246 - DNA, 22 bp, Homo sapiens
ggacagctcctgcacttgagta

SEQ ID NO: 6957247 - DNA, 22 bp, Homo sapiens
agtatcatgttggaattaatca

SEQ ID NO: 6957248 - DNA, 22 bp, Homo sapiens
gggcagtgtggtcgtgcctttg

SEQ ID NO: 6957249 - DNA, 22 bp, Homo sapiens
aagtgatttgcatgcttaattc

SEQ ID NO: 6957250 - DNA, 22 bp, Homo sapiens
taggggaggggatcatgtgctg

SEQ ID NO: 6957251 - DNA, 22 bp, Homo sapiens
tctgatatttcattcaaaagta

SEQ ID NO: 6957252 - DNA, 17 bp, Homo sapiens
atttgtaactagctctt

SEQ ID NO: 6957253 - DNA, 22 bp, Homo sapiens
ttgacacaatcatggcagacat

SEQ ID NO: 6957254 - DNA, 20 bp, Homo sapiens
tgttatgagggcgatctata

SEQ ID NO: 6957255 - DNA, 22 bp, Homo sapiens
caagagcatttagttagctggt

SEQ ID NO: 6957256 - DNA, 22 bp, Homo sapiens
caaaggctgccactgtggctgt

SEQ ID NO: 6957257 - DNA, 22 bp, Homo sapiens
caaggctagcaagcagtagtca

SEQ ID NO: 6957258 - DNA, 21 bp, Homo sapiens
tcactgtgcaaatgttgatgg

SEQ ID NO: 6957259 - DNA, 22 bp, Homo sapiens
gattcacaactgccctgaaggg

SEQ ID NO: 6957260 - DNA, 22 bp, Homo sapiens
tacagcacggtgcatttactac

SEQ ID NO: 6957261 - DNA, 23 bp, Homo sapiens
agctctggcgttggggaggtagt

SEQ ID NO: 6957262 - DNA, 22 bp, Homo sapiens
aggggaaaatgagttagtgtgt

SEQ ID NO: 6957263 - DNA, 22 bp, Homo sapiens
agcagtgtggccttagacccgg

SEQ ID NO: 6957264 - DNA, 22 bp, Homo sapiens
attcaatcccagaaagaaactg

SEQ ID NO: 6957265 - DNA, 19 bp, Homo sapiens
atcatcactcatggtcctg

SEQ ID NO: 6957266 - DNA, 22 bp, Homo sapiens
aagaatctgacataatttcctg

SEQ ID NO: 6957267 - DNA, 22 bp, Homo sapiens
tgggaagcctagcagacagctg

SEQ ID NO: 6957268 - DNA, 22 bp, Homo sapiens
ataggcatgacatgcagggatt

SEQ ID NO: 6957269 - DNA, 22 bp, Homo sapiens
tggaggccagaggtactgggac

SEQ ID NO: 6957270 - DNA, 22 bp, Homo sapiens
gctgaggaagtcaggtggccca

SEQ ID NO: 6957271 - DNA, 22 bp, Homo sapiens
tatcatgtctggagatactttt

SEQ ID NO: 6957272 - DNA, 22 bp, Homo sapiens
ccagccccgggaacctggccgt

SEQ ID NO: 6957273 - DNA, 22 bp, Homo sapiens
tggggccagcggggaggactca

SEQ ID NO: 6957274 - DNA, 22 bp, Homo sapiens
ttcacagtggtaagggttgtga

SEQ ID NO: 6957275 - DNA, 22 bp, Homo sapiens
attctagaacagaggtttctaa

SEQ ID NO: 6957276 - DNA, 22 bp, Homo sapiens
aaatactgtagataatagagtt

SEQ ID NO: 6957277 - DNA, 22 bp, Homo sapiens
gccaggaaaaaccggccctgct

SEQ ID NO: 6957278 - DNA, 22 bp, Homo sapiens
agtgcccacctctcttcagcta

SEQ ID NO: 6957279 - DNA, 22 bp, Homo sapiens
aaagtctcaggcaaaccaggac

SEQ ID NO: 6957280 - DNA, 18 bp, Homo sapiens
tgaggctgaatatggggc

SEQ ID NO: 6957281 - DNA, 22 bp, Homo sapiens
ctgccttcatctctgagctggg

SEQ ID NO: 6957282 - DNA, 22 bp, Homo sapiens
acatatctttactcatcatctc

SEQ ID NO: 6957283 - DNA, 22 bp, Homo sapiens
tgctgctgatcatttatagtct

SEQ ID NO: 6957284 - DNA, 21 bp, Homo sapiens
ctacagaagctctcctatcca

SEQ ID NO: 6957285 - DNA, 22 bp, Homo sapiens
aatgatttggcaaaggaatcca

SEQ ID NO: 6957286 - DNA, 22 bp, Homo sapiens
agtgattgtgtagaaccatccc

SEQ ID NO: 6957287 - DNA, 22 bp, Homo sapiens
tggtcctgggcacagtatatgc

SEQ ID NO: 6957288 - DNA, 22 bp, Homo sapiens
tcagcagggtttgacttctaat

SEQ ID NO: 6957289 - DNA, 19 bp, Homo sapiens
ctgggacaatgaaagcatc

SEQ ID NO: 6957290 - DNA, 22 bp, Homo sapiens
atttccaaggtaattttgagta

SEQ ID NO: 6957291 - DNA, 22 bp, Homo sapiens
gaactcaacacagtatttggta

SEQ ID NO: 6957292 - DNA, 22 bp, Homo sapiens
attaaggcgttggcgtgcttat

SEQ ID NO: 6957293 - DNA, 22 bp, Homo sapiens
ttaaacacactgagatttatgt

SEQ ID NO: 6957294 - DNA, 20 bp, Homo sapiens
agagtgggtgtcacaggctg

SEQ ID NO: 6957295 - DNA, 22 bp, Homo sapiens
ccaagaatgataggtgtgagca

SEQ ID NO: 6957296 - DNA, 23 bp, Homo sapiens
cctgtgacactgtttgtggtaag

SEQ ID NO: 6957297 - DNA, 22 bp, Homo sapiens
agtggtccttaagctgctgggt

SEQ ID NO: 6957298 - DNA, 22 bp, Homo sapiens
agtctagggattgaagcatgat

SEQ ID NO: 6957299 - DNA, 22 bp, Homo sapiens
gcatctctttagaatcagatgg

SEQ ID NO: 6957300 - DNA, 22 bp, Homo sapiens
ggtatcaaagaagggggtgcca

SEQ ID NO: 6957301 - DNA, 22 bp, Homo sapiens
tgaaattatgcattgttgtacc

SEQ ID NO: 6957302 - DNA, 22 bp, Homo sapiens
ttctgcagtgttaacaatgtca

SEQ ID NO: 6957303 - DNA, 22 bp, Homo sapiens
ttgttgcagagatgaatgacat

SEQ ID NO: 6957304 - DNA, 22 bp, Homo sapiens
tctcctgccactgcttcccatt

SEQ ID NO: 6957305 - DNA, 22 bp, Homo sapiens
aagtccctggtgctggctgcgc

SEQ ID NO: 6957306 - DNA, 22 bp, Homo sapiens
ctcttggtgggtggcctgttga

SEQ ID NO: 6957307 - DNA, 21 bp, Homo sapiens
gcagtgtcatggtttcaagtt

SEQ ID NO: 6957308 - DNA, 22 bp, Homo sapiens
aggtaaatgaatgtttagtctt

SEQ ID NO: 6957309 - DNA, 22 bp, Homo sapiens
ttaaaatcacagtcacccagta

SEQ ID NO: 6957310 - DNA, 16 bp, Homo sapiens
tacaagtgttagggaa

SEQ ID NO: 6957311 - DNA, 23 bp, Homo sapiens
ttatagagcagatgcaatgtgaa

SEQ ID NO: 6957312 - DNA, 22 bp, Homo sapiens
atatttctctcagacatggaag

SEQ ID NO: 6957313 - DNA, 22 bp, Homo sapiens
aaggacaggttggggcttcagg

SEQ ID NO: 6957314 - DNA, 22 bp, Homo sapiens
accatttgaaggaatcattgac

SEQ ID NO: 6957315 - DNA, 23 bp, Homo sapiens
gaggtggcaatgagggcagttgg

SEQ ID NO: 6957316 - DNA, 22 bp, Homo sapiens
tagcattttagctgttttctct

SEQ ID NO: 6957317 - DNA, 22 bp, Homo sapiens
gttcggcaggaaagcgttgaat

SEQ ID NO: 6957318 - DNA, 22 bp, Homo sapiens
gggatttcaccatgttggttgg

SEQ ID NO: 6957319 - DNA, 20 bp, Homo sapiens
cctgttggatgaggtccaga

SEQ ID NO: 6957320 - DNA, 20 bp, Homo sapiens
cattgcaaagtagcagactg

SEQ ID NO: 6957321 - DNA, 22 bp, Homo sapiens
atcccagagaataatgatcagg

SEQ ID NO: 6957322 - DNA, 22 bp, Homo sapiens
ctggttatctcggccacagaga

SEQ ID NO: 6957323 - DNA, 22 bp, Homo sapiens
gcatatggcttcatttaattct

SEQ ID NO: 6957324 - DNA, 22 bp, Homo sapiens
gctgcctgggctggcattccca

SEQ ID NO: 6957325 - DNA, 22 bp, Homo sapiens
attaaagctatccagtcatgaa

SEQ ID NO: 6957326 - DNA, 22 bp, Homo sapiens
aaagttctcctggattgtgctg

SEQ ID NO: 6957327 - DNA, 22 bp, Homo sapiens
cacggttagccacaggctggaa

SEQ ID NO: 6957328 - DNA, 22 bp, Homo sapiens
cgctccttgagcgtgtcggcct

SEQ ID NO: 6957329 - DNA, 22 bp, Homo sapiens
tctgagaggcatctgcacttct

SEQ ID NO: 6957330 - DNA, 22 bp, Homo sapiens
tttctggacagcaagatcagtt

SEQ ID NO: 6957331 - DNA, 22 bp, Homo sapiens
tctaaagtcatgtccctgaagt

SEQ ID NO: 6957332 - DNA, 22 bp, Homo sapiens
gtgcttctccgttctgcagcac

SEQ ID NO: 6957333 - DNA, 22 bp, Homo sapiens
agatggagttgtagcagtgact

SEQ ID NO: 6957334 - DNA, 22 bp, Homo sapiens
acttctattggtcatgataaaa

SEQ ID NO: 6957335 - DNA, 22 bp, Homo sapiens
tgcatgctttcagaaatagggc

SEQ ID NO: 6957336 - DNA, 22 bp, Homo sapiens
tcagacagtcatcagagcttgt

SEQ ID NO: 6957337 - DNA, 22 bp, Homo sapiens
gctctgggaagtcctttaccat

SEQ ID NO: 6957338 - DNA, 22 bp, Homo sapiens
atctgttgtttttcaccaccca

SEQ ID NO: 6957339 - DNA, 22 bp, Homo sapiens
gtagttttctgaaaattacttt

SEQ ID NO: 6957340 - DNA, 22 bp, Homo sapiens
ttgtaaagttcttaggaagctc

SEQ ID NO: 6957341 - DNA, 22 bp, Homo sapiens
atcacaggctatgtgggttttg

SEQ ID NO: 6957342 - DNA, 22 bp, Homo sapiens
gggttttcttcaaaagtctaga

SEQ ID NO: 6957343 - DNA, 22 bp, Homo sapiens
tgaaatctaccctattcagggt

SEQ ID NO: 6957344 - DNA, 22 bp, Homo sapiens
tactgctgagctgggtagaagg

SEQ ID NO: 6957345 - DNA, 18 bp, Homo sapiens
tccaccagtcaatctgtc

SEQ ID NO: 6957346 - DNA, 22 bp, Homo sapiens
aagagcccagggcttgatgctg

SEQ ID NO: 6957347 - DNA, 22 bp, Homo sapiens
ctgattgtgttcctgggagctg

SEQ ID NO: 6957348 - DNA, 22 bp, Homo sapiens
aggtagggttaatggagatata

SEQ ID NO: 6957349 - DNA, 22 bp, Homo sapiens
gctctttctgtccgcagggcct

SEQ ID NO: 6957350 - DNA, 22 bp, Homo sapiens
tagaactttgccttagggcaaa

SEQ ID NO: 6957351 - DNA, 22 bp, Homo sapiens
ttacttacagacagtagactct

SEQ ID NO: 6957352 - DNA, 22 bp, Homo sapiens
aatttggagctttgtttctaga

SEQ ID NO: 6957353 - DNA, 22 bp, Homo sapiens
ttgcagtcacactctaaagtag

SEQ ID NO: 6957354 - DNA, 21 bp, Homo sapiens
aggagcattgttgtggtggag

SEQ ID NO: 6957355 - DNA, 22 bp, Homo sapiens
actgtggttacctcttgtctta

SEQ ID NO: 6957356 - DNA, 20 bp, Homo sapiens
aagcatctggatgtagcaat

SEQ ID NO: 6957357 - DNA, 22 bp, Homo sapiens
aatcacaggcatagattgctcc

SEQ ID NO: 6957358 - DNA, 22 bp, Homo sapiens
cagtggctgtgaccagggacct

SEQ ID NO: 6957359 - DNA, 22 bp, Homo sapiens
ctgccagctcgccacaatgaca

SEQ ID NO: 6957360 - DNA, 22 bp, Homo sapiens
gtaaaatctttattgctggtga

SEQ ID NO: 6957361 - DNA, 22 bp, Homo sapiens
ctgaaagcaaatacatgaatct

SEQ ID NO: 6957362 - DNA, 22 bp, Homo sapiens
actcagtggcactttggaattt

SEQ ID NO: 6957363 - DNA, 22 bp, Homo sapiens
tagggcagagcttgtacacgat

SEQ ID NO: 6957364 - DNA, 19 bp, Homo sapiens
tggcttcctgactctcatc

SEQ ID NO: 6957365 - DNA, 21 bp, Homo sapiens
cattcctcccctgacgtcagc

SEQ ID NO: 6957366 - DNA, 22 bp, Homo sapiens
cagggagctggagttggagtac

SEQ ID NO: 6957367 - DNA, 22 bp, Homo sapiens
aatttcagaacccaaattagcg

SEQ ID NO: 6957368 - DNA, 22 bp, Homo sapiens
gtacacagatgcttgagaatct

SEQ ID NO: 6957369 - DNA, 22 bp, Homo sapiens
tatggacttgcagctgccagat

SEQ ID NO: 6957370 - DNA, 22 bp, Homo sapiens
ctcaatgtagacctcaacatat

SEQ ID NO: 6957371 - DNA, 22 bp, Homo sapiens
gagctaggggtagtcaggagac

SEQ ID NO: 6957372 - DNA, 22 bp, Homo sapiens
gggagacccccaatgccaggtc

SEQ ID NO: 6957373 - DNA, 22 bp, Homo sapiens
ttgtaaactggatagacctatt

SEQ ID NO: 6957374 - DNA, 22 bp, Homo sapiens
atccatttcagtgttccacttg

SEQ ID NO: 6957375 - DNA, 22 bp, Homo sapiens
gggaacagaggagggtgttgct

SEQ ID NO: 6957376 - DNA, 21 bp, Homo sapiens
gcacttggaaacttcaactag

SEQ ID NO: 6957377 - DNA, 22 bp, Homo sapiens
tttatagggtagctaggattga

SEQ ID NO: 6957378 - DNA, 22 bp, Homo sapiens
atgcatggtctgaagtcaacct

SEQ ID NO: 6957379 - DNA, 22 bp, Homo sapiens
agagggcgcccaggcccacgcc

SEQ ID NO: 6957380 - DNA, 22 bp, Homo sapiens
tttggtttgcctgagtaccctc

SEQ ID NO: 6957381 - DNA, 22 bp, Homo sapiens
tagctgaatgtgaccttaaaga

SEQ ID NO: 6957382 - DNA, 22 bp, Homo sapiens
ggtggcccagtgctttctgaag

SEQ ID NO: 6957383 - DNA, 23 bp, Homo sapiens
tggagctgggctcagaccctggg

SEQ ID NO: 6957384 - DNA, 19 bp, Homo sapiens
cagtgctgttcattcagtg

SEQ ID NO: 6957385 - DNA, 22 bp, Homo sapiens
tgacagctgcacaccccttcag

SEQ ID NO: 6957386 - DNA, 22 bp, Homo sapiens
cagctgtcacttctaagttttg

SEQ ID NO: 6957387 - DNA, 22 bp, Homo sapiens
gttgctttacagctggtgacag

SEQ ID NO: 6957388 - DNA, 22 bp, Homo sapiens
tctaatgaaagatgtaggaact

SEQ ID NO: 6957389 - DNA, 22 bp, Homo sapiens
aagtggcatgtataagaaagaa

SEQ ID NO: 6957390 - DNA, 22 bp, Homo sapiens
cctgttcttgtctcattggcta

SEQ ID NO: 6957391 - DNA, 22 bp, Homo sapiens
gaaagcaagttgactgcagaat

SEQ ID NO: 6957392 - DNA, 22 bp, Homo sapiens
tttgaaaggaattaggatgaca

SEQ ID NO: 6957393 - DNA, 22 bp, Homo sapiens
ataccctgttcatctttgtgtt

SEQ ID NO: 6957394 - DNA, 22 bp, Homo sapiens
tggaattttgtattagctttga

SEQ ID NO: 6957395 - DNA, 22 bp, Homo sapiens
cagagggtcaccaggaagtgca

SEQ ID NO: 6957396 - DNA, 22 bp, Homo sapiens
gtgggacaggtcaaatcttaaa

SEQ ID NO: 6957397 - DNA, 22 bp, Homo sapiens
tgtgagacaggatttagagcag

SEQ ID NO: 6957398 - DNA, 22 bp, Homo sapiens
atctgggcagggcagcaaggcg

SEQ ID NO: 6957399 - DNA, 22 bp, Homo sapiens
tcctggggctctttgatgtgat

SEQ ID NO: 6957400 - DNA, 22 bp, Homo sapiens
gccaggctggggggagatgtct

SEQ ID NO: 6957401 - DNA, 22 bp, Homo sapiens
ggcaagcataacctgtacagcc

SEQ ID NO: 6957402 - DNA, 22 bp, Homo sapiens
gtctgaatgatgagtgggactc

SEQ ID NO: 6957403 - DNA, 22 bp, Homo sapiens
agggcacttcagtcagactgag

SEQ ID NO: 6957404 - DNA, 22 bp, Homo sapiens
tgcgggtcccagggtcacaggc

SEQ ID NO: 6957405 - DNA, 22 bp, Homo sapiens
ggtcatcttgaatttccattct

SEQ ID NO: 6957406 - DNA, 22 bp, Homo sapiens
ggtggcagagacataggacata

SEQ ID NO: 6957407 - DNA, 22 bp, Homo sapiens
tctgggctttaagaactctgtt

SEQ ID NO: 6957408 - DNA, 22 bp, Homo sapiens
agcaacttttctagacatggtc

SEQ ID NO: 6957409 - DNA, 23 bp, Homo sapiens
cacatgcaggcagtggccttcaa

SEQ ID NO: 6957410 - DNA, 22 bp, Homo sapiens
ccatccatgcgccagacagatt

SEQ ID NO: 6957411 - DNA, 19 bp, Homo sapiens
aagatttggtcattgataa

SEQ ID NO: 6957412 - DNA, 22 bp, Homo sapiens
aaactggtaataaaatggatta

SEQ ID NO: 6957413 - DNA, 22 bp, Homo sapiens
tatagcagcatgatttatagtc

SEQ ID NO: 6957414 - DNA, 22 bp, Homo sapiens
gcagccactgggagtgcttata

SEQ ID NO: 6957415 - DNA, 22 bp, Homo sapiens
tttccagagctgagaaggcttg

SEQ ID NO: 6957416 - DNA, 22 bp, Homo sapiens
ttgccatgcagccaggaaggag

SEQ ID NO: 6957417 - DNA, 22 bp, Homo sapiens
tgctggccaacaaggctccaag

SEQ ID NO: 6957418 - DNA, 22 bp, Homo sapiens
tcttttccttccctacagatct

SEQ ID NO: 6957419 - DNA, 22 bp, Homo sapiens
gtgctgcctgccagcttctggg

SEQ ID NO: 6957420 - DNA, 22 bp, Homo sapiens
tcagcccatcactcacgtatta

SEQ ID NO: 6957421 - DNA, 22 bp, Homo sapiens
cacagtatttgtttttctgagt

SEQ ID NO: 6957422 - DNA, 22 bp, Homo sapiens
atatggagtccttgctgtgtgc

SEQ ID NO: 6957423 - DNA, 22 bp, Homo sapiens
atggtttattagctgcacaggc

SEQ ID NO: 6957424 - DNA, 22 bp, Homo sapiens
agatggctgggctcgtccgcag

SEQ ID NO: 6957425 - DNA, 22 bp, Homo sapiens
taggtctgtttgggaaatgtga

SEQ ID NO: 6957426 - DNA, 18 bp, Homo sapiens
cagctgccagctcatgga

SEQ ID NO: 6957427 - DNA, 22 bp, Homo sapiens
atagttggagttggaggttatg

SEQ ID NO: 6957428 - DNA, 22 bp, Homo sapiens
tagtgcaacagggaaagagtgt

SEQ ID NO: 6957429 - DNA, 22 bp, Homo sapiens
ctggagctggcccaggctggcc

SEQ ID NO: 6957430 - DNA, 22 bp, Homo sapiens
agcccagctgcctgcctgctgt

SEQ ID NO: 6957431 - DNA, 22 bp, Homo sapiens
ttcaagtcatgttaactgcttc

SEQ ID NO: 6957432 - DNA, 22 bp, Homo sapiens
tttctgcttaggactctgtgga

SEQ ID NO: 6957433 - DNA, 22 bp, Homo sapiens
tgtattagagcagtagaattat

SEQ ID NO: 6957434 - DNA, 22 bp, Homo sapiens
atgcttcagtgctaccttcaaa

SEQ ID NO: 6957435 - DNA, 22 bp, Homo sapiens
agctgaagacctcaagtaagag

SEQ ID NO: 6957436 - DNA, 20 bp, Homo sapiens
tagatttcatacttctcttt

SEQ ID NO: 6957437 - DNA, 23 bp, Homo sapiens
atcattctccaatctggagcagg

SEQ ID NO: 6957438 - DNA, 22 bp, Homo sapiens
ttgctgatttccccttgagtgt

SEQ ID NO: 6957439 - DNA, 22 bp, Homo sapiens
gcttcattaatagaattagtat

SEQ ID NO: 6957440 - DNA, 22 bp, Homo sapiens
tctaatgaggactttatagaga

SEQ ID NO: 6957441 - DNA, 18 bp, Homo sapiens
ttcacaggaaatgtcttt

SEQ ID NO: 6957442 - DNA, 23 bp, Homo sapiens
agctggtttcaatgtgttatttc

SEQ ID NO: 6957443 - DNA, 22 bp, Homo sapiens
acaaatgccatgtgacctacca

SEQ ID NO: 6957444 - DNA, 19 bp, Homo sapiens
catgtgtcaatactgtacc

SEQ ID NO: 6957445 - DNA, 22 bp, Homo sapiens
ttctgtcaaatgccagtagaga

SEQ ID NO: 6957446 - DNA, 22 bp, Homo sapiens
gctatcccaccaaggtcccagt

SEQ ID NO: 6957447 - DNA, 22 bp, Homo sapiens
agggttgcagcagaggcccagt

SEQ ID NO: 6957448 - DNA, 22 bp, Homo sapiens
atgcttggcccctttatagcct

SEQ ID NO: 6957449 - DNA, 22 bp, Homo sapiens
taggaaacagtgcatatatagt

SEQ ID NO: 6957450 - DNA, 22 bp, Homo sapiens
ctctgtgcttatgctccatggg

SEQ ID NO: 6957451 - DNA, 22 bp, Homo sapiens
ggagggggaagaagctaaagac

SEQ ID NO: 6957452 - DNA, 21 bp, Homo sapiens
gtggttctagagaaacagaat

SEQ ID NO: 6957453 - DNA, 22 bp, Homo sapiens
ttgcagggtacattcttagaat

SEQ ID NO: 6957454 - DNA, 22 bp, Homo sapiens
aaccagactctccaaaggcaaa

SEQ ID NO: 6957455 - DNA, 22 bp, Homo sapiens
ctgctgtggccagccaggtcaa

SEQ ID NO: 6957456 - DNA, 22 bp, Homo sapiens
aatgcattgttgatttggagtg

SEQ ID NO: 6957457 - DNA, 22 bp, Homo sapiens
taggcctagttactgcttactt

SEQ ID NO: 6957458 - DNA, 22 bp, Homo sapiens
tattggctgcagcttcctctgt

SEQ ID NO: 6957459 - DNA, 22 bp, Homo sapiens
tggctttgacttaccagaagtg

SEQ ID NO: 6957460 - DNA, 22 bp, Homo sapiens
acaggctgctgagccatttgct

SEQ ID NO: 6957461 - DNA, 22 bp, Homo sapiens
gctttgtgtgaagtccatggcg

SEQ ID NO: 6957462 - DNA, 22 bp, Homo sapiens
cacagagaggcttgtctccaag

SEQ ID NO: 6957463 - DNA, 22 bp, Homo sapiens
ctgtggctcaattgcctactga

SEQ ID NO: 6957464 - DNA, 22 bp, Homo sapiens
tgagaaaaggttgagatgataa

SEQ ID NO: 6957465 - DNA, 22 bp, Homo sapiens
ttaatccaatatcctggctatt

SEQ ID NO: 6957466 - DNA, 22 bp, Homo sapiens
tgtgaaaagggctttgtacaaa

SEQ ID NO: 6957467 - DNA, 22 bp, Homo sapiens
tctgctggtcaaggctgggtcc

SEQ ID NO: 6957468 - DNA, 22 bp, Homo sapiens
gcagcctcaaactccccagctc

SEQ ID NO: 6957469 - DNA, 22 bp, Homo sapiens
caaagcagaaggttctgtggta

SEQ ID NO: 6957470 - DNA, 22 bp, Homo sapiens
cattacaacaatctgccatggc

SEQ ID NO: 6957471 - DNA, 22 bp, Homo sapiens
tgccctcaagcaacagagagga

SEQ ID NO: 6957472 - DNA, 22 bp, Homo sapiens
tgcctgccctgaaaactgccca

SEQ ID NO: 6957473 - DNA, 22 bp, Homo sapiens
aagccaaggttttggtcacagc

SEQ ID NO: 6957474 - DNA, 22 bp, Homo sapiens
acagcctgcagccccaggtcgc

SEQ ID NO: 6957475 - DNA, 22 bp, Homo sapiens
cctgaagaaaattccacgagaa

SEQ ID NO: 6957476 - DNA, 22 bp, Homo sapiens
tctctggggaaaaggctgatac

SEQ ID NO: 6957477 - DNA, 22 bp, Homo sapiens
atgtatttgcgaggttaggaaa

SEQ ID NO: 6957478 - DNA, 22 bp, Homo sapiens
ctgaataaagccctcgcgcgct

SEQ ID NO: 6957479 - DNA, 22 bp, Homo sapiens
atgctgggaagacaaggtggag

SEQ ID NO: 6957480 - DNA, 17 bp, Homo sapiens
agttaaggctctttgct

SEQ ID NO: 6957481 - DNA, 22 bp, Homo sapiens
atggcagacacaggcaggcaga

SEQ ID NO: 6957482 - DNA, 23 bp, Homo sapiens
tttcttctcgaagagggagctta

SEQ ID NO: 6957483 - DNA, 20 bp, Homo sapiens
ctgtgaccagagacccagga

SEQ ID NO: 6957484 - DNA, 22 bp, Homo sapiens
tcctccagctactaggcaaata

SEQ ID NO: 6957485 - DNA, 22 bp, Homo sapiens
ggaggagagaggttgcaaacac

SEQ ID NO: 6957486 - DNA, 22 bp, Homo sapiens
agtcccagtgagatgaaccagg

SEQ ID NO: 6957487 - DNA, 22 bp, Homo sapiens
ctttccaagaatgcagatacct

SEQ ID NO: 6957488 - DNA, 19 bp, Homo sapiens
tactaaacatgcatattgg

SEQ ID NO: 6957489 - DNA, 22 bp, Homo sapiens
gagaagacgtgatggccaagaa

SEQ ID NO: 6957490 - DNA, 22 bp, Homo sapiens
ctgggcacaggggagcagagtc

SEQ ID NO: 6957491 - DNA, 22 bp, Homo sapiens
agtggagcttttcctatcagag

SEQ ID NO: 6957492 - DNA, 22 bp, Homo sapiens
taaagttataaattacctgtca

SEQ ID NO: 6957493 - DNA, 22 bp, Homo sapiens
tagaaagtactaaatttaactg

SEQ ID NO: 6957494 - DNA, 22 bp, Homo sapiens
cttagcttctctgcatctgtgt

SEQ ID NO: 6957495 - DNA, 20 bp, Homo sapiens
aaatgcagggctgctgcgga

SEQ ID NO: 6957496 - DNA, 22 bp, Homo sapiens
aaaatgctgggaaagttggaat

SEQ ID NO: 6957497 - DNA, 22 bp, Homo sapiens
caccagagttgtccaaatgatt

SEQ ID NO: 6957498 - DNA, 20 bp, Homo sapiens
tggaagacactgaagggcca

SEQ ID NO: 6957499 - DNA, 22 bp, Homo sapiens
tttggacttagcctgcagaatt

SEQ ID NO: 6957500 - DNA, 22 bp, Homo sapiens
ggcaatttgcagtttgtcttat

SEQ ID NO: 6957501 - DNA, 22 bp, Homo sapiens
gtgaacagttcattttatcatg

SEQ ID NO: 6957502 - DNA, 22 bp, Homo sapiens
aatgtcttttaacctctggact

SEQ ID NO: 6957503 - DNA, 22 bp, Homo sapiens
ggccacagagggcgggatgctg

SEQ ID NO: 6957504 - DNA, 22 bp, Homo sapiens
tggttactttcactggtctggg

SEQ ID NO: 6957505 - DNA, 22 bp, Homo sapiens
atgtacactttggaagagtcac

SEQ ID NO: 6957506 - DNA, 16 bp, Homo sapiens
ttgatggagttgggtt

SEQ ID NO: 6957507 - DNA, 18 bp, Homo sapiens
cttttcccctttggactc

SEQ ID NO: 6957508 - DNA, 21 bp, Homo sapiens
agtcatctgttcattcaacag

SEQ ID NO: 6957509 - DNA, 22 bp, Homo sapiens
tttatatctggagttgctagga

SEQ ID NO: 6957510 - DNA, 22 bp, Homo sapiens
attttccatctccacaccaggg

SEQ ID NO: 6957511 - DNA, 22 bp, Homo sapiens
gcagtgaagcagtccttgttga

SEQ ID NO: 6957512 - DNA, 22 bp, Homo sapiens
agatttccgttctctcttcagt

SEQ ID NO: 6957513 - DNA, 22 bp, Homo sapiens
caggcccactgcttgtctagtc

SEQ ID NO: 6957514 - DNA, 15 bp, Homo sapiens
ttgctttaagacatg

SEQ ID NO: 6957515 - DNA, 22 bp, Homo sapiens
gagctcagagcctatagttggt

SEQ ID NO: 6957516 - DNA, 22 bp, Homo sapiens
cagacctcaaagctgcagtgct

SEQ ID NO: 6957517 - DNA, 22 bp, Homo sapiens
gaatccttggttttaagcaata

SEQ ID NO: 6957518 - DNA, 22 bp, Homo sapiens
ctggagctggcttccttccact

SEQ ID NO: 6957519 - DNA, 22 bp, Homo sapiens
tttcacaatcaaatggtgaaat

SEQ ID NO: 6957520 - DNA, 22 bp, Homo sapiens
tcattctgcatcactcttgctc

SEQ ID NO: 6957521 - DNA, 22 bp, Homo sapiens
cacaggaaaaatgggtccttta

SEQ ID NO: 6957522 - DNA, 22 bp, Homo sapiens
actatcaagtagagcttgcttt

SEQ ID NO: 6957523 - DNA, 19 bp, Homo sapiens
agcttagaaagcaatttta

SEQ ID NO: 6957524 - DNA, 22 bp, Homo sapiens
tggtcctggtgcaagtgcattt

SEQ ID NO: 6957525 - DNA, 20 bp, Homo sapiens
cacaactgagaaccctatgg

SEQ ID NO: 6957526 - DNA, 22 bp, Homo sapiens
tctaaactctgcaatttacggt

SEQ ID NO: 6957527 - DNA, 22 bp, Homo sapiens
tggcagacactgtcgaagccta

SEQ ID NO: 6957528 - DNA, 22 bp, Homo sapiens
tgaatagctgtgacagacatca

SEQ ID NO: 6957529 - DNA, 22 bp, Homo sapiens
aaacttcagtaggagccaacct

SEQ ID NO: 6957530 - DNA, 22 bp, Homo sapiens
ctttgatgagcatgcaatattt

SEQ ID NO: 6957531 - DNA, 22 bp, Homo sapiens
taagcaaatagctagatcagag

SEQ ID NO: 6957532 - DNA, 22 bp, Homo sapiens
aggctttaattatctacaggag

SEQ ID NO: 6957533 - DNA, 22 bp, Homo sapiens
agtcaaggtggaccagaaaaat

SEQ ID NO: 6957534 - DNA, 22 bp, Homo sapiens
gccccacctgctaccttccagc

SEQ ID NO: 6957535 - DNA, 22 bp, Homo sapiens
tctcataattaggtaagtcaga

SEQ ID NO: 6957536 - DNA, 22 bp, Homo sapiens
catggcttcaaagcctttggca

SEQ ID NO: 6957537 - DNA, 22 bp, Homo sapiens
aaatgttccgggtaaggagaaa

SEQ ID NO: 6957538 - DNA, 21 bp, Homo sapiens
tcaggagtggagagaattggt

SEQ ID NO: 6957539 - DNA, 22 bp, Homo sapiens
tttggatttggggatggagtat

SEQ ID NO: 6957540 - DNA, 22 bp, Homo sapiens
tctcaacaccacttgctgaaga

SEQ ID NO: 6957541 - DNA, 22 bp, Homo sapiens
ccttgactgccttcaggctggg

SEQ ID NO: 6957542 - DNA, 22 bp, Homo sapiens
ggagaggacatggctcccacag

SEQ ID NO: 6957543 - DNA, 22 bp, Homo sapiens
gcctgctgaagccagagtgtgt

SEQ ID NO: 6957544 - DNA, 22 bp, Homo sapiens
ttcagggacttagtgtcagttt

SEQ ID NO: 6957545 - DNA, 22 bp, Homo sapiens
acccatacacacatatttatgt

SEQ ID NO: 6957546 - DNA, 22 bp, Homo sapiens
tccaatgttccagggtaaatgt

SEQ ID NO: 6957547 - DNA, 22 bp, Homo sapiens
actggcagccacaactggcagg

SEQ ID NO: 6957548 - DNA, 22 bp, Homo sapiens
tgcatgctccacagcccattca

SEQ ID NO: 6957549 - DNA, 22 bp, Homo sapiens
atcatcattcttggataaagca

SEQ ID NO: 6957550 - DNA, 22 bp, Homo sapiens
tccttagccagggcagctcaaa

SEQ ID NO: 6957551 - DNA, 22 bp, Homo sapiens
aactctgggtcactgtgcaatt

SEQ ID NO: 6957552 - DNA, 17 bp, Homo sapiens
tctgaggtgaggatgca

SEQ ID NO: 6957553 - DNA, 22 bp, Homo sapiens
tccagacccatgaccctgggga

SEQ ID NO: 6957554 - DNA, 20 bp, Homo sapiens
ctctttacatgtctcttcct

SEQ ID NO: 6957555 - DNA, 22 bp, Homo sapiens
caataaggttttgactattgag

SEQ ID NO: 6957556 - DNA, 22 bp, Homo sapiens
tttggttggaaggatggatagc

SEQ ID NO: 6957557 - DNA, 22 bp, Homo sapiens
catgcaatttttggttctctat

SEQ ID NO: 6957558 - DNA, 22 bp, Homo sapiens
agtaaactgtgggtacagatgt

SEQ ID NO: 6957559 - DNA, 22 bp, Homo sapiens
aacatgaggcactgagtttcat

SEQ ID NO: 6957560 - DNA, 22 bp, Homo sapiens
gtttacatgtactcattatact

SEQ ID NO: 6957561 - DNA, 22 bp, Homo sapiens
tagaagcactgacagagtttga

SEQ ID NO: 6957562 - DNA, 22 bp, Homo sapiens
gcttgatgatacctaggagatg

SEQ ID NO: 6957563 - DNA, 22 bp, Homo sapiens
ttcactcttcggcatctctgta

SEQ ID NO: 6957564 - DNA, 22 bp, Homo sapiens
tcgctcacttggttatgaaggt

SEQ ID NO: 6957565 - DNA, 23 bp, Homo sapiens
tcatctgtaagtatctgtggagt

SEQ ID NO: 6957566 - DNA, 22 bp, Homo sapiens
tggcctgattttgctaagagaa

SEQ ID NO: 6957567 - DNA, 22 bp, Homo sapiens
caggaaggggctcactctggcc

SEQ ID NO: 6957568 - DNA, 18 bp, Homo sapiens
tgaagacatgaggttagt

SEQ ID NO: 6957569 - DNA, 22 bp, Homo sapiens
tcagtctcatcaactctattcc

SEQ ID NO: 6957570 - DNA, 23 bp, Homo sapiens
ggctgggagctccgggtgcacgt

SEQ ID NO: 6957571 - DNA, 23 bp, Homo sapiens
tagtccagtatggcaatgctatg

SEQ ID NO: 6957572 - DNA, 22 bp, Homo sapiens
tttaggcaaatttcagatgtgc

SEQ ID NO: 6957573 - DNA, 22 bp, Homo sapiens
ctggctggagaaatgaaattct

SEQ ID NO: 6957574 - DNA, 22 bp, Homo sapiens
cagatggaaggcatagaggttt

SEQ ID NO: 6957575 - DNA, 22 bp, Homo sapiens
gaagaagtgtaagtctgtttca

SEQ ID NO: 6957576 - DNA, 22 bp, Homo sapiens
ttacattcaatttctagaggta

SEQ ID NO: 6957577 - DNA, 22 bp, Homo sapiens
caaaatagatgttaacctggaa

SEQ ID NO: 6957578 - DNA, 22 bp, Homo sapiens
agtctcaggcagaggaaggcta

SEQ ID NO: 6957579 - DNA, 22 bp, Homo sapiens
tgtttcatgattgctgtcattt

SEQ ID NO: 6957580 - DNA, 22 bp, Homo sapiens
accatcagtactggatgctgac

SEQ ID NO: 6957581 - DNA, 22 bp, Homo sapiens
acactagagagcaggcattccc

SEQ ID NO: 6957582 - DNA, 22 bp, Homo sapiens
ctgtctggtcaacaactgagtg

SEQ ID NO: 6957583 - DNA, 22 bp, Homo sapiens
ggggagttaaaatgtgctgcaa

SEQ ID NO: 6957584 - DNA, 22 bp, Homo sapiens
tctgtcacttaagaattgccta

SEQ ID NO: 6957585 - DNA, 22 bp, Homo sapiens
tttacagatgaggatactgagg

SEQ ID NO: 6957586 - DNA, 22 bp, Homo sapiens
tcagccagtttgtttattccgg

SEQ ID NO: 6957587 - DNA, 22 bp, Homo sapiens
taaagtggaaggatccactaag

SEQ ID NO: 6957588 - DNA, 22 bp, Homo sapiens
agcagctaagtagcgcagttaa

SEQ ID NO: 6957589 - DNA, 22 bp, Homo sapiens
atgctcttgaggctaaagacat

SEQ ID NO: 6957590 - DNA, 22 bp, Homo sapiens
ggaaccttgataataagttgtt

SEQ ID NO: 6957591 - DNA, 22 bp, Homo sapiens
tgtcttcacaaagcagaaggga

SEQ ID NO: 6957592 - DNA, 22 bp, Homo sapiens
aagctttagagatgagttcctt

SEQ ID NO: 6957593 - DNA, 22 bp, Homo sapiens
tactgcatagacactgggatat

SEQ ID NO: 6957594 - DNA, 16 bp, Homo sapiens
tactgtggagcaaggc

SEQ ID NO: 6957595 - DNA, 22 bp, Homo sapiens
tagctgtgtaacatgagaatgt

SEQ ID NO: 6957596 - DNA, 20 bp, Homo sapiens
gtggaatgcactctgtgctg

SEQ ID NO: 6957597 - DNA, 22 bp, Homo sapiens
tctgagctatccagatagtatt

SEQ ID NO: 6957598 - DNA, 22 bp, Homo sapiens
ccaatgagacagaaagagcctc

SEQ ID NO: 6957599 - DNA, 23 bp, Homo sapiens
attccaggaaatacttggctttc

SEQ ID NO: 6957600 - DNA, 22 bp, Homo sapiens
gatcaaaggaattttttacatg

SEQ ID NO: 6957601 - DNA, 22 bp, Homo sapiens
aaggtgccatattttggaatag

SEQ ID NO: 6957602 - DNA, 20 bp, Homo sapiens
tttgcgaggccaaggcgggc

SEQ ID NO: 6957603 - DNA, 22 bp, Homo sapiens
tggccagtgtcggaggccagga

SEQ ID NO: 6957604 - DNA, 22 bp, Homo sapiens
cctgtggagctttcagcagctc

SEQ ID NO: 6957605 - DNA, 22 bp, Homo sapiens
tgtcagcatttaaggagtaagg

SEQ ID NO: 6957606 - DNA, 22 bp, Homo sapiens
agcatggctttggaggatagca

SEQ ID NO: 6957607 - DNA, 22 bp, Homo sapiens
gtggccaggccgactgccaggc

SEQ ID NO: 6957608 - DNA, 22 bp, Homo sapiens
aaaatagatgaaaggaagtctg

SEQ ID NO: 6957609 - DNA, 22 bp, Homo sapiens
atcttaccctcaacacatccag

SEQ ID NO: 6957610 - DNA, 18 bp, Homo sapiens
aagattctgcttctctct

SEQ ID NO: 6957611 - DNA, 22 bp, Homo sapiens
tttctattttaaaggcatatgg

SEQ ID NO: 6957612 - DNA, 22 bp, Homo sapiens
cacatgagagcccccaagagca

SEQ ID NO: 6957613 - DNA, 23 bp, Homo sapiens
gccttcagctcgggaaggctccc

SEQ ID NO: 6957614 - DNA, 22 bp, Homo sapiens
ccagaactgagaaaataaattt

SEQ ID NO: 6957615 - DNA, 22 bp, Homo sapiens
taggggtgggatccaggaatta

SEQ ID NO: 6957616 - DNA, 22 bp, Homo sapiens
tggcacagcccggattctatga

SEQ ID NO: 6957617 - DNA, 19 bp, Homo sapiens
tcagccaccagaagagata

SEQ ID NO: 6957618 - DNA, 22 bp, Homo sapiens
aggactcacatagcttcagatg

SEQ ID NO: 6957619 - DNA, 18 bp, Homo sapiens
tggcagcaggaagccatt

SEQ ID NO: 6957620 - DNA, 16 bp, Homo sapiens
cctctcttattcctcc

SEQ ID NO: 6957621 - DNA, 23 bp, Homo sapiens
ggctgctcttttcatgctgtttc

SEQ ID NO: 6957622 - DNA, 22 bp, Homo sapiens
tgtggagcctcaaggccatctc

SEQ ID NO: 6957623 - DNA, 22 bp, Homo sapiens
cataatatctccgattacttgc

SEQ ID NO: 6957624 - DNA, 22 bp, Homo sapiens
taggcattttcagtgttgttgt

SEQ ID NO: 6957625 - DNA, 22 bp, Homo sapiens
ttcatttgtggttatttacaat

SEQ ID NO: 6957626 - DNA, 20 bp, Homo sapiens
tgcaatattcagttggttat

SEQ ID NO: 6957627 - DNA, 22 bp, Homo sapiens
atccattttccttggcagcagg

SEQ ID NO: 6957628 - DNA, 22 bp, Homo sapiens
ggtgatgaaaagtgcctttatc

SEQ ID NO: 6957629 - DNA, 23 bp, Homo sapiens
atcttacatatttagcacctgaa

SEQ ID NO: 6957630 - DNA, 23 bp, Homo sapiens
ggggacagttcccactggggtct

SEQ ID NO: 6957631 - DNA, 19 bp, Homo sapiens
ctgtcaaccccatgggagt

SEQ ID NO: 6957632 - DNA, 21 bp, Homo sapiens
gggtataaaatggtatctcat

SEQ ID NO: 6957633 - DNA, 22 bp, Homo sapiens
aaaagtctacaagcttcaacaa

SEQ ID NO: 6957634 - DNA, 22 bp, Homo sapiens
gacaagtgatgattataattca

SEQ ID NO: 6957635 - DNA, 22 bp, Homo sapiens
atggaaggctttatgactcaaa

SEQ ID NO: 6957636 - DNA, 22 bp, Homo sapiens
ttgggacagcaacggttctgtt

SEQ ID NO: 6957637 - DNA, 22 bp, Homo sapiens
tcagaggagccaaagttctgag

SEQ ID NO: 6957638 - DNA, 22 bp, Homo sapiens
gtcctgagccacatactatcca

SEQ ID NO: 6957639 - DNA, 22 bp, Homo sapiens
tagtacagtttaaatattaata

SEQ ID NO: 6957640 - DNA, 22 bp, Homo sapiens
tacaccattttctgcagtgttt

SEQ ID NO: 6957641 - DNA, 22 bp, Homo sapiens
tctctacagatcctatatagaa

SEQ ID NO: 6957642 - DNA, 22 bp, Homo sapiens
ctccccagccctggtattctga

SEQ ID NO: 6957643 - DNA, 22 bp, Homo sapiens
ttcgttcatagtagaaatggct

SEQ ID NO: 6957644 - DNA, 22 bp, Homo sapiens
ttgaaatatcaagttattagtg

SEQ ID NO: 6957645 - DNA, 22 bp, Homo sapiens
tcctctggtcttcggtgtggac

SEQ ID NO: 6957646 - DNA, 23 bp, Homo sapiens
tagagcattgctgaggcctccct

SEQ ID NO: 6957647 - DNA, 22 bp, Homo sapiens
taaatgctttctatgaaagagg

SEQ ID NO: 6957648 - DNA, 22 bp, Homo sapiens
tagaaaagccccagctggaggg

SEQ ID NO: 6957649 - DNA, 22 bp, Homo sapiens
agtgcataagtggggttgaagg

SEQ ID NO: 6957650 - DNA, 22 bp, Homo sapiens
aacagcagcatgacagctgggt

SEQ ID NO: 6957651 - DNA, 22 bp, Homo sapiens
tgagttataatgaatatttgaa

SEQ ID NO: 6957652 - DNA, 22 bp, Homo sapiens
tccagcccagtttggtgaattg

SEQ ID NO: 6957653 - DNA, 22 bp, Homo sapiens
ccttgcagctgattatttttca

SEQ ID NO: 6957654 - DNA, 20 bp, Homo sapiens
aggagctgaattagagggtt

SEQ ID NO: 6957655 - DNA, 22 bp, Homo sapiens
tttttcctagcgatttgtcagc

SEQ ID NO: 6957656 - DNA, 22 bp, Homo sapiens
gtcagtgtcttaacagagatta

SEQ ID NO: 6957657 - DNA, 22 bp, Homo sapiens
gccagagaggccttagaatcca

SEQ ID NO: 6957658 - DNA, 22 bp, Homo sapiens
agcccaggaatctgcatcttga

SEQ ID NO: 6957659 - DNA, 22 bp, Homo sapiens
ttatagcaggtgactaatgagt

SEQ ID NO: 6957660 - DNA, 22 bp, Homo sapiens
tgtctttagcccatatagactt

SEQ ID NO: 6957661 - DNA, 22 bp, Homo sapiens
tcaataaaattgttttcctatc

SEQ ID NO: 6957662 - DNA, 22 bp, Homo sapiens
cagtgattcaggtctccagttt

SEQ ID NO: 6957663 - DNA, 22 bp, Homo sapiens
atgaaagcaacttatttgagat

SEQ ID NO: 6957664 - DNA, 18 bp, Homo sapiens
tgaacagctgagactatc

SEQ ID NO: 6957665 - DNA, 22 bp, Homo sapiens
gattagttgattaagagtcaga

SEQ ID NO: 6957666 - DNA, 20 bp, Homo sapiens
cattattgtaatcagctgta

SEQ ID NO: 6957667 - DNA, 22 bp, Homo sapiens
ttcattggcacaggggcaggtt

SEQ ID NO: 6957668 - DNA, 22 bp, Homo sapiens
ttgccatttatactgcaagtca

SEQ ID NO: 6957669 - DNA, 22 bp, Homo sapiens
tccagctggggccgaagtggat

SEQ ID NO: 6957670 - DNA, 22 bp, Homo sapiens
agagtgtttcagtcttcctaga

SEQ ID NO: 6957671 - DNA, 22 bp, Homo sapiens
ttgccagatcttccacatggct

SEQ ID NO: 6957672 - DNA, 20 bp, Homo sapiens
cctcacagggcagagagggg

SEQ ID NO: 6957673 - DNA, 19 bp, Homo sapiens
caggtggcgctctacaggg

SEQ ID NO: 6957674 - DNA, 22 bp, Homo sapiens
ctgtgcctccctttactttgag

SEQ ID NO: 6957675 - DNA, 22 bp, Homo sapiens
aagatacaaatgtcaatattgg

SEQ ID NO: 6957676 - DNA, 22 bp, Homo sapiens
gaggctcattgcattgtgcatt

SEQ ID NO: 6957677 - DNA, 22 bp, Homo sapiens
ggcttcgccatcgccagcttca

SEQ ID NO: 6957678 - DNA, 22 bp, Homo sapiens
tgtcccactgacttcacatcca

SEQ ID NO: 6957679 - DNA, 22 bp, Homo sapiens
tcactgccattagttggttaat

SEQ ID NO: 6957680 - DNA, 22 bp, Homo sapiens
tggtcagaggaccaaactagtg

SEQ ID NO: 6957681 - DNA, 22 bp, Homo sapiens
acagatacaaatatacaaatac

SEQ ID NO: 6957682 - DNA, 22 bp, Homo sapiens
cctggcagcaggtgggcccgtg

SEQ ID NO: 6957683 - DNA, 18 bp, Homo sapiens
gtccacagccctcacagc

SEQ ID NO: 6957684 - DNA, 22 bp, Homo sapiens
aatattatcaaaagctttttca

SEQ ID NO: 6957685 - DNA, 22 bp, Homo sapiens
gcttggcaggtctgggattgtt

SEQ ID NO: 6957686 - DNA, 22 bp, Homo sapiens
gctgctggcatctagggggtgg

SEQ ID NO: 6957687 - DNA, 18 bp, Homo sapiens
tgctgggcattaggctta

SEQ ID NO: 6957688 - DNA, 22 bp, Homo sapiens
ttcatgaggtacctgtgatcat

SEQ ID NO: 6957689 - DNA, 22 bp, Homo sapiens
gaagccctgtaggtgcaaaggt

SEQ ID NO: 6957690 - DNA, 22 bp, Homo sapiens
aaggaagagaatccttctcaga

SEQ ID NO: 6957691 - DNA, 22 bp, Homo sapiens
attcagctaagtgcttcatgct

SEQ ID NO: 6957692 - DNA, 22 bp, Homo sapiens
gtcttctgcccaggcagacgga

SEQ ID NO: 6957693 - DNA, 22 bp, Homo sapiens
ctggctggagctgttgtaggct

SEQ ID NO: 6957694 - DNA, 22 bp, Homo sapiens
gtgatccgatgtcagtcgcaga

SEQ ID NO: 6957695 - DNA, 22 bp, Homo sapiens
tgggccttgtcccctcagctgt

SEQ ID NO: 6957696 - DNA, 22 bp, Homo sapiens
tttcttgattagctgtggctca

SEQ ID NO: 6957697 - DNA, 22 bp, Homo sapiens
tgcacagggagggggccagctc

SEQ ID NO: 6957698 - DNA, 22 bp, Homo sapiens
ttgtgctctaaggtcagggcga

SEQ ID NO: 6957699 - DNA, 22 bp, Homo sapiens
gtttataaggcccaatatttct

SEQ ID NO: 6957700 - DNA, 22 bp, Homo sapiens
tgggagtcagtcgttctcagag

SEQ ID NO: 6957701 - DNA, 22 bp, Homo sapiens
tcagcaggtgctttgtttactc

SEQ ID NO: 6957702 - DNA, 22 bp, Homo sapiens
gctttgcttccttccccttcaa

SEQ ID NO: 6957703 - DNA, 22 bp, Homo sapiens
tggctcctaggatggtgcctgg

SEQ ID NO: 6957704 - DNA, 22 bp, Homo sapiens
ggaacagtactcggaggccaga

SEQ ID NO: 6957705 - DNA, 22 bp, Homo sapiens
tttcaaactgggagtgagggga

SEQ ID NO: 6957706 - DNA, 22 bp, Homo sapiens
gttggggtaccttgaggctggg

SEQ ID NO: 6957707 - DNA, 22 bp, Homo sapiens
ccgtgtacataaagccctggta

SEQ ID NO: 6957708 - DNA, 22 bp, Homo sapiens
tcagccagctcttggactctga

SEQ ID NO: 6957709 - DNA, 21 bp, Homo sapiens
agggaaaaggctgagtgaggg

SEQ ID NO: 6957710 - DNA, 22 bp, Homo sapiens
tgtaccaaacccatcataacta

SEQ ID NO: 6957711 - DNA, 22 bp, Homo sapiens
ttcacacttgttaggatggctt

SEQ ID NO: 6957712 - DNA, 22 bp, Homo sapiens
tgtgaataatgccgcaataaac

SEQ ID NO: 6957713 - DNA, 22 bp, Homo sapiens
ctttgagcaattctgagatgca

SEQ ID NO: 6957714 - DNA, 22 bp, Homo sapiens
aatgtctctctaaataaacttt

SEQ ID NO: 6957715 - DNA, 22 bp, Homo sapiens
gtcacctgaggggaggtgacag

SEQ ID NO: 6957716 - DNA, 20 bp, Homo sapiens
ctcttccggaggggcgctcc

SEQ ID NO: 6957717 - DNA, 22 bp, Homo sapiens
tcaggagtaagggtaacccaga

SEQ ID NO: 6957718 - DNA, 22 bp, Homo sapiens
ttcttagtggtagtcatctttg

SEQ ID NO: 6957719 - DNA, 22 bp, Homo sapiens
gctggaattggacccagggctc

SEQ ID NO: 6957720 - DNA, 22 bp, Homo sapiens
gtgggagaaattagctctagtt

SEQ ID NO: 6957721 - DNA, 22 bp, Homo sapiens
attgagtagtaggaaaataact

SEQ ID NO: 6957722 - DNA, 22 bp, Homo sapiens
tcagaagtccaataccatggga

SEQ ID NO: 6957723 - DNA, 22 bp, Homo sapiens
aggtagaaggaccagaatttat

SEQ ID NO: 6957724 - DNA, 22 bp, Homo sapiens
ggagaccttaaggtgcttccta

SEQ ID NO: 6957725 - DNA, 22 bp, Homo sapiens
acttgggccatcccatagtcaa

SEQ ID NO: 6957726 - DNA, 22 bp, Homo sapiens
tgggctgcggataggcctcgga

SEQ ID NO: 6957727 - DNA, 22 bp, Homo sapiens
ggagacacagagcaacaaaata

SEQ ID NO: 6957728 - DNA, 22 bp, Homo sapiens
aactttctgttacgtccccaga

SEQ ID NO: 6957729 - DNA, 22 bp, Homo sapiens
cctggcctctccgagtaacctg

SEQ ID NO: 6957730 - DNA, 22 bp, Homo sapiens
ttctcacaattcttgtatttgc

SEQ ID NO: 6957731 - DNA, 22 bp, Homo sapiens
tctctggttattaactaactcc

SEQ ID NO: 6957732 - DNA, 22 bp, Homo sapiens
aactactcaactctgccattgt

SEQ ID NO: 6957733 - DNA, 22 bp, Homo sapiens
aagatgtgatggtagcttttac

SEQ ID NO: 6957734 - DNA, 22 bp, Homo sapiens
ttatagtgcataattaacatgg

SEQ ID NO: 6957735 - DNA, 22 bp, Homo sapiens
gtgaactctgactctcatgcct

SEQ ID NO: 6957736 - DNA, 22 bp, Homo sapiens
ccatggagttcctctggtctat

SEQ ID NO: 6957737 - DNA, 22 bp, Homo sapiens
ctacagtgtcgtgtggtttctg

SEQ ID NO: 6957738 - DNA, 22 bp, Homo sapiens
gtgttctctagagctgtacaaa

SEQ ID NO: 6957739 - DNA, 22 bp, Homo sapiens
ctcagccaggagagtgttcaca

SEQ ID NO: 6957740 - DNA, 22 bp, Homo sapiens
aggagagagaacacttgggtcc

SEQ ID NO: 6957741 - DNA, 22 bp, Homo sapiens
tagtctctgctttgcccttggc

SEQ ID NO: 6957742 - DNA, 18 bp, Homo sapiens
gctctgcagctgaggctt

SEQ ID NO: 6957743 - DNA, 22 bp, Homo sapiens
ctggccagactacacatgtgtg

SEQ ID NO: 6957744 - DNA, 22 bp, Homo sapiens
cactgcctgtgagctgtgtgcc

SEQ ID NO: 6957745 - DNA, 22 bp, Homo sapiens
ttacagtttagtccaagccaga

SEQ ID NO: 6957746 - DNA, 22 bp, Homo sapiens
tcataaagcatttcagcttttg

SEQ ID NO: 6957747 - DNA, 22 bp, Homo sapiens
gacaattagatcattcctttga

SEQ ID NO: 6957748 - DNA, 22 bp, Homo sapiens
ctggtgccattctgtggcctag

SEQ ID NO: 6957749 - DNA, 22 bp, Homo sapiens
tgggatattttgagctttcctc

SEQ ID NO: 6957750 - DNA, 22 bp, Homo sapiens
tgatcaaagccaaagttgagat

SEQ ID NO: 6957751 - DNA, 22 bp, Homo sapiens
gcaggcccttagccttggtggg

SEQ ID NO: 6957752 - DNA, 22 bp, Homo sapiens
agggctgcctgctctgcattga

SEQ ID NO: 6957753 - DNA, 22 bp, Homo sapiens
aaaagtgaggcagcccaaggga

SEQ ID NO: 6957754 - DNA, 22 bp, Homo sapiens
ttggggtaaggaaatatggctt

SEQ ID NO: 6957755 - DNA, 22 bp, Homo sapiens
attttcctagtcatgtgcttct

SEQ ID NO: 6957756 - DNA, 22 bp, Homo sapiens
cactggaatatggcgttgaacc

SEQ ID NO: 6957757 - DNA, 22 bp, Homo sapiens
catggcagctttgggaggagga

SEQ ID NO: 6957758 - DNA, 22 bp, Homo sapiens
ttcagagtggtatgaagtgatg

SEQ ID NO: 6957759 - DNA, 22 bp, Homo sapiens
ggctgtgctttgttaggttgtc

SEQ ID NO: 6957760 - DNA, 22 bp, Homo sapiens
ttcttagggctggacaaggggc

SEQ ID NO: 6957761 - DNA, 22 bp, Homo sapiens
gacattcattgatgtcttcctc

SEQ ID NO: 6957762 - DNA, 22 bp, Homo sapiens
tccacatctaggtttgtcaaca

SEQ ID NO: 6957763 - DNA, 22 bp, Homo sapiens
ccaaaaattagatacacatata

SEQ ID NO: 6957764 - DNA, 22 bp, Homo sapiens
gggcctggggtgacgtacccct

SEQ ID NO: 6957765 - DNA, 22 bp, Homo sapiens
agtggactaaagccaggcagca

SEQ ID NO: 6957766 - DNA, 22 bp, Homo sapiens
cgctgggggaacttcagccaat

SEQ ID NO: 6957767 - DNA, 19 bp, Homo sapiens
ccactggggctccacatta

SEQ ID NO: 6957768 - DNA, 22 bp, Homo sapiens
ttctggggttatgggtgattct

SEQ ID NO: 6957769 - DNA, 22 bp, Homo sapiens
cagaagtggcatcattcaagag

SEQ ID NO: 6957770 - DNA, 22 bp, Homo sapiens
tgcctctgtggaaatggtggtc

SEQ ID NO: 6957771 - DNA, 22 bp, Homo sapiens
gacttagaccctgtctttattc

SEQ ID NO: 6957772 - DNA, 23 bp, Homo sapiens
tctgcagacgctgttctattgtc

SEQ ID NO: 6957773 - DNA, 22 bp, Homo sapiens
gtgctgtaacaacagagtgtct

SEQ ID NO: 6957774 - DNA, 22 bp, Homo sapiens
tccagtgctggaccagagcacc

SEQ ID NO: 6957775 - DNA, 22 bp, Homo sapiens
gacagaaggcatctagggcacg

SEQ ID NO: 6957776 - DNA, 17 bp, Homo sapiens
cctgtggatgacacctg

SEQ ID NO: 6957777 - DNA, 22 bp, Homo sapiens
tcagttaatatgggtaaagcat

SEQ ID NO: 6957778 - DNA, 22 bp, Homo sapiens
gctggcaagtaggttttggctg

SEQ ID NO: 6957779 - DNA, 22 bp, Homo sapiens
ccaggcttcaggagtggtttcc

SEQ ID NO: 6957780 - DNA, 22 bp, Homo sapiens
tgagattttcagcatcacttca

SEQ ID NO: 6957781 - DNA, 22 bp, Homo sapiens
tcctggagttgtgcagtgcaca

SEQ ID NO: 6957782 - DNA, 22 bp, Homo sapiens
cccagctccctggtatttgtgc

SEQ ID NO: 6957783 - DNA, 22 bp, Homo sapiens
gcactggtttatttaagaacaa

SEQ ID NO: 6957784 - DNA, 22 bp, Homo sapiens
aaacttggccgcatccaccggg

SEQ ID NO: 6957785 - DNA, 22 bp, Homo sapiens
cccaggcctggtctgggccagt

SEQ ID NO: 6957786 - DNA, 22 bp, Homo sapiens
cagcagccgagagggggctctg

SEQ ID NO: 6957787 - DNA, 18 bp, Homo sapiens
tcattattgtttctggag

SEQ ID NO: 6957788 - DNA, 21 bp, Homo sapiens
atatagcgtgtctacatgtta

SEQ ID NO: 6957789 - DNA, 22 bp, Homo sapiens
agtcttcctgcccagcaggagg

SEQ ID NO: 6957790 - DNA, 20 bp, Homo sapiens
accttgaacccgccagccat

SEQ ID NO: 6957791 - DNA, 22 bp, Homo sapiens
gccctcctgcaggggcttctgg

SEQ ID NO: 6957792 - DNA, 22 bp, Homo sapiens
tcctatgtattgccagagccag

SEQ ID NO: 6957793 - DNA, 22 bp, Homo sapiens
tgccttaaaaaattctaaacat

SEQ ID NO: 6957794 - DNA, 22 bp, Homo sapiens
gcactctgccaggtctcctgat

SEQ ID NO: 6957795 - DNA, 22 bp, Homo sapiens
gagctggaggaccaggactggg

SEQ ID NO: 6957796 - DNA, 20 bp, Homo sapiens
cagacatctccaaatctgtg

SEQ ID NO: 6957797 - DNA, 22 bp, Homo sapiens
agtcttatggttaaatagatgc

SEQ ID NO: 6957798 - DNA, 22 bp, Homo sapiens
ctagtcactcagcactgacaaa

SEQ ID NO: 6957799 - DNA, 22 bp, Homo sapiens
tcactgcttcttggagaatgtc

SEQ ID NO: 6957800 - DNA, 22 bp, Homo sapiens
gccagtggtcagtgggagggtg

SEQ ID NO: 6957801 - DNA, 22 bp, Homo sapiens
tgtgaggatgttaaggggatga

SEQ ID NO: 6957802 - DNA, 22 bp, Homo sapiens
atgtcagtttcattttaagtca

SEQ ID NO: 6957803 - DNA, 22 bp, Homo sapiens
tttccttccatgttgggcaaaa

SEQ ID NO: 6957804 - DNA, 22 bp, Homo sapiens
caggctgggctggtgttagagt

SEQ ID NO: 6957805 - DNA, 22 bp, Homo sapiens
atagattagccctatagtttta

SEQ ID NO: 6957806 - DNA, 22 bp, Homo sapiens
ggcactgaagtgggtgttgggt

SEQ ID NO: 6957807 - DNA, 22 bp, Homo sapiens
cagagggacagtgtaatgcata

SEQ ID NO: 6957808 - DNA, 22 bp, Homo sapiens
ttctgaaagtctttttaagtta

SEQ ID NO: 6957809 - DNA, 22 bp, Homo sapiens
ttacctgcaactcccatggtga

SEQ ID NO: 6957810 - DNA, 22 bp, Homo sapiens
tcttcaaagaattttagtaatt

SEQ ID NO: 6957811 - DNA, 22 bp, Homo sapiens
agtgctaccctgggaggagctc

SEQ ID NO: 6957812 - DNA, 22 bp, Homo sapiens
tccagtcaggctgaattcaagg

SEQ ID NO: 6957813 - DNA, 22 bp, Homo sapiens
cagctggacttttgatagaagt

SEQ ID NO: 6957814 - DNA, 22 bp, Homo sapiens
gccacctgcgggccgtggtgga

SEQ ID NO: 6957815 - DNA, 19 bp, Homo sapiens
acagaagcatagaaaagga

SEQ ID NO: 6957816 - DNA, 22 bp, Homo sapiens
ctgcctgctgcctgtggagggt

SEQ ID NO: 6957817 - DNA, 22 bp, Homo sapiens
atcacccaggctggagtgcagt

SEQ ID NO: 6957818 - DNA, 22 bp, Homo sapiens
aagcggagtccggctgggggtg

SEQ ID NO: 6957819 - DNA, 22 bp, Homo sapiens
tctactgtggtccttgtaacca

SEQ ID NO: 6957820 - DNA, 22 bp, Homo sapiens
aaattataggtgccaccttgga

SEQ ID NO: 6957821 - DNA, 21 bp, Homo sapiens
gacaggactagaccagagctc

SEQ ID NO: 6957822 - DNA, 22 bp, Homo sapiens
aatgttgagcttgaaagtaggt

SEQ ID NO: 6957823 - DNA, 22 bp, Homo sapiens
caggctcccacttggcttaaag

SEQ ID NO: 6957824 - DNA, 22 bp, Homo sapiens
gtccagggggcttaagcaaact

SEQ ID NO: 6957825 - DNA, 22 bp, Homo sapiens
caggtggcattgtcccgccagc

SEQ ID NO: 6957826 - DNA, 22 bp, Homo sapiens
tcagaattttggtttggttggt

SEQ ID NO: 6957827 - DNA, 19 bp, Homo sapiens
gctaccaaggcaagacaaa

SEQ ID NO: 6957828 - DNA, 22 bp, Homo sapiens
aagtgctgggattacaggcgtg

SEQ ID NO: 6957829 - DNA, 23 bp, Homo sapiens
caccagttaaaatataaatcagc

SEQ ID NO: 6957830 - DNA, 18 bp, Homo sapiens
tgtagaaaagataggaat

SEQ ID NO: 6957831 - DNA, 22 bp, Homo sapiens
ttaagtgcctctaaaacaagcc

SEQ ID NO: 6957832 - DNA, 21 bp, Homo sapiens
ctctgaatcctgcttctcagt

SEQ ID NO: 6957833 - DNA, 20 bp, Homo sapiens
gatgggaatcggagctggta

SEQ ID NO: 6957834 - DNA, 22 bp, Homo sapiens
gcagcagcagcaattttctgtc

SEQ ID NO: 6957835 - DNA, 22 bp, Homo sapiens
caggatccctggcctccgccca

SEQ ID NO: 6957836 - DNA, 22 bp, Homo sapiens
agcacctgctatgtgtcaggga

SEQ ID NO: 6957837 - DNA, 22 bp, Homo sapiens
agttggcaaggtctggccagcg

SEQ ID NO: 6957838 - DNA, 22 bp, Homo sapiens
ctattctaagctcagaatccca

SEQ ID NO: 6957839 - DNA, 22 bp, Homo sapiens
gccagaaagaggaggacctggg

SEQ ID NO: 6957840 - DNA, 22 bp, Homo sapiens
gcagtaagatgtaagtgctata

SEQ ID NO: 6957841 - DNA, 22 bp, Homo sapiens
attctgataaataagcagcaag

SEQ ID NO: 6957842 - DNA, 22 bp, Homo sapiens
agtctgaaggatggaaggtacc

SEQ ID NO: 6957843 - DNA, 22 bp, Homo sapiens
tattgaattagaccctaaaatg

SEQ ID NO: 6957844 - DNA, 22 bp, Homo sapiens
tagtgccaaagcctggtgtcat

SEQ ID NO: 6957845 - DNA, 22 bp, Homo sapiens
atgcccactcccattacaggac

SEQ ID NO: 6957846 - DNA, 22 bp, Homo sapiens
ttgctataaatggtctatcttt

SEQ ID NO: 6957847 - DNA, 19 bp, Homo sapiens
gtggcagcagatttggtgt

SEQ ID NO: 6957848 - DNA, 22 bp, Homo sapiens
agcccagcaaagggaggttcag

SEQ ID NO: 6957849 - DNA, 22 bp, Homo sapiens
gtaaatgtcctgctacagagtg

SEQ ID NO: 6957850 - DNA, 22 bp, Homo sapiens
tctctttagtgcttagacgtct

SEQ ID NO: 6957851 - DNA, 17 bp, Homo sapiens
gaaagtttctctctctt

SEQ ID NO: 6957852 - DNA, 22 bp, Homo sapiens
cctccagactttggccatcctc

SEQ ID NO: 6957853 - DNA, 22 bp, Homo sapiens
ctgcctttggggagttagaggg

SEQ ID NO: 6957854 - DNA, 22 bp, Homo sapiens
acagaccagctttcattccctt

SEQ ID NO: 6957855 - DNA, 22 bp, Homo sapiens
aatatcctgaccagtaaactaa

SEQ ID NO: 6957856 - DNA, 22 bp, Homo sapiens
actgcaggatgtgctcctattg

SEQ ID NO: 6957857 - DNA, 22 bp, Homo sapiens
gggagccagcagggcatggagc

SEQ ID NO: 6957858 - DNA, 22 bp, Homo sapiens
atggcatttgaccgctttgtgg

SEQ ID NO: 6957859 - DNA, 22 bp, Homo sapiens
cagattcactaatagctggcct

SEQ ID NO: 6957860 - DNA, 22 bp, Homo sapiens
ctgctgtgtatcattttagatg

SEQ ID NO: 6957861 - DNA, 22 bp, Homo sapiens
ccctcagctccaccctcagcag

SEQ ID NO: 6957862 - DNA, 22 bp, Homo sapiens
gaacagccctgttaagtctgtt

SEQ ID NO: 6957863 - DNA, 22 bp, Homo sapiens
tgccctgctgtgcctggagcca

SEQ ID NO: 6957864 - DNA, 22 bp, Homo sapiens
agggaagtccatgggggcggtg

SEQ ID NO: 6957865 - DNA, 22 bp, Homo sapiens
gtgattctgaaatattagaaaa

SEQ ID NO: 6957866 - DNA, 22 bp, Homo sapiens
cttttctctgtaccgtatatct

SEQ ID NO: 6957867 - DNA, 22 bp, Homo sapiens
ctgagagtattggcaggcttgg

SEQ ID NO: 6957868 - DNA, 22 bp, Homo sapiens
ctggctgtttctcctttgtcta

SEQ ID NO: 6957869 - DNA, 22 bp, Homo sapiens
agtgtgctgcttaaacagttgt

SEQ ID NO: 6957870 - DNA, 22 bp, Homo sapiens
tctttagtgacagttgtgcaag

SEQ ID NO: 6957871 - DNA, 22 bp, Homo sapiens
atatgattgtccttagcaaatt

SEQ ID NO: 6957872 - DNA, 22 bp, Homo sapiens
ctgtgagaaataaatgtttgct

SEQ ID NO: 6957873 - DNA, 22 bp, Homo sapiens
ggcagtcacaggggagactggg

SEQ ID NO: 6957874 - DNA, 22 bp, Homo sapiens
gcctattaaagagcttggagca

SEQ ID NO: 6957875 - DNA, 22 bp, Homo sapiens
tctaagatctactatacatgtg

SEQ ID NO: 6957876 - DNA, 22 bp, Homo sapiens
tcacaggctccagggcctggat

SEQ ID NO: 6957877 - DNA, 22 bp, Homo sapiens
cagaccatcttgaagcaaactg

SEQ ID NO: 6957878 - DNA, 20 bp, Homo sapiens
gctgacccctgctgtcatgc

SEQ ID NO: 6957879 - DNA, 22 bp, Homo sapiens
catggctttttagcatattcaa

SEQ ID NO: 6957880 - DNA, 22 bp, Homo sapiens
tttcacaagtaaagtcctaagt

SEQ ID NO: 6957881 - DNA, 22 bp, Homo sapiens
gcaggagccctggcatgttctt

SEQ ID NO: 6957882 - DNA, 22 bp, Homo sapiens
cctccctccctcttatggttta

SEQ ID NO: 6957883 - DNA, 22 bp, Homo sapiens
tggcagggcctgaatcttatac

SEQ ID NO: 6957884 - DNA, 22 bp, Homo sapiens
cacggtttacttaacaagccca

SEQ ID NO: 6957885 - DNA, 22 bp, Homo sapiens
tacaatgattagctaacttgcc

SEQ ID NO: 6957886 - DNA, 22 bp, Homo sapiens
agtgagctatgatcatgttact

SEQ ID NO: 6957887 - DNA, 22 bp, Homo sapiens
tttcctcactcatgtcatcagt

SEQ ID NO: 6957888 - DNA, 22 bp, Homo sapiens
ctttgcaaagtctttggcaaga

SEQ ID NO: 6957889 - DNA, 22 bp, Homo sapiens
agagtcttagcctcattagtca

SEQ ID NO: 6957890 - DNA, 22 bp, Homo sapiens
aagtaaatgttggagctcaaat

SEQ ID NO: 6957891 - DNA, 21 bp, Homo sapiens
catatgaaagaagtatctgac

SEQ ID NO: 6957892 - DNA, 23 bp, Homo sapiens
ccaattcagatattggcttgtgc

SEQ ID NO: 6957893 - DNA, 22 bp, Homo sapiens
tggcctcttaaggatgacacaa

SEQ ID NO: 6957894 - DNA, 22 bp, Homo sapiens
gatgatctgaggtacatgaaac

SEQ ID NO: 6957895 - DNA, 22 bp, Homo sapiens
ggttcctgtgcctctagctggc

SEQ ID NO: 6957896 - DNA, 22 bp, Homo sapiens
ctggctgggccatttctttagg

SEQ ID NO: 6957897 - DNA, 22 bp, Homo sapiens
aggcagatatttcagttcacat

SEQ ID NO: 6957898 - DNA, 19 bp, Homo sapiens
tcattgtgctgagcaaggt

SEQ ID NO: 6957899 - DNA, 22 bp, Homo sapiens
aacagagtggagccaaactttg

SEQ ID NO: 6957900 - DNA, 22 bp, Homo sapiens
ggagagaattccatggacatgt

SEQ ID NO: 6957901 - DNA, 22 bp, Homo sapiens
aaagagtcaaaggcatgtctct

SEQ ID NO: 6957902 - DNA, 22 bp, Homo sapiens
gtattaggaaatatgaagaaag

SEQ ID NO: 6957903 - DNA, 22 bp, Homo sapiens
atacatcgtttattttagttca

SEQ ID NO: 6957904 - DNA, 22 bp, Homo sapiens
aatgcaatacctttttatgctg

SEQ ID NO: 6957905 - DNA, 20 bp, Homo sapiens
tcagagaagggactgagatt

SEQ ID NO: 6957906 - DNA, 22 bp, Homo sapiens
agctggtgtgctctggaatcct

SEQ ID NO: 6957907 - DNA, 22 bp, Homo sapiens
gcctaggagtacagaatggttt

SEQ ID NO: 6957908 - DNA, 22 bp, Homo sapiens
cagagctggcggtgagaagaca

SEQ ID NO: 6957909 - DNA, 22 bp, Homo sapiens
tgcgctggtggcggataagggt

SEQ ID NO: 6957910 - DNA, 22 bp, Homo sapiens
ttctaagtgttgacaaagtcta

SEQ ID NO: 6957911 - DNA, 22 bp, Homo sapiens
cttcttaaagattacacaatga

SEQ ID NO: 6957912 - DNA, 22 bp, Homo sapiens
cagtgacgtaaactgcatgtgc

SEQ ID NO: 6957913 - DNA, 22 bp, Homo sapiens
actttctccagaaaaccaagga

SEQ ID NO: 6957914 - DNA, 22 bp, Homo sapiens
cacatgaggtggagatgaatga

SEQ ID NO: 6957915 - DNA, 22 bp, Homo sapiens
ggaaggaacaaaccctgtgtgg

SEQ ID NO: 6957916 - DNA, 22 bp, Homo sapiens
tttgacagagttgtgaggattt

SEQ ID NO: 6957917 - DNA, 22 bp, Homo sapiens
tcagcccgaggtcaggatgggg

SEQ ID NO: 6957918 - DNA, 22 bp, Homo sapiens
ttctgggtggccagtatttaga

SEQ ID NO: 6957919 - DNA, 22 bp, Homo sapiens
ttcacaaagctggttccttctg

SEQ ID NO: 6957920 - DNA, 22 bp, Homo sapiens
tatgacattttcccagatttat

SEQ ID NO: 6957921 - DNA, 22 bp, Homo sapiens
tgctgcacagcccgctggccca

SEQ ID NO: 6957922 - DNA, 22 bp, Homo sapiens
cgtgaaatgagttgaattattg

SEQ ID NO: 6957923 - DNA, 22 bp, Homo sapiens
caactattaccatgttattgtc

SEQ ID NO: 6957924 - DNA, 22 bp, Homo sapiens
atgtgcttgaagcctcagagaa

SEQ ID NO: 6957925 - DNA, 18 bp, Homo sapiens
gtggagggttctcagaat

SEQ ID NO: 6957926 - DNA, 22 bp, Homo sapiens
ttgtctgacttctttagttact

SEQ ID NO: 6957927 - DNA, 22 bp, Homo sapiens
gcctggcttttgcctcatgttc

SEQ ID NO: 6957928 - DNA, 22 bp, Homo sapiens
cagtgggggtgaggccgaggta

SEQ ID NO: 6957929 - DNA, 22 bp, Homo sapiens
gccatttaggaggtggaaagga

SEQ ID NO: 6957930 - DNA, 22 bp, Homo sapiens
cctttcaaaacagaacactagc

SEQ ID NO: 6957931 - DNA, 20 bp, Homo sapiens
tgttggcaattgttgtttcc

SEQ ID NO: 6957932 - DNA, 19 bp, Homo sapiens
tcagtcatatatctgcacc

SEQ ID NO: 6957933 - DNA, 22 bp, Homo sapiens
gcagaaaccacagtgtctttta

SEQ ID NO: 6957934 - DNA, 17 bp, Homo sapiens
cccagctgcgtctgagg

SEQ ID NO: 6957935 - DNA, 22 bp, Homo sapiens
aaacttgtggtggagaagccta

SEQ ID NO: 6957936 - DNA, 22 bp, Homo sapiens
tttttcattgcagcctctctcc

SEQ ID NO: 6957937 - DNA, 22 bp, Homo sapiens
gaccagggtcactcacagggct

SEQ ID NO: 6957938 - DNA, 22 bp, Homo sapiens
ctgtaacagctgtcagagcagg

SEQ ID NO: 6957939 - DNA, 22 bp, Homo sapiens
tctctaaataacacttattgaa

SEQ ID NO: 6957940 - DNA, 22 bp, Homo sapiens
gacaggcttagggagggtgctc

SEQ ID NO: 6957941 - DNA, 22 bp, Homo sapiens
tctcctaggctggagtgcagtg

SEQ ID NO: 6957942 - DNA, 22 bp, Homo sapiens
gtctgctgtaggtaggacagca

SEQ ID NO: 6957943 - DNA, 17 bp, Homo sapiens
tttgtacaacattttaa

SEQ ID NO: 6957944 - DNA, 20 bp, Homo sapiens
cctggaagagctccccaggc

SEQ ID NO: 6957945 - DNA, 22 bp, Homo sapiens
ctgaatgtcgatcagcttgggt

SEQ ID NO: 6957946 - DNA, 22 bp, Homo sapiens
tacaaatccaagacccatacaa

SEQ ID NO: 6957947 - DNA, 22 bp, Homo sapiens
atgtgagtgctatgatagacag

SEQ ID NO: 6957948 - DNA, 22 bp, Homo sapiens
gggctccaaaatcctgtagcct

SEQ ID NO: 6957949 - DNA, 22 bp, Homo sapiens
tgctccaggagcaacctttgag

SEQ ID NO: 6957950 - DNA, 21 bp, Homo sapiens
aaactgaggcttcaagcagtg

SEQ ID NO: 6957951 - DNA, 22 bp, Homo sapiens
ctaatgtaatgatatgttgaat

SEQ ID NO: 6957952 - DNA, 22 bp, Homo sapiens
ataagaggaattacagaagagg

SEQ ID NO: 6957953 - DNA, 22 bp, Homo sapiens
tccgctggagagggggctgcca

SEQ ID NO: 6957954 - DNA, 22 bp, Homo sapiens
tcacaccaggagcagtgccaga

SEQ ID NO: 6957955 - DNA, 22 bp, Homo sapiens
tgttcattagtggaagtaagtt

SEQ ID NO: 6957956 - DNA, 22 bp, Homo sapiens
cccagttgttgccggctctgga

SEQ ID NO: 6957957 - DNA, 22 bp, Homo sapiens
tggcagctggtacagtgggtct

SEQ ID NO: 6957958 - DNA, 22 bp, Homo sapiens
ctttatgaaaaccagattgggg

SEQ ID NO: 6957959 - DNA, 22 bp, Homo sapiens
ttcaacaagtagtacacacagt

SEQ ID NO: 6957960 - DNA, 22 bp, Homo sapiens
tttgtgaataagagaatgacag

SEQ ID NO: 6957961 - DNA, 22 bp, Homo sapiens
tagaaagtagggaaggtaggat

SEQ ID NO: 6957962 - DNA, 21 bp, Homo sapiens
aggtggctgcatcctcagaag

SEQ ID NO: 6957963 - DNA, 22 bp, Homo sapiens
gttctagataaaactgcatgaa

SEQ ID NO: 6957964 - DNA, 22 bp, Homo sapiens
cagccacgtagcccttggccgt

SEQ ID NO: 6957965 - DNA, 22 bp, Homo sapiens
gttagcaatgaaatctggatgc

SEQ ID NO: 6957966 - DNA, 22 bp, Homo sapiens
gatcttttcagaatttatcagt

SEQ ID NO: 6957967 - DNA, 23 bp, Homo sapiens
aaggttgaaattggagcttggat

SEQ ID NO: 6957968 - DNA, 22 bp, Homo sapiens
aagtgctttacaaatgtctgtt

SEQ ID NO: 6957969 - DNA, 22 bp, Homo sapiens
tcaatctagagattaaaatagg

SEQ ID NO: 6957970 - DNA, 22 bp, Homo sapiens
tttacactgtgaaacaggtatc

SEQ ID NO: 6957971 - DNA, 21 bp, Homo sapiens
atacagaacattgatccaaga

SEQ ID NO: 6957972 - DNA, 22 bp, Homo sapiens
cggccaggcacagtggcccacg

SEQ ID NO: 6957973 - DNA, 22 bp, Homo sapiens
tctcacagatcagcagggggct

SEQ ID NO: 6957974 - DNA, 22 bp, Homo sapiens
ccatcagttctcagaccacact

SEQ ID NO: 6957975 - DNA, 22 bp, Homo sapiens
gctgagaacagagctctgagct

SEQ ID NO: 6957976 - DNA, 22 bp, Homo sapiens
cccccatccatgtcaggagagg

SEQ ID NO: 6957977 - DNA, 22 bp, Homo sapiens
aggagtttggcacatgtatgca

SEQ ID NO: 6957978 - DNA, 22 bp, Homo sapiens
tggctcatgcatcttttctaca

SEQ ID NO: 6957979 - DNA, 22 bp, Homo sapiens
caggaatgtcccatccccttca

SEQ ID NO: 6957980 - DNA, 22 bp, Homo sapiens
aaatcccaatgctagacccggt

SEQ ID NO: 6957981 - DNA, 22 bp, Homo sapiens
gtgcacagaaacatacaatgtg

SEQ ID NO: 6957982 - DNA, 22 bp, Homo sapiens
gtcactggggccacatgcagaa

SEQ ID NO: 6957983 - DNA, 17 bp, Homo sapiens
cagtgaagagacattaa

SEQ ID NO: 6957984 - DNA, 18 bp, Homo sapiens
gcagctgcagttgtagct

SEQ ID NO: 6957985 - DNA, 22 bp, Homo sapiens
ctgccagagaaaagtggatctt

SEQ ID NO: 6957986 - DNA, 22 bp, Homo sapiens
ttgcatgcatgtttctcattct

SEQ ID NO: 6957987 - DNA, 22 bp, Homo sapiens
tccacaggtcagggagataggc

SEQ ID NO: 6957988 - DNA, 22 bp, Homo sapiens
ctgccactttcacccagtgctc

SEQ ID NO: 6957989 - DNA, 22 bp, Homo sapiens
acctctgtatagttgcctgtgg

SEQ ID NO: 6957990 - DNA, 22 bp, Homo sapiens
tgcccacctttactgtgattta

SEQ ID NO: 6957991 - DNA, 22 bp, Homo sapiens
gtttggtgagcagcttgggtat

SEQ ID NO: 6957992 - DNA, 22 bp, Homo sapiens
cctgcctgcaccttctctgggg

SEQ ID NO: 6957993 - DNA, 20 bp, Homo sapiens
ctgaggtagggcagatcacc

SEQ ID NO: 6957994 - DNA, 18 bp, Homo sapiens
ccagctgtgcagcatctg

SEQ ID NO: 6957995 - DNA, 22 bp, Homo sapiens
cagccctgctgccttagtgcct

SEQ ID NO: 6957996 - DNA, 22 bp, Homo sapiens
tcacagcagaatttaggaggca

SEQ ID NO: 6957997 - DNA, 22 bp, Homo sapiens
agccagacctcggagtagtgag

SEQ ID NO: 6957998 - DNA, 21 bp, Homo sapiens
ccaaatagcctccattaacag

SEQ ID NO: 6957999 - DNA, 22 bp, Homo sapiens
tattgctgaggattgaggcttg

SEQ ID NO: 6958000 - DNA, 22 bp, Homo sapiens
tccgttgacactgcatggagat

SEQ ID NO: 6958001 - DNA, 19 bp, Homo sapiens
cctgagattcctccttttc

SEQ ID NO: 6958002 - DNA, 22 bp, Homo sapiens
ttggacactgagactagcaagc

SEQ ID NO: 6958003 - DNA, 22 bp, Homo sapiens
ggcagctggggcagtgccctgt

SEQ ID NO: 6958004 - DNA, 22 bp, Homo sapiens
tgatttacagtagtgtctaaac

SEQ ID NO: 6958005 - DNA, 22 bp, Homo sapiens
ctgtcgtctgtgctgtaggatg

SEQ ID NO: 6958006 - DNA, 22 bp, Homo sapiens
caggtgcagctggatggaagcc

SEQ ID NO: 6958007 - DNA, 22 bp, Homo sapiens
ccacaaagttgctgagtttctg

SEQ ID NO: 6958008 - DNA, 23 bp, Homo sapiens
tgtaggctgtagtttgtaggtcc

SEQ ID NO: 6958009 - DNA, 22 bp, Homo sapiens
gccctgccctctcggcactcgc

SEQ ID NO: 6958010 - DNA, 22 bp, Homo sapiens
acagattttattattcaggtat

SEQ ID NO: 6958011 - DNA, 22 bp, Homo sapiens
ttactgaattgcactccagcgt

SEQ ID NO: 6958012 - DNA, 22 bp, Homo sapiens
actctcacagtctttgacttgg

SEQ ID NO: 6958013 - DNA, 22 bp, Homo sapiens
ggtcatatctttctgattgttc

SEQ ID NO: 6958014 - DNA, 22 bp, Homo sapiens
tctcagcaacgatccggagtaa

SEQ ID NO: 6958015 - DNA, 22 bp, Homo sapiens
agcctcttccagctcctttcta

SEQ ID NO: 6958016 - DNA, 19 bp, Homo sapiens
atttattgtatgattccat

SEQ ID NO: 6958017 - DNA, 22 bp, Homo sapiens
agagcttagaatttcagatgat

SEQ ID NO: 6958018 - DNA, 22 bp, Homo sapiens
tgtggcagctggaggtggagaa

SEQ ID NO: 6958019 - DNA, 22 bp, Homo sapiens
gctagaagttgggcctggtgct

SEQ ID NO: 6958020 - DNA, 22 bp, Homo sapiens
aactgtctaaggagaatatgaa

SEQ ID NO: 6958021 - DNA, 22 bp, Homo sapiens
ggtatttatatgtctgaagctg

SEQ ID NO: 6958022 - DNA, 20 bp, Homo sapiens
agtgaatttaaataatattc

SEQ ID NO: 6958023 - DNA, 22 bp, Homo sapiens
aatcaggcgtcaggaaagatag

SEQ ID NO: 6958024 - DNA, 20 bp, Homo sapiens
tctgcagcacttgacaatgt

SEQ ID NO: 6958025 - DNA, 22 bp, Homo sapiens
agggaagcagcagccgcctgtc

SEQ ID NO: 6958026 - DNA, 22 bp, Homo sapiens
gagctaggttttccagtcgcat

SEQ ID NO: 6958027 - DNA, 22 bp, Homo sapiens
atgcggagccccaagcttgaag

SEQ ID NO: 6958028 - DNA, 22 bp, Homo sapiens
cagcaggatatggtggagagag

SEQ ID NO: 6958029 - DNA, 22 bp, Homo sapiens
tattcccagttgtggtgagtag

SEQ ID NO: 6958030 - DNA, 22 bp, Homo sapiens
gacacagaattcccctccaagt

SEQ ID NO: 6958031 - DNA, 22 bp, Homo sapiens
tgaagctggaagcatgcagact

SEQ ID NO: 6958032 - DNA, 19 bp, Homo sapiens
ggcctgaggccacagatcc

SEQ ID NO: 6958033 - DNA, 22 bp, Homo sapiens
ttgcttggcccattgcttcagt

SEQ ID NO: 6958034 - DNA, 22 bp, Homo sapiens
gacttcaaaggtcaaacatcgc

SEQ ID NO: 6958035 - DNA, 22 bp, Homo sapiens
aactcatctgggtgagtttgtc

SEQ ID NO: 6958036 - DNA, 22 bp, Homo sapiens
tattgtacagagagagaggttt

SEQ ID NO: 6958037 - DNA, 22 bp, Homo sapiens
tacaaagtgagcaacctctttt

SEQ ID NO: 6958038 - DNA, 22 bp, Homo sapiens
cccactggcaatattatgagac

SEQ ID NO: 6958039 - DNA, 22 bp, Homo sapiens
aaacctggaacatttgactagg

SEQ ID NO: 6958040 - DNA, 22 bp, Homo sapiens
cccaagttgcttgttccaagac

SEQ ID NO: 6958041 - DNA, 22 bp, Homo sapiens
gattacacgtttttaatcacat

SEQ ID NO: 6958042 - DNA, 22 bp, Homo sapiens
caagctgggtgcgggcagtata

SEQ ID NO: 6958043 - DNA, 22 bp, Homo sapiens
ctatgcagggctgggagggaaa

SEQ ID NO: 6958044 - DNA, 22 bp, Homo sapiens
ttaagcataattaaagtgaaat

SEQ ID NO: 6958045 - DNA, 22 bp, Homo sapiens
aatttcagcttaagttgtttgg

SEQ ID NO: 6958046 - DNA, 22 bp, Homo sapiens
ttgcatcagtcctcaataaaat

SEQ ID NO: 6958047 - DNA, 22 bp, Homo sapiens
tagagctatttatcagccagaa

SEQ ID NO: 6958048 - DNA, 22 bp, Homo sapiens
ctcatttaacagattaaaaagt

SEQ ID NO: 6958049 - DNA, 22 bp, Homo sapiens
ttgcatttcctgtactgtttga

SEQ ID NO: 6958050 - DNA, 22 bp, Homo sapiens
cctgagaatttgtggttcagga

SEQ ID NO: 6958051 - DNA, 22 bp, Homo sapiens
ctgagcacagaaataagatatt

SEQ ID NO: 6958052 - DNA, 22 bp, Homo sapiens
atacactgctgccacacagctg

SEQ ID NO: 6958053 - DNA, 22 bp, Homo sapiens
gtgattctaaagctttgagcag

SEQ ID NO: 6958054 - DNA, 22 bp, Homo sapiens
tgcagttctaagtagacaagtc

SEQ ID NO: 6958055 - DNA, 22 bp, Homo sapiens
cccagcctggtgcactgtgggg

SEQ ID NO: 6958056 - DNA, 22 bp, Homo sapiens
atggacaggtggataggtggat

SEQ ID NO: 6958057 - DNA, 22 bp, Homo sapiens
aggttttcacaggaagtatgtt

SEQ ID NO: 6958058 - DNA, 22 bp, Homo sapiens
aggagcttcagagagaacctgg

SEQ ID NO: 6958059 - DNA, 22 bp, Homo sapiens
atgagttcattgcatttgacag

SEQ ID NO: 6958060 - DNA, 22 bp, Homo sapiens
ttctttcccttccagcagctcc

SEQ ID NO: 6958061 - DNA, 22 bp, Homo sapiens
cacatgcccagaacttctcatt

SEQ ID NO: 6958062 - DNA, 22 bp, Homo sapiens
tgaatctggatctatgatcaat

SEQ ID NO: 6958063 - DNA, 22 bp, Homo sapiens
acatggcaggaatcatgtgttt

SEQ ID NO: 6958064 - DNA, 22 bp, Homo sapiens
gtgtagatagtttagatttcaa

SEQ ID NO: 6958065 - DNA, 17 bp, Homo sapiens
ggaggcaacagacaggg

SEQ ID NO: 6958066 - DNA, 22 bp, Homo sapiens
gagatcctcagtggattggatg

SEQ ID NO: 6958067 - DNA, 22 bp, Homo sapiens
agatgctgtgtctgttcccttg

SEQ ID NO: 6958068 - DNA, 22 bp, Homo sapiens
gctggacatccatcctgtagaa

SEQ ID NO: 6958069 - DNA, 20 bp, Homo sapiens
gccaatttttctatgtatac

SEQ ID NO: 6958070 - DNA, 22 bp, Homo sapiens
agccaggcggggcaggtttcct

SEQ ID NO: 6958071 - DNA, 22 bp, Homo sapiens
tatctgtaaaccaaggaggctt

SEQ ID NO: 6958072 - DNA, 22 bp, Homo sapiens
gtgggctgttgttccctgttct

SEQ ID NO: 6958073 - DNA, 22 bp, Homo sapiens
gctttagatactcccaatgtcc

SEQ ID NO: 6958074 - DNA, 22 bp, Homo sapiens
gctgtgagtacaaggccctggg

SEQ ID NO: 6958075 - DNA, 22 bp, Homo sapiens
ccagaatgtgtgaaatttgatg

SEQ ID NO: 6958076 - DNA, 22 bp, Homo sapiens
actggataggcgtcccgagagg

SEQ ID NO: 6958077 - DNA, 22 bp, Homo sapiens
agaaaactggagcctggggttg

SEQ ID NO: 6958078 - DNA, 22 bp, Homo sapiens
tgattacagtatttgagatcca

SEQ ID NO: 6958079 - DNA, 21 bp, Homo sapiens
agctggcctggtttgagctcc

SEQ ID NO: 6958080 - DNA, 22 bp, Homo sapiens
taggccagattactagagtagg

SEQ ID NO: 6958081 - DNA, 17 bp, Homo sapiens
gcctctgcttgtgtcat

SEQ ID NO: 6958082 - DNA, 22 bp, Homo sapiens
ggccacctgggatctcatcctg

SEQ ID NO: 6958083 - DNA, 22 bp, Homo sapiens
agttaaggcagccaccaggtca

SEQ ID NO: 6958084 - DNA, 22 bp, Homo sapiens
cttgacaagttttggacagcca

SEQ ID NO: 6958085 - DNA, 22 bp, Homo sapiens
tatttaattagtgattgtagag

SEQ ID NO: 6958086 - DNA, 22 bp, Homo sapiens
cattgtttctggagggatctgt

SEQ ID NO: 6958087 - DNA, 22 bp, Homo sapiens
ggggggtgacaagtagaggttg

SEQ ID NO: 6958088 - DNA, 22 bp, Homo sapiens
aggccttaccatagctgtagca

SEQ ID NO: 6958089 - DNA, 22 bp, Homo sapiens
ttgtgcaaggtaaagagggctt

SEQ ID NO: 6958090 - DNA, 22 bp, Homo sapiens
atgccaagtacaggcactgctc

SEQ ID NO: 6958091 - DNA, 20 bp, Homo sapiens
tacagacatgacaataatgg

SEQ ID NO: 6958092 - DNA, 22 bp, Homo sapiens
gaagggctttctgggagaagag

SEQ ID NO: 6958093 - DNA, 22 bp, Homo sapiens
gacctctcaggaatctcacatg

SEQ ID NO: 6958094 - DNA, 22 bp, Homo sapiens
ccaggctgccgaggaaagaaag

SEQ ID NO: 6958095 - DNA, 22 bp, Homo sapiens
gagactgtaagctccttgagga

SEQ ID NO: 6958096 - DNA, 22 bp, Homo sapiens
aagctaatgaggtgtgtttctg

SEQ ID NO: 6958097 - DNA, 22 bp, Homo sapiens
tcagagcttatctcttgctgga

SEQ ID NO: 6958098 - DNA, 22 bp, Homo sapiens
ccaccagatttactttactatt

SEQ ID NO: 6958099 - DNA, 21 bp, Homo sapiens
ccagactcagaagtttaacca

SEQ ID NO: 6958100 - DNA, 22 bp, Homo sapiens
gaaacctgtgctgatttgttag

SEQ ID NO: 6958101 - DNA, 22 bp, Homo sapiens
cctgcagaccacactcagtcct

SEQ ID NO: 6958102 - DNA, 22 bp, Homo sapiens
tcttgatttattctacccagaa

SEQ ID NO: 6958103 - DNA, 21 bp, Homo sapiens
agaattcttaagtattctaat

SEQ ID NO: 6958104 - DNA, 22 bp, Homo sapiens
gtggttagcgccccattcttct

SEQ ID NO: 6958105 - DNA, 22 bp, Homo sapiens
tatgaacacttattggggaagg

SEQ ID NO: 6958106 - DNA, 22 bp, Homo sapiens
gacacagctaatggcttaggac

SEQ ID NO: 6958107 - DNA, 22 bp, Homo sapiens
gaggttcagtcctgctctgtca

SEQ ID NO: 6958108 - DNA, 22 bp, Homo sapiens
gtagactgatgggactgaggta

SEQ ID NO: 6958109 - DNA, 22 bp, Homo sapiens
ccttcagcctagaacttgagag

SEQ ID NO: 6958110 - DNA, 22 bp, Homo sapiens
tggctgccttccctgctggagg

SEQ ID NO: 6958111 - DNA, 22 bp, Homo sapiens
cccagcagaatctgatgagggc

SEQ ID NO: 6958112 - DNA, 22 bp, Homo sapiens
attctgtctaagctggctacgt

SEQ ID NO: 6958113 - DNA, 22 bp, Homo sapiens
tcagatttactgcagagcagat

SEQ ID NO: 6958114 - DNA, 22 bp, Homo sapiens
cttcctctgtgtcctgggcttc

SEQ ID NO: 6958115 - DNA, 22 bp, Homo sapiens
acagtgcttctgatatgatgcc

SEQ ID NO: 6958116 - DNA, 22 bp, Homo sapiens
agggatgatggaaagaagcagg

SEQ ID NO: 6958117 - DNA, 18 bp, Homo sapiens
gaggcagctagcaatttt

SEQ ID NO: 6958118 - DNA, 22 bp, Homo sapiens
gagagtgaaggcttcccagcaa

SEQ ID NO: 6958119 - DNA, 22 bp, Homo sapiens
tgtaaacttttgcatactgctt

SEQ ID NO: 6958120 - DNA, 22 bp, Homo sapiens
tctccaatctgtagctgtttgt

SEQ ID NO: 6958121 - DNA, 22 bp, Homo sapiens
atactacaaggtatgtgctaaa

SEQ ID NO: 6958122 - DNA, 22 bp, Homo sapiens
tcccaggctcttcaaggaagac

SEQ ID NO: 6958123 - DNA, 22 bp, Homo sapiens
accttagaaagtgacaaacgaa

SEQ ID NO: 6958124 - DNA, 22 bp, Homo sapiens
gcctggccgggtcttggatttt

SEQ ID NO: 6958125 - DNA, 22 bp, Homo sapiens
gcagcaagtctagtttgtaggc

SEQ ID NO: 6958126 - DNA, 22 bp, Homo sapiens
cccattttggaacgagtagcca

SEQ ID NO: 6958127 - DNA, 22 bp, Homo sapiens
tactgttagagccagaaaccta

SEQ ID NO: 6958128 - DNA, 22 bp, Homo sapiens
ctgggcctcaagctcagatttc

SEQ ID NO: 6958129 - DNA, 22 bp, Homo sapiens
agtgtttaacttcgtcctgaag

SEQ ID NO: 6958130 - DNA, 22 bp, Homo sapiens
gaagagagaacattacataaac

SEQ ID NO: 6958131 - DNA, 22 bp, Homo sapiens
gagattgggtcttgctctgtca

SEQ ID NO: 6958132 - DNA, 22 bp, Homo sapiens
tttggtcttttgtaagttatct

SEQ ID NO: 6958133 - DNA, 22 bp, Homo sapiens
attggcttcgaaagttatatta

SEQ ID NO: 6958134 - DNA, 22 bp, Homo sapiens
tgcagccagactttgtgcgaaa

SEQ ID NO: 6958135 - DNA, 22 bp, Homo sapiens
tcacatccattaagttagaatt

SEQ ID NO: 6958136 - DNA, 22 bp, Homo sapiens
cagtaagtgtctccacttttct

SEQ ID NO: 6958137 - DNA, 22 bp, Homo sapiens
atttgcatttacatagcataga

SEQ ID NO: 6958138 - DNA, 22 bp, Homo sapiens
gtttcaagtagctgctgattat

SEQ ID NO: 6958139 - DNA, 22 bp, Homo sapiens
acagtaacaaatggcctgagga

SEQ ID NO: 6958140 - DNA, 22 bp, Homo sapiens
agcacaaaagcagccacagatg

SEQ ID NO: 6958141 - DNA, 22 bp, Homo sapiens
tggtatattttgctctatggtg

SEQ ID NO: 6958142 - DNA, 22 bp, Homo sapiens
tctggggtgtgacctgagcatg

SEQ ID NO: 6958143 - DNA, 22 bp, Homo sapiens
gggttaaacatgctatatgagt

SEQ ID NO: 6958144 - DNA, 22 bp, Homo sapiens
tctcactcatttcctaggtctt

SEQ ID NO: 6958145 - DNA, 22 bp, Homo sapiens
attttgttatcagggctttgca

SEQ ID NO: 6958146 - DNA, 22 bp, Homo sapiens
cctgtgagtcaacccctccttg

SEQ ID NO: 6958147 - DNA, 18 bp, Homo sapiens
cacagtgacttctgatac

SEQ ID NO: 6958148 - DNA, 22 bp, Homo sapiens
aggcttcacattttctaggcct

SEQ ID NO: 6958149 - DNA, 22 bp, Homo sapiens
agccaacagccagcatcaacca

SEQ ID NO: 6958150 - DNA, 22 bp, Homo sapiens
actcagtatacaccagtatagg

SEQ ID NO: 6958151 - DNA, 22 bp, Homo sapiens
tgaaacttattcagtttctacc

SEQ ID NO: 6958152 - DNA, 22 bp, Homo sapiens
actgagctcttgactgggagtt

SEQ ID NO: 6958153 - DNA, 19 bp, Homo sapiens
ggagtcactagaagccatc

SEQ ID NO: 6958154 - DNA, 22 bp, Homo sapiens
gctctaagtgagaaggtgccat

SEQ ID NO: 6958155 - DNA, 22 bp, Homo sapiens
agggatcagaatttcctccttt

SEQ ID NO: 6958156 - DNA, 20 bp, Homo sapiens
tctttagttcctggcccttt

SEQ ID NO: 6958157 - DNA, 22 bp, Homo sapiens
agactctgggattttgaaagca

SEQ ID NO: 6958158 - DNA, 22 bp, Homo sapiens
tgaagataaattgtactgaaga

SEQ ID NO: 6958159 - DNA, 22 bp, Homo sapiens
ttacagtagattttgaatgtgg

SEQ ID NO: 6958160 - DNA, 22 bp, Homo sapiens
gattctgaaattaacagactgg

SEQ ID NO: 6958161 - DNA, 22 bp, Homo sapiens
ggctctgcctgcctgagtgtcc

SEQ ID NO: 6958162 - DNA, 22 bp, Homo sapiens
tccagggtcagaagtcacatac

SEQ ID NO: 6958163 - DNA, 22 bp, Homo sapiens
atgtctcggctctaaacgatcg

SEQ ID NO: 6958164 - DNA, 22 bp, Homo sapiens
ctggctcccatgagctctcacg

SEQ ID NO: 6958165 - DNA, 19 bp, Homo sapiens
ggcgaagcgcttggagtag

SEQ ID NO: 6958166 - DNA, 22 bp, Homo sapiens
aggccagcaccagagtcaagaa

SEQ ID NO: 6958167 - DNA, 22 bp, Homo sapiens
catgcatgtcagggatcctgga

SEQ ID NO: 6958168 - DNA, 22 bp, Homo sapiens
tgtcaaacaaattaccaaactg

SEQ ID NO: 6958169 - DNA, 22 bp, Homo sapiens
ctgtgatgacaggcagggccaa

SEQ ID NO: 6958170 - DNA, 22 bp, Homo sapiens
gcattccttgttagcatttgat

SEQ ID NO: 6958171 - DNA, 22 bp, Homo sapiens
tgacagtatacttgtgatggga

SEQ ID NO: 6958172 - DNA, 22 bp, Homo sapiens
gtgcatgccctaagatatttat

SEQ ID NO: 6958173 - DNA, 22 bp, Homo sapiens
catgcatttctaccaaggaata

SEQ ID NO: 6958174 - DNA, 22 bp, Homo sapiens
ttatgatttgccacagattggt

SEQ ID NO: 6958175 - DNA, 22 bp, Homo sapiens
tgtgaacattcagatcaagctc

SEQ ID NO: 6958176 - DNA, 22 bp, Homo sapiens
tttatctgttgtacatttatgc

SEQ ID NO: 6958177 - DNA, 22 bp, Homo sapiens
ttcatagtgcttaatttgataa

SEQ ID NO: 6958178 - DNA, 22 bp, Homo sapiens
ctgtgactgggtgacagtcctc

SEQ ID NO: 6958179 - DNA, 22 bp, Homo sapiens
gatgtctggctaccactcgcac

SEQ ID NO: 6958180 - DNA, 22 bp, Homo sapiens
cctctgtgggccgggcctgctg

SEQ ID NO: 6958181 - DNA, 22 bp, Homo sapiens
gaggagctctgctccatccttc

SEQ ID NO: 6958182 - DNA, 22 bp, Homo sapiens
ggctaccagataaattacagag

SEQ ID NO: 6958183 - DNA, 22 bp, Homo sapiens
ttcgggaatttgttggtgattt

SEQ ID NO: 6958184 - DNA, 22 bp, Homo sapiens
tggcttcagttcctgtgttgtt

SEQ ID NO: 6958185 - DNA, 21 bp, Homo sapiens
ggacactgataatcttgttgc

SEQ ID NO: 6958186 - DNA, 22 bp, Homo sapiens
ttattattgtggttgcattatc

SEQ ID NO: 6958187 - DNA, 22 bp, Homo sapiens
aatgcaaacagcccagaatcca

SEQ ID NO: 6958188 - DNA, 22 bp, Homo sapiens
tgtgatcaggtgatcatgtgag

SEQ ID NO: 6958189 - DNA, 22 bp, Homo sapiens
agctgccaggcccctgagaacc

SEQ ID NO: 6958190 - DNA, 22 bp, Homo sapiens
tgcttctcagcctgtctggaaa

SEQ ID NO: 6958191 - DNA, 21 bp, Homo sapiens
tgctttgcaggtggatttagt

SEQ ID NO: 6958192 - DNA, 22 bp, Homo sapiens
aggcagctaagatggataatga

SEQ ID NO: 6958193 - DNA, 22 bp, Homo sapiens
atgtggatctgttattctagat

SEQ ID NO: 6958194 - DNA, 22 bp, Homo sapiens
atgaagcaattagaaacttgaa

SEQ ID NO: 6958195 - DNA, 22 bp, Homo sapiens
tctgcaaggttcaggaaacctt

SEQ ID NO: 6958196 - DNA, 22 bp, Homo sapiens
agatcatatgaaaaatttcaag

SEQ ID NO: 6958197 - DNA, 22 bp, Homo sapiens
caggcactagcagaatgaggct

SEQ ID NO: 6958198 - DNA, 19 bp, Homo sapiens
tgtgacatcactgggcagc

SEQ ID NO: 6958199 - DNA, 22 bp, Homo sapiens
atcgaggagagttggtttgttt

SEQ ID NO: 6958200 - DNA, 22 bp, Homo sapiens
cactttattataaatttgagag

SEQ ID NO: 6958201 - DNA, 22 bp, Homo sapiens
aattctgagaacaaaaggtact

SEQ ID NO: 6958202 - DNA, 22 bp, Homo sapiens
catatttagtgtttggagatcg

SEQ ID NO: 6958203 - DNA, 22 bp, Homo sapiens
ttcattcacccaggaaacatct

SEQ ID NO: 6958204 - DNA, 22 bp, Homo sapiens
tggggagagattgaggagtttt

SEQ ID NO: 6958205 - DNA, 22 bp, Homo sapiens
aatataacacagatggcctgtt

SEQ ID NO: 6958206 - DNA, 22 bp, Homo sapiens
atgttcattttcttaatgtgcc

SEQ ID NO: 6958207 - DNA, 22 bp, Homo sapiens
actttggattgggtccctccca

SEQ ID NO: 6958208 - DNA, 22 bp, Homo sapiens
tctggctgggtgagagcttctc

SEQ ID NO: 6958209 - DNA, 22 bp, Homo sapiens
gggctttttacattgaacattt

SEQ ID NO: 6958210 - DNA, 22 bp, Homo sapiens
caatagaaggcacagataggta

SEQ ID NO: 6958211 - DNA, 22 bp, Homo sapiens
ttagtgtctttcaaaaggttta

SEQ ID NO: 6958212 - DNA, 20 bp, Homo sapiens
tggcctctgtagaggccaag

SEQ ID NO: 6958213 - DNA, 22 bp, Homo sapiens
ttcacatttgaaaggaaagata

SEQ ID NO: 6958214 - DNA, 22 bp, Homo sapiens
ctgtgctgggtccttcttttga

SEQ ID NO: 6958215 - DNA, 22 bp, Homo sapiens
tccaaattgacagtagtgatta

SEQ ID NO: 6958216 - DNA, 22 bp, Homo sapiens
atgactctaagaattctagatg

SEQ ID NO: 6958217 - DNA, 22 bp, Homo sapiens
tgaagcaactggacaagttggc

SEQ ID NO: 6958218 - DNA, 22 bp, Homo sapiens
acacagtagtgtggaaaaacat

SEQ ID NO: 6958219 - DNA, 22 bp, Homo sapiens
gctgccatcccctgctgggctg

SEQ ID NO: 6958220 - DNA, 22 bp, Homo sapiens
gccagcttttgaccccgttgtg

SEQ ID NO: 6958221 - DNA, 22 bp, Homo sapiens
caggtcctgccttggttaccct

SEQ ID NO: 6958222 - DNA, 22 bp, Homo sapiens
cagcaacccgggggacctttct

SEQ ID NO: 6958223 - DNA, 22 bp, Homo sapiens
tctagggtggagctgggaatcc

SEQ ID NO: 6958224 - DNA, 19 bp, Homo sapiens
actcttttccttttgaatc

SEQ ID NO: 6958225 - DNA, 22 bp, Homo sapiens
atgtcattaaaattgtgctgca

SEQ ID NO: 6958226 - DNA, 22 bp, Homo sapiens
aggatggattctgtatgtggga

SEQ ID NO: 6958227 - DNA, 22 bp, Homo sapiens
agggccacagtaatgctgagta

SEQ ID NO: 6958228 - DNA, 22 bp, Homo sapiens
agccctctgcaaacacctgata

SEQ ID NO: 6958229 - DNA, 22 bp, Homo sapiens
ctttctccagagctgcttattt

SEQ ID NO: 6958230 - DNA, 22 bp, Homo sapiens
ttgccatttagtatgcttgtat

SEQ ID NO: 6958231 - DNA, 19 bp, Homo sapiens
tccctgcgtttcggcccac

SEQ ID NO: 6958232 - DNA, 22 bp, Homo sapiens
ctctgagcagaggccgtggcta

SEQ ID NO: 6958233 - DNA, 22 bp, Homo sapiens
ggccctgatctcctggattctt

SEQ ID NO: 6958234 - DNA, 22 bp, Homo sapiens
gggtggcacaggtgcagagggt

SEQ ID NO: 6958235 - DNA, 22 bp, Homo sapiens
gtcaggatcaaattgaagttat

SEQ ID NO: 6958236 - DNA, 22 bp, Homo sapiens
tcagatggaggcaatgttacct

SEQ ID NO: 6958237 - DNA, 22 bp, Homo sapiens
tggtcgggagcgagcagctatt

SEQ ID NO: 6958238 - DNA, 22 bp, Homo sapiens
tttcaagagcaggaaaaaggtc

SEQ ID NO: 6958239 - DNA, 22 bp, Homo sapiens
ttgattcatttattgagtgcct

SEQ ID NO: 6958240 - DNA, 22 bp, Homo sapiens
tacatgtggagttttctagtca

SEQ ID NO: 6958241 - DNA, 22 bp, Homo sapiens
tctccaaggccctactctattt

SEQ ID NO: 6958242 - DNA, 22 bp, Homo sapiens
gccagaagcacatgagaggtga

SEQ ID NO: 6958243 - DNA, 22 bp, Homo sapiens
acttcagagttagttatagacc

SEQ ID NO: 6958244 - DNA, 22 bp, Homo sapiens
aggggcctggacatggacgcgc

SEQ ID NO: 6958245 - DNA, 22 bp, Homo sapiens
aacacttcccgaccatatggct

SEQ ID NO: 6958246 - DNA, 22 bp, Homo sapiens
aagagccttggcaatgagtcct

SEQ ID NO: 6958247 - DNA, 17 bp, Homo sapiens
attgtctcttcacttat

SEQ ID NO: 6958248 - DNA, 22 bp, Homo sapiens
gtttataatgtctgtgccaaaa

SEQ ID NO: 6958249 - DNA, 22 bp, Homo sapiens
agcatttattgacctgctgctg

SEQ ID NO: 6958250 - DNA, 22 bp, Homo sapiens
ttttctaaaatatccaggacag

SEQ ID NO: 6958251 - DNA, 22 bp, Homo sapiens
catcactgacgctgagattcca

SEQ ID NO: 6958252 - DNA, 19 bp, Homo sapiens
agttcttgtcctgtctgtt

SEQ ID NO: 6958253 - DNA, 22 bp, Homo sapiens
atgttctttggaatttatgaaa

SEQ ID NO: 6958254 - DNA, 22 bp, Homo sapiens
tgacacttcaaagaccagggtc

SEQ ID NO: 6958255 - DNA, 22 bp, Homo sapiens
agctgcaatacccttcttcctt

SEQ ID NO: 6958256 - DNA, 22 bp, Homo sapiens
aggcctgcctggatcacacaga

SEQ ID NO: 6958257 - DNA, 22 bp, Homo sapiens
tccctcagcaggaatgtggcag

SEQ ID NO: 6958258 - DNA, 18 bp, Homo sapiens
atgggcaggtaagatcca

SEQ ID NO: 6958259 - DNA, 22 bp, Homo sapiens
ttcactaattcagtgtttgcgg

SEQ ID NO: 6958260 - DNA, 22 bp, Homo sapiens
ctcagcatcatggtatctgggg

SEQ ID NO: 6958261 - DNA, 22 bp, Homo sapiens
gaggctaaggttctgccagaag

SEQ ID NO: 6958262 - DNA, 22 bp, Homo sapiens
gctgagttggagatcactttga

SEQ ID NO: 6958263 - DNA, 20 bp, Homo sapiens
aattctgtcttttctgctgc

SEQ ID NO: 6958264 - DNA, 22 bp, Homo sapiens
cacattcatggagtttgcctgt

SEQ ID NO: 6958265 - DNA, 22 bp, Homo sapiens
atgcaaatggcaatgagtgacc

SEQ ID NO: 6958266 - DNA, 22 bp, Homo sapiens
aatgtatctgccacgatgctat

SEQ ID NO: 6958267 - DNA, 22 bp, Homo sapiens
tttaaatttagaagaaacactg

SEQ ID NO: 6958268 - DNA, 22 bp, Homo sapiens
tcatgcatctgggctggctggt

SEQ ID NO: 6958269 - DNA, 22 bp, Homo sapiens
gcatgtgttcttgaaaggccac

SEQ ID NO: 6958270 - DNA, 22 bp, Homo sapiens
agtgggagccagcagcttgggg

SEQ ID NO: 6958271 - DNA, 19 bp, Homo sapiens
cttccaactgtgatctaga

SEQ ID NO: 6958272 - DNA, 22 bp, Homo sapiens
tcacagaagttgaatttgcatg

SEQ ID NO: 6958273 - DNA, 20 bp, Homo sapiens
gctgtggcaaagctttgtgt

SEQ ID NO: 6958274 - DNA, 16 bp, Homo sapiens
ctgaggtttggccaca

SEQ ID NO: 6958275 - DNA, 20 bp, Homo sapiens
ttgcattggatgtgcaggtg

SEQ ID NO: 6958276 - DNA, 22 bp, Homo sapiens
tgagcaggagataaacaggtag

SEQ ID NO: 6958277 - DNA, 22 bp, Homo sapiens
tcacatgctcacctaagccaca

SEQ ID NO: 6958278 - DNA, 22 bp, Homo sapiens
tgtgagcatatgttttcagctc

SEQ ID NO: 6958279 - DNA, 22 bp, Homo sapiens
ttcttggccaccagatctcact

SEQ ID NO: 6958280 - DNA, 22 bp, Homo sapiens
tcctgtttctcctgcaaaatcc

SEQ ID NO: 6958281 - DNA, 22 bp, Homo sapiens
gggatggtggcttgcatctgta

SEQ ID NO: 6958282 - DNA, 22 bp, Homo sapiens
ctttgcagatttgtttagtgct

SEQ ID NO: 6958283 - DNA, 22 bp, Homo sapiens
agctgcctggccggagccactg

SEQ ID NO: 6958284 - DNA, 18 bp, Homo sapiens
gatgtaaaatagtagctt

SEQ ID NO: 6958285 - DNA, 22 bp, Homo sapiens
tgttgcctaactgccctctgaa

SEQ ID NO: 6958286 - DNA, 22 bp, Homo sapiens
ttaatggattggaggtttcaat

SEQ ID NO: 6958287 - DNA, 23 bp, Homo sapiens
gcagatggccccagagtgctgcc

SEQ ID NO: 6958288 - DNA, 22 bp, Homo sapiens
agtcagtgttctccggagaggc

SEQ ID NO: 6958289 - DNA, 22 bp, Homo sapiens
ctccaggccatggctgcggagg

SEQ ID NO: 6958290 - DNA, 22 bp, Homo sapiens
tgagccaaggcctcaagaattt

SEQ ID NO: 6958291 - DNA, 22 bp, Homo sapiens
ctattcactgtggcagagggag

SEQ ID NO: 6958292 - DNA, 22 bp, Homo sapiens
caatctatcctctgattttgta

SEQ ID NO: 6958293 - DNA, 22 bp, Homo sapiens
actgtagctgccactggatgca

SEQ ID NO: 6958294 - DNA, 22 bp, Homo sapiens
ggctgctggcattgaggtaggt

SEQ ID NO: 6958295 - DNA, 22 bp, Homo sapiens
taaacgggagcgtgggctagtg

SEQ ID NO: 6958296 - DNA, 18 bp, Homo sapiens
aagaatctctgactcttt

SEQ ID NO: 6958297 - DNA, 22 bp, Homo sapiens
gtgttttggccattagtgtgat

SEQ ID NO: 6958298 - DNA, 22 bp, Homo sapiens
ggaccctggagacccactggga

SEQ ID NO: 6958299 - DNA, 22 bp, Homo sapiens
tttgaatatacttcaaacaaag

SEQ ID NO: 6958300 - DNA, 22 bp, Homo sapiens
tctgtcatctgtaacaggaggg

SEQ ID NO: 6958301 - DNA, 22 bp, Homo sapiens
caggccaggtgctctagaatca

SEQ ID NO: 6958302 - DNA, 22 bp, Homo sapiens
gatgattctgtgtttggaatgc

SEQ ID NO: 6958303 - DNA, 23 bp, Homo sapiens
ttgcttgcctttagtcaggacca

SEQ ID NO: 6958304 - DNA, 22 bp, Homo sapiens
ttttctctacaaaataaccagc

SEQ ID NO: 6958305 - DNA, 22 bp, Homo sapiens
atctactcagtaactgcttagg

SEQ ID NO: 6958306 - DNA, 22 bp, Homo sapiens
tagggaagtgtataggggtcat

SEQ ID NO: 6958307 - DNA, 22 bp, Homo sapiens
aagctggactctgccatttact

SEQ ID NO: 6958308 - DNA, 22 bp, Homo sapiens
cgtcaggtccccagtgaagttg

SEQ ID NO: 6958309 - DNA, 19 bp, Homo sapiens
gagtttatctcctagccct

SEQ ID NO: 6958310 - DNA, 22 bp, Homo sapiens
ttcgcccatcatgtctgtagaa

SEQ ID NO: 6958311 - DNA, 22 bp, Homo sapiens
aattcctagtccagatgtgttg

SEQ ID NO: 6958312 - DNA, 22 bp, Homo sapiens
gcccaggagaggccagggctga

SEQ ID NO: 6958313 - DNA, 22 bp, Homo sapiens
aatttcagctcaaacttgtgtt

SEQ ID NO: 6958314 - DNA, 16 bp, Homo sapiens
ccagatgaatgggagt

SEQ ID NO: 6958315 - DNA, 22 bp, Homo sapiens
gttaacaaccaaacagaagttc

SEQ ID NO: 6958316 - DNA, 22 bp, Homo sapiens
gtaattacatgagtactgtaag

SEQ ID NO: 6958317 - DNA, 22 bp, Homo sapiens
gaatacctggtcccacatctca

SEQ ID NO: 6958318 - DNA, 22 bp, Homo sapiens
agaggccctgggctggtgtgct

SEQ ID NO: 6958319 - DNA, 18 bp, Homo sapiens
ggggagcagactgaactc

SEQ ID NO: 6958320 - DNA, 22 bp, Homo sapiens
cggcccgctgcgagtgcaccgt

SEQ ID NO: 6958321 - DNA, 22 bp, Homo sapiens
cccaggactcggcactctcctt

SEQ ID NO: 6958322 - DNA, 22 bp, Homo sapiens
ctgattctttcttcttgccagg

SEQ ID NO: 6958323 - DNA, 22 bp, Homo sapiens
agatacatcatttataccttca

SEQ ID NO: 6958324 - DNA, 22 bp, Homo sapiens
gacagtttctgaatgcgtactt

SEQ ID NO: 6958325 - DNA, 23 bp, Homo sapiens
tcctccaaccagcagctgcataa

SEQ ID NO: 6958326 - DNA, 22 bp, Homo sapiens
acatttctcctacttgttattt

SEQ ID NO: 6958327 - DNA, 22 bp, Homo sapiens
caggcagccctgcaccaagtgt

SEQ ID NO: 6958328 - DNA, 22 bp, Homo sapiens
gagcttcctcagcctttctcac

SEQ ID NO: 6958329 - DNA, 22 bp, Homo sapiens
gccttccctctcatcctgctgg

SEQ ID NO: 6958330 - DNA, 22 bp, Homo sapiens
agaccagtgcatggcgtttgct

SEQ ID NO: 6958331 - DNA, 22 bp, Homo sapiens
ttaggaaagggttttctaacag

SEQ ID NO: 6958332 - DNA, 22 bp, Homo sapiens
agcagttatgtgtctcttgact

SEQ ID NO: 6958333 - DNA, 22 bp, Homo sapiens
tttgcatgggaggtagtaatca

SEQ ID NO: 6958334 - DNA, 22 bp, Homo sapiens
ctatttggatgttagcctcagt

SEQ ID NO: 6958335 - DNA, 22 bp, Homo sapiens
gcaaatatttctaattcctgaa

SEQ ID NO: 6958336 - DNA, 22 bp, Homo sapiens
gctcatgtgtgattacagtttt

SEQ ID NO: 6958337 - DNA, 22 bp, Homo sapiens
agtttccagcacagggcaagct

SEQ ID NO: 6958338 - DNA, 22 bp, Homo sapiens
tttatcagagatatgtgtggac

SEQ ID NO: 6958339 - DNA, 18 bp, Homo sapiens
gtcttttctcccttcctc

SEQ ID NO: 6958340 - DNA, 22 bp, Homo sapiens
ttaaagaggcatgggaatgtat

SEQ ID NO: 6958341 - DNA, 22 bp, Homo sapiens
tacagagggtaattgatcaagg

SEQ ID NO: 6958342 - DNA, 22 bp, Homo sapiens
acaggtggcttattggctgatt

SEQ ID NO: 6958343 - DNA, 22 bp, Homo sapiens
tcagagagcagaacttttttac

SEQ ID NO: 6958344 - DNA, 22 bp, Homo sapiens
agtggtgaggggcatgtgtgat

SEQ ID NO: 6958345 - DNA, 22 bp, Homo sapiens
tctattgtaggcatgtagcttg

SEQ ID NO: 6958346 - DNA, 22 bp, Homo sapiens
tgaatgattaaaacccggacta

SEQ ID NO: 6958347 - DNA, 22 bp, Homo sapiens
agagggtggtgaggcctggttc

SEQ ID NO: 6958348 - DNA, 21 bp, Homo sapiens
agcaccttcaattctattgtc

SEQ ID NO: 6958349 - DNA, 23 bp, Homo sapiens
gccatcctaaaacccctgtctgt

SEQ ID NO: 6958350 - DNA, 22 bp, Homo sapiens
ctaaggcaccgaggcaggagcg

SEQ ID NO: 6958351 - DNA, 22 bp, Homo sapiens
gataacatttgtatagcgcttt

SEQ ID NO: 6958352 - DNA, 22 bp, Homo sapiens
ctgagaatggacagcagggcag

SEQ ID NO: 6958353 - DNA, 22 bp, Homo sapiens
gggcagtggtccaggctacagc

SEQ ID NO: 6958354 - DNA, 22 bp, Homo sapiens
tgagatttgagggttaatctga

SEQ ID NO: 6958355 - DNA, 22 bp, Homo sapiens
agaaatgttcttcatttgccat

SEQ ID NO: 6958356 - DNA, 22 bp, Homo sapiens
caaagtggagagcctgtggttg

SEQ ID NO: 6958357 - DNA, 20 bp, Homo sapiens
agaagaggatacaaccaggc

SEQ ID NO: 6958358 - DNA, 22 bp, Homo sapiens
agcaggtgttagggatccaatg

SEQ ID NO: 6958359 - DNA, 22 bp, Homo sapiens
ccagagggcctttggagttatc

SEQ ID NO: 6958360 - DNA, 22 bp, Homo sapiens
gggcaattcacagggttgttat

SEQ ID NO: 6958361 - DNA, 22 bp, Homo sapiens
gaggcagggtgttgattacaga

SEQ ID NO: 6958362 - DNA, 22 bp, Homo sapiens
ctcagctccaggtgtgcatctt

SEQ ID NO: 6958363 - DNA, 22 bp, Homo sapiens
aacttagttggggacaccatgg

SEQ ID NO: 6958364 - DNA, 21 bp, Homo sapiens
ccagactggcctatgtggtag

SEQ ID NO: 6958365 - DNA, 22 bp, Homo sapiens
agttgcactttctagatactgt

SEQ ID NO: 6958366 - DNA, 22 bp, Homo sapiens
ctggtgccctgtgtggcaggag

SEQ ID NO: 6958367 - DNA, 22 bp, Homo sapiens
gaggcttctgttcactcacgct

SEQ ID NO: 6958368 - DNA, 22 bp, Homo sapiens
gtggcttcaccccagttgtctc

SEQ ID NO: 6958369 - DNA, 22 bp, Homo sapiens
ttcctgagaacatggcagctta

SEQ ID NO: 6958370 - DNA, 22 bp, Homo sapiens
agcaccatgaccttgccattga

SEQ ID NO: 6958371 - DNA, 22 bp, Homo sapiens
atggtcttgggcttaggcagag

SEQ ID NO: 6958372 - DNA, 22 bp, Homo sapiens
tcaaacagaggaacaattgttt

SEQ ID NO: 6958373 - DNA, 22 bp, Homo sapiens
ggtcctcaatcccaacaaggca

SEQ ID NO: 6958374 - DNA, 22 bp, Homo sapiens
ggcaggcgtggtggcctcagaa

SEQ ID NO: 6958375 - DNA, 23 bp, Homo sapiens
tcagtgtgcaagaatggagaagc

SEQ ID NO: 6958376 - DNA, 22 bp, Homo sapiens
ggtctgaggctccaaggaggtg

SEQ ID NO: 6958377 - DNA, 22 bp, Homo sapiens
tcagaggaatctgtacttgaaa

SEQ ID NO: 6958378 - DNA, 22 bp, Homo sapiens
cagaaatggagcccaggaatct

SEQ ID NO: 6958379 - DNA, 22 bp, Homo sapiens
tgtatatgcactttccttatcc

SEQ ID NO: 6958380 - DNA, 22 bp, Homo sapiens
ctatgttctcggcactatggat

SEQ ID NO: 6958381 - DNA, 16 bp, Homo sapiens
tgggcagatgagaaga

SEQ ID NO: 6958382 - DNA, 23 bp, Homo sapiens
agtcattaagaagttcaggaact

SEQ ID NO: 6958383 - DNA, 22 bp, Homo sapiens
ttttacttcattcctgacttca

SEQ ID NO: 6958384 - DNA, 22 bp, Homo sapiens
ggagaggtgtattcagtgggtc

SEQ ID NO: 6958385 - DNA, 22 bp, Homo sapiens
agaactgtcacgagtgacaaag

SEQ ID NO: 6958386 - DNA, 22 bp, Homo sapiens
agcaggctttcaagagtcttct

SEQ ID NO: 6958387 - DNA, 22 bp, Homo sapiens
catagctgtgtgccatgtaaaa

SEQ ID NO: 6958388 - DNA, 22 bp, Homo sapiens
tggcactggaatcgtagccttg

SEQ ID NO: 6958389 - DNA, 22 bp, Homo sapiens
ctggaaagacagagggcatggg

SEQ ID NO: 6958390 - DNA, 22 bp, Homo sapiens
tcagctcctatactttgtcctg

SEQ ID NO: 6958391 - DNA, 22 bp, Homo sapiens
aacagctagtaccaatccacta

SEQ ID NO: 6958392 - DNA, 22 bp, Homo sapiens
tggctgtgcggcctcgggcaga

SEQ ID NO: 6958393 - DNA, 22 bp, Homo sapiens
cagaggtgttggtgaatggaga

SEQ ID NO: 6958394 - DNA, 22 bp, Homo sapiens
gtgctgtatatgcaagaggaag

SEQ ID NO: 6958395 - DNA, 22 bp, Homo sapiens
aaagttactatcacaatgaaat

SEQ ID NO: 6958396 - DNA, 22 bp, Homo sapiens
tgacaatagcgatttatcttgc

SEQ ID NO: 6958397 - DNA, 22 bp, Homo sapiens
aaccttcctgaggaaagtctaa

SEQ ID NO: 6958398 - DNA, 22 bp, Homo sapiens
ttcaaccaggttaattcactac

SEQ ID NO: 6958399 - DNA, 22 bp, Homo sapiens
attcctgagacttatctgtttc

SEQ ID NO: 6958400 - DNA, 22 bp, Homo sapiens
ttcacctggcacatgtgagcct

SEQ ID NO: 6958401 - DNA, 22 bp, Homo sapiens
tttgttttcaatgtgtcattca

SEQ ID NO: 6958402 - DNA, 22 bp, Homo sapiens
agccagctgttctggggcagca

SEQ ID NO: 6958403 - DNA, 22 bp, Homo sapiens
tcttccagtgtagacatctgcc

SEQ ID NO: 6958404 - DNA, 22 bp, Homo sapiens
tgcaggacagtttggaagagag

SEQ ID NO: 6958405 - DNA, 22 bp, Homo sapiens
catgttgtgaaggaaaatgggc

SEQ ID NO: 6958406 - DNA, 22 bp, Homo sapiens
gcacaattatttatgcagtatg

SEQ ID NO: 6958407 - DNA, 22 bp, Homo sapiens
taacactgtgcccagagtccca

SEQ ID NO: 6958408 - DNA, 22 bp, Homo sapiens
cacagaggtgatagtggtcaag

SEQ ID NO: 6958409 - DNA, 22 bp, Homo sapiens
tgagtcctaaagctgtgccctt

SEQ ID NO: 6958410 - DNA, 14 bp, Homo sapiens
atggtacaggggct

SEQ ID NO: 6958411 - DNA, 22 bp, Homo sapiens
tgggatgagaagtgcgagggtt

SEQ ID NO: 6958412 - DNA, 22 bp, Homo sapiens
agccttgcaaaatttttggcaa

SEQ ID NO: 6958413 - DNA, 22 bp, Homo sapiens
gaggccctccagctgtcagctg

SEQ ID NO: 6958414 - DNA, 22 bp, Homo sapiens
gctttgaagacttttccagggt

SEQ ID NO: 6958415 - DNA, 22 bp, Homo sapiens
atacagccagcttcctgacctt

SEQ ID NO: 6958416 - DNA, 22 bp, Homo sapiens
accaggagacatgaccaatgag

SEQ ID NO: 6958417 - DNA, 22 bp, Homo sapiens
caaggtttctatgctcaaagga

SEQ ID NO: 6958418 - DNA, 22 bp, Homo sapiens
tttggaatggtaccttcagttg

SEQ ID NO: 6958419 - DNA, 22 bp, Homo sapiens
cagatagcaaatgggtaagcta

SEQ ID NO: 6958420 - DNA, 22 bp, Homo sapiens
tggaatgtttccccagcctgca

SEQ ID NO: 6958421 - DNA, 22 bp, Homo sapiens
agtggcccctagggaacagcct

SEQ ID NO: 6958422 - DNA, 22 bp, Homo sapiens
tcaaggttgagtaaattgttgg

SEQ ID NO: 6958423 - DNA, 23 bp, Homo sapiens
tcaactgctctgggaaggtcccc

SEQ ID NO: 6958424 - DNA, 23 bp, Homo sapiens
tgcctcagtggaatgtgagggtg

SEQ ID NO: 6958425 - DNA, 22 bp, Homo sapiens
tcctggttgttgttatagtata

SEQ ID NO: 6958426 - DNA, 21 bp, Homo sapiens
tggctctgaaagagtgctgca

SEQ ID NO: 6958427 - DNA, 22 bp, Homo sapiens
tatgcatagtgatttagaacag

SEQ ID NO: 6958428 - DNA, 22 bp, Homo sapiens
gcaggtgattcaccctgggcct

SEQ ID NO: 6958429 - DNA, 22 bp, Homo sapiens
aatatgatgccaaattgctaca

SEQ ID NO: 6958430 - DNA, 22 bp, Homo sapiens
catgtgtggttacctacttgac

SEQ ID NO: 6958431 - DNA, 22 bp, Homo sapiens
cttacatttaatcatgtgtcat

SEQ ID NO: 6958432 - DNA, 22 bp, Homo sapiens
cactctggttctgaacaggatc

SEQ ID NO: 6958433 - DNA, 19 bp, Homo sapiens
gtggctgccgatcgcggct

SEQ ID NO: 6958434 - DNA, 22 bp, Homo sapiens
tggcatggagtggatggcccca

SEQ ID NO: 6958435 - DNA, 22 bp, Homo sapiens
tcatcgcctcgtgcatcttggc

SEQ ID NO: 6958436 - DNA, 22 bp, Homo sapiens
gtgttaaaatgctttatagtag

SEQ ID NO: 6958437 - DNA, 22 bp, Homo sapiens
agggcatgtgggagaggagcct

SEQ ID NO: 6958438 - DNA, 22 bp, Homo sapiens
aaagccaggggagggattccca

SEQ ID NO: 6958439 - DNA, 22 bp, Homo sapiens
gaagcgcggcgtcggcgtgggt

SEQ ID NO: 6958440 - DNA, 22 bp, Homo sapiens
ttcaatacaaagaaaggaattt

SEQ ID NO: 6958441 - DNA, 22 bp, Homo sapiens
tggcagggagttcgttcacaac

SEQ ID NO: 6958442 - DNA, 20 bp, Homo sapiens
ttgaagaggatatatcgctc

SEQ ID NO: 6958443 - DNA, 22 bp, Homo sapiens
agccaagctgatctcctgctga

SEQ ID NO: 6958444 - DNA, 22 bp, Homo sapiens
gtgagttgggggattagaagct

SEQ ID NO: 6958445 - DNA, 22 bp, Homo sapiens
taaggagggggaatgattggca

SEQ ID NO: 6958446 - DNA, 22 bp, Homo sapiens
caggcacatgggagctcatcat

SEQ ID NO: 6958447 - DNA, 22 bp, Homo sapiens
cttgcctccctcagctcacagc

SEQ ID NO: 6958448 - DNA, 22 bp, Homo sapiens
aggtagaggcctccaggcagca

SEQ ID NO: 6958449 - DNA, 22 bp, Homo sapiens
tggactcagagttggtggcagt

SEQ ID NO: 6958450 - DNA, 22 bp, Homo sapiens
tttgcataggatggacatttta

SEQ ID NO: 6958451 - DNA, 22 bp, Homo sapiens
atctttcactttttgtggatga

SEQ ID NO: 6958452 - DNA, 22 bp, Homo sapiens
ccttcagaatgaaattctaatg

SEQ ID NO: 6958453 - DNA, 22 bp, Homo sapiens
cctctggccatcccccattaag

SEQ ID NO: 6958454 - DNA, 22 bp, Homo sapiens
aaagtgtggtcgttcattttgt

SEQ ID NO: 6958455 - DNA, 22 bp, Homo sapiens
gctgcctagttctttatgtgaa

SEQ ID NO: 6958456 - DNA, 22 bp, Homo sapiens
ctttgtctcctaagaactctca

SEQ ID NO: 6958457 - DNA, 22 bp, Homo sapiens
ctcaggatttactaatttcaag

SEQ ID NO: 6958458 - DNA, 21 bp, Homo sapiens
tgccttggcaaatgaccatga

SEQ ID NO: 6958459 - DNA, 21 bp, Homo sapiens
ttagctttctagaatctttgt

SEQ ID NO: 6958460 - DNA, 22 bp, Homo sapiens
agagggcagcagcaacaactct

SEQ ID NO: 6958461 - DNA, 22 bp, Homo sapiens
aagcagtgataagagctaccat

SEQ ID NO: 6958462 - DNA, 22 bp, Homo sapiens
cagctttgagcagccagtggca

SEQ ID NO: 6958463 - DNA, 22 bp, Homo sapiens
agccagcaggtgagtgcagcct

SEQ ID NO: 6958464 - DNA, 22 bp, Homo sapiens
ttgctgggctcttcaacacaca

SEQ ID NO: 6958465 - DNA, 22 bp, Homo sapiens
tcaaggaagtcttattgcacag

SEQ ID NO: 6958466 - DNA, 19 bp, Homo sapiens
ccacagcctgctgtcttcc

SEQ ID NO: 6958467 - DNA, 22 bp, Homo sapiens
tagataacttgcacctacagga

SEQ ID NO: 6958468 - DNA, 22 bp, Homo sapiens
atggctggcatccaggtgggct

SEQ ID NO: 6958469 - DNA, 22 bp, Homo sapiens
gacagtttaagcacctaatatt

SEQ ID NO: 6958470 - DNA, 22 bp, Homo sapiens
acatgaaaagactatctgatta

SEQ ID NO: 6958471 - DNA, 22 bp, Homo sapiens
tttagctggcagttacagatgt

SEQ ID NO: 6958472 - DNA, 22 bp, Homo sapiens
gagtttaaaaagcctggtttgt

SEQ ID NO: 6958473 - DNA, 19 bp, Homo sapiens
aggcagcaggccagggatg

SEQ ID NO: 6958474 - DNA, 22 bp, Homo sapiens
gcttacaagccagctgtaccac

SEQ ID NO: 6958475 - DNA, 22 bp, Homo sapiens
aagtgtacagcaacttctcagc

SEQ ID NO: 6958476 - DNA, 22 bp, Homo sapiens
tctctgagggagatggcctgcc

SEQ ID NO: 6958477 - DNA, 22 bp, Homo sapiens
tctcttcatttgctatgggtca

SEQ ID NO: 6958478 - DNA, 22 bp, Homo sapiens
tatccatttattttctaggcaa

SEQ ID NO: 6958479 - DNA, 22 bp, Homo sapiens
ttgcagcagggtgaattcactc

SEQ ID NO: 6958480 - DNA, 21 bp, Homo sapiens
tacaagaccggattcgggccc

SEQ ID NO: 6958481 - DNA, 22 bp, Homo sapiens
ctccttaaagggagcagcagct

SEQ ID NO: 6958482 - DNA, 23 bp, Homo sapiens
tattacaattggtcttattaaga

SEQ ID NO: 6958483 - DNA, 22 bp, Homo sapiens
ttggtaaatactctttggagac

SEQ ID NO: 6958484 - DNA, 23 bp, Homo sapiens
gaggtcaaggctgcagtgattgc

SEQ ID NO: 6958485 - DNA, 22 bp, Homo sapiens
ggcctgagtcacatcaggagag

SEQ ID NO: 6958486 - DNA, 22 bp, Homo sapiens
tcattgtattaaaatattggtt

SEQ ID NO: 6958487 - DNA, 22 bp, Homo sapiens
tggcccaggcgaggtgggcaga

SEQ ID NO: 6958488 - DNA, 22 bp, Homo sapiens
caagtccaacagtttttcagac

SEQ ID NO: 6958489 - DNA, 22 bp, Homo sapiens
ggctcctgctgtcctttgaagc

SEQ ID NO: 6958490 - DNA, 19 bp, Homo sapiens
gaatttatctcttcagtcc

SEQ ID NO: 6958491 - DNA, 22 bp, Homo sapiens
ccactgaggcaggcagtatcta

SEQ ID NO: 6958492 - DNA, 20 bp, Homo sapiens
tggaatgggtccttgaaaaa

SEQ ID NO: 6958493 - DNA, 22 bp, Homo sapiens
cctcggaatctattctagttac

SEQ ID NO: 6958494 - DNA, 22 bp, Homo sapiens
aggtagagctccagtagaaaat

SEQ ID NO: 6958495 - DNA, 23 bp, Homo sapiens
ggcctcctggtctaggctagact

SEQ ID NO: 6958496 - DNA, 22 bp, Homo sapiens
cattggtagagtttgttttata

SEQ ID NO: 6958497 - DNA, 22 bp, Homo sapiens
gccaccctgagctgggccaggg

SEQ ID NO: 6958498 - DNA, 22 bp, Homo sapiens
tccactgctcattccacaggca

SEQ ID NO: 6958499 - DNA, 22 bp, Homo sapiens
gcagatggctgagcctgcagat

SEQ ID NO: 6958500 - DNA, 22 bp, Homo sapiens
gtcagacacatttctttcagtg

SEQ ID NO: 6958501 - DNA, 22 bp, Homo sapiens
ggcctctctccagtcagtgcag

SEQ ID NO: 6958502 - DNA, 22 bp, Homo sapiens
tggcctgtcactgcccagggct

SEQ ID NO: 6958503 - DNA, 22 bp, Homo sapiens
tttcaactagcccctaagtcct

SEQ ID NO: 6958504 - DNA, 21 bp, Homo sapiens
tgcagttttgcttgatctctg

SEQ ID NO: 6958505 - DNA, 22 bp, Homo sapiens
agagatgctgtgggtagaggca

SEQ ID NO: 6958506 - DNA, 21 bp, Homo sapiens
tttgaatagaaatagtgctta

SEQ ID NO: 6958507 - DNA, 22 bp, Homo sapiens
cctgccctgctcactgtcggta

SEQ ID NO: 6958508 - DNA, 22 bp, Homo sapiens
attttagagaaacaaacgtagg

SEQ ID NO: 6958509 - DNA, 22 bp, Homo sapiens
catgcagtcaataaacatgtgt

SEQ ID NO: 6958510 - DNA, 22 bp, Homo sapiens
cccaggaggttggggctacagt

SEQ ID NO: 6958511 - DNA, 22 bp, Homo sapiens
agctgaggctctgagagggaag

SEQ ID NO: 6958512 - DNA, 22 bp, Homo sapiens
ctgcaccacagcctgaggcagc

SEQ ID NO: 6958513 - DNA, 19 bp, Homo sapiens
cagaacagaggtcatggcc

SEQ ID NO: 6958514 - DNA, 20 bp, Homo sapiens
cacaactgtccacatgctcc

SEQ ID NO: 6958515 - DNA, 22 bp, Homo sapiens
tgtgtcaggccttatcggtggc

SEQ ID NO: 6958516 - DNA, 17 bp, Homo sapiens
gccttctctgccctcac

SEQ ID NO: 6958517 - DNA, 22 bp, Homo sapiens
gtatttgagccatgccttgagg

SEQ ID NO: 6958518 - DNA, 22 bp, Homo sapiens
gaggaaccactctgagaagcca

SEQ ID NO: 6958519 - DNA, 22 bp, Homo sapiens
agtgggcaggcagggtgcgcag

SEQ ID NO: 6958520 - DNA, 16 bp, Homo sapiens
tccaggcatatctgag

SEQ ID NO: 6958521 - DNA, 22 bp, Homo sapiens
ttgcacagagtggatattcagt

SEQ ID NO: 6958522 - DNA, 22 bp, Homo sapiens
tattcccactcctcagcaattt

SEQ ID NO: 6958523 - DNA, 22 bp, Homo sapiens
ttcaaagtcagccatctggcta

SEQ ID NO: 6958524 - DNA, 22 bp, Homo sapiens
ttaggcatcctgtccctggatt

SEQ ID NO: 6958525 - DNA, 22 bp, Homo sapiens
aatagccaaagtgcatttatga

SEQ ID NO: 6958526 - DNA, 22 bp, Homo sapiens
tcaggcctgtgctggaggagat

SEQ ID NO: 6958527 - DNA, 22 bp, Homo sapiens
tcacatcactagctggtaatga

SEQ ID NO: 6958528 - DNA, 22 bp, Homo sapiens
aaataagttagcagattccagt

SEQ ID NO: 6958529 - DNA, 22 bp, Homo sapiens
aagagagaagtctctctggttc

SEQ ID NO: 6958530 - DNA, 22 bp, Homo sapiens
ctggctgcttgggacagccatg

SEQ ID NO: 6958531 - DNA, 21 bp, Homo sapiens
cctggccaatctgatagggtt

SEQ ID NO: 6958532 - DNA, 22 bp, Homo sapiens
ctggctttctgcacagaattgg

SEQ ID NO: 6958533 - DNA, 22 bp, Homo sapiens
aacctggctgcaaagaagggga

SEQ ID NO: 6958534 - DNA, 22 bp, Homo sapiens
tgtatttgggtcacaagatggg

SEQ ID NO: 6958535 - DNA, 21 bp, Homo sapiens
tgggcaccaaaacctaggagt

SEQ ID NO: 6958536 - DNA, 22 bp, Homo sapiens
tttaaggaaaaaatgtacttag

SEQ ID NO: 6958537 - DNA, 22 bp, Homo sapiens
gtcacaattataggaactcaga

SEQ ID NO: 6958538 - DNA, 22 bp, Homo sapiens
ggctggctcagggcttgagaga

SEQ ID NO: 6958539 - DNA, 22 bp, Homo sapiens
tcctggacagatccccatcatc

SEQ ID NO: 6958540 - DNA, 22 bp, Homo sapiens
acatttgacccatggagggtag

SEQ ID NO: 6958541 - DNA, 22 bp, Homo sapiens
attgaaaaattcacaattctgg

SEQ ID NO: 6958542 - DNA, 23 bp, Homo sapiens
acaaatgcccatacatctagttc

SEQ ID NO: 6958543 - DNA, 22 bp, Homo sapiens
gtcctctgtgtaggctgcagac

SEQ ID NO: 6958544 - DNA, 22 bp, Homo sapiens
cagaggctgatggctgtagcca

SEQ ID NO: 6958545 - DNA, 22 bp, Homo sapiens
tcactgcatcctccgcctcctg

SEQ ID NO: 6958546 - DNA, 22 bp, Homo sapiens
tcagtgtggaaaatcctttggc

SEQ ID NO: 6958547 - DNA, 21 bp, Homo sapiens
aatttcagacccattttgcct

SEQ ID NO: 6958548 - DNA, 20 bp, Homo sapiens
gaaaataggccagccaggta

SEQ ID NO: 6958549 - DNA, 17 bp, Homo sapiens
ctgtctgctgcttcctc

SEQ ID NO: 6958550 - DNA, 22 bp, Homo sapiens
tttattccatgtgtctatgacc

SEQ ID NO: 6958551 - DNA, 22 bp, Homo sapiens
cccaggtagttggaagagacaa

SEQ ID NO: 6958552 - DNA, 17 bp, Homo sapiens
tggacccttgggcctcc

SEQ ID NO: 6958553 - DNA, 22 bp, Homo sapiens
tagccctctccagcgaggtctg

SEQ ID NO: 6958554 - DNA, 22 bp, Homo sapiens
cttcagagaacttgatcgctgc

SEQ ID NO: 6958555 - DNA, 22 bp, Homo sapiens
ctggctttcatttcaagcacgt

SEQ ID NO: 6958556 - DNA, 22 bp, Homo sapiens
gtaaactgtccacatgtggcac

SEQ ID NO: 6958557 - DNA, 20 bp, Homo sapiens
gaaggaagggggcaaggtga

SEQ ID NO: 6958558 - DNA, 22 bp, Homo sapiens
tcacagtattcatgaacatgga

SEQ ID NO: 6958559 - DNA, 22 bp, Homo sapiens
gggagtctgggctagactcctt

SEQ ID NO: 6958560 - DNA, 22 bp, Homo sapiens
cctgctgagacttccaagggag

SEQ ID NO: 6958561 - DNA, 22 bp, Homo sapiens
cagggcctgtcacgacgctcat

SEQ ID NO: 6958562 - DNA, 20 bp, Homo sapiens
tgctttgatggaaatacagc

SEQ ID NO: 6958563 - DNA, 22 bp, Homo sapiens
tgtttgctctgactatcttgcg

SEQ ID NO: 6958564 - DNA, 22 bp, Homo sapiens
atatgctatgttgaataatttg

SEQ ID NO: 6958565 - DNA, 22 bp, Homo sapiens
tccccaaaatacatggacgtgt

SEQ ID NO: 6958566 - DNA, 22 bp, Homo sapiens
aaacttgggtgaccctgagcaa

SEQ ID NO: 6958567 - DNA, 22 bp, Homo sapiens
gtaggtgagtgatgctcagatt

SEQ ID NO: 6958568 - DNA, 22 bp, Homo sapiens
tctctttctatatgtgagtctt

SEQ ID NO: 6958569 - DNA, 22 bp, Homo sapiens
atcgatgctgacttcttgttat

SEQ ID NO: 6958570 - DNA, 22 bp, Homo sapiens
ttcattacttaggcaggcattt

SEQ ID NO: 6958571 - DNA, 22 bp, Homo sapiens
atacaaggtcatgaaggtttac

SEQ ID NO: 6958572 - DNA, 22 bp, Homo sapiens
aggcaggtgggagtgattcctt

SEQ ID NO: 6958573 - DNA, 22 bp, Homo sapiens
gatcctgggactgaatgggtgc

SEQ ID NO: 6958574 - DNA, 22 bp, Homo sapiens
taccttggggttttgttgctct

SEQ ID NO: 6958575 - DNA, 22 bp, Homo sapiens
ttggggtcccacaggctgcctg

SEQ ID NO: 6958576 - DNA, 22 bp, Homo sapiens
atctgcttcagtgatatgtgaa

SEQ ID NO: 6958577 - DNA, 22 bp, Homo sapiens
agcccagagccccggccatgtt

SEQ ID NO: 6958578 - DNA, 22 bp, Homo sapiens
tttcaaaccactgaggttctga

SEQ ID NO: 6958579 - DNA, 22 bp, Homo sapiens
attccaaaggctggcctggagg

SEQ ID NO: 6958580 - DNA, 22 bp, Homo sapiens
atgcattgaggatgacatgagt

SEQ ID NO: 6958581 - DNA, 22 bp, Homo sapiens
ccttgagttgaattaatggtgg

SEQ ID NO: 6958582 - DNA, 22 bp, Homo sapiens
actgagcagtagattttctgtt

SEQ ID NO: 6958583 - DNA, 22 bp, Homo sapiens
ggtgagagaaaagaaacactgt

SEQ ID NO: 6958584 - DNA, 18 bp, Homo sapiens
ctaaactgcacctaatga

SEQ ID NO: 6958585 - DNA, 22 bp, Homo sapiens
aagatgaactgtcttcacccat

SEQ ID NO: 6958586 - DNA, 22 bp, Homo sapiens
taggccttgtcacaggaataca

SEQ ID NO: 6958587 - DNA, 22 bp, Homo sapiens
tcataaagatactaagtgagtt

SEQ ID NO: 6958588 - DNA, 22 bp, Homo sapiens
tgatgtacacaatgaaattatg

SEQ ID NO: 6958589 - DNA, 22 bp, Homo sapiens
tcacaatttttaagtagcgcaa

SEQ ID NO: 6958590 - DNA, 22 bp, Homo sapiens
attcctgaagaaggtatgttgc

SEQ ID NO: 6958591 - DNA, 22 bp, Homo sapiens
ctccctgacctggattccaggc

SEQ ID NO: 6958592 - DNA, 21 bp, Homo sapiens
acatgtctggtcatttttagc

SEQ ID NO: 6958593 - DNA, 22 bp, Homo sapiens
acaaagtagtcaaagtagatga

SEQ ID NO: 6958594 - DNA, 22 bp, Homo sapiens
gaagtatatgtctttaatctat

SEQ ID NO: 6958595 - DNA, 23 bp, Homo sapiens
gccctcagtagaaaatgttagaa

SEQ ID NO: 6958596 - DNA, 22 bp, Homo sapiens
atttggtgaggtagccattgtt

SEQ ID NO: 6958597 - DNA, 22 bp, Homo sapiens
cctgaggctggcccttccatcc

SEQ ID NO: 6958598 - DNA, 20 bp, Homo sapiens
gtttttctctcttgccacta

SEQ ID NO: 6958599 - DNA, 22 bp, Homo sapiens
ctgcagagacctaggtcaggtt

SEQ ID NO: 6958600 - DNA, 22 bp, Homo sapiens
gagaactaatcatgcatggagt

SEQ ID NO: 6958601 - DNA, 18 bp, Homo sapiens
tggaagctggtgagcaga

SEQ ID NO: 6958602 - DNA, 22 bp, Homo sapiens
acgtttatggagtgcctatcat

SEQ ID NO: 6958603 - DNA, 19 bp, Homo sapiens
tggaacactcaaactgggt

SEQ ID NO: 6958604 - DNA, 22 bp, Homo sapiens
ttattgagcacatagtatgtgg

SEQ ID NO: 6958605 - DNA, 22 bp, Homo sapiens
aggcctcagtttccccagttgt

SEQ ID NO: 6958606 - DNA, 22 bp, Homo sapiens
tccaccctgctttcttatctcc

SEQ ID NO: 6958607 - DNA, 22 bp, Homo sapiens
ttgacaaaacaacacagatttc

SEQ ID NO: 6958608 - DNA, 22 bp, Homo sapiens
ggcatgtttcatcacatcaaga

SEQ ID NO: 6958609 - DNA, 22 bp, Homo sapiens
gggtggctaggtatcccccatt

SEQ ID NO: 6958610 - DNA, 22 bp, Homo sapiens
ggctgagccactgcgcctggct

SEQ ID NO: 6958611 - DNA, 22 bp, Homo sapiens
tttaccttcttttaactacagt

SEQ ID NO: 6958612 - DNA, 23 bp, Homo sapiens
gccttggagaagtcactcaggga

SEQ ID NO: 6958613 - DNA, 21 bp, Homo sapiens
cctggagacaaagacagggtg

SEQ ID NO: 6958614 - DNA, 22 bp, Homo sapiens
cagacagaggctgtatgagggc

SEQ ID NO: 6958615 - DNA, 22 bp, Homo sapiens
atggaataggctgctctttaaa

SEQ ID NO: 6958616 - DNA, 22 bp, Homo sapiens
gaatttcagatcagagaccatt

SEQ ID NO: 6958617 - DNA, 22 bp, Homo sapiens
atggtttatcctttaccagtcg

SEQ ID NO: 6958618 - DNA, 22 bp, Homo sapiens
ggagccagagtttaatgtggag

SEQ ID NO: 6958619 - DNA, 22 bp, Homo sapiens
agcttatcttgttagtttcatt

SEQ ID NO: 6958620 - DNA, 22 bp, Homo sapiens
aagcctccttattaaaggatat

SEQ ID NO: 6958621 - DNA, 20 bp, Homo sapiens
agccctcttgctttagggta

SEQ ID NO: 6958622 - DNA, 22 bp, Homo sapiens
gtgggcttttgacagtgcctgg

SEQ ID NO: 6958623 - DNA, 22 bp, Homo sapiens
ctctgcctgtgtcgccaccaca

SEQ ID NO: 6958624 - DNA, 16 bp, Homo sapiens
aagcctaaattacaga

SEQ ID NO: 6958625 - DNA, 22 bp, Homo sapiens
ccagctggtgttccttaggacc

SEQ ID NO: 6958626 - DNA, 22 bp, Homo sapiens
ccagagtctttatattcctgaa

SEQ ID NO: 6958627 - DNA, 22 bp, Homo sapiens
agtggaacactacattgttgtt

SEQ ID NO: 6958628 - DNA, 22 bp, Homo sapiens
caagtgatcctcccatcttggc

SEQ ID NO: 6958629 - DNA, 22 bp, Homo sapiens
ttgttatttaggtctgggttag

SEQ ID NO: 6958630 - DNA, 22 bp, Homo sapiens
atctggagatctgaattttgtg

SEQ ID NO: 6958631 - DNA, 22 bp, Homo sapiens
catcacaggtcctgatgacatt

SEQ ID NO: 6958632 - DNA, 22 bp, Homo sapiens
ggctccttcaagcctgtcactg

SEQ ID NO: 6958633 - DNA, 22 bp, Homo sapiens
atgttgactcagagtgagggta

SEQ ID NO: 6958634 - DNA, 22 bp, Homo sapiens
attatgagaggagaaaagtcag

SEQ ID NO: 6958635 - DNA, 19 bp, Homo sapiens
tatatttgttgaataaaaa

SEQ ID NO: 6958636 - DNA, 22 bp, Homo sapiens
tgtttagactcaaaattgaaag

SEQ ID NO: 6958637 - DNA, 21 bp, Homo sapiens
ctgtaagaaatcagttttatc

SEQ ID NO: 6958638 - DNA, 22 bp, Homo sapiens
tcttcagctctgaggctctggc

SEQ ID NO: 6958639 - DNA, 17 bp, Homo sapiens
agtgaaatttacattgc

SEQ ID NO: 6958640 - DNA, 22 bp, Homo sapiens
aggagctcagccattcatttga

SEQ ID NO: 6958641 - DNA, 22 bp, Homo sapiens
ttttacagtcagtcaaactcag

SEQ ID NO: 6958642 - DNA, 22 bp, Homo sapiens
acatgaaatgcagcctgtaacc

SEQ ID NO: 6958643 - DNA, 22 bp, Homo sapiens
caagctggctgggagaggcacg

SEQ ID NO: 6958644 - DNA, 22 bp, Homo sapiens
tctttgcagaatttaactttgc

SEQ ID NO: 6958645 - DNA, 22 bp, Homo sapiens
acagtgatatttttactcaaat

SEQ ID NO: 6958646 - DNA, 22 bp, Homo sapiens
agactgggccatttccccagct

SEQ ID NO: 6958647 - DNA, 22 bp, Homo sapiens
acactgaaagaagccagcttgt

SEQ ID NO: 6958648 - DNA, 22 bp, Homo sapiens
ttctggcttacttcactcattt

SEQ ID NO: 6958649 - DNA, 22 bp, Homo sapiens
cgcggagctccgcccggtgccc

SEQ ID NO: 6958650 - DNA, 22 bp, Homo sapiens
tagcagagctgggactagatta

SEQ ID NO: 6958651 - DNA, 22 bp, Homo sapiens
aatgaggtcattaatggtggga

SEQ ID NO: 6958652 - DNA, 22 bp, Homo sapiens
gttttatagttcgggacctgtt

SEQ ID NO: 6958653 - DNA, 22 bp, Homo sapiens
caactttcacactccacatgct

SEQ ID NO: 6958654 - DNA, 22 bp, Homo sapiens
ctctagaactgattgggaagaa

SEQ ID NO: 6958655 - DNA, 22 bp, Homo sapiens
ttgcaattgctatggagagcgt

SEQ ID NO: 6958656 - DNA, 22 bp, Homo sapiens
ttatataactcaggtgggctca

SEQ ID NO: 6958657 - DNA, 22 bp, Homo sapiens
ttattgctatgatgatgtgtag

SEQ ID NO: 6958658 - DNA, 22 bp, Homo sapiens
agatagtattttggtggggttc

SEQ ID NO: 6958659 - DNA, 22 bp, Homo sapiens
gacattgggtgtacaattggca

SEQ ID NO: 6958660 - DNA, 22 bp, Homo sapiens
atcagcagatgctcaatgaaca

SEQ ID NO: 6958661 - DNA, 21 bp, Homo sapiens
tcagagaatggcctactctca

SEQ ID NO: 6958662 - DNA, 22 bp, Homo sapiens
aatgtgattgaaaatcaggtcc

SEQ ID NO: 6958663 - DNA, 22 bp, Homo sapiens
gaacagacagaagcttatctcc

SEQ ID NO: 6958664 - DNA, 22 bp, Homo sapiens
aaattttgtattctagttctag

SEQ ID NO: 6958665 - DNA, 22 bp, Homo sapiens
catggcagtgattcagcctttg

SEQ ID NO: 6958666 - DNA, 22 bp, Homo sapiens
tcaaaggcttgtggttctggga

SEQ ID NO: 6958667 - DNA, 22 bp, Homo sapiens
actctgaaccagagatcatacc

SEQ ID NO: 6958668 - DNA, 21 bp, Homo sapiens
tggtccctttcagagtctgga

SEQ ID NO: 6958669 - DNA, 22 bp, Homo sapiens
agctgtgctgtggtcatctggg

SEQ ID NO: 6958670 - DNA, 22 bp, Homo sapiens
acccagggcttaaggcggtgca

SEQ ID NO: 6958671 - DNA, 22 bp, Homo sapiens
agcaaagtagctgctgttctta

SEQ ID NO: 6958672 - DNA, 20 bp, Homo sapiens
tttcacagtccctgtttcct

SEQ ID NO: 6958673 - DNA, 22 bp, Homo sapiens
acaagattttatgactcttttt

SEQ ID NO: 6958674 - DNA, 22 bp, Homo sapiens
gccagcaaagcaagttgtcagc

SEQ ID NO: 6958675 - DNA, 22 bp, Homo sapiens
actggccaggagctggaaatac

SEQ ID NO: 6958676 - DNA, 22 bp, Homo sapiens
tgccttttagtgctcaataaag

SEQ ID NO: 6958677 - DNA, 22 bp, Homo sapiens
cttcccacagaattcaatcagt

SEQ ID NO: 6958678 - DNA, 22 bp, Homo sapiens
gccattaatgtgaaggaaggaa

SEQ ID NO: 6958679 - DNA, 22 bp, Homo sapiens
ttggcagatgaacacaactgga

SEQ ID NO: 6958680 - DNA, 22 bp, Homo sapiens
ttcagcgatattattcatgagc

SEQ ID NO: 6958681 - DNA, 22 bp, Homo sapiens
tgcccatgcatgacagatggct

SEQ ID NO: 6958682 - DNA, 22 bp, Homo sapiens
caaatctctgctactagctatg

SEQ ID NO: 6958683 - DNA, 22 bp, Homo sapiens
tcagtcttctaaagggatgcaa

SEQ ID NO: 6958684 - DNA, 22 bp, Homo sapiens
atgcaaattctttgcttcttct

SEQ ID NO: 6958685 - DNA, 20 bp, Homo sapiens
aagggcagagggaacagact

SEQ ID NO: 6958686 - DNA, 22 bp, Homo sapiens
atattgagataagaactgacat

SEQ ID NO: 6958687 - DNA, 22 bp, Homo sapiens
caaaaggcaggggaaagagtgc

SEQ ID NO: 6958688 - DNA, 22 bp, Homo sapiens
agtgtgtaatgccaggggctgc

SEQ ID NO: 6958689 - DNA, 22 bp, Homo sapiens
atcattgaatataagtgctatt

SEQ ID NO: 6958690 - DNA, 22 bp, Homo sapiens
agactttagatacgtcttcttc

SEQ ID NO: 6958691 - DNA, 22 bp, Homo sapiens
cattctcagtatcagccagccc

SEQ ID NO: 6958692 - DNA, 22 bp, Homo sapiens
aaatgtgtcatattcaaagtca

SEQ ID NO: 6958693 - DNA, 22 bp, Homo sapiens
gctgctcactgaaggaccctgt

SEQ ID NO: 6958694 - DNA, 22 bp, Homo sapiens
gccacagcttttaacctcgggg

SEQ ID NO: 6958695 - DNA, 22 bp, Homo sapiens
ttttttgtagcaagcgcagata

SEQ ID NO: 6958696 - DNA, 17 bp, Homo sapiens
cagacagatatcctggg

SEQ ID NO: 6958697 - DNA, 22 bp, Homo sapiens
tcaggctgtatatcttgcactc

SEQ ID NO: 6958698 - DNA, 22 bp, Homo sapiens
aggtaactagcattagcttctg

SEQ ID NO: 6958699 - DNA, 21 bp, Homo sapiens
aagttactactgtttccaaga

SEQ ID NO: 6958700 - DNA, 22 bp, Homo sapiens
tgagaaccacctggaggtgact

SEQ ID NO: 6958701 - DNA, 22 bp, Homo sapiens
ctgagacacggagaggctgtgt

SEQ ID NO: 6958702 - DNA, 22 bp, Homo sapiens
aaaggctgcaaagctgtaagtg

SEQ ID NO: 6958703 - DNA, 22 bp, Homo sapiens
catcaaagttgatatccaatta

SEQ ID NO: 6958704 - DNA, 23 bp, Homo sapiens
ttaagcactgttagtagaaaagg

SEQ ID NO: 6958705 - DNA, 22 bp, Homo sapiens
gagcctgggtccttccctggga

SEQ ID NO: 6958706 - DNA, 22 bp, Homo sapiens
aggatggaattaggtagcaagt

SEQ ID NO: 6958707 - DNA, 22 bp, Homo sapiens
ggtgtttgcatggggccagttt

SEQ ID NO: 6958708 - DNA, 21 bp, Homo sapiens
aattgtgctattctgctttta

SEQ ID NO: 6958709 - DNA, 22 bp, Homo sapiens
ggctgcagaggcccccagtggg

SEQ ID NO: 6958710 - DNA, 22 bp, Homo sapiens
acagtcaaatgtctatcttctt

SEQ ID NO: 6958711 - DNA, 22 bp, Homo sapiens
gttgttttataggctcatgcct

SEQ ID NO: 6958712 - DNA, 22 bp, Homo sapiens
tgtgtagtgattttcttccaac

SEQ ID NO: 6958713 - DNA, 22 bp, Homo sapiens
tcaggctcaggttaggggccaa

SEQ ID NO: 6958714 - DNA, 22 bp, Homo sapiens
agtgtctgcctatttttcaagc

SEQ ID NO: 6958715 - DNA, 22 bp, Homo sapiens
ggggtgaaggttttctgaaagc

SEQ ID NO: 6958716 - DNA, 18 bp, Homo sapiens
ccctgagatgatgctgtg

SEQ ID NO: 6958717 - DNA, 22 bp, Homo sapiens
gtggctgttcttgccccatgct

SEQ ID NO: 6958718 - DNA, 22 bp, Homo sapiens
aacacagggactcccaggagaa

SEQ ID NO: 6958719 - DNA, 22 bp, Homo sapiens
tgtctctttgggttcctcttgg

SEQ ID NO: 6958720 - DNA, 22 bp, Homo sapiens
gcctccagggatgattccttcc

SEQ ID NO: 6958721 - DNA, 22 bp, Homo sapiens
tctctgaggaagaggctgtaat

SEQ ID NO: 6958722 - DNA, 22 bp, Homo sapiens
atactgaaaaagaagtgttgaa

SEQ ID NO: 6958723 - DNA, 22 bp, Homo sapiens
tgacattagagttattgtctca

SEQ ID NO: 6958724 - DNA, 22 bp, Homo sapiens
atttcttcaggtcagaaataga

SEQ ID NO: 6958725 - DNA, 22 bp, Homo sapiens
gcggtgaggaactggtgggaag

SEQ ID NO: 6958726 - DNA, 21 bp, Homo sapiens
tcactggaatacaattgattt

SEQ ID NO: 6958727 - DNA, 20 bp, Homo sapiens
tagctaccttgatcccctgg

SEQ ID NO: 6958728 - DNA, 22 bp, Homo sapiens
aagtacattatatgagcagaat

SEQ ID NO: 6958729 - DNA, 22 bp, Homo sapiens
ggaagccaggcccagagatgct

SEQ ID NO: 6958730 - DNA, 22 bp, Homo sapiens
gggccacattgaagggtgggta

SEQ ID NO: 6958731 - DNA, 22 bp, Homo sapiens
tcttcaaaccctggctcttcct

SEQ ID NO: 6958732 - DNA, 22 bp, Homo sapiens
accatgacgtcacagaggcttc

SEQ ID NO: 6958733 - DNA, 22 bp, Homo sapiens
ggccgctctccggtgtggatct

SEQ ID NO: 6958734 - DNA, 22 bp, Homo sapiens
tgagtgagacatcctgtcttaa

SEQ ID NO: 6958735 - DNA, 22 bp, Homo sapiens
caccagctactcgggtttcctg

SEQ ID NO: 6958736 - DNA, 22 bp, Homo sapiens
tctaaaagagggaggagagcct

SEQ ID NO: 6958737 - DNA, 22 bp, Homo sapiens
atctacagccagtctggtttgt

SEQ ID NO: 6958738 - DNA, 22 bp, Homo sapiens
acaggctgaggatgattgcatc

SEQ ID NO: 6958739 - DNA, 22 bp, Homo sapiens
acctgatatgtttgatcaccct

SEQ ID NO: 6958740 - DNA, 22 bp, Homo sapiens
ctgtatgaaattgtcattttta

SEQ ID NO: 6958741 - DNA, 22 bp, Homo sapiens
atctctagctaaccctctggca

SEQ ID NO: 6958742 - DNA, 22 bp, Homo sapiens
tcacaggaccctgagggtggcg

SEQ ID NO: 6958743 - DNA, 22 bp, Homo sapiens
ttgtgcaagaagccagcaccaa

SEQ ID NO: 6958744 - DNA, 22 bp, Homo sapiens
caacctgacaagactatgagta

SEQ ID NO: 6958745 - DNA, 19 bp, Homo sapiens
tggcagcattggtaccttg

SEQ ID NO: 6958746 - DNA, 22 bp, Homo sapiens
atgcatgtatatattacactca

SEQ ID NO: 6958747 - DNA, 22 bp, Homo sapiens
ctttgtagtcaaactgatacat

SEQ ID NO: 6958748 - DNA, 22 bp, Homo sapiens
ttgaatgaggaagagcactggc

SEQ ID NO: 6958749 - DNA, 16 bp, Homo sapiens
agcaggtgtatagtgt

SEQ ID NO: 6958750 - DNA, 22 bp, Homo sapiens
cccttgcacatttgtctttaat

SEQ ID NO: 6958751 - DNA, 22 bp, Homo sapiens
agtctgtgtactgggtttctgt

SEQ ID NO: 6958752 - DNA, 22 bp, Homo sapiens
gaaaagcttactgccacttggc

SEQ ID NO: 6958753 - DNA, 22 bp, Homo sapiens
gtctctgtgccttctccccacc

SEQ ID NO: 6958754 - DNA, 19 bp, Homo sapiens
ctcttgggtggcagaggcc

SEQ ID NO: 6958755 - DNA, 22 bp, Homo sapiens
gtcagctaggcagctgtgatgg

SEQ ID NO: 6958756 - DNA, 21 bp, Homo sapiens
ttgcaccatgataaattcaga

SEQ ID NO: 6958757 - DNA, 22 bp, Homo sapiens
tatttggaggccactgttgagt

SEQ ID NO: 6958758 - DNA, 22 bp, Homo sapiens
ttctcagagtgaccaagtcttt

SEQ ID NO: 6958759 - DNA, 22 bp, Homo sapiens
tcaggagctcttccctggtgtg

SEQ ID NO: 6958760 - DNA, 17 bp, Homo sapiens
cctgtcttgtttctgcc

SEQ ID NO: 6958761 - DNA, 22 bp, Homo sapiens
tggcagcagcaaatggcatatc

SEQ ID NO: 6958762 - DNA, 22 bp, Homo sapiens
agaaccttccatcactccctac

SEQ ID NO: 6958763 - DNA, 22 bp, Homo sapiens
actttgcccagaactgtcccag

SEQ ID NO: 6958764 - DNA, 19 bp, Homo sapiens
gaaaggctgctgctacctg

SEQ ID NO: 6958765 - DNA, 22 bp, Homo sapiens
gaggaggctgtttctctgcatt

SEQ ID NO: 6958766 - DNA, 22 bp, Homo sapiens
ccagtgggtgctgggctctgcc

SEQ ID NO: 6958767 - DNA, 22 bp, Homo sapiens
actctgtactttcttgttgtgt

SEQ ID NO: 6958768 - DNA, 22 bp, Homo sapiens
aggggctcctggcctggagagc

SEQ ID NO: 6958769 - DNA, 22 bp, Homo sapiens
gcagagatgaggcactcatccc

SEQ ID NO: 6958770 - DNA, 22 bp, Homo sapiens
tcctgccacaggtgataactgg

SEQ ID NO: 6958771 - DNA, 21 bp, Homo sapiens
ctgcttcctctcttcatggca

SEQ ID NO: 6958772 - DNA, 22 bp, Homo sapiens
tgagatgaaagcagaaagactt

SEQ ID NO: 6958773 - DNA, 22 bp, Homo sapiens
ctgggagaggtggtgggaagta

SEQ ID NO: 6958774 - DNA, 22 bp, Homo sapiens
aagtctctgatgtgtgttaggt

SEQ ID NO: 6958775 - DNA, 22 bp, Homo sapiens
tcagatgtctccaagggctggg

SEQ ID NO: 6958776 - DNA, 22 bp, Homo sapiens
actggctcagagttcctagaga

SEQ ID NO: 6958777 - DNA, 22 bp, Homo sapiens
ccacagtaaatggattcagacc

SEQ ID NO: 6958778 - DNA, 22 bp, Homo sapiens
tacatgttcaaatttgtctttc

SEQ ID NO: 6958779 - DNA, 22 bp, Homo sapiens
tttctactttggaatgcactga

SEQ ID NO: 6958780 - DNA, 22 bp, Homo sapiens
gcatggccaggaaaggtagaaa

SEQ ID NO: 6958781 - DNA, 22 bp, Homo sapiens
ccatttgtggtttatttgctct

SEQ ID NO: 6958782 - DNA, 22 bp, Homo sapiens
tttatctgacctcacttcttaa

SEQ ID NO: 6958783 - DNA, 22 bp, Homo sapiens
aagtcattcctgcttgttgccc

SEQ ID NO: 6958784 - DNA, 22 bp, Homo sapiens
gttgggccccagaggtccaggc

SEQ ID NO: 6958785 - DNA, 15 bp, Homo sapiens
tcattgattctggat

SEQ ID NO: 6958786 - DNA, 22 bp, Homo sapiens
acagtatattttcttgattgtt

SEQ ID NO: 6958787 - DNA, 22 bp, Homo sapiens
gccccactgtggaacctaagtc

SEQ ID NO: 6958788 - DNA, 22 bp, Homo sapiens
gcagatgttgtgaggctggtaa

SEQ ID NO: 6958789 - DNA, 23 bp, Homo sapiens
ttgcatggagcctgggattcctc

SEQ ID NO: 6958790 - DNA, 22 bp, Homo sapiens
gtcctaaatatagtgattcatg

SEQ ID NO: 6958791 - DNA, 22 bp, Homo sapiens
agagttatggacttaatgcagg

SEQ ID NO: 6958792 - DNA, 22 bp, Homo sapiens
tacgtgcactcatacctgaaat

SEQ ID NO: 6958793 - DNA, 22 bp, Homo sapiens
tggaaagcgaggagttggcatt

SEQ ID NO: 6958794 - DNA, 22 bp, Homo sapiens
agacaatgcaagcagggagtgg

SEQ ID NO: 6958795 - DNA, 18 bp, Homo sapiens
cattgtacaatgctttat

SEQ ID NO: 6958796 - DNA, 22 bp, Homo sapiens
attgcattgtgttttaggaggt

SEQ ID NO: 6958797 - DNA, 22 bp, Homo sapiens
agcatatagctatctttgattg

SEQ ID NO: 6958798 - DNA, 16 bp, Homo sapiens
tagggctgggaaggag

SEQ ID NO: 6958799 - DNA, 22 bp, Homo sapiens
acaccagtcatttattcagtca

SEQ ID NO: 6958800 - DNA, 22 bp, Homo sapiens
tcaaagacatggggaagctgag

SEQ ID NO: 6958801 - DNA, 22 bp, Homo sapiens
ggtgagtcatttggctcaagag

SEQ ID NO: 6958802 - DNA, 22 bp, Homo sapiens
agcaggtggtctgttgctgctg

SEQ ID NO: 6958803 - DNA, 22 bp, Homo sapiens
acgtcttcgttggcagagattt

SEQ ID NO: 6958804 - DNA, 22 bp, Homo sapiens
aaatgctctgcatctgatagac

SEQ ID NO: 6958805 - DNA, 22 bp, Homo sapiens
ttggctctaggaaccaaagtga

SEQ ID NO: 6958806 - DNA, 22 bp, Homo sapiens
gtcttcaggacctggaattttg

SEQ ID NO: 6958807 - DNA, 22 bp, Homo sapiens
ttatttacaactcttctcttcc

SEQ ID NO: 6958808 - DNA, 22 bp, Homo sapiens
gtgtctgcctttggactaactg

SEQ ID NO: 6958809 - DNA, 22 bp, Homo sapiens
tccaggcacagagttggtcagt

SEQ ID NO: 6958810 - DNA, 22 bp, Homo sapiens
aggttcctcttcctctggcctg

SEQ ID NO: 6958811 - DNA, 22 bp, Homo sapiens
cttattgtcctgactcatggcc

SEQ ID NO: 6958812 - DNA, 22 bp, Homo sapiens
taagtttaagtcatgtttgatg

SEQ ID NO: 6958813 - DNA, 21 bp, Homo sapiens
agcttgttattaattcagaac

SEQ ID NO: 6958814 - DNA, 22 bp, Homo sapiens
gccagggtcctgaagaccaagt

SEQ ID NO: 6958815 - DNA, 20 bp, Homo sapiens
gtattaggaggtaaatgtaa

SEQ ID NO: 6958816 - DNA, 22 bp, Homo sapiens
aggttattgtagattataggca

SEQ ID NO: 6958817 - DNA, 22 bp, Homo sapiens
tcctgtgcctccacctgctccg

SEQ ID NO: 6958818 - DNA, 21 bp, Homo sapiens
tgagttaaaatggagagtctt

SEQ ID NO: 6958819 - DNA, 22 bp, Homo sapiens
gcacagtgataggcagttgtgc

SEQ ID NO: 6958820 - DNA, 22 bp, Homo sapiens
accattttgggtattttcagag

SEQ ID NO: 6958821 - DNA, 22 bp, Homo sapiens
ataggctttgtgttttgttatc

SEQ ID NO: 6958822 - DNA, 22 bp, Homo sapiens
gatgtgagtggtagctgggatt

SEQ ID NO: 6958823 - DNA, 22 bp, Homo sapiens
tacaggtaagctgtcggcctag

SEQ ID NO: 6958824 - DNA, 22 bp, Homo sapiens
agacaccaaagagttggcagtg

SEQ ID NO: 6958825 - DNA, 22 bp, Homo sapiens
gaagctgtgaacaagctacgtg

SEQ ID NO: 6958826 - DNA, 22 bp, Homo sapiens
tggtaagataagagccaggcct

SEQ ID NO: 6958827 - DNA, 22 bp, Homo sapiens
gctacagtagataaggacggtc

SEQ ID NO: 6958828 - DNA, 22 bp, Homo sapiens
tatttgtctttcttataagaat

SEQ ID NO: 6958829 - DNA, 22 bp, Homo sapiens
ctcagctcattgtggatccggt

SEQ ID NO: 6958830 - DNA, 22 bp, Homo sapiens
tgtgtggcctccatagggtact

SEQ ID NO: 6958831 - DNA, 22 bp, Homo sapiens
tcatgcaggcagcctttagtaa

SEQ ID NO: 6958832 - DNA, 22 bp, Homo sapiens
tagcaaggacgtccaaagaact

SEQ ID NO: 6958833 - DNA, 22 bp, Homo sapiens
cccatagaaggggaagtgctac

SEQ ID NO: 6958834 - DNA, 22 bp, Homo sapiens
aggtgcctatctggtctctgca

SEQ ID NO: 6958835 - DNA, 22 bp, Homo sapiens
tctggagaaagttgagtttgtg

SEQ ID NO: 6958836 - DNA, 22 bp, Homo sapiens
actatacaccaaaatattaagg

SEQ ID NO: 6958837 - DNA, 21 bp, Homo sapiens
tggagactctggttctttgtg

SEQ ID NO: 6958838 - DNA, 22 bp, Homo sapiens
caggctgggctccggagataaa

SEQ ID NO: 6958839 - DNA, 22 bp, Homo sapiens
tggtgatcagtcaactgtcttc

SEQ ID NO: 6958840 - DNA, 22 bp, Homo sapiens
gtatatattggataaaccagag

SEQ ID NO: 6958841 - DNA, 22 bp, Homo sapiens
tctcttccatgtttcagcccca

SEQ ID NO: 6958842 - DNA, 22 bp, Homo sapiens
atgaatgatgccagttgaaatg

SEQ ID NO: 6958843 - DNA, 22 bp, Homo sapiens
agctatgtgccaagaaatgggg

SEQ ID NO: 6958844 - DNA, 22 bp, Homo sapiens
cttccagctgattggcatccag

SEQ ID NO: 6958845 - DNA, 22 bp, Homo sapiens
tatctcccaactagactctgca

SEQ ID NO: 6958846 - DNA, 19 bp, Homo sapiens
tgtcaccttctgtcagttt

SEQ ID NO: 6958847 - DNA, 22 bp, Homo sapiens
ggctgctctccatcccaggcct

SEQ ID NO: 6958848 - DNA, 22 bp, Homo sapiens
tacttggtattgtcagttgtaa

SEQ ID NO: 6958849 - DNA, 22 bp, Homo sapiens
caggatggagagttgttggttg

SEQ ID NO: 6958850 - DNA, 22 bp, Homo sapiens
gcagcagaggccctactctttg

SEQ ID NO: 6958851 - DNA, 22 bp, Homo sapiens
tatgaagactcatttattgggt

SEQ ID NO: 6958852 - DNA, 22 bp, Homo sapiens
tcatgtttgccctaagaaaaag

SEQ ID NO: 6958853 - DNA, 22 bp, Homo sapiens
gcttttcatagataaaattcta

SEQ ID NO: 6958854 - DNA, 22 bp, Homo sapiens
agaaggcagatgggacggagca

SEQ ID NO: 6958855 - DNA, 22 bp, Homo sapiens
atgcaacaaattgtgtgcaata

SEQ ID NO: 6958856 - DNA, 22 bp, Homo sapiens
ctactgtatgtgttctctagtc

SEQ ID NO: 6958857 - DNA, 22 bp, Homo sapiens
aatgcaaacttcttgttacttg

SEQ ID NO: 6958858 - DNA, 22 bp, Homo sapiens
gggaggtcagggtgcctgctgg

SEQ ID NO: 6958859 - DNA, 22 bp, Homo sapiens
tatataactactattttgctca

SEQ ID NO: 6958860 - DNA, 22 bp, Homo sapiens
ctcctgcaggtcagcaggcttg

SEQ ID NO: 6958861 - DNA, 22 bp, Homo sapiens
ctgggtctgggcctcctggagt

SEQ ID NO: 6958862 - DNA, 22 bp, Homo sapiens
aaggtattgttccctagtttct

SEQ ID NO: 6958863 - DNA, 21 bp, Homo sapiens
tgcttaccgccccagggctcc

SEQ ID NO: 6958864 - DNA, 22 bp, Homo sapiens
gatgtatctgagctgcttaggt

SEQ ID NO: 6958865 - DNA, 22 bp, Homo sapiens
ggcatgcttgccatgggccagt

SEQ ID NO: 6958866 - DNA, 22 bp, Homo sapiens
cagcagagacggtaagcagaac

SEQ ID NO: 6958867 - DNA, 22 bp, Homo sapiens
aaacttagtagagttcatatta

SEQ ID NO: 6958868 - DNA, 22 bp, Homo sapiens
gttctattactccctgcttctt

SEQ ID NO: 6958869 - DNA, 22 bp, Homo sapiens
ggtggcaccttaccctgcgcag

SEQ ID NO: 6958870 - DNA, 18 bp, Homo sapiens
gaagggctttgaagtaga

SEQ ID NO: 6958871 - DNA, 23 bp, Homo sapiens
tgcagggcaagttagagacccca

SEQ ID NO: 6958872 - DNA, 22 bp, Homo sapiens
tgtgcatattactacctactcc

SEQ ID NO: 6958873 - DNA, 22 bp, Homo sapiens
ctcaagtgtgagttttaaagtc

SEQ ID NO: 6958874 - DNA, 22 bp, Homo sapiens
atttagcttacctcgttactga

SEQ ID NO: 6958875 - DNA, 22 bp, Homo sapiens
gtgagggataatatgcggggtt

SEQ ID NO: 6958876 - DNA, 22 bp, Homo sapiens
caaagctgacgaggtcagcatc

SEQ ID NO: 6958877 - DNA, 22 bp, Homo sapiens
gacactgaccccaagctgtcct

SEQ ID NO: 6958878 - DNA, 22 bp, Homo sapiens
ctgccaggcagcagagggagaa

SEQ ID NO: 6958879 - DNA, 22 bp, Homo sapiens
atgcttctgtgtatgtttcagg

SEQ ID NO: 6958880 - DNA, 22 bp, Homo sapiens
gctgcttcagggacgtgccagc

SEQ ID NO: 6958881 - DNA, 22 bp, Homo sapiens
gacagacaggtgtggtaggcac

SEQ ID NO: 6958882 - DNA, 22 bp, Homo sapiens
gattctttggcctttattgaca

SEQ ID NO: 6958883 - DNA, 22 bp, Homo sapiens
aatagcaattacccttcaactc

SEQ ID NO: 6958884 - DNA, 22 bp, Homo sapiens
ctgggtggcagagcctgcagtg

SEQ ID NO: 6958885 - DNA, 22 bp, Homo sapiens
tgtgactggttgggaagaggct

SEQ ID NO: 6958886 - DNA, 22 bp, Homo sapiens
cagcggaggacagatgggagct

SEQ ID NO: 6958887 - DNA, 22 bp, Homo sapiens
attgttcagagaagggaagaat

SEQ ID NO: 6958888 - DNA, 21 bp, Homo sapiens
ggctttatgctcacccagcct

SEQ ID NO: 6958889 - DNA, 22 bp, Homo sapiens
aggtttatgattctgcacgtgg

SEQ ID NO: 6958890 - DNA, 22 bp, Homo sapiens
tacagagtgttattacagaatc

SEQ ID NO: 6958891 - DNA, 22 bp, Homo sapiens
ccctcacagtctaggagcagct

SEQ ID NO: 6958892 - DNA, 19 bp, Homo sapiens
tcagaaggcaggagaggcc

SEQ ID NO: 6958893 - DNA, 22 bp, Homo sapiens
tctcgtgcaggccttgctcgga

SEQ ID NO: 6958894 - DNA, 21 bp, Homo sapiens
cacctgtgagactctcagacc

SEQ ID NO: 6958895 - DNA, 22 bp, Homo sapiens
gacaaatgagacatcaattccc

SEQ ID NO: 6958896 - DNA, 22 bp, Homo sapiens
agggccaccagggagtctcagg

SEQ ID NO: 6958897 - DNA, 22 bp, Homo sapiens
tagggccatgtctgtcttgttc

SEQ ID NO: 6958898 - DNA, 22 bp, Homo sapiens
aggtgctgtttgtcagcagttt

SEQ ID NO: 6958899 - DNA, 22 bp, Homo sapiens
gctcaaagcataagacatctaa

SEQ ID NO: 6958900 - DNA, 22 bp, Homo sapiens
gctaaggaaatgcgcggcacag

SEQ ID NO: 6958901 - DNA, 22 bp, Homo sapiens
agcattccacactgaagtctgc

SEQ ID NO: 6958902 - DNA, 22 bp, Homo sapiens
tcctcccttggggtttcgttat

SEQ ID NO: 6958903 - DNA, 22 bp, Homo sapiens
catgtttctgatgcagctttta

SEQ ID NO: 6958904 - DNA, 22 bp, Homo sapiens
gccctgtggacagtgagaagtg

SEQ ID NO: 6958905 - DNA, 22 bp, Homo sapiens
caggagttttaaatctagcatg

SEQ ID NO: 6958906 - DNA, 22 bp, Homo sapiens
tcctcacagcatgaccaggcag

SEQ ID NO: 6958907 - DNA, 22 bp, Homo sapiens
aactggacactggtctgtactg

SEQ ID NO: 6958908 - DNA, 22 bp, Homo sapiens
tcctgccgtcctccggggcctc

SEQ ID NO: 6958909 - DNA, 22 bp, Homo sapiens
tgcaggtgtctgggggcaacag

SEQ ID NO: 6958910 - DNA, 18 bp, Homo sapiens
ttgttttaagactctgtc

SEQ ID NO: 6958911 - DNA, 22 bp, Homo sapiens
tggaaagaattcctatggttca

SEQ ID NO: 6958912 - DNA, 22 bp, Homo sapiens
ttgctgaagtgaaggtatgttt

SEQ ID NO: 6958913 - DNA, 22 bp, Homo sapiens
ggaggccaagtcactgacctgg

SEQ ID NO: 6958914 - DNA, 22 bp, Homo sapiens
aagtgcttcgttctgtattggg

SEQ ID NO: 6958915 - DNA, 22 bp, Homo sapiens
tcactatctcagtaaagcactc

SEQ ID NO: 6958916 - DNA, 22 bp, Homo sapiens
ttgagcaggatggctatgcaca

SEQ ID NO: 6958917 - DNA, 22 bp, Homo sapiens
ttgagacagtatctttgttggc

SEQ ID NO: 6958918 - DNA, 22 bp, Homo sapiens
gagttagcgtgacaccctcgct

SEQ ID NO: 6958919 - DNA, 16 bp, Homo sapiens
gcacacagccagcctt

SEQ ID NO: 6958920 - DNA, 22 bp, Homo sapiens
cgtgacacattctggacatggt

SEQ ID NO: 6958921 - DNA, 22 bp, Homo sapiens
attcatgtggggagccttctgt

SEQ ID NO: 6958922 - DNA, 22 bp, Homo sapiens
gcagctgcaggcaggcttgctg

SEQ ID NO: 6958923 - DNA, 22 bp, Homo sapiens
tggagagcaggggatgcgggcg

SEQ ID NO: 6958924 - DNA, 22 bp, Homo sapiens
gtgtgcaggccacaggccaggg

SEQ ID NO: 6958925 - DNA, 22 bp, Homo sapiens
ccaggtgtgatttggcagtgtc

SEQ ID NO: 6958926 - DNA, 22 bp, Homo sapiens
gtcatagtagtggaacagcagc

SEQ ID NO: 6958927 - DNA, 22 bp, Homo sapiens
tcttcctgctttggtgaggctt

SEQ ID NO: 6958928 - DNA, 22 bp, Homo sapiens
cagccactgaactcctggctat

SEQ ID NO: 6958929 - DNA, 22 bp, Homo sapiens
aggaatttggggttacatgatg

SEQ ID NO: 6958930 - DNA, 22 bp, Homo sapiens
catctgaagtgaattgcttttt

SEQ ID NO: 6958931 - DNA, 23 bp, Homo sapiens
ccgtgaagacagacagacagcag

SEQ ID NO: 6958932 - DNA, 22 bp, Homo sapiens
atatgagaattggaaaatatca

SEQ ID NO: 6958933 - DNA, 22 bp, Homo sapiens
tagtttctgaggattgaaagat

SEQ ID NO: 6958934 - DNA, 22 bp, Homo sapiens
cagggtcttataaggccaattt

SEQ ID NO: 6958935 - DNA, 22 bp, Homo sapiens
ggagagcttggagtgcgatttt

SEQ ID NO: 6958936 - DNA, 22 bp, Homo sapiens
ctgctgacttacactgtttatt

SEQ ID NO: 6958937 - DNA, 22 bp, Homo sapiens
gcggcaggagtaaaggaggaag

SEQ ID NO: 6958938 - DNA, 22 bp, Homo sapiens
cttgtcttgcacacggttgcca

SEQ ID NO: 6958939 - DNA, 22 bp, Homo sapiens
atgcgatgctcttcacttcagg

SEQ ID NO: 6958940 - DNA, 22 bp, Homo sapiens
atattctgcttttgatgcattc

SEQ ID NO: 6958941 - DNA, 22 bp, Homo sapiens
cagaaacactgtatttagggaa

SEQ ID NO: 6958942 - DNA, 22 bp, Homo sapiens
attgcaggttgcatttgtttat

SEQ ID NO: 6958943 - DNA, 22 bp, Homo sapiens
ggatgctctgtctcttgctgtt

SEQ ID NO: 6958944 - DNA, 22 bp, Homo sapiens
tgctattagaagccatgctgtt

SEQ ID NO: 6958945 - DNA, 22 bp, Homo sapiens
cccaggctgtgcaaacttcaaa

SEQ ID NO: 6958946 - DNA, 22 bp, Homo sapiens
cgaggtgatggcatttagactc

SEQ ID NO: 6958947 - DNA, 22 bp, Homo sapiens
atgagagacaggaacgagctgg

SEQ ID NO: 6958948 - DNA, 22 bp, Homo sapiens
gctctgagataaacgttgccct

SEQ ID NO: 6958949 - DNA, 22 bp, Homo sapiens
tggttgtataatgtcactaagc

SEQ ID NO: 6958950 - DNA, 22 bp, Homo sapiens
atctcaacatccctatggagtg

SEQ ID NO: 6958951 - DNA, 22 bp, Homo sapiens
caggccacacggcggctccctg

SEQ ID NO: 6958952 - DNA, 22 bp, Homo sapiens
attcccatcgtcaacttcactg

SEQ ID NO: 6958953 - DNA, 22 bp, Homo sapiens
gtcctaatctcttcttataagg

SEQ ID NO: 6958954 - DNA, 22 bp, Homo sapiens
aaagatcagaggatagctgagt

SEQ ID NO: 6958955 - DNA, 22 bp, Homo sapiens
taaaggcagcctaggaagtgtt

SEQ ID NO: 6958956 - DNA, 22 bp, Homo sapiens
aaggctttatgtgaccaaaaga

SEQ ID NO: 6958957 - DNA, 22 bp, Homo sapiens
gtttcccaggctgtggggccct

SEQ ID NO: 6958958 - DNA, 22 bp, Homo sapiens
attccacttagtgactcatttg

SEQ ID NO: 6958959 - DNA, 22 bp, Homo sapiens
gagaggtttatttactccatct

SEQ ID NO: 6958960 - DNA, 22 bp, Homo sapiens
caagaagccgagctacaggctc

SEQ ID NO: 6958961 - DNA, 22 bp, Homo sapiens
gcttgtctgctgagccacctgt

SEQ ID NO: 6958962 - DNA, 22 bp, Homo sapiens
agctgcaagtctgtgtggggag

SEQ ID NO: 6958963 - DNA, 22 bp, Homo sapiens
ctgccagggcatcctgtggtgg

SEQ ID NO: 6958964 - DNA, 20 bp, Homo sapiens
atgttgtttactcatagcat

SEQ ID NO: 6958965 - DNA, 23 bp, Homo sapiens
tctgcaagataatgaagatgata

SEQ ID NO: 6958966 - DNA, 22 bp, Homo sapiens
taggaaaacgtgattttctcac

SEQ ID NO: 6958967 - DNA, 22 bp, Homo sapiens
tctgggccttggagtggggaga

SEQ ID NO: 6958968 - DNA, 22 bp, Homo sapiens
tccgcgtgggaggggccggtgt

SEQ ID NO: 6958969 - DNA, 22 bp, Homo sapiens
ctttagtgttcaacccagataa

SEQ ID NO: 6958970 - DNA, 22 bp, Homo sapiens
tgttaatgctgtgctcctgtga

SEQ ID NO: 6958971 - DNA, 21 bp, Homo sapiens
caggatgatgataattcatgg

SEQ ID NO: 6958972 - DNA, 22 bp, Homo sapiens
cagagttttatgtatgcatgta

SEQ ID NO: 6958973 - DNA, 22 bp, Homo sapiens
cctaccacactatggagaagtg

SEQ ID NO: 6958974 - DNA, 22 bp, Homo sapiens
agttggcattttatttaagtat

SEQ ID NO: 6958975 - DNA, 22 bp, Homo sapiens
ttctcaggaactcagtgtcagc

SEQ ID NO: 6958976 - DNA, 22 bp, Homo sapiens
gggtgaggccttgctgccatca

SEQ ID NO: 6958977 - DNA, 22 bp, Homo sapiens
aacatttatgattgaggtaaat

SEQ ID NO: 6958978 - DNA, 22 bp, Homo sapiens
cagatgtgcctccagggctttg

SEQ ID NO: 6958979 - DNA, 22 bp, Homo sapiens
gaccggttctgccgtggactgg

SEQ ID NO: 6958980 - DNA, 22 bp, Homo sapiens
ctgggccatctcctttgtgtgg

SEQ ID NO: 6958981 - DNA, 21 bp, Homo sapiens
tgttcctgccccaatccttgg

SEQ ID NO: 6958982 - DNA, 22 bp, Homo sapiens
taatgaacaatatatcaatagc

SEQ ID NO: 6958983 - DNA, 22 bp, Homo sapiens
tgctttcacaccatgcctataa

SEQ ID NO: 6958984 - DNA, 22 bp, Homo sapiens
ttccagagagagaaaatttgat

SEQ ID NO: 6958985 - DNA, 22 bp, Homo sapiens
gacattagactaatgtagcatt

SEQ ID NO: 6958986 - DNA, 22 bp, Homo sapiens
ggtgagaggcagaggacagctt

SEQ ID NO: 6958987 - DNA, 22 bp, Homo sapiens
aatttctcaattgttacaggtg

SEQ ID NO: 6958988 - DNA, 20 bp, Homo sapiens
attattcatacatgtgtgac

SEQ ID NO: 6958989 - DNA, 22 bp, Homo sapiens
tacattccactagtgactggcg

SEQ ID NO: 6958990 - DNA, 22 bp, Homo sapiens
accaggcccgctgctatggtgg

SEQ ID NO: 6958991 - DNA, 22 bp, Homo sapiens
atgaggtatctcatttcctgaa

SEQ ID NO: 6958992 - DNA, 22 bp, Homo sapiens
ctggatctgtcttttggatccc

SEQ ID NO: 6958993 - DNA, 22 bp, Homo sapiens
ccagcatcagtcagattttgct

SEQ ID NO: 6958994 - DNA, 22 bp, Homo sapiens
tcctacagaaccaggctaggtg

SEQ ID NO: 6958995 - DNA, 22 bp, Homo sapiens
gaggactctttgagtctgacat

SEQ ID NO: 6958996 - DNA, 22 bp, Homo sapiens
gggaagagtgtcggttgaagtg

SEQ ID NO: 6958997 - DNA, 22 bp, Homo sapiens
agtagatagattctaagcacta

SEQ ID NO: 6958998 - DNA, 22 bp, Homo sapiens
aaggccctttagcagaggaggg

SEQ ID NO: 6958999 - DNA, 22 bp, Homo sapiens
ggcacagagaggccctggaagg

SEQ ID NO: 6959000 - DNA, 22 bp, Homo sapiens
gtacaaaggcagaattgggtag

SEQ ID NO: 6959001 - DNA, 22 bp, Homo sapiens
gtgcagattcccgggcctctcc

SEQ ID NO: 6959002 - DNA, 22 bp, Homo sapiens
ttactttagaaatagtcatcaa

SEQ ID NO: 6959003 - DNA, 22 bp, Homo sapiens
tgaggccatggaactagcttgg

SEQ ID NO: 6959004 - DNA, 22 bp, Homo sapiens
agtcagttttcttaaagggaag

SEQ ID NO: 6959005 - DNA, 22 bp, Homo sapiens
atctttagattagaaactctaa

SEQ ID NO: 6959006 - DNA, 22 bp, Homo sapiens
ttcactacggtcacgaccctgg

SEQ ID NO: 6959007 - DNA, 22 bp, Homo sapiens
catttcactattcactaaaagg

SEQ ID NO: 6959008 - DNA, 22 bp, Homo sapiens
agattcctcagtcatgaagcct

SEQ ID NO: 6959009 - DNA, 21 bp, Homo sapiens
attgaaagtcaacaatcagtt

SEQ ID NO: 6959010 - DNA, 22 bp, Homo sapiens
ttacagaactgccctagttggc

SEQ ID NO: 6959011 - DNA, 22 bp, Homo sapiens
tccatcatggcagcagcagtga

SEQ ID NO: 6959012 - DNA, 22 bp, Homo sapiens
ggagacagtggtagggcctaag

SEQ ID NO: 6959013 - DNA, 22 bp, Homo sapiens
tcagatggttccatcatttttc

SEQ ID NO: 6959014 - DNA, 20 bp, Homo sapiens
accctctgaatagtatctgg

SEQ ID NO: 6959015 - DNA, 22 bp, Homo sapiens
gcgtggaagtgagggctcaagg

SEQ ID NO: 6959016 - DNA, 22 bp, Homo sapiens
gtcacatggaattgactagagt

SEQ ID NO: 6959017 - DNA, 22 bp, Homo sapiens
gatgtctcaagtatccaagccc

SEQ ID NO: 6959018 - DNA, 22 bp, Homo sapiens
agagtgtaataagggcaagggc

SEQ ID NO: 6959019 - DNA, 22 bp, Homo sapiens
tccagttctaggtcactctctg

SEQ ID NO: 6959020 - DNA, 22 bp, Homo sapiens
acatactttgtccttaacgtac

SEQ ID NO: 6959021 - DNA, 22 bp, Homo sapiens
tgtcatctggcctggccttgtg

SEQ ID NO: 6959022 - DNA, 22 bp, Homo sapiens
acacttgccatgctgcacactg

SEQ ID NO: 6959023 - DNA, 21 bp, Homo sapiens
actttctgtgggttcaagcat

SEQ ID NO: 6959024 - DNA, 22 bp, Homo sapiens
cttccaagttgctctgctgacc

SEQ ID NO: 6959025 - DNA, 22 bp, Homo sapiens
atgagataggaacaaacttaca

SEQ ID NO: 6959026 - DNA, 22 bp, Homo sapiens
ttaaggtccacagtataaagat

SEQ ID NO: 6959027 - DNA, 22 bp, Homo sapiens
ttcctgggttccctctcattct

SEQ ID NO: 6959028 - DNA, 22 bp, Homo sapiens
tgttgcattgtactgaaaagcc

SEQ ID NO: 6959029 - DNA, 22 bp, Homo sapiens
acattatccctggcacaactgc

SEQ ID NO: 6959030 - DNA, 22 bp, Homo sapiens
tagcaacagcaatagtggtatt

SEQ ID NO: 6959031 - DNA, 22 bp, Homo sapiens
taagtgagccctcagagtatgg

SEQ ID NO: 6959032 - DNA, 22 bp, Homo sapiens
aaagccaaatgaaagatggttc

SEQ ID NO: 6959033 - DNA, 22 bp, Homo sapiens
tccaggggagactagacccaca

SEQ ID NO: 6959034 - DNA, 22 bp, Homo sapiens
tgcttgcagatgaaaggaagtc

SEQ ID NO: 6959035 - DNA, 22 bp, Homo sapiens
tgctgggcttcacccccacagt

SEQ ID NO: 6959036 - DNA, 22 bp, Homo sapiens
ttaagtaacttgtccaaatgag

SEQ ID NO: 6959037 - DNA, 22 bp, Homo sapiens
atatcctttgtgtaggcaattt

SEQ ID NO: 6959038 - DNA, 22 bp, Homo sapiens
atagtgtgtaaagtgcagtgat

SEQ ID NO: 6959039 - DNA, 23 bp, Homo sapiens
tgattcagaaggttgttattgct

SEQ ID NO: 6959040 - DNA, 22 bp, Homo sapiens
tccttcaaaagttgagagagcc

SEQ ID NO: 6959041 - DNA, 22 bp, Homo sapiens
tagtgacatctagtggactgtt

SEQ ID NO: 6959042 - DNA, 22 bp, Homo sapiens
tatttttgcctctcagataaaa

SEQ ID NO: 6959043 - DNA, 22 bp, Homo sapiens
aggcagtctagtccccaggcaa

SEQ ID NO: 6959044 - DNA, 22 bp, Homo sapiens
tacaaccatagacatatactag

SEQ ID NO: 6959045 - DNA, 22 bp, Homo sapiens
taacacactgaaggtgagatgg

SEQ ID NO: 6959046 - DNA, 22 bp, Homo sapiens
gctgcccttcgtcatctataaa

SEQ ID NO: 6959047 - DNA, 22 bp, Homo sapiens
tgagccttccttgtcatatcat

SEQ ID NO: 6959048 - DNA, 22 bp, Homo sapiens
tctagtgttttggaacatggaa

SEQ ID NO: 6959049 - DNA, 22 bp, Homo sapiens
atgcccacaacactgcactttt

SEQ ID NO: 6959050 - DNA, 22 bp, Homo sapiens
cacacagcaacaagaatagcca

SEQ ID NO: 6959051 - DNA, 22 bp, Homo sapiens
ttcaggaaatttgtgtcacagg

SEQ ID NO: 6959052 - DNA, 22 bp, Homo sapiens
ccttgttttggaaccaaaggat

SEQ ID NO: 6959053 - DNA, 22 bp, Homo sapiens
actcagtgaattttcatcaaat

SEQ ID NO: 6959054 - DNA, 22 bp, Homo sapiens
gtggtaatttaatcctacactg

SEQ ID NO: 6959055 - DNA, 22 bp, Homo sapiens
ctgtgtgagcatcacttcagat

SEQ ID NO: 6959056 - DNA, 22 bp, Homo sapiens
agttacaggaaagggccaggaa

SEQ ID NO: 6959057 - DNA, 22 bp, Homo sapiens
tatttctccctataccctccaa

SEQ ID NO: 6959058 - DNA, 22 bp, Homo sapiens
atttctgatacccggtcaccct

SEQ ID NO: 6959059 - DNA, 22 bp, Homo sapiens
acagagctgtactacttactga

SEQ ID NO: 6959060 - DNA, 22 bp, Homo sapiens
attaggatgttcctatgcacat

SEQ ID NO: 6959061 - DNA, 21 bp, Homo sapiens
tcatttgtgatctgatttcca

SEQ ID NO: 6959062 - DNA, 22 bp, Homo sapiens
gaaatgttgtcctgtctcttga

SEQ ID NO: 6959063 - DNA, 22 bp, Homo sapiens
tatatatgagcatgtgaggaca

SEQ ID NO: 6959064 - DNA, 20 bp, Homo sapiens
tggacacagccctgttgagt

SEQ ID NO: 6959065 - DNA, 22 bp, Homo sapiens
ctggtgtggactccgcgcggag

SEQ ID NO: 6959066 - DNA, 22 bp, Homo sapiens
tgctcccagctgtaggaatgtt

SEQ ID NO: 6959067 - DNA, 22 bp, Homo sapiens
tggcagaggtatattgggagga

SEQ ID NO: 6959068 - DNA, 22 bp, Homo sapiens
agcagtgttcaatgatacactg

SEQ ID NO: 6959069 - DNA, 22 bp, Homo sapiens
tcactggggcctttggtcagga

SEQ ID NO: 6959070 - DNA, 22 bp, Homo sapiens
tagaaccaccttctcctttacc

SEQ ID NO: 6959071 - DNA, 22 bp, Homo sapiens
caggccctcgtggtgagctggg

SEQ ID NO: 6959072 - DNA, 22 bp, Homo sapiens
aaacacagatttctttgtccca

SEQ ID NO: 6959073 - DNA, 22 bp, Homo sapiens
atgtgtctttgagactctgcta

SEQ ID NO: 6959074 - DNA, 22 bp, Homo sapiens
ctgaggtatgtgggactagcct

SEQ ID NO: 6959075 - DNA, 22 bp, Homo sapiens
agtgagacagtatactgagcag

SEQ ID NO: 6959076 - DNA, 22 bp, Homo sapiens
cgggcacacacttgacaggttc

SEQ ID NO: 6959077 - DNA, 22 bp, Homo sapiens
ctggaatctttggagaatgtgg

SEQ ID NO: 6959078 - DNA, 19 bp, Homo sapiens
atgatggtcccattcacct

SEQ ID NO: 6959079 - DNA, 22 bp, Homo sapiens
aaaagcctggatactatcatta

SEQ ID NO: 6959080 - DNA, 22 bp, Homo sapiens
gctttagtttgtcactggcatt

SEQ ID NO: 6959081 - DNA, 22 bp, Homo sapiens
actaaaacagtggctagtagac

SEQ ID NO: 6959082 - DNA, 22 bp, Homo sapiens
taaaacttctcatttttatggt

SEQ ID NO: 6959083 - DNA, 22 bp, Homo sapiens
gttagggagtcaggtggctctt

SEQ ID NO: 6959084 - DNA, 22 bp, Homo sapiens
ctgccctgcagctccacggact

SEQ ID NO: 6959085 - DNA, 22 bp, Homo sapiens
gcatttgtgtggcggaaggatt

SEQ ID NO: 6959086 - DNA, 22 bp, Homo sapiens
gtccaggtctggaccctgagcc

SEQ ID NO: 6959087 - DNA, 22 bp, Homo sapiens
tagatgaaaggtctagcacagt

SEQ ID NO: 6959088 - DNA, 22 bp, Homo sapiens
gtcctcagaagcctgcttagct

SEQ ID NO: 6959089 - DNA, 22 bp, Homo sapiens
cctcctggccctgggcctggaa

SEQ ID NO: 6959090 - DNA, 22 bp, Homo sapiens
gcctcctggttgcttctccaac

SEQ ID NO: 6959091 - DNA, 22 bp, Homo sapiens
tccccaggaaattctgattctt

SEQ ID NO: 6959092 - DNA, 22 bp, Homo sapiens
cttattggtgctttttctcata

SEQ ID NO: 6959093 - DNA, 22 bp, Homo sapiens
agctcagaacctcctcatccca

SEQ ID NO: 6959094 - DNA, 22 bp, Homo sapiens
aacatgctctgtttcttggatg

SEQ ID NO: 6959095 - DNA, 22 bp, Homo sapiens
ccagagagtaaacattttccgg

SEQ ID NO: 6959096 - DNA, 19 bp, Homo sapiens
atgatctgcccttgtaata

SEQ ID NO: 6959097 - DNA, 22 bp, Homo sapiens
gggacgggcacggagggccctc

SEQ ID NO: 6959098 - DNA, 22 bp, Homo sapiens
gcaggatgagtgagtacattta

SEQ ID NO: 6959099 - DNA, 22 bp, Homo sapiens
ccaccaagtcccactataattt

SEQ ID NO: 6959100 - DNA, 22 bp, Homo sapiens
ctgtggcctttgttggaggtcc

SEQ ID NO: 6959101 - DNA, 22 bp, Homo sapiens
ccacagagttacaaaacagtca

SEQ ID NO: 6959102 - DNA, 22 bp, Homo sapiens
tggaagtgctcttctgaccaac

SEQ ID NO: 6959103 - DNA, 22 bp, Homo sapiens
tacttaaaaattatcaaagtgg

SEQ ID NO: 6959104 - DNA, 22 bp, Homo sapiens
cagctttgagagttgcatttta

SEQ ID NO: 6959105 - DNA, 22 bp, Homo sapiens
cctggcagttttgcccaggatt

SEQ ID NO: 6959106 - DNA, 22 bp, Homo sapiens
aggagatggagctcagtgggca

SEQ ID NO: 6959107 - DNA, 22 bp, Homo sapiens
agtcactgaataccttaatgtt

SEQ ID NO: 6959108 - DNA, 22 bp, Homo sapiens
gactggctctatctccttggcg

SEQ ID NO: 6959109 - DNA, 22 bp, Homo sapiens
actttacagatggtttcctgac

SEQ ID NO: 6959110 - DNA, 22 bp, Homo sapiens
catccgttgtgctgttgctctc

SEQ ID NO: 6959111 - DNA, 22 bp, Homo sapiens
ctaggctgtaaagagctaggag

SEQ ID NO: 6959112 - DNA, 22 bp, Homo sapiens
aagccagtggcttctccctgct

SEQ ID NO: 6959113 - DNA, 22 bp, Homo sapiens
ctggcacctccagctcatggcc

SEQ ID NO: 6959114 - DNA, 22 bp, Homo sapiens
ggactctggtatttcactcttg

SEQ ID NO: 6959115 - DNA, 22 bp, Homo sapiens
tgtggtcctggggagacatgaa

SEQ ID NO: 6959116 - DNA, 22 bp, Homo sapiens
tagcagcaggggaaacagctgt

SEQ ID NO: 6959117 - DNA, 22 bp, Homo sapiens
aggaagcagtttataatgcatt

SEQ ID NO: 6959118 - DNA, 22 bp, Homo sapiens
atgtagatgcaccaagactgct

SEQ ID NO: 6959119 - DNA, 22 bp, Homo sapiens
tagcccagaaagcaaatgtctc

SEQ ID NO: 6959120 - DNA, 22 bp, Homo sapiens
gtttgctaatttaaagctattt

SEQ ID NO: 6959121 - DNA, 22 bp, Homo sapiens
tcccatcactctggaatgggta

SEQ ID NO: 6959122 - DNA, 22 bp, Homo sapiens
gcccagctccattcttggtgag

SEQ ID NO: 6959123 - DNA, 22 bp, Homo sapiens
agacatagaaaatcattaggaa

SEQ ID NO: 6959124 - DNA, 22 bp, Homo sapiens
tcaggagcagcatgggtgagag

SEQ ID NO: 6959125 - DNA, 22 bp, Homo sapiens
tgcaaaatgacttctgaaaaga

SEQ ID NO: 6959126 - DNA, 22 bp, Homo sapiens
ttatcctgccccagcctggaat

SEQ ID NO: 6959127 - DNA, 22 bp, Homo sapiens
ttcatttgatggtgggagagaa

SEQ ID NO: 6959128 - DNA, 23 bp, Homo sapiens
tggacaggacccccttcggaccc

SEQ ID NO: 6959129 - DNA, 22 bp, Homo sapiens
tcttggtctttcatccttcaac

SEQ ID NO: 6959130 - DNA, 19 bp, Homo sapiens
gatataaagagatggtgaa

SEQ ID NO: 6959131 - DNA, 22 bp, Homo sapiens
agaggctccgtcatccctcttt

SEQ ID NO: 6959132 - DNA, 22 bp, Homo sapiens
agcaaacattcagcagattggc

SEQ ID NO: 6959133 - DNA, 22 bp, Homo sapiens
tccgggttttacactcacatca

SEQ ID NO: 6959134 - DNA, 22 bp, Homo sapiens
atgtagttagaagattcaaaca

SEQ ID NO: 6959135 - DNA, 22 bp, Homo sapiens
ctgattgtagctcacactattt

SEQ ID NO: 6959136 - DNA, 22 bp, Homo sapiens
tggcagtgttgtgccacattcc

SEQ ID NO: 6959137 - DNA, 22 bp, Homo sapiens
gagttaaaggcagttgaggaaa

SEQ ID NO: 6959138 - DNA, 22 bp, Homo sapiens
tggaatatactcagaacaggct

SEQ ID NO: 6959139 - DNA, 22 bp, Homo sapiens
ttggcctcatggacagctcatc

SEQ ID NO: 6959140 - DNA, 23 bp, Homo sapiens
tgcaatatgtcagtgcaaagtgg

SEQ ID NO: 6959141 - DNA, 22 bp, Homo sapiens
aggatttgtggctctgagtctg

SEQ ID NO: 6959142 - DNA, 22 bp, Homo sapiens
acgatgctatgctgctggcttt

SEQ ID NO: 6959143 - DNA, 22 bp, Homo sapiens
acacagtatgacattggcagag

SEQ ID NO: 6959144 - DNA, 22 bp, Homo sapiens
gttgtgaatagtgccgcaataa

SEQ ID NO: 6959145 - DNA, 22 bp, Homo sapiens
ttgggaggtaatggagccaagt

SEQ ID NO: 6959146 - DNA, 22 bp, Homo sapiens
aggagtatctaataatctgaga

SEQ ID NO: 6959147 - DNA, 22 bp, Homo sapiens
tgtgctacaggattataggaac

SEQ ID NO: 6959148 - DNA, 22 bp, Homo sapiens
gggtgccacagagcttccactt

SEQ ID NO: 6959149 - DNA, 22 bp, Homo sapiens
agggttgtaagtgtatggtttc

SEQ ID NO: 6959150 - DNA, 22 bp, Homo sapiens
gaccctgtggctctgtggcaga

SEQ ID NO: 6959151 - DNA, 22 bp, Homo sapiens
caggaacctgctccaagaggca

SEQ ID NO: 6959152 - DNA, 22 bp, Homo sapiens
gcttcctagatctgtggtactc

SEQ ID NO: 6959153 - DNA, 22 bp, Homo sapiens
taagtcctggctggtttgaagc

SEQ ID NO: 6959154 - DNA, 22 bp, Homo sapiens
tggaaaaactgagacttagaca

SEQ ID NO: 6959155 - DNA, 22 bp, Homo sapiens
actgttcactagtgagggttga

SEQ ID NO: 6959156 - DNA, 22 bp, Homo sapiens
tctgctggtgatgacctcataa

SEQ ID NO: 6959157 - DNA, 22 bp, Homo sapiens
gctccctggtagccatgctctc

SEQ ID NO: 6959158 - DNA, 22 bp, Homo sapiens
cacatacccggctattgctgct

SEQ ID NO: 6959159 - DNA, 19 bp, Homo sapiens
gttgaaagtaggtgagggt

SEQ ID NO: 6959160 - DNA, 22 bp, Homo sapiens
cacaattttaatacacagtcaa

SEQ ID NO: 6959161 - DNA, 22 bp, Homo sapiens
caggctgagggttaggccttag

SEQ ID NO: 6959162 - DNA, 22 bp, Homo sapiens
aactttagctatttaatctgat

SEQ ID NO: 6959163 - DNA, 22 bp, Homo sapiens
tttcttgagtgatgcttagtgt

SEQ ID NO: 6959164 - DNA, 22 bp, Homo sapiens
catcacatcaaacctactctca

SEQ ID NO: 6959165 - DNA, 22 bp, Homo sapiens
gtgcctgggacacgagattttc

SEQ ID NO: 6959166 - DNA, 22 bp, Homo sapiens
cagcttcagggacagcttcttt

SEQ ID NO: 6959167 - DNA, 22 bp, Homo sapiens
tacccaggagaaacagcagggc

SEQ ID NO: 6959168 - DNA, 22 bp, Homo sapiens
acaatgtttctctttagtcatt

SEQ ID NO: 6959169 - DNA, 22 bp, Homo sapiens
atttcagagtgagagtgctcaa

SEQ ID NO: 6959170 - DNA, 22 bp, Homo sapiens
agtaaccctctgattttaaagt

SEQ ID NO: 6959171 - DNA, 22 bp, Homo sapiens
tgggccagttggaatggatact

SEQ ID NO: 6959172 - DNA, 22 bp, Homo sapiens
agccatgtcacatatggtcatc

SEQ ID NO: 6959173 - DNA, 22 bp, Homo sapiens
acaggacaaggggaagaagata

SEQ ID NO: 6959174 - DNA, 22 bp, Homo sapiens
atgaatacgcggtcatacacat

SEQ ID NO: 6959175 - DNA, 22 bp, Homo sapiens
ccaggatctgggtccatgggac

SEQ ID NO: 6959176 - DNA, 23 bp, Homo sapiens
atgggcttagaaagcaagtggga

SEQ ID NO: 6959177 - DNA, 22 bp, Homo sapiens
aggcgcacagggtgttgatgtg

SEQ ID NO: 6959178 - DNA, 18 bp, Homo sapiens
tgaggcccatctctctga

SEQ ID NO: 6959179 - DNA, 22 bp, Homo sapiens
ttccaagtgcccatatttcatc

SEQ ID NO: 6959180 - DNA, 22 bp, Homo sapiens
gtgtaaatgccccattcattga

SEQ ID NO: 6959181 - DNA, 20 bp, Homo sapiens
tcaatgtaatcatatcatca

SEQ ID NO: 6959182 - DNA, 22 bp, Homo sapiens
cagccacttcccctctatgggt

SEQ ID NO: 6959183 - DNA, 22 bp, Homo sapiens
tcagtggttggatgatggtcgc

SEQ ID NO: 6959184 - DNA, 22 bp, Homo sapiens
ccaggcactcacggggcactgg

SEQ ID NO: 6959185 - DNA, 22 bp, Homo sapiens
acatttctcatctagtagagta

SEQ ID NO: 6959186 - DNA, 22 bp, Homo sapiens
gcatccttaactctgtagatgc

SEQ ID NO: 6959187 - DNA, 22 bp, Homo sapiens
aagaagcactttcctacatgtt

SEQ ID NO: 6959188 - DNA, 22 bp, Homo sapiens
gtgtatactaggttctattcca

SEQ ID NO: 6959189 - DNA, 22 bp, Homo sapiens
agagcttcactggagagcacat

SEQ ID NO: 6959190 - DNA, 22 bp, Homo sapiens
cacgagatgtgccctgctggaa

SEQ ID NO: 6959191 - DNA, 22 bp, Homo sapiens
gtgactcttacctacccagcct

SEQ ID NO: 6959192 - DNA, 19 bp, Homo sapiens
agaccgctcacgccgtgct

SEQ ID NO: 6959193 - DNA, 22 bp, Homo sapiens
gaagcttgaacagggccaggct

SEQ ID NO: 6959194 - DNA, 22 bp, Homo sapiens
tgtcatgtgagggaacttgttc

SEQ ID NO: 6959195 - DNA, 22 bp, Homo sapiens
cctgtcagctgatggctatgta

SEQ ID NO: 6959196 - DNA, 20 bp, Homo sapiens
tgccttgggacagtgcctgt

SEQ ID NO: 6959197 - DNA, 22 bp, Homo sapiens
cacccagtaagcatgaggccct

SEQ ID NO: 6959198 - DNA, 19 bp, Homo sapiens
aaggacacaacagagatag

SEQ ID NO: 6959199 - DNA, 22 bp, Homo sapiens
gctggacccggcccctcacctc

SEQ ID NO: 6959200 - DNA, 22 bp, Homo sapiens
cacactcattagtcatttctct

SEQ ID NO: 6959201 - DNA, 18 bp, Homo sapiens
tgagaggcaggtagagga

SEQ ID NO: 6959202 - DNA, 22 bp, Homo sapiens
tccaggaggcctcatttcctgt

SEQ ID NO: 6959203 - DNA, 22 bp, Homo sapiens
atctggctattgacatgttata

SEQ ID NO: 6959204 - DNA, 22 bp, Homo sapiens
ttagtactgatagggtcaatca

SEQ ID NO: 6959205 - DNA, 22 bp, Homo sapiens
tgagctgtgagggtacagatat

SEQ ID NO: 6959206 - DNA, 22 bp, Homo sapiens
ggtgctctgacaccctccttgg

SEQ ID NO: 6959207 - DNA, 22 bp, Homo sapiens
gcttttctataagaactttcaa

SEQ ID NO: 6959208 - DNA, 22 bp, Homo sapiens
ctgttggcctttcatcagtaat

SEQ ID NO: 6959209 - DNA, 22 bp, Homo sapiens
tggcaggatctttgagagtgaa

SEQ ID NO: 6959210 - DNA, 22 bp, Homo sapiens
caggccagttttgatttaagcc

SEQ ID NO: 6959211 - DNA, 18 bp, Homo sapiens
agaggcttaatgaatggc

SEQ ID NO: 6959212 - DNA, 22 bp, Homo sapiens
cccaggagatggtgcgtggtct

SEQ ID NO: 6959213 - DNA, 19 bp, Homo sapiens
gcataaaatgtcaatgtgt

SEQ ID NO: 6959214 - DNA, 22 bp, Homo sapiens
tgaaaaacctcagtccgcttta

SEQ ID NO: 6959215 - DNA, 22 bp, Homo sapiens
tggcagggtgggcttcagcccc

SEQ ID NO: 6959216 - DNA, 22 bp, Homo sapiens
ccttgagaggaagtttgtagaa

SEQ ID NO: 6959217 - DNA, 22 bp, Homo sapiens
ccccgcgcgttgtcccgcaggt

SEQ ID NO: 6959218 - DNA, 22 bp, Homo sapiens
aggcttcagcagccctctcttg

SEQ ID NO: 6959219 - DNA, 22 bp, Homo sapiens
tggagcaggaagtctatggctg

SEQ ID NO: 6959220 - DNA, 19 bp, Homo sapiens
atacatgcatttacatgct

SEQ ID NO: 6959221 - DNA, 22 bp, Homo sapiens
tgtgtgaaggagccactgttca

SEQ ID NO: 6959222 - DNA, 22 bp, Homo sapiens
gggctgctgcccaggaggcacc

SEQ ID NO: 6959223 - DNA, 22 bp, Homo sapiens
aagggggcccagcactaagttg

SEQ ID NO: 6959224 - DNA, 22 bp, Homo sapiens
ttgcaaattcatggatctgaat

SEQ ID NO: 6959225 - DNA, 22 bp, Homo sapiens
agtctacatttctaacaagctc

SEQ ID NO: 6959226 - DNA, 22 bp, Homo sapiens
ttcaggatggcggatgttgggg

SEQ ID NO: 6959227 - DNA, 19 bp, Homo sapiens
agtttagagagactctaaa

SEQ ID NO: 6959228 - DNA, 22 bp, Homo sapiens
gtggtgtggctggcagagttta

SEQ ID NO: 6959229 - DNA, 22 bp, Homo sapiens
tgcatcaagaagtctaagtttg

SEQ ID NO: 6959230 - DNA, 22 bp, Homo sapiens
taggtgtccatatatgtgtgta

SEQ ID NO: 6959231 - DNA, 22 bp, Homo sapiens
ggcttaggtgtctctctgcacc

SEQ ID NO: 6959232 - DNA, 22 bp, Homo sapiens
tactgaatggggcagtaagaaa

SEQ ID NO: 6959233 - DNA, 22 bp, Homo sapiens
aggtattttaagtccaccagag

SEQ ID NO: 6959234 - DNA, 22 bp, Homo sapiens
tcttgttatcaggaaaacagta

SEQ ID NO: 6959235 - DNA, 22 bp, Homo sapiens
ccatggcattttatgtgtctta

SEQ ID NO: 6959236 - DNA, 22 bp, Homo sapiens
aatgtcagtgttactgctattg

SEQ ID NO: 6959237 - DNA, 21 bp, Homo sapiens
acacagtaactgggcgcaggg

SEQ ID NO: 6959238 - DNA, 22 bp, Homo sapiens
tctgtccagaggtcctggagac

SEQ ID NO: 6959239 - DNA, 22 bp, Homo sapiens
tggccactcctccctgcaggct

SEQ ID NO: 6959240 - DNA, 22 bp, Homo sapiens
tccttagacctggcaaatgggg

SEQ ID NO: 6959241 - DNA, 22 bp, Homo sapiens
tttctaatatgctctaagtcaa

SEQ ID NO: 6959242 - DNA, 22 bp, Homo sapiens
atcaaagtgatttgtaaacagg

SEQ ID NO: 6959243 - DNA, 22 bp, Homo sapiens
tttctttaggctgtgttgccaa

SEQ ID NO: 6959244 - DNA, 22 bp, Homo sapiens
gagagcacggtcttgggcatgg

SEQ ID NO: 6959245 - DNA, 22 bp, Homo sapiens
tctataaatgcagatatgtgtg

SEQ ID NO: 6959246 - DNA, 18 bp, Homo sapiens
gctttgcagaaatacaga

SEQ ID NO: 6959247 - DNA, 22 bp, Homo sapiens
atttagtttaggaaaagtaggt

SEQ ID NO: 6959248 - DNA, 20 bp, Homo sapiens
tgggagctggtgaggtctca

SEQ ID NO: 6959249 - DNA, 22 bp, Homo sapiens
tgggatttttaaatgtattaag

SEQ ID NO: 6959250 - DNA, 22 bp, Homo sapiens
aagcacctgcagttgacaaaaa

SEQ ID NO: 6959251 - DNA, 22 bp, Homo sapiens
ttagttgatgctaagggatccc

SEQ ID NO: 6959252 - DNA, 22 bp, Homo sapiens
ccagctcctcttgtctctagca

SEQ ID NO: 6959253 - DNA, 22 bp, Homo sapiens
tctgagaggattcctgtcccga

SEQ ID NO: 6959254 - DNA, 22 bp, Homo sapiens
tccagggctgacttgggagagg

SEQ ID NO: 6959255 - DNA, 22 bp, Homo sapiens
ttcgttgctttaagccactacg

SEQ ID NO: 6959256 - DNA, 22 bp, Homo sapiens
ggcggcgcctgctgcgtgacct

SEQ ID NO: 6959257 - DNA, 18 bp, Homo sapiens
catgggtgacaggtggat

SEQ ID NO: 6959258 - DNA, 22 bp, Homo sapiens
ttctatcatttagttgtcttct

SEQ ID NO: 6959259 - DNA, 22 bp, Homo sapiens
tctgcgtgaaactagatggcag

SEQ ID NO: 6959260 - DNA, 22 bp, Homo sapiens
gctgggagcaagtactcatctt

SEQ ID NO: 6959261 - DNA, 22 bp, Homo sapiens
ttggggtaaaatgtcgtaagag

SEQ ID NO: 6959262 - DNA, 22 bp, Homo sapiens
ctcgcatccaggataccctgag

SEQ ID NO: 6959263 - DNA, 22 bp, Homo sapiens
tctgctttagtgcaaagtctta

SEQ ID NO: 6959264 - DNA, 22 bp, Homo sapiens
tgtcaattatgtgacacatctt

SEQ ID NO: 6959265 - DNA, 22 bp, Homo sapiens
tgatttatgaccaagttagaat

SEQ ID NO: 6959266 - DNA, 22 bp, Homo sapiens
gcaggcaccgggttgctcccct

SEQ ID NO: 6959267 - DNA, 22 bp, Homo sapiens
ggaaggctccacccaaggcgag

SEQ ID NO: 6959268 - DNA, 22 bp, Homo sapiens
gctgaaggtggttttcaagtat

SEQ ID NO: 6959269 - DNA, 22 bp, Homo sapiens
gtctgctttgtctttcatgata

SEQ ID NO: 6959270 - DNA, 22 bp, Homo sapiens
atgatgtccacaggggtgttca

SEQ ID NO: 6959271 - DNA, 22 bp, Homo sapiens
aaaggcatggatagtgaattca

SEQ ID NO: 6959272 - DNA, 22 bp, Homo sapiens
agaaacctgggggttgtacata

SEQ ID NO: 6959273 - DNA, 16 bp, Homo sapiens
gcccaggacgggaggc

SEQ ID NO: 6959274 - DNA, 22 bp, Homo sapiens
acagataaggcagttaagagtt

SEQ ID NO: 6959275 - DNA, 22 bp, Homo sapiens
cgaattccatcagggtcttttg

SEQ ID NO: 6959276 - DNA, 23 bp, Homo sapiens
tacattcatttgcacagccagta

SEQ ID NO: 6959277 - DNA, 22 bp, Homo sapiens
cttctgaatggctgtgtatgct

SEQ ID NO: 6959278 - DNA, 22 bp, Homo sapiens
tggaaactagccttttaggttg

SEQ ID NO: 6959279 - DNA, 22 bp, Homo sapiens
tggcagtgtcttgctggggcag

SEQ ID NO: 6959280 - DNA, 22 bp, Homo sapiens
acatgtgtgtatacgtatttat

SEQ ID NO: 6959281 - DNA, 22 bp, Homo sapiens
gcagacattttgaatctaggct

SEQ ID NO: 6959282 - DNA, 22 bp, Homo sapiens
caggcaaggaggcactgaggga

SEQ ID NO: 6959283 - DNA, 22 bp, Homo sapiens
acagtgctcatgtgacatggtg

SEQ ID NO: 6959284 - DNA, 22 bp, Homo sapiens
agtcacattctggggtactggg

SEQ ID NO: 6959285 - DNA, 22 bp, Homo sapiens
cttgttaaattatataagcaga

SEQ ID NO: 6959286 - DNA, 22 bp, Homo sapiens
ttgacaggctattattaaaatg

SEQ ID NO: 6959287 - DNA, 22 bp, Homo sapiens
ctccagccagagtgcctctgtt

SEQ ID NO: 6959288 - DNA, 22 bp, Homo sapiens
cagagatggcggctgttgtgtt

SEQ ID NO: 6959289 - DNA, 22 bp, Homo sapiens
atgttaagaatgcagacaaatg

SEQ ID NO: 6959290 - DNA, 22 bp, Homo sapiens
acctcagaggccagggatctag

SEQ ID NO: 6959291 - DNA, 22 bp, Homo sapiens
aagtgcttgatcatagttctca

SEQ ID NO: 6959292 - DNA, 22 bp, Homo sapiens
tggtaagaataggggctttgga

SEQ ID NO: 6959293 - DNA, 22 bp, Homo sapiens
tttatctgctatctgctgtgct

SEQ ID NO: 6959294 - DNA, 22 bp, Homo sapiens
actcccttttctacttctaccc

SEQ ID NO: 6959295 - DNA, 22 bp, Homo sapiens
tgtttcttgagagtattaccct

SEQ ID NO: 6959296 - DNA, 22 bp, Homo sapiens
gtacatgtcaaaaaatgcataa

SEQ ID NO: 6959297 - DNA, 22 bp, Homo sapiens
tggtggcacaagggagagaatc

SEQ ID NO: 6959298 - DNA, 22 bp, Homo sapiens
aagtatgtctttgggtattatt

SEQ ID NO: 6959299 - DNA, 22 bp, Homo sapiens
taggcagccagcatcagttggg

SEQ ID NO: 6959300 - DNA, 18 bp, Homo sapiens
gctctttctgtctccagc

SEQ ID NO: 6959301 - DNA, 22 bp, Homo sapiens
caggctggacattagatacata

SEQ ID NO: 6959302 - DNA, 22 bp, Homo sapiens
atgtgccttcatcctccctgtc

SEQ ID NO: 6959303 - DNA, 22 bp, Homo sapiens
atgatgtctatctttgtagtat

SEQ ID NO: 6959304 - DNA, 19 bp, Homo sapiens
caattctattatcattcca

SEQ ID NO: 6959305 - DNA, 22 bp, Homo sapiens
taaagtgaagttcagaatggct

SEQ ID NO: 6959306 - DNA, 22 bp, Homo sapiens
cagagcctctaaaatttctatc

SEQ ID NO: 6959307 - DNA, 23 bp, Homo sapiens
tgtcaggtaaggaaggattcact

SEQ ID NO: 6959308 - DNA, 22 bp, Homo sapiens
gggaatgtgcagccacagtgag

SEQ ID NO: 6959309 - DNA, 22 bp, Homo sapiens
agggaagaagaacccattttga

SEQ ID NO: 6959310 - DNA, 22 bp, Homo sapiens
agagcctgagcctgaaagccct

SEQ ID NO: 6959311 - DNA, 22 bp, Homo sapiens
aaatattagggagaacagggac

SEQ ID NO: 6959312 - DNA, 22 bp, Homo sapiens
ttctttatagctattggatgag

SEQ ID NO: 6959313 - DNA, 22 bp, Homo sapiens
aggcttcatatttaggcatatg

SEQ ID NO: 6959314 - DNA, 22 bp, Homo sapiens
ggctgcggatctaaggctggga

SEQ ID NO: 6959315 - DNA, 20 bp, Homo sapiens
agcatttacatcccttggtg

SEQ ID NO: 6959316 - DNA, 22 bp, Homo sapiens
cggatcatgtgacctttgagtg

SEQ ID NO: 6959317 - DNA, 22 bp, Homo sapiens
agtttcttgccgtgctttccat

SEQ ID NO: 6959318 - DNA, 20 bp, Homo sapiens
gcttcaaagccatcctttta

SEQ ID NO: 6959319 - DNA, 22 bp, Homo sapiens
ctcatccagtcaagcttttaga

SEQ ID NO: 6959320 - DNA, 22 bp, Homo sapiens
aggctaggaatcaagcctttct

SEQ ID NO: 6959321 - DNA, 22 bp, Homo sapiens
tgcaccactgcactccagcctg

SEQ ID NO: 6959322 - DNA, 22 bp, Homo sapiens
tgtatgcctttttctgttgtaa

SEQ ID NO: 6959323 - DNA, 22 bp, Homo sapiens
tctgtggggagcaggagccggg

SEQ ID NO: 6959324 - DNA, 22 bp, Homo sapiens
aagtgcttcaactagtgtggtc

SEQ ID NO: 6959325 - DNA, 22 bp, Homo sapiens
actggcagtggcagcagaaaga

SEQ ID NO: 6959326 - DNA, 22 bp, Homo sapiens
aggcagacttaccttctgggga

SEQ ID NO: 6959327 - DNA, 22 bp, Homo sapiens
ctggtgtgattgagcccaggtg

SEQ ID NO: 6959328 - DNA, 22 bp, Homo sapiens
gtctggaaagagctgaggttca

SEQ ID NO: 6959329 - DNA, 22 bp, Homo sapiens
aatgctttgagggaagatgaaa

SEQ ID NO: 6959330 - DNA, 22 bp, Homo sapiens
tgactcaccatcggagtttgaa

SEQ ID NO: 6959331 - DNA, 22 bp, Homo sapiens
tctaatgagggtgaaggcccag

SEQ ID NO: 6959332 - DNA, 22 bp, Homo sapiens
tgttaagaagaggcagtactta

SEQ ID NO: 6959333 - DNA, 22 bp, Homo sapiens
ttttgtcacctgatttgcccac

SEQ ID NO: 6959334 - DNA, 22 bp, Homo sapiens
cagctatagatggactgaagag

SEQ ID NO: 6959335 - DNA, 22 bp, Homo sapiens
atgtttgtgttacactctgcag

SEQ ID NO: 6959336 - DNA, 22 bp, Homo sapiens
tcaggaggagctcataagtttg

SEQ ID NO: 6959337 - DNA, 22 bp, Homo sapiens
gttagagacatctctggtttct

SEQ ID NO: 6959338 - DNA, 22 bp, Homo sapiens
catacctttctcaagcacatgt

SEQ ID NO: 6959339 - DNA, 22 bp, Homo sapiens
atggagactgcgtctgccatcc

SEQ ID NO: 6959340 - DNA, 22 bp, Homo sapiens
acattcctcagtgccagttgag

SEQ ID NO: 6959341 - DNA, 22 bp, Homo sapiens
tcaagaagataatgtctagggt

SEQ ID NO: 6959342 - DNA, 22 bp, Homo sapiens
atgcaggtaacttttcagttta

SEQ ID NO: 6959343 - DNA, 22 bp, Homo sapiens
aaaggtctacatcactgaaaga

SEQ ID NO: 6959344 - DNA, 22 bp, Homo sapiens
ctaggcttgcagggtggacatg

SEQ ID NO: 6959345 - DNA, 22 bp, Homo sapiens
ttacatccaggaaggtgggagc

SEQ ID NO: 6959346 - DNA, 22 bp, Homo sapiens
ccaggctgttttcaaacttggg

SEQ ID NO: 6959347 - DNA, 22 bp, Homo sapiens
tgctggagacctgcttgcacca

SEQ ID NO: 6959348 - DNA, 22 bp, Homo sapiens
agtagcaccagggaagcagggc

SEQ ID NO: 6959349 - DNA, 22 bp, Homo sapiens
ctcagcaacagcgacttaaggg

SEQ ID NO: 6959350 - DNA, 22 bp, Homo sapiens
gcaggagtgtatttgcatgtaa

SEQ ID NO: 6959351 - DNA, 22 bp, Homo sapiens
ttctcctacttaaggccttcca

SEQ ID NO: 6959352 - DNA, 22 bp, Homo sapiens
agtgtgtgcctttggatacctg

SEQ ID NO: 6959353 - DNA, 22 bp, Homo sapiens
gcattcttcacagtattcctcc

SEQ ID NO: 6959354 - DNA, 22 bp, Homo sapiens
ctgtgcgtaagtagccaaaata

SEQ ID NO: 6959355 - DNA, 22 bp, Homo sapiens
aataagatcctgaagatatgtt

SEQ ID NO: 6959356 - DNA, 22 bp, Homo sapiens
tggatgaggctgggttaggcag

SEQ ID NO: 6959357 - DNA, 22 bp, Homo sapiens
atccacagggtgtgttaagatg

SEQ ID NO: 6959358 - DNA, 22 bp, Homo sapiens
aaagtcatggaaaatcttggaa

SEQ ID NO: 6959359 - DNA, 22 bp, Homo sapiens
tagccgggtgttgtgtcatgca

SEQ ID NO: 6959360 - DNA, 22 bp, Homo sapiens
ttcctgaaaatacagggagaga

SEQ ID NO: 6959361 - DNA, 22 bp, Homo sapiens
gaagccaggggcctgacaggca

SEQ ID NO: 6959362 - DNA, 22 bp, Homo sapiens
tagcacaagcaactactgaagt

SEQ ID NO: 6959363 - DNA, 22 bp, Homo sapiens
agggggtgtctctgattgggtt

SEQ ID NO: 6959364 - DNA, 18 bp, Homo sapiens
aaaggcagattactggga

SEQ ID NO: 6959365 - DNA, 22 bp, Homo sapiens
gctgttcatagaaatggtctca

SEQ ID NO: 6959366 - DNA, 22 bp, Homo sapiens
taactggtactctggtagcctg

SEQ ID NO: 6959367 - DNA, 22 bp, Homo sapiens
caccagatgagggatgtgctca

SEQ ID NO: 6959368 - DNA, 22 bp, Homo sapiens
acaggacttaagtcatttataa

SEQ ID NO: 6959369 - DNA, 22 bp, Homo sapiens
cttgtaaaaggtacattatgct

SEQ ID NO: 6959370 - DNA, 22 bp, Homo sapiens
gagctcggcgagaaactttgcc

SEQ ID NO: 6959371 - DNA, 21 bp, Homo sapiens
acataggcgaatgttcgggag

SEQ ID NO: 6959372 - DNA, 22 bp, Homo sapiens
agtgtctgttacgcttgcagaa

SEQ ID NO: 6959373 - DNA, 22 bp, Homo sapiens
aggccaatcctgggtgcattga

SEQ ID NO: 6959374 - DNA, 22 bp, Homo sapiens
gtccctgacacccgggtggagg

SEQ ID NO: 6959375 - DNA, 19 bp, Homo sapiens
aggtttatggggagggtga

SEQ ID NO: 6959376 - DNA, 22 bp, Homo sapiens
gaggcggaggttgcagtgagcc

SEQ ID NO: 6959377 - DNA, 22 bp, Homo sapiens
cagggatgtgatgagctgagcc

SEQ ID NO: 6959378 - DNA, 21 bp, Homo sapiens
acagtctccccagatctctcc

SEQ ID NO: 6959379 - DNA, 22 bp, Homo sapiens
aagtttctcagggttgattggg

SEQ ID NO: 6959380 - DNA, 22 bp, Homo sapiens
aaggtctggatgatgggtgtgc

SEQ ID NO: 6959381 - DNA, 22 bp, Homo sapiens
ggctagatggtatataaggatg

SEQ ID NO: 6959382 - DNA, 22 bp, Homo sapiens
accttacccagaggggcatgac

SEQ ID NO: 6959383 - DNA, 22 bp, Homo sapiens
ctgcagggacccaagtctttgg

SEQ ID NO: 6959384 - DNA, 22 bp, Homo sapiens
ttctgtttgtgaactggctgag

SEQ ID NO: 6959385 - DNA, 22 bp, Homo sapiens
tgtccagagtcacagagctcaa

SEQ ID NO: 6959386 - DNA, 22 bp, Homo sapiens
gttattctttgtatggtacatc

SEQ ID NO: 6959387 - DNA, 22 bp, Homo sapiens
gcaggtgatgtgatgtgagcat

SEQ ID NO: 6959388 - DNA, 22 bp, Homo sapiens
tctgggcagcagcagctagtag

SEQ ID NO: 6959389 - DNA, 22 bp, Homo sapiens
gccagtgtggtgtagtcatgaa

SEQ ID NO: 6959390 - DNA, 22 bp, Homo sapiens
agtgtttttacaagcactctgg

SEQ ID NO: 6959391 - DNA, 22 bp, Homo sapiens
gatgtctttctgtgtgcctaga

SEQ ID NO: 6959392 - DNA, 22 bp, Homo sapiens
ttaatcctcacaattacctcag

SEQ ID NO: 6959393 - DNA, 22 bp, Homo sapiens
tattcttgtaccttaaatgatt

SEQ ID NO: 6959394 - DNA, 22 bp, Homo sapiens
gcagttgtaatatgatgtgagg

SEQ ID NO: 6959395 - DNA, 22 bp, Homo sapiens
agcaaagcatcactccaatctg

SEQ ID NO: 6959396 - DNA, 22 bp, Homo sapiens
ttggaggtttcccaactgtggg

SEQ ID NO: 6959397 - DNA, 21 bp, Homo sapiens
tcatggattttctctgctttt

SEQ ID NO: 6959398 - DNA, 20 bp, Homo sapiens
gggaggccagcctcagagaa

SEQ ID NO: 6959399 - DNA, 22 bp, Homo sapiens
ctgctttaccaaactcttggat

SEQ ID NO: 6959400 - DNA, 22 bp, Homo sapiens
cagaggctgatgtgggatgggc

SEQ ID NO: 6959401 - DNA, 22 bp, Homo sapiens
caccttgtggcccagtcaggtt

SEQ ID NO: 6959402 - DNA, 22 bp, Homo sapiens
ttgagggatttacagaggtggg

SEQ ID NO: 6959403 - DNA, 22 bp, Homo sapiens
aggggccattgttctgcccgct

SEQ ID NO: 6959404 - DNA, 22 bp, Homo sapiens
tcaaagggtaatgtaatagtct

SEQ ID NO: 6959405 - DNA, 22 bp, Homo sapiens
caggtgggccatgaaaaatgac

SEQ ID NO: 6959406 - DNA, 22 bp, Homo sapiens
gacctttagtgtccaatattca

SEQ ID NO: 6959407 - DNA, 22 bp, Homo sapiens
taaatgtaaatggcgtcttgcg

SEQ ID NO: 6959408 - DNA, 22 bp, Homo sapiens
tcaggaaatacaagtgacatca

SEQ ID NO: 6959409 - DNA, 19 bp, Homo sapiens
taaatctgtattcttcaaa

SEQ ID NO: 6959410 - DNA, 22 bp, Homo sapiens
ttatactgtagtctgaaagttg

SEQ ID NO: 6959411 - DNA, 22 bp, Homo sapiens
ggaggagattcccctctcactt

SEQ ID NO: 6959412 - DNA, 22 bp, Homo sapiens
ttatctgtcatcaggcagacag

SEQ ID NO: 6959413 - DNA, 22 bp, Homo sapiens
agttctgctatcttgtcttctt

SEQ ID NO: 6959414 - DNA, 22 bp, Homo sapiens
aaagttgtaatggaagaaatgc

SEQ ID NO: 6959415 - DNA, 22 bp, Homo sapiens
aatggacaaacttgggaagtat

SEQ ID NO: 6959416 - DNA, 22 bp, Homo sapiens
tttagtgagtgtgaatcaaatg

SEQ ID NO: 6959417 - DNA, 22 bp, Homo sapiens
ttcacagtataggtttccagcg

SEQ ID NO: 6959418 - DNA, 22 bp, Homo sapiens
cagcatccctcaggggcctctg

SEQ ID NO: 6959419 - DNA, 22 bp, Homo sapiens
ggacagtattcattggagagaa

SEQ ID NO: 6959420 - DNA, 22 bp, Homo sapiens
aagctgatcatccttccaggtt

SEQ ID NO: 6959421 - DNA, 22 bp, Homo sapiens
gctggaggaggaagtgtgaggg

SEQ ID NO: 6959422 - DNA, 22 bp, Homo sapiens
ggctggaggtagaagaacactt

SEQ ID NO: 6959423 - DNA, 22 bp, Homo sapiens
gtggaaggtgaaggagcagcga

SEQ ID NO: 6959424 - DNA, 22 bp, Homo sapiens
cttaaagaaattgaggagagga

SEQ ID NO: 6959425 - DNA, 22 bp, Homo sapiens
tttatctgtggtaaataacatt

SEQ ID NO: 6959426 - DNA, 20 bp, Homo sapiens
ctccacacctgttcgcaggc

SEQ ID NO: 6959427 - DNA, 22 bp, Homo sapiens
atccattgtggtcttgtacatt

SEQ ID NO: 6959428 - DNA, 22 bp, Homo sapiens
gtcatttattctggtcaattca

SEQ ID NO: 6959429 - DNA, 22 bp, Homo sapiens
ttgtataagaagttggcagata

SEQ ID NO: 6959430 - DNA, 22 bp, Homo sapiens
aaaacagtttttgctaactgct

SEQ ID NO: 6959431 - DNA, 22 bp, Homo sapiens
agcttgttctcatccattcttc

SEQ ID NO: 6959432 - DNA, 22 bp, Homo sapiens
agctcttttatcatgaggagag

SEQ ID NO: 6959433 - DNA, 22 bp, Homo sapiens
aaatggtgtttctaatgctaga

SEQ ID NO: 6959434 - DNA, 23 bp, Homo sapiens
tgcctggagaagcatgaaatgta

SEQ ID NO: 6959435 - DNA, 18 bp, Homo sapiens
cctgtgacagaggcatca

SEQ ID NO: 6959436 - DNA, 22 bp, Homo sapiens
ccaagcagagcagcctctctgg

SEQ ID NO: 6959437 - DNA, 22 bp, Homo sapiens
gccacactgcttctttgagcct

SEQ ID NO: 6959438 - DNA, 22 bp, Homo sapiens
tacatttggatgtgcttaagtg

SEQ ID NO: 6959439 - DNA, 22 bp, Homo sapiens
ccctttcaacattctgccttgt

SEQ ID NO: 6959440 - DNA, 22 bp, Homo sapiens
ttagtggagagttattatcagc

SEQ ID NO: 6959441 - DNA, 19 bp, Homo sapiens
catctttggtcacctagtc

SEQ ID NO: 6959442 - DNA, 22 bp, Homo sapiens
aatggaacttgtaattatgtcc

SEQ ID NO: 6959443 - DNA, 22 bp, Homo sapiens
cagaacctgagagcacaatcct

SEQ ID NO: 6959444 - DNA, 22 bp, Homo sapiens
atatatagagctagatgttaaa

SEQ ID NO: 6959445 - DNA, 22 bp, Homo sapiens
aagtgcatagtaatggagtcaa

SEQ ID NO: 6959446 - DNA, 21 bp, Homo sapiens
gggtgtggaaattacatcctg

SEQ ID NO: 6959447 - DNA, 22 bp, Homo sapiens
ctgagaaaggacctcaaacagg

SEQ ID NO: 6959448 - DNA, 22 bp, Homo sapiens
ttccccttgataatgcagtaag

SEQ ID NO: 6959449 - DNA, 22 bp, Homo sapiens
tcataaagtgaaggatgatggg

SEQ ID NO: 6959450 - DNA, 22 bp, Homo sapiens
tcgaaccacgtagtaaacaaca

SEQ ID NO: 6959451 - DNA, 22 bp, Homo sapiens
gggcactcctgatcgggacttg

SEQ ID NO: 6959452 - DNA, 22 bp, Homo sapiens
tacatgtgctatttgttttgta

SEQ ID NO: 6959453 - DNA, 22 bp, Homo sapiens
tgtgtgtatccattagaggcca

SEQ ID NO: 6959454 - DNA, 22 bp, Homo sapiens
ctctctttctgaatgaggacta

SEQ ID NO: 6959455 - DNA, 22 bp, Homo sapiens
agaggtatgggcatggtgctgt

SEQ ID NO: 6959456 - DNA, 22 bp, Homo sapiens
gttcatgatgaggaaaacagga

SEQ ID NO: 6959457 - DNA, 22 bp, Homo sapiens
atttcgggagaacgcgcaggct

SEQ ID NO: 6959458 - DNA, 22 bp, Homo sapiens
ggctggaatgcaactgtgtgtt

SEQ ID NO: 6959459 - DNA, 23 bp, Homo sapiens
ctttgccacccagagcctgacag

SEQ ID NO: 6959460 - DNA, 19 bp, Homo sapiens
catcaagtggagtatctcg

SEQ ID NO: 6959461 - DNA, 19 bp, Homo sapiens
tctcagtgccgctgaccgc

SEQ ID NO: 6959462 - DNA, 22 bp, Homo sapiens
ccctgagcagtctgcagagagc

SEQ ID NO: 6959463 - DNA, 19 bp, Homo sapiens
gccaggctccatagccggc

SEQ ID NO: 6959464 - DNA, 22 bp, Homo sapiens
aatgtattcttcaaccttgcta

SEQ ID NO: 6959465 - DNA, 19 bp, Homo sapiens
gcactgaagagttggtcac

SEQ ID NO: 6959466 - DNA, 22 bp, Homo sapiens
agtggctgtaggctatgagaga

SEQ ID NO: 6959467 - DNA, 22 bp, Homo sapiens
ctgggacatagatcagcctttt

SEQ ID NO: 6959468 - DNA, 22 bp, Homo sapiens
tggtcagacaaaggagaatgtt

SEQ ID NO: 6959469 - DNA, 23 bp, Homo sapiens
acacaatagagtactattcagcc

SEQ ID NO: 6959470 - DNA, 22 bp, Homo sapiens
agccattttggtaatgataaca

SEQ ID NO: 6959471 - DNA, 22 bp, Homo sapiens
agcagcttggggccgagataga

SEQ ID NO: 6959472 - DNA, 22 bp, Homo sapiens
gaggttggttccaaccctccca

SEQ ID NO: 6959473 - DNA, 22 bp, Homo sapiens
tccttagcccactaatacttat

SEQ ID NO: 6959474 - DNA, 22 bp, Homo sapiens
gacaagctcgcctgccccggaa

SEQ ID NO: 6959475 - DNA, 22 bp, Homo sapiens
gtgggccagttcctcacaggta

SEQ ID NO: 6959476 - DNA, 22 bp, Homo sapiens
attagaaaatctggaggtgggg

SEQ ID NO: 6959477 - DNA, 22 bp, Homo sapiens
ggtgactggagggacccaggcc

SEQ ID NO: 6959478 - DNA, 23 bp, Homo sapiens
gaacattcattggttgctttaga

SEQ ID NO: 6959479 - DNA, 21 bp, Homo sapiens
tggttcagttcgttacgtgtg

SEQ ID NO: 6959480 - DNA, 22 bp, Homo sapiens
acatttaacctttgaggaactg

SEQ ID NO: 6959481 - DNA, 23 bp, Homo sapiens
cccctctggtggctcagctcctg

SEQ ID NO: 6959482 - DNA, 22 bp, Homo sapiens
ctgtgcacacgtgcccaacagt

SEQ ID NO: 6959483 - DNA, 22 bp, Homo sapiens
cagactctgatgcagccttgtg

SEQ ID NO: 6959484 - DNA, 22 bp, Homo sapiens
ttaaaagagcagcccagcatat

SEQ ID NO: 6959485 - DNA, 22 bp, Homo sapiens
ggcagctgttggctctctagga

SEQ ID NO: 6959486 - DNA, 22 bp, Homo sapiens
ttgtaacagctgcttaatagag

SEQ ID NO: 6959487 - DNA, 22 bp, Homo sapiens
aagtcttacataatagtttgga

SEQ ID NO: 6959488 - DNA, 23 bp, Homo sapiens
ccctggagtaaattcttggaagg

SEQ ID NO: 6959489 - DNA, 22 bp, Homo sapiens
ctaaatgccctacaatgactgg

SEQ ID NO: 6959490 - DNA, 22 bp, Homo sapiens
cctgagctggagacattacata

SEQ ID NO: 6959491 - DNA, 22 bp, Homo sapiens
gaacttgcagctgtgatttgtg

SEQ ID NO: 6959492 - DNA, 22 bp, Homo sapiens
tgccacagtttcatggattctg

SEQ ID NO: 6959493 - DNA, 22 bp, Homo sapiens
tggggcacagctgagaaagcac

SEQ ID NO: 6959494 - DNA, 22 bp, Homo sapiens
agagccctgtggttctggtaag

SEQ ID NO: 6959495 - DNA, 21 bp, Homo sapiens
agctgcccagagtagggaagg

SEQ ID NO: 6959496 - DNA, 22 bp, Homo sapiens
gaagttctcaaggatcacagaa

SEQ ID NO: 6959497 - DNA, 22 bp, Homo sapiens
cagttatttcaacagagaggat

SEQ ID NO: 6959498 - DNA, 22 bp, Homo sapiens
tcccaatgtggtttctgcaaga

SEQ ID NO: 6959499 - DNA, 22 bp, Homo sapiens
ttgaaatgctctttggaatcta

SEQ ID NO: 6959500 - DNA, 21 bp, Homo sapiens
tctgaacaacatacgaatctt

SEQ ID NO: 6959501 - DNA, 20 bp, Homo sapiens
tcctaataacctgaagaaat

SEQ ID NO: 6959502 - DNA, 22 bp, Homo sapiens
acttggtctaactagtgcttct

SEQ ID NO: 6959503 - DNA, 17 bp, Homo sapiens
agccgcctgggtcctgt

SEQ ID NO: 6959504 - DNA, 20 bp, Homo sapiens
ttcatgctggaggggctggc

SEQ ID NO: 6959505 - DNA, 22 bp, Homo sapiens
tgtaatatatataactgtgtgc

SEQ ID NO: 6959506 - DNA, 22 bp, Homo sapiens
gtacattcagcttagcacttct

SEQ ID NO: 6959507 - DNA, 22 bp, Homo sapiens
tcccagagtttcctgtgtccca

SEQ ID NO: 6959508 - DNA, 22 bp, Homo sapiens
tctgagattaagcagagatgga

SEQ ID NO: 6959509 - DNA, 22 bp, Homo sapiens
ttgagagtgccaagcatcctcc

SEQ ID NO: 6959510 - DNA, 22 bp, Homo sapiens
ctagttgctctcctttaaacct

SEQ ID NO: 6959511 - DNA, 22 bp, Homo sapiens
aaggatttttgctaggaagaca

SEQ ID NO: 6959512 - DNA, 21 bp, Homo sapiens
gagtgctcagttaagtggaga

SEQ ID NO: 6959513 - DNA, 22 bp, Homo sapiens
gtcactcttccccatagcctac

SEQ ID NO: 6959514 - DNA, 22 bp, Homo sapiens
tttatgctactcaatagtcagt

SEQ ID NO: 6959515 - DNA, 22 bp, Homo sapiens
ttctggagtattcctggcacct

SEQ ID NO: 6959516 - DNA, 21 bp, Homo sapiens
ttcacttgaagatcttgcccc

SEQ ID NO: 6959517 - DNA, 22 bp, Homo sapiens
ggactgctgtggacagagtcat

SEQ ID NO: 6959518 - DNA, 22 bp, Homo sapiens
atttgttctcataaagaatgaa

SEQ ID NO: 6959519 - DNA, 22 bp, Homo sapiens
tggccaatggctccggcctcat

SEQ ID NO: 6959520 - DNA, 17 bp, Homo sapiens
gcactgagccacagttt

SEQ ID NO: 6959521 - DNA, 19 bp, Homo sapiens
tctgcctctggtcaggctc

SEQ ID NO: 6959522 - DNA, 22 bp, Homo sapiens
ctccacagctgtaaatataggg

SEQ ID NO: 6959523 - DNA, 22 bp, Homo sapiens
agagatgctgacgtttacattt

SEQ ID NO: 6959524 - DNA, 22 bp, Homo sapiens
gctctagacagaaagaccagtg

SEQ ID NO: 6959525 - DNA, 22 bp, Homo sapiens
gaggtgtgttacagattgtcat

SEQ ID NO: 6959526 - DNA, 22 bp, Homo sapiens
gggctgactcctattggatgaa

SEQ ID NO: 6959527 - DNA, 22 bp, Homo sapiens
gctgctgtcacggtgctaaggg

SEQ ID NO: 6959528 - DNA, 22 bp, Homo sapiens
tgtcctgtgccaccttcctgag

SEQ ID NO: 6959529 - DNA, 22 bp, Homo sapiens
gttctgtcctcactgcaggcct

SEQ ID NO: 6959530 - DNA, 22 bp, Homo sapiens
acattcaaaattgtggtttaga

SEQ ID NO: 6959531 - DNA, 21 bp, Homo sapiens
tgtaagtttcatctgaattgg

SEQ ID NO: 6959532 - DNA, 22 bp, Homo sapiens
tctgagaataaaaattgcattt

SEQ ID NO: 6959533 - DNA, 20 bp, Homo sapiens
ctacacagggttcgctgggc

SEQ ID NO: 6959534 - DNA, 22 bp, Homo sapiens
ccctgagccacacagagcaggt

SEQ ID NO: 6959535 - DNA, 22 bp, Homo sapiens
ttagcaaagtttgccatctagt

SEQ ID NO: 6959536 - DNA, 22 bp, Homo sapiens
gacttaaaggctgaatgtagga

SEQ ID NO: 6959537 - DNA, 22 bp, Homo sapiens
tcacccagattacatcctgtca

SEQ ID NO: 6959538 - DNA, 22 bp, Homo sapiens
cccaggatcacctggtcaaggg

SEQ ID NO: 6959539 - DNA, 22 bp, Homo sapiens
ctagaggaacagtttcaggttt

SEQ ID NO: 6959540 - DNA, 22 bp, Homo sapiens
ggtgctgacttcacagtcttac

SEQ ID NO: 6959541 - DNA, 22 bp, Homo sapiens
aattgcttactgtttttcacct

SEQ ID NO: 6959542 - DNA, 18 bp, Homo sapiens
tctgccccagccgcactg

SEQ ID NO: 6959543 - DNA, 22 bp, Homo sapiens
tggggctagaatcctgcaggaa

SEQ ID NO: 6959544 - DNA, 22 bp, Homo sapiens
actgaggtggggtctgcttgga

SEQ ID NO: 6959545 - DNA, 22 bp, Homo sapiens
agtgcattctgtcatcttggtt

SEQ ID NO: 6959546 - DNA, 22 bp, Homo sapiens
cagtgaatttagatgttggtgg

SEQ ID NO: 6959547 - DNA, 22 bp, Homo sapiens
gaatacaaagcagaactcatac

SEQ ID NO: 6959548 - DNA, 22 bp, Homo sapiens
tttccatgtgtactggccagaa

SEQ ID NO: 6959549 - DNA, 22 bp, Homo sapiens
tgaataattatgggagtcctaa

SEQ ID NO: 6959550 - DNA, 22 bp, Homo sapiens
gaacttggcctgtctgtctggc

SEQ ID NO: 6959551 - DNA, 22 bp, Homo sapiens
gcctgcttcacggacaggcctc

SEQ ID NO: 6959552 - DNA, 22 bp, Homo sapiens
agaggtaagcagtggcaagtgc

SEQ ID NO: 6959553 - DNA, 18 bp, Homo sapiens
tccaaagccagagaagtt

SEQ ID NO: 6959554 - DNA, 22 bp, Homo sapiens
atcaggaaagaaaagcttggcg

SEQ ID NO: 6959555 - DNA, 22 bp, Homo sapiens
ttctataaatgaatgtgtatat

SEQ ID NO: 6959556 - DNA, 22 bp, Homo sapiens
aaaaacacaagtggcttggtct

SEQ ID NO: 6959557 - DNA, 21 bp, Homo sapiens
cctggcagaagcctgatatgc

SEQ ID NO: 6959558 - DNA, 22 bp, Homo sapiens
ggccagagctcaaacagtcgca

SEQ ID NO: 6959559 - DNA, 20 bp, Homo sapiens
tcacagctggctatgacagg

SEQ ID NO: 6959560 - DNA, 22 bp, Homo sapiens
tcctgaaggcctgagttccacc

SEQ ID NO: 6959561 - DNA, 22 bp, Homo sapiens
tgcaggctctgtgtgtgcctgg

SEQ ID NO: 6959562 - DNA, 22 bp, Homo sapiens
cgtgtctgtgtatgcaggccgt

SEQ ID NO: 6959563 - DNA, 21 bp, Homo sapiens
cccctcatacactctccttgc

SEQ ID NO: 6959564 - DNA, 22 bp, Homo sapiens
caggcagaatgagattacttca

SEQ ID NO: 6959565 - DNA, 22 bp, Homo sapiens
atttgttgaataaattagtatt

SEQ ID NO: 6959566 - DNA, 22 bp, Homo sapiens
tgtaaagttttattgttccttc

SEQ ID NO: 6959567 - DNA, 22 bp, Homo sapiens
ttacctgagcggatttgttgca

SEQ ID NO: 6959568 - DNA, 20 bp, Homo sapiens
aggggcacctgcgacggggc

SEQ ID NO: 6959569 - DNA, 22 bp, Homo sapiens
cttagccagctaacttaagcac

SEQ ID NO: 6959570 - DNA, 22 bp, Homo sapiens
caggattcaggttttccctcct

SEQ ID NO: 6959571 - DNA, 19 bp, Homo sapiens
aggtaggcagtggcatgga

SEQ ID NO: 6959572 - DNA, 22 bp, Homo sapiens
gtacatattaaaggtctataaa

SEQ ID NO: 6959573 - DNA, 20 bp, Homo sapiens
cacagtattcttccttaaaa

SEQ ID NO: 6959574 - DNA, 22 bp, Homo sapiens
gccaggcagctagcaacccctg

SEQ ID NO: 6959575 - DNA, 22 bp, Homo sapiens
cactgcaatatctgcatcctgg

SEQ ID NO: 6959576 - DNA, 22 bp, Homo sapiens
atttccatagagcgtctcacag

SEQ ID NO: 6959577 - DNA, 22 bp, Homo sapiens
gtaactggaaattcccaataag

SEQ ID NO: 6959578 - DNA, 22 bp, Homo sapiens
aagccttatggggacagttttg

SEQ ID NO: 6959579 - DNA, 22 bp, Homo sapiens
tgttttctcttgaaaagcagtc

SEQ ID NO: 6959580 - DNA, 22 bp, Homo sapiens
tgagcagtaggtctgaatagtg

SEQ ID NO: 6959581 - DNA, 22 bp, Homo sapiens
tcctggccctctgcaaacgcca

SEQ ID NO: 6959582 - DNA, 22 bp, Homo sapiens
aaggtggggtcctgtcatctga

SEQ ID NO: 6959583 - DNA, 22 bp, Homo sapiens
ttgcccctcttggattttccgg

SEQ ID NO: 6959584 - DNA, 21 bp, Homo sapiens
tggtaggtactggcttcaggc

SEQ ID NO: 6959585 - DNA, 22 bp, Homo sapiens
tggttccaatcgcactggctca

SEQ ID NO: 6959586 - DNA, 22 bp, Homo sapiens
ttggagctaccaggaagggctg

SEQ ID NO: 6959587 - DNA, 22 bp, Homo sapiens
aagcccagatgtgagaactgag

SEQ ID NO: 6959588 - DNA, 22 bp, Homo sapiens
tgacaatgattaggtagcttct

SEQ ID NO: 6959589 - DNA, 23 bp, Homo sapiens
cttctagagtcagctccaagttt

SEQ ID NO: 6959590 - DNA, 21 bp, Homo sapiens
gggcagcacgtcattcctgtg

SEQ ID NO: 6959591 - DNA, 22 bp, Homo sapiens
aatagcttttactcctccgagg

SEQ ID NO: 6959592 - DNA, 22 bp, Homo sapiens
ttggaggttattaacactggcc

SEQ ID NO: 6959593 - DNA, 22 bp, Homo sapiens
ttagtggtgttggtgaggactg

SEQ ID NO: 6959594 - DNA, 22 bp, Homo sapiens
aatctggacttgtctgtgaaga

SEQ ID NO: 6959595 - DNA, 22 bp, Homo sapiens
ccactggaaatgacacgtcact

SEQ ID NO: 6959596 - DNA, 21 bp, Homo sapiens
cacacagctgcccttaggtag

SEQ ID NO: 6959597 - DNA, 21 bp, Homo sapiens
gacaggggaagaagcaaggag

SEQ ID NO: 6959598 - DNA, 22 bp, Homo sapiens
tcaaactgctaccttttatgtg

SEQ ID NO: 6959599 - DNA, 22 bp, Homo sapiens
tttaggaagagttgagtaaatt

SEQ ID NO: 6959600 - DNA, 22 bp, Homo sapiens
gtttagatgaaagtttgtttca

SEQ ID NO: 6959601 - DNA, 21 bp, Homo sapiens
ttcaagtctctaggacttctc

SEQ ID NO: 6959602 - DNA, 21 bp, Homo sapiens
gttatacattctatggatttg

SEQ ID NO: 6959603 - DNA, 22 bp, Homo sapiens
aggttcaggctgcacacctgag

SEQ ID NO: 6959604 - DNA, 19 bp, Homo sapiens
gaatgtctcctacttctga

SEQ ID NO: 6959605 - DNA, 22 bp, Homo sapiens
tgatggaatataccttcgggag

SEQ ID NO: 6959606 - DNA, 22 bp, Homo sapiens
aaagctcttatagcagagtgtg

SEQ ID NO: 6959607 - DNA, 22 bp, Homo sapiens
tgattagacaaaggaatcatgc

SEQ ID NO: 6959608 - DNA, 22 bp, Homo sapiens
tattctgctaagtgatttctac

SEQ ID NO: 6959609 - DNA, 22 bp, Homo sapiens
ggagaatgattctttgctcact

SEQ ID NO: 6959610 - DNA, 20 bp, Homo sapiens
ctggcaggagcgagtctacc

SEQ ID NO: 6959611 - DNA, 22 bp, Homo sapiens
ttacagcagcagggacagacta

SEQ ID NO: 6959612 - DNA, 22 bp, Homo sapiens
gaggctagatgtttgctgggag

SEQ ID NO: 6959613 - DNA, 16 bp, Homo sapiens
tgctggggcgccgtcc

SEQ ID NO: 6959614 - DNA, 21 bp, Homo sapiens
ggctgtgttcagggcatgcgg

SEQ ID NO: 6959615 - DNA, 22 bp, Homo sapiens
tcaatgtttggaaatcctttgt

SEQ ID NO: 6959616 - DNA, 22 bp, Homo sapiens
aaatgagtttgcctctagatag

SEQ ID NO: 6959617 - DNA, 22 bp, Homo sapiens
ccaaggggcctttagacactat

SEQ ID NO: 6959618 - DNA, 22 bp, Homo sapiens
ctgctttaagaatgagtgtaag

SEQ ID NO: 6959619 - DNA, 22 bp, Homo sapiens
agcagacaccaggagtaaagaa

SEQ ID NO: 6959620 - DNA, 22 bp, Homo sapiens
gtagttctgcagtgtcacctga

SEQ ID NO: 6959621 - DNA, 22 bp, Homo sapiens
cagccctggcgcccccagatct

SEQ ID NO: 6959622 - DNA, 22 bp, Homo sapiens
tctattactcttttaaggaaaa

SEQ ID NO: 6959623 - DNA, 22 bp, Homo sapiens
catctttggttttctatatgcc

SEQ ID NO: 6959624 - DNA, 22 bp, Homo sapiens
atccaagagacatttgtgaatg

SEQ ID NO: 6959625 - DNA, 22 bp, Homo sapiens
tcaagtcccagctcttcactta

SEQ ID NO: 6959626 - DNA, 22 bp, Homo sapiens
tacacatgcatgtactccagga

SEQ ID NO: 6959627 - DNA, 22 bp, Homo sapiens
gtagggacatgccattatctca

SEQ ID NO: 6959628 - DNA, 22 bp, Homo sapiens
ccactttggcaccttctgccta

SEQ ID NO: 6959629 - DNA, 22 bp, Homo sapiens
gtcctcagggaatgtggcgggt

SEQ ID NO: 6959630 - DNA, 21 bp, Homo sapiens
caggaaactgaggccatgggg

SEQ ID NO: 6959631 - DNA, 22 bp, Homo sapiens
ataatgccattgtctcatccag

SEQ ID NO: 6959632 - DNA, 22 bp, Homo sapiens
gcccaggatggctggaggtgct

SEQ ID NO: 6959633 - DNA, 22 bp, Homo sapiens
tgagcgttttcttggtcagttc

SEQ ID NO: 6959634 - DNA, 22 bp, Homo sapiens
tgcagctcctctggctgcctga

SEQ ID NO: 6959635 - DNA, 22 bp, Homo sapiens
acatgtatctgatctgcaattg

SEQ ID NO: 6959636 - DNA, 22 bp, Homo sapiens
gaacctgtaagtatagatgtgg

SEQ ID NO: 6959637 - DNA, 22 bp, Homo sapiens
caactgatctatttcctaactg

SEQ ID NO: 6959638 - DNA, 22 bp, Homo sapiens
aacagactccattacctggctt

SEQ ID NO: 6959639 - DNA, 22 bp, Homo sapiens
gtccactcactcttagtcactc

SEQ ID NO: 6959640 - DNA, 22 bp, Homo sapiens
gaaatcaggatgatgttccaga

SEQ ID NO: 6959641 - DNA, 22 bp, Homo sapiens
ggccccacgggggagtcctagt

SEQ ID NO: 6959642 - DNA, 18 bp, Homo sapiens
gatctctgcagtgcctac

SEQ ID NO: 6959643 - DNA, 22 bp, Homo sapiens
aggaaaaagagttgctgccttc

SEQ ID NO: 6959644 - DNA, 22 bp, Homo sapiens
cagtcagagtcacagtaatttg

SEQ ID NO: 6959645 - DNA, 20 bp, Homo sapiens
tttaactggccttctggctc

SEQ ID NO: 6959646 - DNA, 22 bp, Homo sapiens
ttatggctaaatttcaatatta

SEQ ID NO: 6959647 - DNA, 22 bp, Homo sapiens
cacatcttccagagtagctaaa

SEQ ID NO: 6959648 - DNA, 18 bp, Homo sapiens
gcattcagtagtgaacaa

SEQ ID NO: 6959649 - DNA, 22 bp, Homo sapiens
tttcaagtactgtaaacatgct

SEQ ID NO: 6959650 - DNA, 22 bp, Homo sapiens
ttgcaaatgtttcataacagta

SEQ ID NO: 6959651 - DNA, 22 bp, Homo sapiens
ggcgaggtgtctgccatcaagc

SEQ ID NO: 6959652 - DNA, 22 bp, Homo sapiens
cttgttgttatggctggtggag

SEQ ID NO: 6959653 - DNA, 22 bp, Homo sapiens
gtatcacttttgagagtgagaa

SEQ ID NO: 6959654 - DNA, 22 bp, Homo sapiens
tagacaatatttgaaagtagtg

SEQ ID NO: 6959655 - DNA, 22 bp, Homo sapiens
caaagtgctgggattacaggtg

SEQ ID NO: 6959656 - DNA, 22 bp, Homo sapiens
tgcctttggtttgctacatgcc

SEQ ID NO: 6959657 - DNA, 22 bp, Homo sapiens
ctgtctggagttatgtaaatag

SEQ ID NO: 6959658 - DNA, 22 bp, Homo sapiens
agccatgtgtctttattctgtt

SEQ ID NO: 6959659 - DNA, 22 bp, Homo sapiens
agacagtatgatatatgaatac

SEQ ID NO: 6959660 - DNA, 22 bp, Homo sapiens
agtgagacagtggactctgcat

SEQ ID NO: 6959661 - DNA, 22 bp, Homo sapiens
tggctcagttaggtcagaaaca

SEQ ID NO: 6959662 - DNA, 22 bp, Homo sapiens
tctgaggccttgggacagaagt

SEQ ID NO: 6959663 - DNA, 22 bp, Homo sapiens
atgtatgtatacaccccacata

SEQ ID NO: 6959664 - DNA, 22 bp, Homo sapiens
tatcattcttctcacctttgaa

SEQ ID NO: 6959665 - DNA, 21 bp, Homo sapiens
catttctattgatgagaaaag

SEQ ID NO: 6959666 - DNA, 22 bp, Homo sapiens
agctcctgtagtacatattatt

SEQ ID NO: 6959667 - DNA, 22 bp, Homo sapiens
agctcttccacctcatgatggg

SEQ ID NO: 6959668 - DNA, 20 bp, Homo sapiens
cagctgcctggctctgggat

SEQ ID NO: 6959669 - DNA, 22 bp, Homo sapiens
ctgcaatggacagctctgagca

SEQ ID NO: 6959670 - DNA, 22 bp, Homo sapiens
tcatgtaaagtgtaggtttaga

SEQ ID NO: 6959671 - DNA, 22 bp, Homo sapiens
tagcagagggtagtgccggggc

SEQ ID NO: 6959672 - DNA, 22 bp, Homo sapiens
tggctccagctcaagtatggca

SEQ ID NO: 6959673 - DNA, 22 bp, Homo sapiens
tcagtttttacggtcacaggga

SEQ ID NO: 6959674 - DNA, 22 bp, Homo sapiens
cctgcacctctgtgcttggaac

SEQ ID NO: 6959675 - DNA, 22 bp, Homo sapiens
tgatttaggaaacagctacagg

SEQ ID NO: 6959676 - DNA, 22 bp, Homo sapiens
acagtgttcttggcgctgagtg

SEQ ID NO: 6959677 - DNA, 22 bp, Homo sapiens
cagaccagtagggctcatccca

SEQ ID NO: 6959678 - DNA, 22 bp, Homo sapiens
tcagtttcctggttttaatatt

SEQ ID NO: 6959679 - DNA, 22 bp, Homo sapiens
tagaatcaagcagtagagcaga

SEQ ID NO: 6959680 - DNA, 22 bp, Homo sapiens
gcaaaaaccacaattactttta

SEQ ID NO: 6959681 - DNA, 20 bp, Homo sapiens
ttggctctgatcagtggagc

SEQ ID NO: 6959682 - DNA, 22 bp, Homo sapiens
tgaaatttaggtgcagataaat

SEQ ID NO: 6959683 - DNA, 22 bp, Homo sapiens
tggcccttttgtgaagtggcca

SEQ ID NO: 6959684 - DNA, 22 bp, Homo sapiens
acaaatccagtgaactccagtg

SEQ ID NO: 6959685 - DNA, 20 bp, Homo sapiens
aagtccctaagtctctggcc

SEQ ID NO: 6959686 - DNA, 22 bp, Homo sapiens
tcctaggaagtggaggcacctg

SEQ ID NO: 6959687 - DNA, 22 bp, Homo sapiens
gaaatcttttcatctcatttga

SEQ ID NO: 6959688 - DNA, 21 bp, Homo sapiens
aggcagttgagcatgttatga

SEQ ID NO: 6959689 - DNA, 22 bp, Homo sapiens
tttgcattgcatacaaggaact

SEQ ID NO: 6959690 - DNA, 22 bp, Homo sapiens
actaaagtgcacccctttgaga

SEQ ID NO: 6959691 - DNA, 22 bp, Homo sapiens
ttgcttcactgagttatgcctg

SEQ ID NO: 6959692 - DNA, 22 bp, Homo sapiens
aagctgttgaagtaattcagcc

SEQ ID NO: 6959693 - DNA, 22 bp, Homo sapiens
tctgctaaatagatttggcaat

SEQ ID NO: 6959694 - DNA, 22 bp, Homo sapiens
tctaactatacaaagaaaacat

SEQ ID NO: 6959695 - DNA, 22 bp, Homo sapiens
tatttgtatgtgtgtacatata

SEQ ID NO: 6959696 - DNA, 22 bp, Homo sapiens
gatgaagtcagttagtgggaaa

SEQ ID NO: 6959697 - DNA, 22 bp, Homo sapiens
cttcagaactataaaaagtact

SEQ ID NO: 6959698 - DNA, 22 bp, Homo sapiens
tctccaggaagccctccctgac

SEQ ID NO: 6959699 - DNA, 23 bp, Homo sapiens
taggcctccctggagcacccagc

SEQ ID NO: 6959700 - DNA, 20 bp, Homo sapiens
ccagtccaaattccttatga

SEQ ID NO: 6959701 - DNA, 23 bp, Homo sapiens
ccatggccaatgtcaagctacta

SEQ ID NO: 6959702 - DNA, 22 bp, Homo sapiens
atgatatatgtgttgagcttgc

SEQ ID NO: 6959703 - DNA, 22 bp, Homo sapiens
tactgcccagagctgcccgtgg

SEQ ID NO: 6959704 - DNA, 22 bp, Homo sapiens
gactggaatcccaggctctgtg

SEQ ID NO: 6959705 - DNA, 22 bp, Homo sapiens
ggtcagtgcgtgcccgcgcgtg

SEQ ID NO: 6959706 - DNA, 22 bp, Homo sapiens
tggcagttgtgaggttcatatt

SEQ ID NO: 6959707 - DNA, 22 bp, Homo sapiens
aaagcatgattagatagatgat

SEQ ID NO: 6959708 - DNA, 22 bp, Homo sapiens
acctgaggctgttagtctaggt

SEQ ID NO: 6959709 - DNA, 22 bp, Homo sapiens
agctagcttagcctgtgaggta

SEQ ID NO: 6959710 - DNA, 23 bp, Homo sapiens
acagagactgccaagatattctc

SEQ ID NO: 6959711 - DNA, 18 bp, Homo sapiens
gtcagtagagcctgtccc

SEQ ID NO: 6959712 - DNA, 20 bp, Homo sapiens
tacagaaacaggacttttgg

SEQ ID NO: 6959713 - DNA, 22 bp, Homo sapiens
tagttcaaagtctgtcaaagga

SEQ ID NO: 6959714 - DNA, 22 bp, Homo sapiens
tagcattatttcctctttttgt

SEQ ID NO: 6959715 - DNA, 22 bp, Homo sapiens
gaggcctggtctatgagatgtt

SEQ ID NO: 6959716 - DNA, 22 bp, Homo sapiens
ctgctactggccagctttgcag

SEQ ID NO: 6959717 - DNA, 22 bp, Homo sapiens
gacattcagccaattactttct

SEQ ID NO: 6959718 - DNA, 22 bp, Homo sapiens
agacagtgtggttggtggttcc

SEQ ID NO: 6959719 - DNA, 22 bp, Homo sapiens
ggcattgcatgacacgcagctg

SEQ ID NO: 6959720 - DNA, 23 bp, Homo sapiens
gtaactggggaatttgagctatg

SEQ ID NO: 6959721 - DNA, 22 bp, Homo sapiens
tataaattaatgtgcccatgag

SEQ ID NO: 6959722 - DNA, 22 bp, Homo sapiens
aaatggatggaaagcaattttt

SEQ ID NO: 6959723 - DNA, 22 bp, Homo sapiens
gcacctggtttatataatcata

SEQ ID NO: 6959724 - DNA, 22 bp, Homo sapiens
tcatttatagaagtgggcagta

SEQ ID NO: 6959725 - DNA, 22 bp, Homo sapiens
gttttgaatcactgcgcttcac

SEQ ID NO: 6959726 - DNA, 22 bp, Homo sapiens
tctatcgcttggctatgatttt

SEQ ID NO: 6959727 - DNA, 22 bp, Homo sapiens
aagggctgccagggggtgccag

SEQ ID NO: 6959728 - DNA, 22 bp, Homo sapiens
tatgcacattggtttcctcatt

SEQ ID NO: 6959729 - DNA, 22 bp, Homo sapiens
tttgtccttgtcctacatcggt

SEQ ID NO: 6959730 - DNA, 22 bp, Homo sapiens
ggcagcagggtctagattgatg

SEQ ID NO: 6959731 - DNA, 22 bp, Homo sapiens
atccccctgtatctggaagaat

SEQ ID NO: 6959732 - DNA, 22 bp, Homo sapiens
tgggatgaggcctctgttgtga

SEQ ID NO: 6959733 - DNA, 22 bp, Homo sapiens
ggcagtagccagggactggcag

SEQ ID NO: 6959734 - DNA, 22 bp, Homo sapiens
ggccagtattgaggctatatat

SEQ ID NO: 6959735 - DNA, 22 bp, Homo sapiens
tgatggaaatgttctgtatctg

SEQ ID NO: 6959736 - DNA, 23 bp, Homo sapiens
ggtccacccgagcctgcagcttc

SEQ ID NO: 6959737 - DNA, 22 bp, Homo sapiens
actgaaatttatattttgggca

SEQ ID NO: 6959738 - DNA, 22 bp, Homo sapiens
gaagtttgatttttctcctaga

SEQ ID NO: 6959739 - DNA, 20 bp, Homo sapiens
acttagtgtagggttcctag

SEQ ID NO: 6959740 - DNA, 22 bp, Homo sapiens
ggtacagaataaaaatcctaca

SEQ ID NO: 6959741 - DNA, 18 bp, Homo sapiens
cattcttggcagcttttg

SEQ ID NO: 6959742 - DNA, 22 bp, Homo sapiens
ccagccatgggccacctagctg

SEQ ID NO: 6959743 - DNA, 22 bp, Homo sapiens
aggcacttaacctactaactga

SEQ ID NO: 6959744 - DNA, 22 bp, Homo sapiens
aagccaggctgcacttgctggg

SEQ ID NO: 6959745 - DNA, 22 bp, Homo sapiens
tctagctcctgagtgccagagg

SEQ ID NO: 6959746 - DNA, 22 bp, Homo sapiens
tgcagagagatcctcagggttt

SEQ ID NO: 6959747 - DNA, 18 bp, Homo sapiens
agaagcctgcctcaatgc

SEQ ID NO: 6959748 - DNA, 22 bp, Homo sapiens
tgttattctggccagcaccgtt

SEQ ID NO: 6959749 - DNA, 22 bp, Homo sapiens
actttcaattcactgagatata

SEQ ID NO: 6959750 - DNA, 22 bp, Homo sapiens
atgtttccagatatgtcaccct

SEQ ID NO: 6959751 - DNA, 22 bp, Homo sapiens
tactgctttgactgtatgggac

SEQ ID NO: 6959752 - DNA, 22 bp, Homo sapiens
gacccagcctggtttttatagg

SEQ ID NO: 6959753 - DNA, 22 bp, Homo sapiens
tgtaaaacaaaatttgtggaga

SEQ ID NO: 6959754 - DNA, 22 bp, Homo sapiens
tcacaaatcattttatctgtgt

SEQ ID NO: 6959755 - DNA, 22 bp, Homo sapiens
tggttgaacaagttgggtatat

SEQ ID NO: 6959756 - DNA, 22 bp, Homo sapiens
gctcaggaaacagcagggcttg

SEQ ID NO: 6959757 - DNA, 22 bp, Homo sapiens
ttaaggggacagattttgtcag

SEQ ID NO: 6959758 - DNA, 22 bp, Homo sapiens
aatgagccaatgtttatgaagt

SEQ ID NO: 6959759 - DNA, 22 bp, Homo sapiens
agctagttcactgaagcctatg

SEQ ID NO: 6959760 - DNA, 22 bp, Homo sapiens
gctctgaggaatatataattgg

SEQ ID NO: 6959761 - DNA, 22 bp, Homo sapiens
tttctagatattcgcagataga

SEQ ID NO: 6959762 - DNA, 22 bp, Homo sapiens
tgtgttcagcaggcaccttctt

SEQ ID NO: 6959763 - DNA, 22 bp, Homo sapiens
ccttgctgttagcctacattat

SEQ ID NO: 6959764 - DNA, 22 bp, Homo sapiens
ttgagacagtggggtgttgccg

SEQ ID NO: 6959765 - DNA, 22 bp, Homo sapiens
ttttccttagcttctctgcgag

SEQ ID NO: 6959766 - DNA, 23 bp, Homo sapiens
tttatagcagcatgatttatagt

SEQ ID NO: 6959767 - DNA, 23 bp, Homo sapiens
gagaacagccacagagagctgtg

SEQ ID NO: 6959768 - DNA, 22 bp, Homo sapiens
aattactgtctcctgctggtgt

SEQ ID NO: 6959769 - DNA, 22 bp, Homo sapiens
tcacagttttagctgttaaata

SEQ ID NO: 6959770 - DNA, 22 bp, Homo sapiens
cctcaggcaagtcacttaacat

SEQ ID NO: 6959771 - DNA, 22 bp, Homo sapiens
catgggctgaaaatctgcaaac

SEQ ID NO: 6959772 - DNA, 22 bp, Homo sapiens
tgagtggagactgtgtgtagag

SEQ ID NO: 6959773 - DNA, 22 bp, Homo sapiens
gctgtcacatcaaggcactaaa

SEQ ID NO: 6959774 - DNA, 22 bp, Homo sapiens
ttaaagagtaatcataggtcaa

SEQ ID NO: 6959775 - DNA, 23 bp, Homo sapiens
gctgtcctcctgggcccagcagc

SEQ ID NO: 6959776 - DNA, 22 bp, Homo sapiens
ttgagacaccaaactttcctaa

SEQ ID NO: 6959777 - DNA, 22 bp, Homo sapiens
attagcttaggcatgaagagaa

SEQ ID NO: 6959778 - DNA, 22 bp, Homo sapiens
ggctgccagcactggtgtagag

SEQ ID NO: 6959779 - DNA, 23 bp, Homo sapiens
ttaaaatgtggtctctccctagt

SEQ ID NO: 6959780 - DNA, 22 bp, Homo sapiens
ttgtgtactcaccagcacatac

SEQ ID NO: 6959781 - DNA, 22 bp, Homo sapiens
agcctgcttcctcagggaacaa

SEQ ID NO: 6959782 - DNA, 21 bp, Homo sapiens
atcttaaaaggtcttaacttt

SEQ ID NO: 6959783 - DNA, 22 bp, Homo sapiens
tacattgtgataggaagtcacc

SEQ ID NO: 6959784 - DNA, 22 bp, Homo sapiens
gcaggagttagggtaaaaatga

SEQ ID NO: 6959785 - DNA, 22 bp, Homo sapiens
atcacagtgctaggctgaggga

SEQ ID NO: 6959786 - DNA, 22 bp, Homo sapiens
cctgtttggtacaatctgccaa

SEQ ID NO: 6959787 - DNA, 22 bp, Homo sapiens
ccctttcccttctggctcaggg

SEQ ID NO: 6959788 - DNA, 22 bp, Homo sapiens
tactctaaaattagctcttggc

SEQ ID NO: 6959789 - DNA, 22 bp, Homo sapiens
tatatgtttcttacaaaatatt

SEQ ID NO: 6959790 - DNA, 22 bp, Homo sapiens
attgagctgaaggaagatagtg

SEQ ID NO: 6959791 - DNA, 22 bp, Homo sapiens
tcctggaagccagagttgagga

SEQ ID NO: 6959792 - DNA, 22 bp, Homo sapiens
tgggtccttgctaacttctatg

SEQ ID NO: 6959793 - DNA, 22 bp, Homo sapiens
atgtgcataaacatattgttgg

SEQ ID NO: 6959794 - DNA, 22 bp, Homo sapiens
tagatatgacagcagaacaagc

SEQ ID NO: 6959795 - DNA, 22 bp, Homo sapiens
cagaggctaagatgagtgggtg

SEQ ID NO: 6959796 - DNA, 22 bp, Homo sapiens
gaagaccactgtgaaatgccat

SEQ ID NO: 6959797 - DNA, 22 bp, Homo sapiens
tctacaacgtggttttgttgta

SEQ ID NO: 6959798 - DNA, 22 bp, Homo sapiens
acttctgattaaggatgaatgc

SEQ ID NO: 6959799 - DNA, 21 bp, Homo sapiens
gcagccagacgggattcagtt

SEQ ID NO: 6959800 - DNA, 22 bp, Homo sapiens
aggaaccagacagaactgaatg

SEQ ID NO: 6959801 - DNA, 22 bp, Homo sapiens
tcaacctctggagaaatcagga

SEQ ID NO: 6959802 - DNA, 22 bp, Homo sapiens
gagctcagcaaaggtctgtgtg

SEQ ID NO: 6959803 - DNA, 22 bp, Homo sapiens
actgcattggagagcatgaatt

SEQ ID NO: 6959804 - DNA, 22 bp, Homo sapiens
gtatataaggtaaagcgattgt

SEQ ID NO: 6959805 - DNA, 22 bp, Homo sapiens
aatggagacaagaacccaggac

SEQ ID NO: 6959806 - DNA, 22 bp, Homo sapiens
agcctaggaggttggggctgca

SEQ ID NO: 6959807 - DNA, 22 bp, Homo sapiens
caggaaataaaaagtatcttct

SEQ ID NO: 6959808 - DNA, 22 bp, Homo sapiens
ttttaatgtgctctgcaatgat

SEQ ID NO: 6959809 - DNA, 22 bp, Homo sapiens
gatgccctgcatgagtcctgct

SEQ ID NO: 6959810 - DNA, 22 bp, Homo sapiens
ctggttcaagtcctggctctgt

SEQ ID NO: 6959811 - DNA, 22 bp, Homo sapiens
caaagcagacctttacccttta

SEQ ID NO: 6959812 - DNA, 22 bp, Homo sapiens
accagtggaattattctgtggt

SEQ ID NO: 6959813 - DNA, 22 bp, Homo sapiens
cttctgctgctgttcatggttg

SEQ ID NO: 6959814 - DNA, 22 bp, Homo sapiens
ctaaacctttgtgcttgcaatt

SEQ ID NO: 6959815 - DNA, 22 bp, Homo sapiens
gatttgtggtgtgaggaagagc

SEQ ID NO: 6959816 - DNA, 21 bp, Homo sapiens
tgggtccccgacacgctacct

SEQ ID NO: 6959817 - DNA, 22 bp, Homo sapiens
gagtgtgttctttatgctgtga

SEQ ID NO: 6959818 - DNA, 22 bp, Homo sapiens
tgcactggggtcccagcgcacg

SEQ ID NO: 6959819 - DNA, 22 bp, Homo sapiens
ccccacttgctcagcatgtcca

SEQ ID NO: 6959820 - DNA, 22 bp, Homo sapiens
caggtgctgcgtggcggagctg

SEQ ID NO: 6959821 - DNA, 22 bp, Homo sapiens
ctaagaaaatagaagcatgcta

SEQ ID NO: 6959822 - DNA, 22 bp, Homo sapiens
tgtgttcagaatttgctgcttt

SEQ ID NO: 6959823 - DNA, 22 bp, Homo sapiens
gcagagctgtctaagtcacttc

SEQ ID NO: 6959824 - DNA, 23 bp, Homo sapiens
attttgcctcttggctgcttagg

SEQ ID NO: 6959825 - DNA, 22 bp, Homo sapiens
tacaggttacacttttaaaagt

SEQ ID NO: 6959826 - DNA, 22 bp, Homo sapiens
atgttgaactaggatctcttga

SEQ ID NO: 6959827 - DNA, 22 bp, Homo sapiens
gaatggctatcggattattagg

SEQ ID NO: 6959828 - DNA, 22 bp, Homo sapiens
ttggagtcattggcctgggtga

SEQ ID NO: 6959829 - DNA, 22 bp, Homo sapiens
aaatggaggcacgcagtggtta

SEQ ID NO: 6959830 - DNA, 22 bp, Homo sapiens
tttgtgcctcatcatccaaggt

SEQ ID NO: 6959831 - DNA, 19 bp, Homo sapiens
acatttagaatgtacttgc

SEQ ID NO: 6959832 - DNA, 22 bp, Homo sapiens
taatgcttatgttatgcaattt

SEQ ID NO: 6959833 - DNA, 22 bp, Homo sapiens
gagctgcagacatagataagcg

SEQ ID NO: 6959834 - DNA, 22 bp, Homo sapiens
tggcactgtagccactactgcc

SEQ ID NO: 6959835 - DNA, 20 bp, Homo sapiens
ttgctgttgccaagattttg

SEQ ID NO: 6959836 - DNA, 22 bp, Homo sapiens
tcggtgcgcgaggcgcggtccc

SEQ ID NO: 6959837 - DNA, 22 bp, Homo sapiens
gaggctggaggtcaaagatgaa

SEQ ID NO: 6959838 - DNA, 22 bp, Homo sapiens
ccacatctcttgatgtacctac

SEQ ID NO: 6959839 - DNA, 23 bp, Homo sapiens
gtctttatagtggggcactttgt

SEQ ID NO: 6959840 - DNA, 22 bp, Homo sapiens
gtcctctgtttccatctgactt

SEQ ID NO: 6959841 - DNA, 22 bp, Homo sapiens
gctggctggaggagggaggttg

SEQ ID NO: 6959842 - DNA, 23 bp, Homo sapiens
gtcaggtcattagaggtgacttc

SEQ ID NO: 6959843 - DNA, 22 bp, Homo sapiens
ttgctcagctgtgagatatcca

SEQ ID NO: 6959844 - DNA, 22 bp, Homo sapiens
attgacaagaaagatattttta

SEQ ID NO: 6959845 - DNA, 23 bp, Homo sapiens
aggagttgagggttgggttggca

SEQ ID NO: 6959846 - DNA, 22 bp, Homo sapiens
catcctgcggggagcagagggc

SEQ ID NO: 6959847 - DNA, 22 bp, Homo sapiens
tcatgcactatagtgtttgaca

SEQ ID NO: 6959848 - DNA, 19 bp, Homo sapiens
gagcaacatatgtaaactc

SEQ ID NO: 6959849 - DNA, 22 bp, Homo sapiens
gagaaactgaaacatagggcca

SEQ ID NO: 6959850 - DNA, 22 bp, Homo sapiens
acaggtctgtgtgcacagtgct

SEQ ID NO: 6959851 - DNA, 22 bp, Homo sapiens
cccaggagatggaggttgcagt

SEQ ID NO: 6959852 - DNA, 22 bp, Homo sapiens
taagtgaattgtccgaggacac

SEQ ID NO: 6959853 - DNA, 20 bp, Homo sapiens
aagtaatatttgtgtaactg

SEQ ID NO: 6959854 - DNA, 22 bp, Homo sapiens
actctgggatgagaaaagggtt

SEQ ID NO: 6959855 - DNA, 22 bp, Homo sapiens
attgttcaaagtgctttgcatg

SEQ ID NO: 6959856 - DNA, 22 bp, Homo sapiens
atgcctggatttgggactcaaa

SEQ ID NO: 6959857 - DNA, 22 bp, Homo sapiens
agatgcctaaatctgggcaagg

SEQ ID NO: 6959858 - DNA, 22 bp, Homo sapiens
acagccagcttgatgggatccg

SEQ ID NO: 6959859 - DNA, 22 bp, Homo sapiens
acaattgtgagtatgaagtgat

SEQ ID NO: 6959860 - DNA, 22 bp, Homo sapiens
ttttatacacatgaacatgcag

SEQ ID NO: 6959861 - DNA, 22 bp, Homo sapiens
ttgttgctgctcaacctctata

SEQ ID NO: 6959862 - DNA, 22 bp, Homo sapiens
tcagaggcttctgctcacctca

SEQ ID NO: 6959863 - DNA, 22 bp, Homo sapiens
ggcctggaagaggacagagaaa

SEQ ID NO: 6959864 - DNA, 22 bp, Homo sapiens
ccctggctatttttacgcaagg

SEQ ID NO: 6959865 - DNA, 22 bp, Homo sapiens
cagcatgagaaaatgaatcaga

SEQ ID NO: 6959866 - DNA, 22 bp, Homo sapiens
gccagaggtatcaaagatagta

SEQ ID NO: 6959867 - DNA, 22 bp, Homo sapiens
ctggggccacaacggcgcacgc

SEQ ID NO: 6959868 - DNA, 22 bp, Homo sapiens
agcgtgggtccaaggctctggt

SEQ ID NO: 6959869 - DNA, 22 bp, Homo sapiens
tggcctctgcactgggctcccc

SEQ ID NO: 6959870 - DNA, 22 bp, Homo sapiens
gcagagccaggctggggcaggt

SEQ ID NO: 6959871 - DNA, 22 bp, Homo sapiens
ccagatctagtgttgtaaagct

SEQ ID NO: 6959872 - DNA, 22 bp, Homo sapiens
ccagctgcttgggaaaatgtct

SEQ ID NO: 6959873 - DNA, 22 bp, Homo sapiens
aggtctgagtctatatacattg

SEQ ID NO: 6959874 - DNA, 22 bp, Homo sapiens
tgctctgattggagtctgttgc

SEQ ID NO: 6959875 - DNA, 18 bp, Homo sapiens
agtaaatgctaaggtctg

SEQ ID NO: 6959876 - DNA, 22 bp, Homo sapiens
tatttgctgaatctgattcaga

SEQ ID NO: 6959877 - DNA, 22 bp, Homo sapiens
atgttaaaagtctgagtgggag

SEQ ID NO: 6959878 - DNA, 22 bp, Homo sapiens
ttggtcaaggacattacagttt

SEQ ID NO: 6959879 - DNA, 22 bp, Homo sapiens
ctaggctggagtgcagtggcac

SEQ ID NO: 6959880 - DNA, 20 bp, Homo sapiens
acaggggcagcacaataatg

SEQ ID NO: 6959881 - DNA, 20 bp, Homo sapiens
aaattactgccacacatttc

SEQ ID NO: 6959882 - DNA, 22 bp, Homo sapiens
tcccaagcaatgagtcagggcc

SEQ ID NO: 6959883 - DNA, 22 bp, Homo sapiens
tgctttcaaaggctttctagat

SEQ ID NO: 6959884 - DNA, 22 bp, Homo sapiens
ctgcagctgcagttctgagaga

SEQ ID NO: 6959885 - DNA, 22 bp, Homo sapiens
gatcatttgactttataaggct

SEQ ID NO: 6959886 - DNA, 22 bp, Homo sapiens
ctggtcatgccaggtttgctgc

SEQ ID NO: 6959887 - DNA, 22 bp, Homo sapiens
actgtcttgctatgagctccca

SEQ ID NO: 6959888 - DNA, 22 bp, Homo sapiens
tgtagcacactcaggggtagca

SEQ ID NO: 6959889 - DNA, 22 bp, Homo sapiens
tggctgccatgacgcctgggga

SEQ ID NO: 6959890 - DNA, 22 bp, Homo sapiens
gcgcctggcacacagcaagggc

SEQ ID NO: 6959891 - DNA, 22 bp, Homo sapiens
tggactcaagtccaagttcacg

SEQ ID NO: 6959892 - DNA, 22 bp, Homo sapiens
cagataaatagatagataaact

SEQ ID NO: 6959893 - DNA, 22 bp, Homo sapiens
agcagggctccatttcactgcc

SEQ ID NO: 6959894 - DNA, 22 bp, Homo sapiens
tgtgaggctggcaggggccagg

SEQ ID NO: 6959895 - DNA, 22 bp, Homo sapiens
tggtttgtatatgtttgtgaga

SEQ ID NO: 6959896 - DNA, 22 bp, Homo sapiens
aactaaatgtgtatctactcaa

SEQ ID NO: 6959897 - DNA, 22 bp, Homo sapiens
tgagccccaggaaattgaggag

SEQ ID NO: 6959898 - DNA, 22 bp, Homo sapiens
cagcatctcacttcccagaagg

SEQ ID NO: 6959899 - DNA, 22 bp, Homo sapiens
aaggccagctggagggatgagg

SEQ ID NO: 6959900 - DNA, 22 bp, Homo sapiens
ctcttgggagtgctctggagaa

SEQ ID NO: 6959901 - DNA, 22 bp, Homo sapiens
atgtgccagtgccaggtctcta

SEQ ID NO: 6959902 - DNA, 22 bp, Homo sapiens
gctctctttaaactgcatggct

SEQ ID NO: 6959903 - DNA, 22 bp, Homo sapiens
gagctcaggtggtcaaaacaat

SEQ ID NO: 6959904 - DNA, 22 bp, Homo sapiens
ttccttttacaaatagcctcct

SEQ ID NO: 6959905 - DNA, 22 bp, Homo sapiens
cccgtgggagagacacgcaccc

SEQ ID NO: 6959906 - DNA, 19 bp, Homo sapiens
tattgcagtgttaggagga

SEQ ID NO: 6959907 - DNA, 22 bp, Homo sapiens
gtattattctcagctttgggat

SEQ ID NO: 6959908 - DNA, 22 bp, Homo sapiens
cctgactctggccaggccagct

SEQ ID NO: 6959909 - DNA, 22 bp, Homo sapiens
atgcatattgtcatttagtcct

SEQ ID NO: 6959910 - DNA, 22 bp, Homo sapiens
aattagctgcaaaggatgttat

SEQ ID NO: 6959911 - DNA, 22 bp, Homo sapiens
ctggatttaattaactgttgct

SEQ ID NO: 6959912 - DNA, 22 bp, Homo sapiens
tgtcatgccaggaaatagtccc

SEQ ID NO: 6959913 - DNA, 22 bp, Homo sapiens
acagcaagacccctagcatggt

SEQ ID NO: 6959914 - DNA, 22 bp, Homo sapiens
ccacttgacaataaactgagct

SEQ ID NO: 6959915 - DNA, 23 bp, Homo sapiens
aagtgctttgggatggagtctgg

SEQ ID NO: 6959916 - DNA, 22 bp, Homo sapiens
tagtccagtgtttgaattcaat

SEQ ID NO: 6959917 - DNA, 22 bp, Homo sapiens
ttttctgttacaaagtacagcg

SEQ ID NO: 6959918 - DNA, 22 bp, Homo sapiens
gctgctctctccctaagttggg

SEQ ID NO: 6959919 - DNA, 22 bp, Homo sapiens
aaattagtgcaccaggttgaag

SEQ ID NO: 6959920 - DNA, 22 bp, Homo sapiens
cagaacttgatcagagctgaag

SEQ ID NO: 6959921 - DNA, 21 bp, Homo sapiens
gattatgagttcggtttgggg

SEQ ID NO: 6959922 - DNA, 22 bp, Homo sapiens
agtagaatcagcctcttgatgg

SEQ ID NO: 6959923 - DNA, 22 bp, Homo sapiens
tgtctaatgaattaattaatta

SEQ ID NO: 6959924 - DNA, 22 bp, Homo sapiens
gctgcccacaatgattacatgg

SEQ ID NO: 6959925 - DNA, 18 bp, Homo sapiens
ggcagatgacaggagaga

SEQ ID NO: 6959926 - DNA, 22 bp, Homo sapiens
tggcagtctgggttggcagtta

SEQ ID NO: 6959927 - DNA, 22 bp, Homo sapiens
tgcaggacccgggctgtggtca

SEQ ID NO: 6959928 - DNA, 22 bp, Homo sapiens
aaatgtctgtaggggctgcagg

SEQ ID NO: 6959929 - DNA, 22 bp, Homo sapiens
acagctgtgttttataatcagc

SEQ ID NO: 6959930 - DNA, 22 bp, Homo sapiens
taaggcattagagtgaaagcaa

SEQ ID NO: 6959931 - DNA, 22 bp, Homo sapiens
tttaatgtagcgtgaaatgatt

SEQ ID NO: 6959932 - DNA, 20 bp, Homo sapiens
gagagtgcttttcattgctc

SEQ ID NO: 6959933 - DNA, 22 bp, Homo sapiens
tgctggaggagtttactgtggc

SEQ ID NO: 6959934 - DNA, 22 bp, Homo sapiens
actcaggccccatcgcccatct

SEQ ID NO: 6959935 - DNA, 22 bp, Homo sapiens
atatcaagattattagggtcat

SEQ ID NO: 6959936 - DNA, 22 bp, Homo sapiens
ttagctcatcaggtgtatatag

SEQ ID NO: 6959937 - DNA, 22 bp, Homo sapiens
gctctgaatcaatcagataagg

SEQ ID NO: 6959938 - DNA, 22 bp, Homo sapiens
tattggcttggagcattttcct

SEQ ID NO: 6959939 - DNA, 22 bp, Homo sapiens
attcaagtggctgctatgttaa

SEQ ID NO: 6959940 - DNA, 22 bp, Homo sapiens
atggcttgcttttagagagatc

SEQ ID NO: 6959941 - DNA, 22 bp, Homo sapiens
acttactactcctttgcaattt

SEQ ID NO: 6959942 - DNA, 22 bp, Homo sapiens
agcagggttctcagttggtgct

SEQ ID NO: 6959943 - DNA, 22 bp, Homo sapiens
ctttatgtgctgggcattaagg

SEQ ID NO: 6959944 - DNA, 22 bp, Homo sapiens
gagctgttcaaggacaggcacg

SEQ ID NO: 6959945 - DNA, 22 bp, Homo sapiens
aatcagtggttcccagcccagg

SEQ ID NO: 6959946 - DNA, 23 bp, Homo sapiens
ggctggcccggggctgctcctga

SEQ ID NO: 6959947 - DNA, 18 bp, Homo sapiens
actctgggacctgttatt

SEQ ID NO: 6959948 - DNA, 22 bp, Homo sapiens
gctgaggtttcaggagtggcag

SEQ ID NO: 6959949 - DNA, 22 bp, Homo sapiens
catggtgcagggcacatgagga

SEQ ID NO: 6959950 - DNA, 19 bp, Homo sapiens
acaggcagaattgggtgtg

SEQ ID NO: 6959951 - DNA, 22 bp, Homo sapiens
gggacctgccaaggccacccag

SEQ ID NO: 6959952 - DNA, 22 bp, Homo sapiens
tgtttctatctggatcaataga

SEQ ID NO: 6959953 - DNA, 22 bp, Homo sapiens
agtcttcccagaggaggtgcca

SEQ ID NO: 6959954 - DNA, 22 bp, Homo sapiens
gcctctgtggctcagccttgct

SEQ ID NO: 6959955 - DNA, 22 bp, Homo sapiens
gagggcctactggacatgtcag

SEQ ID NO: 6959956 - DNA, 22 bp, Homo sapiens
ctagaggtctactcttggtagt

SEQ ID NO: 6959957 - DNA, 22 bp, Homo sapiens
atggcatttgaatctgtctttt

SEQ ID NO: 6959958 - DNA, 19 bp, Homo sapiens
atagcttgtcagctgctcc

SEQ ID NO: 6959959 - DNA, 20 bp, Homo sapiens
agagagcacaggcaggaaag

SEQ ID NO: 6959960 - DNA, 22 bp, Homo sapiens
gccttggctgttggagcttgat

SEQ ID NO: 6959961 - DNA, 23 bp, Homo sapiens
atgttacttaacctctctgtgcc

SEQ ID NO: 6959962 - DNA, 22 bp, Homo sapiens
caaagtcccagctgcttagaga

SEQ ID NO: 6959963 - DNA, 22 bp, Homo sapiens
caagccattctcctgcctcagc

SEQ ID NO: 6959964 - DNA, 22 bp, Homo sapiens
ccggggacagcaggtccgactt

SEQ ID NO: 6959965 - DNA, 22 bp, Homo sapiens
acattgaattcaaaattactga

SEQ ID NO: 6959966 - DNA, 22 bp, Homo sapiens
gcagggctggggctgctcctga

SEQ ID NO: 6959967 - DNA, 22 bp, Homo sapiens
ctggcctgatctcatgctgtcc

SEQ ID NO: 6959968 - DNA, 22 bp, Homo sapiens
ttagcacctcattcccaccttc

SEQ ID NO: 6959969 - DNA, 22 bp, Homo sapiens
cgtaattctctctagtacccct

SEQ ID NO: 6959970 - DNA, 22 bp, Homo sapiens
gagggagcttgatggatgtttg

SEQ ID NO: 6959971 - DNA, 22 bp, Homo sapiens
agcccagcctgattctacaccc

SEQ ID NO: 6959972 - DNA, 22 bp, Homo sapiens
tgcaaggtcttctctctggagg

SEQ ID NO: 6959973 - DNA, 22 bp, Homo sapiens
ccatggaagaactgatgtgcca

SEQ ID NO: 6959974 - DNA, 22 bp, Homo sapiens
gctgggagccccgagccagcgc

SEQ ID NO: 6959975 - DNA, 22 bp, Homo sapiens
gtggtcccttctggccctggtc

SEQ ID NO: 6959976 - DNA, 22 bp, Homo sapiens
actttaaagcagaatggctatg

SEQ ID NO: 6959977 - DNA, 23 bp, Homo sapiens
catttcaacgaattttccttctg

SEQ ID NO: 6959978 - DNA, 22 bp, Homo sapiens
catgtcaaccaagatgagatat

SEQ ID NO: 6959979 - DNA, 22 bp, Homo sapiens
gtggcagagcaggagacaggac

SEQ ID NO: 6959980 - DNA, 22 bp, Homo sapiens
gagtcacaaaagatgcccaggg

SEQ ID NO: 6959981 - DNA, 22 bp, Homo sapiens
aggtggagttggctgtagttca

SEQ ID NO: 6959982 - DNA, 20 bp, Homo sapiens
agctccagtgctgacgcttc

SEQ ID NO: 6959983 - DNA, 22 bp, Homo sapiens
caatttcatcttgtgcttcaat

SEQ ID NO: 6959984 - DNA, 22 bp, Homo sapiens
ctgcctgcctggagacagatgg

SEQ ID NO: 6959985 - DNA, 22 bp, Homo sapiens
ttacatcactttacttaataat

SEQ ID NO: 6959986 - DNA, 22 bp, Homo sapiens
aggagacagtttggacgtgtag

SEQ ID NO: 6959987 - DNA, 22 bp, Homo sapiens
aacaaacaaacattttgtcatc

SEQ ID NO: 6959988 - DNA, 22 bp, Homo sapiens
tcagactggggctccctgagga

SEQ ID NO: 6959989 - DNA, 22 bp, Homo sapiens
taggaacttagatgaacacatg

SEQ ID NO: 6959990 - DNA, 22 bp, Homo sapiens
cagggcctgtacaagtcccacc

SEQ ID NO: 6959991 - DNA, 22 bp, Homo sapiens
tattcacagttgatttacagtt

SEQ ID NO: 6959992 - DNA, 22 bp, Homo sapiens
ttgagtcatagattccacaatg

SEQ ID NO: 6959993 - DNA, 22 bp, Homo sapiens
taggccacgaaggagatgatag

SEQ ID NO: 6959994 - DNA, 22 bp, Homo sapiens
acctggagaaagcctctccctg

SEQ ID NO: 6959995 - DNA, 22 bp, Homo sapiens
tacagttctttgaaggatctag

SEQ ID NO: 6959996 - DNA, 22 bp, Homo sapiens
ctgcagtaacgatcatggtgcc

SEQ ID NO: 6959997 - DNA, 22 bp, Homo sapiens
tgggcctgtggggatcttgaag

SEQ ID NO: 6959998 - DNA, 22 bp, Homo sapiens
gcccttagccttatagcctcta

SEQ ID NO: 6959999 - DNA, 22 bp, Homo sapiens
ttctgggcacacaggccctggt

SEQ ID NO: 6960000 - DNA, 22 bp, Homo sapiens
gccagcagtccagtccttagtg

SEQ ID NO: 6960001 - DNA, 22 bp, Homo sapiens
gggcagctctttggtatccttc

SEQ ID NO: 6960002 - DNA, 22 bp, Homo sapiens
tgtaaatgaagtatgctttact

SEQ ID NO: 6960003 - DNA, 22 bp, Homo sapiens
acgatgatgaaagagaacattc

SEQ ID NO: 6960004 - DNA, 22 bp, Homo sapiens
tgtgcttctgcagagactattt

SEQ ID NO: 6960005 - DNA, 22 bp, Homo sapiens
cttaatgtcctctttctgagct

SEQ ID NO: 6960006 - DNA, 22 bp, Homo sapiens
agtcagactatcttggttgaga

SEQ ID NO: 6960007 - DNA, 22 bp, Homo sapiens
gacaccaggaatagttctgtct

SEQ ID NO: 6960008 - DNA, 22 bp, Homo sapiens
ttaattgagccagaaagtatct

SEQ ID NO: 6960009 - DNA, 22 bp, Homo sapiens
ttgaggtctgtgataaaagtca

SEQ ID NO: 6960010 - DNA, 22 bp, Homo sapiens
atgcctctgctcttggtcctca

SEQ ID NO: 6960011 - DNA, 22 bp, Homo sapiens
cacaattctatcagaaagcaga

SEQ ID NO: 6960012 - DNA, 22 bp, Homo sapiens
agaaaaggattgatggatcaga

SEQ ID NO: 6960013 - DNA, 22 bp, Homo sapiens
ctgtggggagctgatcagatca

SEQ ID NO: 6960014 - DNA, 22 bp, Homo sapiens
agcagcaggaggctgtccacca

SEQ ID NO: 6960015 - DNA, 22 bp, Homo sapiens
tatagatcccccgtatgtgtga

SEQ ID NO: 6960016 - DNA, 22 bp, Homo sapiens
attcagtgagtgtttaccggaa

SEQ ID NO: 6960017 - DNA, 22 bp, Homo sapiens
gaggtcccccatggctgtgact

SEQ ID NO: 6960018 - DNA, 22 bp, Homo sapiens
tggaagcatagcagcgtgtgtg

SEQ ID NO: 6960019 - DNA, 22 bp, Homo sapiens
ctgctgggaaggtctgctcagt

SEQ ID NO: 6960020 - DNA, 22 bp, Homo sapiens
tttgtgcaagacatgctaagag

SEQ ID NO: 6960021 - DNA, 22 bp, Homo sapiens
ctgcccagtttgggagcctttc

SEQ ID NO: 6960022 - DNA, 22 bp, Homo sapiens
ctgtgaatttaaagcacacatc

SEQ ID NO: 6960023 - DNA, 22 bp, Homo sapiens
caggaaaatgtcaatggaaagc

SEQ ID NO: 6960024 - DNA, 22 bp, Homo sapiens
gcaagacaatggagcataaacg

SEQ ID NO: 6960025 - DNA, 22 bp, Homo sapiens
gagcatctggctagaggagtga

SEQ ID NO: 6960026 - DNA, 22 bp, Homo sapiens
tttgttcacctagcaaactttt

SEQ ID NO: 6960027 - DNA, 22 bp, Homo sapiens
aggctccaggcaaaatttcgga

SEQ ID NO: 6960028 - DNA, 19 bp, Homo sapiens
ggccggtagacacaaagtg

SEQ ID NO: 6960029 - DNA, 22 bp, Homo sapiens
atgtaactgttatattttgttg

SEQ ID NO: 6960030 - DNA, 22 bp, Homo sapiens
tatgagtacaaggaatcttcca

SEQ ID NO: 6960031 - DNA, 22 bp, Homo sapiens
atgaataaaacattttaatcag

SEQ ID NO: 6960032 - DNA, 22 bp, Homo sapiens
tcctgcccagagctctccactc

SEQ ID NO: 6960033 - DNA, 22 bp, Homo sapiens
gggctcagctgggcgtgctggt

SEQ ID NO: 6960034 - DNA, 20 bp, Homo sapiens
tcatgttgggccatcagaat

SEQ ID NO: 6960035 - DNA, 22 bp, Homo sapiens
actggatcagaatctgattttt

SEQ ID NO: 6960036 - DNA, 22 bp, Homo sapiens
ttacacattaacaggcagctaa

SEQ ID NO: 6960037 - DNA, 16 bp, Homo sapiens
gccacagcccctgtct

SEQ ID NO: 6960038 - DNA, 22 bp, Homo sapiens
tagccagtgccatgggactgat

SEQ ID NO: 6960039 - DNA, 22 bp, Homo sapiens
atgaactcttgctttatttcag

SEQ ID NO: 6960040 - DNA, 20 bp, Homo sapiens
tacagtcagggcacaggcag

SEQ ID NO: 6960041 - DNA, 22 bp, Homo sapiens
tttcatattgtccagtcagcgc

SEQ ID NO: 6960042 - DNA, 19 bp, Homo sapiens
gctgaacaagtcagcaacc

SEQ ID NO: 6960043 - DNA, 22 bp, Homo sapiens
acaacatcagctgagaccttca

SEQ ID NO: 6960044 - DNA, 22 bp, Homo sapiens
cagtccttgctctgggatgatg

SEQ ID NO: 6960045 - DNA, 22 bp, Homo sapiens
gagagagaaaatgactccggac

SEQ ID NO: 6960046 - DNA, 22 bp, Homo sapiens
tactgtgacagagtacttaaac

SEQ ID NO: 6960047 - DNA, 22 bp, Homo sapiens
cagggcagtttgtgcctatgag

SEQ ID NO: 6960048 - DNA, 22 bp, Homo sapiens
agctggagatgcccagcaccgg

SEQ ID NO: 6960049 - DNA, 22 bp, Homo sapiens
tttttataactcttttgtgaca

SEQ ID NO: 6960050 - DNA, 22 bp, Homo sapiens
ggcagatggggtgacaagagag

SEQ ID NO: 6960051 - DNA, 22 bp, Homo sapiens
agagggaaggacagatgtttca

SEQ ID NO: 6960052 - DNA, 22 bp, Homo sapiens
ttaggcataaaggttgtatgca

SEQ ID NO: 6960053 - DNA, 22 bp, Homo sapiens
atcattctctgcttgagcactc

SEQ ID NO: 6960054 - DNA, 22 bp, Homo sapiens
cctacttagcatattttctctt

SEQ ID NO: 6960055 - DNA, 22 bp, Homo sapiens
accatgggtcagccacctcagc

SEQ ID NO: 6960056 - DNA, 23 bp, Homo sapiens
gctgtccccatgctccatccctg

SEQ ID NO: 6960057 - DNA, 22 bp, Homo sapiens
actgtggatgccaaaggggagg

SEQ ID NO: 6960058 - DNA, 22 bp, Homo sapiens
gctgtttagtggcagagtcaga

SEQ ID NO: 6960059 - DNA, 21 bp, Homo sapiens
aggcagctggaaggcctggct

SEQ ID NO: 6960060 - DNA, 22 bp, Homo sapiens
actttgtataagacaataaaga

SEQ ID NO: 6960061 - DNA, 22 bp, Homo sapiens
tcagtgtctgtgggcaggatgg

SEQ ID NO: 6960062 - DNA, 22 bp, Homo sapiens
acaatagagttctcataggaca

SEQ ID NO: 6960063 - DNA, 22 bp, Homo sapiens
aagtcctcaattttctctgcta

SEQ ID NO: 6960064 - DNA, 22 bp, Homo sapiens
tggtctcaggagagtctcttca

SEQ ID NO: 6960065 - DNA, 22 bp, Homo sapiens
ggcttatgtaggacactgtgca

SEQ ID NO: 6960066 - DNA, 22 bp, Homo sapiens
tagatatatctgtcatactggt

SEQ ID NO: 6960067 - DNA, 22 bp, Homo sapiens
gctgcccattgctctcccactc

SEQ ID NO: 6960068 - DNA, 22 bp, Homo sapiens
gccaataactggttccaaattt

SEQ ID NO: 6960069 - DNA, 22 bp, Homo sapiens
ggaagccagaaagtgagaatat

SEQ ID NO: 6960070 - DNA, 20 bp, Homo sapiens
aggatttactactacctgct

SEQ ID NO: 6960071 - DNA, 22 bp, Homo sapiens
gtgtgcatctcacccttccccg

SEQ ID NO: 6960072 - DNA, 21 bp, Homo sapiens
gctctgtacgttggtgccttc

SEQ ID NO: 6960073 - DNA, 22 bp, Homo sapiens
cattagaattaggttgtttacc

SEQ ID NO: 6960074 - DNA, 17 bp, Homo sapiens
agcaggctgcagaggcc

SEQ ID NO: 6960075 - DNA, 22 bp, Homo sapiens
tctctctcagccattacagaac

SEQ ID NO: 6960076 - DNA, 22 bp, Homo sapiens
gatattgcacctctaatacatt

SEQ ID NO: 6960077 - DNA, 22 bp, Homo sapiens
aataacagggttgatttgcaat

SEQ ID NO: 6960078 - DNA, 22 bp, Homo sapiens
agggagctgggccacactgatc

SEQ ID NO: 6960079 - DNA, 22 bp, Homo sapiens
gtctctgttatttccagggtca

SEQ ID NO: 6960080 - DNA, 22 bp, Homo sapiens
tggagagtggatatgggagcaa

SEQ ID NO: 6960081 - DNA, 22 bp, Homo sapiens
tctctggccctgttttctatct

SEQ ID NO: 6960082 - DNA, 22 bp, Homo sapiens
ttttacaagctgagtcgttaaa

SEQ ID NO: 6960083 - DNA, 18 bp, Homo sapiens
agtgggcacacagagaac

SEQ ID NO: 6960084 - DNA, 22 bp, Homo sapiens
tggatggccccactggatccat

SEQ ID NO: 6960085 - DNA, 22 bp, Homo sapiens
ggttcagagaaggctaaatagt

SEQ ID NO: 6960086 - DNA, 22 bp, Homo sapiens
aagcaggagagcctgggtgagc

SEQ ID NO: 6960087 - DNA, 22 bp, Homo sapiens
cctgtgcactatctgcattttt

SEQ ID NO: 6960088 - DNA, 20 bp, Homo sapiens
ccccacactattgagcactt

SEQ ID NO: 6960089 - DNA, 22 bp, Homo sapiens
gggctacagacatgctctaagc

SEQ ID NO: 6960090 - DNA, 22 bp, Homo sapiens
ggcacagagctttgtcccagtt

SEQ ID NO: 6960091 - DNA, 21 bp, Homo sapiens
gcctgccctctgtgatggcca

SEQ ID NO: 6960092 - DNA, 22 bp, Homo sapiens
tttcatttcatagaattgtgtt

SEQ ID NO: 6960093 - DNA, 22 bp, Homo sapiens
gaatatgtgcatttatgagtgt

SEQ ID NO: 6960094 - DNA, 22 bp, Homo sapiens
gtaatagatgaaacaatgtgga

SEQ ID NO: 6960095 - DNA, 22 bp, Homo sapiens
caagctactcaggcaagatgtg

SEQ ID NO: 6960096 - DNA, 22 bp, Homo sapiens
agcaaattcagaagcagaatgg

SEQ ID NO: 6960097 - DNA, 22 bp, Homo sapiens
gtctgaaacgcattgttatcga

SEQ ID NO: 6960098 - DNA, 22 bp, Homo sapiens
atcgtgcatttttattaaccct

SEQ ID NO: 6960099 - DNA, 22 bp, Homo sapiens
cttggggcagcccaggctgagc

SEQ ID NO: 6960100 - DNA, 22 bp, Homo sapiens
tgccttggactctttattccag

SEQ ID NO: 6960101 - DNA, 22 bp, Homo sapiens
tgggcagggtctctgttatcag

SEQ ID NO: 6960102 - DNA, 15 bp, Homo sapiens
taacttttttgggct

SEQ ID NO: 6960103 - DNA, 22 bp, Homo sapiens
tataaaattctcagtttggggt

SEQ ID NO: 6960104 - DNA, 19 bp, Homo sapiens
gggtgaggaagagcgttgc

SEQ ID NO: 6960105 - DNA, 22 bp, Homo sapiens
acaggcctgatgttatcctatt

SEQ ID NO: 6960106 - DNA, 22 bp, Homo sapiens
gctccaggccccagcgttccgc

SEQ ID NO: 6960107 - DNA, 22 bp, Homo sapiens
gtgctgagcatcatgaggcact

SEQ ID NO: 6960108 - DNA, 20 bp, Homo sapiens
acttgcctctatgctacgtt

SEQ ID NO: 6960109 - DNA, 23 bp, Homo sapiens
gcctgccatatacctggaaacag

SEQ ID NO: 6960110 - DNA, 22 bp, Homo sapiens
tccttccaggtccagggatgtg

SEQ ID NO: 6960111 - DNA, 22 bp, Homo sapiens
tatttctcttcaaaattgatgt

SEQ ID NO: 6960112 - DNA, 22 bp, Homo sapiens
cttgcagccttaccaaggcatt

SEQ ID NO: 6960113 - DNA, 22 bp, Homo sapiens
acttagttaagtattttggaaa

SEQ ID NO: 6960114 - DNA, 22 bp, Homo sapiens
aagtgtgttttcagtgtactta

SEQ ID NO: 6960115 - DNA, 22 bp, Homo sapiens
atggaagcagaccggaggaata

SEQ ID NO: 6960116 - DNA, 22 bp, Homo sapiens
caagagctggagaggcagtcta

SEQ ID NO: 6960117 - DNA, 22 bp, Homo sapiens
ctggctccagtgacaagtcgat

SEQ ID NO: 6960118 - DNA, 22 bp, Homo sapiens
cagagccatcatgatatggagt

SEQ ID NO: 6960119 - DNA, 22 bp, Homo sapiens
aggggctccaaggaagtttggg

SEQ ID NO: 6960120 - DNA, 22 bp, Homo sapiens
gagctaaggtcacaagaagcag

SEQ ID NO: 6960121 - DNA, 22 bp, Homo sapiens
ggctggcactgaggagagctct

SEQ ID NO: 6960122 - DNA, 22 bp, Homo sapiens
taaggcagccgctcagagaggt

SEQ ID NO: 6960123 - DNA, 22 bp, Homo sapiens
atcagtgctaagagagggcctg

SEQ ID NO: 6960124 - DNA, 22 bp, Homo sapiens
aatgctttcaaaaatgtgcagt

SEQ ID NO: 6960125 - DNA, 22 bp, Homo sapiens
gggcttcagtaccaaagtttga

SEQ ID NO: 6960126 - DNA, 19 bp, Homo sapiens
ttcatttgtatctgctcac

SEQ ID NO: 6960127 - DNA, 22 bp, Homo sapiens
agtcccatgaggaatggggacg

SEQ ID NO: 6960128 - DNA, 22 bp, Homo sapiens
tgccgcgcgcccaggttaggtg

SEQ ID NO: 6960129 - DNA, 22 bp, Homo sapiens
agacagggtgatcgcttgagcc

SEQ ID NO: 6960130 - DNA, 22 bp, Homo sapiens
gatattcaaagattactgatat

SEQ ID NO: 6960131 - DNA, 22 bp, Homo sapiens
cctaggaagctgagattgcagt

SEQ ID NO: 6960132 - DNA, 22 bp, Homo sapiens
agacaaaggattaatgatgatg

SEQ ID NO: 6960133 - DNA, 22 bp, Homo sapiens
ggagctaggcaaagctcacgga

SEQ ID NO: 6960134 - DNA, 22 bp, Homo sapiens
gagggtgcagctgggccccacg

SEQ ID NO: 6960135 - DNA, 22 bp, Homo sapiens
ttcaaaggcaggatagcagctg

SEQ ID NO: 6960136 - DNA, 22 bp, Homo sapiens
tgaagatcagttttgtgtctga

SEQ ID NO: 6960137 - DNA, 22 bp, Homo sapiens
tggttcagttgcacaggctgtt

SEQ ID NO: 6960138 - DNA, 22 bp, Homo sapiens
agtgaaatcctggtcaacaggt

SEQ ID NO: 6960139 - DNA, 22 bp, Homo sapiens
aacttggctttgccatttatcg

SEQ ID NO: 6960140 - DNA, 22 bp, Homo sapiens
agtaaagcctactcaaccacac

SEQ ID NO: 6960141 - DNA, 22 bp, Homo sapiens
gggcacagtactccaatcaact

SEQ ID NO: 6960142 - DNA, 22 bp, Homo sapiens
tgactctgattgccttagcttg

SEQ ID NO: 6960143 - DNA, 22 bp, Homo sapiens
gcaggtgtcctgggctggcagt

SEQ ID NO: 6960144 - DNA, 22 bp, Homo sapiens
ccaggtgctcttgccagggctg

SEQ ID NO: 6960145 - DNA, 22 bp, Homo sapiens
actcatctttgaattttcagta

SEQ ID NO: 6960146 - DNA, 22 bp, Homo sapiens
tttatactccactctgcaagcg

SEQ ID NO: 6960147 - DNA, 22 bp, Homo sapiens
attctagaaggcaaagcaaggg

SEQ ID NO: 6960148 - DNA, 22 bp, Homo sapiens
aagtctgggccagggcacagcc

SEQ ID NO: 6960149 - DNA, 22 bp, Homo sapiens
tgtcaacaggctttctaaggca

SEQ ID NO: 6960150 - DNA, 22 bp, Homo sapiens
gagaaactaacatctgaaggtg

SEQ ID NO: 6960151 - DNA, 22 bp, Homo sapiens
tttctatttacagtgctaggta

SEQ ID NO: 6960152 - DNA, 22 bp, Homo sapiens
gtacctgagcacgcggtccgag

SEQ ID NO: 6960153 - DNA, 22 bp, Homo sapiens
gtaaaacctgcttttcaacacc

SEQ ID NO: 6960154 - DNA, 22 bp, Homo sapiens
gtacattcatggttccaccagg

SEQ ID NO: 6960155 - DNA, 22 bp, Homo sapiens
gtcagttcattagcacttccaa

SEQ ID NO: 6960156 - DNA, 22 bp, Homo sapiens
ctagatgccaatttttatggat

SEQ ID NO: 6960157 - DNA, 22 bp, Homo sapiens
ggaagattcagcatatatgagt

SEQ ID NO: 6960158 - DNA, 22 bp, Homo sapiens
atcacagtggctacctctggat

SEQ ID NO: 6960159 - DNA, 22 bp, Homo sapiens
ctggtctgcaaggccatataga

SEQ ID NO: 6960160 - DNA, 22 bp, Homo sapiens
gagaggtacaccctttaaactt

SEQ ID NO: 6960161 - DNA, 22 bp, Homo sapiens
tatagcatttatcatctctgaa

SEQ ID NO: 6960162 - DNA, 22 bp, Homo sapiens
ctgggcacactctgctccagct

SEQ ID NO: 6960163 - DNA, 22 bp, Homo sapiens
actgagcagaagagatctgtga

SEQ ID NO: 6960164 - DNA, 22 bp, Homo sapiens
agatgggtgccttctttcttta

SEQ ID NO: 6960165 - DNA, 22 bp, Homo sapiens
catacaaatgtgtccaggctct

SEQ ID NO: 6960166 - DNA, 22 bp, Homo sapiens
aaacggagggcaaatgctgtta

SEQ ID NO: 6960167 - DNA, 22 bp, Homo sapiens
actgcccagaagagatgaaagt

SEQ ID NO: 6960168 - DNA, 22 bp, Homo sapiens
tggcaggttatgcgggccacat

SEQ ID NO: 6960169 - DNA, 22 bp, Homo sapiens
ttaaggaatggttggaatggat

SEQ ID NO: 6960170 - DNA, 22 bp, Homo sapiens
gagtgcaagttttgggtttctt

SEQ ID NO: 6960171 - DNA, 22 bp, Homo sapiens
gaggcagtaattgtgggcaata

SEQ ID NO: 6960172 - DNA, 22 bp, Homo sapiens
tgttggaaaagaattaactagg

SEQ ID NO: 6960173 - DNA, 22 bp, Homo sapiens
ctgggctggcgcatccgacacg

SEQ ID NO: 6960174 - DNA, 22 bp, Homo sapiens
gatgtacaatgtcactatgacc

SEQ ID NO: 6960175 - DNA, 22 bp, Homo sapiens
ggtccttgtgtctctatggccc

SEQ ID NO: 6960176 - DNA, 22 bp, Homo sapiens
ataatatttggataggacagta

SEQ ID NO: 6960177 - DNA, 22 bp, Homo sapiens
aggctccagcccaaggctgcag

SEQ ID NO: 6960178 - DNA, 22 bp, Homo sapiens
gaggtgggcggatcacaaggtc

SEQ ID NO: 6960179 - DNA, 22 bp, Homo sapiens
gctgacagttgtacctgcccct

SEQ ID NO: 6960180 - DNA, 20 bp, Homo sapiens
tgtcatttatttatcaaatg

SEQ ID NO: 6960181 - DNA, 22 bp, Homo sapiens
aacgtcattgattgatggtagt

SEQ ID NO: 6960182 - DNA, 22 bp, Homo sapiens
gtgcttatgtgggagggagagg

SEQ ID NO: 6960183 - DNA, 22 bp, Homo sapiens
cttcaagtaattctgatggcta

SEQ ID NO: 6960184 - DNA, 22 bp, Homo sapiens
gcacacactgttttcctcacat

SEQ ID NO: 6960185 - DNA, 22 bp, Homo sapiens
agatctgcccagggtacaaagg

SEQ ID NO: 6960186 - DNA, 22 bp, Homo sapiens
tgcttacaactttattgaggaa

SEQ ID NO: 6960187 - DNA, 22 bp, Homo sapiens
taggagacattgatcccaagaa

SEQ ID NO: 6960188 - DNA, 22 bp, Homo sapiens
acatcatttgtctgtagctgaa

SEQ ID NO: 6960189 - DNA, 22 bp, Homo sapiens
ccctgaccatcccgcactgact

SEQ ID NO: 6960190 - DNA, 22 bp, Homo sapiens
tccctgtctcccttgagactag

SEQ ID NO: 6960191 - DNA, 22 bp, Homo sapiens
ttctcaaagggtggtttgcaaa

SEQ ID NO: 6960192 - DNA, 22 bp, Homo sapiens
actattgcttagagcaatgggg

SEQ ID NO: 6960193 - DNA, 22 bp, Homo sapiens
aaacattcaaagcaggatgtgt

SEQ ID NO: 6960194 - DNA, 22 bp, Homo sapiens
tcttggcagttcttgtgctttt

SEQ ID NO: 6960195 - DNA, 22 bp, Homo sapiens
aactaaaactggtttgttctct

SEQ ID NO: 6960196 - DNA, 22 bp, Homo sapiens
gactcagatttagagggtaaga

SEQ ID NO: 6960197 - DNA, 22 bp, Homo sapiens
catgaccagagaggacggccag

SEQ ID NO: 6960198 - DNA, 22 bp, Homo sapiens
ctattgggtcagccttctggct

SEQ ID NO: 6960199 - DNA, 22 bp, Homo sapiens
acaagtcagtggaattaatatt

SEQ ID NO: 6960200 - DNA, 22 bp, Homo sapiens
agccttagatttgggcaagaac

SEQ ID NO: 6960201 - DNA, 22 bp, Homo sapiens
tgtttcctttctggtgagcata

SEQ ID NO: 6960202 - DNA, 22 bp, Homo sapiens
actgagctgcaagtcagggagg

SEQ ID NO: 6960203 - DNA, 22 bp, Homo sapiens
atgtaatttgccctcaagttaa

SEQ ID NO: 6960204 - DNA, 20 bp, Homo sapiens
tgttccaagctaatgaatga

SEQ ID NO: 6960205 - DNA, 22 bp, Homo sapiens
tggcctgtgactgcctctgggc

SEQ ID NO: 6960206 - DNA, 22 bp, Homo sapiens
atggcccaaaacctcctccctc

SEQ ID NO: 6960207 - DNA, 17 bp, Homo sapiens
accagagttttccatgc

SEQ ID NO: 6960208 - DNA, 22 bp, Homo sapiens
ctgatacaatgctaataaattt

SEQ ID NO: 6960209 - DNA, 23 bp, Homo sapiens
ttgtatctctggaaattcttcaa

SEQ ID NO: 6960210 - DNA, 20 bp, Homo sapiens
ccaaggacactggctcctgg

SEQ ID NO: 6960211 - DNA, 22 bp, Homo sapiens
gcaacattcatgttctgtaacc

SEQ ID NO: 6960212 - DNA, 22 bp, Homo sapiens
gtccttctcaaatcctgtgttt

SEQ ID NO: 6960213 - DNA, 22 bp, Homo sapiens
tgaggcctgaagcctgaagtga

SEQ ID NO: 6960214 - DNA, 22 bp, Homo sapiens
ctggtctggtttgtttagacag

SEQ ID NO: 6960215 - DNA, 22 bp, Homo sapiens
gcagtgtcagtgcctgggtggt

SEQ ID NO: 6960216 - DNA, 18 bp, Homo sapiens
tagggccaaaatggaaaa

SEQ ID NO: 6960217 - DNA, 20 bp, Homo sapiens
ttgaaattggatggtagcta

SEQ ID NO: 6960218 - DNA, 22 bp, Homo sapiens
tctgaaatattggtaatacttt

SEQ ID NO: 6960219 - DNA, 20 bp, Homo sapiens
aggagaccaagccaagtgga

SEQ ID NO: 6960220 - DNA, 22 bp, Homo sapiens
atattttggtagctctcaatga

SEQ ID NO: 6960221 - DNA, 22 bp, Homo sapiens
ctcaagatattccagctctcaa

SEQ ID NO: 6960222 - DNA, 22 bp, Homo sapiens
ctggcaatgggagtagtagggt

SEQ ID NO: 6960223 - DNA, 22 bp, Homo sapiens
agcagtaagtgaagactagttt

SEQ ID NO: 6960224 - DNA, 22 bp, Homo sapiens
aaaggcacagaagggaaaccaa

SEQ ID NO: 6960225 - DNA, 22 bp, Homo sapiens
gtgagggcaaattagaatcaaa

SEQ ID NO: 6960226 - DNA, 19 bp, Homo sapiens
atgcacagtcatttgtaag

SEQ ID NO: 6960227 - DNA, 22 bp, Homo sapiens
ggctgtggtggcatccctgagc

SEQ ID NO: 6960228 - DNA, 22 bp, Homo sapiens
gtgagacaagatttgtaggcag

SEQ ID NO: 6960229 - DNA, 22 bp, Homo sapiens
ttcagttttattgtactgctat

SEQ ID NO: 6960230 - DNA, 22 bp, Homo sapiens
atctgtttaattcattttcaca

SEQ ID NO: 6960231 - DNA, 19 bp, Homo sapiens
tctgtgctgggaggcagca

SEQ ID NO: 6960232 - DNA, 22 bp, Homo sapiens
gcacagttgacaatgattaaga

SEQ ID NO: 6960233 - DNA, 22 bp, Homo sapiens
gctaatgtgatagagcagaaag

SEQ ID NO: 6960234 - DNA, 19 bp, Homo sapiens
cagcaaacactgtaaatgg

SEQ ID NO: 6960235 - DNA, 22 bp, Homo sapiens
cttctttgttctgttgtctcac

SEQ ID NO: 6960236 - DNA, 22 bp, Homo sapiens
aacagtgtgtacacatcatagg

SEQ ID NO: 6960237 - DNA, 22 bp, Homo sapiens
tgacatttactattcctggtta

SEQ ID NO: 6960238 - DNA, 22 bp, Homo sapiens
ttctgcatttctaataagttcc

SEQ ID NO: 6960239 - DNA, 22 bp, Homo sapiens
tggccacatgcgtctgtgaggc

SEQ ID NO: 6960240 - DNA, 22 bp, Homo sapiens
atttggtctccatactggttag

SEQ ID NO: 6960241 - DNA, 21 bp, Homo sapiens
ggtctgctgtgtctagcctca

SEQ ID NO: 6960242 - DNA, 22 bp, Homo sapiens
tctgtctcaagttcttgcactc

SEQ ID NO: 6960243 - DNA, 22 bp, Homo sapiens
caggccagggttgagaagagaa

SEQ ID NO: 6960244 - DNA, 22 bp, Homo sapiens
gctcacagtacagtgctggctc

SEQ ID NO: 6960245 - DNA, 17 bp, Homo sapiens
acagtttgattttagca

SEQ ID NO: 6960246 - DNA, 22 bp, Homo sapiens
gcttggcagtgggtcctgcctt

SEQ ID NO: 6960247 - DNA, 23 bp, Homo sapiens
tggctcagctagttttccatttc

SEQ ID NO: 6960248 - DNA, 22 bp, Homo sapiens
tagcagcatgtaagtgagtaga

SEQ ID NO: 6960249 - DNA, 22 bp, Homo sapiens
gagtgtcaaggctctctttggc

SEQ ID NO: 6960250 - DNA, 22 bp, Homo sapiens
tgggagatttctgtcctcaatg

SEQ ID NO: 6960251 - DNA, 22 bp, Homo sapiens
attccacacagtaatactcaat

SEQ ID NO: 6960252 - DNA, 22 bp, Homo sapiens
agcagccaggaatctgcagagc

SEQ ID NO: 6960253 - DNA, 22 bp, Homo sapiens
aaggcaggatgggaaaagattt

SEQ ID NO: 6960254 - DNA, 22 bp, Homo sapiens
ccacagaatgatgacacttcag

SEQ ID NO: 6960255 - DNA, 22 bp, Homo sapiens
ctgcctgttttctgatagattt

SEQ ID NO: 6960256 - DNA, 22 bp, Homo sapiens
tcaggtcctctgggtcccagcc

SEQ ID NO: 6960257 - DNA, 22 bp, Homo sapiens
cacactaatttttcaagagttt

SEQ ID NO: 6960258 - DNA, 22 bp, Homo sapiens
caaatgcatgagaaataagagg

SEQ ID NO: 6960259 - DNA, 22 bp, Homo sapiens
tgggcctgtgatgctgggctat

SEQ ID NO: 6960260 - DNA, 22 bp, Homo sapiens
catggcttctgatcaaggaact

SEQ ID NO: 6960261 - DNA, 22 bp, Homo sapiens
atgcttctgctcatatttcatt

SEQ ID NO: 6960262 - DNA, 22 bp, Homo sapiens
ccctcagggaccactgacttca

SEQ ID NO: 6960263 - DNA, 22 bp, Homo sapiens
ctctggaccctcctgctgagag

SEQ ID NO: 6960264 - DNA, 22 bp, Homo sapiens
gtagtagatgagaatctcttta

SEQ ID NO: 6960265 - DNA, 22 bp, Homo sapiens
gctttacagggcacaaagggag

SEQ ID NO: 6960266 - DNA, 20 bp, Homo sapiens
tgcccagcaagagtgcagtt

SEQ ID NO: 6960267 - DNA, 22 bp, Homo sapiens
tactataccatgtaagatatga

SEQ ID NO: 6960268 - DNA, 22 bp, Homo sapiens
atcaacataaagaagtcctcag

SEQ ID NO: 6960269 - DNA, 22 bp, Homo sapiens
ttcaagttgtgttttccgggct

SEQ ID NO: 6960270 - DNA, 22 bp, Homo sapiens
ctaggtattcatgtttcgtggc

SEQ ID NO: 6960271 - DNA, 21 bp, Homo sapiens
ccagggaagaaatgagggcag

SEQ ID NO: 6960272 - DNA, 22 bp, Homo sapiens
tgttcaagtggatgtggctttt

SEQ ID NO: 6960273 - DNA, 22 bp, Homo sapiens
agtgtctgttgagtttcaaaag

SEQ ID NO: 6960274 - DNA, 17 bp, Homo sapiens
ttggccttctagcctct

SEQ ID NO: 6960275 - DNA, 22 bp, Homo sapiens
ctgccagcaatgtgaccatgct

SEQ ID NO: 6960276 - DNA, 22 bp, Homo sapiens
gaagagatgacaaaggagcatg

SEQ ID NO: 6960277 - DNA, 22 bp, Homo sapiens
caaggcattctcaccaactctc

SEQ ID NO: 6960278 - DNA, 22 bp, Homo sapiens
ttgcatatgaagctgacttaaa

SEQ ID NO: 6960279 - DNA, 22 bp, Homo sapiens
actgaagctgggcgatgcctcc

SEQ ID NO: 6960280 - DNA, 22 bp, Homo sapiens
tcacttaggccttcctgtcata

SEQ ID NO: 6960281 - DNA, 22 bp, Homo sapiens
cagggccttatcctgccattga

SEQ ID NO: 6960282 - DNA, 22 bp, Homo sapiens
ctgtctctctaggacactgggg

SEQ ID NO: 6960283 - DNA, 22 bp, Homo sapiens
agattcttgagtagctgtgctt

SEQ ID NO: 6960284 - DNA, 22 bp, Homo sapiens
aatctgtagggaacaactgtac

SEQ ID NO: 6960285 - DNA, 22 bp, Homo sapiens
cctggggacctgcctcagccct

SEQ ID NO: 6960286 - DNA, 22 bp, Homo sapiens
ctccggagaggtcggaaaacag

SEQ ID NO: 6960287 - DNA, 22 bp, Homo sapiens
gacaaggaaattactagctgga

SEQ ID NO: 6960288 - DNA, 22 bp, Homo sapiens
ctctgggcaggaccagtggacc

SEQ ID NO: 6960289 - DNA, 22 bp, Homo sapiens
ggtctgaaaatggtgaccacca

SEQ ID NO: 6960290 - DNA, 22 bp, Homo sapiens
tctctgcccatgagcaatctgc

SEQ ID NO: 6960291 - DNA, 22 bp, Homo sapiens
cagctgctgagaagcctccctt

SEQ ID NO: 6960292 - DNA, 21 bp, Homo sapiens
ccaccaggtcttctgctcggg

SEQ ID NO: 6960293 - DNA, 22 bp, Homo sapiens
cctgtgaggtcatctgtggtaa

SEQ ID NO: 6960294 - DNA, 18 bp, Homo sapiens
tttaggaattccaagaga

SEQ ID NO: 6960295 - DNA, 22 bp, Homo sapiens
tatatcttatatgtgcaggtac

SEQ ID NO: 6960296 - DNA, 22 bp, Homo sapiens
ttgaggcctgctggaaggtgtt

SEQ ID NO: 6960297 - DNA, 21 bp, Homo sapiens
cccaacccatttccagttcat

SEQ ID NO: 6960298 - DNA, 22 bp, Homo sapiens
tggagatgtaaagcaaggctta

SEQ ID NO: 6960299 - DNA, 22 bp, Homo sapiens
attctgggtttttgtcttctgt

SEQ ID NO: 6960300 - DNA, 22 bp, Homo sapiens
ttctggaggagaaagggtgggc

SEQ ID NO: 6960301 - DNA, 22 bp, Homo sapiens
gaattcagttatctaattcaag

SEQ ID NO: 6960302 - DNA, 22 bp, Homo sapiens
ggcttaagatatttctgattcc

SEQ ID NO: 6960303 - DNA, 22 bp, Homo sapiens
caagttttctgggttcagagca

SEQ ID NO: 6960304 - DNA, 22 bp, Homo sapiens
ggcttcactgactggttctagg

SEQ ID NO: 6960305 - DNA, 22 bp, Homo sapiens
gccagctgggccttagggctgg

SEQ ID NO: 6960306 - DNA, 22 bp, Homo sapiens
ttacctggtgtttatggtccat

SEQ ID NO: 6960307 - DNA, 22 bp, Homo sapiens
gtctcctcttcatatacctgtt

SEQ ID NO: 6960308 - DNA, 22 bp, Homo sapiens
taatggcagagtcatgctttct

SEQ ID NO: 6960309 - DNA, 22 bp, Homo sapiens
gtgaaggaggggccacagatat

SEQ ID NO: 6960310 - DNA, 22 bp, Homo sapiens
tgcacctgagaggtctctgagg

SEQ ID NO: 6960311 - DNA, 22 bp, Homo sapiens
tccaggagtggggcagaggtct

SEQ ID NO: 6960312 - DNA, 22 bp, Homo sapiens
cacaatttggtgctaaagaaag

SEQ ID NO: 6960313 - DNA, 20 bp, Homo sapiens
ttggaatcacctggagaggt

SEQ ID NO: 6960314 - DNA, 19 bp, Homo sapiens
ttttaagtcctctctattc

SEQ ID NO: 6960315 - DNA, 23 bp, Homo sapiens
gcagaggtttttcagtatggttt

SEQ ID NO: 6960316 - DNA, 21 bp, Homo sapiens
aactgcaaatgatgctggaga

SEQ ID NO: 6960317 - DNA, 22 bp, Homo sapiens
aagcatctctatgtggagagtg

SEQ ID NO: 6960318 - DNA, 22 bp, Homo sapiens
tgtgttcaatgacttcatcttt

SEQ ID NO: 6960319 - DNA, 22 bp, Homo sapiens
atataatgattttctggtgagt

SEQ ID NO: 6960320 - DNA, 19 bp, Homo sapiens
tcaaggctgcctctccttt

SEQ ID NO: 6960321 - DNA, 16 bp, Homo sapiens
tatgtgtgtgggagtg

SEQ ID NO: 6960322 - DNA, 22 bp, Homo sapiens
tatacagaaccgcctgaagtct

SEQ ID NO: 6960323 - DNA, 22 bp, Homo sapiens
atgtgtatgatacctttgctga

SEQ ID NO: 6960324 - DNA, 22 bp, Homo sapiens
taattacaggtccaaaacaatc

SEQ ID NO: 6960325 - DNA, 22 bp, Homo sapiens
catatctggagactcctggtct

SEQ ID NO: 6960326 - DNA, 22 bp, Homo sapiens
aggtggcagatgggggtgctcg

SEQ ID NO: 6960327 - DNA, 22 bp, Homo sapiens
tccatactcagaaagtattgca

SEQ ID NO: 6960328 - DNA, 22 bp, Homo sapiens
gagggctccacacgggcccagc

SEQ ID NO: 6960329 - DNA, 22 bp, Homo sapiens
tcagaatgttcctgctgtcagt

SEQ ID NO: 6960330 - DNA, 22 bp, Homo sapiens
tagtttaggaattatgagggtg

SEQ ID NO: 6960331 - DNA, 22 bp, Homo sapiens
agtgccctgggccttccaggac

SEQ ID NO: 6960332 - DNA, 22 bp, Homo sapiens
gtctgccctgctgatctcaccc

SEQ ID NO: 6960333 - DNA, 22 bp, Homo sapiens
gccagctagaggctgcagtgca

SEQ ID NO: 6960334 - DNA, 22 bp, Homo sapiens
tagaaactctcacgagtgaaac

SEQ ID NO: 6960335 - DNA, 22 bp, Homo sapiens
ggtggcaagggcagccagtaac

SEQ ID NO: 6960336 - DNA, 22 bp, Homo sapiens
agctttatttgtcattcacggc

SEQ ID NO: 6960337 - DNA, 22 bp, Homo sapiens
cccagaggtgacatcccattct

SEQ ID NO: 6960338 - DNA, 22 bp, Homo sapiens
actcactctttcaattgaaaga

SEQ ID NO: 6960339 - DNA, 22 bp, Homo sapiens
aaagcagcaacagctgttagaa

SEQ ID NO: 6960340 - DNA, 22 bp, Homo sapiens
ggaaggaggggcaaagcagttc

SEQ ID NO: 6960341 - DNA, 22 bp, Homo sapiens
agtggctcccatgtcttgcact

SEQ ID NO: 6960342 - DNA, 22 bp, Homo sapiens
cttcaggatttaggaagatgaa

SEQ ID NO: 6960343 - DNA, 22 bp, Homo sapiens
agggcatgaaatgggcagaagc

SEQ ID NO: 6960344 - DNA, 23 bp, Homo sapiens
cacagggagggaaactctttcag

SEQ ID NO: 6960345 - DNA, 22 bp, Homo sapiens
caagccctgttaggggtctcta

SEQ ID NO: 6960346 - DNA, 22 bp, Homo sapiens
gaacacttggctttggatttaa

SEQ ID NO: 6960347 - DNA, 22 bp, Homo sapiens
tcagcattctttacaaggatga

SEQ ID NO: 6960348 - DNA, 22 bp, Homo sapiens
ctcagtttcctcaactgcaaaa

SEQ ID NO: 6960349 - DNA, 22 bp, Homo sapiens
aacagaacccgagtgtgaatct

SEQ ID NO: 6960350 - DNA, 22 bp, Homo sapiens
tccagggacctccctgagagct

SEQ ID NO: 6960351 - DNA, 22 bp, Homo sapiens
actattagcatatcatgaatgg

SEQ ID NO: 6960352 - DNA, 22 bp, Homo sapiens
actgagggtgcacaggcaggca

SEQ ID NO: 6960353 - DNA, 22 bp, Homo sapiens
acagccagggcattgtcgccga

SEQ ID NO: 6960354 - DNA, 22 bp, Homo sapiens
tgcatatcactttgaatgggga

SEQ ID NO: 6960355 - DNA, 22 bp, Homo sapiens
aggctttgttttatctcattta

SEQ ID NO: 6960356 - DNA, 22 bp, Homo sapiens
gagtcttctgagttattggata

SEQ ID NO: 6960357 - DNA, 22 bp, Homo sapiens
accacccacctcacagcatagt

SEQ ID NO: 6960358 - DNA, 22 bp, Homo sapiens
tttgcaatgtgaaattaaagaa

SEQ ID NO: 6960359 - DNA, 22 bp, Homo sapiens
gcctcctgtcccaggctgagga

SEQ ID NO: 6960360 - DNA, 22 bp, Homo sapiens
ttagtctctttgcattgccata

SEQ ID NO: 6960361 - DNA, 22 bp, Homo sapiens
gattttcatgataaacttgtga

SEQ ID NO: 6960362 - DNA, 22 bp, Homo sapiens
aggcaggtttactcttatttgg

SEQ ID NO: 6960363 - DNA, 22 bp, Homo sapiens
gctgtggtctgtgagctccaaa

SEQ ID NO: 6960364 - DNA, 22 bp, Homo sapiens
tgctgctgtatcatgccttcat

SEQ ID NO: 6960365 - DNA, 22 bp, Homo sapiens
cttccactctgagtccaccctg

SEQ ID NO: 6960366 - DNA, 22 bp, Homo sapiens
gactttccaggtcctgggctat

SEQ ID NO: 6960367 - DNA, 22 bp, Homo sapiens
aagctgttagggagtggtaggt

SEQ ID NO: 6960368 - DNA, 22 bp, Homo sapiens
agaataaatgctacctatcaca

SEQ ID NO: 6960369 - DNA, 22 bp, Homo sapiens
tctgtccaggcttactatatat

SEQ ID NO: 6960370 - DNA, 22 bp, Homo sapiens
tgccaagctagaacgttcccag

SEQ ID NO: 6960371 - DNA, 22 bp, Homo sapiens
tatctaaggtatatgaggaatc

SEQ ID NO: 6960372 - DNA, 19 bp, Homo sapiens
tggaggaagtatatttcat

SEQ ID NO: 6960373 - DNA, 22 bp, Homo sapiens
acgcatggtaaatccactgact

SEQ ID NO: 6960374 - DNA, 22 bp, Homo sapiens
ctgctccacacctccatttcct

SEQ ID NO: 6960375 - DNA, 22 bp, Homo sapiens
atgtgcttggaaaagcagtggt

SEQ ID NO: 6960376 - DNA, 19 bp, Homo sapiens
tccaggaggctgccattga

SEQ ID NO: 6960377 - DNA, 22 bp, Homo sapiens
tgccatctgcacccacctgccc

SEQ ID NO: 6960378 - DNA, 22 bp, Homo sapiens
tagcaagcagattagaagatcc

SEQ ID NO: 6960379 - DNA, 22 bp, Homo sapiens
actaacatgttaatcaaaagaa

SEQ ID NO: 6960380 - DNA, 22 bp, Homo sapiens
atggtaaacatttaacaactag

SEQ ID NO: 6960381 - DNA, 22 bp, Homo sapiens
tcagaggcaaagaactttatta

SEQ ID NO: 6960382 - DNA, 22 bp, Homo sapiens
cccagagtcacatggggtgttc

SEQ ID NO: 6960383 - DNA, 22 bp, Homo sapiens
tgttgttagacccactgcccga

SEQ ID NO: 6960384 - DNA, 20 bp, Homo sapiens
ttgtagcgatacagtttgca

SEQ ID NO: 6960385 - DNA, 20 bp, Homo sapiens
cctccactgtcactgacctg

SEQ ID NO: 6960386 - DNA, 19 bp, Homo sapiens
tggtaaagactgtccccca

SEQ ID NO: 6960387 - DNA, 22 bp, Homo sapiens
tgtcaaagcctgaatcacatag

SEQ ID NO: 6960388 - DNA, 22 bp, Homo sapiens
aagcaggtaaatatgtttccct

SEQ ID NO: 6960389 - DNA, 20 bp, Homo sapiens
tctggggtgaagcccaggaa

SEQ ID NO: 6960390 - DNA, 22 bp, Homo sapiens
tggtacaactgtattaggcaaa

SEQ ID NO: 6960391 - DNA, 22 bp, Homo sapiens
tccaggttcaagcgattgtcct

SEQ ID NO: 6960392 - DNA, 22 bp, Homo sapiens
gcctgagagtctccagaccttg

SEQ ID NO: 6960393 - DNA, 22 bp, Homo sapiens
atgacaatacttcaataagctg

SEQ ID NO: 6960394 - DNA, 19 bp, Homo sapiens
gcagcaatagaagacaaat

SEQ ID NO: 6960395 - DNA, 22 bp, Homo sapiens
ttaagggccattatggatgggt

SEQ ID NO: 6960396 - DNA, 22 bp, Homo sapiens
gaactttcctagacctgagatg

SEQ ID NO: 6960397 - DNA, 22 bp, Homo sapiens
ttgcccactcatgcttttgata

SEQ ID NO: 6960398 - DNA, 22 bp, Homo sapiens
gagggaggtgatactgaacgta

SEQ ID NO: 6960399 - DNA, 21 bp, Homo sapiens
tggactgcgctgctatgcagt

SEQ ID NO: 6960400 - DNA, 22 bp, Homo sapiens
ttttggcagattacttaatatg

SEQ ID NO: 6960401 - DNA, 19 bp, Homo sapiens
ttcacattttgctctgagg

SEQ ID NO: 6960402 - DNA, 22 bp, Homo sapiens
atgaaggctgtgtagatggatg

SEQ ID NO: 6960403 - DNA, 22 bp, Homo sapiens
ctgggacatgatagaaacagat

SEQ ID NO: 6960404 - DNA, 22 bp, Homo sapiens
cttcttaatcccttatatattt

SEQ ID NO: 6960405 - DNA, 22 bp, Homo sapiens
aggccctgctgaggcctccctc

SEQ ID NO: 6960406 - DNA, 22 bp, Homo sapiens
tagatgcttataaagagcatat

SEQ ID NO: 6960407 - DNA, 22 bp, Homo sapiens
attcagtattctgctgcataat

SEQ ID NO: 6960408 - DNA, 22 bp, Homo sapiens
gtcaaaagctaatttgttattt

SEQ ID NO: 6960409 - DNA, 22 bp, Homo sapiens
ttagaacatttttagaccaata

SEQ ID NO: 6960410 - DNA, 22 bp, Homo sapiens
tctgcaggtcacgctccagcct

SEQ ID NO: 6960411 - DNA, 22 bp, Homo sapiens
tagcacaagaagtacacataga

SEQ ID NO: 6960412 - DNA, 22 bp, Homo sapiens
ctttacagaaagagaactctgg

SEQ ID NO: 6960413 - DNA, 22 bp, Homo sapiens
tttcccctcagtactaaacata

SEQ ID NO: 6960414 - DNA, 22 bp, Homo sapiens
ggctttaatagataaggtttct

SEQ ID NO: 6960415 - DNA, 22 bp, Homo sapiens
agaaatactgtgagagcagcct

SEQ ID NO: 6960416 - DNA, 22 bp, Homo sapiens
aagttactttacctctttagct

SEQ ID NO: 6960417 - DNA, 22 bp, Homo sapiens
gtagtatgaacatgtaggtaga

SEQ ID NO: 6960418 - DNA, 22 bp, Homo sapiens
gctggcttgtaataggaatttc

SEQ ID NO: 6960419 - DNA, 22 bp, Homo sapiens
ctgaggcatcatggagaacagt

SEQ ID NO: 6960420 - DNA, 17 bp, Homo sapiens
agcttgtttttgaaagc

SEQ ID NO: 6960421 - DNA, 22 bp, Homo sapiens
atttaccagtgctgacatttga

SEQ ID NO: 6960422 - DNA, 22 bp, Homo sapiens
gtgccgtccctgctctcttgct

SEQ ID NO: 6960423 - DNA, 22 bp, Homo sapiens
tatctttggtagctttcctaag

SEQ ID NO: 6960424 - DNA, 22 bp, Homo sapiens
tggcacatagcaggtactcagt

SEQ ID NO: 6960425 - DNA, 22 bp, Homo sapiens
accacttatcatcactatctca

SEQ ID NO: 6960426 - DNA, 22 bp, Homo sapiens
ctttcttaatttttaaggacac

SEQ ID NO: 6960427 - DNA, 22 bp, Homo sapiens
aagatatagaaagagctgggag

SEQ ID NO: 6960428 - DNA, 22 bp, Homo sapiens
gggttttccttctgcattggag

SEQ ID NO: 6960429 - DNA, 22 bp, Homo sapiens
ggagctggctacagagaactcc

SEQ ID NO: 6960430 - DNA, 21 bp, Homo sapiens
agaggaagtgattggtctggc

SEQ ID NO: 6960431 - DNA, 22 bp, Homo sapiens
tgaaaccattctcaggtacact

SEQ ID NO: 6960432 - DNA, 22 bp, Homo sapiens
tctgcatctcttataaatgatg

SEQ ID NO: 6960433 - DNA, 16 bp, Homo sapiens
attcacaaggcatcgg

SEQ ID NO: 6960434 - DNA, 22 bp, Homo sapiens
agactgtgccacacatgggagt

SEQ ID NO: 6960435 - DNA, 22 bp, Homo sapiens
aaacatgcattcaagaaaatct

SEQ ID NO: 6960436 - DNA, 22 bp, Homo sapiens
cacagtgaacattctgtcaggg

SEQ ID NO: 6960437 - DNA, 22 bp, Homo sapiens
cccttaaaggctttgcctctct

SEQ ID NO: 6960438 - DNA, 22 bp, Homo sapiens
ccaggaggtggagattgcagtg

SEQ ID NO: 6960439 - DNA, 22 bp, Homo sapiens
ccgggaggtggagattgcggtg

SEQ ID NO: 6960440 - DNA, 22 bp, Homo sapiens
tggccgtgttagatgtttggct

SEQ ID NO: 6960441 - DNA, 23 bp, Homo sapiens
ttctgggctgtggaagcctcggg

SEQ ID NO: 6960442 - DNA, 22 bp, Homo sapiens
ctggttttatgttatagatgga

SEQ ID NO: 6960443 - DNA, 22 bp, Homo sapiens
ggctagggactcctcctcaggg

SEQ ID NO: 6960444 - DNA, 22 bp, Homo sapiens
gttaggaacactggagcctaaa

SEQ ID NO: 6960445 - DNA, 22 bp, Homo sapiens
atcatacatacatggtcctcag

SEQ ID NO: 6960446 - DNA, 21 bp, Homo sapiens
aatttgctaagcaaaggagca

SEQ ID NO: 6960447 - DNA, 22 bp, Homo sapiens
ggcaagagggcagatggagtgc

SEQ ID NO: 6960448 - DNA, 22 bp, Homo sapiens
ttgtgtaattagcaaacaaatc

SEQ ID NO: 6960449 - DNA, 22 bp, Homo sapiens
acagttaactggagagcgagtt

SEQ ID NO: 6960450 - DNA, 22 bp, Homo sapiens
agctggcttttgtgaaggtttt

SEQ ID NO: 6960451 - DNA, 22 bp, Homo sapiens
ggagtgtgggatggagctcagg

SEQ ID NO: 6960452 - DNA, 22 bp, Homo sapiens
ccagatgagaccacactgctgg

SEQ ID NO: 6960453 - DNA, 22 bp, Homo sapiens
ctgacagcagcaaatggagata

SEQ ID NO: 6960454 - DNA, 22 bp, Homo sapiens
gcctgtcctggatgctctgcaa

SEQ ID NO: 6960455 - DNA, 22 bp, Homo sapiens
aagcatggctgttctagctata

SEQ ID NO: 6960456 - DNA, 22 bp, Homo sapiens
gtgaccttggcaatctctcaga

SEQ ID NO: 6960457 - DNA, 22 bp, Homo sapiens
taagtcatcacattgcagagat

SEQ ID NO: 6960458 - DNA, 22 bp, Homo sapiens
ttcaatcatttttacatagtcc

SEQ ID NO: 6960459 - DNA, 22 bp, Homo sapiens
tttttgtggtgtgagtggacat

SEQ ID NO: 6960460 - DNA, 22 bp, Homo sapiens
ctgataccttgatcttggactt

SEQ ID NO: 6960461 - DNA, 22 bp, Homo sapiens
tatgctctcctcccagtcccag

SEQ ID NO: 6960462 - DNA, 22 bp, Homo sapiens
aaaggcttagacacagaactgt

SEQ ID NO: 6960463 - DNA, 22 bp, Homo sapiens
agtgtttatggaaccctggtgg

SEQ ID NO: 6960464 - DNA, 22 bp, Homo sapiens
ctggcagcgtgtttatgaacat

SEQ ID NO: 6960465 - DNA, 22 bp, Homo sapiens
agactgtaatttgtggcctcct

SEQ ID NO: 6960466 - DNA, 22 bp, Homo sapiens
ctgactgttgctgttgatgagg

SEQ ID NO: 6960467 - DNA, 22 bp, Homo sapiens
gtgtgagagaagctgccatgga

SEQ ID NO: 6960468 - DNA, 22 bp, Homo sapiens
gatggctgcctcctgcggtcct

SEQ ID NO: 6960469 - DNA, 22 bp, Homo sapiens
aattatggtgtgtggttaaggg

SEQ ID NO: 6960470 - DNA, 23 bp, Homo sapiens
acactgtctcatggatagactgc

SEQ ID NO: 6960471 - DNA, 22 bp, Homo sapiens
ttattattccccaagtcattat

SEQ ID NO: 6960472 - DNA, 14 bp, Homo sapiens
aacattgcatttga

SEQ ID NO: 6960473 - DNA, 22 bp, Homo sapiens
agcttctgagaatagtaaatgc

SEQ ID NO: 6960474 - DNA, 22 bp, Homo sapiens
ggccattttataggcagtgggg

SEQ ID NO: 6960475 - DNA, 22 bp, Homo sapiens
ccaggcttggtgtgtggtcagg

SEQ ID NO: 6960476 - DNA, 22 bp, Homo sapiens
tcattcatactcttttctatta

SEQ ID NO: 6960477 - DNA, 22 bp, Homo sapiens
agaaatgtgagccccttatcaa

SEQ ID NO: 6960478 - DNA, 22 bp, Homo sapiens
aaagccatcagtaaaatgattt

SEQ ID NO: 6960479 - DNA, 22 bp, Homo sapiens
agagatgacatgagggacttaa

SEQ ID NO: 6960480 - DNA, 22 bp, Homo sapiens
ctttcttcaacctcattctgca

SEQ ID NO: 6960481 - DNA, 22 bp, Homo sapiens
ggagctgaaccccatcgtgctg

SEQ ID NO: 6960482 - DNA, 22 bp, Homo sapiens
agtacaatgtctgacacagtag

SEQ ID NO: 6960483 - DNA, 22 bp, Homo sapiens
gtggcctctgttggctcctagg

SEQ ID NO: 6960484 - DNA, 21 bp, Homo sapiens
ttcccttctggttttgagaga

SEQ ID NO: 6960485 - DNA, 21 bp, Homo sapiens
tgtaacaaaatactgcagatt

SEQ ID NO: 6960486 - DNA, 22 bp, Homo sapiens
ggctgtaggttggtgctggaca

SEQ ID NO: 6960487 - DNA, 22 bp, Homo sapiens
agggacccatagagagaccagt

SEQ ID NO: 6960488 - DNA, 22 bp, Homo sapiens
tccagccgtcacagccacattc

SEQ ID NO: 6960489 - DNA, 22 bp, Homo sapiens
gggaggttctgttcgcacttga

SEQ ID NO: 6960490 - DNA, 22 bp, Homo sapiens
gccctagggcttttgggcctgt

SEQ ID NO: 6960491 - DNA, 22 bp, Homo sapiens
tcgcgctgtagccgcgcagagt

SEQ ID NO: 6960492 - DNA, 22 bp, Homo sapiens
tggctagactcggccagccaca

SEQ ID NO: 6960493 - DNA, 22 bp, Homo sapiens
cagaatgagataacccagattg

SEQ ID NO: 6960494 - DNA, 22 bp, Homo sapiens
tgactgaggcctgataacagtt

SEQ ID NO: 6960495 - DNA, 22 bp, Homo sapiens
tcattattctctttaatgttct

SEQ ID NO: 6960496 - DNA, 17 bp, Homo sapiens
ctgtctgcgcatgaggt

SEQ ID NO: 6960497 - DNA, 22 bp, Homo sapiens
ggagatatttgtattctgtctc

SEQ ID NO: 6960498 - DNA, 18 bp, Homo sapiens
ggaagtttgggtcccctg

SEQ ID NO: 6960499 - DNA, 22 bp, Homo sapiens
aaaaccacttccttgctattgg

SEQ ID NO: 6960500 - DNA, 22 bp, Homo sapiens
gcctctgagctcctttgaccac

SEQ ID NO: 6960501 - DNA, 22 bp, Homo sapiens
ggaggacaggggctgcagcaca

SEQ ID NO: 6960502 - DNA, 22 bp, Homo sapiens
aatctcatgagcttcttgtccc

SEQ ID NO: 6960503 - DNA, 22 bp, Homo sapiens
aattcatccatgaacaattcca

SEQ ID NO: 6960504 - DNA, 22 bp, Homo sapiens
cttcccgttattgcccttgggt

SEQ ID NO: 6960505 - DNA, 22 bp, Homo sapiens
gtacaggaccgcggccccctgg

SEQ ID NO: 6960506 - DNA, 22 bp, Homo sapiens
tctgccagaagccagggtctgg

SEQ ID NO: 6960507 - DNA, 19 bp, Homo sapiens
cctgtgactatctttgtaa

SEQ ID NO: 6960508 - DNA, 22 bp, Homo sapiens
tgggcagtcatcagcacaccgg

SEQ ID NO: 6960509 - DNA, 22 bp, Homo sapiens
atacaatcaaccacttgcgagc

SEQ ID NO: 6960510 - DNA, 22 bp, Homo sapiens
gcagcagagtagacagagccct

SEQ ID NO: 6960511 - DNA, 22 bp, Homo sapiens
gagcatggtgcttcagtgaagg

SEQ ID NO: 6960512 - DNA, 22 bp, Homo sapiens
ttttgtcagtgagaacagagtt

SEQ ID NO: 6960513 - DNA, 22 bp, Homo sapiens
tgaggcccgggtggaggaatgc

SEQ ID NO: 6960514 - DNA, 22 bp, Homo sapiens
agtttgaaggagttgaatcacc

SEQ ID NO: 6960515 - DNA, 22 bp, Homo sapiens
aaggggagttagtgataaaacc

SEQ ID NO: 6960516 - DNA, 22 bp, Homo sapiens
aagtacaaattttgaagagctt

SEQ ID NO: 6960517 - DNA, 22 bp, Homo sapiens
tggcttggtaaggaccagcagg

SEQ ID NO: 6960518 - DNA, 22 bp, Homo sapiens
ctggcacagagtgagcattcaa

SEQ ID NO: 6960519 - DNA, 22 bp, Homo sapiens
caggctgcatggaggggtacag

SEQ ID NO: 6960520 - DNA, 22 bp, Homo sapiens
atacagcttacagttctaatgc

SEQ ID NO: 6960521 - DNA, 22 bp, Homo sapiens
actcggccatggcgccccggcc

SEQ ID NO: 6960522 - DNA, 22 bp, Homo sapiens
catcttaaattaaagcttaagg

SEQ ID NO: 6960523 - DNA, 22 bp, Homo sapiens
acagtgttgaggtgcttgtttc

SEQ ID NO: 6960524 - DNA, 22 bp, Homo sapiens
gcactgctccaggtgtggcttg

SEQ ID NO: 6960525 - DNA, 22 bp, Homo sapiens
actactggaaactgtagataat

SEQ ID NO: 6960526 - DNA, 22 bp, Homo sapiens
ttgcaaattccaatccaatatt

SEQ ID NO: 6960527 - DNA, 22 bp, Homo sapiens
accctgggacctggaggtggat

SEQ ID NO: 6960528 - DNA, 22 bp, Homo sapiens
tgctatttgtgtaatggtaaat

SEQ ID NO: 6960529 - DNA, 22 bp, Homo sapiens
tccaggctggagtgcagtggca

SEQ ID NO: 6960530 - DNA, 22 bp, Homo sapiens
gggctaggtctgatcagagaag

SEQ ID NO: 6960531 - DNA, 22 bp, Homo sapiens
tcattcataaaaattagttggc

SEQ ID NO: 6960532 - DNA, 22 bp, Homo sapiens
agtaaagtaccaaagtgtgagt

SEQ ID NO: 6960533 - DNA, 22 bp, Homo sapiens
gcagtgcttgaagaggtggcca

SEQ ID NO: 6960534 - DNA, 22 bp, Homo sapiens
tctacagccattttgagcagtg

SEQ ID NO: 6960535 - DNA, 22 bp, Homo sapiens
gcaggtggtggcgcgcgccctg

SEQ ID NO: 6960536 - DNA, 19 bp, Homo sapiens
gctgctcctggctgaccac

SEQ ID NO: 6960537 - DNA, 22 bp, Homo sapiens
ttaatctgaatcagtaaacact

SEQ ID NO: 6960538 - DNA, 22 bp, Homo sapiens
ggctgcaggaacgacggagggg

SEQ ID NO: 6960539 - DNA, 22 bp, Homo sapiens
aacagttgctgaagtagtattc

SEQ ID NO: 6960540 - DNA, 22 bp, Homo sapiens
tctggatttaaatctcaatgct

SEQ ID NO: 6960541 - DNA, 22 bp, Homo sapiens
tcacttcttcccttgcacatat

SEQ ID NO: 6960542 - DNA, 22 bp, Homo sapiens
tttggctcttcccgtaccataa

SEQ ID NO: 6960543 - DNA, 22 bp, Homo sapiens
gagcacagctgtcttgcaagct

SEQ ID NO: 6960544 - DNA, 22 bp, Homo sapiens
caatgggcggaatcgggaggcg

SEQ ID NO: 6960545 - DNA, 22 bp, Homo sapiens
agggtctgcagggatcttctgg

SEQ ID NO: 6960546 - DNA, 22 bp, Homo sapiens
tgtcacctggaaatcactctaa

SEQ ID NO: 6960547 - DNA, 22 bp, Homo sapiens
aaggtgccccctcctgaacctt

SEQ ID NO: 6960548 - DNA, 22 bp, Homo sapiens
atcaagcatatataaaactgca

SEQ ID NO: 6960549 - DNA, 22 bp, Homo sapiens
tagcacactgcatatgaagatt

SEQ ID NO: 6960550 - DNA, 22 bp, Homo sapiens
cacagtttatgatctcagtgaa

SEQ ID NO: 6960551 - DNA, 22 bp, Homo sapiens
gttgggagcagcagaccaagag

SEQ ID NO: 6960552 - DNA, 22 bp, Homo sapiens
gaaggctgatgacagattctgc

SEQ ID NO: 6960553 - DNA, 22 bp, Homo sapiens
attgtgcaaaacctcaggcctc

SEQ ID NO: 6960554 - DNA, 21 bp, Homo sapiens
gttcaagtatttttttcgctg

SEQ ID NO: 6960555 - DNA, 22 bp, Homo sapiens
ggaatgggagctattagtggaa

SEQ ID NO: 6960556 - DNA, 22 bp, Homo sapiens
acaaggttgttctgaggattta

SEQ ID NO: 6960557 - DNA, 22 bp, Homo sapiens
gtcctgcaaagttcagcttgct

SEQ ID NO: 6960558 - DNA, 21 bp, Homo sapiens
gtgacctgcgcggggcgcagc

SEQ ID NO: 6960559 - DNA, 22 bp, Homo sapiens
tgagtgattaggtttttccttc

SEQ ID NO: 6960560 - DNA, 17 bp, Homo sapiens
gacatcagtacttacag

SEQ ID NO: 6960561 - DNA, 22 bp, Homo sapiens
atgaatgagattaccaatgtga

SEQ ID NO: 6960562 - DNA, 22 bp, Homo sapiens
cctgtgccctcagcctggctct

SEQ ID NO: 6960563 - DNA, 22 bp, Homo sapiens
actaagacctagatactagggg

SEQ ID NO: 6960564 - DNA, 22 bp, Homo sapiens
cagccgcgctcgtgccagacag

SEQ ID NO: 6960565 - DNA, 22 bp, Homo sapiens
cagagtgatttgatgagttgca

SEQ ID NO: 6960566 - DNA, 22 bp, Homo sapiens
ggttggctactggagacctatg

SEQ ID NO: 6960567 - DNA, 22 bp, Homo sapiens
gacacagggggatgtgtggacg

SEQ ID NO: 6960568 - DNA, 22 bp, Homo sapiens
tctgaagaactgagtaaacatg

SEQ ID NO: 6960569 - DNA, 22 bp, Homo sapiens
gctgtaactttttcattttcaa

SEQ ID NO: 6960570 - DNA, 22 bp, Homo sapiens
agggccagaggcaccttgcagc

SEQ ID NO: 6960571 - DNA, 22 bp, Homo sapiens
acagccccccgctcagtttcca

SEQ ID NO: 6960572 - DNA, 23 bp, Homo sapiens
tcatcttcctcatttctccaggg

SEQ ID NO: 6960573 - DNA, 22 bp, Homo sapiens
agtcacttccagacacctgcct

SEQ ID NO: 6960574 - DNA, 19 bp, Homo sapiens
tcacaaggcctcttagtct

SEQ ID NO: 6960575 - DNA, 19 bp, Homo sapiens
agtctgcatttctagcaag

SEQ ID NO: 6960576 - DNA, 22 bp, Homo sapiens
aggaatgtctgagaaagaggca

SEQ ID NO: 6960577 - DNA, 22 bp, Homo sapiens
cacatcttcttaactccaaagt

SEQ ID NO: 6960578 - DNA, 22 bp, Homo sapiens
gcactctcctggctgccacagt

SEQ ID NO: 6960579 - DNA, 22 bp, Homo sapiens
tcacagtgcaccagtgtgaagc

SEQ ID NO: 6960580 - DNA, 22 bp, Homo sapiens
tctggaatgtaaagtttatggg

SEQ ID NO: 6960581 - DNA, 18 bp, Homo sapiens
tggctggctctgtcatct

SEQ ID NO: 6960582 - DNA, 22 bp, Homo sapiens
ctggcgagcaggaggcgacggc

SEQ ID NO: 6960583 - DNA, 21 bp, Homo sapiens
cttcttggggagcagctagac

SEQ ID NO: 6960584 - DNA, 22 bp, Homo sapiens
gactttatttccttatttgtga

SEQ ID NO: 6960585 - DNA, 22 bp, Homo sapiens
gggcactgagggcccacaggat

SEQ ID NO: 6960586 - DNA, 22 bp, Homo sapiens
tagaagttcatgcgaattattt

SEQ ID NO: 6960587 - DNA, 22 bp, Homo sapiens
tcaaagtttttgagaattacat

SEQ ID NO: 6960588 - DNA, 22 bp, Homo sapiens
ttgctgaaccctgccctctaat

SEQ ID NO: 6960589 - DNA, 22 bp, Homo sapiens
ggtcagcagtgcagggcagagc

SEQ ID NO: 6960590 - DNA, 22 bp, Homo sapiens
tgacatccggccactagactcc

SEQ ID NO: 6960591 - DNA, 22 bp, Homo sapiens
tattgcttaaaaaatatgtgag

SEQ ID NO: 6960592 - DNA, 22 bp, Homo sapiens
agtccacagagtctctcctgaa

SEQ ID NO: 6960593 - DNA, 22 bp, Homo sapiens
ttgcagaacttaaagacagagt

SEQ ID NO: 6960594 - DNA, 22 bp, Homo sapiens
acatggagactctaccagaaaa

SEQ ID NO: 6960595 - DNA, 22 bp, Homo sapiens
tgcagaagatggtctgagcacc

SEQ ID NO: 6960596 - DNA, 22 bp, Homo sapiens
tcttggactagtcctaaatcca

SEQ ID NO: 6960597 - DNA, 22 bp, Homo sapiens
aagatgataggacttgcttaag

SEQ ID NO: 6960598 - DNA, 22 bp, Homo sapiens
atcagaatcatttcatccctat

SEQ ID NO: 6960599 - DNA, 22 bp, Homo sapiens
agggctttcggcactctgaggg

SEQ ID NO: 6960600 - DNA, 22 bp, Homo sapiens
tttcaaacctacttgtatgttt

SEQ ID NO: 6960601 - DNA, 22 bp, Homo sapiens
gcttccagcaccagcagagggg

SEQ ID NO: 6960602 - DNA, 22 bp, Homo sapiens
ttgtgtactacagtatgccaca

SEQ ID NO: 6960603 - DNA, 22 bp, Homo sapiens
agaactctaggattggctggat

SEQ ID NO: 6960604 - DNA, 22 bp, Homo sapiens
aaatactggttttggagatgct

SEQ ID NO: 6960605 - DNA, 22 bp, Homo sapiens
tgaaggtggctgtttgtgcata

SEQ ID NO: 6960606 - DNA, 22 bp, Homo sapiens
gcatttggtgatgcaccgttta

SEQ ID NO: 6960607 - DNA, 22 bp, Homo sapiens
agacctggattccaatcctacc

SEQ ID NO: 6960608 - DNA, 22 bp, Homo sapiens
ctaaggaacatcacaggccgtc

SEQ ID NO: 6960609 - DNA, 22 bp, Homo sapiens
cccaggaggtcaaggctgcagt

SEQ ID NO: 6960610 - DNA, 22 bp, Homo sapiens
tcttgctgtacggctacttgca

SEQ ID NO: 6960611 - DNA, 22 bp, Homo sapiens
tatgcatacaatgagatattcc

SEQ ID NO: 6960612 - DNA, 22 bp, Homo sapiens
gccctgtgtgtttgcactgatt

SEQ ID NO: 6960613 - DNA, 22 bp, Homo sapiens
cctctgagtcctttgggctctc

SEQ ID NO: 6960614 - DNA, 22 bp, Homo sapiens
tagctcttgtgttttacatata

SEQ ID NO: 6960615 - DNA, 20 bp, Homo sapiens
tgtgcattctatgggtttgg

SEQ ID NO: 6960616 - DNA, 22 bp, Homo sapiens
tctgttatacaacaagtaacag

SEQ ID NO: 6960617 - DNA, 22 bp, Homo sapiens
taaggtagccctaatgtgggtt

SEQ ID NO: 6960618 - DNA, 22 bp, Homo sapiens
tccccctcctgtggttttctgc

SEQ ID NO: 6960619 - DNA, 22 bp, Homo sapiens
tcctgccaaaatatccctacct

SEQ ID NO: 6960620 - DNA, 20 bp, Homo sapiens
tgagtgatggaggcgggtca

SEQ ID NO: 6960621 - DNA, 22 bp, Homo sapiens
cactgcactccagcctgggcca

SEQ ID NO: 6960622 - DNA, 22 bp, Homo sapiens
gctctgaggctgtgaggtgctg

SEQ ID NO: 6960623 - DNA, 22 bp, Homo sapiens
caggctccttatcttacaactt

SEQ ID NO: 6960624 - DNA, 22 bp, Homo sapiens
aaggaaggaattgatcatgcgc

SEQ ID NO: 6960625 - DNA, 22 bp, Homo sapiens
tattcaccagatcccatatctt

SEQ ID NO: 6960626 - DNA, 20 bp, Homo sapiens
tgccagtgtgtcaatttata

SEQ ID NO: 6960627 - DNA, 22 bp, Homo sapiens
agcagcagggctctgcccgtgc

SEQ ID NO: 6960628 - DNA, 22 bp, Homo sapiens
cactttggatgccactggtcta

SEQ ID NO: 6960629 - DNA, 18 bp, Homo sapiens
ttcctccacagagcgctg

SEQ ID NO: 6960630 - DNA, 21 bp, Homo sapiens
ttgctctacagtgagggcagc

SEQ ID NO: 6960631 - DNA, 21 bp, Homo sapiens
ggcactgctgggccatctgct

SEQ ID NO: 6960632 - DNA, 22 bp, Homo sapiens
tagggctttgctcatcctaggt

SEQ ID NO: 6960633 - DNA, 22 bp, Homo sapiens
gtgggcatcaccagggcctcca

SEQ ID NO: 6960634 - DNA, 22 bp, Homo sapiens
ttacacaaaagcaagtgtgtgt

SEQ ID NO: 6960635 - DNA, 22 bp, Homo sapiens
tgcatctggcctttgctggcta

SEQ ID NO: 6960636 - DNA, 22 bp, Homo sapiens
tgccttcactgagcttatggga

SEQ ID NO: 6960637 - DNA, 22 bp, Homo sapiens
ctgaggtggaacagaggtgaag

SEQ ID NO: 6960638 - DNA, 22 bp, Homo sapiens
acttggttctaactagtgtata

SEQ ID NO: 6960639 - DNA, 22 bp, Homo sapiens
attgaaaataaggccagaaaca

SEQ ID NO: 6960640 - DNA, 20 bp, Homo sapiens
atcactggagaaggaaacct

SEQ ID NO: 6960641 - DNA, 22 bp, Homo sapiens
atggcattgtttatagattgca

SEQ ID NO: 6960642 - DNA, 23 bp, Homo sapiens
agctttaaccctttcaggagcat

SEQ ID NO: 6960643 - DNA, 22 bp, Homo sapiens
tttgaaagagctgatacatgaa

SEQ ID NO: 6960644 - DNA, 22 bp, Homo sapiens
tccctgggttcccgtggaagtg

SEQ ID NO: 6960645 - DNA, 22 bp, Homo sapiens
gctgagccatgaggcctcttgc

SEQ ID NO: 6960646 - DNA, 22 bp, Homo sapiens
gaatttttctggaagcaattat

SEQ ID NO: 6960647 - DNA, 22 bp, Homo sapiens
gagacacaaacatttattccac

SEQ ID NO: 6960648 - DNA, 22 bp, Homo sapiens
aataggctcaaatgttcttctc

SEQ ID NO: 6960649 - DNA, 22 bp, Homo sapiens
tacgattagagatgaatgcatg

SEQ ID NO: 6960650 - DNA, 22 bp, Homo sapiens
agctttgcagctgtgggaggag

SEQ ID NO: 6960651 - DNA, 22 bp, Homo sapiens
aactcctcactgcctctggcac

SEQ ID NO: 6960652 - DNA, 22 bp, Homo sapiens
ttatagatttttatgaagtctg

SEQ ID NO: 6960653 - DNA, 22 bp, Homo sapiens
acatcctcggggaaaggcactg

SEQ ID NO: 6960654 - DNA, 21 bp, Homo sapiens
tttctccaagtgactgattcc

SEQ ID NO: 6960655 - DNA, 22 bp, Homo sapiens
caggcctggctgcagctcgcct

SEQ ID NO: 6960656 - DNA, 19 bp, Homo sapiens
gcaggcacagccctgggtg

SEQ ID NO: 6960657 - DNA, 22 bp, Homo sapiens
actgaccagatctttgagctta

SEQ ID NO: 6960658 - DNA, 22 bp, Homo sapiens
tcacaaatttcagctccctgaa

SEQ ID NO: 6960659 - DNA, 22 bp, Homo sapiens
ccttttggaaatatttatgacc

SEQ ID NO: 6960660 - DNA, 22 bp, Homo sapiens
gcagaagtggtgctgtgccact

SEQ ID NO: 6960661 - DNA, 22 bp, Homo sapiens
agagcacaggctcaccattgtt

SEQ ID NO: 6960662 - DNA, 22 bp, Homo sapiens
gcagcatggagttgtggaatga

SEQ ID NO: 6960663 - DNA, 22 bp, Homo sapiens
aatccctttttcatttaataga

SEQ ID NO: 6960664 - DNA, 22 bp, Homo sapiens
cggcagctccgcgccgtaggac

SEQ ID NO: 6960665 - DNA, 22 bp, Homo sapiens
gcctggagctctccacttgggg

SEQ ID NO: 6960666 - DNA, 22 bp, Homo sapiens
gttctgcacatcacacaggtgc

SEQ ID NO: 6960667 - DNA, 19 bp, Homo sapiens
gaactctgcagactgggaa

SEQ ID NO: 6960668 - DNA, 22 bp, Homo sapiens
cagtgccacttaatgaggctgc

SEQ ID NO: 6960669 - DNA, 22 bp, Homo sapiens
tctggatttcagttctaaatct

SEQ ID NO: 6960670 - DNA, 22 bp, Homo sapiens
agttttcagggtttctgtcctc

SEQ ID NO: 6960671 - DNA, 22 bp, Homo sapiens
agaagccaccagctgaggaaga

SEQ ID NO: 6960672 - DNA, 22 bp, Homo sapiens
tacctgtggcttgttggatgga

SEQ ID NO: 6960673 - DNA, 17 bp, Homo sapiens
tcagagggatgagcagg

SEQ ID NO: 6960674 - DNA, 22 bp, Homo sapiens
gctcagaaaagtgaggctcagt

SEQ ID NO: 6960675 - DNA, 21 bp, Homo sapiens
agatgaggatactgaggccta

SEQ ID NO: 6960676 - DNA, 22 bp, Homo sapiens
cgtttcatcagtgctttaagaa

SEQ ID NO: 6960677 - DNA, 22 bp, Homo sapiens
tttcatctatttgctttgtgaa

SEQ ID NO: 6960678 - DNA, 22 bp, Homo sapiens
ccagcctttctattggtttctc

SEQ ID NO: 6960679 - DNA, 22 bp, Homo sapiens
tcaaaagacacaggaggctagt

SEQ ID NO: 6960680 - DNA, 22 bp, Homo sapiens
cctccagagggtttcccatgaa

SEQ ID NO: 6960681 - DNA, 22 bp, Homo sapiens
atggctgtgttagatgctaagt

SEQ ID NO: 6960682 - DNA, 22 bp, Homo sapiens
ccactgccccctgaagaccagg

SEQ ID NO: 6960683 - DNA, 22 bp, Homo sapiens
ttccataattaagtggagagaa

SEQ ID NO: 6960684 - DNA, 22 bp, Homo sapiens
tcaagcagcttttacagaagag

SEQ ID NO: 6960685 - DNA, 22 bp, Homo sapiens
gtagttccagatcatagagcat

SEQ ID NO: 6960686 - DNA, 22 bp, Homo sapiens
tcaaagtagccggatggaattt

SEQ ID NO: 6960687 - DNA, 22 bp, Homo sapiens
tggcagatgtggcatagagcat

SEQ ID NO: 6960688 - DNA, 22 bp, Homo sapiens
ctggactctgcagagaaaagta

SEQ ID NO: 6960689 - DNA, 22 bp, Homo sapiens
ttttgcttaatctagattttgc

SEQ ID NO: 6960690 - DNA, 22 bp, Homo sapiens
ccttgggtctaggccagggagt

SEQ ID NO: 6960691 - DNA, 22 bp, Homo sapiens
cctcccagtgcctccagagcag

SEQ ID NO: 6960692 - DNA, 22 bp, Homo sapiens
aatgtcaattaccagaacagaa

SEQ ID NO: 6960693 - DNA, 22 bp, Homo sapiens
cagggtggaagctgtagagtgg

SEQ ID NO: 6960694 - DNA, 22 bp, Homo sapiens
tgttcacaaggtgatgctttga

SEQ ID NO: 6960695 - DNA, 22 bp, Homo sapiens
aagacaaaggggtccttggatg

SEQ ID NO: 6960696 - DNA, 22 bp, Homo sapiens
caacctctggaaagtatggaca

SEQ ID NO: 6960697 - DNA, 22 bp, Homo sapiens
taacagaaaggctcaggtgctc

SEQ ID NO: 6960698 - DNA, 22 bp, Homo sapiens
agtggcccctgtgccaccacac

SEQ ID NO: 6960699 - DNA, 19 bp, Homo sapiens
tcctgctttctactctgct

SEQ ID NO: 6960700 - DNA, 22 bp, Homo sapiens
cagatgctatagtgctgccata

SEQ ID NO: 6960701 - DNA, 22 bp, Homo sapiens
gtacaatagcagttttcccttt

SEQ ID NO: 6960702 - DNA, 22 bp, Homo sapiens
ttggctcacatgattatggagg

SEQ ID NO: 6960703 - DNA, 22 bp, Homo sapiens
agttttatggctcaacctaata

SEQ ID NO: 6960704 - DNA, 22 bp, Homo sapiens
acttctgtatgtcctgcattca

SEQ ID NO: 6960705 - DNA, 22 bp, Homo sapiens
gcactagatactgttcaggaaa

SEQ ID NO: 6960706 - DNA, 22 bp, Homo sapiens
attccacagctacgttttgagc

SEQ ID NO: 6960707 - DNA, 22 bp, Homo sapiens
attgacccagtggacttgatgg

SEQ ID NO: 6960708 - DNA, 22 bp, Homo sapiens
ttgtcacaggaaagggtgcaag

SEQ ID NO: 6960709 - DNA, 22 bp, Homo sapiens
ttgatgtttccccttggacatt

SEQ ID NO: 6960710 - DNA, 22 bp, Homo sapiens
agagtccctcttcccaggaggc

SEQ ID NO: 6960711 - DNA, 22 bp, Homo sapiens
ttaacagacttgggattttcta

SEQ ID NO: 6960712 - DNA, 23 bp, Homo sapiens
ttgaagtctcagttttctcatag

SEQ ID NO: 6960713 - DNA, 22 bp, Homo sapiens
atagttccagcatctttggtaa

SEQ ID NO: 6960714 - DNA, 22 bp, Homo sapiens
gtggaggaaaagaagttgggtg

SEQ ID NO: 6960715 - DNA, 22 bp, Homo sapiens
ataatgcagcttttcaatggcc

SEQ ID NO: 6960716 - DNA, 22 bp, Homo sapiens
aatgatctactctcattatctc

SEQ ID NO: 6960717 - DNA, 22 bp, Homo sapiens
acaggtctgcagtaactgggaa

SEQ ID NO: 6960718 - DNA, 22 bp, Homo sapiens
acctgcccggggacattccttt

SEQ ID NO: 6960719 - DNA, 22 bp, Homo sapiens
atgttacaaccctgaggagccg

SEQ ID NO: 6960720 - DNA, 22 bp, Homo sapiens
ttcacttaacatcatatcatga

SEQ ID NO: 6960721 - DNA, 22 bp, Homo sapiens
ctggggagacgatcgatgttct

SEQ ID NO: 6960722 - DNA, 22 bp, Homo sapiens
ggctccagaaatcatagagcag

SEQ ID NO: 6960723 - DNA, 22 bp, Homo sapiens
ctgtccaggctgaggagtttat

SEQ ID NO: 6960724 - DNA, 22 bp, Homo sapiens
atgggctgaaagagtaagctgt

SEQ ID NO: 6960725 - DNA, 22 bp, Homo sapiens
tcaggaaggcttcacacgagtg

SEQ ID NO: 6960726 - DNA, 22 bp, Homo sapiens
actatagctcgggttataatgt

SEQ ID NO: 6960727 - DNA, 22 bp, Homo sapiens
aacatgctctggattgctgtga

SEQ ID NO: 6960728 - DNA, 21 bp, Homo sapiens
ttcttcaggccaatgctcatt

SEQ ID NO: 6960729 - DNA, 22 bp, Homo sapiens
tccagaaacttcatttgcaagc

SEQ ID NO: 6960730 - DNA, 22 bp, Homo sapiens
gagccatgagatagttggttcg

SEQ ID NO: 6960731 - DNA, 22 bp, Homo sapiens
cactgagctgatagaattccag

SEQ ID NO: 6960732 - DNA, 21 bp, Homo sapiens
taagtgcaaagagacagatac

SEQ ID NO: 6960733 - DNA, 22 bp, Homo sapiens
aagatagatgtcatcagcatat

SEQ ID NO: 6960734 - DNA, 22 bp, Homo sapiens
gaccttgtgatctgcccacctt

SEQ ID NO: 6960735 - DNA, 22 bp, Homo sapiens
cagcatctgtatcctaggctga

SEQ ID NO: 6960736 - DNA, 22 bp, Homo sapiens
cagagctgttgcggggcttggc

SEQ ID NO: 6960737 - DNA, 22 bp, Homo sapiens
agctgccctgggctggagatgg

SEQ ID NO: 6960738 - DNA, 20 bp, Homo sapiens
agggaacaatggacgctgtc

SEQ ID NO: 6960739 - DNA, 22 bp, Homo sapiens
agcacctgtcaagtccaggctg

SEQ ID NO: 6960740 - DNA, 22 bp, Homo sapiens
gtctttccttataatgccctaa

SEQ ID NO: 6960741 - DNA, 23 bp, Homo sapiens
gaggagggtctgacaagtgtagc

SEQ ID NO: 6960742 - DNA, 22 bp, Homo sapiens
cagaatgtattctcataaagcc

SEQ ID NO: 6960743 - DNA, 22 bp, Homo sapiens
ttctggaagttttctcctgtgg

SEQ ID NO: 6960744 - DNA, 23 bp, Homo sapiens
tgccagaggcagtcacagtggtg

SEQ ID NO: 6960745 - DNA, 22 bp, Homo sapiens
tgcttggctttctgagcttctg

SEQ ID NO: 6960746 - DNA, 22 bp, Homo sapiens
acacagataatgctcatatagg

SEQ ID NO: 6960747 - DNA, 22 bp, Homo sapiens
tgcagcattgcaaagcagtctt

SEQ ID NO: 6960748 - DNA, 22 bp, Homo sapiens
aatagctttggtcaccatctgg

SEQ ID NO: 6960749 - DNA, 19 bp, Homo sapiens
gtgtgcattgtcgcatcat

SEQ ID NO: 6960750 - DNA, 23 bp, Homo sapiens
tttctaaggtttttatctgctac

SEQ ID NO: 6960751 - DNA, 16 bp, Homo sapiens
ggtgtcagatgtccag

SEQ ID NO: 6960752 - DNA, 22 bp, Homo sapiens
acaggtttgtctgatgtaatga

SEQ ID NO: 6960753 - DNA, 22 bp, Homo sapiens
tcctgacctcttgctctgacct

SEQ ID NO: 6960754 - DNA, 18 bp, Homo sapiens
taagaattgagagtttac

SEQ ID NO: 6960755 - DNA, 22 bp, Homo sapiens
ccagacttttagtagtgagtta

SEQ ID NO: 6960756 - DNA, 22 bp, Homo sapiens
gagctaggttgagactcactta

SEQ ID NO: 6960757 - DNA, 20 bp, Homo sapiens
gtagaaccatgtgtgctggg

SEQ ID NO: 6960758 - DNA, 17 bp, Homo sapiens
gagagccctcagatgtc

SEQ ID NO: 6960759 - DNA, 22 bp, Homo sapiens
tcgaaggttattgtctttacgt

SEQ ID NO: 6960760 - DNA, 22 bp, Homo sapiens
ggaggtgtcttgagattatcat

SEQ ID NO: 6960761 - DNA, 22 bp, Homo sapiens
atcagtccacttgatgaaatcg

SEQ ID NO: 6960762 - DNA, 22 bp, Homo sapiens
cacattaaaatcctaacttcca

SEQ ID NO: 6960763 - DNA, 22 bp, Homo sapiens
cctgagaaacctggtgcaatta

SEQ ID NO: 6960764 - DNA, 22 bp, Homo sapiens
ttcttacagagtttacagagcc

SEQ ID NO: 6960765 - DNA, 22 bp, Homo sapiens
tattggtcttctgttccctatt

SEQ ID NO: 6960766 - DNA, 19 bp, Homo sapiens
ccaccagtgtgatctaaga

SEQ ID NO: 6960767 - DNA, 22 bp, Homo sapiens
ggtgcaaaaatctatcaccagc

SEQ ID NO: 6960768 - DNA, 22 bp, Homo sapiens
ctgctggtgcagagtggggctg

SEQ ID NO: 6960769 - DNA, 22 bp, Homo sapiens
agctgaaggctagaacagctgg

SEQ ID NO: 6960770 - DNA, 22 bp, Homo sapiens
ggggaagagcattgcacggtgt

SEQ ID NO: 6960771 - DNA, 22 bp, Homo sapiens
gccctagccatcctgtgctctg

SEQ ID NO: 6960772 - DNA, 22 bp, Homo sapiens
gggtgagagtcaggcagagatt

SEQ ID NO: 6960773 - DNA, 22 bp, Homo sapiens
ttagaaagaatagcctggctgc

SEQ ID NO: 6960774 - DNA, 22 bp, Homo sapiens
aggtttgggagtagaaatcaga

SEQ ID NO: 6960775 - DNA, 22 bp, Homo sapiens
ttcttcagactccctctttaag

SEQ ID NO: 6960776 - DNA, 22 bp, Homo sapiens
tactcgaaatttactaaggtgt

SEQ ID NO: 6960777 - DNA, 20 bp, Homo sapiens
ggcttagactgagttctcac

SEQ ID NO: 6960778 - DNA, 21 bp, Homo sapiens
tccagaaaagaggtcattagc

SEQ ID NO: 6960779 - DNA, 22 bp, Homo sapiens
cagccaggcctggtgaccaaag

SEQ ID NO: 6960780 - DNA, 22 bp, Homo sapiens
tattctcatcatcactggagct

SEQ ID NO: 6960781 - DNA, 22 bp, Homo sapiens
gacagtgacagcttggaaagca

SEQ ID NO: 6960782 - DNA, 21 bp, Homo sapiens
gcttctgtatctagcaggaac

SEQ ID NO: 6960783 - DNA, 22 bp, Homo sapiens
ataaactgaagggaacactgag

SEQ ID NO: 6960784 - DNA, 22 bp, Homo sapiens
ttcagaaatcgagtttcatgtc

SEQ ID NO: 6960785 - DNA, 22 bp, Homo sapiens
ctcagattgtttgcctcgcagt

SEQ ID NO: 6960786 - DNA, 22 bp, Homo sapiens
aattcttggaaacattactgga

SEQ ID NO: 6960787 - DNA, 22 bp, Homo sapiens
gagctagagggagaagggcact

SEQ ID NO: 6960788 - DNA, 22 bp, Homo sapiens
agttatccgaaggcactgagat

SEQ ID NO: 6960789 - DNA, 21 bp, Homo sapiens
agtgaaatgaagtgtatgctc

SEQ ID NO: 6960790 - DNA, 22 bp, Homo sapiens
cctggcacatgcagtactcaag

SEQ ID NO: 6960791 - DNA, 22 bp, Homo sapiens
ctgcttgggtcctggcatgggt

SEQ ID NO: 6960792 - DNA, 22 bp, Homo sapiens
aagaggctggaggatactgcgc

SEQ ID NO: 6960793 - DNA, 22 bp, Homo sapiens
atgggtaaggctgaaggaaagt

SEQ ID NO: 6960794 - DNA, 19 bp, Homo sapiens
ctgctctccttgacttgga

SEQ ID NO: 6960795 - DNA, 22 bp, Homo sapiens
ccggggtgcgaggagcgtcttt

SEQ ID NO: 6960796 - DNA, 22 bp, Homo sapiens
tcagcttgggggtggcttctca

SEQ ID NO: 6960797 - DNA, 22 bp, Homo sapiens
gaggctcagagaagtcatggta

SEQ ID NO: 6960798 - DNA, 23 bp, Homo sapiens
acagaaagttctgctggacagag

SEQ ID NO: 6960799 - DNA, 22 bp, Homo sapiens
gtattgcttatgaaaacaggtc

SEQ ID NO: 6960800 - DNA, 22 bp, Homo sapiens
ttacttgaaatgtgataagaga

SEQ ID NO: 6960801 - DNA, 22 bp, Homo sapiens
tggtcctgtctcaaggagcctt

SEQ ID NO: 6960802 - DNA, 22 bp, Homo sapiens
tcactagtggtttctggtggtt

SEQ ID NO: 6960803 - DNA, 22 bp, Homo sapiens
ttggtgccgaggatctgcaggt

SEQ ID NO: 6960804 - DNA, 22 bp, Homo sapiens
ggccggcttactgggtagggtg

SEQ ID NO: 6960805 - DNA, 22 bp, Homo sapiens
tatggcattttgtaagggcttg

SEQ ID NO: 6960806 - DNA, 22 bp, Homo sapiens
aggagcagaccgtagtcctgca

SEQ ID NO: 6960807 - DNA, 22 bp, Homo sapiens
ggcaggtggacgtgctaaagct

SEQ ID NO: 6960808 - DNA, 22 bp, Homo sapiens
ttgcacaggcagtaattgcttg

SEQ ID NO: 6960809 - DNA, 22 bp, Homo sapiens
agagactgtacgtggcaagtat

SEQ ID NO: 6960810 - DNA, 22 bp, Homo sapiens
gcagagctgttaatggagctga

SEQ ID NO: 6960811 - DNA, 22 bp, Homo sapiens
cgagagagacatggtgacctgc

SEQ ID NO: 6960812 - DNA, 22 bp, Homo sapiens
tagcagctcctaaacagtggtg

SEQ ID NO: 6960813 - DNA, 20 bp, Homo sapiens
tgtcagtgcctgaggcacag

SEQ ID NO: 6960814 - DNA, 22 bp, Homo sapiens
tctttctacatcatttgcttct

SEQ ID NO: 6960815 - DNA, 19 bp, Homo sapiens
ctgagaatcctacttattt

SEQ ID NO: 6960816 - DNA, 22 bp, Homo sapiens
ctaggaggcgggggctgcagta

SEQ ID NO: 6960817 - DNA, 22 bp, Homo sapiens
ttcttgatttcatgcagttaag

SEQ ID NO: 6960818 - DNA, 22 bp, Homo sapiens
attagccttaataatttagaag

SEQ ID NO: 6960819 - DNA, 22 bp, Homo sapiens
ttgttttcacagctttgcccgg

SEQ ID NO: 6960820 - DNA, 22 bp, Homo sapiens
gaacttttgggaagccgtgtga

SEQ ID NO: 6960821 - DNA, 19 bp, Homo sapiens
tccagaagtccctgagcgg

SEQ ID NO: 6960822 - DNA, 22 bp, Homo sapiens
tgggagagcactgcagccccgg

SEQ ID NO: 6960823 - DNA, 20 bp, Homo sapiens
catttgaatctccattctgc

SEQ ID NO: 6960824 - DNA, 22 bp, Homo sapiens
ttggccaggtgtccagcccagg

SEQ ID NO: 6960825 - DNA, 22 bp, Homo sapiens
ccagacaggaacacacatctcc

SEQ ID NO: 6960826 - DNA, 22 bp, Homo sapiens
ataatggccgggggctgaatgc

SEQ ID NO: 6960827 - DNA, 22 bp, Homo sapiens
aagtattgtgggaaagcagaaa

SEQ ID NO: 6960828 - DNA, 22 bp, Homo sapiens
acactttaagcatttcacactg

SEQ ID NO: 6960829 - DNA, 22 bp, Homo sapiens
ggcagctcccctgggttttatt

SEQ ID NO: 6960830 - DNA, 22 bp, Homo sapiens
aggctgagaaagtgggaagatg

SEQ ID NO: 6960831 - DNA, 22 bp, Homo sapiens
aatgttattacacttgtgaaat

SEQ ID NO: 6960832 - DNA, 22 bp, Homo sapiens
agaagtgagtgtgactcagcag

SEQ ID NO: 6960833 - DNA, 22 bp, Homo sapiens
aaattctcttcagaggaaccag

SEQ ID NO: 6960834 - DNA, 23 bp, Homo sapiens
gctccctgtccctgcacttaggc

SEQ ID NO: 6960835 - DNA, 22 bp, Homo sapiens
gggtgcatggtgtatgactgga

SEQ ID NO: 6960836 - DNA, 22 bp, Homo sapiens
gtgtgcatggagggggcagtga

SEQ ID NO: 6960837 - DNA, 23 bp, Homo sapiens
ggggacagagggcagcccgcatc

SEQ ID NO: 6960838 - DNA, 23 bp, Homo sapiens
acactggttttaaagcagttaat

SEQ ID NO: 6960839 - DNA, 22 bp, Homo sapiens
atggcaatgtggcttatttgga

SEQ ID NO: 6960840 - DNA, 22 bp, Homo sapiens
aactgaggtctccagtgcagaa

SEQ ID NO: 6960841 - DNA, 22 bp, Homo sapiens
cctctgagtcctccctggttgc

SEQ ID NO: 6960842 - DNA, 23 bp, Homo sapiens
tgcacaggacggccttataagta

SEQ ID NO: 6960843 - DNA, 22 bp, Homo sapiens
actgctgattattgaagtagag

SEQ ID NO: 6960844 - DNA, 22 bp, Homo sapiens
ctcttccttaagactataaaga

SEQ ID NO: 6960845 - DNA, 22 bp, Homo sapiens
aactggttctggaggctgcagg

SEQ ID NO: 6960846 - DNA, 19 bp, Homo sapiens
ggagtgggtagttagtggt

SEQ ID NO: 6960847 - DNA, 22 bp, Homo sapiens
ggtctcagtgaaggagtgtgct

SEQ ID NO: 6960848 - DNA, 22 bp, Homo sapiens
ttggtaaacttgacagagaatc

SEQ ID NO: 6960849 - DNA, 22 bp, Homo sapiens
accaggcaactgtgaatgggct

SEQ ID NO: 6960850 - DNA, 22 bp, Homo sapiens
tgctctggacgctgagtggttt

SEQ ID NO: 6960851 - DNA, 18 bp, Homo sapiens
agcaccagtcactaacag

SEQ ID NO: 6960852 - DNA, 22 bp, Homo sapiens
actcttcatccctttatcagga

SEQ ID NO: 6960853 - DNA, 20 bp, Homo sapiens
agatctgcctgcaccctctc

SEQ ID NO: 6960854 - DNA, 22 bp, Homo sapiens
gtcctgagaatactaggcacaa

SEQ ID NO: 6960855 - DNA, 23 bp, Homo sapiens
agggagctaaaaggctggagcag

SEQ ID NO: 6960856 - DNA, 22 bp, Homo sapiens
gagtttctgattcagtctgtgt

SEQ ID NO: 6960857 - DNA, 22 bp, Homo sapiens
ttatatccaaaggcaaggagga

SEQ ID NO: 6960858 - DNA, 22 bp, Homo sapiens
ttttcacacaaggtgataagtt

SEQ ID NO: 6960859 - DNA, 20 bp, Homo sapiens
ctgggtctccttctgcttaa

SEQ ID NO: 6960860 - DNA, 22 bp, Homo sapiens
ctcacagtgtaatattgaaccc

SEQ ID NO: 6960861 - DNA, 22 bp, Homo sapiens
ataccaattagagtttgttgca

SEQ ID NO: 6960862 - DNA, 22 bp, Homo sapiens
aagctaatagccagttttcttc

SEQ ID NO: 6960863 - DNA, 22 bp, Homo sapiens
aaagatgaccgtatgtcagagc

SEQ ID NO: 6960864 - DNA, 22 bp, Homo sapiens
gtgggcaaagggactagggcca

SEQ ID NO: 6960865 - DNA, 22 bp, Homo sapiens
gggctggagccagctgtggctg

SEQ ID NO: 6960866 - DNA, 22 bp, Homo sapiens
caaagaagagatttacagagct

SEQ ID NO: 6960867 - DNA, 22 bp, Homo sapiens
gacactttattaagctgttgtt

SEQ ID NO: 6960868 - DNA, 22 bp, Homo sapiens
ctcagaaagggttgctgagggc

SEQ ID NO: 6960869 - DNA, 21 bp, Homo sapiens
gcaggcatgtctactgcatgt

SEQ ID NO: 6960870 - DNA, 22 bp, Homo sapiens
cagtggatgtctcatagtgtga

SEQ ID NO: 6960871 - DNA, 22 bp, Homo sapiens
cataaaaggtagcagtttgaaa

SEQ ID NO: 6960872 - DNA, 22 bp, Homo sapiens
aaatgtagtatgttgcatgtat

SEQ ID NO: 6960873 - DNA, 22 bp, Homo sapiens
tttcacagagaaatataacagg

SEQ ID NO: 6960874 - DNA, 22 bp, Homo sapiens
agccttggtcccgcgtcagcca

SEQ ID NO: 6960875 - DNA, 22 bp, Homo sapiens
gactttctctcctcccaggtgt

SEQ ID NO: 6960876 - DNA, 22 bp, Homo sapiens
tgattgaagctagaacaaccat

SEQ ID NO: 6960877 - DNA, 19 bp, Homo sapiens
ccagtcccatacaggagat

SEQ ID NO: 6960878 - DNA, 22 bp, Homo sapiens
tgggatataatggtattacatc

SEQ ID NO: 6960879 - DNA, 22 bp, Homo sapiens
aagacctgcagtttctctacct

SEQ ID NO: 6960880 - DNA, 19 bp, Homo sapiens
tgagatgccttccagccct

SEQ ID NO: 6960881 - DNA, 22 bp, Homo sapiens
tggcctctgtgggagctgagca

SEQ ID NO: 6960882 - DNA, 22 bp, Homo sapiens
gacagtggattcatctagtcaa

SEQ ID NO: 6960883 - DNA, 22 bp, Homo sapiens
tcaggtgtcttgtgggatttta

SEQ ID NO: 6960884 - DNA, 22 bp, Homo sapiens
ataaacatctgtttctcttctg

SEQ ID NO: 6960885 - DNA, 23 bp, Homo sapiens
gccagagctgcctgcccttgctg

SEQ ID NO: 6960886 - DNA, 22 bp, Homo sapiens
ctgtccagctgaccagagcagc

SEQ ID NO: 6960887 - DNA, 22 bp, Homo sapiens
caagtgcacacacatcctgtgc

SEQ ID NO: 6960888 - DNA, 23 bp, Homo sapiens
tagagcagggaaatctgtcagag

SEQ ID NO: 6960889 - DNA, 22 bp, Homo sapiens
cagcaacttaggcagaacatct

SEQ ID NO: 6960890 - DNA, 22 bp, Homo sapiens
ttgggcctgatcggaataagga

SEQ ID NO: 6960891 - DNA, 22 bp, Homo sapiens
gaatgttattggacagcagtgg

SEQ ID NO: 6960892 - DNA, 22 bp, Homo sapiens
agtgtctgcttatcagttcttg

SEQ ID NO: 6960893 - DNA, 22 bp, Homo sapiens
ggctcaggggccaggcctgtcc

SEQ ID NO: 6960894 - DNA, 22 bp, Homo sapiens
cctgaagaattcaaatccagat

SEQ ID NO: 6960895 - DNA, 22 bp, Homo sapiens
attttctgtaactatttctata

SEQ ID NO: 6960896 - DNA, 22 bp, Homo sapiens
ttgcatgttgggctcatcctct

SEQ ID NO: 6960897 - DNA, 22 bp, Homo sapiens
aaaatgggtttcttcaacctca

SEQ ID NO: 6960898 - DNA, 22 bp, Homo sapiens
tgtcgaacagcctcatggacta

SEQ ID NO: 6960899 - DNA, 22 bp, Homo sapiens
cccttgcttgcccagtcacagg

SEQ ID NO: 6960900 - DNA, 22 bp, Homo sapiens
tggcaaccaggtggtctagggt

SEQ ID NO: 6960901 - DNA, 22 bp, Homo sapiens
gcatccattgtttatgtgtttc

SEQ ID NO: 6960902 - DNA, 22 bp, Homo sapiens
gtcacttggggtaagccaagag

SEQ ID NO: 6960903 - DNA, 22 bp, Homo sapiens
ccattcatgtttttgaactatg

SEQ ID NO: 6960904 - DNA, 22 bp, Homo sapiens
tcatggataaaatattggttaa

SEQ ID NO: 6960905 - DNA, 16 bp, Homo sapiens
gcaggtggatcacctg

SEQ ID NO: 6960906 - DNA, 23 bp, Homo sapiens
tggaagaaaatggtttggctgtg

SEQ ID NO: 6960907 - DNA, 21 bp, Homo sapiens
agagacagagaaagtaacatt

SEQ ID NO: 6960908 - DNA, 22 bp, Homo sapiens
tagttagagaagccacagtgga

SEQ ID NO: 6960909 - DNA, 22 bp, Homo sapiens
atgtctgtggcaattgttgatg

SEQ ID NO: 6960910 - DNA, 23 bp, Homo sapiens
actgagcaatgtttacatacttg

SEQ ID NO: 6960911 - DNA, 22 bp, Homo sapiens
ccatggcttacagatggagcat

SEQ ID NO: 6960912 - DNA, 22 bp, Homo sapiens
gaatttgcaggtgtgctgtgta

SEQ ID NO: 6960913 - DNA, 22 bp, Homo sapiens
tgagtcacatccatttttgtgt

SEQ ID NO: 6960914 - DNA, 22 bp, Homo sapiens
ctctgagaggctgccctgccat

SEQ ID NO: 6960915 - DNA, 22 bp, Homo sapiens
taagctctccaggtgatcatga

SEQ ID NO: 6960916 - DNA, 22 bp, Homo sapiens
cacctctcagctaggagtaagt

SEQ ID NO: 6960917 - DNA, 23 bp, Homo sapiens
tgtgttctcacacagatgcagta

SEQ ID NO: 6960918 - DNA, 22 bp, Homo sapiens
tgtctagtccaagaattcaatt

SEQ ID NO: 6960919 - DNA, 22 bp, Homo sapiens
gaaatgtgttgttcatttctaa

SEQ ID NO: 6960920 - DNA, 22 bp, Homo sapiens
tggcagagtggaccatactcaa

SEQ ID NO: 6960921 - DNA, 22 bp, Homo sapiens
tttgggctggaattttagtacc

SEQ ID NO: 6960922 - DNA, 22 bp, Homo sapiens
ggcagcatgtgtggtccgctgg

SEQ ID NO: 6960923 - DNA, 22 bp, Homo sapiens
ttgtctgattgctggattagca

SEQ ID NO: 6960924 - DNA, 22 bp, Homo sapiens
actgggaagtcagagagaggct

SEQ ID NO: 6960925 - DNA, 22 bp, Homo sapiens
tcagctgttttgagtttaattg

SEQ ID NO: 6960926 - DNA, 22 bp, Homo sapiens
tttgtaagaactataaattgct

SEQ ID NO: 6960927 - DNA, 22 bp, Homo sapiens
acaggccataaaggcaggccct

SEQ ID NO: 6960928 - DNA, 22 bp, Homo sapiens
ccaaccagctatggaatcttgt

SEQ ID NO: 6960929 - DNA, 22 bp, Homo sapiens
tactagaagctgtaatttttca

SEQ ID NO: 6960930 - DNA, 23 bp, Homo sapiens
tgaaggtattacctgagatgctc

SEQ ID NO: 6960931 - DNA, 22 bp, Homo sapiens
aagtttctacatctccatcata

SEQ ID NO: 6960932 - DNA, 22 bp, Homo sapiens
gattatggtaacaatgattaaa

SEQ ID NO: 6960933 - DNA, 22 bp, Homo sapiens
caaaggtataagttaatataca

SEQ ID NO: 6960934 - DNA, 22 bp, Homo sapiens
agctggagatcatgctgatact

SEQ ID NO: 6960935 - DNA, 22 bp, Homo sapiens
gtctgcagcacatagattagaa

SEQ ID NO: 6960936 - DNA, 22 bp, Homo sapiens
aagaggaggacggttcccagaa

SEQ ID NO: 6960937 - DNA, 22 bp, Homo sapiens
tcaccgccttgcccggccgggc

SEQ ID NO: 6960938 - DNA, 21 bp, Homo sapiens
tcaaacatgatctgggtcatc

SEQ ID NO: 6960939 - DNA, 22 bp, Homo sapiens
cttaaattggatgagttaagtt

SEQ ID NO: 6960940 - DNA, 22 bp, Homo sapiens
tggctcactgtagccttgacct

SEQ ID NO: 6960941 - DNA, 22 bp, Homo sapiens
caccatttaagaaagccaaatt

SEQ ID NO: 6960942 - DNA, 22 bp, Homo sapiens
gtaaatgttgcatttatgggta

SEQ ID NO: 6960943 - DNA, 22 bp, Homo sapiens
agagcacagtgcaggatccccg

SEQ ID NO: 6960944 - DNA, 22 bp, Homo sapiens
aaatgtgtttgataggaatatt

SEQ ID NO: 6960945 - DNA, 22 bp, Homo sapiens
aaggcagtatctgtagagtgct

SEQ ID NO: 6960946 - DNA, 22 bp, Homo sapiens
ggtttcaatgagaagtgcttgt

SEQ ID NO: 6960947 - DNA, 22 bp, Homo sapiens
tcacttgactccagtttcttct

SEQ ID NO: 6960948 - DNA, 22 bp, Homo sapiens
ccagtgtgaacctcaccaccct

SEQ ID NO: 6960949 - DNA, 22 bp, Homo sapiens
gtattgccggaggcacctcctt

SEQ ID NO: 6960950 - DNA, 19 bp, Homo sapiens
tcaggactgacttgaagtc

SEQ ID NO: 6960951 - DNA, 22 bp, Homo sapiens
tggtttatttctctgaaaggtt

SEQ ID NO: 6960952 - DNA, 22 bp, Homo sapiens
aggtccagctgttgcagcctcc

SEQ ID NO: 6960953 - DNA, 23 bp, Homo sapiens
tctgggcaccttgttgacatgat

SEQ ID NO: 6960954 - DNA, 22 bp, Homo sapiens
cacacctgtgagtctcggcttg

SEQ ID NO: 6960955 - DNA, 22 bp, Homo sapiens
cttaaacaggaaagagccaggt

SEQ ID NO: 6960956 - DNA, 22 bp, Homo sapiens
ctttagttctaatgcattgaaa

SEQ ID NO: 6960957 - DNA, 22 bp, Homo sapiens
tccagggcttggctgggacggt

SEQ ID NO: 6960958 - DNA, 22 bp, Homo sapiens
gtgaggaagtgtttgtcaaatt

SEQ ID NO: 6960959 - DNA, 22 bp, Homo sapiens
ttgaggccaaaaagtcctatga

SEQ ID NO: 6960960 - DNA, 22 bp, Homo sapiens
attgacaaatggatgttgacat

SEQ ID NO: 6960961 - DNA, 22 bp, Homo sapiens
aagtacttctagatggataatc

SEQ ID NO: 6960962 - DNA, 22 bp, Homo sapiens
gcggtcggcagaggggctctgc

SEQ ID NO: 6960963 - DNA, 23 bp, Homo sapiens
agaagcaatgctttttttcctct

SEQ ID NO: 6960964 - DNA, 22 bp, Homo sapiens
aatcacagccacaacctggggg

SEQ ID NO: 6960965 - DNA, 22 bp, Homo sapiens
ttgcatagaatatcatattttc

SEQ ID NO: 6960966 - DNA, 22 bp, Homo sapiens
atagcaaggtatgactggagcc

SEQ ID NO: 6960967 - DNA, 22 bp, Homo sapiens
cagcaggcaagaggttttatca

SEQ ID NO: 6960968 - DNA, 22 bp, Homo sapiens
cagaaggcagcaaatgaaaacc

SEQ ID NO: 6960969 - DNA, 22 bp, Homo sapiens
acccattcctttacttcatctg

SEQ ID NO: 6960970 - DNA, 22 bp, Homo sapiens
tctgggctgtgccaaagctctt

SEQ ID NO: 6960971 - DNA, 22 bp, Homo sapiens
gaggccctgaagacagctgggg

SEQ ID NO: 6960972 - DNA, 22 bp, Homo sapiens
tcatcactgtatcattgataga

SEQ ID NO: 6960973 - DNA, 22 bp, Homo sapiens
agagccctgagtcagttctgga

SEQ ID NO: 6960974 - DNA, 21 bp, Homo sapiens
tcaatacaggtgcatgtgtct

SEQ ID NO: 6960975 - DNA, 22 bp, Homo sapiens
gtgatctgccagcctcagcctc

SEQ ID NO: 6960976 - DNA, 22 bp, Homo sapiens
tttgactctgggtgctttttcg

SEQ ID NO: 6960977 - DNA, 22 bp, Homo sapiens
tgtgaccatttgccacaatggt

SEQ ID NO: 6960978 - DNA, 22 bp, Homo sapiens
cgctagcgcccaggcgcctctc

SEQ ID NO: 6960979 - DNA, 22 bp, Homo sapiens
tttcacaacgttgtggtgagag

SEQ ID NO: 6960980 - DNA, 22 bp, Homo sapiens
ttagcagcggtcagttttgaag

SEQ ID NO: 6960981 - DNA, 22 bp, Homo sapiens
gagctgaggtgatgtggtcgtt

SEQ ID NO: 6960982 - DNA, 22 bp, Homo sapiens
ggcatggtttaagtggtgggga

SEQ ID NO: 6960983 - DNA, 22 bp, Homo sapiens
gtttagaatggcaaaattaagt

SEQ ID NO: 6960984 - DNA, 22 bp, Homo sapiens
tgcttctgatgtgagcagcccc

SEQ ID NO: 6960985 - DNA, 22 bp, Homo sapiens
acttcaaatgtgacaatgtgaa

SEQ ID NO: 6960986 - DNA, 22 bp, Homo sapiens
tcacacattctaggtatgttga

SEQ ID NO: 6960987 - DNA, 22 bp, Homo sapiens
tctcaccatcttgaatccctta

SEQ ID NO: 6960988 - DNA, 22 bp, Homo sapiens
ggcagtgccactaagctctgct

SEQ ID NO: 6960989 - DNA, 22 bp, Homo sapiens
tgcatgctcaagttagttgtga

SEQ ID NO: 6960990 - DNA, 22 bp, Homo sapiens
gaggtggccagagtcaagagcc

SEQ ID NO: 6960991 - DNA, 22 bp, Homo sapiens
tggaaaaccagaccgcgttggg

SEQ ID NO: 6960992 - DNA, 22 bp, Homo sapiens
ctcccaggttccgacgcctctt

SEQ ID NO: 6960993 - DNA, 20 bp, Homo sapiens
aagtggatccctaagaacag

SEQ ID NO: 6960994 - DNA, 22 bp, Homo sapiens
agtttcatgagacagattttca

SEQ ID NO: 6960995 - DNA, 22 bp, Homo sapiens
gtagggattcttctcactgagc

SEQ ID NO: 6960996 - DNA, 22 bp, Homo sapiens
acagccttctcttcactgtgtc

SEQ ID NO: 6960997 - DNA, 22 bp, Homo sapiens
gcagctcttcacttactccttt

SEQ ID NO: 6960998 - DNA, 22 bp, Homo sapiens
ctcagcacattcctaagggatg

SEQ ID NO: 6960999 - DNA, 22 bp, Homo sapiens
ctattcaattttgctattgtag

SEQ ID NO: 6961000 - DNA, 22 bp, Homo sapiens
agctcaggtctcaggaggtgtc

SEQ ID NO: 6961001 - DNA, 22 bp, Homo sapiens
ttgggatacatcttgctgagcc

SEQ ID NO: 6961002 - DNA, 22 bp, Homo sapiens
gtatttctttccattatagtca

SEQ ID NO: 6961003 - DNA, 22 bp, Homo sapiens
gtgagctgttggagtggcagag

SEQ ID NO: 6961004 - DNA, 19 bp, Homo sapiens
aacatctttccagtagagg

SEQ ID NO: 6961005 - DNA, 22 bp, Homo sapiens
gctcttgaggaagtgcagggca

SEQ ID NO: 6961006 - DNA, 22 bp, Homo sapiens
cgctgtgtgcagactgaaaatg

SEQ ID NO: 6961007 - DNA, 22 bp, Homo sapiens
aggccctgggttagggcccact

SEQ ID NO: 6961008 - DNA, 22 bp, Homo sapiens
ttgtgcaagaattggaaagcaa

SEQ ID NO: 6961009 - DNA, 22 bp, Homo sapiens
cagcaactctcctgtgctcaaa

SEQ ID NO: 6961010 - DNA, 22 bp, Homo sapiens
acacaaagttggatgacaaaat

SEQ ID NO: 6961011 - DNA, 22 bp, Homo sapiens
tgctgaggcagtcctaacagga

SEQ ID NO: 6961012 - DNA, 20 bp, Homo sapiens
aataaagcaacgagcgagct

SEQ ID NO: 6961013 - DNA, 22 bp, Homo sapiens
cacgttaacagctaacagatga

SEQ ID NO: 6961014 - DNA, 22 bp, Homo sapiens
tgtcaatatgtaataactgaat

SEQ ID NO: 6961015 - DNA, 22 bp, Homo sapiens
tggggccacacatctctttcta

SEQ ID NO: 6961016 - DNA, 22 bp, Homo sapiens
aatagttgtgaatcaggactag

SEQ ID NO: 6961017 - DNA, 22 bp, Homo sapiens
cagggttaatttaatgtgagag

SEQ ID NO: 6961018 - DNA, 22 bp, Homo sapiens
gcagtttctgaatttatccaag

SEQ ID NO: 6961019 - DNA, 22 bp, Homo sapiens
aaatgatggaaatgaggctgaa

SEQ ID NO: 6961020 - DNA, 22 bp, Homo sapiens
actgtgccacaattcaccaggg

SEQ ID NO: 6961021 - DNA, 23 bp, Homo sapiens
ggagttggattgtacttgctgct

SEQ ID NO: 6961022 - DNA, 22 bp, Homo sapiens
taactcaaaatgcacctgctga

SEQ ID NO: 6961023 - DNA, 22 bp, Homo sapiens
ttcataggtggatgctgccagg

SEQ ID NO: 6961024 - DNA, 22 bp, Homo sapiens
aatcaaagaatgggctagttgg

SEQ ID NO: 6961025 - DNA, 22 bp, Homo sapiens
tccagtcacttcattttacaga

SEQ ID NO: 6961026 - DNA, 22 bp, Homo sapiens
ggaaatgtaatcacagagggtt

SEQ ID NO: 6961027 - DNA, 22 bp, Homo sapiens
ataaggcatctctcagttagca

SEQ ID NO: 6961028 - DNA, 22 bp, Homo sapiens
agcatgtggctatctttggggg

SEQ ID NO: 6961029 - DNA, 22 bp, Homo sapiens
accaaaacctgctactaaagga

SEQ ID NO: 6961030 - DNA, 22 bp, Homo sapiens
atcagcagtgtctacctcggtg

SEQ ID NO: 6961031 - DNA, 22 bp, Homo sapiens
tatttgctttgctttatagaga

SEQ ID NO: 6961032 - DNA, 22 bp, Homo sapiens
caagcagtcagcctgaagactg

SEQ ID NO: 6961033 - DNA, 22 bp, Homo sapiens
ccagtctcctaagagcccctga

SEQ ID NO: 6961034 - DNA, 22 bp, Homo sapiens
aggtcagacacagtgctgggtg

SEQ ID NO: 6961035 - DNA, 22 bp, Homo sapiens
aacattctggttctaaaaacct

SEQ ID NO: 6961036 - DNA, 22 bp, Homo sapiens
ttctggccaaggctgccagatt

SEQ ID NO: 6961037 - DNA, 21 bp, Homo sapiens
ctaccctctcctgctcatatc

SEQ ID NO: 6961038 - DNA, 22 bp, Homo sapiens
gacaagtgctgatttatctccc

SEQ ID NO: 6961039 - DNA, 22 bp, Homo sapiens
agtttatttctccatttaccta

SEQ ID NO: 6961040 - DNA, 22 bp, Homo sapiens
gtgcatcgctctaataggatga

SEQ ID NO: 6961041 - DNA, 22 bp, Homo sapiens
gctgggcaggcctcgtgagggc

SEQ ID NO: 6961042 - DNA, 22 bp, Homo sapiens
tcatcacatgtgtagtcatccc

SEQ ID NO: 6961043 - DNA, 22 bp, Homo sapiens
atatctgtgtttcccttttgct

SEQ ID NO: 6961044 - DNA, 22 bp, Homo sapiens
gacatgctgaataactatatga

SEQ ID NO: 6961045 - DNA, 21 bp, Homo sapiens
atgtgaaaccttccacgctga

SEQ ID NO: 6961046 - DNA, 22 bp, Homo sapiens
tcctgggtgaaagaacaggcag

SEQ ID NO: 6961047 - DNA, 22 bp, Homo sapiens
agaggaggtggtgatgctttaa

SEQ ID NO: 6961048 - DNA, 22 bp, Homo sapiens
tgccaggctccggaacgacagt

SEQ ID NO: 6961049 - DNA, 22 bp, Homo sapiens
tggaagagaaaggagtggatct

SEQ ID NO: 6961050 - DNA, 22 bp, Homo sapiens
gagaagttctaattggctcttt

SEQ ID NO: 6961051 - DNA, 23 bp, Homo sapiens
gctcaggcatcattcttcctggc

SEQ ID NO: 6961052 - DNA, 22 bp, Homo sapiens
aggagccagcgttcctcaggat

SEQ ID NO: 6961053 - DNA, 22 bp, Homo sapiens
gaccaaatgaaaggatggatgg

SEQ ID NO: 6961054 - DNA, 18 bp, Homo sapiens
ggcagggaaaagataggg

SEQ ID NO: 6961055 - DNA, 21 bp, Homo sapiens
ttctcagatcgagtagtgaga

SEQ ID NO: 6961056 - DNA, 22 bp, Homo sapiens
tcagaacatcctggtttaaaat

SEQ ID NO: 6961057 - DNA, 22 bp, Homo sapiens
ataatgtttttgtataagcatg

SEQ ID NO: 6961058 - DNA, 22 bp, Homo sapiens
tcagcctttgaagggctgcagg

SEQ ID NO: 6961059 - DNA, 22 bp, Homo sapiens
tgaagttgttaaggttgccatt

SEQ ID NO: 6961060 - DNA, 22 bp, Homo sapiens
atttctcatgtacaaaaacact

SEQ ID NO: 6961061 - DNA, 19 bp, Homo sapiens
gggagctgaggtctttggt

SEQ ID NO: 6961062 - DNA, 22 bp, Homo sapiens
tactgtactgtcttttttgctg

SEQ ID NO: 6961063 - DNA, 22 bp, Homo sapiens
tgtgtaagtgccaggcacaagt

SEQ ID NO: 6961064 - DNA, 22 bp, Homo sapiens
ggctttcagccaaaggacaacc

SEQ ID NO: 6961065 - DNA, 22 bp, Homo sapiens
taggggactgacaagcggggac

SEQ ID NO: 6961066 - DNA, 22 bp, Homo sapiens
aaccagatgctttgtggagtta

SEQ ID NO: 6961067 - DNA, 22 bp, Homo sapiens
aagtccttgtatacagaatcaa

SEQ ID NO: 6961068 - DNA, 22 bp, Homo sapiens
ggaacctttctccaggttgtag

SEQ ID NO: 6961069 - DNA, 22 bp, Homo sapiens
agctgtgtgtttgtcatgggcg

SEQ ID NO: 6961070 - DNA, 22 bp, Homo sapiens
tgtgactgcatttggagctggg

SEQ ID NO: 6961071 - DNA, 22 bp, Homo sapiens
tttcaagttctgttcctaaact

SEQ ID NO: 6961072 - DNA, 22 bp, Homo sapiens
cagaaatacccagcatttggag

SEQ ID NO: 6961073 - DNA, 22 bp, Homo sapiens
tcacattttatctattttaagt

SEQ ID NO: 6961074 - DNA, 18 bp, Homo sapiens
aagctcattctcttccta

SEQ ID NO: 6961075 - DNA, 22 bp, Homo sapiens
tgatttgaattttaaaacactg

SEQ ID NO: 6961076 - DNA, 20 bp, Homo sapiens
tttcctaagtggtttgctga

SEQ ID NO: 6961077 - DNA, 22 bp, Homo sapiens
tagctgtcagctgcaggcaggc

SEQ ID NO: 6961078 - DNA, 22 bp, Homo sapiens
ttctgaggtccatgcagtactg

SEQ ID NO: 6961079 - DNA, 22 bp, Homo sapiens
ccttagaaatgtaccaaaggaa

SEQ ID NO: 6961080 - DNA, 22 bp, Homo sapiens
tcctggcttcctgctcttgtca

SEQ ID NO: 6961081 - DNA, 22 bp, Homo sapiens
agaggctcagaggcctggtcct

SEQ ID NO: 6961082 - DNA, 22 bp, Homo sapiens
aagccctggcccaaccttgatt

SEQ ID NO: 6961083 - DNA, 23 bp, Homo sapiens
tccagtctcctgaaaggcagcgt

SEQ ID NO: 6961084 - DNA, 19 bp, Homo sapiens
tcttattgagcagctgagg

SEQ ID NO: 6961085 - DNA, 22 bp, Homo sapiens
cggtcagttgccaggccctgcc

SEQ ID NO: 6961086 - DNA, 22 bp, Homo sapiens
tgacagaggcacccacaactat

SEQ ID NO: 6961087 - DNA, 21 bp, Homo sapiens
agcaggcagtgggctggattt

SEQ ID NO: 6961088 - DNA, 23 bp, Homo sapiens
taacctgagattgcaagggagct

SEQ ID NO: 6961089 - DNA, 22 bp, Homo sapiens
atcgactaagaatattgccacc

SEQ ID NO: 6961090 - DNA, 22 bp, Homo sapiens
agcttcactttgtactttgtca

SEQ ID NO: 6961091 - DNA, 22 bp, Homo sapiens
tgagctcttctaactaattgtg

SEQ ID NO: 6961092 - DNA, 22 bp, Homo sapiens
tgctattgtgaacagtgccaca

SEQ ID NO: 6961093 - DNA, 22 bp, Homo sapiens
gctgatgtatatagtgattgag

SEQ ID NO: 6961094 - DNA, 22 bp, Homo sapiens
tgctcattgctgatttacatgt

SEQ ID NO: 6961095 - DNA, 22 bp, Homo sapiens
aatcttcactcattcagagttg

SEQ ID NO: 6961096 - DNA, 22 bp, Homo sapiens
tctagaatggctgggcacagct

SEQ ID NO: 6961097 - DNA, 22 bp, Homo sapiens
aattctagcattgtgaaaatat

SEQ ID NO: 6961098 - DNA, 22 bp, Homo sapiens
tctgccaggttgttatgctact

SEQ ID NO: 6961099 - DNA, 22 bp, Homo sapiens
tcagaatatattcatgttgtca

SEQ ID NO: 6961100 - DNA, 22 bp, Homo sapiens
aggctagaggcttctggcttca

SEQ ID NO: 6961101 - DNA, 22 bp, Homo sapiens
ccagagatgctcagggtttgca

SEQ ID NO: 6961102 - DNA, 22 bp, Homo sapiens
atgtcccaagatacagctagag

SEQ ID NO: 6961103 - DNA, 22 bp, Homo sapiens
cattgtctggtaggaagtgggc

SEQ ID NO: 6961104 - DNA, 22 bp, Homo sapiens
cacaggaggaggtgcccgggcc

SEQ ID NO: 6961105 - DNA, 22 bp, Homo sapiens
atgcagtagataggcactttta

SEQ ID NO: 6961106 - DNA, 22 bp, Homo sapiens
tggtgagacaggatcaacccct

SEQ ID NO: 6961107 - DNA, 22 bp, Homo sapiens
tcacagagatgaacttttgata

SEQ ID NO: 6961108 - DNA, 22 bp, Homo sapiens
aggcctttgtggagctcatggc

SEQ ID NO: 6961109 - DNA, 22 bp, Homo sapiens
cttaggaagttgttacacactt

SEQ ID NO: 6961110 - DNA, 22 bp, Homo sapiens
ggcttcacatagcaatgtgagc

SEQ ID NO: 6961111 - DNA, 22 bp, Homo sapiens
cattcttctcccttaccttcca

SEQ ID NO: 6961112 - DNA, 22 bp, Homo sapiens
ggaataaaaattgtttactgta

SEQ ID NO: 6961113 - DNA, 22 bp, Homo sapiens
ctggatctgaacatcggtatca

SEQ ID NO: 6961114 - DNA, 22 bp, Homo sapiens
gggccctgcgtccggaagtctg

SEQ ID NO: 6961115 - DNA, 18 bp, Homo sapiens
atgtgctcatggggaaag

SEQ ID NO: 6961116 - DNA, 19 bp, Homo sapiens
aaccaggaactaaagcaga

SEQ ID NO: 6961117 - DNA, 23 bp, Homo sapiens
cctgcctgttctaactccatttc

SEQ ID NO: 6961118 - DNA, 22 bp, Homo sapiens
caggcttggagggcagtggcat

SEQ ID NO: 6961119 - DNA, 22 bp, Homo sapiens
atctgatgtcagtgcaattatc

SEQ ID NO: 6961120 - DNA, 22 bp, Homo sapiens
gccagctggagactggcagggg

SEQ ID NO: 6961121 - DNA, 22 bp, Homo sapiens
tttatattgggagtcgttttga

SEQ ID NO: 6961122 - DNA, 22 bp, Homo sapiens
tgaaacactttcaattacatat

SEQ ID NO: 6961123 - DNA, 22 bp, Homo sapiens
ttcaaaccatggcacaggaagg

SEQ ID NO: 6961124 - DNA, 22 bp, Homo sapiens
gtttcctagatcagtgttctta

SEQ ID NO: 6961125 - DNA, 22 bp, Homo sapiens
gcccactctggagcctgttccc

SEQ ID NO: 6961126 - DNA, 22 bp, Homo sapiens
tcagcaggggccgttgggtgga

SEQ ID NO: 6961127 - DNA, 22 bp, Homo sapiens
tgaccactgacctcagccctgg

SEQ ID NO: 6961128 - DNA, 22 bp, Homo sapiens
tcagcaaatacttattgagcgc

SEQ ID NO: 6961129 - DNA, 22 bp, Homo sapiens
tcttcctggcattgatgctgca

SEQ ID NO: 6961130 - DNA, 22 bp, Homo sapiens
gagcctcagggttttgttgaca

SEQ ID NO: 6961131 - DNA, 22 bp, Homo sapiens
gtaaaatagaataacgtggcta

SEQ ID NO: 6961132 - DNA, 20 bp, Homo sapiens
atctgcttgcctgtcctcgg

SEQ ID NO: 6961133 - DNA, 18 bp, Homo sapiens
gacccagcagatgggctt

SEQ ID NO: 6961134 - DNA, 22 bp, Homo sapiens
taacatttcggtgacagtggga

SEQ ID NO: 6961135 - DNA, 19 bp, Homo sapiens
tcacttctgttagcatgga

SEQ ID NO: 6961136 - DNA, 22 bp, Homo sapiens
agagtttggaggtgttcctgga

SEQ ID NO: 6961137 - DNA, 22 bp, Homo sapiens
ctgcacagcatgctctgattta

SEQ ID NO: 6961138 - DNA, 22 bp, Homo sapiens
ggctcctgagaatgggccatca

SEQ ID NO: 6961139 - DNA, 22 bp, Homo sapiens
aagtggagccagggaaactgaa

SEQ ID NO: 6961140 - DNA, 22 bp, Homo sapiens
ggtgggtttggaagagcaggct

SEQ ID NO: 6961141 - DNA, 22 bp, Homo sapiens
gcagctgggacactgaggccag

SEQ ID NO: 6961142 - DNA, 22 bp, Homo sapiens
tatgcacagttacaagaatatc

SEQ ID NO: 6961143 - DNA, 22 bp, Homo sapiens
tagtgtttagtacatatgcata

SEQ ID NO: 6961144 - DNA, 22 bp, Homo sapiens
ttgcagctctgatccagggacc

SEQ ID NO: 6961145 - DNA, 22 bp, Homo sapiens
ttaagttgtgaataatccagtc

SEQ ID NO: 6961146 - DNA, 22 bp, Homo sapiens
agtgctggattacaggcgtgag

SEQ ID NO: 6961147 - DNA, 22 bp, Homo sapiens
agttggcacatagcaaattcgc

SEQ ID NO: 6961148 - DNA, 22 bp, Homo sapiens
cactatgtgcattgttttctcc

SEQ ID NO: 6961149 - DNA, 23 bp, Homo sapiens
tgattgaaatgaggagtatttgt

SEQ ID NO: 6961150 - DNA, 19 bp, Homo sapiens
ttgcttcatgtcttttgct

SEQ ID NO: 6961151 - DNA, 22 bp, Homo sapiens
acacaggttaaaataattggga

SEQ ID NO: 6961152 - DNA, 22 bp, Homo sapiens
gtggcatgaaagcatctgtgat

SEQ ID NO: 6961153 - DNA, 22 bp, Homo sapiens
caagaaactttattctgccata

SEQ ID NO: 6961154 - DNA, 22 bp, Homo sapiens
tctctgagcccaatgtagcaat

SEQ ID NO: 6961155 - DNA, 22 bp, Homo sapiens
tcctcccttgactcctgctttt

SEQ ID NO: 6961156 - DNA, 22 bp, Homo sapiens
tcttacagccactctgtgaagc

SEQ ID NO: 6961157 - DNA, 22 bp, Homo sapiens
atcagaagcttgtagtctctct

SEQ ID NO: 6961158 - DNA, 22 bp, Homo sapiens
tgctgcagttcaccctgccgtc

SEQ ID NO: 6961159 - DNA, 22 bp, Homo sapiens
acctttatagctgattatgaca

SEQ ID NO: 6961160 - DNA, 22 bp, Homo sapiens
aaagtggcttctctgtgctttt

SEQ ID NO: 6961161 - DNA, 22 bp, Homo sapiens
tctgcttaacaacagcacagag

SEQ ID NO: 6961162 - DNA, 22 bp, Homo sapiens
agagatgcccttgaaaggatta

SEQ ID NO: 6961163 - DNA, 22 bp, Homo sapiens
cctgtctgcatgagtgagcata

SEQ ID NO: 6961164 - DNA, 22 bp, Homo sapiens
tggtgcctccagctgcttctcc

SEQ ID NO: 6961165 - DNA, 22 bp, Homo sapiens
tacgttcttgtttggaatgagg

SEQ ID NO: 6961166 - DNA, 22 bp, Homo sapiens
aggcatggacatttcggcagct

SEQ ID NO: 6961167 - DNA, 17 bp, Homo sapiens
gctccagaattctagtc

SEQ ID NO: 6961168 - DNA, 22 bp, Homo sapiens
catcactggcatcatgggaggg

SEQ ID NO: 6961169 - DNA, 22 bp, Homo sapiens
cctggcttctgggtctgtgaga

SEQ ID NO: 6961170 - DNA, 22 bp, Homo sapiens
tgccactgggcatgcagatgtc

SEQ ID NO: 6961171 - DNA, 22 bp, Homo sapiens
ggttctccttgagtgtcccagg

SEQ ID NO: 6961172 - DNA, 22 bp, Homo sapiens
gctgatatgattgataaaggta

SEQ ID NO: 6961173 - DNA, 22 bp, Homo sapiens
ggctatggaaatggcaggacat

SEQ ID NO: 6961174 - DNA, 22 bp, Homo sapiens
acttcaaaaataagtgagaggt

SEQ ID NO: 6961175 - DNA, 22 bp, Homo sapiens
cttgatgatttgcagagggagt

SEQ ID NO: 6961176 - DNA, 22 bp, Homo sapiens
ttcatagcagtccctttctggg

SEQ ID NO: 6961177 - DNA, 22 bp, Homo sapiens
tccagcctggttgcgggcatcc

SEQ ID NO: 6961178 - DNA, 22 bp, Homo sapiens
ggtgtgccacttcactgagcag

SEQ ID NO: 6961179 - DNA, 22 bp, Homo sapiens
ggcaggaagctcatgtggactg

SEQ ID NO: 6961180 - DNA, 22 bp, Homo sapiens
cagagctgtcatttgccagtga

SEQ ID NO: 6961181 - DNA, 22 bp, Homo sapiens
taatcctggtgagtttgaaaaa

SEQ ID NO: 6961182 - DNA, 22 bp, Homo sapiens
caccccttgtctttggggtcgt

SEQ ID NO: 6961183 - DNA, 22 bp, Homo sapiens
gggagccatgctggtcttcttt

SEQ ID NO: 6961184 - DNA, 22 bp, Homo sapiens
aaagccaggctggcctggggtt

SEQ ID NO: 6961185 - DNA, 22 bp, Homo sapiens
cctgcctgtactagagacccag

SEQ ID NO: 6961186 - DNA, 22 bp, Homo sapiens
gctgaagtttatgtcttctttt

SEQ ID NO: 6961187 - DNA, 22 bp, Homo sapiens
atgctgagtgagtgaaacccag

SEQ ID NO: 6961188 - DNA, 22 bp, Homo sapiens
ttaaaccatagtttaacataag

SEQ ID NO: 6961189 - DNA, 22 bp, Homo sapiens
agaatgtagtcttggagattta

SEQ ID NO: 6961190 - DNA, 22 bp, Homo sapiens
tctcaggaagattagggctaag

SEQ ID NO: 6961191 - DNA, 22 bp, Homo sapiens
agtgtcaattctcaaatctcgg

SEQ ID NO: 6961192 - DNA, 22 bp, Homo sapiens
cgcggaggaggtcaggaggtga

SEQ ID NO: 6961193 - DNA, 22 bp, Homo sapiens
gttgtgattgtagctaaactag

SEQ ID NO: 6961194 - DNA, 21 bp, Homo sapiens
tgtctcaagaaaggcctctcc

SEQ ID NO: 6961195 - DNA, 22 bp, Homo sapiens
aagacttatagtcagtaattct

SEQ ID NO: 6961196 - DNA, 22 bp, Homo sapiens
ttgcttcagagggagacacttt

SEQ ID NO: 6961197 - DNA, 22 bp, Homo sapiens
tatgtgtgtttcagtggaaatg

SEQ ID NO: 6961198 - DNA, 22 bp, Homo sapiens
tggcatttcagtattttcataa

SEQ ID NO: 6961199 - DNA, 22 bp, Homo sapiens
cagcacaggcctgtctttgtct

SEQ ID NO: 6961200 - DNA, 22 bp, Homo sapiens
atttcccaatacgctaagtgga

SEQ ID NO: 6961201 - DNA, 22 bp, Homo sapiens
taggccttttgcatgcaatgtt

SEQ ID NO: 6961202 - DNA, 22 bp, Homo sapiens
tgtgaagggcactgtctggaat

SEQ ID NO: 6961203 - DNA, 23 bp, Homo sapiens
tagcacctctcacatagtgggtt

SEQ ID NO: 6961204 - DNA, 22 bp, Homo sapiens
ctgtcagcttctcctggccaga

SEQ ID NO: 6961205 - DNA, 22 bp, Homo sapiens
gccaactggctgatctcaaagc

SEQ ID NO: 6961206 - DNA, 23 bp, Homo sapiens
aggggcagcaagttttggtgtta

SEQ ID NO: 6961207 - DNA, 22 bp, Homo sapiens
atggctggatttgatccatggg

SEQ ID NO: 6961208 - DNA, 19 bp, Homo sapiens
agcagagcaaagtggctga

SEQ ID NO: 6961209 - DNA, 22 bp, Homo sapiens
tctgcccaaggctgtcactaga

SEQ ID NO: 6961210 - DNA, 22 bp, Homo sapiens
tcctgggcttgctcctccagct

SEQ ID NO: 6961211 - DNA, 15 bp, Homo sapiens
acctctctcgctggc

SEQ ID NO: 6961212 - DNA, 22 bp, Homo sapiens
gctttgggggctgcagtgcgtg

SEQ ID NO: 6961213 - DNA, 22 bp, Homo sapiens
tgttctggagataagaggtaga

SEQ ID NO: 6961214 - DNA, 22 bp, Homo sapiens
ttggaagagagccacagttaat

SEQ ID NO: 6961215 - DNA, 22 bp, Homo sapiens
attggctccttctaacatgtct

SEQ ID NO: 6961216 - DNA, 22 bp, Homo sapiens
aatgtctatgaaatgaaaggga

SEQ ID NO: 6961217 - DNA, 23 bp, Homo sapiens
gccaatttagtaaaggcagtggg

SEQ ID NO: 6961218 - DNA, 22 bp, Homo sapiens
gagccctgcccacttgtctgag

SEQ ID NO: 6961219 - DNA, 19 bp, Homo sapiens
gtgtatgtaagttgtgagg

SEQ ID NO: 6961220 - DNA, 22 bp, Homo sapiens
attctacacctctctcatttag

SEQ ID NO: 6961221 - DNA, 22 bp, Homo sapiens
atgctgaatattagcctcatga

SEQ ID NO: 6961222 - DNA, 17 bp, Homo sapiens
gatgtcctctggactac

SEQ ID NO: 6961223 - DNA, 19 bp, Homo sapiens
agtctctgaggcctaagtt

SEQ ID NO: 6961224 - DNA, 22 bp, Homo sapiens
tcttgggattgccctgcagttc

SEQ ID NO: 6961225 - DNA, 22 bp, Homo sapiens
aagcaggaagctcaggtccttg

SEQ ID NO: 6961226 - DNA, 22 bp, Homo sapiens
agctaatgggagaccctttcac

SEQ ID NO: 6961227 - DNA, 22 bp, Homo sapiens
ccagggaaggactctctttccc

SEQ ID NO: 6961228 - DNA, 22 bp, Homo sapiens
aacagatataggcagaactttg

SEQ ID NO: 6961229 - DNA, 22 bp, Homo sapiens
aagagagagttcctaggcaaaa

SEQ ID NO: 6961230 - DNA, 22 bp, Homo sapiens
atccacaagaccccttttcact

SEQ ID NO: 6961231 - DNA, 22 bp, Homo sapiens
atttcaggatggaaagaggcca

SEQ ID NO: 6961232 - DNA, 22 bp, Homo sapiens
caggaggcccacaggcccctgc

SEQ ID NO: 6961233 - DNA, 22 bp, Homo sapiens
tgagaaaggtatttcatgcact

SEQ ID NO: 6961234 - DNA, 17 bp, Homo sapiens
cagtgcagagccctttc

SEQ ID NO: 6961235 - DNA, 22 bp, Homo sapiens
atgtatgtgttgcaattatgtt

SEQ ID NO: 6961236 - DNA, 22 bp, Homo sapiens
tgaaatggtattctttttcaat

SEQ ID NO: 6961237 - DNA, 22 bp, Homo sapiens
ttgtcatgagtcacaaaaataa

SEQ ID NO: 6961238 - DNA, 22 bp, Homo sapiens
gctaagggataggctgcctcct

SEQ ID NO: 6961239 - DNA, 22 bp, Homo sapiens
agtgtattaaaatgctcctaag

SEQ ID NO: 6961240 - DNA, 18 bp, Homo sapiens
cattgtttccagaagacc

SEQ ID NO: 6961241 - DNA, 22 bp, Homo sapiens
atgcagctcatttgtttaaaag

SEQ ID NO: 6961242 - DNA, 22 bp, Homo sapiens
aggcccttgggtcctctccaca

SEQ ID NO: 6961243 - DNA, 22 bp, Homo sapiens
caggaagcaccagcccggcccc

SEQ ID NO: 6961244 - DNA, 22 bp, Homo sapiens
gggctccacagcagtgagtgga

SEQ ID NO: 6961245 - DNA, 22 bp, Homo sapiens
cacaactttaggaaccacattc

SEQ ID NO: 6961246 - DNA, 22 bp, Homo sapiens
cacaatgcgtacatatatcaaa

SEQ ID NO: 6961247 - DNA, 22 bp, Homo sapiens
gctgctgccgcggccgctggga

SEQ ID NO: 6961248 - DNA, 22 bp, Homo sapiens
aaattgtgctcacactgatatt

SEQ ID NO: 6961249 - DNA, 22 bp, Homo sapiens
tcacaggataaggtggcatcac

SEQ ID NO: 6961250 - DNA, 22 bp, Homo sapiens
cataaagttttataggctcaaa

SEQ ID NO: 6961251 - DNA, 22 bp, Homo sapiens
gcatttcatgccgtggaagtcc

SEQ ID NO: 6961252 - DNA, 22 bp, Homo sapiens
agcagagaagacacaggcttca

SEQ ID NO: 6961253 - DNA, 22 bp, Homo sapiens
ctgtggaaaatgctttacatat

SEQ ID NO: 6961254 - DNA, 22 bp, Homo sapiens
actgcagtggcaggaacttatc

SEQ ID NO: 6961255 - DNA, 22 bp, Homo sapiens
cacaggagccctgaggcctccc

SEQ ID NO: 6961256 - DNA, 21 bp, Homo sapiens
agcattcttggccagtccacc

SEQ ID NO: 6961257 - DNA, 22 bp, Homo sapiens
ctgggtttagggtctccccttg

SEQ ID NO: 6961258 - DNA, 22 bp, Homo sapiens
tttgtactgccacagctgacgt

SEQ ID NO: 6961259 - DNA, 22 bp, Homo sapiens
gaaggccacaaaaaatgtcata

SEQ ID NO: 6961260 - DNA, 22 bp, Homo sapiens
gctcttgactcccagttctgtg

SEQ ID NO: 6961261 - DNA, 22 bp, Homo sapiens
gcagcccaggtctctctcactc

SEQ ID NO: 6961262 - DNA, 19 bp, Homo sapiens
agtgagcatccagagaggt

SEQ ID NO: 6961263 - DNA, 22 bp, Homo sapiens
tctatgtctcgacccaagacaa

SEQ ID NO: 6961264 - DNA, 22 bp, Homo sapiens
acagtgttcacttaacaatgga

SEQ ID NO: 6961265 - DNA, 22 bp, Homo sapiens
ctccctctgtcttgtccagaaa

SEQ ID NO: 6961266 - DNA, 22 bp, Homo sapiens
cagtttttcaaaattacatgat

SEQ ID NO: 6961267 - DNA, 22 bp, Homo sapiens
cccaggaagcccagaattctgg

SEQ ID NO: 6961268 - DNA, 22 bp, Homo sapiens
ttccatattcccaattttgcca

SEQ ID NO: 6961269 - DNA, 20 bp, Homo sapiens
ctgcttgggacactgccaga

SEQ ID NO: 6961270 - DNA, 22 bp, Homo sapiens
tggcttcttgatcttggacttg

SEQ ID NO: 6961271 - DNA, 22 bp, Homo sapiens
taatgtgtgtcatcagtagagt

SEQ ID NO: 6961272 - DNA, 22 bp, Homo sapiens
tagaggatgcaggattgtttgt

SEQ ID NO: 6961273 - DNA, 22 bp, Homo sapiens
cagggcctctcctccaggaact

SEQ ID NO: 6961274 - DNA, 22 bp, Homo sapiens
ttagtgtgcatggatgcctcaa

SEQ ID NO: 6961275 - DNA, 22 bp, Homo sapiens
acaaggattaaatgatatacag

SEQ ID NO: 6961276 - DNA, 22 bp, Homo sapiens
aggcgagaggcttgggctagta

SEQ ID NO: 6961277 - DNA, 22 bp, Homo sapiens
ccagctctagccccatgtggct

SEQ ID NO: 6961278 - DNA, 22 bp, Homo sapiens
tgagttctttccgttaggtatg

SEQ ID NO: 6961279 - DNA, 22 bp, Homo sapiens
agtatgaagaatacatagatga

SEQ ID NO: 6961280 - DNA, 22 bp, Homo sapiens
tcttcagagcatttctgaggta

SEQ ID NO: 6961281 - DNA, 22 bp, Homo sapiens
tctccagggacatgtttctgga

SEQ ID NO: 6961282 - DNA, 22 bp, Homo sapiens
agatctgagggtccaagggagg

SEQ ID NO: 6961283 - DNA, 22 bp, Homo sapiens
cacagtcttatcccaaccacca

SEQ ID NO: 6961284 - DNA, 22 bp, Homo sapiens
gcatgctacagcccaactgtga

SEQ ID NO: 6961285 - DNA, 22 bp, Homo sapiens
ctctggatctgccctgacgcca

SEQ ID NO: 6961286 - DNA, 18 bp, Homo sapiens
cccacggtgctgtagggc

SEQ ID NO: 6961287 - DNA, 22 bp, Homo sapiens
ccaaggctcctcagctggtctt

SEQ ID NO: 6961288 - DNA, 21 bp, Homo sapiens
tgcatttctaactagttgacc

SEQ ID NO: 6961289 - DNA, 22 bp, Homo sapiens
tgaattctcatctcctgacact

SEQ ID NO: 6961290 - DNA, 23 bp, Homo sapiens
ccctaggtgggcccgctctaggg

SEQ ID NO: 6961291 - DNA, 22 bp, Homo sapiens
ggccttgcttctgggcatggtt

SEQ ID NO: 6961292 - DNA, 22 bp, Homo sapiens
ttatggagtgcttacctgccag

SEQ ID NO: 6961293 - DNA, 22 bp, Homo sapiens
tctcccactggccttgtatgat

SEQ ID NO: 6961294 - DNA, 22 bp, Homo sapiens
agagttggccaaaaggggcatt

SEQ ID NO: 6961295 - DNA, 22 bp, Homo sapiens
aaacagattgaaattcgtagta

SEQ ID NO: 6961296 - DNA, 22 bp, Homo sapiens
agctggtgctcaggggcatgga

SEQ ID NO: 6961297 - DNA, 22 bp, Homo sapiens
tagaggcattgcttaatttcag

SEQ ID NO: 6961298 - DNA, 22 bp, Homo sapiens
gtggcttcatgaacactgatga

SEQ ID NO: 6961299 - DNA, 22 bp, Homo sapiens
ccacttttgggaacagtgagta

SEQ ID NO: 6961300 - DNA, 22 bp, Homo sapiens
attggcaagtgaatttaacagc

SEQ ID NO: 6961301 - DNA, 22 bp, Homo sapiens
gctaggaacatttatatacaaa

SEQ ID NO: 6961302 - DNA, 22 bp, Homo sapiens
gctcagtgtgcacgagtactct

SEQ ID NO: 6961303 - DNA, 22 bp, Homo sapiens
ctgattccctggtgcctccgtt

SEQ ID NO: 6961304 - DNA, 22 bp, Homo sapiens
gtagttatcagtatgacaccag

SEQ ID NO: 6961305 - DNA, 22 bp, Homo sapiens
tggcagaatttctagcagattc

SEQ ID NO: 6961306 - DNA, 22 bp, Homo sapiens
attgagagtgtatagctgatct

SEQ ID NO: 6961307 - DNA, 22 bp, Homo sapiens
gctgctgtcacccacatctgtc

SEQ ID NO: 6961308 - DNA, 22 bp, Homo sapiens
gagcacagatcctggagccaca

SEQ ID NO: 6961309 - DNA, 22 bp, Homo sapiens
ggaaatgcataggagtttagaa

SEQ ID NO: 6961310 - DNA, 22 bp, Homo sapiens
cattcaaaagctccatgtttgt

SEQ ID NO: 6961311 - DNA, 22 bp, Homo sapiens
tttgtacatataaatcttgtat

SEQ ID NO: 6961312 - DNA, 22 bp, Homo sapiens
gggaagtgaagtgtagctgtct

SEQ ID NO: 6961313 - DNA, 22 bp, Homo sapiens
cagcagctcaggctccttccca

SEQ ID NO: 6961314 - DNA, 22 bp, Homo sapiens
agtcaggggttggacggggcca

SEQ ID NO: 6961315 - DNA, 22 bp, Homo sapiens
tttaaggaggggctcacgtggg

SEQ ID NO: 6961316 - DNA, 22 bp, Homo sapiens
tttctgaattcctaggatgttg

SEQ ID NO: 6961317 - DNA, 22 bp, Homo sapiens
ctgtctgaatcctaagcttcct

SEQ ID NO: 6961318 - DNA, 21 bp, Homo sapiens
tgtttaatacatatttgtgga

SEQ ID NO: 6961319 - DNA, 22 bp, Homo sapiens
tgtttacttgaggtggaaacaa

SEQ ID NO: 6961320 - DNA, 22 bp, Homo sapiens
ttcacattagccaagagatgga

SEQ ID NO: 6961321 - DNA, 22 bp, Homo sapiens
gtgtccttttgagggtccacag

SEQ ID NO: 6961322 - DNA, 22 bp, Homo sapiens
ctattgggtatttattgagcac

SEQ ID NO: 6961323 - DNA, 22 bp, Homo sapiens
cagctggcatacctgggcccgg

SEQ ID NO: 6961324 - DNA, 22 bp, Homo sapiens
tactgtggttactgctattaga

SEQ ID NO: 6961325 - DNA, 22 bp, Homo sapiens
ttaactgttccaaatgctgtag

SEQ ID NO: 6961326 - DNA, 23 bp, Homo sapiens
gccctgactgcggcctcccactc

SEQ ID NO: 6961327 - DNA, 22 bp, Homo sapiens
agccctgcaggaggtgggagag

SEQ ID NO: 6961328 - DNA, 22 bp, Homo sapiens
agagattaagtcacttggtcag

SEQ ID NO: 6961329 - DNA, 22 bp, Homo sapiens
caggctgcagaggcctttcatg

SEQ ID NO: 6961330 - DNA, 22 bp, Homo sapiens
gaagctgaggtcaggtgggtgg

SEQ ID NO: 6961331 - DNA, 22 bp, Homo sapiens
tgggagtgttcttggcttgctt

SEQ ID NO: 6961332 - DNA, 22 bp, Homo sapiens
cttctgtgaagagcagaaccat

SEQ ID NO: 6961333 - DNA, 22 bp, Homo sapiens
agcactctaagtgcaagacact

SEQ ID NO: 6961334 - DNA, 19 bp, Homo sapiens
tagaaagatgatgggtggg

SEQ ID NO: 6961335 - DNA, 22 bp, Homo sapiens
gtgtttatttagagtaggccat

SEQ ID NO: 6961336 - DNA, 19 bp, Homo sapiens
cctgtctgtcttcagctag

SEQ ID NO: 6961337 - DNA, 22 bp, Homo sapiens
tgctgtgcatcatagtgtttgg

SEQ ID NO: 6961338 - DNA, 22 bp, Homo sapiens
gctcacagttctatttttcatg

SEQ ID NO: 6961339 - DNA, 22 bp, Homo sapiens
cactatcttgtagggcatggca

SEQ ID NO: 6961340 - DNA, 22 bp, Homo sapiens
tccgttctctaggagaaacttc

SEQ ID NO: 6961341 - DNA, 22 bp, Homo sapiens
aaggcagtttgggccaccatct

SEQ ID NO: 6961342 - DNA, 22 bp, Homo sapiens
actagctgtgacagctgcgtgt

SEQ ID NO: 6961343 - DNA, 22 bp, Homo sapiens
tcctggagctgactccgtttga

SEQ ID NO: 6961344 - DNA, 22 bp, Homo sapiens
agctgctagttcctgttctcac

SEQ ID NO: 6961345 - DNA, 22 bp, Homo sapiens
cctgattagggtctttcaaatg

SEQ ID NO: 6961346 - DNA, 22 bp, Homo sapiens
tggcacatggttaatcataatt

SEQ ID NO: 6961347 - DNA, 22 bp, Homo sapiens
gcatggccatggcactatggac

SEQ ID NO: 6961348 - DNA, 22 bp, Homo sapiens
ccactttttcagtgtgcatgca

SEQ ID NO: 6961349 - DNA, 22 bp, Homo sapiens
agaatctgcattttaacaagct

SEQ ID NO: 6961350 - DNA, 20 bp, Homo sapiens
tgtaaactgcagagtgagaa

SEQ ID NO: 6961351 - DNA, 22 bp, Homo sapiens
aatgtcaaaataattgatttgt

SEQ ID NO: 6961352 - DNA, 22 bp, Homo sapiens
tggcctgccactgccacgccac

SEQ ID NO: 6961353 - DNA, 22 bp, Homo sapiens
atccttctccagtcgtattttt

SEQ ID NO: 6961354 - DNA, 22 bp, Homo sapiens
caggccgggcactgcgctaggt

SEQ ID NO: 6961355 - DNA, 22 bp, Homo sapiens
actcctgggtgctgaccagcgt

SEQ ID NO: 6961356 - DNA, 21 bp, Homo sapiens
agccgtaagataagtaaatgt

SEQ ID NO: 6961357 - DNA, 22 bp, Homo sapiens
agacacaggtgtaatttctgct

SEQ ID NO: 6961358 - DNA, 21 bp, Homo sapiens
cctgggagaattgggtgtggc

SEQ ID NO: 6961359 - DNA, 21 bp, Homo sapiens
gaggctgtctgctgctggcct

SEQ ID NO: 6961360 - DNA, 22 bp, Homo sapiens
gctgttctgcaccagacttcag

SEQ ID NO: 6961361 - DNA, 22 bp, Homo sapiens
attgcttatctatctttaagtc

SEQ ID NO: 6961362 - DNA, 22 bp, Homo sapiens
tcaccatcctcacctagaaatg

SEQ ID NO: 6961363 - DNA, 22 bp, Homo sapiens
agagaggtctcaggagaaacca

SEQ ID NO: 6961364 - DNA, 22 bp, Homo sapiens
tggcagtccagaccctggactc

SEQ ID NO: 6961365 - DNA, 22 bp, Homo sapiens
atacctgcagtattttattgtt

SEQ ID NO: 6961366 - DNA, 22 bp, Homo sapiens
tggagctgaactttgaggccag

SEQ ID NO: 6961367 - DNA, 22 bp, Homo sapiens
gttaacaagaattactctggaa

SEQ ID NO: 6961368 - DNA, 22 bp, Homo sapiens
gggaccactccgacatgtaggg

SEQ ID NO: 6961369 - DNA, 22 bp, Homo sapiens
atcctaagacgtgtggtttgag

SEQ ID NO: 6961370 - DNA, 22 bp, Homo sapiens
atacacaattgtgtttttatga

SEQ ID NO: 6961371 - DNA, 22 bp, Homo sapiens
ttcaccctgagccccacctctg

SEQ ID NO: 6961372 - DNA, 22 bp, Homo sapiens
tgtgtcttaagttccaagacat

SEQ ID NO: 6961373 - DNA, 22 bp, Homo sapiens
cttcagaatgggactgtgtttg

SEQ ID NO: 6961374 - DNA, 22 bp, Homo sapiens
tcaatttcaacagctgataaga

SEQ ID NO: 6961375 - DNA, 22 bp, Homo sapiens
tgtcatttaaagctttccagat

SEQ ID NO: 6961376 - DNA, 22 bp, Homo sapiens
agagctcctgcattcttccctg

SEQ ID NO: 6961377 - DNA, 22 bp, Homo sapiens
aaggcatttgttggatttctca

SEQ ID NO: 6961378 - DNA, 20 bp, Homo sapiens
agtctctgtagtgcctgaga

SEQ ID NO: 6961379 - DNA, 22 bp, Homo sapiens
tattagcctggatctgtgactg

SEQ ID NO: 6961380 - DNA, 22 bp, Homo sapiens
aggcactgggaatatgctgagg

SEQ ID NO: 6961381 - DNA, 19 bp, Homo sapiens
gccatcctgcccttgacat

SEQ ID NO: 6961382 - DNA, 22 bp, Homo sapiens
agtttatgaaacacagatttga

SEQ ID NO: 6961383 - DNA, 22 bp, Homo sapiens
agggccacttgtagactggtga

SEQ ID NO: 6961384 - DNA, 22 bp, Homo sapiens
tgtcacatgaagccaacatagc

SEQ ID NO: 6961385 - DNA, 22 bp, Homo sapiens
tcagacagaaagatgagtatgg

SEQ ID NO: 6961386 - DNA, 22 bp, Homo sapiens
gagaggctgaaatcacaggagc

SEQ ID NO: 6961387 - DNA, 22 bp, Homo sapiens
aacatagaagatggttaattgt

SEQ ID NO: 6961388 - DNA, 22 bp, Homo sapiens
agatgacatgggagcaagcact

SEQ ID NO: 6961389 - DNA, 22 bp, Homo sapiens
gggaaattttaggtttgtctcg

SEQ ID NO: 6961390 - DNA, 22 bp, Homo sapiens
ttctgcattggagtctattctt

SEQ ID NO: 6961391 - DNA, 22 bp, Homo sapiens
taacactgatttgttctcaggg

SEQ ID NO: 6961392 - DNA, 22 bp, Homo sapiens
ccagctggtgggtctttctctg

SEQ ID NO: 6961393 - DNA, 23 bp, Homo sapiens
acagggcttatctgtcactcatc

SEQ ID NO: 6961394 - DNA, 22 bp, Homo sapiens
tctgggtgatgaaatgcactgt

SEQ ID NO: 6961395 - DNA, 21 bp, Homo sapiens
tccagcacagatgacctcccc

SEQ ID NO: 6961396 - DNA, 22 bp, Homo sapiens
acagcaggcatgaagaaatgtt

SEQ ID NO: 6961397 - DNA, 22 bp, Homo sapiens
ggcaacaactggacatagctgg

SEQ ID NO: 6961398 - DNA, 22 bp, Homo sapiens
ctcgcaagtcgctccggttact

SEQ ID NO: 6961399 - DNA, 22 bp, Homo sapiens
ctctgaaagacaagctctcatt

SEQ ID NO: 6961400 - DNA, 22 bp, Homo sapiens
gacaatcagccatatccagggt

SEQ ID NO: 6961401 - DNA, 22 bp, Homo sapiens
ctggtgatcttgggcaagtcac

SEQ ID NO: 6961402 - DNA, 21 bp, Homo sapiens
agtcccaggggtgagtgatgt

SEQ ID NO: 6961403 - DNA, 23 bp, Homo sapiens
tcaataactcgggttaaaataga

SEQ ID NO: 6961404 - DNA, 22 bp, Homo sapiens
taggtctgtaccctgtccttct

SEQ ID NO: 6961405 - DNA, 22 bp, Homo sapiens
atgtccttcctgagatccctgt

SEQ ID NO: 6961406 - DNA, 22 bp, Homo sapiens
ctactctgaaaacccagaaact

SEQ ID NO: 6961407 - DNA, 22 bp, Homo sapiens
ttctagaatgatatgaggtact

SEQ ID NO: 6961408 - DNA, 22 bp, Homo sapiens
ctgccctgcccaggccttgggc

SEQ ID NO: 6961409 - DNA, 22 bp, Homo sapiens
actgcaacacctcctgggttca

SEQ ID NO: 6961410 - DNA, 22 bp, Homo sapiens
ctccagacagatcttctagcag

SEQ ID NO: 6961411 - DNA, 22 bp, Homo sapiens
ttggataaagaggaagattatc

SEQ ID NO: 6961412 - DNA, 22 bp, Homo sapiens
gaagaggttcaacgtggtcatc

SEQ ID NO: 6961413 - DNA, 22 bp, Homo sapiens
aagggctctgtgtgcctcccca

SEQ ID NO: 6961414 - DNA, 22 bp, Homo sapiens
ctacagagttcacaggatttta

SEQ ID NO: 6961415 - DNA, 22 bp, Homo sapiens
tcagggcagcctaaggcacctc

SEQ ID NO: 6961416 - DNA, 22 bp, Homo sapiens
gctatcttcatggaaatacagg

SEQ ID NO: 6961417 - DNA, 22 bp, Homo sapiens
cagaaactttctttactgagca

SEQ ID NO: 6961418 - DNA, 19 bp, Homo sapiens
tggctgtggggaaatgctt

SEQ ID NO: 6961419 - DNA, 22 bp, Homo sapiens
tcagggcaggttaacttgggtg

SEQ ID NO: 6961420 - DNA, 22 bp, Homo sapiens
aacctgaaactacattcttgat

SEQ ID NO: 6961421 - DNA, 22 bp, Homo sapiens
ctggggctgtgggagacaaggc

SEQ ID NO: 6961422 - DNA, 22 bp, Homo sapiens
tgcagctggtatcccatggatt

SEQ ID NO: 6961423 - DNA, 22 bp, Homo sapiens
tcagaactggaagaggttctgc

SEQ ID NO: 6961424 - DNA, 22 bp, Homo sapiens
ggaaaatgggaacctgaagcca

SEQ ID NO: 6961425 - DNA, 20 bp, Homo sapiens
ggcatccttctgacccagag

SEQ ID NO: 6961426 - DNA, 22 bp, Homo sapiens
gccagcttccatggccacgtca

SEQ ID NO: 6961427 - DNA, 22 bp, Homo sapiens
acattctcatttggtgatcatt

SEQ ID NO: 6961428 - DNA, 22 bp, Homo sapiens
ttacattcattgaagtgattca

SEQ ID NO: 6961429 - DNA, 19 bp, Homo sapiens
ggaaggagagaaatgcatg

SEQ ID NO: 6961430 - DNA, 22 bp, Homo sapiens
tgtttactttccttctcacagg

SEQ ID NO: 6961431 - DNA, 22 bp, Homo sapiens
ttgagtcttcagtaaaagggta

SEQ ID NO: 6961432 - DNA, 22 bp, Homo sapiens
agagttctgctcttctcagtga

SEQ ID NO: 6961433 - DNA, 22 bp, Homo sapiens
tcacaagatacagttagaagca

SEQ ID NO: 6961434 - DNA, 19 bp, Homo sapiens
cccagaggaatgcctggaa

SEQ ID NO: 6961435 - DNA, 22 bp, Homo sapiens
gtgtcacatggtttactgcagc

SEQ ID NO: 6961436 - DNA, 22 bp, Homo sapiens
tctgctaacaatattgcagact

SEQ ID NO: 6961437 - DNA, 18 bp, Homo sapiens
ttctgggtgttatgttta

SEQ ID NO: 6961438 - DNA, 22 bp, Homo sapiens
acattcaaaaagcatctgtcac

SEQ ID NO: 6961439 - DNA, 22 bp, Homo sapiens
tatgggtaagatcttttgtatt

SEQ ID NO: 6961440 - DNA, 22 bp, Homo sapiens
attctccacacatccagacctt

SEQ ID NO: 6961441 - DNA, 22 bp, Homo sapiens
ggaagctgggatctctctcccg

SEQ ID NO: 6961442 - DNA, 22 bp, Homo sapiens
cttggcacattttgttcttctg

SEQ ID NO: 6961443 - DNA, 22 bp, Homo sapiens
cagctggcctgagcggtggcgg

SEQ ID NO: 6961444 - DNA, 22 bp, Homo sapiens
ctctttaaagtaaaatttgtct

SEQ ID NO: 6961445 - DNA, 22 bp, Homo sapiens
attatggacgttaattttggaa

SEQ ID NO: 6961446 - DNA, 22 bp, Homo sapiens
tcccagggtatcctgtagtaaa

SEQ ID NO: 6961447 - DNA, 22 bp, Homo sapiens
tcagggacccctctgagtggag

SEQ ID NO: 6961448 - DNA, 19 bp, Homo sapiens
aacatgacagccactctgg

SEQ ID NO: 6961449 - DNA, 23 bp, Homo sapiens
aggagcccaaggagaggtaactt

SEQ ID NO: 6961450 - DNA, 22 bp, Homo sapiens
cctctgagtacagtgatggatt

SEQ ID NO: 6961451 - DNA, 22 bp, Homo sapiens
tgacccttctggttcctaccaa

SEQ ID NO: 6961452 - DNA, 22 bp, Homo sapiens
agaaaacttgctcgagcctgtt

SEQ ID NO: 6961453 - DNA, 22 bp, Homo sapiens
cagcctttcttgactgtgtgtt

SEQ ID NO: 6961454 - DNA, 22 bp, Homo sapiens
ccagcatttgcttaatttggag

SEQ ID NO: 6961455 - DNA, 22 bp, Homo sapiens
tgacataagttggtagaaagga

SEQ ID NO: 6961456 - DNA, 18 bp, Homo sapiens
gtctgccttctcccttcc

SEQ ID NO: 6961457 - DNA, 22 bp, Homo sapiens
tctgcctctttcaggcctggca

SEQ ID NO: 6961458 - DNA, 20 bp, Homo sapiens
aaagtctcaacagctgagaa

SEQ ID NO: 6961459 - DNA, 22 bp, Homo sapiens
gcctctgcccatccaccatcag

SEQ ID NO: 6961460 - DNA, 22 bp, Homo sapiens
tgggatagggctattgctcaca

SEQ ID NO: 6961461 - DNA, 22 bp, Homo sapiens
agttctggaactctacagcaac

SEQ ID NO: 6961462 - DNA, 22 bp, Homo sapiens
ctgcctgtaactttctgaagca

SEQ ID NO: 6961463 - DNA, 20 bp, Homo sapiens
agcaccagtgggggcagccc

SEQ ID NO: 6961464 - DNA, 22 bp, Homo sapiens
ttcacgttgttgaagaaaatac

SEQ ID NO: 6961465 - DNA, 21 bp, Homo sapiens
cagagcctgtgttgacagttg

SEQ ID NO: 6961466 - DNA, 19 bp, Homo sapiens
acccagagccctttgcagg

SEQ ID NO: 6961467 - DNA, 22 bp, Homo sapiens
gcagtgtagactttagttgatg

SEQ ID NO: 6961468 - DNA, 22 bp, Homo sapiens
tgtagaacaagaaaatctcagt

SEQ ID NO: 6961469 - DNA, 22 bp, Homo sapiens
agtgaggggattcaggcaaggt

SEQ ID NO: 6961470 - DNA, 22 bp, Homo sapiens
actcatgtaagcggaatgtagt

SEQ ID NO: 6961471 - DNA, 22 bp, Homo sapiens
cctgctgtcccctgagcctgga

SEQ ID NO: 6961472 - DNA, 23 bp, Homo sapiens
acatacataagcaccacattttg

SEQ ID NO: 6961473 - DNA, 22 bp, Homo sapiens
taggccagtggcaggttgtgtg

SEQ ID NO: 6961474 - DNA, 20 bp, Homo sapiens
tgcatttgttatttgtactc

SEQ ID NO: 6961475 - DNA, 21 bp, Homo sapiens
acaggctacatgcaggagctg

SEQ ID NO: 6961476 - DNA, 22 bp, Homo sapiens
gctcaatgctcaatgctgcaaa

SEQ ID NO: 6961477 - DNA, 22 bp, Homo sapiens
aaaccatcagataattcatact

SEQ ID NO: 6961478 - DNA, 22 bp, Homo sapiens
ggcatctccaaaacatgaactc

SEQ ID NO: 6961479 - DNA, 22 bp, Homo sapiens
cactattttctcttcagatggc

SEQ ID NO: 6961480 - DNA, 22 bp, Homo sapiens
tcagggcaagtctcagaaggtt

SEQ ID NO: 6961481 - DNA, 22 bp, Homo sapiens
cagtcatttggcacctactgta

SEQ ID NO: 6961482 - DNA, 22 bp, Homo sapiens
tgtccttagggatataaaatat

SEQ ID NO: 6961483 - DNA, 22 bp, Homo sapiens
cagaatttcccacactgggact

SEQ ID NO: 6961484 - DNA, 22 bp, Homo sapiens
tggaataaaatgtcagttctta

SEQ ID NO: 6961485 - DNA, 22 bp, Homo sapiens
tgggaatgtggcaaggcataga

SEQ ID NO: 6961486 - DNA, 17 bp, Homo sapiens
caaagggagcccaccaa

SEQ ID NO: 6961487 - DNA, 22 bp, Homo sapiens
tctttggacatgttgaggttgc

SEQ ID NO: 6961488 - DNA, 23 bp, Homo sapiens
cagaggcatcggattcaacatca

SEQ ID NO: 6961489 - DNA, 22 bp, Homo sapiens
tcctggcctcacagtcctgggt

SEQ ID NO: 6961490 - DNA, 22 bp, Homo sapiens
gtctagatgattcaaagtggta

SEQ ID NO: 6961491 - DNA, 22 bp, Homo sapiens
gttagggatcaggaacaagagc

SEQ ID NO: 6961492 - DNA, 22 bp, Homo sapiens
atggcctggccagagctctgct

SEQ ID NO: 6961493 - DNA, 22 bp, Homo sapiens
ccctgtggggtccgcctgtccg

SEQ ID NO: 6961494 - DNA, 19 bp, Homo sapiens
tgagggtgagctttggaga

SEQ ID NO: 6961495 - DNA, 21 bp, Homo sapiens
tggacctgtccttctcgctgt

SEQ ID NO: 6961496 - DNA, 22 bp, Homo sapiens
ttttgtgatggcattacattta

SEQ ID NO: 6961497 - DNA, 20 bp, Homo sapiens
atgattcatgatgatgtctc

SEQ ID NO: 6961498 - DNA, 22 bp, Homo sapiens
tggccagaacctgcagtaggcc

SEQ ID NO: 6961499 - DNA, 22 bp, Homo sapiens
tgtgcagatagtgatttcagaa

SEQ ID NO: 6961500 - DNA, 22 bp, Homo sapiens
tgacatttatcaaagaaatggt

SEQ ID NO: 6961501 - DNA, 22 bp, Homo sapiens
tcagttgcacctgcatggtact

SEQ ID NO: 6961502 - DNA, 22 bp, Homo sapiens
tgaaaactccaagtttcatcag

SEQ ID NO: 6961503 - DNA, 22 bp, Homo sapiens
cctgctcctgctattcttctgg

SEQ ID NO: 6961504 - DNA, 22 bp, Homo sapiens
ttcctgcaaaactactagtagc

SEQ ID NO: 6961505 - DNA, 22 bp, Homo sapiens
cacagctgccctaactgtactc

SEQ ID NO: 6961506 - DNA, 22 bp, Homo sapiens
tgcacaaacttgtgtcccaggg

SEQ ID NO: 6961507 - DNA, 22 bp, Homo sapiens
gcatgcagacagtctgagacca

SEQ ID NO: 6961508 - DNA, 22 bp, Homo sapiens
gaggtattggccattgtctgtt

SEQ ID NO: 6961509 - DNA, 22 bp, Homo sapiens
atgaaccataggcaagacaata

SEQ ID NO: 6961510 - DNA, 22 bp, Homo sapiens
tctcagcctcacctctatggag

SEQ ID NO: 6961511 - DNA, 22 bp, Homo sapiens
tttgttgtctagcatgaggtgc

SEQ ID NO: 6961512 - DNA, 23 bp, Homo sapiens
gttcattttattgtctgattgct

SEQ ID NO: 6961513 - DNA, 22 bp, Homo sapiens
ctaggaaatttaaaatatgatt

SEQ ID NO: 6961514 - DNA, 22 bp, Homo sapiens
cactggcctaagcgcctcagcc

SEQ ID NO: 6961515 - DNA, 22 bp, Homo sapiens
cagatcctgccaggctgagttg

SEQ ID NO: 6961516 - DNA, 22 bp, Homo sapiens
gctccagagcagagactaggtt

SEQ ID NO: 6961517 - DNA, 19 bp, Homo sapiens
tgagtttaatgcaaaactg

SEQ ID NO: 6961518 - DNA, 23 bp, Homo sapiens
tagcagcatttttagcctctgtc

SEQ ID NO: 6961519 - DNA, 22 bp, Homo sapiens
gctttacaacaaattgaatatg

SEQ ID NO: 6961520 - DNA, 22 bp, Homo sapiens
aagctgtgtaagttgcttggtt

SEQ ID NO: 6961521 - DNA, 20 bp, Homo sapiens
gattctgggcagtcagtgtc

SEQ ID NO: 6961522 - DNA, 22 bp, Homo sapiens
gtgtcccaatctacttttccct

SEQ ID NO: 6961523 - DNA, 23 bp, Homo sapiens
agcttgcttttcccagtactgca

SEQ ID NO: 6961524 - DNA, 22 bp, Homo sapiens
tgcagattcaaatgaaatgcaa

SEQ ID NO: 6961525 - DNA, 22 bp, Homo sapiens
ccagtcagagaaaatgtccact

SEQ ID NO: 6961526 - DNA, 22 bp, Homo sapiens
tcaagagaaggggaaatagact

SEQ ID NO: 6961527 - DNA, 22 bp, Homo sapiens
aggcccatagtagctctgggca

SEQ ID NO: 6961528 - DNA, 21 bp, Homo sapiens
tctctgtgtctttaagctgga

SEQ ID NO: 6961529 - DNA, 22 bp, Homo sapiens
tgtatgaagacttcttctgtgt

SEQ ID NO: 6961530 - DNA, 20 bp, Homo sapiens
agcagtttcctaactcagct

SEQ ID NO: 6961531 - DNA, 22 bp, Homo sapiens
cttctctggctcctcagcgccc

SEQ ID NO: 6961532 - DNA, 22 bp, Homo sapiens
ctgggagctggaatgggagaag

SEQ ID NO: 6961533 - DNA, 22 bp, Homo sapiens
acctcagttcaattcagttaga

SEQ ID NO: 6961534 - DNA, 22 bp, Homo sapiens
tgagggctgcttccagagctag

SEQ ID NO: 6961535 - DNA, 22 bp, Homo sapiens
gcgcagagtagcagagtgctga

SEQ ID NO: 6961536 - DNA, 22 bp, Homo sapiens
atgcaggggcagcagagcctgg

SEQ ID NO: 6961537 - DNA, 22 bp, Homo sapiens
tgcaatttggggaagaaagaga

SEQ ID NO: 6961538 - DNA, 22 bp, Homo sapiens
tgcaccattttgtcaggctact

SEQ ID NO: 6961539 - DNA, 22 bp, Homo sapiens
tcaggctgaccaggttttgctc

SEQ ID NO: 6961540 - DNA, 22 bp, Homo sapiens
ttgatgtaaactttgatttcat

SEQ ID NO: 6961541 - DNA, 22 bp, Homo sapiens
ggtgagggacatcactcagcca

SEQ ID NO: 6961542 - DNA, 22 bp, Homo sapiens
ttacaaagtgctgcaccatttt

SEQ ID NO: 6961543 - DNA, 22 bp, Homo sapiens
tcgtatttgtctttgaaaaatc

SEQ ID NO: 6961544 - DNA, 20 bp, Homo sapiens
aggcactggatttcttatat

SEQ ID NO: 6961545 - DNA, 22 bp, Homo sapiens
gtgaagtgcaaagcagccagtt

SEQ ID NO: 6961546 - DNA, 22 bp, Homo sapiens
ctcggagtggtgtttacagtaa

SEQ ID NO: 6961547 - DNA, 22 bp, Homo sapiens
agcggggtgttttgggtggcct

SEQ ID NO: 6961548 - DNA, 22 bp, Homo sapiens
aactgcaattacttttgcacca

SEQ ID NO: 6961549 - DNA, 22 bp, Homo sapiens
gcctgccaaaagaagctgctgg

SEQ ID NO: 6961550 - DNA, 22 bp, Homo sapiens
aagacattggacaatccagagg

SEQ ID NO: 6961551 - DNA, 22 bp, Homo sapiens
tcctgggaagcgccggcctgcg

SEQ ID NO: 6961552 - DNA, 17 bp, Homo sapiens
gcttcccctgccctctc

SEQ ID NO: 6961553 - DNA, 22 bp, Homo sapiens
tattagcgcttactgagttgcc

SEQ ID NO: 6961554 - DNA, 19 bp, Homo sapiens
tggggctgtgttttgaccc

SEQ ID NO: 6961555 - DNA, 22 bp, Homo sapiens
ggcagagcgcatgcgtcgcaga

SEQ ID NO: 6961556 - DNA, 22 bp, Homo sapiens
ataaatgaacattcacagagct

SEQ ID NO: 6961557 - DNA, 22 bp, Homo sapiens
aatgcaagtcaatgctataccc

SEQ ID NO: 6961558 - DNA, 22 bp, Homo sapiens
aaaggtaaagtatctgcccaag

SEQ ID NO: 6961559 - DNA, 22 bp, Homo sapiens
atgggtcagttcagtggccaac

SEQ ID NO: 6961560 - DNA, 22 bp, Homo sapiens
atacatgacagcatagcatcct

SEQ ID NO: 6961561 - DNA, 22 bp, Homo sapiens
gtgcagctgagggcctcttcta

SEQ ID NO: 6961562 - DNA, 22 bp, Homo sapiens
ccaggcaaagcccatgcaagag

SEQ ID NO: 6961563 - DNA, 22 bp, Homo sapiens
tttccaaacccagcgagctaca

SEQ ID NO: 6961564 - DNA, 22 bp, Homo sapiens
tcccagggactgggctaggctt

SEQ ID NO: 6961565 - DNA, 22 bp, Homo sapiens
atgcattctagcctggacaaca

SEQ ID NO: 6961566 - DNA, 22 bp, Homo sapiens
tgagcaggggagagcgaatgtg

SEQ ID NO: 6961567 - DNA, 22 bp, Homo sapiens
ccctgagatgcctcaccctagt

SEQ ID NO: 6961568 - DNA, 22 bp, Homo sapiens
ttgaatgcagtcatgaaaagtt

SEQ ID NO: 6961569 - DNA, 22 bp, Homo sapiens
gaatccagggtgtttgctgagg

SEQ ID NO: 6961570 - DNA, 22 bp, Homo sapiens
taaggcttttgttcagcgtggg

SEQ ID NO: 6961571 - DNA, 22 bp, Homo sapiens
tgaagttcactgagagttcacc

SEQ ID NO: 6961572 - DNA, 21 bp, Homo sapiens
gagcatctccttcctcctgct

SEQ ID NO: 6961573 - DNA, 22 bp, Homo sapiens
aatttatgacaaacaggtaggt

SEQ ID NO: 6961574 - DNA, 22 bp, Homo sapiens
ggcaggtgctcaaaaatatttg

SEQ ID NO: 6961575 - DNA, 22 bp, Homo sapiens
tgaaagttacaggaaaacagat

SEQ ID NO: 6961576 - DNA, 22 bp, Homo sapiens
caggcctgggcttcggggctga

SEQ ID NO: 6961577 - DNA, 22 bp, Homo sapiens
ttctctaagccttagtttcttc

SEQ ID NO: 6961578 - DNA, 22 bp, Homo sapiens
cataattaggcagttgatcatt

SEQ ID NO: 6961579 - DNA, 20 bp, Homo sapiens
cgcccagtgcggttctgacc

SEQ ID NO: 6961580 - DNA, 21 bp, Homo sapiens
actgcatctgaagtcccagga

SEQ ID NO: 6961581 - DNA, 17 bp, Homo sapiens
tagcccatggctgccag

SEQ ID NO: 6961582 - DNA, 20 bp, Homo sapiens
acatgtacagacaggtttct

SEQ ID NO: 6961583 - DNA, 22 bp, Homo sapiens
tttggagtatggaggtgacaca

SEQ ID NO: 6961584 - DNA, 21 bp, Homo sapiens
tacaagatagaggtaatatat

SEQ ID NO: 6961585 - DNA, 22 bp, Homo sapiens
cagtgccatattgaaagacatt

SEQ ID NO: 6961586 - DNA, 22 bp, Homo sapiens
tggatttatggagaccgaaagt

SEQ ID NO: 6961587 - DNA, 22 bp, Homo sapiens
gagctgtgtatgcatcattctg

SEQ ID NO: 6961588 - DNA, 22 bp, Homo sapiens
actgggctgcttgagtgccttc

SEQ ID NO: 6961589 - DNA, 22 bp, Homo sapiens
gtggcccaggttggagtgcagt

SEQ ID NO: 6961590 - DNA, 22 bp, Homo sapiens
ctaccgggttctcagccaggca

SEQ ID NO: 6961591 - DNA, 22 bp, Homo sapiens
tctgcatgatgaacaaatgagc

SEQ ID NO: 6961592 - DNA, 22 bp, Homo sapiens
cacagagaaaatgttggtgctt

SEQ ID NO: 6961593 - DNA, 22 bp, Homo sapiens
gtaggtatagattctctgagga

SEQ ID NO: 6961594 - DNA, 19 bp, Homo sapiens
atgcctgttgattagttac

SEQ ID NO: 6961595 - DNA, 23 bp, Homo sapiens
gggagctgtggtgaaaagaggtg

SEQ ID NO: 6961596 - DNA, 22 bp, Homo sapiens
tgcctctgtgggcagagctgcc

SEQ ID NO: 6961597 - DNA, 22 bp, Homo sapiens
gaatcccaatctgttattgaca

SEQ ID NO: 6961598 - DNA, 22 bp, Homo sapiens
gtatcggtttatttttgggata

SEQ ID NO: 6961599 - DNA, 22 bp, Homo sapiens
ttacccagtgaagccgaggcag

SEQ ID NO: 6961600 - DNA, 22 bp, Homo sapiens
ggtctgaggtgggacccaggaa

SEQ ID NO: 6961601 - DNA, 22 bp, Homo sapiens
gcatacaaaggtttacaactga

SEQ ID NO: 6961602 - DNA, 22 bp, Homo sapiens
acatttgtatttggtgagtggt

SEQ ID NO: 6961603 - DNA, 22 bp, Homo sapiens
ctggcctgtcctgacccagcct

SEQ ID NO: 6961604 - DNA, 22 bp, Homo sapiens
tactccagacattctgtcctcg

SEQ ID NO: 6961605 - DNA, 20 bp, Homo sapiens
ttctgaaagcagcagaggga

SEQ ID NO: 6961606 - DNA, 22 bp, Homo sapiens
attatcagaaattcaaagggtg

SEQ ID NO: 6961607 - DNA, 22 bp, Homo sapiens
agttgagggtgggagagaaatg

SEQ ID NO: 6961608 - DNA, 22 bp, Homo sapiens
gccatcaaataccagcctgaat

SEQ ID NO: 6961609 - DNA, 22 bp, Homo sapiens
atacacacatatgtgagttttg

SEQ ID NO: 6961610 - DNA, 22 bp, Homo sapiens
gcctgcagaggtgctgctagct

SEQ ID NO: 6961611 - DNA, 22 bp, Homo sapiens
tgctggaacttagcatgctctc

SEQ ID NO: 6961612 - DNA, 22 bp, Homo sapiens
ggctgcaagcatgcacagatac

SEQ ID NO: 6961613 - DNA, 22 bp, Homo sapiens
gaaaatgagcctcagctacatt

SEQ ID NO: 6961614 - DNA, 22 bp, Homo sapiens
aaggaagagcaaagaattatgt

SEQ ID NO: 6961615 - DNA, 22 bp, Homo sapiens
acagacagacagattgcatatg

SEQ ID NO: 6961616 - DNA, 20 bp, Homo sapiens
ctgtatcaggttacaaagta

SEQ ID NO: 6961617 - DNA, 22 bp, Homo sapiens
gtctgggctcccagggtcggcg

SEQ ID NO: 6961618 - DNA, 22 bp, Homo sapiens
aatggcctgtatggaaagtgaa

SEQ ID NO: 6961619 - DNA, 22 bp, Homo sapiens
tctgtgctgagctctgagatgt

SEQ ID NO: 6961620 - DNA, 22 bp, Homo sapiens
gccctgtgagtcatgcggcaga

SEQ ID NO: 6961621 - DNA, 22 bp, Homo sapiens
tcaaactgttcagaactccttt

SEQ ID NO: 6961622 - DNA, 22 bp, Homo sapiens
ccaggaagcctttttctttgac

SEQ ID NO: 6961623 - DNA, 22 bp, Homo sapiens
aaataattatagcgagtctatc

SEQ ID NO: 6961624 - DNA, 22 bp, Homo sapiens
tgttctttggcttcacagctct

SEQ ID NO: 6961625 - DNA, 22 bp, Homo sapiens
aagcagcttccctggctcctgg

SEQ ID NO: 6961626 - DNA, 22 bp, Homo sapiens
gctgtctctcccaggatccatg

SEQ ID NO: 6961627 - DNA, 20 bp, Homo sapiens
tccttaagtacctaagagtg

SEQ ID NO: 6961628 - DNA, 22 bp, Homo sapiens
gtgctccaggtcgctcagagag

SEQ ID NO: 6961629 - DNA, 22 bp, Homo sapiens
tgctagctcacccttgcctccc

SEQ ID NO: 6961630 - DNA, 22 bp, Homo sapiens
cttctggcaatcccagggtctt

SEQ ID NO: 6961631 - DNA, 22 bp, Homo sapiens
atagatattagcaaaattttat

SEQ ID NO: 6961632 - DNA, 23 bp, Homo sapiens
atcaaagtggaaatcaattatct

SEQ ID NO: 6961633 - DNA, 19 bp, Homo sapiens
tcagcccaggctgggaagc

SEQ ID NO: 6961634 - DNA, 22 bp, Homo sapiens
cgtcagtgtaaaagacagcacc

SEQ ID NO: 6961635 - DNA, 22 bp, Homo sapiens
ttggcacaaatttctgaaataa

SEQ ID NO: 6961636 - DNA, 22 bp, Homo sapiens
agcaccaggccatggggtccct

SEQ ID NO: 6961637 - DNA, 22 bp, Homo sapiens
agagagacgggggctgctgctt

SEQ ID NO: 6961638 - DNA, 22 bp, Homo sapiens
acagggcagagggcagttggta

SEQ ID NO: 6961639 - DNA, 22 bp, Homo sapiens
agtcctctggagtatgccttat

SEQ ID NO: 6961640 - DNA, 17 bp, Homo sapiens
gttattgctgcttcctt

SEQ ID NO: 6961641 - DNA, 22 bp, Homo sapiens
tctctgatctttaattcagata

SEQ ID NO: 6961642 - DNA, 22 bp, Homo sapiens
agaccctgttagttccagtctt

SEQ ID NO: 6961643 - DNA, 22 bp, Homo sapiens
ttctatgtgctggagaatattt

SEQ ID NO: 6961644 - DNA, 22 bp, Homo sapiens
tttattcactggggtctgcccg

SEQ ID NO: 6961645 - DNA, 22 bp, Homo sapiens
ttacttctttggccttcagcca

SEQ ID NO: 6961646 - DNA, 22 bp, Homo sapiens
agagccttgaagatctggaaaa

SEQ ID NO: 6961647 - DNA, 22 bp, Homo sapiens
tctgggctggttgtgcttgctt

SEQ ID NO: 6961648 - DNA, 21 bp, Homo sapiens
tccaggctggaaggggcgttg

SEQ ID NO: 6961649 - DNA, 17 bp, Homo sapiens
aggtatttaaggagctg

SEQ ID NO: 6961650 - DNA, 22 bp, Homo sapiens
atgcttgaaagttatttcattt

SEQ ID NO: 6961651 - DNA, 22 bp, Homo sapiens
agagttggagaaattaaaattt

SEQ ID NO: 6961652 - DNA, 22 bp, Homo sapiens
gatcctgtgcatggggtgatgg

SEQ ID NO: 6961653 - DNA, 22 bp, Homo sapiens
ttggaagggaaccgagtttgct

SEQ ID NO: 6961654 - DNA, 22 bp, Homo sapiens
gcctcagggataggatgagcat

SEQ ID NO: 6961655 - DNA, 22 bp, Homo sapiens
gaggtggtttgtggtgactcat

SEQ ID NO: 6961656 - DNA, 22 bp, Homo sapiens
gtcttgtcagtgttggcagctt

SEQ ID NO: 6961657 - DNA, 22 bp, Homo sapiens
ttttgtgagcccataaatgcca

SEQ ID NO: 6961658 - DNA, 22 bp, Homo sapiens
agttccaaagcctgtattctta

SEQ ID NO: 6961659 - DNA, 21 bp, Homo sapiens
tctgtcttcctcagcctaagg

SEQ ID NO: 6961660 - DNA, 22 bp, Homo sapiens
agctgtcagtgctgtgcctgta

SEQ ID NO: 6961661 - DNA, 22 bp, Homo sapiens
gatgttaaaggttggtaagtca

SEQ ID NO: 6961662 - DNA, 22 bp, Homo sapiens
tctgggaaggctctgcagatat

SEQ ID NO: 6961663 - DNA, 21 bp, Homo sapiens
aagcctcaagcagaagacaga

SEQ ID NO: 6961664 - DNA, 22 bp, Homo sapiens
agtggaggttacagctgtacat

SEQ ID NO: 6961665 - DNA, 22 bp, Homo sapiens
ccagcatctatgtgctgttgat

SEQ ID NO: 6961666 - DNA, 22 bp, Homo sapiens
tcccacagcatgagtaactctc

SEQ ID NO: 6961667 - DNA, 22 bp, Homo sapiens
atgaggcaaaggtggaggtggg

SEQ ID NO: 6961668 - DNA, 22 bp, Homo sapiens
ttctgcttttctctgtctgagt

SEQ ID NO: 6961669 - DNA, 20 bp, Homo sapiens
aaaggcacagcaacagagct

SEQ ID NO: 6961670 - DNA, 22 bp, Homo sapiens
cttcagagcttgttaaaactgt

SEQ ID NO: 6961671 - DNA, 21 bp, Homo sapiens
agtgaaattgcatcagaggga

SEQ ID NO: 6961672 - DNA, 21 bp, Homo sapiens
ttggctctgaaacttgcacct

SEQ ID NO: 6961673 - DNA, 22 bp, Homo sapiens
acttcagtttccctcaacaaga

SEQ ID NO: 6961674 - DNA, 22 bp, Homo sapiens
cttgtctagttcctggtgatgt

SEQ ID NO: 6961675 - DNA, 22 bp, Homo sapiens
ctctgcttttatgtgccggcgc

SEQ ID NO: 6961676 - DNA, 22 bp, Homo sapiens
ccctgaggagagcgcttcccga

SEQ ID NO: 6961677 - DNA, 22 bp, Homo sapiens
attgttctgtagtgacatgtag

SEQ ID NO: 6961678 - DNA, 21 bp, Homo sapiens
ctttagtgaaaaggggctaac

SEQ ID NO: 6961679 - DNA, 19 bp, Homo sapiens
tggaaactcctgatattag

SEQ ID NO: 6961680 - DNA, 22 bp, Homo sapiens
agcatgaaaggcgtgccaactt

SEQ ID NO: 6961681 - DNA, 22 bp, Homo sapiens
agtggaggttattgagttaagg

SEQ ID NO: 6961682 - DNA, 22 bp, Homo sapiens
tgagtttgtctgagtggtaaca

SEQ ID NO: 6961683 - DNA, 22 bp, Homo sapiens
tgttaacatactgctttctaat

SEQ ID NO: 6961684 - DNA, 22 bp, Homo sapiens
aaatgctgagtgtttagagatc

SEQ ID NO: 6961685 - DNA, 22 bp, Homo sapiens
tgtcctttgggagggcacagct

SEQ ID NO: 6961686 - DNA, 22 bp, Homo sapiens
tgctcactctattcacagtgcc

SEQ ID NO: 6961687 - DNA, 22 bp, Homo sapiens
ggccttcctgttgtgtccaccg

SEQ ID NO: 6961688 - DNA, 22 bp, Homo sapiens
tcactgctttgtttacaactat

SEQ ID NO: 6961689 - DNA, 19 bp, Homo sapiens
agcactccctgttctgtct

SEQ ID NO: 6961690 - DNA, 22 bp, Homo sapiens
cctctgggcctggaagggcagt

SEQ ID NO: 6961691 - DNA, 20 bp, Homo sapiens
gctgggctttgactgacaca

SEQ ID NO: 6961692 - DNA, 22 bp, Homo sapiens
ggctagtaagaaagaccaagct

SEQ ID NO: 6961693 - DNA, 22 bp, Homo sapiens
catgtgcatccttaatctccct

SEQ ID NO: 6961694 - DNA, 22 bp, Homo sapiens
actgctgcaggtccagcccctt

SEQ ID NO: 6961695 - DNA, 18 bp, Homo sapiens
gcagatggagattcaggg

SEQ ID NO: 6961696 - DNA, 21 bp, Homo sapiens
cctaggaggcttaattaggct

SEQ ID NO: 6961697 - DNA, 22 bp, Homo sapiens
accatctgagtagagagaagta

SEQ ID NO: 6961698 - DNA, 22 bp, Homo sapiens
ggagttcaaatcttttggatct

SEQ ID NO: 6961699 - DNA, 21 bp, Homo sapiens
agatcctgtggctgagaagta

SEQ ID NO: 6961700 - DNA, 22 bp, Homo sapiens
agcttgtcccggtgctcacata

SEQ ID NO: 6961701 - DNA, 22 bp, Homo sapiens
atcaacatactgctcaggcatt

SEQ ID NO: 6961702 - DNA, 22 bp, Homo sapiens
tttcagtgcccagagctttgca

SEQ ID NO: 6961703 - DNA, 22 bp, Homo sapiens
tagcagaggctgtctgacttaa

SEQ ID NO: 6961704 - DNA, 22 bp, Homo sapiens
tgagaattttttgtcatgcatt

SEQ ID NO: 6961705 - DNA, 20 bp, Homo sapiens
aggaagccaaaggctgtctt

SEQ ID NO: 6961706 - DNA, 20 bp, Homo sapiens
tccagtatgttatttggtgt

SEQ ID NO: 6961707 - DNA, 22 bp, Homo sapiens
ctctggaggtggaggttgcagt

SEQ ID NO: 6961708 - DNA, 22 bp, Homo sapiens
ttgcgggcctttagttcttgac

SEQ ID NO: 6961709 - DNA, 22 bp, Homo sapiens
agaataccataatatagaaaga

SEQ ID NO: 6961710 - DNA, 22 bp, Homo sapiens
tctgcagggcccttggctcctg

SEQ ID NO: 6961711 - DNA, 22 bp, Homo sapiens
taaaatagccagtgcccctctg

SEQ ID NO: 6961712 - DNA, 22 bp, Homo sapiens
atcatgttaaatatttcaatct

SEQ ID NO: 6961713 - DNA, 22 bp, Homo sapiens
ggcttctgctcagcctgcacgc

SEQ ID NO: 6961714 - DNA, 19 bp, Homo sapiens
aggtggtctaggctggaga

SEQ ID NO: 6961715 - DNA, 22 bp, Homo sapiens
ggccttgggcagacacgtcaca

SEQ ID NO: 6961716 - DNA, 22 bp, Homo sapiens
ccgcatttccaatgaggcaaag

SEQ ID NO: 6961717 - DNA, 22 bp, Homo sapiens
acaactgttggaggaacacagg

SEQ ID NO: 6961718 - DNA, 22 bp, Homo sapiens
ccattgaacccctctaggccac

SEQ ID NO: 6961719 - DNA, 22 bp, Homo sapiens
gctccttcaggtggtagctgtt

SEQ ID NO: 6961720 - DNA, 22 bp, Homo sapiens
cagggctcccaaatatctcttc

SEQ ID NO: 6961721 - DNA, 22 bp, Homo sapiens
tgctgtaatacttaaggttaag

SEQ ID NO: 6961722 - DNA, 16 bp, Homo sapiens
tctttgtaatcagcag

SEQ ID NO: 6961723 - DNA, 22 bp, Homo sapiens
aggcttgcaatggacacatgtg

SEQ ID NO: 6961724 - DNA, 22 bp, Homo sapiens
tcagtaaaacctgcttttagtg

SEQ ID NO: 6961725 - DNA, 18 bp, Homo sapiens
tctgctgctgcgtcctgc

SEQ ID NO: 6961726 - DNA, 22 bp, Homo sapiens
gagggcctctgtgggtgctcac

SEQ ID NO: 6961727 - DNA, 22 bp, Homo sapiens
tggtaacacaggcattaaagtt

SEQ ID NO: 6961728 - DNA, 22 bp, Homo sapiens
cctcaaagtagagggagatgag

SEQ ID NO: 6961729 - DNA, 22 bp, Homo sapiens
acattctggatgtctgatgaga

SEQ ID NO: 6961730 - DNA, 22 bp, Homo sapiens
tggcagctattacaaggaagtc

SEQ ID NO: 6961731 - DNA, 22 bp, Homo sapiens
cagtcctctctgtgtctgcacc

SEQ ID NO: 6961732 - DNA, 22 bp, Homo sapiens
cttggagaatgacagtggatta

SEQ ID NO: 6961733 - DNA, 23 bp, Homo sapiens
atttgaaactttcttgtttccag

SEQ ID NO: 6961734 - DNA, 22 bp, Homo sapiens
taggcgaaggtctgggtgggca

SEQ ID NO: 6961735 - DNA, 23 bp, Homo sapiens
ttcttcattttcagagttgagca

SEQ ID NO: 6961736 - DNA, 22 bp, Homo sapiens
cataatttcccaagagattgaa

SEQ ID NO: 6961737 - DNA, 22 bp, Homo sapiens
tgtcagtgtatacatacagtat

SEQ ID NO: 6961738 - DNA, 22 bp, Homo sapiens
tcagatgctaaagatggaatta

SEQ ID NO: 6961739 - DNA, 22 bp, Homo sapiens
cttcctgggtcagcctggaggt

SEQ ID NO: 6961740 - DNA, 22 bp, Homo sapiens
tcccagtggtcctggccctggg

SEQ ID NO: 6961741 - DNA, 22 bp, Homo sapiens
ttaaaggaattgagtttcttgt

SEQ ID NO: 6961742 - DNA, 22 bp, Homo sapiens
tccctataattgcacatccatt

SEQ ID NO: 6961743 - DNA, 22 bp, Homo sapiens
gagccaagcaatatacccaacc

SEQ ID NO: 6961744 - DNA, 22 bp, Homo sapiens
tttgacagtgctattaagaaac

SEQ ID NO: 6961745 - DNA, 22 bp, Homo sapiens
atcaagcagtgaaaaatgctag

SEQ ID NO: 6961746 - DNA, 22 bp, Homo sapiens
gagagtgagataatttcacata

SEQ ID NO: 6961747 - DNA, 20 bp, Homo sapiens
agaacaagtactaaaggaga

SEQ ID NO: 6961748 - DNA, 22 bp, Homo sapiens
gcatttagctttaaaatatttc

SEQ ID NO: 6961749 - DNA, 23 bp, Homo sapiens
tactgccttgttcatgtgtattt

SEQ ID NO: 6961750 - DNA, 22 bp, Homo sapiens
aaacaggcttgcaacatgtttt

SEQ ID NO: 6961751 - DNA, 20 bp, Homo sapiens
agtttgtgtgtctatgcgct

SEQ ID NO: 6961752 - DNA, 22 bp, Homo sapiens
ataaggtaagggtattgtcaga

SEQ ID NO: 6961753 - DNA, 22 bp, Homo sapiens
agggacctcatgtaagtggatt

SEQ ID NO: 6961754 - DNA, 22 bp, Homo sapiens
ccaagtcttggttctgtatctt

SEQ ID NO: 6961755 - DNA, 22 bp, Homo sapiens
tgtcagattactggtgggaccg

SEQ ID NO: 6961756 - DNA, 20 bp, Homo sapiens
tggacagttactttatctct

SEQ ID NO: 6961757 - DNA, 23 bp, Homo sapiens
aagtgcaagtgaaaggcacagtt

SEQ ID NO: 6961758 - DNA, 22 bp, Homo sapiens
tctgaaatctgtaagcactagc

SEQ ID NO: 6961759 - DNA, 22 bp, Homo sapiens
gtttacatgtaatgtgttattg

SEQ ID NO: 6961760 - DNA, 22 bp, Homo sapiens
tggcctgcccagagcagctctg

SEQ ID NO: 6961761 - DNA, 22 bp, Homo sapiens
tttgtttctgcaatacctatag

SEQ ID NO: 6961762 - DNA, 20 bp, Homo sapiens
aattagcttaagtcaatcag

SEQ ID NO: 6961763 - DNA, 22 bp, Homo sapiens
ttaaagcagtttgtatacatgg

SEQ ID NO: 6961764 - DNA, 22 bp, Homo sapiens
ctggcagcaggtcacacgcaga

SEQ ID NO: 6961765 - DNA, 22 bp, Homo sapiens
tgagaccttggggagccctgtt

SEQ ID NO: 6961766 - DNA, 22 bp, Homo sapiens
agaaagttatcacaaaattgag

SEQ ID NO: 6961767 - DNA, 22 bp, Homo sapiens
tgctgtatatattttgaagtga

SEQ ID NO: 6961768 - DNA, 22 bp, Homo sapiens
ttggacaaaagaatattccagg

SEQ ID NO: 6961769 - DNA, 22 bp, Homo sapiens
catacattgctcattcagtatc

SEQ ID NO: 6961770 - DNA, 22 bp, Homo sapiens
cctggctcctgcacagatcttt

SEQ ID NO: 6961771 - DNA, 22 bp, Homo sapiens
agcgtatgaatatttgaagaga

SEQ ID NO: 6961772 - DNA, 22 bp, Homo sapiens
tcactctgggccctactgggct

SEQ ID NO: 6961773 - DNA, 22 bp, Homo sapiens
caaggctgtctccagcttccaa

SEQ ID NO: 6961774 - DNA, 22 bp, Homo sapiens
aagaccttgtctaaacatgtag

SEQ ID NO: 6961775 - DNA, 22 bp, Homo sapiens
tgacagagttcggattgagttt

SEQ ID NO: 6961776 - DNA, 22 bp, Homo sapiens
taaaggttgaaaactgactgcc

SEQ ID NO: 6961777 - DNA, 22 bp, Homo sapiens
tgacaccaaggaagtatcattt

SEQ ID NO: 6961778 - DNA, 22 bp, Homo sapiens
ctgaggcaggcagatcacttga

SEQ ID NO: 6961779 - DNA, 22 bp, Homo sapiens
ctttgatttctctggtccaatc

SEQ ID NO: 6961780 - DNA, 22 bp, Homo sapiens
tatatgcagtgtgtcattcaag

SEQ ID NO: 6961781 - DNA, 22 bp, Homo sapiens
agcacaggaacatggagatggg

SEQ ID NO: 6961782 - DNA, 22 bp, Homo sapiens
ttgaaagtagaatgtatgtgga

SEQ ID NO: 6961783 - DNA, 22 bp, Homo sapiens
acactaatcttttatttggttt

SEQ ID NO: 6961784 - DNA, 20 bp, Homo sapiens
atgtggataagggcagaatc

SEQ ID NO: 6961785 - DNA, 21 bp, Homo sapiens
tgctacattgctggttatgtt

SEQ ID NO: 6961786 - DNA, 22 bp, Homo sapiens
gatgaatgagctgtgcacatta

SEQ ID NO: 6961787 - DNA, 22 bp, Homo sapiens
caccaggctgcccaggacaggg

SEQ ID NO: 6961788 - DNA, 22 bp, Homo sapiens
gaatgtttgactaaaggtagct

SEQ ID NO: 6961789 - DNA, 18 bp, Homo sapiens
atctcccattggccaagg

SEQ ID NO: 6961790 - DNA, 22 bp, Homo sapiens
acctcacaagtctctgtcagct

SEQ ID NO: 6961791 - DNA, 22 bp, Homo sapiens
agtggttcagttttggtctggc

SEQ ID NO: 6961792 - DNA, 20 bp, Homo sapiens
tggttttgccagaaatccct

SEQ ID NO: 6961793 - DNA, 22 bp, Homo sapiens
tgtcctggggcgacttggggcc

SEQ ID NO: 6961794 - DNA, 22 bp, Homo sapiens
cccaccctcaagggtgtctata

SEQ ID NO: 6961795 - DNA, 22 bp, Homo sapiens
cactagttttgcattgctgaaa

SEQ ID NO: 6961796 - DNA, 22 bp, Homo sapiens
tgagcacatttcacatgacagg

SEQ ID NO: 6961797 - DNA, 22 bp, Homo sapiens
attgtaacaggatccctgtggc

SEQ ID NO: 6961798 - DNA, 22 bp, Homo sapiens
gtctcctccctttcattcacct

SEQ ID NO: 6961799 - DNA, 22 bp, Homo sapiens
ggagccgcacgtgctgggcccg

SEQ ID NO: 6961800 - DNA, 20 bp, Homo sapiens
tccaagagtgatgtttcata

SEQ ID NO: 6961801 - DNA, 22 bp, Homo sapiens
acttgggagttctggaagcctg

SEQ ID NO: 6961802 - DNA, 22 bp, Homo sapiens
aggctaagtgattagtgacata

SEQ ID NO: 6961803 - DNA, 22 bp, Homo sapiens
aggtgggtgcctatgtatgtat

SEQ ID NO: 6961804 - DNA, 22 bp, Homo sapiens
attgtgcaaatattatctgtag

SEQ ID NO: 6961805 - DNA, 22 bp, Homo sapiens
atgcagctgctgacagctttca

SEQ ID NO: 6961806 - DNA, 22 bp, Homo sapiens
tggggcctgaaaggttctcgcc

SEQ ID NO: 6961807 - DNA, 22 bp, Homo sapiens
aagcagggtcttcctcagttgg

SEQ ID NO: 6961808 - DNA, 22 bp, Homo sapiens
tcagacagcttgggataactga

SEQ ID NO: 6961809 - DNA, 23 bp, Homo sapiens
ttcaagatacggtttccaggctg

SEQ ID NO: 6961810 - DNA, 22 bp, Homo sapiens
tctgagctgtaagtagacaagg

SEQ ID NO: 6961811 - DNA, 21 bp, Homo sapiens
atgtcaaatgctttattttat

SEQ ID NO: 6961812 - DNA, 22 bp, Homo sapiens
actaaggactgtggcgcctgcc

SEQ ID NO: 6961813 - DNA, 20 bp, Homo sapiens
acatgtactaatgaatacag

SEQ ID NO: 6961814 - DNA, 22 bp, Homo sapiens
atggacagagctgagctccacc

SEQ ID NO: 6961815 - DNA, 22 bp, Homo sapiens
ttctccacatggtgtgctgtga

SEQ ID NO: 6961816 - DNA, 22 bp, Homo sapiens
aacacagtttctgcattggtag

SEQ ID NO: 6961817 - DNA, 22 bp, Homo sapiens
cccttgcaagcaaggattagcc

SEQ ID NO: 6961818 - DNA, 19 bp, Homo sapiens
actgcagggaggaggtgtg

SEQ ID NO: 6961819 - DNA, 22 bp, Homo sapiens
tcgctgtgtccagaattgcacc

SEQ ID NO: 6961820 - DNA, 22 bp, Homo sapiens
tagaatccacctacacaagaga

SEQ ID NO: 6961821 - DNA, 22 bp, Homo sapiens
tgctttcagctggtaaagaaac

SEQ ID NO: 6961822 - DNA, 23 bp, Homo sapiens
taatgcacatctgtgagctccta

SEQ ID NO: 6961823 - DNA, 22 bp, Homo sapiens
actcttggtcagaacaattcag

SEQ ID NO: 6961824 - DNA, 22 bp, Homo sapiens
gggctatagcactatgtatggg

SEQ ID NO: 6961825 - DNA, 22 bp, Homo sapiens
taagaaactgtcacagtactat

SEQ ID NO: 6961826 - DNA, 22 bp, Homo sapiens
agtccgtttcatgccacacttg

SEQ ID NO: 6961827 - DNA, 22 bp, Homo sapiens
aaggctgagggctgtacctggc

SEQ ID NO: 6961828 - DNA, 22 bp, Homo sapiens
aagtggcagttcaggaagcaga

SEQ ID NO: 6961829 - DNA, 22 bp, Homo sapiens
ttgttttcttgtatatagcctc

SEQ ID NO: 6961830 - DNA, 20 bp, Homo sapiens
gtccagagtaatgtgctgac

SEQ ID NO: 6961831 - DNA, 22 bp, Homo sapiens
ggctttatttgcagccattgtt

SEQ ID NO: 6961832 - DNA, 22 bp, Homo sapiens
attttagagctccaagtacagc

SEQ ID NO: 6961833 - DNA, 22 bp, Homo sapiens
acagccttattgcgagcaaggc

SEQ ID NO: 6961834 - DNA, 22 bp, Homo sapiens
aggaatctgtggttttaacagg

SEQ ID NO: 6961835 - DNA, 22 bp, Homo sapiens
ctgaggaggctaatttgaggat

SEQ ID NO: 6961836 - DNA, 22 bp, Homo sapiens
ggtcctgggaagatgctcatga

SEQ ID NO: 6961837 - DNA, 19 bp, Homo sapiens
agctggctcttctttgtct

SEQ ID NO: 6961838 - DNA, 20 bp, Homo sapiens
tgatttgatcatggctgcat

SEQ ID NO: 6961839 - DNA, 22 bp, Homo sapiens
taagtcattaggctgagttcaa

SEQ ID NO: 6961840 - DNA, 22 bp, Homo sapiens
atatgcacgcatacacacataa

SEQ ID NO: 6961841 - DNA, 22 bp, Homo sapiens
aggaatttagacagggcataaa

SEQ ID NO: 6961842 - DNA, 22 bp, Homo sapiens
tggggcatgtgaacctggatgt

SEQ ID NO: 6961843 - DNA, 22 bp, Homo sapiens
ttaggtattcatttacatgttc

SEQ ID NO: 6961844 - DNA, 22 bp, Homo sapiens
tcactgtgattctgtatggatt

SEQ ID NO: 6961845 - DNA, 22 bp, Homo sapiens
tcaggcctcagcagcccacagg

SEQ ID NO: 6961846 - DNA, 22 bp, Homo sapiens
cctcactgaagaggtgacattt

SEQ ID NO: 6961847 - DNA, 22 bp, Homo sapiens
cgtgagggcatggcagtgagga

SEQ ID NO: 6961848 - DNA, 22 bp, Homo sapiens
cagagtggcactctgctggatg

SEQ ID NO: 6961849 - DNA, 22 bp, Homo sapiens
gggatggctttgtggctgactc

SEQ ID NO: 6961850 - DNA, 22 bp, Homo sapiens
tctttctgtaagctccatggaa

SEQ ID NO: 6961851 - DNA, 22 bp, Homo sapiens
ttagatatgtttttgctaatgc

SEQ ID NO: 6961852 - DNA, 22 bp, Homo sapiens
agactaaaagaaggaagctacc

SEQ ID NO: 6961853 - DNA, 22 bp, Homo sapiens
actttatttcctattgcatcca

SEQ ID NO: 6961854 - DNA, 22 bp, Homo sapiens
aggcttcagatgaccttagcat

SEQ ID NO: 6961855 - DNA, 22 bp, Homo sapiens
atggccttattatggcacccga

SEQ ID NO: 6961856 - DNA, 22 bp, Homo sapiens
aatgactagtccacatttgtaa

SEQ ID NO: 6961857 - DNA, 22 bp, Homo sapiens
ccagctgacgatgcctggtctc

SEQ ID NO: 6961858 - DNA, 22 bp, Homo sapiens
atctgcatgctaagtcttggtt

SEQ ID NO: 6961859 - DNA, 22 bp, Homo sapiens
ctatgaatgtatataggcagat

SEQ ID NO: 6961860 - DNA, 22 bp, Homo sapiens
gcactgggctccaggaaggagg

SEQ ID NO: 6961861 - DNA, 22 bp, Homo sapiens
tgggagcctggcaggccagagg

SEQ ID NO: 6961862 - DNA, 22 bp, Homo sapiens
ttcttcaggaagagcctggact

SEQ ID NO: 6961863 - DNA, 22 bp, Homo sapiens
caggctggagtgcagtgtcgcc

SEQ ID NO: 6961864 - DNA, 22 bp, Homo sapiens
tctaaggagccaggactattag

SEQ ID NO: 6961865 - DNA, 22 bp, Homo sapiens
cgattgtcatattctgttggat

SEQ ID NO: 6961866 - DNA, 22 bp, Homo sapiens
ccttgctgaccatcacctttga

SEQ ID NO: 6961867 - DNA, 22 bp, Homo sapiens
ccagccctgtttatgtgtcact

SEQ ID NO: 6961868 - DNA, 21 bp, Homo sapiens
gccctcaggggaggatggcct

SEQ ID NO: 6961869 - DNA, 22 bp, Homo sapiens
cgaggtagtggcggccgcggcc

SEQ ID NO: 6961870 - DNA, 23 bp, Homo sapiens
agtctgtgctgaagaagttacaa

SEQ ID NO: 6961871 - DNA, 22 bp, Homo sapiens
gtcaagactacctttctggagt

SEQ ID NO: 6961872 - DNA, 22 bp, Homo sapiens
ttctcagggtcttgtgcaaggg

SEQ ID NO: 6961873 - DNA, 21 bp, Homo sapiens
gcagtgcagcttggagggtag

SEQ ID NO: 6961874 - DNA, 22 bp, Homo sapiens
gggcttggctcataagtggatg

SEQ ID NO: 6961875 - DNA, 22 bp, Homo sapiens
agttgccttcccccagagccaa

SEQ ID NO: 6961876 - DNA, 22 bp, Homo sapiens
attctgcatggtggtgtctctg

SEQ ID NO: 6961877 - DNA, 22 bp, Homo sapiens
ggagtccatgcagcttgagaca

SEQ ID NO: 6961878 - DNA, 21 bp, Homo sapiens
ttttgctgaatggacacgtgc

SEQ ID NO: 6961879 - DNA, 22 bp, Homo sapiens
tgcatggaggataataattgag

SEQ ID NO: 6961880 - DNA, 22 bp, Homo sapiens
gctatctaccacatcagccagg

SEQ ID NO: 6961881 - DNA, 22 bp, Homo sapiens
tcaggaggtttggattcagtta

SEQ ID NO: 6961882 - DNA, 19 bp, Homo sapiens
atggatgcctcatgcctca

SEQ ID NO: 6961883 - DNA, 22 bp, Homo sapiens
cagggtggcacatcacagcatt

SEQ ID NO: 6961884 - DNA, 22 bp, Homo sapiens
gatgctgggaccacagagtgtt

SEQ ID NO: 6961885 - DNA, 22 bp, Homo sapiens
taggaatgaaggataaggtgtg

SEQ ID NO: 6961886 - DNA, 22 bp, Homo sapiens
ctcataaaggcacacttgttgt

SEQ ID NO: 6961887 - DNA, 22 bp, Homo sapiens
ctggattctttcataaaagtca

SEQ ID NO: 6961888 - DNA, 22 bp, Homo sapiens
tctgactagggacttggtgtat

SEQ ID NO: 6961889 - DNA, 22 bp, Homo sapiens
gttcctaaccagcagagaaaca

SEQ ID NO: 6961890 - DNA, 22 bp, Homo sapiens
gctctgagtgattaaggagctt

SEQ ID NO: 6961891 - DNA, 22 bp, Homo sapiens
tgaggggttgtgagaaatgtag

SEQ ID NO: 6961892 - DNA, 18 bp, Homo sapiens
aagtgattcctttccctt

SEQ ID NO: 6961893 - DNA, 23 bp, Homo sapiens
catgatatttatcttccctgggt

SEQ ID NO: 6961894 - DNA, 22 bp, Homo sapiens
ggcttccccacagtcctgagct

SEQ ID NO: 6961895 - DNA, 22 bp, Homo sapiens
ttttcagttatagaatggtaga

SEQ ID NO: 6961896 - DNA, 22 bp, Homo sapiens
ctgctgcagatgacagacccaa

SEQ ID NO: 6961897 - DNA, 22 bp, Homo sapiens
ttagacaagggctccttaaaag

SEQ ID NO: 6961898 - DNA, 22 bp, Homo sapiens
gcagctgccttcagctggatgg

SEQ ID NO: 6961899 - DNA, 22 bp, Homo sapiens
tcagtgcaatcaaggtatgttt

SEQ ID NO: 6961900 - DNA, 22 bp, Homo sapiens
agcaaagaagggttcttcatta

SEQ ID NO: 6961901 - DNA, 20 bp, Homo sapiens
aggagggtttctctgacaca

SEQ ID NO: 6961902 - DNA, 18 bp, Homo sapiens
agctggtgaaatccagta

SEQ ID NO: 6961903 - DNA, 22 bp, Homo sapiens
taggatgaaaatccagcttata

SEQ ID NO: 6961904 - DNA, 22 bp, Homo sapiens
cagtgctgtgctggaagctgtt

SEQ ID NO: 6961905 - DNA, 22 bp, Homo sapiens
cagctggcctgatccctgtggc

SEQ ID NO: 6961906 - DNA, 22 bp, Homo sapiens
gaagactttaagccgagattag

SEQ ID NO: 6961907 - DNA, 22 bp, Homo sapiens
acacagtattgtgactataact

SEQ ID NO: 6961908 - DNA, 22 bp, Homo sapiens
gcctttatatttttctggtgtt

SEQ ID NO: 6961909 - DNA, 22 bp, Homo sapiens
gtagatctgccttaacctggga

SEQ ID NO: 6961910 - DNA, 22 bp, Homo sapiens
gaacactgacattttcctgact

SEQ ID NO: 6961911 - DNA, 22 bp, Homo sapiens
gtgatcactgcttcttccacca

SEQ ID NO: 6961912 - DNA, 22 bp, Homo sapiens
cagagcttcctgctgggcttct

SEQ ID NO: 6961913 - DNA, 22 bp, Homo sapiens
taagatgaccttataaagagca

SEQ ID NO: 6961914 - DNA, 20 bp, Homo sapiens
cagagtaattattacccttt

SEQ ID NO: 6961915 - DNA, 22 bp, Homo sapiens
gtgccctgagtgggtaggagag

SEQ ID NO: 6961916 - DNA, 22 bp, Homo sapiens
ctggccccggttcctaaaaacc

SEQ ID NO: 6961917 - DNA, 19 bp, Homo sapiens
agagttgggcactgtttca

SEQ ID NO: 6961918 - DNA, 20 bp, Homo sapiens
tggtatgctgcaggcagcag

SEQ ID NO: 6961919 - DNA, 22 bp, Homo sapiens
tgctttcacatgtatgcacaaa

SEQ ID NO: 6961920 - DNA, 22 bp, Homo sapiens
tacagttaaaaagttcaatggt

SEQ ID NO: 6961921 - DNA, 22 bp, Homo sapiens
ttgacaaagatatattcatgct

SEQ ID NO: 6961922 - DNA, 21 bp, Homo sapiens
cagtgctgcctaatagggagt

SEQ ID NO: 6961923 - DNA, 22 bp, Homo sapiens
gtgtatcaagtctgacccccca

SEQ ID NO: 6961924 - DNA, 22 bp, Homo sapiens
gcccagtggcatcttcactgct

SEQ ID NO: 6961925 - DNA, 22 bp, Homo sapiens
acatgcatctctgggacacatg

SEQ ID NO: 6961926 - DNA, 22 bp, Homo sapiens
ctgcatcattggtgattcagga

SEQ ID NO: 6961927 - DNA, 22 bp, Homo sapiens
gaatacatgcacgacacggggg

SEQ ID NO: 6961928 - DNA, 22 bp, Homo sapiens
tgttacagaatgaatttccgga

SEQ ID NO: 6961929 - DNA, 22 bp, Homo sapiens
tgaaggtgtatgctgtgggtca

SEQ ID NO: 6961930 - DNA, 20 bp, Homo sapiens
gctgccagggcggagacatc

SEQ ID NO: 6961931 - DNA, 22 bp, Homo sapiens
catcagttcccaggcccagaca

SEQ ID NO: 6961932 - DNA, 22 bp, Homo sapiens
atgttcatctacaaggcattgt

SEQ ID NO: 6961933 - DNA, 22 bp, Homo sapiens
agcctggagcttgagttatgag

SEQ ID NO: 6961934 - DNA, 22 bp, Homo sapiens
agctggccttcggtgtcactgg

SEQ ID NO: 6961935 - DNA, 22 bp, Homo sapiens
cctgctggtttttacaaagatg

SEQ ID NO: 6961936 - DNA, 22 bp, Homo sapiens
ttacatcattgagacatacata

SEQ ID NO: 6961937 - DNA, 22 bp, Homo sapiens
aggggcaggtgctgcacttaga

SEQ ID NO: 6961938 - DNA, 22 bp, Homo sapiens
agggaagtggtctgggaacttg

SEQ ID NO: 6961939 - DNA, 22 bp, Homo sapiens
gtttggcaatatttgtggaaca

SEQ ID NO: 6961940 - DNA, 22 bp, Homo sapiens
tccagcacccaatgtggctaag

SEQ ID NO: 6961941 - DNA, 22 bp, Homo sapiens
aaaaacactgggctgggagtca

SEQ ID NO: 6961942 - DNA, 22 bp, Homo sapiens
cctcagtgagtgtttccttctt

SEQ ID NO: 6961943 - DNA, 22 bp, Homo sapiens
aatctgcttagagctttgagga

SEQ ID NO: 6961944 - DNA, 22 bp, Homo sapiens
tacttgttctttcaagagatag

SEQ ID NO: 6961945 - DNA, 22 bp, Homo sapiens
gtgtgcagggctgcctgtgccg

SEQ ID NO: 6961946 - DNA, 22 bp, Homo sapiens
aaatccagtgggtcctcatgag

SEQ ID NO: 6961947 - DNA, 22 bp, Homo sapiens
tgttaaggaaactgtggggtta

SEQ ID NO: 6961948 - DNA, 22 bp, Homo sapiens
aaagagttgaggcagttatcca

SEQ ID NO: 6961949 - DNA, 22 bp, Homo sapiens
ttctggatatggattttggtga

SEQ ID NO: 6961950 - DNA, 22 bp, Homo sapiens
gggaataggacaaatgaaggag

SEQ ID NO: 6961951 - DNA, 22 bp, Homo sapiens
cttgagctgaagccagttgaaa

SEQ ID NO: 6961952 - DNA, 22 bp, Homo sapiens
ggggagagtattttattcaagt

SEQ ID NO: 6961953 - DNA, 22 bp, Homo sapiens
agtgggtgagcttggtctagat

SEQ ID NO: 6961954 - DNA, 22 bp, Homo sapiens
aaatccagatgagggtaccaga

SEQ ID NO: 6961955 - DNA, 20 bp, Homo sapiens
gtgtgaagccctcaggagga

SEQ ID NO: 6961956 - DNA, 22 bp, Homo sapiens
ggcctctggcaggcaggccctc

SEQ ID NO: 6961957 - DNA, 21 bp, Homo sapiens
tgcatggaggaaagttataga

SEQ ID NO: 6961958 - DNA, 22 bp, Homo sapiens
tcctgagctgccgcatcagcag

SEQ ID NO: 6961959 - DNA, 22 bp, Homo sapiens
tctgccttcttttagtcatctt

SEQ ID NO: 6961960 - DNA, 22 bp, Homo sapiens
ctctccctcattgggttccatt

SEQ ID NO: 6961961 - DNA, 22 bp, Homo sapiens
ctggctcccagctttcagggag

SEQ ID NO: 6961962 - DNA, 22 bp, Homo sapiens
tgcatggatatataccctaggc

SEQ ID NO: 6961963 - DNA, 22 bp, Homo sapiens
atttgcagattctgtcaggttt

SEQ ID NO: 6961964 - DNA, 22 bp, Homo sapiens
actgtattttgggtgtattttc

SEQ ID NO: 6961965 - DNA, 22 bp, Homo sapiens
cctccccacgggcagccggcgc

SEQ ID NO: 6961966 - DNA, 22 bp, Homo sapiens
tctatgtaaagccatattgata

SEQ ID NO: 6961967 - DNA, 22 bp, Homo sapiens
ttatggctaggatatgtgtgta

SEQ ID NO: 6961968 - DNA, 22 bp, Homo sapiens
ggctctggggcctcctcccttg

SEQ ID NO: 6961969 - DNA, 22 bp, Homo sapiens
tgtgaaggagatgaagggagtg

SEQ ID NO: 6961970 - DNA, 22 bp, Homo sapiens
cctgggtcctggcagcctcctg

SEQ ID NO: 6961971 - DNA, 22 bp, Homo sapiens
tagcaaatgtgttatgctatgc

SEQ ID NO: 6961972 - DNA, 22 bp, Homo sapiens
cacatgtagtaagcaggcaatg

SEQ ID NO: 6961973 - DNA, 22 bp, Homo sapiens
taaagctaatagtttgtaagat

SEQ ID NO: 6961974 - DNA, 22 bp, Homo sapiens
atcaacatagccactccttaga

SEQ ID NO: 6961975 - DNA, 22 bp, Homo sapiens
ttgacaaaaataacacagcata

SEQ ID NO: 6961976 - DNA, 22 bp, Homo sapiens
atcttggggaatcctctgtgta

SEQ ID NO: 6961977 - DNA, 21 bp, Homo sapiens
gctgggctccagtctgccgct

SEQ ID NO: 6961978 - DNA, 22 bp, Homo sapiens
gaacattcttgggcaagttact

SEQ ID NO: 6961979 - DNA, 23 bp, Homo sapiens
ggcaccaggccatggagcgggag

SEQ ID NO: 6961980 - DNA, 22 bp, Homo sapiens
ttttgttgtaatatacctatcc

SEQ ID NO: 6961981 - DNA, 22 bp, Homo sapiens
tgtctcctcggctgtccagcca

SEQ ID NO: 6961982 - DNA, 22 bp, Homo sapiens
aatctgcataagcacagttgga

SEQ ID NO: 6961983 - DNA, 22 bp, Homo sapiens
aaatgcagcctagctcagtttt

SEQ ID NO: 6961984 - DNA, 23 bp, Homo sapiens
gtgatattaaggatagagacaag

SEQ ID NO: 6961985 - DNA, 18 bp, Homo sapiens
atttctctggggtgattc

SEQ ID NO: 6961986 - DNA, 22 bp, Homo sapiens
gcagaggggaagctgaggaatt

SEQ ID NO: 6961987 - DNA, 22 bp, Homo sapiens
ctgagctcaagcgatcctccca

SEQ ID NO: 6961988 - DNA, 18 bp, Homo sapiens
gtagcaaaggagttactt

SEQ ID NO: 6961989 - DNA, 22 bp, Homo sapiens
aatgtggcattgtcattattgg

SEQ ID NO: 6961990 - DNA, 22 bp, Homo sapiens
tctgctgtgtcccctgtgcggg

SEQ ID NO: 6961991 - DNA, 22 bp, Homo sapiens
gggaaggctgcctgagggatgg

SEQ ID NO: 6961992 - DNA, 22 bp, Homo sapiens
ctctccagttacctaggtctga

SEQ ID NO: 6961993 - DNA, 22 bp, Homo sapiens
agacatgtcaccaattcttact

SEQ ID NO: 6961994 - DNA, 22 bp, Homo sapiens
gaaagttcgtcctgtggcttct

SEQ ID NO: 6961995 - DNA, 22 bp, Homo sapiens
agagctccagggttttgtagtg

SEQ ID NO: 6961996 - DNA, 23 bp, Homo sapiens
ttgtttctttgtattgtctctat

SEQ ID NO: 6961997 - DNA, 22 bp, Homo sapiens
tgcacccatgtctccacgtaca

SEQ ID NO: 6961998 - DNA, 22 bp, Homo sapiens
tccctcctttatcaaaaagaga

SEQ ID NO: 6961999 - DNA, 22 bp, Homo sapiens
tcccagaatcctcactctatca

SEQ ID NO: 6962000 - DNA, 20 bp, Homo sapiens
cctctgtgtcctgtgtcata

SEQ ID NO: 6962001 - DNA, 20 bp, Homo sapiens
tcattacagtgctaagatgt

SEQ ID NO: 6962002 - DNA, 22 bp, Homo sapiens
gccagtttaaaccttgtgaata

SEQ ID NO: 6962003 - DNA, 22 bp, Homo sapiens
ggaaatggtggaggaaggctta

SEQ ID NO: 6962004 - DNA, 22 bp, Homo sapiens
ttaccttggaccgggtatcaga

SEQ ID NO: 6962005 - DNA, 22 bp, Homo sapiens
gtgatatttttaaagattaagg

SEQ ID NO: 6962006 - DNA, 22 bp, Homo sapiens
aaccaccaccgtaatttaccca

SEQ ID NO: 6962007 - DNA, 22 bp, Homo sapiens
cctctctttcctacaccttgga

SEQ ID NO: 6962008 - DNA, 22 bp, Homo sapiens
ccattattataggaggctcatt

SEQ ID NO: 6962009 - DNA, 22 bp, Homo sapiens
ttggaaaatgtatttctagaag

SEQ ID NO: 6962010 - DNA, 22 bp, Homo sapiens
tcaataaatagcttggctcagc

SEQ ID NO: 6962011 - DNA, 22 bp, Homo sapiens
gtaggggtcaggtagggactct

SEQ ID NO: 6962012 - DNA, 22 bp, Homo sapiens
gaatgttatgtatccagtcaca

SEQ ID NO: 6962013 - DNA, 22 bp, Homo sapiens
acagagtggagttcagtaaata

SEQ ID NO: 6962014 - DNA, 22 bp, Homo sapiens
tggaaagtgctctagactttct

SEQ ID NO: 6962015 - DNA, 22 bp, Homo sapiens
aggccctgagcatccgagggca

SEQ ID NO: 6962016 - DNA, 22 bp, Homo sapiens
catgcagtggtaaaaagtcagg

SEQ ID NO: 6962017 - DNA, 22 bp, Homo sapiens
tgcaggactttcagtgctcaaa

SEQ ID NO: 6962018 - DNA, 21 bp, Homo sapiens
acagctaagcaacaactactg

SEQ ID NO: 6962019 - DNA, 22 bp, Homo sapiens
gtcactgacatggtcattggca

SEQ ID NO: 6962020 - DNA, 22 bp, Homo sapiens
agaccacaggcatgcacagagc

SEQ ID NO: 6962021 - DNA, 22 bp, Homo sapiens
atgcagaaagagaatgtaatgt

SEQ ID NO: 6962022 - DNA, 20 bp, Homo sapiens
agaagctgagactgggtttt

SEQ ID NO: 6962023 - DNA, 22 bp, Homo sapiens
taagataagtgggttgagatgg

SEQ ID NO: 6962024 - DNA, 22 bp, Homo sapiens
cttcccagaacaatgtaggctt

SEQ ID NO: 6962025 - DNA, 21 bp, Homo sapiens
tgagcaggagtcatgggaatg

SEQ ID NO: 6962026 - DNA, 22 bp, Homo sapiens
taagacatagccaagagcatcc

SEQ ID NO: 6962027 - DNA, 22 bp, Homo sapiens
gtcgtggagctcacagtgtgcc

SEQ ID NO: 6962028 - DNA, 22 bp, Homo sapiens
gactggagataaaaccatgagt

SEQ ID NO: 6962029 - DNA, 22 bp, Homo sapiens
tgccaggattgttgagatgatt

SEQ ID NO: 6962030 - DNA, 22 bp, Homo sapiens
ctggctttccttgtctgcatcc

SEQ ID NO: 6962031 - DNA, 22 bp, Homo sapiens
tcacagtgataactaagtcctg

SEQ ID NO: 6962032 - DNA, 22 bp, Homo sapiens
tccacatagagcttagaagcaa

SEQ ID NO: 6962033 - DNA, 22 bp, Homo sapiens
tactacagtatgtgtgttatac

SEQ ID NO: 6962034 - DNA, 22 bp, Homo sapiens
attagctatcaaaggttaatga

SEQ ID NO: 6962035 - DNA, 22 bp, Homo sapiens
ctctgctagaaggtcaatctct

SEQ ID NO: 6962036 - DNA, 22 bp, Homo sapiens
ctggaaagggtcctcattctgt

SEQ ID NO: 6962037 - DNA, 22 bp, Homo sapiens
agggctagagttgagatgggga

SEQ ID NO: 6962038 - DNA, 20 bp, Homo sapiens
tccaggtaacatctctctgg

SEQ ID NO: 6962039 - DNA, 22 bp, Homo sapiens
acagtctctccacactgcaggg

SEQ ID NO: 6962040 - DNA, 22 bp, Homo sapiens
gaatccctaagatttttataaa

SEQ ID NO: 6962041 - DNA, 22 bp, Homo sapiens
aggcagcatttctgcttatcca

SEQ ID NO: 6962042 - DNA, 23 bp, Homo sapiens
cagaaatctgaaatctagaaatg

SEQ ID NO: 6962043 - DNA, 23 bp, Homo sapiens
agcaataagaagggatacatgtg

SEQ ID NO: 6962044 - DNA, 22 bp, Homo sapiens
aagatgtgaacagaaccacagg

SEQ ID NO: 6962045 - DNA, 22 bp, Homo sapiens
agccctgcgtgccaggggactg

SEQ ID NO: 6962046 - DNA, 22 bp, Homo sapiens
tgagacagtaattgtatagttt

SEQ ID NO: 6962047 - DNA, 22 bp, Homo sapiens
gggagaaggaggactgtgctgt

SEQ ID NO: 6962048 - DNA, 22 bp, Homo sapiens
ctttgctttactcccactgtgt

SEQ ID NO: 6962049 - DNA, 22 bp, Homo sapiens
taacatgtgtattggtttccta

SEQ ID NO: 6962050 - DNA, 17 bp, Homo sapiens
acttcaagttcagtgac

SEQ ID NO: 6962051 - DNA, 22 bp, Homo sapiens
aagtgtcttttagccactttta

SEQ ID NO: 6962052 - DNA, 22 bp, Homo sapiens
ctggaggaatcacagaaggctt

SEQ ID NO: 6962053 - DNA, 22 bp, Homo sapiens
atatacaaagggcaacctcgct

SEQ ID NO: 6962054 - DNA, 22 bp, Homo sapiens
atgggttcaagtgattctcctg

SEQ ID NO: 6962055 - DNA, 22 bp, Homo sapiens
agtgtgagtttggttgagactt

SEQ ID NO: 6962056 - DNA, 22 bp, Homo sapiens
agagtgaaggttgacacttcac

SEQ ID NO: 6962057 - DNA, 22 bp, Homo sapiens
actcttcacacatgctgccctc

SEQ ID NO: 6962058 - DNA, 22 bp, Homo sapiens
ctgataatacagcagtttgtct

SEQ ID NO: 6962059 - DNA, 22 bp, Homo sapiens
agccaggcgcagtggcttatgc

SEQ ID NO: 6962060 - DNA, 22 bp, Homo sapiens
atgaggatgttagtggactgga

SEQ ID NO: 6962061 - DNA, 22 bp, Homo sapiens
ttcagggcagacagaagagatg

SEQ ID NO: 6962062 - DNA, 22 bp, Homo sapiens
tttgtagattttctctccagta

SEQ ID NO: 6962063 - DNA, 17 bp, Homo sapiens
cttctagaaggcaaact

SEQ ID NO: 6962064 - DNA, 22 bp, Homo sapiens
gattggagagtggaacatgctg

SEQ ID NO: 6962065 - DNA, 22 bp, Homo sapiens
ttattcaccagtgtaaaacact

SEQ ID NO: 6962066 - DNA, 22 bp, Homo sapiens
ttgtcctaatttatggcctgga

SEQ ID NO: 6962067 - DNA, 22 bp, Homo sapiens
tcctggcactttgggggctcgc

SEQ ID NO: 6962068 - DNA, 22 bp, Homo sapiens
tccaccagagccctctttgcgg

SEQ ID NO: 6962069 - DNA, 22 bp, Homo sapiens
cgagaaggtcttcccacagagc

SEQ ID NO: 6962070 - DNA, 23 bp, Homo sapiens
aggcagagccaaggtcaaaaccc

SEQ ID NO: 6962071 - DNA, 22 bp, Homo sapiens
tttctgacttttatatgcatat

SEQ ID NO: 6962072 - DNA, 22 bp, Homo sapiens
ctcttctgtacctcggcctcca

SEQ ID NO: 6962073 - DNA, 22 bp, Homo sapiens
ttagtgtcttcttcatcctctg

SEQ ID NO: 6962074 - DNA, 22 bp, Homo sapiens
cctgctggacgtggaggagggg

SEQ ID NO: 6962075 - DNA, 22 bp, Homo sapiens
ctgcagggccatgggttctata

SEQ ID NO: 6962076 - DNA, 22 bp, Homo sapiens
agcttcttagttcacttttaat

SEQ ID NO: 6962077 - DNA, 22 bp, Homo sapiens
tcagaatcggtggggccaggaa

SEQ ID NO: 6962078 - DNA, 22 bp, Homo sapiens
ttactgatggaacagagataga

SEQ ID NO: 6962079 - DNA, 22 bp, Homo sapiens
aaagagctgggacttaaagtgc

SEQ ID NO: 6962080 - DNA, 20 bp, Homo sapiens
tgttccctatttgactgaag

SEQ ID NO: 6962081 - DNA, 22 bp, Homo sapiens
cctcaggatccgcaggtgcagt

SEQ ID NO: 6962082 - DNA, 22 bp, Homo sapiens
taacagaaaagaactgagtttg

SEQ ID NO: 6962083 - DNA, 22 bp, Homo sapiens
gaggcactgaatacttgagggt

SEQ ID NO: 6962084 - DNA, 22 bp, Homo sapiens
gtacatattataaaatacagct

SEQ ID NO: 6962085 - DNA, 22 bp, Homo sapiens
acttcatgtttctattagctca

SEQ ID NO: 6962086 - DNA, 22 bp, Homo sapiens
accaaatgtttttccagaaatg

SEQ ID NO: 6962087 - DNA, 22 bp, Homo sapiens
atgtgtctggttattgacatgc

SEQ ID NO: 6962088 - DNA, 22 bp, Homo sapiens
tggaagaatagaagatggttga

SEQ ID NO: 6962089 - DNA, 22 bp, Homo sapiens
tggatatgttggaggtgaaggt

SEQ ID NO: 6962090 - DNA, 22 bp, Homo sapiens
tgagaactggtagcacttgtga

SEQ ID NO: 6962091 - DNA, 22 bp, Homo sapiens
cactaagtcaacagcctctctt

SEQ ID NO: 6962092 - DNA, 21 bp, Homo sapiens
tcttgaaaattgtagcagttt

SEQ ID NO: 6962093 - DNA, 22 bp, Homo sapiens
aaatctgtaagcaattgctcag

SEQ ID NO: 6962094 - DNA, 22 bp, Homo sapiens
aatataaattcctgggcccagc

SEQ ID NO: 6962095 - DNA, 22 bp, Homo sapiens
cagctcccagtggcagctcctt

SEQ ID NO: 6962096 - DNA, 22 bp, Homo sapiens
agcccagatggtagccctagaa

SEQ ID NO: 6962097 - DNA, 21 bp, Homo sapiens
gtcaaactggggtacatttgt

SEQ ID NO: 6962098 - DNA, 22 bp, Homo sapiens
ggggctgctcgccgcgcgtttc

SEQ ID NO: 6962099 - DNA, 21 bp, Homo sapiens
cttcatcccggagattctggt

SEQ ID NO: 6962100 - DNA, 22 bp, Homo sapiens
cagtcagaggtcttctaaaaca

SEQ ID NO: 6962101 - DNA, 23 bp, Homo sapiens
ttcttacaaggctggcccacttg

SEQ ID NO: 6962102 - DNA, 19 bp, Homo sapiens
taaggctgaaggaggaggg

SEQ ID NO: 6962103 - DNA, 22 bp, Homo sapiens
agtaccatctctgcctctgcct

SEQ ID NO: 6962104 - DNA, 22 bp, Homo sapiens
ttctgtttcctgccttcccatt

SEQ ID NO: 6962105 - DNA, 22 bp, Homo sapiens
ttacagaagagaaagaattcag

SEQ ID NO: 6962106 - DNA, 18 bp, Homo sapiens
actcaagggtggagagaa

SEQ ID NO: 6962107 - DNA, 22 bp, Homo sapiens
gaatataggacctctgggaaca

SEQ ID NO: 6962108 - DNA, 22 bp, Homo sapiens
aagagaattctggttttcctat

SEQ ID NO: 6962109 - DNA, 18 bp, Homo sapiens
cttggctgatgggggtgt

SEQ ID NO: 6962110 - DNA, 22 bp, Homo sapiens
ggattcagataagtggaggtga

SEQ ID NO: 6962111 - DNA, 22 bp, Homo sapiens
gcctggcacaggaattaggagg

SEQ ID NO: 6962112 - DNA, 22 bp, Homo sapiens
tgctgaggtcacggcggccaga

SEQ ID NO: 6962113 - DNA, 22 bp, Homo sapiens
ctggctggagcaggcatcttgt

SEQ ID NO: 6962114 - DNA, 21 bp, Homo sapiens
tcccacagcgccagctcctgt

SEQ ID NO: 6962115 - DNA, 21 bp, Homo sapiens
ggcatcggcgcagtgatagag

SEQ ID NO: 6962116 - DNA, 22 bp, Homo sapiens
atgttcctttaaaatatagatt

SEQ ID NO: 6962117 - DNA, 22 bp, Homo sapiens
gggctacattgtgagagaagtt

SEQ ID NO: 6962118 - DNA, 22 bp, Homo sapiens
tgaaggcctccccgagcattag

SEQ ID NO: 6962119 - DNA, 22 bp, Homo sapiens
atttggtcagaactctctttag

SEQ ID NO: 6962120 - DNA, 22 bp, Homo sapiens
attcacagagtggttagtggta

SEQ ID NO: 6962121 - DNA, 22 bp, Homo sapiens
tgttccaataaggagttgaaat

SEQ ID NO: 6962122 - DNA, 22 bp, Homo sapiens
gtgattctttgatctatgaaag

SEQ ID NO: 6962123 - DNA, 22 bp, Homo sapiens
aagccctggctcagctcaccag

SEQ ID NO: 6962124 - DNA, 22 bp, Homo sapiens
tcgcaccattgcactccagcca

SEQ ID NO: 6962125 - DNA, 20 bp, Homo sapiens
agctgaagcccttggggaaa

SEQ ID NO: 6962126 - DNA, 22 bp, Homo sapiens
aggacaggtgtagtgggctctg

SEQ ID NO: 6962127 - DNA, 22 bp, Homo sapiens
ttttggtacatgcaatagcaat

SEQ ID NO: 6962128 - DNA, 22 bp, Homo sapiens
ctgaggccagaacccgaccctg

SEQ ID NO: 6962129 - DNA, 22 bp, Homo sapiens
aggccagatgtcgggctagaag

SEQ ID NO: 6962130 - DNA, 21 bp, Homo sapiens
ttgtaccttagagcacaccct

SEQ ID NO: 6962131 - DNA, 22 bp, Homo sapiens
tgcaggtgagtgcaggggctca

SEQ ID NO: 6962132 - DNA, 22 bp, Homo sapiens
ggtggagctgtggacaggaagg

SEQ ID NO: 6962133 - DNA, 22 bp, Homo sapiens
agccacctcctgctctgctcac

SEQ ID NO: 6962134 - DNA, 20 bp, Homo sapiens
atttgctgtcagtccctagg

SEQ ID NO: 6962135 - DNA, 22 bp, Homo sapiens
tttggcagaattgatggtcctt

SEQ ID NO: 6962136 - DNA, 23 bp, Homo sapiens
tggcagtgcccagggagatgatc

SEQ ID NO: 6962137 - DNA, 22 bp, Homo sapiens
tcaggtttttctcaaatcaggt

SEQ ID NO: 6962138 - DNA, 22 bp, Homo sapiens
ctgtggaatcatcaggtcttac

SEQ ID NO: 6962139 - DNA, 22 bp, Homo sapiens
cagcttctgtttattgtgtgcc

SEQ ID NO: 6962140 - DNA, 21 bp, Homo sapiens
gcggcgatacgcgcaggggag

SEQ ID NO: 6962141 - DNA, 22 bp, Homo sapiens
agccagagggaatctttgggga

SEQ ID NO: 6962142 - DNA, 22 bp, Homo sapiens
tgtgtacagcaggatttctcaa

SEQ ID NO: 6962143 - DNA, 22 bp, Homo sapiens
atgcatttgtaaaatataatcg

SEQ ID NO: 6962144 - DNA, 22 bp, Homo sapiens
ggcttggctacaagccatgggc

SEQ ID NO: 6962145 - DNA, 22 bp, Homo sapiens
tctcagagatttatggaaaact

SEQ ID NO: 6962146 - DNA, 22 bp, Homo sapiens
agccctgtgggccttgtggcac

SEQ ID NO: 6962147 - DNA, 22 bp, Homo sapiens
cagggtctgctacacttggcaa

SEQ ID NO: 6962148 - DNA, 22 bp, Homo sapiens
agggcagaaatattgatactgt

SEQ ID NO: 6962149 - DNA, 22 bp, Homo sapiens
cacctgctgagctgctgggggt

SEQ ID NO: 6962150 - DNA, 22 bp, Homo sapiens
tgtcatatctattaaatgtcta

SEQ ID NO: 6962151 - DNA, 22 bp, Homo sapiens
ctttcatccgcagatgagcctc

SEQ ID NO: 6962152 - DNA, 22 bp, Homo sapiens
cgatggtatcggccagccccgg

SEQ ID NO: 6962153 - DNA, 22 bp, Homo sapiens
acagtctgcagggtgaacatgt

SEQ ID NO: 6962154 - DNA, 22 bp, Homo sapiens
tcaagagacaggacgtgtttca

SEQ ID NO: 6962155 - DNA, 22 bp, Homo sapiens
catgccatttacttggaggaga

SEQ ID NO: 6962156 - DNA, 22 bp, Homo sapiens
aattatggtatgttcaacaact

SEQ ID NO: 6962157 - DNA, 22 bp, Homo sapiens
atttagctttctctcactggtg

SEQ ID NO: 6962158 - DNA, 22 bp, Homo sapiens
acagaggccccgtgggagagcc

SEQ ID NO: 6962159 - DNA, 22 bp, Homo sapiens
agccaagggtcagctgcacaga

SEQ ID NO: 6962160 - DNA, 22 bp, Homo sapiens
gaggcagtatagtcattaagta

SEQ ID NO: 6962161 - DNA, 22 bp, Homo sapiens
ggcagccatgtcccagggcttc

SEQ ID NO: 6962162 - DNA, 22 bp, Homo sapiens
gtaaaggctctgataagtactg

SEQ ID NO: 6962163 - DNA, 20 bp, Homo sapiens
gtactcagatcaagtcagct

SEQ ID NO: 6962164 - DNA, 19 bp, Homo sapiens
tgtctgtataggtaaagaa

SEQ ID NO: 6962165 - DNA, 19 bp, Homo sapiens
tcctgggcgttgactttgg

SEQ ID NO: 6962166 - DNA, 22 bp, Homo sapiens
catcttgcctgctattctgttg

SEQ ID NO: 6962167 - DNA, 22 bp, Homo sapiens
gctaatgatagcaagataaaca

SEQ ID NO: 6962168 - DNA, 22 bp, Homo sapiens
gggaagtgaggagcccctctgc

SEQ ID NO: 6962169 - DNA, 22 bp, Homo sapiens
tctcctgcagtcagcagtctca

SEQ ID NO: 6962170 - DNA, 22 bp, Homo sapiens
tcggggtctttgacacgctctg

SEQ ID NO: 6962171 - DNA, 22 bp, Homo sapiens
atctacaacatcacatggcatt

SEQ ID NO: 6962172 - DNA, 22 bp, Homo sapiens
tatgcacatataacctgcactg

SEQ ID NO: 6962173 - DNA, 22 bp, Homo sapiens
tgctggctctaggctgagacag

SEQ ID NO: 6962174 - DNA, 22 bp, Homo sapiens
tgcagaaattcagaaagcataa

SEQ ID NO: 6962175 - DNA, 22 bp, Homo sapiens
aagccagttagcacatcattgc

SEQ ID NO: 6962176 - DNA, 22 bp, Homo sapiens
ctgagctgggagtagagactct

SEQ ID NO: 6962177 - DNA, 18 bp, Homo sapiens
taaggcattcttatgtga

SEQ ID NO: 6962178 - DNA, 22 bp, Homo sapiens
tcctgagagcagagtccaggtg

SEQ ID NO: 6962179 - DNA, 22 bp, Homo sapiens
gagtattttcaaattcagcaga

SEQ ID NO: 6962180 - DNA, 22 bp, Homo sapiens
gcagtgaaaaagtgcaccctgt

SEQ ID NO: 6962181 - DNA, 21 bp, Homo sapiens
cctagtgttaaaacagtttaa

SEQ ID NO: 6962182 - DNA, 22 bp, Homo sapiens
aaggcaatgactgatttagaat

SEQ ID NO: 6962183 - DNA, 22 bp, Homo sapiens
tctggcttggcgctgccctctg

SEQ ID NO: 6962184 - DNA, 22 bp, Homo sapiens
tggggtctgagtatctgcattt

SEQ ID NO: 6962185 - DNA, 22 bp, Homo sapiens
tttaccaaatagattatgtcag

SEQ ID NO: 6962186 - DNA, 22 bp, Homo sapiens
gccttggactcgggtggactca

SEQ ID NO: 6962187 - DNA, 22 bp, Homo sapiens
atgtgaaagaggtgttcagtgg

SEQ ID NO: 6962188 - DNA, 22 bp, Homo sapiens
ttgcatcacagtatctctgtaa

SEQ ID NO: 6962189 - DNA, 22 bp, Homo sapiens
cctgcgggctggtaagaggctt

SEQ ID NO: 6962190 - DNA, 22 bp, Homo sapiens
gggagcagcctgcctcccacct

SEQ ID NO: 6962191 - DNA, 22 bp, Homo sapiens
tccctggaggtgtttgctcagg

SEQ ID NO: 6962192 - DNA, 22 bp, Homo sapiens
ctgaggagatgataatgtcatt

SEQ ID NO: 6962193 - DNA, 21 bp, Homo sapiens
agactttgcttgcagagagtc

SEQ ID NO: 6962194 - DNA, 22 bp, Homo sapiens
tgtgagacgtgttagaacagtg

SEQ ID NO: 6962195 - DNA, 22 bp, Homo sapiens
gagaattactgtttttataaca

SEQ ID NO: 6962196 - DNA, 22 bp, Homo sapiens
tggctttatacctttgccttgg

SEQ ID NO: 6962197 - DNA, 22 bp, Homo sapiens
ggggtggagatggtggcccttt

SEQ ID NO: 6962198 - DNA, 21 bp, Homo sapiens
agggaaatccagtcacttttc

SEQ ID NO: 6962199 - DNA, 22 bp, Homo sapiens
tgtacttatgagatcctagtcg

SEQ ID NO: 6962200 - DNA, 22 bp, Homo sapiens
attggtctctgctaaagggagg

SEQ ID NO: 6962201 - DNA, 22 bp, Homo sapiens
tccaggccgcaggggcagcccc

SEQ ID NO: 6962202 - DNA, 22 bp, Homo sapiens
gggctggatctcctgcaggcag

SEQ ID NO: 6962203 - DNA, 22 bp, Homo sapiens
atactaagctcattacattttg

SEQ ID NO: 6962204 - DNA, 22 bp, Homo sapiens
tgcaggctccatgaggacaggc

SEQ ID NO: 6962205 - DNA, 22 bp, Homo sapiens
tcacacagctgctctgttttat

SEQ ID NO: 6962206 - DNA, 22 bp, Homo sapiens
agattttggctggctggagaga

SEQ ID NO: 6962207 - DNA, 22 bp, Homo sapiens
taagtggcagagcttgttctca

SEQ ID NO: 6962208 - DNA, 22 bp, Homo sapiens
aagttatatcatctcattgacg

SEQ ID NO: 6962209 - DNA, 22 bp, Homo sapiens
ggaagcaaaatcatcagtcatt

SEQ ID NO: 6962210 - DNA, 22 bp, Homo sapiens
ctctgcatcaggcattatggat

SEQ ID NO: 6962211 - DNA, 16 bp, Homo sapiens
cttcctcttcactggc

SEQ ID NO: 6962212 - DNA, 22 bp, Homo sapiens
tatgaaagcaatcattatgtac

SEQ ID NO: 6962213 - DNA, 22 bp, Homo sapiens
tcagtatcatgcggtagccatg

SEQ ID NO: 6962214 - DNA, 22 bp, Homo sapiens
aattgcaggcaccagcaggagc

SEQ ID NO: 6962215 - DNA, 22 bp, Homo sapiens
cacatgtttggcatgtcaccaa

SEQ ID NO: 6962216 - DNA, 22 bp, Homo sapiens
tgccgctccaggtctcgcggtg

SEQ ID NO: 6962217 - DNA, 22 bp, Homo sapiens
gggaaacagcccaggctcaggg

SEQ ID NO: 6962218 - DNA, 22 bp, Homo sapiens
gtcattgtaatattctcattta

SEQ ID NO: 6962219 - DNA, 22 bp, Homo sapiens
tggaatgttatgatgatggtaa

SEQ ID NO: 6962220 - DNA, 22 bp, Homo sapiens
atgaaatgtctggatctttttc

SEQ ID NO: 6962221 - DNA, 22 bp, Homo sapiens
gccttattttacttggattctg

SEQ ID NO: 6962222 - DNA, 22 bp, Homo sapiens
ggctgagaaggagtgggtgagg

SEQ ID NO: 6962223 - DNA, 22 bp, Homo sapiens
ctggtaaatgatgagaagcacc

SEQ ID NO: 6962224 - DNA, 21 bp, Homo sapiens
ggtagcttcccttctggaata

SEQ ID NO: 6962225 - DNA, 22 bp, Homo sapiens
tttgccattgcctgtcagttgt

SEQ ID NO: 6962226 - DNA, 22 bp, Homo sapiens
tgagcaggtcaagactccagct

SEQ ID NO: 6962227 - DNA, 22 bp, Homo sapiens
attgcttcaactgttcaatggg

SEQ ID NO: 6962228 - DNA, 22 bp, Homo sapiens
ggagacacatatacagaaagag

SEQ ID NO: 6962229 - DNA, 22 bp, Homo sapiens
ccagtagtagtttgttctttaa

SEQ ID NO: 6962230 - DNA, 22 bp, Homo sapiens
cttcccagcacctcagtctggc

SEQ ID NO: 6962231 - DNA, 22 bp, Homo sapiens
agattgtgtcaatttctcttta

SEQ ID NO: 6962232 - DNA, 22 bp, Homo sapiens
caaaccttgttccagtcaactc

SEQ ID NO: 6962233 - DNA, 22 bp, Homo sapiens
atggctgcttacaaaaactgtg

SEQ ID NO: 6962234 - DNA, 22 bp, Homo sapiens
cactttcaagtttcagaggata

SEQ ID NO: 6962235 - DNA, 22 bp, Homo sapiens
gctgaagctgacacatagtgct

SEQ ID NO: 6962236 - DNA, 22 bp, Homo sapiens
ggtactttatacatgcatctgc

SEQ ID NO: 6962237 - DNA, 19 bp, Homo sapiens
tttcaatggcttagagaaa

SEQ ID NO: 6962238 - DNA, 22 bp, Homo sapiens
atcatctaaattgagtccagct

SEQ ID NO: 6962239 - DNA, 19 bp, Homo sapiens
ggcagcttgggaaggtagc

SEQ ID NO: 6962240 - DNA, 22 bp, Homo sapiens
tggcagctcctggggccagcac

SEQ ID NO: 6962241 - DNA, 22 bp, Homo sapiens
tagacataggaagtggaagctt

SEQ ID NO: 6962242 - DNA, 21 bp, Homo sapiens
cacattgaatacagagatgga

SEQ ID NO: 6962243 - DNA, 22 bp, Homo sapiens
aactgtaaaggttgagtggtaa

SEQ ID NO: 6962244 - DNA, 22 bp, Homo sapiens
agattaggattcagattctgcc

SEQ ID NO: 6962245 - DNA, 22 bp, Homo sapiens
tggcattagtgctcctactcag

SEQ ID NO: 6962246 - DNA, 22 bp, Homo sapiens
ttatttaattttctcactcaga

SEQ ID NO: 6962247 - DNA, 22 bp, Homo sapiens
aagcttatatcagaacaatgct

SEQ ID NO: 6962248 - DNA, 22 bp, Homo sapiens
cagtgcctggcatagaggcggc

SEQ ID NO: 6962249 - DNA, 22 bp, Homo sapiens
agtatgtcagagtgaaaatggt

SEQ ID NO: 6962250 - DNA, 22 bp, Homo sapiens
ctcccagccttcgccagtctga

SEQ ID NO: 6962251 - DNA, 22 bp, Homo sapiens
ctttgatgccagataactgcag

SEQ ID NO: 6962252 - DNA, 22 bp, Homo sapiens
agggcagcagcggcccaggcct

SEQ ID NO: 6962253 - DNA, 22 bp, Homo sapiens
tgtgaaattcttgaaatgcaca

SEQ ID NO: 6962254 - DNA, 22 bp, Homo sapiens
tcctgggtagcctgtccaagat

SEQ ID NO: 6962255 - DNA, 17 bp, Homo sapiens
gagatgctaatctgatc

SEQ ID NO: 6962256 - DNA, 22 bp, Homo sapiens
atctttggacggtcccaactga

SEQ ID NO: 6962257 - DNA, 21 bp, Homo sapiens
agggtggctctgggtcagaac

SEQ ID NO: 6962258 - DNA, 22 bp, Homo sapiens
tcccttcacagatgcgatgttt

SEQ ID NO: 6962259 - DNA, 22 bp, Homo sapiens
agccaacaactctgagcccagt

SEQ ID NO: 6962260 - DNA, 22 bp, Homo sapiens
agaaatgtaggcatataaggaa

SEQ ID NO: 6962261 - DNA, 22 bp, Homo sapiens
tcagggcactgtcacctgatat

SEQ ID NO: 6962262 - DNA, 22 bp, Homo sapiens
atgtgtctaattccaggagcac

SEQ ID NO: 6962263 - DNA, 22 bp, Homo sapiens
tcaatgcacacaggacttggtg

SEQ ID NO: 6962264 - DNA, 22 bp, Homo sapiens
ctggggtctcaattctagcggg

SEQ ID NO: 6962265 - DNA, 22 bp, Homo sapiens
gaaggcttcaaaaggtgtaatt

SEQ ID NO: 6962266 - DNA, 22 bp, Homo sapiens
ggaagctgaggcccagtgaagg

SEQ ID NO: 6962267 - DNA, 22 bp, Homo sapiens
tggatacaaaaacaatctctac

SEQ ID NO: 6962268 - DNA, 22 bp, Homo sapiens
atgcctcctcaaatctgccaca

SEQ ID NO: 6962269 - DNA, 22 bp, Homo sapiens
aagtgcatcactactcattaca

SEQ ID NO: 6962270 - DNA, 22 bp, Homo sapiens
ctctggttgcagctgaagttcc

SEQ ID NO: 6962271 - DNA, 22 bp, Homo sapiens
atgaacattaaaatggtagaat

SEQ ID NO: 6962272 - DNA, 22 bp, Homo sapiens
aattaccatcgtcaaatcatat

SEQ ID NO: 6962273 - DNA, 22 bp, Homo sapiens
agagtccatatgtgggaggagt

SEQ ID NO: 6962274 - DNA, 22 bp, Homo sapiens
tgctgtgtaaaaggtgattgaa

SEQ ID NO: 6962275 - DNA, 22 bp, Homo sapiens
agggggctcctccggtgcttcc

SEQ ID NO: 6962276 - DNA, 22 bp, Homo sapiens
agtttgcagtcaagatgttgga

SEQ ID NO: 6962277 - DNA, 22 bp, Homo sapiens
ctccaggacatgactttcttgc

SEQ ID NO: 6962278 - DNA, 23 bp, Homo sapiens
aagcgtcttttcaatgtggctgg

SEQ ID NO: 6962279 - DNA, 22 bp, Homo sapiens
gatccgtttgtgtgggagtatt

SEQ ID NO: 6962280 - DNA, 22 bp, Homo sapiens
ttttggtaattaagtagatatt

SEQ ID NO: 6962281 - DNA, 22 bp, Homo sapiens
ggtttggttctgagagttggca

SEQ ID NO: 6962282 - DNA, 22 bp, Homo sapiens
agcacagactggtcccaggtct

SEQ ID NO: 6962283 - DNA, 23 bp, Homo sapiens
tttggctgggctgtgggcacacc

SEQ ID NO: 6962284 - DNA, 22 bp, Homo sapiens
tgaagtcccaaggaggtttcaa

SEQ ID NO: 6962285 - DNA, 22 bp, Homo sapiens
gggtgacattaggaagatagac

SEQ ID NO: 6962286 - DNA, 22 bp, Homo sapiens
aatcagttagaaggaagagaat

SEQ ID NO: 6962287 - DNA, 22 bp, Homo sapiens
tgtaaattggaaatcaatcaag

SEQ ID NO: 6962288 - DNA, 19 bp, Homo sapiens
gtcctctcaacaacccggg

SEQ ID NO: 6962289 - DNA, 22 bp, Homo sapiens
tgctttagttcaacatgccaaa

SEQ ID NO: 6962290 - DNA, 22 bp, Homo sapiens
aggagctgcaaaaccggccgct

SEQ ID NO: 6962291 - DNA, 22 bp, Homo sapiens
ggggagcttggttattcatgca

SEQ ID NO: 6962292 - DNA, 23 bp, Homo sapiens
caaaatgctatgtgcccaatgca

SEQ ID NO: 6962293 - DNA, 22 bp, Homo sapiens
ttctgcatctgaatttaagtac

SEQ ID NO: 6962294 - DNA, 22 bp, Homo sapiens
catcatttcacttagatgaagt

SEQ ID NO: 6962295 - DNA, 22 bp, Homo sapiens
aaatgtcaggtggtggatggct

SEQ ID NO: 6962296 - DNA, 23 bp, Homo sapiens
ataatgcaagtggtggtaatctg

SEQ ID NO: 6962297 - DNA, 22 bp, Homo sapiens
tgaggctcagtgattaaagtgg

SEQ ID NO: 6962298 - DNA, 22 bp, Homo sapiens
ggtttcactagaagaaggaatt

SEQ ID NO: 6962299 - DNA, 22 bp, Homo sapiens
actttgtaggtttcagtgaaac

SEQ ID NO: 6962300 - DNA, 18 bp, Homo sapiens
caatactgagaggtgggg

SEQ ID NO: 6962301 - DNA, 22 bp, Homo sapiens
ttggaggatggagttagcatct

SEQ ID NO: 6962302 - DNA, 22 bp, Homo sapiens
tctcagagaagtgatgagcaat

SEQ ID NO: 6962303 - DNA, 22 bp, Homo sapiens
gacaattaggttaagagcaaga

SEQ ID NO: 6962304 - DNA, 23 bp, Homo sapiens
tttctgttcctctagctttgcat

SEQ ID NO: 6962305 - DNA, 22 bp, Homo sapiens
atacttctttaagagtaagtct

SEQ ID NO: 6962306 - DNA, 22 bp, Homo sapiens
gcccagcaaggaccaagggccg

SEQ ID NO: 6962307 - DNA, 22 bp, Homo sapiens
cagatgttattaacggctgtag

SEQ ID NO: 6962308 - DNA, 22 bp, Homo sapiens
tcctgcttaacatatggtcaag

SEQ ID NO: 6962309 - DNA, 22 bp, Homo sapiens
aacttttcattgaatcatgtca

SEQ ID NO: 6962310 - DNA, 22 bp, Homo sapiens
gttgctgggagcagggatcctg

SEQ ID NO: 6962311 - DNA, 22 bp, Homo sapiens
tggcaaagactgcaaggacttt

SEQ ID NO: 6962312 - DNA, 22 bp, Homo sapiens
agacttctcagttttattagta

SEQ ID NO: 6962313 - DNA, 22 bp, Homo sapiens
ttctctacttgagattttaatg

SEQ ID NO: 6962314 - DNA, 22 bp, Homo sapiens
gtggctgcagagggcacagcat

SEQ ID NO: 6962315 - DNA, 22 bp, Homo sapiens
ctctctgtatgtgtatatttat

SEQ ID NO: 6962316 - DNA, 22 bp, Homo sapiens
tgcaagatcttgtctctgccac

SEQ ID NO: 6962317 - DNA, 22 bp, Homo sapiens
tgatgtctagtacatacaagag

SEQ ID NO: 6962318 - DNA, 22 bp, Homo sapiens
cagaggcacagtgcgggccact

SEQ ID NO: 6962319 - DNA, 22 bp, Homo sapiens
ggtcttcagctttgcatgtctt

SEQ ID NO: 6962320 - DNA, 22 bp, Homo sapiens
agtgacatgctctcaggcataa

SEQ ID NO: 6962321 - DNA, 22 bp, Homo sapiens
accatttagtaagtatacctgg

SEQ ID NO: 6962322 - DNA, 18 bp, Homo sapiens
tcttggcagcatctggca

SEQ ID NO: 6962323 - DNA, 22 bp, Homo sapiens
acaggattagcaagtaatcagg

SEQ ID NO: 6962324 - DNA, 22 bp, Homo sapiens
agggagaaggtccatgcctgtc

SEQ ID NO: 6962325 - DNA, 22 bp, Homo sapiens
gtcttcctaatttgctattagg

SEQ ID NO: 6962326 - DNA, 22 bp, Homo sapiens
tggggcttctcctgtaggctca

SEQ ID NO: 6962327 - DNA, 22 bp, Homo sapiens
acacacaggtaaaggagcctgg

SEQ ID NO: 6962328 - DNA, 22 bp, Homo sapiens
gtattaggtggtggaattgtag

SEQ ID NO: 6962329 - DNA, 22 bp, Homo sapiens
aagccctgtaaattgcccttaa

SEQ ID NO: 6962330 - DNA, 22 bp, Homo sapiens
aggaaaaacctgttaatggtag

SEQ ID NO: 6962331 - DNA, 22 bp, Homo sapiens
gtgaactgctgagttttatcat

SEQ ID NO: 6962332 - DNA, 22 bp, Homo sapiens
cactggcaaatggagagaatgt

SEQ ID NO: 6962333 - DNA, 22 bp, Homo sapiens
tgaaggtggcataggagagatg

SEQ ID NO: 6962334 - DNA, 22 bp, Homo sapiens
acagtgattggtttgggggtga

SEQ ID NO: 6962335 - DNA, 22 bp, Homo sapiens
ctacagaatggagggtcagaga

SEQ ID NO: 6962336 - DNA, 22 bp, Homo sapiens
cagagtgtggcatcttccaact

SEQ ID NO: 6962337 - DNA, 22 bp, Homo sapiens
aaatgcacgctacccagctaga

SEQ ID NO: 6962338 - DNA, 22 bp, Homo sapiens
ttcttctgaaacagtgacagac

SEQ ID NO: 6962339 - DNA, 22 bp, Homo sapiens
gcagcagtggcagttaatattt

SEQ ID NO: 6962340 - DNA, 22 bp, Homo sapiens
agggacttggtgccctgtgttg

SEQ ID NO: 6962341 - DNA, 22 bp, Homo sapiens
ctagggaacaagatgcccaggg

SEQ ID NO: 6962342 - DNA, 22 bp, Homo sapiens
gttcatattctaagtaactggc

SEQ ID NO: 6962343 - DNA, 22 bp, Homo sapiens
ggagcacctttgtctatttctc

SEQ ID NO: 6962344 - DNA, 22 bp, Homo sapiens
tcagagtggtagcctattttct

SEQ ID NO: 6962345 - DNA, 22 bp, Homo sapiens
cttatggcctgcccacagtagt

SEQ ID NO: 6962346 - DNA, 19 bp, Homo sapiens
ctgaggtgcagtaagaggc

SEQ ID NO: 6962347 - DNA, 17 bp, Homo sapiens
ggtgtttaagtgccagc

SEQ ID NO: 6962348 - DNA, 22 bp, Homo sapiens
ctgaaatattttaatctcagga

SEQ ID NO: 6962349 - DNA, 22 bp, Homo sapiens
tcatggctgaaacagtaacaca

SEQ ID NO: 6962350 - DNA, 22 bp, Homo sapiens
aagtccagctgtagctcaacag

SEQ ID NO: 6962351 - DNA, 17 bp, Homo sapiens
aagacaagacaaatgca

SEQ ID NO: 6962352 - DNA, 22 bp, Homo sapiens
agttccactgatggcctacaaa

SEQ ID NO: 6962353 - DNA, 22 bp, Homo sapiens
tacatgtgataaattgattaaa

SEQ ID NO: 6962354 - DNA, 17 bp, Homo sapiens
cctgatattcaagcagc

SEQ ID NO: 6962355 - DNA, 22 bp, Homo sapiens
attcagtgtcttgatctgggaa

SEQ ID NO: 6962356 - DNA, 22 bp, Homo sapiens
gagccagagctacaagtgtctg

SEQ ID NO: 6962357 - DNA, 22 bp, Homo sapiens
cacggccactgcagcaccccag

SEQ ID NO: 6962358 - DNA, 22 bp, Homo sapiens
ttgtttgtaaggctcttagaat

SEQ ID NO: 6962359 - DNA, 22 bp, Homo sapiens
ttgcagcttctaccactgtttc

SEQ ID NO: 6962360 - DNA, 22 bp, Homo sapiens
atagcaaaaatgaacaaagctt

SEQ ID NO: 6962361 - DNA, 22 bp, Homo sapiens
tttgactcttaagtggctcaat

SEQ ID NO: 6962362 - DNA, 19 bp, Homo sapiens
tggctagaccgcggagcca

SEQ ID NO: 6962363 - DNA, 22 bp, Homo sapiens
aacaagatgggagaaggacctc

SEQ ID NO: 6962364 - DNA, 22 bp, Homo sapiens
gctgagccacaggcagtgcact

SEQ ID NO: 6962365 - DNA, 21 bp, Homo sapiens
tatagtgtggatatgctgatg

SEQ ID NO: 6962366 - DNA, 22 bp, Homo sapiens
cgaagacagaccatctgagtag

SEQ ID NO: 6962367 - DNA, 22 bp, Homo sapiens
gtcaccagtgctaagaggtgga

SEQ ID NO: 6962368 - DNA, 22 bp, Homo sapiens
cagctgcatgtctgtggtggtc

SEQ ID NO: 6962369 - DNA, 22 bp, Homo sapiens
actgtcatctggtagatgatgg

SEQ ID NO: 6962370 - DNA, 22 bp, Homo sapiens
cacttccgcacagtgagagcca

SEQ ID NO: 6962371 - DNA, 22 bp, Homo sapiens
tctggaagacagtgagcccgct

SEQ ID NO: 6962372 - DNA, 22 bp, Homo sapiens
tgttattatgtttccagagcct

SEQ ID NO: 6962373 - DNA, 20 bp, Homo sapiens
ttggatcttatgggaggggg

SEQ ID NO: 6962374 - DNA, 22 bp, Homo sapiens
tagcttccctagctaaagaggt

SEQ ID NO: 6962375 - DNA, 22 bp, Homo sapiens
cagatggaggataaaacatgca

SEQ ID NO: 6962376 - DNA, 22 bp, Homo sapiens
cgcatgtgcgttgattgcagtg

SEQ ID NO: 6962377 - DNA, 22 bp, Homo sapiens
agtaaaatcttaagcacagtgg

SEQ ID NO: 6962378 - DNA, 22 bp, Homo sapiens
actttttctcagaaggattggt

SEQ ID NO: 6962379 - DNA, 22 bp, Homo sapiens
tgttcaaaaatatcttctgcaa

SEQ ID NO: 6962380 - DNA, 22 bp, Homo sapiens
tagaggccctgctcaccctccc

SEQ ID NO: 6962381 - DNA, 23 bp, Homo sapiens
aagtagataacactgttctgaga

SEQ ID NO: 6962382 - DNA, 22 bp, Homo sapiens
tggcatgtagtaggtgctataa

SEQ ID NO: 6962383 - DNA, 22 bp, Homo sapiens
aaagcatgtgaatagaatatgg

SEQ ID NO: 6962384 - DNA, 22 bp, Homo sapiens
tgcccagagcctgagaggatta

SEQ ID NO: 6962385 - DNA, 22 bp, Homo sapiens
cagtagcatgtaataaagacag

SEQ ID NO: 6962386 - DNA, 22 bp, Homo sapiens
tctgaggttgaactttgcaaag

SEQ ID NO: 6962387 - DNA, 22 bp, Homo sapiens
tagtggcaaaagcattttgggt

SEQ ID NO: 6962388 - DNA, 22 bp, Homo sapiens
ttactgtagaagagaatgattc

SEQ ID NO: 6962389 - DNA, 22 bp, Homo sapiens
aggagccaaaagctgaacaaga

SEQ ID NO: 6962390 - DNA, 22 bp, Homo sapiens
atatacagtatgtactgtggtt

SEQ ID NO: 6962391 - DNA, 22 bp, Homo sapiens
ctggccaggttttgaacagttg

SEQ ID NO: 6962392 - DNA, 22 bp, Homo sapiens
ctcttcagttggtcactattct

SEQ ID NO: 6962393 - DNA, 22 bp, Homo sapiens
cttgctctttgatgaattttcc

SEQ ID NO: 6962394 - DNA, 22 bp, Homo sapiens
ctgggccttcattgctctccca

SEQ ID NO: 6962395 - DNA, 17 bp, Homo sapiens
cctggcattgttcctga

SEQ ID NO: 6962396 - DNA, 22 bp, Homo sapiens
gagtaacataccaaaattcaca

SEQ ID NO: 6962397 - DNA, 22 bp, Homo sapiens
ttaattcttccggactgtgaaa

SEQ ID NO: 6962398 - DNA, 22 bp, Homo sapiens
ctcctctttacccgcatggtct

SEQ ID NO: 6962399 - DNA, 22 bp, Homo sapiens
gagccctgtagcaagtcatgtc

SEQ ID NO: 6962400 - DNA, 22 bp, Homo sapiens
tcatcttcctcatttctccagg

SEQ ID NO: 6962401 - DNA, 22 bp, Homo sapiens
tgttggcactatctcatgtttt

SEQ ID NO: 6962402 - DNA, 22 bp, Homo sapiens
tgcacagatagtgatagatagc

SEQ ID NO: 6962403 - DNA, 22 bp, Homo sapiens
catattgctgtcattgtccctc

SEQ ID NO: 6962404 - DNA, 22 bp, Homo sapiens
agatttctgtcaccttctatgc

SEQ ID NO: 6962405 - DNA, 22 bp, Homo sapiens
ccaagattagaaaatttgagga

SEQ ID NO: 6962406 - DNA, 22 bp, Homo sapiens
cacctgagcactggggccgccc

SEQ ID NO: 6962407 - DNA, 22 bp, Homo sapiens
tctgttgtctgcaattctggga

SEQ ID NO: 6962408 - DNA, 22 bp, Homo sapiens
cctggcatctgagcctggcctg

SEQ ID NO: 6962409 - DNA, 22 bp, Homo sapiens
cattctcaatagtagatgagta

SEQ ID NO: 6962410 - DNA, 22 bp, Homo sapiens
tgtgcccttttgacagtgagag

SEQ ID NO: 6962411 - DNA, 22 bp, Homo sapiens
cttcagcagcctcttgcataaa

SEQ ID NO: 6962412 - DNA, 22 bp, Homo sapiens
atccttggatgtgtctttttgt

SEQ ID NO: 6962413 - DNA, 22 bp, Homo sapiens
tggcacaggatctcagcggcca

SEQ ID NO: 6962414 - DNA, 22 bp, Homo sapiens
tcagtggagagcttccaggatt

SEQ ID NO: 6962415 - DNA, 22 bp, Homo sapiens
caatttctctttatatctcaca

SEQ ID NO: 6962416 - DNA, 18 bp, Homo sapiens
agggccctggtggccatt

SEQ ID NO: 6962417 - DNA, 22 bp, Homo sapiens
ttcatgtagtgtaatgtcttca

SEQ ID NO: 6962418 - DNA, 22 bp, Homo sapiens
gtggccagtggtgggcgccctg

SEQ ID NO: 6962419 - DNA, 23 bp, Homo sapiens
gagcttagtctactcagacatcc

SEQ ID NO: 6962420 - DNA, 21 bp, Homo sapiens
tggagctgccacttgtcctcc

SEQ ID NO: 6962421 - DNA, 22 bp, Homo sapiens
ttaaggtagctcactaaatatg

SEQ ID NO: 6962422 - DNA, 22 bp, Homo sapiens
taaattcactcctggtagacct

SEQ ID NO: 6962423 - DNA, 22 bp, Homo sapiens
caggcttgagggcaggcccagt

SEQ ID NO: 6962424 - DNA, 22 bp, Homo sapiens
agagaacaaattaaaggtggtt

SEQ ID NO: 6962425 - DNA, 22 bp, Homo sapiens
ttgagagtctatcaaatagctt

SEQ ID NO: 6962426 - DNA, 22 bp, Homo sapiens
aagtgtgaattttagagtcagg

SEQ ID NO: 6962427 - DNA, 22 bp, Homo sapiens
atttccaggagaaaggatttta

SEQ ID NO: 6962428 - DNA, 22 bp, Homo sapiens
cattcattcagcaactgttatt

SEQ ID NO: 6962429 - DNA, 22 bp, Homo sapiens
tgtgccttccctctgctgattt

SEQ ID NO: 6962430 - DNA, 22 bp, Homo sapiens
tggagatgaatatgtgtacctg

SEQ ID NO: 6962431 - DNA, 22 bp, Homo sapiens
ttgtgtacaggtgtttccaagt

SEQ ID NO: 6962432 - DNA, 22 bp, Homo sapiens
ttctgagtctcctgtcgacagt

SEQ ID NO: 6962433 - DNA, 22 bp, Homo sapiens
tgcagtggtggtaaagatgctc

SEQ ID NO: 6962434 - DNA, 22 bp, Homo sapiens
ttctttaccagtgaaatgttat

SEQ ID NO: 6962435 - DNA, 22 bp, Homo sapiens
aagtttgtcgaaattatcagca

SEQ ID NO: 6962436 - DNA, 22 bp, Homo sapiens
attgactagagtcacagttgca

SEQ ID NO: 6962437 - DNA, 22 bp, Homo sapiens
agggcaagttgagtgtgcgtgg

SEQ ID NO: 6962438 - DNA, 22 bp, Homo sapiens
tattttgagcccctgacatcta

SEQ ID NO: 6962439 - DNA, 22 bp, Homo sapiens
aacctgaattacttttgcacca

SEQ ID NO: 6962440 - DNA, 22 bp, Homo sapiens
gtctggctcccactcttacaaa

SEQ ID NO: 6962441 - DNA, 22 bp, Homo sapiens
ctgctgtgcctcttttcacgtg

SEQ ID NO: 6962442 - DNA, 22 bp, Homo sapiens
aagctcttgaagaccaccagga

SEQ ID NO: 6962443 - DNA, 22 bp, Homo sapiens
cttgatggaggggccaggcttt

SEQ ID NO: 6962444 - DNA, 22 bp, Homo sapiens
ggtggagctatacgggatggct

SEQ ID NO: 6962445 - DNA, 20 bp, Homo sapiens
ttttagcacttgttatggtg

SEQ ID NO: 6962446 - DNA, 22 bp, Homo sapiens
ggtgttgtacattctgtggatt

SEQ ID NO: 6962447 - DNA, 22 bp, Homo sapiens
gctccgccacgcccactcctac

SEQ ID NO: 6962448 - DNA, 22 bp, Homo sapiens
tggcttctggccaggcacagga

SEQ ID NO: 6962449 - DNA, 22 bp, Homo sapiens
gtacattctaaactgtatgccc

SEQ ID NO: 6962450 - DNA, 22 bp, Homo sapiens
actggagcccgtggaggcgcag

SEQ ID NO: 6962451 - DNA, 22 bp, Homo sapiens
gagtccagttagtgaggctggg

SEQ ID NO: 6962452 - DNA, 22 bp, Homo sapiens
attacagagtcttgggaggtca

SEQ ID NO: 6962453 - DNA, 19 bp, Homo sapiens
ggctcaagcatccaggtag

SEQ ID NO: 6962454 - DNA, 22 bp, Homo sapiens
atgctggttgctaagcagcgat

SEQ ID NO: 6962455 - DNA, 22 bp, Homo sapiens
caacctgatgtgcatgccacgg

SEQ ID NO: 6962456 - DNA, 22 bp, Homo sapiens
cctggcaacatttcaaggtctt

SEQ ID NO: 6962457 - DNA, 22 bp, Homo sapiens
cagcacatctccaagaatttct

SEQ ID NO: 6962458 - DNA, 22 bp, Homo sapiens
gttgagtgttgtgcatgcacca

SEQ ID NO: 6962459 - DNA, 22 bp, Homo sapiens
acctgcctagttggttctgccc

SEQ ID NO: 6962460 - DNA, 22 bp, Homo sapiens
cagagacaccccagaaaataag

SEQ ID NO: 6962461 - DNA, 22 bp, Homo sapiens
ctgcccaccgtgtgcacgtgcg

SEQ ID NO: 6962462 - DNA, 22 bp, Homo sapiens
acctgcatgatgtctgaagcaa

SEQ ID NO: 6962463 - DNA, 22 bp, Homo sapiens
cggtcaggtgcagcgttggcac

SEQ ID NO: 6962464 - DNA, 22 bp, Homo sapiens
gcgcctgccaccatgccaggct

SEQ ID NO: 6962465 - DNA, 22 bp, Homo sapiens
tattaggtgtgtttataagacc

SEQ ID NO: 6962466 - DNA, 22 bp, Homo sapiens
cgcatccagggcgcaggatctg

SEQ ID NO: 6962467 - DNA, 22 bp, Homo sapiens
ctgtatctgtcagctggtctcg

SEQ ID NO: 6962468 - DNA, 16 bp, Homo sapiens
aaggagggaagagaat

SEQ ID NO: 6962469 - DNA, 22 bp, Homo sapiens
atctctgtgccatcattgcccc

SEQ ID NO: 6962470 - DNA, 22 bp, Homo sapiens
cgatggagaggtcctgatagtt

SEQ ID NO: 6962471 - DNA, 22 bp, Homo sapiens
ttcacatgttggacatagagga

SEQ ID NO: 6962472 - DNA, 22 bp, Homo sapiens
tagtaacccacacaacagtaga

SEQ ID NO: 6962473 - DNA, 22 bp, Homo sapiens
ttgtgcaaggctcttggaatgt

SEQ ID NO: 6962474 - DNA, 22 bp, Homo sapiens
gttgctgaaagccctgactggc

SEQ ID NO: 6962475 - DNA, 22 bp, Homo sapiens
ggtgaggggctcctctgcccgg

SEQ ID NO: 6962476 - DNA, 20 bp, Homo sapiens
cgtgtgtggctattttgggt

SEQ ID NO: 6962477 - DNA, 22 bp, Homo sapiens
caatcgtagttgaaatgaatct

SEQ ID NO: 6962478 - DNA, 22 bp, Homo sapiens
atataaagagcttagtatagtg

SEQ ID NO: 6962479 - DNA, 22 bp, Homo sapiens
tgaaacagtagtctgtgggttt

SEQ ID NO: 6962480 - DNA, 21 bp, Homo sapiens
gcccatgtgggaggggtagaa

SEQ ID NO: 6962481 - DNA, 22 bp, Homo sapiens
gctgagggcatgtgtggcgact

SEQ ID NO: 6962482 - DNA, 22 bp, Homo sapiens
aaggtctatgaggccagaacat

SEQ ID NO: 6962483 - DNA, 22 bp, Homo sapiens
aacagatgagagaattgaggct

SEQ ID NO: 6962484 - DNA, 20 bp, Homo sapiens
gccagaggccggcaggggct

SEQ ID NO: 6962485 - DNA, 22 bp, Homo sapiens
attcatatcatagagttattga

SEQ ID NO: 6962486 - DNA, 22 bp, Homo sapiens
gctttggagcctgtgttctgcc

SEQ ID NO: 6962487 - DNA, 22 bp, Homo sapiens
ttctttaaaatagtgagaaaga

SEQ ID NO: 6962488 - DNA, 22 bp, Homo sapiens
tccctgaggatggttgtattta

SEQ ID NO: 6962489 - DNA, 22 bp, Homo sapiens
caagactttggaggaatttgga

SEQ ID NO: 6962490 - DNA, 22 bp, Homo sapiens
tggcttcttgtttggtttaaga

SEQ ID NO: 6962491 - DNA, 22 bp, Homo sapiens
aggtgccacctctggtgctgtc

SEQ ID NO: 6962492 - DNA, 22 bp, Homo sapiens
taactcaaatatgttgtctgaa

SEQ ID NO: 6962493 - DNA, 22 bp, Homo sapiens
atgaagcagactcaggtggtgc

SEQ ID NO: 6962494 - DNA, 22 bp, Homo sapiens
tggctccattctttatgagttg

SEQ ID NO: 6962495 - DNA, 22 bp, Homo sapiens
tataactgagaagatacatagt

SEQ ID NO: 6962496 - DNA, 21 bp, Homo sapiens
gctggagagccaggcaggggc

SEQ ID NO: 6962497 - DNA, 18 bp, Homo sapiens
gaacttttggctttgtgt

SEQ ID NO: 6962498 - DNA, 22 bp, Homo sapiens
ccaggaggtgctggaagaaagc

SEQ ID NO: 6962499 - DNA, 22 bp, Homo sapiens
ctctaatcctttgtccctgggt

SEQ ID NO: 6962500 - DNA, 22 bp, Homo sapiens
tcagaggcatcattcatagtta

SEQ ID NO: 6962501 - DNA, 22 bp, Homo sapiens
agaacgctattcagaacactgg

SEQ ID NO: 6962502 - DNA, 22 bp, Homo sapiens
cactagtggccccatgtggttg

SEQ ID NO: 6962503 - DNA, 22 bp, Homo sapiens
gggtcttcatttattctacact

SEQ ID NO: 6962504 - DNA, 22 bp, Homo sapiens
cgggggagttgaggcacatggg

SEQ ID NO: 6962505 - DNA, 22 bp, Homo sapiens
taaatgcagttagtacttgcca

SEQ ID NO: 6962506 - DNA, 22 bp, Homo sapiens
gtctgtccatgagtagttccat

SEQ ID NO: 6962507 - DNA, 19 bp, Homo sapiens
gctgctctgggtctcatct

SEQ ID NO: 6962508 - DNA, 22 bp, Homo sapiens
ctggaggccactgtacagattg

SEQ ID NO: 6962509 - DNA, 22 bp, Homo sapiens
atggacagattaacacagtaga

SEQ ID NO: 6962510 - DNA, 22 bp, Homo sapiens
agagagggaatatttggggtat

SEQ ID NO: 6962511 - DNA, 22 bp, Homo sapiens
tgttggcattagagggttattg

SEQ ID NO: 6962512 - DNA, 22 bp, Homo sapiens
tttatatgtgaaggtttgcaga

SEQ ID NO: 6962513 - DNA, 22 bp, Homo sapiens
caagccagtgacagccagggaa

SEQ ID NO: 6962514 - DNA, 22 bp, Homo sapiens
aagtttctgttcatatctctga

SEQ ID NO: 6962515 - DNA, 22 bp, Homo sapiens
caaggggttcagaaagaggtga

SEQ ID NO: 6962516 - DNA, 22 bp, Homo sapiens
aggccactcagggggccaagat

SEQ ID NO: 6962517 - DNA, 22 bp, Homo sapiens
ttctctattacagaaatggaat

SEQ ID NO: 6962518 - DNA, 22 bp, Homo sapiens
caccctggaatagtagttctgc

SEQ ID NO: 6962519 - DNA, 22 bp, Homo sapiens
ccatgcaaagaatgtgggcata

SEQ ID NO: 6962520 - DNA, 22 bp, Homo sapiens
tggtatgtaaattgtaactcaa

SEQ ID NO: 6962521 - DNA, 22 bp, Homo sapiens
caaggctctgcttctatcacat

SEQ ID NO: 6962522 - DNA, 22 bp, Homo sapiens
agtcaccttgtttatgcccagg

SEQ ID NO: 6962523 - DNA, 22 bp, Homo sapiens
aggtgggcggattcatgaggtc

SEQ ID NO: 6962524 - DNA, 22 bp, Homo sapiens
catttccccctcatgttgcagc

SEQ ID NO: 6962525 - DNA, 22 bp, Homo sapiens
cctgtgccctctgcatagcagc

SEQ ID NO: 6962526 - DNA, 19 bp, Homo sapiens
ccagtcctctttgggcctg

SEQ ID NO: 6962527 - DNA, 22 bp, Homo sapiens
aaggccctggatggttttgaga

SEQ ID NO: 6962528 - DNA, 22 bp, Homo sapiens
gtattctcaggtggttcctcga

SEQ ID NO: 6962529 - DNA, 21 bp, Homo sapiens
acagctggtgcagggcgggga

SEQ ID NO: 6962530 - DNA, 22 bp, Homo sapiens
gcagcagctgacagtgggtgcc

SEQ ID NO: 6962531 - DNA, 22 bp, Homo sapiens
ggctggaagagactgaggacac

SEQ ID NO: 6962532 - DNA, 22 bp, Homo sapiens
tgtacagaaattcctactacat

SEQ ID NO: 6962533 - DNA, 22 bp, Homo sapiens
tgagatggagtcttgctctgtt

SEQ ID NO: 6962534 - DNA, 22 bp, Homo sapiens
actctaaatagataaccatgca

SEQ ID NO: 6962535 - DNA, 22 bp, Homo sapiens
agatcccaggatactggcctat

SEQ ID NO: 6962536 - DNA, 22 bp, Homo sapiens
cctggctgcccatggaccctct

SEQ ID NO: 6962537 - DNA, 22 bp, Homo sapiens
tgtaaacatatgtatgtatgta

SEQ ID NO: 6962538 - DNA, 22 bp, Homo sapiens
ttcttgtctttgttatgtagga

SEQ ID NO: 6962539 - DNA, 22 bp, Homo sapiens
ttctcagacttccagcaccagc

SEQ ID NO: 6962540 - DNA, 22 bp, Homo sapiens
gatgcattacaaaagtgattat

SEQ ID NO: 6962541 - DNA, 22 bp, Homo sapiens
catggcagcaattttcctgact

SEQ ID NO: 6962542 - DNA, 22 bp, Homo sapiens
atcatctgcctcatcactgcat

SEQ ID NO: 6962543 - DNA, 22 bp, Homo sapiens
tctacaagtttaattccactta

SEQ ID NO: 6962544 - DNA, 22 bp, Homo sapiens
gtccagcccgggctccgccagc

SEQ ID NO: 6962545 - DNA, 22 bp, Homo sapiens
gggcccttcagcttcctctgca

SEQ ID NO: 6962546 - DNA, 22 bp, Homo sapiens
gtgcataatttggcaatagaat

SEQ ID NO: 6962547 - DNA, 19 bp, Homo sapiens
gcttttattgctcaggtgc

SEQ ID NO: 6962548 - DNA, 22 bp, Homo sapiens
ggtgctgatttgttgctgagat

SEQ ID NO: 6962549 - DNA, 23 bp, Homo sapiens
ggttagggaatgatctcaggcat

SEQ ID NO: 6962550 - DNA, 22 bp, Homo sapiens
cgatggttctggctgcttgtat

SEQ ID NO: 6962551 - DNA, 22 bp, Homo sapiens
tgtagaaactacacatgcaaca

SEQ ID NO: 6962552 - DNA, 22 bp, Homo sapiens
ggtcctggcagctctgtgtcca

SEQ ID NO: 6962553 - DNA, 22 bp, Homo sapiens
tgatggaatggaggacatgtgg

SEQ ID NO: 6962554 - DNA, 22 bp, Homo sapiens
gactttattactaaccctgtga

SEQ ID NO: 6962555 - DNA, 22 bp, Homo sapiens
ggagcagtggtcattcagctgg

SEQ ID NO: 6962556 - DNA, 22 bp, Homo sapiens
agggacttgatgtcagggagat

SEQ ID NO: 6962557 - DNA, 22 bp, Homo sapiens
gctgcctgtctgtttcttttat

SEQ ID NO: 6962558 - DNA, 21 bp, Homo sapiens
tggcaatggccaacagtcatc

SEQ ID NO: 6962559 - DNA, 22 bp, Homo sapiens
tgggcctctgggttagtcccta

SEQ ID NO: 6962560 - DNA, 23 bp, Homo sapiens
tctttcctcagcacacaccaaga

SEQ ID NO: 6962561 - DNA, 22 bp, Homo sapiens
tttcagaaagcatcatcaaagt

SEQ ID NO: 6962562 - DNA, 23 bp, Homo sapiens
agtttctttgagacttgccctgt

SEQ ID NO: 6962563 - DNA, 23 bp, Homo sapiens
taggtgtctagtgtccactatgt

SEQ ID NO: 6962564 - DNA, 22 bp, Homo sapiens
gaacccaggaggttgcagtgag

SEQ ID NO: 6962565 - DNA, 22 bp, Homo sapiens
gagtaaggctgctgatggagtg

SEQ ID NO: 6962566 - DNA, 22 bp, Homo sapiens
gccgtgcgtgcgcaggtgctgt

SEQ ID NO: 6962567 - DNA, 22 bp, Homo sapiens
cagtttctctcatacatatttg

SEQ ID NO: 6962568 - DNA, 22 bp, Homo sapiens
tacagtagtcgtcttattttga

SEQ ID NO: 6962569 - DNA, 22 bp, Homo sapiens
atttgcttcctaatactcatat

SEQ ID NO: 6962570 - DNA, 22 bp, Homo sapiens
cacagctgaagtagccatgtgg

SEQ ID NO: 6962571 - DNA, 22 bp, Homo sapiens
tcaattcaacacatgcacattg

SEQ ID NO: 6962572 - DNA, 22 bp, Homo sapiens
gaccacagagcacggcctgctt

SEQ ID NO: 6962573 - DNA, 22 bp, Homo sapiens
tgatggcttagtggcagggcga

SEQ ID NO: 6962574 - DNA, 22 bp, Homo sapiens
gagaggtagaggctctgcttaa

SEQ ID NO: 6962575 - DNA, 22 bp, Homo sapiens
ttcttggatgccctcatgcctt

SEQ ID NO: 6962576 - DNA, 20 bp, Homo sapiens
ttgtcagattttgcttgatg

SEQ ID NO: 6962577 - DNA, 22 bp, Homo sapiens
ctcactgcaacctccgcctcct

SEQ ID NO: 6962578 - DNA, 22 bp, Homo sapiens
agtttcctgggagattcttaca

SEQ ID NO: 6962579 - DNA, 22 bp, Homo sapiens
tgtttgagttctagcgcattta

SEQ ID NO: 6962580 - DNA, 22 bp, Homo sapiens
tcctctggatataagcctcacc

SEQ ID NO: 6962581 - DNA, 22 bp, Homo sapiens
cattgcactccaccctaggcaa

SEQ ID NO: 6962582 - DNA, 22 bp, Homo sapiens
cacatttacatataaaactttc

SEQ ID NO: 6962583 - DNA, 22 bp, Homo sapiens
tctttggaaaaaatggacaatc

SEQ ID NO: 6962584 - DNA, 22 bp, Homo sapiens
ctgagcagcaacccagagcctc

SEQ ID NO: 6962585 - DNA, 22 bp, Homo sapiens
tagcttccagaatttaatgtca

SEQ ID NO: 6962586 - DNA, 22 bp, Homo sapiens
actggcttcaaaccgtttcacc

SEQ ID NO: 6962587 - DNA, 22 bp, Homo sapiens
taagtttgacttttggctctgc

SEQ ID NO: 6962588 - DNA, 22 bp, Homo sapiens
atgttttgctggatgttggcta

SEQ ID NO: 6962589 - DNA, 19 bp, Homo sapiens
ctgtggagcaagaaaagat

SEQ ID NO: 6962590 - DNA, 20 bp, Homo sapiens
ctgctgtgtgtgcctcagcc

SEQ ID NO: 6962591 - DNA, 22 bp, Homo sapiens
gtttctcagcaactatatgact

SEQ ID NO: 6962592 - DNA, 22 bp, Homo sapiens
cagtggttcctgttcttctggg

SEQ ID NO: 6962593 - DNA, 22 bp, Homo sapiens
ctgctgtgattgggagaaaccg

SEQ ID NO: 6962594 - DNA, 22 bp, Homo sapiens
cctctcatcattatcgctttgt

SEQ ID NO: 6962595 - DNA, 22 bp, Homo sapiens
taagaagggtacaataaggcat

SEQ ID NO: 6962596 - DNA, 22 bp, Homo sapiens
ctggcagcatggagcctgtgct

SEQ ID NO: 6962597 - DNA, 22 bp, Homo sapiens
agccagtcagccatgcttacct

SEQ ID NO: 6962598 - DNA, 22 bp, Homo sapiens
taaggcttggggaaaagtgagg

SEQ ID NO: 6962599 - DNA, 22 bp, Homo sapiens
accgaagacactggtggttaag

SEQ ID NO: 6962600 - DNA, 22 bp, Homo sapiens
aatttattcccgtctctgggct

SEQ ID NO: 6962601 - DNA, 22 bp, Homo sapiens
caacattcttatcactataagc

SEQ ID NO: 6962602 - DNA, 22 bp, Homo sapiens
ttctgtgaggacttctcaagga

SEQ ID NO: 6962603 - DNA, 22 bp, Homo sapiens
agctggctcagccgggtggtct

SEQ ID NO: 6962604 - DNA, 22 bp, Homo sapiens
cctggtgccggtagacgcgcag

SEQ ID NO: 6962605 - DNA, 20 bp, Homo sapiens
tccagggcaactagagtgtg

SEQ ID NO: 6962606 - DNA, 22 bp, Homo sapiens
caacatgtctgatctctgtgaa

SEQ ID NO: 6962607 - DNA, 22 bp, Homo sapiens
tggcaattatatttttggctga

SEQ ID NO: 6962608 - DNA, 22 bp, Homo sapiens
aaaatcctctaattctagaata

SEQ ID NO: 6962609 - DNA, 22 bp, Homo sapiens
ccctggaaatgaggcatgtgcg

SEQ ID NO: 6962610 - DNA, 22 bp, Homo sapiens
gctcatctggggctttcagctt

SEQ ID NO: 6962611 - DNA, 22 bp, Homo sapiens
atgaaccttgatttgttcatct

SEQ ID NO: 6962612 - DNA, 22 bp, Homo sapiens
aggctcagttcacgtcaacttt

SEQ ID NO: 6962613 - DNA, 22 bp, Homo sapiens
gcaggcggatcactggaagtca

SEQ ID NO: 6962614 - DNA, 22 bp, Homo sapiens
actctgctccctaagccatgat

SEQ ID NO: 6962615 - DNA, 22 bp, Homo sapiens
gagcccagggtgaaatagcagc

SEQ ID NO: 6962616 - DNA, 22 bp, Homo sapiens
tcctggggctcatgggatttgt

SEQ ID NO: 6962617 - DNA, 22 bp, Homo sapiens
actgtggggtgaggcccaagaa

SEQ ID NO: 6962618 - DNA, 22 bp, Homo sapiens
attgtcttctggtcttatcttt

SEQ ID NO: 6962619 - DNA, 20 bp, Homo sapiens
ttcttctctagttatcttca

SEQ ID NO: 6962620 - DNA, 22 bp, Homo sapiens
ttgattgtactccaagtacctg

SEQ ID NO: 6962621 - DNA, 22 bp, Homo sapiens
aggaggggcaatgatagtctgg

SEQ ID NO: 6962622 - DNA, 22 bp, Homo sapiens
aagagcttcctctttcattgct

SEQ ID NO: 6962623 - DNA, 22 bp, Homo sapiens
catgcagcggcgtttggtttaa

SEQ ID NO: 6962624 - DNA, 22 bp, Homo sapiens
agaaatcacaggaggcagaagg

SEQ ID NO: 6962625 - DNA, 22 bp, Homo sapiens
ctctgggactagaaccccaggg

SEQ ID NO: 6962626 - DNA, 22 bp, Homo sapiens
ttcttagttcaactaaaattta

SEQ ID NO: 6962627 - DNA, 22 bp, Homo sapiens
gtttcacaagcaacgggtaagg

SEQ ID NO: 6962628 - DNA, 22 bp, Homo sapiens
tgaattagcagtagacagactg

SEQ ID NO: 6962629 - DNA, 22 bp, Homo sapiens
tgctatttttatcttgatcaaa

SEQ ID NO: 6962630 - DNA, 22 bp, Homo sapiens
ggcttcatggacaaaagcctca

SEQ ID NO: 6962631 - DNA, 22 bp, Homo sapiens
tctgtggcccaagtgatggctg

SEQ ID NO: 6962632 - DNA, 22 bp, Homo sapiens
tgactctggggttgaccagatg

SEQ ID NO: 6962633 - DNA, 22 bp, Homo sapiens
cctcttaattgtactccttcag

SEQ ID NO: 6962634 - DNA, 22 bp, Homo sapiens
gcagagaagatgcccaggcttc

SEQ ID NO: 6962635 - DNA, 21 bp, Homo sapiens
gtgaagactttgcctttaaga

SEQ ID NO: 6962636 - DNA, 22 bp, Homo sapiens
atggccagagaaggcagggtca

SEQ ID NO: 6962637 - DNA, 22 bp, Homo sapiens
ccagggctctatgagggtggag

SEQ ID NO: 6962638 - DNA, 22 bp, Homo sapiens
ttctgtggttgaaaggagagat

SEQ ID NO: 6962639 - DNA, 22 bp, Homo sapiens
ttgggcctggggtagtgtcgga

SEQ ID NO: 6962640 - DNA, 22 bp, Homo sapiens
tgcaggaacttggttttactca

SEQ ID NO: 6962641 - DNA, 22 bp, Homo sapiens
catattctgttggtcacataga

SEQ ID NO: 6962642 - DNA, 22 bp, Homo sapiens
tcagatattcaattaagttaaa

SEQ ID NO: 6962643 - DNA, 22 bp, Homo sapiens
tgaggctctgcttctgtggctc

SEQ ID NO: 6962644 - DNA, 22 bp, Homo sapiens
attgtcttggcattcaaattag

SEQ ID NO: 6962645 - DNA, 22 bp, Homo sapiens
tgtggacagtgatccctagtca

SEQ ID NO: 6962646 - DNA, 22 bp, Homo sapiens
ggcctccatcttatcttactct

SEQ ID NO: 6962647 - DNA, 22 bp, Homo sapiens
ccttgggtgtttaatagatata

SEQ ID NO: 6962648 - DNA, 22 bp, Homo sapiens
ggctctgcccgcggctgcccac

SEQ ID NO: 6962649 - DNA, 22 bp, Homo sapiens
tgtttacatggaggttttcagc

SEQ ID NO: 6962650 - DNA, 22 bp, Homo sapiens
tatttcagggggtacaagaaga

SEQ ID NO: 6962651 - DNA, 22 bp, Homo sapiens
acagtatgaatgtctgaaaaat

SEQ ID NO: 6962652 - DNA, 22 bp, Homo sapiens
cattgttggcagagggacagag

SEQ ID NO: 6962653 - DNA, 22 bp, Homo sapiens
tttagtagaatgatacagggca

SEQ ID NO: 6962654 - DNA, 22 bp, Homo sapiens
gctctgagtgatcagctgggaa

SEQ ID NO: 6962655 - DNA, 22 bp, Homo sapiens
gtcaccagcaccaatgccacat

SEQ ID NO: 6962656 - DNA, 22 bp, Homo sapiens
atggcagcctgtggacagtcaa

SEQ ID NO: 6962657 - DNA, 22 bp, Homo sapiens
aagactgaatttgcatagttgg

SEQ ID NO: 6962658 - DNA, 22 bp, Homo sapiens
catattagacacttatgtccac

SEQ ID NO: 6962659 - DNA, 22 bp, Homo sapiens
gaggagctgggaccctgtcatc

SEQ ID NO: 6962660 - DNA, 18 bp, Homo sapiens
ggttttggcatgtgtgcc

SEQ ID NO: 6962661 - DNA, 22 bp, Homo sapiens
gtggaggaagggattcagacca

SEQ ID NO: 6962662 - DNA, 22 bp, Homo sapiens
aacatttgcatgctttattaga

SEQ ID NO: 6962663 - DNA, 20 bp, Homo sapiens
tggctctctctagtaagtgg

SEQ ID NO: 6962664 - DNA, 22 bp, Homo sapiens
ctaaacatgttggtgctttaaa

SEQ ID NO: 6962665 - DNA, 21 bp, Homo sapiens
tttctgtctctgccactagtt

SEQ ID NO: 6962666 - DNA, 22 bp, Homo sapiens
aaacattgctaaataatgctgc

SEQ ID NO: 6962667 - DNA, 22 bp, Homo sapiens
tctgttgcaatgtgcatggtga

SEQ ID NO: 6962668 - DNA, 22 bp, Homo sapiens
cccacaggacgggctaaagagt

SEQ ID NO: 6962669 - DNA, 22 bp, Homo sapiens
aaggtgtgaagagatgggaaga

SEQ ID NO: 6962670 - DNA, 22 bp, Homo sapiens
tgcagagtgaggaagaactgca

SEQ ID NO: 6962671 - DNA, 22 bp, Homo sapiens
agggctgagtgggagagagttg

SEQ ID NO: 6962672 - DNA, 22 bp, Homo sapiens
ttattgaaggaactgaaataaa

SEQ ID NO: 6962673 - DNA, 21 bp, Homo sapiens
tcaggctgatgtcgatgttag

SEQ ID NO: 6962674 - DNA, 22 bp, Homo sapiens
gctcagaagatatttgatgctg

SEQ ID NO: 6962675 - DNA, 22 bp, Homo sapiens
tgtctctgtctcccaggttgtg

SEQ ID NO: 6962676 - DNA, 22 bp, Homo sapiens
cctggattggctgcccatgctc

SEQ ID NO: 6962677 - DNA, 22 bp, Homo sapiens
actgtatttttgaatcattgtg

SEQ ID NO: 6962678 - DNA, 22 bp, Homo sapiens
aatgccattgatttatatactt

SEQ ID NO: 6962679 - DNA, 22 bp, Homo sapiens
gttggtcaaggacagaggttca

SEQ ID NO: 6962680 - DNA, 22 bp, Homo sapiens
ttcttctacctctgagacttgt

SEQ ID NO: 6962681 - DNA, 22 bp, Homo sapiens
gagagaacacaaagggccagct

SEQ ID NO: 6962682 - DNA, 22 bp, Homo sapiens
gcatatcagcatcaaaacacag

SEQ ID NO: 6962683 - DNA, 22 bp, Homo sapiens
attgtctaattgacttggtgtg

SEQ ID NO: 6962684 - DNA, 22 bp, Homo sapiens
gacagccatgcacttctgctgt

SEQ ID NO: 6962685 - DNA, 22 bp, Homo sapiens
tcaaagaacatcatctgaaatg

SEQ ID NO: 6962686 - DNA, 22 bp, Homo sapiens
cagatgctgcctgggaatgtct

SEQ ID NO: 6962687 - DNA, 21 bp, Homo sapiens
tgcagctgacactggtatgcc

SEQ ID NO: 6962688 - DNA, 22 bp, Homo sapiens
tgcaagagcagaaagaactgag

SEQ ID NO: 6962689 - DNA, 22 bp, Homo sapiens
tagactttccagcctgctgctt

SEQ ID NO: 6962690 - DNA, 22 bp, Homo sapiens
atccaggcgaatgcagaaggcc

SEQ ID NO: 6962691 - DNA, 22 bp, Homo sapiens
tagcagctggggctattcatca

SEQ ID NO: 6962692 - DNA, 20 bp, Homo sapiens
aaagagaagcctcaccttgt

SEQ ID NO: 6962693 - DNA, 22 bp, Homo sapiens
aagatttctgctcctgagagaa

SEQ ID NO: 6962694 - DNA, 22 bp, Homo sapiens
gaagcagctaggatcttcattt

SEQ ID NO: 6962695 - DNA, 22 bp, Homo sapiens
tgccaaatattctctacgtgct

SEQ ID NO: 6962696 - DNA, 22 bp, Homo sapiens
tgtttaagatccgtcagtcact

SEQ ID NO: 6962697 - DNA, 23 bp, Homo sapiens
tgggcagcttctgcatgcccacc

SEQ ID NO: 6962698 - DNA, 22 bp, Homo sapiens
cctctcctggctgtaggacctc

SEQ ID NO: 6962699 - DNA, 22 bp, Homo sapiens
gagtacatgtatagagattaac

SEQ ID NO: 6962700 - DNA, 22 bp, Homo sapiens
ttcaggaggtgagcaagaaggg

SEQ ID NO: 6962701 - DNA, 22 bp, Homo sapiens
agctgctgagagtctgccgggc

SEQ ID NO: 6962702 - DNA, 22 bp, Homo sapiens
tttagcatatttaaggaatgat

SEQ ID NO: 6962703 - DNA, 22 bp, Homo sapiens
ccctctcagtcagagccagata

SEQ ID NO: 6962704 - DNA, 22 bp, Homo sapiens
ctctgacttatcggagaagtcc

SEQ ID NO: 6962705 - DNA, 22 bp, Homo sapiens
ttagagaaagggtttgattccg

SEQ ID NO: 6962706 - DNA, 22 bp, Homo sapiens
agaatacttgggaatgggttaa

SEQ ID NO: 6962707 - DNA, 22 bp, Homo sapiens
tgctgtgacgcctcaggaatcc

SEQ ID NO: 6962708 - DNA, 22 bp, Homo sapiens
cctcctgttgtcctgctggggc

SEQ ID NO: 6962709 - DNA, 22 bp, Homo sapiens
attagctgtgaagaagatgctt

SEQ ID NO: 6962710 - DNA, 22 bp, Homo sapiens
tctgtggcttcctatttcttgg

SEQ ID NO: 6962711 - DNA, 22 bp, Homo sapiens
gtggactggcagtgaccttggt

SEQ ID NO: 6962712 - DNA, 22 bp, Homo sapiens
taaaaagtagtgagaatggcgc

SEQ ID NO: 6962713 - DNA, 19 bp, Homo sapiens
aggctgcccagtctctgcc

SEQ ID NO: 6962714 - DNA, 22 bp, Homo sapiens
tgaggcaagagtttgattagag

SEQ ID NO: 6962715 - DNA, 22 bp, Homo sapiens
tgtggacttgaaattacttttc

SEQ ID NO: 6962716 - DNA, 22 bp, Homo sapiens
aaatgatgttataagaccagga

SEQ ID NO: 6962717 - DNA, 22 bp, Homo sapiens
gaatatctgtctggttgaggaa

SEQ ID NO: 6962718 - DNA, 22 bp, Homo sapiens
ttcttctctcatagattaaggt

SEQ ID NO: 6962719 - DNA, 22 bp, Homo sapiens
agccccacactctctctgagaa

SEQ ID NO: 6962720 - DNA, 23 bp, Homo sapiens
tcatcaaaggaagtacgtgtcac

SEQ ID NO: 6962721 - DNA, 22 bp, Homo sapiens
atgatgttattttcagaaacat

SEQ ID NO: 6962722 - DNA, 20 bp, Homo sapiens
tagatcctggggatttattg

SEQ ID NO: 6962723 - DNA, 22 bp, Homo sapiens
tgtctgtacaaattttctgtgt

SEQ ID NO: 6962724 - DNA, 19 bp, Homo sapiens
tgccttggctgccaggaaa

SEQ ID NO: 6962725 - DNA, 22 bp, Homo sapiens
cctggcagtcaggggagtcctt

SEQ ID NO: 6962726 - DNA, 22 bp, Homo sapiens
tattgggcagacatcaggctta

SEQ ID NO: 6962727 - DNA, 22 bp, Homo sapiens
tgctttatctgtgagaacctga

SEQ ID NO: 6962728 - DNA, 17 bp, Homo sapiens
aggagtctcagatgagc

SEQ ID NO: 6962729 - DNA, 22 bp, Homo sapiens
tgaggaaaacgtattgaaagga

SEQ ID NO: 6962730 - DNA, 22 bp, Homo sapiens
agtgcttggcaaccttctgacc

SEQ ID NO: 6962731 - DNA, 22 bp, Homo sapiens
cagccctgcagctggatctcac

SEQ ID NO: 6962732 - DNA, 22 bp, Homo sapiens
aacagtttgggtaggtatgtag

SEQ ID NO: 6962733 - DNA, 22 bp, Homo sapiens
agctgcaggtggacccgtaccg

SEQ ID NO: 6962734 - DNA, 22 bp, Homo sapiens
ttcaggcctaatttctagcccc

SEQ ID NO: 6962735 - DNA, 22 bp, Homo sapiens
tttgggttccttgagcttaatg

SEQ ID NO: 6962736 - DNA, 22 bp, Homo sapiens
atgtatgtaggatgggccagtg

SEQ ID NO: 6962737 - DNA, 22 bp, Homo sapiens
cgggtgtttctctttccctggc

SEQ ID NO: 6962738 - DNA, 22 bp, Homo sapiens
cagcagtgtggaagctgagggg

SEQ ID NO: 6962739 - DNA, 22 bp, Homo sapiens
acaggagttaaggctgagttga

SEQ ID NO: 6962740 - DNA, 19 bp, Homo sapiens
ctaagtctgtcaaggaatt

SEQ ID NO: 6962741 - DNA, 19 bp, Homo sapiens
accaaacagtggacggagc

SEQ ID NO: 6962742 - DNA, 22 bp, Homo sapiens
actggcaggctgctggccggcg

SEQ ID NO: 6962743 - DNA, 22 bp, Homo sapiens
agtggtgataaccactatcata

SEQ ID NO: 6962744 - DNA, 22 bp, Homo sapiens
agctcctgcttgacagaagagg

SEQ ID NO: 6962745 - DNA, 22 bp, Homo sapiens
aagtgtttattgattggtctag

SEQ ID NO: 6962746 - DNA, 22 bp, Homo sapiens
caagcaggtttgctattttctt

SEQ ID NO: 6962747 - DNA, 22 bp, Homo sapiens
tacatgaaataggattctggag

SEQ ID NO: 6962748 - DNA, 22 bp, Homo sapiens
gggctctgtgcaccccagcacc

SEQ ID NO: 6962749 - DNA, 22 bp, Homo sapiens
tgccagcgtgaagctgggcccc

SEQ ID NO: 6962750 - DNA, 22 bp, Homo sapiens
atgcaatgttcctttcttcacc

SEQ ID NO: 6962751 - DNA, 22 bp, Homo sapiens
gccagagagactgatacatgct

SEQ ID NO: 6962752 - DNA, 22 bp, Homo sapiens
agaaaggattagtttggtataa

SEQ ID NO: 6962753 - DNA, 23 bp, Homo sapiens
ggctcctgcttcatgtcccacct

SEQ ID NO: 6962754 - DNA, 22 bp, Homo sapiens
ggcaaggaagaagccatgatgt

SEQ ID NO: 6962755 - DNA, 22 bp, Homo sapiens
taggtaccaaggagtcactgga

SEQ ID NO: 6962756 - DNA, 22 bp, Homo sapiens
tcagtgtccttcgttcttgttg

SEQ ID NO: 6962757 - DNA, 22 bp, Homo sapiens
ctgcccacacctgagctgggcc

SEQ ID NO: 6962758 - DNA, 22 bp, Homo sapiens
aaggctttgtgctgagttgtcg

SEQ ID NO: 6962759 - DNA, 22 bp, Homo sapiens
agagttaagtgaaatgtaataa

SEQ ID NO: 6962760 - DNA, 22 bp, Homo sapiens
gcagttgcaggatttgtgttgt

SEQ ID NO: 6962761 - DNA, 19 bp, Homo sapiens
tattggtatgtgtgaggca

SEQ ID NO: 6962762 - DNA, 22 bp, Homo sapiens
tttagttttaactgaaagctat

SEQ ID NO: 6962763 - DNA, 20 bp, Homo sapiens
tagagagaggatattaaagt

SEQ ID NO: 6962764 - DNA, 22 bp, Homo sapiens
caattacttttgcaccaatata

SEQ ID NO: 6962765 - DNA, 22 bp, Homo sapiens
tttcagctttaccattccatga

SEQ ID NO: 6962766 - DNA, 22 bp, Homo sapiens
atgaattgaaagaagaatatct

SEQ ID NO: 6962767 - DNA, 22 bp, Homo sapiens
tgctgaatggtaaagaagtata

SEQ ID NO: 6962768 - DNA, 17 bp, Homo sapiens
tgcttataaactctgct

SEQ ID NO: 6962769 - DNA, 23 bp, Homo sapiens
gctgaagagcaaaccaggcaaaa

SEQ ID NO: 6962770 - DNA, 22 bp, Homo sapiens
gacagcttgcctggtactgcaa

SEQ ID NO: 6962771 - DNA, 22 bp, Homo sapiens
aatactagctgcatttaaaggt

SEQ ID NO: 6962772 - DNA, 22 bp, Homo sapiens
acagtagattggtatgatgtca

SEQ ID NO: 6962773 - DNA, 22 bp, Homo sapiens
gaggcagtttgccatgccagga

SEQ ID NO: 6962774 - DNA, 22 bp, Homo sapiens
agggcacttcctctgggtccct

SEQ ID NO: 6962775 - DNA, 22 bp, Homo sapiens
cctgggcaggatgggcccggtg

SEQ ID NO: 6962776 - DNA, 22 bp, Homo sapiens
ttctctaagctggctgaggtct

SEQ ID NO: 6962777 - DNA, 22 bp, Homo sapiens
gtttccatggctctgttaatgg

SEQ ID NO: 6962778 - DNA, 22 bp, Homo sapiens
cccatcaggaacccaggagccc

SEQ ID NO: 6962779 - DNA, 22 bp, Homo sapiens
atcatgtacttgacaaatatgt

SEQ ID NO: 6962780 - DNA, 22 bp, Homo sapiens
cagggagctctgggccggactc

SEQ ID NO: 6962781 - DNA, 22 bp, Homo sapiens
atttgggagttgctagtgagtt

SEQ ID NO: 6962782 - DNA, 22 bp, Homo sapiens
ttctgaatcctcgaaacatagc

SEQ ID NO: 6962783 - DNA, 22 bp, Homo sapiens
aggctccaggcaatgtttctga

SEQ ID NO: 6962784 - DNA, 22 bp, Homo sapiens
gacaggtatttgagagctggga

SEQ ID NO: 6962785 - DNA, 22 bp, Homo sapiens
gcagggacgcagcactctccgt

SEQ ID NO: 6962786 - DNA, 22 bp, Homo sapiens
cctagggaccaggatccccacc

SEQ ID NO: 6962787 - DNA, 22 bp, Homo sapiens
tgcaagaaatgtgaagctacaa

SEQ ID NO: 6962788 - DNA, 22 bp, Homo sapiens
ttgtgctgcgtaggacgtggac

SEQ ID NO: 6962789 - DNA, 20 bp, Homo sapiens
acctgtggtgctgatgacag

SEQ ID NO: 6962790 - DNA, 22 bp, Homo sapiens
tgttcagagacagaaattctaa

SEQ ID NO: 6962791 - DNA, 22 bp, Homo sapiens
agaggctctgccgcctcaggta

SEQ ID NO: 6962792 - DNA, 22 bp, Homo sapiens
attgtcgtcaatggacacatag

SEQ ID NO: 6962793 - DNA, 22 bp, Homo sapiens
gcaggtgtcttcatggaactct

SEQ ID NO: 6962794 - DNA, 22 bp, Homo sapiens
ttggaagattctgtgtctggtg

SEQ ID NO: 6962795 - DNA, 22 bp, Homo sapiens
tcatttacttctatgacaacat

SEQ ID NO: 6962796 - DNA, 22 bp, Homo sapiens
aggaggtgctgtttgtcctgga

SEQ ID NO: 6962797 - DNA, 22 bp, Homo sapiens
ctccagtgcactggtcttttca

SEQ ID NO: 6962798 - DNA, 22 bp, Homo sapiens
tagctaccattattgagcacct

SEQ ID NO: 6962799 - DNA, 22 bp, Homo sapiens
gcatttttctaatcattggcat

SEQ ID NO: 6962800 - DNA, 22 bp, Homo sapiens
aggtgcacctgagggtgtcatc

SEQ ID NO: 6962801 - DNA, 22 bp, Homo sapiens
tgagatggagttttggggatat

SEQ ID NO: 6962802 - DNA, 22 bp, Homo sapiens
gccagaaacatacacatcactt

SEQ ID NO: 6962803 - DNA, 22 bp, Homo sapiens
catcccctgatgctcttgagta

SEQ ID NO: 6962804 - DNA, 22 bp, Homo sapiens
gacaaataggtcaacaggaggg

SEQ ID NO: 6962805 - DNA, 20 bp, Homo sapiens
tctttagatttatcttatgt

SEQ ID NO: 6962806 - DNA, 23 bp, Homo sapiens
ggcttcttgcctgtcttggtgct

SEQ ID NO: 6962807 - DNA, 22 bp, Homo sapiens
tataaaacagaaagcactacct

SEQ ID NO: 6962808 - DNA, 22 bp, Homo sapiens
aacttcagagctgtgtggtttg

SEQ ID NO: 6962809 - DNA, 22 bp, Homo sapiens
actctgactggagtgagagagg

SEQ ID NO: 6962810 - DNA, 22 bp, Homo sapiens
tatcaggaggaaatttccattg

SEQ ID NO: 6962811 - DNA, 22 bp, Homo sapiens
ttgtatgtaccacaggtggtgg

SEQ ID NO: 6962812 - DNA, 19 bp, Homo sapiens
tcacagtgcagaaccctcc

SEQ ID NO: 6962813 - DNA, 22 bp, Homo sapiens
gcaggaacagggcttcaagctt

SEQ ID NO: 6962814 - DNA, 22 bp, Homo sapiens
atgcttccaatattctcccttt

SEQ ID NO: 6962815 - DNA, 22 bp, Homo sapiens
tggcaagagggatgcaaggttt

SEQ ID NO: 6962816 - DNA, 22 bp, Homo sapiens
gatggcagtcaaccaggtgagg

SEQ ID NO: 6962817 - DNA, 20 bp, Homo sapiens
gcatgtgtatggaaggggga

SEQ ID NO: 6962818 - DNA, 22 bp, Homo sapiens
aatagaatttaaatgcagtggc

SEQ ID NO: 6962819 - DNA, 22 bp, Homo sapiens
cccaccctgggctacacatcca

SEQ ID NO: 6962820 - DNA, 22 bp, Homo sapiens
aatgggttgtagggaaagtcaa

SEQ ID NO: 6962821 - DNA, 22 bp, Homo sapiens
cctccctggtggctctggtcta

SEQ ID NO: 6962822 - DNA, 20 bp, Homo sapiens
tctctgagcttctcttgggg

SEQ ID NO: 6962823 - DNA, 22 bp, Homo sapiens
gcaaggctgctgccacccatct

SEQ ID NO: 6962824 - DNA, 22 bp, Homo sapiens
gcttagctagatgaaatgccca

SEQ ID NO: 6962825 - DNA, 22 bp, Homo sapiens
taaatgtgtctatggacccgcc

SEQ ID NO: 6962826 - DNA, 22 bp, Homo sapiens
tctgatgagggaaagtcttatg

SEQ ID NO: 6962827 - DNA, 17 bp, Homo sapiens
gcatgtagtacatgtaa

SEQ ID NO: 6962828 - DNA, 22 bp, Homo sapiens
tcttagtcacagaggtgagaaa

SEQ ID NO: 6962829 - DNA, 20 bp, Homo sapiens
ctacatgttctgcttctctc

SEQ ID NO: 6962830 - DNA, 20 bp, Homo sapiens
tagaatctgttctgattcat

SEQ ID NO: 6962831 - DNA, 22 bp, Homo sapiens
tgaaacggaatgttctttatcg

SEQ ID NO: 6962832 - DNA, 22 bp, Homo sapiens
gtacgtgcatgcacgtgtgcct

SEQ ID NO: 6962833 - DNA, 22 bp, Homo sapiens
ataggccagatatgctcgcagt

SEQ ID NO: 6962834 - DNA, 21 bp, Homo sapiens
tttagcatttacatatttcca

SEQ ID NO: 6962835 - DNA, 23 bp, Homo sapiens
ctgctgtgaaacatggttttggt

SEQ ID NO: 6962836 - DNA, 22 bp, Homo sapiens
ataaggttggtcttaactacct

SEQ ID NO: 6962837 - DNA, 22 bp, Homo sapiens
actgtgagagtttttctaggag

SEQ ID NO: 6962838 - DNA, 22 bp, Homo sapiens
aatgccagtgtgttgattccag

SEQ ID NO: 6962839 - DNA, 22 bp, Homo sapiens
agttcgagatctgctgatgaga

SEQ ID NO: 6962840 - DNA, 22 bp, Homo sapiens
agctgtttccataaatgagaca

SEQ ID NO: 6962841 - DNA, 22 bp, Homo sapiens
ctatggcttgcaatattcttgg

SEQ ID NO: 6962842 - DNA, 22 bp, Homo sapiens
acaggtaggttaaaatgtgtca

SEQ ID NO: 6962843 - DNA, 22 bp, Homo sapiens
ttagcacaggagtctctgttat

SEQ ID NO: 6962844 - DNA, 22 bp, Homo sapiens
ccagggaagtagttgtgagagc

SEQ ID NO: 6962845 - DNA, 22 bp, Homo sapiens
accagttaaagaatatgaggcc

SEQ ID NO: 6962846 - DNA, 22 bp, Homo sapiens
tgttcacaacgtgcaggtttgt

SEQ ID NO: 6962847 - DNA, 22 bp, Homo sapiens
taagagatggttatcaaaagca

SEQ ID NO: 6962848 - DNA, 22 bp, Homo sapiens
atagtgttgtatgtacagtctg

SEQ ID NO: 6962849 - DNA, 19 bp, Homo sapiens
ctgaggtgaggggcatcat

SEQ ID NO: 6962850 - DNA, 22 bp, Homo sapiens
ctaactttatttgctaagtaga

SEQ ID NO: 6962851 - DNA, 23 bp, Homo sapiens
aatctagaatgacctactcatct

SEQ ID NO: 6962852 - DNA, 22 bp, Homo sapiens
aatttattatatcctaggggaa

SEQ ID NO: 6962853 - DNA, 22 bp, Homo sapiens
ggcaatgaagtgaagagattaa

SEQ ID NO: 6962854 - DNA, 22 bp, Homo sapiens
gattaacagcccctgattgctg

SEQ ID NO: 6962855 - DNA, 22 bp, Homo sapiens
tgaacttcagtgcataattatc

SEQ ID NO: 6962856 - DNA, 22 bp, Homo sapiens
gggctccagattgcagcgatca

SEQ ID NO: 6962857 - DNA, 22 bp, Homo sapiens
tcattctggatgactttctaga

SEQ ID NO: 6962858 - DNA, 22 bp, Homo sapiens
ctcattctttcacagtctgtgg

SEQ ID NO: 6962859 - DNA, 21 bp, Homo sapiens
acatgcatagagagatttctg

SEQ ID NO: 6962860 - DNA, 18 bp, Homo sapiens
aagtctggcagctttccc

SEQ ID NO: 6962861 - DNA, 22 bp, Homo sapiens
tcaggaggatgtcggcaaattt

SEQ ID NO: 6962862 - DNA, 22 bp, Homo sapiens
agcccaaagtcctgcttccctg

SEQ ID NO: 6962863 - DNA, 19 bp, Homo sapiens
tcccatcaggaactggctt

SEQ ID NO: 6962864 - DNA, 22 bp, Homo sapiens
gcattcctgagaatgcagagtg

SEQ ID NO: 6962865 - DNA, 22 bp, Homo sapiens
aagacagcattttaccccaaca

SEQ ID NO: 6962866 - DNA, 22 bp, Homo sapiens
tacactttatggatcctacttt

SEQ ID NO: 6962867 - DNA, 22 bp, Homo sapiens
ctcatccaccctcactaggaaa

SEQ ID NO: 6962868 - DNA, 22 bp, Homo sapiens
gcccaggtttcatctgctccgt

SEQ ID NO: 6962869 - DNA, 20 bp, Homo sapiens
aaggtaagaaagccctgccc

SEQ ID NO: 6962870 - DNA, 22 bp, Homo sapiens
gtgccaatgatatcctataatg

SEQ ID NO: 6962871 - DNA, 22 bp, Homo sapiens
tcagagtttcaggatacaaata

SEQ ID NO: 6962872 - DNA, 22 bp, Homo sapiens
ctgtcccagtgatcctgagtgc

SEQ ID NO: 6962873 - DNA, 22 bp, Homo sapiens
ctgaagcaggcctacttcattg

SEQ ID NO: 6962874 - DNA, 22 bp, Homo sapiens
gaaagttattcagcctctctga

SEQ ID NO: 6962875 - DNA, 22 bp, Homo sapiens
ttagagacaggcttcccaagga

SEQ ID NO: 6962876 - DNA, 22 bp, Homo sapiens
ttgattcttctgaatttgcaga

SEQ ID NO: 6962877 - DNA, 22 bp, Homo sapiens
cattttcatgagtttctgttca

SEQ ID NO: 6962878 - DNA, 22 bp, Homo sapiens
ccccacactctttacattcata

SEQ ID NO: 6962879 - DNA, 21 bp, Homo sapiens
tggcgccgtcttgggactggc

SEQ ID NO: 6962880 - DNA, 22 bp, Homo sapiens
tgcgcaggagctctgccaggag

SEQ ID NO: 6962881 - DNA, 22 bp, Homo sapiens
tagcagcatcctgtggtgatgg

SEQ ID NO: 6962882 - DNA, 22 bp, Homo sapiens
cctccagtcacctggatgagaa

SEQ ID NO: 6962883 - DNA, 22 bp, Homo sapiens
tcagagaaaatggaaactttta

SEQ ID NO: 6962884 - DNA, 22 bp, Homo sapiens
tgtatcatatggggaagcttca

SEQ ID NO: 6962885 - DNA, 22 bp, Homo sapiens
ctgagctgggagcctggcacca

SEQ ID NO: 6962886 - DNA, 22 bp, Homo sapiens
tatggaaagctctttttgattg

SEQ ID NO: 6962887 - DNA, 22 bp, Homo sapiens
gcgtgccggccggtggaggcga

SEQ ID NO: 6962888 - DNA, 22 bp, Homo sapiens
aaatgcacaataaagtaaaggc

SEQ ID NO: 6962889 - DNA, 22 bp, Homo sapiens
cctgacttaagtctcctgttgg

SEQ ID NO: 6962890 - DNA, 22 bp, Homo sapiens
ttaaagagtctactgcacatcc

SEQ ID NO: 6962891 - DNA, 22 bp, Homo sapiens
agggtgcagaacaaattaagac

SEQ ID NO: 6962892 - DNA, 22 bp, Homo sapiens
ccaactctgaaaatccagatat

SEQ ID NO: 6962893 - DNA, 22 bp, Homo sapiens
catgcatggagctcaccctccc

SEQ ID NO: 6962894 - DNA, 22 bp, Homo sapiens
ggctccaggaacctcctctcct

SEQ ID NO: 6962895 - DNA, 22 bp, Homo sapiens
caagctctgggatgcagacatc

SEQ ID NO: 6962896 - DNA, 22 bp, Homo sapiens
aaggagcacacaatctagaacc

SEQ ID NO: 6962897 - DNA, 22 bp, Homo sapiens
gactctattcctggggccatag

SEQ ID NO: 6962898 - DNA, 22 bp, Homo sapiens
agatttcaggttggggcagaag

SEQ ID NO: 6962899 - DNA, 22 bp, Homo sapiens
gaatcagatgcggtttagctta

SEQ ID NO: 6962900 - DNA, 22 bp, Homo sapiens
tgacacacagggggatggagtt

SEQ ID NO: 6962901 - DNA, 22 bp, Homo sapiens
aaagtgctcggattacaggtat

SEQ ID NO: 6962902 - DNA, 22 bp, Homo sapiens
tcagagagtgcaaaatatagct

SEQ ID NO: 6962903 - DNA, 22 bp, Homo sapiens
gtctgtgttttcaggcctttgt

SEQ ID NO: 6962904 - DNA, 22 bp, Homo sapiens
gctggctgttgaataatggcat

SEQ ID NO: 6962905 - DNA, 22 bp, Homo sapiens
atgcttgatcttcatagcattt

SEQ ID NO: 6962906 - DNA, 18 bp, Homo sapiens
ccccagcagtgtggtgcc

SEQ ID NO: 6962907 - DNA, 22 bp, Homo sapiens
ttctcttctgttcagtgcccaa

SEQ ID NO: 6962908 - DNA, 21 bp, Homo sapiens
agaaggcaaaagcagacatct

SEQ ID NO: 6962909 - DNA, 22 bp, Homo sapiens
tgactcatatttcatggatacg

SEQ ID NO: 6962910 - DNA, 22 bp, Homo sapiens
tgaggtcacctggaggcagcct

SEQ ID NO: 6962911 - DNA, 22 bp, Homo sapiens
tattaatatgtgtgtgcatgta

SEQ ID NO: 6962912 - DNA, 22 bp, Homo sapiens
tgcatcaaaactggactccttc

SEQ ID NO: 6962913 - DNA, 22 bp, Homo sapiens
ataaggttaacatcatcagtga

SEQ ID NO: 6962914 - DNA, 22 bp, Homo sapiens
agaagttgttcaaggtggtgag

SEQ ID NO: 6962915 - DNA, 17 bp, Homo sapiens
tgagatggaagaagact

SEQ ID NO: 6962916 - DNA, 22 bp, Homo sapiens
gctggccacattgtgccgtcct

SEQ ID NO: 6962917 - DNA, 22 bp, Homo sapiens
acttccgggtgctagatgattc

SEQ ID NO: 6962918 - DNA, 15 bp, Homo sapiens
agggtgagtaactgt

SEQ ID NO: 6962919 - DNA, 21 bp, Homo sapiens
ataagttgtgcaactgtttga

SEQ ID NO: 6962920 - DNA, 22 bp, Homo sapiens
agggaccttgatgggtttggga

SEQ ID NO: 6962921 - DNA, 17 bp, Homo sapiens
tgccctgtgcctggtgt

SEQ ID NO: 6962922 - DNA, 22 bp, Homo sapiens
tactgtttgcagtttgcagtat

SEQ ID NO: 6962923 - DNA, 22 bp, Homo sapiens
cttgatgatagaatgtgaggag

SEQ ID NO: 6962924 - DNA, 22 bp, Homo sapiens
ctgattctgttgaacaccttcc

SEQ ID NO: 6962925 - DNA, 22 bp, Homo sapiens
tcaaggcaaagtaaatattcaa

SEQ ID NO: 6962926 - DNA, 22 bp, Homo sapiens
ccagctgctgcaccgtgcatgg

SEQ ID NO: 6962927 - DNA, 22 bp, Homo sapiens
gtgggacacatagaaaaataag

SEQ ID NO: 6962928 - DNA, 20 bp, Homo sapiens
aggaggcatagtctggaaag

SEQ ID NO: 6962929 - DNA, 19 bp, Homo sapiens
tttgtgcagcaacattaat

SEQ ID NO: 6962930 - DNA, 22 bp, Homo sapiens
tttaccaagatagcatctggtt

SEQ ID NO: 6962931 - DNA, 22 bp, Homo sapiens
tggccctggctgagttagattt

SEQ ID NO: 6962932 - DNA, 22 bp, Homo sapiens
acagctggagccctatggctgg

SEQ ID NO: 6962933 - DNA, 23 bp, Homo sapiens
tcccagcctcttctcttgcatac

SEQ ID NO: 6962934 - DNA, 22 bp, Homo sapiens
tgcctgctctttattttatgat

SEQ ID NO: 6962935 - DNA, 22 bp, Homo sapiens
agcatattgtatgtctatatgt

SEQ ID NO: 6962936 - DNA, 22 bp, Homo sapiens
ccctgctgatgccttgattttg

SEQ ID NO: 6962937 - DNA, 22 bp, Homo sapiens
ccttccttcaagcacacatcta

SEQ ID NO: 6962938 - DNA, 22 bp, Homo sapiens
gtctgagcccccgggaagctgg

SEQ ID NO: 6962939 - DNA, 22 bp, Homo sapiens
tgccatttttgctgggaattta

SEQ ID NO: 6962940 - DNA, 22 bp, Homo sapiens
tgctggctgttctagggaggcc

SEQ ID NO: 6962941 - DNA, 22 bp, Homo sapiens
gtgaacagataatagaaatgaa

SEQ ID NO: 6962942 - DNA, 22 bp, Homo sapiens
tagcatctccttagggtaagga

SEQ ID NO: 6962943 - DNA, 20 bp, Homo sapiens
tagagcttaggttttattct

SEQ ID NO: 6962944 - DNA, 22 bp, Homo sapiens
gcttgcctggcatttctggggc

SEQ ID NO: 6962945 - DNA, 22 bp, Homo sapiens
gattgctgttcccagggggctg

SEQ ID NO: 6962946 - DNA, 22 bp, Homo sapiens
cagaatcttcttaattggcaca

SEQ ID NO: 6962947 - DNA, 22 bp, Homo sapiens
ttattgtagcactttggcagtg

SEQ ID NO: 6962948 - DNA, 22 bp, Homo sapiens
aggctcagagatgagtaagcac

SEQ ID NO: 6962949 - DNA, 22 bp, Homo sapiens
tctttttatattgacaaaaggt

SEQ ID NO: 6962950 - DNA, 22 bp, Homo sapiens
agttgtgaatagatctgattgg

SEQ ID NO: 6962951 - DNA, 22 bp, Homo sapiens
ttggaattcctgttgtttcgtc

SEQ ID NO: 6962952 - DNA, 22 bp, Homo sapiens
tcagctttctctcgccatcagg

SEQ ID NO: 6962953 - DNA, 22 bp, Homo sapiens
tggcaattcctgagctctgaga

SEQ ID NO: 6962954 - DNA, 22 bp, Homo sapiens
agaaatctttgaagtgtaatgt

SEQ ID NO: 6962955 - DNA, 22 bp, Homo sapiens
ttcttacattagtctgtgcttt

SEQ ID NO: 6962956 - DNA, 22 bp, Homo sapiens
tgctctagtgggtagagcattg

SEQ ID NO: 6962957 - DNA, 22 bp, Homo sapiens
tggtcaagattacacactggtg

SEQ ID NO: 6962958 - DNA, 22 bp, Homo sapiens
ttccagaaatctttcagctcaa

SEQ ID NO: 6962959 - DNA, 22 bp, Homo sapiens
tgtacagactgtatttacaagt

SEQ ID NO: 6962960 - DNA, 22 bp, Homo sapiens
tcctgcctgcaatcccagcact

SEQ ID NO: 6962961 - DNA, 22 bp, Homo sapiens
ttgaagcaggaaaatttctatt

SEQ ID NO: 6962962 - DNA, 22 bp, Homo sapiens
gctgtttctctcccaccccttc

SEQ ID NO: 6962963 - DNA, 22 bp, Homo sapiens
acatatgagtactatacagtgc

SEQ ID NO: 6962964 - DNA, 22 bp, Homo sapiens
agtgccagttaataagaaatgg

SEQ ID NO: 6962965 - DNA, 22 bp, Homo sapiens
gacatggcttctaggaagcttt

SEQ ID NO: 6962966 - DNA, 22 bp, Homo sapiens
tgaggtaaattctggcccaaac

SEQ ID NO: 6962967 - DNA, 22 bp, Homo sapiens
ccgggagagtggaaccaagagg

SEQ ID NO: 6962968 - DNA, 22 bp, Homo sapiens
cagcaggaggtgagatgtgacc

SEQ ID NO: 6962969 - DNA, 22 bp, Homo sapiens
tttgaagggcacgacaatagtt

SEQ ID NO: 6962970 - DNA, 18 bp, Homo sapiens
gtcattgcaacatactgt

SEQ ID NO: 6962971 - DNA, 22 bp, Homo sapiens
tctacaaataaattactatgta

SEQ ID NO: 6962972 - DNA, 22 bp, Homo sapiens
gatactttccatccaaatgcat

SEQ ID NO: 6962973 - DNA, 22 bp, Homo sapiens
tgaggaactcaccaggcagaga

SEQ ID NO: 6962974 - DNA, 22 bp, Homo sapiens
tggagagcctggagtccctgat

SEQ ID NO: 6962975 - DNA, 22 bp, Homo sapiens
cacttgaaatattaggggtgat

SEQ ID NO: 6962976 - DNA, 22 bp, Homo sapiens
agcgccgcccctgctggtgttg

SEQ ID NO: 6962977 - DNA, 22 bp, Homo sapiens
agtggcaggtgtgtagtatccc

SEQ ID NO: 6962978 - DNA, 22 bp, Homo sapiens
cccttggctttagtttctaaag

SEQ ID NO: 6962979 - DNA, 22 bp, Homo sapiens
tttggctaggttaagactggga

SEQ ID NO: 6962980 - DNA, 22 bp, Homo sapiens
agcagaaatgatggtatgggac

SEQ ID NO: 6962981 - DNA, 23 bp, Homo sapiens
agcaggaaaccgagggtgatgtt

SEQ ID NO: 6962982 - DNA, 22 bp, Homo sapiens
atttgacattattctctcagtc

SEQ ID NO: 6962983 - DNA, 22 bp, Homo sapiens
aggccttggaagccagggagcc

SEQ ID NO: 6962984 - DNA, 22 bp, Homo sapiens
tagaagtggcaacactcagaaa

SEQ ID NO: 6962985 - DNA, 22 bp, Homo sapiens
cagtttgtatttattactcata

SEQ ID NO: 6962986 - DNA, 22 bp, Homo sapiens
gtgttcaaaatgtaggtagatt

SEQ ID NO: 6962987 - DNA, 22 bp, Homo sapiens
attttttcagattgagtgttaa

SEQ ID NO: 6962988 - DNA, 22 bp, Homo sapiens
ggtggtgaagacaagtggaagt

SEQ ID NO: 6962989 - DNA, 22 bp, Homo sapiens
ctccagctgagtaagaacacta

SEQ ID NO: 6962990 - DNA, 22 bp, Homo sapiens
ttggtcaccataaagaagaaca

SEQ ID NO: 6962991 - DNA, 22 bp, Homo sapiens
aattttattaactggatgtagc

SEQ ID NO: 6962992 - DNA, 22 bp, Homo sapiens
tagaagcagcaggagtaaaggc

SEQ ID NO: 6962993 - DNA, 21 bp, Homo sapiens
tgatttatgcccaagtccctg

SEQ ID NO: 6962994 - DNA, 22 bp, Homo sapiens
aggtcagaagtgccagggaatt

SEQ ID NO: 6962995 - DNA, 22 bp, Homo sapiens
tcctgactaggagggctaaggt

SEQ ID NO: 6962996 - DNA, 19 bp, Homo sapiens
aaatcagaatctgcatttt

SEQ ID NO: 6962997 - DNA, 22 bp, Homo sapiens
atggataaatacttggtggtat

SEQ ID NO: 6962998 - DNA, 22 bp, Homo sapiens
ctgtgggcgcctgtcagcctca

SEQ ID NO: 6962999 - DNA, 22 bp, Homo sapiens
acagtttctccatttacacctt

SEQ ID NO: 6963000 - DNA, 22 bp, Homo sapiens
gcactagaatcccttcaagaag

SEQ ID NO: 6963001 - DNA, 22 bp, Homo sapiens
ggtggtgggagagctttctgga

SEQ ID NO: 6963002 - DNA, 22 bp, Homo sapiens
agaacagctgattccatgtcaa

SEQ ID NO: 6963003 - DNA, 22 bp, Homo sapiens
gtgaattaggacaaaagggctt

SEQ ID NO: 6963004 - DNA, 22 bp, Homo sapiens
gagaggtaatttgaagtgcaaa

SEQ ID NO: 6963005 - DNA, 19 bp, Homo sapiens
tgctgggtcatatggaaac

SEQ ID NO: 6963006 - DNA, 20 bp, Homo sapiens
ggcaggcaggaggtttccag

SEQ ID NO: 6963007 - DNA, 22 bp, Homo sapiens
caggatggccccggggctgtgc

SEQ ID NO: 6963008 - DNA, 22 bp, Homo sapiens
gccatgtcatctgacttatctg

SEQ ID NO: 6963009 - DNA, 22 bp, Homo sapiens
aagcatgagctttcaaaccaga

SEQ ID NO: 6963010 - DNA, 22 bp, Homo sapiens
gggctgagccacagcttttgtt

SEQ ID NO: 6963011 - DNA, 19 bp, Homo sapiens
ataaggcaggaggaaattt

SEQ ID NO: 6963012 - DNA, 22 bp, Homo sapiens
acaggtgttgactcacaggccc

SEQ ID NO: 6963013 - DNA, 18 bp, Homo sapiens
tggaaattgaaacagaaa

SEQ ID NO: 6963014 - DNA, 22 bp, Homo sapiens
atacaacagaaaatgattattc

SEQ ID NO: 6963015 - DNA, 22 bp, Homo sapiens
agttataccttatacacatatg

SEQ ID NO: 6963016 - DNA, 22 bp, Homo sapiens
atgctttattggagacagtcat

SEQ ID NO: 6963017 - DNA, 22 bp, Homo sapiens
atgcaaattcttaggctccatc

SEQ ID NO: 6963018 - DNA, 22 bp, Homo sapiens
gggtattaaaatgaaggagaaa

SEQ ID NO: 6963019 - DNA, 22 bp, Homo sapiens
ggcagagcagccccagggtttg

SEQ ID NO: 6963020 - DNA, 22 bp, Homo sapiens
ggctgtcaattcataggtcaga

SEQ ID NO: 6963021 - DNA, 22 bp, Homo sapiens
ttagggacagctctgtaggtga

SEQ ID NO: 6963022 - DNA, 22 bp, Homo sapiens
tggcaatttcatatggttcata

SEQ ID NO: 6963023 - DNA, 22 bp, Homo sapiens
agttctcatcatgaagcataag

SEQ ID NO: 6963024 - DNA, 22 bp, Homo sapiens
tgccttttatggctagcctcag

SEQ ID NO: 6963025 - DNA, 22 bp, Homo sapiens
tatgtagtacttagtgcataca

SEQ ID NO: 6963026 - DNA, 22 bp, Homo sapiens
aggtcagcatgctcctctctgt

SEQ ID NO: 6963027 - DNA, 22 bp, Homo sapiens
gattaagattacatatttaagt

SEQ ID NO: 6963028 - DNA, 22 bp, Homo sapiens
caagtgagtgaccagagttggt

SEQ ID NO: 6963029 - DNA, 22 bp, Homo sapiens
tgatgattgggagacatttggg

SEQ ID NO: 6963030 - DNA, 22 bp, Homo sapiens
tagcagaagaaattcagagttg

SEQ ID NO: 6963031 - DNA, 22 bp, Homo sapiens
ctgagccttattcaccagccct

SEQ ID NO: 6963032 - DNA, 22 bp, Homo sapiens
atgtgtagggaagtgaaatgta

SEQ ID NO: 6963033 - DNA, 22 bp, Homo sapiens
cagtgccaggagacaagatcag

SEQ ID NO: 6963034 - DNA, 22 bp, Homo sapiens
ggacagtgaatgtggggatgca

SEQ ID NO: 6963035 - DNA, 22 bp, Homo sapiens
ggaccaggggcgcactccctgc

SEQ ID NO: 6963036 - DNA, 22 bp, Homo sapiens
agccatcactggggcccaccat

SEQ ID NO: 6963037 - DNA, 22 bp, Homo sapiens
aattctgcttcatcagctcttt

SEQ ID NO: 6963038 - DNA, 22 bp, Homo sapiens
atacattcaaaggaaggataga

SEQ ID NO: 6963039 - DNA, 22 bp, Homo sapiens
attacctatgctctagtaatca

SEQ ID NO: 6963040 - DNA, 22 bp, Homo sapiens
atgtatgtttttgcagatacat

SEQ ID NO: 6963041 - DNA, 18 bp, Homo sapiens
cagtataaccagcaactc

SEQ ID NO: 6963042 - DNA, 22 bp, Homo sapiens
ttctaatacacggtatgacttt

SEQ ID NO: 6963043 - DNA, 22 bp, Homo sapiens
tgtgtgtgactcatactagaac

SEQ ID NO: 6963044 - DNA, 22 bp, Homo sapiens
catggactctggtttggggagc

SEQ ID NO: 6963045 - DNA, 22 bp, Homo sapiens
tggtcataaggatttggaagct

SEQ ID NO: 6963046 - DNA, 22 bp, Homo sapiens
aaccaggacaattttgaaagta

SEQ ID NO: 6963047 - DNA, 22 bp, Homo sapiens
gctgctgttcctccagtggatc

SEQ ID NO: 6963048 - DNA, 22 bp, Homo sapiens
agtggtagaaaatgcagctcga

SEQ ID NO: 6963049 - DNA, 22 bp, Homo sapiens
aggaacaattgataaactcaca

SEQ ID NO: 6963050 - DNA, 22 bp, Homo sapiens
tgcaggtggtttggacactgct

SEQ ID NO: 6963051 - DNA, 22 bp, Homo sapiens
actgcactccagcctcggggtc

SEQ ID NO: 6963052 - DNA, 22 bp, Homo sapiens
tataaatgccaggactttagat

SEQ ID NO: 6963053 - DNA, 22 bp, Homo sapiens
cagatcgctaaattgaccaaat

SEQ ID NO: 6963054 - DNA, 22 bp, Homo sapiens
acaggcatatttctagattaca

SEQ ID NO: 6963055 - DNA, 22 bp, Homo sapiens
gatattttcgcagggagaattc

SEQ ID NO: 6963056 - DNA, 22 bp, Homo sapiens
gcgctaggcaagtcctttcaac

SEQ ID NO: 6963057 - DNA, 22 bp, Homo sapiens
caggacgggcaaacaggatggt

SEQ ID NO: 6963058 - DNA, 22 bp, Homo sapiens
gttcatcactcagagacctccc

SEQ ID NO: 6963059 - DNA, 22 bp, Homo sapiens
ctcataaagtgagaatatgacc

SEQ ID NO: 6963060 - DNA, 22 bp, Homo sapiens
ggcccagagtctgcaatggagt

SEQ ID NO: 6963061 - DNA, 20 bp, Homo sapiens
tgggcaccagatgggatgcc

SEQ ID NO: 6963062 - DNA, 22 bp, Homo sapiens
cagattgggtgagatgatttca

SEQ ID NO: 6963063 - DNA, 22 bp, Homo sapiens
tcccactgctttgctctgctca

SEQ ID NO: 6963064 - DNA, 22 bp, Homo sapiens
tgtctctccacacagccagtgc

SEQ ID NO: 6963065 - DNA, 22 bp, Homo sapiens
atttagcacacggcctggtaca

SEQ ID NO: 6963066 - DNA, 18 bp, Homo sapiens
acctgattggcgcagccc

SEQ ID NO: 6963067 - DNA, 22 bp, Homo sapiens
tctatgtcaaccttgcagtgca

SEQ ID NO: 6963068 - DNA, 22 bp, Homo sapiens
attctccatcaccactggcact

SEQ ID NO: 6963069 - DNA, 22 bp, Homo sapiens
aggtctgtctggccccatgaat

SEQ ID NO: 6963070 - DNA, 17 bp, Homo sapiens
tgctgccaagtcccaac

SEQ ID NO: 6963071 - DNA, 22 bp, Homo sapiens
tggaggcctcctcaaattttta

SEQ ID NO: 6963072 - DNA, 22 bp, Homo sapiens
cagctgccacacctctttctct

SEQ ID NO: 6963073 - DNA, 22 bp, Homo sapiens
tttttcacacatgtggcttgat

SEQ ID NO: 6963074 - DNA, 22 bp, Homo sapiens
attctactcattgatctatata

SEQ ID NO: 6963075 - DNA, 22 bp, Homo sapiens
cccaggtgtttgtggcagaggt

SEQ ID NO: 6963076 - DNA, 22 bp, Homo sapiens
cactgtcttcagtttcactgca

SEQ ID NO: 6963077 - DNA, 22 bp, Homo sapiens
tgagcagaagccctcctggact

SEQ ID NO: 6963078 - DNA, 22 bp, Homo sapiens
aatcagaacgctcgatcttcgg

SEQ ID NO: 6963079 - DNA, 22 bp, Homo sapiens
acatacttctttacattccata

SEQ ID NO: 6963080 - DNA, 22 bp, Homo sapiens
gccagagagagtccctgggcct

SEQ ID NO: 6963081 - DNA, 22 bp, Homo sapiens
atgtaaattgtactgacacacg

SEQ ID NO: 6963082 - DNA, 22 bp, Homo sapiens
gcagtgtgtttggataacacac

SEQ ID NO: 6963083 - DNA, 22 bp, Homo sapiens
gcaggtgtctgactgccttctt

SEQ ID NO: 6963084 - DNA, 19 bp, Homo sapiens
gcttccagcactgcaggag

SEQ ID NO: 6963085 - DNA, 22 bp, Homo sapiens
agcagttttcctgagctcctca

SEQ ID NO: 6963086 - DNA, 22 bp, Homo sapiens
accaagatctgttaggggctag

SEQ ID NO: 6963087 - DNA, 22 bp, Homo sapiens
tttcttctcatccctgaaatca

SEQ ID NO: 6963088 - DNA, 22 bp, Homo sapiens
gaatacaagccaggcacaaggc

SEQ ID NO: 6963089 - DNA, 22 bp, Homo sapiens
tgtttgacaacaggctcacaga

SEQ ID NO: 6963090 - DNA, 18 bp, Homo sapiens
gacaccagcctctgcccc

SEQ ID NO: 6963091 - DNA, 22 bp, Homo sapiens
accaggagtctagcctagtcaa

SEQ ID NO: 6963092 - DNA, 22 bp, Homo sapiens
gaactgtttctggtgaaagagt

SEQ ID NO: 6963093 - DNA, 22 bp, Homo sapiens
gtatttttaggtaaggaaagta

SEQ ID NO: 6963094 - DNA, 22 bp, Homo sapiens
aaactgcatgaagctgatttta

SEQ ID NO: 6963095 - DNA, 22 bp, Homo sapiens
aagccatcttgtttatatgtta

SEQ ID NO: 6963096 - DNA, 22 bp, Homo sapiens
gagagtgatgaatggttaaaca

SEQ ID NO: 6963097 - DNA, 22 bp, Homo sapiens
tgcccttacacatggaaaggga

SEQ ID NO: 6963098 - DNA, 22 bp, Homo sapiens
ctacaggaaggatcttgctcaa

SEQ ID NO: 6963099 - DNA, 22 bp, Homo sapiens
gggctgagaattcagctttcct

SEQ ID NO: 6963100 - DNA, 23 bp, Homo sapiens
ttgttaactttcctgcccctaca

SEQ ID NO: 6963101 - DNA, 22 bp, Homo sapiens
tctgaaggtctgagaaccagga

SEQ ID NO: 6963102 - DNA, 22 bp, Homo sapiens
agctgcaggcctctcctgggga

SEQ ID NO: 6963103 - DNA, 22 bp, Homo sapiens
accgtggatttgtagtcatttc

SEQ ID NO: 6963104 - DNA, 22 bp, Homo sapiens
ctgcagctccttctggcatgtg

SEQ ID NO: 6963105 - DNA, 22 bp, Homo sapiens
agcctgcaggatgggcagcacc

SEQ ID NO: 6963106 - DNA, 22 bp, Homo sapiens
actggaataaatggagggatga

SEQ ID NO: 6963107 - DNA, 22 bp, Homo sapiens
gcctggaagtgtgtcgtgggaa

SEQ ID NO: 6963108 - DNA, 20 bp, Homo sapiens
cagtcctgccccttggggac

SEQ ID NO: 6963109 - DNA, 23 bp, Homo sapiens
tgccagggccctgtgtgcaatgc

SEQ ID NO: 6963110 - DNA, 22 bp, Homo sapiens
ttagggcaggcatgagagaact

SEQ ID NO: 6963111 - DNA, 22 bp, Homo sapiens
atcacatcgaggagcaatcaga

SEQ ID NO: 6963112 - DNA, 22 bp, Homo sapiens
gaaaggctcactttagatcatg

SEQ ID NO: 6963113 - DNA, 22 bp, Homo sapiens
agtgtcctcctctgggagccag

SEQ ID NO: 6963114 - DNA, 22 bp, Homo sapiens
gaatcagatactgatttcagtc

SEQ ID NO: 6963115 - DNA, 22 bp, Homo sapiens
acagtgtggggtgagatggaac

SEQ ID NO: 6963116 - DNA, 22 bp, Homo sapiens
ttctgagacagcaaagattctt

SEQ ID NO: 6963117 - DNA, 22 bp, Homo sapiens
gaatgctttgggaattcagaat

SEQ ID NO: 6963118 - DNA, 22 bp, Homo sapiens
acagtgttcctttgttgtgact

SEQ ID NO: 6963119 - DNA, 22 bp, Homo sapiens
caccagcgactgtgaccagcaa

SEQ ID NO: 6963120 - DNA, 22 bp, Homo sapiens
ctcaggaaaggccatgcaaggg

SEQ ID NO: 6963121 - DNA, 18 bp, Homo sapiens
acaaatgtgtcacaggaa

SEQ ID NO: 6963122 - DNA, 22 bp, Homo sapiens
ggaccccagagataccagtttt

SEQ ID NO: 6963123 - DNA, 22 bp, Homo sapiens
tcatctgaagattgctgttcaa

SEQ ID NO: 6963124 - DNA, 22 bp, Homo sapiens
tgaggcaagctgggcccatgga

SEQ ID NO: 6963125 - DNA, 22 bp, Homo sapiens
agtaacaagtgccaacgttaga

SEQ ID NO: 6963126 - DNA, 22 bp, Homo sapiens
tcctctggtcctgcagcagatc

SEQ ID NO: 6963127 - DNA, 22 bp, Homo sapiens
cctggtttgggtgccagtgagt

SEQ ID NO: 6963128 - DNA, 22 bp, Homo sapiens
acagtatagggcttatattgta

SEQ ID NO: 6963129 - DNA, 22 bp, Homo sapiens
taacatgtccctgattctttgt

SEQ ID NO: 6963130 - DNA, 22 bp, Homo sapiens
aaaattcattcctcagactgcc

SEQ ID NO: 6963131 - DNA, 22 bp, Homo sapiens
gtccctcaaggtccagtcatgg

SEQ ID NO: 6963132 - DNA, 22 bp, Homo sapiens
agcctgggcaactccattcact

SEQ ID NO: 6963133 - DNA, 22 bp, Homo sapiens
aggtccctaggagagtaggaag

SEQ ID NO: 6963134 - DNA, 22 bp, Homo sapiens
aagtggttgcttgtgagtcccc

SEQ ID NO: 6963135 - DNA, 22 bp, Homo sapiens
tcttgaagtgggagacatcgtg

SEQ ID NO: 6963136 - DNA, 22 bp, Homo sapiens
agcagcacctgtcctcgctgct

SEQ ID NO: 6963137 - DNA, 22 bp, Homo sapiens
atcctgcttgttacttatagag

SEQ ID NO: 6963138 - DNA, 22 bp, Homo sapiens
tctggaatgatttccttcccct

SEQ ID NO: 6963139 - DNA, 22 bp, Homo sapiens
tcaagtttctctcagattatgg

SEQ ID NO: 6963140 - DNA, 22 bp, Homo sapiens
attcagaaagttgtcatatttg

SEQ ID NO: 6963141 - DNA, 22 bp, Homo sapiens
acagagctgtacatgtgccatg

SEQ ID NO: 6963142 - DNA, 22 bp, Homo sapiens
ctgctgccaagggtgccacagg

SEQ ID NO: 6963143 - DNA, 22 bp, Homo sapiens
tatctgcatctgcatgtgtatt

SEQ ID NO: 6963144 - DNA, 22 bp, Homo sapiens
tctgggcttgcctggttgtgca

SEQ ID NO: 6963145 - DNA, 22 bp, Homo sapiens
tgtcactttggccaagccattg

SEQ ID NO: 6963146 - DNA, 22 bp, Homo sapiens
cataactggggacacttctcta

SEQ ID NO: 6963147 - DNA, 22 bp, Homo sapiens
cagcctctaagcacagcctctc

SEQ ID NO: 6963148 - DNA, 22 bp, Homo sapiens
agccttgttggtctgagtttgg

SEQ ID NO: 6963149 - DNA, 22 bp, Homo sapiens
ttggccgtttcactgggcagtt

SEQ ID NO: 6963150 - DNA, 22 bp, Homo sapiens
tctcctggagcaggaaggtggg

SEQ ID NO: 6963151 - DNA, 22 bp, Homo sapiens
tttgttgggagaaacattattt

SEQ ID NO: 6963152 - DNA, 21 bp, Homo sapiens
aactgctggtcttttctgtct

SEQ ID NO: 6963153 - DNA, 22 bp, Homo sapiens
attggtctaaagttaagaagat

SEQ ID NO: 6963154 - DNA, 22 bp, Homo sapiens
tctttcctagaggctgatgagt

SEQ ID NO: 6963155 - DNA, 22 bp, Homo sapiens
tcagcttccctatctgaccata

SEQ ID NO: 6963156 - DNA, 22 bp, Homo sapiens
gtgcaaccatcaccactgactc

SEQ ID NO: 6963157 - DNA, 22 bp, Homo sapiens
gtctttctatgatgaactgttg

SEQ ID NO: 6963158 - DNA, 22 bp, Homo sapiens
gaggagctggcgctatttatga

SEQ ID NO: 6963159 - DNA, 22 bp, Homo sapiens
agtgaccatacaggtgcagagc

SEQ ID NO: 6963160 - DNA, 21 bp, Homo sapiens
tgtcatgtttttccaggcatc

SEQ ID NO: 6963161 - DNA, 22 bp, Homo sapiens
gttgaacatgtgagtctcagga

SEQ ID NO: 6963162 - DNA, 22 bp, Homo sapiens
gctgctttagaattgaaacaga

SEQ ID NO: 6963163 - DNA, 22 bp, Homo sapiens
gtaaaaggtcaaggccaagtct

SEQ ID NO: 6963164 - DNA, 22 bp, Homo sapiens
ccaagctgcctgaggcaaattt

SEQ ID NO: 6963165 - DNA, 22 bp, Homo sapiens
atgaggttatatttaattcact

SEQ ID NO: 6963166 - DNA, 21 bp, Homo sapiens
agcagccttgtgtgccaggca

SEQ ID NO: 6963167 - DNA, 22 bp, Homo sapiens
aagttattggtggagagcactg

SEQ ID NO: 6963168 - DNA, 22 bp, Homo sapiens
aaacttagatgtttttagagtt

SEQ ID NO: 6963169 - DNA, 22 bp, Homo sapiens
ttaagtgtagtgctaagggcag

SEQ ID NO: 6963170 - DNA, 22 bp, Homo sapiens
agccagcatatatatagttgaa

SEQ ID NO: 6963171 - DNA, 22 bp, Homo sapiens
ctgctttgcatagctgccagag

SEQ ID NO: 6963172 - DNA, 22 bp, Homo sapiens
tgccctgaagcaccctcaccct

SEQ ID NO: 6963173 - DNA, 22 bp, Homo sapiens
tattccttggcaaaaaatatat

SEQ ID NO: 6963174 - DNA, 22 bp, Homo sapiens
actctctgggcatgccccacca

SEQ ID NO: 6963175 - DNA, 22 bp, Homo sapiens
gaatccttggggaatggggccc

SEQ ID NO: 6963176 - DNA, 22 bp, Homo sapiens
ttgtcaccctaaccaaacaccc

SEQ ID NO: 6963177 - DNA, 22 bp, Homo sapiens
tattcctatttctaaacatatg

SEQ ID NO: 6963178 - DNA, 22 bp, Homo sapiens
tatagacttgatggtattaagt

SEQ ID NO: 6963179 - DNA, 22 bp, Homo sapiens
gcagaatagggcataactttgc

SEQ ID NO: 6963180 - DNA, 22 bp, Homo sapiens
tagttcttactgttttcagcgt

SEQ ID NO: 6963181 - DNA, 20 bp, Homo sapiens
gataaagcattgagtaaatt

SEQ ID NO: 6963182 - DNA, 22 bp, Homo sapiens
tttaatgatagctgtttcacat

SEQ ID NO: 6963183 - DNA, 22 bp, Homo sapiens
gactgggtcctctgcttatggt

SEQ ID NO: 6963184 - DNA, 22 bp, Homo sapiens
aatccagattccagaaaatcgc

SEQ ID NO: 6963185 - DNA, 22 bp, Homo sapiens
tatcaactgagattaaatattt

SEQ ID NO: 6963186 - DNA, 22 bp, Homo sapiens
gaagatttgttgtaatttttag

SEQ ID NO: 6963187 - DNA, 22 bp, Homo sapiens
tctagacaatgcactgtaagga

SEQ ID NO: 6963188 - DNA, 22 bp, Homo sapiens
ccttctgctccctggccagggc

SEQ ID NO: 6963189 - DNA, 22 bp, Homo sapiens
cctgcccagcttcacctcaggc

SEQ ID NO: 6963190 - DNA, 22 bp, Homo sapiens
tgtacagttaatcttaagccat

SEQ ID NO: 6963191 - DNA, 22 bp, Homo sapiens
ctgggtggatcgcagccccagg

SEQ ID NO: 6963192 - DNA, 22 bp, Homo sapiens
tgagaatagcaaaagctgtcag

SEQ ID NO: 6963193 - DNA, 22 bp, Homo sapiens
tgtatcttcagtttgtctttcc

SEQ ID NO: 6963194 - DNA, 22 bp, Homo sapiens
aaggtttattaaatgttgcatg

SEQ ID NO: 6963195 - DNA, 22 bp, Homo sapiens
ctgtgctggcagcaatcaagga

SEQ ID NO: 6963196 - DNA, 22 bp, Homo sapiens
tgccatccttgaggaagggcaa

SEQ ID NO: 6963197 - DNA, 22 bp, Homo sapiens
agagtcaccaaagggccaacat

SEQ ID NO: 6963198 - DNA, 22 bp, Homo sapiens
gtctggctttgctcagatgctg

SEQ ID NO: 6963199 - DNA, 22 bp, Homo sapiens
acgtcactcttgcctctaagaa

SEQ ID NO: 6963200 - DNA, 22 bp, Homo sapiens
cacagtgtggcaaatttcaact

SEQ ID NO: 6963201 - DNA, 22 bp, Homo sapiens
ttaaaggcatggttagacatgg

SEQ ID NO: 6963202 - DNA, 22 bp, Homo sapiens
agccttcactgggaccttggat

SEQ ID NO: 6963203 - DNA, 22 bp, Homo sapiens
taaaagatatcttagggatttg

SEQ ID NO: 6963204 - DNA, 18 bp, Homo sapiens
attaatcataaaatgctg

SEQ ID NO: 6963205 - DNA, 22 bp, Homo sapiens
agcctgttctccctccagacac

SEQ ID NO: 6963206 - DNA, 22 bp, Homo sapiens
tagtgttttctagaatggtttt

SEQ ID NO: 6963207 - DNA, 22 bp, Homo sapiens
tctttgctccacactctagaga

SEQ ID NO: 6963208 - DNA, 22 bp, Homo sapiens
aattccctcaggggactccttt

SEQ ID NO: 6963209 - DNA, 22 bp, Homo sapiens
cagcccattccttcctgggggt

SEQ ID NO: 6963210 - DNA, 22 bp, Homo sapiens
ggcagcagcaaggttggagctg

SEQ ID NO: 6963211 - DNA, 22 bp, Homo sapiens
agctcccaattgacttgaacta

SEQ ID NO: 6963212 - DNA, 22 bp, Homo sapiens
ttggtcaaatgtcatctggtgt

SEQ ID NO: 6963213 - DNA, 22 bp, Homo sapiens
atgccattgtatattcattgat

SEQ ID NO: 6963214 - DNA, 20 bp, Homo sapiens
ctgcatgttggaggtgtacc

SEQ ID NO: 6963215 - DNA, 22 bp, Homo sapiens
ctaattctttggagacaatctg

SEQ ID NO: 6963216 - DNA, 22 bp, Homo sapiens
ttgtattttttcctggcggtgg

SEQ ID NO: 6963217 - DNA, 22 bp, Homo sapiens
atgcactgttggatatatttgt

SEQ ID NO: 6963218 - DNA, 22 bp, Homo sapiens
gtgaattaggctatggcagagg

SEQ ID NO: 6963219 - DNA, 22 bp, Homo sapiens
actgtgctttctctggaggcat

SEQ ID NO: 6963220 - DNA, 22 bp, Homo sapiens
cagtgatatttatcctactcac

SEQ ID NO: 6963221 - DNA, 21 bp, Homo sapiens
tgcccaggggccaaccgctgc

SEQ ID NO: 6963222 - DNA, 22 bp, Homo sapiens
caatgcaagcaagatggtcaca

SEQ ID NO: 6963223 - DNA, 22 bp, Homo sapiens
gcaatataatttgtgggatatc

SEQ ID NO: 6963224 - DNA, 22 bp, Homo sapiens
tcccagcacagggcagatgtga

SEQ ID NO: 6963225 - DNA, 22 bp, Homo sapiens
attcttatttaaatagagtctg

SEQ ID NO: 6963226 - DNA, 20 bp, Homo sapiens
agagaattccctttggagat

SEQ ID NO: 6963227 - DNA, 22 bp, Homo sapiens
caggcgacccctaggagcaaca

SEQ ID NO: 6963228 - DNA, 22 bp, Homo sapiens
gcaggcctgggagtcatcttgt

SEQ ID NO: 6963229 - DNA, 22 bp, Homo sapiens
atccttggatcctgtgttcctg

SEQ ID NO: 6963230 - DNA, 22 bp, Homo sapiens
aaactgtaaacacagcagtaca

SEQ ID NO: 6963231 - DNA, 22 bp, Homo sapiens
ctgcaggcatctaactgtgggc

SEQ ID NO: 6963232 - DNA, 22 bp, Homo sapiens
cttctccttatatgtcccgttc

SEQ ID NO: 6963233 - DNA, 22 bp, Homo sapiens
atcagaaattgcccagctgttt

SEQ ID NO: 6963234 - DNA, 22 bp, Homo sapiens
atttggcttacacgatattttc

SEQ ID NO: 6963235 - DNA, 22 bp, Homo sapiens
tagctaagttacttggcaacag

SEQ ID NO: 6963236 - DNA, 22 bp, Homo sapiens
caatgtgtcaggaaaagggcca

SEQ ID NO: 6963237 - DNA, 22 bp, Homo sapiens
ttagttaggatttggtggtata

SEQ ID NO: 6963238 - DNA, 22 bp, Homo sapiens
attgccaggatgtggtttgtag

SEQ ID NO: 6963239 - DNA, 22 bp, Homo sapiens
attaatcatttctgcattatct

SEQ ID NO: 6963240 - DNA, 22 bp, Homo sapiens
tgttttcatggttatgtgtcta

SEQ ID NO: 6963241 - DNA, 22 bp, Homo sapiens
gttaaggatcttgagatgagga

SEQ ID NO: 6963242 - DNA, 22 bp, Homo sapiens
gatgaagccccagtgtaagtaa

SEQ ID NO: 6963243 - DNA, 22 bp, Homo sapiens
aaagcacattacaagctcagtc

SEQ ID NO: 6963244 - DNA, 22 bp, Homo sapiens
tctgcctttctcaagggcaaaa

SEQ ID NO: 6963245 - DNA, 22 bp, Homo sapiens
tacacatatgtccattaatcag

SEQ ID NO: 6963246 - DNA, 21 bp, Homo sapiens
acagctggaaattacttgccc

SEQ ID NO: 6963247 - DNA, 22 bp, Homo sapiens
aaagctatgaggcatgcatttc

SEQ ID NO: 6963248 - DNA, 22 bp, Homo sapiens
ctctgtcacttctccagctgag

SEQ ID NO: 6963249 - DNA, 22 bp, Homo sapiens
ctgccctgctggagatcacagt

SEQ ID NO: 6963250 - DNA, 22 bp, Homo sapiens
aaactgtatgttgagatgacag

SEQ ID NO: 6963251 - DNA, 22 bp, Homo sapiens
tgtctttagccagcagtcttct

SEQ ID NO: 6963252 - DNA, 22 bp, Homo sapiens
ctttccagtaccaggaagcgga

SEQ ID NO: 6963253 - DNA, 22 bp, Homo sapiens
caatggtggtgtcagaagagat

SEQ ID NO: 6963254 - DNA, 22 bp, Homo sapiens
caggctgccgtggggtccaggc

SEQ ID NO: 6963255 - DNA, 22 bp, Homo sapiens
tgagaaggaaacaatggctttt

SEQ ID NO: 6963256 - DNA, 16 bp, Homo sapiens
gcagttggggagagct

SEQ ID NO: 6963257 - DNA, 22 bp, Homo sapiens
aggatcaagaggcccctgactg

SEQ ID NO: 6963258 - DNA, 22 bp, Homo sapiens
tctctgggaattttttggacat

SEQ ID NO: 6963259 - DNA, 22 bp, Homo sapiens
gtcattataccattataattgt

SEQ ID NO: 6963260 - DNA, 22 bp, Homo sapiens
ttagactagaagcttccacttt

SEQ ID NO: 6963261 - DNA, 22 bp, Homo sapiens
tgaagtagcaggctgatggttt

SEQ ID NO: 6963262 - DNA, 22 bp, Homo sapiens
cgcctctctttttctcccagac

SEQ ID NO: 6963263 - DNA, 19 bp, Homo sapiens
gttggcactgaaaatggct

SEQ ID NO: 6963264 - DNA, 22 bp, Homo sapiens
taagcaggggtcaagtgtacaa

SEQ ID NO: 6963265 - DNA, 22 bp, Homo sapiens
ttgctttagaatctgcttctgg

SEQ ID NO: 6963266 - DNA, 22 bp, Homo sapiens
ctctctgaaactggagagtctc

SEQ ID NO: 6963267 - DNA, 23 bp, Homo sapiens
gggtatccattatcattactttt

SEQ ID NO: 6963268 - DNA, 22 bp, Homo sapiens
tcaacagaagtgatagctatta

SEQ ID NO: 6963269 - DNA, 22 bp, Homo sapiens
gcttttttgctattgaagtggt

SEQ ID NO: 6963270 - DNA, 22 bp, Homo sapiens
aagaacattgactaagaggggc

SEQ ID NO: 6963271 - DNA, 22 bp, Homo sapiens
cacattcctggtgctcagcagc

SEQ ID NO: 6963272 - DNA, 22 bp, Homo sapiens
tgattacagtctgacagatgtt

SEQ ID NO: 6963273 - DNA, 22 bp, Homo sapiens
tatctgtattctgacagtcact

SEQ ID NO: 6963274 - DNA, 22 bp, Homo sapiens
acatgaggtaagggatgttaag

SEQ ID NO: 6963275 - DNA, 22 bp, Homo sapiens
atagcaaattctttaggtgctt

SEQ ID NO: 6963276 - DNA, 22 bp, Homo sapiens
tccaaggaggagctggagattg

SEQ ID NO: 6963277 - DNA, 22 bp, Homo sapiens
attgaagattctgacatcagaa

SEQ ID NO: 6963278 - DNA, 22 bp, Homo sapiens
cctgtgtcatcagctgtggcta

SEQ ID NO: 6963279 - DNA, 22 bp, Homo sapiens
gcagaagtggattctacaattt

SEQ ID NO: 6963280 - DNA, 22 bp, Homo sapiens
taattcttgttcagaggtagta

SEQ ID NO: 6963281 - DNA, 22 bp, Homo sapiens
catctttgtttcatctgtccag

SEQ ID NO: 6963282 - DNA, 22 bp, Homo sapiens
aggctccaggcccttcaccagc

SEQ ID NO: 6963283 - DNA, 22 bp, Homo sapiens
aaatgtcagaggaacatattga

SEQ ID NO: 6963284 - DNA, 17 bp, Homo sapiens
tgctttcttcctgccct

SEQ ID NO: 6963285 - DNA, 19 bp, Homo sapiens
tcagtgtccctgttaatat

SEQ ID NO: 6963286 - DNA, 22 bp, Homo sapiens
gttcatttaggaaaggaagagt

SEQ ID NO: 6963287 - DNA, 22 bp, Homo sapiens
tgaagcaatgatagcagaatga

SEQ ID NO: 6963288 - DNA, 22 bp, Homo sapiens
catgatggggaatgttaaggga

SEQ ID NO: 6963289 - DNA, 21 bp, Homo sapiens
agtacatctcaaatgtaaatc

SEQ ID NO: 6963290 - DNA, 22 bp, Homo sapiens
tagtgcttgagtctctccgtac

SEQ ID NO: 6963291 - DNA, 22 bp, Homo sapiens
ggagtctgttttacatgcagga

SEQ ID NO: 6963292 - DNA, 22 bp, Homo sapiens
tttggaaatacgcgtaggcaga

SEQ ID NO: 6963293 - DNA, 22 bp, Homo sapiens
actgtcaaatgcaatgaactca

SEQ ID NO: 6963294 - DNA, 22 bp, Homo sapiens
tctcatctttaaatgaaaattt

SEQ ID NO: 6963295 - DNA, 22 bp, Homo sapiens
tagaaacacagatctggtgtca

SEQ ID NO: 6963296 - DNA, 22 bp, Homo sapiens
taaggccaattaacaaccaggg

SEQ ID NO: 6963297 - DNA, 22 bp, Homo sapiens
cagacatcttttatcttcagga

SEQ ID NO: 6963298 - DNA, 22 bp, Homo sapiens
aagactctgtatcatgagggag

SEQ ID NO: 6963299 - DNA, 22 bp, Homo sapiens
ttcaggattgtgtttttcctga

SEQ ID NO: 6963300 - DNA, 22 bp, Homo sapiens
cgctctggagaatagtagcttt

SEQ ID NO: 6963301 - DNA, 22 bp, Homo sapiens
gctgtgtgctctggtctttctt

SEQ ID NO: 6963302 - DNA, 22 bp, Homo sapiens
tgaagttttacatcctctccaa

SEQ ID NO: 6963303 - DNA, 22 bp, Homo sapiens
aatcagaaccttgggtcataac

SEQ ID NO: 6963304 - DNA, 22 bp, Homo sapiens
tgattccagcaacccaggaatt

SEQ ID NO: 6963305 - DNA, 22 bp, Homo sapiens
tctgttcttggtgcagctggga

SEQ ID NO: 6963306 - DNA, 22 bp, Homo sapiens
agactagtctgaaggttttttt

SEQ ID NO: 6963307 - DNA, 19 bp, Homo sapiens
agtcagcatgcatgtgact

SEQ ID NO: 6963308 - DNA, 22 bp, Homo sapiens
taatagttatggttggttctca

SEQ ID NO: 6963309 - DNA, 22 bp, Homo sapiens
gtccttggctgtggctgtaatg

SEQ ID NO: 6963310 - DNA, 22 bp, Homo sapiens
ctcaagtctgatgggttaggtt

SEQ ID NO: 6963311 - DNA, 22 bp, Homo sapiens
actgaattttaattagatctgc

SEQ ID NO: 6963312 - DNA, 22 bp, Homo sapiens
gagatgttattcttcagtgtgt

SEQ ID NO: 6963313 - DNA, 22 bp, Homo sapiens
aagggctgaatgaagggttgaa

SEQ ID NO: 6963314 - DNA, 22 bp, Homo sapiens
atgtagcatctatcctgataaa

SEQ ID NO: 6963315 - DNA, 22 bp, Homo sapiens
gaagttttctgaggctgtagct

SEQ ID NO: 6963316 - DNA, 22 bp, Homo sapiens
cccaggtccccacctgtctgct

SEQ ID NO: 6963317 - DNA, 22 bp, Homo sapiens
cccagggccctggacagctaca

SEQ ID NO: 6963318 - DNA, 22 bp, Homo sapiens
agtgtctgaactgggtgctgac

SEQ ID NO: 6963319 - DNA, 22 bp, Homo sapiens
acatctggagactacagtttgg

SEQ ID NO: 6963320 - DNA, 22 bp, Homo sapiens
caggtgggaccatgatagggca

SEQ ID NO: 6963321 - DNA, 22 bp, Homo sapiens
tgcatactgaatctgccatcac

SEQ ID NO: 6963322 - DNA, 22 bp, Homo sapiens
atgtggaggaaatgagtgtaca

SEQ ID NO: 6963323 - DNA, 22 bp, Homo sapiens
tcagaagagtaatagggtgaga

SEQ ID NO: 6963324 - DNA, 22 bp, Homo sapiens
agtcaccaacatggttcccagg

SEQ ID NO: 6963325 - DNA, 22 bp, Homo sapiens
tgcgcctgtaagtccagagtcc

SEQ ID NO: 6963326 - DNA, 19 bp, Homo sapiens
aggccctcaagtaacatta

SEQ ID NO: 6963327 - DNA, 22 bp, Homo sapiens
tctgtgcaggatttgaggaacc

SEQ ID NO: 6963328 - DNA, 22 bp, Homo sapiens
cccttggcttctatgggttttc

SEQ ID NO: 6963329 - DNA, 22 bp, Homo sapiens
gatgctgtggggttgaccctgg

SEQ ID NO: 6963330 - DNA, 22 bp, Homo sapiens
tgcagggcagctagggagcttt

SEQ ID NO: 6963331 - DNA, 22 bp, Homo sapiens
tcatatacctgcatgtgcatgt

SEQ ID NO: 6963332 - DNA, 22 bp, Homo sapiens
gactgaggctcccctaggctca

SEQ ID NO: 6963333 - DNA, 22 bp, Homo sapiens
gggcggggggagctggaatgaa

SEQ ID NO: 6963334 - DNA, 19 bp, Homo sapiens
agttccacactttatctgg

SEQ ID NO: 6963335 - DNA, 22 bp, Homo sapiens
acagattttggtatttgcaatg

SEQ ID NO: 6963336 - DNA, 22 bp, Homo sapiens
gctgaggcagtccacccttgtg

SEQ ID NO: 6963337 - DNA, 22 bp, Homo sapiens
gcttgctagaagcttaaaggta

SEQ ID NO: 6963338 - DNA, 22 bp, Homo sapiens
ttagtagaagacagataacaaa

SEQ ID NO: 6963339 - DNA, 22 bp, Homo sapiens
aacagacaactcctgtggctca

SEQ ID NO: 6963340 - DNA, 22 bp, Homo sapiens
atggcagggtctgtcttcagct

SEQ ID NO: 6963341 - DNA, 22 bp, Homo sapiens
tgttttgtccttttctatatac

SEQ ID NO: 6963342 - DNA, 23 bp, Homo sapiens
attagaaaggctttctggtgaaa

SEQ ID NO: 6963343 - DNA, 22 bp, Homo sapiens
agggctcaagggcatgctacgt

SEQ ID NO: 6963344 - DNA, 22 bp, Homo sapiens
tgtggggctgtggtgttcttct

SEQ ID NO: 6963345 - DNA, 22 bp, Homo sapiens
aaaagagtgtttcaactttggc

SEQ ID NO: 6963346 - DNA, 23 bp, Homo sapiens
tctgttttgcaacatgtgacaag

SEQ ID NO: 6963347 - DNA, 20 bp, Homo sapiens
ataacctgcccagaggatga

SEQ ID NO: 6963348 - DNA, 22 bp, Homo sapiens
aagcaattgtcctgtctctaca

SEQ ID NO: 6963349 - DNA, 22 bp, Homo sapiens
aacgttaatattttataagtct

SEQ ID NO: 6963350 - DNA, 22 bp, Homo sapiens
caaacatttaggaggagggagg

SEQ ID NO: 6963351 - DNA, 22 bp, Homo sapiens
tggctgagaagttctggtggga

SEQ ID NO: 6963352 - DNA, 20 bp, Homo sapiens
tcatatttttgccctgggcc

SEQ ID NO: 6963353 - DNA, 22 bp, Homo sapiens
ccagtgtattatttgagaaatt

SEQ ID NO: 6963354 - DNA, 22 bp, Homo sapiens
tctgcaggagcagggcgtggag

SEQ ID NO: 6963355 - DNA, 22 bp, Homo sapiens
tatgcacacattagcacagggt

SEQ ID NO: 6963356 - DNA, 20 bp, Homo sapiens
tatacagtcttttgggaaaa

SEQ ID NO: 6963357 - DNA, 22 bp, Homo sapiens
tatggcaagatgacatgttctc

SEQ ID NO: 6963358 - DNA, 20 bp, Homo sapiens
tcacaggggaccaggagcag

SEQ ID NO: 6963359 - DNA, 22 bp, Homo sapiens
tttaccaaagtactctgaggca

SEQ ID NO: 6963360 - DNA, 22 bp, Homo sapiens
tcccctctggttgacccaggag

SEQ ID NO: 6963361 - DNA, 22 bp, Homo sapiens
ataggtgtgtggttcatggccc

SEQ ID NO: 6963362 - DNA, 22 bp, Homo sapiens
ttcctggtctgtgccattcaga

SEQ ID NO: 6963363 - DNA, 22 bp, Homo sapiens
atcacagtgccttcgtaaattt

SEQ ID NO: 6963364 - DNA, 22 bp, Homo sapiens
ttttggcaggatatgcaccagc

SEQ ID NO: 6963365 - DNA, 20 bp, Homo sapiens
agtcttcccccagaagaggg

SEQ ID NO: 6963366 - DNA, 22 bp, Homo sapiens
agggctcagaacaatgagtgta

SEQ ID NO: 6963367 - DNA, 22 bp, Homo sapiens
ttcagctcagtctgtgcagcag

SEQ ID NO: 6963368 - DNA, 22 bp, Homo sapiens
ctgccctgacctgcctcagagt

SEQ ID NO: 6963369 - DNA, 22 bp, Homo sapiens
tgactaattatgttactaatca

SEQ ID NO: 6963370 - DNA, 22 bp, Homo sapiens
tgccagagagtggctgggtgtc

SEQ ID NO: 6963371 - DNA, 22 bp, Homo sapiens
ttcatgttttattcagtaatta

SEQ ID NO: 6963372 - DNA, 22 bp, Homo sapiens
aatgattctatttgcagcttgg

SEQ ID NO: 6963373 - DNA, 22 bp, Homo sapiens
ttaagaggtgaggcctttaaga

SEQ ID NO: 6963374 - DNA, 22 bp, Homo sapiens
ttttcctgcctgtctctagagg

SEQ ID NO: 6963375 - DNA, 23 bp, Homo sapiens
ccactgctttcattttgtcatgg

SEQ ID NO: 6963376 - DNA, 22 bp, Homo sapiens
aaattctatgtcaatgtttatt

SEQ ID NO: 6963377 - DNA, 22 bp, Homo sapiens
ttctcatgtaaatgccatcatc

SEQ ID NO: 6963378 - DNA, 22 bp, Homo sapiens
ctgttgtagctgcgctgcttca

SEQ ID NO: 6963379 - DNA, 22 bp, Homo sapiens
ggcagtgaatctgagagcctgg

SEQ ID NO: 6963380 - DNA, 22 bp, Homo sapiens
tcctctgatttgattacctagt

SEQ ID NO: 6963381 - DNA, 22 bp, Homo sapiens
aacaagcagatgcaatgcactt

SEQ ID NO: 6963382 - DNA, 22 bp, Homo sapiens
tcagaagcaagcttctacttct

SEQ ID NO: 6963383 - DNA, 22 bp, Homo sapiens
ggaatgttgtcatttacattat

SEQ ID NO: 6963384 - DNA, 22 bp, Homo sapiens
gtacatatcctttacgttttgt

SEQ ID NO: 6963385 - DNA, 22 bp, Homo sapiens
agatgcttactatggttgtatg

SEQ ID NO: 6963386 - DNA, 22 bp, Homo sapiens
tccccctacataatagggtagc

SEQ ID NO: 6963387 - DNA, 22 bp, Homo sapiens
ttccactgattttggttgacct

SEQ ID NO: 6963388 - DNA, 18 bp, Homo sapiens
ctgccatgtcctactgtc

SEQ ID NO: 6963389 - DNA, 22 bp, Homo sapiens
tgcagctgacccactccagtcc

SEQ ID NO: 6963390 - DNA, 22 bp, Homo sapiens
ttgcagctggtggtggccgtgt

SEQ ID NO: 6963391 - DNA, 22 bp, Homo sapiens
agctagggctttcgtagacagt

SEQ ID NO: 6963392 - DNA, 16 bp, Homo sapiens
ctggacagaaaaacct

SEQ ID NO: 6963393 - DNA, 22 bp, Homo sapiens
gttattcaacttgtgtctctta

SEQ ID NO: 6963394 - DNA, 22 bp, Homo sapiens
acctatgtacagttttactagt

SEQ ID NO: 6963395 - DNA, 22 bp, Homo sapiens
ggcctgagctctggggaggcaa

SEQ ID NO: 6963396 - DNA, 22 bp, Homo sapiens
gtgcagggccctcctaacatct

SEQ ID NO: 6963397 - DNA, 22 bp, Homo sapiens
gcaggattgggcagagggtgaa

SEQ ID NO: 6963398 - DNA, 22 bp, Homo sapiens
atacagaatttgcccttttcat

SEQ ID NO: 6963399 - DNA, 22 bp, Homo sapiens
ctgccatgcagttagtccctca

SEQ ID NO: 6963400 - DNA, 22 bp, Homo sapiens
actacttgagctgaggctagca

SEQ ID NO: 6963401 - DNA, 22 bp, Homo sapiens
aggctgagctggtagtgagtac

SEQ ID NO: 6963402 - DNA, 22 bp, Homo sapiens
tcctggtgcttgtatttgaagt

SEQ ID NO: 6963403 - DNA, 22 bp, Homo sapiens
gaagaaggtgccagaggcttac

SEQ ID NO: 6963404 - DNA, 22 bp, Homo sapiens
aatgtttctggatattgtgggt

SEQ ID NO: 6963405 - DNA, 22 bp, Homo sapiens
agtggcagtggctgggcagagc

SEQ ID NO: 6963406 - DNA, 22 bp, Homo sapiens
tacaaaaggaagagggatctta

SEQ ID NO: 6963407 - DNA, 22 bp, Homo sapiens
ttcttatattgggtcatggata

SEQ ID NO: 6963408 - DNA, 22 bp, Homo sapiens
ggcaaaaagttcccatcagtgt

SEQ ID NO: 6963409 - DNA, 22 bp, Homo sapiens
gccttcagtagtatcctcatga

SEQ ID NO: 6963410 - DNA, 22 bp, Homo sapiens
ttaccattccatgacatcagga

SEQ ID NO: 6963411 - DNA, 22 bp, Homo sapiens
ccagtctgctgtggtaggaaga

SEQ ID NO: 6963412 - DNA, 21 bp, Homo sapiens
aattagggtgcctcttataat

SEQ ID NO: 6963413 - DNA, 22 bp, Homo sapiens
aggagggtttcaatgggatgag

SEQ ID NO: 6963414 - DNA, 22 bp, Homo sapiens
actaaactgaagcatgaaaagg

SEQ ID NO: 6963415 - DNA, 22 bp, Homo sapiens
acatctcatgaatgataaatca

SEQ ID NO: 6963416 - DNA, 22 bp, Homo sapiens
tgttcattcgctattgtctatg

SEQ ID NO: 6963417 - DNA, 22 bp, Homo sapiens
aaagtgttatgcaaaactctgt

SEQ ID NO: 6963418 - DNA, 22 bp, Homo sapiens
atcaggtgatgctctggttccc

SEQ ID NO: 6963419 - DNA, 22 bp, Homo sapiens
agtttgcagattatattagtgt

SEQ ID NO: 6963420 - DNA, 22 bp, Homo sapiens
gcactacatcttcacgtgtctt

SEQ ID NO: 6963421 - DNA, 22 bp, Homo sapiens
aatgtgtcccttatttcacagg

SEQ ID NO: 6963422 - DNA, 22 bp, Homo sapiens
tcattaagattacgtgccagaa

SEQ ID NO: 6963423 - DNA, 22 bp, Homo sapiens
ggcccaaatctccacttgttgc

SEQ ID NO: 6963424 - DNA, 22 bp, Homo sapiens
tattccagtgtgatctttgtag

SEQ ID NO: 6963425 - DNA, 22 bp, Homo sapiens
tgccagcagaaataaatacttg

SEQ ID NO: 6963426 - DNA, 22 bp, Homo sapiens
atctacaggattttacagagtt

SEQ ID NO: 6963427 - DNA, 22 bp, Homo sapiens
gccctgtgagattagaacagca

SEQ ID NO: 6963428 - DNA, 22 bp, Homo sapiens
acactgtagactgttgaagtac

SEQ ID NO: 6963429 - DNA, 22 bp, Homo sapiens
tgcatggagtaattgatgcttg

SEQ ID NO: 6963430 - DNA, 22 bp, Homo sapiens
aagaaagtgatgagctacagat

SEQ ID NO: 6963431 - DNA, 17 bp, Homo sapiens
atttccagagtggccct

SEQ ID NO: 6963432 - DNA, 22 bp, Homo sapiens
aaggcttgtgtgttcagtgagg

SEQ ID NO: 6963433 - DNA, 23 bp, Homo sapiens
catcagcctcagtctgtggaccc

SEQ ID NO: 6963434 - DNA, 22 bp, Homo sapiens
ggtaaaaatcacaaatacttta

SEQ ID NO: 6963435 - DNA, 22 bp, Homo sapiens
cagtgattttaaactatggatg

SEQ ID NO: 6963436 - DNA, 22 bp, Homo sapiens
ttctgaatggcaagcattaggc

SEQ ID NO: 6963437 - DNA, 22 bp, Homo sapiens
atgtatcagaaatagcattggc

SEQ ID NO: 6963438 - DNA, 22 bp, Homo sapiens
attagcttattgtaaggtgaaa

SEQ ID NO: 6963439 - DNA, 22 bp, Homo sapiens
agctggttaagggtggagttaa

SEQ ID NO: 6963440 - DNA, 22 bp, Homo sapiens
tctaacattgaatggctgatta

SEQ ID NO: 6963441 - DNA, 22 bp, Homo sapiens
gacaggcttcatcctcagagtt

SEQ ID NO: 6963442 - DNA, 22 bp, Homo sapiens
cagtaaatggtacgtatatttt

SEQ ID NO: 6963443 - DNA, 22 bp, Homo sapiens
tcctcaaaggatacccaggctt

SEQ ID NO: 6963444 - DNA, 22 bp, Homo sapiens
atggcacagattagggtcacag

SEQ ID NO: 6963445 - DNA, 23 bp, Homo sapiens
tcctttaagatatcttattcctt

SEQ ID NO: 6963446 - DNA, 17 bp, Homo sapiens
cttcccaccatctcctg

SEQ ID NO: 6963447 - DNA, 22 bp, Homo sapiens
gctcaggtcttacccatgcctg

SEQ ID NO: 6963448 - DNA, 22 bp, Homo sapiens
atgcaggtccaaacgctagtgt

SEQ ID NO: 6963449 - DNA, 22 bp, Homo sapiens
ttcaagaatcttcctgaccact

SEQ ID NO: 6963450 - DNA, 17 bp, Homo sapiens
ctgaggagaacagaaag

SEQ ID NO: 6963451 - DNA, 22 bp, Homo sapiens
tcaatgtccgggccccattcca

SEQ ID NO: 6963452 - DNA, 22 bp, Homo sapiens
cagcagcctggcccctcctcgg

SEQ ID NO: 6963453 - DNA, 22 bp, Homo sapiens
taggccattcttggagcttact

SEQ ID NO: 6963454 - DNA, 22 bp, Homo sapiens
gtcctctgtagggctgggccac

SEQ ID NO: 6963455 - DNA, 22 bp, Homo sapiens
gagtaattttcttgatttctta

SEQ ID NO: 6963456 - DNA, 22 bp, Homo sapiens
gaaagactcttgatgtctttgg

SEQ ID NO: 6963457 - DNA, 22 bp, Homo sapiens
cactgtggggtttggctggaac

SEQ ID NO: 6963458 - DNA, 22 bp, Homo sapiens
gcccacacaccagctcaggagg

SEQ ID NO: 6963459 - DNA, 22 bp, Homo sapiens
gggacctgcgccactcactgtc

SEQ ID NO: 6963460 - DNA, 20 bp, Homo sapiens
tgcagcacgggccctttcca

SEQ ID NO: 6963461 - DNA, 22 bp, Homo sapiens
atggcaggcccaggtgttcatt

SEQ ID NO: 6963462 - DNA, 22 bp, Homo sapiens
tgctgaagggaaggtcttgaat

SEQ ID NO: 6963463 - DNA, 22 bp, Homo sapiens
tggttttaaaagatgtttgaga

SEQ ID NO: 6963464 - DNA, 21 bp, Homo sapiens
ttcatctggccgtattccagg

SEQ ID NO: 6963465 - DNA, 22 bp, Homo sapiens
tcaccaggcaactatgtactcc

SEQ ID NO: 6963466 - DNA, 19 bp, Homo sapiens
ggggagaactagagacagc

SEQ ID NO: 6963467 - DNA, 19 bp, Homo sapiens
aatctagaaatatgtgttc

SEQ ID NO: 6963468 - DNA, 22 bp, Homo sapiens
tctgcagcccaaagtctcttag

SEQ ID NO: 6963469 - DNA, 18 bp, Homo sapiens
gcaaggcagctctctggg

SEQ ID NO: 6963470 - DNA, 22 bp, Homo sapiens
gcccaggaggtggaggtgcagt

SEQ ID NO: 6963471 - DNA, 22 bp, Homo sapiens
tggaatccataaatgtcagatt

SEQ ID NO: 6963472 - DNA, 21 bp, Homo sapiens
tgcaatttagacttgaacatt

SEQ ID NO: 6963473 - DNA, 22 bp, Homo sapiens
atgacatttatacagtgagctt

SEQ ID NO: 6963474 - DNA, 22 bp, Homo sapiens
gtttctcaaattatttcagctt

SEQ ID NO: 6963475 - DNA, 22 bp, Homo sapiens
tgcaaatgggcatctccaagtg

SEQ ID NO: 6963476 - DNA, 22 bp, Homo sapiens
cagcagaggcacgtctgtgaat

SEQ ID NO: 6963477 - DNA, 23 bp, Homo sapiens
acccatctctcctgtcatgcaga

SEQ ID NO: 6963478 - DNA, 22 bp, Homo sapiens
gtgcacttgatctagacagatt

SEQ ID NO: 6963479 - DNA, 19 bp, Homo sapiens
ggaggcctgggtatttgcc

SEQ ID NO: 6963480 - DNA, 22 bp, Homo sapiens
gcattccttggtttaaaacaag

SEQ ID NO: 6963481 - DNA, 20 bp, Homo sapiens
ttggaggtgcagtgcatgca

SEQ ID NO: 6963482 - DNA, 21 bp, Homo sapiens
tgttagtctgacaaagaccta

SEQ ID NO: 6963483 - DNA, 21 bp, Homo sapiens
tactgtagccttgcactgtag

SEQ ID NO: 6963484 - DNA, 22 bp, Homo sapiens
cgtgccctgcgcaagtgctgct

SEQ ID NO: 6963485 - DNA, 22 bp, Homo sapiens
catttgttctgatttcaaaagg

SEQ ID NO: 6963486 - DNA, 22 bp, Homo sapiens
atgttcatatccccattctgat

SEQ ID NO: 6963487 - DNA, 22 bp, Homo sapiens
attcttcacactaaccctgtga

SEQ ID NO: 6963488 - DNA, 22 bp, Homo sapiens
acccggcggagcctgcagtgag

SEQ ID NO: 6963489 - DNA, 22 bp, Homo sapiens
tggcttttgaaaaggtgatgta

SEQ ID NO: 6963490 - DNA, 19 bp, Homo sapiens
tctaaactagtcccataac

SEQ ID NO: 6963491 - DNA, 18 bp, Homo sapiens
agcattcggtagtggtag

SEQ ID NO: 6963492 - DNA, 21 bp, Homo sapiens
tgctcatgagcccacagctgc

SEQ ID NO: 6963493 - DNA, 22 bp, Homo sapiens
actgcatagaggtccctgcgtc

SEQ ID NO: 6963494 - DNA, 22 bp, Homo sapiens
gtgcctctcttcatacatttgt

SEQ ID NO: 6963495 - DNA, 19 bp, Homo sapiens
ttgagaattatctgagtca

SEQ ID NO: 6963496 - DNA, 22 bp, Homo sapiens
actgcagcaaagcccgtgtctt

SEQ ID NO: 6963497 - DNA, 22 bp, Homo sapiens
gaagcagtgtgaacccatgtaa

SEQ ID NO: 6963498 - DNA, 22 bp, Homo sapiens
catggtgtgctgaatatgaagt

SEQ ID NO: 6963499 - DNA, 22 bp, Homo sapiens
ttgcatgtccagggtattgtgg

SEQ ID NO: 6963500 - DNA, 22 bp, Homo sapiens
gtttcataggcatgtgacctat

SEQ ID NO: 6963501 - DNA, 23 bp, Homo sapiens
atttctaggggattttctggtgc

SEQ ID NO: 6963502 - DNA, 22 bp, Homo sapiens
tggaacaagacagcatagagct

SEQ ID NO: 6963503 - DNA, 22 bp, Homo sapiens
tggactaaagaggaaagatgta

SEQ ID NO: 6963504 - DNA, 22 bp, Homo sapiens
tttcacatttaggcgtgaattg

SEQ ID NO: 6963505 - DNA, 22 bp, Homo sapiens
taaagctaatgtttacgttcct

SEQ ID NO: 6963506 - DNA, 22 bp, Homo sapiens
tagtcctttccggctgctataa

SEQ ID NO: 6963507 - DNA, 22 bp, Homo sapiens
tctggtggtgggccacaagcat

SEQ ID NO: 6963508 - DNA, 23 bp, Homo sapiens
ataagaaaacagtaggctcagag

SEQ ID NO: 6963509 - DNA, 22 bp, Homo sapiens
acctgggagtcacacctgagaa

SEQ ID NO: 6963510 - DNA, 22 bp, Homo sapiens
tggtcctggtagcggtgtgctt

SEQ ID NO: 6963511 - DNA, 22 bp, Homo sapiens
agtaacaaatagctgcctttaa

SEQ ID NO: 6963512 - DNA, 22 bp, Homo sapiens
tactactttcattcatctgact

SEQ ID NO: 6963513 - DNA, 18 bp, Homo sapiens
atgtacatttgctaaagc

SEQ ID NO: 6963514 - DNA, 22 bp, Homo sapiens
attgcattgtttgaggcagagg

SEQ ID NO: 6963515 - DNA, 22 bp, Homo sapiens
aaggcaatgtcatggctcttgc

SEQ ID NO: 6963516 - DNA, 22 bp, Homo sapiens
aatcccattgtggaattaagga

SEQ ID NO: 6963517 - DNA, 22 bp, Homo sapiens
gcagggccagggctcaggctgt

SEQ ID NO: 6963518 - DNA, 22 bp, Homo sapiens
ctgtggtggcctccctgccatg

SEQ ID NO: 6963519 - DNA, 22 bp, Homo sapiens
tgcttatatttcattggcccaa

SEQ ID NO: 6963520 - DNA, 16 bp, Homo sapiens
tgaggtcttattagca

SEQ ID NO: 6963521 - DNA, 22 bp, Homo sapiens
cctcatgaggcaggcagggtag

SEQ ID NO: 6963522 - DNA, 22 bp, Homo sapiens
cttatagactcttgttgttaga

SEQ ID NO: 6963523 - DNA, 22 bp, Homo sapiens
tctctagcttccttaggaacac

SEQ ID NO: 6963524 - DNA, 22 bp, Homo sapiens
aaacatgttttctgaatatttt

SEQ ID NO: 6963525 - DNA, 22 bp, Homo sapiens
tacaaggcttcagctcagctat

SEQ ID NO: 6963526 - DNA, 22 bp, Homo sapiens
atacattagaatctggtactca

SEQ ID NO: 6963527 - DNA, 22 bp, Homo sapiens
gagctaagccctggagaggtcg

SEQ ID NO: 6963528 - DNA, 23 bp, Homo sapiens
ccctgtagcccaggacaggcttt

SEQ ID NO: 6963529 - DNA, 22 bp, Homo sapiens
taatgcacctttgctttctgaa

SEQ ID NO: 6963530 - DNA, 22 bp, Homo sapiens
cacacatgtgggatccgcaggg

SEQ ID NO: 6963531 - DNA, 22 bp, Homo sapiens
gccaatactcacctagggtttt

SEQ ID NO: 6963532 - DNA, 22 bp, Homo sapiens
tatagcatatacagataagctg

SEQ ID NO: 6963533 - DNA, 22 bp, Homo sapiens
acttcccttgctttacgatgtt

SEQ ID NO: 6963534 - DNA, 22 bp, Homo sapiens
ctgctctgtggtccatgagaca

SEQ ID NO: 6963535 - DNA, 22 bp, Homo sapiens
ctctgggctgaatggctgaacc

SEQ ID NO: 6963536 - DNA, 22 bp, Homo sapiens
gaggagaagctaagaaacacag

SEQ ID NO: 6963537 - DNA, 22 bp, Homo sapiens
tgcagggtctctgcaaatgagg

SEQ ID NO: 6963538 - DNA, 21 bp, Homo sapiens
taggccacatgggttggagat

SEQ ID NO: 6963539 - DNA, 22 bp, Homo sapiens
ccaacagtccagatgagatggt

SEQ ID NO: 6963540 - DNA, 22 bp, Homo sapiens
cactggcatctaagggtggtag

SEQ ID NO: 6963541 - DNA, 22 bp, Homo sapiens
cagtcaggctgcgcttctctga

SEQ ID NO: 6963542 - DNA, 22 bp, Homo sapiens
acagaactgtgatctcataaat

SEQ ID NO: 6963543 - DNA, 22 bp, Homo sapiens
agtctatttgctgtccgagcaa

SEQ ID NO: 6963544 - DNA, 22 bp, Homo sapiens
cacatttctggaattgacttgg

SEQ ID NO: 6963545 - DNA, 20 bp, Homo sapiens
ggacactgtagatttcaaac

SEQ ID NO: 6963546 - DNA, 22 bp, Homo sapiens
tcagaggtagtagcagagttga

SEQ ID NO: 6963547 - DNA, 22 bp, Homo sapiens
aagtcagtgctagctaatggct

SEQ ID NO: 6963548 - DNA, 22 bp, Homo sapiens
ccgaggctcctccccgagtctg

SEQ ID NO: 6963549 - DNA, 22 bp, Homo sapiens
gaatgcttggaacctgaagttc

SEQ ID NO: 6963550 - DNA, 22 bp, Homo sapiens
tttctaatagttgagtcagcta

SEQ ID NO: 6963551 - DNA, 22 bp, Homo sapiens
agcttcagttttctattgttaa

SEQ ID NO: 6963552 - DNA, 22 bp, Homo sapiens
tctggatgttgcggagtacaga

SEQ ID NO: 6963553 - DNA, 22 bp, Homo sapiens
gagagcagactctcaaagctgg

SEQ ID NO: 6963554 - DNA, 22 bp, Homo sapiens
attaagatcattgtagaagatt

SEQ ID NO: 6963555 - DNA, 22 bp, Homo sapiens
tcacttgatccttccctgaaat

SEQ ID NO: 6963556 - DNA, 22 bp, Homo sapiens
tctcagggccccaaaggctagt

SEQ ID NO: 6963557 - DNA, 22 bp, Homo sapiens
tcagtgggagcaggagagtgac

SEQ ID NO: 6963558 - DNA, 22 bp, Homo sapiens
atgacatgaataaaaatcgtgt

SEQ ID NO: 6963559 - DNA, 22 bp, Homo sapiens
ttattctgttggccctctcatc

SEQ ID NO: 6963560 - DNA, 22 bp, Homo sapiens
attatattgagtataaccagag

SEQ ID NO: 6963561 - DNA, 22 bp, Homo sapiens
aagtttccactggcagtccgta

SEQ ID NO: 6963562 - DNA, 22 bp, Homo sapiens
ctccagaaattcaacagcaaat

SEQ ID NO: 6963563 - DNA, 18 bp, Homo sapiens
ctgtgggaaggctttcta

SEQ ID NO: 6963564 - DNA, 22 bp, Homo sapiens
tctggctatatgctggcttcca

SEQ ID NO: 6963565 - DNA, 22 bp, Homo sapiens
tctgtggcttctatttaacttt

SEQ ID NO: 6963566 - DNA, 22 bp, Homo sapiens
tttgatcagcaagataaataga

SEQ ID NO: 6963567 - DNA, 22 bp, Homo sapiens
acagttcaagacatcagtatga

SEQ ID NO: 6963568 - DNA, 22 bp, Homo sapiens
aatgtcttcagtgtatacatgg

SEQ ID NO: 6963569 - DNA, 22 bp, Homo sapiens
tgaagggtggcatggcaggcag

SEQ ID NO: 6963570 - DNA, 22 bp, Homo sapiens
cctgggctctatcctgacccag

SEQ ID NO: 6963571 - DNA, 23 bp, Homo sapiens
ttgaagttctgctgtgttatagg

SEQ ID NO: 6963572 - DNA, 22 bp, Homo sapiens
cagcatttaatgcagtgcttcc

SEQ ID NO: 6963573 - DNA, 22 bp, Homo sapiens
agcagcatcaaccctcccgtgt

SEQ ID NO: 6963574 - DNA, 22 bp, Homo sapiens
ctttggatgactggtgcaggtt

SEQ ID NO: 6963575 - DNA, 23 bp, Homo sapiens
aatcacttccctccaaatggatt

SEQ ID NO: 6963576 - DNA, 22 bp, Homo sapiens
aagatatattcgacgtgaatga

SEQ ID NO: 6963577 - DNA, 22 bp, Homo sapiens
aggccctctagaggagtgtttg

SEQ ID NO: 6963578 - DNA, 23 bp, Homo sapiens
gcacatagtaagtaagcagacat

SEQ ID NO: 6963579 - DNA, 22 bp, Homo sapiens
tccctgggacggccttttggag

SEQ ID NO: 6963580 - DNA, 22 bp, Homo sapiens
ctatagaaacaacctctctttc

SEQ ID NO: 6963581 - DNA, 22 bp, Homo sapiens
ctgacatgttgacaagaaataa

SEQ ID NO: 6963582 - DNA, 22 bp, Homo sapiens
atcagagtgggtctggcatgag

SEQ ID NO: 6963583 - DNA, 22 bp, Homo sapiens
catgtgccccgggtcccttggt

SEQ ID NO: 6963584 - DNA, 22 bp, Homo sapiens
gcaggaactggagctggatgtt

SEQ ID NO: 6963585 - DNA, 22 bp, Homo sapiens
tgttagtgtaattccagttttc

SEQ ID NO: 6963586 - DNA, 22 bp, Homo sapiens
agagctgcaacttcataggcct

SEQ ID NO: 6963587 - DNA, 22 bp, Homo sapiens
aagcagagccaccagctttgga

SEQ ID NO: 6963588 - DNA, 22 bp, Homo sapiens
gtgggcttgttttgatgagatc

SEQ ID NO: 6963589 - DNA, 22 bp, Homo sapiens
ttatatatcttgatttgttcca

SEQ ID NO: 6963590 - DNA, 22 bp, Homo sapiens
tccaggagaggcctgaccaggt

SEQ ID NO: 6963591 - DNA, 22 bp, Homo sapiens
gtctggaccttggactccttaa

SEQ ID NO: 6963592 - DNA, 22 bp, Homo sapiens
tgcatattatgtgtatctgtct

SEQ ID NO: 6963593 - DNA, 22 bp, Homo sapiens
aaggtggttgcaattaccataa

SEQ ID NO: 6963594 - DNA, 22 bp, Homo sapiens
agcacataccagaaccacaggt

SEQ ID NO: 6963595 - DNA, 22 bp, Homo sapiens
cttctctccctggcactcagac

SEQ ID NO: 6963596 - DNA, 22 bp, Homo sapiens
ttaacaggttatattgtacagg

SEQ ID NO: 6963597 - DNA, 22 bp, Homo sapiens
taaagcaaggaatagagtagtc

SEQ ID NO: 6963598 - DNA, 22 bp, Homo sapiens
ttgacaaaggctgagaggaaaa

SEQ ID NO: 6963599 - DNA, 22 bp, Homo sapiens
gcaggaaaaccttcccatgttt

SEQ ID NO: 6963600 - DNA, 22 bp, Homo sapiens
tggtaactttgatgatttgggt

SEQ ID NO: 6963601 - DNA, 22 bp, Homo sapiens
ttgagaataaattagcagacat

SEQ ID NO: 6963602 - DNA, 22 bp, Homo sapiens
ttctttgttgagcaagtaggac

SEQ ID NO: 6963603 - DNA, 22 bp, Homo sapiens
tgaggctggcaaggctggtatt

SEQ ID NO: 6963604 - DNA, 22 bp, Homo sapiens
aatctgatgttaaatgtaaggt

SEQ ID NO: 6963605 - DNA, 22 bp, Homo sapiens
tctgtgcaatagtttgttttac

SEQ ID NO: 6963606 - DNA, 22 bp, Homo sapiens
agctgcagtatgaggctggtgg

SEQ ID NO: 6963607 - DNA, 22 bp, Homo sapiens
ggcagacctctccagccccaca

SEQ ID NO: 6963608 - DNA, 22 bp, Homo sapiens
gttattatttctctccttgcta

SEQ ID NO: 6963609 - DNA, 22 bp, Homo sapiens
ggtattctaagctgtgtttact

SEQ ID NO: 6963610 - DNA, 23 bp, Homo sapiens
cctgagatctgtaagggaccttg

SEQ ID NO: 6963611 - DNA, 22 bp, Homo sapiens
gattcacctttatttcattggg

SEQ ID NO: 6963612 - DNA, 21 bp, Homo sapiens
agctttgctttgtactcattt

SEQ ID NO: 6963613 - DNA, 22 bp, Homo sapiens
agagattgtgctactcacccaa

SEQ ID NO: 6963614 - DNA, 22 bp, Homo sapiens
tttgtaagcaagttaacatttt

SEQ ID NO: 6963615 - DNA, 22 bp, Homo sapiens
ataaaatttgctactgttaaat

SEQ ID NO: 6963616 - DNA, 22 bp, Homo sapiens
atcactagctcaacatttacta

SEQ ID NO: 6963617 - DNA, 22 bp, Homo sapiens
ccacagctgaaagcagaggctc

SEQ ID NO: 6963618 - DNA, 22 bp, Homo sapiens
tttacacatacctctttaaagt

SEQ ID NO: 6963619 - DNA, 22 bp, Homo sapiens
gctgtggcctagtttgttatat

SEQ ID NO: 6963620 - DNA, 22 bp, Homo sapiens
ttacgcagctgctccaggaagc

SEQ ID NO: 6963621 - DNA, 22 bp, Homo sapiens
tttggcaatggatggtcatcta

SEQ ID NO: 6963622 - DNA, 22 bp, Homo sapiens
ttattcagtttgtgtagaggtg

SEQ ID NO: 6963623 - DNA, 22 bp, Homo sapiens
tagatcatatttgtggagaaaa

SEQ ID NO: 6963624 - DNA, 22 bp, Homo sapiens
tcctccagggggatcttcagcc

SEQ ID NO: 6963625 - DNA, 22 bp, Homo sapiens
tctgtccattcagaatggccct

SEQ ID NO: 6963626 - DNA, 22 bp, Homo sapiens
aattgtgatgacagctggtggt

SEQ ID NO: 6963627 - DNA, 22 bp, Homo sapiens
acttcatgaactaagggatcgg

SEQ ID NO: 6963628 - DNA, 22 bp, Homo sapiens
tgggaagggcctgcccttcctc

SEQ ID NO: 6963629 - DNA, 22 bp, Homo sapiens
tggaagcagagagctatcacca

SEQ ID NO: 6963630 - DNA, 22 bp, Homo sapiens
agattgtcattgacgatgagca

SEQ ID NO: 6963631 - DNA, 22 bp, Homo sapiens
cggctcagctagcttggcccca

SEQ ID NO: 6963632 - DNA, 22 bp, Homo sapiens
tcactctgtcccccattgagat

SEQ ID NO: 6963633 - DNA, 22 bp, Homo sapiens
actctattttctcattttgcat

SEQ ID NO: 6963634 - DNA, 22 bp, Homo sapiens
agaacgtggaatgtggctcctt

SEQ ID NO: 6963635 - DNA, 22 bp, Homo sapiens
tcaggctgttagccacctcctc

SEQ ID NO: 6963636 - DNA, 22 bp, Homo sapiens
cagcacagtttctggcccgccg

SEQ ID NO: 6963637 - DNA, 22 bp, Homo sapiens
agtgggccggacagcccaggcc

SEQ ID NO: 6963638 - DNA, 19 bp, Homo sapiens
ctagggcttggcagcaggc

SEQ ID NO: 6963639 - DNA, 22 bp, Homo sapiens
acagtctttgcagaagcaatat

SEQ ID NO: 6963640 - DNA, 22 bp, Homo sapiens
tcacacctgtaatcccaggcct

SEQ ID NO: 6963641 - DNA, 22 bp, Homo sapiens
agagcctgtgggagatgcagct

SEQ ID NO: 6963642 - DNA, 22 bp, Homo sapiens
gagaaagatgaagagtggcgtt

SEQ ID NO: 6963643 - DNA, 22 bp, Homo sapiens
aggtgctggagtctgggcagga

SEQ ID NO: 6963644 - DNA, 18 bp, Homo sapiens
agtttttaggaagaaatg

SEQ ID NO: 6963645 - DNA, 22 bp, Homo sapiens
tccagctctaaggctgatagcc

SEQ ID NO: 6963646 - DNA, 22 bp, Homo sapiens
agttctcattgcatgagacaga

SEQ ID NO: 6963647 - DNA, 22 bp, Homo sapiens
ctgccaggtgccagggcgcggc

SEQ ID NO: 6963648 - DNA, 22 bp, Homo sapiens
tgcttaatgtacgtgagtgtac

SEQ ID NO: 6963649 - DNA, 22 bp, Homo sapiens
tggagactgactgcctgtattt

SEQ ID NO: 6963650 - DNA, 22 bp, Homo sapiens
gaggacacggccttttggaaaa

SEQ ID NO: 6963651 - DNA, 22 bp, Homo sapiens
ttagtcaatagtgaatatagag

SEQ ID NO: 6963652 - DNA, 22 bp, Homo sapiens
aggtctacatgcttaatatatc

SEQ ID NO: 6963653 - DNA, 22 bp, Homo sapiens
tgaggctctccaagcagatgag

SEQ ID NO: 6963654 - DNA, 22 bp, Homo sapiens
aggtttatgtttggtgcaggag

SEQ ID NO: 6963655 - DNA, 22 bp, Homo sapiens
gcagagcggtgatcaggcgcag

SEQ ID NO: 6963656 - DNA, 22 bp, Homo sapiens
ttcaacatttgatacaagtcag

SEQ ID NO: 6963657 - DNA, 22 bp, Homo sapiens
tttcacaggtatccacgggtct

SEQ ID NO: 6963658 - DNA, 22 bp, Homo sapiens
aggccatgccaggcccaggaag

SEQ ID NO: 6963659 - DNA, 19 bp, Homo sapiens
acagagctctctgcttctg

SEQ ID NO: 6963660 - DNA, 22 bp, Homo sapiens
tgtcatcttaaatcattcccac

SEQ ID NO: 6963661 - DNA, 22 bp, Homo sapiens
atggcaagcaagctgaagagat

SEQ ID NO: 6963662 - DNA, 22 bp, Homo sapiens
gatctggtttcatcatggactt

SEQ ID NO: 6963663 - DNA, 22 bp, Homo sapiens
tttgaaagtgtttacttgggaa

SEQ ID NO: 6963664 - DNA, 22 bp, Homo sapiens
ttcatgtctgccttttcaagtg

SEQ ID NO: 6963665 - DNA, 22 bp, Homo sapiens
acaattctgggtatttatatag

SEQ ID NO: 6963666 - DNA, 22 bp, Homo sapiens
tttattatgatggacaccttcg

SEQ ID NO: 6963667 - DNA, 22 bp, Homo sapiens
acagactgtgagtatgcatagt

SEQ ID NO: 6963668 - DNA, 22 bp, Homo sapiens
gccctctgatgctcaccgagga

SEQ ID NO: 6963669 - DNA, 22 bp, Homo sapiens
tttagcaagattgagccgtctt

SEQ ID NO: 6963670 - DNA, 22 bp, Homo sapiens
aatgccatgctaagggcttggt

SEQ ID NO: 6963671 - DNA, 22 bp, Homo sapiens
tctctctgtgacagctttgctg

SEQ ID NO: 6963672 - DNA, 20 bp, Homo sapiens
aaccaggatagaccagggaa

SEQ ID NO: 6963673 - DNA, 20 bp, Homo sapiens
acacttgacaccagaaatgg

SEQ ID NO: 6963674 - DNA, 22 bp, Homo sapiens
ctttcacagctactcacctctg

SEQ ID NO: 6963675 - DNA, 22 bp, Homo sapiens
tcctgcagcatccgtcgtctgt

SEQ ID NO: 6963676 - DNA, 22 bp, Homo sapiens
gaggaagttctatgattacatc

SEQ ID NO: 6963677 - DNA, 22 bp, Homo sapiens
tggaatgaaaatggagatcttg

SEQ ID NO: 6963678 - DNA, 22 bp, Homo sapiens
attagagtaatgccagggccgg

SEQ ID NO: 6963679 - DNA, 22 bp, Homo sapiens
catgtaaagaatttcacacaag

SEQ ID NO: 6963680 - DNA, 22 bp, Homo sapiens
ttgtaaacatagagatttaggt

SEQ ID NO: 6963681 - DNA, 22 bp, Homo sapiens
cctttgcattctagatgtttag

SEQ ID NO: 6963682 - DNA, 22 bp, Homo sapiens
cccaggcagtgctgatccctca

SEQ ID NO: 6963683 - DNA, 22 bp, Homo sapiens
gactttgccctaatgaggtctc

SEQ ID NO: 6963684 - DNA, 22 bp, Homo sapiens
ttaggccacagggaaaatcaaa

SEQ ID NO: 6963685 - DNA, 22 bp, Homo sapiens
ttctgtccgcttgtttgttaga

SEQ ID NO: 6963686 - DNA, 22 bp, Homo sapiens
aactgagattacaagagacatt

SEQ ID NO: 6963687 - DNA, 20 bp, Homo sapiens
gcagtgtgtatgaatagctg

SEQ ID NO: 6963688 - DNA, 20 bp, Homo sapiens
atgtatattactggctgtga

SEQ ID NO: 6963689 - DNA, 22 bp, Homo sapiens
gcagaggtgagtttctcagctg

SEQ ID NO: 6963690 - DNA, 22 bp, Homo sapiens
gggctctggaaggtgcaccatg

SEQ ID NO: 6963691 - DNA, 22 bp, Homo sapiens
aatacctttcctgccattcact

SEQ ID NO: 6963692 - DNA, 23 bp, Homo sapiens
gtatacgtgcaagtcacagggga

SEQ ID NO: 6963693 - DNA, 22 bp, Homo sapiens
agtttttcctgattttacagaa

SEQ ID NO: 6963694 - DNA, 22 bp, Homo sapiens
ggcagcttcctaggagagggca

SEQ ID NO: 6963695 - DNA, 21 bp, Homo sapiens
gtgtcatggttgactttggca

SEQ ID NO: 6963696 - DNA, 22 bp, Homo sapiens
gagattctggttaggtgtattt

SEQ ID NO: 6963697 - DNA, 22 bp, Homo sapiens
tgtggtgtgtctcacaaatgca

SEQ ID NO: 6963698 - DNA, 22 bp, Homo sapiens
tgaaatcatcaaaagagccatt

SEQ ID NO: 6963699 - DNA, 22 bp, Homo sapiens
ttagaagtggtaagtagaaaga

SEQ ID NO: 6963700 - DNA, 17 bp, Homo sapiens
acccaggctctatcttg

SEQ ID NO: 6963701 - DNA, 22 bp, Homo sapiens
tccttcctcggggacccagatc

SEQ ID NO: 6963702 - DNA, 22 bp, Homo sapiens
tacatctatactgatctacatt

SEQ ID NO: 6963703 - DNA, 22 bp, Homo sapiens
tatccacgtatgataaaactct

SEQ ID NO: 6963704 - DNA, 22 bp, Homo sapiens
atattgggattttaggttaaag

SEQ ID NO: 6963705 - DNA, 22 bp, Homo sapiens
ggccctctgatacagaagaatg

SEQ ID NO: 6963706 - DNA, 22 bp, Homo sapiens
ttcatgtaacttttcttctcca

SEQ ID NO: 6963707 - DNA, 17 bp, Homo sapiens
ccctggctctaggtgga

SEQ ID NO: 6963708 - DNA, 18 bp, Homo sapiens
gttttgaattgtcttaca

SEQ ID NO: 6963709 - DNA, 23 bp, Homo sapiens
atcctatataaccttggaggctg

SEQ ID NO: 6963710 - DNA, 22 bp, Homo sapiens
tcagatcatggatctattactt

SEQ ID NO: 6963711 - DNA, 22 bp, Homo sapiens
aaacagctgggaggtagaggcg

SEQ ID NO: 6963712 - DNA, 22 bp, Homo sapiens
tgcagttcaaggttgtacagct

SEQ ID NO: 6963713 - DNA, 20 bp, Homo sapiens
gcagctactctgtctcgctc

SEQ ID NO: 6963714 - DNA, 20 bp, Homo sapiens
gcaagcatgaagagtagaga

SEQ ID NO: 6963715 - DNA, 22 bp, Homo sapiens
agggaagcaatattagatatca

SEQ ID NO: 6963716 - DNA, 22 bp, Homo sapiens
ttgctctgcagtccagacagta

SEQ ID NO: 6963717 - DNA, 22 bp, Homo sapiens
aggcacctcagctgagcctggg

SEQ ID NO: 6963718 - DNA, 23 bp, Homo sapiens
acaggcaggcatggccaaatgtg

SEQ ID NO: 6963719 - DNA, 22 bp, Homo sapiens
tgtgaggattaaatgcatagtg

SEQ ID NO: 6963720 - DNA, 22 bp, Homo sapiens
tgtatatatttctttcattcta

SEQ ID NO: 6963721 - DNA, 22 bp, Homo sapiens
tggtctgatagtctgaaaatga

SEQ ID NO: 6963722 - DNA, 22 bp, Homo sapiens
cccaggaagggatgccaaggaa

SEQ ID NO: 6963723 - DNA, 17 bp, Homo sapiens
cctttctctttcatctc

SEQ ID NO: 6963724 - DNA, 22 bp, Homo sapiens
gggatgagagctgggacagaag

SEQ ID NO: 6963725 - DNA, 20 bp, Homo sapiens
tctgccttagggggagcctc

SEQ ID NO: 6963726 - DNA, 21 bp, Homo sapiens
tcatccatggcttttgtgctt

SEQ ID NO: 6963727 - DNA, 22 bp, Homo sapiens
cccccagctctgctgggtcccg

SEQ ID NO: 6963728 - DNA, 22 bp, Homo sapiens
gccacaggtactatgggagaga

SEQ ID NO: 6963729 - DNA, 22 bp, Homo sapiens
aatcagagccctctgagcttca

SEQ ID NO: 6963730 - DNA, 22 bp, Homo sapiens
ctgctgctgagagctcagcctg

SEQ ID NO: 6963731 - DNA, 22 bp, Homo sapiens
tggagatgcacgagcaggtgga

SEQ ID NO: 6963732 - DNA, 22 bp, Homo sapiens
cagcagagtatggcactcaact

SEQ ID NO: 6963733 - DNA, 22 bp, Homo sapiens
ttccatattggaaggcacaggc

SEQ ID NO: 6963734 - DNA, 22 bp, Homo sapiens
gacagtggtgttttccattgca

SEQ ID NO: 6963735 - DNA, 22 bp, Homo sapiens
tgttcctgtttaatgtgctcat

SEQ ID NO: 6963736 - DNA, 22 bp, Homo sapiens
tttccagttgttctagaaagct

SEQ ID NO: 6963737 - DNA, 22 bp, Homo sapiens
atcagtgtaccttatggatttt

SEQ ID NO: 6963738 - DNA, 22 bp, Homo sapiens
ctgcagcagaataatctgctca

SEQ ID NO: 6963739 - DNA, 22 bp, Homo sapiens
aatgtcaaagtgctttgcaaac

SEQ ID NO: 6963740 - DNA, 22 bp, Homo sapiens
tcataaattatctatttggcta

SEQ ID NO: 6963741 - DNA, 22 bp, Homo sapiens
tcttgaagtccttacatttgat

SEQ ID NO: 6963742 - DNA, 22 bp, Homo sapiens
cctgtgtcttccccactggtgt

SEQ ID NO: 6963743 - DNA, 22 bp, Homo sapiens
tactgtattgttggctcttttg

SEQ ID NO: 6963744 - DNA, 22 bp, Homo sapiens
gaaaaggcagagttccggggaa

SEQ ID NO: 6963745 - DNA, 18 bp, Homo sapiens
acaaatgtagtgtcttaa

SEQ ID NO: 6963746 - DNA, 22 bp, Homo sapiens
ttagatgtggctatatgatcgt

SEQ ID NO: 6963747 - DNA, 22 bp, Homo sapiens
ttgtgagtagtgccgcaataaa

SEQ ID NO: 6963748 - DNA, 22 bp, Homo sapiens
ttgtgaatagtgccacaataaa

SEQ ID NO: 6963749 - DNA, 22 bp, Homo sapiens
aaagtgcattgtttgtgttcct

SEQ ID NO: 6963750 - DNA, 22 bp, Homo sapiens
atgtagcagaagatgttttcct

SEQ ID NO: 6963751 - DNA, 22 bp, Homo sapiens
agctgctatgtaggaataagat

SEQ ID NO: 6963752 - DNA, 22 bp, Homo sapiens
agaagagtagtaacagaaatta

SEQ ID NO: 6963753 - DNA, 22 bp, Homo sapiens
tccctgtgggatgaggactctg

SEQ ID NO: 6963754 - DNA, 22 bp, Homo sapiens
ttatacactgcagaaccagcat

SEQ ID NO: 6963755 - DNA, 22 bp, Homo sapiens
aaggcagccatgtgctttgggt

SEQ ID NO: 6963756 - DNA, 22 bp, Homo sapiens
gatggctttgcctgctgtgagg

SEQ ID NO: 6963757 - DNA, 22 bp, Homo sapiens
ggccggttcaagggcagtcaga

SEQ ID NO: 6963758 - DNA, 22 bp, Homo sapiens
cagcaggaaggtttcccctgca

SEQ ID NO: 6963759 - DNA, 22 bp, Homo sapiens
gtttcctgaagttatttcatcc

SEQ ID NO: 6963760 - DNA, 22 bp, Homo sapiens
tggagccagtgttgcccaacac

SEQ ID NO: 6963761 - DNA, 22 bp, Homo sapiens
gtgctaaatattgtgtttgtct

SEQ ID NO: 6963762 - DNA, 22 bp, Homo sapiens
cttcaacagttttagaacactg

SEQ ID NO: 6963763 - DNA, 22 bp, Homo sapiens
ctgcctggggcatcagtcaagg

SEQ ID NO: 6963764 - DNA, 22 bp, Homo sapiens
tgtctattttacagcatacatt

SEQ ID NO: 6963765 - DNA, 22 bp, Homo sapiens
aacagctgcttctatcttttca

SEQ ID NO: 6963766 - DNA, 22 bp, Homo sapiens
gcagagcctgacgggatttttc

SEQ ID NO: 6963767 - DNA, 22 bp, Homo sapiens
atatcataaatcggtgcatgaa

SEQ ID NO: 6963768 - DNA, 22 bp, Homo sapiens
tctgagctgcccctttactttg

SEQ ID NO: 6963769 - DNA, 22 bp, Homo sapiens
tgtatacaaattggaatcagat

SEQ ID NO: 6963770 - DNA, 22 bp, Homo sapiens
ccacagcatgcaggcctgacac

SEQ ID NO: 6963771 - DNA, 22 bp, Homo sapiens
cagctgggctaagagtagaggc

SEQ ID NO: 6963772 - DNA, 22 bp, Homo sapiens
tttagtgtggcactgatgttca

SEQ ID NO: 6963773 - DNA, 22 bp, Homo sapiens
tgcagctcaggattctcagggc

SEQ ID NO: 6963774 - DNA, 22 bp, Homo sapiens
tccagccttgccacttttctgt

SEQ ID NO: 6963775 - DNA, 21 bp, Homo sapiens
gagtgcagcaaggtagagtct

SEQ ID NO: 6963776 - DNA, 21 bp, Homo sapiens
tatcaaggcactttttaaaga

SEQ ID NO: 6963777 - DNA, 22 bp, Homo sapiens
aggttggccaagctgctggccc

SEQ ID NO: 6963778 - DNA, 22 bp, Homo sapiens
aattcaacagtcagttatctca

SEQ ID NO: 6963779 - DNA, 22 bp, Homo sapiens
aagaaacaaccactgctctcct

SEQ ID NO: 6963780 - DNA, 22 bp, Homo sapiens
taattttacttcctgagcacct

SEQ ID NO: 6963781 - DNA, 23 bp, Homo sapiens
ttcaaaggcaatatgctgagaaa

SEQ ID NO: 6963782 - DNA, 22 bp, Homo sapiens
actctgtactctagaggaagtg

SEQ ID NO: 6963783 - DNA, 23 bp, Homo sapiens
acagttctctgatgggtttaaca

SEQ ID NO: 6963784 - DNA, 22 bp, Homo sapiens
gagctagggaggaggcttgctc

SEQ ID NO: 6963785 - DNA, 22 bp, Homo sapiens
caggctggagttacctttaggg

SEQ ID NO: 6963786 - DNA, 22 bp, Homo sapiens
actggactcacgtattcctgag

SEQ ID NO: 6963787 - DNA, 22 bp, Homo sapiens
atacctgatcaaggcaaaaatg

SEQ ID NO: 6963788 - DNA, 18 bp, Homo sapiens
atacaagctctgttactt

SEQ ID NO: 6963789 - DNA, 22 bp, Homo sapiens
tgcagcaagaaggcactgtctg

SEQ ID NO: 6963790 - DNA, 20 bp, Homo sapiens
ccctgagacgactgagctcc

SEQ ID NO: 6963791 - DNA, 22 bp, Homo sapiens
tcctgtggcttccacgacctaa

SEQ ID NO: 6963792 - DNA, 22 bp, Homo sapiens
ctggctcttggctagggagagt

SEQ ID NO: 6963793 - DNA, 22 bp, Homo sapiens
gttattatcttgaggaatctgt

SEQ ID NO: 6963794 - DNA, 22 bp, Homo sapiens
gctaggaggccctgcacgctta

SEQ ID NO: 6963795 - DNA, 22 bp, Homo sapiens
gccaaatctggatttagcaaga

SEQ ID NO: 6963796 - DNA, 22 bp, Homo sapiens
tttctttcaattctcctaatgc

SEQ ID NO: 6963797 - DNA, 22 bp, Homo sapiens
tgcttcatgaggtagtggcagt

SEQ ID NO: 6963798 - DNA, 22 bp, Homo sapiens
actacatttctcagtacctgaa

SEQ ID NO: 6963799 - DNA, 22 bp, Homo sapiens
catagattttaggttagatcga

SEQ ID NO: 6963800 - DNA, 22 bp, Homo sapiens
tctgtattttaagatgctgttt

SEQ ID NO: 6963801 - DNA, 22 bp, Homo sapiens
tgtaggactgagaatgattttt

SEQ ID NO: 6963802 - DNA, 22 bp, Homo sapiens
aagaggtaatgactgcttgagt

SEQ ID NO: 6963803 - DNA, 22 bp, Homo sapiens
agcaggtgacagggctgtggtg

SEQ ID NO: 6963804 - DNA, 17 bp, Homo sapiens
atgacagcattaaggta

SEQ ID NO: 6963805 - DNA, 22 bp, Homo sapiens
ctttgctgccagaacccagcag

SEQ ID NO: 6963806 - DNA, 22 bp, Homo sapiens
cagaacagacttaacagggctg

SEQ ID NO: 6963807 - DNA, 22 bp, Homo sapiens
gcctctgctgcaagcctggttg

SEQ ID NO: 6963808 - DNA, 22 bp, Homo sapiens
ttattatggtatttctttgcag

SEQ ID NO: 6963809 - DNA, 22 bp, Homo sapiens
tggcaaaggggaccatgttgaa

SEQ ID NO: 6963810 - DNA, 22 bp, Homo sapiens
tacctcactgggcctcagtttt

SEQ ID NO: 6963811 - DNA, 22 bp, Homo sapiens
ttcaacaatgcacttgagtata

SEQ ID NO: 6963812 - DNA, 22 bp, Homo sapiens
ttcctggccagctgtggtgagt

SEQ ID NO: 6963813 - DNA, 19 bp, Homo sapiens
cccagtctaggtcctagga

SEQ ID NO: 6963814 - DNA, 22 bp, Homo sapiens
gtctctggctttatgctggttt

SEQ ID NO: 6963815 - DNA, 22 bp, Homo sapiens
gcacctgggcaaggattcagag

SEQ ID NO: 6963816 - DNA, 22 bp, Homo sapiens
gatgaagctaaatctaaggttt

SEQ ID NO: 6963817 - DNA, 22 bp, Homo sapiens
ctactgttgggagccctggaag

SEQ ID NO: 6963818 - DNA, 22 bp, Homo sapiens
gaaggttttgtttgcaaatcat

SEQ ID NO: 6963819 - DNA, 22 bp, Homo sapiens
agggcatctagttccctctctt

SEQ ID NO: 6963820 - DNA, 22 bp, Homo sapiens
aatatgttgagtctatctttat

SEQ ID NO: 6963821 - DNA, 22 bp, Homo sapiens
tctgacaggtcattttctatag

SEQ ID NO: 6963822 - DNA, 19 bp, Homo sapiens
tcagcagattttgcaaaca

SEQ ID NO: 6963823 - DNA, 22 bp, Homo sapiens
ggaggtcataagtgtatagatg

SEQ ID NO: 6963824 - DNA, 22 bp, Homo sapiens
cggcttcttttaaggttgctga

SEQ ID NO: 6963825 - DNA, 22 bp, Homo sapiens
agagcagagggctctgggacaa

SEQ ID NO: 6963826 - DNA, 22 bp, Homo sapiens
atcagctgatgaatggatgaat

SEQ ID NO: 6963827 - DNA, 22 bp, Homo sapiens
aaatccaggaagcagtggtgta

SEQ ID NO: 6963828 - DNA, 22 bp, Homo sapiens
agctaaatcctacttttgtatt

SEQ ID NO: 6963829 - DNA, 17 bp, Homo sapiens
aagtcacttctgggcca

SEQ ID NO: 6963830 - DNA, 22 bp, Homo sapiens
ctctgtaccttaaaagggcttt

SEQ ID NO: 6963831 - DNA, 22 bp, Homo sapiens
aaataactttctgtgtatagtc

SEQ ID NO: 6963832 - DNA, 22 bp, Homo sapiens
gtcccaggaacattctggctag

SEQ ID NO: 6963833 - DNA, 22 bp, Homo sapiens
cctggtggacagcagccagcag

SEQ ID NO: 6963834 - DNA, 23 bp, Homo sapiens
aggcaaacctataaaataggaat

SEQ ID NO: 6963835 - DNA, 22 bp, Homo sapiens
tgctgccaggtcttgctgtcca

SEQ ID NO: 6963836 - DNA, 22 bp, Homo sapiens
tcctgggtctcttccttagttc

SEQ ID NO: 6963837 - DNA, 22 bp, Homo sapiens
aggggagcttgaggcatggcct

SEQ ID NO: 6963838 - DNA, 22 bp, Homo sapiens
ccaagaggaccttgccagggca

SEQ ID NO: 6963839 - DNA, 22 bp, Homo sapiens
tagctgcctatgtgataagaga

SEQ ID NO: 6963840 - DNA, 22 bp, Homo sapiens
ctaggctcaggtgactccaagc

SEQ ID NO: 6963841 - DNA, 22 bp, Homo sapiens
ttcagtgtgcctaagtcagttg

SEQ ID NO: 6963842 - DNA, 22 bp, Homo sapiens
tgtgtactaaacttccatatat

SEQ ID NO: 6963843 - DNA, 22 bp, Homo sapiens
gaagccagtactgtgctctgca

SEQ ID NO: 6963844 - DNA, 23 bp, Homo sapiens
tgtatgaatatgccacagtttaa

SEQ ID NO: 6963845 - DNA, 22 bp, Homo sapiens
cactgaggtttgttaactgagt

SEQ ID NO: 6963846 - DNA, 22 bp, Homo sapiens
accatttatcaagcacctgtga

SEQ ID NO: 6963847 - DNA, 22 bp, Homo sapiens
tgctttggacccagggagcgga

SEQ ID NO: 6963848 - DNA, 22 bp, Homo sapiens
tcaggaagaagacggggcagga

SEQ ID NO: 6963849 - DNA, 22 bp, Homo sapiens
gccagcaagtatcaccaaagcc

SEQ ID NO: 6963850 - DNA, 22 bp, Homo sapiens
cagcaaggtctgtcaatagtgg

SEQ ID NO: 6963851 - DNA, 22 bp, Homo sapiens
aagatgatgcagactttgatgt

SEQ ID NO: 6963852 - DNA, 22 bp, Homo sapiens
aatgttaattcacagccaaata

SEQ ID NO: 6963853 - DNA, 22 bp, Homo sapiens
tgtatttgaaacagtgcatggg

SEQ ID NO: 6963854 - DNA, 22 bp, Homo sapiens
tctagcaccacattaaatagca

SEQ ID NO: 6963855 - DNA, 22 bp, Homo sapiens
gttccaaagcaaaggaggtgag

SEQ ID NO: 6963856 - DNA, 22 bp, Homo sapiens
agttttgatactttctcttcat

SEQ ID NO: 6963857 - DNA, 22 bp, Homo sapiens
gtatttccctgagttctgtgag

SEQ ID NO: 6963858 - DNA, 22 bp, Homo sapiens
gaagtctcacagacagatcaga

SEQ ID NO: 6963859 - DNA, 19 bp, Homo sapiens
gaaggggaaggtgggtacc

SEQ ID NO: 6963860 - DNA, 22 bp, Homo sapiens
tgtcctcagatatgtctactct

SEQ ID NO: 6963861 - DNA, 22 bp, Homo sapiens
gtgtcctgcaggccaggaatgg

SEQ ID NO: 6963862 - DNA, 22 bp, Homo sapiens
tcagtagcccttgagttcatgt

SEQ ID NO: 6963863 - DNA, 22 bp, Homo sapiens
aggctaagaaggctttgttcct

SEQ ID NO: 6963864 - DNA, 22 bp, Homo sapiens
aaccaaggacagctagtgatgc

SEQ ID NO: 6963865 - DNA, 21 bp, Homo sapiens
atactttgaattacagccttg

SEQ ID NO: 6963866 - DNA, 22 bp, Homo sapiens
tggagagtgtagacttcagagt

SEQ ID NO: 6963867 - DNA, 22 bp, Homo sapiens
taggcttttccagtataagaga

SEQ ID NO: 6963868 - DNA, 22 bp, Homo sapiens
acactcttctcacagtcagttt

SEQ ID NO: 6963869 - DNA, 22 bp, Homo sapiens
agccacaggccatgagatacca

SEQ ID NO: 6963870 - DNA, 22 bp, Homo sapiens
gacaagacacctctctccatcc

SEQ ID NO: 6963871 - DNA, 22 bp, Homo sapiens
agtggctatgcatgactggaat

SEQ ID NO: 6963872 - DNA, 22 bp, Homo sapiens
ttggggaagagttgactttgga

SEQ ID NO: 6963873 - DNA, 22 bp, Homo sapiens
agctgtgattatccactggaat

SEQ ID NO: 6963874 - DNA, 20 bp, Homo sapiens
ccagagctgatggctgcccg

SEQ ID NO: 6963875 - DNA, 22 bp, Homo sapiens
ccatttggatacttttggttac

SEQ ID NO: 6963876 - DNA, 22 bp, Homo sapiens
cttggcaccaccaagtggccat

SEQ ID NO: 6963877 - DNA, 22 bp, Homo sapiens
gctttaatgaagtcacgcaaag

SEQ ID NO: 6963878 - DNA, 22 bp, Homo sapiens
ggcatttgactcagtgactggg

SEQ ID NO: 6963879 - DNA, 22 bp, Homo sapiens
taaagcaattactcagtggctt

SEQ ID NO: 6963880 - DNA, 20 bp, Homo sapiens
gctgggctaccactggccct

SEQ ID NO: 6963881 - DNA, 22 bp, Homo sapiens
aagccctggcgggtggagggcc

SEQ ID NO: 6963882 - DNA, 22 bp, Homo sapiens
tcaaatgggtatgctttataat

SEQ ID NO: 6963883 - DNA, 22 bp, Homo sapiens
tgccaagagggcagagggcagt

SEQ ID NO: 6963884 - DNA, 22 bp, Homo sapiens
gtggctaggcccaacggcagga

SEQ ID NO: 6963885 - DNA, 22 bp, Homo sapiens
aatgtacactgaaagcctatca

SEQ ID NO: 6963886 - DNA, 22 bp, Homo sapiens
gtttatgaattgcattcccttt

SEQ ID NO: 6963887 - DNA, 22 bp, Homo sapiens
cagaggaaagtatttctggaag

SEQ ID NO: 6963888 - DNA, 22 bp, Homo sapiens
actttggggaacttttctcctc

SEQ ID NO: 6963889 - DNA, 22 bp, Homo sapiens
ctcagcagtgacaagagagtat

SEQ ID NO: 6963890 - DNA, 22 bp, Homo sapiens
aggataacgacagtgacgacga

SEQ ID NO: 6963891 - DNA, 22 bp, Homo sapiens
caaatgcaaaatataaccctgt

SEQ ID NO: 6963892 - DNA, 22 bp, Homo sapiens
agatatctggaaaaaatgtatg

SEQ ID NO: 6963893 - DNA, 19 bp, Homo sapiens
tcattgaacataattactt

SEQ ID NO: 6963894 - DNA, 22 bp, Homo sapiens
acttcattgtaatattatagca

SEQ ID NO: 6963895 - DNA, 22 bp, Homo sapiens
taagttcctagcctttacatag

SEQ ID NO: 6963896 - DNA, 22 bp, Homo sapiens
aggcagctgaccacagtatgat

SEQ ID NO: 6963897 - DNA, 22 bp, Homo sapiens
tctgttctaagcattctatgtg

SEQ ID NO: 6963898 - DNA, 22 bp, Homo sapiens
ctgagctcaagtgatctgccca

SEQ ID NO: 6963899 - DNA, 22 bp, Homo sapiens
ccactcaggagcttatctatgc

SEQ ID NO: 6963900 - DNA, 22 bp, Homo sapiens
aggtggaaatggctttcctagg

SEQ ID NO: 6963901 - DNA, 22 bp, Homo sapiens
gtcccctcagccacccatgggg

SEQ ID NO: 6963902 - DNA, 22 bp, Homo sapiens
tgtccttagaagaagtgaaaga

SEQ ID NO: 6963903 - DNA, 22 bp, Homo sapiens
gtgctagggttggagtggggct

SEQ ID NO: 6963904 - DNA, 22 bp, Homo sapiens
cacattctgtccttgaactgca

SEQ ID NO: 6963905 - DNA, 22 bp, Homo sapiens
gtgaaatgaatctggaaatatt

SEQ ID NO: 6963906 - DNA, 22 bp, Homo sapiens
aagcacatcatgttgttcagac

SEQ ID NO: 6963907 - DNA, 22 bp, Homo sapiens
ggtgtctgattccaaggccaca

SEQ ID NO: 6963908 - DNA, 22 bp, Homo sapiens
acagacatgggccgctcttgag

SEQ ID NO: 6963909 - DNA, 22 bp, Homo sapiens
tgggtgaatgcatttgttcctg

SEQ ID NO: 6963910 - DNA, 22 bp, Homo sapiens
tttacagattctgggtattagg

SEQ ID NO: 6963911 - DNA, 22 bp, Homo sapiens
gagttctcaagcaatcaaagag

SEQ ID NO: 6963912 - DNA, 22 bp, Homo sapiens
tgtaaaccagggtcatccttag

SEQ ID NO: 6963913 - DNA, 22 bp, Homo sapiens
gtggcacagagatggggcatga

SEQ ID NO: 6963914 - DNA, 22 bp, Homo sapiens
tagattctactgtcacttagtt

SEQ ID NO: 6963915 - DNA, 22 bp, Homo sapiens
acaaccaagaacagagggaaag

SEQ ID NO: 6963916 - DNA, 22 bp, Homo sapiens
tgccaggaacctgttcttgttc

SEQ ID NO: 6963917 - DNA, 22 bp, Homo sapiens
ttacaaagttctgagttcaaac

SEQ ID NO: 6963918 - DNA, 22 bp, Homo sapiens
tggcccaggtgcaagagacaga

SEQ ID NO: 6963919 - DNA, 22 bp, Homo sapiens
attgtgtaggggcagtctggga

SEQ ID NO: 6963920 - DNA, 22 bp, Homo sapiens
gaaatgcaaattctctctcgct

SEQ ID NO: 6963921 - DNA, 22 bp, Homo sapiens
agagttaatgcaggccaagcct

SEQ ID NO: 6963922 - DNA, 22 bp, Homo sapiens
gccacagcagggccctctcagg

SEQ ID NO: 6963923 - DNA, 22 bp, Homo sapiens
tgcagaggtgaaagactagcaa

SEQ ID NO: 6963924 - DNA, 22 bp, Homo sapiens
cctgcccacacagcaattttaa

SEQ ID NO: 6963925 - DNA, 22 bp, Homo sapiens
ttcgcattcagctttgccactg

SEQ ID NO: 6963926 - DNA, 22 bp, Homo sapiens
atggagctctgatatatcaatt

SEQ ID NO: 6963927 - DNA, 21 bp, Homo sapiens
aaagagcccgctgagaggttc

SEQ ID NO: 6963928 - DNA, 22 bp, Homo sapiens
gtgctgtctcaagaaggattct

SEQ ID NO: 6963929 - DNA, 23 bp, Homo sapiens
agcttcgccttcctttctctgca

SEQ ID NO: 6963930 - DNA, 22 bp, Homo sapiens
cagaaccaggaactgatggaga

SEQ ID NO: 6963931 - DNA, 16 bp, Homo sapiens
ttgccctgaggggagg

SEQ ID NO: 6963932 - DNA, 22 bp, Homo sapiens
gaattaccattttaatggtgct

SEQ ID NO: 6963933 - DNA, 22 bp, Homo sapiens
actgaggcgcagtccggctgtc

SEQ ID NO: 6963934 - DNA, 22 bp, Homo sapiens
ctggatgtcttggggactcctg

SEQ ID NO: 6963935 - DNA, 22 bp, Homo sapiens
tgtatcaagggtttatgtaagc

SEQ ID NO: 6963936 - DNA, 22 bp, Homo sapiens
actggactccccaagggccagg

SEQ ID NO: 6963937 - DNA, 22 bp, Homo sapiens
gtttagaatgaaacttttgagc

SEQ ID NO: 6963938 - DNA, 19 bp, Homo sapiens
acatagctggctacactgt

SEQ ID NO: 6963939 - DNA, 22 bp, Homo sapiens
agcctttacaagcattagctca

SEQ ID NO: 6963940 - DNA, 22 bp, Homo sapiens
caagagctcagaaacccttgct

SEQ ID NO: 6963941 - DNA, 22 bp, Homo sapiens
gcccgtgtctcctgctctgtgg

SEQ ID NO: 6963942 - DNA, 23 bp, Homo sapiens
aggcagtgtctcttatcctgtcc

SEQ ID NO: 6963943 - DNA, 22 bp, Homo sapiens
atggaagactaacagaaacatg

SEQ ID NO: 6963944 - DNA, 22 bp, Homo sapiens
ggtcttcaggtctagttggtat

SEQ ID NO: 6963945 - DNA, 22 bp, Homo sapiens
tgcatatccacaccttatctct

SEQ ID NO: 6963946 - DNA, 22 bp, Homo sapiens
tttgaattattccttgagttga

SEQ ID NO: 6963947 - DNA, 22 bp, Homo sapiens
atggataatgtctctgtttccc

SEQ ID NO: 6963948 - DNA, 22 bp, Homo sapiens
ctcctgagaattttcagttgga

SEQ ID NO: 6963949 - DNA, 22 bp, Homo sapiens
acagggctatattcctcagagc

SEQ ID NO: 6963950 - DNA, 22 bp, Homo sapiens
accaggggatggttggcactgt

SEQ ID NO: 6963951 - DNA, 22 bp, Homo sapiens
tgttaacaggtaactgaggctg

SEQ ID NO: 6963952 - DNA, 23 bp, Homo sapiens
ttctgcccatgtgggatggtttg

SEQ ID NO: 6963953 - DNA, 18 bp, Homo sapiens
agcctggagggttgaagt

SEQ ID NO: 6963954 - DNA, 22 bp, Homo sapiens
tttggatcactgttcctctggg

SEQ ID NO: 6963955 - DNA, 22 bp, Homo sapiens
cccactctggctcccttctagt

SEQ ID NO: 6963956 - DNA, 22 bp, Homo sapiens
ctgctgtaatgagtcagcatct

SEQ ID NO: 6963957 - DNA, 22 bp, Homo sapiens
gcttctttccttgggctggaac

SEQ ID NO: 6963958 - DNA, 22 bp, Homo sapiens
atatttaaacagggtaccaata

SEQ ID NO: 6963959 - DNA, 22 bp, Homo sapiens
ttctgagacttgagattaattt

SEQ ID NO: 6963960 - DNA, 22 bp, Homo sapiens
tgactgtgcaagcagagagcat

SEQ ID NO: 6963961 - DNA, 22 bp, Homo sapiens
tctttggaatgctagcattcta

SEQ ID NO: 6963962 - DNA, 22 bp, Homo sapiens
ttatttgaatgatggcacaatt

SEQ ID NO: 6963963 - DNA, 19 bp, Homo sapiens
atgagcaatagttttaatc

SEQ ID NO: 6963964 - DNA, 22 bp, Homo sapiens
ggccttggtaaagggatgcatg

SEQ ID NO: 6963965 - DNA, 22 bp, Homo sapiens
gacaatgcagaagtacttgttc

SEQ ID NO: 6963966 - DNA, 22 bp, Homo sapiens
tcctgggagacccagctgtgga

SEQ ID NO: 6963967 - DNA, 21 bp, Homo sapiens
agaccagtgggataaataggt

SEQ ID NO: 6963968 - DNA, 22 bp, Homo sapiens
tagattctacagctcagctgtc

SEQ ID NO: 6963969 - DNA, 22 bp, Homo sapiens
gcctgggttcctgcttttgtga

SEQ ID NO: 6963970 - DNA, 23 bp, Homo sapiens
ggtttagccactcaaggcttgcc

SEQ ID NO: 6963971 - DNA, 22 bp, Homo sapiens
taacactgtccaaagaattcca

SEQ ID NO: 6963972 - DNA, 22 bp, Homo sapiens
atctaacagcaacaccagaata

SEQ ID NO: 6963973 - DNA, 22 bp, Homo sapiens
cactgaagctttcattctcttg

SEQ ID NO: 6963974 - DNA, 22 bp, Homo sapiens
gaaagtttataggttatataat

SEQ ID NO: 6963975 - DNA, 22 bp, Homo sapiens
gttaacattcaattaaacagtc

SEQ ID NO: 6963976 - DNA, 20 bp, Homo sapiens
gaggctctgggcatggcgcc

SEQ ID NO: 6963977 - DNA, 22 bp, Homo sapiens
aatttcttgggagctcagagaa

SEQ ID NO: 6963978 - DNA, 22 bp, Homo sapiens
tttgtagaactatacttacatt

SEQ ID NO: 6963979 - DNA, 22 bp, Homo sapiens
ctaggggcatgaaatagagaat

SEQ ID NO: 6963980 - DNA, 22 bp, Homo sapiens
ctcagggtgcagcacagttcct

SEQ ID NO: 6963981 - DNA, 22 bp, Homo sapiens
agagatctctgaagctgctgct

SEQ ID NO: 6963982 - DNA, 22 bp, Homo sapiens
gggagcataaactcagatttca

SEQ ID NO: 6963983 - DNA, 19 bp, Homo sapiens
tgcacgttggaatcacctg

SEQ ID NO: 6963984 - DNA, 22 bp, Homo sapiens
tattcccgtttgtgggggatat

SEQ ID NO: 6963985 - DNA, 22 bp, Homo sapiens
cagcatcaccaacttgagcaat

SEQ ID NO: 6963986 - DNA, 22 bp, Homo sapiens
atgactaagtgcattttaattg

SEQ ID NO: 6963987 - DNA, 22 bp, Homo sapiens
ttgcattgtaggatgttagaag

SEQ ID NO: 6963988 - DNA, 22 bp, Homo sapiens
gcccaggaagttgaggctgccg

SEQ ID NO: 6963989 - DNA, 22 bp, Homo sapiens
ctcagatcatcagaaacaatgt

SEQ ID NO: 6963990 - DNA, 22 bp, Homo sapiens
tctggctccactctgtgcatgc

SEQ ID NO: 6963991 - DNA, 22 bp, Homo sapiens
aacatctccaacctacatccac

SEQ ID NO: 6963992 - DNA, 22 bp, Homo sapiens
ccagtgcccagtctccctggtc

SEQ ID NO: 6963993 - DNA, 22 bp, Homo sapiens
agtttacatgacgtgtatttca

SEQ ID NO: 6963994 - DNA, 22 bp, Homo sapiens
gccaggtggtctggctccagag

SEQ ID NO: 6963995 - DNA, 22 bp, Homo sapiens
cagtatttcctcttcttaactt

SEQ ID NO: 6963996 - DNA, 22 bp, Homo sapiens
agtctctgctggttgtgcctat

SEQ ID NO: 6963997 - DNA, 22 bp, Homo sapiens
gccaaatatggtggacagtttg

SEQ ID NO: 6963998 - DNA, 22 bp, Homo sapiens
atctgattcattgaaatgggtg

SEQ ID NO: 6963999 - DNA, 22 bp, Homo sapiens
agatttcctcttttgtaaagtg

SEQ ID NO: 6964000 - DNA, 22 bp, Homo sapiens
agaaagaacgttggttatctta

SEQ ID NO: 6964001 - DNA, 17 bp, Homo sapiens
tgtcccaggctcaacgc

SEQ ID NO: 6964002 - DNA, 19 bp, Homo sapiens
aatacagtgttatagaatt

SEQ ID NO: 6964003 - DNA, 22 bp, Homo sapiens
ttccaggcatgtcagacatagg

SEQ ID NO: 6964004 - DNA, 22 bp, Homo sapiens
acatatattactagtaaagaca

SEQ ID NO: 6964005 - DNA, 22 bp, Homo sapiens
cctgcgatccgggcttggtgct

SEQ ID NO: 6964006 - DNA, 22 bp, Homo sapiens
gaatggtaagagacaaaagtat

SEQ ID NO: 6964007 - DNA, 22 bp, Homo sapiens
tctggcaggacatgctgaccat

SEQ ID NO: 6964008 - DNA, 22 bp, Homo sapiens
taatctctagcccatgcaaaga

SEQ ID NO: 6964009 - DNA, 22 bp, Homo sapiens
agcacacctattacataaatgg

SEQ ID NO: 6964010 - DNA, 22 bp, Homo sapiens
ggctgtataaagttaaaggctt

SEQ ID NO: 6964011 - DNA, 22 bp, Homo sapiens
atggataagaacaaatatctga

SEQ ID NO: 6964012 - DNA, 22 bp, Homo sapiens
cacaaatcattccatcattctt

SEQ ID NO: 6964013 - DNA, 22 bp, Homo sapiens
gcccaagccgccttccagagac

SEQ ID NO: 6964014 - DNA, 22 bp, Homo sapiens
tggagccaagagtcaaggggag

SEQ ID NO: 6964015 - DNA, 22 bp, Homo sapiens
aacatatcataggatgtcattg

SEQ ID NO: 6964016 - DNA, 22 bp, Homo sapiens
aatgaagccactgaagacaatc

SEQ ID NO: 6964017 - DNA, 22 bp, Homo sapiens
taacaatggttttgctgataat

SEQ ID NO: 6964018 - DNA, 16 bp, Homo sapiens
tccctgggagtggtgg

SEQ ID NO: 6964019 - DNA, 22 bp, Homo sapiens
atagccttggtccttgctccac

SEQ ID NO: 6964020 - DNA, 22 bp, Homo sapiens
agtaatgccctctgctttggag

SEQ ID NO: 6964021 - DNA, 22 bp, Homo sapiens
tgacagaggctgagttagtctg

SEQ ID NO: 6964022 - DNA, 22 bp, Homo sapiens
tctgtggctttcgtgtaagatg

SEQ ID NO: 6964023 - DNA, 22 bp, Homo sapiens
actgttgtcaggctgctttgga

SEQ ID NO: 6964024 - DNA, 22 bp, Homo sapiens
ttcattgttggctagctacctc

SEQ ID NO: 6964025 - DNA, 22 bp, Homo sapiens
aggtgacaggatgcagataaac

SEQ ID NO: 6964026 - DNA, 22 bp, Homo sapiens
ctcacagtgatgtcttatgaca

SEQ ID NO: 6964027 - DNA, 22 bp, Homo sapiens
gctagtgtttgccagcgtagcc

SEQ ID NO: 6964028 - DNA, 22 bp, Homo sapiens
gtccactgctgtgtgcttcacc

SEQ ID NO: 6964029 - DNA, 22 bp, Homo sapiens
atgacagaccctctaaagacaa

SEQ ID NO: 6964030 - DNA, 22 bp, Homo sapiens
catctggtttaaaagaagaaag

SEQ ID NO: 6964031 - DNA, 22 bp, Homo sapiens
ttggctcttctcccagtggcct

SEQ ID NO: 6964032 - DNA, 22 bp, Homo sapiens
aggtacatgtgaccacttgggg

SEQ ID NO: 6964033 - DNA, 22 bp, Homo sapiens
taggacagtggagataaccaga

SEQ ID NO: 6964034 - DNA, 22 bp, Homo sapiens
ggtgaggcaggtggctgctgag

SEQ ID NO: 6964035 - DNA, 18 bp, Homo sapiens
cagagctcctggatgcag

SEQ ID NO: 6964036 - DNA, 22 bp, Homo sapiens
gaagttctttatagcagtgtga

SEQ ID NO: 6964037 - DNA, 22 bp, Homo sapiens
ggctggcatccagggaaatcca

SEQ ID NO: 6964038 - DNA, 19 bp, Homo sapiens
gaagccctgcattctccgc

SEQ ID NO: 6964039 - DNA, 22 bp, Homo sapiens
agccagggctctccttcgcgtg

SEQ ID NO: 6964040 - DNA, 22 bp, Homo sapiens
atgttggactaggctcttaatt

SEQ ID NO: 6964041 - DNA, 19 bp, Homo sapiens
tttaccttcttgagagcag

SEQ ID NO: 6964042 - DNA, 22 bp, Homo sapiens
agagggtgaatgagatagaaaa

SEQ ID NO: 6964043 - DNA, 22 bp, Homo sapiens
acaggctgggcgcttcctgcgg

SEQ ID NO: 6964044 - DNA, 22 bp, Homo sapiens
ctggcctagctctctgcttgaa

SEQ ID NO: 6964045 - DNA, 19 bp, Homo sapiens
ttctggggcctggccttgg

SEQ ID NO: 6964046 - DNA, 22 bp, Homo sapiens
actgggaacaaggtgctcagcg

SEQ ID NO: 6964047 - DNA, 22 bp, Homo sapiens
ggcttaacttgtagcaatagat

SEQ ID NO: 6964048 - DNA, 22 bp, Homo sapiens
ggcaccagcaggcaccgatgcc

SEQ ID NO: 6964049 - DNA, 22 bp, Homo sapiens
gctgaagtctgagaatttgcaa

SEQ ID NO: 6964050 - DNA, 19 bp, Homo sapiens
atacacatacgtaaactga

SEQ ID NO: 6964051 - DNA, 22 bp, Homo sapiens
tgtctcagtatacgaaacactt

SEQ ID NO: 6964052 - DNA, 22 bp, Homo sapiens
cttcctttcagaggaaggcctg

SEQ ID NO: 6964053 - DNA, 23 bp, Homo sapiens
acacatatattcagatacagatg

SEQ ID NO: 6964054 - DNA, 22 bp, Homo sapiens
tacaaaggagataaattggagg

SEQ ID NO: 6964055 - DNA, 21 bp, Homo sapiens
taccaattgccttctagttgt

SEQ ID NO: 6964056 - DNA, 22 bp, Homo sapiens
tctggtcaagacatcctaacat

SEQ ID NO: 6964057 - DNA, 22 bp, Homo sapiens
gcccagctgcaccctggtgggt

SEQ ID NO: 6964058 - DNA, 22 bp, Homo sapiens
ggtgctggttcagggtggctgt

SEQ ID NO: 6964059 - DNA, 22 bp, Homo sapiens
tatctgagaaagaagcaccaga

SEQ ID NO: 6964060 - DNA, 22 bp, Homo sapiens
attcaagtccagcttctctaca

SEQ ID NO: 6964061 - DNA, 22 bp, Homo sapiens
tggagccagaagagccagttca

SEQ ID NO: 6964062 - DNA, 22 bp, Homo sapiens
aagcacttgcttagatgtggtt

SEQ ID NO: 6964063 - DNA, 22 bp, Homo sapiens
aacacaggggcgtggctcttac

SEQ ID NO: 6964064 - DNA, 22 bp, Homo sapiens
gatgagtgatgttgaagaaggt

SEQ ID NO: 6964065 - DNA, 22 bp, Homo sapiens
cagaagtgcaatttaaattagg

SEQ ID NO: 6964066 - DNA, 22 bp, Homo sapiens
tctgtacttgttagtcttcatg

SEQ ID NO: 6964067 - DNA, 22 bp, Homo sapiens
atatgtatgtacgcacatattc

SEQ ID NO: 6964068 - DNA, 22 bp, Homo sapiens
ccatctactgacttagcctcat

SEQ ID NO: 6964069 - DNA, 22 bp, Homo sapiens
tctggcttcgcagctcccagcc

SEQ ID NO: 6964070 - DNA, 22 bp, Homo sapiens
gtcaggattttaaaatcccagt

SEQ ID NO: 6964071 - DNA, 22 bp, Homo sapiens
tcctggagtttgtggtgatatg

SEQ ID NO: 6964072 - DNA, 22 bp, Homo sapiens
caggccctgggcaggatcagcc

SEQ ID NO: 6964073 - DNA, 22 bp, Homo sapiens
acagctttgttttccctgctga

SEQ ID NO: 6964074 - DNA, 22 bp, Homo sapiens
attgaggtcccagaaaggactg

SEQ ID NO: 6964075 - DNA, 21 bp, Homo sapiens
gtccattgagcgtctccgtgg

SEQ ID NO: 6964076 - DNA, 22 bp, Homo sapiens
gtgtctcttttcagactcttca

SEQ ID NO: 6964077 - DNA, 22 bp, Homo sapiens
catcagtgaaagtgaatgttct

SEQ ID NO: 6964078 - DNA, 22 bp, Homo sapiens
acacagaagctttttctattcc

SEQ ID NO: 6964079 - DNA, 22 bp, Homo sapiens
cacctgccaaatggggatgctg

SEQ ID NO: 6964080 - DNA, 22 bp, Homo sapiens
ttctatgattcatttagaagtt

SEQ ID NO: 6964081 - DNA, 22 bp, Homo sapiens
agctggcaaaactaatgggaag

SEQ ID NO: 6964082 - DNA, 22 bp, Homo sapiens
acttcaaacaattaacagagaa

SEQ ID NO: 6964083 - DNA, 22 bp, Homo sapiens
attcaaactgtgttaggcagca

SEQ ID NO: 6964084 - DNA, 22 bp, Homo sapiens
agaaactgtgttactagaatgt

SEQ ID NO: 6964085 - DNA, 22 bp, Homo sapiens
tatttggaaagtttatctatct

SEQ ID NO: 6964086 - DNA, 19 bp, Homo sapiens
agactctgccactcttctc

SEQ ID NO: 6964087 - DNA, 22 bp, Homo sapiens
gcaagctatagaatataagggg

SEQ ID NO: 6964088 - DNA, 22 bp, Homo sapiens
aagtaacacatgttacttctgc

SEQ ID NO: 6964089 - DNA, 22 bp, Homo sapiens
actcttactccctcaggcactg

SEQ ID NO: 6964090 - DNA, 22 bp, Homo sapiens
gcagggaccaaaagaggcagta

SEQ ID NO: 6964091 - DNA, 22 bp, Homo sapiens
tctctattaattgacaatggct

SEQ ID NO: 6964092 - DNA, 22 bp, Homo sapiens
ccatgcagccacgtctagctaa

SEQ ID NO: 6964093 - DNA, 18 bp, Homo sapiens
ggcaggagcaagaatagg

SEQ ID NO: 6964094 - DNA, 22 bp, Homo sapiens
taaagcaatttgagcaagttct

SEQ ID NO: 6964095 - DNA, 22 bp, Homo sapiens
aggatttaggagctggctaacg

SEQ ID NO: 6964096 - DNA, 22 bp, Homo sapiens
ttgtcagccagctcgcactctt

SEQ ID NO: 6964097 - DNA, 22 bp, Homo sapiens
agactctggccacccccgcagt

SEQ ID NO: 6964098 - DNA, 22 bp, Homo sapiens
tcctgagagtcaagaatgcagg

SEQ ID NO: 6964099 - DNA, 22 bp, Homo sapiens
tcaggcttgcgatggaagtcac

SEQ ID NO: 6964100 - DNA, 22 bp, Homo sapiens
ttgggacattatcagtctgcag

SEQ ID NO: 6964101 - DNA, 22 bp, Homo sapiens
gatggcttctgaatcagggcct

SEQ ID NO: 6964102 - DNA, 22 bp, Homo sapiens
ctgctattggaaggaggcatga

SEQ ID NO: 6964103 - DNA, 22 bp, Homo sapiens
caccataaaaataagagatgcc

SEQ ID NO: 6964104 - DNA, 22 bp, Homo sapiens
tcagagaaatgacaatatatag

SEQ ID NO: 6964105 - DNA, 22 bp, Homo sapiens
tcagagttcctcatagatccag

SEQ ID NO: 6964106 - DNA, 20 bp, Homo sapiens
tctgtgcagtggaggggcag

SEQ ID NO: 6964107 - DNA, 22 bp, Homo sapiens
actgcctcttggtgctgagaga

SEQ ID NO: 6964108 - DNA, 22 bp, Homo sapiens
ttgggaagaggcccctggattc

SEQ ID NO: 6964109 - DNA, 22 bp, Homo sapiens
tatctgacaaaccctgtgccca

SEQ ID NO: 6964110 - DNA, 22 bp, Homo sapiens
actgcccaggaatctcaaagaa

SEQ ID NO: 6964111 - DNA, 22 bp, Homo sapiens
tattggcttttccagacctggc

SEQ ID NO: 6964112 - DNA, 21 bp, Homo sapiens
tccagctcttatgttcatgaa

SEQ ID NO: 6964113 - DNA, 22 bp, Homo sapiens
taattttgctgtgaccattgaa

SEQ ID NO: 6964114 - DNA, 21 bp, Homo sapiens
agtcccctgtccttacttcta

SEQ ID NO: 6964115 - DNA, 22 bp, Homo sapiens
tcagtctttgcttatgacaata

SEQ ID NO: 6964116 - DNA, 22 bp, Homo sapiens
taggaacacacatgtgtagctg

SEQ ID NO: 6964117 - DNA, 22 bp, Homo sapiens
tctctaaagaagcctccctaaa

SEQ ID NO: 6964118 - DNA, 22 bp, Homo sapiens
gctgcagaatttccttctcatt

SEQ ID NO: 6964119 - DNA, 23 bp, Homo sapiens
ttgtcctctggatcggtttggtt

SEQ ID NO: 6964120 - DNA, 22 bp, Homo sapiens
tgccctccacagtggctccacc

SEQ ID NO: 6964121 - DNA, 22 bp, Homo sapiens
tagagtgtaagctccttgaggg

SEQ ID NO: 6964122 - DNA, 22 bp, Homo sapiens
gcagatggatgtggacggcgcc

SEQ ID NO: 6964123 - DNA, 22 bp, Homo sapiens
gcagtcctctcattggcctcct

SEQ ID NO: 6964124 - DNA, 22 bp, Homo sapiens
gagcacccatgcagagggaaca

SEQ ID NO: 6964125 - DNA, 22 bp, Homo sapiens
ggtgaaggtctactgtgtgcca

SEQ ID NO: 6964126 - DNA, 22 bp, Homo sapiens
tctgtgctaatgcttcacaata

SEQ ID NO: 6964127 - DNA, 22 bp, Homo sapiens
ggatcttatttccaatccaggc

SEQ ID NO: 6964128 - DNA, 22 bp, Homo sapiens
cttaggcagtttaggaaagaga

SEQ ID NO: 6964129 - DNA, 19 bp, Homo sapiens
ggcctggctatccctgctg

SEQ ID NO: 6964130 - DNA, 22 bp, Homo sapiens
gtcctagtgcctggaagctggg

SEQ ID NO: 6964131 - DNA, 22 bp, Homo sapiens
agaggattgaaggatttgttga

SEQ ID NO: 6964132 - DNA, 22 bp, Homo sapiens
ctgtggacaaggatgttagcta

SEQ ID NO: 6964133 - DNA, 22 bp, Homo sapiens
gaggaagctgcgtggcatttca

SEQ ID NO: 6964134 - DNA, 22 bp, Homo sapiens
tgagagttctctcttcaggtgg

SEQ ID NO: 6964135 - DNA, 22 bp, Homo sapiens
cattgcactccagcctgggcaa

SEQ ID NO: 6964136 - DNA, 22 bp, Homo sapiens
tcagtggtaccaagggggctgg

SEQ ID NO: 6964137 - DNA, 19 bp, Homo sapiens
taggtaggtaggtaggtat

SEQ ID NO: 6964138 - DNA, 22 bp, Homo sapiens
ctggttcattaggtattagtgg

SEQ ID NO: 6964139 - DNA, 22 bp, Homo sapiens
tgctgctgaggctaaagtatag

SEQ ID NO: 6964140 - DNA, 22 bp, Homo sapiens
tgcaggagataatggtgcttag

SEQ ID NO: 6964141 - DNA, 22 bp, Homo sapiens
acattcattgccagggtggaag

SEQ ID NO: 6964142 - DNA, 22 bp, Homo sapiens
agtttctgtgactcttggcata

SEQ ID NO: 6964143 - DNA, 22 bp, Homo sapiens
gcaccctctgagctccgctccg

SEQ ID NO: 6964144 - DNA, 22 bp, Homo sapiens
tcacagtagacttctcaagagc

SEQ ID NO: 6964145 - DNA, 22 bp, Homo sapiens
caggcgagggccctgaggagcc

SEQ ID NO: 6964146 - DNA, 22 bp, Homo sapiens
tctccaatctgatgtgactggt

SEQ ID NO: 6964147 - DNA, 22 bp, Homo sapiens
aaaggctgcctcagtgccatga

SEQ ID NO: 6964148 - DNA, 22 bp, Homo sapiens
tcccctggcacctagtcctact

SEQ ID NO: 6964149 - DNA, 22 bp, Homo sapiens
aactgacttagccagtggagct

SEQ ID NO: 6964150 - DNA, 22 bp, Homo sapiens
ggaatgtgttcttactgtattt

SEQ ID NO: 6964151 - DNA, 20 bp, Homo sapiens
catgtgtcagttctcaccca

SEQ ID NO: 6964152 - DNA, 22 bp, Homo sapiens
tgcatatacccgcatttacata

SEQ ID NO: 6964153 - DNA, 22 bp, Homo sapiens
gaaaaggcctggggcaaagtgt

SEQ ID NO: 6964154 - DNA, 22 bp, Homo sapiens
aggaactgatttataactttag

SEQ ID NO: 6964155 - DNA, 22 bp, Homo sapiens
tctgtgggcatttataatctgg

SEQ ID NO: 6964156 - DNA, 22 bp, Homo sapiens
agctcatggtgctatctcaggg

SEQ ID NO: 6964157 - DNA, 22 bp, Homo sapiens
gcagaaggttgtttgggaaagg

SEQ ID NO: 6964158 - DNA, 22 bp, Homo sapiens
taaatgtgagtgatgcggtgaa

SEQ ID NO: 6964159 - DNA, 22 bp, Homo sapiens
tcctggactggctcagcaccct

SEQ ID NO: 6964160 - DNA, 22 bp, Homo sapiens
gtatacttgcagacatttatat

SEQ ID NO: 6964161 - DNA, 22 bp, Homo sapiens
ccataattgggtagccatctga

SEQ ID NO: 6964162 - DNA, 22 bp, Homo sapiens
tgaagtatctatggatataaga

SEQ ID NO: 6964163 - DNA, 22 bp, Homo sapiens
tgcctgcctaggaagctgtgaa

SEQ ID NO: 6964164 - DNA, 18 bp, Homo sapiens
atggaggcagagagctga

SEQ ID NO: 6964165 - DNA, 18 bp, Homo sapiens
tctgtctgtgttgtcttt

SEQ ID NO: 6964166 - DNA, 22 bp, Homo sapiens
actgtgcattccccaacctgtg

SEQ ID NO: 6964167 - DNA, 22 bp, Homo sapiens
cctgcagtctacccaatgtgtg

SEQ ID NO: 6964168 - DNA, 22 bp, Homo sapiens
tggtttctgtctgagttcctcc

SEQ ID NO: 6964169 - DNA, 22 bp, Homo sapiens
atggatcccactattttaagac

SEQ ID NO: 6964170 - DNA, 22 bp, Homo sapiens
ttccagaggatctcaggtattt

SEQ ID NO: 6964171 - DNA, 22 bp, Homo sapiens
ggtcttcctatggcggggccct

SEQ ID NO: 6964172 - DNA, 16 bp, Homo sapiens
caggtgtcagtcacct

SEQ ID NO: 6964173 - DNA, 23 bp, Homo sapiens
ctcagggatagaaaggaagacag

SEQ ID NO: 6964174 - DNA, 22 bp, Homo sapiens
cattgtgcagggataatgcagc

SEQ ID NO: 6964175 - DNA, 22 bp, Homo sapiens
gaaaggcttgagacattgatga

SEQ ID NO: 6964176 - DNA, 22 bp, Homo sapiens
aggtttctggatttattatggc

SEQ ID NO: 6964177 - DNA, 22 bp, Homo sapiens
ctgaaactccatgagaaattgc

SEQ ID NO: 6964178 - DNA, 22 bp, Homo sapiens
ggagccttccagactgcccaca

SEQ ID NO: 6964179 - DNA, 22 bp, Homo sapiens
tcctgctggactctgagtacaa

SEQ ID NO: 6964180 - DNA, 22 bp, Homo sapiens
ttggcctttggactctgggact

SEQ ID NO: 6964181 - DNA, 22 bp, Homo sapiens
ccaccacttctggcttctggtg

SEQ ID NO: 6964182 - DNA, 22 bp, Homo sapiens
agctctgggtcacggctgccga

SEQ ID NO: 6964183 - DNA, 22 bp, Homo sapiens
catcaagtgcctttcacctcta

SEQ ID NO: 6964184 - DNA, 20 bp, Homo sapiens
actgatcttgttcttactcc

SEQ ID NO: 6964185 - DNA, 22 bp, Homo sapiens
caggcacaaatttctagataag

SEQ ID NO: 6964186 - DNA, 22 bp, Homo sapiens
cctcaggctctgggtgcctacc

SEQ ID NO: 6964187 - DNA, 22 bp, Homo sapiens
aatatgcactctgatttagcag

SEQ ID NO: 6964188 - DNA, 22 bp, Homo sapiens
tctgaatgtatcgaattgaggc

SEQ ID NO: 6964189 - DNA, 22 bp, Homo sapiens
gggcactggaaggctctcaggc

SEQ ID NO: 6964190 - DNA, 22 bp, Homo sapiens
caggaagtcgcagagctggggg

SEQ ID NO: 6964191 - DNA, 22 bp, Homo sapiens
atgttaccttgttctccaaaaa

SEQ ID NO: 6964192 - DNA, 22 bp, Homo sapiens
tcccactggacgtctgtgctgg

SEQ ID NO: 6964193 - DNA, 22 bp, Homo sapiens
ggagtggctgtttctgccccca

SEQ ID NO: 6964194 - DNA, 22 bp, Homo sapiens
ccaggcacggtggctcatgcct

SEQ ID NO: 6964195 - DNA, 22 bp, Homo sapiens
gaaatacgagtttattcattta

SEQ ID NO: 6964196 - DNA, 22 bp, Homo sapiens
gcagctcccttgaacttctcct

SEQ ID NO: 6964197 - DNA, 22 bp, Homo sapiens
cacagggcagagggtccgtggc

SEQ ID NO: 6964198 - DNA, 22 bp, Homo sapiens
taatactgctgtgcttgagttg

SEQ ID NO: 6964199 - DNA, 22 bp, Homo sapiens
ggtctgaaattatgtcactgct

SEQ ID NO: 6964200 - DNA, 22 bp, Homo sapiens
taaagacaaatgacattacggc

SEQ ID NO: 6964201 - DNA, 22 bp, Homo sapiens
actgaagtccacacatgtagga

SEQ ID NO: 6964202 - DNA, 22 bp, Homo sapiens
ctgctcctggtcatcctccact

SEQ ID NO: 6964203 - DNA, 22 bp, Homo sapiens
cacatgcttcttttgattatga

SEQ ID NO: 6964204 - DNA, 22 bp, Homo sapiens
catcaggcagaggaaaggactg

SEQ ID NO: 6964205 - DNA, 22 bp, Homo sapiens
ggatgggttccgtgggcaaatg

SEQ ID NO: 6964206 - DNA, 22 bp, Homo sapiens
tgtgcttggggttgactagtgt

SEQ ID NO: 6964207 - DNA, 22 bp, Homo sapiens
agattctaccagagctagtttg

SEQ ID NO: 6964208 - DNA, 22 bp, Homo sapiens
tgtgttcatgtatgtatacata

SEQ ID NO: 6964209 - DNA, 22 bp, Homo sapiens
gaaacctgagccagagtgggga

SEQ ID NO: 6964210 - DNA, 22 bp, Homo sapiens
agaaatggtgagtgagagcccc

SEQ ID NO: 6964211 - DNA, 22 bp, Homo sapiens
atgtgccaatttatagaggctc

SEQ ID NO: 6964212 - DNA, 22 bp, Homo sapiens
tagtgcaatgtgaggcagtacc

SEQ ID NO: 6964213 - DNA, 22 bp, Homo sapiens
tgtccttttctttagtgcagct

SEQ ID NO: 6964214 - DNA, 22 bp, Homo sapiens
ccttttctggccaccaagcgct

SEQ ID NO: 6964215 - DNA, 22 bp, Homo sapiens
attggaaatgctacaagttaga

SEQ ID NO: 6964216 - DNA, 22 bp, Homo sapiens
ttaggcacactttaccccctga

SEQ ID NO: 6964217 - DNA, 22 bp, Homo sapiens
aaagctttgtaaataaacaggt

SEQ ID NO: 6964218 - DNA, 22 bp, Homo sapiens
ctggagagaccgaaagaggctg

SEQ ID NO: 6964219 - DNA, 22 bp, Homo sapiens
ctgagagatgatatagcttaat

SEQ ID NO: 6964220 - DNA, 22 bp, Homo sapiens
actagctttacagcatgagtgg

SEQ ID NO: 6964221 - DNA, 22 bp, Homo sapiens
atgaaaagcataaacgctgaag

SEQ ID NO: 6964222 - DNA, 22 bp, Homo sapiens
ttccacttttctctctcatgcc

SEQ ID NO: 6964223 - DNA, 20 bp, Homo sapiens
ggcactggaagcacacagga

SEQ ID NO: 6964224 - DNA, 22 bp, Homo sapiens
ccaggcttattatcttctccat

SEQ ID NO: 6964225 - DNA, 22 bp, Homo sapiens
ttcttcaaccatctacataaac

SEQ ID NO: 6964226 - DNA, 22 bp, Homo sapiens
ctccagtcatagtctgtcttgt

SEQ ID NO: 6964227 - DNA, 22 bp, Homo sapiens
tctgcccagggacccacaggga

SEQ ID NO: 6964228 - DNA, 22 bp, Homo sapiens
actttatgtttgatatctatgg

SEQ ID NO: 6964229 - DNA, 21 bp, Homo sapiens
tagagccagtggtgttctgac

SEQ ID NO: 6964230 - DNA, 18 bp, Homo sapiens
aagtctctgaaagctttt

SEQ ID NO: 6964231 - DNA, 22 bp, Homo sapiens
catagcttccatattgacacca

SEQ ID NO: 6964232 - DNA, 20 bp, Homo sapiens
gaaagattgtaagaggcaga

SEQ ID NO: 6964233 - DNA, 22 bp, Homo sapiens
ttcacattatcaggattgtttc

SEQ ID NO: 6964234 - DNA, 22 bp, Homo sapiens
cctgggtcccagccaggctttg

SEQ ID NO: 6964235 - DNA, 22 bp, Homo sapiens
ctaatcacctcatccctcagcg

SEQ ID NO: 6964236 - DNA, 22 bp, Homo sapiens
agtctcttcgagccgcagggct

SEQ ID NO: 6964237 - DNA, 20 bp, Homo sapiens
tcccaagggctgagaggatc

SEQ ID NO: 6964238 - DNA, 21 bp, Homo sapiens
gccatttcacacagacatttg

SEQ ID NO: 6964239 - DNA, 22 bp, Homo sapiens
tgccttggtttccccatctgta

SEQ ID NO: 6964240 - DNA, 22 bp, Homo sapiens
agttttcctttattgagtacca

SEQ ID NO: 6964241 - DNA, 22 bp, Homo sapiens
tcattttgtgccttatgaccgc

SEQ ID NO: 6964242 - DNA, 22 bp, Homo sapiens
tctcagagctcacacctcctgg

SEQ ID NO: 6964243 - DNA, 22 bp, Homo sapiens
agttaacaagttggcaatcaac

SEQ ID NO: 6964244 - DNA, 21 bp, Homo sapiens
tgtgtttgagactatgtttcc

SEQ ID NO: 6964245 - DNA, 22 bp, Homo sapiens
gagtgctcgggtgtcccgcggg

SEQ ID NO: 6964246 - DNA, 22 bp, Homo sapiens
gataagcactatataagtattt

SEQ ID NO: 6964247 - DNA, 21 bp, Homo sapiens
ttctccagggggagctctctc

SEQ ID NO: 6964248 - DNA, 22 bp, Homo sapiens
gaaagtgcttagagtgtggtat

SEQ ID NO: 6964249 - DNA, 22 bp, Homo sapiens
tctctcaggctggagtgcagtg

SEQ ID NO: 6964250 - DNA, 22 bp, Homo sapiens
gggcagcacagacagtgaaggc

SEQ ID NO: 6964251 - DNA, 22 bp, Homo sapiens
atcttagagagtcgtgttttgt

SEQ ID NO: 6964252 - DNA, 22 bp, Homo sapiens
tgggttgtcatgggtccaaccc

SEQ ID NO: 6964253 - DNA, 22 bp, Homo sapiens
ctcaggacggccgggggagcct

SEQ ID NO: 6964254 - DNA, 22 bp, Homo sapiens
tttctctttcaatctgcagtac

SEQ ID NO: 6964255 - DNA, 18 bp, Homo sapiens
attgttctgtgacatgtc

SEQ ID NO: 6964256 - DNA, 22 bp, Homo sapiens
ttcatgtgtatggaacattttt

SEQ ID NO: 6964257 - DNA, 22 bp, Homo sapiens
tgcttctgggtaggcctcagga

SEQ ID NO: 6964258 - DNA, 22 bp, Homo sapiens
ggttggtaactccctgtgcagt

SEQ ID NO: 6964259 - DNA, 22 bp, Homo sapiens
ggggctgagtcagtgggaagag

SEQ ID NO: 6964260 - DNA, 22 bp, Homo sapiens
tcagataatgactgagttttac

SEQ ID NO: 6964261 - DNA, 22 bp, Homo sapiens
cacttgggagcattgcacatgt

SEQ ID NO: 6964262 - DNA, 22 bp, Homo sapiens
agtcctaatgccttggaattca

SEQ ID NO: 6964263 - DNA, 22 bp, Homo sapiens
agtcttcagcagccttctcagg

SEQ ID NO: 6964264 - DNA, 22 bp, Homo sapiens
aaggagctgggagggacacatg

SEQ ID NO: 6964265 - DNA, 22 bp, Homo sapiens
gtgtggaaacagagagggcaac

SEQ ID NO: 6964266 - DNA, 22 bp, Homo sapiens
cacagaggcggaaaattctgaa

SEQ ID NO: 6964267 - DNA, 22 bp, Homo sapiens
tgggctctcaaagtgcggcttg

SEQ ID NO: 6964268 - DNA, 22 bp, Homo sapiens
tctacagctctggagcttttgg

SEQ ID NO: 6964269 - DNA, 22 bp, Homo sapiens
atcccagatagtgaccctcagg

SEQ ID NO: 6964270 - DNA, 19 bp, Homo sapiens
tctttcatttctagctctg

SEQ ID NO: 6964271 - DNA, 19 bp, Homo sapiens
aaatatcagagagatgata

SEQ ID NO: 6964272 - DNA, 22 bp, Homo sapiens
cccagctgtaacgggtctgcac

SEQ ID NO: 6964273 - DNA, 22 bp, Homo sapiens
atcgccgaggtcctgctccaag

SEQ ID NO: 6964274 - DNA, 22 bp, Homo sapiens
gcaggagagtctgtgccaggtt

SEQ ID NO: 6964275 - DNA, 19 bp, Homo sapiens
ggcttcagtttagcaggct

SEQ ID NO: 6964276 - DNA, 22 bp, Homo sapiens
tttgtagttgtggatgctgaag

SEQ ID NO: 6964277 - DNA, 22 bp, Homo sapiens
tggtctgagcggggccattcag

SEQ ID NO: 6964278 - DNA, 22 bp, Homo sapiens
acgatgctcaactatatgaatt

SEQ ID NO: 6964279 - DNA, 22 bp, Homo sapiens
gtacacatatattaaaaattgt

SEQ ID NO: 6964280 - DNA, 22 bp, Homo sapiens
tctctcaggaggcaggttccta

SEQ ID NO: 6964281 - DNA, 22 bp, Homo sapiens
atcaggatctgcatcataagaa

SEQ ID NO: 6964282 - DNA, 22 bp, Homo sapiens
tagaattgagtttcactgttcc

SEQ ID NO: 6964283 - DNA, 22 bp, Homo sapiens
caggtgcccagctcctgctgtg

SEQ ID NO: 6964284 - DNA, 22 bp, Homo sapiens
aaatcatctctgcatccttagc

SEQ ID NO: 6964285 - DNA, 22 bp, Homo sapiens
gcttctgtggttgtcacgacta

SEQ ID NO: 6964286 - DNA, 22 bp, Homo sapiens
aaacacaagatggcctcttctg

SEQ ID NO: 6964287 - DNA, 22 bp, Homo sapiens
tagcagagcacatcttcattct

SEQ ID NO: 6964288 - DNA, 22 bp, Homo sapiens
gacaataaagtgatacatggga

SEQ ID NO: 6964289 - DNA, 22 bp, Homo sapiens
ttggtggacctcatcagaaccg

SEQ ID NO: 6964290 - DNA, 22 bp, Homo sapiens
aattatcagatataaaactgca

SEQ ID NO: 6964291 - DNA, 22 bp, Homo sapiens
aatatagttctagaaatatttt

SEQ ID NO: 6964292 - DNA, 22 bp, Homo sapiens
agtgacaacaagttgactagaa

SEQ ID NO: 6964293 - DNA, 22 bp, Homo sapiens
agcaataaccactctaatttat

SEQ ID NO: 6964294 - DNA, 23 bp, Homo sapiens
tttagcacgtcgcccagggaggc

SEQ ID NO: 6964295 - DNA, 20 bp, Homo sapiens
tacaagaatccccagttgtc

SEQ ID NO: 6964296 - DNA, 22 bp, Homo sapiens
tgtcccagacacagtatgcgct

SEQ ID NO: 6964297 - DNA, 22 bp, Homo sapiens
tggggtaaggacagccagtagg

SEQ ID NO: 6964298 - DNA, 22 bp, Homo sapiens
tatctagatatttggataaatg

SEQ ID NO: 6964299 - DNA, 22 bp, Homo sapiens
atacagctttctttcacatgag

SEQ ID NO: 6964300 - DNA, 22 bp, Homo sapiens
aatcaggaaactatcaacacat

SEQ ID NO: 6964301 - DNA, 20 bp, Homo sapiens
tcagacccggggaagggagc

SEQ ID NO: 6964302 - DNA, 22 bp, Homo sapiens
gttttctctgagatgcctttct

SEQ ID NO: 6964303 - DNA, 22 bp, Homo sapiens
tatctatgtgctctgacctctc

SEQ ID NO: 6964304 - DNA, 22 bp, Homo sapiens
cactggttttcttcctcgtagc

SEQ ID NO: 6964305 - DNA, 22 bp, Homo sapiens
tagggcaggtgaagaaaagcta

SEQ ID NO: 6964306 - DNA, 22 bp, Homo sapiens
tagtggaggcctgttgtgtgca

SEQ ID NO: 6964307 - DNA, 22 bp, Homo sapiens
ttcagtctcatggatgtgaaat

SEQ ID NO: 6964308 - DNA, 22 bp, Homo sapiens
ctgttgcatgactgtgcatgct

SEQ ID NO: 6964309 - DNA, 22 bp, Homo sapiens
aggctttaagtggcctacagct

SEQ ID NO: 6964310 - DNA, 22 bp, Homo sapiens
gctgccttccataatgtacgta

SEQ ID NO: 6964311 - DNA, 21 bp, Homo sapiens
ggtcttcaaagcttttacgat

SEQ ID NO: 6964312 - DNA, 22 bp, Homo sapiens
tccttatatcttcagagaagca

SEQ ID NO: 6964313 - DNA, 22 bp, Homo sapiens
cagaggcagtggggttgctcct

SEQ ID NO: 6964314 - DNA, 22 bp, Homo sapiens
tcaataaggcaacattaagtta

SEQ ID NO: 6964315 - DNA, 22 bp, Homo sapiens
gataaaagaggaaatttgttca

SEQ ID NO: 6964316 - DNA, 22 bp, Homo sapiens
aagatttagggccagtttacat

SEQ ID NO: 6964317 - DNA, 22 bp, Homo sapiens
ctgcaccatccttcatgctctg

SEQ ID NO: 6964318 - DNA, 22 bp, Homo sapiens
tgacaggatagtaggaagatct

SEQ ID NO: 6964319 - DNA, 22 bp, Homo sapiens
tgtgtcctcatgtggcagagag

SEQ ID NO: 6964320 - DNA, 22 bp, Homo sapiens
accagagaatgtgcatctctaa

SEQ ID NO: 6964321 - DNA, 22 bp, Homo sapiens
aggaagctggtgtgaggatgaa

SEQ ID NO: 6964322 - DNA, 22 bp, Homo sapiens
gcctgcaactggcacagcttgt

SEQ ID NO: 6964323 - DNA, 22 bp, Homo sapiens
tccaccctgcttttgtctttga

SEQ ID NO: 6964324 - DNA, 22 bp, Homo sapiens
ttaaatagtaggtctattttgg

SEQ ID NO: 6964325 - DNA, 22 bp, Homo sapiens
ccaaagtgctaggattacaggc

SEQ ID NO: 6964326 - DNA, 22 bp, Homo sapiens
atcacagttactcaaataatga

SEQ ID NO: 6964327 - DNA, 22 bp, Homo sapiens
cccagcatgcacgctgacactc

SEQ ID NO: 6964328 - DNA, 22 bp, Homo sapiens
tgggtgggagcgccctgtctgg

SEQ ID NO: 6964329 - DNA, 22 bp, Homo sapiens
ttacacaattttattgacctaa

SEQ ID NO: 6964330 - DNA, 22 bp, Homo sapiens
ggtcctgtctgacatcactgct

SEQ ID NO: 6964331 - DNA, 22 bp, Homo sapiens
aggcagagctgggttttgaaat

SEQ ID NO: 6964332 - DNA, 22 bp, Homo sapiens
cttgtattatggttcgcttagt

SEQ ID NO: 6964333 - DNA, 22 bp, Homo sapiens
tcctttggaactgactccgtta

SEQ ID NO: 6964334 - DNA, 22 bp, Homo sapiens
cctgtgtcctcccactcagtcc

SEQ ID NO: 6964335 - DNA, 22 bp, Homo sapiens
attgtcttctgtcttaggtgat

SEQ ID NO: 6964336 - DNA, 22 bp, Homo sapiens
tgaagttttctggttgattaag

SEQ ID NO: 6964337 - DNA, 22 bp, Homo sapiens
gtatgtatatatgtgtacacac

SEQ ID NO: 6964338 - DNA, 22 bp, Homo sapiens
gcaaggctgggagatgaggcct

SEQ ID NO: 6964339 - DNA, 22 bp, Homo sapiens
gatcaccagttgtaggtatttt

SEQ ID NO: 6964340 - DNA, 22 bp, Homo sapiens
ctttccccagtatatcattgcc

SEQ ID NO: 6964341 - DNA, 22 bp, Homo sapiens
gttagcttttacttgaacactt

SEQ ID NO: 6964342 - DNA, 22 bp, Homo sapiens
tatacacaaggtgtgcatttgt

SEQ ID NO: 6964343 - DNA, 22 bp, Homo sapiens
ctggttttgaatatgtctgctt

SEQ ID NO: 6964344 - DNA, 19 bp, Homo sapiens
atgcaacaaaagtgtaaga

SEQ ID NO: 6964345 - DNA, 22 bp, Homo sapiens
ttgcataaagattttattgcat

SEQ ID NO: 6964346 - DNA, 22 bp, Homo sapiens
ctcacagatctgtgcctgaacc

SEQ ID NO: 6964347 - DNA, 22 bp, Homo sapiens
tgagatggaaggtgaggcagta

SEQ ID NO: 6964348 - DNA, 22 bp, Homo sapiens
tctggcttggacacaatcttcc

SEQ ID NO: 6964349 - DNA, 22 bp, Homo sapiens
tgagatgggtggggagctcagg

SEQ ID NO: 6964350 - DNA, 20 bp, Homo sapiens
acacagagtgagtctgcttg

SEQ ID NO: 6964351 - DNA, 18 bp, Homo sapiens
acagaaatagctgtgcct

SEQ ID NO: 6964352 - DNA, 22 bp, Homo sapiens
tctcctttgaaagttaggactg

SEQ ID NO: 6964353 - DNA, 18 bp, Homo sapiens
gggttcacctgcctttgg

SEQ ID NO: 6964354 - DNA, 22 bp, Homo sapiens
cagaatttttcactcaatcttc

SEQ ID NO: 6964355 - DNA, 22 bp, Homo sapiens
tatctcattttattgcaaatgt

SEQ ID NO: 6964356 - DNA, 22 bp, Homo sapiens
aaactgcctcctgggcaactaa

SEQ ID NO: 6964357 - DNA, 22 bp, Homo sapiens
tgggcggtgtgcaggctctgct

SEQ ID NO: 6964358 - DNA, 22 bp, Homo sapiens
tgtacacagtatgaggcatctt

SEQ ID NO: 6964359 - DNA, 22 bp, Homo sapiens
accaggctgtgaagtgagacta

SEQ ID NO: 6964360 - DNA, 22 bp, Homo sapiens
caggatgagaagggctcttacg

SEQ ID NO: 6964361 - DNA, 22 bp, Homo sapiens
tcagagaaggtaagtgacctgc

SEQ ID NO: 6964362 - DNA, 22 bp, Homo sapiens
tgccacagagcaattctgctga

SEQ ID NO: 6964363 - DNA, 22 bp, Homo sapiens
gccagatgccgtaaagatgggc

SEQ ID NO: 6964364 - DNA, 22 bp, Homo sapiens
acccgcttccggagctgcagtg

SEQ ID NO: 6964365 - DNA, 22 bp, Homo sapiens
gatggcttaagagtaaaaggca

SEQ ID NO: 6964366 - DNA, 22 bp, Homo sapiens
tctaggcccaggcctgcggctg

SEQ ID NO: 6964367 - DNA, 22 bp, Homo sapiens
ctctctgggggccatgccaaga

SEQ ID NO: 6964368 - DNA, 22 bp, Homo sapiens
gacattgctcggaaattagtgt

SEQ ID NO: 6964369 - DNA, 22 bp, Homo sapiens
gagagggctggaaacttcctgg

SEQ ID NO: 6964370 - DNA, 22 bp, Homo sapiens
ttaatatgctgcttcttgaaaa

SEQ ID NO: 6964371 - DNA, 22 bp, Homo sapiens
ctggctggggaagtcatttgat

SEQ ID NO: 6964372 - DNA, 22 bp, Homo sapiens
gcaggctgccctcttgtgttga

SEQ ID NO: 6964373 - DNA, 19 bp, Homo sapiens
ggctcagtggcaccatcct

SEQ ID NO: 6964374 - DNA, 22 bp, Homo sapiens
atccagaacacctgtatcacca

SEQ ID NO: 6964375 - DNA, 22 bp, Homo sapiens
acttttatgataatcaatgttc

SEQ ID NO: 6964376 - DNA, 22 bp, Homo sapiens
ctgatatggtaactgtgtttct

SEQ ID NO: 6964377 - DNA, 22 bp, Homo sapiens
cttgctggaaactctctctgcc

SEQ ID NO: 6964378 - DNA, 22 bp, Homo sapiens
aggttcagacgcataataggca

SEQ ID NO: 6964379 - DNA, 22 bp, Homo sapiens
actgttagccttccataacaca

SEQ ID NO: 6964380 - DNA, 22 bp, Homo sapiens
ctggtggaccagcctccccagc

SEQ ID NO: 6964381 - DNA, 22 bp, Homo sapiens
ccagtcctggccagtaacatga

SEQ ID NO: 6964382 - DNA, 22 bp, Homo sapiens
tgagttttgtaatattcaagat

SEQ ID NO: 6964383 - DNA, 22 bp, Homo sapiens
atctcctaaagtttccagaaga

SEQ ID NO: 6964384 - DNA, 22 bp, Homo sapiens
tgattgatggaggtgatttacc

SEQ ID NO: 6964385 - DNA, 22 bp, Homo sapiens
ggcagtttatattatgtgtgtg

SEQ ID NO: 6964386 - DNA, 22 bp, Homo sapiens
tcagtgccatgggcagacaggc

SEQ ID NO: 6964387 - DNA, 18 bp, Homo sapiens
ttccataatgtatgtaac

SEQ ID NO: 6964388 - DNA, 22 bp, Homo sapiens
tgcagggccatggtggcggctg

SEQ ID NO: 6964389 - DNA, 22 bp, Homo sapiens
aaatgactaatgatcctgggca

SEQ ID NO: 6964390 - DNA, 22 bp, Homo sapiens
ggaatcctgccagctctgcccc

SEQ ID NO: 6964391 - DNA, 22 bp, Homo sapiens
aaaagctttgttaataggtttg

SEQ ID NO: 6964392 - DNA, 22 bp, Homo sapiens
gcagaggcacagccccagatga

SEQ ID NO: 6964393 - DNA, 22 bp, Homo sapiens
tcttgtctaggacagtgatgtg

SEQ ID NO: 6964394 - DNA, 22 bp, Homo sapiens
tccaggccccactgaagcccct

SEQ ID NO: 6964395 - DNA, 20 bp, Homo sapiens
tggcttctcttcactcctgt

SEQ ID NO: 6964396 - DNA, 22 bp, Homo sapiens
ttcttgtactggagatacatga

SEQ ID NO: 6964397 - DNA, 22 bp, Homo sapiens
aaggtttcgggagcgggtctgg

SEQ ID NO: 6964398 - DNA, 22 bp, Homo sapiens
gggagccacagtgaggtgcatg

SEQ ID NO: 6964399 - DNA, 22 bp, Homo sapiens
agtgtctgcaaaatgaaagagc

SEQ ID NO: 6964400 - DNA, 22 bp, Homo sapiens
agttgtaagctctcttgctggg

SEQ ID NO: 6964401 - DNA, 22 bp, Homo sapiens
gtttatatgaacttcataccca

SEQ ID NO: 6964402 - DNA, 22 bp, Homo sapiens
aaagtagaacattttcttatct

SEQ ID NO: 6964403 - DNA, 22 bp, Homo sapiens
agagcaccaaggtggtttggac

SEQ ID NO: 6964404 - DNA, 22 bp, Homo sapiens
ttggaccattgacctgatctac

SEQ ID NO: 6964405 - DNA, 22 bp, Homo sapiens
gacagggactccctggttagaa

SEQ ID NO: 6964406 - DNA, 22 bp, Homo sapiens
gaagagctgtagcctgctcttt

SEQ ID NO: 6964407 - DNA, 19 bp, Homo sapiens
agtgaacacaaagagaagg

SEQ ID NO: 6964408 - DNA, 22 bp, Homo sapiens
aaacatcataggcatgcatgat

SEQ ID NO: 6964409 - DNA, 22 bp, Homo sapiens
ctgcagatcttgtgtacttgtc

SEQ ID NO: 6964410 - DNA, 22 bp, Homo sapiens
tatgtacataacatgaaatgca

SEQ ID NO: 6964411 - DNA, 22 bp, Homo sapiens
ttattataatgagggataaaaa

SEQ ID NO: 6964412 - DNA, 22 bp, Homo sapiens
agttatttggctatagatggta

SEQ ID NO: 6964413 - DNA, 22 bp, Homo sapiens
ttcaaacaaaactctttcctat

SEQ ID NO: 6964414 - DNA, 22 bp, Homo sapiens
tggccctgaaggccttgagcat

SEQ ID NO: 6964415 - DNA, 22 bp, Homo sapiens
gaatgcacttccaacatctatt

SEQ ID NO: 6964416 - DNA, 22 bp, Homo sapiens
ttgatacatagcacagtttagg

SEQ ID NO: 6964417 - DNA, 22 bp, Homo sapiens
aaggactaatgaatagatgaat

SEQ ID NO: 6964418 - DNA, 22 bp, Homo sapiens
aggcactgggggatgagcaagg

SEQ ID NO: 6964419 - DNA, 22 bp, Homo sapiens
catgagttcaaaatgcctgcct

SEQ ID NO: 6964420 - DNA, 22 bp, Homo sapiens
ttatttgaaaagaaggttacgt

SEQ ID NO: 6964421 - DNA, 22 bp, Homo sapiens
acctcctggctgctcatggaac

SEQ ID NO: 6964422 - DNA, 22 bp, Homo sapiens
cagctgagaaaggcaggctcac

SEQ ID NO: 6964423 - DNA, 22 bp, Homo sapiens
ttcccagaggagatttgcttat

SEQ ID NO: 6964424 - DNA, 22 bp, Homo sapiens
ttggttttcaggggcaggataa

SEQ ID NO: 6964425 - DNA, 22 bp, Homo sapiens
caggaggtgaaggagaaccagt

SEQ ID NO: 6964426 - DNA, 22 bp, Homo sapiens
ttgagtgagaattacatcagct

SEQ ID NO: 6964427 - DNA, 22 bp, Homo sapiens
acctgtcatcccggctgcaccg

SEQ ID NO: 6964428 - DNA, 22 bp, Homo sapiens
tctcctgcttcaactgatggac

SEQ ID NO: 6964429 - DNA, 22 bp, Homo sapiens
tgcctaggctggagtgcaatgg

SEQ ID NO: 6964430 - DNA, 22 bp, Homo sapiens
ttacacttttgacaaacctgag

SEQ ID NO: 6964431 - DNA, 22 bp, Homo sapiens
cctacacatgaatgcgagaaat

SEQ ID NO: 6964432 - DNA, 22 bp, Homo sapiens
tctgtccattcagccatccatc

SEQ ID NO: 6964433 - DNA, 22 bp, Homo sapiens
gatttcacctgatcttgtcatc

SEQ ID NO: 6964434 - DNA, 22 bp, Homo sapiens
tgcaataactactttaatgttg

SEQ ID NO: 6964435 - DNA, 22 bp, Homo sapiens
tgagcaagagaaactgactgta

SEQ ID NO: 6964436 - DNA, 22 bp, Homo sapiens
ggagggaaccttggctggattg

SEQ ID NO: 6964437 - DNA, 22 bp, Homo sapiens
ggcccaggatgcaagaactgaa

SEQ ID NO: 6964438 - DNA, 22 bp, Homo sapiens
gtttacttgtgccttggcttaa

SEQ ID NO: 6964439 - DNA, 22 bp, Homo sapiens
cctgaagatgctgtggcctggt

SEQ ID NO: 6964440 - DNA, 22 bp, Homo sapiens
ctgctgccggcgagcctccctt

SEQ ID NO: 6964441 - DNA, 22 bp, Homo sapiens
atcttaccttctacaggcactg

SEQ ID NO: 6964442 - DNA, 22 bp, Homo sapiens
aagtttagggaagtctgagcgc

SEQ ID NO: 6964443 - DNA, 21 bp, Homo sapiens
ctctccagtggttcctgattc

SEQ ID NO: 6964444 - DNA, 22 bp, Homo sapiens
tcccagaagagatgccacttga

SEQ ID NO: 6964445 - DNA, 22 bp, Homo sapiens
cgcggcgcgcccccgggtgtgt

SEQ ID NO: 6964446 - DNA, 20 bp, Homo sapiens
tcctgcaaaaggacaagttt

SEQ ID NO: 6964447 - DNA, 22 bp, Homo sapiens
cactaattctggagacaactca

SEQ ID NO: 6964448 - DNA, 20 bp, Homo sapiens
gggctgtgcctcctcgtggt

SEQ ID NO: 6964449 - DNA, 22 bp, Homo sapiens
taggaaggcctgtcactacttg

SEQ ID NO: 6964450 - DNA, 22 bp, Homo sapiens
ggcaccttggctagtgatcaac

SEQ ID NO: 6964451 - DNA, 22 bp, Homo sapiens
ttgcaaagcctttctaatcgtc

SEQ ID NO: 6964452 - DNA, 22 bp, Homo sapiens
tgaatgagtttggctgctgttc

SEQ ID NO: 6964453 - DNA, 22 bp, Homo sapiens
cagctcttttttgcagcagctg

SEQ ID NO: 6964454 - DNA, 22 bp, Homo sapiens
cagtagcaggcactcagcacgt

SEQ ID NO: 6964455 - DNA, 22 bp, Homo sapiens
ttgcacatgctatttatgtttt

SEQ ID NO: 6964456 - DNA, 22 bp, Homo sapiens
acacatatgtcattgaaaaatc

SEQ ID NO: 6964457 - DNA, 22 bp, Homo sapiens
aaatcaacttgtgacgttaggt

SEQ ID NO: 6964458 - DNA, 22 bp, Homo sapiens
ctggttttgtcagaagctttat

SEQ ID NO: 6964459 - DNA, 22 bp, Homo sapiens
ttgagctcccgcttcttctttg

SEQ ID NO: 6964460 - DNA, 22 bp, Homo sapiens
atgaagagttctgttttggaca

SEQ ID NO: 6964461 - DNA, 22 bp, Homo sapiens
tggtttttggtgttcacagagg

SEQ ID NO: 6964462 - DNA, 22 bp, Homo sapiens
ggtgaattctaggagatctgac

SEQ ID NO: 6964463 - DNA, 22 bp, Homo sapiens
gtcctctgactcagccttggga

SEQ ID NO: 6964464 - DNA, 22 bp, Homo sapiens
aagatccatgggaatgtttggc

SEQ ID NO: 6964465 - DNA, 18 bp, Homo sapiens
gtttacattactgaatag

SEQ ID NO: 6964466 - DNA, 22 bp, Homo sapiens
ccagaaagataggaaatcaagt

SEQ ID NO: 6964467 - DNA, 22 bp, Homo sapiens
attcagactcttgagcagtccc

SEQ ID NO: 6964468 - DNA, 22 bp, Homo sapiens
cttgggaggagaacaaagctcc

SEQ ID NO: 6964469 - DNA, 22 bp, Homo sapiens
cttagctttgtcctaggtctct

SEQ ID NO: 6964470 - DNA, 22 bp, Homo sapiens
agctgggcttggccaggtcgct

SEQ ID NO: 6964471 - DNA, 22 bp, Homo sapiens
tttaatctattccctaaacacc

SEQ ID NO: 6964472 - DNA, 18 bp, Homo sapiens
tacaaactccttgaaggc

SEQ ID NO: 6964473 - DNA, 22 bp, Homo sapiens
tgaggaatgtgacaaaaccaag

SEQ ID NO: 6964474 - DNA, 22 bp, Homo sapiens
ttgacaaaggaccttgctattt

SEQ ID NO: 6964475 - DNA, 22 bp, Homo sapiens
acggtaacagataccacagact

SEQ ID NO: 6964476 - DNA, 22 bp, Homo sapiens
acttctggtgtcatactgcatt

SEQ ID NO: 6964477 - DNA, 17 bp, Homo sapiens
gtagcaaaccttttagg

SEQ ID NO: 6964478 - DNA, 22 bp, Homo sapiens
atctggctttcttaatgactta

SEQ ID NO: 6964479 - DNA, 22 bp, Homo sapiens
tgaagcagagtgaaggtgaatt

SEQ ID NO: 6964480 - DNA, 22 bp, Homo sapiens
tggtgcaatattatgaaaggta

SEQ ID NO: 6964481 - DNA, 22 bp, Homo sapiens
tggcaggttggcctttggttca

SEQ ID NO: 6964482 - DNA, 22 bp, Homo sapiens
cagtatttgttacagcattagc

SEQ ID NO: 6964483 - DNA, 22 bp, Homo sapiens
ctggatctaaaggtggatgtag

SEQ ID NO: 6964484 - DNA, 22 bp, Homo sapiens
tgtacagtgtaaataagtggat

SEQ ID NO: 6964485 - DNA, 22 bp, Homo sapiens
tgggctcaggaccccagaggcc

SEQ ID NO: 6964486 - DNA, 16 bp, Homo sapiens
gcagtgtgtttaatag

SEQ ID NO: 6964487 - DNA, 22 bp, Homo sapiens
ggcacaggaatctgtgaagtgc

SEQ ID NO: 6964488 - DNA, 22 bp, Homo sapiens
atcctacaaagcagggctatgg

SEQ ID NO: 6964489 - DNA, 22 bp, Homo sapiens
agtatatctgcttctgggtccc

SEQ ID NO: 6964490 - DNA, 22 bp, Homo sapiens
ttcagtatgattcctccagtag

SEQ ID NO: 6964491 - DNA, 20 bp, Homo sapiens
gctgctgagcttccctgggg

SEQ ID NO: 6964492 - DNA, 22 bp, Homo sapiens
tgtatgcacatggataagtatg

SEQ ID NO: 6964493 - DNA, 22 bp, Homo sapiens
atgccaagctctatccctgacc

SEQ ID NO: 6964494 - DNA, 22 bp, Homo sapiens
ctccccacgcctggactaagag

SEQ ID NO: 6964495 - DNA, 22 bp, Homo sapiens
tcttatcaataatgactgttga

SEQ ID NO: 6964496 - DNA, 22 bp, Homo sapiens
gtccaaggatggggtctcccag

SEQ ID NO: 6964497 - DNA, 22 bp, Homo sapiens
tccttgccctaaatgtctgtgt

SEQ ID NO: 6964498 - DNA, 22 bp, Homo sapiens
gcagtagagcttcttttgatga

SEQ ID NO: 6964499 - DNA, 17 bp, Homo sapiens
gggctggatggccatgg

SEQ ID NO: 6964500 - DNA, 22 bp, Homo sapiens
atcatccatggctgatcataaa

SEQ ID NO: 6964501 - DNA, 22 bp, Homo sapiens
tacagagaactcatagaaagaa

SEQ ID NO: 6964502 - DNA, 22 bp, Homo sapiens
gactggattctgctttggctgt

SEQ ID NO: 6964503 - DNA, 22 bp, Homo sapiens
ttgtagtctaggatagattttt

SEQ ID NO: 6964504 - DNA, 22 bp, Homo sapiens
ctaagataatggctgggtaaag

SEQ ID NO: 6964505 - DNA, 22 bp, Homo sapiens
aggctgagctgacctggtttgg

SEQ ID NO: 6964506 - DNA, 22 bp, Homo sapiens
taagtgaatccttgagaagaaa

SEQ ID NO: 6964507 - DNA, 22 bp, Homo sapiens
agagatggcgtctcagagcctg

SEQ ID NO: 6964508 - DNA, 22 bp, Homo sapiens
acacccaggctggcgtgcagtg

SEQ ID NO: 6964509 - DNA, 22 bp, Homo sapiens
gttcaaggaagggaggaaagcc

SEQ ID NO: 6964510 - DNA, 22 bp, Homo sapiens
gagggcaaaacagagaagatgt

SEQ ID NO: 6964511 - DNA, 22 bp, Homo sapiens
tagttacagatctaggactgtt

SEQ ID NO: 6964512 - DNA, 22 bp, Homo sapiens
acgctatcaatctagacaaaga

SEQ ID NO: 6964513 - DNA, 22 bp, Homo sapiens
ggttaaaaataatttacttggc

SEQ ID NO: 6964514 - DNA, 22 bp, Homo sapiens
acagtggctcatgcctgtcatc

SEQ ID NO: 6964515 - DNA, 20 bp, Homo sapiens
gagcagtgagccagggaaag

SEQ ID NO: 6964516 - DNA, 22 bp, Homo sapiens
tgtacatagatcttgaaaatta

SEQ ID NO: 6964517 - DNA, 22 bp, Homo sapiens
ctgtgccagagggtgaccaagg

SEQ ID NO: 6964518 - DNA, 22 bp, Homo sapiens
agtaaacagaaagcaagatgat

SEQ ID NO: 6964519 - DNA, 22 bp, Homo sapiens
cagttttagggcaatgtgaaga

SEQ ID NO: 6964520 - DNA, 22 bp, Homo sapiens
ttgcagggccttggcttcttcc

SEQ ID NO: 6964521 - DNA, 22 bp, Homo sapiens
cagcctttgaacttcagaggtt

SEQ ID NO: 6964522 - DNA, 22 bp, Homo sapiens
gtcaccctgctggctgttcagc

SEQ ID NO: 6964523 - DNA, 22 bp, Homo sapiens
aatagctgcataaagtatagaa

SEQ ID NO: 6964524 - DNA, 22 bp, Homo sapiens
tcataaaatgctcctgatattg

SEQ ID NO: 6964525 - DNA, 17 bp, Homo sapiens
tgcttggcttctttagg

SEQ ID NO: 6964526 - DNA, 22 bp, Homo sapiens
ctgagctctaatgtcagccttg

SEQ ID NO: 6964527 - DNA, 22 bp, Homo sapiens
gaaaggatttggtgccaagcgt

SEQ ID NO: 6964528 - DNA, 22 bp, Homo sapiens
cttaagaatattgaagttgtgg

SEQ ID NO: 6964529 - DNA, 22 bp, Homo sapiens
ccctaggctgggctcttggctt

SEQ ID NO: 6964530 - DNA, 22 bp, Homo sapiens
gcatgctgcaccagagcctctc

SEQ ID NO: 6964531 - DNA, 22 bp, Homo sapiens
aaaggagacttcagatctcctt

SEQ ID NO: 6964532 - DNA, 22 bp, Homo sapiens
tatgctccaaagacatgttgcc

SEQ ID NO: 6964533 - DNA, 17 bp, Homo sapiens
atggaggcagacaggtc

SEQ ID NO: 6964534 - DNA, 22 bp, Homo sapiens
tacatgaacctttatgtgtgat

SEQ ID NO: 6964535 - DNA, 22 bp, Homo sapiens
cctggagcacatggcaggaggc

SEQ ID NO: 6964536 - DNA, 23 bp, Homo sapiens
gccaaaggtctgttcagtggtga

SEQ ID NO: 6964537 - DNA, 22 bp, Homo sapiens
gcagccctgcagctccacaccg

SEQ ID NO: 6964538 - DNA, 22 bp, Homo sapiens
tggtacaagttctggcatgtga

SEQ ID NO: 6964539 - DNA, 22 bp, Homo sapiens
agaggccaggctgcagagggat

SEQ ID NO: 6964540 - DNA, 17 bp, Homo sapiens
ttctgtgcttcctggct

SEQ ID NO: 6964541 - DNA, 22 bp, Homo sapiens
ttaagctctcattattattatt

SEQ ID NO: 6964542 - DNA, 21 bp, Homo sapiens
atttggatattgctggcaaat

SEQ ID NO: 6964543 - DNA, 22 bp, Homo sapiens
ctgaggtcctcagagggaaagg

SEQ ID NO: 6964544 - DNA, 22 bp, Homo sapiens
tgaaatctttagtttctgtccc

SEQ ID NO: 6964545 - DNA, 22 bp, Homo sapiens
catggcagctcctccagtgtga

SEQ ID NO: 6964546 - DNA, 22 bp, Homo sapiens
actgagatttacatgttctagt

SEQ ID NO: 6964547 - DNA, 22 bp, Homo sapiens
ggtgatcttgaactaaataaac

SEQ ID NO: 6964548 - DNA, 22 bp, Homo sapiens
aacctgagataataggagagta

SEQ ID NO: 6964549 - DNA, 22 bp, Homo sapiens
aagattaaaggggagacaagct

SEQ ID NO: 6964550 - DNA, 22 bp, Homo sapiens
catttagtacaacttttacagt

SEQ ID NO: 6964551 - DNA, 22 bp, Homo sapiens
ccctttgcccagtatattctag

SEQ ID NO: 6964552 - DNA, 22 bp, Homo sapiens
aaggcaggagctgtatcttatt

SEQ ID NO: 6964553 - DNA, 22 bp, Homo sapiens
tggctgtgatttgcacgagatg

SEQ ID NO: 6964554 - DNA, 22 bp, Homo sapiens
ttctttcccagaagatatgttt

SEQ ID NO: 6964555 - DNA, 22 bp, Homo sapiens
agggctttggccccctgctgca

SEQ ID NO: 6964556 - DNA, 22 bp, Homo sapiens
tgctggtggagaaagtggaggt

SEQ ID NO: 6964557 - DNA, 21 bp, Homo sapiens
ataaactgcatcaagttggtg

SEQ ID NO: 6964558 - DNA, 22 bp, Homo sapiens
tttggtaaccttgcattcttta

SEQ ID NO: 6964559 - DNA, 22 bp, Homo sapiens
tcctgctgtgcttattatcctg

SEQ ID NO: 6964560 - DNA, 22 bp, Homo sapiens
ctaagcatccatctcttcttca

SEQ ID NO: 6964561 - DNA, 22 bp, Homo sapiens
tggttctaggctttgtcttttg

SEQ ID NO: 6964562 - DNA, 20 bp, Homo sapiens
cagagctatccctttattta

SEQ ID NO: 6964563 - DNA, 22 bp, Homo sapiens
agtgactaaaggttttaatggc

SEQ ID NO: 6964564 - DNA, 22 bp, Homo sapiens
tatgactatagggcttagtgtt

SEQ ID NO: 6964565 - DNA, 22 bp, Homo sapiens
ggccagcttctctgctgcctgt

SEQ ID NO: 6964566 - DNA, 22 bp, Homo sapiens
acatttgactctgttcatatta

SEQ ID NO: 6964567 - DNA, 22 bp, Homo sapiens
ctgtcacctgttcactgcagca

SEQ ID NO: 6964568 - DNA, 22 bp, Homo sapiens
ttgacaaaaacctcatttcacc

SEQ ID NO: 6964569 - DNA, 20 bp, Homo sapiens
aaacattcatgtacaagtga

SEQ ID NO: 6964570 - DNA, 22 bp, Homo sapiens
cctgcatgtggtcagcactcct

SEQ ID NO: 6964571 - DNA, 22 bp, Homo sapiens
cttttaatgggagcagtatttg

SEQ ID NO: 6964572 - DNA, 18 bp, Homo sapiens
cctgaggtgggaggaagg

SEQ ID NO: 6964573 - DNA, 22 bp, Homo sapiens
agctggtatttctgaaggaaag

SEQ ID NO: 6964574 - DNA, 22 bp, Homo sapiens
tagcacacactgcatctacaaa

SEQ ID NO: 6964575 - DNA, 21 bp, Homo sapiens
tagcaggatttggtttatttt

SEQ ID NO: 6964576 - DNA, 22 bp, Homo sapiens
tgaacgcaggtccacatggctc

SEQ ID NO: 6964577 - DNA, 22 bp, Homo sapiens
atcaaagtccatcagaaggtag

SEQ ID NO: 6964578 - DNA, 20 bp, Homo sapiens
gtgccaggcaagacaggtgg

SEQ ID NO: 6964579 - DNA, 19 bp, Homo sapiens
tcagtggagaaaggggaag

SEQ ID NO: 6964580 - DNA, 22 bp, Homo sapiens
tttggagagatgaagttctgtg

SEQ ID NO: 6964581 - DNA, 22 bp, Homo sapiens
aaagagttgttgtataacagga

SEQ ID NO: 6964582 - DNA, 22 bp, Homo sapiens
gcacttgattacattagtgcct

SEQ ID NO: 6964583 - DNA, 22 bp, Homo sapiens
tgggctccgttgcctggggcag

SEQ ID NO: 6964584 - DNA, 22 bp, Homo sapiens
aaggagctcccggcagaccagg

SEQ ID NO: 6964585 - DNA, 22 bp, Homo sapiens
tcaaggcttttggttttccata

SEQ ID NO: 6964586 - DNA, 22 bp, Homo sapiens
tgcagctcattggtgtcctggt

SEQ ID NO: 6964587 - DNA, 22 bp, Homo sapiens
gggagcttaagacagttccaat

SEQ ID NO: 6964588 - DNA, 22 bp, Homo sapiens
ttcagaaacccattgggtctct

SEQ ID NO: 6964589 - DNA, 22 bp, Homo sapiens
cagtctgtaatgggttttaaaa

SEQ ID NO: 6964590 - DNA, 22 bp, Homo sapiens
tctataaagggccagatagtag

SEQ ID NO: 6964591 - DNA, 22 bp, Homo sapiens
ctggcagcttcctttgcatctg

SEQ ID NO: 6964592 - DNA, 22 bp, Homo sapiens
ctcaggtcttagttctgtcatc

SEQ ID NO: 6964593 - DNA, 22 bp, Homo sapiens
ggctctgaattattcctgagtc

SEQ ID NO: 6964594 - DNA, 22 bp, Homo sapiens
acaaatgactatttggtacagg

SEQ ID NO: 6964595 - DNA, 22 bp, Homo sapiens
ataaggaaatgaaactctaata

SEQ ID NO: 6964596 - DNA, 22 bp, Homo sapiens
aagagaaagcagactttgtcat

SEQ ID NO: 6964597 - DNA, 22 bp, Homo sapiens
agtggagaatatgcagaaagcc

SEQ ID NO: 6964598 - DNA, 21 bp, Homo sapiens
agtttcacagaggggccgtcc

SEQ ID NO: 6964599 - DNA, 19 bp, Homo sapiens
ttcagaattgggaggtgat

SEQ ID NO: 6964600 - DNA, 22 bp, Homo sapiens
ttctctaggactttggagtcct

SEQ ID NO: 6964601 - DNA, 22 bp, Homo sapiens
ccccagagtgagggattgagtg

SEQ ID NO: 6964602 - DNA, 22 bp, Homo sapiens
ggctgcagccctcgcctagcca

SEQ ID NO: 6964603 - DNA, 17 bp, Homo sapiens
ctttgtcaccaatgcca

SEQ ID NO: 6964604 - DNA, 22 bp, Homo sapiens
gtggagtggtgatggataggtt

SEQ ID NO: 6964605 - DNA, 23 bp, Homo sapiens
cagaaagccctttccccacagta

SEQ ID NO: 6964606 - DNA, 22 bp, Homo sapiens
ggagagctctgggtctccgaca

SEQ ID NO: 6964607 - DNA, 22 bp, Homo sapiens
aacaagttgttgaaaataatta

SEQ ID NO: 6964608 - DNA, 22 bp, Homo sapiens
tccagagctacttgctcaactt

SEQ ID NO: 6964609 - DNA, 17 bp, Homo sapiens
ccacaccctttccttcc

SEQ ID NO: 6964610 - DNA, 22 bp, Homo sapiens
aggctgtgtggatgagtcttac

SEQ ID NO: 6964611 - DNA, 22 bp, Homo sapiens
gttgaaagagcatggacttgaa

SEQ ID NO: 6964612 - DNA, 22 bp, Homo sapiens
cctggacagggccaggccatgc

SEQ ID NO: 6964613 - DNA, 22 bp, Homo sapiens
ctgggcagctccataccaccca

SEQ ID NO: 6964614 - DNA, 22 bp, Homo sapiens
tggcctagagaagccaaaagat

SEQ ID NO: 6964615 - DNA, 22 bp, Homo sapiens
ctgaagagaaatgtacacatgg

SEQ ID NO: 6964616 - DNA, 22 bp, Homo sapiens
caggaccattgcaactgcccct

SEQ ID NO: 6964617 - DNA, 22 bp, Homo sapiens
tggcactgagcagccgcggcag

SEQ ID NO: 6964618 - DNA, 22 bp, Homo sapiens
aagccacagatcgttctgtcac

SEQ ID NO: 6964619 - DNA, 22 bp, Homo sapiens
acaaccatcgtctttgcagcca

SEQ ID NO: 6964620 - DNA, 22 bp, Homo sapiens
gtttcttatttgcaggttgctt

SEQ ID NO: 6964621 - DNA, 21 bp, Homo sapiens
aagggtgcatgcttacctctc

SEQ ID NO: 6964622 - DNA, 22 bp, Homo sapiens
tgagctgtctgaatggtgagga

SEQ ID NO: 6964623 - DNA, 22 bp, Homo sapiens
ctctgcccccagctggtgcttg

SEQ ID NO: 6964624 - DNA, 22 bp, Homo sapiens
cctgagggagggtataggctgt

SEQ ID NO: 6964625 - DNA, 22 bp, Homo sapiens
ggacatagatctagactttaaa

SEQ ID NO: 6964626 - DNA, 22 bp, Homo sapiens
atgtttacaaaaaggaggcttg

SEQ ID NO: 6964627 - DNA, 22 bp, Homo sapiens
agctgctgggaccccagatcca

SEQ ID NO: 6964628 - DNA, 22 bp, Homo sapiens
ccaggcaccaaagtatgcttta

SEQ ID NO: 6964629 - DNA, 22 bp, Homo sapiens
acaatttttcaaagaagcttat

SEQ ID NO: 6964630 - DNA, 22 bp, Homo sapiens
gagagctgtggtttgaccaggc

SEQ ID NO: 6964631 - DNA, 22 bp, Homo sapiens
cacatggcctgtgtggccagac

SEQ ID NO: 6964632 - DNA, 22 bp, Homo sapiens
tctggagtagggtctgggaatt

SEQ ID NO: 6964633 - DNA, 16 bp, Homo sapiens
catattgctgaaagag

SEQ ID NO: 6964634 - DNA, 22 bp, Homo sapiens
gccctgctctggtctctgcccg

SEQ ID NO: 6964635 - DNA, 23 bp, Homo sapiens
tgtaggctaagtcccataaatca

SEQ ID NO: 6964636 - DNA, 22 bp, Homo sapiens
tgctttgcctgctttgactcat

SEQ ID NO: 6964637 - DNA, 22 bp, Homo sapiens
aaattccttgagacgcaggttt

SEQ ID NO: 6964638 - DNA, 22 bp, Homo sapiens
ctcctgaggacttctattgggt

SEQ ID NO: 6964639 - DNA, 22 bp, Homo sapiens
tttggactactgggaccttgtg

SEQ ID NO: 6964640 - DNA, 17 bp, Homo sapiens
tgcagctgatggggaaa

SEQ ID NO: 6964641 - DNA, 22 bp, Homo sapiens
acatgcaagcccctgaacacat

SEQ ID NO: 6964642 - DNA, 23 bp, Homo sapiens
ttgccattccaaataatttccta

SEQ ID NO: 6964643 - DNA, 22 bp, Homo sapiens
atatcagaaatagtaagcagag

SEQ ID NO: 6964644 - DNA, 20 bp, Homo sapiens
taacagttgtagagggtttt

SEQ ID NO: 6964645 - DNA, 22 bp, Homo sapiens
gcaacagcccaggttctgtgtg

SEQ ID NO: 6964646 - DNA, 20 bp, Homo sapiens
taggcagcttgacccttggt

SEQ ID NO: 6964647 - DNA, 22 bp, Homo sapiens
atctctggtccaaatgttacct

SEQ ID NO: 6964648 - DNA, 22 bp, Homo sapiens
agggctgacctaagctccactt

SEQ ID NO: 6964649 - DNA, 22 bp, Homo sapiens
gaaggagaggattgtgaggctg

SEQ ID NO: 6964650 - DNA, 22 bp, Homo sapiens
actgaacacacctgcagcacgt

SEQ ID NO: 6964651 - DNA, 22 bp, Homo sapiens
ttggtcagtcagagaatggagt

SEQ ID NO: 6964652 - DNA, 22 bp, Homo sapiens
cagcttttggcaggatgaccag

SEQ ID NO: 6964653 - DNA, 22 bp, Homo sapiens
tgctctgggcaacagcctccct

SEQ ID NO: 6964654 - DNA, 22 bp, Homo sapiens
atcaattcttaggaaaatagct

SEQ ID NO: 6964655 - DNA, 21 bp, Homo sapiens
cctttacaattttgcattcct

SEQ ID NO: 6964656 - DNA, 22 bp, Homo sapiens
agagaggctgctggactatatg

SEQ ID NO: 6964657 - DNA, 22 bp, Homo sapiens
aacttcatgggttcaaagctgg

SEQ ID NO: 6964658 - DNA, 22 bp, Homo sapiens
tctttctagtggcctctattct

SEQ ID NO: 6964659 - DNA, 21 bp, Homo sapiens
agtgtccttgatcttgccttg

SEQ ID NO: 6964660 - DNA, 22 bp, Homo sapiens
aagcactgggtatagcaatgat

SEQ ID NO: 6964661 - DNA, 20 bp, Homo sapiens
tatgctttttataagattga

SEQ ID NO: 6964662 - DNA, 20 bp, Homo sapiens
tgtgtcttcctttctttatg

SEQ ID NO: 6964663 - DNA, 22 bp, Homo sapiens
tcggccacggggtttcctccaa

SEQ ID NO: 6964664 - DNA, 21 bp, Homo sapiens
gtgccctgttcccacatgccc

SEQ ID NO: 6964665 - DNA, 22 bp, Homo sapiens
cttagcagataaaaaccttcag

SEQ ID NO: 6964666 - DNA, 22 bp, Homo sapiens
gagacacagagaggctgtgtga

SEQ ID NO: 6964667 - DNA, 22 bp, Homo sapiens
cacaaaggtaactggagtattt

SEQ ID NO: 6964668 - DNA, 22 bp, Homo sapiens
ctgtttaatgcaatgaaatgag

SEQ ID NO: 6964669 - DNA, 22 bp, Homo sapiens
ttggtacagatgaggtattctc

SEQ ID NO: 6964670 - DNA, 22 bp, Homo sapiens
gttacactctccaggcacttgg

SEQ ID NO: 6964671 - DNA, 22 bp, Homo sapiens
cagagctggtaagtggtagagg

SEQ ID NO: 6964672 - DNA, 22 bp, Homo sapiens
atcatctgtctctgcagttgaa

SEQ ID NO: 6964673 - DNA, 22 bp, Homo sapiens
tcagaattctgaccttgggtca

SEQ ID NO: 6964674 - DNA, 22 bp, Homo sapiens
gacagcttagtgaaaatgtaaa

SEQ ID NO: 6964675 - DNA, 22 bp, Homo sapiens
cacttaaatgttcctacagcag

SEQ ID NO: 6964676 - DNA, 22 bp, Homo sapiens
cccagcctcagctttacttcca

SEQ ID NO: 6964677 - DNA, 17 bp, Homo sapiens
aatacctgccaattcta

SEQ ID NO: 6964678 - DNA, 22 bp, Homo sapiens
agcttcctgttgagagagggag

SEQ ID NO: 6964679 - DNA, 22 bp, Homo sapiens
gcagtcttgccacagggtttca

SEQ ID NO: 6964680 - DNA, 22 bp, Homo sapiens
aagtcatagtcgggaaagacat

SEQ ID NO: 6964681 - DNA, 20 bp, Homo sapiens
gggtccctccggcctgctat

SEQ ID NO: 6964682 - DNA, 20 bp, Homo sapiens
gagttccccatttctcctgg

SEQ ID NO: 6964683 - DNA, 22 bp, Homo sapiens
atgtggatagcacaggaatggt

SEQ ID NO: 6964684 - DNA, 22 bp, Homo sapiens
gagctaagaagcaaataaatca

SEQ ID NO: 6964685 - DNA, 22 bp, Homo sapiens
tgacagcagccacctctcaccc

SEQ ID NO: 6964686 - DNA, 22 bp, Homo sapiens
tgtctgggagactgatcacccg

SEQ ID NO: 6964687 - DNA, 22 bp, Homo sapiens
gtggagcaggactagctgagaa

SEQ ID NO: 6964688 - DNA, 22 bp, Homo sapiens
cctgaggaccagcacccatctg

SEQ ID NO: 6964689 - DNA, 22 bp, Homo sapiens
agtgtttacagagtagtggaaa

SEQ ID NO: 6964690 - DNA, 20 bp, Homo sapiens
ctttatcaaagggctactag

SEQ ID NO: 6964691 - DNA, 22 bp, Homo sapiens
gtaaatgcgattgactgatgga

SEQ ID NO: 6964692 - DNA, 22 bp, Homo sapiens
taactgcatttttggttggagc

SEQ ID NO: 6964693 - DNA, 22 bp, Homo sapiens
agtgctaaaggatcacagggtc

SEQ ID NO: 6964694 - DNA, 22 bp, Homo sapiens
agtgtgagatgattgaggagca

SEQ ID NO: 6964695 - DNA, 22 bp, Homo sapiens
ctctttcctcagccacagtcta

SEQ ID NO: 6964696 - DNA, 22 bp, Homo sapiens
ggagctgtgggacgctgtccca

SEQ ID NO: 6964697 - DNA, 20 bp, Homo sapiens
gggactgtcccatcctcatc

SEQ ID NO: 6964698 - DNA, 22 bp, Homo sapiens
ctctctgggtcctcttttatag

SEQ ID NO: 6964699 - DNA, 22 bp, Homo sapiens
agggggctgccaaggaatgtaa

SEQ ID NO: 6964700 - DNA, 22 bp, Homo sapiens
agggccccatagtcactgcccg

SEQ ID NO: 6964701 - DNA, 22 bp, Homo sapiens
agagctgctcagatgtcactgc

SEQ ID NO: 6964702 - DNA, 21 bp, Homo sapiens
tcttgaaaagttagattctct

SEQ ID NO: 6964703 - DNA, 22 bp, Homo sapiens
gacctccattctgtcatgactg

SEQ ID NO: 6964704 - DNA, 22 bp, Homo sapiens
taccaagagttcttgcctgttt

SEQ ID NO: 6964705 - DNA, 22 bp, Homo sapiens
gctgtctgcatctctagagctt

SEQ ID NO: 6964706 - DNA, 22 bp, Homo sapiens
tgtgagcagagcctgacatgag

SEQ ID NO: 6964707 - DNA, 22 bp, Homo sapiens
gttgaaagtggagaacctggtt

SEQ ID NO: 6964708 - DNA, 22 bp, Homo sapiens
cagcatattactttaaaaaatc

SEQ ID NO: 6964709 - DNA, 22 bp, Homo sapiens
ctccagtgccctccttgggggc

SEQ ID NO: 6964710 - DNA, 22 bp, Homo sapiens
agccttagataaatgctagctc

SEQ ID NO: 6964711 - DNA, 22 bp, Homo sapiens
ctggcctggcgcagtggctcac

SEQ ID NO: 6964712 - DNA, 22 bp, Homo sapiens
tcagtcttgaacagccccctgt

SEQ ID NO: 6964713 - DNA, 22 bp, Homo sapiens
gtggaaattttaggatcatctt

SEQ ID NO: 6964714 - DNA, 17 bp, Homo sapiens
tgcctgccagcattgga

SEQ ID NO: 6964715 - DNA, 22 bp, Homo sapiens
tatagagctttggcattgatta

SEQ ID NO: 6964716 - DNA, 22 bp, Homo sapiens
ttaagagtaatggaaggccact

SEQ ID NO: 6964717 - DNA, 23 bp, Homo sapiens
catgtgtgacagtatcactgttt

SEQ ID NO: 6964718 - DNA, 22 bp, Homo sapiens
aagaaaacgttttgaggagttt

SEQ ID NO: 6964719 - DNA, 22 bp, Homo sapiens
agcaggtggaaaattcttatca

SEQ ID NO: 6964720 - DNA, 22 bp, Homo sapiens
caggtctttgttgcagcatgga

SEQ ID NO: 6964721 - DNA, 22 bp, Homo sapiens
tgatggtcaacaattttgagtg

SEQ ID NO: 6964722 - DNA, 22 bp, Homo sapiens
cttcagttagccaattcaggtc

SEQ ID NO: 6964723 - DNA, 22 bp, Homo sapiens
gcagagattggaagatgaattt

SEQ ID NO: 6964724 - DNA, 22 bp, Homo sapiens
ctgccgttgtgaagctcttaga

SEQ ID NO: 6964725 - DNA, 22 bp, Homo sapiens
gcccctggctggccagctcctc

SEQ ID NO: 6964726 - DNA, 22 bp, Homo sapiens
ttaggaagaaggaggcagtatt

SEQ ID NO: 6964727 - DNA, 22 bp, Homo sapiens
acagatatatgattgtgtaaat

SEQ ID NO: 6964728 - DNA, 22 bp, Homo sapiens
actgggtgtattagtggtgttt

SEQ ID NO: 6964729 - DNA, 22 bp, Homo sapiens
catggccagggcagatggcagg

SEQ ID NO: 6964730 - DNA, 22 bp, Homo sapiens
gggaggagggtgctggctaaac

SEQ ID NO: 6964731 - DNA, 22 bp, Homo sapiens
atgaaactctagctttcagcac

SEQ ID NO: 6964732 - DNA, 21 bp, Homo sapiens
cgggtgagttgagcaggacac

SEQ ID NO: 6964733 - DNA, 22 bp, Homo sapiens
cacagtactgctttgggatgtg

SEQ ID NO: 6964734 - DNA, 22 bp, Homo sapiens
ttaaattatttctagtgaggtg

SEQ ID NO: 6964735 - DNA, 22 bp, Homo sapiens
tttggaaaaagacagcttatga

SEQ ID NO: 6964736 - DNA, 22 bp, Homo sapiens
atggtttataggacagctctgt

SEQ ID NO: 6964737 - DNA, 22 bp, Homo sapiens
gggtccagacactccagaggaa

SEQ ID NO: 6964738 - DNA, 22 bp, Homo sapiens
ttggaagggtttcagttagtct

SEQ ID NO: 6964739 - DNA, 20 bp, Homo sapiens
gacatcatgtacacattgcc

SEQ ID NO: 6964740 - DNA, 22 bp, Homo sapiens
ggatttcctcttgactctaaag

SEQ ID NO: 6964741 - DNA, 22 bp, Homo sapiens
atctgtcctccagcatctccat

SEQ ID NO: 6964742 - DNA, 17 bp, Homo sapiens
caggccttgagccttta

SEQ ID NO: 6964743 - DNA, 22 bp, Homo sapiens
tggcaattctctacctttctca

SEQ ID NO: 6964744 - DNA, 22 bp, Homo sapiens
agttgtgctgtgatgcaggata

SEQ ID NO: 6964745 - DNA, 22 bp, Homo sapiens
ctacagaatctacctcaagcca

SEQ ID NO: 6964746 - DNA, 22 bp, Homo sapiens
tgacacagggcatgcagcagaa

SEQ ID NO: 6964747 - DNA, 22 bp, Homo sapiens
ttgaggaggaaaagggggtacc

SEQ ID NO: 6964748 - DNA, 22 bp, Homo sapiens
ctggtcaaggagagtctctgca

SEQ ID NO: 6964749 - DNA, 22 bp, Homo sapiens
gctctgccaaggacccattctc

SEQ ID NO: 6964750 - DNA, 22 bp, Homo sapiens
gagaactttctgtgtttttatc

SEQ ID NO: 6964751 - DNA, 22 bp, Homo sapiens
acatagtgagagaaagatcagc

SEQ ID NO: 6964752 - DNA, 22 bp, Homo sapiens
cacattcctgagcttcgacctg

SEQ ID NO: 6964753 - DNA, 22 bp, Homo sapiens
tcctcccttctcactgggaagg

SEQ ID NO: 6964754 - DNA, 22 bp, Homo sapiens
gagtgctgctaatgcaagggtg

SEQ ID NO: 6964755 - DNA, 22 bp, Homo sapiens
tgcaaagaaggggaggaggatt

SEQ ID NO: 6964756 - DNA, 22 bp, Homo sapiens
tgcatgctagcctcgtgaataa

SEQ ID NO: 6964757 - DNA, 22 bp, Homo sapiens
cagatgaagatcatagaatagt

SEQ ID NO: 6964758 - DNA, 22 bp, Homo sapiens
acccagaggcggaggttgcagt

SEQ ID NO: 6964759 - DNA, 22 bp, Homo sapiens
tcggagagctcacagctgtggc

SEQ ID NO: 6964760 - DNA, 22 bp, Homo sapiens
gtggccatgtgcttgcagggta

SEQ ID NO: 6964761 - DNA, 22 bp, Homo sapiens
agtgtggagccactgagtggct

SEQ ID NO: 6964762 - DNA, 22 bp, Homo sapiens
ggacaggcaggtgatttccaga

SEQ ID NO: 6964763 - DNA, 21 bp, Homo sapiens
aatggcttatacagaagtaag

SEQ ID NO: 6964764 - DNA, 22 bp, Homo sapiens
cctcagcatcctggtgaagtag

SEQ ID NO: 6964765 - DNA, 22 bp, Homo sapiens
gcattcttggtggagtgctaaa

SEQ ID NO: 6964766 - DNA, 22 bp, Homo sapiens
gagatggggtcagctgggacat

SEQ ID NO: 6964767 - DNA, 22 bp, Homo sapiens
gtacatttcagtttccttaaga

SEQ ID NO: 6964768 - DNA, 22 bp, Homo sapiens
actctcttgggggagagcagag

SEQ ID NO: 6964769 - DNA, 22 bp, Homo sapiens
aaatcagatcttacacaattgt

SEQ ID NO: 6964770 - DNA, 22 bp, Homo sapiens
tgtaccatatagatggtacctt

SEQ ID NO: 6964771 - DNA, 22 bp, Homo sapiens
gcaggagactggctgtggtagt

SEQ ID NO: 6964772 - DNA, 22 bp, Homo sapiens
cttgagaacagggttaggtaac

SEQ ID NO: 6964773 - DNA, 16 bp, Homo sapiens
cacatatatttatatg

SEQ ID NO: 6964774 - DNA, 22 bp, Homo sapiens
ctctttggagaagcacgtatta

SEQ ID NO: 6964775 - DNA, 22 bp, Homo sapiens
cagggcttggttggaaccaccc

SEQ ID NO: 6964776 - DNA, 22 bp, Homo sapiens
tatcatttagagtatttcttca

SEQ ID NO: 6964777 - DNA, 21 bp, Homo sapiens
tgagcaggtgcagggaagtgg

SEQ ID NO: 6964778 - DNA, 22 bp, Homo sapiens
ttcatctggtctagtttttagt

SEQ ID NO: 6964779 - DNA, 22 bp, Homo sapiens
tgctgagatagctgactaggca

SEQ ID NO: 6964780 - DNA, 22 bp, Homo sapiens
ttagtagctgtggccctgaagt

SEQ ID NO: 6964781 - DNA, 22 bp, Homo sapiens
gccctgctccaggagaataccc

SEQ ID NO: 6964782 - DNA, 22 bp, Homo sapiens
catcagaaggaaggacgattat

SEQ ID NO: 6964783 - DNA, 22 bp, Homo sapiens
ggcagtggttagaaacatgagc

SEQ ID NO: 6964784 - DNA, 22 bp, Homo sapiens
gtccagctgatcttgacccagc

SEQ ID NO: 6964785 - DNA, 22 bp, Homo sapiens
gctggggagaattgggttatct

SEQ ID NO: 6964786 - DNA, 22 bp, Homo sapiens
tcctaggcagttggtgctccat

SEQ ID NO: 6964787 - DNA, 22 bp, Homo sapiens
ggtcagtgacttttttctgtgg

SEQ ID NO: 6964788 - DNA, 22 bp, Homo sapiens
tttctgaagggcagcagactct

SEQ ID NO: 6964789 - DNA, 21 bp, Homo sapiens
cctggcttcagggtgcactgg

SEQ ID NO: 6964790 - DNA, 22 bp, Homo sapiens
ctgctgctcgaccagtcccagg

SEQ ID NO: 6964791 - DNA, 22 bp, Homo sapiens
atgatactctaggtgatttaca

SEQ ID NO: 6964792 - DNA, 22 bp, Homo sapiens
tacaagaaggatggagcccact

SEQ ID NO: 6964793 - DNA, 22 bp, Homo sapiens
acacactgaattttgtggaaac

SEQ ID NO: 6964794 - DNA, 22 bp, Homo sapiens
tggctcgtattgatcttgaggc

SEQ ID NO: 6964795 - DNA, 22 bp, Homo sapiens
ttgtagctgaaagtaaagaagt

SEQ ID NO: 6964796 - DNA, 22 bp, Homo sapiens
ttgtctgcattgtttctatggg

SEQ ID NO: 6964797 - DNA, 22 bp, Homo sapiens
ctgtagcatttgttatggcaat

SEQ ID NO: 6964798 - DNA, 22 bp, Homo sapiens
aggattgtgcctccagtcagaa

SEQ ID NO: 6964799 - DNA, 22 bp, Homo sapiens
tccaccaggctccatgttcagt

SEQ ID NO: 6964800 - DNA, 22 bp, Homo sapiens
aatgctgttctgagtctgcagg

SEQ ID NO: 6964801 - DNA, 22 bp, Homo sapiens
atatttgtagtgggtaagaagt

SEQ ID NO: 6964802 - DNA, 22 bp, Homo sapiens
acactgagcttccaagatgggg

SEQ ID NO: 6964803 - DNA, 18 bp, Homo sapiens
tccaggcctgaagtgtcc

SEQ ID NO: 6964804 - DNA, 22 bp, Homo sapiens
ataaactggtaggaaaacagta

SEQ ID NO: 6964805 - DNA, 22 bp, Homo sapiens
gaagcccaagcttcacagctat

SEQ ID NO: 6964806 - DNA, 22 bp, Homo sapiens
acacacacaagcaggttgtgga

SEQ ID NO: 6964807 - DNA, 22 bp, Homo sapiens
aatgtgggtgttaatagtgcct

SEQ ID NO: 6964808 - DNA, 22 bp, Homo sapiens
catttgctgaggccttcagagg

SEQ ID NO: 6964809 - DNA, 22 bp, Homo sapiens
aatacagtaggtaatagttcat

SEQ ID NO: 6964810 - DNA, 22 bp, Homo sapiens
acagagtaggtgctcagtaaat

SEQ ID NO: 6964811 - DNA, 22 bp, Homo sapiens
gatcctttggtttctgatttag

SEQ ID NO: 6964812 - DNA, 22 bp, Homo sapiens
agtcctgtatctgagctgagtc

SEQ ID NO: 6964813 - DNA, 22 bp, Homo sapiens
attcatgtaaaattggatagac

SEQ ID NO: 6964814 - DNA, 22 bp, Homo sapiens
ggccagtgtgggagtagttctt

SEQ ID NO: 6964815 - DNA, 22 bp, Homo sapiens
tgttcacatgtacatgaatatt

SEQ ID NO: 6964816 - DNA, 22 bp, Homo sapiens
ttgcagcagctctttgaatgtt

SEQ ID NO: 6964817 - DNA, 22 bp, Homo sapiens
agaggaggtccttttctgatgt

SEQ ID NO: 6964818 - DNA, 22 bp, Homo sapiens
atgttgagtggatgaacaaaca

SEQ ID NO: 6964819 - DNA, 22 bp, Homo sapiens
aaagtgcactctcagtgctgct

SEQ ID NO: 6964820 - DNA, 22 bp, Homo sapiens
ttgataggttttatgtatagtt

SEQ ID NO: 6964821 - DNA, 22 bp, Homo sapiens
ctgagggctggagctgaggcct

SEQ ID NO: 6964822 - DNA, 22 bp, Homo sapiens
aacattgagctggtggagagga

SEQ ID NO: 6964823 - DNA, 22 bp, Homo sapiens
gcttttcatgacaactcagcga

SEQ ID NO: 6964824 - DNA, 22 bp, Homo sapiens
gaaagctctgcttcagcctgca

SEQ ID NO: 6964825 - DNA, 22 bp, Homo sapiens
aagaaagccaaagttcatacct

SEQ ID NO: 6964826 - DNA, 22 bp, Homo sapiens
tgcatgtaggatgcatctacat

SEQ ID NO: 6964827 - DNA, 21 bp, Homo sapiens
ctgtggcctggctagcaccgt

SEQ ID NO: 6964828 - DNA, 22 bp, Homo sapiens
aaattattacaagctagttggc

SEQ ID NO: 6964829 - DNA, 22 bp, Homo sapiens
cactatgcagtgagaaaatggc

SEQ ID NO: 6964830 - DNA, 22 bp, Homo sapiens
tagggcagccttatagctccca

SEQ ID NO: 6964831 - DNA, 22 bp, Homo sapiens
aggtctggtgagagcaggtgct

SEQ ID NO: 6964832 - DNA, 22 bp, Homo sapiens
actgtttctgccacaatagccc

SEQ ID NO: 6964833 - DNA, 22 bp, Homo sapiens
ttccagtcacaaaacatattaa

SEQ ID NO: 6964834 - DNA, 17 bp, Homo sapiens
ctgtgctcgagtgatgg

SEQ ID NO: 6964835 - DNA, 22 bp, Homo sapiens
caggaagctgtgaaggagacgg

SEQ ID NO: 6964836 - DNA, 22 bp, Homo sapiens
tagtgcaggttaataggacttc

SEQ ID NO: 6964837 - DNA, 22 bp, Homo sapiens
atggcaggatacccagtccggc

SEQ ID NO: 6964838 - DNA, 22 bp, Homo sapiens
ttccttagcagacctggtatcc

SEQ ID NO: 6964839 - DNA, 22 bp, Homo sapiens
tctctaaatgctctcccatccc

SEQ ID NO: 6964840 - DNA, 22 bp, Homo sapiens
aatctgtcgtgttgatagttct

SEQ ID NO: 6964841 - DNA, 18 bp, Homo sapiens
ctctgtcataagtgtcat

SEQ ID NO: 6964842 - DNA, 16 bp, Homo sapiens
agccatcatcaacttg

SEQ ID NO: 6964843 - DNA, 23 bp, Homo sapiens
ttctcagtcctgcccagggaggc

SEQ ID NO: 6964844 - DNA, 22 bp, Homo sapiens
ctcagtccagggaccggcctcc

SEQ ID NO: 6964845 - DNA, 22 bp, Homo sapiens
ttccagagtctggttccatggt

SEQ ID NO: 6964846 - DNA, 22 bp, Homo sapiens
tggaagccaggcccgctcctaa

SEQ ID NO: 6964847 - DNA, 22 bp, Homo sapiens
atggcagctttgaatttcttga

SEQ ID NO: 6964848 - DNA, 22 bp, Homo sapiens
aggctccctgaatcgcccgttc

SEQ ID NO: 6964849 - DNA, 22 bp, Homo sapiens
ccagggcttggtggcttgtatc

SEQ ID NO: 6964850 - DNA, 22 bp, Homo sapiens
aaagtgctgggattacaggtgt

SEQ ID NO: 6964851 - DNA, 22 bp, Homo sapiens
ctggctctgagtggctctaatt

SEQ ID NO: 6964852 - DNA, 22 bp, Homo sapiens
ttgtgcagagttgcctttattt

SEQ ID NO: 6964853 - DNA, 22 bp, Homo sapiens
agaaagagatgaatgctttaag

SEQ ID NO: 6964854 - DNA, 22 bp, Homo sapiens
agctctgggagtagttccacct

SEQ ID NO: 6964855 - DNA, 22 bp, Homo sapiens
gcatctgttggagtctccggcc

SEQ ID NO: 6964856 - DNA, 22 bp, Homo sapiens
gcttcaaactgagcttcaagtg

SEQ ID NO: 6964857 - DNA, 21 bp, Homo sapiens
tgcagcagagtaagcagggga

SEQ ID NO: 6964858 - DNA, 22 bp, Homo sapiens
gtgcattaggctggaatgttga

SEQ ID NO: 6964859 - DNA, 22 bp, Homo sapiens
tgcaagaggcatcttttaaaaa

SEQ ID NO: 6964860 - DNA, 18 bp, Homo sapiens
ctccttggagaagaggcc

SEQ ID NO: 6964861 - DNA, 22 bp, Homo sapiens
ccagtgtgttagtggatttccc

SEQ ID NO: 6964862 - DNA, 22 bp, Homo sapiens
actgtgtgccctgacgccaggg

SEQ ID NO: 6964863 - DNA, 22 bp, Homo sapiens
actctggccatcttggaccttg

SEQ ID NO: 6964864 - DNA, 17 bp, Homo sapiens
tgctctgtggtctttta

SEQ ID NO: 6964865 - DNA, 22 bp, Homo sapiens
gtgcattccaccgtgcaggttg

SEQ ID NO: 6964866 - DNA, 22 bp, Homo sapiens
aattcactgttccttctgcttt

SEQ ID NO: 6964867 - DNA, 20 bp, Homo sapiens
ggtcactgtggctgcaggat

SEQ ID NO: 6964868 - DNA, 22 bp, Homo sapiens
ccaggaggggtctctgtctccc

SEQ ID NO: 6964869 - DNA, 22 bp, Homo sapiens
tgggccacgggggtggagagct

SEQ ID NO: 6964870 - DNA, 21 bp, Homo sapiens
tgtgttttctctctgggaggt

SEQ ID NO: 6964871 - DNA, 22 bp, Homo sapiens
tttcaaagtaaggattttcatc

SEQ ID NO: 6964872 - DNA, 22 bp, Homo sapiens
tgtgtcctgtgatctctagggt

SEQ ID NO: 6964873 - DNA, 23 bp, Homo sapiens
ttctgccctccatagatgttccc

SEQ ID NO: 6964874 - DNA, 22 bp, Homo sapiens
ttctggaggctccagggaagaa

SEQ ID NO: 6964875 - DNA, 22 bp, Homo sapiens
tctgcctgcgctcacggggccg

SEQ ID NO: 6964876 - DNA, 19 bp, Homo sapiens
tgtggcctggggacaggcc

SEQ ID NO: 6964877 - DNA, 22 bp, Homo sapiens
gcagcaattatcaatctcatta

SEQ ID NO: 6964878 - DNA, 22 bp, Homo sapiens
tcttgcagttgcgcagtgcatg

SEQ ID NO: 6964879 - DNA, 22 bp, Homo sapiens
ttatcaagggagaaacaggagg

SEQ ID NO: 6964880 - DNA, 22 bp, Homo sapiens
aacatcatcagatgggtgcttg

SEQ ID NO: 6964881 - DNA, 21 bp, Homo sapiens
gttcaatagctctttgaatgc

SEQ ID NO: 6964882 - DNA, 22 bp, Homo sapiens
gattctgcttaccatttgatct

SEQ ID NO: 6964883 - DNA, 22 bp, Homo sapiens
tattggagaggtcttgggtaga

SEQ ID NO: 6964884 - DNA, 22 bp, Homo sapiens
ccaaatagtctttcattgaatt

SEQ ID NO: 6964885 - DNA, 22 bp, Homo sapiens
tgtcaaccaggtattttggtct

SEQ ID NO: 6964886 - DNA, 22 bp, Homo sapiens
gatgcaaagataaaacagacgc

SEQ ID NO: 6964887 - DNA, 22 bp, Homo sapiens
atcaccattgaaaaacaggttt

SEQ ID NO: 6964888 - DNA, 22 bp, Homo sapiens
ttaccagttttgccatttgcta

SEQ ID NO: 6964889 - DNA, 22 bp, Homo sapiens
actggcagaacgtgatgcgggt

SEQ ID NO: 6964890 - DNA, 22 bp, Homo sapiens
agcagggctttggctggctttc

SEQ ID NO: 6964891 - DNA, 22 bp, Homo sapiens
tacagtcaagcataagaagtca

SEQ ID NO: 6964892 - DNA, 22 bp, Homo sapiens
tggataaatgtgcagatgacat

SEQ ID NO: 6964893 - DNA, 21 bp, Homo sapiens
tgtgtaattttttaaatggcc

SEQ ID NO: 6964894 - DNA, 16 bp, Homo sapiens
ctgttacttgactgtt

SEQ ID NO: 6964895 - DNA, 23 bp, Homo sapiens
tgcccagtgcctttgcccatgca

SEQ ID NO: 6964896 - DNA, 23 bp, Homo sapiens
aggtctggacccttggcccctgc

SEQ ID NO: 6964897 - DNA, 20 bp, Homo sapiens
ggcagggagggatactgagg

SEQ ID NO: 6964898 - DNA, 22 bp, Homo sapiens
tgtcccagctgtctctgttttt

SEQ ID NO: 6964899 - DNA, 22 bp, Homo sapiens
gccattgatgtgaaagtaagac

SEQ ID NO: 6964900 - DNA, 22 bp, Homo sapiens
ggaggcacttgttaaactacta

SEQ ID NO: 6964901 - DNA, 22 bp, Homo sapiens
tatgtgtcccttggtgtagcaa

SEQ ID NO: 6964902 - DNA, 22 bp, Homo sapiens
tttcaaagaccattaactatca

SEQ ID NO: 6964903 - DNA, 20 bp, Homo sapiens
agtgtatttgggtagagtgt

SEQ ID NO: 6964904 - DNA, 22 bp, Homo sapiens
gatgaggctgtgtctgcacaag

SEQ ID NO: 6964905 - DNA, 22 bp, Homo sapiens
tggcttctctgtggtggctccc

SEQ ID NO: 6964906 - DNA, 22 bp, Homo sapiens
cttgcacacatgtacatgtgta

SEQ ID NO: 6964907 - DNA, 22 bp, Homo sapiens
acctttttccaatgagggaagt

SEQ ID NO: 6964908 - DNA, 22 bp, Homo sapiens
cacactttgtgctaatctattt

SEQ ID NO: 6964909 - DNA, 22 bp, Homo sapiens
tgtctgctggttgggagcttaa

SEQ ID NO: 6964910 - DNA, 21 bp, Homo sapiens
tgaacccagagctcatgacca

SEQ ID NO: 6964911 - DNA, 20 bp, Homo sapiens
agcccaggcctgtgtgagtc

SEQ ID NO: 6964912 - DNA, 22 bp, Homo sapiens
ctggaaagtgctgagacaattg

SEQ ID NO: 6964913 - DNA, 20 bp, Homo sapiens
ggctggaagtgtgggtttgg

SEQ ID NO: 6964914 - DNA, 22 bp, Homo sapiens
ttgagaactactttattattct

SEQ ID NO: 6964915 - DNA, 22 bp, Homo sapiens
cctcagtttatcctctgtaaca

SEQ ID NO: 6964916 - DNA, 22 bp, Homo sapiens
tacaaagctgtatagcctggtc

SEQ ID NO: 6964917 - DNA, 22 bp, Homo sapiens
agcagccagaaatccagaggtg

SEQ ID NO: 6964918 - DNA, 20 bp, Homo sapiens
ctacacttggcacctggcat

SEQ ID NO: 6964919 - DNA, 22 bp, Homo sapiens
cactggcatgtgaggcggtggc

SEQ ID NO: 6964920 - DNA, 19 bp, Homo sapiens
atgactcttattgtctgaa

SEQ ID NO: 6964921 - DNA, 22 bp, Homo sapiens
acattctgtgagtcatgtttta

SEQ ID NO: 6964922 - DNA, 22 bp, Homo sapiens
tccagggagatactggctgcca

SEQ ID NO: 6964923 - DNA, 22 bp, Homo sapiens
ggagtctgcggcagacactgta

SEQ ID NO: 6964924 - DNA, 22 bp, Homo sapiens
tggcaatgagcaggtgctctgg

SEQ ID NO: 6964925 - DNA, 21 bp, Homo sapiens
acagtaaattccctgcaaaga

SEQ ID NO: 6964926 - DNA, 22 bp, Homo sapiens
actcacaagtgatgtgaatggc

SEQ ID NO: 6964927 - DNA, 22 bp, Homo sapiens
tctggaattttctagggcatca

SEQ ID NO: 6964928 - DNA, 22 bp, Homo sapiens
aggatgaggctggcaggtcttg

SEQ ID NO: 6964929 - DNA, 22 bp, Homo sapiens
acttccaggaactgccgctaac

SEQ ID NO: 6964930 - DNA, 22 bp, Homo sapiens
atcaggaagaagaatgtgttgg

SEQ ID NO: 6964931 - DNA, 22 bp, Homo sapiens
ccagaggatgctggtcagcctc

SEQ ID NO: 6964932 - DNA, 22 bp, Homo sapiens
tctcagtggtggcattccagac

SEQ ID NO: 6964933 - DNA, 22 bp, Homo sapiens
caggtccaaggttcctgaatag

SEQ ID NO: 6964934 - DNA, 22 bp, Homo sapiens
ctctgcctcccaggttcaagcg

SEQ ID NO: 6964935 - DNA, 22 bp, Homo sapiens
ttccttagttgactgtcttagt

SEQ ID NO: 6964936 - DNA, 22 bp, Homo sapiens
tgccaatccactgcagccacag

SEQ ID NO: 6964937 - DNA, 22 bp, Homo sapiens
gtgctgagattggagtgagcag

SEQ ID NO: 6964938 - DNA, 19 bp, Homo sapiens
ttgaaggttcggagatagg

SEQ ID NO: 6964939 - DNA, 22 bp, Homo sapiens
ctgaggcctaagacatgaatga

SEQ ID NO: 6964940 - DNA, 22 bp, Homo sapiens
gttcttcatcttaaccatctgt

SEQ ID NO: 6964941 - DNA, 22 bp, Homo sapiens
cagtggccttgatgcctcattc

SEQ ID NO: 6964942 - DNA, 19 bp, Homo sapiens
tggtgcgctgttcctgagc

SEQ ID NO: 6964943 - DNA, 22 bp, Homo sapiens
ggctagattttggcattgctct

SEQ ID NO: 6964944 - DNA, 22 bp, Homo sapiens
gaatttacaagttgaataacaa

SEQ ID NO: 6964945 - DNA, 22 bp, Homo sapiens
gggtcccctcatcatggagact

SEQ ID NO: 6964946 - DNA, 19 bp, Homo sapiens
tgaggggctcacagtctca

SEQ ID NO: 6964947 - DNA, 22 bp, Homo sapiens
ttggtcctgccccctccaggtc

SEQ ID NO: 6964948 - DNA, 22 bp, Homo sapiens
caataactgctgaggagaagca

SEQ ID NO: 6964949 - DNA, 22 bp, Homo sapiens
atttggagacaggatttttcag

SEQ ID NO: 6964950 - DNA, 22 bp, Homo sapiens
ttgtgagagccaaacatgtaag

SEQ ID NO: 6964951 - DNA, 22 bp, Homo sapiens
agatataataatttacaagtgt

SEQ ID NO: 6964952 - DNA, 22 bp, Homo sapiens
ctttggctgacgaggaggaggc

SEQ ID NO: 6964953 - DNA, 22 bp, Homo sapiens
ggtggtgactgtcctagggatg

SEQ ID NO: 6964954 - DNA, 22 bp, Homo sapiens
atattctataagcagttggaag

SEQ ID NO: 6964955 - DNA, 22 bp, Homo sapiens
ttttggtagaatcaacaatgta

SEQ ID NO: 6964956 - DNA, 22 bp, Homo sapiens
tcaacccttgtgcaacagtgat

SEQ ID NO: 6964957 - DNA, 22 bp, Homo sapiens
taactcaactatctctgggtaa

SEQ ID NO: 6964958 - DNA, 22 bp, Homo sapiens
cagagacccctggcatggtggt

SEQ ID NO: 6964959 - DNA, 22 bp, Homo sapiens
ttgctttaaaatggctaagtct

SEQ ID NO: 6964960 - DNA, 22 bp, Homo sapiens
ggcagtcttatcagcattggac

SEQ ID NO: 6964961 - DNA, 22 bp, Homo sapiens
tgggaaccacaggactcggcac

SEQ ID NO: 6964962 - DNA, 22 bp, Homo sapiens
agctgaaaattagtgatagttt

SEQ ID NO: 6964963 - DNA, 22 bp, Homo sapiens
ccctggcatgcatgtccctggc

SEQ ID NO: 6964964 - DNA, 22 bp, Homo sapiens
cagacagggccctgtgatggta

SEQ ID NO: 6964965 - DNA, 22 bp, Homo sapiens
cagcagaggtggttcacattgt

SEQ ID NO: 6964966 - DNA, 22 bp, Homo sapiens
tatggctttttattcatcttac

SEQ ID NO: 6964967 - DNA, 22 bp, Homo sapiens
ggatgaggtagatgaacaaggg

SEQ ID NO: 6964968 - DNA, 22 bp, Homo sapiens
cctctgcaaagaatttgtctcc

SEQ ID NO: 6964969 - DNA, 22 bp, Homo sapiens
ttccttaatgaatcaggccatt

SEQ ID NO: 6964970 - DNA, 19 bp, Homo sapiens
gccttggcattctctgctt

SEQ ID NO: 6964971 - DNA, 19 bp, Homo sapiens
ctgtctgcggggcctgttc

SEQ ID NO: 6964972 - DNA, 22 bp, Homo sapiens
ttgggacatctggcatacagtt

SEQ ID NO: 6964973 - DNA, 22 bp, Homo sapiens
acccaggaaaacatggtgcaga

SEQ ID NO: 6964974 - DNA, 21 bp, Homo sapiens
cctggactaaaaccaggccac

SEQ ID NO: 6964975 - DNA, 22 bp, Homo sapiens
gaagcagctgccagagatgtct

SEQ ID NO: 6964976 - DNA, 22 bp, Homo sapiens
caccctccagctcccgggggct

SEQ ID NO: 6964977 - DNA, 22 bp, Homo sapiens
acatcctgaagtcagtcatttg

SEQ ID NO: 6964978 - DNA, 22 bp, Homo sapiens
attgaactgaatcctggattgc

SEQ ID NO: 6964979 - DNA, 22 bp, Homo sapiens
gaaggcctagggatgctctgcg

SEQ ID NO: 6964980 - DNA, 22 bp, Homo sapiens
tcccatcactagcatctgcacc

SEQ ID NO: 6964981 - DNA, 22 bp, Homo sapiens
tgttaagttgccagtgtatgac

SEQ ID NO: 6964982 - DNA, 22 bp, Homo sapiens
cttgtctgggcagcttgggagt

SEQ ID NO: 6964983 - DNA, 22 bp, Homo sapiens
atatcacagctctttcattgct

SEQ ID NO: 6964984 - DNA, 21 bp, Homo sapiens
aagatcccagagtgctcagta

SEQ ID NO: 6964985 - DNA, 22 bp, Homo sapiens
taactacaagggcggtctctgt

SEQ ID NO: 6964986 - DNA, 22 bp, Homo sapiens
aactttccatctttatcgtctt

SEQ ID NO: 6964987 - DNA, 22 bp, Homo sapiens
tttgtacatgtaagattgcatc

SEQ ID NO: 6964988 - DNA, 22 bp, Homo sapiens
agcatggtctgatcaggtggct

SEQ ID NO: 6964989 - DNA, 22 bp, Homo sapiens
tcagtgattggtggactgccta

SEQ ID NO: 6964990 - DNA, 22 bp, Homo sapiens
ccagctgcatgacattaggtga

SEQ ID NO: 6964991 - DNA, 22 bp, Homo sapiens
actgcactccagcccgagcaac

SEQ ID NO: 6964992 - DNA, 22 bp, Homo sapiens
agtggagcagagaggggatctt

SEQ ID NO: 6964993 - DNA, 22 bp, Homo sapiens
actgcactccagcctgggcaac

SEQ ID NO: 6964994 - DNA, 22 bp, Homo sapiens
tggcgcagtttctctgctgcct

SEQ ID NO: 6964995 - DNA, 22 bp, Homo sapiens
tgtatgtgtggatagatgtata

SEQ ID NO: 6964996 - DNA, 22 bp, Homo sapiens
acttccagaacaggtacatttt

SEQ ID NO: 6964997 - DNA, 21 bp, Homo sapiens
actctatttcagtttcaacaa

SEQ ID NO: 6964998 - DNA, 22 bp, Homo sapiens
agctcccaggcagtcatgagga

SEQ ID NO: 6964999 - DNA, 20 bp, Homo sapiens
ctgcatctgtgacttgcaaa

SEQ ID NO: 6965000 - DNA, 22 bp, Homo sapiens
tcctggtggtgccggtgcccgg

SEQ ID NO: 6965001 - DNA, 22 bp, Homo sapiens
agccagctctgagttgaagtac

SEQ ID NO: 6965002 - DNA, 22 bp, Homo sapiens
gtcaccatctacagctccaaac

SEQ ID NO: 6965003 - DNA, 22 bp, Homo sapiens
cataaggtcaaaagaggctcaa

SEQ ID NO: 6965004 - DNA, 22 bp, Homo sapiens
atcctgggtttgtgagtttatg

SEQ ID NO: 6965005 - DNA, 22 bp, Homo sapiens
catacaatcaagttctttatta

SEQ ID NO: 6965006 - DNA, 22 bp, Homo sapiens
ctattacatttctggacattca

SEQ ID NO: 6965007 - DNA, 22 bp, Homo sapiens
tgctccagaaaaacttgagact

SEQ ID NO: 6965008 - DNA, 22 bp, Homo sapiens
tgagataacatggaagagtagc

SEQ ID NO: 6965009 - DNA, 22 bp, Homo sapiens
aattcattgccagaatctatga

SEQ ID NO: 6965010 - DNA, 22 bp, Homo sapiens
tctgaccctcagatcatgtcca

SEQ ID NO: 6965011 - DNA, 22 bp, Homo sapiens
tctcagaacctcagtttgctct

SEQ ID NO: 6965012 - DNA, 22 bp, Homo sapiens
ctccagtctttcagatgtccct

SEQ ID NO: 6965013 - DNA, 22 bp, Homo sapiens
atgaagtcttgttagagtatca

SEQ ID NO: 6965014 - DNA, 22 bp, Homo sapiens
ctacattcaacagcagagtttt

SEQ ID NO: 6965015 - DNA, 22 bp, Homo sapiens
tgcggctggtgctgaagctgag

SEQ ID NO: 6965016 - DNA, 22 bp, Homo sapiens
ggatggcatgttgggctctgtt

SEQ ID NO: 6965017 - DNA, 22 bp, Homo sapiens
ctggaaagtacagtgtgtcaca

SEQ ID NO: 6965018 - DNA, 22 bp, Homo sapiens
tgcgtctggagtggagtttgaa

SEQ ID NO: 6965019 - DNA, 22 bp, Homo sapiens
cagcagctgactccaagagagc

SEQ ID NO: 6965020 - DNA, 22 bp, Homo sapiens
caggtaaaggttaactattaga

SEQ ID NO: 6965021 - DNA, 22 bp, Homo sapiens
ttctataggactcccttgaata

SEQ ID NO: 6965022 - DNA, 22 bp, Homo sapiens
cacacccaaattctaacagtag

SEQ ID NO: 6965023 - DNA, 22 bp, Homo sapiens
gtggcagctcatgttgttttaa

SEQ ID NO: 6965024 - DNA, 22 bp, Homo sapiens
gagacagatctcggctccatgc

SEQ ID NO: 6965025 - DNA, 22 bp, Homo sapiens
tccctggctgtgttcaggtgcg

SEQ ID NO: 6965026 - DNA, 22 bp, Homo sapiens
tgaaggcataaatcttgggaac

SEQ ID NO: 6965027 - DNA, 22 bp, Homo sapiens
tgacatgctaagattatgttat

SEQ ID NO: 6965028 - DNA, 22 bp, Homo sapiens
cactgtttaataatattgttaa

SEQ ID NO: 6965029 - DNA, 22 bp, Homo sapiens
gctctgtacctgcggagatgag

SEQ ID NO: 6965030 - DNA, 22 bp, Homo sapiens
acagcaggcatgaatgacactg

SEQ ID NO: 6965031 - DNA, 22 bp, Homo sapiens
caacaagggacagtgttctaaa

SEQ ID NO: 6965032 - DNA, 22 bp, Homo sapiens
cagcggggcctgtgctggggag

SEQ ID NO: 6965033 - DNA, 18 bp, Homo sapiens
tatgtgtctgttacaact

SEQ ID NO: 6965034 - DNA, 22 bp, Homo sapiens
aagtcacaagcatatatgcatt

SEQ ID NO: 6965035 - DNA, 22 bp, Homo sapiens
gaggcctaggagccaggcatca

SEQ ID NO: 6965036 - DNA, 22 bp, Homo sapiens
atctttagtgtgaatttattga

SEQ ID NO: 6965037 - DNA, 22 bp, Homo sapiens
acacattagtgctctgtctcat

SEQ ID NO: 6965038 - DNA, 22 bp, Homo sapiens
tatccatagtttatagatcaag

SEQ ID NO: 6965039 - DNA, 22 bp, Homo sapiens
gggcggtgcctgtctccgaagc

SEQ ID NO: 6965040 - DNA, 22 bp, Homo sapiens
gttctgggtagatgtatctttt

SEQ ID NO: 6965041 - DNA, 21 bp, Homo sapiens
actggctggtggctaagaatc

SEQ ID NO: 6965042 - DNA, 22 bp, Homo sapiens
ccgggttgaggttcccatagat

SEQ ID NO: 6965043 - DNA, 22 bp, Homo sapiens
aggtaattactagagttattta

SEQ ID NO: 6965044 - DNA, 22 bp, Homo sapiens
tggaagctcaaggcagggtgag

SEQ ID NO: 6965045 - DNA, 22 bp, Homo sapiens
ttctcctcagcaaggcagcttt

SEQ ID NO: 6965046 - DNA, 22 bp, Homo sapiens
tccgtaaatggttggttaaggc

SEQ ID NO: 6965047 - DNA, 16 bp, Homo sapiens
cattgcactctagcct

SEQ ID NO: 6965048 - DNA, 22 bp, Homo sapiens
tctgtgcagtcagggctcagtc

SEQ ID NO: 6965049 - DNA, 18 bp, Homo sapiens
tgcactagatgctggcag

SEQ ID NO: 6965050 - DNA, 22 bp, Homo sapiens
ggacatgaagcaaaatgggagg

SEQ ID NO: 6965051 - DNA, 22 bp, Homo sapiens
actatttctagatgctctgata

SEQ ID NO: 6965052 - DNA, 22 bp, Homo sapiens
ccagctggtttatattccccac

SEQ ID NO: 6965053 - DNA, 22 bp, Homo sapiens
tgacaagtcactgttcttcaat

SEQ ID NO: 6965054 - DNA, 19 bp, Homo sapiens
actgttctaacttgcagct

SEQ ID NO: 6965055 - DNA, 22 bp, Homo sapiens
aaggctattgggaagaaaaatg

SEQ ID NO: 6965056 - DNA, 22 bp, Homo sapiens
tgtgcctcatgtatctggatga

SEQ ID NO: 6965057 - DNA, 22 bp, Homo sapiens
attcccacctgaaaaaggtagg

SEQ ID NO: 6965058 - DNA, 22 bp, Homo sapiens
aacagtgcttcattcacacatt

SEQ ID NO: 6965059 - DNA, 22 bp, Homo sapiens
tcaattatttgatatgaaaggg

SEQ ID NO: 6965060 - DNA, 22 bp, Homo sapiens
aggctgaggtgtgctgtgatcg

SEQ ID NO: 6965061 - DNA, 22 bp, Homo sapiens
tggctctgggaatctgttgctt

SEQ ID NO: 6965062 - DNA, 22 bp, Homo sapiens
ggtctcagctggagtccttggt

SEQ ID NO: 6965063 - DNA, 22 bp, Homo sapiens
gaggccagctacccaagggtca

SEQ ID NO: 6965064 - DNA, 22 bp, Homo sapiens
tctctaaacttatatgaactat

SEQ ID NO: 6965065 - DNA, 22 bp, Homo sapiens
gtagacagcaaccaaaccaggt

SEQ ID NO: 6965066 - DNA, 22 bp, Homo sapiens
actgggaagatggaggcaagca

SEQ ID NO: 6965067 - DNA, 22 bp, Homo sapiens
gacatttgtatgacactttaaa

SEQ ID NO: 6965068 - DNA, 22 bp, Homo sapiens
atcagagtgggttttaaaagtg

SEQ ID NO: 6965069 - DNA, 22 bp, Homo sapiens
gtgacagattatagggagcgtt

SEQ ID NO: 6965070 - DNA, 22 bp, Homo sapiens
tctattgcagatggatgccctc

SEQ ID NO: 6965071 - DNA, 22 bp, Homo sapiens
atgtgtgtgtgcgcgcgcagga

SEQ ID NO: 6965072 - DNA, 22 bp, Homo sapiens
aaaacataaactgacagcccat

SEQ ID NO: 6965073 - DNA, 22 bp, Homo sapiens
ctaggctcagtctctggtctgt

SEQ ID NO: 6965074 - DNA, 22 bp, Homo sapiens
gttcttcaccaaggtcagaggc

SEQ ID NO: 6965075 - DNA, 22 bp, Homo sapiens
ggagttccagaccagactggcc

SEQ ID NO: 6965076 - DNA, 22 bp, Homo sapiens
acattcaaaatatttctgatgt

SEQ ID NO: 6965077 - DNA, 22 bp, Homo sapiens
ccagatttgagcgtcttaaacc

SEQ ID NO: 6965078 - DNA, 22 bp, Homo sapiens
tttatccatcatctgctgaagg

SEQ ID NO: 6965079 - DNA, 22 bp, Homo sapiens
tgggatgccctgaccctctgga

SEQ ID NO: 6965080 - DNA, 22 bp, Homo sapiens
ttgaagacctttagtgctatgt

SEQ ID NO: 6965081 - DNA, 22 bp, Homo sapiens
tcctcggctgggccccaggctt

SEQ ID NO: 6965082 - DNA, 17 bp, Homo sapiens
ttacaacaattcatgag

SEQ ID NO: 6965083 - DNA, 22 bp, Homo sapiens
ctctgggagtggccacttctca

SEQ ID NO: 6965084 - DNA, 22 bp, Homo sapiens
atgtccaggatctatccccaga

SEQ ID NO: 6965085 - DNA, 22 bp, Homo sapiens
gcagccagcccctctgacctct

SEQ ID NO: 6965086 - DNA, 22 bp, Homo sapiens
cagcatctggggaacattcaag

SEQ ID NO: 6965087 - DNA, 22 bp, Homo sapiens
gagtcccaggaatgagcatagt

SEQ ID NO: 6965088 - DNA, 22 bp, Homo sapiens
ttgtccattttattggatggtg

SEQ ID NO: 6965089 - DNA, 22 bp, Homo sapiens
actgtcatcagaagatgaaaat

SEQ ID NO: 6965090 - DNA, 22 bp, Homo sapiens
aattgagatgacagaggaatag

SEQ ID NO: 6965091 - DNA, 22 bp, Homo sapiens
tgggcctcaccttcttggcagc

SEQ ID NO: 6965092 - DNA, 22 bp, Homo sapiens
cagggcctgcctggttcctgga

SEQ ID NO: 6965093 - DNA, 22 bp, Homo sapiens
gggtctctccctttagttattt

SEQ ID NO: 6965094 - DNA, 22 bp, Homo sapiens
cagcagctgaggcgctggcgtg

SEQ ID NO: 6965095 - DNA, 22 bp, Homo sapiens
cccagtgctatgcctattacat

SEQ ID NO: 6965096 - DNA, 22 bp, Homo sapiens
aatagttttataggtgggatta

SEQ ID NO: 6965097 - DNA, 22 bp, Homo sapiens
tcaaggaagatagctattatga

SEQ ID NO: 6965098 - DNA, 22 bp, Homo sapiens
ctctctcttgtgttgctgcaga

SEQ ID NO: 6965099 - DNA, 22 bp, Homo sapiens
tttgccctttctgagcctcatc

SEQ ID NO: 6965100 - DNA, 21 bp, Homo sapiens
ttttctggagtatgtctcctc

SEQ ID NO: 6965101 - DNA, 22 bp, Homo sapiens
tgctgccacctggtggctgaag

SEQ ID NO: 6965102 - DNA, 22 bp, Homo sapiens
gatcttctctttagtagaaaca

SEQ ID NO: 6965103 - DNA, 22 bp, Homo sapiens
atttgagcatataagtggccca

SEQ ID NO: 6965104 - DNA, 22 bp, Homo sapiens
tctttgttattgctttatctat

SEQ ID NO: 6965105 - DNA, 22 bp, Homo sapiens
tgtggggacccatgccatgggc

SEQ ID NO: 6965106 - DNA, 17 bp, Homo sapiens
agagtggctaaggctca

SEQ ID NO: 6965107 - DNA, 22 bp, Homo sapiens
gctactaggaagattccaggat

SEQ ID NO: 6965108 - DNA, 22 bp, Homo sapiens
caacaatatgccagactcaatt

SEQ ID NO: 6965109 - DNA, 22 bp, Homo sapiens
ccttccagaggcgtgacaccct

SEQ ID NO: 6965110 - DNA, 22 bp, Homo sapiens
cagctccacttgagtggggcct

SEQ ID NO: 6965111 - DNA, 22 bp, Homo sapiens
ccctgccctggagacacttaaa

SEQ ID NO: 6965112 - DNA, 22 bp, Homo sapiens
aagtacagaatcattggaagca

SEQ ID NO: 6965113 - DNA, 22 bp, Homo sapiens
tccttgcagacatctctcttca

SEQ ID NO: 6965114 - DNA, 22 bp, Homo sapiens
tgaacaggctgtactcatgagg

SEQ ID NO: 6965115 - DNA, 23 bp, Homo sapiens
ctgtagctaaaagctgggatttg

SEQ ID NO: 6965116 - DNA, 22 bp, Homo sapiens
atatgcttgtcacacacatcca

SEQ ID NO: 6965117 - DNA, 22 bp, Homo sapiens
tatcatttaacagaatcattgc

SEQ ID NO: 6965118 - DNA, 22 bp, Homo sapiens
tatccggagactttttaaattg

SEQ ID NO: 6965119 - DNA, 22 bp, Homo sapiens
tgaggcagtattttagtgactt

SEQ ID NO: 6965120 - DNA, 22 bp, Homo sapiens
tgcattatcatctggaagcttg

SEQ ID NO: 6965121 - DNA, 22 bp, Homo sapiens
ctggcctaaaaatacagaacaa

SEQ ID NO: 6965122 - DNA, 22 bp, Homo sapiens
caaagcagcggattgggatagt

SEQ ID NO: 6965123 - DNA, 22 bp, Homo sapiens
tctgccagtggattcttattct

SEQ ID NO: 6965124 - DNA, 22 bp, Homo sapiens
tagtcagtagcaaggtattttg

SEQ ID NO: 6965125 - DNA, 22 bp, Homo sapiens
catcttgggtaagcagttgctt

SEQ ID NO: 6965126 - DNA, 19 bp, Homo sapiens
tttaggataaagtctggac

SEQ ID NO: 6965127 - DNA, 22 bp, Homo sapiens
gccagcatcctggtggtggttg

SEQ ID NO: 6965128 - DNA, 22 bp, Homo sapiens
ttagctaaactgtaactagaat

SEQ ID NO: 6965129 - DNA, 22 bp, Homo sapiens
tttattgagcacccgttgtgcg

SEQ ID NO: 6965130 - DNA, 22 bp, Homo sapiens
gagtgtctcacagtagcatttt

SEQ ID NO: 6965131 - DNA, 22 bp, Homo sapiens
aggagtctgaactggtcccctg

SEQ ID NO: 6965132 - DNA, 22 bp, Homo sapiens
aaataagaggacagatgtttgg

SEQ ID NO: 6965133 - DNA, 22 bp, Homo sapiens
gaatttggatctttgatagagt

SEQ ID NO: 6965134 - DNA, 22 bp, Homo sapiens
gtgtgccaagagatagttgctg

SEQ ID NO: 6965135 - DNA, 22 bp, Homo sapiens
ctacagaaggagaaatgggtaa

SEQ ID NO: 6965136 - DNA, 20 bp, Homo sapiens
ggcatctataaacacatcca

SEQ ID NO: 6965137 - DNA, 22 bp, Homo sapiens
cgtttgtagagttttctgaggg

SEQ ID NO: 6965138 - DNA, 23 bp, Homo sapiens
gcattgtctccccacttctgggc

SEQ ID NO: 6965139 - DNA, 20 bp, Homo sapiens
agacaggagcccccattcag

SEQ ID NO: 6965140 - DNA, 21 bp, Homo sapiens
ggcctctgccttgccccactc

SEQ ID NO: 6965141 - DNA, 22 bp, Homo sapiens
actgagggagagtcttaggttg

SEQ ID NO: 6965142 - DNA, 22 bp, Homo sapiens
ggttcctggcagatgtagggct

SEQ ID NO: 6965143 - DNA, 18 bp, Homo sapiens
tcctaagatttgtgagaa

SEQ ID NO: 6965144 - DNA, 22 bp, Homo sapiens
ctcagctcactcttttgtgctt

SEQ ID NO: 6965145 - DNA, 22 bp, Homo sapiens
ctggaggtagatggtggtaatg

SEQ ID NO: 6965146 - DNA, 22 bp, Homo sapiens
tcagagttggcagtaaaacaca

SEQ ID NO: 6965147 - DNA, 22 bp, Homo sapiens
atgcctttctggtgttcttcct

SEQ ID NO: 6965148 - DNA, 22 bp, Homo sapiens
acagagtcataagcggagctcg

SEQ ID NO: 6965149 - DNA, 22 bp, Homo sapiens
tggaggagggctggtgtctgta

SEQ ID NO: 6965150 - DNA, 22 bp, Homo sapiens
tatttagaacagacaatagaaa

SEQ ID NO: 6965151 - DNA, 22 bp, Homo sapiens
actggaaagttgattatgtcca

SEQ ID NO: 6965152 - DNA, 22 bp, Homo sapiens
tgtgcccatccctctggagtgt

SEQ ID NO: 6965153 - DNA, 22 bp, Homo sapiens
aacacagaagtgccaagagcca

SEQ ID NO: 6965154 - DNA, 22 bp, Homo sapiens
tgggaagggtcagtttcttcat

SEQ ID NO: 6965155 - DNA, 22 bp, Homo sapiens
cccacaggcaggtgcatgggct

SEQ ID NO: 6965156 - DNA, 22 bp, Homo sapiens
caaagcagacgcagtaagggta

SEQ ID NO: 6965157 - DNA, 22 bp, Homo sapiens
gattgcattgatttgctccaag

SEQ ID NO: 6965158 - DNA, 22 bp, Homo sapiens
cagaatccacaacagaagttga

SEQ ID NO: 6965159 - DNA, 23 bp, Homo sapiens
ttaagactggctgaacttagtag

SEQ ID NO: 6965160 - DNA, 22 bp, Homo sapiens
ggctctgggtaaggcgtttgac

SEQ ID NO: 6965161 - DNA, 22 bp, Homo sapiens
tgaggtggtgctaatctctgct

SEQ ID NO: 6965162 - DNA, 22 bp, Homo sapiens
tgccagagaatcacctctcctt

SEQ ID NO: 6965163 - DNA, 22 bp, Homo sapiens
cagatgcttttgattctggggt

SEQ ID NO: 6965164 - DNA, 20 bp, Homo sapiens
gcccatgaggactgcagctg

SEQ ID NO: 6965165 - DNA, 22 bp, Homo sapiens
ggctttaacaacagaaatttat

SEQ ID NO: 6965166 - DNA, 22 bp, Homo sapiens
ctgtggctcattcttggtggca

SEQ ID NO: 6965167 - DNA, 22 bp, Homo sapiens
ttagagatgtcccaaaatgaag

SEQ ID NO: 6965168 - DNA, 22 bp, Homo sapiens
ccagtgtggtttaggataggga

SEQ ID NO: 6965169 - DNA, 22 bp, Homo sapiens
tttgacagtactctgtaggatc

SEQ ID NO: 6965170 - DNA, 22 bp, Homo sapiens
tatgcacaacatgcaggtttgt

SEQ ID NO: 6965171 - DNA, 22 bp, Homo sapiens
aacagagctctgctctcagatt

SEQ ID NO: 6965172 - DNA, 22 bp, Homo sapiens
ggcagatgttgcagtgagcaga

SEQ ID NO: 6965173 - DNA, 22 bp, Homo sapiens
ggctcatcagaaatacctgaca

SEQ ID NO: 6965174 - DNA, 22 bp, Homo sapiens
ttcattcatggtcttctgagat

SEQ ID NO: 6965175 - DNA, 22 bp, Homo sapiens
aacatctcatggactacattct

SEQ ID NO: 6965176 - DNA, 22 bp, Homo sapiens
taagagcctgtgctttgagttc

SEQ ID NO: 6965177 - DNA, 22 bp, Homo sapiens
tgtcatcttggtctggaataag

SEQ ID NO: 6965178 - DNA, 22 bp, Homo sapiens
tcttgcaggcaaactacctcta

SEQ ID NO: 6965179 - DNA, 22 bp, Homo sapiens
ctgattccaaagccaaagctat

SEQ ID NO: 6965180 - DNA, 22 bp, Homo sapiens
agaaaattagattttactgtgt

SEQ ID NO: 6965181 - DNA, 22 bp, Homo sapiens
tagcacctgcaggatgtgcaca

SEQ ID NO: 6965182 - DNA, 22 bp, Homo sapiens
aaagttcagattagactcaaga

SEQ ID NO: 6965183 - DNA, 23 bp, Homo sapiens
ggcagcttacttggtctctttca

SEQ ID NO: 6965184 - DNA, 22 bp, Homo sapiens
cctgcagatgtgggacagctgt

SEQ ID NO: 6965185 - DNA, 22 bp, Homo sapiens
gcatcctttcctttccattgtg

SEQ ID NO: 6965186 - DNA, 22 bp, Homo sapiens
tttccttgggtctcttagtggc

SEQ ID NO: 6965187 - DNA, 22 bp, Homo sapiens
gattacccgactcccttcaatg

SEQ ID NO: 6965188 - DNA, 22 bp, Homo sapiens
gttgaaaatgactttataccat

SEQ ID NO: 6965189 - DNA, 22 bp, Homo sapiens
aatacctaggatgtgctgggtg

SEQ ID NO: 6965190 - DNA, 22 bp, Homo sapiens
tgcctgcctctggagcccatcc

SEQ ID NO: 6965191 - DNA, 22 bp, Homo sapiens
catcttttggcctattctgagg

SEQ ID NO: 6965192 - DNA, 22 bp, Homo sapiens
gtcattcagagatgcaggtaga

SEQ ID NO: 6965193 - DNA, 22 bp, Homo sapiens
atgctgtagatcttagcctcta

SEQ ID NO: 6965194 - DNA, 22 bp, Homo sapiens
actgtaaattacataagaacag

SEQ ID NO: 6965195 - DNA, 21 bp, Homo sapiens
gcctcaccatgtcaagccagg

SEQ ID NO: 6965196 - DNA, 22 bp, Homo sapiens
agagtaatttttggacaatgcc

SEQ ID NO: 6965197 - DNA, 22 bp, Homo sapiens
cctcagtgtgtttggggtgagg

SEQ ID NO: 6965198 - DNA, 22 bp, Homo sapiens
ctccagatgtatactttccaag

SEQ ID NO: 6965199 - DNA, 22 bp, Homo sapiens
tagagaactcagtgtgcagcct

SEQ ID NO: 6965200 - DNA, 22 bp, Homo sapiens
atcattctagtccttatggtct

SEQ ID NO: 6965201 - DNA, 22 bp, Homo sapiens
tgaggacattgagactggagac

SEQ ID NO: 6965202 - DNA, 22 bp, Homo sapiens
ggcaggaggaagagttagcacc

SEQ ID NO: 6965203 - DNA, 22 bp, Homo sapiens
actgtctgctggcccctggtta

SEQ ID NO: 6965204 - DNA, 22 bp, Homo sapiens
cagatgaactaggctgcacttg

SEQ ID NO: 6965205 - DNA, 22 bp, Homo sapiens
gacagtttttaatcctttcatg

SEQ ID NO: 6965206 - DNA, 22 bp, Homo sapiens
ctacaggtatgtgcatgacatc

SEQ ID NO: 6965207 - DNA, 22 bp, Homo sapiens
atcttggactacagaagagagg

SEQ ID NO: 6965208 - DNA, 23 bp, Homo sapiens
tcagagaggccccctgcagagat

SEQ ID NO: 6965209 - DNA, 22 bp, Homo sapiens
tccagggccatctccatgaggc

SEQ ID NO: 6965210 - DNA, 19 bp, Homo sapiens
tcccagtggggagaggtgt

SEQ ID NO: 6965211 - DNA, 22 bp, Homo sapiens
gctgctgggcaccccctgagct

SEQ ID NO: 6965212 - DNA, 19 bp, Homo sapiens
aaactctgaaggccactgg

SEQ ID NO: 6965213 - DNA, 22 bp, Homo sapiens
agtgagatactgagaacatctc

SEQ ID NO: 6965214 - DNA, 22 bp, Homo sapiens
atgtctctgctgtggttagctt

SEQ ID NO: 6965215 - DNA, 22 bp, Homo sapiens
tgactcacagtggagaaagagg

SEQ ID NO: 6965216 - DNA, 22 bp, Homo sapiens
gtaggcagtctctcaggtgatc

SEQ ID NO: 6965217 - DNA, 22 bp, Homo sapiens
gtacatccccaaagccacgccc

SEQ ID NO: 6965218 - DNA, 22 bp, Homo sapiens
ggagcctgaaaagtctgcattt

SEQ ID NO: 6965219 - DNA, 22 bp, Homo sapiens
gccacctcccaggacgaggctg

SEQ ID NO: 6965220 - DNA, 23 bp, Homo sapiens
ttggtgtcagggaactttggaat

SEQ ID NO: 6965221 - DNA, 22 bp, Homo sapiens
tcagtcagaatcaccagacttt

SEQ ID NO: 6965222 - DNA, 22 bp, Homo sapiens
ccttggctgaggagggagctga

SEQ ID NO: 6965223 - DNA, 22 bp, Homo sapiens
tctgctaaggcatttgcttgga

SEQ ID NO: 6965224 - DNA, 22 bp, Homo sapiens
atcagaaaggtgggcaagcaga

SEQ ID NO: 6965225 - DNA, 22 bp, Homo sapiens
atacacagccattatgaattag

SEQ ID NO: 6965226 - DNA, 22 bp, Homo sapiens
agtgcaaagggatcagattggg

SEQ ID NO: 6965227 - DNA, 19 bp, Homo sapiens
aagaagcaataagctgtga

SEQ ID NO: 6965228 - DNA, 22 bp, Homo sapiens
ggaaggctgtgccagaagaact

SEQ ID NO: 6965229 - DNA, 22 bp, Homo sapiens
actgggctccagatgtgatacg

SEQ ID NO: 6965230 - DNA, 21 bp, Homo sapiens
tgcacctgtgccccatccttc

SEQ ID NO: 6965231 - DNA, 22 bp, Homo sapiens
tcagggcacgtttctgcaatgc

SEQ ID NO: 6965232 - DNA, 22 bp, Homo sapiens
aagaaaggtctctgcccgctat

SEQ ID NO: 6965233 - DNA, 22 bp, Homo sapiens
aagatgattaggatgaaagcaa

SEQ ID NO: 6965234 - DNA, 22 bp, Homo sapiens
ggcaatgtttcgatgggagctg

SEQ ID NO: 6965235 - DNA, 22 bp, Homo sapiens
gcgcggcctcacccctcggtga

SEQ ID NO: 6965236 - DNA, 22 bp, Homo sapiens
aaagagttctatgatctttcca

SEQ ID NO: 6965237 - DNA, 22 bp, Homo sapiens
tatttcatgtgcaccataattc

SEQ ID NO: 6965238 - DNA, 22 bp, Homo sapiens
gggtagtaactacacagcgaag

SEQ ID NO: 6965239 - DNA, 22 bp, Homo sapiens
gtgcccaccacgggctgtggcg

SEQ ID NO: 6965240 - DNA, 22 bp, Homo sapiens
ttgcaatcaaaaagaagtacag

SEQ ID NO: 6965241 - DNA, 22 bp, Homo sapiens
agatgctctcttgctggttcat

SEQ ID NO: 6965242 - DNA, 22 bp, Homo sapiens
tctgctgtctatgcaagtcctt

SEQ ID NO: 6965243 - DNA, 22 bp, Homo sapiens
gagaaacttggagttattctgg

SEQ ID NO: 6965244 - DNA, 22 bp, Homo sapiens
taaggcaaacaggaaagcaggc

SEQ ID NO: 6965245 - DNA, 22 bp, Homo sapiens
cctgtcatatacatacctcctc

SEQ ID NO: 6965246 - DNA, 22 bp, Homo sapiens
ctggaatgagcagggcttatgg

SEQ ID NO: 6965247 - DNA, 22 bp, Homo sapiens
tcctgagaggtgtgaggtgcag

SEQ ID NO: 6965248 - DNA, 23 bp, Homo sapiens
ttataaatattttcaggtgtgtt

SEQ ID NO: 6965249 - DNA, 22 bp, Homo sapiens
tgccctgggaggctttcctgtt

SEQ ID NO: 6965250 - DNA, 22 bp, Homo sapiens
cctcctggggtgaaggatggga

SEQ ID NO: 6965251 - DNA, 22 bp, Homo sapiens
gctcagaggttgttcttgggtt

SEQ ID NO: 6965252 - DNA, 22 bp, Homo sapiens
ttttgcatctggtgaagaccag

SEQ ID NO: 6965253 - DNA, 22 bp, Homo sapiens
attgtaacatgttcagatcact

SEQ ID NO: 6965254 - DNA, 22 bp, Homo sapiens
aatcttgagggactcatgaggt

SEQ ID NO: 6965255 - DNA, 18 bp, Homo sapiens
acacttcctggtggtgtg

SEQ ID NO: 6965256 - DNA, 22 bp, Homo sapiens
acagagacttggagcaggctga

SEQ ID NO: 6965257 - DNA, 22 bp, Homo sapiens
tgtgacagcacggttcaactgc

SEQ ID NO: 6965258 - DNA, 22 bp, Homo sapiens
agaatccctgcttgtcttcaaa

SEQ ID NO: 6965259 - DNA, 22 bp, Homo sapiens
tgtgggctccccctcactctgt

SEQ ID NO: 6965260 - DNA, 22 bp, Homo sapiens
gagcctggatagccttgttcca

SEQ ID NO: 6965261 - DNA, 22 bp, Homo sapiens
cccatttagacctattctgccc

SEQ ID NO: 6965262 - DNA, 22 bp, Homo sapiens
agtttgtactgaattcaattta

SEQ ID NO: 6965263 - DNA, 22 bp, Homo sapiens
tcaacattcatatatagccaca

SEQ ID NO: 6965264 - DNA, 22 bp, Homo sapiens
cctttcctgcctcaggaagtag

SEQ ID NO: 6965265 - DNA, 22 bp, Homo sapiens
aatccatctctccgagaagttt

SEQ ID NO: 6965266 - DNA, 22 bp, Homo sapiens
ttcacattggttcttgatagct

SEQ ID NO: 6965267 - DNA, 22 bp, Homo sapiens
cttggacaacttttctctggtt

SEQ ID NO: 6965268 - DNA, 22 bp, Homo sapiens
tggccgggccgggcgcctccac

SEQ ID NO: 6965269 - DNA, 17 bp, Homo sapiens
aaggtgagagctgttct

SEQ ID NO: 6965270 - DNA, 22 bp, Homo sapiens
ggctcactgcaacctctgcctc

SEQ ID NO: 6965271 - DNA, 22 bp, Homo sapiens
agttctgctgctgcctagggtg

SEQ ID NO: 6965272 - DNA, 22 bp, Homo sapiens
tacacacctgcctgcagactct

SEQ ID NO: 6965273 - DNA, 22 bp, Homo sapiens
ggcagatgacagaccagtatgt

SEQ ID NO: 6965274 - DNA, 22 bp, Homo sapiens
aagccttaaatgtttctaatat

SEQ ID NO: 6965275 - DNA, 22 bp, Homo sapiens
ttctggcttttcatgttccagt

SEQ ID NO: 6965276 - DNA, 22 bp, Homo sapiens
ggctttaaggtttaggaagcaa

SEQ ID NO: 6965277 - DNA, 22 bp, Homo sapiens
actgttatgatttacacagtcc

SEQ ID NO: 6965278 - DNA, 22 bp, Homo sapiens
tcaaaggcaccaaggtcactgc

SEQ ID NO: 6965279 - DNA, 22 bp, Homo sapiens
agaggcaactgatttctgccag

SEQ ID NO: 6965280 - DNA, 20 bp, Homo sapiens
tgaagagtgcgcacattgcc

SEQ ID NO: 6965281 - DNA, 22 bp, Homo sapiens
tgcctgctcttaccactctccc

SEQ ID NO: 6965282 - DNA, 22 bp, Homo sapiens
tcacatcatggagaattatggg

SEQ ID NO: 6965283 - DNA, 22 bp, Homo sapiens
tgagaaggcctgtgtgacaggg

SEQ ID NO: 6965284 - DNA, 22 bp, Homo sapiens
cagggggcagcgtagaaaatga

SEQ ID NO: 6965285 - DNA, 22 bp, Homo sapiens
cgctgcctctctggggccctgg

SEQ ID NO: 6965286 - DNA, 22 bp, Homo sapiens
ttctgacatatccagtctcagt

SEQ ID NO: 6965287 - DNA, 22 bp, Homo sapiens
atctggcttttaccccacggcc

SEQ ID NO: 6965288 - DNA, 22 bp, Homo sapiens
tgtgttcaccaaagtgtagaaa

SEQ ID NO: 6965289 - DNA, 22 bp, Homo sapiens
aacattgaacttggcacaccca

SEQ ID NO: 6965290 - DNA, 22 bp, Homo sapiens
atttattgagacttaacaaccc

SEQ ID NO: 6965291 - DNA, 20 bp, Homo sapiens
cttgagttcagagctgtcat

SEQ ID NO: 6965292 - DNA, 22 bp, Homo sapiens
attgttttaattccattgtgaa

SEQ ID NO: 6965293 - DNA, 22 bp, Homo sapiens
ccagagaagtcttgcctggatt

SEQ ID NO: 6965294 - DNA, 22 bp, Homo sapiens
tcctggagttgtctgtactcat

SEQ ID NO: 6965295 - DNA, 22 bp, Homo sapiens
tttaagtcatggagaattgtgg

SEQ ID NO: 6965296 - DNA, 22 bp, Homo sapiens
agggagcttctacttcaaggca

SEQ ID NO: 6965297 - DNA, 22 bp, Homo sapiens
gagacacaggtggttcctgtca

SEQ ID NO: 6965298 - DNA, 22 bp, Homo sapiens
ttgtccttagatgtggcctcca

SEQ ID NO: 6965299 - DNA, 22 bp, Homo sapiens
ttgtgccagagaaagcacaaga

SEQ ID NO: 6965300 - DNA, 22 bp, Homo sapiens
tggctcaggggtctggctctgt

SEQ ID NO: 6965301 - DNA, 22 bp, Homo sapiens
gctggaagggaggcccagccgg

SEQ ID NO: 6965302 - DNA, 18 bp, Homo sapiens
acacacacacctgtgtat

SEQ ID NO: 6965303 - DNA, 22 bp, Homo sapiens
ttcagaatgattacattctggt

SEQ ID NO: 6965304 - DNA, 22 bp, Homo sapiens
catgagctgctgggagcctgtc

SEQ ID NO: 6965305 - DNA, 22 bp, Homo sapiens
tgtgagagtataatctctctgt

SEQ ID NO: 6965306 - DNA, 22 bp, Homo sapiens
agtgtttatcagacaagccctg

SEQ ID NO: 6965307 - DNA, 22 bp, Homo sapiens
agtttacttgaatgatgaattc

SEQ ID NO: 6965308 - DNA, 22 bp, Homo sapiens
aatgtgctgtcaacatttcgaa

SEQ ID NO: 6965309 - DNA, 22 bp, Homo sapiens
aaatgtgctcatttataaaagt

SEQ ID NO: 6965310 - DNA, 22 bp, Homo sapiens
aacagaatattttgcctttctc

SEQ ID NO: 6965311 - DNA, 22 bp, Homo sapiens
acgtgtgtatgagtgtacatat

SEQ ID NO: 6965312 - DNA, 22 bp, Homo sapiens
cttctttgaaaaaggcagtcag

SEQ ID NO: 6965313 - DNA, 22 bp, Homo sapiens
gcagagcagaggtgcaggttgg

SEQ ID NO: 6965314 - DNA, 20 bp, Homo sapiens
ccttctctggaattgcctcc

SEQ ID NO: 6965315 - DNA, 22 bp, Homo sapiens
gggcatggtgatgtgcacctgt

SEQ ID NO: 6965316 - DNA, 22 bp, Homo sapiens
cctgccaggctttcaggtttgg

SEQ ID NO: 6965317 - DNA, 22 bp, Homo sapiens
aggctgccctgccgccagtggg

SEQ ID NO: 6965318 - DNA, 20 bp, Homo sapiens
ctttggcaggccttgccacg

SEQ ID NO: 6965319 - DNA, 22 bp, Homo sapiens
tttgatactgagaaaaacaaat

SEQ ID NO: 6965320 - DNA, 22 bp, Homo sapiens
aggtacatgaagcttgtgttgg

SEQ ID NO: 6965321 - DNA, 22 bp, Homo sapiens
atgttatgtgcaagatacataa

SEQ ID NO: 6965322 - DNA, 22 bp, Homo sapiens
agacattggctaaaagtagtgt

SEQ ID NO: 6965323 - DNA, 22 bp, Homo sapiens
ctgggaagaaattgtgggaggc

SEQ ID NO: 6965324 - DNA, 22 bp, Homo sapiens
atgtgtaaaaggcatgttttat

SEQ ID NO: 6965325 - DNA, 22 bp, Homo sapiens
agcctaggtttccgattctctt

SEQ ID NO: 6965326 - DNA, 22 bp, Homo sapiens
gattctttacatctctgctgac

SEQ ID NO: 6965327 - DNA, 22 bp, Homo sapiens
cctttcctttttagtgtgggag

SEQ ID NO: 6965328 - DNA, 22 bp, Homo sapiens
tctggggatgagtgatgtcgta

SEQ ID NO: 6965329 - DNA, 22 bp, Homo sapiens
tgacatagggcaaaagagtagg

SEQ ID NO: 6965330 - DNA, 22 bp, Homo sapiens
tatctgtttcctatgcatgtga

SEQ ID NO: 6965331 - DNA, 22 bp, Homo sapiens
ttggcagatttgtcagtaagct

SEQ ID NO: 6965332 - DNA, 22 bp, Homo sapiens
tggaatgtagtgtccatggaat

SEQ ID NO: 6965333 - DNA, 22 bp, Homo sapiens
attgacctgattgttcctggaa

SEQ ID NO: 6965334 - DNA, 22 bp, Homo sapiens
caaatattccaggtacatccct

SEQ ID NO: 6965335 - DNA, 22 bp, Homo sapiens
aaatatgtatggagttcatgaa

SEQ ID NO: 6965336 - DNA, 22 bp, Homo sapiens
taaagtgtatgccatctctcat

SEQ ID NO: 6965337 - DNA, 22 bp, Homo sapiens
agaaggcaccgtggccaatatt

SEQ ID NO: 6965338 - DNA, 22 bp, Homo sapiens
ccgtccccagccacctgctgat

SEQ ID NO: 6965339 - DNA, 22 bp, Homo sapiens
tagaaacagaaaactgtaatag

SEQ ID NO: 6965340 - DNA, 22 bp, Homo sapiens
cacttgaacccgggaggctgag

SEQ ID NO: 6965341 - DNA, 22 bp, Homo sapiens
taaagtagcgcctaactaatgt

SEQ ID NO: 6965342 - DNA, 22 bp, Homo sapiens
tgtctgccaaagcttcctcctg

SEQ ID NO: 6965343 - DNA, 22 bp, Homo sapiens
gttccacataacacatctacaa

SEQ ID NO: 6965344 - DNA, 21 bp, Homo sapiens
cacatttgaacctcacagcaa

SEQ ID NO: 6965345 - DNA, 22 bp, Homo sapiens
actgcaacctccacctcctggg

SEQ ID NO: 6965346 - DNA, 22 bp, Homo sapiens
aaaggcatgtgggctggttgta

SEQ ID NO: 6965347 - DNA, 22 bp, Homo sapiens
tgggcaggttgttatttgacat

SEQ ID NO: 6965348 - DNA, 22 bp, Homo sapiens
agtttgtaaacttgagctagcc

SEQ ID NO: 6965349 - DNA, 22 bp, Homo sapiens
gactatgtaatggatggcatga

SEQ ID NO: 6965350 - DNA, 22 bp, Homo sapiens
tgagctgcagagatctttgata

SEQ ID NO: 6965351 - DNA, 22 bp, Homo sapiens
tgtcaaagtatcagtctctggc

SEQ ID NO: 6965352 - DNA, 22 bp, Homo sapiens
acgcagaagggcctggcgtgcc

SEQ ID NO: 6965353 - DNA, 22 bp, Homo sapiens
atctagaagcctgagccaagat

SEQ ID NO: 6965354 - DNA, 22 bp, Homo sapiens
taagccactgagatttggggtt

SEQ ID NO: 6965355 - DNA, 20 bp, Homo sapiens
tggccactggccactggagc

SEQ ID NO: 6965356 - DNA, 22 bp, Homo sapiens
gaggaccagcattttcagagtg

SEQ ID NO: 6965357 - DNA, 22 bp, Homo sapiens
tgctgcactaggatttgctttc

SEQ ID NO: 6965358 - DNA, 22 bp, Homo sapiens
ggctggcaaaaaccttctctga

SEQ ID NO: 6965359 - DNA, 22 bp, Homo sapiens
gctcaaaggttgatagctgtgc

SEQ ID NO: 6965360 - DNA, 20 bp, Homo sapiens
tccagctccgtgttcttcct

SEQ ID NO: 6965361 - DNA, 22 bp, Homo sapiens
cacttcattgggaccagggctg

SEQ ID NO: 6965362 - DNA, 22 bp, Homo sapiens
atcagtgtttcaaatgtaatct

SEQ ID NO: 6965363 - DNA, 22 bp, Homo sapiens
aaaagcactacaatttcgcttc

SEQ ID NO: 6965364 - DNA, 22 bp, Homo sapiens
tggaatgatgactaggaattgt

SEQ ID NO: 6965365 - DNA, 22 bp, Homo sapiens
agcaccaggaaagaaggggcca

SEQ ID NO: 6965366 - DNA, 22 bp, Homo sapiens
ccagcagctgacaccagtccca

SEQ ID NO: 6965367 - DNA, 22 bp, Homo sapiens
ctcttccacctccttcaggaga

SEQ ID NO: 6965368 - DNA, 22 bp, Homo sapiens
taggctcttggtaaacaaaatt

SEQ ID NO: 6965369 - DNA, 22 bp, Homo sapiens
gacacaggaaaagctccagccc

SEQ ID NO: 6965370 - DNA, 22 bp, Homo sapiens
ctgattaattagctataaaact

SEQ ID NO: 6965371 - DNA, 23 bp, Homo sapiens
tgggcatctcctctgtgccaggc

SEQ ID NO: 6965372 - DNA, 21 bp, Homo sapiens
gggtgcaagttctctgtcttt

SEQ ID NO: 6965373 - DNA, 22 bp, Homo sapiens
agctcagaagggaggaaatgag

SEQ ID NO: 6965374 - DNA, 22 bp, Homo sapiens
agttcttattgaatagaaatca

SEQ ID NO: 6965375 - DNA, 22 bp, Homo sapiens
acagaaaaatgagggagctgga

SEQ ID NO: 6965376 - DNA, 22 bp, Homo sapiens
tttcttttgccctgtgggttag

SEQ ID NO: 6965377 - DNA, 22 bp, Homo sapiens
ttgaaactcatcttagtgatgt

SEQ ID NO: 6965378 - DNA, 22 bp, Homo sapiens
atgataagaacacagtatgggg

SEQ ID NO: 6965379 - DNA, 22 bp, Homo sapiens
ctaattctcagcatgaactggt

SEQ ID NO: 6965380 - DNA, 22 bp, Homo sapiens
agtaggcattgtgaaactgcat

SEQ ID NO: 6965381 - DNA, 22 bp, Homo sapiens
tcagcccagggacagaggcccc

SEQ ID NO: 6965382 - DNA, 19 bp, Homo sapiens
aggctgtttgttaataaag

SEQ ID NO: 6965383 - DNA, 22 bp, Homo sapiens
gagcccagggcaggcaaggcag

SEQ ID NO: 6965384 - DNA, 22 bp, Homo sapiens
tagagcagccttcagagcagtt

SEQ ID NO: 6965385 - DNA, 22 bp, Homo sapiens
cctgagatggggattattccaa

SEQ ID NO: 6965386 - DNA, 22 bp, Homo sapiens
tgacagggtgattatgagagct

SEQ ID NO: 6965387 - DNA, 22 bp, Homo sapiens
gggctccaaggaggccagcctg

SEQ ID NO: 6965388 - DNA, 22 bp, Homo sapiens
tttcaagcaggatcaaagcaaa

SEQ ID NO: 6965389 - DNA, 22 bp, Homo sapiens
tggctgtcagtcgcctgcattc

SEQ ID NO: 6965390 - DNA, 22 bp, Homo sapiens
acacattgcagacatctcatta

SEQ ID NO: 6965391 - DNA, 22 bp, Homo sapiens
gctgggagtgggcaagatgaga

SEQ ID NO: 6965392 - DNA, 22 bp, Homo sapiens
agaacagcagtagtatacagta

SEQ ID NO: 6965393 - DNA, 22 bp, Homo sapiens
tagagtgttgtaattgaaaagg

SEQ ID NO: 6965394 - DNA, 21 bp, Homo sapiens
ggaaggctatggtgtattttt

SEQ ID NO: 6965395 - DNA, 22 bp, Homo sapiens
agtctctttctaaataaggtca

SEQ ID NO: 6965396 - DNA, 22 bp, Homo sapiens
tctggggagtcaaagagacctg

SEQ ID NO: 6965397 - DNA, 22 bp, Homo sapiens
tgggctctggtttcctggctgg

SEQ ID NO: 6965398 - DNA, 22 bp, Homo sapiens
ctgagcagaagggtgcacgtgc

SEQ ID NO: 6965399 - DNA, 23 bp, Homo sapiens
gggcatggagtgtaggtggaagg

SEQ ID NO: 6965400 - DNA, 22 bp, Homo sapiens
tcaggagcaacatctttgaatc

SEQ ID NO: 6965401 - DNA, 22 bp, Homo sapiens
agccagggtgagagggctttgt

SEQ ID NO: 6965402 - DNA, 22 bp, Homo sapiens
gcacttggcctttatctgggga

SEQ ID NO: 6965403 - DNA, 22 bp, Homo sapiens
tatggcttccaggctggccagg

SEQ ID NO: 6965404 - DNA, 22 bp, Homo sapiens
attctggaattctaagattctg

SEQ ID NO: 6965405 - DNA, 22 bp, Homo sapiens
ttttcatgaggaaatactgccc

SEQ ID NO: 6965406 - DNA, 22 bp, Homo sapiens
cagtcattcctaaccaagaaca

SEQ ID NO: 6965407 - DNA, 22 bp, Homo sapiens
atgaatgtacctgaaatagcct

SEQ ID NO: 6965408 - DNA, 19 bp, Homo sapiens
atgtcccaccgcccctgag

SEQ ID NO: 6965409 - DNA, 22 bp, Homo sapiens
agagtatattgaagcagtcagg

SEQ ID NO: 6965410 - DNA, 22 bp, Homo sapiens
ctgtgagttcattgtgccacct

SEQ ID NO: 6965411 - DNA, 22 bp, Homo sapiens
aggatgtggtctgttttctgag

SEQ ID NO: 6965412 - DNA, 22 bp, Homo sapiens
gaggaggaaaggagttgaaatg

SEQ ID NO: 6965413 - DNA, 20 bp, Homo sapiens
agagcccagatgtctgtatt

SEQ ID NO: 6965414 - DNA, 22 bp, Homo sapiens
taacactaagaatctaaattta

SEQ ID NO: 6965415 - DNA, 22 bp, Homo sapiens
atggtattgcaacaactgtcat

SEQ ID NO: 6965416 - DNA, 22 bp, Homo sapiens
ctgagagttcgttccaccctcc

SEQ ID NO: 6965417 - DNA, 22 bp, Homo sapiens
cctgtctgttctgactggtcag

SEQ ID NO: 6965418 - DNA, 22 bp, Homo sapiens
ataaccctctggataggacagg

SEQ ID NO: 6965419 - DNA, 22 bp, Homo sapiens
gctgagactgacatgaagaggt

SEQ ID NO: 6965420 - DNA, 22 bp, Homo sapiens
aaggccttggctctctgtgtgc

SEQ ID NO: 6965421 - DNA, 22 bp, Homo sapiens
caccgatgatgtgggagacact

SEQ ID NO: 6965422 - DNA, 22 bp, Homo sapiens
cattcttacacaatattttaat

SEQ ID NO: 6965423 - DNA, 22 bp, Homo sapiens
tgaaagttgcacataagagaat

SEQ ID NO: 6965424 - DNA, 22 bp, Homo sapiens
atgaccagccgagataaacaga

SEQ ID NO: 6965425 - DNA, 22 bp, Homo sapiens
gagccagcaggacttaagccag

SEQ ID NO: 6965426 - DNA, 22 bp, Homo sapiens
tcagagaatctctccttagttt

SEQ ID NO: 6965427 - DNA, 22 bp, Homo sapiens
cactgtgggtcccagactggag

SEQ ID NO: 6965428 - DNA, 22 bp, Homo sapiens
agtttcctcatgttaatatgga

SEQ ID NO: 6965429 - DNA, 22 bp, Homo sapiens
tttgtataaattttgaggtgag

SEQ ID NO: 6965430 - DNA, 22 bp, Homo sapiens
ctatgctttagtaatattctca

SEQ ID NO: 6965431 - DNA, 22 bp, Homo sapiens
attcctttggactcctccttgc

SEQ ID NO: 6965432 - DNA, 22 bp, Homo sapiens
tgctgcagcagtgcgggcagct

SEQ ID NO: 6965433 - DNA, 22 bp, Homo sapiens
tgaagtctattaactgatttct

SEQ ID NO: 6965434 - DNA, 22 bp, Homo sapiens
tgcttcaccttgtctgatacca

SEQ ID NO: 6965435 - DNA, 22 bp, Homo sapiens
gacgcatcaggaggcgaggagc

SEQ ID NO: 6965436 - DNA, 22 bp, Homo sapiens
tcatgtaagtatagaaagcagt

SEQ ID NO: 6965437 - DNA, 22 bp, Homo sapiens
ttgcaagaaataatcgaataga

SEQ ID NO: 6965438 - DNA, 22 bp, Homo sapiens
atttcaagtgttgagctcataa

SEQ ID NO: 6965439 - DNA, 18 bp, Homo sapiens
ggtggctggggacggaca

SEQ ID NO: 6965440 - DNA, 22 bp, Homo sapiens
tcttcatgtcttgcctgatata

SEQ ID NO: 6965441 - DNA, 22 bp, Homo sapiens
tgaactttcacaagaatatgct

SEQ ID NO: 6965442 - DNA, 22 bp, Homo sapiens
ttgaggagttgtgacagatact

SEQ ID NO: 6965443 - DNA, 22 bp, Homo sapiens
aaagaagagctggaaggagtct

SEQ ID NO: 6965444 - DNA, 22 bp, Homo sapiens
agagatcaaagcttgccaagta

SEQ ID NO: 6965445 - DNA, 18 bp, Homo sapiens
tataaacacacttaggtt

SEQ ID NO: 6965446 - DNA, 22 bp, Homo sapiens
ttaaactgcttgaattgggttt

SEQ ID NO: 6965447 - DNA, 22 bp, Homo sapiens
atgtacatactgcattttcaaa

SEQ ID NO: 6965448 - DNA, 22 bp, Homo sapiens
tcttgctgttacagaattaaca

SEQ ID NO: 6965449 - DNA, 22 bp, Homo sapiens
aaagtgctttaggatatttgga

SEQ ID NO: 6965450 - DNA, 19 bp, Homo sapiens
accttacagaaacaggcat

SEQ ID NO: 6965451 - DNA, 22 bp, Homo sapiens
cggcttcttcatcaggtcagca

SEQ ID NO: 6965452 - DNA, 22 bp, Homo sapiens
tgtcagttgctattccaggcct

SEQ ID NO: 6965453 - DNA, 22 bp, Homo sapiens
accacagtatgaaatctgaaat

SEQ ID NO: 6965454 - DNA, 22 bp, Homo sapiens
acatggtgtgctgagaatgaca

SEQ ID NO: 6965455 - DNA, 22 bp, Homo sapiens
gaaagtgcagtcagacaaggca

SEQ ID NO: 6965456 - DNA, 22 bp, Homo sapiens
tctattaatgattcaatagtgt

SEQ ID NO: 6965457 - DNA, 19 bp, Homo sapiens
tgacaggttttatgtgttt

SEQ ID NO: 6965458 - DNA, 22 bp, Homo sapiens
gcagggctaggtcttctagggc

SEQ ID NO: 6965459 - DNA, 22 bp, Homo sapiens
ttgcttagagccaatcttgatt

SEQ ID NO: 6965460 - DNA, 22 bp, Homo sapiens
acagttcaagtcttagacaaca

SEQ ID NO: 6965461 - DNA, 22 bp, Homo sapiens
ccaggtcttgtttgacatcaat

SEQ ID NO: 6965462 - DNA, 19 bp, Homo sapiens
ggccatggcgggggtcaca

SEQ ID NO: 6965463 - DNA, 22 bp, Homo sapiens
cctgcagaggtcaggccagaaa

SEQ ID NO: 6965464 - DNA, 22 bp, Homo sapiens
ttttgtgagctccttggaggta

SEQ ID NO: 6965465 - DNA, 22 bp, Homo sapiens
tccccaagtaaagatcctgaga

SEQ ID NO: 6965466 - DNA, 22 bp, Homo sapiens
tcctgcacagttggtgcttgaa

SEQ ID NO: 6965467 - DNA, 22 bp, Homo sapiens
atgcagggattaaatgactgcc

SEQ ID NO: 6965468 - DNA, 22 bp, Homo sapiens
gtgcatgcacacatgtgtgagg

SEQ ID NO: 6965469 - DNA, 22 bp, Homo sapiens
tggctgcacttacctctcctgc

SEQ ID NO: 6965470 - DNA, 22 bp, Homo sapiens
ggtgccactgcactctggcctg

SEQ ID NO: 6965471 - DNA, 16 bp, Homo sapiens
tgttagctgtgcatta

SEQ ID NO: 6965472 - DNA, 22 bp, Homo sapiens
gtgactctccactagtatgaaa

SEQ ID NO: 6965473 - DNA, 22 bp, Homo sapiens
ccctcactgtccttgggccctt

SEQ ID NO: 6965474 - DNA, 22 bp, Homo sapiens
aagcaagcaaggtgttacatat

SEQ ID NO: 6965475 - DNA, 22 bp, Homo sapiens
tagtttaggatcttttttgtgc

SEQ ID NO: 6965476 - DNA, 22 bp, Homo sapiens
aaatccaggtagtttggtttga

SEQ ID NO: 6965477 - DNA, 22 bp, Homo sapiens
ggccccaggcctttggtctggc

SEQ ID NO: 6965478 - DNA, 22 bp, Homo sapiens
tggtcagactaggacactccgg

SEQ ID NO: 6965479 - DNA, 22 bp, Homo sapiens
ggatcattaacacatccatcac

SEQ ID NO: 6965480 - DNA, 22 bp, Homo sapiens
ctgggccagggaggtgtctgta

SEQ ID NO: 6965481 - DNA, 22 bp, Homo sapiens
ccaggctcctcatgatcttgtt

SEQ ID NO: 6965482 - DNA, 22 bp, Homo sapiens
ttcagtctgatctgagctgaga

SEQ ID NO: 6965483 - DNA, 22 bp, Homo sapiens
gctgcccagggtggagccggct

SEQ ID NO: 6965484 - DNA, 22 bp, Homo sapiens
tgggctctagactttagtgtgg

SEQ ID NO: 6965485 - DNA, 22 bp, Homo sapiens
acagactaaaattgcacagtgg

SEQ ID NO: 6965486 - DNA, 22 bp, Homo sapiens
agccttgaatgcgctgcattgg

SEQ ID NO: 6965487 - DNA, 22 bp, Homo sapiens
tttgaccctgttattctccctg

SEQ ID NO: 6965488 - DNA, 22 bp, Homo sapiens
gcagctgcctattcagggcttg

SEQ ID NO: 6965489 - DNA, 22 bp, Homo sapiens
caagggcagaggcagggccccg

SEQ ID NO: 6965490 - DNA, 22 bp, Homo sapiens
tgggagtcactgttgttgaggg

SEQ ID NO: 6965491 - DNA, 22 bp, Homo sapiens
taggcctggatctctgggagca

SEQ ID NO: 6965492 - DNA, 22 bp, Homo sapiens
agtgcacttttgggggatgtta

SEQ ID NO: 6965493 - DNA, 22 bp, Homo sapiens
tttctctgaggctggcctccct

SEQ ID NO: 6965494 - DNA, 22 bp, Homo sapiens
ccagaggctggcagccagctga

SEQ ID NO: 6965495 - DNA, 22 bp, Homo sapiens
tgtggcagaactgggactcaaa

SEQ ID NO: 6965496 - DNA, 23 bp, Homo sapiens
acttaaatggttctttatctcag

SEQ ID NO: 6965497 - DNA, 22 bp, Homo sapiens
taatgtcttgtgagagctggag

SEQ ID NO: 6965498 - DNA, 22 bp, Homo sapiens
ctgaggagtcagcttactcact

SEQ ID NO: 6965499 - DNA, 20 bp, Homo sapiens
gatttcaaagcagagtggcc

SEQ ID NO: 6965500 - DNA, 22 bp, Homo sapiens
actttacaaactcctcactgtt

SEQ ID NO: 6965501 - DNA, 23 bp, Homo sapiens
ggctgagaagtcccatgataggt

SEQ ID NO: 6965502 - DNA, 19 bp, Homo sapiens
gcatctgcatgatggggtt

SEQ ID NO: 6965503 - DNA, 22 bp, Homo sapiens
gatcaagaggaatattggcaaa

SEQ ID NO: 6965504 - DNA, 22 bp, Homo sapiens
ttccaagacttggccagcaggg

SEQ ID NO: 6965505 - DNA, 22 bp, Homo sapiens
gttcacagttcagcctgtaaca

SEQ ID NO: 6965506 - DNA, 22 bp, Homo sapiens
ttggccttgtcacttcattact

SEQ ID NO: 6965507 - DNA, 22 bp, Homo sapiens
aacttcagggacagaaaagagc

SEQ ID NO: 6965508 - DNA, 19 bp, Homo sapiens
agggagtttatatttgcac

SEQ ID NO: 6965509 - DNA, 22 bp, Homo sapiens
tatttctggctttgagggtgat

SEQ ID NO: 6965510 - DNA, 22 bp, Homo sapiens
ggctgtatcctggttttggaga

SEQ ID NO: 6965511 - DNA, 22 bp, Homo sapiens
acggctattttcacactgtggg

SEQ ID NO: 6965512 - DNA, 22 bp, Homo sapiens
atagcagcatcagtttatctcc

SEQ ID NO: 6965513 - DNA, 22 bp, Homo sapiens
gaagtctcatagttaaaattct

SEQ ID NO: 6965514 - DNA, 22 bp, Homo sapiens
ttacttgaatgactagtgggat

SEQ ID NO: 6965515 - DNA, 21 bp, Homo sapiens
cccgtggagaaaaggaatgag

SEQ ID NO: 6965516 - DNA, 22 bp, Homo sapiens
gcctaaggatatgctttgcttg

SEQ ID NO: 6965517 - DNA, 22 bp, Homo sapiens
aagtgtatttttgtactaacat

SEQ ID NO: 6965518 - DNA, 22 bp, Homo sapiens
atggctgtgagcaggcagcttc

SEQ ID NO: 6965519 - DNA, 22 bp, Homo sapiens
ttctattgtaccttttctctca

SEQ ID NO: 6965520 - DNA, 22 bp, Homo sapiens
agaaagcagcatttatgatctc

SEQ ID NO: 6965521 - DNA, 18 bp, Homo sapiens
ttactacagcactttctt

SEQ ID NO: 6965522 - DNA, 22 bp, Homo sapiens
agtcccagactccagttttctg

SEQ ID NO: 6965523 - DNA, 22 bp, Homo sapiens
gctctgaggagccaagaatgtg

SEQ ID NO: 6965524 - DNA, 22 bp, Homo sapiens
agcaggcttgttatgtctgaga

SEQ ID NO: 6965525 - DNA, 22 bp, Homo sapiens
ctaggctctgccagcactgtcg

SEQ ID NO: 6965526 - DNA, 22 bp, Homo sapiens
tgagatgcaggagatgggactg

SEQ ID NO: 6965527 - DNA, 20 bp, Homo sapiens
cctggcaggcgggttactta

SEQ ID NO: 6965528 - DNA, 22 bp, Homo sapiens
taaatgacaacacctgcttttg

SEQ ID NO: 6965529 - DNA, 22 bp, Homo sapiens
tcactcagaaatagaatgaacc

SEQ ID NO: 6965530 - DNA, 22 bp, Homo sapiens
tttctgcacatttctaaagttg

SEQ ID NO: 6965531 - DNA, 22 bp, Homo sapiens
tgcacacgcatgcaagtgcagg

SEQ ID NO: 6965532 - DNA, 22 bp, Homo sapiens
agtcactgttctgtcatgtcaa

SEQ ID NO: 6965533 - DNA, 22 bp, Homo sapiens
agcagccatagatagcatgcaa

SEQ ID NO: 6965534 - DNA, 22 bp, Homo sapiens
agattagggtctgtgtctggcg

SEQ ID NO: 6965535 - DNA, 22 bp, Homo sapiens
ttacagaagtttcagcgtttta

SEQ ID NO: 6965536 - DNA, 22 bp, Homo sapiens
tgaggagccactctagcagtca

SEQ ID NO: 6965537 - DNA, 22 bp, Homo sapiens
ttcagtgtatattttttgagta

SEQ ID NO: 6965538 - DNA, 22 bp, Homo sapiens
aggcatgatgtgcagtggcaaa

SEQ ID NO: 6965539 - DNA, 21 bp, Homo sapiens
ccagtctgtaaaatggggaca

SEQ ID NO: 6965540 - DNA, 23 bp, Homo sapiens
gtgcgccaggacaacctgacgga

SEQ ID NO: 6965541 - DNA, 22 bp, Homo sapiens
actgggagttctccatgtccct

SEQ ID NO: 6965542 - DNA, 22 bp, Homo sapiens
atgttctaatccctgctatgta

SEQ ID NO: 6965543 - DNA, 22 bp, Homo sapiens
gcagttctagcaaactaatact

SEQ ID NO: 6965544 - DNA, 22 bp, Homo sapiens
cctgaggtcatgcatttccaac

SEQ ID NO: 6965545 - DNA, 22 bp, Homo sapiens
tgagccaagcagcttcccaggg

SEQ ID NO: 6965546 - DNA, 22 bp, Homo sapiens
ttgggcttgtctgggaaactgc

SEQ ID NO: 6965547 - DNA, 22 bp, Homo sapiens
aacatgatagtattttgaggtg

SEQ ID NO: 6965548 - DNA, 22 bp, Homo sapiens
attggaaatactgagagataaa

SEQ ID NO: 6965549 - DNA, 21 bp, Homo sapiens
gataaagcagcttgcctaagg

SEQ ID NO: 6965550 - DNA, 20 bp, Homo sapiens
ttagctttggcaatagtgac

SEQ ID NO: 6965551 - DNA, 22 bp, Homo sapiens
acatgccaatttggttagttca

SEQ ID NO: 6965552 - DNA, 23 bp, Homo sapiens
tgccacccttctcttcccagctt

SEQ ID NO: 6965553 - DNA, 22 bp, Homo sapiens
attacacactcaagtcctgtta

SEQ ID NO: 6965554 - DNA, 22 bp, Homo sapiens
tttggtctggaatcttcagggt

SEQ ID NO: 6965555 - DNA, 22 bp, Homo sapiens
ttcttttggactcaaagagaac

SEQ ID NO: 6965556 - DNA, 22 bp, Homo sapiens
tagggctgtttaaaagtgaggt

SEQ ID NO: 6965557 - DNA, 22 bp, Homo sapiens
tccaagaagctcagcaaacatc

SEQ ID NO: 6965558 - DNA, 22 bp, Homo sapiens
ctcacaaccttatgaagcatga

SEQ ID NO: 6965559 - DNA, 22 bp, Homo sapiens
tctgtacatttgtgttgtgaat

SEQ ID NO: 6965560 - DNA, 22 bp, Homo sapiens
cttgctgttttctaccctcaag

SEQ ID NO: 6965561 - DNA, 22 bp, Homo sapiens
tctgaatcacagtcattcagct

SEQ ID NO: 6965562 - DNA, 22 bp, Homo sapiens
tggaaactatcctcacaactag

SEQ ID NO: 6965563 - DNA, 22 bp, Homo sapiens
actcatttaaacatttactgaa

SEQ ID NO: 6965564 - DNA, 22 bp, Homo sapiens
cattgaaaaacgttgactgagt

SEQ ID NO: 6965565 - DNA, 22 bp, Homo sapiens
ccagaaaaggagctgcaggatg

SEQ ID NO: 6965566 - DNA, 19 bp, Homo sapiens
ttgttcgttcctgacaggc

SEQ ID NO: 6965567 - DNA, 22 bp, Homo sapiens
gcatttgagcacattttaaaga

SEQ ID NO: 6965568 - DNA, 22 bp, Homo sapiens
tcttgagagatatactactgaa

SEQ ID NO: 6965569 - DNA, 22 bp, Homo sapiens
gtgcaacgttctaatatgttct

SEQ ID NO: 6965570 - DNA, 22 bp, Homo sapiens
actgtggcaaagaagcaggctc

SEQ ID NO: 6965571 - DNA, 23 bp, Homo sapiens
tgtctggagagggcttgctctcc

SEQ ID NO: 6965572 - DNA, 22 bp, Homo sapiens
tgctttatctgacttggcgctg

SEQ ID NO: 6965573 - DNA, 22 bp, Homo sapiens
cagcatcagcctggctcaggcc

SEQ ID NO: 6965574 - DNA, 22 bp, Homo sapiens
ttccaaatgcccatctacacag

SEQ ID NO: 6965575 - DNA, 22 bp, Homo sapiens
gaagacagaaacctgtttggct

SEQ ID NO: 6965576 - DNA, 21 bp, Homo sapiens
tgattctgttttatcatcagc

SEQ ID NO: 6965577 - DNA, 22 bp, Homo sapiens
tctgacttggcgctcttgtctt

SEQ ID NO: 6965578 - DNA, 22 bp, Homo sapiens
tcctgactccaggtcctgtgtg

SEQ ID NO: 6965579 - DNA, 22 bp, Homo sapiens
cattagaaggttttaaaggaat

SEQ ID NO: 6965580 - DNA, 22 bp, Homo sapiens
tattatcatgttaattagtggg

SEQ ID NO: 6965581 - DNA, 22 bp, Homo sapiens
agggctcctatgccccatggac

SEQ ID NO: 6965582 - DNA, 22 bp, Homo sapiens
ctcctgcagtatgtttctctat

SEQ ID NO: 6965583 - DNA, 22 bp, Homo sapiens
tttctctggcctcagtttaaca

SEQ ID NO: 6965584 - DNA, 22 bp, Homo sapiens
taagtcctagatgattcacaga

SEQ ID NO: 6965585 - DNA, 21 bp, Homo sapiens
ggataaatggtctggtttctc

SEQ ID NO: 6965586 - DNA, 22 bp, Homo sapiens
cccttgggcttccacccagccc

SEQ ID NO: 6965587 - DNA, 22 bp, Homo sapiens
ggaaatcttccttcactctttc

SEQ ID NO: 6965588 - DNA, 22 bp, Homo sapiens
ccatggcaactggcgtccaggg

SEQ ID NO: 6965589 - DNA, 20 bp, Homo sapiens
tccagcccaggtcctgcctg

SEQ ID NO: 6965590 - DNA, 22 bp, Homo sapiens
gcgggtttgatgtgctaatgag

SEQ ID NO: 6965591 - DNA, 19 bp, Homo sapiens
atacaagagagcagttgag

SEQ ID NO: 6965592 - DNA, 22 bp, Homo sapiens
aatggtaatttgcagaaagtcc

SEQ ID NO: 6965593 - DNA, 19 bp, Homo sapiens
catcacatggtctgatgaa

SEQ ID NO: 6965594 - DNA, 22 bp, Homo sapiens
tgtatgcttgtgtataatataa

SEQ ID NO: 6965595 - DNA, 22 bp, Homo sapiens
tggcgttgttctcgttccctac

SEQ ID NO: 6965596 - DNA, 22 bp, Homo sapiens
ttggtgactccccaccatgatg

SEQ ID NO: 6965597 - DNA, 22 bp, Homo sapiens
ttctgagaaggctgtggacaca

SEQ ID NO: 6965598 - DNA, 22 bp, Homo sapiens
agccaggcagggctctcgctct

SEQ ID NO: 6965599 - DNA, 22 bp, Homo sapiens
agtcaagagacttaaaatattt

SEQ ID NO: 6965600 - DNA, 22 bp, Homo sapiens
tctgaggacagtgctgtgcctg

SEQ ID NO: 6965601 - DNA, 22 bp, Homo sapiens
acaggaaattggcatatcagtt

SEQ ID NO: 6965602 - DNA, 22 bp, Homo sapiens
aaacactcatgtgttactctcc

SEQ ID NO: 6965603 - DNA, 21 bp, Homo sapiens
atgagagtaatgctataaatt

SEQ ID NO: 6965604 - DNA, 22 bp, Homo sapiens
tgagcctctaccacaggtggaa

SEQ ID NO: 6965605 - DNA, 22 bp, Homo sapiens
gtcttacccacagcatctagaa

SEQ ID NO: 6965606 - DNA, 22 bp, Homo sapiens
acagatgagagacaatgtgcta

SEQ ID NO: 6965607 - DNA, 21 bp, Homo sapiens
gttcaaatcctgacactacac

SEQ ID NO: 6965608 - DNA, 22 bp, Homo sapiens
ggcaggtgtttttatattaaag

SEQ ID NO: 6965609 - DNA, 22 bp, Homo sapiens
atcaagtgaagggctcttgaag

SEQ ID NO: 6965610 - DNA, 22 bp, Homo sapiens
gctaggaagctggggagaagtc

SEQ ID NO: 6965611 - DNA, 22 bp, Homo sapiens
cctggactttcaggactactgt

SEQ ID NO: 6965612 - DNA, 20 bp, Homo sapiens
tttgaactttgtactctgtt

SEQ ID NO: 6965613 - DNA, 22 bp, Homo sapiens
ctctgggtggtctcactgagtg

SEQ ID NO: 6965614 - DNA, 22 bp, Homo sapiens
gctgcaggctgtggcaggggag

SEQ ID NO: 6965615 - DNA, 19 bp, Homo sapiens
ctgagcaggcaggtaggat

SEQ ID NO: 6965616 - DNA, 22 bp, Homo sapiens
ccatccatgtggcagggctggc

SEQ ID NO: 6965617 - DNA, 22 bp, Homo sapiens
atctgctggcatctctagccca

SEQ ID NO: 6965618 - DNA, 22 bp, Homo sapiens
cttcttgaaacctgctccctca

SEQ ID NO: 6965619 - DNA, 22 bp, Homo sapiens
gcctcattggtcttgctgggga

SEQ ID NO: 6965620 - DNA, 22 bp, Homo sapiens
gtatttcacatatggatatgct

SEQ ID NO: 6965621 - DNA, 20 bp, Homo sapiens
acttaacaccgactaatgat

SEQ ID NO: 6965622 - DNA, 22 bp, Homo sapiens
ttcagcaatgacagcctatata

SEQ ID NO: 6965623 - DNA, 21 bp, Homo sapiens
gcctgggaagagaaaggtaag

SEQ ID NO: 6965624 - DNA, 19 bp, Homo sapiens
aataatgttcatgagattg

SEQ ID NO: 6965625 - DNA, 22 bp, Homo sapiens
tggagcaggacggggagtggta

SEQ ID NO: 6965626 - DNA, 22 bp, Homo sapiens
agctcctgcagactcctgctca

SEQ ID NO: 6965627 - DNA, 22 bp, Homo sapiens
gtcttgtccattccatgctgct

SEQ ID NO: 6965628 - DNA, 22 bp, Homo sapiens
atcacagtgtagaccttttaaa

SEQ ID NO: 6965629 - DNA, 22 bp, Homo sapiens
aggcagctggaggcagagacta

SEQ ID NO: 6965630 - DNA, 21 bp, Homo sapiens
tggcatcctcttctcctttcc

SEQ ID NO: 6965631 - DNA, 22 bp, Homo sapiens
gccaggacctcccagagctttc

SEQ ID NO: 6965632 - DNA, 22 bp, Homo sapiens
tgtacaaattcagttctagggt

SEQ ID NO: 6965633 - DNA, 22 bp, Homo sapiens
tactacatacagaatttagaga

SEQ ID NO: 6965634 - DNA, 22 bp, Homo sapiens
ccattctgacttcattgcctca

SEQ ID NO: 6965635 - DNA, 22 bp, Homo sapiens
agccagcaggtgcagaattcca

SEQ ID NO: 6965636 - DNA, 22 bp, Homo sapiens
tgtcccatggcttttctggtgg

SEQ ID NO: 6965637 - DNA, 22 bp, Homo sapiens
ggatgaggaaaccacagtgtcc

SEQ ID NO: 6965638 - DNA, 22 bp, Homo sapiens
aggatcctttggccacttctta

SEQ ID NO: 6965639 - DNA, 22 bp, Homo sapiens
cctatggtgttggaactgatca

SEQ ID NO: 6965640 - DNA, 22 bp, Homo sapiens
cctttgtggggcggtgggtaat

SEQ ID NO: 6965641 - DNA, 22 bp, Homo sapiens
ggaagctgaatccagagacagg

SEQ ID NO: 6965642 - DNA, 22 bp, Homo sapiens
ctgctcagtcatgttggattgt

SEQ ID NO: 6965643 - DNA, 22 bp, Homo sapiens
agagatcccttctgcctgggga

SEQ ID NO: 6965644 - DNA, 22 bp, Homo sapiens
acacatgcataagccttccctt

SEQ ID NO: 6965645 - DNA, 22 bp, Homo sapiens
tgctgtctttttcccttcctaa

SEQ ID NO: 6965646 - DNA, 22 bp, Homo sapiens
tgacaggctaggaggctgaagg

SEQ ID NO: 6965647 - DNA, 22 bp, Homo sapiens
aagaaaagaaacctgaggcttt

SEQ ID NO: 6965648 - DNA, 22 bp, Homo sapiens
agaagtccccccagcatcgtag

SEQ ID NO: 6965649 - DNA, 22 bp, Homo sapiens
tggcagagttggaggtggaaga

SEQ ID NO: 6965650 - DNA, 20 bp, Homo sapiens
cccaggagtttgctcttact

SEQ ID NO: 6965651 - DNA, 22 bp, Homo sapiens
agctgcagaaaggacaactaat

SEQ ID NO: 6965652 - DNA, 22 bp, Homo sapiens
cttggattccgtgaacttaacc

SEQ ID NO: 6965653 - DNA, 22 bp, Homo sapiens
ttgctaataaagtttttatgtg

SEQ ID NO: 6965654 - DNA, 22 bp, Homo sapiens
tggtatttcagcttttgtatct

SEQ ID NO: 6965655 - DNA, 22 bp, Homo sapiens
cagggctggtttgtcgaagaaa

SEQ ID NO: 6965656 - DNA, 22 bp, Homo sapiens
cagatggctgccttcttgctgt

SEQ ID NO: 6965657 - DNA, 22 bp, Homo sapiens
ccagcagctttgcatacactaa

SEQ ID NO: 6965658 - DNA, 22 bp, Homo sapiens
taatgtaaagaagatgtaggaa

SEQ ID NO: 6965659 - DNA, 22 bp, Homo sapiens
cacgtgcaggtcttaggagaca

SEQ ID NO: 6965660 - DNA, 22 bp, Homo sapiens
ttggcttcctgcacttgagttt

SEQ ID NO: 6965661 - DNA, 22 bp, Homo sapiens
tggctcagccagccctaggaac

SEQ ID NO: 6965662 - DNA, 21 bp, Homo sapiens
agacttccatcctgagagagg

SEQ ID NO: 6965663 - DNA, 22 bp, Homo sapiens
gggaagcagacggcggggaaat

SEQ ID NO: 6965664 - DNA, 22 bp, Homo sapiens
agcccggagccagtgcacctac

SEQ ID NO: 6965665 - DNA, 22 bp, Homo sapiens
aagctctttaatagtctaaaaa

SEQ ID NO: 6965666 - DNA, 22 bp, Homo sapiens
tcctgtgctttggatgcttaga

SEQ ID NO: 6965667 - DNA, 22 bp, Homo sapiens
aatgttgtaaatattctttgag

SEQ ID NO: 6965668 - DNA, 22 bp, Homo sapiens
tagaatcagaagatttgactgt

SEQ ID NO: 6965669 - DNA, 22 bp, Homo sapiens
tgtgagcagctctgtggactca

SEQ ID NO: 6965670 - DNA, 22 bp, Homo sapiens
taaaaagttgaaaggacttatc

SEQ ID NO: 6965671 - DNA, 22 bp, Homo sapiens
aggaatggttatggggatagta

SEQ ID NO: 6965672 - DNA, 22 bp, Homo sapiens
gccagaggctcaggttgccatg

SEQ ID NO: 6965673 - DNA, 22 bp, Homo sapiens
tctcattcataccctacatgct

SEQ ID NO: 6965674 - DNA, 22 bp, Homo sapiens
ggatacaaggtgttctatcact

SEQ ID NO: 6965675 - DNA, 22 bp, Homo sapiens
tgctgaggaatttggtttatgt

SEQ ID NO: 6965676 - DNA, 22 bp, Homo sapiens
tgcagctgctcattctctcagt

SEQ ID NO: 6965677 - DNA, 22 bp, Homo sapiens
caaaagatacttgcatctaact

SEQ ID NO: 6965678 - DNA, 22 bp, Homo sapiens
gctgtggggagagaacacacaa

SEQ ID NO: 6965679 - DNA, 22 bp, Homo sapiens
gggaaggcagtgggaggaactg

SEQ ID NO: 6965680 - DNA, 22 bp, Homo sapiens
ttagcattctgcctcctatatc

SEQ ID NO: 6965681 - DNA, 19 bp, Homo sapiens
ccctggaggagtgttggct

SEQ ID NO: 6965682 - DNA, 22 bp, Homo sapiens
taactgaagctggaagcgctgg

SEQ ID NO: 6965683 - DNA, 22 bp, Homo sapiens
tccaagtataaattagatactg

SEQ ID NO: 6965684 - DNA, 22 bp, Homo sapiens
atctccaggattttcacactca

SEQ ID NO: 6965685 - DNA, 22 bp, Homo sapiens
ttttgtgagctgagaaatgtat

SEQ ID NO: 6965686 - DNA, 22 bp, Homo sapiens
aggccagcgctgctagctcccg

SEQ ID NO: 6965687 - DNA, 22 bp, Homo sapiens
ttggatgaagtctagctttagt

SEQ ID NO: 6965688 - DNA, 22 bp, Homo sapiens
cttagcttcactgggtctcagt

SEQ ID NO: 6965689 - DNA, 22 bp, Homo sapiens
tgcccacctaacagtgtttgga

SEQ ID NO: 6965690 - DNA, 23 bp, Homo sapiens
agcacagactagaaaggtctttc

SEQ ID NO: 6965691 - DNA, 22 bp, Homo sapiens
atactgatacggaagaaaaaag

SEQ ID NO: 6965692 - DNA, 22 bp, Homo sapiens
ctgaggctcaagggcaggtggg

SEQ ID NO: 6965693 - DNA, 22 bp, Homo sapiens
agtaacaggtgtacagactatc

SEQ ID NO: 6965694 - DNA, 22 bp, Homo sapiens
gacccatataggaccctccaaa

SEQ ID NO: 6965695 - DNA, 22 bp, Homo sapiens
cctctgggcggagatctgctgc

SEQ ID NO: 6965696 - DNA, 22 bp, Homo sapiens
ggccagaggccatcctcctgct

SEQ ID NO: 6965697 - DNA, 19 bp, Homo sapiens
caattctgcaacactgtcc

SEQ ID NO: 6965698 - DNA, 22 bp, Homo sapiens
gttacattaaaaacattcactg

SEQ ID NO: 6965699 - DNA, 22 bp, Homo sapiens
agggaataggagatttgaattg

SEQ ID NO: 6965700 - DNA, 22 bp, Homo sapiens
ctgcctctggttttggtccctg

SEQ ID NO: 6965701 - DNA, 22 bp, Homo sapiens
tataggaccgacttgtttatag

SEQ ID NO: 6965702 - DNA, 22 bp, Homo sapiens
ctgcttatggaattgtatactg

SEQ ID NO: 6965703 - DNA, 22 bp, Homo sapiens
ccttcctttgcaggtcaggtca

SEQ ID NO: 6965704 - DNA, 22 bp, Homo sapiens
aatggactcataaacagagtga

SEQ ID NO: 6965705 - DNA, 22 bp, Homo sapiens
gttcagtattaatgagatgatt

SEQ ID NO: 6965706 - DNA, 22 bp, Homo sapiens
tatgtgctgaagtctttacacc

SEQ ID NO: 6965707 - DNA, 22 bp, Homo sapiens
actgtaaaagaaggtctttgca

SEQ ID NO: 6965708 - DNA, 22 bp, Homo sapiens
tagctggcttatataaaagggc

SEQ ID NO: 6965709 - DNA, 22 bp, Homo sapiens
gagagctttcccattttgctta

SEQ ID NO: 6965710 - DNA, 21 bp, Homo sapiens
ctgaggcagcacagctagtca

SEQ ID NO: 6965711 - DNA, 22 bp, Homo sapiens
cctggattataggccctctgaa

SEQ ID NO: 6965712 - DNA, 22 bp, Homo sapiens
ttgagtactggctgtgtgccag

SEQ ID NO: 6965713 - DNA, 22 bp, Homo sapiens
taacatgagagctaagacatta

SEQ ID NO: 6965714 - DNA, 22 bp, Homo sapiens
gaatgacccactatcaagagac

SEQ ID NO: 6965715 - DNA, 22 bp, Homo sapiens
catttcatagttgtcacaataa

SEQ ID NO: 6965716 - DNA, 20 bp, Homo sapiens
aggcatgggatgcccagatt

SEQ ID NO: 6965717 - DNA, 22 bp, Homo sapiens
gctgaagcagatccaggtgtgg

SEQ ID NO: 6965718 - DNA, 22 bp, Homo sapiens
ctgggtgagctggccagagggt

SEQ ID NO: 6965719 - DNA, 22 bp, Homo sapiens
aaattggattgggagaatgtga

SEQ ID NO: 6965720 - DNA, 22 bp, Homo sapiens
ttgaagtcctaatctccaggac

SEQ ID NO: 6965721 - DNA, 22 bp, Homo sapiens
ggcttgtaggtgatggagaact

SEQ ID NO: 6965722 - DNA, 22 bp, Homo sapiens
aggatttaaatccttaaccact

SEQ ID NO: 6965723 - DNA, 22 bp, Homo sapiens
tgtgcatgcatatgtatttttg

SEQ ID NO: 6965724 - DNA, 22 bp, Homo sapiens
tggctgagagtcatcctgtgtg

SEQ ID NO: 6965725 - DNA, 22 bp, Homo sapiens
ggtctggaccctcctggagtgg

SEQ ID NO: 6965726 - DNA, 22 bp, Homo sapiens
agcaagcacacttcatgtgaac

SEQ ID NO: 6965727 - DNA, 22 bp, Homo sapiens
ccacaggtacggattgaggacc

SEQ ID NO: 6965728 - DNA, 22 bp, Homo sapiens
attctccttattctgaaaaaag

SEQ ID NO: 6965729 - DNA, 22 bp, Homo sapiens
ttccttggaagggtaattgcaa

SEQ ID NO: 6965730 - DNA, 22 bp, Homo sapiens
cagcaggctggacttcagtccc

SEQ ID NO: 6965731 - DNA, 22 bp, Homo sapiens
ttattcaccatttattatgtga

SEQ ID NO: 6965732 - DNA, 22 bp, Homo sapiens
agaaatgacacacatgagacat

SEQ ID NO: 6965733 - DNA, 22 bp, Homo sapiens
tgtctccatggtgaagcagggt

SEQ ID NO: 6965734 - DNA, 22 bp, Homo sapiens
aatctgttgtcaggaatccaca

SEQ ID NO: 6965735 - DNA, 20 bp, Homo sapiens
agtacctctctccattgagg

SEQ ID NO: 6965736 - DNA, 22 bp, Homo sapiens
gggcaggtggagggcccagcca

SEQ ID NO: 6965737 - DNA, 22 bp, Homo sapiens
ttggtgcaaattcctgtaagag

SEQ ID NO: 6965738 - DNA, 22 bp, Homo sapiens
tccaggccccagaccgtactgc

SEQ ID NO: 6965739 - DNA, 22 bp, Homo sapiens
tacccagtgccaccctctgagg

SEQ ID NO: 6965740 - DNA, 22 bp, Homo sapiens
gggaaactttcacaatgtccag

SEQ ID NO: 6965741 - DNA, 22 bp, Homo sapiens
gtgcaaaagtaattgcagtttt

SEQ ID NO: 6965742 - DNA, 22 bp, Homo sapiens
cacagagttgaatattgacatt

SEQ ID NO: 6965743 - DNA, 22 bp, Homo sapiens
actgcactccagcctgggacac

SEQ ID NO: 6965744 - DNA, 22 bp, Homo sapiens
tccagccacgtattatctcact

SEQ ID NO: 6965745 - DNA, 21 bp, Homo sapiens
agagagaaggccatatggtcc

SEQ ID NO: 6965746 - DNA, 22 bp, Homo sapiens
tttgtttgccacacaaaacagt

SEQ ID NO: 6965747 - DNA, 22 bp, Homo sapiens
ggtgacagtggttaaaatttgt

SEQ ID NO: 6965748 - DNA, 22 bp, Homo sapiens
agtgatttgaggattattgctc

SEQ ID NO: 6965749 - DNA, 22 bp, Homo sapiens
caggacatcgtcatcatgggga

SEQ ID NO: 6965750 - DNA, 22 bp, Homo sapiens
tgagtccaccttagtatatggg

SEQ ID NO: 6965751 - DNA, 22 bp, Homo sapiens
agtgtttcaagtgatgctttgg

SEQ ID NO: 6965752 - DNA, 22 bp, Homo sapiens
agtgccattcaagttttaaggg

SEQ ID NO: 6965753 - DNA, 22 bp, Homo sapiens
agtacacagtatatggtgagat

SEQ ID NO: 6965754 - DNA, 22 bp, Homo sapiens
tttcaagtggcgagataaggaa

SEQ ID NO: 6965755 - DNA, 22 bp, Homo sapiens
tagaagtctctcaagaaacata

SEQ ID NO: 6965756 - DNA, 22 bp, Homo sapiens
gggacacagagaaactggagaa

SEQ ID NO: 6965757 - DNA, 22 bp, Homo sapiens
acattcaggccacagtggagtc

SEQ ID NO: 6965758 - DNA, 22 bp, Homo sapiens
tttgtataagaacattctagca

SEQ ID NO: 6965759 - DNA, 18 bp, Homo sapiens
gagtagcattgaggaaac

SEQ ID NO: 6965760 - DNA, 22 bp, Homo sapiens
aggtgcactgtctaattaggtc

SEQ ID NO: 6965761 - DNA, 22 bp, Homo sapiens
ggtccctgccctaaaactcgtc

SEQ ID NO: 6965762 - DNA, 22 bp, Homo sapiens
caggccaggtggcaggcaaaac

SEQ ID NO: 6965763 - DNA, 22 bp, Homo sapiens
agcagggcctgagtgacctaac

SEQ ID NO: 6965764 - DNA, 22 bp, Homo sapiens
catttgtcatcactgagctgcc

SEQ ID NO: 6965765 - DNA, 22 bp, Homo sapiens
tagaagaaaagcacttagagat

SEQ ID NO: 6965766 - DNA, 22 bp, Homo sapiens
tagatgtaagaggtttcttaca

SEQ ID NO: 6965767 - DNA, 20 bp, Homo sapiens
gtatatccattcatgcctct

SEQ ID NO: 6965768 - DNA, 22 bp, Homo sapiens
tcccctctctgcgctcccaggt

SEQ ID NO: 6965769 - DNA, 22 bp, Homo sapiens
catcacccggaactgtgtctgc

SEQ ID NO: 6965770 - DNA, 23 bp, Homo sapiens
gaatacaaagcagatggtccagc

SEQ ID NO: 6965771 - DNA, 22 bp, Homo sapiens
cgccggcttgaggcaggcggca

SEQ ID NO: 6965772 - DNA, 22 bp, Homo sapiens
tcacatcaacattatagcatga

SEQ ID NO: 6965773 - DNA, 22 bp, Homo sapiens
gctctgaagggtgagctgttcg

SEQ ID NO: 6965774 - DNA, 23 bp, Homo sapiens
tttgaatgggtctatttttctta

SEQ ID NO: 6965775 - DNA, 22 bp, Homo sapiens
cagacaaccaggtctttcagtt

SEQ ID NO: 6965776 - DNA, 22 bp, Homo sapiens
ctgttacttcaatcttctcccg

SEQ ID NO: 6965777 - DNA, 22 bp, Homo sapiens
tctgtctgaggagtttttgacc

SEQ ID NO: 6965778 - DNA, 22 bp, Homo sapiens
ttctgagatgaggaggaaaaag

SEQ ID NO: 6965779 - DNA, 22 bp, Homo sapiens
aatacgtcccatcatctttttc

SEQ ID NO: 6965780 - DNA, 22 bp, Homo sapiens
taactcactccaaaaaggcatt

SEQ ID NO: 6965781 - DNA, 22 bp, Homo sapiens
ctcttagatatggagaattacc

SEQ ID NO: 6965782 - DNA, 22 bp, Homo sapiens
caaggcttatcagccaggagcc

SEQ ID NO: 6965783 - DNA, 22 bp, Homo sapiens
atcacagtttacaaacctgctg

SEQ ID NO: 6965784 - DNA, 22 bp, Homo sapiens
cgcgggggtcctcaggcaggcg

SEQ ID NO: 6965785 - DNA, 22 bp, Homo sapiens
aggcacttaataaggattcaat

SEQ ID NO: 6965786 - DNA, 22 bp, Homo sapiens
accctttagaaggcatctcagt

SEQ ID NO: 6965787 - DNA, 22 bp, Homo sapiens
acaggcctagctaatgctttcc

SEQ ID NO: 6965788 - DNA, 22 bp, Homo sapiens
gacagacatgggacttcatact

SEQ ID NO: 6965789 - DNA, 22 bp, Homo sapiens
tggtggcatcagtgaagtacac

SEQ ID NO: 6965790 - DNA, 22 bp, Homo sapiens
ccagctattgctgtgtaacagt

SEQ ID NO: 6965791 - DNA, 19 bp, Homo sapiens
aagggcctctgctgtcttc

SEQ ID NO: 6965792 - DNA, 21 bp, Homo sapiens
aagcaattaccttcccatgtg

SEQ ID NO: 6965793 - DNA, 22 bp, Homo sapiens
tgggcctacgtgacagaaacat

SEQ ID NO: 6965794 - DNA, 22 bp, Homo sapiens
agttccatgtctgggtttgtga

SEQ ID NO: 6965795 - DNA, 22 bp, Homo sapiens
actgctgagagcaatcccaaac

SEQ ID NO: 6965796 - DNA, 22 bp, Homo sapiens
ttgtgcccagaagaaagtgatt

SEQ ID NO: 6965797 - DNA, 22 bp, Homo sapiens
tttcttttacagtgtggctatt

SEQ ID NO: 6965798 - DNA, 22 bp, Homo sapiens
aggaggcttttgcaggtgccac

SEQ ID NO: 6965799 - DNA, 22 bp, Homo sapiens
ttgctgcctttgtactctgatg

SEQ ID NO: 6965800 - DNA, 22 bp, Homo sapiens
gggccagctctgtgatgtaggg

SEQ ID NO: 6965801 - DNA, 21 bp, Homo sapiens
agacagctttaaagacacagg

SEQ ID NO: 6965802 - DNA, 22 bp, Homo sapiens
ttttggctcttggtaggtcaga

SEQ ID NO: 6965803 - DNA, 22 bp, Homo sapiens
cagaggcagaccctccagggcg

SEQ ID NO: 6965804 - DNA, 22 bp, Homo sapiens
ggctgtggacactgagctcaga

SEQ ID NO: 6965805 - DNA, 22 bp, Homo sapiens
cacagctatgagcagcctagct

SEQ ID NO: 6965806 - DNA, 22 bp, Homo sapiens
ttcgactctgtgcctgaagagc

SEQ ID NO: 6965807 - DNA, 22 bp, Homo sapiens
tgtcacatgaaacttgctcatc

SEQ ID NO: 6965808 - DNA, 22 bp, Homo sapiens
tttagcagctggtgttaccata

SEQ ID NO: 6965809 - DNA, 22 bp, Homo sapiens
tagacactttagaagtaagggt

SEQ ID NO: 6965810 - DNA, 22 bp, Homo sapiens
gcaggcagagaggggtttccag

SEQ ID NO: 6965811 - DNA, 22 bp, Homo sapiens
agtgtctggtgagggctctctc

SEQ ID NO: 6965812 - DNA, 22 bp, Homo sapiens
gggggaagactgggctagtgat

SEQ ID NO: 6965813 - DNA, 22 bp, Homo sapiens
atgattgaaaatgacattgcca

SEQ ID NO: 6965814 - DNA, 22 bp, Homo sapiens
ttaaggaaggcacagcagttga

SEQ ID NO: 6965815 - DNA, 22 bp, Homo sapiens
aagattgtcaggcttgctgtat

SEQ ID NO: 6965816 - DNA, 22 bp, Homo sapiens
tacatacatattcatacaggtg

SEQ ID NO: 6965817 - DNA, 21 bp, Homo sapiens
taacagcagggaaatacgtgc

SEQ ID NO: 6965818 - DNA, 22 bp, Homo sapiens
agttttatgttcacagaaggat

SEQ ID NO: 6965819 - DNA, 22 bp, Homo sapiens
aggcttttggagaagcatatgc

SEQ ID NO: 6965820 - DNA, 22 bp, Homo sapiens
atgaaatgtgaatgcttttcat

SEQ ID NO: 6965821 - DNA, 23 bp, Homo sapiens
ttagacaatcctcaaaaggtaat

SEQ ID NO: 6965822 - DNA, 22 bp, Homo sapiens
ggctggcatttacacaatgcat

SEQ ID NO: 6965823 - DNA, 22 bp, Homo sapiens
tccaggagtcctgggtggcccc

SEQ ID NO: 6965824 - DNA, 20 bp, Homo sapiens
gcacagagatgagcaaagta

SEQ ID NO: 6965825 - DNA, 22 bp, Homo sapiens
tttggtccttcatacttccttt

SEQ ID NO: 6965826 - DNA, 22 bp, Homo sapiens
tgatacaatcatgagagaggac

SEQ ID NO: 6965827 - DNA, 22 bp, Homo sapiens
tcaggaaagagttagatgatta

SEQ ID NO: 6965828 - DNA, 18 bp, Homo sapiens
aggaaagaaaggcaggtg

SEQ ID NO: 6965829 - DNA, 22 bp, Homo sapiens
ttctcacgttattggctgagag

SEQ ID NO: 6965830 - DNA, 22 bp, Homo sapiens
cctgaacagtctgaaaggagac

SEQ ID NO: 6965831 - DNA, 22 bp, Homo sapiens
cagatttatgcaaaaaggaaga

SEQ ID NO: 6965832 - DNA, 17 bp, Homo sapiens
acactgacatgccacac

SEQ ID NO: 6965833 - DNA, 22 bp, Homo sapiens
tcatacatgttgtgttcaaatg

SEQ ID NO: 6965834 - DNA, 22 bp, Homo sapiens
tcttcaagttccaaagtgcagg

SEQ ID NO: 6965835 - DNA, 22 bp, Homo sapiens
caggctaaggaaaggctcaggt

SEQ ID NO: 6965836 - DNA, 22 bp, Homo sapiens
gccccaggataaatttgtaaga

SEQ ID NO: 6965837 - DNA, 22 bp, Homo sapiens
tcatctgaggtttgaggcagtt

SEQ ID NO: 6965838 - DNA, 22 bp, Homo sapiens
ccctgctgtgtcccacctggaa

SEQ ID NO: 6965839 - DNA, 22 bp, Homo sapiens
tctgagaaggtgcatcagctgc

SEQ ID NO: 6965840 - DNA, 22 bp, Homo sapiens
gtcgtgcagacctcacagcatt

SEQ ID NO: 6965841 - DNA, 22 bp, Homo sapiens
catgggctgctgacaggggctc

SEQ ID NO: 6965842 - DNA, 19 bp, Homo sapiens
ttgagaacaccaagtactg

SEQ ID NO: 6965843 - DNA, 22 bp, Homo sapiens
cagtgctggaggggtgcttgca

SEQ ID NO: 6965844 - DNA, 22 bp, Homo sapiens
aacatgtcttactttgctttct

SEQ ID NO: 6965845 - DNA, 22 bp, Homo sapiens
ttatgtcatgtggtggtgaaga

SEQ ID NO: 6965846 - DNA, 22 bp, Homo sapiens
ctgctttggacaactattcttg

SEQ ID NO: 6965847 - DNA, 22 bp, Homo sapiens
ttgtacagggaagtaatacaag

SEQ ID NO: 6965848 - DNA, 22 bp, Homo sapiens
cagctgaatggctccctgctaa

SEQ ID NO: 6965849 - DNA, 22 bp, Homo sapiens
agataaacccaacttaatgaag

SEQ ID NO: 6965850 - DNA, 22 bp, Homo sapiens
cccattgtggttgttgaggata

SEQ ID NO: 6965851 - DNA, 22 bp, Homo sapiens
agagccagcaagtgaatagtga

SEQ ID NO: 6965852 - DNA, 22 bp, Homo sapiens
agctggcaaggcaatttggatt

SEQ ID NO: 6965853 - DNA, 22 bp, Homo sapiens
cttcagcatctttttcttgggg

SEQ ID NO: 6965854 - DNA, 22 bp, Homo sapiens
aaggactgtctaaggcctccaa

SEQ ID NO: 6965855 - DNA, 22 bp, Homo sapiens
tgcctggggattgctctgggcc

SEQ ID NO: 6965856 - DNA, 22 bp, Homo sapiens
ttcaatgagcccaagaacgtga

SEQ ID NO: 6965857 - DNA, 22 bp, Homo sapiens
gcctgtgtggatgcgccggtgc

SEQ ID NO: 6965858 - DNA, 19 bp, Homo sapiens
ggaaatgtggaaacatcct

SEQ ID NO: 6965859 - DNA, 23 bp, Homo sapiens
agctgcaagactccctgtctgag

SEQ ID NO: 6965860 - DNA, 22 bp, Homo sapiens
tctgacagttatataagcacca

SEQ ID NO: 6965861 - DNA, 22 bp, Homo sapiens
tgtctgaatctcggtttcctca

SEQ ID NO: 6965862 - DNA, 22 bp, Homo sapiens
gggtccaggtcttcaggcagag

SEQ ID NO: 6965863 - DNA, 22 bp, Homo sapiens
ttctggagagaaaccttacaaa

SEQ ID NO: 6965864 - DNA, 22 bp, Homo sapiens
tctcagggagcccagtacttac

SEQ ID NO: 6965865 - DNA, 23 bp, Homo sapiens
tgcagggtgttcctgcctttgct

SEQ ID NO: 6965866 - DNA, 22 bp, Homo sapiens
tcactataatatgtcaaaatac

SEQ ID NO: 6965867 - DNA, 22 bp, Homo sapiens
ggtggctcgtttttcttgaaag

SEQ ID NO: 6965868 - DNA, 22 bp, Homo sapiens
aagcacatttggaaaacatgga

SEQ ID NO: 6965869 - DNA, 22 bp, Homo sapiens
gatgtgcttagtacagatgtgt

SEQ ID NO: 6965870 - DNA, 22 bp, Homo sapiens
agtgtctgatgcacagttgtcc

SEQ ID NO: 6965871 - DNA, 22 bp, Homo sapiens
atagcaatcagtgtatttgaaa

SEQ ID NO: 6965872 - DNA, 22 bp, Homo sapiens
ccttgtttctctcccagataag

SEQ ID NO: 6965873 - DNA, 22 bp, Homo sapiens
aatgttaagtttagattataac

SEQ ID NO: 6965874 - DNA, 22 bp, Homo sapiens
caaaagtaatgtatgctcatcg

SEQ ID NO: 6965875 - DNA, 22 bp, Homo sapiens
ctgggcagtatgaatattcaaa

SEQ ID NO: 6965876 - DNA, 22 bp, Homo sapiens
aacaactgagcaggagtgacag

SEQ ID NO: 6965877 - DNA, 22 bp, Homo sapiens
tctgtgttttactccaattata

SEQ ID NO: 6965878 - DNA, 22 bp, Homo sapiens
tagctgtgcccgccacccaacg

SEQ ID NO: 6965879 - DNA, 22 bp, Homo sapiens
tcaagcaagttgcatattgcta

SEQ ID NO: 6965880 - DNA, 22 bp, Homo sapiens
atgtgtacacacatatatgtat

SEQ ID NO: 6965881 - DNA, 21 bp, Homo sapiens
ggtgtccagaggagtccccag

SEQ ID NO: 6965882 - DNA, 22 bp, Homo sapiens
attcttacaaagcagagtctgt

SEQ ID NO: 6965883 - DNA, 22 bp, Homo sapiens
ttccaaggctgctatttgtttc

SEQ ID NO: 6965884 - DNA, 22 bp, Homo sapiens
tgcttgttcatggcctagtggc

SEQ ID NO: 6965885 - DNA, 22 bp, Homo sapiens
gcagagcaggaaggaagtcagg

SEQ ID NO: 6965886 - DNA, 22 bp, Homo sapiens
tgcatgtgcccactctggctta

SEQ ID NO: 6965887 - DNA, 22 bp, Homo sapiens
tagcctatagtttctgctaaga

SEQ ID NO: 6965888 - DNA, 22 bp, Homo sapiens
gagtgcagttggggtgagggga

SEQ ID NO: 6965889 - DNA, 22 bp, Homo sapiens
gaggtctggaccaagtcgcccc

SEQ ID NO: 6965890 - DNA, 21 bp, Homo sapiens
tggaccaaagtaatttgcctt

SEQ ID NO: 6965891 - DNA, 22 bp, Homo sapiens
gacttggggatttatctcacag

SEQ ID NO: 6965892 - DNA, 22 bp, Homo sapiens
tctccctcattcctgcttccat

SEQ ID NO: 6965893 - DNA, 22 bp, Homo sapiens
ccttgggaggctcccagggaga

SEQ ID NO: 6965894 - DNA, 22 bp, Homo sapiens
gggccttgatcccctatatggc

SEQ ID NO: 6965895 - DNA, 22 bp, Homo sapiens
ggaggggagtctcccaaagccg

SEQ ID NO: 6965896 - DNA, 22 bp, Homo sapiens
gcatacagagaggatgtggcat

SEQ ID NO: 6965897 - DNA, 22 bp, Homo sapiens
cagctccagctctgggcgcctc

SEQ ID NO: 6965898 - DNA, 22 bp, Homo sapiens
gcagctcagtaaaagaggagca

SEQ ID NO: 6965899 - DNA, 22 bp, Homo sapiens
cactggtgacttctgagctgga

SEQ ID NO: 6965900 - DNA, 22 bp, Homo sapiens
gcccaggaagccaccgggaagt

SEQ ID NO: 6965901 - DNA, 22 bp, Homo sapiens
ctctgctcagatgatttatcaa

SEQ ID NO: 6965902 - DNA, 23 bp, Homo sapiens
actataaagttgttctgatttac

SEQ ID NO: 6965903 - DNA, 22 bp, Homo sapiens
atatacttttcactaatggcta

SEQ ID NO: 6965904 - DNA, 22 bp, Homo sapiens
atgggctgacaagacatgcata

SEQ ID NO: 6965905 - DNA, 23 bp, Homo sapiens
gagctgagtgtagggagactagg

SEQ ID NO: 6965906 - DNA, 22 bp, Homo sapiens
agattgatagatgtttctaaaa

SEQ ID NO: 6965907 - DNA, 22 bp, Homo sapiens
gcagaagaccatggtggaaaga

SEQ ID NO: 6965908 - DNA, 22 bp, Homo sapiens
agtcacttctattctattaagt

SEQ ID NO: 6965909 - DNA, 22 bp, Homo sapiens
tgacctttcaacccttcttggc

SEQ ID NO: 6965910 - DNA, 22 bp, Homo sapiens
ttatcgtacgcttcagaaattt

SEQ ID NO: 6965911 - DNA, 22 bp, Homo sapiens
gactctggcctcatccctgagg

SEQ ID NO: 6965912 - DNA, 22 bp, Homo sapiens
atgcagtctaagcatgtaaggg

SEQ ID NO: 6965913 - DNA, 22 bp, Homo sapiens
cagtttatatgagggtatcaag

SEQ ID NO: 6965914 - DNA, 22 bp, Homo sapiens
cagagctggtgttacaagtcca

SEQ ID NO: 6965915 - DNA, 22 bp, Homo sapiens
caggtgggtacatcacagagac

SEQ ID NO: 6965916 - DNA, 22 bp, Homo sapiens
agccacccattcccgagcccta

SEQ ID NO: 6965917 - DNA, 21 bp, Homo sapiens
atcagaatctctagatttgga

SEQ ID NO: 6965918 - DNA, 20 bp, Homo sapiens
acttattctgaggacagtac

SEQ ID NO: 6965919 - DNA, 22 bp, Homo sapiens
aagtgcttggagcatacctgtt

SEQ ID NO: 6965920 - DNA, 22 bp, Homo sapiens
ctctggctttgctcatgcatcc

SEQ ID NO: 6965921 - DNA, 22 bp, Homo sapiens
atctttagacaggaagcaatca

SEQ ID NO: 6965922 - DNA, 22 bp, Homo sapiens
actgagaagtcaggttctcttc

SEQ ID NO: 6965923 - DNA, 22 bp, Homo sapiens
agtacatatagtaatttagcca

SEQ ID NO: 6965924 - DNA, 22 bp, Homo sapiens
ttactgaaggtggatagtgagt

SEQ ID NO: 6965925 - DNA, 23 bp, Homo sapiens
tgtgtatgtatctatgcataggt

SEQ ID NO: 6965926 - DNA, 22 bp, Homo sapiens
ctgagaggtgacagcgtgctgg

SEQ ID NO: 6965927 - DNA, 22 bp, Homo sapiens
ctgtggtgggccctgggcttca

SEQ ID NO: 6965928 - DNA, 22 bp, Homo sapiens
tgacaggttgtgtaggtggcca

SEQ ID NO: 6965929 - DNA, 22 bp, Homo sapiens
tacatgtctgggttttgtttcc

SEQ ID NO: 6965930 - DNA, 22 bp, Homo sapiens
agtccaaatcttgtttcatatc

SEQ ID NO: 6965931 - DNA, 22 bp, Homo sapiens
attatcaagtttactgtgtgga

SEQ ID NO: 6965932 - DNA, 22 bp, Homo sapiens
gtattagactgagaaatggagt

SEQ ID NO: 6965933 - DNA, 22 bp, Homo sapiens
agaagtgtcagtgcaggcagct

SEQ ID NO: 6965934 - DNA, 22 bp, Homo sapiens
aaagagcaagggctttgaggct

SEQ ID NO: 6965935 - DNA, 22 bp, Homo sapiens
aattctgaaagattccttattc

SEQ ID NO: 6965936 - DNA, 22 bp, Homo sapiens
acaggacaaaaatctggatggc

SEQ ID NO: 6965937 - DNA, 22 bp, Homo sapiens
accagctgttatctgtagtatc

SEQ ID NO: 6965938 - DNA, 22 bp, Homo sapiens
tggctaaggtcgatagaggctt

SEQ ID NO: 6965939 - DNA, 22 bp, Homo sapiens
gtttccagctttctgatgcttg

SEQ ID NO: 6965940 - DNA, 18 bp, Homo sapiens
acacaggttattctctcc

SEQ ID NO: 6965941 - DNA, 22 bp, Homo sapiens
ttctctaaggtcccgttctgga

SEQ ID NO: 6965942 - DNA, 22 bp, Homo sapiens
aaacttgatttagaactaaggc

SEQ ID NO: 6965943 - DNA, 22 bp, Homo sapiens
actctctctgatggaactttag

SEQ ID NO: 6965944 - DNA, 22 bp, Homo sapiens
aatacagaggggtcacaattca

SEQ ID NO: 6965945 - DNA, 22 bp, Homo sapiens
acgcttctggttctggctttag

SEQ ID NO: 6965946 - DNA, 22 bp, Homo sapiens
agttcagaggcaggagaaggct

SEQ ID NO: 6965947 - DNA, 22 bp, Homo sapiens
acaaaggcaggattgacttagt

SEQ ID NO: 6965948 - DNA, 22 bp, Homo sapiens
aaacggaccttcctaagtgcaa

SEQ ID NO: 6965949 - DNA, 22 bp, Homo sapiens
caattattcagtgacttaagag

SEQ ID NO: 6965950 - DNA, 22 bp, Homo sapiens
agagccaggaagtggcgtgggg

SEQ ID NO: 6965951 - DNA, 22 bp, Homo sapiens
gcccccaggtgacttatccaca

SEQ ID NO: 6965952 - DNA, 22 bp, Homo sapiens
gcttgcatcatcttgagagtcc

SEQ ID NO: 6965953 - DNA, 22 bp, Homo sapiens
aagtaggtaccgcgcagcaggg

SEQ ID NO: 6965954 - DNA, 22 bp, Homo sapiens
aagtccaggtccaggaggttcc

SEQ ID NO: 6965955 - DNA, 22 bp, Homo sapiens
agtcccccgtcctgcttgtcta

SEQ ID NO: 6965956 - DNA, 18 bp, Homo sapiens
gcttggtttccacaaacc

SEQ ID NO: 6965957 - DNA, 22 bp, Homo sapiens
tggtaaattatttttatatccc

SEQ ID NO: 6965958 - DNA, 22 bp, Homo sapiens
tcacagtagttgttctctgttt

SEQ ID NO: 6965959 - DNA, 22 bp, Homo sapiens
gtcattgagtcgtcagagtctt

SEQ ID NO: 6965960 - DNA, 23 bp, Homo sapiens
tgctgggtaaatagctgagtaac

SEQ ID NO: 6965961 - DNA, 22 bp, Homo sapiens
tctggcttgctggcttggtccc

SEQ ID NO: 6965962 - DNA, 23 bp, Homo sapiens
tccagcagccaagaagggtagaa

SEQ ID NO: 6965963 - DNA, 22 bp, Homo sapiens
ggccctgtcctggctgtctccg

SEQ ID NO: 6965964 - DNA, 22 bp, Homo sapiens
tctgttagagaatcagtgaggt

SEQ ID NO: 6965965 - DNA, 22 bp, Homo sapiens
acacacttcagatgtaatttgt

SEQ ID NO: 6965966 - DNA, 22 bp, Homo sapiens
aaggcaattgcagtttttgcca

SEQ ID NO: 6965967 - DNA, 22 bp, Homo sapiens
tgaatagagctgcagtggacat

SEQ ID NO: 6965968 - DNA, 22 bp, Homo sapiens
atgatctcattctttcaaaggg

SEQ ID NO: 6965969 - DNA, 22 bp, Homo sapiens
aggcaagctgcagagagtcctt

SEQ ID NO: 6965970 - DNA, 22 bp, Homo sapiens
ctgggagtcaccaggagcaagg

SEQ ID NO: 6965971 - DNA, 22 bp, Homo sapiens
tattttctggacagtcttgctt

SEQ ID NO: 6965972 - DNA, 22 bp, Homo sapiens
gcagtatatggattttaaacat

SEQ ID NO: 6965973 - DNA, 22 bp, Homo sapiens
ttaaggcacagagaggttaagt

SEQ ID NO: 6965974 - DNA, 22 bp, Homo sapiens
gagaaaggtactattccctcca

SEQ ID NO: 6965975 - DNA, 22 bp, Homo sapiens
ttcaacatcattgtaagcctct

SEQ ID NO: 6965976 - DNA, 22 bp, Homo sapiens
tccaggtctggttggacaggtt

SEQ ID NO: 6965977 - DNA, 22 bp, Homo sapiens
aggtccctgcaaagctattcag

SEQ ID NO: 6965978 - DNA, 22 bp, Homo sapiens
caggaatgaaaggtcagggttg

SEQ ID NO: 6965979 - DNA, 22 bp, Homo sapiens
tgctttgctctgtctctagcta

SEQ ID NO: 6965980 - DNA, 20 bp, Homo sapiens
gcacagtagcagtgcaaatg

SEQ ID NO: 6965981 - DNA, 22 bp, Homo sapiens
gccagccacttcagctatggct

SEQ ID NO: 6965982 - DNA, 22 bp, Homo sapiens
tctctgtgggtttcaccagcgc

SEQ ID NO: 6965983 - DNA, 22 bp, Homo sapiens
tcagtgcattgttcattgtagg

SEQ ID NO: 6965984 - DNA, 22 bp, Homo sapiens
ttaagcagaaaatttgagcact

SEQ ID NO: 6965985 - DNA, 22 bp, Homo sapiens
aagtgtgtattgtttatgctgc

SEQ ID NO: 6965986 - DNA, 22 bp, Homo sapiens
cctgcctcatcaacttgtcgtg

SEQ ID NO: 6965987 - DNA, 22 bp, Homo sapiens
gcatggctggtgtcctgaggga

SEQ ID NO: 6965988 - DNA, 22 bp, Homo sapiens
gctgctctgtgacagcctccgg

SEQ ID NO: 6965989 - DNA, 22 bp, Homo sapiens
tgaggtcatggctgatatttcc

SEQ ID NO: 6965990 - DNA, 22 bp, Homo sapiens
ccaggtgtgtacagaacagcac

SEQ ID NO: 6965991 - DNA, 22 bp, Homo sapiens
tagatggaggctagatgcaggg

SEQ ID NO: 6965992 - DNA, 22 bp, Homo sapiens
atactgtgtgtgctcaaggaat

SEQ ID NO: 6965993 - DNA, 17 bp, Homo sapiens
gaatccttctctgttct

SEQ ID NO: 6965994 - DNA, 22 bp, Homo sapiens
tctcagagatgttagggaagag

SEQ ID NO: 6965995 - DNA, 22 bp, Homo sapiens
acctcagagggatgttacaggc

SEQ ID NO: 6965996 - DNA, 20 bp, Homo sapiens
gatgggtattgaagtcacct

SEQ ID NO: 6965997 - DNA, 22 bp, Homo sapiens
ctcacaggagaaagtcatggtc

SEQ ID NO: 6965998 - DNA, 22 bp, Homo sapiens
ttgggcacggacaggtggggat

SEQ ID NO: 6965999 - DNA, 22 bp, Homo sapiens
cagcatactgcatcaaatgagg

SEQ ID NO: 6966000 - DNA, 22 bp, Homo sapiens
gcccagggcttcaaagagagaa

SEQ ID NO: 6966001 - DNA, 19 bp, Homo sapiens
gaaggcttttggtatgttt

SEQ ID NO: 6966002 - DNA, 22 bp, Homo sapiens
accatagactggaggatctcct

SEQ ID NO: 6966003 - DNA, 20 bp, Homo sapiens
tcacagagtagccttgtctg

SEQ ID NO: 6966004 - DNA, 22 bp, Homo sapiens
agtggcagccgagcaggagatg

SEQ ID NO: 6966005 - DNA, 22 bp, Homo sapiens
taaaggcagccactgagctcaa

SEQ ID NO: 6966006 - DNA, 22 bp, Homo sapiens
aagctggcctgtacctgctgag

SEQ ID NO: 6966007 - DNA, 22 bp, Homo sapiens
aggaccctgagcgggcatgccg

SEQ ID NO: 6966008 - DNA, 22 bp, Homo sapiens
ctattacaatctgctactatga

SEQ ID NO: 6966009 - DNA, 22 bp, Homo sapiens
atatgtattgagtgccaactgt

SEQ ID NO: 6966010 - DNA, 22 bp, Homo sapiens
gtgctttttcaatcagaaggga

SEQ ID NO: 6966011 - DNA, 22 bp, Homo sapiens
tacaaatgaccatagccactta

SEQ ID NO: 6966012 - DNA, 22 bp, Homo sapiens
ccctggcctacaggcccagaga

SEQ ID NO: 6966013 - DNA, 22 bp, Homo sapiens
cctcaggcttgtgagccttcag

SEQ ID NO: 6966014 - DNA, 22 bp, Homo sapiens
tatttacctagagccctctatc

SEQ ID NO: 6966015 - DNA, 22 bp, Homo sapiens
ctgggaagaagtgggctacatt

SEQ ID NO: 6966016 - DNA, 22 bp, Homo sapiens
tttgtacaggtgcaggcatttg

SEQ ID NO: 6966017 - DNA, 22 bp, Homo sapiens
catcacaaatgtaataatgtct

SEQ ID NO: 6966018 - DNA, 22 bp, Homo sapiens
gtgtgggaaggctaggatgctg

SEQ ID NO: 6966019 - DNA, 22 bp, Homo sapiens
ctcagtcagtttttgtgagaga

SEQ ID NO: 6966020 - DNA, 22 bp, Homo sapiens
aatgttgatgttttcagtgagc

SEQ ID NO: 6966021 - DNA, 22 bp, Homo sapiens
catcattaccatcattagtagt

SEQ ID NO: 6966022 - DNA, 22 bp, Homo sapiens
acagttctcttgtcacttcctc

SEQ ID NO: 6966023 - DNA, 22 bp, Homo sapiens
aaagacacatatgcttaaccca

SEQ ID NO: 6966024 - DNA, 22 bp, Homo sapiens
gaggcctcaggcgtgggaaggg

SEQ ID NO: 6966025 - DNA, 22 bp, Homo sapiens
aggcaaaattacaaagttatta

SEQ ID NO: 6966026 - DNA, 22 bp, Homo sapiens
cggtagctacaaaacataaaca

SEQ ID NO: 6966027 - DNA, 22 bp, Homo sapiens
tacctctcggggtctgtttgtg

SEQ ID NO: 6966028 - DNA, 22 bp, Homo sapiens
tgaaggcacgtgggtggatact

SEQ ID NO: 6966029 - DNA, 22 bp, Homo sapiens
ctgaaaaatatgttttggagaa

SEQ ID NO: 6966030 - DNA, 22 bp, Homo sapiens
taggaaattctcttgctaagtt

SEQ ID NO: 6966031 - DNA, 22 bp, Homo sapiens
ttctctaatggtgatgattaga

SEQ ID NO: 6966032 - DNA, 22 bp, Homo sapiens
ctcagtggttgagagcctgggc

SEQ ID NO: 6966033 - DNA, 22 bp, Homo sapiens
ccattgaaggcacttgagcaga

SEQ ID NO: 6966034 - DNA, 22 bp, Homo sapiens
ctcagatctttcccattttccc

SEQ ID NO: 6966035 - DNA, 22 bp, Homo sapiens
gttattcttggtggccctgctg

SEQ ID NO: 6966036 - DNA, 22 bp, Homo sapiens
tgaggtgggtgtcaggtcagag

SEQ ID NO: 6966037 - DNA, 22 bp, Homo sapiens
ttcactgtactttggcaatgct

SEQ ID NO: 6966038 - DNA, 22 bp, Homo sapiens
gctacaggtgacagcctctgca

SEQ ID NO: 6966039 - DNA, 22 bp, Homo sapiens
aggaggaggtgggacacagtga

SEQ ID NO: 6966040 - DNA, 22 bp, Homo sapiens
tcagacacagatgagacaagga

SEQ ID NO: 6966041 - DNA, 22 bp, Homo sapiens
atttgtaagctagagccatgat

SEQ ID NO: 6966042 - DNA, 22 bp, Homo sapiens
agatatggttttctcttctcct

SEQ ID NO: 6966043 - DNA, 22 bp, Homo sapiens
atgcaatttactgtacataaat

SEQ ID NO: 6966044 - DNA, 22 bp, Homo sapiens
ggaaaggagatgaataggatta

SEQ ID NO: 6966045 - DNA, 22 bp, Homo sapiens
tgcctcagtttcatctgcagaa

SEQ ID NO: 6966046 - DNA, 22 bp, Homo sapiens
agtgtcctcaggctttgttcct

SEQ ID NO: 6966047 - DNA, 22 bp, Homo sapiens
aagtttatgttctttgaaggca

SEQ ID NO: 6966048 - DNA, 22 bp, Homo sapiens
agctgctcctttcctgcaggcg

SEQ ID NO: 6966049 - DNA, 20 bp, Homo sapiens
tgtaagaagtaggagggtta

SEQ ID NO: 6966050 - DNA, 22 bp, Homo sapiens
atgccacttctctaagtcatgt

SEQ ID NO: 6966051 - DNA, 21 bp, Homo sapiens
ttagttctaccacttgcattc

SEQ ID NO: 6966052 - DNA, 22 bp, Homo sapiens
acacatgttcaagaatgttcag

SEQ ID NO: 6966053 - DNA, 20 bp, Homo sapiens
gcctgcaggttggatgggat

SEQ ID NO: 6966054 - DNA, 22 bp, Homo sapiens
tgcctagccttcttcatgccat

SEQ ID NO: 6966055 - DNA, 22 bp, Homo sapiens
agcagcagctcagttctcagct

SEQ ID NO: 6966056 - DNA, 22 bp, Homo sapiens
tgggcctcatgcccagccaccc

SEQ ID NO: 6966057 - DNA, 22 bp, Homo sapiens
gcagaatgtcagtatggtcacc

SEQ ID NO: 6966058 - DNA, 22 bp, Homo sapiens
actgtgaaagctaacatcttag

SEQ ID NO: 6966059 - DNA, 22 bp, Homo sapiens
ttctccttggtttatgggacat

SEQ ID NO: 6966060 - DNA, 22 bp, Homo sapiens
ccccagctgagatttgaggaga

SEQ ID NO: 6966061 - DNA, 21 bp, Homo sapiens
ggggcatcaagacagagttag

SEQ ID NO: 6966062 - DNA, 22 bp, Homo sapiens
cttgatgactcaggaggaggag

SEQ ID NO: 6966063 - DNA, 20 bp, Homo sapiens
tgtattcttctccttcctcc

SEQ ID NO: 6966064 - DNA, 22 bp, Homo sapiens
tctcctgatatctgcagaccta

SEQ ID NO: 6966065 - DNA, 22 bp, Homo sapiens
tgaccacattgatttctcatcc

SEQ ID NO: 6966066 - DNA, 22 bp, Homo sapiens
gcatcctcccggtgctgctggc

SEQ ID NO: 6966067 - DNA, 22 bp, Homo sapiens
cttgttttctaaaacatcattt

SEQ ID NO: 6966068 - DNA, 22 bp, Homo sapiens
gcaggctgatagaggattccat

SEQ ID NO: 6966069 - DNA, 22 bp, Homo sapiens
tgtgttcatttctctctgctgt

SEQ ID NO: 6966070 - DNA, 22 bp, Homo sapiens
tatggcttttctttcctagtgt

SEQ ID NO: 6966071 - DNA, 22 bp, Homo sapiens
acagatgatgtgcacagataga

SEQ ID NO: 6966072 - DNA, 22 bp, Homo sapiens
ttgtctgcatgattctaggcag

SEQ ID NO: 6966073 - DNA, 22 bp, Homo sapiens
agagagcaggacttcactgagc

SEQ ID NO: 6966074 - DNA, 22 bp, Homo sapiens
ctgcagtttgtaaacattttaa

SEQ ID NO: 6966075 - DNA, 22 bp, Homo sapiens
agccagagagtgttggagatgt

SEQ ID NO: 6966076 - DNA, 22 bp, Homo sapiens
tgacaaatatttgaagaggctg

SEQ ID NO: 6966077 - DNA, 22 bp, Homo sapiens
tttaagcacagggataaagtta

SEQ ID NO: 6966078 - DNA, 22 bp, Homo sapiens
agcagttgagtgggaatcaggc

SEQ ID NO: 6966079 - DNA, 22 bp, Homo sapiens
atgcttgtgtaagaagcctatg

SEQ ID NO: 6966080 - DNA, 22 bp, Homo sapiens
taggtctcctggcctagagatt

SEQ ID NO: 6966081 - DNA, 22 bp, Homo sapiens
tagaacacagaaatgtgtggcc

SEQ ID NO: 6966082 - DNA, 22 bp, Homo sapiens
tgcatgctctgtagaaagcagg

SEQ ID NO: 6966083 - DNA, 22 bp, Homo sapiens
tggcagttttgtatttgagcat

SEQ ID NO: 6966084 - DNA, 22 bp, Homo sapiens
gatgagcattgtttcatgtgtt

SEQ ID NO: 6966085 - DNA, 22 bp, Homo sapiens
ctggtgacttcatctcctcccc

SEQ ID NO: 6966086 - DNA, 22 bp, Homo sapiens
aaagtttccaagttacaccatt

SEQ ID NO: 6966087 - DNA, 22 bp, Homo sapiens
aacagagaggccacctcagcag

SEQ ID NO: 6966088 - DNA, 21 bp, Homo sapiens
tgagagcctccaaccggctac

SEQ ID NO: 6966089 - DNA, 22 bp, Homo sapiens
ctttggtctccgtcatcaatca

SEQ ID NO: 6966090 - DNA, 18 bp, Homo sapiens
ctgtcccatcctcaggtt

SEQ ID NO: 6966091 - DNA, 23 bp, Homo sapiens
acagatgaaagtgtggctcagag

SEQ ID NO: 6966092 - DNA, 21 bp, Homo sapiens
taggggctggggctccagctg

SEQ ID NO: 6966093 - DNA, 22 bp, Homo sapiens
tagcaggaaacctgtgttgagg

SEQ ID NO: 6966094 - DNA, 22 bp, Homo sapiens
caacatcagtcctcatgagaca

SEQ ID NO: 6966095 - DNA, 21 bp, Homo sapiens
tgtccaaggtatgcactgggg

SEQ ID NO: 6966096 - DNA, 23 bp, Homo sapiens
ttacatgtgtgcacacattctgg

SEQ ID NO: 6966097 - DNA, 22 bp, Homo sapiens
gtggcaggtcccattggagcag

SEQ ID NO: 6966098 - DNA, 22 bp, Homo sapiens
aaacagtcaaaggcctaagcta

SEQ ID NO: 6966099 - DNA, 21 bp, Homo sapiens
gataaaatgggccttggtcct

SEQ ID NO: 6966100 - DNA, 22 bp, Homo sapiens
ctgggaggatacacaagatcag

SEQ ID NO: 6966101 - DNA, 22 bp, Homo sapiens
cctgtgggagggagcggctgga

SEQ ID NO: 6966102 - DNA, 22 bp, Homo sapiens
tgacaggggctggtggataaat

SEQ ID NO: 6966103 - DNA, 22 bp, Homo sapiens
actatgtcatggtgctgttttg

SEQ ID NO: 6966104 - DNA, 22 bp, Homo sapiens
tagattgtgaacaagtatttgg

SEQ ID NO: 6966105 - DNA, 21 bp, Homo sapiens
tgaaacatttgatcaaagcac

SEQ ID NO: 6966106 - DNA, 22 bp, Homo sapiens
tcttattcttttaaacaacgca

SEQ ID NO: 6966107 - DNA, 18 bp, Homo sapiens
aggccctggcctcgaaca

SEQ ID NO: 6966108 - DNA, 22 bp, Homo sapiens
tagcccctgcctttgaacctgg

SEQ ID NO: 6966109 - DNA, 22 bp, Homo sapiens
gctgactgagctggcttttcgt

SEQ ID NO: 6966110 - DNA, 22 bp, Homo sapiens
agaggtaattatagcctggccg

SEQ ID NO: 6966111 - DNA, 23 bp, Homo sapiens
agttaggtcaagttaggtcaatt

SEQ ID NO: 6966112 - DNA, 22 bp, Homo sapiens
agcattctgtggtcttctatgg

SEQ ID NO: 6966113 - DNA, 22 bp, Homo sapiens
tagctcactatttcaggctttt

SEQ ID NO: 6966114 - DNA, 22 bp, Homo sapiens
ttaaggcaactgggtccaagat

SEQ ID NO: 6966115 - DNA, 22 bp, Homo sapiens
cctcttctcaactccagccaga

SEQ ID NO: 6966116 - DNA, 22 bp, Homo sapiens
ttctaattgtgtttgcatatct

SEQ ID NO: 6966117 - DNA, 22 bp, Homo sapiens
agttctttaacgagtaagattt

SEQ ID NO: 6966118 - DNA, 22 bp, Homo sapiens
ctggtgggaggcaaggtggaag

SEQ ID NO: 6966119 - DNA, 20 bp, Homo sapiens
agtgcttattttcatggctg

SEQ ID NO: 6966120 - DNA, 22 bp, Homo sapiens
tcagaatgaaatttctttcaga

SEQ ID NO: 6966121 - DNA, 21 bp, Homo sapiens
aggaggggtctttcccactga

SEQ ID NO: 6966122 - DNA, 22 bp, Homo sapiens
gagaatacaaccagaagctgag

SEQ ID NO: 6966123 - DNA, 22 bp, Homo sapiens
tccatccatgtaggaagatggt

SEQ ID NO: 6966124 - DNA, 22 bp, Homo sapiens
cagcagtgatgtgtgagggttc

SEQ ID NO: 6966125 - DNA, 18 bp, Homo sapiens
catttgttattgtgtgtg

SEQ ID NO: 6966126 - DNA, 22 bp, Homo sapiens
gcgcttccaccgaaggcagctc

SEQ ID NO: 6966127 - DNA, 22 bp, Homo sapiens
taagaaactaatgcaataagag

SEQ ID NO: 6966128 - DNA, 22 bp, Homo sapiens
atgagaaagagttgtatctaga

SEQ ID NO: 6966129 - DNA, 22 bp, Homo sapiens
tttgtcatatagactattgtga

SEQ ID NO: 6966130 - DNA, 22 bp, Homo sapiens
tagcacacagcttggggaccag

SEQ ID NO: 6966131 - DNA, 20 bp, Homo sapiens
gatgtgtcctcagcagtggt

SEQ ID NO: 6966132 - DNA, 22 bp, Homo sapiens
tcatatatttagttgtgcaaca

SEQ ID NO: 6966133 - DNA, 22 bp, Homo sapiens
actctgctcaaagtcctgaggc

SEQ ID NO: 6966134 - DNA, 22 bp, Homo sapiens
caagttagtattggttttggga

SEQ ID NO: 6966135 - DNA, 22 bp, Homo sapiens
agccctgattaaccttggcttt

SEQ ID NO: 6966136 - DNA, 22 bp, Homo sapiens
ttctcttacattttctcagcct

SEQ ID NO: 6966137 - DNA, 21 bp, Homo sapiens
gcaaggcttttgtgtttccca

SEQ ID NO: 6966138 - DNA, 22 bp, Homo sapiens
accagtttaataactgctcaag

SEQ ID NO: 6966139 - DNA, 22 bp, Homo sapiens
agtagacattttgcaacatctg

SEQ ID NO: 6966140 - DNA, 22 bp, Homo sapiens
acaagcagagattaaatgtttt

SEQ ID NO: 6966141 - DNA, 22 bp, Homo sapiens
ttctcaaaactcagggtatctg

SEQ ID NO: 6966142 - DNA, 22 bp, Homo sapiens
gagtgcagatgaacagaagatt

SEQ ID NO: 6966143 - DNA, 22 bp, Homo sapiens
gatttcacagtggtccaaggca

SEQ ID NO: 6966144 - DNA, 22 bp, Homo sapiens
tgatgcaatcctttagaagtaa

SEQ ID NO: 6966145 - DNA, 20 bp, Homo sapiens
ctgagagtctgtgcttagtc

SEQ ID NO: 6966146 - DNA, 22 bp, Homo sapiens
ccagggtggcgtagatgctggg

SEQ ID NO: 6966147 - DNA, 22 bp, Homo sapiens
tctcagtgttatctatctgcct

SEQ ID NO: 6966148 - DNA, 22 bp, Homo sapiens
ctgcctggtgcggtgcccaccc

SEQ ID NO: 6966149 - DNA, 22 bp, Homo sapiens
tggaaggggagttgttccacgt

SEQ ID NO: 6966150 - DNA, 21 bp, Homo sapiens
tctgtgcctcaaccctcatct

SEQ ID NO: 6966151 - DNA, 22 bp, Homo sapiens
tctggtctccaggagtggtggt

SEQ ID NO: 6966152 - DNA, 22 bp, Homo sapiens
atgatgtcatgaatatattagt

SEQ ID NO: 6966153 - DNA, 22 bp, Homo sapiens
gcactcagtaccaggtcactgc

SEQ ID NO: 6966154 - DNA, 22 bp, Homo sapiens
cagcccttgcgacaccctggct

SEQ ID NO: 6966155 - DNA, 22 bp, Homo sapiens
tgttcagccctctattaatcag

SEQ ID NO: 6966156 - DNA, 22 bp, Homo sapiens
cttggtcatcgataattgaatc

SEQ ID NO: 6966157 - DNA, 22 bp, Homo sapiens
tgctaggtaagaagggggctcc

SEQ ID NO: 6966158 - DNA, 21 bp, Homo sapiens
atgattctgcaaatgagtagt

SEQ ID NO: 6966159 - DNA, 23 bp, Homo sapiens
aggctgcttactggtatcagagc

SEQ ID NO: 6966160 - DNA, 22 bp, Homo sapiens
ataataacaatgccagatgcct

SEQ ID NO: 6966161 - DNA, 22 bp, Homo sapiens
ttaagagaaggaatgacctagc

SEQ ID NO: 6966162 - DNA, 22 bp, Homo sapiens
gtgccagaatctttgaagagag

SEQ ID NO: 6966163 - DNA, 22 bp, Homo sapiens
cagagtctggactgcaggctcc

SEQ ID NO: 6966164 - DNA, 22 bp, Homo sapiens
gtgccctgtctcttgtctccag

SEQ ID NO: 6966165 - DNA, 22 bp, Homo sapiens
aaacaagcaagcacataatttt

SEQ ID NO: 6966166 - DNA, 22 bp, Homo sapiens
tgtctgtgtccaaatttcctct

SEQ ID NO: 6966167 - DNA, 23 bp, Homo sapiens
cgttttttcctcagatgttctgg

SEQ ID NO: 6966168 - DNA, 22 bp, Homo sapiens
tctcttccagtaagagtcttta

SEQ ID NO: 6966169 - DNA, 22 bp, Homo sapiens
aagaggtgccaggggttttgta

SEQ ID NO: 6966170 - DNA, 22 bp, Homo sapiens
tatcctggagaatctgatagga

SEQ ID NO: 6966171 - DNA, 22 bp, Homo sapiens
aagtaatataattgttgttgtt

SEQ ID NO: 6966172 - DNA, 22 bp, Homo sapiens
tcctgccctcgggggtgttcca

SEQ ID NO: 6966173 - DNA, 22 bp, Homo sapiens
cacatcatgttaattcattaca

SEQ ID NO: 6966174 - DNA, 22 bp, Homo sapiens
atgaccaagagtccaggtcaag

SEQ ID NO: 6966175 - DNA, 22 bp, Homo sapiens
aagtttatccctctcacagtta

SEQ ID NO: 6966176 - DNA, 22 bp, Homo sapiens
agccctgggtcccagtcctggc

SEQ ID NO: 6966177 - DNA, 22 bp, Homo sapiens
tgtgaaaagcaggctactttct

SEQ ID NO: 6966178 - DNA, 22 bp, Homo sapiens
ctatatatatcatcttccagtt

SEQ ID NO: 6966179 - DNA, 22 bp, Homo sapiens
ccaggaagcataatgtagtggg

SEQ ID NO: 6966180 - DNA, 22 bp, Homo sapiens
ggctggtgttacagtcggcagc

SEQ ID NO: 6966181 - DNA, 22 bp, Homo sapiens
actgaaaatgaattagaaacag

SEQ ID NO: 6966182 - DNA, 22 bp, Homo sapiens
actcagtcatttggggaacagt

SEQ ID NO: 6966183 - DNA, 22 bp, Homo sapiens
gatatagtaatattcctgaact

SEQ ID NO: 6966184 - DNA, 22 bp, Homo sapiens
tccagccctctggcccgcggtg

SEQ ID NO: 6966185 - DNA, 22 bp, Homo sapiens
tgatttgaggtacataaatcca

SEQ ID NO: 6966186 - DNA, 22 bp, Homo sapiens
tggccagtttgctcaggcagtc

SEQ ID NO: 6966187 - DNA, 22 bp, Homo sapiens
ggctgtgttccaagtgtcagga

SEQ ID NO: 6966188 - DNA, 22 bp, Homo sapiens
caggaacacaatgagtctcaaa

SEQ ID NO: 6966189 - DNA, 22 bp, Homo sapiens
tctggaatgaatgaggttctgt

SEQ ID NO: 6966190 - DNA, 22 bp, Homo sapiens
ggtttccaggagaagagatttg

SEQ ID NO: 6966191 - DNA, 22 bp, Homo sapiens
ctttggaatattttattgagaa

SEQ ID NO: 6966192 - DNA, 22 bp, Homo sapiens
aaaatagattctaggatgtctt

SEQ ID NO: 6966193 - DNA, 22 bp, Homo sapiens
catttatgatagtaatatgaaa

SEQ ID NO: 6966194 - DNA, 19 bp, Homo sapiens
tgacacagctaggtttgct

SEQ ID NO: 6966195 - DNA, 22 bp, Homo sapiens
ttgcatcagcaggcataattgg

SEQ ID NO: 6966196 - DNA, 23 bp, Homo sapiens
attatccagtgcacttcacagct

SEQ ID NO: 6966197 - DNA, 22 bp, Homo sapiens
ggcacagggggctgaggactag

SEQ ID NO: 6966198 - DNA, 22 bp, Homo sapiens
attgaaaatgacatttgtgccc

SEQ ID NO: 6966199 - DNA, 20 bp, Homo sapiens
ccaggactgctggggactct

SEQ ID NO: 6966200 - DNA, 21 bp, Homo sapiens
atagtttggagtgggaaagtc

SEQ ID NO: 6966201 - DNA, 22 bp, Homo sapiens
aaagtctttattttgtatcttt

SEQ ID NO: 6966202 - DNA, 22 bp, Homo sapiens
gcacagagagtcccgggtgccc

SEQ ID NO: 6966203 - DNA, 22 bp, Homo sapiens
tgaaatactgagtgaaagaatt

SEQ ID NO: 6966204 - DNA, 22 bp, Homo sapiens
catgctccagctccagacaggt

SEQ ID NO: 6966205 - DNA, 22 bp, Homo sapiens
aaatggactgtgatatttacat

SEQ ID NO: 6966206 - DNA, 22 bp, Homo sapiens
agacaggccactctggtctggt

SEQ ID NO: 6966207 - DNA, 22 bp, Homo sapiens
aagtctgactagaatctctccc

SEQ ID NO: 6966208 - DNA, 22 bp, Homo sapiens
atggaggatgtgcagcatgggc

SEQ ID NO: 6966209 - DNA, 22 bp, Homo sapiens
cagcaactgtgcctgacacaca

SEQ ID NO: 6966210 - DNA, 20 bp, Homo sapiens
tttaccaaaggagttatgat

SEQ ID NO: 6966211 - DNA, 22 bp, Homo sapiens
tgaagctacaaaagattattgc

SEQ ID NO: 6966212 - DNA, 22 bp, Homo sapiens
ctccagctgccaccagatgttt

SEQ ID NO: 6966213 - DNA, 14 bp, Homo sapiens
acaggcagatttct

SEQ ID NO: 6966214 - DNA, 21 bp, Homo sapiens
tcagagtggaagacagtttga

SEQ ID NO: 6966215 - DNA, 19 bp, Homo sapiens
gcatcaaagctgactcctg

SEQ ID NO: 6966216 - DNA, 22 bp, Homo sapiens
tgaattctgggtcagcagcttg

SEQ ID NO: 6966217 - DNA, 22 bp, Homo sapiens
agcctctagaccctggcctgca

SEQ ID NO: 6966218 - DNA, 22 bp, Homo sapiens
ttcctcagctcagcgagagaga

SEQ ID NO: 6966219 - DNA, 22 bp, Homo sapiens
tcctgtttaggctgtggtctgg

SEQ ID NO: 6966220 - DNA, 22 bp, Homo sapiens
tggcaacctctgtgctatggag

SEQ ID NO: 6966221 - DNA, 20 bp, Homo sapiens
gcagccgtggagactaggag

SEQ ID NO: 6966222 - DNA, 22 bp, Homo sapiens
tgaggctgaaactggcgataga

SEQ ID NO: 6966223 - DNA, 22 bp, Homo sapiens
ggaaagacctgagataggaata

SEQ ID NO: 6966224 - DNA, 22 bp, Homo sapiens
atctgccaagagaacgtgggtc

SEQ ID NO: 6966225 - DNA, 22 bp, Homo sapiens
gtgattatatttctatgtgaat

SEQ ID NO: 6966226 - DNA, 22 bp, Homo sapiens
gggacgggcagtccaaggggtc

SEQ ID NO: 6966227 - DNA, 22 bp, Homo sapiens
ttgccactaactagctgtgaga

SEQ ID NO: 6966228 - DNA, 22 bp, Homo sapiens
tcctggcagcccgcaggtgctg

SEQ ID NO: 6966229 - DNA, 22 bp, Homo sapiens
tttaacttaatctgcttgatga

SEQ ID NO: 6966230 - DNA, 22 bp, Homo sapiens
gcccaagggcatcaagttctac

SEQ ID NO: 6966231 - DNA, 22 bp, Homo sapiens
tctttgctcttacacagttagt

SEQ ID NO: 6966232 - DNA, 22 bp, Homo sapiens
cctgctgttttcttcacttcag

SEQ ID NO: 6966233 - DNA, 22 bp, Homo sapiens
tgtccctgatccactggacccc

SEQ ID NO: 6966234 - DNA, 22 bp, Homo sapiens
cagccctctctgggccccaagg

SEQ ID NO: 6966235 - DNA, 22 bp, Homo sapiens
tggaatgtgctagggctgtggc

SEQ ID NO: 6966236 - DNA, 22 bp, Homo sapiens
tgggtgagggacaaaagtttct

SEQ ID NO: 6966237 - DNA, 22 bp, Homo sapiens
tccaggccagggtaagaggaga

SEQ ID NO: 6966238 - DNA, 22 bp, Homo sapiens
tgctggagcggaggtgagccag

SEQ ID NO: 6966239 - DNA, 22 bp, Homo sapiens
tactttggggacaatatggaat

SEQ ID NO: 6966240 - DNA, 22 bp, Homo sapiens
ctgtatttgtcctctatttatt

SEQ ID NO: 6966241 - DNA, 22 bp, Homo sapiens
ctcagcagtatactctgaagat

SEQ ID NO: 6966242 - DNA, 22 bp, Homo sapiens
acagatgaggaatttatttggt

SEQ ID NO: 6966243 - DNA, 22 bp, Homo sapiens
aacttagtacccaggcgttcgg

SEQ ID NO: 6966244 - DNA, 22 bp, Homo sapiens
tatggcttgacttgcaccggca

SEQ ID NO: 6966245 - DNA, 22 bp, Homo sapiens
cccagggtgcggccctggctgg

SEQ ID NO: 6966246 - DNA, 22 bp, Homo sapiens
gggaagcaggtgcagctcgcct

SEQ ID NO: 6966247 - DNA, 22 bp, Homo sapiens
caacagttcagttgagctcaac

SEQ ID NO: 6966248 - DNA, 22 bp, Homo sapiens
ttttactttggatacagtactt

SEQ ID NO: 6966249 - DNA, 22 bp, Homo sapiens
cttgccatctaaccagactgcc

SEQ ID NO: 6966250 - DNA, 22 bp, Homo sapiens
agggtctgtggatgcatctggg

SEQ ID NO: 6966251 - DNA, 22 bp, Homo sapiens
ttcacagtggctgtgccatttg

SEQ ID NO: 6966252 - DNA, 22 bp, Homo sapiens
agaaatgctcaggtcaacttaa

SEQ ID NO: 6966253 - DNA, 23 bp, Homo sapiens
tcattccacaaatacttatctag

SEQ ID NO: 6966254 - DNA, 22 bp, Homo sapiens
ccaagcagtctgctaggagttt

SEQ ID NO: 6966255 - DNA, 22 bp, Homo sapiens
ctgggacacgttctattccaaa

SEQ ID NO: 6966256 - DNA, 22 bp, Homo sapiens
ccagctgcgggcatcgagagtt

SEQ ID NO: 6966257 - DNA, 22 bp, Homo sapiens
tctctgggcctgttttctcatc

SEQ ID NO: 6966258 - DNA, 22 bp, Homo sapiens
ggcagtgcaaggcagcctggat

SEQ ID NO: 6966259 - DNA, 22 bp, Homo sapiens
agctggttcccactgggcctgt

SEQ ID NO: 6966260 - DNA, 22 bp, Homo sapiens
agatggcttagcctggctccca

SEQ ID NO: 6966261 - DNA, 22 bp, Homo sapiens
gacccttttcagactcaggtac

SEQ ID NO: 6966262 - DNA, 22 bp, Homo sapiens
ccacagtaactgttttgtaccg

SEQ ID NO: 6966263 - DNA, 22 bp, Homo sapiens
tgagccaaggagcaaagcctca

SEQ ID NO: 6966264 - DNA, 22 bp, Homo sapiens
aatcagatgaatcaatatatcc

SEQ ID NO: 6966265 - DNA, 22 bp, Homo sapiens
gttgacagctggtgagctgcta

SEQ ID NO: 6966266 - DNA, 22 bp, Homo sapiens
tgtacaatagctattatctcca

SEQ ID NO: 6966267 - DNA, 22 bp, Homo sapiens
gctcagtgtggtcctcagatgt

SEQ ID NO: 6966268 - DNA, 17 bp, Homo sapiens
ttcagaagcattttggc

SEQ ID NO: 6966269 - DNA, 22 bp, Homo sapiens
tcttggaggagagtaagtacct

SEQ ID NO: 6966270 - DNA, 22 bp, Homo sapiens
aagaatacttcgtaagtaggat

SEQ ID NO: 6966271 - DNA, 21 bp, Homo sapiens
tctgagctgagtcctctaggt

SEQ ID NO: 6966272 - DNA, 22 bp, Homo sapiens
aggcctggcctgggcggcattg

SEQ ID NO: 6966273 - DNA, 22 bp, Homo sapiens
tggtgggagtccgctgtgctgc

SEQ ID NO: 6966274 - DNA, 22 bp, Homo sapiens
tcatttcttaactagagtgaac

SEQ ID NO: 6966275 - DNA, 22 bp, Homo sapiens
aagtaaaagcaggtgtgctggg

SEQ ID NO: 6966276 - DNA, 22 bp, Homo sapiens
ttggttttagttcttgctcatg

SEQ ID NO: 6966277 - DNA, 22 bp, Homo sapiens
ctgaagatgatgatactaagga

SEQ ID NO: 6966278 - DNA, 22 bp, Homo sapiens
agtaaacactgtctttatatat

SEQ ID NO: 6966279 - DNA, 22 bp, Homo sapiens
gtttggaatagcagtaaacatt

SEQ ID NO: 6966280 - DNA, 22 bp, Homo sapiens
ttaatactataatttgaagtac

SEQ ID NO: 6966281 - DNA, 22 bp, Homo sapiens
tgcctacctgaaaatgtctaat

SEQ ID NO: 6966282 - DNA, 22 bp, Homo sapiens
gtctgagggtcatgggtctcac

SEQ ID NO: 6966283 - DNA, 22 bp, Homo sapiens
gcagagcctgggggtctgcgga

SEQ ID NO: 6966284 - DNA, 22 bp, Homo sapiens
tctgccagtttatagacaagcc

SEQ ID NO: 6966285 - DNA, 22 bp, Homo sapiens
ggctcccacccatagggcgagt

SEQ ID NO: 6966286 - DNA, 22 bp, Homo sapiens
ttctagagccagggcagctgca

SEQ ID NO: 6966287 - DNA, 22 bp, Homo sapiens
ttgcctttaagtataactgctg

SEQ ID NO: 6966288 - DNA, 22 bp, Homo sapiens
tctcttggagagtccatcatca

SEQ ID NO: 6966289 - DNA, 22 bp, Homo sapiens
cctcttccagctgttgcttcca

SEQ ID NO: 6966290 - DNA, 21 bp, Homo sapiens
agtgaagagtgaaacacatgg

SEQ ID NO: 6966291 - DNA, 22 bp, Homo sapiens
ccagcatcgacttcctgcctga

SEQ ID NO: 6966292 - DNA, 20 bp, Homo sapiens
aatatgctgggagtttatat

SEQ ID NO: 6966293 - DNA, 22 bp, Homo sapiens
agtgatttgactcttttattgt

SEQ ID NO: 6966294 - DNA, 22 bp, Homo sapiens
gtggaattgatttttggaggac

SEQ ID NO: 6966295 - DNA, 22 bp, Homo sapiens
atcacacttttgtaaccatcag

SEQ ID NO: 6966296 - DNA, 22 bp, Homo sapiens
atgtccttggagtccactttcc

SEQ ID NO: 6966297 - DNA, 22 bp, Homo sapiens
tccacctggattttgtctacag

SEQ ID NO: 6966298 - DNA, 23 bp, Homo sapiens
cctgggaaaactgctgatcttgc

SEQ ID NO: 6966299 - DNA, 22 bp, Homo sapiens
ctgtggctctcagaggctgctg

SEQ ID NO: 6966300 - DNA, 22 bp, Homo sapiens
gctggaggatcacttgagccca

SEQ ID NO: 6966301 - DNA, 20 bp, Homo sapiens
tcctgcagtcgctagcgccc

SEQ ID NO: 6966302 - DNA, 22 bp, Homo sapiens
actttaagatatttgaaaacag

SEQ ID NO: 6966303 - DNA, 22 bp, Homo sapiens
acaaaggcagagaattcaacat

SEQ ID NO: 6966304 - DNA, 22 bp, Homo sapiens
gacaccaggtctgttgtcctcc

SEQ ID NO: 6966305 - DNA, 22 bp, Homo sapiens
ctctggacactggcatggggtc

SEQ ID NO: 6966306 - DNA, 22 bp, Homo sapiens
ctgaaggattcaaaatggcagg

SEQ ID NO: 6966307 - DNA, 21 bp, Homo sapiens
agtgttaatggaaattatatt

SEQ ID NO: 6966308 - DNA, 22 bp, Homo sapiens
cattctaggcctggcttgggcc

SEQ ID NO: 6966309 - DNA, 22 bp, Homo sapiens
ggaggggatttagtagatgcta

SEQ ID NO: 6966310 - DNA, 22 bp, Homo sapiens
tctttctacattttatatgctt

SEQ ID NO: 6966311 - DNA, 22 bp, Homo sapiens
cagctagtgagagaaaggacac

SEQ ID NO: 6966312 - DNA, 22 bp, Homo sapiens
cttccttccacaccttcagaat

SEQ ID NO: 6966313 - DNA, 22 bp, Homo sapiens
tcaggcttattacgttattgtc

SEQ ID NO: 6966314 - DNA, 22 bp, Homo sapiens
agtatatgtgcacatatgcatg

SEQ ID NO: 6966315 - DNA, 22 bp, Homo sapiens
tggcctgggccggcagatatac

SEQ ID NO: 6966316 - DNA, 19 bp, Homo sapiens
tgatggaatttgacattcc

SEQ ID NO: 6966317 - DNA, 23 bp, Homo sapiens
tcacatctgccgtagtgtattct

SEQ ID NO: 6966318 - DNA, 22 bp, Homo sapiens
gacacatatgcgtatagtttag

SEQ ID NO: 6966319 - DNA, 22 bp, Homo sapiens
gtgcattctatcaaatggtaca

SEQ ID NO: 6966320 - DNA, 22 bp, Homo sapiens
cagggtgagtgggaagcagcgt

SEQ ID NO: 6966321 - DNA, 22 bp, Homo sapiens
agctcagggccatcggcccttt

SEQ ID NO: 6966322 - DNA, 22 bp, Homo sapiens
caggaaagagctgccaggcagg

SEQ ID NO: 6966323 - DNA, 22 bp, Homo sapiens
actgagggatttaataaatttt

SEQ ID NO: 6966324 - DNA, 22 bp, Homo sapiens
tgtggaagccggtgggaagcag

SEQ ID NO: 6966325 - DNA, 22 bp, Homo sapiens
ccctgggaagtattccagctat

SEQ ID NO: 6966326 - DNA, 23 bp, Homo sapiens
tagatccttccaactactcttac

SEQ ID NO: 6966327 - DNA, 22 bp, Homo sapiens
ggcagacacaaaaacataaggt

SEQ ID NO: 6966328 - DNA, 22 bp, Homo sapiens
aggtccaggatttgtggggtct

SEQ ID NO: 6966329 - DNA, 22 bp, Homo sapiens
acagagtacattcagagactat

SEQ ID NO: 6966330 - DNA, 22 bp, Homo sapiens
gggcatgagcacatagtgtcta

SEQ ID NO: 6966331 - DNA, 22 bp, Homo sapiens
ccattcaataccttagagaaaa

SEQ ID NO: 6966332 - DNA, 22 bp, Homo sapiens
aaaggattaaataaatgtgctg

SEQ ID NO: 6966333 - DNA, 22 bp, Homo sapiens
tggccctttggtttatgactga

SEQ ID NO: 6966334 - DNA, 22 bp, Homo sapiens
caggagtgttgattgctcagga

SEQ ID NO: 6966335 - DNA, 22 bp, Homo sapiens
agggtcagagatcggccatgtg

SEQ ID NO: 6966336 - DNA, 22 bp, Homo sapiens
tgaccctttgcttcctcattgt

SEQ ID NO: 6966337 - DNA, 22 bp, Homo sapiens
tagggcagtttcatgttatctt

SEQ ID NO: 6966338 - DNA, 22 bp, Homo sapiens
ggaaccttgctagatgctgagg

SEQ ID NO: 6966339 - DNA, 22 bp, Homo sapiens
ttgtgaatggtgccgcaataaa

SEQ ID NO: 6966340 - DNA, 22 bp, Homo sapiens
tggattttagcatgtaactgtg

SEQ ID NO: 6966341 - DNA, 22 bp, Homo sapiens
aggggagcaacatagtcactct

SEQ ID NO: 6966342 - DNA, 22 bp, Homo sapiens
tcctccctgcactcagtgaagt

SEQ ID NO: 6966343 - DNA, 22 bp, Homo sapiens
gaaggctgtggctggtctcagt

SEQ ID NO: 6966344 - DNA, 22 bp, Homo sapiens
tctggagcttgtttcagatggt

SEQ ID NO: 6966345 - DNA, 21 bp, Homo sapiens
agttttccattagggagggag

SEQ ID NO: 6966346 - DNA, 22 bp, Homo sapiens
aggttaggaaccagtgtttgac

SEQ ID NO: 6966347 - DNA, 22 bp, Homo sapiens
gtgacagagtgagaccttgtct

SEQ ID NO: 6966348 - DNA, 21 bp, Homo sapiens
aagaactattgaggtacacag

SEQ ID NO: 6966349 - DNA, 22 bp, Homo sapiens
tgtgacttaatccttgggtggg

SEQ ID NO: 6966350 - DNA, 22 bp, Homo sapiens
aggatgtttggtgcagggaaga

SEQ ID NO: 6966351 - DNA, 22 bp, Homo sapiens
atctgaaactctgacattgtct

SEQ ID NO: 6966352 - DNA, 19 bp, Homo sapiens
tccagtgtagctggtcatt

SEQ ID NO: 6966353 - DNA, 18 bp, Homo sapiens
aagtgggaaaagcaagca

SEQ ID NO: 6966354 - DNA, 22 bp, Homo sapiens
tctgttcttgcttttctccaac

SEQ ID NO: 6966355 - DNA, 22 bp, Homo sapiens
agtgggaattttctcccaggga

SEQ ID NO: 6966356 - DNA, 22 bp, Homo sapiens
gcctctgcgcctcagccgacct

SEQ ID NO: 6966357 - DNA, 22 bp, Homo sapiens
gatgctccaaacagcaattctt

SEQ ID NO: 6966358 - DNA, 22 bp, Homo sapiens
cacagtgttccagagcagtggt

SEQ ID NO: 6966359 - DNA, 22 bp, Homo sapiens
ttaaattcattccaacttttga

SEQ ID NO: 6966360 - DNA, 22 bp, Homo sapiens
agcaacctgccagtcactcagt

SEQ ID NO: 6966361 - DNA, 22 bp, Homo sapiens
tctggagtggacccagagcact

SEQ ID NO: 6966362 - DNA, 22 bp, Homo sapiens
tctgtcatgtttccattacatg

SEQ ID NO: 6966363 - DNA, 22 bp, Homo sapiens
tgttttctgatggttaatgagt

SEQ ID NO: 6966364 - DNA, 22 bp, Homo sapiens
taatctgttgttaatattgact

SEQ ID NO: 6966365 - DNA, 22 bp, Homo sapiens
ctaaacactatgtaagcaagaa

SEQ ID NO: 6966366 - DNA, 21 bp, Homo sapiens
atactgaacctcataagccca

SEQ ID NO: 6966367 - DNA, 22 bp, Homo sapiens
gatccttctcctttttcatgct

SEQ ID NO: 6966368 - DNA, 22 bp, Homo sapiens
ggcaattttaggcatgaatgaa

SEQ ID NO: 6966369 - DNA, 22 bp, Homo sapiens
ggctccagccctggctcttcac

SEQ ID NO: 6966370 - DNA, 22 bp, Homo sapiens
atgtctgtatgtggagaggggt

SEQ ID NO: 6966371 - DNA, 22 bp, Homo sapiens
acatatattttcacacatggtt

SEQ ID NO: 6966372 - DNA, 22 bp, Homo sapiens
acagtgattttttcgagcagaa

SEQ ID NO: 6966373 - DNA, 20 bp, Homo sapiens
gcatcaaggtacgctctcca

SEQ ID NO: 6966374 - DNA, 22 bp, Homo sapiens
atgcagggcagagtacgttagc

SEQ ID NO: 6966375 - DNA, 22 bp, Homo sapiens
cctcggctgcccagcccagctg

SEQ ID NO: 6966376 - DNA, 22 bp, Homo sapiens
ggtgcctaataattctattgca

SEQ ID NO: 6966377 - DNA, 22 bp, Homo sapiens
tgcaggcctggactgatgtggt

SEQ ID NO: 6966378 - DNA, 22 bp, Homo sapiens
gattcagtgagggtgagaagaa

SEQ ID NO: 6966379 - DNA, 22 bp, Homo sapiens
aactttaaaaaatatgtctgtt

SEQ ID NO: 6966380 - DNA, 22 bp, Homo sapiens
tccactggtatccacagtgggg

SEQ ID NO: 6966381 - DNA, 22 bp, Homo sapiens
ctctgtagactccacctttgag

SEQ ID NO: 6966382 - DNA, 22 bp, Homo sapiens
gcagtgggcaacaagagctgga

SEQ ID NO: 6966383 - DNA, 17 bp, Homo sapiens
gcagtgaaaagagatca

SEQ ID NO: 6966384 - DNA, 22 bp, Homo sapiens
ttaaaattatggcccatttgga

SEQ ID NO: 6966385 - DNA, 22 bp, Homo sapiens
tggagtccttgttggaagtgaa

SEQ ID NO: 6966386 - DNA, 20 bp, Homo sapiens
tgtgggcccttggctggcaa

SEQ ID NO: 6966387 - DNA, 23 bp, Homo sapiens
aactagttgccatgaataaaagc

SEQ ID NO: 6966388 - DNA, 22 bp, Homo sapiens
atggtagccccacactcaccag

SEQ ID NO: 6966389 - DNA, 22 bp, Homo sapiens
actctgcttgggccatatctgg

SEQ ID NO: 6966390 - DNA, 22 bp, Homo sapiens
ctggttggtgccacatggtggc

SEQ ID NO: 6966391 - DNA, 22 bp, Homo sapiens
agtctaggtacgggtccaactt

SEQ ID NO: 6966392 - DNA, 22 bp, Homo sapiens
attgcacaaacacagtcagact

SEQ ID NO: 6966393 - DNA, 22 bp, Homo sapiens
caacttattttcagtgggcctg

SEQ ID NO: 6966394 - DNA, 22 bp, Homo sapiens
ttccaaattccaatcccctgaa

SEQ ID NO: 6966395 - DNA, 22 bp, Homo sapiens
ataggcagaaatgctccctatt

SEQ ID NO: 6966396 - DNA, 22 bp, Homo sapiens
gaagacaattctgggtggagga

SEQ ID NO: 6966397 - DNA, 22 bp, Homo sapiens
tacaaagtaatgtataatatcg

SEQ ID NO: 6966398 - DNA, 22 bp, Homo sapiens
gggatttggaatctcctaatgc

SEQ ID NO: 6966399 - DNA, 22 bp, Homo sapiens
aaagatgtccaagtaaagttaa

SEQ ID NO: 6966400 - DNA, 22 bp, Homo sapiens
taacattccctttgtgccaagg

SEQ ID NO: 6966401 - DNA, 22 bp, Homo sapiens
aggaatgttaaagattaagagc

SEQ ID NO: 6966402 - DNA, 22 bp, Homo sapiens
attacactaatgtgacaacaat

SEQ ID NO: 6966403 - DNA, 22 bp, Homo sapiens
gccttctgtgctcctggccttt

SEQ ID NO: 6966404 - DNA, 22 bp, Homo sapiens
tctatacctttgctgtgacttt

SEQ ID NO: 6966405 - DNA, 22 bp, Homo sapiens
caaggcaagtcatatgggcaag

SEQ ID NO: 6966406 - DNA, 22 bp, Homo sapiens
ctccctccaaataagactcggg

SEQ ID NO: 6966407 - DNA, 22 bp, Homo sapiens
agcatctgtgatattttgttat

SEQ ID NO: 6966408 - DNA, 18 bp, Homo sapiens
ttgctcttctatgtcaat

SEQ ID NO: 6966409 - DNA, 22 bp, Homo sapiens
tatgtattagagctccatgagg

SEQ ID NO: 6966410 - DNA, 22 bp, Homo sapiens
aaggtatttagtgtgaaagcta

SEQ ID NO: 6966411 - DNA, 19 bp, Homo sapiens
actaaaaatgatgtttgag

SEQ ID NO: 6966412 - DNA, 22 bp, Homo sapiens
agttctttggtcctaaccctgc

SEQ ID NO: 6966413 - DNA, 22 bp, Homo sapiens
tcatccagaaaaatgtcttagc

SEQ ID NO: 6966414 - DNA, 21 bp, Homo sapiens
gcactgctagaaccccctgga

SEQ ID NO: 6966415 - DNA, 22 bp, Homo sapiens
gagtttatgtctttcattgttc

SEQ ID NO: 6966416 - DNA, 22 bp, Homo sapiens
agactcaagactgcagaagacg

SEQ ID NO: 6966417 - DNA, 22 bp, Homo sapiens
agacttctcttggctatattat

SEQ ID NO: 6966418 - DNA, 22 bp, Homo sapiens
cagcagcagtgttctagaatct

SEQ ID NO: 6966419 - DNA, 22 bp, Homo sapiens
acaaacacgagacgccactgtg

SEQ ID NO: 6966420 - DNA, 21 bp, Homo sapiens
taatactgaaagtgacatctg

SEQ ID NO: 6966421 - DNA, 22 bp, Homo sapiens
tcatgacatggacatgattgta

SEQ ID NO: 6966422 - DNA, 22 bp, Homo sapiens
ttgttcttctctagagaagtgg

SEQ ID NO: 6966423 - DNA, 23 bp, Homo sapiens
tgagacactcattcatggagtat

SEQ ID NO: 6966424 - DNA, 21 bp, Homo sapiens
ggcatgagggcagtgagcaga

SEQ ID NO: 6966425 - DNA, 22 bp, Homo sapiens
tctcagtttctcattataaaag

SEQ ID NO: 6966426 - DNA, 22 bp, Homo sapiens
gaatgtgaggttgtatgtgaaa

SEQ ID NO: 6966427 - DNA, 22 bp, Homo sapiens
gaaactggatgcagggatgcag

SEQ ID NO: 6966428 - DNA, 22 bp, Homo sapiens
atgcatatggcttgagggaata

SEQ ID NO: 6966429 - DNA, 22 bp, Homo sapiens
gaagctgatgaggaccagattg

SEQ ID NO: 6966430 - DNA, 22 bp, Homo sapiens
ttaattttctcatctgtgaaat

SEQ ID NO: 6966431 - DNA, 22 bp, Homo sapiens
aaattgcattttaaaggtagat

SEQ ID NO: 6966432 - DNA, 18 bp, Homo sapiens
ttatgcagatcagttcac

SEQ ID NO: 6966433 - DNA, 22 bp, Homo sapiens
attaggtaatctttagatacac

SEQ ID NO: 6966434 - DNA, 22 bp, Homo sapiens
ggtttctagcagagtctcttta

SEQ ID NO: 6966435 - DNA, 22 bp, Homo sapiens
atatctcattaccttgctgttc

SEQ ID NO: 6966436 - DNA, 22 bp, Homo sapiens
gctttctgtggtgatgtaaagg

SEQ ID NO: 6966437 - DNA, 22 bp, Homo sapiens
agggtctgactgaatggaaaag

SEQ ID NO: 6966438 - DNA, 22 bp, Homo sapiens
tctcttaaaggtcttcagctga

SEQ ID NO: 6966439 - DNA, 22 bp, Homo sapiens
tggtggcagagcaagagctgga

SEQ ID NO: 6966440 - DNA, 22 bp, Homo sapiens
ttcaatgcaagggaggtctgaa

SEQ ID NO: 6966441 - DNA, 22 bp, Homo sapiens
agaggccagcaaccacagtaaa

SEQ ID NO: 6966442 - DNA, 22 bp, Homo sapiens
ctccagcctcatctcctggctg

SEQ ID NO: 6966443 - DNA, 22 bp, Homo sapiens
agatcatactacttgtactaaa

SEQ ID NO: 6966444 - DNA, 22 bp, Homo sapiens
aattctgatgaataaatcatcc

SEQ ID NO: 6966445 - DNA, 22 bp, Homo sapiens
cagatgtgccgcggcgccgctc

SEQ ID NO: 6966446 - DNA, 22 bp, Homo sapiens
tctgtctgcctgtgtccccacc

SEQ ID NO: 6966447 - DNA, 22 bp, Homo sapiens
cttttcttatgtggacgtacct

SEQ ID NO: 6966448 - DNA, 22 bp, Homo sapiens
aatgggaggattttctctcttg

SEQ ID NO: 6966449 - DNA, 22 bp, Homo sapiens
ggcaggcagaaaaatagaatat

SEQ ID NO: 6966450 - DNA, 22 bp, Homo sapiens
taaaaccattcctgctttcatg

SEQ ID NO: 6966451 - DNA, 20 bp, Homo sapiens
ccaatgtttacagattactt

SEQ ID NO: 6966452 - DNA, 22 bp, Homo sapiens
aaggctgactcaacagggggcc

SEQ ID NO: 6966453 - DNA, 22 bp, Homo sapiens
cctgtgccttaaccctttaggc

SEQ ID NO: 6966454 - DNA, 22 bp, Homo sapiens
cctctgtaagccttagtctaga

SEQ ID NO: 6966455 - DNA, 22 bp, Homo sapiens
gccaataactgccatttgcttt

SEQ ID NO: 6966456 - DNA, 21 bp, Homo sapiens
gttaagccttgaggtgattgt

SEQ ID NO: 6966457 - DNA, 22 bp, Homo sapiens
cactatttttcacttaggctta

SEQ ID NO: 6966458 - DNA, 22 bp, Homo sapiens
aaggatgtggcatttttcatat

SEQ ID NO: 6966459 - DNA, 22 bp, Homo sapiens
ccaccctggacaggcctctgag

SEQ ID NO: 6966460 - DNA, 22 bp, Homo sapiens
gtcctgtttgtatttgctggaa

SEQ ID NO: 6966461 - DNA, 22 bp, Homo sapiens
taggaaactcaaagggaagtgg

SEQ ID NO: 6966462 - DNA, 22 bp, Homo sapiens
gccaggagtgtcccactcattt

SEQ ID NO: 6966463 - DNA, 18 bp, Homo sapiens
tgagtatccagagtcttc

SEQ ID NO: 6966464 - DNA, 22 bp, Homo sapiens
attgattttcagactatgcgag

SEQ ID NO: 6966465 - DNA, 22 bp, Homo sapiens
ctcatgtcccagacttaatcag

SEQ ID NO: 6966466 - DNA, 22 bp, Homo sapiens
ttctaggcctggcttgggccca

SEQ ID NO: 6966467 - DNA, 22 bp, Homo sapiens
ggtggcatctctttccagattt

SEQ ID NO: 6966468 - DNA, 22 bp, Homo sapiens
tgacacactaggaaaagcattt

SEQ ID NO: 6966469 - DNA, 22 bp, Homo sapiens
aggaattctgtctctagacatt

SEQ ID NO: 6966470 - DNA, 22 bp, Homo sapiens
tgaagttttactaggtgaattt

SEQ ID NO: 6966471 - DNA, 22 bp, Homo sapiens
ctgtgccagcctgtcccaggag

SEQ ID NO: 6966472 - DNA, 22 bp, Homo sapiens
gccctgagtggtacctgtgggt

SEQ ID NO: 6966473 - DNA, 19 bp, Homo sapiens
ggctgggtctggcaggttc

SEQ ID NO: 6966474 - DNA, 21 bp, Homo sapiens
agggacaaaacacaatgccac

SEQ ID NO: 6966475 - DNA, 22 bp, Homo sapiens
tgctctgggaccgtcattaaaa

SEQ ID NO: 6966476 - DNA, 22 bp, Homo sapiens
tataatctggttttattaagag

SEQ ID NO: 6966477 - DNA, 22 bp, Homo sapiens
gacccagtgactcgtctctgtg

SEQ ID NO: 6966478 - DNA, 22 bp, Homo sapiens
atgctttatgttctggcatttt

SEQ ID NO: 6966479 - DNA, 22 bp, Homo sapiens
gatacacaaaagtctagtgagg

SEQ ID NO: 6966480 - DNA, 22 bp, Homo sapiens
tacagcattgtgtcttcactca

SEQ ID NO: 6966481 - DNA, 22 bp, Homo sapiens
agtggcagagcaggtgctggaa

SEQ ID NO: 6966482 - DNA, 22 bp, Homo sapiens
cactggggtgggcctggtagag

SEQ ID NO: 6966483 - DNA, 22 bp, Homo sapiens
tgctgcctttgtggggtcactg

SEQ ID NO: 6966484 - DNA, 22 bp, Homo sapiens
ctcagctacttgggaagcttag

SEQ ID NO: 6966485 - DNA, 22 bp, Homo sapiens
tctgggccgctgcgttccatga

SEQ ID NO: 6966486 - DNA, 22 bp, Homo sapiens
tagttaggaatagcagcgactc

SEQ ID NO: 6966487 - DNA, 22 bp, Homo sapiens
cacttcaagagcaagggtgcca

SEQ ID NO: 6966488 - DNA, 22 bp, Homo sapiens
tctagaaagccaaattaggaat

SEQ ID NO: 6966489 - DNA, 22 bp, Homo sapiens
gggagtggttgatggtgaaaat

SEQ ID NO: 6966490 - DNA, 20 bp, Homo sapiens
caccaggaccattggctatg

SEQ ID NO: 6966491 - DNA, 22 bp, Homo sapiens
ccagtattgtgaaattgatgtc

SEQ ID NO: 6966492 - DNA, 22 bp, Homo sapiens
acatatctttccctctcctgaa

SEQ ID NO: 6966493 - DNA, 19 bp, Homo sapiens
tccttcacttcttaccagg

SEQ ID NO: 6966494 - DNA, 22 bp, Homo sapiens
ggtcttccgagaggcctgtgct

SEQ ID NO: 6966495 - DNA, 22 bp, Homo sapiens
ggctctggttgaccatgatggc

SEQ ID NO: 6966496 - DNA, 22 bp, Homo sapiens
gaaaggttgggtgaatggtgga

SEQ ID NO: 6966497 - DNA, 18 bp, Homo sapiens
agtgtctggatatttggg

SEQ ID NO: 6966498 - DNA, 18 bp, Homo sapiens
ccatgtgttccttttggg

SEQ ID NO: 6966499 - DNA, 22 bp, Homo sapiens
agatacagaatggttgtttgtc

SEQ ID NO: 6966500 - DNA, 22 bp, Homo sapiens
ctttccttctcgtggttctcac

SEQ ID NO: 6966501 - DNA, 22 bp, Homo sapiens
tttgaacaagagcttcacatta

SEQ ID NO: 6966502 - DNA, 20 bp, Homo sapiens
atgagtttaaacattcagag

SEQ ID NO: 6966503 - DNA, 22 bp, Homo sapiens
gacctggaggatcctcttcttg

SEQ ID NO: 6966504 - DNA, 22 bp, Homo sapiens
gtgaggcattgaagaccggaat

SEQ ID NO: 6966505 - DNA, 22 bp, Homo sapiens
tatattctttcaccttcttcct

SEQ ID NO: 6966506 - DNA, 22 bp, Homo sapiens
tttaggctcaaaagagttggtg

SEQ ID NO: 6966507 - DNA, 22 bp, Homo sapiens
tctgctgctgagcacactccta

SEQ ID NO: 6966508 - DNA, 22 bp, Homo sapiens
tacattctggaaaggcacagac

SEQ ID NO: 6966509 - DNA, 22 bp, Homo sapiens
cagaggccacctgtggccactg

SEQ ID NO: 6966510 - DNA, 22 bp, Homo sapiens
acatgcttctgtttcaagaact

SEQ ID NO: 6966511 - DNA, 22 bp, Homo sapiens
ctctgtggctacacaaacctcc

SEQ ID NO: 6966512 - DNA, 23 bp, Homo sapiens
ttcctgtggtatattttataggg

SEQ ID NO: 6966513 - DNA, 21 bp, Homo sapiens
gaggaatggtttgcaaagcac

SEQ ID NO: 6966514 - DNA, 22 bp, Homo sapiens
caggcttgctgctagagcactt

SEQ ID NO: 6966515 - DNA, 22 bp, Homo sapiens
tgctggcccagtatggactgca

SEQ ID NO: 6966516 - DNA, 22 bp, Homo sapiens
gactgtccagaattcctaggtg

SEQ ID NO: 6966517 - DNA, 19 bp, Homo sapiens
acaaggctgggagagcgcc

SEQ ID NO: 6966518 - DNA, 22 bp, Homo sapiens
caaatactgagcacgcaatcaa

SEQ ID NO: 6966519 - DNA, 22 bp, Homo sapiens
aggctggatctctgttgccttc

SEQ ID NO: 6966520 - DNA, 22 bp, Homo sapiens
agagcacagaagttatatgtta

SEQ ID NO: 6966521 - DNA, 22 bp, Homo sapiens
tcagaacagtgcctggcactaa

SEQ ID NO: 6966522 - DNA, 22 bp, Homo sapiens
gtctgggttaagtcctgataat

SEQ ID NO: 6966523 - DNA, 22 bp, Homo sapiens
gcttcatttgagaacctctgtg

SEQ ID NO: 6966524 - DNA, 22 bp, Homo sapiens
gagctctgtgaatgtggggagg

SEQ ID NO: 6966525 - DNA, 23 bp, Homo sapiens
tgtcttatctagcttctagaggc

SEQ ID NO: 6966526 - DNA, 22 bp, Homo sapiens
tgccatgaaagttcttagacat

SEQ ID NO: 6966527 - DNA, 22 bp, Homo sapiens
aggtatttatgagagcacatat

SEQ ID NO: 6966528 - DNA, 18 bp, Homo sapiens
atcttaacttgatggagt

SEQ ID NO: 6966529 - DNA, 22 bp, Homo sapiens
acaatattgtacccagaagttt

SEQ ID NO: 6966530 - DNA, 22 bp, Homo sapiens
tgagtaaagggccagatagtaa

SEQ ID NO: 6966531 - DNA, 22 bp, Homo sapiens
aatgaacaaatggtgctgcttg

SEQ ID NO: 6966532 - DNA, 22 bp, Homo sapiens
ttggaaaagtgaaactagatgc

SEQ ID NO: 6966533 - DNA, 22 bp, Homo sapiens
gctaacattgattcagtgcctg

SEQ ID NO: 6966534 - DNA, 22 bp, Homo sapiens
tcctagtaagcggctttctggg

SEQ ID NO: 6966535 - DNA, 22 bp, Homo sapiens
gttgtacagcatccagtgcaga

SEQ ID NO: 6966536 - DNA, 22 bp, Homo sapiens
acaaaatttttagacaaggctt

SEQ ID NO: 6966537 - DNA, 22 bp, Homo sapiens
taaaggcaaactctccaaggat

SEQ ID NO: 6966538 - DNA, 22 bp, Homo sapiens
tatatacttttgtaagttggct

SEQ ID NO: 6966539 - DNA, 22 bp, Homo sapiens
aatgctttgtctgctccagact

SEQ ID NO: 6966540 - DNA, 22 bp, Homo sapiens
aagggctctgctgtctctcccc

SEQ ID NO: 6966541 - DNA, 22 bp, Homo sapiens
tgtcagttcaattatagtaatt

SEQ ID NO: 6966542 - DNA, 22 bp, Homo sapiens
gcttagccttgcctgccttgtc

SEQ ID NO: 6966543 - DNA, 22 bp, Homo sapiens
ctacaaatccacaaggcacttt

SEQ ID NO: 6966544 - DNA, 22 bp, Homo sapiens
aaagtgctgagattacaagcgt

SEQ ID NO: 6966545 - DNA, 22 bp, Homo sapiens
aaagtgctgggattacaggcgt

SEQ ID NO: 6966546 - DNA, 22 bp, Homo sapiens
aaactaagactaatgaagaact

SEQ ID NO: 6966547 - DNA, 22 bp, Homo sapiens
agggcctctgacgcccccagcc

SEQ ID NO: 6966548 - DNA, 22 bp, Homo sapiens
aacactaacatatagtcagtgg

SEQ ID NO: 6966549 - DNA, 22 bp, Homo sapiens
ggcaggactgatcagtgggatg

SEQ ID NO: 6966550 - DNA, 22 bp, Homo sapiens
tctgaggctgcatctatgtgac

SEQ ID NO: 6966551 - DNA, 22 bp, Homo sapiens
acatgcacccagttacactctc

SEQ ID NO: 6966552 - DNA, 18 bp, Homo sapiens
tccagggcttcctcctct

SEQ ID NO: 6966553 - DNA, 19 bp, Homo sapiens
gtttcattaagataggaaa

SEQ ID NO: 6966554 - DNA, 22 bp, Homo sapiens
ggctccccaggtccaggagctg

SEQ ID NO: 6966555 - DNA, 22 bp, Homo sapiens
aaaccatgagcagctgggctga

SEQ ID NO: 6966556 - DNA, 19 bp, Homo sapiens
ggtcagcagtttagggtct

SEQ ID NO: 6966557 - DNA, 22 bp, Homo sapiens
tgcttggctaaaaatggcaaga

SEQ ID NO: 6966558 - DNA, 22 bp, Homo sapiens
catggtttattagagcttattt

SEQ ID NO: 6966559 - DNA, 22 bp, Homo sapiens
atgtccttgggccagggtgcct

SEQ ID NO: 6966560 - DNA, 22 bp, Homo sapiens
tgcatcttcagccctcagccag

SEQ ID NO: 6966561 - DNA, 22 bp, Homo sapiens
cttacagtgaccctgcagattt

SEQ ID NO: 6966562 - DNA, 22 bp, Homo sapiens
tatttgaagacagggtctttaa

SEQ ID NO: 6966563 - DNA, 22 bp, Homo sapiens
gcattacaggaatttgttactg

SEQ ID NO: 6966564 - DNA, 23 bp, Homo sapiens
tggcagttttcttttgtgccagc

SEQ ID NO: 6966565 - DNA, 22 bp, Homo sapiens
cactgcctgctggctgtcactt

SEQ ID NO: 6966566 - DNA, 20 bp, Homo sapiens
atttatgtatagcttgttgt

SEQ ID NO: 6966567 - DNA, 18 bp, Homo sapiens
tcatagaagtgaatcaga

SEQ ID NO: 6966568 - DNA, 22 bp, Homo sapiens
gcctcagaatcatttatcatct

SEQ ID NO: 6966569 - DNA, 22 bp, Homo sapiens
actttctcaaatcagactttaa

SEQ ID NO: 6966570 - DNA, 22 bp, Homo sapiens
ctctggtgtctcccctaagcta

SEQ ID NO: 6966571 - DNA, 22 bp, Homo sapiens
actgagctgtgacaatgcttaa

SEQ ID NO: 6966572 - DNA, 22 bp, Homo sapiens
ttcaccaggtgtacagttagtt

SEQ ID NO: 6966573 - DNA, 22 bp, Homo sapiens
atacaactgccttagaaggaaa

SEQ ID NO: 6966574 - DNA, 22 bp, Homo sapiens
tggaagggggaagacagctctg

SEQ ID NO: 6966575 - DNA, 22 bp, Homo sapiens
ctgaaattactggccctggagc

SEQ ID NO: 6966576 - DNA, 22 bp, Homo sapiens
taggaagcgagcatctaactag

SEQ ID NO: 6966577 - DNA, 22 bp, Homo sapiens
ttcaagttctagtgttcacttc

SEQ ID NO: 6966578 - DNA, 22 bp, Homo sapiens
tggaatcttgcgggcacatggc

SEQ ID NO: 6966579 - DNA, 22 bp, Homo sapiens
tccaggcatgtcccaagccgga

SEQ ID NO: 6966580 - DNA, 22 bp, Homo sapiens
accaccccagaatttttcaagg

SEQ ID NO: 6966581 - DNA, 22 bp, Homo sapiens
tctcaggcccactgtgttgaaa

SEQ ID NO: 6966582 - DNA, 22 bp, Homo sapiens
cacttcaacctctgagtcctgg

SEQ ID NO: 6966583 - DNA, 22 bp, Homo sapiens
tatgatctctgggtctggagct

SEQ ID NO: 6966584 - DNA, 22 bp, Homo sapiens
ttgacaagcgaagtaccataat

SEQ ID NO: 6966585 - DNA, 22 bp, Homo sapiens
tctgcctgctgcctgggggctc

SEQ ID NO: 6966586 - DNA, 22 bp, Homo sapiens
tgtggggccaaagcccagccac

SEQ ID NO: 6966587 - DNA, 22 bp, Homo sapiens
actgaagtgaaggcaatctttt

SEQ ID NO: 6966588 - DNA, 22 bp, Homo sapiens
gagtgggtaaaggtgcttggct

SEQ ID NO: 6966589 - DNA, 22 bp, Homo sapiens
gtagcttccagaaagtgtcttt

SEQ ID NO: 6966590 - DNA, 22 bp, Homo sapiens
aataaagcagggtccttgcact

SEQ ID NO: 6966591 - DNA, 22 bp, Homo sapiens
atacacatgcacacatgtgtgt

SEQ ID NO: 6966592 - DNA, 22 bp, Homo sapiens
ttctgcagcccaacagtagttt

SEQ ID NO: 6966593 - DNA, 22 bp, Homo sapiens
ttcattgaaattaagcccaact

SEQ ID NO: 6966594 - DNA, 22 bp, Homo sapiens
atggtataggccattgggggca

SEQ ID NO: 6966595 - DNA, 22 bp, Homo sapiens
caaggacactgatgttcatcct

SEQ ID NO: 6966596 - DNA, 17 bp, Homo sapiens
aaaggtcgataaggtgg

SEQ ID NO: 6966597 - DNA, 22 bp, Homo sapiens
tctctgactaggtctgattttc

SEQ ID NO: 6966598 - DNA, 22 bp, Homo sapiens
tgggactgagaatatgatgggg

SEQ ID NO: 6966599 - DNA, 22 bp, Homo sapiens
atgtgtatttatttggggctta

SEQ ID NO: 6966600 - DNA, 22 bp, Homo sapiens
ctgcaggctcgaagacacggat

SEQ ID NO: 6966601 - DNA, 22 bp, Homo sapiens
tggggcgcgaggtcctggctcc

SEQ ID NO: 6966602 - DNA, 22 bp, Homo sapiens
tggcagaagttcactagtagct

SEQ ID NO: 6966603 - DNA, 22 bp, Homo sapiens
atgtaaagtaatctgtcgatca

SEQ ID NO: 6966604 - DNA, 22 bp, Homo sapiens
atttccatgtcggtattttata

SEQ ID NO: 6966605 - DNA, 22 bp, Homo sapiens
tttcataaacagtagaagacta

SEQ ID NO: 6966606 - DNA, 22 bp, Homo sapiens
atacactggcctttgcagagcc

SEQ ID NO: 6966607 - DNA, 22 bp, Homo sapiens
ctcagaataatgtttctaaagg

SEQ ID NO: 6966608 - DNA, 22 bp, Homo sapiens
agcacatgtattctccttgaat

SEQ ID NO: 6966609 - DNA, 22 bp, Homo sapiens
acttatgtagtacctcttatgt

SEQ ID NO: 6966610 - DNA, 22 bp, Homo sapiens
tagtaaatctcagaaaaagatc

SEQ ID NO: 6966611 - DNA, 22 bp, Homo sapiens
gctcacatcatagtaagctcat

SEQ ID NO: 6966612 - DNA, 22 bp, Homo sapiens
gctgttcattagaaatagaatg

SEQ ID NO: 6966613 - DNA, 22 bp, Homo sapiens
ttagtagtaagagtcatatgta

SEQ ID NO: 6966614 - DNA, 22 bp, Homo sapiens
tcattaagtaaggcaggtggtt

SEQ ID NO: 6966615 - DNA, 22 bp, Homo sapiens
gctcagggaaggccacgtgaga

SEQ ID NO: 6966616 - DNA, 22 bp, Homo sapiens
tgtccagccggagtcggttaga

SEQ ID NO: 6966617 - DNA, 22 bp, Homo sapiens
ccatcccttcaccacagcagta

SEQ ID NO: 6966618 - DNA, 22 bp, Homo sapiens
ggtggccttttatgagcagggt

SEQ ID NO: 6966619 - DNA, 22 bp, Homo sapiens
ggagatctttaggagttggact

SEQ ID NO: 6966620 - DNA, 17 bp, Homo sapiens
tcactgggcctgctccc

SEQ ID NO: 6966621 - DNA, 22 bp, Homo sapiens
ggctgatcaggtgcaaatgcat

SEQ ID NO: 6966622 - DNA, 22 bp, Homo sapiens
ttctctggcggtgtgttttcct

SEQ ID NO: 6966623 - DNA, 22 bp, Homo sapiens
ttacagttggtattagaccaaa

SEQ ID NO: 6966624 - DNA, 22 bp, Homo sapiens
agctgcagtgaattcgctaact

SEQ ID NO: 6966625 - DNA, 22 bp, Homo sapiens
aggactggccctgaggggaggc

SEQ ID NO: 6966626 - DNA, 22 bp, Homo sapiens
cctcaaatagcccccagtctag

SEQ ID NO: 6966627 - DNA, 22 bp, Homo sapiens
gaaggaggtctgatacaatatg

SEQ ID NO: 6966628 - DNA, 22 bp, Homo sapiens
ttaccaggaggcattctctgaa

SEQ ID NO: 6966629 - DNA, 22 bp, Homo sapiens
gacagtaactgagagatgtaat

SEQ ID NO: 6966630 - DNA, 22 bp, Homo sapiens
cagggttcagtgggccctcttg

SEQ ID NO: 6966631 - DNA, 18 bp, Homo sapiens
tggcctggagacaactct

SEQ ID NO: 6966632 - DNA, 17 bp, Homo sapiens
tcatgcccaactattac

SEQ ID NO: 6966633 - DNA, 22 bp, Homo sapiens
tgcatgcacgtatctgcgtgtg

SEQ ID NO: 6966634 - DNA, 22 bp, Homo sapiens
ggcagccctttctggccagctc

SEQ ID NO: 6966635 - DNA, 22 bp, Homo sapiens
tgccagtatagttaaggtctta

SEQ ID NO: 6966636 - DNA, 22 bp, Homo sapiens
cagagctgattggatccagaga

SEQ ID NO: 6966637 - DNA, 22 bp, Homo sapiens
gctcctgtgaggacacagccgc

SEQ ID NO: 6966638 - DNA, 22 bp, Homo sapiens
gttcccaggccctgggctctcc

SEQ ID NO: 6966639 - DNA, 22 bp, Homo sapiens
tttcccaaagcctggggtgagt

SEQ ID NO: 6966640 - DNA, 22 bp, Homo sapiens
tcagctgggtgagtgttctgca

SEQ ID NO: 6966641 - DNA, 22 bp, Homo sapiens
ggagacacgggtgctgaggacc

SEQ ID NO: 6966642 - DNA, 22 bp, Homo sapiens
cagctctgtgtattttccccac

SEQ ID NO: 6966643 - DNA, 22 bp, Homo sapiens
agcttaaataggagccccaggg

SEQ ID NO: 6966644 - DNA, 22 bp, Homo sapiens
agttcaagcaatgctggaagaa

SEQ ID NO: 6966645 - DNA, 22 bp, Homo sapiens
gtggtaccagtaggtcagccat

SEQ ID NO: 6966646 - DNA, 22 bp, Homo sapiens
tatgcacattcacacaaaaatg

SEQ ID NO: 6966647 - DNA, 22 bp, Homo sapiens
ctggcttgttttaagaatacaa

SEQ ID NO: 6966648 - DNA, 22 bp, Homo sapiens
tggtcttctaaccctcagtcca

SEQ ID NO: 6966649 - DNA, 19 bp, Homo sapiens
ttggtggtggttttggttc

SEQ ID NO: 6966650 - DNA, 22 bp, Homo sapiens
acatcgtgtatcactgaacctt

SEQ ID NO: 6966651 - DNA, 22 bp, Homo sapiens
gtgtcttagggttgcacagagt

SEQ ID NO: 6966652 - DNA, 22 bp, Homo sapiens
caaagtgcctgtaccactttgc

SEQ ID NO: 6966653 - DNA, 22 bp, Homo sapiens
tcagagaaatgaagtagggatt

SEQ ID NO: 6966654 - DNA, 22 bp, Homo sapiens
ggagttcaccaaggttatgcag

SEQ ID NO: 6966655 - DNA, 22 bp, Homo sapiens
aacttacaatgttagagtctca

SEQ ID NO: 6966656 - DNA, 20 bp, Homo sapiens
aagatactccagaaattaaa

SEQ ID NO: 6966657 - DNA, 22 bp, Homo sapiens
acaaaccagcttaagcaagatg

SEQ ID NO: 6966658 - DNA, 22 bp, Homo sapiens
ggagctagtagtttcatgagtt

SEQ ID NO: 6966659 - DNA, 22 bp, Homo sapiens
ctggtgtttatctgactgccta

SEQ ID NO: 6966660 - DNA, 22 bp, Homo sapiens
cagtgccctcatctatgaaatc

SEQ ID NO: 6966661 - DNA, 22 bp, Homo sapiens
agatatggcctcatacagacat

SEQ ID NO: 6966662 - DNA, 22 bp, Homo sapiens
tcacagtttcttttctgataaa

SEQ ID NO: 6966663 - DNA, 22 bp, Homo sapiens
ggagctcttccagcttgttgct

SEQ ID NO: 6966664 - DNA, 17 bp, Homo sapiens
ccctgccaccaggaagc

SEQ ID NO: 6966665 - DNA, 22 bp, Homo sapiens
acataagtgcacaataaatatt

SEQ ID NO: 6966666 - DNA, 22 bp, Homo sapiens
gtcaattagctaaaatttggta

SEQ ID NO: 6966667 - DNA, 22 bp, Homo sapiens
gctccctgaaaagaacaaagtc

SEQ ID NO: 6966668 - DNA, 22 bp, Homo sapiens
gccctgttgtcggacgtcaagg

SEQ ID NO: 6966669 - DNA, 22 bp, Homo sapiens
agagaattacagaagaatgtca

SEQ ID NO: 6966670 - DNA, 22 bp, Homo sapiens
tcttcttcccatccctcaaatg

SEQ ID NO: 6966671 - DNA, 23 bp, Homo sapiens
ggtcagtgagttcgtttctctgg

SEQ ID NO: 6966672 - DNA, 22 bp, Homo sapiens
agcagcaaggaacagaatggac

SEQ ID NO: 6966673 - DNA, 22 bp, Homo sapiens
acttggcaaacaacgtggatat

SEQ ID NO: 6966674 - DNA, 22 bp, Homo sapiens
agcatctgttgaatataatatt

SEQ ID NO: 6966675 - DNA, 22 bp, Homo sapiens
acttttctccctcctgccttca

SEQ ID NO: 6966676 - DNA, 22 bp, Homo sapiens
gaaattaaccacctttggcttt

SEQ ID NO: 6966677 - DNA, 22 bp, Homo sapiens
ctggagctaggaagtccaagat

SEQ ID NO: 6966678 - DNA, 22 bp, Homo sapiens
cgatttccgcttgatctgatct

SEQ ID NO: 6966679 - DNA, 22 bp, Homo sapiens
tcagagtgaccttacatggtct

SEQ ID NO: 6966680 - DNA, 23 bp, Homo sapiens
aaactgaggcttgatgaggcggt

SEQ ID NO: 6966681 - DNA, 22 bp, Homo sapiens
tgagaataactgatttaaatgc

SEQ ID NO: 6966682 - DNA, 22 bp, Homo sapiens
tctatgaatcaattttaacatc

SEQ ID NO: 6966683 - DNA, 22 bp, Homo sapiens
tttgggcagtagatgtatcact

SEQ ID NO: 6966684 - DNA, 21 bp, Homo sapiens
gtattctttatgaagtgaaaa

SEQ ID NO: 6966685 - DNA, 22 bp, Homo sapiens
actggcattccagcactataat

SEQ ID NO: 6966686 - DNA, 22 bp, Homo sapiens
gaagttactttagaggaggctg

SEQ ID NO: 6966687 - DNA, 22 bp, Homo sapiens
ttacagttgttctatcagcatg

SEQ ID NO: 6966688 - DNA, 22 bp, Homo sapiens
agatcaaagccatgagagattt

SEQ ID NO: 6966689 - DNA, 22 bp, Homo sapiens
gatgaaaatcttgagatgtcga

SEQ ID NO: 6966690 - DNA, 22 bp, Homo sapiens
ggagtgcagtggcgtgagctcg

SEQ ID NO: 6966691 - DNA, 22 bp, Homo sapiens
aggtcctgtggtttgggtaaaa

SEQ ID NO: 6966692 - DNA, 22 bp, Homo sapiens
tcaaatgctctttgcagagagg

SEQ ID NO: 6966693 - DNA, 22 bp, Homo sapiens
tgcccaaggtggccttttactc

SEQ ID NO: 6966694 - DNA, 22 bp, Homo sapiens
ggtggcacactggggagctcgg

SEQ ID NO: 6966695 - DNA, 22 bp, Homo sapiens
ctgcctctgttgggcatggtct

SEQ ID NO: 6966696 - DNA, 22 bp, Homo sapiens
ttgacagaatgttacatataga

SEQ ID NO: 6966697 - DNA, 22 bp, Homo sapiens
ccaggagccctgccacaatggt

SEQ ID NO: 6966698 - DNA, 22 bp, Homo sapiens
actgccaatggtagtttgatgg

SEQ ID NO: 6966699 - DNA, 22 bp, Homo sapiens
tcatgcagagtagaaagggcaa

SEQ ID NO: 6966700 - DNA, 22 bp, Homo sapiens
aagggaggtaaagctatttaaa

SEQ ID NO: 6966701 - DNA, 22 bp, Homo sapiens
tctgatttgtagctacatgtct

SEQ ID NO: 6966702 - DNA, 22 bp, Homo sapiens
tcagtgttggagataattgcac

SEQ ID NO: 6966703 - DNA, 22 bp, Homo sapiens
attcaccccctatttgcaatgc

SEQ ID NO: 6966704 - DNA, 22 bp, Homo sapiens
gaaactgtatgtagtttttggg

SEQ ID NO: 6966705 - DNA, 22 bp, Homo sapiens
cttcagccctgagtgccagcag

SEQ ID NO: 6966706 - DNA, 22 bp, Homo sapiens
gtaggagcattgagggtatgga

SEQ ID NO: 6966707 - DNA, 21 bp, Homo sapiens
atgtcagtggtttaacacaac

SEQ ID NO: 6966708 - DNA, 22 bp, Homo sapiens
tgggccaggtctgtgtcagctg

SEQ ID NO: 6966709 - DNA, 22 bp, Homo sapiens
tttattcagcagcagcagtggt

SEQ ID NO: 6966710 - DNA, 19 bp, Homo sapiens
ctgagcagagggaggaact

SEQ ID NO: 6966711 - DNA, 22 bp, Homo sapiens
gcctgttgggtaacagagttca

SEQ ID NO: 6966712 - DNA, 22 bp, Homo sapiens
tataaagagtctcaaagaagtt

SEQ ID NO: 6966713 - DNA, 22 bp, Homo sapiens
tccttagcaacactgttataat

SEQ ID NO: 6966714 - DNA, 21 bp, Homo sapiens
cagcccagcccattgacagtg

SEQ ID NO: 6966715 - DNA, 22 bp, Homo sapiens
tttcattgtccccaggcaagac

SEQ ID NO: 6966716 - DNA, 22 bp, Homo sapiens
atcacacagagcattaggggcc

SEQ ID NO: 6966717 - DNA, 22 bp, Homo sapiens
tacaggtcttctgccttcactc

SEQ ID NO: 6966718 - DNA, 22 bp, Homo sapiens
caggcctttcttggggcttaga

SEQ ID NO: 6966719 - DNA, 22 bp, Homo sapiens
attctagccctggaacggcgac

SEQ ID NO: 6966720 - DNA, 22 bp, Homo sapiens
atcagaaatagtcatgttactt

SEQ ID NO: 6966721 - DNA, 22 bp, Homo sapiens
cgccttcacaaggacagtatat

SEQ ID NO: 6966722 - DNA, 19 bp, Homo sapiens
gagatatagaagtagatgt

SEQ ID NO: 6966723 - DNA, 22 bp, Homo sapiens
tcattcaggttgggcaagtgtc

SEQ ID NO: 6966724 - DNA, 22 bp, Homo sapiens
cactgtcacgttctgaaactgt

SEQ ID NO: 6966725 - DNA, 22 bp, Homo sapiens
tcagtgcattcatgggtggctg

SEQ ID NO: 6966726 - DNA, 22 bp, Homo sapiens
cctgtttcagaatttttagtga

SEQ ID NO: 6966727 - DNA, 22 bp, Homo sapiens
aggctgcttcagctgcagggag

SEQ ID NO: 6966728 - DNA, 22 bp, Homo sapiens
tagggcctaagtcctgacatgg

SEQ ID NO: 6966729 - DNA, 22 bp, Homo sapiens
ttttcctctgcaataaaagcag

SEQ ID NO: 6966730 - DNA, 22 bp, Homo sapiens
gacagggtttgcaaggacttcg

SEQ ID NO: 6966731 - DNA, 22 bp, Homo sapiens
acactgtgatttctgggttcca

SEQ ID NO: 6966732 - DNA, 22 bp, Homo sapiens
gagggtgcaggcaagagcaaaa

SEQ ID NO: 6966733 - DNA, 22 bp, Homo sapiens
ctaaagagagttcaagactcct

SEQ ID NO: 6966734 - DNA, 22 bp, Homo sapiens
gctgccttccctgttctttcag

SEQ ID NO: 6966735 - DNA, 22 bp, Homo sapiens
gcctggggaacttgatcctgtc

SEQ ID NO: 6966736 - DNA, 22 bp, Homo sapiens
ggaagagaggttcagccctaag

SEQ ID NO: 6966737 - DNA, 22 bp, Homo sapiens
tcacccaggtccaggctctggc

SEQ ID NO: 6966738 - DNA, 22 bp, Homo sapiens
aagtagaatctcaggtaggcta

SEQ ID NO: 6966739 - DNA, 22 bp, Homo sapiens
cagtgattgtactgttgtgcct

SEQ ID NO: 6966740 - DNA, 21 bp, Homo sapiens
gaaaggtcttaacttacagag

SEQ ID NO: 6966741 - DNA, 22 bp, Homo sapiens
aaagttcagtgccttctataca

SEQ ID NO: 6966742 - DNA, 22 bp, Homo sapiens
tttgggctcaatatttgggctc

SEQ ID NO: 6966743 - DNA, 22 bp, Homo sapiens
aagggccataacttgcagtgtt

SEQ ID NO: 6966744 - DNA, 22 bp, Homo sapiens
atgggacacacaaggaagtaaa

SEQ ID NO: 6966745 - DNA, 22 bp, Homo sapiens
tattcaagattgaactggcaga

SEQ ID NO: 6966746 - DNA, 22 bp, Homo sapiens
aattagctttccgccatcacac

SEQ ID NO: 6966747 - DNA, 22 bp, Homo sapiens
gcagaggtctagcaccaagaat

SEQ ID NO: 6966748 - DNA, 22 bp, Homo sapiens
tctcataattgtttcccagcta

SEQ ID NO: 6966749 - DNA, 22 bp, Homo sapiens
aaactgtcacctaatgtatttt

SEQ ID NO: 6966750 - DNA, 19 bp, Homo sapiens
gttctgtgtcctggaggaa

SEQ ID NO: 6966751 - DNA, 22 bp, Homo sapiens
ttttggtttcccttcttatggt

SEQ ID NO: 6966752 - DNA, 22 bp, Homo sapiens
gctgagagcaaagcatgtctag

SEQ ID NO: 6966753 - DNA, 22 bp, Homo sapiens
tccctgtacttacacagcgtcc

SEQ ID NO: 6966754 - DNA, 16 bp, Homo sapiens
ttgcaaggcgtttata

SEQ ID NO: 6966755 - DNA, 22 bp, Homo sapiens
gggcctggtgcttctgactcct

SEQ ID NO: 6966756 - DNA, 22 bp, Homo sapiens
ctgtgactgtgttggatgcaca

SEQ ID NO: 6966757 - DNA, 22 bp, Homo sapiens
tcacatgaagatccctcaattt

SEQ ID NO: 6966758 - DNA, 22 bp, Homo sapiens
acagggtcattttatgatctgt

SEQ ID NO: 6966759 - DNA, 22 bp, Homo sapiens
gcatttacatggagctatctaa

SEQ ID NO: 6966760 - DNA, 22 bp, Homo sapiens
cacacgagccctggagccagca

SEQ ID NO: 6966761 - DNA, 22 bp, Homo sapiens
ttaaaatgaatattgattagca

SEQ ID NO: 6966762 - DNA, 22 bp, Homo sapiens
aggactggtgtgtgatcagcat

SEQ ID NO: 6966763 - DNA, 22 bp, Homo sapiens
aggcaacaggaaaccacatgat

SEQ ID NO: 6966764 - DNA, 22 bp, Homo sapiens
ggccctctgcctgtgctggcga

SEQ ID NO: 6966765 - DNA, 20 bp, Homo sapiens
ttcctgtatacaaagagttc

SEQ ID NO: 6966766 - DNA, 22 bp, Homo sapiens
cttgggtgtgaccttggcattg

SEQ ID NO: 6966767 - DNA, 22 bp, Homo sapiens
gcatggcttcggggtgctgcct

SEQ ID NO: 6966768 - DNA, 22 bp, Homo sapiens
gatatagtaggacacatcatga

SEQ ID NO: 6966769 - DNA, 22 bp, Homo sapiens
ttgcatttgagaaagttctcct

SEQ ID NO: 6966770 - DNA, 23 bp, Homo sapiens
tcagaaggtgccactgacgcttt

SEQ ID NO: 6966771 - DNA, 22 bp, Homo sapiens
acaattcctgagaatacttgtt

SEQ ID NO: 6966772 - DNA, 22 bp, Homo sapiens
gccagtggtcactgaggaagaa

SEQ ID NO: 6966773 - DNA, 22 bp, Homo sapiens
accagttacagcttatgtttga

SEQ ID NO: 6966774 - DNA, 20 bp, Homo sapiens
agcaaacaggctccaccaga

SEQ ID NO: 6966775 - DNA, 22 bp, Homo sapiens
gaggcagcaaaatatatcataa

SEQ ID NO: 6966776 - DNA, 22 bp, Homo sapiens
tagcagtggaatcttttgtcca

SEQ ID NO: 6966777 - DNA, 23 bp, Homo sapiens
agggctccttgttgattagcatt

SEQ ID NO: 6966778 - DNA, 22 bp, Homo sapiens
catttagaaactgtttttaaca

SEQ ID NO: 6966779 - DNA, 22 bp, Homo sapiens
atttgctagcaagtattctgaa

SEQ ID NO: 6966780 - DNA, 23 bp, Homo sapiens
tgggagataagcagaagcctggt

SEQ ID NO: 6966781 - DNA, 22 bp, Homo sapiens
catttgctcttcatccccaact

SEQ ID NO: 6966782 - DNA, 22 bp, Homo sapiens
tattttacatgatccagagttg

SEQ ID NO: 6966783 - DNA, 22 bp, Homo sapiens
ttaaacactgggggttaatgca

SEQ ID NO: 6966784 - DNA, 22 bp, Homo sapiens
atgctacagcatctctcatcag

SEQ ID NO: 6966785 - DNA, 22 bp, Homo sapiens
gaggcatctgggcacagaagtg

SEQ ID NO: 6966786 - DNA, 23 bp, Homo sapiens
cttgcaggaagcagatggcacac

SEQ ID NO: 6966787 - DNA, 22 bp, Homo sapiens
ctccactcaggtgcttaagttg

SEQ ID NO: 6966788 - DNA, 22 bp, Homo sapiens
gtttaagaaaattcatgttgtt

SEQ ID NO: 6966789 - DNA, 22 bp, Homo sapiens
gggaaagaagatctagatactg

SEQ ID NO: 6966790 - DNA, 22 bp, Homo sapiens
ttggaaatacagcagttacttt

SEQ ID NO: 6966791 - DNA, 22 bp, Homo sapiens
tctgagaatgagtgttttctta

SEQ ID NO: 6966792 - DNA, 22 bp, Homo sapiens
ttgtctgaaagatcattacatt

SEQ ID NO: 6966793 - DNA, 22 bp, Homo sapiens
actccagagctcacatgtctaa

SEQ ID NO: 6966794 - DNA, 22 bp, Homo sapiens
gtgtacagtgatttgagttcac

SEQ ID NO: 6966795 - DNA, 22 bp, Homo sapiens
actctgctgataggtcctcaga

SEQ ID NO: 6966796 - DNA, 22 bp, Homo sapiens
aaggcttctttagtgtcctaat

SEQ ID NO: 6966797 - DNA, 22 bp, Homo sapiens
cccaggaaacccgaaggcgacc

SEQ ID NO: 6966798 - DNA, 22 bp, Homo sapiens
aacagagcattctgcactacaa

SEQ ID NO: 6966799 - DNA, 22 bp, Homo sapiens
gctctgccctgggccgttgtaa

SEQ ID NO: 6966800 - DNA, 22 bp, Homo sapiens
ggcagaggaagctggaagtggg

SEQ ID NO: 6966801 - DNA, 22 bp, Homo sapiens
tgttctttcagttagacacagt

SEQ ID NO: 6966802 - DNA, 22 bp, Homo sapiens
cagggctccatgcagggactcc

SEQ ID NO: 6966803 - DNA, 22 bp, Homo sapiens
aagtttgatgagtttctggagg

SEQ ID NO: 6966804 - DNA, 22 bp, Homo sapiens
attctaagtgcttgtggtggtt

SEQ ID NO: 6966805 - DNA, 22 bp, Homo sapiens
gcagtgcagtgggacagggcgc

SEQ ID NO: 6966806 - DNA, 22 bp, Homo sapiens
cagacacacaagcaatctaagt

SEQ ID NO: 6966807 - DNA, 23 bp, Homo sapiens
agttcaaaatcaaccaggacact

SEQ ID NO: 6966808 - DNA, 22 bp, Homo sapiens
atgtagtagttcacattctgtt

SEQ ID NO: 6966809 - DNA, 22 bp, Homo sapiens
tgctgtgttcctcagtttcatg

SEQ ID NO: 6966810 - DNA, 22 bp, Homo sapiens
catagaatatgtgtgattgtta

SEQ ID NO: 6966811 - DNA, 22 bp, Homo sapiens
ccctacaggtgattctggtgct

SEQ ID NO: 6966812 - DNA, 22 bp, Homo sapiens
acagagcacatagattggagtt

SEQ ID NO: 6966813 - DNA, 22 bp, Homo sapiens
tccaccacttcctgcagccatt

SEQ ID NO: 6966814 - DNA, 22 bp, Homo sapiens
cccaaggcctctccttggcttg

SEQ ID NO: 6966815 - DNA, 20 bp, Homo sapiens
ttctttgttccttacatttg

SEQ ID NO: 6966816 - DNA, 22 bp, Homo sapiens
ggcaagagtgaggagtgtctct

SEQ ID NO: 6966817 - DNA, 19 bp, Homo sapiens
agcacttgtggtcctccct

SEQ ID NO: 6966818 - DNA, 22 bp, Homo sapiens
actctggtctttctgaaagcaa

SEQ ID NO: 6966819 - DNA, 22 bp, Homo sapiens
atgttttatgcttcagatgagg

SEQ ID NO: 6966820 - DNA, 21 bp, Homo sapiens
catccgtttatatctctgtgg

SEQ ID NO: 6966821 - DNA, 22 bp, Homo sapiens
gcccagggtgaagtgcagttgt

SEQ ID NO: 6966822 - DNA, 22 bp, Homo sapiens
cagaggcaggaagatgggcagt

SEQ ID NO: 6966823 - DNA, 22 bp, Homo sapiens
caaagcgtcctgcctccatttg

SEQ ID NO: 6966824 - DNA, 22 bp, Homo sapiens
caaggattttgattgtttgaaa

SEQ ID NO: 6966825 - DNA, 22 bp, Homo sapiens
ttgtatggatttgtgggtgagt

SEQ ID NO: 6966826 - DNA, 22 bp, Homo sapiens
tatatatatgcacacacaccta

SEQ ID NO: 6966827 - DNA, 22 bp, Homo sapiens
gcagtcctggaggaaggtgtga

SEQ ID NO: 6966828 - DNA, 22 bp, Homo sapiens
cagctcttggagcctccagtaa

SEQ ID NO: 6966829 - DNA, 22 bp, Homo sapiens
aacatgcagattccccgggccc

SEQ ID NO: 6966830 - DNA, 22 bp, Homo sapiens
aactgtcatctttcaaggaaga

SEQ ID NO: 6966831 - DNA, 22 bp, Homo sapiens
gtgtgcagaagacacaagacat

SEQ ID NO: 6966832 - DNA, 22 bp, Homo sapiens
agcagcctttgatcatctggga

SEQ ID NO: 6966833 - DNA, 22 bp, Homo sapiens
tgcttaaaggatagtttaaact

SEQ ID NO: 6966834 - DNA, 22 bp, Homo sapiens
aagtccaggtcctcattccatc

SEQ ID NO: 6966835 - DNA, 21 bp, Homo sapiens
gcagggtcctttccattccta

SEQ ID NO: 6966836 - DNA, 22 bp, Homo sapiens
tattcacaggttctggggatca

SEQ ID NO: 6966837 - DNA, 22 bp, Homo sapiens
ttgcatctagggcaacccagag

SEQ ID NO: 6966838 - DNA, 22 bp, Homo sapiens
aggagagagctgagctttgctg

SEQ ID NO: 6966839 - DNA, 21 bp, Homo sapiens
gggctcagcgctcggctcctc

SEQ ID NO: 6966840 - DNA, 22 bp, Homo sapiens
atagaagatagcttttgtttct

SEQ ID NO: 6966841 - DNA, 22 bp, Homo sapiens
tcccagcattaatgcctgtcag

SEQ ID NO: 6966842 - DNA, 22 bp, Homo sapiens
atagggcccccgtgggtgctca

SEQ ID NO: 6966843 - DNA, 22 bp, Homo sapiens
ttgtgcatattaggtacatgct

SEQ ID NO: 6966844 - DNA, 23 bp, Homo sapiens
ataagccttttctttctgcccca

SEQ ID NO: 6966845 - DNA, 22 bp, Homo sapiens
ttctaggcagattgtctaaagc

SEQ ID NO: 6966846 - DNA, 22 bp, Homo sapiens
gtatttgatgtaatttcagtgc

SEQ ID NO: 6966847 - DNA, 22 bp, Homo sapiens
aagtgcaagcaggacttagttt

SEQ ID NO: 6966848 - DNA, 22 bp, Homo sapiens
ccagctctgcagggcctggggt

SEQ ID NO: 6966849 - DNA, 20 bp, Homo sapiens
ctgtcctgatcttttcagaa

SEQ ID NO: 6966850 - DNA, 22 bp, Homo sapiens
cgggcgcactccgggcagctgt

SEQ ID NO: 6966851 - DNA, 22 bp, Homo sapiens
ctggaggtgggggcaagagtgt

SEQ ID NO: 6966852 - DNA, 22 bp, Homo sapiens
gtcttctaagtatcaaagcaga

SEQ ID NO: 6966853 - DNA, 22 bp, Homo sapiens
tttccactctggccaccatctt

SEQ ID NO: 6966854 - DNA, 22 bp, Homo sapiens
tttctgacacatcagttgtaaa

SEQ ID NO: 6966855 - DNA, 22 bp, Homo sapiens
gctgcctcccagagccctgcag

SEQ ID NO: 6966856 - DNA, 22 bp, Homo sapiens
cctggccttaagggcagggagc

SEQ ID NO: 6966857 - DNA, 22 bp, Homo sapiens
taaatctcctgtttttcatcta

SEQ ID NO: 6966858 - DNA, 22 bp, Homo sapiens
tgccgctgtcgccaccatggct

SEQ ID NO: 6966859 - DNA, 22 bp, Homo sapiens
caatttccttcatagatgactg

SEQ ID NO: 6966860 - DNA, 22 bp, Homo sapiens
tgcattatacttttagaaattt

SEQ ID NO: 6966861 - DNA, 22 bp, Homo sapiens
acagatagatttgagggaggct

SEQ ID NO: 6966862 - DNA, 22 bp, Homo sapiens
ttctggcatgagagatgggggt

SEQ ID NO: 6966863 - DNA, 22 bp, Homo sapiens
ttgcccaccatccaataaaatg

SEQ ID NO: 6966864 - DNA, 20 bp, Homo sapiens
ggggacccagaatcacagct

SEQ ID NO: 6966865 - DNA, 22 bp, Homo sapiens
gacaggccagacaggagactga

SEQ ID NO: 6966866 - DNA, 20 bp, Homo sapiens
tagaatctactatttggccc

SEQ ID NO: 6966867 - DNA, 22 bp, Homo sapiens
gaaacactatgccaagacaggg

SEQ ID NO: 6966868 - DNA, 20 bp, Homo sapiens
tgctgggccatcttgcatgc

SEQ ID NO: 6966869 - DNA, 22 bp, Homo sapiens
agactctgttgaactattttgg

SEQ ID NO: 6966870 - DNA, 22 bp, Homo sapiens
gacacagatgatcaggtgtgga

SEQ ID NO: 6966871 - DNA, 23 bp, Homo sapiens
caccccaccctgaggaggaggga

SEQ ID NO: 6966872 - DNA, 22 bp, Homo sapiens
gaccatcctggccaacgtggta

SEQ ID NO: 6966873 - DNA, 22 bp, Homo sapiens
ctctggctggcacctgatctga

SEQ ID NO: 6966874 - DNA, 22 bp, Homo sapiens
tgaaacactgcgataaaatcct

SEQ ID NO: 6966875 - DNA, 22 bp, Homo sapiens
cgccccagatgcaagacaaaga

SEQ ID NO: 6966876 - DNA, 22 bp, Homo sapiens
attcacacacatttagagcaga

SEQ ID NO: 6966877 - DNA, 17 bp, Homo sapiens
tctttccctgggagatg

SEQ ID NO: 6966878 - DNA, 22 bp, Homo sapiens
taactgcactgacagtgagtga

SEQ ID NO: 6966879 - DNA, 22 bp, Homo sapiens
aattctgtgcaggcagagctat

SEQ ID NO: 6966880 - DNA, 22 bp, Homo sapiens
agccagggacgctgcaggctac

SEQ ID NO: 6966881 - DNA, 22 bp, Homo sapiens
tctttggagtgttatcagtaat

SEQ ID NO: 6966882 - DNA, 22 bp, Homo sapiens
tggcagatggcctggaaccaaa

SEQ ID NO: 6966883 - DNA, 23 bp, Homo sapiens
tgctggcttttatctggtcccta

SEQ ID NO: 6966884 - DNA, 22 bp, Homo sapiens
cagaaatggtctgttcagctta

SEQ ID NO: 6966885 - DNA, 22 bp, Homo sapiens
tgaagtttataacatagcctcc

SEQ ID NO: 6966886 - DNA, 22 bp, Homo sapiens
caggcatttaactctctaatgg

SEQ ID NO: 6966887 - DNA, 22 bp, Homo sapiens
aaaatcacaagcttgggtcact

SEQ ID NO: 6966888 - DNA, 22 bp, Homo sapiens
ttctgctgagtgggcaggtgca

SEQ ID NO: 6966889 - DNA, 22 bp, Homo sapiens
aggatttattccagaaatgcaa

SEQ ID NO: 6966890 - DNA, 22 bp, Homo sapiens
aaactaggttctgatttccaag

SEQ ID NO: 6966891 - DNA, 22 bp, Homo sapiens
ctgacagtttttgctgtattgt

SEQ ID NO: 6966892 - DNA, 22 bp, Homo sapiens
tgtgtttatagtgtatcttcca

SEQ ID NO: 6966893 - DNA, 22 bp, Homo sapiens
agtgtgctcaattcaagtcttt

SEQ ID NO: 6966894 - DNA, 22 bp, Homo sapiens
aatcagaatttattgaatcttt

SEQ ID NO: 6966895 - DNA, 19 bp, Homo sapiens
cctttggtttttggttcat

SEQ ID NO: 6966896 - DNA, 22 bp, Homo sapiens
tggacactggccatttgagtag

SEQ ID NO: 6966897 - DNA, 22 bp, Homo sapiens
gagggagaattgcagccagcgt

SEQ ID NO: 6966898 - DNA, 22 bp, Homo sapiens
aaggtctgcttatatcttacat

SEQ ID NO: 6966899 - DNA, 22 bp, Homo sapiens
ggctgccaccctcggacttccg

SEQ ID NO: 6966900 - DNA, 22 bp, Homo sapiens
ttagaatcagaagagaggtatt

SEQ ID NO: 6966901 - DNA, 22 bp, Homo sapiens
cttgaaccaatcactgtagcca

SEQ ID NO: 6966902 - DNA, 22 bp, Homo sapiens
aaacaggcacatagtaacattt

SEQ ID NO: 6966903 - DNA, 22 bp, Homo sapiens
taatgtttccagtctatgatgg

SEQ ID NO: 6966904 - DNA, 22 bp, Homo sapiens
acactgggtaacatatctgtta

SEQ ID NO: 6966905 - DNA, 22 bp, Homo sapiens
attttgttatagaactctgtga

SEQ ID NO: 6966906 - DNA, 22 bp, Homo sapiens
gtgtggccgccacttggggcag

SEQ ID NO: 6966907 - DNA, 22 bp, Homo sapiens
tgcttctagacactgcaattga

SEQ ID NO: 6966908 - DNA, 22 bp, Homo sapiens
aacagtttcagttactgatgag

SEQ ID NO: 6966909 - DNA, 22 bp, Homo sapiens
cacccaggcaggtggctgagaa

SEQ ID NO: 6966910 - DNA, 22 bp, Homo sapiens
acacttttaagactttaatgaa

SEQ ID NO: 6966911 - DNA, 22 bp, Homo sapiens
tttcattgccataaggtgggat

SEQ ID NO: 6966912 - DNA, 22 bp, Homo sapiens
ttgcaatctgcaaagctgtgga

SEQ ID NO: 6966913 - DNA, 22 bp, Homo sapiens
tccgttgacttggaagccctga

SEQ ID NO: 6966914 - DNA, 22 bp, Homo sapiens
cagaggccatatttcttcactc

SEQ ID NO: 6966915 - DNA, 22 bp, Homo sapiens
agactttatagtttttggctat

SEQ ID NO: 6966916 - DNA, 22 bp, Homo sapiens
tggctggcgttggggccagtga

SEQ ID NO: 6966917 - DNA, 22 bp, Homo sapiens
tctcttccctttatggtatgtg

SEQ ID NO: 6966918 - DNA, 22 bp, Homo sapiens
cacgattactgtgtgaaagtga

SEQ ID NO: 6966919 - DNA, 22 bp, Homo sapiens
ctcttgagtggcatgctctaac

SEQ ID NO: 6966920 - DNA, 22 bp, Homo sapiens
cctcttcctgcactgacatttt

SEQ ID NO: 6966921 - DNA, 22 bp, Homo sapiens
atcttacacgataactgttagt

SEQ ID NO: 6966922 - DNA, 22 bp, Homo sapiens
cctcttctgagtgagactccct

SEQ ID NO: 6966923 - DNA, 21 bp, Homo sapiens
cagtagtgcgtcgcagaggac

SEQ ID NO: 6966924 - DNA, 22 bp, Homo sapiens
ggaaatacaaagatacaccact

SEQ ID NO: 6966925 - DNA, 22 bp, Homo sapiens
caaaagtaatggcggtttttac

SEQ ID NO: 6966926 - DNA, 22 bp, Homo sapiens
tattattatattggatgagact

SEQ ID NO: 6966927 - DNA, 18 bp, Homo sapiens
gctctgcaggtgctcggt

SEQ ID NO: 6966928 - DNA, 22 bp, Homo sapiens
aagctgtcagtgtcaggctaaa

SEQ ID NO: 6966929 - DNA, 22 bp, Homo sapiens
aagaattatctgaaagctgtgt

SEQ ID NO: 6966930 - DNA, 22 bp, Homo sapiens
aacttggttgttggcaatttgc

SEQ ID NO: 6966931 - DNA, 22 bp, Homo sapiens
ctatttctgcctaatgacctgt

SEQ ID NO: 6966932 - DNA, 22 bp, Homo sapiens
tttgcatacatgagaatgtctt

SEQ ID NO: 6966933 - DNA, 22 bp, Homo sapiens
cctggccacagggctctgcatt

SEQ ID NO: 6966934 - DNA, 22 bp, Homo sapiens
gttttagtgggtggccactgat

SEQ ID NO: 6966935 - DNA, 22 bp, Homo sapiens
aggctcagtatagctggcaagt

SEQ ID NO: 6966936 - DNA, 19 bp, Homo sapiens
agccagtgagcctctgggt

SEQ ID NO: 6966937 - DNA, 20 bp, Homo sapiens
attgttgctgctgctgttga

SEQ ID NO: 6966938 - DNA, 20 bp, Homo sapiens
atgcacatacgcatgcacat

SEQ ID NO: 6966939 - DNA, 22 bp, Homo sapiens
ttatattgtgtaataagtgaag

SEQ ID NO: 6966940 - DNA, 20 bp, Homo sapiens
tccttccctctctttttgca

SEQ ID NO: 6966941 - DNA, 21 bp, Homo sapiens
aggcttggatctagacaggcc

SEQ ID NO: 6966942 - DNA, 22 bp, Homo sapiens
gagtatgatgggatgacaggag

SEQ ID NO: 6966943 - DNA, 22 bp, Homo sapiens
tcgcagcactagccctgcattg

SEQ ID NO: 6966944 - DNA, 22 bp, Homo sapiens
gaggaccactgcttagtaagat

SEQ ID NO: 6966945 - DNA, 22 bp, Homo sapiens
accatacattaaatgactttca

SEQ ID NO: 6966946 - DNA, 22 bp, Homo sapiens
cttttctgggccccacgctgga

SEQ ID NO: 6966947 - DNA, 22 bp, Homo sapiens
tgcccaggtttgagtgcccaag

SEQ ID NO: 6966948 - DNA, 19 bp, Homo sapiens
gctcagtctcctgattgct

SEQ ID NO: 6966949 - DNA, 22 bp, Homo sapiens
tgcttgtcaggataagctctgg

SEQ ID NO: 6966950 - DNA, 22 bp, Homo sapiens
ccaaactgtgtcgtctgcatag

SEQ ID NO: 6966951 - DNA, 22 bp, Homo sapiens
ataggctgtaataattcacatt

SEQ ID NO: 6966952 - DNA, 22 bp, Homo sapiens
aggttaaaaaggattcagttaa

SEQ ID NO: 6966953 - DNA, 22 bp, Homo sapiens
tatagtagagagagaatctttt

SEQ ID NO: 6966954 - DNA, 22 bp, Homo sapiens
catagttataaggcaacactgt

SEQ ID NO: 6966955 - DNA, 22 bp, Homo sapiens
tgaggctccttgtagagagtgg

SEQ ID NO: 6966956 - DNA, 22 bp, Homo sapiens
ctgcacagagcggcagttctta

SEQ ID NO: 6966957 - DNA, 22 bp, Homo sapiens
agtacatgtggtcctggccaga

SEQ ID NO: 6966958 - DNA, 22 bp, Homo sapiens
gagaggagtagacactttggtt

SEQ ID NO: 6966959 - DNA, 22 bp, Homo sapiens
ctgctgtccaggagtgccctgt

SEQ ID NO: 6966960 - DNA, 21 bp, Homo sapiens
tcatctggtctggggcctgct

SEQ ID NO: 6966961 - DNA, 22 bp, Homo sapiens
tctgaggaaaagttcttgtcac

SEQ ID NO: 6966962 - DNA, 22 bp, Homo sapiens
agcaccatcacagctgtatgtc

SEQ ID NO: 6966963 - DNA, 22 bp, Homo sapiens
ggggagcttagggtctctgaat

SEQ ID NO: 6966964 - DNA, 22 bp, Homo sapiens
aatgtttaatgttagtggtaat

SEQ ID NO: 6966965 - DNA, 22 bp, Homo sapiens
cagctgatggttttgctgagac

SEQ ID NO: 6966966 - DNA, 22 bp, Homo sapiens
tagtatatctttagtacatagt

SEQ ID NO: 6966967 - DNA, 22 bp, Homo sapiens
taggcacaagaccatgcaaagg

SEQ ID NO: 6966968 - DNA, 18 bp, Homo sapiens
catctacaaatgccagaa

SEQ ID NO: 6966969 - DNA, 22 bp, Homo sapiens
tcagcccagcccagcaagtgca

SEQ ID NO: 6966970 - DNA, 22 bp, Homo sapiens
tgccatttggacctaactgggc

SEQ ID NO: 6966971 - DNA, 22 bp, Homo sapiens
cattcacattcttcttactgtt

SEQ ID NO: 6966972 - DNA, 22 bp, Homo sapiens
taatggctttagtggatggcat

SEQ ID NO: 6966973 - DNA, 20 bp, Homo sapiens
atgtgaaagatcagttgtct

SEQ ID NO: 6966974 - DNA, 21 bp, Homo sapiens
gtatggcattgattagttact

SEQ ID NO: 6966975 - DNA, 22 bp, Homo sapiens
atggtaaccagaagactatgac

SEQ ID NO: 6966976 - DNA, 22 bp, Homo sapiens
catggtgggtgtagtttccgcc

SEQ ID NO: 6966977 - DNA, 19 bp, Homo sapiens
agcagctgtagatagacac

SEQ ID NO: 6966978 - DNA, 22 bp, Homo sapiens
tggatcacttgaggttgggatt

SEQ ID NO: 6966979 - DNA, 22 bp, Homo sapiens
taagaaacatgattaatggcag

SEQ ID NO: 6966980 - DNA, 22 bp, Homo sapiens
tctgatgttgcttctgcagaac

SEQ ID NO: 6966981 - DNA, 22 bp, Homo sapiens
ggattgagagcactggtagctg

SEQ ID NO: 6966982 - DNA, 22 bp, Homo sapiens
caggtgattctaaagtctagcc

SEQ ID NO: 6966983 - DNA, 22 bp, Homo sapiens
ggcctgtggatctgatgaacca

SEQ ID NO: 6966984 - DNA, 22 bp, Homo sapiens
gcccttgacagtggcagaagca

SEQ ID NO: 6966985 - DNA, 22 bp, Homo sapiens
gagcagctgcagtgcagaccct

SEQ ID NO: 6966986 - DNA, 22 bp, Homo sapiens
tttaggttttttcacgtggcta

SEQ ID NO: 6966987 - DNA, 22 bp, Homo sapiens
tattccaatgtcagttatatca

SEQ ID NO: 6966988 - DNA, 22 bp, Homo sapiens
gcagtgtggcgtggggacctaa

SEQ ID NO: 6966989 - DNA, 22 bp, Homo sapiens
gaatgtttttaggaatgttatg

SEQ ID NO: 6966990 - DNA, 22 bp, Homo sapiens
ctgaggcctggtgaggtggtga

SEQ ID NO: 6966991 - DNA, 22 bp, Homo sapiens
gaagggtgtgatttgcctgaga

SEQ ID NO: 6966992 - DNA, 20 bp, Homo sapiens
tgcttgtcatgcactcaggc

SEQ ID NO: 6966993 - DNA, 22 bp, Homo sapiens
tacagtgtgaataagcaggcat

SEQ ID NO: 6966994 - DNA, 22 bp, Homo sapiens
tggctcagatgctcttccagtg

SEQ ID NO: 6966995 - DNA, 22 bp, Homo sapiens
catttgattactaaagataatt

SEQ ID NO: 6966996 - DNA, 22 bp, Homo sapiens
tgagggtttttgagcagtgatt

SEQ ID NO: 6966997 - DNA, 22 bp, Homo sapiens
attcaagagcccatgtttcctg

SEQ ID NO: 6966998 - DNA, 22 bp, Homo sapiens
ggcccagcctggcaacaatgac

SEQ ID NO: 6966999 - DNA, 22 bp, Homo sapiens
actttcaatttgcactaaccta

SEQ ID NO: 6967000 - DNA, 22 bp, Homo sapiens
ggtttactcgtagtggcggttt

SEQ ID NO: 6967001 - DNA, 22 bp, Homo sapiens
ctgggaggcggaggttgtagtg

SEQ ID NO: 6967002 - DNA, 20 bp, Homo sapiens
tggcaccaggtggtggcccc

SEQ ID NO: 6967003 - DNA, 22 bp, Homo sapiens
tttggcaaaggtcagagactcc

SEQ ID NO: 6967004 - DNA, 22 bp, Homo sapiens
acagtaattaaggtctgaaacg

SEQ ID NO: 6967005 - DNA, 22 bp, Homo sapiens
tactttgcatgcttgtgtgatc

SEQ ID NO: 6967006 - DNA, 22 bp, Homo sapiens
ttccttgttaatagtgtctgga

SEQ ID NO: 6967007 - DNA, 22 bp, Homo sapiens
aatctgaaagtatggagcagta

SEQ ID NO: 6967008 - DNA, 22 bp, Homo sapiens
acaatgtagagtaaaatatgtt

SEQ ID NO: 6967009 - DNA, 22 bp, Homo sapiens
atttactcgtgcttcattgaat

SEQ ID NO: 6967010 - DNA, 22 bp, Homo sapiens
gctggctctgccccacctgttc

SEQ ID NO: 6967011 - DNA, 22 bp, Homo sapiens
ttgagaactagcatggtctatc

SEQ ID NO: 6967012 - DNA, 22 bp, Homo sapiens
ctctggctggcattgctggact

SEQ ID NO: 6967013 - DNA, 20 bp, Homo sapiens
gggtcgctctgagcccatcc

SEQ ID NO: 6967014 - DNA, 22 bp, Homo sapiens
ctgggctggagtgcaatggcgc

SEQ ID NO: 6967015 - DNA, 22 bp, Homo sapiens
gtttctgctccagtgatgcaag

SEQ ID NO: 6967016 - DNA, 22 bp, Homo sapiens
ccaagcttctttcctactacag

SEQ ID NO: 6967017 - DNA, 22 bp, Homo sapiens
aatgttcctatttaccccctaa

SEQ ID NO: 6967018 - DNA, 22 bp, Homo sapiens
atgtcactgtttaccagctcca

SEQ ID NO: 6967019 - DNA, 22 bp, Homo sapiens
agccttgcatgatttcattcat

SEQ ID NO: 6967020 - DNA, 22 bp, Homo sapiens
ctgtatttgaaagaaaagattt

SEQ ID NO: 6967021 - DNA, 22 bp, Homo sapiens
tctgtcctgtttcctcctgaca

SEQ ID NO: 6967022 - DNA, 22 bp, Homo sapiens
atgcctggtatgaagcaaggaa

SEQ ID NO: 6967023 - DNA, 22 bp, Homo sapiens
agctggaactgggtttgttgga

SEQ ID NO: 6967024 - DNA, 22 bp, Homo sapiens
gtcctctgtccctggggcacgg

SEQ ID NO: 6967025 - DNA, 22 bp, Homo sapiens
ttacaagacacagtgctgaagg

SEQ ID NO: 6967026 - DNA, 22 bp, Homo sapiens
ttggccaacatggtgaaacccc

SEQ ID NO: 6967027 - DNA, 22 bp, Homo sapiens
tcttttatcctacatttagctc

SEQ ID NO: 6967028 - DNA, 22 bp, Homo sapiens
tgttcatagctatcattgtgtc

SEQ ID NO: 6967029 - DNA, 22 bp, Homo sapiens
tatctttagaggaagagaatct

SEQ ID NO: 6967030 - DNA, 22 bp, Homo sapiens
gaagtgacaagatgctaggatc

SEQ ID NO: 6967031 - DNA, 22 bp, Homo sapiens
gagtaatttatccagtgaagta

SEQ ID NO: 6967032 - DNA, 22 bp, Homo sapiens
gaacacaggtggcccggcaggg

SEQ ID NO: 6967033 - DNA, 22 bp, Homo sapiens
tggctgaataatattctgttgt

SEQ ID NO: 6967034 - DNA, 19 bp, Homo sapiens
aagttctcagagttcaaag

SEQ ID NO: 6967035 - DNA, 22 bp, Homo sapiens
ttagatcattttgaactaattt

SEQ ID NO: 6967036 - DNA, 22 bp, Homo sapiens
tatttcttgttccctccaagtt

SEQ ID NO: 6967037 - DNA, 22 bp, Homo sapiens
tcccaaggataagagagtctga

SEQ ID NO: 6967038 - DNA, 22 bp, Homo sapiens
ttttctctatattgtctgtgaa

SEQ ID NO: 6967039 - DNA, 22 bp, Homo sapiens
tcctggcctcgctgtccacctt

SEQ ID NO: 6967040 - DNA, 22 bp, Homo sapiens
agcctctctttattcccagcta

SEQ ID NO: 6967041 - DNA, 22 bp, Homo sapiens
agtcttctgtttttcagcagct

SEQ ID NO: 6967042 - DNA, 22 bp, Homo sapiens
tggcaaactgaagtacatgtca

SEQ ID NO: 6967043 - DNA, 22 bp, Homo sapiens
tggtcacccactgggactgcgg

SEQ ID NO: 6967044 - DNA, 22 bp, Homo sapiens
tcagcttctccaagtgacatgg

SEQ ID NO: 6967045 - DNA, 22 bp, Homo sapiens
cctggggagccgcctgagcccc

SEQ ID NO: 6967046 - DNA, 22 bp, Homo sapiens
gggctccaggagccctaagaga

SEQ ID NO: 6967047 - DNA, 18 bp, Homo sapiens
aggcactggaattaaggg

SEQ ID NO: 6967048 - DNA, 22 bp, Homo sapiens
tttccaaaagtttgttctgtgc

SEQ ID NO: 6967049 - DNA, 22 bp, Homo sapiens
atgacacatttgtgctgttgaa

SEQ ID NO: 6967050 - DNA, 22 bp, Homo sapiens
agcttataatgtaactaaggac

SEQ ID NO: 6967051 - DNA, 20 bp, Homo sapiens
ggaacactgttcattctgta

SEQ ID NO: 6967052 - DNA, 22 bp, Homo sapiens
attgagtaataattgatcttgg

SEQ ID NO: 6967053 - DNA, 22 bp, Homo sapiens
ggtgagttggggttcacaggtc

SEQ ID NO: 6967054 - DNA, 22 bp, Homo sapiens
cagggatgaccagagggatgtg

SEQ ID NO: 6967055 - DNA, 22 bp, Homo sapiens
ccaaatgtctattaggtcaatt

SEQ ID NO: 6967056 - DNA, 22 bp, Homo sapiens
atggtgtacagcaatgtgtcag

SEQ ID NO: 6967057 - DNA, 22 bp, Homo sapiens
gctcccttagtccttgccggga

SEQ ID NO: 6967058 - DNA, 22 bp, Homo sapiens
tctggactttcggtgcaagagt

SEQ ID NO: 6967059 - DNA, 22 bp, Homo sapiens
ggctgcaagacaaggttggttt

SEQ ID NO: 6967060 - DNA, 22 bp, Homo sapiens
gatgtggcatctgggtgacagc

SEQ ID NO: 6967061 - DNA, 23 bp, Homo sapiens
tggtctgacttgtagctgtgaga

SEQ ID NO: 6967062 - DNA, 22 bp, Homo sapiens
ttcaggcccaacgcacagcttc

SEQ ID NO: 6967063 - DNA, 22 bp, Homo sapiens
attgcttcccacaaagatgtat

SEQ ID NO: 6967064 - DNA, 20 bp, Homo sapiens
ttccaactcacatctctaca

SEQ ID NO: 6967065 - DNA, 22 bp, Homo sapiens
agagtcttctttaggccattta

SEQ ID NO: 6967066 - DNA, 20 bp, Homo sapiens
tgcagaatcctgtgatcagt

SEQ ID NO: 6967067 - DNA, 22 bp, Homo sapiens
tgattggctctattttgagtga

SEQ ID NO: 6967068 - DNA, 22 bp, Homo sapiens
acaatgtttttgttcaaagagt

SEQ ID NO: 6967069 - DNA, 22 bp, Homo sapiens
ttaaaatgtacaggggaaagtg

SEQ ID NO: 6967070 - DNA, 22 bp, Homo sapiens
gaagtagaaagcctcgtaaata

SEQ ID NO: 6967071 - DNA, 22 bp, Homo sapiens
ggacggctctctggcactgtgg

SEQ ID NO: 6967072 - DNA, 22 bp, Homo sapiens
atgcccaatgtaggccccagga

SEQ ID NO: 6967073 - DNA, 22 bp, Homo sapiens
tgctggctttgcgagatgcatt

SEQ ID NO: 6967074 - DNA, 23 bp, Homo sapiens
ttcatttgtctacttcacttgtt

SEQ ID NO: 6967075 - DNA, 20 bp, Homo sapiens
gaagccagaggggaaaggag

SEQ ID NO: 6967076 - DNA, 22 bp, Homo sapiens
atgtttcccagagcaaatctgg

SEQ ID NO: 6967077 - DNA, 22 bp, Homo sapiens
aagagtaaattcaggactttaa

SEQ ID NO: 6967078 - DNA, 22 bp, Homo sapiens
acccggaggcgggggatgcagt

SEQ ID NO: 6967079 - DNA, 22 bp, Homo sapiens
ttgctgttacaattatttaccc

SEQ ID NO: 6967080 - DNA, 22 bp, Homo sapiens
ctgtagcaagttattcaataaa

SEQ ID NO: 6967081 - DNA, 22 bp, Homo sapiens
catctaaatttgactccaagga

SEQ ID NO: 6967082 - DNA, 22 bp, Homo sapiens
atgggagttttctctgatgctc

SEQ ID NO: 6967083 - DNA, 22 bp, Homo sapiens
gttccacatcacactacttgat

SEQ ID NO: 6967084 - DNA, 22 bp, Homo sapiens
aaatcagagtagaattgagcca

SEQ ID NO: 6967085 - DNA, 22 bp, Homo sapiens
cttaaaggtcattctgttgata

SEQ ID NO: 6967086 - DNA, 22 bp, Homo sapiens
acagtgctaaacacttcttgaa

SEQ ID NO: 6967087 - DNA, 22 bp, Homo sapiens
gaggcacagagccctaggagct

SEQ ID NO: 6967088 - DNA, 18 bp, Homo sapiens
tgtaaacactttcattct

SEQ ID NO: 6967089 - DNA, 20 bp, Homo sapiens
atacacatgcagacagatgc

SEQ ID NO: 6967090 - DNA, 22 bp, Homo sapiens
atctgcttgaaacttcttatac

SEQ ID NO: 6967091 - DNA, 22 bp, Homo sapiens
gggctaagtggatcagtcagga

SEQ ID NO: 6967092 - DNA, 22 bp, Homo sapiens
aagaggggtgtgtgtcaaccca

SEQ ID NO: 6967093 - DNA, 22 bp, Homo sapiens
agatacattagtagttacttgt

SEQ ID NO: 6967094 - DNA, 22 bp, Homo sapiens
agctggctggccccttcctgcc

SEQ ID NO: 6967095 - DNA, 22 bp, Homo sapiens
actgtgtggaaatttgtgaggg

SEQ ID NO: 6967096 - DNA, 22 bp, Homo sapiens
ctgatgtatgggtgacaggcaa

SEQ ID NO: 6967097 - DNA, 22 bp, Homo sapiens
tacagcagggcgctgtgatgaa

SEQ ID NO: 6967098 - DNA, 18 bp, Homo sapiens
ctgggctcgagagatcct

SEQ ID NO: 6967099 - DNA, 22 bp, Homo sapiens
tcctaaatgattcagaaatttc

SEQ ID NO: 6967100 - DNA, 22 bp, Homo sapiens
ctcttcctctcatgcggtcata

SEQ ID NO: 6967101 - DNA, 22 bp, Homo sapiens
cctcaccctgaccactactttt

SEQ ID NO: 6967102 - DNA, 22 bp, Homo sapiens
acagcttgcacaagggaactca

SEQ ID NO: 6967103 - DNA, 22 bp, Homo sapiens
tggctggatatcaggcaagggg

SEQ ID NO: 6967104 - DNA, 22 bp, Homo sapiens
aatgcatatgtaggcaagcagt

SEQ ID NO: 6967105 - DNA, 22 bp, Homo sapiens
ccagtgagatatctgggcatta

SEQ ID NO: 6967106 - DNA, 20 bp, Homo sapiens
atagatcagtgagactaaag

SEQ ID NO: 6967107 - DNA, 23 bp, Homo sapiens
agctggaaatggccgagctctgc

SEQ ID NO: 6967108 - DNA, 22 bp, Homo sapiens
atgaggcacttaaaagtgaaga

SEQ ID NO: 6967109 - DNA, 22 bp, Homo sapiens
tggggccagagatggggcgcag

SEQ ID NO: 6967110 - DNA, 22 bp, Homo sapiens
agccagggctgcaggttccttg

SEQ ID NO: 6967111 - DNA, 22 bp, Homo sapiens
cactagaaaggtacagattatg

SEQ ID NO: 6967112 - DNA, 18 bp, Homo sapiens
agacagacaggtttgtgc

SEQ ID NO: 6967113 - DNA, 20 bp, Homo sapiens
cagcctccactcactcagct

SEQ ID NO: 6967114 - DNA, 22 bp, Homo sapiens
gggtggctgactgttttgtgga

SEQ ID NO: 6967115 - DNA, 22 bp, Homo sapiens
actagggagatcaattgtgcag

SEQ ID NO: 6967116 - DNA, 22 bp, Homo sapiens
aacataagtggcactttgccca

SEQ ID NO: 6967117 - DNA, 22 bp, Homo sapiens
ttcctttagtgtcatatacttt

SEQ ID NO: 6967118 - DNA, 22 bp, Homo sapiens
ttcttggcattttcccatttgg

SEQ ID NO: 6967119 - DNA, 22 bp, Homo sapiens
cacacatggtagcaggtacaag

SEQ ID NO: 6967120 - DNA, 22 bp, Homo sapiens
ccaaggctgaggtttccagttg

SEQ ID NO: 6967121 - DNA, 22 bp, Homo sapiens
ccggcctttgttgtggagggtc

SEQ ID NO: 6967122 - DNA, 22 bp, Homo sapiens
gctgggtctctgggtgtaacaa

SEQ ID NO: 6967123 - DNA, 22 bp, Homo sapiens
tcccagcactgtaattctttgg

SEQ ID NO: 6967124 - DNA, 22 bp, Homo sapiens
ctggcccagagagcagagctta

SEQ ID NO: 6967125 - DNA, 19 bp, Homo sapiens
tctgggaatgatgccagca

SEQ ID NO: 6967126 - DNA, 22 bp, Homo sapiens
agtctagtaggatctctgggct

SEQ ID NO: 6967127 - DNA, 22 bp, Homo sapiens
gtacacatactattcaaagaga

SEQ ID NO: 6967128 - DNA, 22 bp, Homo sapiens
tggctggaggcatgcaagctcc

SEQ ID NO: 6967129 - DNA, 22 bp, Homo sapiens
ttgcctatgtaactttatattt

SEQ ID NO: 6967130 - DNA, 22 bp, Homo sapiens
gctcaggactggaggagcgggg

SEQ ID NO: 6967131 - DNA, 22 bp, Homo sapiens
tgtcaggtgacacactaggagc

SEQ ID NO: 6967132 - DNA, 20 bp, Homo sapiens
tggagtctgacagatgggta

SEQ ID NO: 6967133 - DNA, 19 bp, Homo sapiens
aagtcacttgagggcagga

SEQ ID NO: 6967134 - DNA, 22 bp, Homo sapiens
agctgcaggattatggaatgga

SEQ ID NO: 6967135 - DNA, 22 bp, Homo sapiens
tgctctaagaactctaggaatt

SEQ ID NO: 6967136 - DNA, 19 bp, Homo sapiens
actgcctgcaggtgttggg

SEQ ID NO: 6967137 - DNA, 22 bp, Homo sapiens
cttggcacgtgataggtgttga

SEQ ID NO: 6967138 - DNA, 21 bp, Homo sapiens
tttgtgtgtcacgtgcacagg

SEQ ID NO: 6967139 - DNA, 22 bp, Homo sapiens
taaggaaggggaaagacatgtc

SEQ ID NO: 6967140 - DNA, 22 bp, Homo sapiens
ctcatgcccagagccactgttg

SEQ ID NO: 6967141 - DNA, 22 bp, Homo sapiens
gctctgcctggtcgcgtgctgg

SEQ ID NO: 6967142 - DNA, 22 bp, Homo sapiens
ggctctcagggaaaggcctccc

SEQ ID NO: 6967143 - DNA, 22 bp, Homo sapiens
aggctaatatggcacatgaaca

SEQ ID NO: 6967144 - DNA, 22 bp, Homo sapiens
tcaggaaagagtaatgtataca

SEQ ID NO: 6967145 - DNA, 22 bp, Homo sapiens
cactgttctttttgtagtccaa

SEQ ID NO: 6967146 - DNA, 22 bp, Homo sapiens
atggctgtggtatcagacgcag

SEQ ID NO: 6967147 - DNA, 22 bp, Homo sapiens
ctaaggcagacagaatatttgg

SEQ ID NO: 6967148 - DNA, 22 bp, Homo sapiens
gctcagaggagcatcataagga

SEQ ID NO: 6967149 - DNA, 22 bp, Homo sapiens
gccccttgtctccaggccccaa

SEQ ID NO: 6967150 - DNA, 22 bp, Homo sapiens
acccaggctggcagaggctcct

SEQ ID NO: 6967151 - DNA, 22 bp, Homo sapiens
acttgaattaggccttgagaga

SEQ ID NO: 6967152 - DNA, 22 bp, Homo sapiens
gctcacaggcagtgttgggaga

SEQ ID NO: 6967153 - DNA, 21 bp, Homo sapiens
tggaaatggaatactttggat

SEQ ID NO: 6967154 - DNA, 22 bp, Homo sapiens
cgcacattagaagtaactaatg

SEQ ID NO: 6967155 - DNA, 22 bp, Homo sapiens
tggagagaaaaaagacagttct

SEQ ID NO: 6967156 - DNA, 22 bp, Homo sapiens
tataggaacagctagcacagaa

SEQ ID NO: 6967157 - DNA, 22 bp, Homo sapiens
ggctttgcaggcagcatcaagg

SEQ ID NO: 6967158 - DNA, 22 bp, Homo sapiens
aaggaactcacagtctgttggg

SEQ ID NO: 6967159 - DNA, 22 bp, Homo sapiens
ggaaggctccatacacaaagca

SEQ ID NO: 6967160 - DNA, 22 bp, Homo sapiens
tgcagtaaattcaggtacaact

SEQ ID NO: 6967161 - DNA, 22 bp, Homo sapiens
ctggcacagccactgcaggcag

SEQ ID NO: 6967162 - DNA, 22 bp, Homo sapiens
tggaacctaaaaatgtcattgc

SEQ ID NO: 6967163 - DNA, 22 bp, Homo sapiens
cagatctgagccaagctcgatg

SEQ ID NO: 6967164 - DNA, 22 bp, Homo sapiens
gtaggaaatcaggggtttaagc

SEQ ID NO: 6967165 - DNA, 22 bp, Homo sapiens
ccacagagacagagcccagggt

SEQ ID NO: 6967166 - DNA, 22 bp, Homo sapiens
gccacagcggggccgctagagc

SEQ ID NO: 6967167 - DNA, 22 bp, Homo sapiens
ttctggatctgagggggaagat

SEQ ID NO: 6967168 - DNA, 19 bp, Homo sapiens
ggtaatattgtcagtgaca

SEQ ID NO: 6967169 - DNA, 22 bp, Homo sapiens
atttgcaattttactttgcagt

SEQ ID NO: 6967170 - DNA, 22 bp, Homo sapiens
tttcacatgtgctgttgtcaat

SEQ ID NO: 6967171 - DNA, 22 bp, Homo sapiens
tgtcagagcaatgaggttcagc

SEQ ID NO: 6967172 - DNA, 22 bp, Homo sapiens
ttctatgctagtggaaagcttc

SEQ ID NO: 6967173 - DNA, 22 bp, Homo sapiens
tctgctgcctcggtgtgggtac

SEQ ID NO: 6967174 - DNA, 22 bp, Homo sapiens
cgtggctcttttctgcatcagg

SEQ ID NO: 6967175 - DNA, 22 bp, Homo sapiens
tccagaccatgtgagaggcgca

SEQ ID NO: 6967176 - DNA, 22 bp, Homo sapiens
aatatttgaacagtcactgagt

SEQ ID NO: 6967177 - DNA, 22 bp, Homo sapiens
tcaggtctatactatgagaggc

SEQ ID NO: 6967178 - DNA, 22 bp, Homo sapiens
tttcaagactcattgagtattg

SEQ ID NO: 6967179 - DNA, 19 bp, Homo sapiens
ttcccctccccagggatag

SEQ ID NO: 6967180 - DNA, 22 bp, Homo sapiens
actatatgtgaaggtagaattt

SEQ ID NO: 6967181 - DNA, 22 bp, Homo sapiens
agaatttgagtgctttctgtgt

SEQ ID NO: 6967182 - DNA, 22 bp, Homo sapiens
tcaaccctggtgggaatatttg

SEQ ID NO: 6967183 - DNA, 22 bp, Homo sapiens
tcatctgtgagtaaaggcacat

SEQ ID NO: 6967184 - DNA, 22 bp, Homo sapiens
cctttggaggaagtgtggccct

SEQ ID NO: 6967185 - DNA, 22 bp, Homo sapiens
ccagggcaggagaaagactcac

SEQ ID NO: 6967186 - DNA, 20 bp, Homo sapiens
agtttattccaggagaactg

SEQ ID NO: 6967187 - DNA, 22 bp, Homo sapiens
actgtgaatcactactagtaga

SEQ ID NO: 6967188 - DNA, 22 bp, Homo sapiens
ccattcacctcttcacgtgctc

SEQ ID NO: 6967189 - DNA, 22 bp, Homo sapiens
agtggtgagacctggtgctttc

SEQ ID NO: 6967190 - DNA, 22 bp, Homo sapiens
taccatgctctgcatctcacaa

SEQ ID NO: 6967191 - DNA, 22 bp, Homo sapiens
atggcttttcacagagggttct

SEQ ID NO: 6967192 - DNA, 22 bp, Homo sapiens
acatcgagtctgagttgctatg

SEQ ID NO: 6967193 - DNA, 22 bp, Homo sapiens
aaagcctttgtctcaggctctg

SEQ ID NO: 6967194 - DNA, 22 bp, Homo sapiens
tccatacatacagatatgcatt

SEQ ID NO: 6967195 - DNA, 22 bp, Homo sapiens
ataaaagaagttttggtacttg

SEQ ID NO: 6967196 - DNA, 22 bp, Homo sapiens
acagctacatcaaactcagaag

SEQ ID NO: 6967197 - DNA, 23 bp, Homo sapiens
catggaaaactgaaagctgacct

SEQ ID NO: 6967198 - DNA, 22 bp, Homo sapiens
tttcacatggactttttgttct

SEQ ID NO: 6967199 - DNA, 22 bp, Homo sapiens
agagataaagctatgatttatg

SEQ ID NO: 6967200 - DNA, 22 bp, Homo sapiens
gagctgaggctcaggctggcgt

SEQ ID NO: 6967201 - DNA, 22 bp, Homo sapiens
gctctcttggtggctgtcctgg

SEQ ID NO: 6967202 - DNA, 22 bp, Homo sapiens
ccacatctgttcttagttctga

SEQ ID NO: 6967203 - DNA, 22 bp, Homo sapiens
cctttggtggttttcagagatc

SEQ ID NO: 6967204 - DNA, 21 bp, Homo sapiens
tggccaaactggagcatttga

SEQ ID NO: 6967205 - DNA, 22 bp, Homo sapiens
tttatctgaatatgctccccac

SEQ ID NO: 6967206 - DNA, 22 bp, Homo sapiens
ggttggggcgagctggaggccc

SEQ ID NO: 6967207 - DNA, 22 bp, Homo sapiens
tagccatcattctcacattctt

SEQ ID NO: 6967208 - DNA, 22 bp, Homo sapiens
cgcaggtgtgttttcaggacta

SEQ ID NO: 6967209 - DNA, 22 bp, Homo sapiens
gctgccaatccagctgtgggag

SEQ ID NO: 6967210 - DNA, 22 bp, Homo sapiens
aggtagggaagaaggcatgaaa

SEQ ID NO: 6967211 - DNA, 22 bp, Homo sapiens
aagaggcttcagatccttcaga

SEQ ID NO: 6967212 - DNA, 22 bp, Homo sapiens
gaattacatagtttctaggttc

SEQ ID NO: 6967213 - DNA, 22 bp, Homo sapiens
gctggggtgtggtggataagct

SEQ ID NO: 6967214 - DNA, 22 bp, Homo sapiens
gagagagaagtgggtgtcacct

SEQ ID NO: 6967215 - DNA, 22 bp, Homo sapiens
ttctgattgctgatgaggccca

SEQ ID NO: 6967216 - DNA, 22 bp, Homo sapiens
ccttagaaaatcatggaatatt

SEQ ID NO: 6967217 - DNA, 22 bp, Homo sapiens
taaccagacagaaacagctaga

SEQ ID NO: 6967218 - DNA, 22 bp, Homo sapiens
ggcacccttggggggccacagc

SEQ ID NO: 6967219 - DNA, 22 bp, Homo sapiens
cagtgcccgccgccgttcctgg

SEQ ID NO: 6967220 - DNA, 21 bp, Homo sapiens
gcccagaagactggctctgcc

SEQ ID NO: 6967221 - DNA, 22 bp, Homo sapiens
gaactgagttttctgcctggac

SEQ ID NO: 6967222 - DNA, 22 bp, Homo sapiens
atgccttttccatctcaggcag

SEQ ID NO: 6967223 - DNA, 22 bp, Homo sapiens
ttctgcatggtcaaggctttct

SEQ ID NO: 6967224 - DNA, 22 bp, Homo sapiens
agaatgtaagaatgcaaagatt

SEQ ID NO: 6967225 - DNA, 23 bp, Homo sapiens
ctgggctgcttgagtccctggct

SEQ ID NO: 6967226 - DNA, 22 bp, Homo sapiens
tcctcatgccgggtctcacgct

SEQ ID NO: 6967227 - DNA, 22 bp, Homo sapiens
ggcttcagatttctcagttgtt

SEQ ID NO: 6967228 - DNA, 22 bp, Homo sapiens
ttctgccaaagaagtaaatgga

SEQ ID NO: 6967229 - DNA, 20 bp, Homo sapiens
agagctgggaagctccctat

SEQ ID NO: 6967230 - DNA, 22 bp, Homo sapiens
tgcaaagatgaaatattaaagg

SEQ ID NO: 6967231 - DNA, 22 bp, Homo sapiens
gatgccctggcctgtccccgca

SEQ ID NO: 6967232 - DNA, 22 bp, Homo sapiens
acagaattgatggaaatctcag

SEQ ID NO: 6967233 - DNA, 22 bp, Homo sapiens
tggctctgtcgccgtttggaat

SEQ ID NO: 6967234 - DNA, 23 bp, Homo sapiens
ttgcacagtttcggaaactgagg

SEQ ID NO: 6967235 - DNA, 22 bp, Homo sapiens
gtatggtttatagggaaattgt

SEQ ID NO: 6967236 - DNA, 22 bp, Homo sapiens
cataaaatggcttgttctttaa

SEQ ID NO: 6967237 - DNA, 22 bp, Homo sapiens
tttctgccttatctttgctgag

SEQ ID NO: 6967238 - DNA, 22 bp, Homo sapiens
ccttgagaggaacgtggtcatg

SEQ ID NO: 6967239 - DNA, 22 bp, Homo sapiens
accagagactgcatttctctga

SEQ ID NO: 6967240 - DNA, 18 bp, Homo sapiens
tgtctgagttcttccatt

SEQ ID NO: 6967241 - DNA, 22 bp, Homo sapiens
gtccatccattgaatataatag

SEQ ID NO: 6967242 - DNA, 19 bp, Homo sapiens
tgtctggaagagctgcagg

SEQ ID NO: 6967243 - DNA, 22 bp, Homo sapiens
aggcctctctgcttagcttgta

SEQ ID NO: 6967244 - DNA, 22 bp, Homo sapiens
gactttcttttacctcaaggat

SEQ ID NO: 6967245 - DNA, 22 bp, Homo sapiens
aaaggcaaaggctggtatggct

SEQ ID NO: 6967246 - DNA, 22 bp, Homo sapiens
ctttgttaggggctcagggtgg

SEQ ID NO: 6967247 - DNA, 22 bp, Homo sapiens
tcagaacattgacattcttatt

SEQ ID NO: 6967248 - DNA, 22 bp, Homo sapiens
aggctgctcagtagatggagct

SEQ ID NO: 6967249 - DNA, 17 bp, Homo sapiens
cagacaggctgtcaccc

SEQ ID NO: 6967250 - DNA, 22 bp, Homo sapiens
agttcttttgtgaacatatgct

SEQ ID NO: 6967251 - DNA, 22 bp, Homo sapiens
tgcttctgaactcagcatgtgg

SEQ ID NO: 6967252 - DNA, 22 bp, Homo sapiens
taaggcagctgagcttctaaca

SEQ ID NO: 6967253 - DNA, 22 bp, Homo sapiens
attctaacacatgctctaagaa

SEQ ID NO: 6967254 - DNA, 22 bp, Homo sapiens
tttattcacttcagtgccaaag

SEQ ID NO: 6967255 - DNA, 22 bp, Homo sapiens
ctcctcagttgtcccatggaga

SEQ ID NO: 6967256 - DNA, 22 bp, Homo sapiens
gcagacaggggcttaggaaagg

SEQ ID NO: 6967257 - DNA, 22 bp, Homo sapiens
cagtccttgctatgaccctgag

SEQ ID NO: 6967258 - DNA, 22 bp, Homo sapiens
ggcagtgactggggacccccaa

SEQ ID NO: 6967259 - DNA, 22 bp, Homo sapiens
tcttcagtatttggataacatt

SEQ ID NO: 6967260 - DNA, 22 bp, Homo sapiens
aaccagatggtgcggcaggaca

SEQ ID NO: 6967261 - DNA, 22 bp, Homo sapiens
attattcaaattcccactatac

SEQ ID NO: 6967262 - DNA, 22 bp, Homo sapiens
aataatattcctctgtgtgcgt

SEQ ID NO: 6967263 - DNA, 22 bp, Homo sapiens
ttggactctgggattctggatt

SEQ ID NO: 6967264 - DNA, 22 bp, Homo sapiens
tgtatggaggaggctctctcag

SEQ ID NO: 6967265 - DNA, 23 bp, Homo sapiens
actttgcagagccccttgaaaca

SEQ ID NO: 6967266 - DNA, 22 bp, Homo sapiens
ttctctaaagagttaggccaag

SEQ ID NO: 6967267 - DNA, 22 bp, Homo sapiens
ggagaaaggcatagcagaacct

SEQ ID NO: 6967268 - DNA, 22 bp, Homo sapiens
tggtgtgggcgtggcaggcaag

SEQ ID NO: 6967269 - DNA, 22 bp, Homo sapiens
tggctgtcttcctggttcatgt

SEQ ID NO: 6967270 - DNA, 22 bp, Homo sapiens
tgtgcctgtgacagcgacctgg

SEQ ID NO: 6967271 - DNA, 22 bp, Homo sapiens
agataacatttattgaatgtaa

SEQ ID NO: 6967272 - DNA, 22 bp, Homo sapiens
tctggggagtgcctaagtggaa

SEQ ID NO: 6967273 - DNA, 22 bp, Homo sapiens
tctgggaggtggcagggtgcat

SEQ ID NO: 6967274 - DNA, 22 bp, Homo sapiens
catgcacttacctgaaattcaa

SEQ ID NO: 6967275 - DNA, 20 bp, Homo sapiens
tgtggatgaggtaaggatag

SEQ ID NO: 6967276 - DNA, 22 bp, Homo sapiens
tcagcagacattattttctggc

SEQ ID NO: 6967277 - DNA, 22 bp, Homo sapiens
tatttgtcacctatggctgtcc

SEQ ID NO: 6967278 - DNA, 22 bp, Homo sapiens
gccctgtgcaggtgtgcagcag

SEQ ID NO: 6967279 - DNA, 22 bp, Homo sapiens
ggaccagtggcagggtgctgtg

SEQ ID NO: 6967280 - DNA, 23 bp, Homo sapiens
ggctggaagaaaacagaattgtt

SEQ ID NO: 6967281 - DNA, 22 bp, Homo sapiens
ctattgaaagtgtacaattcaa

SEQ ID NO: 6967282 - DNA, 22 bp, Homo sapiens
gtctggaggggagatttgggtt

SEQ ID NO: 6967283 - DNA, 22 bp, Homo sapiens
gggcttctagaccagcagtgag

SEQ ID NO: 6967284 - DNA, 20 bp, Homo sapiens
agaaacatttcttgagaact

SEQ ID NO: 6967285 - DNA, 22 bp, Homo sapiens
ccactgatcctgactttggagc

SEQ ID NO: 6967286 - DNA, 22 bp, Homo sapiens
cccaccctgggaagctaggcag

SEQ ID NO: 6967287 - DNA, 22 bp, Homo sapiens
ttgaatgagtgttttactcatg

SEQ ID NO: 6967288 - DNA, 22 bp, Homo sapiens
ctgcatcataaaatttagagtt

SEQ ID NO: 6967289 - DNA, 22 bp, Homo sapiens
catgcacatgtggctatgtaat

SEQ ID NO: 6967290 - DNA, 22 bp, Homo sapiens
taggaggcatttgctcccaggg

SEQ ID NO: 6967291 - DNA, 22 bp, Homo sapiens
agcacagctgctgaatgataca

SEQ ID NO: 6967292 - DNA, 22 bp, Homo sapiens
tgccaatttgcccctttgctga

SEQ ID NO: 6967293 - DNA, 22 bp, Homo sapiens
tctggaaaagcgataaaccatt

SEQ ID NO: 6967294 - DNA, 22 bp, Homo sapiens
aggcaatattccatgtggaact

SEQ ID NO: 6967295 - DNA, 22 bp, Homo sapiens
gcagctgccagtccccttccag

SEQ ID NO: 6967296 - DNA, 22 bp, Homo sapiens
cctgggaagtcagccaaggacg

SEQ ID NO: 6967297 - DNA, 22 bp, Homo sapiens
tttcagaaatggcactgaaatc

SEQ ID NO: 6967298 - DNA, 22 bp, Homo sapiens
gtgggcagtggtttgcgcggtc

SEQ ID NO: 6967299 - DNA, 22 bp, Homo sapiens
acaatagtatgagccttttaga

SEQ ID NO: 6967300 - DNA, 22 bp, Homo sapiens
ttgccctgcctccctgaggtga

SEQ ID NO: 6967301 - DNA, 22 bp, Homo sapiens
gggagctgggctggttttgctg

SEQ ID NO: 6967302 - DNA, 22 bp, Homo sapiens
gtgctgcagggtcagcaccctc

SEQ ID NO: 6967303 - DNA, 19 bp, Homo sapiens
cacagggagaccacatgtc

SEQ ID NO: 6967304 - DNA, 22 bp, Homo sapiens
tacccagctcctcagaagacca

SEQ ID NO: 6967305 - DNA, 17 bp, Homo sapiens
acctattgatctgtcac

SEQ ID NO: 6967306 - DNA, 22 bp, Homo sapiens
cagtgccagaggtactagtgga

SEQ ID NO: 6967307 - DNA, 22 bp, Homo sapiens
tctgtgtcagaagatatcatgg

SEQ ID NO: 6967308 - DNA, 21 bp, Homo sapiens
atcagggatgggttggacacc

SEQ ID NO: 6967309 - DNA, 22 bp, Homo sapiens
agcctgcttccctttgtgcccc

SEQ ID NO: 6967310 - DNA, 22 bp, Homo sapiens
agatgctcttgccaaagaagtc

SEQ ID NO: 6967311 - DNA, 22 bp, Homo sapiens
tctaaagccttccatataacgc

SEQ ID NO: 6967312 - DNA, 22 bp, Homo sapiens
taatctgaagaaacaggacttg

SEQ ID NO: 6967313 - DNA, 22 bp, Homo sapiens
ctgcagagcttgtctggatgtg

SEQ ID NO: 6967314 - DNA, 22 bp, Homo sapiens
cagagagcttgcccttgtatat

SEQ ID NO: 6967315 - DNA, 22 bp, Homo sapiens
cgctgcttatgagactggcacg

SEQ ID NO: 6967316 - DNA, 22 bp, Homo sapiens
tgtttaagttctgctccttatt

SEQ ID NO: 6967317 - DNA, 22 bp, Homo sapiens
gggaaggagcctgcttgctaga

SEQ ID NO: 6967318 - DNA, 19 bp, Homo sapiens
actaaagcaataactattt

SEQ ID NO: 6967319 - DNA, 22 bp, Homo sapiens
acagattgatcttgagaattat

SEQ ID NO: 6967320 - DNA, 22 bp, Homo sapiens
aaacaatgtctaaggtgcacag

SEQ ID NO: 6967321 - DNA, 22 bp, Homo sapiens
gggctccatcacaggctccatc

SEQ ID NO: 6967322 - DNA, 22 bp, Homo sapiens
agttcagtagtccttcattgta

SEQ ID NO: 6967323 - DNA, 22 bp, Homo sapiens
tgtatagtgtggaaagaacagt

SEQ ID NO: 6967324 - DNA, 22 bp, Homo sapiens
tttagcttgaaagttttggagg

SEQ ID NO: 6967325 - DNA, 22 bp, Homo sapiens
gggaagggagggcctccagtca

SEQ ID NO: 6967326 - DNA, 22 bp, Homo sapiens
ggctgagctccaagtattccat

SEQ ID NO: 6967327 - DNA, 22 bp, Homo sapiens
agttacatctgttatgtgtgtt

SEQ ID NO: 6967328 - DNA, 22 bp, Homo sapiens
actttgggacccagccaaccct

SEQ ID NO: 6967329 - DNA, 22 bp, Homo sapiens
aacagtttgtggatagcttgta

SEQ ID NO: 6967330 - DNA, 22 bp, Homo sapiens
gccgtggggagagagggtgcgt

SEQ ID NO: 6967331 - DNA, 19 bp, Homo sapiens
agtgtttatgtagtgccta

SEQ ID NO: 6967332 - DNA, 19 bp, Homo sapiens
tctacaaagtggcatcagg

SEQ ID NO: 6967333 - DNA, 19 bp, Homo sapiens
gcaaatctgaccaaatagt

SEQ ID NO: 6967334 - DNA, 22 bp, Homo sapiens
ggagcagtctggtgatactcag

SEQ ID NO: 6967335 - DNA, 22 bp, Homo sapiens
ttcattactgcggtagtcacac

SEQ ID NO: 6967336 - DNA, 22 bp, Homo sapiens
ttctgggcagttggaaatttca

SEQ ID NO: 6967337 - DNA, 20 bp, Homo sapiens
aacactgaggcctactcttc

SEQ ID NO: 6967338 - DNA, 22 bp, Homo sapiens
tcagagtctcccccagtttggg

SEQ ID NO: 6967339 - DNA, 23 bp, Homo sapiens
ttgttcttggatcttcctgaagc

SEQ ID NO: 6967340 - DNA, 22 bp, Homo sapiens
actctgaaccaattcgcaatga

SEQ ID NO: 6967341 - DNA, 22 bp, Homo sapiens
atgctcaggttttgcccaagac

SEQ ID NO: 6967342 - DNA, 22 bp, Homo sapiens
aaacacttcctgtaacatgaca

SEQ ID NO: 6967343 - DNA, 22 bp, Homo sapiens
gtggccaggagagggtgggaca

SEQ ID NO: 6967344 - DNA, 23 bp, Homo sapiens
tcctgtcaagtgcttgttcctgc

SEQ ID NO: 6967345 - DNA, 22 bp, Homo sapiens
tgtaaaagacatttctaagcaa

SEQ ID NO: 6967346 - DNA, 22 bp, Homo sapiens
cttaaattcttaatgccctcat

SEQ ID NO: 6967347 - DNA, 22 bp, Homo sapiens
gcattaatgtaagacccactcc

SEQ ID NO: 6967348 - DNA, 22 bp, Homo sapiens
tagatatggccgtctgttttaa

SEQ ID NO: 6967349 - DNA, 22 bp, Homo sapiens
tgtgtgggtacagatgattgtt

SEQ ID NO: 6967350 - DNA, 22 bp, Homo sapiens
tggcccagtatgtataatctta

SEQ ID NO: 6967351 - DNA, 22 bp, Homo sapiens
agtacaaatgcagccagagtag

SEQ ID NO: 6967352 - DNA, 22 bp, Homo sapiens
aagagctccaggcaatgcggtc

SEQ ID NO: 6967353 - DNA, 22 bp, Homo sapiens
gcagtcttttctgtgactggct

SEQ ID NO: 6967354 - DNA, 22 bp, Homo sapiens
aggaactgaagacttttactgt

SEQ ID NO: 6967355 - DNA, 22 bp, Homo sapiens
ctgtcactgatgctcctgccac

SEQ ID NO: 6967356 - DNA, 22 bp, Homo sapiens
atgcttgtagtgtaatcactgt

SEQ ID NO: 6967357 - DNA, 22 bp, Homo sapiens
gcaggagctggaaagtgatgtt

SEQ ID NO: 6967358 - DNA, 15 bp, Homo sapiens
tctagttttgaagac

SEQ ID NO: 6967359 - DNA, 22 bp, Homo sapiens
ggtgtcctcactatagcaagtc

SEQ ID NO: 6967360 - DNA, 22 bp, Homo sapiens
agtgatatatgttgccagagag

SEQ ID NO: 6967361 - DNA, 22 bp, Homo sapiens
gagccctccatggagccaggca

SEQ ID NO: 6967362 - DNA, 22 bp, Homo sapiens
ctgtgaattttccaatattccg

SEQ ID NO: 6967363 - DNA, 22 bp, Homo sapiens
tttaagatcatttgtattatcc

SEQ ID NO: 6967364 - DNA, 21 bp, Homo sapiens
tcagtcattgcctccttctgg

SEQ ID NO: 6967365 - DNA, 22 bp, Homo sapiens
atggctggatagttgaagctct

SEQ ID NO: 6967366 - DNA, 22 bp, Homo sapiens
cagttacattaataatgcacat

SEQ ID NO: 6967367 - DNA, 19 bp, Homo sapiens
tgcttctggggcttctcca

SEQ ID NO: 6967368 - DNA, 22 bp, Homo sapiens
cagtgctagaatgtaactctag

SEQ ID NO: 6967369 - DNA, 22 bp, Homo sapiens
ttctgtttgccatatatagtag

SEQ ID NO: 6967370 - DNA, 22 bp, Homo sapiens
ggctgtggccagcggggctgag

SEQ ID NO: 6967371 - DNA, 22 bp, Homo sapiens
ggatccagaggtgaagatggga

SEQ ID NO: 6967372 - DNA, 22 bp, Homo sapiens
accatcctcatcttggatttga

SEQ ID NO: 6967373 - DNA, 22 bp, Homo sapiens
tcaataaatccctctgaccctg

SEQ ID NO: 6967374 - DNA, 22 bp, Homo sapiens
gcaccaccaccatcggcacctc

SEQ ID NO: 6967375 - DNA, 22 bp, Homo sapiens
gacagtggttccaaggcagctt

SEQ ID NO: 6967376 - DNA, 22 bp, Homo sapiens
caccctggaaagaaggtctggg

SEQ ID NO: 6967377 - DNA, 20 bp, Homo sapiens
tgctctgtctaaaacttccc

SEQ ID NO: 6967378 - DNA, 22 bp, Homo sapiens
aatccctctgtcgggcatctgt

SEQ ID NO: 6967379 - DNA, 22 bp, Homo sapiens
aggatttgtttataggtcttaa

SEQ ID NO: 6967380 - DNA, 22 bp, Homo sapiens
tttcctttgggagcatgaattt

SEQ ID NO: 6967381 - DNA, 22 bp, Homo sapiens
tgctggatttgaccaagttgga

SEQ ID NO: 6967382 - DNA, 22 bp, Homo sapiens
aggctgtgtcctcattttatat

SEQ ID NO: 6967383 - DNA, 16 bp, Homo sapiens
aggggtacagttcatc

SEQ ID NO: 6967384 - DNA, 22 bp, Homo sapiens
atgtctgctattcatagggaaa

SEQ ID NO: 6967385 - DNA, 22 bp, Homo sapiens
atggacaggctgagcttcctca

SEQ ID NO: 6967386 - DNA, 22 bp, Homo sapiens
tttgttgttagagtatgtgaaa

SEQ ID NO: 6967387 - DNA, 22 bp, Homo sapiens
aggaactgatgagcagccaggg

SEQ ID NO: 6967388 - DNA, 19 bp, Homo sapiens
tagccctggccatcatgag

SEQ ID NO: 6967389 - DNA, 22 bp, Homo sapiens
ggagagaactggctccttctag

SEQ ID NO: 6967390 - DNA, 22 bp, Homo sapiens
tccctggctgggggctgccttg

SEQ ID NO: 6967391 - DNA, 22 bp, Homo sapiens
tagacattaggtaggttcatgg

SEQ ID NO: 6967392 - DNA, 22 bp, Homo sapiens
tctctctgcgaattaggtttgc

SEQ ID NO: 6967393 - DNA, 22 bp, Homo sapiens
tgcagggcacggtgcgcgtggg

SEQ ID NO: 6967394 - DNA, 22 bp, Homo sapiens
tcacatttgtgttttattagag

SEQ ID NO: 6967395 - DNA, 22 bp, Homo sapiens
tggccctgagggctcggagcca

SEQ ID NO: 6967396 - DNA, 22 bp, Homo sapiens
tgctttatgtggctgatactca

SEQ ID NO: 6967397 - DNA, 22 bp, Homo sapiens
gcactatagctgcagcacagag

SEQ ID NO: 6967398 - DNA, 22 bp, Homo sapiens
tgctgagtatttgtttgaataa

SEQ ID NO: 6967399 - DNA, 22 bp, Homo sapiens
ttccaggaggtcaaaggcctgt

SEQ ID NO: 6967400 - DNA, 22 bp, Homo sapiens
gctggcatcactggcttcggtg

SEQ ID NO: 6967401 - DNA, 22 bp, Homo sapiens
acattcctacctgctcgggtgt

SEQ ID NO: 6967402 - DNA, 22 bp, Homo sapiens
tggaccactctggtgcccatgt

SEQ ID NO: 6967403 - DNA, 22 bp, Homo sapiens
gcatgcagtcaaccagtaaggg

SEQ ID NO: 6967404 - DNA, 22 bp, Homo sapiens
ttgtagatggcttatttctgtg

SEQ ID NO: 6967405 - DNA, 22 bp, Homo sapiens
gtgcaaaatgatatcctgaagc

SEQ ID NO: 6967406 - DNA, 22 bp, Homo sapiens
agcaaggcagtcagctggctgg

SEQ ID NO: 6967407 - DNA, 22 bp, Homo sapiens
tgcattaaggtaattgtataat

SEQ ID NO: 6967408 - DNA, 22 bp, Homo sapiens
aaattgctagttgcttttttca

SEQ ID NO: 6967409 - DNA, 23 bp, Homo sapiens
agctataaaatctgtgacagcag

SEQ ID NO: 6967410 - DNA, 18 bp, Homo sapiens
gccagtgccctggctcac

SEQ ID NO: 6967411 - DNA, 23 bp, Homo sapiens
tcatgcagcctggaacctcccag

SEQ ID NO: 6967412 - DNA, 22 bp, Homo sapiens
ttagcaaactctgttagattct

SEQ ID NO: 6967413 - DNA, 22 bp, Homo sapiens
accaagcacaaagatgagtaaa

SEQ ID NO: 6967414 - DNA, 22 bp, Homo sapiens
tgttcctgaatgcctggctggc

SEQ ID NO: 6967415 - DNA, 22 bp, Homo sapiens
aaggaccagttttgcagaattg

SEQ ID NO: 6967416 - DNA, 22 bp, Homo sapiens
tatgttaagtgggataatcaaa

SEQ ID NO: 6967417 - DNA, 22 bp, Homo sapiens
actgattcaagttatgcatctt

SEQ ID NO: 6967418 - DNA, 22 bp, Homo sapiens
ttctgcttcactggcctggagg

SEQ ID NO: 6967419 - DNA, 22 bp, Homo sapiens
tcatcttgcagtgtgtgttctg

SEQ ID NO: 6967420 - DNA, 22 bp, Homo sapiens
gtaagccatcctcaggggcctg

SEQ ID NO: 6967421 - DNA, 22 bp, Homo sapiens
ttgcatatatttctaaggaggt

SEQ ID NO: 6967422 - DNA, 22 bp, Homo sapiens
tgcagggaggccccgcagccct

SEQ ID NO: 6967423 - DNA, 23 bp, Homo sapiens
ggctttgccacatattgaccatg

SEQ ID NO: 6967424 - DNA, 22 bp, Homo sapiens
ctgcaaatgggctttaggtggc

SEQ ID NO: 6967425 - DNA, 22 bp, Homo sapiens
ggtatgctgttgtcttcggcca

SEQ ID NO: 6967426 - DNA, 22 bp, Homo sapiens
tcttgaaaattgaggttgaagg

SEQ ID NO: 6967427 - DNA, 20 bp, Homo sapiens
aggaagtgatgttttatctg

SEQ ID NO: 6967428 - DNA, 22 bp, Homo sapiens
acagctggacaggggagagttt

SEQ ID NO: 6967429 - DNA, 22 bp, Homo sapiens
gttctcatagtggaaaataggt

SEQ ID NO: 6967430 - DNA, 22 bp, Homo sapiens
caaaatgcatctgagaccaggc

SEQ ID NO: 6967431 - DNA, 22 bp, Homo sapiens
ttgtattcctgggtcaaggaga

SEQ ID NO: 6967432 - DNA, 22 bp, Homo sapiens
aagtggactaatacaaggacta

SEQ ID NO: 6967433 - DNA, 22 bp, Homo sapiens
cccaggagacagaaacagaggt

SEQ ID NO: 6967434 - DNA, 23 bp, Homo sapiens
tggctgagatcctactgtttgct

SEQ ID NO: 6967435 - DNA, 22 bp, Homo sapiens
gctccagggtggatgacaattc

SEQ ID NO: 6967436 - DNA, 22 bp, Homo sapiens
gcagagctggtacttgagcctg

SEQ ID NO: 6967437 - DNA, 22 bp, Homo sapiens
aaattattttcagaatggagaa

SEQ ID NO: 6967438 - DNA, 22 bp, Homo sapiens
ttcaggcatccctacagttagg

SEQ ID NO: 6967439 - DNA, 22 bp, Homo sapiens
ttttattggagtgataccaagc

SEQ ID NO: 6967440 - DNA, 22 bp, Homo sapiens
aggctgtcatctttgcaggcag

SEQ ID NO: 6967441 - DNA, 22 bp, Homo sapiens
tctgggattttatagacatgct

SEQ ID NO: 6967442 - DNA, 22 bp, Homo sapiens
aagagttaagcaacagatacca

SEQ ID NO: 6967443 - DNA, 17 bp, Homo sapiens
atttcctcagggctgag

SEQ ID NO: 6967444 - DNA, 22 bp, Homo sapiens
cttaggaagcgggacctgtgca

SEQ ID NO: 6967445 - DNA, 22 bp, Homo sapiens
tgaggctcaagaatagacagta

SEQ ID NO: 6967446 - DNA, 20 bp, Homo sapiens
tgagggctaaccagactctg

SEQ ID NO: 6967447 - DNA, 22 bp, Homo sapiens
aaaatggtctcagctggcacca

SEQ ID NO: 6967448 - DNA, 22 bp, Homo sapiens
tggaggcaggggatacaggtca

SEQ ID NO: 6967449 - DNA, 22 bp, Homo sapiens
tggaaactaggatggaagaaat

SEQ ID NO: 6967450 - DNA, 22 bp, Homo sapiens
ggagcagatgtcttcatggcct

SEQ ID NO: 6967451 - DNA, 22 bp, Homo sapiens
agtacaaagtgctcctggttct

SEQ ID NO: 6967452 - DNA, 22 bp, Homo sapiens
ggtgcagtggtgtggcaaaggg

SEQ ID NO: 6967453 - DNA, 22 bp, Homo sapiens
acagagctgggtgccccctgga

SEQ ID NO: 6967454 - DNA, 22 bp, Homo sapiens
tgagcacggaataaacgtctat

SEQ ID NO: 6967455 - DNA, 22 bp, Homo sapiens
aaggcaattgattatttttcct

SEQ ID NO: 6967456 - DNA, 22 bp, Homo sapiens
cctcagaccttgctagtagtct

SEQ ID NO: 6967457 - DNA, 20 bp, Homo sapiens
cacattaaggaaaacaactg

SEQ ID NO: 6967458 - DNA, 22 bp, Homo sapiens
tcaggagagagttgggtaggct

SEQ ID NO: 6967459 - DNA, 20 bp, Homo sapiens
ttaaaaagagtcacaggaga

SEQ ID NO: 6967460 - DNA, 22 bp, Homo sapiens
ccctttccatggctctcctagg

SEQ ID NO: 6967461 - DNA, 21 bp, Homo sapiens
tgagtcttttaataggtgcac

SEQ ID NO: 6967462 - DNA, 21 bp, Homo sapiens
tgagcaggtgctgcttttatg

SEQ ID NO: 6967463 - DNA, 22 bp, Homo sapiens
agtgtagatgaaattaaaccca

SEQ ID NO: 6967464 - DNA, 22 bp, Homo sapiens
aaggctccagtgaatgctggca

SEQ ID NO: 6967465 - DNA, 22 bp, Homo sapiens
aggggcgctgcggtcctcagcc

SEQ ID NO: 6967466 - DNA, 22 bp, Homo sapiens
aatttgattttcttaaaccata

SEQ ID NO: 6967467 - DNA, 22 bp, Homo sapiens
ggagggttgggacaccagggtc

SEQ ID NO: 6967468 - DNA, 22 bp, Homo sapiens
aattgaacaagtaatagaagag

SEQ ID NO: 6967469 - DNA, 22 bp, Homo sapiens
ggactgggaatcagggagatgc

SEQ ID NO: 6967470 - DNA, 22 bp, Homo sapiens
taagaagtacaaaaattttctg

SEQ ID NO: 6967471 - DNA, 22 bp, Homo sapiens
tccagggcctgaggttgaagtg

SEQ ID NO: 6967472 - DNA, 22 bp, Homo sapiens
gctggctctgcacccaggcctc

SEQ ID NO: 6967473 - DNA, 22 bp, Homo sapiens
ttgcccttggctgaaggcactg

SEQ ID NO: 6967474 - DNA, 22 bp, Homo sapiens
gtactacaatgttcacaacatt

SEQ ID NO: 6967475 - DNA, 22 bp, Homo sapiens
tcagccagcattacccctgact

SEQ ID NO: 6967476 - DNA, 22 bp, Homo sapiens
tgctgaaaatgcgtatcttcca

SEQ ID NO: 6967477 - DNA, 22 bp, Homo sapiens
actcccttgtgaactcattctt

SEQ ID NO: 6967478 - DNA, 22 bp, Homo sapiens
tgcagggcatagggtccagttt

SEQ ID NO: 6967479 - DNA, 22 bp, Homo sapiens
agtggcaagagggtctattgtt

SEQ ID NO: 6967480 - DNA, 22 bp, Homo sapiens
gggcatggcgtgtgctggattc

SEQ ID NO: 6967481 - DNA, 22 bp, Homo sapiens
ttgcctgtgaacgctgagtcct

SEQ ID NO: 6967482 - DNA, 22 bp, Homo sapiens
ggccagaggccacagctgtgtc

SEQ ID NO: 6967483 - DNA, 22 bp, Homo sapiens
ggcagctcgtcaggctgcggcg

SEQ ID NO: 6967484 - DNA, 20 bp, Homo sapiens
gctaggctggtgattgtcaa

SEQ ID NO: 6967485 - DNA, 22 bp, Homo sapiens
ccaatacttagattaaaatagt

SEQ ID NO: 6967486 - DNA, 22 bp, Homo sapiens
gctggctgttggaggtacctgc

SEQ ID NO: 6967487 - DNA, 20 bp, Homo sapiens
gaagatgggtagaggcacag

SEQ ID NO: 6967488 - DNA, 22 bp, Homo sapiens
gtcatattataaatgttctgtt

SEQ ID NO: 6967489 - DNA, 22 bp, Homo sapiens
ctgcccaagtggagtctccgca

SEQ ID NO: 6967490 - DNA, 19 bp, Homo sapiens
agcagccatcgaccatgga

SEQ ID NO: 6967491 - DNA, 22 bp, Homo sapiens
cagaagtgaatgtgataaacca

SEQ ID NO: 6967492 - DNA, 22 bp, Homo sapiens
tgggagccattttagaggctgc

SEQ ID NO: 6967493 - DNA, 22 bp, Homo sapiens
tgcatgtctttagcatttgtta

SEQ ID NO: 6967494 - DNA, 22 bp, Homo sapiens
agtccatagtttacattacagc

SEQ ID NO: 6967495 - DNA, 22 bp, Homo sapiens
gagtctggccctgatgcatcat

SEQ ID NO: 6967496 - DNA, 22 bp, Homo sapiens
acctctaaaaaattagaagcct

SEQ ID NO: 6967497 - DNA, 22 bp, Homo sapiens
gcacccctggacggtagggcca

SEQ ID NO: 6967498 - DNA, 22 bp, Homo sapiens
ggacagtattctcttgaaataa

SEQ ID NO: 6967499 - DNA, 22 bp, Homo sapiens
cctgaggtcagccattcttgcc

SEQ ID NO: 6967500 - DNA, 22 bp, Homo sapiens
ctgtggggaagatagaaccgac

SEQ ID NO: 6967501 - DNA, 22 bp, Homo sapiens
taaatgcttagattcatagaaa

SEQ ID NO: 6967502 - DNA, 22 bp, Homo sapiens
cctgtgtgtaggccaggggagt

SEQ ID NO: 6967503 - DNA, 22 bp, Homo sapiens
cagcagcagccccaggaaggtt

SEQ ID NO: 6967504 - DNA, 22 bp, Homo sapiens
cctgctgtgtccctggctttct

SEQ ID NO: 6967505 - DNA, 22 bp, Homo sapiens
tccattctacaaggtagcaggg

SEQ ID NO: 6967506 - DNA, 22 bp, Homo sapiens
atagacatggtcttttgtcatt

SEQ ID NO: 6967507 - DNA, 22 bp, Homo sapiens
caagtccttttcttggctcagg

SEQ ID NO: 6967508 - DNA, 22 bp, Homo sapiens
cttttactgtgaaaagaaactg

SEQ ID NO: 6967509 - DNA, 22 bp, Homo sapiens
tgctgaataaagatatattttc

SEQ ID NO: 6967510 - DNA, 22 bp, Homo sapiens
gaaaggccaccatgccagggac

SEQ ID NO: 6967511 - DNA, 22 bp, Homo sapiens
ctttcaaaacgctctgtatgca

SEQ ID NO: 6967512 - DNA, 22 bp, Homo sapiens
gctttctcttcactgatgttca

SEQ ID NO: 6967513 - DNA, 22 bp, Homo sapiens
cccacctctcagagagccttgc

SEQ ID NO: 6967514 - DNA, 22 bp, Homo sapiens
gttcagtgtctctctattttat

SEQ ID NO: 6967515 - DNA, 22 bp, Homo sapiens
tttgtaagtggtagatctaaga

SEQ ID NO: 6967516 - DNA, 22 bp, Homo sapiens
tcccttcatcagtgagcaagcc

SEQ ID NO: 6967517 - DNA, 22 bp, Homo sapiens
attggccagacttatccttcag

SEQ ID NO: 6967518 - DNA, 22 bp, Homo sapiens
ggtcaaagtgaggagtcaggtt

SEQ ID NO: 6967519 - DNA, 22 bp, Homo sapiens
gcacttgaagaattgaactgga

SEQ ID NO: 6967520 - DNA, 22 bp, Homo sapiens
aagacctctggagggcaatgtc

SEQ ID NO: 6967521 - DNA, 22 bp, Homo sapiens
tcctcccaacttttccatctca

SEQ ID NO: 6967522 - DNA, 22 bp, Homo sapiens
tcagaggattggacttttatgt

SEQ ID NO: 6967523 - DNA, 22 bp, Homo sapiens
tggtgtctgcactccctggcgt

SEQ ID NO: 6967524 - DNA, 22 bp, Homo sapiens
cttatcaaactggagcaggctt

SEQ ID NO: 6967525 - DNA, 22 bp, Homo sapiens
ggccagcagtatatagctaatt

SEQ ID NO: 6967526 - DNA, 22 bp, Homo sapiens
ctggctggttggggagaagaca

SEQ ID NO: 6967527 - DNA, 22 bp, Homo sapiens
agtagggagaccggaggccgcc

SEQ ID NO: 6967528 - DNA, 22 bp, Homo sapiens
agtgacttaaaggaacttactg

SEQ ID NO: 6967529 - DNA, 22 bp, Homo sapiens
ctgttgtgaaatgtccatcaac

SEQ ID NO: 6967530 - DNA, 22 bp, Homo sapiens
tgaggaagtggttgtatggttt

SEQ ID NO: 6967531 - DNA, 22 bp, Homo sapiens
caggcacagagttattcattta

SEQ ID NO: 6967532 - DNA, 22 bp, Homo sapiens
ccattctttcagtgtctcatgt

SEQ ID NO: 6967533 - DNA, 22 bp, Homo sapiens
aatggccagacagatggctgct

SEQ ID NO: 6967534 - DNA, 23 bp, Homo sapiens
ccaagcttctaatgctgctgagc

SEQ ID NO: 6967535 - DNA, 22 bp, Homo sapiens
ttagaaatctgctgccatgcaa

SEQ ID NO: 6967536 - DNA, 22 bp, Homo sapiens
atgttttattaccaacttgtac

SEQ ID NO: 6967537 - DNA, 22 bp, Homo sapiens
aacaggccctgccatttatcca

SEQ ID NO: 6967538 - DNA, 22 bp, Homo sapiens
gccagcagggaagccttgggct

SEQ ID NO: 6967539 - DNA, 22 bp, Homo sapiens
ttagaaatacaagtgaggttga

SEQ ID NO: 6967540 - DNA, 20 bp, Homo sapiens
tggagtcatgggacactcac

SEQ ID NO: 6967541 - DNA, 22 bp, Homo sapiens
taatctgttgactaacttggga

SEQ ID NO: 6967542 - DNA, 22 bp, Homo sapiens
tgggtgtgcccagatggtgtcc

SEQ ID NO: 6967543 - DNA, 22 bp, Homo sapiens
ctttagttttcatcaaatctat

SEQ ID NO: 6967544 - DNA, 22 bp, Homo sapiens
ctttcccttagccccattctat

SEQ ID NO: 6967545 - DNA, 23 bp, Homo sapiens
tccttgagtgtcccccaagagtc

SEQ ID NO: 6967546 - DNA, 22 bp, Homo sapiens
gtcctgtgccgaggtgggaagc

SEQ ID NO: 6967547 - DNA, 22 bp, Homo sapiens
aaacgtggctgaaccttggcac

SEQ ID NO: 6967548 - DNA, 22 bp, Homo sapiens
cacaattatagaagaaagcata

SEQ ID NO: 6967549 - DNA, 22 bp, Homo sapiens
ttaaggaagacagggcaaggtg

SEQ ID NO: 6967550 - DNA, 22 bp, Homo sapiens
ctgtgggtgaagacaagggaga

SEQ ID NO: 6967551 - DNA, 22 bp, Homo sapiens
gtgggcagacatgatagaagga

SEQ ID NO: 6967552 - DNA, 22 bp, Homo sapiens
acctgtctataaaagtgaatac

SEQ ID NO: 6967553 - DNA, 22 bp, Homo sapiens
tagatagataaaatgttgcaga

SEQ ID NO: 6967554 - DNA, 22 bp, Homo sapiens
cagagggttgtcaggcgccttg

SEQ ID NO: 6967555 - DNA, 22 bp, Homo sapiens
tacagtgcacatttcttaggaa

SEQ ID NO: 6967556 - DNA, 22 bp, Homo sapiens
gagtccctgctgtcaggtgctg

SEQ ID NO: 6967557 - DNA, 22 bp, Homo sapiens
aatgtgactgtatttgaaaaga

SEQ ID NO: 6967558 - DNA, 22 bp, Homo sapiens
caggtctccattttgatgagtt

SEQ ID NO: 6967559 - DNA, 22 bp, Homo sapiens
tacagctgctggtgctccatgc

SEQ ID NO: 6967560 - DNA, 22 bp, Homo sapiens
ggcgctggccacggtggctctg

SEQ ID NO: 6967561 - DNA, 22 bp, Homo sapiens
aggtctgagtcccaggggtacc

SEQ ID NO: 6967562 - DNA, 22 bp, Homo sapiens
acacggaaaaggagacagaggg

SEQ ID NO: 6967563 - DNA, 22 bp, Homo sapiens
acccaggatagagtgctgcagt

SEQ ID NO: 6967564 - DNA, 22 bp, Homo sapiens
atgtgagatgcacataattata

SEQ ID NO: 6967565 - DNA, 22 bp, Homo sapiens
tagattgcatatggaatgtatt

SEQ ID NO: 6967566 - DNA, 22 bp, Homo sapiens
atgagcttccagacaaaggcat

SEQ ID NO: 6967567 - DNA, 22 bp, Homo sapiens
cttgagaatcttctctgaagag

SEQ ID NO: 6967568 - DNA, 21 bp, Homo sapiens
ttcttcctaaatacagatctc

SEQ ID NO: 6967569 - DNA, 22 bp, Homo sapiens
agccaacttagaagaaatttga

SEQ ID NO: 6967570 - DNA, 22 bp, Homo sapiens
gggcagtgttgtggttctctat

SEQ ID NO: 6967571 - DNA, 22 bp, Homo sapiens
ggagccagagggatgcagttga

SEQ ID NO: 6967572 - DNA, 22 bp, Homo sapiens
atgtagaacaggttaatgacag

SEQ ID NO: 6967573 - DNA, 22 bp, Homo sapiens
tgcagcactgttcacaatagcc

SEQ ID NO: 6967574 - DNA, 22 bp, Homo sapiens
tgtgccttgtacagcattcaaa

SEQ ID NO: 6967575 - DNA, 22 bp, Homo sapiens
tgctggttcttaggagagagat

SEQ ID NO: 6967576 - DNA, 22 bp, Homo sapiens
agagggcttccctaggagtgag

SEQ ID NO: 6967577 - DNA, 22 bp, Homo sapiens
atgatgaagagtaacaggctga

SEQ ID NO: 6967578 - DNA, 22 bp, Homo sapiens
ttcaggagctagggatgtgaaa

SEQ ID NO: 6967579 - DNA, 22 bp, Homo sapiens
gatctgaaaatgctcttcttct

SEQ ID NO: 6967580 - DNA, 22 bp, Homo sapiens
cctcctggcctgtgcagagccc

SEQ ID NO: 6967581 - DNA, 22 bp, Homo sapiens
ggaagtggtagagccatgagtg

SEQ ID NO: 6967582 - DNA, 21 bp, Homo sapiens
caccaacacctgggataggtc

SEQ ID NO: 6967583 - DNA, 22 bp, Homo sapiens
tgtacaaagttaaacctatata

SEQ ID NO: 6967584 - DNA, 22 bp, Homo sapiens
ggccctctgctctgagatgaag

SEQ ID NO: 6967585 - DNA, 22 bp, Homo sapiens
acccaggggcgaagctggccac

SEQ ID NO: 6967586 - DNA, 22 bp, Homo sapiens
aaggggaatagagtgggttgtg

SEQ ID NO: 6967587 - DNA, 18 bp, Homo sapiens
cttaaactgtccccagta

SEQ ID NO: 6967588 - DNA, 22 bp, Homo sapiens
attctgagttagagtcagccag

SEQ ID NO: 6967589 - DNA, 22 bp, Homo sapiens
ctagcccttggtgagaacagcg

SEQ ID NO: 6967590 - DNA, 22 bp, Homo sapiens
taagtcctattccaggtctctc

SEQ ID NO: 6967591 - DNA, 22 bp, Homo sapiens
gcagggcagtgtgtctgtgggg

SEQ ID NO: 6967592 - DNA, 22 bp, Homo sapiens
agcttcaaggttcaaggatgct

SEQ ID NO: 6967593 - DNA, 22 bp, Homo sapiens
aagaaacgtttgagctttgact

SEQ ID NO: 6967594 - DNA, 22 bp, Homo sapiens
gctgctttagacaggagaagca

SEQ ID NO: 6967595 - DNA, 22 bp, Homo sapiens
gacagagggttccaaaattgat

SEQ ID NO: 6967596 - DNA, 22 bp, Homo sapiens
ccagaggtctctctatactggg

SEQ ID NO: 6967597 - DNA, 22 bp, Homo sapiens
caggtgacctatggtcactaca

SEQ ID NO: 6967598 - DNA, 22 bp, Homo sapiens
gacgggtgtatgctcccagcca

SEQ ID NO: 6967599 - DNA, 22 bp, Homo sapiens
gtgcctcagcaccgcctgcagc

SEQ ID NO: 6967600 - DNA, 22 bp, Homo sapiens
gtctggaaccaagacgtgtagc

SEQ ID NO: 6967601 - DNA, 22 bp, Homo sapiens
gttgcagacactccacagtcga

SEQ ID NO: 6967602 - DNA, 22 bp, Homo sapiens
gatccacaggaaccaaaacgca

SEQ ID NO: 6967603 - DNA, 20 bp, Homo sapiens
agggaggtgctgggcctgag

SEQ ID NO: 6967604 - DNA, 22 bp, Homo sapiens
cacagatagaccttatgagatt

SEQ ID NO: 6967605 - DNA, 22 bp, Homo sapiens
acattctttcaccttgtgtcca

SEQ ID NO: 6967606 - DNA, 22 bp, Homo sapiens
ctgggttgatctcagccctaag

SEQ ID NO: 6967607 - DNA, 22 bp, Homo sapiens
aaaattgagagtcttgtgcaag

SEQ ID NO: 6967608 - DNA, 22 bp, Homo sapiens
tttccaggccagacctttcaat

SEQ ID NO: 6967609 - DNA, 22 bp, Homo sapiens
atctttcagagctccatcaggg

SEQ ID NO: 6967610 - DNA, 22 bp, Homo sapiens
gattagtaggtgagggaggcac

SEQ ID NO: 6967611 - DNA, 22 bp, Homo sapiens
gacagctgaaaaatgtaaggta

SEQ ID NO: 6967612 - DNA, 22 bp, Homo sapiens
ggaggccaaggcaggtggatcg

SEQ ID NO: 6967613 - DNA, 22 bp, Homo sapiens
gcacatgtgagagtagaggcct

SEQ ID NO: 6967614 - DNA, 22 bp, Homo sapiens
atcttgccagtctccaaatcaa

SEQ ID NO: 6967615 - DNA, 22 bp, Homo sapiens
caagaggcaaattgtctagaag

SEQ ID NO: 6967616 - DNA, 22 bp, Homo sapiens
ttccatacgactgaggtctcgg

SEQ ID NO: 6967617 - DNA, 21 bp, Homo sapiens
tattgcataacaaattaccct

SEQ ID NO: 6967618 - DNA, 22 bp, Homo sapiens
tagggagtgcgtagcagggtgg

SEQ ID NO: 6967619 - DNA, 22 bp, Homo sapiens
tggctctctacaggtcaagacc

SEQ ID NO: 6967620 - DNA, 22 bp, Homo sapiens
gggccatctacactccccaaaa

SEQ ID NO: 6967621 - DNA, 18 bp, Homo sapiens
actccccacaggctctgt

SEQ ID NO: 6967622 - DNA, 22 bp, Homo sapiens
cttgagctaggaaggctgaggc

SEQ ID NO: 6967623 - DNA, 22 bp, Homo sapiens
gagctgtgattggtgtctcact

SEQ ID NO: 6967624 - DNA, 22 bp, Homo sapiens
tgtatatgtgatgtacatgtac

SEQ ID NO: 6967625 - DNA, 22 bp, Homo sapiens
tgcttattaaacatgcatattc

SEQ ID NO: 6967626 - DNA, 22 bp, Homo sapiens
taatggctaaaattcagaagaa

SEQ ID NO: 6967627 - DNA, 22 bp, Homo sapiens
ttggaatagatttgttagaaaa

SEQ ID NO: 6967628 - DNA, 22 bp, Homo sapiens
ctagaatctatgtcaggaactc

SEQ ID NO: 6967629 - DNA, 22 bp, Homo sapiens
cagggtggtgaatagctatagt

SEQ ID NO: 6967630 - DNA, 17 bp, Homo sapiens
gtgtacaagcagaaggc

SEQ ID NO: 6967631 - DNA, 22 bp, Homo sapiens
taagagcataggcttgaaaata

SEQ ID NO: 6967632 - DNA, 22 bp, Homo sapiens
agcatcttgaaatataaagtca

SEQ ID NO: 6967633 - DNA, 22 bp, Homo sapiens
aggctgtgtgctccttatgaga

SEQ ID NO: 6967634 - DNA, 22 bp, Homo sapiens
ttattgctagtgtcatttcaca

SEQ ID NO: 6967635 - DNA, 22 bp, Homo sapiens
acagacattcagctaagtctat

SEQ ID NO: 6967636 - DNA, 22 bp, Homo sapiens
tttctctctatttagacaggta

SEQ ID NO: 6967637 - DNA, 22 bp, Homo sapiens
ttattggccaactgccttggag

SEQ ID NO: 6967638 - DNA, 22 bp, Homo sapiens
ttctgttctttatttaccatat

SEQ ID NO: 6967639 - DNA, 22 bp, Homo sapiens
tgacaagtagggtgggatttgt

SEQ ID NO: 6967640 - DNA, 21 bp, Homo sapiens
ggcctgagcacctgtccacct

SEQ ID NO: 6967641 - DNA, 22 bp, Homo sapiens
aacagcatatttcatatattga

SEQ ID NO: 6967642 - DNA, 22 bp, Homo sapiens
tttgttctgaaaatcttccctt

SEQ ID NO: 6967643 - DNA, 22 bp, Homo sapiens
tccaggcccactcagctgaaat

SEQ ID NO: 6967644 - DNA, 22 bp, Homo sapiens
ggtgtgaaatgttcagtgttac

SEQ ID NO: 6967645 - DNA, 20 bp, Homo sapiens
ataccagagtacagtttatg

SEQ ID NO: 6967646 - DNA, 22 bp, Homo sapiens
ctgagactttcatgtgctttta

SEQ ID NO: 6967647 - DNA, 22 bp, Homo sapiens
tggggtggatagaaagtgatgt

SEQ ID NO: 6967648 - DNA, 22 bp, Homo sapiens
ggcttctggtaaagaccacacc

SEQ ID NO: 6967649 - DNA, 22 bp, Homo sapiens
aagatccatgagggcagagatt

SEQ ID NO: 6967650 - DNA, 22 bp, Homo sapiens
gaagatacaaatttcttagatg

SEQ ID NO: 6967651 - DNA, 23 bp, Homo sapiens
ctcagcaggtcaggccccttcct

SEQ ID NO: 6967652 - DNA, 22 bp, Homo sapiens
aggaagctagaaggtcttcttt

SEQ ID NO: 6967653 - DNA, 23 bp, Homo sapiens
agcaggcatctgtggcacaaggc

SEQ ID NO: 6967654 - DNA, 22 bp, Homo sapiens
tgggctggcccaccacacctcg

SEQ ID NO: 6967655 - DNA, 22 bp, Homo sapiens
tgacaggacagagaaatgacct

SEQ ID NO: 6967656 - DNA, 22 bp, Homo sapiens
aaggccagggatgccagctcgg

SEQ ID NO: 6967657 - DNA, 22 bp, Homo sapiens
tgtacagatatcaggagtgagg

SEQ ID NO: 6967658 - DNA, 17 bp, Homo sapiens
aggcacctcttcctgct

SEQ ID NO: 6967659 - DNA, 22 bp, Homo sapiens
acagatttttcagctcctgtgt

SEQ ID NO: 6967660 - DNA, 22 bp, Homo sapiens
catttgttaattactattatct

SEQ ID NO: 6967661 - DNA, 22 bp, Homo sapiens
agcgacaccgcctgcaggccat

SEQ ID NO: 6967662 - DNA, 22 bp, Homo sapiens
agctgaaacccaggcctcagct

SEQ ID NO: 6967663 - DNA, 22 bp, Homo sapiens
taaaggcttctgcagggactga

SEQ ID NO: 6967664 - DNA, 21 bp, Homo sapiens
ttacaacatttgtgttctatg

SEQ ID NO: 6967665 - DNA, 19 bp, Homo sapiens
aaatggagctaatcttgtc

SEQ ID NO: 6967666 - DNA, 22 bp, Homo sapiens
aaagccagtttgtctctttaaa

SEQ ID NO: 6967667 - DNA, 20 bp, Homo sapiens
ctgggccatccttttacaat

SEQ ID NO: 6967668 - DNA, 22 bp, Homo sapiens
actggccaggcgaaccacactg

SEQ ID NO: 6967669 - DNA, 22 bp, Homo sapiens
ttgcttctcagggcctgatgca

SEQ ID NO: 6967670 - DNA, 22 bp, Homo sapiens
actgccaggtgctccatctgaa

SEQ ID NO: 6967671 - DNA, 22 bp, Homo sapiens
cagcatcacagtgcccgaagtc

SEQ ID NO: 6967672 - DNA, 22 bp, Homo sapiens
agctgccagcatcccggaaggg

SEQ ID NO: 6967673 - DNA, 22 bp, Homo sapiens
tgaggctcttctgtaaatgatc

SEQ ID NO: 6967674 - DNA, 23 bp, Homo sapiens
ggcatccttcccgctgcgagtcc

SEQ ID NO: 6967675 - DNA, 23 bp, Homo sapiens
tttggcagaagcacattattgtg

SEQ ID NO: 6967676 - DNA, 22 bp, Homo sapiens
agtgcataaaggaaaaactgaa

SEQ ID NO: 6967677 - DNA, 22 bp, Homo sapiens
agatacatatagaaaacatcaa

SEQ ID NO: 6967678 - DNA, 22 bp, Homo sapiens
ttaccattattaggtggacttg

SEQ ID NO: 6967679 - DNA, 22 bp, Homo sapiens
ctgatgaatggctcctgagtgg

SEQ ID NO: 6967680 - DNA, 22 bp, Homo sapiens
gtatgtcacctctcctaagcac

SEQ ID NO: 6967681 - DNA, 22 bp, Homo sapiens
aagtgggtcagggacagatctt

SEQ ID NO: 6967682 - DNA, 22 bp, Homo sapiens
gggtcaagccgttgcccaaggc

SEQ ID NO: 6967683 - DNA, 22 bp, Homo sapiens
tggctccggcgctctgagacag

SEQ ID NO: 6967684 - DNA, 22 bp, Homo sapiens
actggttttccaggttacttct

SEQ ID NO: 6967685 - DNA, 22 bp, Homo sapiens
tgttttggtttaagtatatgaa

SEQ ID NO: 6967686 - DNA, 22 bp, Homo sapiens
acagagcatgatggaagatcga

SEQ ID NO: 6967687 - DNA, 19 bp, Homo sapiens
tgggcctgcatctgggtct

SEQ ID NO: 6967688 - DNA, 22 bp, Homo sapiens
ttctttctctccacaaggcttg

SEQ ID NO: 6967689 - DNA, 22 bp, Homo sapiens
gtttctctgtacctctgtccca

SEQ ID NO: 6967690 - DNA, 21 bp, Homo sapiens
gtttgcatgaacaagtcagcc

SEQ ID NO: 6967691 - DNA, 22 bp, Homo sapiens
ggaagcagcctgaagccaaggg

SEQ ID NO: 6967692 - DNA, 20 bp, Homo sapiens
cttccaccagggccgctgat

SEQ ID NO: 6967693 - DNA, 22 bp, Homo sapiens
attagggctggatgcaaggaaa

SEQ ID NO: 6967694 - DNA, 22 bp, Homo sapiens
tccaaggcatggtgggagagag

SEQ ID NO: 6967695 - DNA, 22 bp, Homo sapiens
gcattgaaatggcaaaaagaga

SEQ ID NO: 6967696 - DNA, 22 bp, Homo sapiens
tcttcagatggccagttgtccc

SEQ ID NO: 6967697 - DNA, 22 bp, Homo sapiens
ggggaaggattgagttgaccca

SEQ ID NO: 6967698 - DNA, 20 bp, Homo sapiens
aggtcagtagaatgattttg

SEQ ID NO: 6967699 - DNA, 22 bp, Homo sapiens
atagctttgagggctccttagg

SEQ ID NO: 6967700 - DNA, 22 bp, Homo sapiens
accctttgttggataagttggc

SEQ ID NO: 6967701 - DNA, 22 bp, Homo sapiens
agcagtggctgaagatgttcct

SEQ ID NO: 6967702 - DNA, 22 bp, Homo sapiens
agcagctcacaggattcctgaa

SEQ ID NO: 6967703 - DNA, 22 bp, Homo sapiens
gtaatagaacactcagcatgga

SEQ ID NO: 6967704 - DNA, 22 bp, Homo sapiens
ttgcctggagggacatggagac

SEQ ID NO: 6967705 - DNA, 23 bp, Homo sapiens
gtgctacttacagggagcttggt

SEQ ID NO: 6967706 - DNA, 22 bp, Homo sapiens
agaggcgcagactcttgagtgt

SEQ ID NO: 6967707 - DNA, 22 bp, Homo sapiens
caaagtgctaggattacaggcg

SEQ ID NO: 6967708 - DNA, 22 bp, Homo sapiens
taagacatgtccaggctgtgag

SEQ ID NO: 6967709 - DNA, 22 bp, Homo sapiens
ctccattgaacatcctctcaga

SEQ ID NO: 6967710 - DNA, 21 bp, Homo sapiens
atggtgagatactgggtgtgg

SEQ ID NO: 6967711 - DNA, 22 bp, Homo sapiens
actgcagtcatcatctccctgg

SEQ ID NO: 6967712 - DNA, 19 bp, Homo sapiens
gccaggacatcctcctgct

SEQ ID NO: 6967713 - DNA, 22 bp, Homo sapiens
taaagttctggtgagaggtaag

SEQ ID NO: 6967714 - DNA, 22 bp, Homo sapiens
tcttcagttgtcatactgcctt

SEQ ID NO: 6967715 - DNA, 22 bp, Homo sapiens
tgtagattttggagtctacaag

SEQ ID NO: 6967716 - DNA, 23 bp, Homo sapiens
agatacagatctacgtgtcaatg

SEQ ID NO: 6967717 - DNA, 22 bp, Homo sapiens
gaagccactgtgagtggttcca

SEQ ID NO: 6967718 - DNA, 22 bp, Homo sapiens
tagctgttggcttacatctgtt

SEQ ID NO: 6967719 - DNA, 22 bp, Homo sapiens
cgcagccccaacaaatgggaca

SEQ ID NO: 6967720 - DNA, 22 bp, Homo sapiens
caaggaagacccacgcagatat

SEQ ID NO: 6967721 - DNA, 22 bp, Homo sapiens
tgaagtaggcagcatgctgaga

SEQ ID NO: 6967722 - DNA, 22 bp, Homo sapiens
gctatctaccaactcccattat

SEQ ID NO: 6967723 - DNA, 22 bp, Homo sapiens
tcccagctgagattgagcaagg

SEQ ID NO: 6967724 - DNA, 22 bp, Homo sapiens
tttagtgctttgctattcatgg

SEQ ID NO: 6967725 - DNA, 22 bp, Homo sapiens
ttacatacaaaggctgggttat

SEQ ID NO: 6967726 - DNA, 22 bp, Homo sapiens
acagtagtcctttattttggtt

SEQ ID NO: 6967727 - DNA, 22 bp, Homo sapiens
tacactgtgaggtttccaaggg

SEQ ID NO: 6967728 - DNA, 19 bp, Homo sapiens
agtgcattttatgtttcaa

SEQ ID NO: 6967729 - DNA, 22 bp, Homo sapiens
tcattatcctagtatcttgaat

SEQ ID NO: 6967730 - DNA, 20 bp, Homo sapiens
ttcagggctttggggacacc

SEQ ID NO: 6967731 - DNA, 22 bp, Homo sapiens
tgtaatgagaaagagagtgaat

SEQ ID NO: 6967732 - DNA, 20 bp, Homo sapiens
tctccagatgcagatgacat

SEQ ID NO: 6967733 - DNA, 22 bp, Homo sapiens
aaattattagttaagttgggca

SEQ ID NO: 6967734 - DNA, 22 bp, Homo sapiens
gtaagcagaggttaatgttaac

SEQ ID NO: 6967735 - DNA, 22 bp, Homo sapiens
gcagtagatctggaagagaatt

SEQ ID NO: 6967736 - DNA, 22 bp, Homo sapiens
gtttgccttttagataggaatg

SEQ ID NO: 6967737 - DNA, 22 bp, Homo sapiens
atgcagctgtgggcaagaaatg

SEQ ID NO: 6967738 - DNA, 22 bp, Homo sapiens
ttacctgttttacatgcacaac

SEQ ID NO: 6967739 - DNA, 22 bp, Homo sapiens
atctggcttttactgaattgct

SEQ ID NO: 6967740 - DNA, 22 bp, Homo sapiens
catttgttggtcagattgtagt

SEQ ID NO: 6967741 - DNA, 22 bp, Homo sapiens
ctgtgatttctaaagagtagca

SEQ ID NO: 6967742 - DNA, 22 bp, Homo sapiens
gccttaaacaattgcctgttaa

SEQ ID NO: 6967743 - DNA, 22 bp, Homo sapiens
cagctgccccataaatcacagt

SEQ ID NO: 6967744 - DNA, 22 bp, Homo sapiens
cgcgcgtcctcagctctgcgag

SEQ ID NO: 6967745 - DNA, 22 bp, Homo sapiens
ggattccatggtcaggaaatag

SEQ ID NO: 6967746 - DNA, 21 bp, Homo sapiens
atgtctgttctttctggcagg

SEQ ID NO: 6967747 - DNA, 22 bp, Homo sapiens
tcagacttccactttgtgcact

SEQ ID NO: 6967748 - DNA, 22 bp, Homo sapiens
tatagcaaaatagtttccacac

SEQ ID NO: 6967749 - DNA, 22 bp, Homo sapiens
aggcatgtcggattgttgtatt

SEQ ID NO: 6967750 - DNA, 22 bp, Homo sapiens
cagttacatatttagtaggtta

SEQ ID NO: 6967751 - DNA, 22 bp, Homo sapiens
aatgtattctctttataagata

SEQ ID NO: 6967752 - DNA, 22 bp, Homo sapiens
ttgtgagcatgtttacttgatt

SEQ ID NO: 6967753 - DNA, 22 bp, Homo sapiens
gtggggtagatctttctcagga

SEQ ID NO: 6967754 - DNA, 22 bp, Homo sapiens
ccataggagccctggtccctga

SEQ ID NO: 6967755 - DNA, 22 bp, Homo sapiens
tgaaagctttgggacagtgtga

SEQ ID NO: 6967756 - DNA, 22 bp, Homo sapiens
ttccaggcgcacgtcggcctta

SEQ ID NO: 6967757 - DNA, 22 bp, Homo sapiens
aacactgctccaaaaaaggctt

SEQ ID NO: 6967758 - DNA, 22 bp, Homo sapiens
tgagaggtgaggcatgaggcat

SEQ ID NO: 6967759 - DNA, 23 bp, Homo sapiens
ggccaggtgcaccttagagagcc

SEQ ID NO: 6967760 - DNA, 22 bp, Homo sapiens
agactaaattgggatgtgttgt

SEQ ID NO: 6967761 - DNA, 22 bp, Homo sapiens
tgaagcaacaagtctggcccca

SEQ ID NO: 6967762 - DNA, 23 bp, Homo sapiens
aggtccctgagtcttcaaaggat

SEQ ID NO: 6967763 - DNA, 22 bp, Homo sapiens
tacaagttccattttgaaagtg

SEQ ID NO: 6967764 - DNA, 22 bp, Homo sapiens
cccattccctttactgttgcat

SEQ ID NO: 6967765 - DNA, 22 bp, Homo sapiens
aggatttgaaatatttagtaaa

SEQ ID NO: 6967766 - DNA, 22 bp, Homo sapiens
ttgtctctgccatgcttgaggg

SEQ ID NO: 6967767 - DNA, 22 bp, Homo sapiens
acaagattttgtctggtagggt

SEQ ID NO: 6967768 - DNA, 22 bp, Homo sapiens
cacaggcacgcctctggccagg

SEQ ID NO: 6967769 - DNA, 22 bp, Homo sapiens
tacactgtaggtggcaggcagc

SEQ ID NO: 6967770 - DNA, 22 bp, Homo sapiens
cctgataacacagatacaagat

SEQ ID NO: 6967771 - DNA, 22 bp, Homo sapiens
gctgtgtgctgggcatggcact

SEQ ID NO: 6967772 - DNA, 22 bp, Homo sapiens
ggcaaagagacatgcatcgggg

SEQ ID NO: 6967773 - DNA, 19 bp, Homo sapiens
ccaggagagcttggagaag

SEQ ID NO: 6967774 - DNA, 22 bp, Homo sapiens
agcagcaattttcactgtcaat

SEQ ID NO: 6967775 - DNA, 20 bp, Homo sapiens
ggaatcagggtaatgtactg

SEQ ID NO: 6967776 - DNA, 22 bp, Homo sapiens
cttctctgcaccccacttttgc

SEQ ID NO: 6967777 - DNA, 22 bp, Homo sapiens
atggcctccgacccatgacgtg

SEQ ID NO: 6967778 - DNA, 22 bp, Homo sapiens
cgtgggctgcgcccagttcttc

SEQ ID NO: 6967779 - DNA, 22 bp, Homo sapiens
ttggtacatgttaaggaagagt

SEQ ID NO: 6967780 - DNA, 22 bp, Homo sapiens
agctgtgcacactgtgaagtag

SEQ ID NO: 6967781 - DNA, 22 bp, Homo sapiens
gtgagcagtggccagggtccta

SEQ ID NO: 6967782 - DNA, 22 bp, Homo sapiens
agagtgagggggcactgagacg

SEQ ID NO: 6967783 - DNA, 22 bp, Homo sapiens
tcacagttatgggccttggtca

SEQ ID NO: 6967784 - DNA, 22 bp, Homo sapiens
tgcttcaaggccatgtcaagct

SEQ ID NO: 6967785 - DNA, 22 bp, Homo sapiens
ttccagggctaattcctgtgga

SEQ ID NO: 6967786 - DNA, 22 bp, Homo sapiens
cagctccagcctgacaccaaga

SEQ ID NO: 6967787 - DNA, 22 bp, Homo sapiens
ttcacagataacacaggcaaat

SEQ ID NO: 6967788 - DNA, 22 bp, Homo sapiens
gtaggcagaccagtggatgggt

SEQ ID NO: 6967789 - DNA, 22 bp, Homo sapiens
gcctggctatggcctcccccat

SEQ ID NO: 6967790 - DNA, 22 bp, Homo sapiens
gagatttttcaacaagaatagg

SEQ ID NO: 6967791 - DNA, 22 bp, Homo sapiens
ttgggggcatattgagtagtgg

SEQ ID NO: 6967792 - DNA, 17 bp, Homo sapiens
attctcagtgtacagtg

SEQ ID NO: 6967793 - DNA, 22 bp, Homo sapiens
catggattcgggaaggtcagta

SEQ ID NO: 6967794 - DNA, 22 bp, Homo sapiens
atgaacaatgactacatattga

SEQ ID NO: 6967795 - DNA, 22 bp, Homo sapiens
attgttttccaaagatgctgct

SEQ ID NO: 6967796 - DNA, 22 bp, Homo sapiens
aggcccagtgccattagttttg

SEQ ID NO: 6967797 - DNA, 22 bp, Homo sapiens
tctggctggcagtgatggtgtg

SEQ ID NO: 6967798 - DNA, 22 bp, Homo sapiens
accgctctctgagaaacaagga

SEQ ID NO: 6967799 - DNA, 22 bp, Homo sapiens
agggcctggaactgtgggcagg

SEQ ID NO: 6967800 - DNA, 22 bp, Homo sapiens
gtcaaagatcctatgagttaaa

SEQ ID NO: 6967801 - DNA, 23 bp, Homo sapiens
agatgaaagcttcccatcacagt

SEQ ID NO: 6967802 - DNA, 22 bp, Homo sapiens
ctgagcatgctacatgcagcac

SEQ ID NO: 6967803 - DNA, 22 bp, Homo sapiens
caatgtcttctatagttactca

SEQ ID NO: 6967804 - DNA, 22 bp, Homo sapiens
tgctatgtcgaaagggccatta

SEQ ID NO: 6967805 - DNA, 22 bp, Homo sapiens
ttttaaactatagctggatgct

SEQ ID NO: 6967806 - DNA, 22 bp, Homo sapiens
cagtgggctgtgatggattcac

SEQ ID NO: 6967807 - DNA, 22 bp, Homo sapiens
ccccaggagcttgttttagaga

SEQ ID NO: 6967808 - DNA, 22 bp, Homo sapiens
gagctgaacaaattgcgagtgg

SEQ ID NO: 6967809 - DNA, 22 bp, Homo sapiens
tgctggcatgcatgctgtagga

SEQ ID NO: 6967810 - DNA, 22 bp, Homo sapiens
tgagcatctttttacaggttta

SEQ ID NO: 6967811 - DNA, 22 bp, Homo sapiens
gaaaggaaatattctaagcact

SEQ ID NO: 6967812 - DNA, 22 bp, Homo sapiens
tagcaggggtagatagagtgtg

SEQ ID NO: 6967813 - DNA, 22 bp, Homo sapiens
ataataaaccaggatgggtctg

SEQ ID NO: 6967814 - DNA, 22 bp, Homo sapiens
gcgcggggtacacgcggtggcc

SEQ ID NO: 6967815 - DNA, 22 bp, Homo sapiens
gtcatgcctggcttcttagaca

SEQ ID NO: 6967816 - DNA, 22 bp, Homo sapiens
ttgggctgaagtagagggcaga

SEQ ID NO: 6967817 - DNA, 22 bp, Homo sapiens
acttcacattagctaaaaggga

SEQ ID NO: 6967818 - DNA, 21 bp, Homo sapiens
agcatgtctcagtcaacaagg

SEQ ID NO: 6967819 - DNA, 22 bp, Homo sapiens
acgtgtgttggtcagggggccc

SEQ ID NO: 6967820 - DNA, 22 bp, Homo sapiens
agggggtcgtccggaagacctg

SEQ ID NO: 6967821 - DNA, 22 bp, Homo sapiens
aggcagctgtgaggactggatt

SEQ ID NO: 6967822 - DNA, 22 bp, Homo sapiens
ggctagaataattgacttcatt

SEQ ID NO: 6967823 - DNA, 22 bp, Homo sapiens
atctagaggcaatgaaggaggt

SEQ ID NO: 6967824 - DNA, 22 bp, Homo sapiens
caatgtcagagaagctcatatc

SEQ ID NO: 6967825 - DNA, 19 bp, Homo sapiens
actttctccaggacctgtt

SEQ ID NO: 6967826 - DNA, 22 bp, Homo sapiens
tgtgcaatcatattttaaaatg

SEQ ID NO: 6967827 - DNA, 21 bp, Homo sapiens
acaggcaatttcatatggttc

SEQ ID NO: 6967828 - DNA, 22 bp, Homo sapiens
tgaggcagaaaatagcagttca

SEQ ID NO: 6967829 - DNA, 22 bp, Homo sapiens
tgcacacagctgggcctggctg

SEQ ID NO: 6967830 - DNA, 22 bp, Homo sapiens
tcagtccaggattgggagtgac

SEQ ID NO: 6967831 - DNA, 22 bp, Homo sapiens
aaccattcacagtgtagccaaa

SEQ ID NO: 6967832 - DNA, 21 bp, Homo sapiens
gctgatgttgactctgaccct

SEQ ID NO: 6967833 - DNA, 22 bp, Homo sapiens
tgcccagcttcttacttttaaa

SEQ ID NO: 6967834 - DNA, 22 bp, Homo sapiens
aacacaggaaattggtaaatgg

SEQ ID NO: 6967835 - DNA, 22 bp, Homo sapiens
gcttagaagttcctataaaatg

SEQ ID NO: 6967836 - DNA, 22 bp, Homo sapiens
cagctggttggaagggagctga

SEQ ID NO: 6967837 - DNA, 22 bp, Homo sapiens
ggatcagaatctctgagagttt

SEQ ID NO: 6967838 - DNA, 22 bp, Homo sapiens
attttctcacaatgcagaagga

SEQ ID NO: 6967839 - DNA, 22 bp, Homo sapiens
cagagagagtctgtccctgaag

SEQ ID NO: 6967840 - DNA, 22 bp, Homo sapiens
agaagtaggcagggctgtatca

SEQ ID NO: 6967841 - DNA, 19 bp, Homo sapiens
cttattagagtgagagctt

SEQ ID NO: 6967842 - DNA, 22 bp, Homo sapiens
tacagattttgtgaagaagtgt

SEQ ID NO: 6967843 - DNA, 22 bp, Homo sapiens
gtgtcccagcagcacattggct

SEQ ID NO: 6967844 - DNA, 20 bp, Homo sapiens
ttaggaagtcacaatttcag

SEQ ID NO: 6967845 - DNA, 20 bp, Homo sapiens
cagataggttagtgtttcag

SEQ ID NO: 6967846 - DNA, 21 bp, Homo sapiens
ctctgctgtctaccagctgtt

SEQ ID NO: 6967847 - DNA, 22 bp, Homo sapiens
atacagataatgattgtatgtg

SEQ ID NO: 6967848 - DNA, 22 bp, Homo sapiens
tgtggaaggcttccctggggtc

SEQ ID NO: 6967849 - DNA, 22 bp, Homo sapiens
tggtgcccatgtatcccttcac

SEQ ID NO: 6967850 - DNA, 22 bp, Homo sapiens
ggggatctaggcttatgagggc

SEQ ID NO: 6967851 - DNA, 22 bp, Homo sapiens
catctgctgtaattaacaagcc

SEQ ID NO: 6967852 - DNA, 22 bp, Homo sapiens
ctggctcctcaggactgcggga

SEQ ID NO: 6967853 - DNA, 20 bp, Homo sapiens
gcttccaggcccggaaaacc

SEQ ID NO: 6967854 - DNA, 22 bp, Homo sapiens
tcacatgtgtggcagtgcaagt

SEQ ID NO: 6967855 - DNA, 22 bp, Homo sapiens
tcacgcatggacggtcaacatc

SEQ ID NO: 6967856 - DNA, 22 bp, Homo sapiens
ctggctctttcctagctaggct

SEQ ID NO: 6967857 - DNA, 22 bp, Homo sapiens
agctttctagtttagccatctt

SEQ ID NO: 6967858 - DNA, 22 bp, Homo sapiens
cagtgattaaaacatgacagcc

SEQ ID NO: 6967859 - DNA, 22 bp, Homo sapiens
ctcctgggctatgtctgcttgg

SEQ ID NO: 6967860 - DNA, 22 bp, Homo sapiens
tcaaataggcttgtagtgactg

SEQ ID NO: 6967861 - DNA, 22 bp, Homo sapiens
aatgtcatagcatttcttcaat

SEQ ID NO: 6967862 - DNA, 22 bp, Homo sapiens
aagtgtctgatggagcgaaatg

SEQ ID NO: 6967863 - DNA, 22 bp, Homo sapiens
gaggtgcttcctttgggctctg

SEQ ID NO: 6967864 - DNA, 22 bp, Homo sapiens
agagactggagatgggcagtgt

SEQ ID NO: 6967865 - DNA, 22 bp, Homo sapiens
agaaaggtcaaaatcgtgacat

SEQ ID NO: 6967866 - DNA, 19 bp, Homo sapiens
acttaatccctatctcttg

SEQ ID NO: 6967867 - DNA, 21 bp, Homo sapiens
ggcagtaagatttactttaag

SEQ ID NO: 6967868 - DNA, 22 bp, Homo sapiens
tcacagaacaagcctggtggag

SEQ ID NO: 6967869 - DNA, 22 bp, Homo sapiens
ttctcacaggatttcttttagt

SEQ ID NO: 6967870 - DNA, 21 bp, Homo sapiens
tgcagtgtccctaacagtggt

SEQ ID NO: 6967871 - DNA, 22 bp, Homo sapiens
tccagagcctggggtttgtaac

SEQ ID NO: 6967872 - DNA, 18 bp, Homo sapiens
tggcagagtgtctgttct

SEQ ID NO: 6967873 - DNA, 22 bp, Homo sapiens
ctgtgtgacaagtgaggacgcc

SEQ ID NO: 6967874 - DNA, 19 bp, Homo sapiens
agtgtcagaattcattgaa

SEQ ID NO: 6967875 - DNA, 20 bp, Homo sapiens
ggcccacatcctttgctatg

SEQ ID NO: 6967876 - DNA, 22 bp, Homo sapiens
cttatttactgatccacagatg

SEQ ID NO: 6967877 - DNA, 22 bp, Homo sapiens
cacacattgagcagctgtttgt

SEQ ID NO: 6967878 - DNA, 22 bp, Homo sapiens
catgcgaggcgggaggaggcct

SEQ ID NO: 6967879 - DNA, 22 bp, Homo sapiens
agtatcagcagagcttaaaaga

SEQ ID NO: 6967880 - DNA, 22 bp, Homo sapiens
agtgggcctgagtgaccagttc

SEQ ID NO: 6967881 - DNA, 22 bp, Homo sapiens
atagcacttatagatttggtct

SEQ ID NO: 6967882 - DNA, 22 bp, Homo sapiens
gagtggcagaactgggggtcct

SEQ ID NO: 6967883 - DNA, 22 bp, Homo sapiens
accctggtgatttgagagagta

SEQ ID NO: 6967884 - DNA, 22 bp, Homo sapiens
ctgtggggccaaattctcctct

SEQ ID NO: 6967885 - DNA, 22 bp, Homo sapiens
ctcaagtaagaaacagaattgg

SEQ ID NO: 6967886 - DNA, 22 bp, Homo sapiens
atcaaaggtatctatgctgtct

SEQ ID NO: 6967887 - DNA, 20 bp, Homo sapiens
ggggaagtcactgcagtcag

SEQ ID NO: 6967888 - DNA, 22 bp, Homo sapiens
acaagatagcttagaagattca

SEQ ID NO: 6967889 - DNA, 22 bp, Homo sapiens
tttatctgaaaaaactcttgga

SEQ ID NO: 6967890 - DNA, 22 bp, Homo sapiens
gttcatcctgacttggattagt

SEQ ID NO: 6967891 - DNA, 22 bp, Homo sapiens
tcttgagctgagtcagttcctg

SEQ ID NO: 6967892 - DNA, 23 bp, Homo sapiens
agtgtgtattgctgagggcagct

SEQ ID NO: 6967893 - DNA, 22 bp, Homo sapiens
tttctagtgggtattccctgtt

SEQ ID NO: 6967894 - DNA, 22 bp, Homo sapiens
tagacattatgtattaagttct

SEQ ID NO: 6967895 - DNA, 22 bp, Homo sapiens
atacacattactttctgtctga

SEQ ID NO: 6967896 - DNA, 22 bp, Homo sapiens
tacttgttgcttttgtgatcca

SEQ ID NO: 6967897 - DNA, 22 bp, Homo sapiens
ttgcatatcctccaacacatgg

SEQ ID NO: 6967898 - DNA, 22 bp, Homo sapiens
ttgatacagcagcctgtgatcc

SEQ ID NO: 6967899 - DNA, 22 bp, Homo sapiens
tggcctgactgtcaggctgtat

SEQ ID NO: 6967900 - DNA, 22 bp, Homo sapiens
cagccaggagctccccctgctc

SEQ ID NO: 6967901 - DNA, 22 bp, Homo sapiens
agggcttttgagcgcacgtctg

SEQ ID NO: 6967902 - DNA, 23 bp, Homo sapiens
ggttggctgtacccaggctccct

SEQ ID NO: 6967903 - DNA, 22 bp, Homo sapiens
cagaaaagggtgtttgttcagg

SEQ ID NO: 6967904 - DNA, 22 bp, Homo sapiens
atcagaaaaatgagaagagctg

SEQ ID NO: 6967905 - DNA, 22 bp, Homo sapiens
agatattttgtgtgatgtttca

SEQ ID NO: 6967906 - DNA, 17 bp, Homo sapiens
tccaggcatatctccta

SEQ ID NO: 6967907 - DNA, 22 bp, Homo sapiens
gagcaacagtttatggtttttc

SEQ ID NO: 6967908 - DNA, 22 bp, Homo sapiens
aggtatgtgggtgagaggagga

SEQ ID NO: 6967909 - DNA, 22 bp, Homo sapiens
gtggcggactcgacctggcctg

SEQ ID NO: 6967910 - DNA, 22 bp, Homo sapiens
gcgtggtgctgccctgcacaca

SEQ ID NO: 6967911 - DNA, 22 bp, Homo sapiens
gttggggtgctataaaaatgat

SEQ ID NO: 6967912 - DNA, 22 bp, Homo sapiens
tattgctggtgctgttctgaat

SEQ ID NO: 6967913 - DNA, 19 bp, Homo sapiens
cacatcagcagggctgtgg

SEQ ID NO: 6967914 - DNA, 22 bp, Homo sapiens
tagaatatgtggtaggatctgg

SEQ ID NO: 6967915 - DNA, 22 bp, Homo sapiens
ctctagggctctgtgaggttgg

SEQ ID NO: 6967916 - DNA, 22 bp, Homo sapiens
ctgctctctgttcccctggatc

SEQ ID NO: 6967917 - DNA, 22 bp, Homo sapiens
ttatgctttgtgggcctacttt

SEQ ID NO: 6967918 - DNA, 22 bp, Homo sapiens
tcttcaaagaagccttggatta

SEQ ID NO: 6967919 - DNA, 22 bp, Homo sapiens
tgtctgtgatttaggccagggc

SEQ ID NO: 6967920 - DNA, 22 bp, Homo sapiens
ccctctctcaggctgacagcct

SEQ ID NO: 6967921 - DNA, 22 bp, Homo sapiens
gagcagtgaagacagaagtaca

SEQ ID NO: 6967922 - DNA, 22 bp, Homo sapiens
ttgctgcctgaggagcaacact

SEQ ID NO: 6967923 - DNA, 22 bp, Homo sapiens
tcagggtaaaccttcactgtga

SEQ ID NO: 6967924 - DNA, 22 bp, Homo sapiens
tgtactcagctcagatctcagg

SEQ ID NO: 6967925 - DNA, 22 bp, Homo sapiens
tccctgagttttctttctgact

SEQ ID NO: 6967926 - DNA, 22 bp, Homo sapiens
tatcctgtccatcctcccactg

SEQ ID NO: 6967927 - DNA, 22 bp, Homo sapiens
caagcaatgctatactcattat

SEQ ID NO: 6967928 - DNA, 20 bp, Homo sapiens
aactccggcgggcgcggagt

SEQ ID NO: 6967929 - DNA, 22 bp, Homo sapiens
tcactctgaatggtactgagga

SEQ ID NO: 6967930 - DNA, 22 bp, Homo sapiens
gtctgcccttggcctgggactt

SEQ ID NO: 6967931 - DNA, 22 bp, Homo sapiens
acactgtgtctagcattttaca

SEQ ID NO: 6967932 - DNA, 22 bp, Homo sapiens
ggctccctggccctggggacac

SEQ ID NO: 6967933 - DNA, 22 bp, Homo sapiens
ttgcagttgctgtatttaagga

SEQ ID NO: 6967934 - DNA, 22 bp, Homo sapiens
agctggtcagagtggggataga

SEQ ID NO: 6967935 - DNA, 22 bp, Homo sapiens
aagcacacttggctctgtgtac

SEQ ID NO: 6967936 - DNA, 22 bp, Homo sapiens
ttgaactaataggtatcttgta

SEQ ID NO: 6967937 - DNA, 22 bp, Homo sapiens
cttgttcagttgcctctcctgc

SEQ ID NO: 6967938 - DNA, 22 bp, Homo sapiens
ggaggggaactaatcccgtgac

SEQ ID NO: 6967939 - DNA, 22 bp, Homo sapiens
tctggagggggatgcctcatcc

SEQ ID NO: 6967940 - DNA, 20 bp, Homo sapiens
ggcattagattttaaatgtc

SEQ ID NO: 6967941 - DNA, 22 bp, Homo sapiens
tggtaaatatgtccattctctt

SEQ ID NO: 6967942 - DNA, 22 bp, Homo sapiens
gtgggagctttggcatcaggct

SEQ ID NO: 6967943 - DNA, 22 bp, Homo sapiens
tttccagtgatggggtctggct

SEQ ID NO: 6967944 - DNA, 22 bp, Homo sapiens
cctcaagaacaatccaccatta

SEQ ID NO: 6967945 - DNA, 22 bp, Homo sapiens
aggccagagaggggaccagcct

SEQ ID NO: 6967946 - DNA, 22 bp, Homo sapiens
ctgtgctgtcttgggagcctta

SEQ ID NO: 6967947 - DNA, 22 bp, Homo sapiens
tgcagcagcctcatctggtttc

SEQ ID NO: 6967948 - DNA, 22 bp, Homo sapiens
tcccagcccaggtatgatgata

SEQ ID NO: 6967949 - DNA, 22 bp, Homo sapiens
attatcctcagaaaacatgtga

SEQ ID NO: 6967950 - DNA, 22 bp, Homo sapiens
ttatgggagcaattggggaggt

SEQ ID NO: 6967951 - DNA, 22 bp, Homo sapiens
gttctgacttctctgcatctgc

SEQ ID NO: 6967952 - DNA, 22 bp, Homo sapiens
tcagaacatatattttgtgatg

SEQ ID NO: 6967953 - DNA, 22 bp, Homo sapiens
aaatggtataatgtcatgtatt

SEQ ID NO: 6967954 - DNA, 22 bp, Homo sapiens
cagatggccagaggcagctgca

SEQ ID NO: 6967955 - DNA, 22 bp, Homo sapiens
atcaggtgcattagattaatta

SEQ ID NO: 6967956 - DNA, 22 bp, Homo sapiens
ggcaggtgcacctgagccatct

SEQ ID NO: 6967957 - DNA, 22 bp, Homo sapiens
tgattagattgagtcaaccttg

SEQ ID NO: 6967958 - DNA, 22 bp, Homo sapiens
acagcttcgaggatctcatccc

SEQ ID NO: 6967959 - DNA, 22 bp, Homo sapiens
tgctatgttgcctagtgtaata

SEQ ID NO: 6967960 - DNA, 22 bp, Homo sapiens
ggtgaggcccagtgatctgtgt

SEQ ID NO: 6967961 - DNA, 22 bp, Homo sapiens
tcagcagggctgggagctgtga

SEQ ID NO: 6967962 - DNA, 22 bp, Homo sapiens
gggagctcgtgcgcccaggtgc

SEQ ID NO: 6967963 - DNA, 20 bp, Homo sapiens
aaaaattgatatcgcttcct

SEQ ID NO: 6967964 - DNA, 22 bp, Homo sapiens
tttgaaattggctcattggttt

SEQ ID NO: 6967965 - DNA, 22 bp, Homo sapiens
actgtcattaatgaatgtaata

SEQ ID NO: 6967966 - DNA, 22 bp, Homo sapiens
ggtctagatttctgttataggg

SEQ ID NO: 6967967 - DNA, 22 bp, Homo sapiens
tccctggacaacagacttcact

SEQ ID NO: 6967968 - DNA, 22 bp, Homo sapiens
tgtcaacacacctatctcaatt

SEQ ID NO: 6967969 - DNA, 22 bp, Homo sapiens
cacaggaaatgattctgcagca

SEQ ID NO: 6967970 - DNA, 22 bp, Homo sapiens
ctttccagcatttccttgtgaa

SEQ ID NO: 6967971 - DNA, 22 bp, Homo sapiens
gggagctggcctactattagat

SEQ ID NO: 6967972 - DNA, 22 bp, Homo sapiens
cattgagcgaccctgcatgact

SEQ ID NO: 6967973 - DNA, 22 bp, Homo sapiens
ggtcagtgagcaaacaaccacg

SEQ ID NO: 6967974 - DNA, 22 bp, Homo sapiens
cctgggtgcccggcccttctct

SEQ ID NO: 6967975 - DNA, 22 bp, Homo sapiens
cacacattaatatcaaaggctc

SEQ ID NO: 6967976 - DNA, 22 bp, Homo sapiens
atgtctgtctttgtactccaca

SEQ ID NO: 6967977 - DNA, 22 bp, Homo sapiens
gaccaaggaagaggggagccag

SEQ ID NO: 6967978 - DNA, 22 bp, Homo sapiens
gtcaccctgctgtttgtccatt

SEQ ID NO: 6967979 - DNA, 22 bp, Homo sapiens
aacattgaaatatttgcaatag

SEQ ID NO: 6967980 - DNA, 22 bp, Homo sapiens
aagccactttcagctgtctcag

SEQ ID NO: 6967981 - DNA, 22 bp, Homo sapiens
aaaggttgaattcaggatccac

SEQ ID NO: 6967982 - DNA, 21 bp, Homo sapiens
cccaaaagttctgagatggct

SEQ ID NO: 6967983 - DNA, 22 bp, Homo sapiens
cagaggcatactcccagtcttg

SEQ ID NO: 6967984 - DNA, 22 bp, Homo sapiens
agttcagcaaataaaacatagt

SEQ ID NO: 6967985 - DNA, 22 bp, Homo sapiens
ttttctgtggtcagagcttgag

SEQ ID NO: 6967986 - DNA, 22 bp, Homo sapiens
ggcaggtggattttctactcta

SEQ ID NO: 6967987 - DNA, 21 bp, Homo sapiens
cagttgatagagatcttgagc

SEQ ID NO: 6967988 - DNA, 20 bp, Homo sapiens
ccagagagtaggttagtgat

SEQ ID NO: 6967989 - DNA, 22 bp, Homo sapiens
taattgtacgatgttaaatcag

SEQ ID NO: 6967990 - DNA, 22 bp, Homo sapiens
ctgcaaattggtggtgaggcaa

SEQ ID NO: 6967991 - DNA, 22 bp, Homo sapiens
ggagagagatgccgccttgctc

SEQ ID NO: 6967992 - DNA, 22 bp, Homo sapiens
gaggcctgggagcctgtcctcc

SEQ ID NO: 6967993 - DNA, 22 bp, Homo sapiens
gcagggctgtggacactttggt

SEQ ID NO: 6967994 - DNA, 22 bp, Homo sapiens
tctggcagaagtgctgtcagta

SEQ ID NO: 6967995 - DNA, 22 bp, Homo sapiens
aaatgcactgaatattccaaat

SEQ ID NO: 6967996 - DNA, 22 bp, Homo sapiens
gccctgagactgaagaactgtc

SEQ ID NO: 6967997 - DNA, 22 bp, Homo sapiens
caatggttctcaaactatcatg

SEQ ID NO: 6967998 - DNA, 22 bp, Homo sapiens
aggctccacggcaggatgctgt

SEQ ID NO: 6967999 - DNA, 19 bp, Homo sapiens
tacaggatcctcatacagt

SEQ ID NO: 6968000 - DNA, 22 bp, Homo sapiens
ctctggcagagctgtagacttc

SEQ ID NO: 6968001 - DNA, 22 bp, Homo sapiens
ggcaaatattatctttgctggt

SEQ ID NO: 6968002 - DNA, 22 bp, Homo sapiens
tacattgctagaaatgtatttt

SEQ ID NO: 6968003 - DNA, 22 bp, Homo sapiens
tgctatttaacttttatgtgta

SEQ ID NO: 6968004 - DNA, 22 bp, Homo sapiens
tcacagaagggaaagatgccaa

SEQ ID NO: 6968005 - DNA, 22 bp, Homo sapiens
actgcactttaggccaactagg

SEQ ID NO: 6968006 - DNA, 21 bp, Homo sapiens
taattagcaaagctgagattc

SEQ ID NO: 6968007 - DNA, 22 bp, Homo sapiens
ggggagcagaagcagcaacaac

SEQ ID NO: 6968008 - DNA, 22 bp, Homo sapiens
aaaggcttgtttgaggactggt

SEQ ID NO: 6968009 - DNA, 22 bp, Homo sapiens
aatgttgttctctgcaaacaca

SEQ ID NO: 6968010 - DNA, 22 bp, Homo sapiens
agtacatacttcaaatgtactt

SEQ ID NO: 6968011 - DNA, 22 bp, Homo sapiens
atagacaacacttattattcct

SEQ ID NO: 6968012 - DNA, 22 bp, Homo sapiens
ttgcccagagctgcctgttaca

SEQ ID NO: 6968013 - DNA, 22 bp, Homo sapiens
gacataataatctgacctagat

SEQ ID NO: 6968014 - DNA, 22 bp, Homo sapiens
atgcagatgggtgccaaagtct

SEQ ID NO: 6968015 - DNA, 22 bp, Homo sapiens
tctacccagagctatgacctga

SEQ ID NO: 6968016 - DNA, 22 bp, Homo sapiens
tcaaactgaactaagatccaac

SEQ ID NO: 6968017 - DNA, 22 bp, Homo sapiens
tgtgagttattttcaggagttt

SEQ ID NO: 6968018 - DNA, 22 bp, Homo sapiens
ctgctgaggtccttgctcagac

SEQ ID NO: 6968019 - DNA, 22 bp, Homo sapiens
gctctctcttggggattcagca

SEQ ID NO: 6968020 - DNA, 22 bp, Homo sapiens
atgattctggtgagaatgagga

SEQ ID NO: 6968021 - DNA, 22 bp, Homo sapiens
gtaccctgtggccagccagcca

SEQ ID NO: 6968022 - DNA, 22 bp, Homo sapiens
actctgccttggtgtcacaaga

SEQ ID NO: 6968023 - DNA, 23 bp, Homo sapiens
tgggcctggcctcccagtccagc

SEQ ID NO: 6968024 - DNA, 22 bp, Homo sapiens
ctgggcagctaccaccactgct

SEQ ID NO: 6968025 - DNA, 22 bp, Homo sapiens
ttttgcctgtgaatactatctt

SEQ ID NO: 6968026 - DNA, 22 bp, Homo sapiens
tgagtgagacaccaaaggctgt

SEQ ID NO: 6968027 - DNA, 22 bp, Homo sapiens
tagagcattagaaattagtgta

SEQ ID NO: 6968028 - DNA, 22 bp, Homo sapiens
cttggctgtcataaggtcctgg

SEQ ID NO: 6968029 - DNA, 22 bp, Homo sapiens
tgggatgtgtgctgcttagtcc

SEQ ID NO: 6968030 - DNA, 22 bp, Homo sapiens
tgagaattacaaatgagtcaca

SEQ ID NO: 6968031 - DNA, 22 bp, Homo sapiens
gcttaggaaaatggtggagttg

SEQ ID NO: 6968032 - DNA, 22 bp, Homo sapiens
tttagtagtgacagattctggg

SEQ ID NO: 6968033 - DNA, 22 bp, Homo sapiens
ctgcacatagtaagtactcaat

SEQ ID NO: 6968034 - DNA, 22 bp, Homo sapiens
agggcagccatgagccttcagg

SEQ ID NO: 6968035 - DNA, 22 bp, Homo sapiens
caaaacattctctgcagcaggg

SEQ ID NO: 6968036 - DNA, 22 bp, Homo sapiens
ccactgtgcccagcctcatggg

SEQ ID NO: 6968037 - DNA, 22 bp, Homo sapiens
agctgcttgggaaccatcaatt

SEQ ID NO: 6968038 - DNA, 22 bp, Homo sapiens
cgtcatcctttggatgaatcac

SEQ ID NO: 6968039 - DNA, 22 bp, Homo sapiens
actttgcaaataaactctctaa

SEQ ID NO: 6968040 - DNA, 22 bp, Homo sapiens
ttcacagggcagcagctgagcc

SEQ ID NO: 6968041 - DNA, 22 bp, Homo sapiens
aacaagagactctgttccagaa

SEQ ID NO: 6968042 - DNA, 22 bp, Homo sapiens
cattcacatcttgttccatcac

SEQ ID NO: 6968043 - DNA, 22 bp, Homo sapiens
tctcagggcagcaaggaagcat

SEQ ID NO: 6968044 - DNA, 22 bp, Homo sapiens
ttatttccacaatgtggtaggg

SEQ ID NO: 6968045 - DNA, 19 bp, Homo sapiens
tggtctctgtctctttgca

SEQ ID NO: 6968046 - DNA, 22 bp, Homo sapiens
ttctttaccactactcttccaa

SEQ ID NO: 6968047 - DNA, 22 bp, Homo sapiens
atacacagcgatgagaggaggc

SEQ ID NO: 6968048 - DNA, 22 bp, Homo sapiens
attccaaactctttccctgtcg

SEQ ID NO: 6968049 - DNA, 22 bp, Homo sapiens
aggggctgggacagagccaagc

SEQ ID NO: 6968050 - DNA, 21 bp, Homo sapiens
tggaatgtacctccctctctt

SEQ ID NO: 6968051 - DNA, 22 bp, Homo sapiens
tggcccatcatggaaaataaag

SEQ ID NO: 6968052 - DNA, 22 bp, Homo sapiens
aacattaattacagtcaaacat

SEQ ID NO: 6968053 - DNA, 23 bp, Homo sapiens
tgcaactgtgtcagaagttagaa

SEQ ID NO: 6968054 - DNA, 22 bp, Homo sapiens
ggcagcaaggcctcgggtgagc

SEQ ID NO: 6968055 - DNA, 22 bp, Homo sapiens
ttggcacttttaggcagtaccg

SEQ ID NO: 6968056 - DNA, 22 bp, Homo sapiens
acagggccctgtgggccccact

SEQ ID NO: 6968057 - DNA, 22 bp, Homo sapiens
tatttgctcaataatagtttta

SEQ ID NO: 6968058 - DNA, 22 bp, Homo sapiens
taagtccacaggagttgtgttc

SEQ ID NO: 6968059 - DNA, 22 bp, Homo sapiens
tattggaggaaaccaagaagaa

SEQ ID NO: 6968060 - DNA, 21 bp, Homo sapiens
cctttatgcaaggactggcat

SEQ ID NO: 6968061 - DNA, 20 bp, Homo sapiens
catagtaaagacattttagg

SEQ ID NO: 6968062 - DNA, 17 bp, Homo sapiens
gaaaggaggcaacactg

SEQ ID NO: 6968063 - DNA, 22 bp, Homo sapiens
ctgcttccatgcaatggcagtc

SEQ ID NO: 6968064 - DNA, 22 bp, Homo sapiens
ttattgcttatgattaggtgtt

SEQ ID NO: 6968065 - DNA, 22 bp, Homo sapiens
gtggcccacacagacagcatct

SEQ ID NO: 6968066 - DNA, 22 bp, Homo sapiens
ctagttctcctgaaatgtttgg

SEQ ID NO: 6968067 - DNA, 22 bp, Homo sapiens
ggccagacatatcgctcccaaa

SEQ ID NO: 6968068 - DNA, 22 bp, Homo sapiens
atgtaattattaacacctgtgc

SEQ ID NO: 6968069 - DNA, 22 bp, Homo sapiens
gaaagggagtgaagatggtata

SEQ ID NO: 6968070 - DNA, 22 bp, Homo sapiens
tctgcaagtagatgacagtgag

SEQ ID NO: 6968071 - DNA, 19 bp, Homo sapiens
gttcattgttcaggaaaat

SEQ ID NO: 6968072 - DNA, 22 bp, Homo sapiens
cccagctcttttagcggcatct

SEQ ID NO: 6968073 - DNA, 22 bp, Homo sapiens
aaagagttgaaaactaacagtg

SEQ ID NO: 6968074 - DNA, 22 bp, Homo sapiens
gtgcaattttgcatctgtatgc

SEQ ID NO: 6968075 - DNA, 22 bp, Homo sapiens
cctgcaccacactcactgctca

SEQ ID NO: 6968076 - DNA, 22 bp, Homo sapiens
gtacaaatacattctgaaggta

SEQ ID NO: 6968077 - DNA, 22 bp, Homo sapiens
caggcatgcttctgtctgggca

SEQ ID NO: 6968078 - DNA, 18 bp, Homo sapiens
tagaatataggtcattct

SEQ ID NO: 6968079 - DNA, 22 bp, Homo sapiens
ttttggcaaagagatagcatga

SEQ ID NO: 6968080 - DNA, 22 bp, Homo sapiens
tgcttcagtgctctgagcctgt

SEQ ID NO: 6968081 - DNA, 22 bp, Homo sapiens
caggcatggaaaagcccagagg

SEQ ID NO: 6968082 - DNA, 22 bp, Homo sapiens
tggccatgacatggaggctttg

SEQ ID NO: 6968083 - DNA, 22 bp, Homo sapiens
ttccttttatttgtccaggctt

SEQ ID NO: 6968084 - DNA, 22 bp, Homo sapiens
ggcaggaagtagcagtctgagc

SEQ ID NO: 6968085 - DNA, 22 bp, Homo sapiens
tgagggcaaagtggtgctgagg

SEQ ID NO: 6968086 - DNA, 22 bp, Homo sapiens
cccacgtcgaacttgctccaga

SEQ ID NO: 6968087 - DNA, 21 bp, Homo sapiens
atgaatgatttctactcttaa

SEQ ID NO: 6968088 - DNA, 22 bp, Homo sapiens
cttcttcaacctgaaagtttca

SEQ ID NO: 6968089 - DNA, 22 bp, Homo sapiens
ggagcggcagatggagtgggag

SEQ ID NO: 6968090 - DNA, 22 bp, Homo sapiens
tgcagaggtttgtggtgttgct

SEQ ID NO: 6968091 - DNA, 22 bp, Homo sapiens
catctttaaaggggagacaccc

SEQ ID NO: 6968092 - DNA, 20 bp, Homo sapiens
tgttcacagtagttgctgct

SEQ ID NO: 6968093 - DNA, 22 bp, Homo sapiens
gcaggtgttctcagaggaggct

SEQ ID NO: 6968094 - DNA, 22 bp, Homo sapiens
ccctgggacccgctgcagaggc

SEQ ID NO: 6968095 - DNA, 22 bp, Homo sapiens
atgttctacagatggaaagggg

SEQ ID NO: 6968096 - DNA, 22 bp, Homo sapiens
taaaccattcacatcccagaaa

SEQ ID NO: 6968097 - DNA, 22 bp, Homo sapiens
acaatgtgataatttaaagata

SEQ ID NO: 6968098 - DNA, 22 bp, Homo sapiens
tcagtccaggggctgtgatgtc

SEQ ID NO: 6968099 - DNA, 22 bp, Homo sapiens
tgtcaataacatttacttctat

SEQ ID NO: 6968100 - DNA, 22 bp, Homo sapiens
agacccttgcagtctggttgtc

SEQ ID NO: 6968101 - DNA, 22 bp, Homo sapiens
gaaccatttctgaatagtttgt

SEQ ID NO: 6968102 - DNA, 22 bp, Homo sapiens
gacagtagtccttgctattcat

SEQ ID NO: 6968103 - DNA, 22 bp, Homo sapiens
agttacaagctattttacttaa

SEQ ID NO: 6968104 - DNA, 22 bp, Homo sapiens
tgaactccaaatactgctgatt

SEQ ID NO: 6968105 - DNA, 22 bp, Homo sapiens
gatatttacaaatttgccaata

SEQ ID NO: 6968106 - DNA, 22 bp, Homo sapiens
tagcaaggcgtggcactcaaat

SEQ ID NO: 6968107 - DNA, 22 bp, Homo sapiens
agctctgcaggcacagctgagg

SEQ ID NO: 6968108 - DNA, 22 bp, Homo sapiens
gagctcagattctggtgtcaga

SEQ ID NO: 6968109 - DNA, 21 bp, Homo sapiens
gggcagtctggtggctatggc

SEQ ID NO: 6968110 - DNA, 22 bp, Homo sapiens
ttgccattgcaaagtactatga

SEQ ID NO: 6968111 - DNA, 22 bp, Homo sapiens
aggatgccgcatttttattcaa

SEQ ID NO: 6968112 - DNA, 22 bp, Homo sapiens
tgtcagtgaaaaattgtgatag

SEQ ID NO: 6968113 - DNA, 22 bp, Homo sapiens
tgagtcacctctcagaagccac

SEQ ID NO: 6968114 - DNA, 22 bp, Homo sapiens
cagtttagtcctgccaccatgg

SEQ ID NO: 6968115 - DNA, 22 bp, Homo sapiens
tcaacttggagcacatttggct

SEQ ID NO: 6968116 - DNA, 22 bp, Homo sapiens
gcaggtctgttgattacagtca

SEQ ID NO: 6968117 - DNA, 22 bp, Homo sapiens
tggcaagaaccgcaattacttt

SEQ ID NO: 6968118 - DNA, 22 bp, Homo sapiens
attgcagggactcaataagaat

SEQ ID NO: 6968119 - DNA, 22 bp, Homo sapiens
taaagctattgctgtttattgt

SEQ ID NO: 6968120 - DNA, 22 bp, Homo sapiens
cctgcacagccttggctgacac

SEQ ID NO: 6968121 - DNA, 22 bp, Homo sapiens
cctggaaaatgccactttcaca

SEQ ID NO: 6968122 - DNA, 22 bp, Homo sapiens
cttgatttcagccttgtgatat

SEQ ID NO: 6968123 - DNA, 22 bp, Homo sapiens
tgtgtctctttgtcctagagct

SEQ ID NO: 6968124 - DNA, 22 bp, Homo sapiens
ttgcaactcttgaaaagcattg

SEQ ID NO: 6968125 - DNA, 22 bp, Homo sapiens
atgaaatggtggttttccattt

SEQ ID NO: 6968126 - DNA, 22 bp, Homo sapiens
cttgcttttgctgatgattaag

SEQ ID NO: 6968127 - DNA, 22 bp, Homo sapiens
ctgagaaattctttctttcact

SEQ ID NO: 6968128 - DNA, 22 bp, Homo sapiens
gagatgtgatcctttgctgtgt

SEQ ID NO: 6968129 - DNA, 22 bp, Homo sapiens
acagaggccatgagctgccacc

SEQ ID NO: 6968130 - DNA, 22 bp, Homo sapiens
ggtctggatattcaccagggcc

SEQ ID NO: 6968131 - DNA, 22 bp, Homo sapiens
tcctccttgttcttttgcctac

SEQ ID NO: 6968132 - DNA, 22 bp, Homo sapiens
tggcaaagatgaagcatttcgt

SEQ ID NO: 6968133 - DNA, 22 bp, Homo sapiens
ggcattagcgtctgcctcgtcc

SEQ ID NO: 6968134 - DNA, 22 bp, Homo sapiens
tccaggatggtgacggtggcca

SEQ ID NO: 6968135 - DNA, 22 bp, Homo sapiens
tgaggaatggcttaatgtggga

SEQ ID NO: 6968136 - DNA, 22 bp, Homo sapiens
gcttcctgagtacaccctcatc

SEQ ID NO: 6968137 - DNA, 22 bp, Homo sapiens
gtggcctcctccgtccgcctct

SEQ ID NO: 6968138 - DNA, 21 bp, Homo sapiens
aggcacttaaccaatgttagc

SEQ ID NO: 6968139 - DNA, 22 bp, Homo sapiens
tccagagctgagcagtcattct

SEQ ID NO: 6968140 - DNA, 22 bp, Homo sapiens
tacttattgttgaactgaatca

SEQ ID NO: 6968141 - DNA, 22 bp, Homo sapiens
catctgtagctccatgacaatt

SEQ ID NO: 6968142 - DNA, 20 bp, Homo sapiens
cttccacacaagaagcacag

SEQ ID NO: 6968143 - DNA, 21 bp, Homo sapiens
tgtctgatgtattttttgcct

SEQ ID NO: 6968144 - DNA, 22 bp, Homo sapiens
gggttccaaacatagtcttcct

SEQ ID NO: 6968145 - DNA, 22 bp, Homo sapiens
gaaatgtttccttttgtatgct

SEQ ID NO: 6968146 - DNA, 22 bp, Homo sapiens
gaggcagctgaaggagtgacag

SEQ ID NO: 6968147 - DNA, 15 bp, Homo sapiens
aatcagaagtgtggc

SEQ ID NO: 6968148 - DNA, 22 bp, Homo sapiens
gtaaggctaatgtctttgtggt

SEQ ID NO: 6968149 - DNA, 22 bp, Homo sapiens
agagctgggtggtggtgactca

SEQ ID NO: 6968150 - DNA, 22 bp, Homo sapiens
tagaaaagaagtctggccggga

SEQ ID NO: 6968151 - DNA, 22 bp, Homo sapiens
caccctgtacaaatggacatct

SEQ ID NO: 6968152 - DNA, 22 bp, Homo sapiens
aatggcaagctgaactcagaag

SEQ ID NO: 6968153 - DNA, 22 bp, Homo sapiens
tctggcacttaaatgagaattt

SEQ ID NO: 6968154 - DNA, 19 bp, Homo sapiens
ctctttactcccttgcctt

SEQ ID NO: 6968155 - DNA, 22 bp, Homo sapiens
ccaggatgacccccactttcct

SEQ ID NO: 6968156 - DNA, 22 bp, Homo sapiens
ctgcaggctgagcgcctgccgg

SEQ ID NO: 6968157 - DNA, 22 bp, Homo sapiens
aatgtagatgagatattttttg

SEQ ID NO: 6968158 - DNA, 22 bp, Homo sapiens
acactgcagcatcagctacgga

SEQ ID NO: 6968159 - DNA, 22 bp, Homo sapiens
ttgctggagcacaggactaagg

SEQ ID NO: 6968160 - DNA, 22 bp, Homo sapiens
gtttcctgtttctcagcagccc

SEQ ID NO: 6968161 - DNA, 22 bp, Homo sapiens
cacacactgttaatgtaggagt

SEQ ID NO: 6968162 - DNA, 22 bp, Homo sapiens
tgcaaggatatttagtctagtg

SEQ ID NO: 6968163 - DNA, 22 bp, Homo sapiens
ttccctctctagctttccccaa

SEQ ID NO: 6968164 - DNA, 22 bp, Homo sapiens
attccattacagatcttttcct

SEQ ID NO: 6968165 - DNA, 22 bp, Homo sapiens
ttttttgtcccagagagcctgg

SEQ ID NO: 6968166 - DNA, 22 bp, Homo sapiens
ctcccttctgagccttttgtta

SEQ ID NO: 6968167 - DNA, 22 bp, Homo sapiens
tgcttgctccggccggggttgc

SEQ ID NO: 6968168 - DNA, 22 bp, Homo sapiens
gagcttctcaacagttatctct

SEQ ID NO: 6968169 - DNA, 22 bp, Homo sapiens
atctccagcaatggggagctct

SEQ ID NO: 6968170 - DNA, 17 bp, Homo sapiens
aacaataggatgtgtat

SEQ ID NO: 6968171 - DNA, 22 bp, Homo sapiens
tgggtatatatgttgctacaga

SEQ ID NO: 6968172 - DNA, 22 bp, Homo sapiens
agggtccattctttgccttttc

SEQ ID NO: 6968173 - DNA, 22 bp, Homo sapiens
atggacagtactgagtggacta

SEQ ID NO: 6968174 - DNA, 22 bp, Homo sapiens
caggtgtcggtcaggcggtttt

SEQ ID NO: 6968175 - DNA, 22 bp, Homo sapiens
tctataatcctatttcaactgc

SEQ ID NO: 6968176 - DNA, 22 bp, Homo sapiens
tcggaacttgtcaggaagactt

SEQ ID NO: 6968177 - DNA, 22 bp, Homo sapiens
ttgttgccaccctcccttccta

SEQ ID NO: 6968178 - DNA, 21 bp, Homo sapiens
ttcacagtggataactttctg

SEQ ID NO: 6968179 - DNA, 22 bp, Homo sapiens
ttccgtaatgttacattctcaa

SEQ ID NO: 6968180 - DNA, 20 bp, Homo sapiens
ccagcatgtacacatgtgga

SEQ ID NO: 6968181 - DNA, 22 bp, Homo sapiens
ggtgagctggtctggggctgct

SEQ ID NO: 6968182 - DNA, 23 bp, Homo sapiens
tgtctatgagaagttcaggctag

SEQ ID NO: 6968183 - DNA, 22 bp, Homo sapiens
ttgcaagggataccatactaag

SEQ ID NO: 6968184 - DNA, 22 bp, Homo sapiens
cacaggactcgactgcagacag

SEQ ID NO: 6968185 - DNA, 22 bp, Homo sapiens
agagtcttgttaacttgctaag

SEQ ID NO: 6968186 - DNA, 17 bp, Homo sapiens
agcactaaaatgcttcc

SEQ ID NO: 6968187 - DNA, 22 bp, Homo sapiens
tggcaatatccacaattacttt

SEQ ID NO: 6968188 - DNA, 22 bp, Homo sapiens
tagactttgatattgtacaccc

SEQ ID NO: 6968189 - DNA, 22 bp, Homo sapiens
tctgggctctgggaattaggga

SEQ ID NO: 6968190 - DNA, 22 bp, Homo sapiens
actaaagtatctcctatttcat

SEQ ID NO: 6968191 - DNA, 22 bp, Homo sapiens
aactagaaaacaagatgctgat

SEQ ID NO: 6968192 - DNA, 22 bp, Homo sapiens
tctggttagccaataatgccaa

SEQ ID NO: 6968193 - DNA, 22 bp, Homo sapiens
acaaggctgaacagtgaagccg

SEQ ID NO: 6968194 - DNA, 22 bp, Homo sapiens
gactttgaacagtgtatcagta

SEQ ID NO: 6968195 - DNA, 22 bp, Homo sapiens
attcactgaatttcatgattat

SEQ ID NO: 6968196 - DNA, 20 bp, Homo sapiens
ttcattcacgtagctgttga

SEQ ID NO: 6968197 - DNA, 22 bp, Homo sapiens
tgtcattcatttaagtatgttt

SEQ ID NO: 6968198 - DNA, 21 bp, Homo sapiens
taggcaatttgttgtcatagc

SEQ ID NO: 6968199 - DNA, 22 bp, Homo sapiens
tggcttcactgctcaagtgatt

SEQ ID NO: 6968200 - DNA, 22 bp, Homo sapiens
cgtggccacccagtggtgcgtg

SEQ ID NO: 6968201 - DNA, 20 bp, Homo sapiens
ttcaaagtgtatgatatgca

SEQ ID NO: 6968202 - DNA, 22 bp, Homo sapiens
ctgagcagctgttacagagtgt

SEQ ID NO: 6968203 - DNA, 22 bp, Homo sapiens
tgggacagttgtcctccactct

SEQ ID NO: 6968204 - DNA, 22 bp, Homo sapiens
gggctggctctgtctagaaagg

SEQ ID NO: 6968205 - DNA, 22 bp, Homo sapiens
aggctggtctgttggcattttt

SEQ ID NO: 6968206 - DNA, 22 bp, Homo sapiens
ttagatgtgcaggacttttatc

SEQ ID NO: 6968207 - DNA, 22 bp, Homo sapiens
cagctgaacatgtagagcatct

SEQ ID NO: 6968208 - DNA, 21 bp, Homo sapiens
ggctggacatcccaggagact

SEQ ID NO: 6968209 - DNA, 22 bp, Homo sapiens
agatggctggaggtagatgctc

SEQ ID NO: 6968210 - DNA, 17 bp, Homo sapiens
ggctgtgccaggtgaga

SEQ ID NO: 6968211 - DNA, 22 bp, Homo sapiens
tgcagtcagcattagcaaaata

SEQ ID NO: 6968212 - DNA, 22 bp, Homo sapiens
cccctgctggcctgctggtttc

SEQ ID NO: 6968213 - DNA, 22 bp, Homo sapiens
cccagctggccaggtggctttg

SEQ ID NO: 6968214 - DNA, 22 bp, Homo sapiens
aagtccatagtttgcattacag

SEQ ID NO: 6968215 - DNA, 22 bp, Homo sapiens
cataaagtagcagagcatgact

SEQ ID NO: 6968216 - DNA, 22 bp, Homo sapiens
tgctcctggctccttccctaac

SEQ ID NO: 6968217 - DNA, 22 bp, Homo sapiens
tcccttggttaaatatgtagga

SEQ ID NO: 6968218 - DNA, 22 bp, Homo sapiens
tatttccacaccttttgaatct

SEQ ID NO: 6968219 - DNA, 22 bp, Homo sapiens
gcatgcatctagatatgcagac

SEQ ID NO: 6968220 - DNA, 22 bp, Homo sapiens
cacagtattcactgggcagatt

SEQ ID NO: 6968221 - DNA, 22 bp, Homo sapiens
tgaagcccaggtgttagtgggg

SEQ ID NO: 6968222 - DNA, 22 bp, Homo sapiens
tgcacatggcaatgctgctccc

SEQ ID NO: 6968223 - DNA, 22 bp, Homo sapiens
ataaggcaagctgtcagtttgt

SEQ ID NO: 6968224 - DNA, 22 bp, Homo sapiens
aagttcctatatccaaatacag

SEQ ID NO: 6968225 - DNA, 22 bp, Homo sapiens
ggtttatcaatacatattgcta

SEQ ID NO: 6968226 - DNA, 22 bp, Homo sapiens
ttgtacactgttgatgggaatg

SEQ ID NO: 6968227 - DNA, 22 bp, Homo sapiens
aatgctttggggttggtactgt

SEQ ID NO: 6968228 - DNA, 22 bp, Homo sapiens
gctggatcaagtccttcaccca

SEQ ID NO: 6968229 - DNA, 22 bp, Homo sapiens
tgtgtggatgcagcgtgggtct

SEQ ID NO: 6968230 - DNA, 21 bp, Homo sapiens
aggcactgtttgtggtttggg

SEQ ID NO: 6968231 - DNA, 22 bp, Homo sapiens
gtgctcatagatgatgctcttt

SEQ ID NO: 6968232 - DNA, 21 bp, Homo sapiens
gagctgaatatgttctagggg

SEQ ID NO: 6968233 - DNA, 22 bp, Homo sapiens
ccaaagtgatatgtgctgtaag

SEQ ID NO: 6968234 - DNA, 22 bp, Homo sapiens
ttccaggaagtgactatgtcat

SEQ ID NO: 6968235 - DNA, 22 bp, Homo sapiens
tggtatttaagacttcactcct

SEQ ID NO: 6968236 - DNA, 22 bp, Homo sapiens
cttcgtttttagtagcaatgtt

SEQ ID NO: 6968237 - DNA, 22 bp, Homo sapiens
cagcagaggaaagcaaatctaa

SEQ ID NO: 6968238 - DNA, 22 bp, Homo sapiens
tgctggccaatggcagaggcgg

SEQ ID NO: 6968239 - DNA, 22 bp, Homo sapiens
tggccagcagagttcactctct

SEQ ID NO: 6968240 - DNA, 22 bp, Homo sapiens
tgttggagcccgagtcagggag

SEQ ID NO: 6968241 - DNA, 22 bp, Homo sapiens
aagggaaggttccattatactt

SEQ ID NO: 6968242 - DNA, 22 bp, Homo sapiens
ggcagagatgtgggtcagaatc

SEQ ID NO: 6968243 - DNA, 22 bp, Homo sapiens
tagaggctcctgtgtgtaggtt

SEQ ID NO: 6968244 - DNA, 22 bp, Homo sapiens
aggatgtcagcattggctagag

SEQ ID NO: 6968245 - DNA, 22 bp, Homo sapiens
tctgggcttggttagggctgtt

SEQ ID NO: 6968246 - DNA, 22 bp, Homo sapiens
gcaaggcagcgcggagtagcta

SEQ ID NO: 6968247 - DNA, 18 bp, Homo sapiens
gcagcttttgattcaccc

SEQ ID NO: 6968248 - DNA, 22 bp, Homo sapiens
ctagagaatatgagggagtgaa

SEQ ID NO: 6968249 - DNA, 22 bp, Homo sapiens
gttcttcattacaagggaacca

SEQ ID NO: 6968250 - DNA, 22 bp, Homo sapiens
cagagggccatctctatcttca

SEQ ID NO: 6968251 - DNA, 22 bp, Homo sapiens
tctgtgcctgcttccccaccca

SEQ ID NO: 6968252 - DNA, 22 bp, Homo sapiens
cagtatttgttccctatcaatg

SEQ ID NO: 6968253 - DNA, 22 bp, Homo sapiens
tctgaggcatttaattatgacc

SEQ ID NO: 6968254 - DNA, 22 bp, Homo sapiens
gtgtgagcagaaaccatgagta

SEQ ID NO: 6968255 - DNA, 22 bp, Homo sapiens
ctcacagatgttctcctttagg

SEQ ID NO: 6968256 - DNA, 23 bp, Homo sapiens
tcagaataataacctagtaactg

SEQ ID NO: 6968257 - DNA, 22 bp, Homo sapiens
tagtttctgggttggcttctac

SEQ ID NO: 6968258 - DNA, 22 bp, Homo sapiens
aggtaattgtatgttccaagca

SEQ ID NO: 6968259 - DNA, 23 bp, Homo sapiens
tgggctcagcttccagtggggag

SEQ ID NO: 6968260 - DNA, 21 bp, Homo sapiens
ttagcagttgttgatttccag

SEQ ID NO: 6968261 - DNA, 17 bp, Homo sapiens
gctgtttctccagaagt

SEQ ID NO: 6968262 - DNA, 22 bp, Homo sapiens
acagtctactaaacatcatcag

SEQ ID NO: 6968263 - DNA, 22 bp, Homo sapiens
tgcccagccagtttatggtaat

SEQ ID NO: 6968264 - DNA, 22 bp, Homo sapiens
ggagtggcagcgaggatcagat

SEQ ID NO: 6968265 - DNA, 22 bp, Homo sapiens
agcagttttatgcgattgtttc

SEQ ID NO: 6968266 - DNA, 22 bp, Homo sapiens
gaagctctcaacaatggggagt

SEQ ID NO: 6968267 - DNA, 20 bp, Homo sapiens
caggaaccaaagaggactcc

SEQ ID NO: 6968268 - DNA, 22 bp, Homo sapiens
atccagctttgtctggtcttcg

SEQ ID NO: 6968269 - DNA, 22 bp, Homo sapiens
catgaatgctgggttcatgtaa

SEQ ID NO: 6968270 - DNA, 22 bp, Homo sapiens
catagaatcatagcacatttga

SEQ ID NO: 6968271 - DNA, 22 bp, Homo sapiens
aacagtaaaaatcatttagttg

SEQ ID NO: 6968272 - DNA, 16 bp, Homo sapiens
tcattgaagacagtac

SEQ ID NO: 6968273 - DNA, 22 bp, Homo sapiens
gtctgtagatgagtcttaagaa

SEQ ID NO: 6968274 - DNA, 22 bp, Homo sapiens
aacactggacaggaggctaggt

SEQ ID NO: 6968275 - DNA, 22 bp, Homo sapiens
caggcagaaggaagtaccaggc

SEQ ID NO: 6968276 - DNA, 22 bp, Homo sapiens
taagacacattcatatctgtct

SEQ ID NO: 6968277 - DNA, 22 bp, Homo sapiens
gaatgtcttcaaaactagactg

SEQ ID NO: 6968278 - DNA, 22 bp, Homo sapiens
agttaactaaactgtgagtaaa

SEQ ID NO: 6968279 - DNA, 21 bp, Homo sapiens
ggggtatacctatgagatagt

SEQ ID NO: 6968280 - DNA, 21 bp, Homo sapiens
tggaatgaggctgagcagtgc

SEQ ID NO: 6968281 - DNA, 22 bp, Homo sapiens
agcacagagattatttacaaga

SEQ ID NO: 6968282 - DNA, 22 bp, Homo sapiens
gggcttctgggcaccactccct

SEQ ID NO: 6968283 - DNA, 22 bp, Homo sapiens
agggtgccaggattcgctgcag

SEQ ID NO: 6968284 - DNA, 22 bp, Homo sapiens
acaaggtatcatcttggaagca

SEQ ID NO: 6968285 - DNA, 22 bp, Homo sapiens
aggcctcattttcactttatgc

SEQ ID NO: 6968286 - DNA, 22 bp, Homo sapiens
atggccagctagcacttgcatt

SEQ ID NO: 6968287 - DNA, 22 bp, Homo sapiens
gctctccagattcaggagggat

SEQ ID NO: 6968288 - DNA, 22 bp, Homo sapiens
tgtggaaagtcaagttccagga

SEQ ID NO: 6968289 - DNA, 22 bp, Homo sapiens
ttcaacatgcaaacatgtttgt

SEQ ID NO: 6968290 - DNA, 22 bp, Homo sapiens
ggaacttgaaaatcaaggtggt

SEQ ID NO: 6968291 - DNA, 22 bp, Homo sapiens
tcagtgcattaataatatcagt

SEQ ID NO: 6968292 - DNA, 22 bp, Homo sapiens
gcctttcactggtgccggctgt

SEQ ID NO: 6968293 - DNA, 22 bp, Homo sapiens
cattgtcctttggctttgcaaa

SEQ ID NO: 6968294 - DNA, 22 bp, Homo sapiens
gttagtgtatattgccttcaaa

SEQ ID NO: 6968295 - DNA, 22 bp, Homo sapiens
tgaaacatttgatgatctttgg

SEQ ID NO: 6968296 - DNA, 22 bp, Homo sapiens
gtatgtgctcagtaagtacatg

SEQ ID NO: 6968297 - DNA, 22 bp, Homo sapiens
atatgcttatgatggttaattt

SEQ ID NO: 6968298 - DNA, 22 bp, Homo sapiens
tcactgatgcttatgaaagtgt

SEQ ID NO: 6968299 - DNA, 22 bp, Homo sapiens
tgagttcaaattttggctctgc

SEQ ID NO: 6968300 - DNA, 22 bp, Homo sapiens
ttccagactatcagcagcagga

SEQ ID NO: 6968301 - DNA, 21 bp, Homo sapiens
ttcatttgttatagacaaagt

SEQ ID NO: 6968302 - DNA, 18 bp, Homo sapiens
caggcctcttgatcttcc

SEQ ID NO: 6968303 - DNA, 22 bp, Homo sapiens
gccagtgcctgctgctcagggc

SEQ ID NO: 6968304 - DNA, 22 bp, Homo sapiens
cttgggaagtgtttaaagctga

SEQ ID NO: 6968305 - DNA, 22 bp, Homo sapiens
aagcagttaatgttttgtcaat

SEQ ID NO: 6968306 - DNA, 22 bp, Homo sapiens
aataagaacttgtctctggcag

SEQ ID NO: 6968307 - DNA, 22 bp, Homo sapiens
ttcctcttattttcccagtgat

SEQ ID NO: 6968308 - DNA, 23 bp, Homo sapiens
aagcacagaatggtttaggagtt

SEQ ID NO: 6968309 - DNA, 22 bp, Homo sapiens
gtgaaacagaagctcctggaat

SEQ ID NO: 6968310 - DNA, 22 bp, Homo sapiens
gcacaataattcttgttttgct

SEQ ID NO: 6968311 - DNA, 22 bp, Homo sapiens
tccagcctaatgttcttcccac

SEQ ID NO: 6968312 - DNA, 22 bp, Homo sapiens
caggtaggaaaagggtgtcagg

SEQ ID NO: 6968313 - DNA, 22 bp, Homo sapiens
tgtcaggtgcagcttggatgca

SEQ ID NO: 6968314 - DNA, 22 bp, Homo sapiens
tcagaagctaaatttgatattt

SEQ ID NO: 6968315 - DNA, 22 bp, Homo sapiens
gcagggattgtcaatgctgctc

SEQ ID NO: 6968316 - DNA, 21 bp, Homo sapiens
tgctatttaatttttctgttc

SEQ ID NO: 6968317 - DNA, 22 bp, Homo sapiens
caagtaatggttttataatagt

SEQ ID NO: 6968318 - DNA, 22 bp, Homo sapiens
aggcatgtcttcctttgagtgt

SEQ ID NO: 6968319 - DNA, 22 bp, Homo sapiens
ttgggacagcaaccatctgcta

SEQ ID NO: 6968320 - DNA, 22 bp, Homo sapiens
tacattgtattatccgtgattg

SEQ ID NO: 6968321 - DNA, 22 bp, Homo sapiens
ttcttctttatctcagtatcct

SEQ ID NO: 6968322 - DNA, 20 bp, Homo sapiens
cagtgcccgtggaaaagatg

SEQ ID NO: 6968323 - DNA, 22 bp, Homo sapiens
gtaggccatggtggttgtctct

SEQ ID NO: 6968324 - DNA, 22 bp, Homo sapiens
tgggcaatttatttggtcatca

SEQ ID NO: 6968325 - DNA, 22 bp, Homo sapiens
aaggtgtcaaactagaagatgt

SEQ ID NO: 6968326 - DNA, 22 bp, Homo sapiens
ctctggagcgctgcttcccgcg

SEQ ID NO: 6968327 - DNA, 22 bp, Homo sapiens
tttcagagtctggctgcagcct

SEQ ID NO: 6968328 - DNA, 22 bp, Homo sapiens
tcacaaatcgaagccttataat

SEQ ID NO: 6968329 - DNA, 22 bp, Homo sapiens
tcactcaagcatctacagggat

SEQ ID NO: 6968330 - DNA, 22 bp, Homo sapiens
gcacaataacagccaaggttat

SEQ ID NO: 6968331 - DNA, 22 bp, Homo sapiens
ttgagatagatctcatcttccc

SEQ ID NO: 6968332 - DNA, 22 bp, Homo sapiens
tgtgtctaggctcatgcttgct

SEQ ID NO: 6968333 - DNA, 23 bp, Homo sapiens
agattgttattcccagttcatgt

SEQ ID NO: 6968334 - DNA, 22 bp, Homo sapiens
attctgtgttaggatagatggt

SEQ ID NO: 6968335 - DNA, 22 bp, Homo sapiens
ctctgctgcaggaaggcgtgca

SEQ ID NO: 6968336 - DNA, 22 bp, Homo sapiens
ggcagcaatgctgtgcaggcat

SEQ ID NO: 6968337 - DNA, 22 bp, Homo sapiens
gtgcaggtggttggcccagccg

SEQ ID NO: 6968338 - DNA, 22 bp, Homo sapiens
gacagctccagctcctccaggc

SEQ ID NO: 6968339 - DNA, 22 bp, Homo sapiens
acagggtcttagagatcacctg

SEQ ID NO: 6968340 - DNA, 22 bp, Homo sapiens
gtaaatgctagccctttaaagt

SEQ ID NO: 6968341 - DNA, 22 bp, Homo sapiens
aagacaggaacatagcaaatcc

SEQ ID NO: 6968342 - DNA, 22 bp, Homo sapiens
aaggaaacactgaactttgtag

SEQ ID NO: 6968343 - DNA, 22 bp, Homo sapiens
agatgaagatatctgcaggggc

SEQ ID NO: 6968344 - DNA, 22 bp, Homo sapiens
tacaagaatgtcttaaaagctc

SEQ ID NO: 6968345 - DNA, 22 bp, Homo sapiens
ctgctctgtgcacttgttcagg

SEQ ID NO: 6968346 - DNA, 22 bp, Homo sapiens
atgccaaattctcagcctcttt

SEQ ID NO: 6968347 - DNA, 22 bp, Homo sapiens
actgtgtcattgaacatggaaa

SEQ ID NO: 6968348 - DNA, 22 bp, Homo sapiens
tctcaatcaaacatgtctgact

SEQ ID NO: 6968349 - DNA, 22 bp, Homo sapiens
gggcaggtgttgtcaatctaat

SEQ ID NO: 6968350 - DNA, 22 bp, Homo sapiens
tatctagagcagtggttctcaa

SEQ ID NO: 6968351 - DNA, 22 bp, Homo sapiens
ccctttaaagttttaccagcag

SEQ ID NO: 6968352 - DNA, 22 bp, Homo sapiens
agcctggaggtaatgaggaaac

SEQ ID NO: 6968353 - DNA, 22 bp, Homo sapiens
acagctgatagttacctctgtc

SEQ ID NO: 6968354 - DNA, 22 bp, Homo sapiens
gattcagcttctgagcagtaat

SEQ ID NO: 6968355 - DNA, 22 bp, Homo sapiens
ggtccaaggctcggtggcgggg

SEQ ID NO: 6968356 - DNA, 22 bp, Homo sapiens
ctttgccatgttgcctgcagaa

SEQ ID NO: 6968357 - DNA, 22 bp, Homo sapiens
tcacaaatattttaacagtagg

SEQ ID NO: 6968358 - DNA, 19 bp, Homo sapiens
tggcttggctgcagatgct

SEQ ID NO: 6968359 - DNA, 22 bp, Homo sapiens
tgctgaataagacgtggcttgt

SEQ ID NO: 6968360 - DNA, 22 bp, Homo sapiens
tttagagtccctttctcaccac

SEQ ID NO: 6968361 - DNA, 22 bp, Homo sapiens
tcaggaagccactccacagaga

SEQ ID NO: 6968362 - DNA, 22 bp, Homo sapiens
agaatttttgattatctactcg

SEQ ID NO: 6968363 - DNA, 22 bp, Homo sapiens
gctcctggtgcaaagtttcttc

SEQ ID NO: 6968364 - DNA, 22 bp, Homo sapiens
cccagagctcagtgtgcaaggt

SEQ ID NO: 6968365 - DNA, 22 bp, Homo sapiens
ttagcttttttgcagatgtcct

SEQ ID NO: 6968366 - DNA, 22 bp, Homo sapiens
gcatctttctgtccattcagca

SEQ ID NO: 6968367 - DNA, 19 bp, Homo sapiens
atctgcccaataaagatga

SEQ ID NO: 6968368 - DNA, 22 bp, Homo sapiens
tctcctggctctaaaaggctgt

SEQ ID NO: 6968369 - DNA, 22 bp, Homo sapiens
tttggcacattctgtcacattc

SEQ ID NO: 6968370 - DNA, 22 bp, Homo sapiens
agagattacagcagggtccagc

SEQ ID NO: 6968371 - DNA, 21 bp, Homo sapiens
tgtagataaggttgtggagta

SEQ ID NO: 6968372 - DNA, 22 bp, Homo sapiens
caggtgggagccacagcgtaca

SEQ ID NO: 6968373 - DNA, 22 bp, Homo sapiens
gactgtctctgtgaatggtagg

SEQ ID NO: 6968374 - DNA, 22 bp, Homo sapiens
acagcagatctgtggagcttat

SEQ ID NO: 6968375 - DNA, 22 bp, Homo sapiens
atggagagtgaaagtctctcta

SEQ ID NO: 6968376 - DNA, 22 bp, Homo sapiens
ctgagagaagagcgcagtttgt

SEQ ID NO: 6968377 - DNA, 22 bp, Homo sapiens
gggtcactgtaaggcaataagt

SEQ ID NO: 6968378 - DNA, 22 bp, Homo sapiens
aattgcttgtttctttaactga

SEQ ID NO: 6968379 - DNA, 23 bp, Homo sapiens
ccctgctcaggggtctgattctc

SEQ ID NO: 6968380 - DNA, 22 bp, Homo sapiens
agaaggccagatggacggggct

SEQ ID NO: 6968381 - DNA, 22 bp, Homo sapiens
ggctcttctacttcagatgggg

SEQ ID NO: 6968382 - DNA, 22 bp, Homo sapiens
aaatagctgaaagttcctagat

SEQ ID NO: 6968383 - DNA, 22 bp, Homo sapiens
tgccttgcttcaatcaaaccgt

SEQ ID NO: 6968384 - DNA, 21 bp, Homo sapiens
tctctttgggaacattaatca

SEQ ID NO: 6968385 - DNA, 22 bp, Homo sapiens
agtcccagtgacttggccagaa

SEQ ID NO: 6968386 - DNA, 18 bp, Homo sapiens
cagtgaggatgaagggtt

SEQ ID NO: 6968387 - DNA, 22 bp, Homo sapiens
tctgcacctcctgcttgctaga

SEQ ID NO: 6968388 - DNA, 22 bp, Homo sapiens
agctccagccgctgatgggttt

SEQ ID NO: 6968389 - DNA, 22 bp, Homo sapiens
caggctagcagggcccagggca

SEQ ID NO: 6968390 - DNA, 22 bp, Homo sapiens
gagggaatagttggaactgagt

SEQ ID NO: 6968391 - DNA, 22 bp, Homo sapiens
agttatttactcctttgtctct

SEQ ID NO: 6968392 - DNA, 22 bp, Homo sapiens
ggtctccattccttcatctcac

SEQ ID NO: 6968393 - DNA, 22 bp, Homo sapiens
cagtgcctcttaagtgtcaccc

SEQ ID NO: 6968394 - DNA, 22 bp, Homo sapiens
taggaagatcaagtttatctca

SEQ ID NO: 6968395 - DNA, 22 bp, Homo sapiens
ctagcacagtatggtatcagat

SEQ ID NO: 6968396 - DNA, 22 bp, Homo sapiens
cagggaggatgggctgttttgc

SEQ ID NO: 6968397 - DNA, 21 bp, Homo sapiens
cacattccatgggtctattta

SEQ ID NO: 6968398 - DNA, 22 bp, Homo sapiens
ggaggctcttatttgttcaaca

SEQ ID NO: 6968399 - DNA, 22 bp, Homo sapiens
aggtgccaaagcctgcgggtgt

SEQ ID NO: 6968400 - DNA, 22 bp, Homo sapiens
tggcagagagactctccttgat

SEQ ID NO: 6968401 - DNA, 22 bp, Homo sapiens
aggctctgtgatccacaatgag

SEQ ID NO: 6968402 - DNA, 22 bp, Homo sapiens
aatattatacagtcaacctctt

SEQ ID NO: 6968403 - DNA, 22 bp, Homo sapiens
tggtaccatgttgctttgattt

SEQ ID NO: 6968404 - DNA, 22 bp, Homo sapiens
tgaaatcttcactaagtctctt

SEQ ID NO: 6968405 - DNA, 22 bp, Homo sapiens
attacatatgttggcaacattt

SEQ ID NO: 6968406 - DNA, 22 bp, Homo sapiens
acaaattctctaggcaaggaag

SEQ ID NO: 6968407 - DNA, 22 bp, Homo sapiens
ctgaagatgctggagcatgggt

SEQ ID NO: 6968408 - DNA, 22 bp, Homo sapiens
ctccagctcgcgagctctgctc

SEQ ID NO: 6968409 - DNA, 22 bp, Homo sapiens
gggccctgatctgtgagcgcag

SEQ ID NO: 6968410 - DNA, 22 bp, Homo sapiens
tggagtgcagttgggaggacac

SEQ ID NO: 6968411 - DNA, 22 bp, Homo sapiens
tggtggacaccgcagccatgaa

SEQ ID NO: 6968412 - DNA, 22 bp, Homo sapiens
gaggggcacagcagctgttgca

SEQ ID NO: 6968413 - DNA, 18 bp, Homo sapiens
tggtgcctttcactcttc

SEQ ID NO: 6968414 - DNA, 19 bp, Homo sapiens
ttgcttcaggctgtgtgct

SEQ ID NO: 6968415 - DNA, 22 bp, Homo sapiens
tgggtatacaaataatctcttt

SEQ ID NO: 6968416 - DNA, 22 bp, Homo sapiens
ggacgcttaccagtaacgactt

SEQ ID NO: 6968417 - DNA, 22 bp, Homo sapiens
cctacggaggacaggttagcca

SEQ ID NO: 6968418 - DNA, 22 bp, Homo sapiens
gcactggatcttgggagacgtg

SEQ ID NO: 6968419 - DNA, 20 bp, Homo sapiens
actgggagctaacggagatt

SEQ ID NO: 6968420 - DNA, 22 bp, Homo sapiens
attctccagctcactgtccata

SEQ ID NO: 6968421 - DNA, 22 bp, Homo sapiens
cagaaacatgtataaagttgta

SEQ ID NO: 6968422 - DNA, 22 bp, Homo sapiens
ggctaaggaacgcaggcttctc

SEQ ID NO: 6968423 - DNA, 22 bp, Homo sapiens
gggatcagaaacatagccctga

SEQ ID NO: 6968424 - DNA, 22 bp, Homo sapiens
aaggagcgcttagggggcagaa

SEQ ID NO: 6968425 - DNA, 22 bp, Homo sapiens
agtgggcatgatctggtgtctg

SEQ ID NO: 6968426 - DNA, 22 bp, Homo sapiens
tgtcaatgaaaatgtataaggt

SEQ ID NO: 6968427 - DNA, 17 bp, Homo sapiens
ggctggaggggacccgg

SEQ ID NO: 6968428 - DNA, 22 bp, Homo sapiens
atttggatgcactaaataaaat

SEQ ID NO: 6968429 - DNA, 22 bp, Homo sapiens
tattgctcagagaaggagatgt

SEQ ID NO: 6968430 - DNA, 22 bp, Homo sapiens
taggctgacttgtttcataaag

SEQ ID NO: 6968431 - DNA, 22 bp, Homo sapiens
ctggctgggagctcgcctgcgg

SEQ ID NO: 6968432 - DNA, 21 bp, Homo sapiens
tcagcaaaataagcaaatgga

SEQ ID NO: 6968433 - DNA, 22 bp, Homo sapiens
aaagccattgcagagcaggatt

SEQ ID NO: 6968434 - DNA, 22 bp, Homo sapiens
tagctgtgtatggtttacaaat

SEQ ID NO: 6968435 - DNA, 22 bp, Homo sapiens
agcccaagcctggctggcgatg

SEQ ID NO: 6968436 - DNA, 19 bp, Homo sapiens
ggggcctgtgatggtcaca

SEQ ID NO: 6968437 - DNA, 22 bp, Homo sapiens
agtttatgataactggtgacct

SEQ ID NO: 6968438 - DNA, 22 bp, Homo sapiens
ctattctagtctgtcatgtcca

SEQ ID NO: 6968439 - DNA, 22 bp, Homo sapiens
ctgctctaagctggtggagagt

SEQ ID NO: 6968440 - DNA, 22 bp, Homo sapiens
ttttggtatggaatccttgctc

SEQ ID NO: 6968441 - DNA, 22 bp, Homo sapiens
gtcatataggtaggattcagct

SEQ ID NO: 6968442 - DNA, 22 bp, Homo sapiens
tgcagaggagctggaaggctgg

SEQ ID NO: 6968443 - DNA, 22 bp, Homo sapiens
tttagcaattagaatccagcat

SEQ ID NO: 6968444 - DNA, 22 bp, Homo sapiens
gagatttagctgcttaactcct

SEQ ID NO: 6968445 - DNA, 22 bp, Homo sapiens
tcaggctaaccctaggcagaag

SEQ ID NO: 6968446 - DNA, 22 bp, Homo sapiens
aaagttctgggggtgtttctgg

SEQ ID NO: 6968447 - DNA, 22 bp, Homo sapiens
cactgcaacctctgccacctgg

SEQ ID NO: 6968448 - DNA, 22 bp, Homo sapiens
cggtttattttcaggaactgaa

SEQ ID NO: 6968449 - DNA, 20 bp, Homo sapiens
tgcagctgcaggagggtggg

SEQ ID NO: 6968450 - DNA, 22 bp, Homo sapiens
tctctaacaaaggagctgctgc

SEQ ID NO: 6968451 - DNA, 22 bp, Homo sapiens
gatttcaggctatctatgcaga

SEQ ID NO: 6968452 - DNA, 21 bp, Homo sapiens
agttggaggcagtttggcaat

SEQ ID NO: 6968453 - DNA, 22 bp, Homo sapiens
tgttattaaataattctctctt

SEQ ID NO: 6968454 - DNA, 22 bp, Homo sapiens
tttgagcttgtagcattgctat

SEQ ID NO: 6968455 - DNA, 22 bp, Homo sapiens
gaaggcaagctttggatatgag

SEQ ID NO: 6968456 - DNA, 23 bp, Homo sapiens
attgagcaagcttttgcctaagt

SEQ ID NO: 6968457 - DNA, 22 bp, Homo sapiens
tgagatgggtgggtagccaagg

SEQ ID NO: 6968458 - DNA, 22 bp, Homo sapiens
gccataatagagtgtgaggaat

SEQ ID NO: 6968459 - DNA, 22 bp, Homo sapiens
aactcttgggctgcatgctgtt

SEQ ID NO: 6968460 - DNA, 22 bp, Homo sapiens
atgattctctgctactctaaat

SEQ ID NO: 6968461 - DNA, 22 bp, Homo sapiens
gatgctgattatttcttgctag

SEQ ID NO: 6968462 - DNA, 22 bp, Homo sapiens
gtatctggtgagggttcccctg

SEQ ID NO: 6968463 - DNA, 22 bp, Homo sapiens
ggcagctcctcctagtctgccc

SEQ ID NO: 6968464 - DNA, 22 bp, Homo sapiens
ttaagtacttccctgttggaca

SEQ ID NO: 6968465 - DNA, 22 bp, Homo sapiens
aggggcactagaatgggagact

SEQ ID NO: 6968466 - DNA, 17 bp, Homo sapiens
acatgtgggtgtttttc

SEQ ID NO: 6968467 - DNA, 22 bp, Homo sapiens
gtgtatctggcatgtcgagtgt

SEQ ID NO: 6968468 - DNA, 22 bp, Homo sapiens
ttagtgtctacctttatctaaa

SEQ ID NO: 6968469 - DNA, 22 bp, Homo sapiens
ttctgtaccctcgcgattctcc

SEQ ID NO: 6968470 - DNA, 22 bp, Homo sapiens
taggaaataattcactctggct

SEQ ID NO: 6968471 - DNA, 22 bp, Homo sapiens
actggatgaggggaaagagaca

SEQ ID NO: 6968472 - DNA, 22 bp, Homo sapiens
gtgaatgactgttttcagcatt

SEQ ID NO: 6968473 - DNA, 22 bp, Homo sapiens
ggcttctgccttgccagttctt

SEQ ID NO: 6968474 - DNA, 22 bp, Homo sapiens
gtcatctgtttacttttctgct

SEQ ID NO: 6968475 - DNA, 22 bp, Homo sapiens
actaacttgctgagtgaccatg

SEQ ID NO: 6968476 - DNA, 22 bp, Homo sapiens
accagcacggattagaatgctt

SEQ ID NO: 6968477 - DNA, 22 bp, Homo sapiens
tccttctaccagctggatacct

SEQ ID NO: 6968478 - DNA, 22 bp, Homo sapiens
acatttgactacatttatatat

SEQ ID NO: 6968479 - DNA, 22 bp, Homo sapiens
aggacattgaaatcgaagagaa

SEQ ID NO: 6968480 - DNA, 22 bp, Homo sapiens
tggcacagagggacccagcagc

SEQ ID NO: 6968481 - DNA, 22 bp, Homo sapiens
gaaggggagtggctagtgtgtg

SEQ ID NO: 6968482 - DNA, 22 bp, Homo sapiens
caaatctttaattgaggaatca

SEQ ID NO: 6968483 - DNA, 17 bp, Homo sapiens
tttcaacatcactcagc

SEQ ID NO: 6968484 - DNA, 22 bp, Homo sapiens
tctgaattcagtatggtctttc

SEQ ID NO: 6968485 - DNA, 22 bp, Homo sapiens
ctgagtctcctggggaggtgaa

SEQ ID NO: 6968486 - DNA, 22 bp, Homo sapiens
cagcactttgagggctcttaat

SEQ ID NO: 6968487 - DNA, 22 bp, Homo sapiens
ctgactcctatcacagtgttct

SEQ ID NO: 6968488 - DNA, 22 bp, Homo sapiens
caggaaataggcgtttgtcctc

SEQ ID NO: 6968489 - DNA, 22 bp, Homo sapiens
tgtatattgttctgtctcttca

SEQ ID NO: 6968490 - DNA, 22 bp, Homo sapiens
aaataagcacttaactgtatca

SEQ ID NO: 6968491 - DNA, 22 bp, Homo sapiens
gtgccatactcatatcattttt

SEQ ID NO: 6968492 - DNA, 22 bp, Homo sapiens
ttagtgatgaagaattactagg

SEQ ID NO: 6968493 - DNA, 22 bp, Homo sapiens
tacctgagcccagtgcagcata

SEQ ID NO: 6968494 - DNA, 22 bp, Homo sapiens
gcagcaggtccgcatcatcatc

SEQ ID NO: 6968495 - DNA, 22 bp, Homo sapiens
cctcttgaacctaggcaagact

SEQ ID NO: 6968496 - DNA, 22 bp, Homo sapiens
tagaagacaggaaatacaaacc

SEQ ID NO: 6968497 - DNA, 22 bp, Homo sapiens
tagtctttcatttggagcattt

SEQ ID NO: 6968498 - DNA, 22 bp, Homo sapiens
tctccaggtagatatgtcagga

SEQ ID NO: 6968499 - DNA, 22 bp, Homo sapiens
aagtctcagaaaactagtgtgg

SEQ ID NO: 6968500 - DNA, 22 bp, Homo sapiens
ccagctggcactgtggctgccc

SEQ ID NO: 6968501 - DNA, 22 bp, Homo sapiens
gtttggctctgggtgcctgtgc

SEQ ID NO: 6968502 - DNA, 21 bp, Homo sapiens
tctctacactttcactaggct

SEQ ID NO: 6968503 - DNA, 23 bp, Homo sapiens
aagcagggagattcttagctgag

SEQ ID NO: 6968504 - DNA, 22 bp, Homo sapiens
cagcactctggcttcgttaagt

SEQ ID NO: 6968505 - DNA, 22 bp, Homo sapiens
agagaacagtgttttgaaggag

SEQ ID NO: 6968506 - DNA, 22 bp, Homo sapiens
ctagggaagtctgtattttgtg

SEQ ID NO: 6968507 - DNA, 21 bp, Homo sapiens
tttactgagcacttactatgt

SEQ ID NO: 6968508 - DNA, 21 bp, Homo sapiens
ctgagggccgcagctgggctc

SEQ ID NO: 6968509 - DNA, 22 bp, Homo sapiens
gtgctgatcttcacttggctgc

SEQ ID NO: 6968510 - DNA, 22 bp, Homo sapiens
atagacagctacatagaatata

SEQ ID NO: 6968511 - DNA, 22 bp, Homo sapiens
ggatattaatctgtgtcatttc

SEQ ID NO: 6968512 - DNA, 22 bp, Homo sapiens
gaaaaggcctccccataggaat

SEQ ID NO: 6968513 - DNA, 22 bp, Homo sapiens
caggtcccgccccgggctgacc

SEQ ID NO: 6968514 - DNA, 22 bp, Homo sapiens
aggctgtgatggatgtaaagga

SEQ ID NO: 6968515 - DNA, 22 bp, Homo sapiens
tttccatatttggtctttggga

SEQ ID NO: 6968516 - DNA, 22 bp, Homo sapiens
tttggaagtaaatgagtgtttt

SEQ ID NO: 6968517 - DNA, 22 bp, Homo sapiens
ttccatatgaaaaagctgttgc

SEQ ID NO: 6968518 - DNA, 22 bp, Homo sapiens
tttacagatgaggaaactgaga

SEQ ID NO: 6968519 - DNA, 22 bp, Homo sapiens
atgcttgagccagaaacagaaa

SEQ ID NO: 6968520 - DNA, 22 bp, Homo sapiens
acctggcttgtttctacctcct

SEQ ID NO: 6968521 - DNA, 22 bp, Homo sapiens
cagaggctagactgtgcttcct

SEQ ID NO: 6968522 - DNA, 22 bp, Homo sapiens
cctgattcagtggtgcccagag

SEQ ID NO: 6968523 - DNA, 22 bp, Homo sapiens
cacagttagaggtagagtccag

SEQ ID NO: 6968524 - DNA, 22 bp, Homo sapiens
ccctaagctttcgggctgagag

SEQ ID NO: 6968525 - DNA, 22 bp, Homo sapiens
atgtgtctctaccaatgcaatt

SEQ ID NO: 6968526 - DNA, 22 bp, Homo sapiens
tttctccacgccagcttgctta

SEQ ID NO: 6968527 - DNA, 22 bp, Homo sapiens
caccagatgaaaggacatatca

SEQ ID NO: 6968528 - DNA, 22 bp, Homo sapiens
tggctaggctccaagagctgga

SEQ ID NO: 6968529 - DNA, 22 bp, Homo sapiens
ggcattgtaaaggattcataga

SEQ ID NO: 6968530 - DNA, 22 bp, Homo sapiens
cagtacaattttacaaaggacg

SEQ ID NO: 6968531 - DNA, 22 bp, Homo sapiens
ggaaggtgaggtaaggtcttgt

SEQ ID NO: 6968532 - DNA, 22 bp, Homo sapiens
tgatgctgtgtacctcatggga

SEQ ID NO: 6968533 - DNA, 22 bp, Homo sapiens
tctggaatcagtggcttaccct

SEQ ID NO: 6968534 - DNA, 22 bp, Homo sapiens
gtcagtaggaacctagggtcaa

SEQ ID NO: 6968535 - DNA, 22 bp, Homo sapiens
atctggagcttgttagatgttt

SEQ ID NO: 6968536 - DNA, 22 bp, Homo sapiens
gttcacaatttttactgattgg

SEQ ID NO: 6968537 - DNA, 22 bp, Homo sapiens
atgcttgcccatgtttctgaag

SEQ ID NO: 6968538 - DNA, 22 bp, Homo sapiens
ttataggccatctaagtaattt

SEQ ID NO: 6968539 - DNA, 22 bp, Homo sapiens
acattgaacatggcaggacatt

SEQ ID NO: 6968540 - DNA, 22 bp, Homo sapiens
atgtgcatgcacttacatgtgt

SEQ ID NO: 6968541 - DNA, 22 bp, Homo sapiens
ttatgtctgtgaattggcaagc

SEQ ID NO: 6968542 - DNA, 22 bp, Homo sapiens
gctgtgagctgcctgtgtcaca

SEQ ID NO: 6968543 - DNA, 22 bp, Homo sapiens
tgatgaaagttcagtagtgaat

SEQ ID NO: 6968544 - DNA, 22 bp, Homo sapiens
ggtgggagagcttgctttgatg

SEQ ID NO: 6968545 - DNA, 22 bp, Homo sapiens
acaagataaggtgtcagtgtgt

SEQ ID NO: 6968546 - DNA, 22 bp, Homo sapiens
tctgaattaatcatgcctcttt

SEQ ID NO: 6968547 - DNA, 23 bp, Homo sapiens
agaagtggaatggccgtggggtc

SEQ ID NO: 6968548 - DNA, 22 bp, Homo sapiens
agaagacagagtctacattcta

SEQ ID NO: 6968549 - DNA, 22 bp, Homo sapiens
actgagcatggctcacagagag

SEQ ID NO: 6968550 - DNA, 21 bp, Homo sapiens
ggctgtgacgctgctccacag

SEQ ID NO: 6968551 - DNA, 23 bp, Homo sapiens
atcctgttgtaggcagtaattag

SEQ ID NO: 6968552 - DNA, 22 bp, Homo sapiens
aggaggcctgttttctcctgga

SEQ ID NO: 6968553 - DNA, 22 bp, Homo sapiens
aaagactaaacaaccaatatct

SEQ ID NO: 6968554 - DNA, 22 bp, Homo sapiens
caagccttggaaatccattctg

SEQ ID NO: 6968555 - DNA, 22 bp, Homo sapiens
aggtcaagattctacatttgta

SEQ ID NO: 6968556 - DNA, 22 bp, Homo sapiens
gacaatgtgttgaaagggaaaa

SEQ ID NO: 6968557 - DNA, 22 bp, Homo sapiens
acaagatttaatgcaacccaag

SEQ ID NO: 6968558 - DNA, 22 bp, Homo sapiens
aagacaatcctggacagtcagc

SEQ ID NO: 6968559 - DNA, 22 bp, Homo sapiens
gtctcccaaactctgatggtcc

SEQ ID NO: 6968560 - DNA, 22 bp, Homo sapiens
atagaaacagatgcacttctct

SEQ ID NO: 6968561 - DNA, 22 bp, Homo sapiens
tcagagttggcctttctgtatt

SEQ ID NO: 6968562 - DNA, 22 bp, Homo sapiens
cagaagttatgtcaatggtcat

SEQ ID NO: 6968563 - DNA, 22 bp, Homo sapiens
actcagaggcagctgctcaccc

SEQ ID NO: 6968564 - DNA, 22 bp, Homo sapiens
gcctggagggtccctctctgga

SEQ ID NO: 6968565 - DNA, 22 bp, Homo sapiens
gtcctggcacctcactggctac

SEQ ID NO: 6968566 - DNA, 22 bp, Homo sapiens
tatgtgctgccaccagggagag

SEQ ID NO: 6968567 - DNA, 22 bp, Homo sapiens
cagaaatctccatgtcagacat

SEQ ID NO: 6968568 - DNA, 22 bp, Homo sapiens
taaccaataaccaataagatac

SEQ ID NO: 6968569 - DNA, 22 bp, Homo sapiens
ctgagaggcggagcttgcagtg

SEQ ID NO: 6968570 - DNA, 22 bp, Homo sapiens
ttaatctaagtaatggatgctg

SEQ ID NO: 6968571 - DNA, 22 bp, Homo sapiens
ggactgaaagcgaagaatttgt

SEQ ID NO: 6968572 - DNA, 22 bp, Homo sapiens
agaagccatagtctgggaggca

SEQ ID NO: 6968573 - DNA, 22 bp, Homo sapiens
ctcttcccagctccacgagagg

SEQ ID NO: 6968574 - DNA, 22 bp, Homo sapiens
attggtcccctcctatgtgcca

SEQ ID NO: 6968575 - DNA, 22 bp, Homo sapiens
tattaggttggtgcaaaaagta

SEQ ID NO: 6968576 - DNA, 22 bp, Homo sapiens
ccagggaaacagcccagtgtga

SEQ ID NO: 6968577 - DNA, 22 bp, Homo sapiens
aagggctggatctctctgagca

SEQ ID NO: 6968578 - DNA, 19 bp, Homo sapiens
gtatatttatatggctgta

SEQ ID NO: 6968579 - DNA, 20 bp, Homo sapiens
agtaggtgtccttcaggata

SEQ ID NO: 6968580 - DNA, 22 bp, Homo sapiens
gcccttggaagcggcaggtagc

SEQ ID NO: 6968581 - DNA, 22 bp, Homo sapiens
tgcaagtaaccatcactatctc

SEQ ID NO: 6968582 - DNA, 21 bp, Homo sapiens
attggcctgtttacagagtga

SEQ ID NO: 6968583 - DNA, 22 bp, Homo sapiens
gggaagttctgatatttgcagg

SEQ ID NO: 6968584 - DNA, 22 bp, Homo sapiens
caggtgtataaactcagtgact

SEQ ID NO: 6968585 - DNA, 22 bp, Homo sapiens
atgtttaattatctgggttttg

SEQ ID NO: 6968586 - DNA, 22 bp, Homo sapiens
tgcacacacgcggcacatctgt

SEQ ID NO: 6968587 - DNA, 19 bp, Homo sapiens
agggcctgagcagatgttg

SEQ ID NO: 6968588 - DNA, 22 bp, Homo sapiens
ccacactaaactgctcaaacca

SEQ ID NO: 6968589 - DNA, 22 bp, Homo sapiens
aatatccattgggagcaaatgg

SEQ ID NO: 6968590 - DNA, 22 bp, Homo sapiens
attgctggatgagctcttggat

SEQ ID NO: 6968591 - DNA, 22 bp, Homo sapiens
gactgctttaaccaagaaagca

SEQ ID NO: 6968592 - DNA, 22 bp, Homo sapiens
tcttcaaaatattccatccatt

SEQ ID NO: 6968593 - DNA, 22 bp, Homo sapiens
aagtgcttccatgtttgagtgt

SEQ ID NO: 6968594 - DNA, 22 bp, Homo sapiens
acctggcttcagagtctggcca

SEQ ID NO: 6968595 - DNA, 22 bp, Homo sapiens
aaagagttcttgtagctttgag

SEQ ID NO: 6968596 - DNA, 23 bp, Homo sapiens
aaagtgattagcatttctgcaga

SEQ ID NO: 6968597 - DNA, 22 bp, Homo sapiens
tctgccagtggtttggccctga

SEQ ID NO: 6968598 - DNA, 22 bp, Homo sapiens
tctgaggctatgttcaggctaa

SEQ ID NO: 6968599 - DNA, 22 bp, Homo sapiens
acaatagtaaggtatattgtca

SEQ ID NO: 6968600 - DNA, 22 bp, Homo sapiens
cccagctcatcaggagccgccc

SEQ ID NO: 6968601 - DNA, 22 bp, Homo sapiens
ggcgggggtccaggagcctgca

SEQ ID NO: 6968602 - DNA, 22 bp, Homo sapiens
gatgcatagtgaagctgacaga

SEQ ID NO: 6968603 - DNA, 22 bp, Homo sapiens
agtatacatagtgcttcctctt

SEQ ID NO: 6968604 - DNA, 22 bp, Homo sapiens
taagacacgggctgatctaaag

SEQ ID NO: 6968605 - DNA, 22 bp, Homo sapiens
cagctattttgcctatcatggt

SEQ ID NO: 6968606 - DNA, 22 bp, Homo sapiens
accccctgcctgcagcaggggc

SEQ ID NO: 6968607 - DNA, 22 bp, Homo sapiens
ctggtgctttgctcatttgata

SEQ ID NO: 6968608 - DNA, 22 bp, Homo sapiens
tcccatgttgatctttgggttg

SEQ ID NO: 6968609 - DNA, 22 bp, Homo sapiens
gcagctctggggcaggcctgag

SEQ ID NO: 6968610 - DNA, 22 bp, Homo sapiens
tgctgctcttcaccatggcctc

SEQ ID NO: 6968611 - DNA, 22 bp, Homo sapiens
attctgcacttcctttgcttcc

SEQ ID NO: 6968612 - DNA, 22 bp, Homo sapiens
tggcaacatggacaggtctgcc

SEQ ID NO: 6968613 - DNA, 22 bp, Homo sapiens
tatctgtagtcagaataatttt

SEQ ID NO: 6968614 - DNA, 22 bp, Homo sapiens
tgtgtataaaagcagtgcagga

SEQ ID NO: 6968615 - DNA, 22 bp, Homo sapiens
agtggcagacacaatgtgggca

SEQ ID NO: 6968616 - DNA, 22 bp, Homo sapiens
gaacagtatttccaggaatccc

SEQ ID NO: 6968617 - DNA, 22 bp, Homo sapiens
tgtccagtgaaggtgttaaatt

SEQ ID NO: 6968618 - DNA, 22 bp, Homo sapiens
tgtctgcctgcgggccggcaca

SEQ ID NO: 6968619 - DNA, 22 bp, Homo sapiens
agccacatggacctgatgctag

SEQ ID NO: 6968620 - DNA, 22 bp, Homo sapiens
gtagacactgtatttgatgctt

SEQ ID NO: 6968621 - DNA, 22 bp, Homo sapiens
caattcatctgggtaggtagcc

SEQ ID NO: 6968622 - DNA, 22 bp, Homo sapiens
agtaagattcttctgaaaaatt

SEQ ID NO: 6968623 - DNA, 22 bp, Homo sapiens
gatttcaagtatcttgggcgag

SEQ ID NO: 6968624 - DNA, 22 bp, Homo sapiens
aggcctctgagcagcactcatg

SEQ ID NO: 6968625 - DNA, 22 bp, Homo sapiens
ggcatagaatgtgctgtgacaa

SEQ ID NO: 6968626 - DNA, 23 bp, Homo sapiens
tctgtccaccgcatgcagcggcc

SEQ ID NO: 6968627 - DNA, 22 bp, Homo sapiens
tgtggccttgcagcctggaggt

SEQ ID NO: 6968628 - DNA, 22 bp, Homo sapiens
ccacttgaaatatctttgttct

SEQ ID NO: 6968629 - DNA, 22 bp, Homo sapiens
accagagatgtctaataggggc

SEQ ID NO: 6968630 - DNA, 22 bp, Homo sapiens
atggccaagcttactctgttgt

SEQ ID NO: 6968631 - DNA, 22 bp, Homo sapiens
ctagagaaaccccatgagcttt

SEQ ID NO: 6968632 - DNA, 22 bp, Homo sapiens
atctcattctcccgtgccatgg

SEQ ID NO: 6968633 - DNA, 22 bp, Homo sapiens
gggaatgtgagtagggtgagtt

SEQ ID NO: 6968634 - DNA, 22 bp, Homo sapiens
ttgaataatgtgtatgttgtta

SEQ ID NO: 6968635 - DNA, 22 bp, Homo sapiens
tgatacagagaaagcatctttt

SEQ ID NO: 6968636 - DNA, 22 bp, Homo sapiens
agttttctgctaaaccagctaa

SEQ ID NO: 6968637 - DNA, 22 bp, Homo sapiens
tccaggcctgcaatgacaaagc

SEQ ID NO: 6968638 - DNA, 22 bp, Homo sapiens
tccaaagaggttaagaacgaga

SEQ ID NO: 6968639 - DNA, 22 bp, Homo sapiens
gcttgcagtggtgatgcccggg

SEQ ID NO: 6968640 - DNA, 22 bp, Homo sapiens
taggataggatggagacagaat

SEQ ID NO: 6968641 - DNA, 22 bp, Homo sapiens
ttcttcaagtctggtccagctt

SEQ ID NO: 6968642 - DNA, 22 bp, Homo sapiens
aactgcttgagatatgtttgtc

SEQ ID NO: 6968643 - DNA, 22 bp, Homo sapiens
aacattgctgaaagctgggaca

SEQ ID NO: 6968644 - DNA, 22 bp, Homo sapiens
ggctgacctcgcccctacatct

SEQ ID NO: 6968645 - DNA, 19 bp, Homo sapiens
aggcattgttctttagcaa

SEQ ID NO: 6968646 - DNA, 22 bp, Homo sapiens
acagcctttaaccatttcttcc

SEQ ID NO: 6968647 - DNA, 22 bp, Homo sapiens
tgatgagtaaataaggttgagt

SEQ ID NO: 6968648 - DNA, 17 bp, Homo sapiens
ggtgtatggggagggaa

SEQ ID NO: 6968649 - DNA, 22 bp, Homo sapiens
atgccatttgcatcagcggttt

SEQ ID NO: 6968650 - DNA, 22 bp, Homo sapiens
tacttcaaacaatggtacaaac

SEQ ID NO: 6968651 - DNA, 22 bp, Homo sapiens
tactgttcatgccttcataaag

SEQ ID NO: 6968652 - DNA, 22 bp, Homo sapiens
tgtgagtgacagttcccttggt

SEQ ID NO: 6968653 - DNA, 22 bp, Homo sapiens
cgatgccagtgacaccagaccc

SEQ ID NO: 6968654 - DNA, 22 bp, Homo sapiens
tctggaaggggatctgtggtca

SEQ ID NO: 6968655 - DNA, 22 bp, Homo sapiens
cttagctagaggcaattatgtt

SEQ ID NO: 6968656 - DNA, 22 bp, Homo sapiens
cccaggaggcagagatagcagt

SEQ ID NO: 6968657 - DNA, 17 bp, Homo sapiens
gagcccgttatcgggga

SEQ ID NO: 6968658 - DNA, 22 bp, Homo sapiens
gtgcctctgatctggaagtctg

SEQ ID NO: 6968659 - DNA, 22 bp, Homo sapiens
gccctttagagaaagttttctt

SEQ ID NO: 6968660 - DNA, 22 bp, Homo sapiens
agacagctgggaaatggagtgt

SEQ ID NO: 6968661 - DNA, 22 bp, Homo sapiens
cggctggtgtcgggcacagcaa

SEQ ID NO: 6968662 - DNA, 22 bp, Homo sapiens
aaagacatatttctaagtttat

SEQ ID NO: 6968663 - DNA, 22 bp, Homo sapiens
gcagtcagtgttgactacatgc

SEQ ID NO: 6968664 - DNA, 19 bp, Homo sapiens
gagcagctgcacccattga

SEQ ID NO: 6968665 - DNA, 22 bp, Homo sapiens
aagagttttagacaaactgatt

SEQ ID NO: 6968666 - DNA, 22 bp, Homo sapiens
ggcctgggctccgggagttact

SEQ ID NO: 6968667 - DNA, 22 bp, Homo sapiens
tctacagagagcaaacattcta

SEQ ID NO: 6968668 - DNA, 22 bp, Homo sapiens
gaggacgtgccaggcgatctcc

SEQ ID NO: 6968669 - DNA, 22 bp, Homo sapiens
ctgcccaccccgaggcaggaag

SEQ ID NO: 6968670 - DNA, 22 bp, Homo sapiens
cattgggccacaagaagaaaat

SEQ ID NO: 6968671 - DNA, 22 bp, Homo sapiens
ctgggcgcgtcccctgaggcgg

SEQ ID NO: 6968672 - DNA, 22 bp, Homo sapiens
ggtgttgggctcactggtcctt

SEQ ID NO: 6968673 - DNA, 22 bp, Homo sapiens
actgtgggtgagggcaaatcaa

SEQ ID NO: 6968674 - DNA, 22 bp, Homo sapiens
atcacagatttgatacttttgt

SEQ ID NO: 6968675 - DNA, 22 bp, Homo sapiens
gccctgtgtgatcacatgaaca

SEQ ID NO: 6968676 - DNA, 21 bp, Homo sapiens
agcaaaggcaggagaggtttc

SEQ ID NO: 6968677 - DNA, 22 bp, Homo sapiens
actggaattggatggaagtggt

SEQ ID NO: 6968678 - DNA, 22 bp, Homo sapiens
tgtcttatgctctggagggata

SEQ ID NO: 6968679 - DNA, 22 bp, Homo sapiens
tctgtctgcacctaagcacagt

SEQ ID NO: 6968680 - DNA, 22 bp, Homo sapiens
gttccggaagtgactgatccgc

SEQ ID NO: 6968681 - DNA, 22 bp, Homo sapiens
ggctcgagcagctgtgtaggat

SEQ ID NO: 6968682 - DNA, 22 bp, Homo sapiens
gagcctgcctctagtctctaga

SEQ ID NO: 6968683 - DNA, 22 bp, Homo sapiens
tgcaataacccagtatctgtga

SEQ ID NO: 6968684 - DNA, 18 bp, Homo sapiens
gcccagaggtctgggccc

SEQ ID NO: 6968685 - DNA, 22 bp, Homo sapiens
actgtttagtaaattgaaatgg

SEQ ID NO: 6968686 - DNA, 23 bp, Homo sapiens
actgcctgtgccgatctctctca

SEQ ID NO: 6968687 - DNA, 22 bp, Homo sapiens
aagcagcttccccaaagtgcct

SEQ ID NO: 6968688 - DNA, 22 bp, Homo sapiens
aaaccacttatatcgtgatttg

SEQ ID NO: 6968689 - DNA, 22 bp, Homo sapiens
aggaggccctggttaatgttta

SEQ ID NO: 6968690 - DNA, 22 bp, Homo sapiens
acagaaaatgccagaagggtgg

SEQ ID NO: 6968691 - DNA, 22 bp, Homo sapiens
atctctggttgttttgctccca

SEQ ID NO: 6968692 - DNA, 22 bp, Homo sapiens
gacagtggagggctgatgttaa

SEQ ID NO: 6968693 - DNA, 22 bp, Homo sapiens
gctgtttctttgatgatggaat

SEQ ID NO: 6968694 - DNA, 22 bp, Homo sapiens
tagaaataaatctgcagctggg

SEQ ID NO: 6968695 - DNA, 22 bp, Homo sapiens
tcttggcagtggaataccagga

SEQ ID NO: 6968696 - DNA, 22 bp, Homo sapiens
atgtctgtttgctgagcccggc

SEQ ID NO: 6968697 - DNA, 20 bp, Homo sapiens
tatttcactctccagatggc

SEQ ID NO: 6968698 - DNA, 22 bp, Homo sapiens
aaaaatttatggttcttctctg

SEQ ID NO: 6968699 - DNA, 22 bp, Homo sapiens
tcctgagattctgcatttctaa

SEQ ID NO: 6968700 - DNA, 22 bp, Homo sapiens
gcctgagagtctgcatttctaa

SEQ ID NO: 6968701 - DNA, 22 bp, Homo sapiens
ccaggccattcccagagttgct

SEQ ID NO: 6968702 - DNA, 22 bp, Homo sapiens
tggtggcactgacatcagacac

SEQ ID NO: 6968703 - DNA, 21 bp, Homo sapiens
cccaggtcgtggtcttcccag

SEQ ID NO: 6968704 - DNA, 22 bp, Homo sapiens
cacatgctccatacagaatggg

SEQ ID NO: 6968705 - DNA, 22 bp, Homo sapiens
acaggtgggcttaagagtcggc

SEQ ID NO: 6968706 - DNA, 22 bp, Homo sapiens
acatgcataggagaagtcttta

SEQ ID NO: 6968707 - DNA, 22 bp, Homo sapiens
atgttaagtgtaccatatatca

SEQ ID NO: 6968708 - DNA, 21 bp, Homo sapiens
gtcatccacctctcgggctct

SEQ ID NO: 6968709 - DNA, 22 bp, Homo sapiens
tacactgtggtaaactcaaagt

SEQ ID NO: 6968710 - DNA, 22 bp, Homo sapiens
tcttgggcacgatgggaggctt

SEQ ID NO: 6968711 - DNA, 22 bp, Homo sapiens
acccaggctggagtgcagtgat

SEQ ID NO: 6968712 - DNA, 18 bp, Homo sapiens
attggtcctgtccaccca

SEQ ID NO: 6968713 - DNA, 22 bp, Homo sapiens
gtggtcatcaactgagaatggt

SEQ ID NO: 6968714 - DNA, 22 bp, Homo sapiens
catcctgacaagaaagccagaa

SEQ ID NO: 6968715 - DNA, 22 bp, Homo sapiens
catgtacagccagggttgagaa

SEQ ID NO: 6968716 - DNA, 23 bp, Homo sapiens
gctcatcaggcttagagtcaagg

SEQ ID NO: 6968717 - DNA, 22 bp, Homo sapiens
tgagtccaaattctaccacctc

SEQ ID NO: 6968718 - DNA, 19 bp, Homo sapiens
gagcgcagagggcagggga

SEQ ID NO: 6968719 - DNA, 22 bp, Homo sapiens
caggtaacatgataaaacttac

SEQ ID NO: 6968720 - DNA, 22 bp, Homo sapiens
tcagcaatgagaactggcattt

SEQ ID NO: 6968721 - DNA, 22 bp, Homo sapiens
gaggccagctagtccaggaagt

SEQ ID NO: 6968722 - DNA, 22 bp, Homo sapiens
ttccagagctttgcgcttggaa

SEQ ID NO: 6968723 - DNA, 22 bp, Homo sapiens
attgtcagccttcatagatcct

SEQ ID NO: 6968724 - DNA, 22 bp, Homo sapiens
gtgataactcaggcagagaata

SEQ ID NO: 6968725 - DNA, 22 bp, Homo sapiens
cagtgaaatcacaactttagtt

SEQ ID NO: 6968726 - DNA, 23 bp, Homo sapiens
agaggtgtagtgtctcatctact

SEQ ID NO: 6968727 - DNA, 22 bp, Homo sapiens
ttctgcagcatgaggctggagc

SEQ ID NO: 6968728 - DNA, 22 bp, Homo sapiens
tgcatctttagtcttatgtctg

SEQ ID NO: 6968729 - DNA, 21 bp, Homo sapiens
acctgagctccacctcctgcc

SEQ ID NO: 6968730 - DNA, 22 bp, Homo sapiens
acctgatgtatagattctagat

SEQ ID NO: 6968731 - DNA, 22 bp, Homo sapiens
actccgactctgagtctacatt

SEQ ID NO: 6968732 - DNA, 22 bp, Homo sapiens
taatggtttttctatactgtcc

SEQ ID NO: 6968733 - DNA, 22 bp, Homo sapiens
gtctggaggcactttctcatga

SEQ ID NO: 6968734 - DNA, 22 bp, Homo sapiens
aagcatggctgagtgcaatggt

SEQ ID NO: 6968735 - DNA, 23 bp, Homo sapiens
tggcaccaggcattctaggggta

SEQ ID NO: 6968736 - DNA, 20 bp, Homo sapiens
tcctgaatttcctttctgct

SEQ ID NO: 6968737 - DNA, 22 bp, Homo sapiens
aaacctgaagtacgttacataa

SEQ ID NO: 6968738 - DNA, 22 bp, Homo sapiens
atcacaggtggtaggaaaagaa

SEQ ID NO: 6968739 - DNA, 22 bp, Homo sapiens
gcacaggaaatgactcatgtta

SEQ ID NO: 6968740 - DNA, 22 bp, Homo sapiens
tggcaggcaggcagccttctga

SEQ ID NO: 6968741 - DNA, 22 bp, Homo sapiens
ttgagaatgatgagattcttcc

SEQ ID NO: 6968742 - DNA, 22 bp, Homo sapiens
cagtagcttgcttaggctttta

SEQ ID NO: 6968743 - DNA, 22 bp, Homo sapiens
cataaattcagttctgcctctt

SEQ ID NO: 6968744 - DNA, 22 bp, Homo sapiens
tccaaagacttgctgtatgtaa

SEQ ID NO: 6968745 - DNA, 22 bp, Homo sapiens
tctggcccctatggcggtggag

SEQ ID NO: 6968746 - DNA, 22 bp, Homo sapiens
atcacattgttagcatagactg

SEQ ID NO: 6968747 - DNA, 22 bp, Homo sapiens
tgaaaccactgatggtaccaag

SEQ ID NO: 6968748 - DNA, 22 bp, Homo sapiens
cctatgaagatgttgaggctgg

SEQ ID NO: 6968749 - DNA, 22 bp, Homo sapiens
ctgcaggggcctcgagcacagg

SEQ ID NO: 6968750 - DNA, 22 bp, Homo sapiens
atgcagttttcaaagactattc

SEQ ID NO: 6968751 - DNA, 21 bp, Homo sapiens
gatgtacatcaagcactttgc

SEQ ID NO: 6968752 - DNA, 22 bp, Homo sapiens
attctgagaggcacaatgtgga

SEQ ID NO: 6968753 - DNA, 22 bp, Homo sapiens
tcttttgtgattctttagttac

SEQ ID NO: 6968754 - DNA, 22 bp, Homo sapiens
catggctcacaggatgggctag

SEQ ID NO: 6968755 - DNA, 22 bp, Homo sapiens
gttgccatctgagaagagcagc

SEQ ID NO: 6968756 - DNA, 22 bp, Homo sapiens
ctggggcccgagccttgggcca

SEQ ID NO: 6968757 - DNA, 22 bp, Homo sapiens
atctgggtctggctcttaagtc

SEQ ID NO: 6968758 - DNA, 22 bp, Homo sapiens
actgatacaaaagcacttggga

SEQ ID NO: 6968759 - DNA, 22 bp, Homo sapiens
ggccttggggtggccttgtccc

SEQ ID NO: 6968760 - DNA, 19 bp, Homo sapiens
gtctggatttttcggtaac

SEQ ID NO: 6968761 - DNA, 22 bp, Homo sapiens
atagttatttctgtcactgtca

SEQ ID NO: 6968762 - DNA, 22 bp, Homo sapiens
tatctctttcattttagagtca

SEQ ID NO: 6968763 - DNA, 21 bp, Homo sapiens
tgatagggtttgggcaattat

SEQ ID NO: 6968764 - DNA, 22 bp, Homo sapiens
aggaaaacagaccaaggagctc

SEQ ID NO: 6968765 - DNA, 22 bp, Homo sapiens
gtggcctgatgccagccctgtg

SEQ ID NO: 6968766 - DNA, 22 bp, Homo sapiens
aaggttccctctctggaagcct

SEQ ID NO: 6968767 - DNA, 22 bp, Homo sapiens
ttctctctgtggtcccattttg

SEQ ID NO: 6968768 - DNA, 22 bp, Homo sapiens
aggattcgggcataaagccatt

SEQ ID NO: 6968769 - DNA, 17 bp, Homo sapiens
agggggaacctgggagg

SEQ ID NO: 6968770 - DNA, 21 bp, Homo sapiens
aaattgccacacatttcttcc

SEQ ID NO: 6968771 - DNA, 22 bp, Homo sapiens
cactgtctcctagggggacttc

SEQ ID NO: 6968772 - DNA, 22 bp, Homo sapiens
taagcataagatacatgagaca

SEQ ID NO: 6968773 - DNA, 22 bp, Homo sapiens
gttcatcttcctcccagtgcct

SEQ ID NO: 6968774 - DNA, 22 bp, Homo sapiens
ggccagctcagggtccttgggc

SEQ ID NO: 6968775 - DNA, 18 bp, Homo sapiens
aggaatattcaaggtgct

SEQ ID NO: 6968776 - DNA, 22 bp, Homo sapiens
atcattttatggctgagaggac

SEQ ID NO: 6968777 - DNA, 22 bp, Homo sapiens
tggctgctgcagacagacagga

SEQ ID NO: 6968778 - DNA, 22 bp, Homo sapiens
tgcttctctctaggaagacgct

SEQ ID NO: 6968779 - DNA, 22 bp, Homo sapiens
gcagcaggactgccgttaaagt

SEQ ID NO: 6968780 - DNA, 22 bp, Homo sapiens
cgggaaggtggaggttgcagtg

SEQ ID NO: 6968781 - DNA, 22 bp, Homo sapiens
cctcaggcctctgcctcattgg

SEQ ID NO: 6968782 - DNA, 22 bp, Homo sapiens
tccattctttttacctctcaga

SEQ ID NO: 6968783 - DNA, 22 bp, Homo sapiens
gtacacactgtttgatcatttc

SEQ ID NO: 6968784 - DNA, 22 bp, Homo sapiens
cagttgaaaagattttattctg

SEQ ID NO: 6968785 - DNA, 20 bp, Homo sapiens
acagagactgagacacttgc

SEQ ID NO: 6968786 - DNA, 22 bp, Homo sapiens
gagcacagtgcagtttctgcta

SEQ ID NO: 6968787 - DNA, 22 bp, Homo sapiens
atagattgctagttttaaaatt

SEQ ID NO: 6968788 - DNA, 22 bp, Homo sapiens
acttcctgctatgagcttctgt

SEQ ID NO: 6968789 - DNA, 22 bp, Homo sapiens
tccagctctaacatgctgggcc

SEQ ID NO: 6968790 - DNA, 22 bp, Homo sapiens
aatcttttgattctagggctgt

SEQ ID NO: 6968791 - DNA, 22 bp, Homo sapiens
cctgttcagagctaagcatcat

SEQ ID NO: 6968792 - DNA, 20 bp, Homo sapiens
agaatgctttttgcattgca

SEQ ID NO: 6968793 - DNA, 22 bp, Homo sapiens
gttaggcagtgtggtatagcag

SEQ ID NO: 6968794 - DNA, 22 bp, Homo sapiens
gggcctgcaggttctgagaggc

SEQ ID NO: 6968795 - DNA, 22 bp, Homo sapiens
ctgtttataaaccaccagttta

SEQ ID NO: 6968796 - DNA, 22 bp, Homo sapiens
tgtccttatattgtggaagggg

SEQ ID NO: 6968797 - DNA, 22 bp, Homo sapiens
aggcagatgggcgtctataaat

SEQ ID NO: 6968798 - DNA, 21 bp, Homo sapiens
tgggatagaaatatggctgct

SEQ ID NO: 6968799 - DNA, 22 bp, Homo sapiens
tcaggagtctgtgcagttccac

SEQ ID NO: 6968800 - DNA, 22 bp, Homo sapiens
taaaccttcatgatggtcatta

SEQ ID NO: 6968801 - DNA, 22 bp, Homo sapiens
aagtaaatatctgtttatagca

SEQ ID NO: 6968802 - DNA, 22 bp, Homo sapiens
acatttgtaggacagaggaaga

SEQ ID NO: 6968803 - DNA, 22 bp, Homo sapiens
cctgtttatccatgccaatcct

SEQ ID NO: 6968804 - DNA, 22 bp, Homo sapiens
atggatctcagccaaccagtgt

SEQ ID NO: 6968805 - DNA, 22 bp, Homo sapiens
gcactagagcagctctcagaga

SEQ ID NO: 6968806 - DNA, 22 bp, Homo sapiens
gagctgccagacatgggaatga

SEQ ID NO: 6968807 - DNA, 22 bp, Homo sapiens
taggcagaattcattgtgctgc

SEQ ID NO: 6968808 - DNA, 22 bp, Homo sapiens
ataagaaacattattctttcca

SEQ ID NO: 6968809 - DNA, 20 bp, Homo sapiens
tgtgggccttcggcgtgctc

SEQ ID NO: 6968810 - DNA, 22 bp, Homo sapiens
ctgccagagtacttgtaagaat

SEQ ID NO: 6968811 - DNA, 22 bp, Homo sapiens
cttgacagaaggttttatccta

SEQ ID NO: 6968812 - DNA, 22 bp, Homo sapiens
ttgacagtatagctttacctat

SEQ ID NO: 6968813 - DNA, 22 bp, Homo sapiens
aggcttcaggtttgctttgcag

SEQ ID NO: 6968814 - DNA, 22 bp, Homo sapiens
gagagagacatgtaaacgcggt

SEQ ID NO: 6968815 - DNA, 18 bp, Homo sapiens
aggactctgctaccgtat

SEQ ID NO: 6968816 - DNA, 22 bp, Homo sapiens
gaggcagagtcacaaagagtct

SEQ ID NO: 6968817 - DNA, 22 bp, Homo sapiens
ctggactcatccatagaggtga

SEQ ID NO: 6968818 - DNA, 22 bp, Homo sapiens
cagggtcccaggagctgctttc

SEQ ID NO: 6968819 - DNA, 20 bp, Homo sapiens
ttagaaagagcgtgataaga

SEQ ID NO: 6968820 - DNA, 22 bp, Homo sapiens
ggtgggtattgaatacaggtgt

SEQ ID NO: 6968821 - DNA, 21 bp, Homo sapiens
cctgggctgtggtttggagac

SEQ ID NO: 6968822 - DNA, 22 bp, Homo sapiens
atttgtggctcagagtagggta

SEQ ID NO: 6968823 - DNA, 22 bp, Homo sapiens
gcttagaacatgtggattgcaa

SEQ ID NO: 6968824 - DNA, 22 bp, Homo sapiens
taggtggttgtctgctttccta

SEQ ID NO: 6968825 - DNA, 22 bp, Homo sapiens
tgtggagctggcaatatgggca

SEQ ID NO: 6968826 - DNA, 23 bp, Homo sapiens
tcctcagtatataaaggcagatg

SEQ ID NO: 6968827 - DNA, 22 bp, Homo sapiens
cattattgccagccatactgaa

SEQ ID NO: 6968828 - DNA, 20 bp, Homo sapiens
tggccttggggagctcacac

SEQ ID NO: 6968829 - DNA, 22 bp, Homo sapiens
accagagttggaataattttga

SEQ ID NO: 6968830 - DNA, 22 bp, Homo sapiens
gctccagtggactgggggaggc

SEQ ID NO: 6968831 - DNA, 22 bp, Homo sapiens
tgtaggcatattcatagagttg

SEQ ID NO: 6968832 - DNA, 22 bp, Homo sapiens
atgttgtattatgttattgtct

SEQ ID NO: 6968833 - DNA, 22 bp, Homo sapiens
accaaacaaaattgtgcactgt

SEQ ID NO: 6968834 - DNA, 22 bp, Homo sapiens
ctagagaaaactgtgtatcttg

SEQ ID NO: 6968835 - DNA, 22 bp, Homo sapiens
ataatctgacaaagacttaagc

SEQ ID NO: 6968836 - DNA, 22 bp, Homo sapiens
tcagatatgaattcatatctct

SEQ ID NO: 6968837 - DNA, 22 bp, Homo sapiens
acacagtaaatatgtattgaat

SEQ ID NO: 6968838 - DNA, 22 bp, Homo sapiens
agccactttactttcatatttt

SEQ ID NO: 6968839 - DNA, 22 bp, Homo sapiens
tttctgttgtatggcttctgca

SEQ ID NO: 6968840 - DNA, 22 bp, Homo sapiens
aaagctgtcaaggcaggaggct

SEQ ID NO: 6968841 - DNA, 22 bp, Homo sapiens
tagtacagtggcattcaaactt

SEQ ID NO: 6968842 - DNA, 21 bp, Homo sapiens
tcttttgtaactatttcagcc

SEQ ID NO: 6968843 - DNA, 22 bp, Homo sapiens
gattgctaatgtggggatttgg

SEQ ID NO: 6968844 - DNA, 22 bp, Homo sapiens
acatgatatatgggaaatgctt

SEQ ID NO: 6968845 - DNA, 23 bp, Homo sapiens
actttattgaccccaggtcagtt

SEQ ID NO: 6968846 - DNA, 22 bp, Homo sapiens
aggtaactgtggctaggtaact

SEQ ID NO: 6968847 - DNA, 22 bp, Homo sapiens
acatgacagggaatgaggtgaa

SEQ ID NO: 6968848 - DNA, 22 bp, Homo sapiens
gcttctgccttgcactttgtca

SEQ ID NO: 6968849 - DNA, 22 bp, Homo sapiens
tgtacaaggccatctacatgct

SEQ ID NO: 6968850 - DNA, 22 bp, Homo sapiens
actgaccttctcagctaactca

SEQ ID NO: 6968851 - DNA, 22 bp, Homo sapiens
aaggtccacaactggtaaatgg

SEQ ID NO: 6968852 - DNA, 22 bp, Homo sapiens
tcagatttgatgtggttttcta

SEQ ID NO: 6968853 - DNA, 21 bp, Homo sapiens
taaaccaggtaatttccattc

SEQ ID NO: 6968854 - DNA, 22 bp, Homo sapiens
taaatatcagtccagctcttcc

SEQ ID NO: 6968855 - DNA, 22 bp, Homo sapiens
cttcatcagctggcttactgtt

SEQ ID NO: 6968856 - DNA, 22 bp, Homo sapiens
aggccagactttggccaaatcc

SEQ ID NO: 6968857 - DNA, 22 bp, Homo sapiens
gaggctccccatgaggccccag

SEQ ID NO: 6968858 - DNA, 22 bp, Homo sapiens
atgcttccatgaacgttcttgt

SEQ ID NO: 6968859 - DNA, 17 bp, Homo sapiens
tgttctgttggaaagca

SEQ ID NO: 6968860 - DNA, 22 bp, Homo sapiens
agatatctgtattgtttccaat

SEQ ID NO: 6968861 - DNA, 22 bp, Homo sapiens
tcactacaacctccgcctcctg

SEQ ID NO: 6968862 - DNA, 22 bp, Homo sapiens
cttggacttccaggaagtattt

SEQ ID NO: 6968863 - DNA, 20 bp, Homo sapiens
tttctatggggccagcacat

SEQ ID NO: 6968864 - DNA, 22 bp, Homo sapiens
agttatcaagacagtgtggtac

SEQ ID NO: 6968865 - DNA, 21 bp, Homo sapiens
actttgggaggtgtgaggggc

SEQ ID NO: 6968866 - DNA, 22 bp, Homo sapiens
tcaagaaggagttatttattca

SEQ ID NO: 6968867 - DNA, 22 bp, Homo sapiens
actgaggtcatgcatagtttct

SEQ ID NO: 6968868 - DNA, 22 bp, Homo sapiens
cttcccaagactgtattgcaag

SEQ ID NO: 6968869 - DNA, 22 bp, Homo sapiens
atgttgtagcatatgaaatata

SEQ ID NO: 6968870 - DNA, 22 bp, Homo sapiens
tcagaaggaagaagtcatggga

SEQ ID NO: 6968871 - DNA, 21 bp, Homo sapiens
agactctggggatctctgtcc

SEQ ID NO: 6968872 - DNA, 21 bp, Homo sapiens
taacacattttggtactttgg

SEQ ID NO: 6968873 - DNA, 22 bp, Homo sapiens
ttacaagacactgctgacacag

SEQ ID NO: 6968874 - DNA, 22 bp, Homo sapiens
caggctcccacaagctcccagc

SEQ ID NO: 6968875 - DNA, 23 bp, Homo sapiens
acaactttacagatacattttgt

SEQ ID NO: 6968876 - DNA, 22 bp, Homo sapiens
agcacacagtcttccttcctcc

SEQ ID NO: 6968877 - DNA, 22 bp, Homo sapiens
gttaaagtgagctactttaggt

SEQ ID NO: 6968878 - DNA, 22 bp, Homo sapiens
tcaactgcaagtttgcttagtt

SEQ ID NO: 6968879 - DNA, 18 bp, Homo sapiens
aggtgctcaaatgggaaa

SEQ ID NO: 6968880 - DNA, 22 bp, Homo sapiens
ctgggcccaggcggctctcgga

SEQ ID NO: 6968881 - DNA, 22 bp, Homo sapiens
aggaggccgctgatgggctccc

SEQ ID NO: 6968882 - DNA, 22 bp, Homo sapiens
ctgggcaccaggcatgacaggg

SEQ ID NO: 6968883 - DNA, 21 bp, Homo sapiens
taacaatctctacttctcatt

SEQ ID NO: 6968884 - DNA, 22 bp, Homo sapiens
catgcattcagaatctctcaca

SEQ ID NO: 6968885 - DNA, 22 bp, Homo sapiens
tgacatgaaactgtgttgctac

SEQ ID NO: 6968886 - DNA, 22 bp, Homo sapiens
gctatttattaaaatggtgaag

SEQ ID NO: 6968887 - DNA, 22 bp, Homo sapiens
cagggccagcccactagcgagg

SEQ ID NO: 6968888 - DNA, 22 bp, Homo sapiens
ccagggtttagcaagcctacaa

SEQ ID NO: 6968889 - DNA, 22 bp, Homo sapiens
aggaatttggaatttttcctgt

SEQ ID NO: 6968890 - DNA, 22 bp, Homo sapiens
gtccatccagggtcaccatgac

SEQ ID NO: 6968891 - DNA, 22 bp, Homo sapiens
tctctgaattgtttaagttatt

SEQ ID NO: 6968892 - DNA, 22 bp, Homo sapiens
tgctgtcttctctgaggtccct

SEQ ID NO: 6968893 - DNA, 22 bp, Homo sapiens
agccttagagacttaaaacagg

SEQ ID NO: 6968894 - DNA, 19 bp, Homo sapiens
ttgctggcatttgatctct

SEQ ID NO: 6968895 - DNA, 22 bp, Homo sapiens
tcagagggtggctgggagcatc

SEQ ID NO: 6968896 - DNA, 22 bp, Homo sapiens
tgggcagtgggcctaggtgtga

SEQ ID NO: 6968897 - DNA, 19 bp, Homo sapiens
aagtatagtcagccttcta

SEQ ID NO: 6968898 - DNA, 23 bp, Homo sapiens
ctaggcaggattgtaggcgggta

SEQ ID NO: 6968899 - DNA, 22 bp, Homo sapiens
cagccttctgaatgaacgtact

SEQ ID NO: 6968900 - DNA, 22 bp, Homo sapiens
acctgagggagattaggcctga

SEQ ID NO: 6968901 - DNA, 22 bp, Homo sapiens
atgattcttttggatagatgat

SEQ ID NO: 6968902 - DNA, 22 bp, Homo sapiens
gcacagttgccattagccacat

SEQ ID NO: 6968903 - DNA, 22 bp, Homo sapiens
accagagtaatgtgtggaaatt

SEQ ID NO: 6968904 - DNA, 22 bp, Homo sapiens
gctgcctctcctgagttgacag

SEQ ID NO: 6968905 - DNA, 22 bp, Homo sapiens
aagaggcgctcctcacttccta

SEQ ID NO: 6968906 - DNA, 23 bp, Homo sapiens
aatttagtttgagacattagcct

SEQ ID NO: 6968907 - DNA, 22 bp, Homo sapiens
aggccacgctaatggggccaag

SEQ ID NO: 6968908 - DNA, 18 bp, Homo sapiens
tctctcagggaaacagaa

SEQ ID NO: 6968909 - DNA, 22 bp, Homo sapiens
gactggactctgaagatgggtg

SEQ ID NO: 6968910 - DNA, 22 bp, Homo sapiens
ttcatagtaacagtaactatgg

SEQ ID NO: 6968911 - DNA, 22 bp, Homo sapiens
tagaacttgatagacagtacaa

SEQ ID NO: 6968912 - DNA, 22 bp, Homo sapiens
ttgcttgtcttccctttacctc

SEQ ID NO: 6968913 - DNA, 22 bp, Homo sapiens
tcaggatgaccacgagcctcta

SEQ ID NO: 6968914 - DNA, 22 bp, Homo sapiens
tctgtgcaccttctaatgagta

SEQ ID NO: 6968915 - DNA, 22 bp, Homo sapiens
tgtcctttttcttaggaaatat

SEQ ID NO: 6968916 - DNA, 22 bp, Homo sapiens
gaggtgctgctgtacttcttgc

SEQ ID NO: 6968917 - DNA, 22 bp, Homo sapiens
ctgaagcatgcgtttgtaaact

SEQ ID NO: 6968918 - DNA, 22 bp, Homo sapiens
caggacaatttccacttggtaa

SEQ ID NO: 6968919 - DNA, 22 bp, Homo sapiens
tctcttctttggggtgggctca

SEQ ID NO: 6968920 - DNA, 22 bp, Homo sapiens
ctcaggctggtttgggttgttt

SEQ ID NO: 6968921 - DNA, 21 bp, Homo sapiens
tggcaggcagctggaagcttg

SEQ ID NO: 6968922 - DNA, 21 bp, Homo sapiens
tgggagaccgccttcctggga

SEQ ID NO: 6968923 - DNA, 22 bp, Homo sapiens
tggagcccagggtgagaaggag

SEQ ID NO: 6968924 - DNA, 22 bp, Homo sapiens
ccagtggccatgcacgagcagc

SEQ ID NO: 6968925 - DNA, 22 bp, Homo sapiens
tgtggctcaggcggcttctcct

SEQ ID NO: 6968926 - DNA, 22 bp, Homo sapiens
catgcagggagcagaggagaca

SEQ ID NO: 6968927 - DNA, 22 bp, Homo sapiens
aaggctcagtaataagttggaa

SEQ ID NO: 6968928 - DNA, 22 bp, Homo sapiens
tgctttgccagacagttccctt

SEQ ID NO: 6968929 - DNA, 22 bp, Homo sapiens
caagtacaaaatgatatttagt

SEQ ID NO: 6968930 - DNA, 22 bp, Homo sapiens
attactgagcttgtagctgcat

SEQ ID NO: 6968931 - DNA, 22 bp, Homo sapiens
attgtctgtactttaaaaatgt

SEQ ID NO: 6968932 - DNA, 22 bp, Homo sapiens
tcttttagctctgcaaggaaag

SEQ ID NO: 6968933 - DNA, 22 bp, Homo sapiens
ctgggcctcctctgcccaagct

SEQ ID NO: 6968934 - DNA, 22 bp, Homo sapiens
tgctggctctgggccaagcagg

SEQ ID NO: 6968935 - DNA, 22 bp, Homo sapiens
gctttacacagatgaatatttc

SEQ ID NO: 6968936 - DNA, 21 bp, Homo sapiens
cagcaagacatgtttatcaag

SEQ ID NO: 6968937 - DNA, 22 bp, Homo sapiens
gccctgctcttttgcccaccca

SEQ ID NO: 6968938 - DNA, 22 bp, Homo sapiens
cacctagccttcttgtgcctct

SEQ ID NO: 6968939 - DNA, 19 bp, Homo sapiens
tcttctgacttcaagaaac

SEQ ID NO: 6968940 - DNA, 22 bp, Homo sapiens
tctctggcagggatatctggct

SEQ ID NO: 6968941 - DNA, 22 bp, Homo sapiens
ttggaagccctgtgataggcca

SEQ ID NO: 6968942 - DNA, 22 bp, Homo sapiens
cagtttttgccattaagagtaa

SEQ ID NO: 6968943 - DNA, 22 bp, Homo sapiens
gtacagaaggatttctagtagt

SEQ ID NO: 6968944 - DNA, 22 bp, Homo sapiens
tcagaaagtgaactgttgacat

SEQ ID NO: 6968945 - DNA, 23 bp, Homo sapiens
gcagagctgccctattgccttgg

SEQ ID NO: 6968946 - DNA, 22 bp, Homo sapiens
cactcagaacatctccctgatg

SEQ ID NO: 6968947 - DNA, 22 bp, Homo sapiens
tgctggctacattattgctgtc

SEQ ID NO: 6968948 - DNA, 22 bp, Homo sapiens
tagctgttgcaataaacagttc

SEQ ID NO: 6968949 - DNA, 22 bp, Homo sapiens
gcttgcaagataggttacttaa

SEQ ID NO: 6968950 - DNA, 22 bp, Homo sapiens
ccaagtagttgagactacaggt

SEQ ID NO: 6968951 - DNA, 22 bp, Homo sapiens
tacagtgctttttggtggagaa

SEQ ID NO: 6968952 - DNA, 22 bp, Homo sapiens
actccagggtgactctgtctga

SEQ ID NO: 6968953 - DNA, 22 bp, Homo sapiens
gctgaaattagactgcagaagt

SEQ ID NO: 6968954 - DNA, 22 bp, Homo sapiens
tgcacatggcctgagtgcctga

SEQ ID NO: 6968955 - DNA, 22 bp, Homo sapiens
tcctgtgttctaggtatggtct

SEQ ID NO: 6968956 - DNA, 22 bp, Homo sapiens
tctgggctatatggtctctgct

SEQ ID NO: 6968957 - DNA, 18 bp, Homo sapiens
gtgtactcatgtcctcag

SEQ ID NO: 6968958 - DNA, 22 bp, Homo sapiens
ctggagtgttatggtcaagtca

SEQ ID NO: 6968959 - DNA, 22 bp, Homo sapiens
ctgggtctgtcactagataaat

SEQ ID NO: 6968960 - DNA, 22 bp, Homo sapiens
actgtaatggtggatccatgtc

SEQ ID NO: 6968961 - DNA, 22 bp, Homo sapiens
gataatatctggtttattcacc

SEQ ID NO: 6968962 - DNA, 20 bp, Homo sapiens
atgagtctacacactggctt

SEQ ID NO: 6968963 - DNA, 21 bp, Homo sapiens
ccttgggatgcaagtgagact

SEQ ID NO: 6968964 - DNA, 22 bp, Homo sapiens
attcaaaagaccatgcagactc

SEQ ID NO: 6968965 - DNA, 22 bp, Homo sapiens
gcctggctagttagtgtcaggt

SEQ ID NO: 6968966 - DNA, 22 bp, Homo sapiens
taattgaaatcatttcaattca

SEQ ID NO: 6968967 - DNA, 22 bp, Homo sapiens
acaattactcaactttgctgct

SEQ ID NO: 6968968 - DNA, 22 bp, Homo sapiens
taagaggcattagagacatagc

SEQ ID NO: 6968969 - DNA, 22 bp, Homo sapiens
tgcctccatgtttcagcatcta

SEQ ID NO: 6968970 - DNA, 23 bp, Homo sapiens
tctttggagtgctaggggttggg

SEQ ID NO: 6968971 - DNA, 22 bp, Homo sapiens
tcttcacattcacgtaacatag

SEQ ID NO: 6968972 - DNA, 22 bp, Homo sapiens
tttggcaaattcttggtagtat

SEQ ID NO: 6968973 - DNA, 22 bp, Homo sapiens
accaggcagcactttccttgca

SEQ ID NO: 6968974 - DNA, 22 bp, Homo sapiens
tttttatactttgctcaagatt

SEQ ID NO: 6968975 - DNA, 22 bp, Homo sapiens
tgcatgaacacatgtgcatgta

SEQ ID NO: 6968976 - DNA, 22 bp, Homo sapiens
ggcttgaatggatataatctgt

SEQ ID NO: 6968977 - DNA, 20 bp, Homo sapiens
cctttagaaactcatatgta

SEQ ID NO: 6968978 - DNA, 22 bp, Homo sapiens
gtgtgtgtgcatctcttttatt

SEQ ID NO: 6968979 - DNA, 22 bp, Homo sapiens
accctgggttcccgcagcacca

SEQ ID NO: 6968980 - DNA, 22 bp, Homo sapiens
ccagctcctcttcccagtgtca

SEQ ID NO: 6968981 - DNA, 22 bp, Homo sapiens
tcaaataccagcttttccagaa

SEQ ID NO: 6968982 - DNA, 22 bp, Homo sapiens
ttcctggctgtcatgccctagt

SEQ ID NO: 6968983 - DNA, 22 bp, Homo sapiens
ctctgggatgaggcctaggcac

SEQ ID NO: 6968984 - DNA, 22 bp, Homo sapiens
tctgctcaatactgctcatgaa

SEQ ID NO: 6968985 - DNA, 19 bp, Homo sapiens
ggggcccggggtctgcgag

SEQ ID NO: 6968986 - DNA, 22 bp, Homo sapiens
agctggaatcctacttctaaca

SEQ ID NO: 6968987 - DNA, 22 bp, Homo sapiens
ggcctgctcagtcctctttctt

SEQ ID NO: 6968988 - DNA, 22 bp, Homo sapiens
gcattcctgtacctctctgcta

SEQ ID NO: 6968989 - DNA, 22 bp, Homo sapiens
gcaactgtgatttgttatcttg

SEQ ID NO: 6968990 - DNA, 22 bp, Homo sapiens
tctgcgtgatgagggtgcagca

SEQ ID NO: 6968991 - DNA, 22 bp, Homo sapiens
tcatgctttgggttagaaacct

SEQ ID NO: 6968992 - DNA, 22 bp, Homo sapiens
gttacagtgggtttggggccca

SEQ ID NO: 6968993 - DNA, 22 bp, Homo sapiens
ggagaaggcacacccacctctg

SEQ ID NO: 6968994 - DNA, 22 bp, Homo sapiens
atcttacattccctcaccattt

SEQ ID NO: 6968995 - DNA, 19 bp, Homo sapiens
tcagaggatttggctatga

SEQ ID NO: 6968996 - DNA, 22 bp, Homo sapiens
ctcaatgagaggctttggaaag

SEQ ID NO: 6968997 - DNA, 22 bp, Homo sapiens
tacagacagacttcccaccctc

SEQ ID NO: 6968998 - DNA, 22 bp, Homo sapiens
tagaacttgtgaaatatcaatg

SEQ ID NO: 6968999 - DNA, 22 bp, Homo sapiens
ttagagaaccaatgaatagtct

SEQ ID NO: 6969000 - DNA, 23 bp, Homo sapiens
aacacttgcatgaacagctacac

SEQ ID NO: 6969001 - DNA, 22 bp, Homo sapiens
gtggttcacttgaggtcaggag

SEQ ID NO: 6969002 - DNA, 22 bp, Homo sapiens
aaagtacaaatgttctagccat

SEQ ID NO: 6969003 - DNA, 22 bp, Homo sapiens
attctatctctatatttctgca

SEQ ID NO: 6969004 - DNA, 22 bp, Homo sapiens
agagatgtatgcatttgtcaca

SEQ ID NO: 6969005 - DNA, 22 bp, Homo sapiens
cttattaatggaatcctaatga

SEQ ID NO: 6969006 - DNA, 23 bp, Homo sapiens
aaagcttaactgggtaataaagc

SEQ ID NO: 6969007 - DNA, 18 bp, Homo sapiens
gctttcaatttctttcct

SEQ ID NO: 6969008 - DNA, 22 bp, Homo sapiens
ttcctggtggtggtgacagcac

SEQ ID NO: 6969009 - DNA, 16 bp, Homo sapiens
tccagcagtctctgta

SEQ ID NO: 6969010 - DNA, 22 bp, Homo sapiens
gagtggttagaagtagtgtggc

SEQ ID NO: 6969011 - DNA, 22 bp, Homo sapiens
agtgatttttgaagccagccat

SEQ ID NO: 6969012 - DNA, 22 bp, Homo sapiens
catgaaccaaaccaaagtgtcc

SEQ ID NO: 6969013 - DNA, 22 bp, Homo sapiens
acagctgtggggactcttgccc

SEQ ID NO: 6969014 - DNA, 22 bp, Homo sapiens
ggacatgttccttttcatcttt

SEQ ID NO: 6969015 - DNA, 22 bp, Homo sapiens
gccttggctccagccctttccg

SEQ ID NO: 6969016 - DNA, 22 bp, Homo sapiens
caagataagatcatttacacta

SEQ ID NO: 6969017 - DNA, 22 bp, Homo sapiens
taacataacttttccttgaccc

SEQ ID NO: 6969018 - DNA, 22 bp, Homo sapiens
tgtcagcaacccatcactccca

SEQ ID NO: 6969019 - DNA, 22 bp, Homo sapiens
aagaagtggttggaagaagcat

SEQ ID NO: 6969020 - DNA, 18 bp, Homo sapiens
ttctccagaaaacatagc

SEQ ID NO: 6969021 - DNA, 22 bp, Homo sapiens
ctttgctgttataatgatagct

SEQ ID NO: 6969022 - DNA, 22 bp, Homo sapiens
tggctttaaaatggtttggtat

SEQ ID NO: 6969023 - DNA, 22 bp, Homo sapiens
tagtgtctagtgagtttgatgc

SEQ ID NO: 6969024 - DNA, 22 bp, Homo sapiens
tgccaggcatttgacagacact

SEQ ID NO: 6969025 - DNA, 22 bp, Homo sapiens
agtttctcttaatctagtatct

SEQ ID NO: 6969026 - DNA, 22 bp, Homo sapiens
tctcctggaagtgattcccctg

SEQ ID NO: 6969027 - DNA, 22 bp, Homo sapiens
attataaagaacatgtgtgtgg

SEQ ID NO: 6969028 - DNA, 22 bp, Homo sapiens
cctgtgtggccaggctggagtc

SEQ ID NO: 6969029 - DNA, 22 bp, Homo sapiens
tgggtcctgcactgcaagcacc

SEQ ID NO: 6969030 - DNA, 22 bp, Homo sapiens
tcagcaagtattttctgaatgc

SEQ ID NO: 6969031 - DNA, 22 bp, Homo sapiens
aagatgttgtcgttagtgatga

SEQ ID NO: 6969032 - DNA, 22 bp, Homo sapiens
agtacatttattaatggtaaaa

SEQ ID NO: 6969033 - DNA, 19 bp, Homo sapiens
gctcaggctgtgtgtgggg

SEQ ID NO: 6969034 - DNA, 22 bp, Homo sapiens
gtgctactacacatcaggactt

SEQ ID NO: 6969035 - DNA, 22 bp, Homo sapiens
agtgagtggaccctgcaaggaa

SEQ ID NO: 6969036 - DNA, 23 bp, Homo sapiens
gtgctcttcagttttagggtcat

SEQ ID NO: 6969037 - DNA, 22 bp, Homo sapiens
atttcttgcccctgctccctga

SEQ ID NO: 6969038 - DNA, 22 bp, Homo sapiens
agtagaggagataggattgtta

SEQ ID NO: 6969039 - DNA, 22 bp, Homo sapiens
tctttgcacacagcgattcttc

SEQ ID NO: 6969040 - DNA, 22 bp, Homo sapiens
attcacccagcacagtggcagc

SEQ ID NO: 6969041 - DNA, 22 bp, Homo sapiens
tggcacagccatcttctcctgc

SEQ ID NO: 6969042 - DNA, 22 bp, Homo sapiens
ctaaacttcatatgttgcttta

SEQ ID NO: 6969043 - DNA, 22 bp, Homo sapiens
tgtgactggcttatttcactta

SEQ ID NO: 6969044 - DNA, 22 bp, Homo sapiens
tgaattcatccatttatgcaag

SEQ ID NO: 6969045 - DNA, 20 bp, Homo sapiens
gctgcctgtttctgtaagta

SEQ ID NO: 6969046 - DNA, 22 bp, Homo sapiens
ggcatgtgttgggaacagcatg

SEQ ID NO: 6969047 - DNA, 22 bp, Homo sapiens
ctttgttactgatttcagtggg

SEQ ID NO: 6969048 - DNA, 22 bp, Homo sapiens
tcaatttcccctattgatagac

SEQ ID NO: 6969049 - DNA, 22 bp, Homo sapiens
aatggcaccttcaagaagaaaa

SEQ ID NO: 6969050 - DNA, 22 bp, Homo sapiens
tacttctgccttagagaacact

SEQ ID NO: 6969051 - DNA, 22 bp, Homo sapiens
acatatgtgcttatatccatga

SEQ ID NO: 6969052 - DNA, 22 bp, Homo sapiens
aagtttgctaacccttgctcta

SEQ ID NO: 6969053 - DNA, 22 bp, Homo sapiens
catctctccacggcagctctcg

SEQ ID NO: 6969054 - DNA, 22 bp, Homo sapiens
tgccatccatcagtatttgtgg

SEQ ID NO: 6969055 - DNA, 22 bp, Homo sapiens
ctccagtcatgtttactgtgca

SEQ ID NO: 6969056 - DNA, 22 bp, Homo sapiens
cctgagatggccagtgctggga

SEQ ID NO: 6969057 - DNA, 22 bp, Homo sapiens
gtgcttctcttcacacccaact

SEQ ID NO: 6969058 - DNA, 22 bp, Homo sapiens
gtaccatgttgtttggaaggct

SEQ ID NO: 6969059 - DNA, 22 bp, Homo sapiens
cctttgcaatcctgtaggcctt

SEQ ID NO: 6969060 - DNA, 22 bp, Homo sapiens
ctccttcctgccccagtgataa

SEQ ID NO: 6969061 - DNA, 22 bp, Homo sapiens
gggcacttactgccaaggcgag

SEQ ID NO: 6969062 - DNA, 22 bp, Homo sapiens
aggcccagttatcctacttgtt

SEQ ID NO: 6969063 - DNA, 22 bp, Homo sapiens
cagacaggaagttcagaagaaa

SEQ ID NO: 6969064 - DNA, 22 bp, Homo sapiens
gaatattttcagtacagatggt

SEQ ID NO: 6969065 - DNA, 22 bp, Homo sapiens
ctgaggaaagtattgcctggtg

SEQ ID NO: 6969066 - DNA, 22 bp, Homo sapiens
cccatttttgtgtgagtaatga

SEQ ID NO: 6969067 - DNA, 20 bp, Homo sapiens
gcatgcttggagagagagaa

SEQ ID NO: 6969068 - DNA, 22 bp, Homo sapiens
tagcagcacaaatggactatga

SEQ ID NO: 6969069 - DNA, 23 bp, Homo sapiens
tgtcaagtatagcaggccctccc

SEQ ID NO: 6969070 - DNA, 17 bp, Homo sapiens
tttgttcattgaagaga

SEQ ID NO: 6969071 - DNA, 22 bp, Homo sapiens
acacagctttgtgttgctccac

SEQ ID NO: 6969072 - DNA, 22 bp, Homo sapiens
gtacatttaggattcattgaaa

SEQ ID NO: 6969073 - DNA, 22 bp, Homo sapiens
agaacggcttggttggcattgt

SEQ ID NO: 6969074 - DNA, 22 bp, Homo sapiens
aggcaggcctacacaatgggag

SEQ ID NO: 6969075 - DNA, 22 bp, Homo sapiens
tgctccacctcccagctaacat

SEQ ID NO: 6969076 - DNA, 22 bp, Homo sapiens
aggccaagtgaacaatgctagt

SEQ ID NO: 6969077 - DNA, 18 bp, Homo sapiens
tctgcactcctgagagag

SEQ ID NO: 6969078 - DNA, 22 bp, Homo sapiens
tgagcaggattcgcctcttgca

SEQ ID NO: 6969079 - DNA, 22 bp, Homo sapiens
tgaggcactgggagagcacact

SEQ ID NO: 6969080 - DNA, 22 bp, Homo sapiens
gaggcattaaagggaatcttct

SEQ ID NO: 6969081 - DNA, 22 bp, Homo sapiens
cctctttaagtggtaaccctta

SEQ ID NO: 6969082 - DNA, 22 bp, Homo sapiens
ggggaagtcggagcctgagcac

SEQ ID NO: 6969083 - DNA, 22 bp, Homo sapiens
agactctggtcctcttgaattt

SEQ ID NO: 6969084 - DNA, 22 bp, Homo sapiens
aggccaggaatccttgtcccag

SEQ ID NO: 6969085 - DNA, 22 bp, Homo sapiens
atcagcttttctcatcagaaat

SEQ ID NO: 6969086 - DNA, 22 bp, Homo sapiens
ggggaccctcaggactgcgtct

SEQ ID NO: 6969087 - DNA, 22 bp, Homo sapiens
tatggctactacgaataatgct

SEQ ID NO: 6969088 - DNA, 22 bp, Homo sapiens
gctctgctgcttactagatggt

SEQ ID NO: 6969089 - DNA, 22 bp, Homo sapiens
tatacagatggaaagatacaca

SEQ ID NO: 6969090 - DNA, 22 bp, Homo sapiens
cactggcagatttgggatctgg

SEQ ID NO: 6969091 - DNA, 20 bp, Homo sapiens
gccctcagtcttgtctttat

SEQ ID NO: 6969092 - DNA, 22 bp, Homo sapiens
atttctataggaggacagtatt

SEQ ID NO: 6969093 - DNA, 22 bp, Homo sapiens
ctggagaagccaaactagtcac

SEQ ID NO: 6969094 - DNA, 16 bp, Homo sapiens
gccaaagggcaaagaa

SEQ ID NO: 6969095 - DNA, 22 bp, Homo sapiens
gtttcctggaaacattaggaga

SEQ ID NO: 6969096 - DNA, 22 bp, Homo sapiens
gtttacaaatattttaaatggt

SEQ ID NO: 6969097 - DNA, 22 bp, Homo sapiens
aggacagcaaccgttattcaca

SEQ ID NO: 6969098 - DNA, 22 bp, Homo sapiens
ctcagcagctacaggattcggg

SEQ ID NO: 6969099 - DNA, 22 bp, Homo sapiens
aagggcagaaagggacgctttg

SEQ ID NO: 6969100 - DNA, 22 bp, Homo sapiens
gtaattgtgggcttagtagagt

SEQ ID NO: 6969101 - DNA, 20 bp, Homo sapiens
gtcctaggtttgaaggtaaa

SEQ ID NO: 6969102 - DNA, 22 bp, Homo sapiens
gacaagacatgtgatgacatca

SEQ ID NO: 6969103 - DNA, 23 bp, Homo sapiens
tgggtcagctgcctccaggacaa

SEQ ID NO: 6969104 - DNA, 22 bp, Homo sapiens
cttgcagaggctgttccagatg

SEQ ID NO: 6969105 - DNA, 22 bp, Homo sapiens
ggagcaccgttgggaggtgagg

SEQ ID NO: 6969106 - DNA, 22 bp, Homo sapiens
ctggctgcttgtagactcgact

SEQ ID NO: 6969107 - DNA, 22 bp, Homo sapiens
tggctctgggaatgggaagatg

SEQ ID NO: 6969108 - DNA, 22 bp, Homo sapiens
tgaggccaggacccccagcagg

SEQ ID NO: 6969109 - DNA, 22 bp, Homo sapiens
cctggctgccttgtgttgatct

SEQ ID NO: 6969110 - DNA, 22 bp, Homo sapiens
tgggctatgtaggagtggagtt

SEQ ID NO: 6969111 - DNA, 22 bp, Homo sapiens
gtctgagactgggcacatacct

SEQ ID NO: 6969112 - DNA, 22 bp, Homo sapiens
tacttttcctggaaccactgct

SEQ ID NO: 6969113 - DNA, 22 bp, Homo sapiens
ataaatgcatacatggttttga

SEQ ID NO: 6969114 - DNA, 22 bp, Homo sapiens
cattgcactccagtctgggcca

SEQ ID NO: 6969115 - DNA, 22 bp, Homo sapiens
aatctgtttaacagatttctgt

SEQ ID NO: 6969116 - DNA, 22 bp, Homo sapiens
gctctgagagagcaaagtcacc

SEQ ID NO: 6969117 - DNA, 22 bp, Homo sapiens
ctcctgaattgtccctcacagc

SEQ ID NO: 6969118 - DNA, 22 bp, Homo sapiens
ttccttctcagccctcgaggat

SEQ ID NO: 6969119 - DNA, 22 bp, Homo sapiens
aaactactgatttgtgaattga

SEQ ID NO: 6969120 - DNA, 22 bp, Homo sapiens
ttccaaatgttggacaactgta

SEQ ID NO: 6969121 - DNA, 22 bp, Homo sapiens
gtagctgtctcggtcaggagtt

SEQ ID NO: 6969122 - DNA, 22 bp, Homo sapiens
tctgtaaagactccaaaagcca

SEQ ID NO: 6969123 - DNA, 22 bp, Homo sapiens
ctccaagtatgttaaaatctaa

SEQ ID NO: 6969124 - DNA, 22 bp, Homo sapiens
aggtttatctgaacccggggaa

SEQ ID NO: 6969125 - DNA, 23 bp, Homo sapiens
tgttgaagtaactgttacataga

SEQ ID NO: 6969126 - DNA, 16 bp, Homo sapiens
gcttagtgagagcaac

SEQ ID NO: 6969127 - DNA, 22 bp, Homo sapiens
gtaattgaaattgccttgggtt

SEQ ID NO: 6969128 - DNA, 22 bp, Homo sapiens
tgaccgaacacgtcataaatgc

SEQ ID NO: 6969129 - DNA, 22 bp, Homo sapiens
gccactggcatctagttggtag

SEQ ID NO: 6969130 - DNA, 22 bp, Homo sapiens
atttgtaccatactgtttatta

SEQ ID NO: 6969131 - DNA, 22 bp, Homo sapiens
ctttggtcagagggatggagtt

SEQ ID NO: 6969132 - DNA, 22 bp, Homo sapiens
ccagctggagctcgcagatagg

SEQ ID NO: 6969133 - DNA, 22 bp, Homo sapiens
cagaacagagtcaaaagtatgt

SEQ ID NO: 6969134 - DNA, 22 bp, Homo sapiens
ctgcagttggtgggtcctcggt

SEQ ID NO: 6969135 - DNA, 22 bp, Homo sapiens
agagtgaaggccaggttacagt

SEQ ID NO: 6969136 - DNA, 22 bp, Homo sapiens
gacctttttactgtgtacgctg

SEQ ID NO: 6969137 - DNA, 22 bp, Homo sapiens
tgggcagacgggagcttgcctt

SEQ ID NO: 6969138 - DNA, 20 bp, Homo sapiens
tacttctgaggcactctgaa

SEQ ID NO: 6969139 - DNA, 22 bp, Homo sapiens
gtgctgaataacagtagaaatt

SEQ ID NO: 6969140 - DNA, 22 bp, Homo sapiens
tcattacagagatataatctac

SEQ ID NO: 6969141 - DNA, 22 bp, Homo sapiens
ctgcacccatgagctcaaggga

SEQ ID NO: 6969142 - DNA, 22 bp, Homo sapiens
tttaaggtacagctagcagcat

SEQ ID NO: 6969143 - DNA, 22 bp, Homo sapiens
aaactctaattatgcagttctt

SEQ ID NO: 6969144 - DNA, 23 bp, Homo sapiens
ttgaggacaatttacatggtgtt

SEQ ID NO: 6969145 - DNA, 22 bp, Homo sapiens
ggtcaaagttgaagaagggcat

SEQ ID NO: 6969146 - DNA, 22 bp, Homo sapiens
atctttgttttgatgcagatct

SEQ ID NO: 6969147 - DNA, 22 bp, Homo sapiens
tggaaacttggaacgtcttcag

SEQ ID NO: 6969148 - DNA, 22 bp, Homo sapiens
acagtgcagggcgggaagaagg

SEQ ID NO: 6969149 - DNA, 22 bp, Homo sapiens
ttctacatgagaaaatgtattt

SEQ ID NO: 6969150 - DNA, 22 bp, Homo sapiens
gagatttcttttgatgcctgtc

SEQ ID NO: 6969151 - DNA, 22 bp, Homo sapiens
agtggcaatgtagagagtgatc

SEQ ID NO: 6969152 - DNA, 22 bp, Homo sapiens
aggatttacaatgattctaggt

SEQ ID NO: 6969153 - DNA, 22 bp, Homo sapiens
ttccagtacccagcgaaggcac

SEQ ID NO: 6969154 - DNA, 22 bp, Homo sapiens
ccagagaaataaggggaaaatg

SEQ ID NO: 6969155 - DNA, 22 bp, Homo sapiens
tagctttgctggcaagcatgtc

SEQ ID NO: 6969156 - DNA, 22 bp, Homo sapiens
agtgccatggaggaacagatgc

SEQ ID NO: 6969157 - DNA, 22 bp, Homo sapiens
ctgcctgtgtgtgcctgcagaa

SEQ ID NO: 6969158 - DNA, 22 bp, Homo sapiens
acagttctttggatggaagaat

SEQ ID NO: 6969159 - DNA, 22 bp, Homo sapiens
aggttcagagttgttgatgttt

SEQ ID NO: 6969160 - DNA, 22 bp, Homo sapiens
gaatcttttgtctcgtgaataa

SEQ ID NO: 6969161 - DNA, 22 bp, Homo sapiens
tcatgtagagtggagttgattt

SEQ ID NO: 6969162 - DNA, 22 bp, Homo sapiens
ctgtgacttccggatgacatga

SEQ ID NO: 6969163 - DNA, 22 bp, Homo sapiens
aacaatgctgaactgaggaaag

SEQ ID NO: 6969164 - DNA, 22 bp, Homo sapiens
tctcttggacatgtggctctgc

SEQ ID NO: 6969165 - DNA, 22 bp, Homo sapiens
ccaacaggttgagagtctgaat

SEQ ID NO: 6969166 - DNA, 22 bp, Homo sapiens
ttgccctggggctggcctggca

SEQ ID NO: 6969167 - DNA, 22 bp, Homo sapiens
tatagcatggctatattgttgc

SEQ ID NO: 6969168 - DNA, 22 bp, Homo sapiens
tcctggtgggacagaaaacctc

SEQ ID NO: 6969169 - DNA, 22 bp, Homo sapiens
tcttcacaccgggcagcaggaa

SEQ ID NO: 6969170 - DNA, 22 bp, Homo sapiens
ccctgctgtccctcagtcctgc

SEQ ID NO: 6969171 - DNA, 22 bp, Homo sapiens
cagttaacttcatatgatcatt

SEQ ID NO: 6969172 - DNA, 22 bp, Homo sapiens
agttattgtcctcctcacctta

SEQ ID NO: 6969173 - DNA, 22 bp, Homo sapiens
ttgaaatccaattatcatatgt

SEQ ID NO: 6969174 - DNA, 22 bp, Homo sapiens
ggtttggttttggccatcttcc

SEQ ID NO: 6969175 - DNA, 22 bp, Homo sapiens
ctgctccaggatttcaggccag

SEQ ID NO: 6969176 - DNA, 22 bp, Homo sapiens
attgtatttaggagaaaagggt

SEQ ID NO: 6969177 - DNA, 22 bp, Homo sapiens
gcaagacctatctagttgctgt

SEQ ID NO: 6969178 - DNA, 22 bp, Homo sapiens
gctgtacaaggcctctgccatc

SEQ ID NO: 6969179 - DNA, 22 bp, Homo sapiens
tggaatgtaaagcgtgtgataa

SEQ ID NO: 6969180 - DNA, 22 bp, Homo sapiens
gtaccataatgagtctcttaaa

SEQ ID NO: 6969181 - DNA, 22 bp, Homo sapiens
gttttataggtgaaatattact

SEQ ID NO: 6969182 - DNA, 22 bp, Homo sapiens
gaatatattattcagcttttca

SEQ ID NO: 6969183 - DNA, 22 bp, Homo sapiens
tttccaatgtagatgtctctgg

SEQ ID NO: 6969184 - DNA, 22 bp, Homo sapiens
aagagcctccctagaggtgaag

SEQ ID NO: 6969185 - DNA, 22 bp, Homo sapiens
acaggtgtggggctgtggtact

SEQ ID NO: 6969186 - DNA, 21 bp, Homo sapiens
tttagagaatactcactattt

SEQ ID NO: 6969187 - DNA, 22 bp, Homo sapiens
ccaggaaaaagagaaacatggt

SEQ ID NO: 6969188 - DNA, 22 bp, Homo sapiens
atgtgtgtaaacaagtataatt

SEQ ID NO: 6969189 - DNA, 22 bp, Homo sapiens
aggctcttcttttattaactga

SEQ ID NO: 6969190 - DNA, 22 bp, Homo sapiens
ttgttcaggcctgggacagttt

SEQ ID NO: 6969191 - DNA, 22 bp, Homo sapiens
agttaaggttcaattaaagtta

SEQ ID NO: 6969192 - DNA, 22 bp, Homo sapiens
ccaggctccgcatagaccccac

SEQ ID NO: 6969193 - DNA, 22 bp, Homo sapiens
tggaggcagtcacctgaagtca

SEQ ID NO: 6969194 - DNA, 22 bp, Homo sapiens
tagccctctttaatccttccct

SEQ ID NO: 6969195 - DNA, 22 bp, Homo sapiens
tttgagttttacctgtattact

SEQ ID NO: 6969196 - DNA, 22 bp, Homo sapiens
caagtcctaaatgtatttgttg

SEQ ID NO: 6969197 - DNA, 22 bp, Homo sapiens
ttggaagccagaggaccaggga

SEQ ID NO: 6969198 - DNA, 22 bp, Homo sapiens
gtgtgcatatgtgtggctctcc

SEQ ID NO: 6969199 - DNA, 22 bp, Homo sapiens
caaatggaaagagcagaagctt

SEQ ID NO: 6969200 - DNA, 22 bp, Homo sapiens
tccaaggacattgttctagttg

SEQ ID NO: 6969201 - DNA, 22 bp, Homo sapiens
tccaagcatgtggtcaggagcc

SEQ ID NO: 6969202 - DNA, 22 bp, Homo sapiens
ctggctttgatcagagtgacct

SEQ ID NO: 6969203 - DNA, 22 bp, Homo sapiens
caggcatggtgagaactcagcc

SEQ ID NO: 6969204 - DNA, 22 bp, Homo sapiens
attggagaaatggggctttagg

SEQ ID NO: 6969205 - DNA, 22 bp, Homo sapiens
tcccatggatagtgaccttgtt

SEQ ID NO: 6969206 - DNA, 22 bp, Homo sapiens
tccccactctgggccaccacaa

SEQ ID NO: 6969207 - DNA, 22 bp, Homo sapiens
tctctgtgggctttggacttga

SEQ ID NO: 6969208 - DNA, 22 bp, Homo sapiens
tttccactgggcacggggccag

SEQ ID NO: 6969209 - DNA, 22 bp, Homo sapiens
ttacaggtgagaaaactgaggc

SEQ ID NO: 6969210 - DNA, 22 bp, Homo sapiens
ctgtatgagttgggaatagaat

SEQ ID NO: 6969211 - DNA, 22 bp, Homo sapiens
acgtgcaggatctggttggcga

SEQ ID NO: 6969212 - DNA, 19 bp, Homo sapiens
tctgaagaattagagagca

SEQ ID NO: 6969213 - DNA, 22 bp, Homo sapiens
tctgtatcgtaatcatgtctgg

SEQ ID NO: 6969214 - DNA, 22 bp, Homo sapiens
tctgttaaaagtggaataatag

SEQ ID NO: 6969215 - DNA, 22 bp, Homo sapiens
ggagccctgaagcaagaaagta

SEQ ID NO: 6969216 - DNA, 18 bp, Homo sapiens
gctcctggaccaggtcac

SEQ ID NO: 6969217 - DNA, 22 bp, Homo sapiens
ccttccccagtgattctctcag

SEQ ID NO: 6969218 - DNA, 21 bp, Homo sapiens
cctgggagatcagctgccttc

SEQ ID NO: 6969219 - DNA, 22 bp, Homo sapiens
cttgcacagtgactaacacgta

SEQ ID NO: 6969220 - DNA, 22 bp, Homo sapiens
ggaggcaaagcactttgcttgg

SEQ ID NO: 6969221 - DNA, 22 bp, Homo sapiens
ctgcctgcaggacacctcgcta

SEQ ID NO: 6969222 - DNA, 22 bp, Homo sapiens
gcaatgttgtgttggcattcta

SEQ ID NO: 6969223 - DNA, 22 bp, Homo sapiens
acagtgcaaataggactgtctt

SEQ ID NO: 6969224 - DNA, 22 bp, Homo sapiens
ccagcagctttattggctctcc

SEQ ID NO: 6969225 - DNA, 22 bp, Homo sapiens
aatccttactgaatgagaaaaa

SEQ ID NO: 6969226 - DNA, 22 bp, Homo sapiens
aatttggttttaagagcatcag

SEQ ID NO: 6969227 - DNA, 22 bp, Homo sapiens
gctctgaggaccaattcctgtg

SEQ ID NO: 6969228 - DNA, 22 bp, Homo sapiens
tcattggttgtcacacagggag

SEQ ID NO: 6969229 - DNA, 22 bp, Homo sapiens
cagttgtaggcatgtgcatgga

SEQ ID NO: 6969230 - DNA, 22 bp, Homo sapiens
atacaaatttatagatgcattt

SEQ ID NO: 6969231 - DNA, 22 bp, Homo sapiens
agcagctctgagaggccagcac

SEQ ID NO: 6969232 - DNA, 22 bp, Homo sapiens
attctaggacttgagagctaag

SEQ ID NO: 6969233 - DNA, 23 bp, Homo sapiens
ggcagagagcatggctggggccc

SEQ ID NO: 6969234 - DNA, 22 bp, Homo sapiens
aagcggcatgaggagtaagtag

SEQ ID NO: 6969235 - DNA, 22 bp, Homo sapiens
catgatgtcacagagaagcaca

SEQ ID NO: 6969236 - DNA, 22 bp, Homo sapiens
acatgctttctaggtccttctg

SEQ ID NO: 6969237 - DNA, 22 bp, Homo sapiens
tttggtcttttatttaaagcag

SEQ ID NO: 6969238 - DNA, 23 bp, Homo sapiens
tggaagcagaagtttcaatatcc

SEQ ID NO: 6969239 - DNA, 19 bp, Homo sapiens
catggtgaaaccccgtctc

SEQ ID NO: 6969240 - DNA, 21 bp, Homo sapiens
tttctgcaatgcacgttgagg

SEQ ID NO: 6969241 - DNA, 22 bp, Homo sapiens
tgtggcagggatactgaggcag

SEQ ID NO: 6969242 - DNA, 22 bp, Homo sapiens
cccagcatcctcagggagcggg

SEQ ID NO: 6969243 - DNA, 22 bp, Homo sapiens
tattgctgcctcgtccaggctg

SEQ ID NO: 6969244 - DNA, 20 bp, Homo sapiens
aagacaccagtggcagcccc

SEQ ID NO: 6969245 - DNA, 22 bp, Homo sapiens
ctggcacacgtggcagggtagg

SEQ ID NO: 6969246 - DNA, 22 bp, Homo sapiens
atctttacaagaaattctttta

SEQ ID NO: 6969247 - DNA, 22 bp, Homo sapiens
gcagaagttaatcgaaggccat

SEQ ID NO: 6969248 - DNA, 22 bp, Homo sapiens
cagaaaataaagtttctacgca

SEQ ID NO: 6969249 - DNA, 22 bp, Homo sapiens
gctaatactttggaaagaatgt

SEQ ID NO: 6969250 - DNA, 22 bp, Homo sapiens
agagtggcagtaaaatagagca

SEQ ID NO: 6969251 - DNA, 22 bp, Homo sapiens
tggcagcctggaatctctcagc

SEQ ID NO: 6969252 - DNA, 22 bp, Homo sapiens
tgggcaagtatcggactctgag

SEQ ID NO: 6969253 - DNA, 22 bp, Homo sapiens
gcagggctattggaaggagatg

SEQ ID NO: 6969254 - DNA, 22 bp, Homo sapiens
ctacatttcatccagggagagc

SEQ ID NO: 6969255 - DNA, 19 bp, Homo sapiens
ggggaggtattgttttcat

SEQ ID NO: 6969256 - DNA, 22 bp, Homo sapiens
accaggaggaagtgttaatgat

SEQ ID NO: 6969257 - DNA, 22 bp, Homo sapiens
cagtctctctccttgcaggcgt

SEQ ID NO: 6969258 - DNA, 22 bp, Homo sapiens
ttgtctgtgaaatggaaatagt

SEQ ID NO: 6969259 - DNA, 22 bp, Homo sapiens
aaggctttccttgggcggttac

SEQ ID NO: 6969260 - DNA, 22 bp, Homo sapiens
ccaggcactgctcgaggtgcta

SEQ ID NO: 6969261 - DNA, 22 bp, Homo sapiens
catgtttaattgcgatgtttga

SEQ ID NO: 6969262 - DNA, 22 bp, Homo sapiens
tccctgggcttctccagacttg

SEQ ID NO: 6969263 - DNA, 22 bp, Homo sapiens
aaataagtgtgggccagtcaaa

SEQ ID NO: 6969264 - DNA, 20 bp, Homo sapiens
gccactgtgcttacactgct

SEQ ID NO: 6969265 - DNA, 22 bp, Homo sapiens
gaaatacaaatgcctagatcct

SEQ ID NO: 6969266 - DNA, 22 bp, Homo sapiens
tcacatcaaggactgtctggct

SEQ ID NO: 6969267 - DNA, 22 bp, Homo sapiens
tccttcaactttttacttgccc

SEQ ID NO: 6969268 - DNA, 22 bp, Homo sapiens
gttaatctgctttcaaaatgca

SEQ ID NO: 6969269 - DNA, 22 bp, Homo sapiens
tgaaggaatgagggagtgggtc

SEQ ID NO: 6969270 - DNA, 22 bp, Homo sapiens
ttgaggacaggctgattgtata

SEQ ID NO: 6969271 - DNA, 21 bp, Homo sapiens
tgagttaaggatccaattctg

SEQ ID NO: 6969272 - DNA, 21 bp, Homo sapiens
tgctggcctcaagggtgactt

SEQ ID NO: 6969273 - DNA, 22 bp, Homo sapiens
ctctagctgaggtcactgctat

SEQ ID NO: 6969274 - DNA, 22 bp, Homo sapiens
ctgtttgcccacatttttatta

SEQ ID NO: 6969275 - DNA, 22 bp, Homo sapiens
ccaggcagtcagggttgtgtgt

SEQ ID NO: 6969276 - DNA, 22 bp, Homo sapiens
gtccttcaaaggcacgcagtta

SEQ ID NO: 6969277 - DNA, 22 bp, Homo sapiens
ggacaaagctctgctgcctccc

SEQ ID NO: 6969278 - DNA, 22 bp, Homo sapiens
cagctcacttgtttcatcttct

SEQ ID NO: 6969279 - DNA, 22 bp, Homo sapiens
ggggccttttctgaatgtggaa

SEQ ID NO: 6969280 - DNA, 22 bp, Homo sapiens
tcccagggtgcgcctgccctcg

SEQ ID NO: 6969281 - DNA, 23 bp, Homo sapiens
tagatgtattaagtgcattttca

SEQ ID NO: 6969282 - DNA, 22 bp, Homo sapiens
atgaggcctttcttcacccttt

SEQ ID NO: 6969283 - DNA, 22 bp, Homo sapiens
gcaggcccagagtcgctggcct

SEQ ID NO: 6969284 - DNA, 22 bp, Homo sapiens
gccagagaggcaaatcctagca

SEQ ID NO: 6969285 - DNA, 22 bp, Homo sapiens
aaccacatggctcagtggacat

SEQ ID NO: 6969286 - DNA, 22 bp, Homo sapiens
atttcaggaatctgtatgaaag

SEQ ID NO: 6969287 - DNA, 22 bp, Homo sapiens
atccagaggcactgccctttgt

SEQ ID NO: 6969288 - DNA, 22 bp, Homo sapiens
tgtgggctgtactgagggcagg

SEQ ID NO: 6969289 - DNA, 22 bp, Homo sapiens
tctgtcactccctgatgatgaa

SEQ ID NO: 6969290 - DNA, 22 bp, Homo sapiens
acagtaaagccttctggttgac

SEQ ID NO: 6969291 - DNA, 22 bp, Homo sapiens
ttcgtcttttcttactatggtt

SEQ ID NO: 6969292 - DNA, 22 bp, Homo sapiens
aaacatctggttacctagggtc

SEQ ID NO: 6969293 - DNA, 22 bp, Homo sapiens
tcactgttgatgggcatgcagg

SEQ ID NO: 6969294 - DNA, 22 bp, Homo sapiens
tcaggacagccagggtgcagac

SEQ ID NO: 6969295 - DNA, 22 bp, Homo sapiens
acatatgaggtgttattctatg

SEQ ID NO: 6969296 - DNA, 22 bp, Homo sapiens
cagtgcaagctgatactgaggt

SEQ ID NO: 6969297 - DNA, 22 bp, Homo sapiens
tatttcaagaacttctatccat

SEQ ID NO: 6969298 - DNA, 22 bp, Homo sapiens
tcagcctctctgagtccagacc

SEQ ID NO: 6969299 - DNA, 20 bp, Homo sapiens
ccttccccacccgctgaggt

SEQ ID NO: 6969300 - DNA, 20 bp, Homo sapiens
aggcctgagagatgactggg

SEQ ID NO: 6969301 - DNA, 22 bp, Homo sapiens
cagatgcagcaaaatgacaggc

SEQ ID NO: 6969302 - DNA, 20 bp, Homo sapiens
caagccaggccctgctgctg

SEQ ID NO: 6969303 - DNA, 22 bp, Homo sapiens
cttcccttcctggggcaattta

SEQ ID NO: 6969304 - DNA, 22 bp, Homo sapiens
tcgttttaccaaattgaatgtt

SEQ ID NO: 6969305 - DNA, 22 bp, Homo sapiens
ctgcacctacagccacatttac

SEQ ID NO: 6969306 - DNA, 22 bp, Homo sapiens
acatagctcagcataatcgtgg

SEQ ID NO: 6969307 - DNA, 22 bp, Homo sapiens
tgtggtagagggcagatgggca

SEQ ID NO: 6969308 - DNA, 22 bp, Homo sapiens
ctgccaggcgatggattggctg

SEQ ID NO: 6969309 - DNA, 22 bp, Homo sapiens
ggaaacaaaccactcatggtgg

SEQ ID NO: 6969310 - DNA, 22 bp, Homo sapiens
ttcctaagagattggcagtgtt

SEQ ID NO: 6969311 - DNA, 22 bp, Homo sapiens
ggtcactgagctgtaattctgt

SEQ ID NO: 6969312 - DNA, 22 bp, Homo sapiens
cagatgaggcaacctcattgct

SEQ ID NO: 6969313 - DNA, 22 bp, Homo sapiens
agctgttccctcactgcagtca

SEQ ID NO: 6969314 - DNA, 22 bp, Homo sapiens
tggcacttggctgagaggttct

SEQ ID NO: 6969315 - DNA, 22 bp, Homo sapiens
tggccggccacctccagggttg

SEQ ID NO: 6969316 - DNA, 22 bp, Homo sapiens
cctgtctaccagtcacttagcg

SEQ ID NO: 6969317 - DNA, 22 bp, Homo sapiens
tgtctggatggtggagattgag

SEQ ID NO: 6969318 - DNA, 22 bp, Homo sapiens
caagtacaagggtgtcagttta

SEQ ID NO: 6969319 - DNA, 22 bp, Homo sapiens
ctctggctatctgtttctatgt

SEQ ID NO: 6969320 - DNA, 22 bp, Homo sapiens
actttcatttgtaataaacttc

SEQ ID NO: 6969321 - DNA, 22 bp, Homo sapiens
acattcatgggttttacattat

SEQ ID NO: 6969322 - DNA, 22 bp, Homo sapiens
ggctcctgaggaccaggcacag

SEQ ID NO: 6969323 - DNA, 22 bp, Homo sapiens
gaatcacagaggcaaattctga

SEQ ID NO: 6969324 - DNA, 22 bp, Homo sapiens
ctcagaatttagggctctgagg

SEQ ID NO: 6969325 - DNA, 22 bp, Homo sapiens
tctggcttccctctgttctggg

SEQ ID NO: 6969326 - DNA, 22 bp, Homo sapiens
cagccctcaggtcctcagcagc

SEQ ID NO: 6969327 - DNA, 22 bp, Homo sapiens
aaaacgttatgcattgtttatc

SEQ ID NO: 6969328 - DNA, 22 bp, Homo sapiens
cagctgctgcccttggctgcag

SEQ ID NO: 6969329 - DNA, 22 bp, Homo sapiens
attctgattcattaggtctagg

SEQ ID NO: 6969330 - DNA, 22 bp, Homo sapiens
cagtgacacgggctggcccacg

SEQ ID NO: 6969331 - DNA, 22 bp, Homo sapiens
tttacagtctctatagtcaaaa

SEQ ID NO: 6969332 - DNA, 22 bp, Homo sapiens
tgtctgtattagtcagcattct

SEQ ID NO: 6969333 - DNA, 22 bp, Homo sapiens
ctgaacactgagtctacctccc

SEQ ID NO: 6969334 - DNA, 22 bp, Homo sapiens
ggagatgccagaattgcaaatt

SEQ ID NO: 6969335 - DNA, 18 bp, Homo sapiens
gcagacactcgtggaggg

SEQ ID NO: 6969336 - DNA, 22 bp, Homo sapiens
ctgcaagggatcttcaggtagc

SEQ ID NO: 6969337 - DNA, 22 bp, Homo sapiens
ccacagaaagcctgggaagtgg

SEQ ID NO: 6969338 - DNA, 16 bp, Homo sapiens
aggagctgggtaggag

SEQ ID NO: 6969339 - DNA, 22 bp, Homo sapiens
ctgcatctctgctagtcagtca

SEQ ID NO: 6969340 - DNA, 19 bp, Homo sapiens
tgcctgtggcgagcatctt

SEQ ID NO: 6969341 - DNA, 22 bp, Homo sapiens
acaatgcttggtttttctagaa

SEQ ID NO: 6969342 - DNA, 23 bp, Homo sapiens
agagaaaaatatctgggcacatt

SEQ ID NO: 6969343 - DNA, 22 bp, Homo sapiens
aggtcagagcaatgtattgctt

SEQ ID NO: 6969344 - DNA, 22 bp, Homo sapiens
agctggtgtggatttttgaatg

SEQ ID NO: 6969345 - DNA, 22 bp, Homo sapiens
gagtcagaatgtcctcctgcgg

SEQ ID NO: 6969346 - DNA, 22 bp, Homo sapiens
aggtgacatcccggcagcagag

SEQ ID NO: 6969347 - DNA, 22 bp, Homo sapiens
tgacccttcaaatatcctcaaa

SEQ ID NO: 6969348 - DNA, 22 bp, Homo sapiens
agagatgggaaggcagacttca

SEQ ID NO: 6969349 - DNA, 22 bp, Homo sapiens
agcaggtgcatggcgagcgcgg

SEQ ID NO: 6969350 - DNA, 22 bp, Homo sapiens
ttgtactagaaaggatgtcaaa

SEQ ID NO: 6969351 - DNA, 22 bp, Homo sapiens
ttcattgaaatacagtcttgac

SEQ ID NO: 6969352 - DNA, 22 bp, Homo sapiens
tggtgccttgggcctacagcgc

SEQ ID NO: 6969353 - DNA, 22 bp, Homo sapiens
aaatcggttggttcaaggtaat

SEQ ID NO: 6969354 - DNA, 22 bp, Homo sapiens
caggagccctggtgggtggaca

SEQ ID NO: 6969355 - DNA, 17 bp, Homo sapiens
atgctctatagtcagtg

SEQ ID NO: 6969356 - DNA, 22 bp, Homo sapiens
ctggtagctcctgaatatccct

SEQ ID NO: 6969357 - DNA, 22 bp, Homo sapiens
gatgacagtgagtaaccccaac

SEQ ID NO: 6969358 - DNA, 22 bp, Homo sapiens
ccttctggaagctctaagggag

SEQ ID NO: 6969359 - DNA, 22 bp, Homo sapiens
gaagattacctgagaccacttg

SEQ ID NO: 6969360 - DNA, 22 bp, Homo sapiens
tacagtctttggaaagagatag

SEQ ID NO: 6969361 - DNA, 22 bp, Homo sapiens
tattcatcttcatagtcacagt

SEQ ID NO: 6969362 - DNA, 22 bp, Homo sapiens
gttgaatatacctgcatttgtg

SEQ ID NO: 6969363 - DNA, 22 bp, Homo sapiens
agactcctgctacataccttcc

SEQ ID NO: 6969364 - DNA, 20 bp, Homo sapiens
attccatagttggcactttt

SEQ ID NO: 6969365 - DNA, 22 bp, Homo sapiens
ctggccgcctggggccgggtga

SEQ ID NO: 6969366 - DNA, 22 bp, Homo sapiens
attgctgtgatgatgttctgag

SEQ ID NO: 6969367 - DNA, 22 bp, Homo sapiens
aggcacagagaagtaaagtatc

SEQ ID NO: 6969368 - DNA, 22 bp, Homo sapiens
gtggatggagcagtgacccagg

SEQ ID NO: 6969369 - DNA, 22 bp, Homo sapiens
ttttctttaatctggtggggtg

SEQ ID NO: 6969370 - DNA, 22 bp, Homo sapiens
agcagcttcagaggcgggcgca

SEQ ID NO: 6969371 - DNA, 22 bp, Homo sapiens
tcccactcagtccttttcagtt

SEQ ID NO: 6969372 - DNA, 22 bp, Homo sapiens
gggaccagaagaaggatggtga

SEQ ID NO: 6969373 - DNA, 22 bp, Homo sapiens
ctggcaggtatctaaagttgtc

SEQ ID NO: 6969374 - DNA, 22 bp, Homo sapiens
tcagtaatattctttaaaatac

SEQ ID NO: 6969375 - DNA, 23 bp, Homo sapiens
tgttctcttgtccaggccttaac

SEQ ID NO: 6969376 - DNA, 22 bp, Homo sapiens
tatgtattctcagatttactaa

SEQ ID NO: 6969377 - DNA, 22 bp, Homo sapiens
aaaagtaattgcaattttgtag

SEQ ID NO: 6969378 - DNA, 22 bp, Homo sapiens
cactgcactccagcctgggcaa

SEQ ID NO: 6969379 - DNA, 19 bp, Homo sapiens
gccctgcaggaggtggggc

SEQ ID NO: 6969380 - DNA, 23 bp, Homo sapiens
ggctagagtggaggggaactgca

SEQ ID NO: 6969381 - DNA, 22 bp, Homo sapiens
tcttgaaagtatcttattttgt

SEQ ID NO: 6969382 - DNA, 22 bp, Homo sapiens
tgaccagttaagtcatcctgtc

SEQ ID NO: 6969383 - DNA, 22 bp, Homo sapiens
aagagtttcttactggcatcta

SEQ ID NO: 6969384 - DNA, 22 bp, Homo sapiens
acagtgcagtgtgatgagtatt

SEQ ID NO: 6969385 - DNA, 22 bp, Homo sapiens
ggtcatgagggagcagtgcagg

SEQ ID NO: 6969386 - DNA, 22 bp, Homo sapiens
atcaagctggcatatgtagttc

SEQ ID NO: 6969387 - DNA, 22 bp, Homo sapiens
aattgtgctgtgatcaattact

SEQ ID NO: 6969388 - DNA, 22 bp, Homo sapiens
gtgttattagagcattaatttt

SEQ ID NO: 6969389 - DNA, 22 bp, Homo sapiens
aaaccattaggttttatctact

SEQ ID NO: 6969390 - DNA, 22 bp, Homo sapiens
ggctggttcagctagtgctgtt

SEQ ID NO: 6969391 - DNA, 22 bp, Homo sapiens
tcctgccttgcctgggacatca

SEQ ID NO: 6969392 - DNA, 22 bp, Homo sapiens
acatttcagtaagtgttaattt

SEQ ID NO: 6969393 - DNA, 23 bp, Homo sapiens
ccagggagtgctactatcaagcc

SEQ ID NO: 6969394 - DNA, 22 bp, Homo sapiens
agctgctgcgcctcaccctggc

SEQ ID NO: 6969395 - DNA, 22 bp, Homo sapiens
ggacagcccatacacatgtctg

SEQ ID NO: 6969396 - DNA, 22 bp, Homo sapiens
aggagtcataaatgtgaacaaa

SEQ ID NO: 6969397 - DNA, 21 bp, Homo sapiens
tccttatatttgaatacttta

SEQ ID NO: 6969398 - DNA, 22 bp, Homo sapiens
gtgacaggatagtcagctttgt

SEQ ID NO: 6969399 - DNA, 22 bp, Homo sapiens
aggaaccctgcgccatactttg

SEQ ID NO: 6969400 - DNA, 22 bp, Homo sapiens
agggaattcactggaacgccct

SEQ ID NO: 6969401 - DNA, 22 bp, Homo sapiens
tcagccttctgaggacctggga

SEQ ID NO: 6969402 - DNA, 22 bp, Homo sapiens
ttcagtctcaatttaagtttaa

SEQ ID NO: 6969403 - DNA, 22 bp, Homo sapiens
gctctagaaagaaggatgtggg

SEQ ID NO: 6969404 - DNA, 22 bp, Homo sapiens
gttatccatagaataagtcatc

SEQ ID NO: 6969405 - DNA, 22 bp, Homo sapiens
agatggtcttcataagttttaa

SEQ ID NO: 6969406 - DNA, 23 bp, Homo sapiens
gcttgctcattctatcacacagc

SEQ ID NO: 6969407 - DNA, 20 bp, Homo sapiens
ggccacagggtgctggtgga

SEQ ID NO: 6969408 - DNA, 22 bp, Homo sapiens
tgagatgatgggataagagggc

SEQ ID NO: 6969409 - DNA, 19 bp, Homo sapiens
acatttggcattttctctt

SEQ ID NO: 6969410 - DNA, 23 bp, Homo sapiens
gctgactgtgaaattctggagct

SEQ ID NO: 6969411 - DNA, 22 bp, Homo sapiens
ctctgccatcagtttttctttg

SEQ ID NO: 6969412 - DNA, 22 bp, Homo sapiens
ctctctgatttgcttggagaca

SEQ ID NO: 6969413 - DNA, 22 bp, Homo sapiens
tcacaaaggatgatgaattctg

SEQ ID NO: 6969414 - DNA, 22 bp, Homo sapiens
cttgagaaaggaacaggaagct

SEQ ID NO: 6969415 - DNA, 22 bp, Homo sapiens
ccagggcagcgcccctccacgc

SEQ ID NO: 6969416 - DNA, 22 bp, Homo sapiens
gaggagctgcccgtgtgtctgc

SEQ ID NO: 6969417 - DNA, 22 bp, Homo sapiens
gagatccacttaatttttttgc

SEQ ID NO: 6969418 - DNA, 22 bp, Homo sapiens
ttggtcttgagtggcttgttaa

SEQ ID NO: 6969419 - DNA, 22 bp, Homo sapiens
aacatgatggggaagaacaaga

SEQ ID NO: 6969420 - DNA, 22 bp, Homo sapiens
tgcttagctcataggaaacact

SEQ ID NO: 6969421 - DNA, 22 bp, Homo sapiens
ggtgggtgcagggggcttctta

SEQ ID NO: 6969422 - DNA, 22 bp, Homo sapiens
gatttcagccctgggggtcatt

SEQ ID NO: 6969423 - DNA, 23 bp, Homo sapiens
atagtctgcgcaactgagagagg

SEQ ID NO: 6969424 - DNA, 22 bp, Homo sapiens
atttcatgttaactgaacagaa

SEQ ID NO: 6969425 - DNA, 22 bp, Homo sapiens
aagccctgactatgaagacata

SEQ ID NO: 6969426 - DNA, 22 bp, Homo sapiens
tcctgtgggctctcggcctcca

SEQ ID NO: 6969427 - DNA, 22 bp, Homo sapiens
cagaataaaaactcctatgtct

SEQ ID NO: 6969428 - DNA, 22 bp, Homo sapiens
tgtacaatcttggtccctttat

SEQ ID NO: 6969429 - DNA, 22 bp, Homo sapiens
attagagagagcatattactgg

SEQ ID NO: 6969430 - DNA, 22 bp, Homo sapiens
tctaaggccttcatgtcagtat

SEQ ID NO: 6969431 - DNA, 22 bp, Homo sapiens
ttgaaagcaggagacacccaga

SEQ ID NO: 6969432 - DNA, 22 bp, Homo sapiens
cagctgagttactctgaggtct

SEQ ID NO: 6969433 - DNA, 22 bp, Homo sapiens
ggaaatgtcatagaaatataag

SEQ ID NO: 6969434 - DNA, 22 bp, Homo sapiens
ggaaacacatgatcagacatct

SEQ ID NO: 6969435 - DNA, 22 bp, Homo sapiens
gagcaatagcaccaattaactc

SEQ ID NO: 6969436 - DNA, 23 bp, Homo sapiens
tgacagagcacagtgggggagat

SEQ ID NO: 6969437 - DNA, 22 bp, Homo sapiens
ggttttcacctccagaatgtgc

SEQ ID NO: 6969438 - DNA, 22 bp, Homo sapiens
tggcagctccgggtaggggctg

SEQ ID NO: 6969439 - DNA, 22 bp, Homo sapiens
gctggcagagacaagaagacta

SEQ ID NO: 6969440 - DNA, 22 bp, Homo sapiens
ggtgcagcctttgtttctactt

SEQ ID NO: 6969441 - DNA, 22 bp, Homo sapiens
acaaaattacctagttattttc

SEQ ID NO: 6969442 - DNA, 19 bp, Homo sapiens
ggcagagctcctgctttct

SEQ ID NO: 6969443 - DNA, 22 bp, Homo sapiens
atctgttttgatacagttttat

SEQ ID NO: 6969444 - DNA, 22 bp, Homo sapiens
tcagaagaaaagacttttagag

SEQ ID NO: 6969445 - DNA, 22 bp, Homo sapiens
tcagaaagcttttacttaaaca

SEQ ID NO: 6969446 - DNA, 23 bp, Homo sapiens
tgagaagccaggggagcgtgagg

SEQ ID NO: 6969447 - DNA, 22 bp, Homo sapiens
tggccttttctttcacaggcaa

SEQ ID NO: 6969448 - DNA, 22 bp, Homo sapiens
tttgttcacatttaggactctc

SEQ ID NO: 6969449 - DNA, 22 bp, Homo sapiens
tggtaatactcatggcctgtca

SEQ ID NO: 6969450 - DNA, 22 bp, Homo sapiens
agacccttgtaatgactgtgag

SEQ ID NO: 6969451 - DNA, 22 bp, Homo sapiens
tggctctgccccatacccctgc

SEQ ID NO: 6969452 - DNA, 22 bp, Homo sapiens
agcagcatggatgggcctcagc

SEQ ID NO: 6969453 - DNA, 22 bp, Homo sapiens
gaacctttttccaagtaaacaa

SEQ ID NO: 6969454 - DNA, 22 bp, Homo sapiens
ctgtactaattgctttacatgt

SEQ ID NO: 6969455 - DNA, 18 bp, Homo sapiens
aatggctgggttgttgcc

SEQ ID NO: 6969456 - DNA, 22 bp, Homo sapiens
gctgactggttgcacagagggt

SEQ ID NO: 6969457 - DNA, 22 bp, Homo sapiens
acaaagatgtttaaagcattta

SEQ ID NO: 6969458 - DNA, 22 bp, Homo sapiens
gaaacaggtggcaggctagatt

SEQ ID NO: 6969459 - DNA, 22 bp, Homo sapiens
gtattgctagcgggagaagtgg

SEQ ID NO: 6969460 - DNA, 22 bp, Homo sapiens
tacagaatatagaagctggaag

SEQ ID NO: 6969461 - DNA, 22 bp, Homo sapiens
agaacaatgttaaattattaag

SEQ ID NO: 6969462 - DNA, 22 bp, Homo sapiens
gtttcctatgtccattgaggga

SEQ ID NO: 6969463 - DNA, 22 bp, Homo sapiens
tgcagcattattcacagtagcc

SEQ ID NO: 6969464 - DNA, 22 bp, Homo sapiens
ggctgcctcaaagctcaagctc

SEQ ID NO: 6969465 - DNA, 22 bp, Homo sapiens
atggagtctacaaagtgttgga

SEQ ID NO: 6969466 - DNA, 22 bp, Homo sapiens
gcggctgccgagacaagccggt

SEQ ID NO: 6969467 - DNA, 18 bp, Homo sapiens
ccatagagtgtttatact

SEQ ID NO: 6969468 - DNA, 22 bp, Homo sapiens
acctttcaaagtggctatcact

SEQ ID NO: 6969469 - DNA, 23 bp, Homo sapiens
tttatgctatactggaagggaaa

SEQ ID NO: 6969470 - DNA, 22 bp, Homo sapiens
tgagatacagcttgtgacttgg

SEQ ID NO: 6969471 - DNA, 22 bp, Homo sapiens
ccagagaaagctcacaggcagt

SEQ ID NO: 6969472 - DNA, 22 bp, Homo sapiens
gctgagaggcactatctccgga

SEQ ID NO: 6969473 - DNA, 22 bp, Homo sapiens
ccagtctgttctcacctctgag

SEQ ID NO: 6969474 - DNA, 22 bp, Homo sapiens
tgaggctcattctgcatgccaa

SEQ ID NO: 6969475 - DNA, 22 bp, Homo sapiens
gtatgctgcctacgaacatgca

SEQ ID NO: 6969476 - DNA, 22 bp, Homo sapiens
gaggtcctgtctgagaatggag

SEQ ID NO: 6969477 - DNA, 22 bp, Homo sapiens
gatgacagcagctgtggctcac

SEQ ID NO: 6969478 - DNA, 22 bp, Homo sapiens
ccttgcagttgttactgtagcc

SEQ ID NO: 6969479 - DNA, 22 bp, Homo sapiens
aggcactttccttgaggagttt

SEQ ID NO: 6969480 - DNA, 22 bp, Homo sapiens
agaggatggttgaggaagacct

SEQ ID NO: 6969481 - DNA, 22 bp, Homo sapiens
agccactgtaaggggaattgcc

SEQ ID NO: 6969482 - DNA, 22 bp, Homo sapiens
gcttacctatgccttatacagt

SEQ ID NO: 6969483 - DNA, 22 bp, Homo sapiens
agggcagctctcacctctggcc

SEQ ID NO: 6969484 - DNA, 22 bp, Homo sapiens
gcacccagtttgtctcagggtt

SEQ ID NO: 6969485 - DNA, 22 bp, Homo sapiens
attatgctcacctggcaacttg

SEQ ID NO: 6969486 - DNA, 22 bp, Homo sapiens
gccaggtcacagggataaatgg

SEQ ID NO: 6969487 - DNA, 22 bp, Homo sapiens
ctgagctgggactcagtagcaa

SEQ ID NO: 6969488 - DNA, 22 bp, Homo sapiens
taaaaccataaggctggaagga

SEQ ID NO: 6969489 - DNA, 19 bp, Homo sapiens
tcttttcacgcattttgaa

SEQ ID NO: 6969490 - DNA, 22 bp, Homo sapiens
agagaattggagcagtgacagg

SEQ ID NO: 6969491 - DNA, 22 bp, Homo sapiens
aacttctcaactagcttagagt

SEQ ID NO: 6969492 - DNA, 22 bp, Homo sapiens
atagcaaagatcacttccttga

SEQ ID NO: 6969493 - DNA, 22 bp, Homo sapiens
gatgacaagatctggatttgaa

SEQ ID NO: 6969494 - DNA, 22 bp, Homo sapiens
gctccactgtcccatgggactt

SEQ ID NO: 6969495 - DNA, 22 bp, Homo sapiens
gacattcagactcacatggagg

SEQ ID NO: 6969496 - DNA, 22 bp, Homo sapiens
aaagcaattacaaaagggataa

SEQ ID NO: 6969497 - DNA, 22 bp, Homo sapiens
cagcaccattttcctggtcagc

SEQ ID NO: 6969498 - DNA, 22 bp, Homo sapiens
gcacaattgacattttgggcca

SEQ ID NO: 6969499 - DNA, 22 bp, Homo sapiens
gaggtatgttatttcttgaaac

SEQ ID NO: 6969500 - DNA, 22 bp, Homo sapiens
aggcacctcatagccagccccc

SEQ ID NO: 6969501 - DNA, 22 bp, Homo sapiens
gtgactctgtttctgaaaacag

SEQ ID NO: 6969502 - DNA, 22 bp, Homo sapiens
cacatctatggagacagagagt

SEQ ID NO: 6969503 - DNA, 22 bp, Homo sapiens
tgcttcatttccttatattgta

SEQ ID NO: 6969504 - DNA, 22 bp, Homo sapiens
agcttgcagtttctgctgtttt

SEQ ID NO: 6969505 - DNA, 22 bp, Homo sapiens
cactttgggtttatgtcaatca

SEQ ID NO: 6969506 - DNA, 22 bp, Homo sapiens
gcgggccggttcgatccgtatg

SEQ ID NO: 6969507 - DNA, 22 bp, Homo sapiens
cagagctctatgttcatggagg

SEQ ID NO: 6969508 - DNA, 22 bp, Homo sapiens
gaggcctgggttacctactcgt

SEQ ID NO: 6969509 - DNA, 22 bp, Homo sapiens
tcccagaacgggttcttcccag

SEQ ID NO: 6969510 - DNA, 22 bp, Homo sapiens
cctggacagagggcagcggcca

SEQ ID NO: 6969511 - DNA, 22 bp, Homo sapiens
actgactcttgttaacttcagc

SEQ ID NO: 6969512 - DNA, 22 bp, Homo sapiens
gcagagctcaaggtgttcagct

SEQ ID NO: 6969513 - DNA, 22 bp, Homo sapiens
agctgttggctggctgagctct

SEQ ID NO: 6969514 - DNA, 22 bp, Homo sapiens
ttggaacagaaacagacaaata

SEQ ID NO: 6969515 - DNA, 22 bp, Homo sapiens
gtaccatgggatctagggccca

SEQ ID NO: 6969516 - DNA, 20 bp, Homo sapiens
agctaaccctactttctttg

SEQ ID NO: 6969517 - DNA, 22 bp, Homo sapiens
atctgtaacactaagggcaaag

SEQ ID NO: 6969518 - DNA, 22 bp, Homo sapiens
ccagatgggaagaagcatgact

SEQ ID NO: 6969519 - DNA, 22 bp, Homo sapiens
ctgagggcttccttgtcccggg

SEQ ID NO: 6969520 - DNA, 22 bp, Homo sapiens
tccctgtattcgaaagtgatcg

SEQ ID NO: 6969521 - DNA, 22 bp, Homo sapiens
agcagctgccactggaatagga

SEQ ID NO: 6969522 - DNA, 22 bp, Homo sapiens
catttaagagaaatatttagtt

SEQ ID NO: 6969523 - DNA, 22 bp, Homo sapiens
ctccagtgcgtcttagtaaacc

SEQ ID NO: 6969524 - DNA, 22 bp, Homo sapiens
tccagtggtagtaaagaggtct

SEQ ID NO: 6969525 - DNA, 22 bp, Homo sapiens
cctcagcccctgaatggagaga

SEQ ID NO: 6969526 - DNA, 22 bp, Homo sapiens
gatattctattttagccagcta

SEQ ID NO: 6969527 - DNA, 22 bp, Homo sapiens
ttgttcttagtatgcattgttt

SEQ ID NO: 6969528 - DNA, 22 bp, Homo sapiens
acccaggctggcgtgcagtggc

SEQ ID NO: 6969529 - DNA, 22 bp, Homo sapiens
ctagaggctcagcagatgcctg

SEQ ID NO: 6969530 - DNA, 22 bp, Homo sapiens
cttcacagatgctgagagggct

SEQ ID NO: 6969531 - DNA, 22 bp, Homo sapiens
ccttttatagatcagtgtgtta

SEQ ID NO: 6969532 - DNA, 22 bp, Homo sapiens
gctctgagaagtattatttctt

SEQ ID NO: 6969533 - DNA, 22 bp, Homo sapiens
agttaactctgaaaagacattt

SEQ ID NO: 6969534 - DNA, 22 bp, Homo sapiens
cagatagcaatttgggcagggg

SEQ ID NO: 6969535 - DNA, 22 bp, Homo sapiens
cacatgagtcctgccaggtatg

SEQ ID NO: 6969536 - DNA, 22 bp, Homo sapiens
agtagccatttcatgagtttgt

SEQ ID NO: 6969537 - DNA, 22 bp, Homo sapiens
cgcggggctggaaaggaacttc

SEQ ID NO: 6969538 - DNA, 22 bp, Homo sapiens
atgtccagagtaaagcacattc

SEQ ID NO: 6969539 - DNA, 22 bp, Homo sapiens
tttcagttagctgagacccagg

SEQ ID NO: 6969540 - DNA, 22 bp, Homo sapiens
ttgctcatactcatgttgtgat

SEQ ID NO: 6969541 - DNA, 19 bp, Homo sapiens
actgcctgaggctcacagg

SEQ ID NO: 6969542 - DNA, 22 bp, Homo sapiens
tgcagaggtgtgcattcttaag

SEQ ID NO: 6969543 - DNA, 22 bp, Homo sapiens
attacagattataaatttgagc

SEQ ID NO: 6969544 - DNA, 22 bp, Homo sapiens
tcaaaagaaacaccatgttcct

SEQ ID NO: 6969545 - DNA, 20 bp, Homo sapiens
ctgacccaatctctgtcccc

SEQ ID NO: 6969546 - DNA, 22 bp, Homo sapiens
ttgaggagtgtttagggtgagg

SEQ ID NO: 6969547 - DNA, 21 bp, Homo sapiens
atagaacaccaggcatatata

SEQ ID NO: 6969548 - DNA, 22 bp, Homo sapiens
ttcacagatttccctgcacatg

SEQ ID NO: 6969549 - DNA, 22 bp, Homo sapiens
tatcctgttttacctggcacag

SEQ ID NO: 6969550 - DNA, 22 bp, Homo sapiens
gcatcatcacggtcaccgagcc

SEQ ID NO: 6969551 - DNA, 22 bp, Homo sapiens
actcatctgaaaaatgaggaga

SEQ ID NO: 6969552 - DNA, 22 bp, Homo sapiens
cacagtatgatctaaagtaagt

SEQ ID NO: 6969553 - DNA, 22 bp, Homo sapiens
acctttcagtgccctttctgtc

SEQ ID NO: 6969554 - DNA, 22 bp, Homo sapiens
gaagattgaaggctgggaatta

SEQ ID NO: 6969555 - DNA, 22 bp, Homo sapiens
ttctggaagttggaaatagcag

SEQ ID NO: 6969556 - DNA, 22 bp, Homo sapiens
gacagtatccaggtggtgaaga

SEQ ID NO: 6969557 - DNA, 22 bp, Homo sapiens
gactgttacctatatttatgtg

SEQ ID NO: 6969558 - DNA, 22 bp, Homo sapiens
cagctggcgggcagagccgcca

SEQ ID NO: 6969559 - DNA, 22 bp, Homo sapiens
catgggcccgtgagaggcaggg

SEQ ID NO: 6969560 - DNA, 22 bp, Homo sapiens
gcttctgatgtcagacttctgg

SEQ ID NO: 6969561 - DNA, 22 bp, Homo sapiens
tacctctggacattgtggagca

SEQ ID NO: 6969562 - DNA, 22 bp, Homo sapiens
ttctagttacagaagccttgct

SEQ ID NO: 6969563 - DNA, 19 bp, Homo sapiens
ctggcagcctgtctgtgtc

SEQ ID NO: 6969564 - DNA, 22 bp, Homo sapiens
gccctgccgggtattttgtgct

SEQ ID NO: 6969565 - DNA, 22 bp, Homo sapiens
agagtttgaattttgaaaagat

SEQ ID NO: 6969566 - DNA, 22 bp, Homo sapiens
ccacatgaatcttggaagcagg

SEQ ID NO: 6969567 - DNA, 22 bp, Homo sapiens
ctgctgctcagtgtcatcatgt

SEQ ID NO: 6969568 - DNA, 22 bp, Homo sapiens
tacataggtacagcctttttta

SEQ ID NO: 6969569 - DNA, 19 bp, Homo sapiens
gctctgctactattaccac

SEQ ID NO: 6969570 - DNA, 16 bp, Homo sapiens
tacaatgtagaaaaca

SEQ ID NO: 6969571 - DNA, 22 bp, Homo sapiens
cagcttcagcgtgacaccagtg

SEQ ID NO: 6969572 - DNA, 22 bp, Homo sapiens
agccaagaggagcctaaagcga

SEQ ID NO: 6969573 - DNA, 22 bp, Homo sapiens
atgcagaaggagccatgcttgc

SEQ ID NO: 6969574 - DNA, 22 bp, Homo sapiens
aggcagctctgtggcctcccag

SEQ ID NO: 6969575 - DNA, 22 bp, Homo sapiens
cagtagtggaagggagagaaaa

SEQ ID NO: 6969576 - DNA, 22 bp, Homo sapiens
tggcctttgttgatagctatgc

SEQ ID NO: 6969577 - DNA, 22 bp, Homo sapiens
tgtgaagcccagagaggttcac

SEQ ID NO: 6969578 - DNA, 22 bp, Homo sapiens
tttaggcttggtgatattctta

SEQ ID NO: 6969579 - DNA, 22 bp, Homo sapiens
cattcatatttgcagtatacct

SEQ ID NO: 6969580 - DNA, 22 bp, Homo sapiens
ggatcctaaacttcggcatgcc

SEQ ID NO: 6969581 - DNA, 22 bp, Homo sapiens
atgaaactgaaggacaaccaga

SEQ ID NO: 6969582 - DNA, 22 bp, Homo sapiens
ggaaggtcgagctgcatctggc

SEQ ID NO: 6969583 - DNA, 22 bp, Homo sapiens
agtctttggttataagagacag

SEQ ID NO: 6969584 - DNA, 22 bp, Homo sapiens
aatgatacatatgtatcgttag

SEQ ID NO: 6969585 - DNA, 22 bp, Homo sapiens
caccattctgaggagagtggat

SEQ ID NO: 6969586 - DNA, 22 bp, Homo sapiens
ctggttttccaatgttttgact

SEQ ID NO: 6969587 - DNA, 22 bp, Homo sapiens
ttctggctttacttcccatcca

SEQ ID NO: 6969588 - DNA, 22 bp, Homo sapiens
catcctgaaagaaacatttcct

SEQ ID NO: 6969589 - DNA, 22 bp, Homo sapiens
taaattgagattattagggtaa

SEQ ID NO: 6969590 - DNA, 22 bp, Homo sapiens
aagtaaaacacacagtccaccg

SEQ ID NO: 6969591 - DNA, 22 bp, Homo sapiens
atctgtcaagatagactctgca

SEQ ID NO: 6969592 - DNA, 22 bp, Homo sapiens
aaaggacacacaggaggtgtct

SEQ ID NO: 6969593 - DNA, 22 bp, Homo sapiens
tccaggctgatccatgaagaat

SEQ ID NO: 6969594 - DNA, 22 bp, Homo sapiens
aggaatgacaggcctcccgcag

SEQ ID NO: 6969595 - DNA, 22 bp, Homo sapiens
tattgtgaatagtgccgcaata

SEQ ID NO: 6969596 - DNA, 22 bp, Homo sapiens
tattggtagatggagagagaca

SEQ ID NO: 6969597 - DNA, 22 bp, Homo sapiens
agtcaagattctggcactagca

SEQ ID NO: 6969598 - DNA, 22 bp, Homo sapiens
tacatattgtccatagttgctt

SEQ ID NO: 6969599 - DNA, 22 bp, Homo sapiens
ggatgtcgaggatggggtagca

SEQ ID NO: 6969600 - DNA, 22 bp, Homo sapiens
agcctctctgttagtcactggg

SEQ ID NO: 6969601 - DNA, 22 bp, Homo sapiens
aaatgcttattagtgtcacaaa

SEQ ID NO: 6969602 - DNA, 22 bp, Homo sapiens
ttgtttatgtaattggcacact

SEQ ID NO: 6969603 - DNA, 21 bp, Homo sapiens
attgctctgttgtgtctagaa

SEQ ID NO: 6969604 - DNA, 22 bp, Homo sapiens
aaggcaatttggaagaggcaga

SEQ ID NO: 6969605 - DNA, 22 bp, Homo sapiens
cagcatttggtgatcatcttaa

SEQ ID NO: 6969606 - DNA, 22 bp, Homo sapiens
tacagcttttcatatttgtgtt

SEQ ID NO: 6969607 - DNA, 22 bp, Homo sapiens
gctgaagtgtggagtgacagtt

SEQ ID NO: 6969608 - DNA, 22 bp, Homo sapiens
taaagaatagatgggtagggag

SEQ ID NO: 6969609 - DNA, 22 bp, Homo sapiens
tttgttcattagtacagttgta

SEQ ID NO: 6969610 - DNA, 22 bp, Homo sapiens
tcagtccagctcctcatttccc

SEQ ID NO: 6969611 - DNA, 19 bp, Homo sapiens
cccaggaagcggaggttgc

SEQ ID NO: 6969612 - DNA, 22 bp, Homo sapiens
taatgcagtactgatataaaca

SEQ ID NO: 6969613 - DNA, 22 bp, Homo sapiens
tgcaggagcttggctctgtccc

SEQ ID NO: 6969614 - DNA, 22 bp, Homo sapiens
agagactgatggatcaccaaat

SEQ ID NO: 6969615 - DNA, 22 bp, Homo sapiens
tcctggcagaaatggggctgtg

SEQ ID NO: 6969616 - DNA, 22 bp, Homo sapiens
tgcaggactggggagcggaagg

SEQ ID NO: 6969617 - DNA, 19 bp, Homo sapiens
agcagttatatgcatggga

SEQ ID NO: 6969618 - DNA, 22 bp, Homo sapiens
gattcactcatattttacgttt

SEQ ID NO: 6969619 - DNA, 22 bp, Homo sapiens
tctcattattgtattcttagtt

SEQ ID NO: 6969620 - DNA, 22 bp, Homo sapiens
gggaagatagtgttgagggccc

SEQ ID NO: 6969621 - DNA, 22 bp, Homo sapiens
ttgtaaacttgtttgaaggtat

SEQ ID NO: 6969622 - DNA, 23 bp, Homo sapiens
ataataattatggcagcaaagtg

SEQ ID NO: 6969623 - DNA, 22 bp, Homo sapiens
ggaccagagggatgacatttgg

SEQ ID NO: 6969624 - DNA, 22 bp, Homo sapiens
accaggcttgataccaagaaat

SEQ ID NO: 6969625 - DNA, 22 bp, Homo sapiens
aacctcataggacttgaacata

SEQ ID NO: 6969626 - DNA, 22 bp, Homo sapiens
cacagtgtttgatttaggggcc

SEQ ID NO: 6969627 - DNA, 22 bp, Homo sapiens
gaggctgcaggcaatgctgccc

SEQ ID NO: 6969628 - DNA, 22 bp, Homo sapiens
tgcaggtgaaaattatgaggat

SEQ ID NO: 6969629 - DNA, 22 bp, Homo sapiens
ctttctcagtgttaattacttt

SEQ ID NO: 6969630 - DNA, 22 bp, Homo sapiens
gctggaaggctaggctcagttg

SEQ ID NO: 6969631 - DNA, 22 bp, Homo sapiens
aactcagttttctgtggcctca

SEQ ID NO: 6969632 - DNA, 22 bp, Homo sapiens
gaagcttgagaactactgtcct

SEQ ID NO: 6969633 - DNA, 21 bp, Homo sapiens
tcagggcagctgctcttcaga

SEQ ID NO: 6969634 - DNA, 22 bp, Homo sapiens
cttccaggtccttcttgagaag

SEQ ID NO: 6969635 - DNA, 22 bp, Homo sapiens
aatgttcagtgcctttaaacat

SEQ ID NO: 6969636 - DNA, 22 bp, Homo sapiens
gagccaggaggcagagactgca

SEQ ID NO: 6969637 - DNA, 22 bp, Homo sapiens
gctaccaagaaaatctaggaga

SEQ ID NO: 6969638 - DNA, 22 bp, Homo sapiens
tcccagggcagctgtccagaag

SEQ ID NO: 6969639 - DNA, 22 bp, Homo sapiens
gcatggcagtgaggatggtgct

SEQ ID NO: 6969640 - DNA, 20 bp, Homo sapiens
ccctggcctgtttcatgccc

SEQ ID NO: 6969641 - DNA, 22 bp, Homo sapiens
gtctgtccaggtgaatgcttca

SEQ ID NO: 6969642 - DNA, 22 bp, Homo sapiens
aattccaaatcaactagtctag

SEQ ID NO: 6969643 - DNA, 22 bp, Homo sapiens
atttctcagtaggtgcacagtg

SEQ ID NO: 6969644 - DNA, 18 bp, Homo sapiens
agtaaagcttattacatg

SEQ ID NO: 6969645 - DNA, 22 bp, Homo sapiens
ggatgacagatgcaggctttga

SEQ ID NO: 6969646 - DNA, 22 bp, Homo sapiens
agtaaaatttctgctgaggaga

SEQ ID NO: 6969647 - DNA, 22 bp, Homo sapiens
tagttgacatcatcagcctgga

SEQ ID NO: 6969648 - DNA, 22 bp, Homo sapiens
ccatgcatatgcacgtaaatta

SEQ ID NO: 6969649 - DNA, 23 bp, Homo sapiens
aatctatacttaggctggtaata

SEQ ID NO: 6969650 - DNA, 22 bp, Homo sapiens
acacagatgatgttccaggaac

SEQ ID NO: 6969651 - DNA, 22 bp, Homo sapiens
atgcctgtgggaaaaacttgtt

SEQ ID NO: 6969652 - DNA, 22 bp, Homo sapiens
ttacagtctggattaggaaaca

SEQ ID NO: 6969653 - DNA, 22 bp, Homo sapiens
tgctgggggtagctctgcgtag

SEQ ID NO: 6969654 - DNA, 22 bp, Homo sapiens
ctaaatctagtctttactgatt

SEQ ID NO: 6969655 - DNA, 21 bp, Homo sapiens
ggcatctcttagtatcaccat

SEQ ID NO: 6969656 - DNA, 22 bp, Homo sapiens
tctgagctagtgatttataaga

SEQ ID NO: 6969657 - DNA, 22 bp, Homo sapiens
gagtaatgctcaaggtctgttt

SEQ ID NO: 6969658 - DNA, 22 bp, Homo sapiens
cagccctgtctatgactgatga

SEQ ID NO: 6969659 - DNA, 22 bp, Homo sapiens
aggtgacattcagagaacattt

SEQ ID NO: 6969660 - DNA, 19 bp, Homo sapiens
cctcccacggattccttcc

SEQ ID NO: 6969661 - DNA, 22 bp, Homo sapiens
gccaggtgtcctcacagtgagg

SEQ ID NO: 6969662 - DNA, 22 bp, Homo sapiens
ggacagtctttcctcattcctt

SEQ ID NO: 6969663 - DNA, 22 bp, Homo sapiens
gatttggtggctacatttgtaa

SEQ ID NO: 6969664 - DNA, 22 bp, Homo sapiens
taatcacatcagggtaaatggg

SEQ ID NO: 6969665 - DNA, 22 bp, Homo sapiens
tgactttaagctatctgattct

SEQ ID NO: 6969666 - DNA, 22 bp, Homo sapiens
actgagagggaggctgtccggt

SEQ ID NO: 6969667 - DNA, 22 bp, Homo sapiens
acttcccacaccctgttttctc

SEQ ID NO: 6969668 - DNA, 22 bp, Homo sapiens
ttctggctcatatgctaagaag

SEQ ID NO: 6969669 - DNA, 22 bp, Homo sapiens
agccacaggaaacagagacagc

SEQ ID NO: 6969670 - DNA, 22 bp, Homo sapiens
tgtacacatatcatttgtggga

SEQ ID NO: 6969671 - DNA, 22 bp, Homo sapiens
gggcagctgtcttggttctcaa

SEQ ID NO: 6969672 - DNA, 22 bp, Homo sapiens
agcaggcatagagtagcactca

SEQ ID NO: 6969673 - DNA, 22 bp, Homo sapiens
agcttgaattattctgctctta

SEQ ID NO: 6969674 - DNA, 22 bp, Homo sapiens
taaagatgcccacattgcaggt

SEQ ID NO: 6969675 - DNA, 22 bp, Homo sapiens
tagctgaaggctacagcagaac

SEQ ID NO: 6969676 - DNA, 22 bp, Homo sapiens
taaactactaggatgaattttt

SEQ ID NO: 6969677 - DNA, 22 bp, Homo sapiens
cagggctagtgacaccccagtc

SEQ ID NO: 6969678 - DNA, 22 bp, Homo sapiens
tgacgtgtgtccccatttcaag

SEQ ID NO: 6969679 - DNA, 22 bp, Homo sapiens
tatcagtccagggttttgtgac

SEQ ID NO: 6969680 - DNA, 22 bp, Homo sapiens
tggctcagctgtcacagcctgg

SEQ ID NO: 6969681 - DNA, 22 bp, Homo sapiens
gtttgagaacaaaaggggacct

SEQ ID NO: 6969682 - DNA, 22 bp, Homo sapiens
tagcttctggagtgtttgaaaa

SEQ ID NO: 6969683 - DNA, 22 bp, Homo sapiens
ttcagaaacatcagtggatgga

SEQ ID NO: 6969684 - DNA, 22 bp, Homo sapiens
ctgagttctaggctgccacctt

SEQ ID NO: 6969685 - DNA, 22 bp, Homo sapiens
aattatacaattgtcaagttct

SEQ ID NO: 6969686 - DNA, 22 bp, Homo sapiens
ggaggaggcaagtaccagatgc

SEQ ID NO: 6969687 - DNA, 22 bp, Homo sapiens
tcagctctgtgtacagttagca

SEQ ID NO: 6969688 - DNA, 20 bp, Homo sapiens
agagattttagtagccacag

SEQ ID NO: 6969689 - DNA, 22 bp, Homo sapiens
cacacctcacacctcgcatgct

SEQ ID NO: 6969690 - DNA, 22 bp, Homo sapiens
agacagacattctagagccacc

SEQ ID NO: 6969691 - DNA, 21 bp, Homo sapiens
ttttgctgttttagaatgaga

SEQ ID NO: 6969692 - DNA, 22 bp, Homo sapiens
cagcaggaagtactagctttga

SEQ ID NO: 6969693 - DNA, 22 bp, Homo sapiens
cagaggaaatgggaaggagata

SEQ ID NO: 6969694 - DNA, 22 bp, Homo sapiens
agctgtctttctgcctcctgat

SEQ ID NO: 6969695 - DNA, 22 bp, Homo sapiens
tgagtttaatggggccctttga

SEQ ID NO: 6969696 - DNA, 22 bp, Homo sapiens
acatagatggggtgtcatgtca

SEQ ID NO: 6969697 - DNA, 22 bp, Homo sapiens
gtctgtctgccaggttaggctg

SEQ ID NO: 6969698 - DNA, 22 bp, Homo sapiens
ggttgcatttctcagtggaata

SEQ ID NO: 6969699 - DNA, 19 bp, Homo sapiens
tctttgtacaagtctctgc

SEQ ID NO: 6969700 - DNA, 22 bp, Homo sapiens
tttgactgagttctttgatgaa

SEQ ID NO: 6969701 - DNA, 22 bp, Homo sapiens
ggtggtggtcccgacttgggag

SEQ ID NO: 6969702 - DNA, 22 bp, Homo sapiens
atgaaaatactgtggttgatag

SEQ ID NO: 6969703 - DNA, 22 bp, Homo sapiens
cagctttgattcactgcctagt

SEQ ID NO: 6969704 - DNA, 22 bp, Homo sapiens
cagcatgaaaagaataggccta

SEQ ID NO: 6969705 - DNA, 22 bp, Homo sapiens
agtcagcattttcactgagcta

SEQ ID NO: 6969706 - DNA, 22 bp, Homo sapiens
ttttattagtggctagatgggg

SEQ ID NO: 6969707 - DNA, 22 bp, Homo sapiens
tgctggctttttggtccttgct

SEQ ID NO: 6969708 - DNA, 22 bp, Homo sapiens
tgagcctgcaataagcacagcc

SEQ ID NO: 6969709 - DNA, 22 bp, Homo sapiens
tatgaggttttggatctgtgtt

SEQ ID NO: 6969710 - DNA, 22 bp, Homo sapiens
tcaacaagagcccatgcttttt

SEQ ID NO: 6969711 - DNA, 22 bp, Homo sapiens
gaggcacagagtaggtgcacac

SEQ ID NO: 6969712 - DNA, 18 bp, Homo sapiens
atatgcttgagctaagga

SEQ ID NO: 6969713 - DNA, 19 bp, Homo sapiens
cttgggcatatctgaggca

SEQ ID NO: 6969714 - DNA, 22 bp, Homo sapiens
ctaccggtccacggtttaaatg

SEQ ID NO: 6969715 - DNA, 21 bp, Homo sapiens
agattcacacccaggccagct

SEQ ID NO: 6969716 - DNA, 22 bp, Homo sapiens
tggatatccttgttaactttct

SEQ ID NO: 6969717 - DNA, 22 bp, Homo sapiens
ccaaagtgtgggagaagaggta

SEQ ID NO: 6969718 - DNA, 22 bp, Homo sapiens
agcctggcactgaggcagggcg

SEQ ID NO: 6969719 - DNA, 22 bp, Homo sapiens
cttggcagcttttggaggagcc

SEQ ID NO: 6969720 - DNA, 19 bp, Homo sapiens
tttcagacatttcaaattt

SEQ ID NO: 6969721 - DNA, 22 bp, Homo sapiens
tctaagcctaggaaatgagttt

SEQ ID NO: 6969722 - DNA, 22 bp, Homo sapiens
tcagtttatagatattgctgat

SEQ ID NO: 6969723 - DNA, 22 bp, Homo sapiens
tatatttaaatccaggttgaaa

SEQ ID NO: 6969724 - DNA, 22 bp, Homo sapiens
aatcttggttgcagtatatccg

SEQ ID NO: 6969725 - DNA, 22 bp, Homo sapiens
gcaccttggctttcttggtggc

SEQ ID NO: 6969726 - DNA, 22 bp, Homo sapiens
ttaggagtccagatgtcttggg

SEQ ID NO: 6969727 - DNA, 22 bp, Homo sapiens
cagagctgggtttgggaaacct

SEQ ID NO: 6969728 - DNA, 22 bp, Homo sapiens
gggtggagcttggacaccagta

SEQ ID NO: 6969729 - DNA, 22 bp, Homo sapiens
gcagccacctcccatggcgggg

SEQ ID NO: 6969730 - DNA, 22 bp, Homo sapiens
gtggcattgaggtatttggttg

SEQ ID NO: 6969731 - DNA, 22 bp, Homo sapiens
cctggagcccaaggcagtgaga

SEQ ID NO: 6969732 - DNA, 22 bp, Homo sapiens
ttgtttccattgcagactgtgt

SEQ ID NO: 6969733 - DNA, 22 bp, Homo sapiens
tggtactgagaatagcgtctac

SEQ ID NO: 6969734 - DNA, 22 bp, Homo sapiens
gcaagcagttacccaggattcg

SEQ ID NO: 6969735 - DNA, 22 bp, Homo sapiens
gggctgcttatactgatgataa

SEQ ID NO: 6969736 - DNA, 22 bp, Homo sapiens
gcctgtgctgttccctctgcca

SEQ ID NO: 6969737 - DNA, 22 bp, Homo sapiens
atggctttcctgggacatgggc

SEQ ID NO: 6969738 - DNA, 22 bp, Homo sapiens
aaaatagcctcacataattgct

SEQ ID NO: 6969739 - DNA, 22 bp, Homo sapiens
aatatgtcctgctagccccgga

SEQ ID NO: 6969740 - DNA, 22 bp, Homo sapiens
ccagcctcactggcatcaccta

SEQ ID NO: 6969741 - DNA, 22 bp, Homo sapiens
ctggaatatttgtaggatgaaa

SEQ ID NO: 6969742 - DNA, 19 bp, Homo sapiens
ggcttcgaggctggggaag

SEQ ID NO: 6969743 - DNA, 20 bp, Homo sapiens
tacaaagaatgaggttcagg

SEQ ID NO: 6969744 - DNA, 22 bp, Homo sapiens
cttcacagaataaactcattat

SEQ ID NO: 6969745 - DNA, 22 bp, Homo sapiens
aaagcagcaacgtgcatataac

SEQ ID NO: 6969746 - DNA, 22 bp, Homo sapiens
atccttcttctgctagtgtcta

SEQ ID NO: 6969747 - DNA, 22 bp, Homo sapiens
agctggtgaacctgaggcacag

SEQ ID NO: 6969748 - DNA, 23 bp, Homo sapiens
ccaaaagcgagtctgttgttccc

SEQ ID NO: 6969749 - DNA, 22 bp, Homo sapiens
ccatcagttttatctgacaaaa

SEQ ID NO: 6969750 - DNA, 22 bp, Homo sapiens
aatttgtataaaatggtgtttt

SEQ ID NO: 6969751 - DNA, 21 bp, Homo sapiens
tctatgtacgcatctatgcct

SEQ ID NO: 6969752 - DNA, 22 bp, Homo sapiens
tgagtaactctacatatgtaca

SEQ ID NO: 6969753 - DNA, 20 bp, Homo sapiens
taaatgcatctgttcaactg

SEQ ID NO: 6969754 - DNA, 22 bp, Homo sapiens
tctgggaatttattggcacttt

SEQ ID NO: 6969755 - DNA, 22 bp, Homo sapiens
ctgtcacagcccgcgtctcctc

SEQ ID NO: 6969756 - DNA, 22 bp, Homo sapiens
cctgccagtgcctcccactggt

SEQ ID NO: 6969757 - DNA, 22 bp, Homo sapiens
ctcttcttgcctgatgaggcag

SEQ ID NO: 6969758 - DNA, 22 bp, Homo sapiens
ctttgcagctctaggtggaagc

SEQ ID NO: 6969759 - DNA, 22 bp, Homo sapiens
actcggggtggagagagcggtg

SEQ ID NO: 6969760 - DNA, 22 bp, Homo sapiens
ccaggctcacagcatcccagga

SEQ ID NO: 6969761 - DNA, 22 bp, Homo sapiens
catttattcatgatctgtagct

SEQ ID NO: 6969762 - DNA, 22 bp, Homo sapiens
ccagtcctcagatggtctgtgc

SEQ ID NO: 6969763 - DNA, 22 bp, Homo sapiens
attcacaaaatgatatagatac

SEQ ID NO: 6969764 - DNA, 22 bp, Homo sapiens
ggctctgcggcgtgtgcgcagg

SEQ ID NO: 6969765 - DNA, 22 bp, Homo sapiens
tttgtcttgtgtccttaggacc

SEQ ID NO: 6969766 - DNA, 22 bp, Homo sapiens
ccagagaccagaacatggggat

SEQ ID NO: 6969767 - DNA, 22 bp, Homo sapiens
aagctcttctgtggatttgagt

SEQ ID NO: 6969768 - DNA, 22 bp, Homo sapiens
ccaaatgctccactgactttgg

SEQ ID NO: 6969769 - DNA, 22 bp, Homo sapiens
aactattatgaaagacagtgtg

SEQ ID NO: 6969770 - DNA, 22 bp, Homo sapiens
tctgaacattttttgcagccta

SEQ ID NO: 6969771 - DNA, 22 bp, Homo sapiens
ctctgcagaggcccaaggctga

SEQ ID NO: 6969772 - DNA, 22 bp, Homo sapiens
ggggttgatcacagaggggtct

SEQ ID NO: 6969773 - DNA, 19 bp, Homo sapiens
tcctctgaaggttctttta

SEQ ID NO: 6969774 - DNA, 22 bp, Homo sapiens
ctgggtaagttcctaaggctca

SEQ ID NO: 6969775 - DNA, 22 bp, Homo sapiens
gaatgtttttcattggtgactc

SEQ ID NO: 6969776 - DNA, 22 bp, Homo sapiens
taccactgataccttggagttc

SEQ ID NO: 6969777 - DNA, 17 bp, Homo sapiens
gtaaggcttgcagatgc

SEQ ID NO: 6969778 - DNA, 22 bp, Homo sapiens
tgagacaaagcagctgacagaa

SEQ ID NO: 6969779 - DNA, 22 bp, Homo sapiens
tgtcaactgtgatgtcaacact

SEQ ID NO: 6969780 - DNA, 22 bp, Homo sapiens
acagtggagttggggtagccct

SEQ ID NO: 6969781 - DNA, 22 bp, Homo sapiens
tggaaacaggagaatatcttct

SEQ ID NO: 6969782 - DNA, 22 bp, Homo sapiens
aatatcatctctcttttctgca

SEQ ID NO: 6969783 - DNA, 22 bp, Homo sapiens
acaagctgtggtgggacaagag

SEQ ID NO: 6969784 - DNA, 22 bp, Homo sapiens
ctggctgtgtccacagagtaag

SEQ ID NO: 6969785 - DNA, 22 bp, Homo sapiens
ctccctggtctttcccatcatt

SEQ ID NO: 6969786 - DNA, 22 bp, Homo sapiens
tattccaaaggtagggattact

SEQ ID NO: 6969787 - DNA, 22 bp, Homo sapiens
acactggttctcttaaccctat

SEQ ID NO: 6969788 - DNA, 22 bp, Homo sapiens
ttatcatctcctgctgtggtta

SEQ ID NO: 6969789 - DNA, 22 bp, Homo sapiens
ctgtttcctgtcttctcactat

SEQ ID NO: 6969790 - DNA, 22 bp, Homo sapiens
ctttatgtactgtgtatttgaa

SEQ ID NO: 6969791 - DNA, 22 bp, Homo sapiens
gaggctgtgtttcagtgaggcc

SEQ ID NO: 6969792 - DNA, 21 bp, Homo sapiens
gtcttcaaaggcagtgggcag

SEQ ID NO: 6969793 - DNA, 19 bp, Homo sapiens
gcctgcagaaaaggcaggg

SEQ ID NO: 6969794 - DNA, 22 bp, Homo sapiens
tttagaatgtgactgtatttga

SEQ ID NO: 6969795 - DNA, 22 bp, Homo sapiens
gcccccgtagtagatgaggcgc

SEQ ID NO: 6969796 - DNA, 20 bp, Homo sapiens
tggagttgttctgctaggtc

SEQ ID NO: 6969797 - DNA, 22 bp, Homo sapiens
atttccaaaaccacttattgcc

SEQ ID NO: 6969798 - DNA, 22 bp, Homo sapiens
gtctcagtccgtgctgttcagg

SEQ ID NO: 6969799 - DNA, 22 bp, Homo sapiens
gaacccagtccaggtgcagcct

SEQ ID NO: 6969800 - DNA, 20 bp, Homo sapiens
actggcactggtaggtgtgg

SEQ ID NO: 6969801 - DNA, 22 bp, Homo sapiens
tgcagctctgtatgctgattat

SEQ ID NO: 6969802 - DNA, 22 bp, Homo sapiens
tagtatttcctgtaagctatag

SEQ ID NO: 6969803 - DNA, 21 bp, Homo sapiens
tgctggctgaaaggcacagag

SEQ ID NO: 6969804 - DNA, 22 bp, Homo sapiens
cagacaggcaggtgagagctcc

SEQ ID NO: 6969805 - DNA, 22 bp, Homo sapiens
tctgtttatatttcaaaccttc

SEQ ID NO: 6969806 - DNA, 22 bp, Homo sapiens
tctgttatacagtctgtggcac

SEQ ID NO: 6969807 - DNA, 22 bp, Homo sapiens
tggaaggcgtctcgaaggccta

SEQ ID NO: 6969808 - DNA, 22 bp, Homo sapiens
aggagctgagtcagcccgacag

SEQ ID NO: 6969809 - DNA, 22 bp, Homo sapiens
tttgggcaaggtccagattcct

SEQ ID NO: 6969810 - DNA, 22 bp, Homo sapiens
tccttcaggcctcattctcata

SEQ ID NO: 6969811 - DNA, 22 bp, Homo sapiens
ttactaagccagtggtatagat

SEQ ID NO: 6969812 - DNA, 23 bp, Homo sapiens
ctatttctcatagttcaggtctt

SEQ ID NO: 6969813 - DNA, 22 bp, Homo sapiens
ggaagtgaggaattaggtttat

SEQ ID NO: 6969814 - DNA, 22 bp, Homo sapiens
aagcagtttttcaactgtttag

SEQ ID NO: 6969815 - DNA, 22 bp, Homo sapiens
cttaactctacactgcacttta

SEQ ID NO: 6969816 - DNA, 22 bp, Homo sapiens
ctgtgccacaaactcgcgaaaa

SEQ ID NO: 6969817 - DNA, 22 bp, Homo sapiens
cctgttctaatcttggggcaga

SEQ ID NO: 6969818 - DNA, 22 bp, Homo sapiens
ggcgcagtgtgcagaggagtga

SEQ ID NO: 6969819 - DNA, 22 bp, Homo sapiens
tgtattcagggacatatatgta

SEQ ID NO: 6969820 - DNA, 22 bp, Homo sapiens
atatgaatttggctggaaaggt

SEQ ID NO: 6969821 - DNA, 22 bp, Homo sapiens
tcaaactgtttacagtgagata

SEQ ID NO: 6969822 - DNA, 22 bp, Homo sapiens
caacagaaggaagcagggtcag

SEQ ID NO: 6969823 - DNA, 22 bp, Homo sapiens
tgaagctgtgggcagtggagcc

SEQ ID NO: 6969824 - DNA, 20 bp, Homo sapiens
tattggatctaagaaatggg

SEQ ID NO: 6969825 - DNA, 22 bp, Homo sapiens
gctggtagacctcactgcactc

SEQ ID NO: 6969826 - DNA, 22 bp, Homo sapiens
agtgaggtcaggatctcaggga

SEQ ID NO: 6969827 - DNA, 22 bp, Homo sapiens
gctggcattacaggagagaacc

SEQ ID NO: 6969828 - DNA, 22 bp, Homo sapiens
tactctaacatttgttagatgt

SEQ ID NO: 6969829 - DNA, 23 bp, Homo sapiens
ttaactctatacacaccagaatg

SEQ ID NO: 6969830 - DNA, 22 bp, Homo sapiens
gaattacagccagaagaatgaa

SEQ ID NO: 6969831 - DNA, 22 bp, Homo sapiens
ggcaatagttgtgggttcttta

SEQ ID NO: 6969832 - DNA, 22 bp, Homo sapiens
acagccagtaaggaaagaccca

SEQ ID NO: 6969833 - DNA, 22 bp, Homo sapiens
tcaggctatatccaggtatcca

SEQ ID NO: 6969834 - DNA, 22 bp, Homo sapiens
tagatgtagccactgctaaaag

SEQ ID NO: 6969835 - DNA, 22 bp, Homo sapiens
actgaggcagtgaggtcggtct

SEQ ID NO: 6969836 - DNA, 22 bp, Homo sapiens
tctggctctggagtccacctgc

SEQ ID NO: 6969837 - DNA, 22 bp, Homo sapiens
tgagtgctgcattagcagatat

SEQ ID NO: 6969838 - DNA, 22 bp, Homo sapiens
cttagcagaattccaagcttga

SEQ ID NO: 6969839 - DNA, 22 bp, Homo sapiens
cccaggctcagactggcttgtt

SEQ ID NO: 6969840 - DNA, 22 bp, Homo sapiens
gaggcagcctcagtggacctcg

SEQ ID NO: 6969841 - DNA, 22 bp, Homo sapiens
tgaaatggcccaaacacccagt

SEQ ID NO: 6969842 - DNA, 22 bp, Homo sapiens
tatttatcaaggtaggagaata

SEQ ID NO: 6969843 - DNA, 22 bp, Homo sapiens
caggtggagctgactgagggca

SEQ ID NO: 6969844 - DNA, 22 bp, Homo sapiens
acaggaaccaggcaggtcgatt

SEQ ID NO: 6969845 - DNA, 22 bp, Homo sapiens
tctgcctagtgggacagcagcc

SEQ ID NO: 6969846 - DNA, 22 bp, Homo sapiens
gccagctgttcagacattcttt

SEQ ID NO: 6969847 - DNA, 22 bp, Homo sapiens
tagaggtagatggtcagccaat

SEQ ID NO: 6969848 - DNA, 22 bp, Homo sapiens
aactgtaagtggttggaagaag

SEQ ID NO: 6969849 - DNA, 22 bp, Homo sapiens
ggcaagtaatacaggattattt

SEQ ID NO: 6969850 - DNA, 22 bp, Homo sapiens
aaagttgatttggagggatatt

SEQ ID NO: 6969851 - DNA, 22 bp, Homo sapiens
aggcagctggcaaattctagag

SEQ ID NO: 6969852 - DNA, 22 bp, Homo sapiens
atgatgtagacaaaaatatgct

SEQ ID NO: 6969853 - DNA, 22 bp, Homo sapiens
agccttgagcagttcacttggt

SEQ ID NO: 6969854 - DNA, 22 bp, Homo sapiens
atttacataatagactttaggt

SEQ ID NO: 6969855 - DNA, 22 bp, Homo sapiens
tcacaggctctccaccatgagg

SEQ ID NO: 6969856 - DNA, 22 bp, Homo sapiens
tctgtgcaggaagtcattatga

SEQ ID NO: 6969857 - DNA, 22 bp, Homo sapiens
ccaatgcataatgatcccctaa

SEQ ID NO: 6969858 - DNA, 22 bp, Homo sapiens
ttgcacagaaggatatgtcatc

SEQ ID NO: 6969859 - DNA, 20 bp, Homo sapiens
agtagcagtaatatggaaga

SEQ ID NO: 6969860 - DNA, 22 bp, Homo sapiens
cagttgataataccagagagag

SEQ ID NO: 6969861 - DNA, 22 bp, Homo sapiens
actatgtacccaaagatctgat

SEQ ID NO: 6969862 - DNA, 22 bp, Homo sapiens
tttatgaactacagatataact

SEQ ID NO: 6969863 - DNA, 22 bp, Homo sapiens
actttgtaaacatctcaaggtc

SEQ ID NO: 6969864 - DNA, 22 bp, Homo sapiens
ttattctgtcaaacttatacat

SEQ ID NO: 6969865 - DNA, 22 bp, Homo sapiens
acagactgtcccaccacatgga

SEQ ID NO: 6969866 - DNA, 22 bp, Homo sapiens
gcactttggaaaattttgagtt

SEQ ID NO: 6969867 - DNA, 22 bp, Homo sapiens
cacctgctccctcagttccagc

SEQ ID NO: 6969868 - DNA, 22 bp, Homo sapiens
tgagacagcagtcagggaaata

SEQ ID NO: 6969869 - DNA, 22 bp, Homo sapiens
ggccttgtggaaggtatgagca

SEQ ID NO: 6969870 - DNA, 22 bp, Homo sapiens
gagtgccagatggacctcttgg

SEQ ID NO: 6969871 - DNA, 22 bp, Homo sapiens
cacatgtttttggccatcatgg

SEQ ID NO: 6969872 - DNA, 20 bp, Homo sapiens
ctctttgcaatgcagaagac

SEQ ID NO: 6969873 - DNA, 22 bp, Homo sapiens
actgtggcgtcaggaagaaatt

SEQ ID NO: 6969874 - DNA, 22 bp, Homo sapiens
atggaatttgcaataacaggat

SEQ ID NO: 6969875 - DNA, 18 bp, Homo sapiens
tgagtggaatgagggggc

SEQ ID NO: 6969876 - DNA, 20 bp, Homo sapiens
ctgctgtgttattgtagaac

SEQ ID NO: 6969877 - DNA, 19 bp, Homo sapiens
agctaatggaagtttactg

SEQ ID NO: 6969878 - DNA, 22 bp, Homo sapiens
tgctcttattcatctgtagctc

SEQ ID NO: 6969879 - DNA, 18 bp, Homo sapiens
aggccttgggtagcctga

SEQ ID NO: 6969880 - DNA, 22 bp, Homo sapiens
caggagtggcacccttttccct

SEQ ID NO: 6969881 - DNA, 22 bp, Homo sapiens
tatatctaagtgtatgtaagag

SEQ ID NO: 6969882 - DNA, 22 bp, Homo sapiens
cccccaaggccaggctgagacc

SEQ ID NO: 6969883 - DNA, 22 bp, Homo sapiens
cagcactaggatatacatttcc

SEQ ID NO: 6969884 - DNA, 22 bp, Homo sapiens
gtgtcctgatcaattgagctgg

SEQ ID NO: 6969885 - DNA, 23 bp, Homo sapiens
tggtgggccctgcttgctcactg

SEQ ID NO: 6969886 - DNA, 22 bp, Homo sapiens
tcaggtctatagaagaggaggg

SEQ ID NO: 6969887 - DNA, 22 bp, Homo sapiens
agccacaatgccaacctctact

SEQ ID NO: 6969888 - DNA, 22 bp, Homo sapiens
gctcaggcccagcggctggtgt

SEQ ID NO: 6969889 - DNA, 22 bp, Homo sapiens
aacactttccgtaggtttagta

SEQ ID NO: 6969890 - DNA, 22 bp, Homo sapiens
aaagtccagagggcacactgaa

SEQ ID NO: 6969891 - DNA, 22 bp, Homo sapiens
gcatgcaatctatccttaggaa

SEQ ID NO: 6969892 - DNA, 22 bp, Homo sapiens
tgagctgacacccaatcatact

SEQ ID NO: 6969893 - DNA, 20 bp, Homo sapiens
aaactaaaggtgtttggttt

SEQ ID NO: 6969894 - DNA, 22 bp, Homo sapiens
gcctggctgctagccagaggca

SEQ ID NO: 6969895 - DNA, 22 bp, Homo sapiens
atggctgggatttcctttgcgt

SEQ ID NO: 6969896 - DNA, 22 bp, Homo sapiens
ctgtgaggcggaaaggactctc

SEQ ID NO: 6969897 - DNA, 22 bp, Homo sapiens
acctctctgggcctgcttcctg

SEQ ID NO: 6969898 - DNA, 21 bp, Homo sapiens
ggcctcagccacctggctctg

SEQ ID NO: 6969899 - DNA, 22 bp, Homo sapiens
gggctggctcccaggtgttgaa

SEQ ID NO: 6969900 - DNA, 22 bp, Homo sapiens
tagaagttgaactaaaaatatt

SEQ ID NO: 6969901 - DNA, 22 bp, Homo sapiens
aacagtaacgagatgtcctaac

SEQ ID NO: 6969902 - DNA, 22 bp, Homo sapiens
atttggtggttccttttccgaa

SEQ ID NO: 6969903 - DNA, 22 bp, Homo sapiens
ttgcattccatggttttccttc

SEQ ID NO: 6969904 - DNA, 22 bp, Homo sapiens
tagctcatctaggctaccacag

SEQ ID NO: 6969905 - DNA, 22 bp, Homo sapiens
tgcaccttcgatttggaagcct

SEQ ID NO: 6969906 - DNA, 22 bp, Homo sapiens
atgaagctgaccttgtcttgct

SEQ ID NO: 6969907 - DNA, 22 bp, Homo sapiens
actggatggtgtcatgagcagc

SEQ ID NO: 6969908 - DNA, 20 bp, Homo sapiens
tctgtaattatgccatcact

SEQ ID NO: 6969909 - DNA, 22 bp, Homo sapiens
ctctggatggttctgcacattc

SEQ ID NO: 6969910 - DNA, 22 bp, Homo sapiens
ttctgccacgagcagtttcttc

SEQ ID NO: 6969911 - DNA, 22 bp, Homo sapiens
gacttgaaagggtgaacaactt

SEQ ID NO: 6969912 - DNA, 22 bp, Homo sapiens
cccattcttcatacaagtctaa

SEQ ID NO: 6969913 - DNA, 22 bp, Homo sapiens
atcctgtgttgctactggagga

SEQ ID NO: 6969914 - DNA, 22 bp, Homo sapiens
ctgcaagctacccctagcatca

SEQ ID NO: 6969915 - DNA, 23 bp, Homo sapiens
aagcatcttttcctagctccatc

SEQ ID NO: 6969916 - DNA, 22 bp, Homo sapiens
tcattcctccagcgggagtcca

SEQ ID NO: 6969917 - DNA, 22 bp, Homo sapiens
ttttattctcaagacaatggga

SEQ ID NO: 6969918 - DNA, 22 bp, Homo sapiens
tgctgtcccccgtgtctgggct

SEQ ID NO: 6969919 - DNA, 22 bp, Homo sapiens
gagccaggggtcagctccgagg

SEQ ID NO: 6969920 - DNA, 22 bp, Homo sapiens
agtttatgtagaattggcaata

SEQ ID NO: 6969921 - DNA, 22 bp, Homo sapiens
tggcttctgagcattgaaacgt

SEQ ID NO: 6969922 - DNA, 22 bp, Homo sapiens
tatatatgggggaagctggatg

SEQ ID NO: 6969923 - DNA, 22 bp, Homo sapiens
agcctgtgtgaagccctcagag

SEQ ID NO: 6969924 - DNA, 21 bp, Homo sapiens
atggacaattgagtgtctgtc

SEQ ID NO: 6969925 - DNA, 22 bp, Homo sapiens
ggtgagtcctcagctgacacgg

SEQ ID NO: 6969926 - DNA, 22 bp, Homo sapiens
aggttttggtgatcattggaga

SEQ ID NO: 6969927 - DNA, 22 bp, Homo sapiens
ttctccaggggagggttctcca

SEQ ID NO: 6969928 - DNA, 22 bp, Homo sapiens
taaggcagcataattaggccac

SEQ ID NO: 6969929 - DNA, 22 bp, Homo sapiens
tgatctggtcctactgtgggca

SEQ ID NO: 6969930 - DNA, 22 bp, Homo sapiens
gggaggcacgaggcgcgcagtg

SEQ ID NO: 6969931 - DNA, 22 bp, Homo sapiens
gccacatccaggtggatcaaat

SEQ ID NO: 6969932 - DNA, 18 bp, Homo sapiens
tgactttctttttcaacc

SEQ ID NO: 6969933 - DNA, 22 bp, Homo sapiens
caagagctgaggctggagaggt

SEQ ID NO: 6969934 - DNA, 22 bp, Homo sapiens
cccacacactggctgctgccaa

SEQ ID NO: 6969935 - DNA, 22 bp, Homo sapiens
ccagataaggctttttaaaagc

SEQ ID NO: 6969936 - DNA, 22 bp, Homo sapiens
aaactgaggagttagactaggg

SEQ ID NO: 6969937 - DNA, 22 bp, Homo sapiens
tctgtggcatggtatctggagg

SEQ ID NO: 6969938 - DNA, 22 bp, Homo sapiens
gctcggccccgacggccggcgg

SEQ ID NO: 6969939 - DNA, 22 bp, Homo sapiens
gcaggacagcaggatgcttaga

SEQ ID NO: 6969940 - DNA, 22 bp, Homo sapiens
cagtagcatgcaccaggagggt

SEQ ID NO: 6969941 - DNA, 22 bp, Homo sapiens
gttcttcagccctcaggtccta

SEQ ID NO: 6969942 - DNA, 22 bp, Homo sapiens
ttcacaccaggtatttatattt

SEQ ID NO: 6969943 - DNA, 22 bp, Homo sapiens
tggcagatgagccgcgctccaa

SEQ ID NO: 6969944 - DNA, 22 bp, Homo sapiens
gaggggctgggcagtccctgga

SEQ ID NO: 6969945 - DNA, 22 bp, Homo sapiens
ttcctgtagttgtgcaatgtac

SEQ ID NO: 6969946 - DNA, 22 bp, Homo sapiens
agaaaaagtcaaggaattggac

SEQ ID NO: 6969947 - DNA, 22 bp, Homo sapiens
gaaggctcttgaggccaggtaa

SEQ ID NO: 6969948 - DNA, 22 bp, Homo sapiens
taacgtaaagggaggtaggtgt

SEQ ID NO: 6969949 - DNA, 22 bp, Homo sapiens
tcagatgtctctcagcagggtt

SEQ ID NO: 6969950 - DNA, 22 bp, Homo sapiens
gcacacattcggattcttaacc

SEQ ID NO: 6969951 - DNA, 22 bp, Homo sapiens
cagtgcagccaaggacaggcac

SEQ ID NO: 6969952 - DNA, 22 bp, Homo sapiens
aggggcgagtctgtccagccgg

SEQ ID NO: 6969953 - DNA, 22 bp, Homo sapiens
agatgcgtgtgctgtcgagtat

SEQ ID NO: 6969954 - DNA, 22 bp, Homo sapiens
aatggcaaggaaaccgttacca

SEQ ID NO: 6969955 - DNA, 21 bp, Homo sapiens
tggaaagattcaaagaccagg

SEQ ID NO: 6969956 - DNA, 22 bp, Homo sapiens
gtaagtgttgaattagtgctcc

SEQ ID NO: 6969957 - DNA, 22 bp, Homo sapiens
tctcagtgaagagtataacaaa

SEQ ID NO: 6969958 - DNA, 22 bp, Homo sapiens
ctgtccagaaagggggcaacaa

SEQ ID NO: 6969959 - DNA, 22 bp, Homo sapiens
gctgaagttgcctattttaata

SEQ ID NO: 6969960 - DNA, 22 bp, Homo sapiens
caggtaactttagtgaaagagc

SEQ ID NO: 6969961 - DNA, 19 bp, Homo sapiens
cactagtctagatgggatg

SEQ ID NO: 6969962 - DNA, 22 bp, Homo sapiens
tgccttttgtatgcaggccatg

SEQ ID NO: 6969963 - DNA, 21 bp, Homo sapiens
tccaagccttcaacacattca

SEQ ID NO: 6969964 - DNA, 22 bp, Homo sapiens
tgacaatattgagtcttaggtt

SEQ ID NO: 6969965 - DNA, 22 bp, Homo sapiens
gatctgttataatctcttttat

SEQ ID NO: 6969966 - DNA, 22 bp, Homo sapiens
tctgggcccactcaacttcact

SEQ ID NO: 6969967 - DNA, 22 bp, Homo sapiens
atgcaggctcatgaatctgttt

SEQ ID NO: 6969968 - DNA, 22 bp, Homo sapiens
atagagattctggagtttgcac

SEQ ID NO: 6969969 - DNA, 22 bp, Homo sapiens
gtggtcatctaactaaattttc

SEQ ID NO: 6969970 - DNA, 22 bp, Homo sapiens
atctttatttattgagcactta

SEQ ID NO: 6969971 - DNA, 22 bp, Homo sapiens
tgtgtgtgtcctcatttgcaga

SEQ ID NO: 6969972 - DNA, 22 bp, Homo sapiens
tgtcagctcccagtcagagaga

SEQ ID NO: 6969973 - DNA, 22 bp, Homo sapiens
aggcagtgtggagggctgttgc

SEQ ID NO: 6969974 - DNA, 22 bp, Homo sapiens
ctgggtcctggtgctgagttct

SEQ ID NO: 6969975 - DNA, 22 bp, Homo sapiens
atgccagggtcacagtcatatt

SEQ ID NO: 6969976 - DNA, 22 bp, Homo sapiens
tgctgagggagcatcaaagaaa

SEQ ID NO: 6969977 - DNA, 22 bp, Homo sapiens
tccaggcccatagacacttctc

SEQ ID NO: 6969978 - DNA, 22 bp, Homo sapiens
gctgactctttgacaaaatgca

SEQ ID NO: 6969979 - DNA, 22 bp, Homo sapiens
cccttcctcaaggagctgtgtt

SEQ ID NO: 6969980 - DNA, 22 bp, Homo sapiens
cccactgtgttgcagtctagtg

SEQ ID NO: 6969981 - DNA, 16 bp, Homo sapiens
tttgttcactccatgg

SEQ ID NO: 6969982 - DNA, 20 bp, Homo sapiens
ttgataggcagcttgtcagg

SEQ ID NO: 6969983 - DNA, 22 bp, Homo sapiens
cttgcttgtttagttcacagat

SEQ ID NO: 6969984 - DNA, 23 bp, Homo sapiens
accactgagtgtcttgcctgctt

SEQ ID NO: 6969985 - DNA, 22 bp, Homo sapiens
gcctcctggggtgccatcatct

SEQ ID NO: 6969986 - DNA, 22 bp, Homo sapiens
attactctgtctgcctctgacc

SEQ ID NO: 6969987 - DNA, 22 bp, Homo sapiens
ggtagccaatttaaacatttcc

SEQ ID NO: 6969988 - DNA, 22 bp, Homo sapiens
agattggttccttgctttgaaa

SEQ ID NO: 6969989 - DNA, 19 bp, Homo sapiens
gccactcctgatgctgccc

SEQ ID NO: 6969990 - DNA, 21 bp, Homo sapiens
acagtgagaaataaatggaaa

SEQ ID NO: 6969991 - DNA, 22 bp, Homo sapiens
gtccttggctgggcttgcctcg

SEQ ID NO: 6969992 - DNA, 22 bp, Homo sapiens
ggctgccataacagagtaccac

SEQ ID NO: 6969993 - DNA, 22 bp, Homo sapiens
gatggcggtggccacctccttg

SEQ ID NO: 6969994 - DNA, 19 bp, Homo sapiens
cacagtcctatgtttatca

SEQ ID NO: 6969995 - DNA, 22 bp, Homo sapiens
aatgttgtttttctgcatgtct

SEQ ID NO: 6969996 - DNA, 22 bp, Homo sapiens
tggggaagcactttgaacttaa

SEQ ID NO: 6969997 - DNA, 22 bp, Homo sapiens
tctcacagttgtcccttgtgag

SEQ ID NO: 6969998 - DNA, 22 bp, Homo sapiens
tctgaagagaacaccagtagtt

SEQ ID NO: 6969999 - DNA, 20 bp, Homo sapiens
acctgccacagagaaaggta

SEQ ID NO: 6970000 - DNA, 21 bp, Homo sapiens
ccactcatgactccactcacc

SEQ ID NO: 6970001 - DNA, 21 bp, Homo sapiens
gcagcagaggcttgacagaca

SEQ ID NO: 6970002 - DNA, 22 bp, Homo sapiens
atactggttttctttcagcact

SEQ ID NO: 6970003 - DNA, 22 bp, Homo sapiens
caagctccttacatccacaggg

SEQ ID NO: 6970004 - DNA, 22 bp, Homo sapiens
ttgcctgtgaggattctggttg

SEQ ID NO: 6970005 - DNA, 22 bp, Homo sapiens
acaaactacctacagatgttca

SEQ ID NO: 6970006 - DNA, 22 bp, Homo sapiens
ggcagccccagaaacagttcag

SEQ ID NO: 6970007 - DNA, 22 bp, Homo sapiens
aggaggccgatttcagaggtcg

SEQ ID NO: 6970008 - DNA, 22 bp, Homo sapiens
aattatgtgcttgcttgtttcc

SEQ ID NO: 6970009 - DNA, 22 bp, Homo sapiens
tacactggattagctgtcctac

SEQ ID NO: 6970010 - DNA, 22 bp, Homo sapiens
tgttcttgggaatcttacagtt

SEQ ID NO: 6970011 - DNA, 18 bp, Homo sapiens
tgaccctttctccctgtg

SEQ ID NO: 6970012 - DNA, 22 bp, Homo sapiens
tcctggaggcaaatgagcacat

SEQ ID NO: 6970013 - DNA, 22 bp, Homo sapiens
gtgtaaacacccttactgtggc

SEQ ID NO: 6970014 - DNA, 22 bp, Homo sapiens
cacaggcctggggttgagcggg

SEQ ID NO: 6970015 - DNA, 22 bp, Homo sapiens
agtctatttccccttctcttga

SEQ ID NO: 6970016 - DNA, 22 bp, Homo sapiens
gcccgtgtgcagagtgggagct

SEQ ID NO: 6970017 - DNA, 22 bp, Homo sapiens
gggacagtgaggcacggggttt

SEQ ID NO: 6970018 - DNA, 22 bp, Homo sapiens
tggatttaaggcagagagggcc

SEQ ID NO: 6970019 - DNA, 22 bp, Homo sapiens
tcctgtgttcaagtcattcatt

SEQ ID NO: 6970020 - DNA, 22 bp, Homo sapiens
cttgagaagcattaagaggtag

SEQ ID NO: 6970021 - DNA, 22 bp, Homo sapiens
tatggcaatatgtatcaagatc

SEQ ID NO: 6970022 - DNA, 22 bp, Homo sapiens
ctgggtctggtgtcaggcgacg

SEQ ID NO: 6970023 - DNA, 22 bp, Homo sapiens
ggcaatttcatgtggtttaaac

SEQ ID NO: 6970024 - DNA, 23 bp, Homo sapiens
agggcccaagcctggacagcagg

SEQ ID NO: 6970025 - DNA, 22 bp, Homo sapiens
tagaagcagaaggaaggtggct

SEQ ID NO: 6970026 - DNA, 22 bp, Homo sapiens
agaggtagaggttgcagtgagc

SEQ ID NO: 6970027 - DNA, 21 bp, Homo sapiens
gaaggcttctgcctggaggag

SEQ ID NO: 6970028 - DNA, 22 bp, Homo sapiens
tgactcgcaacccctatgagat

SEQ ID NO: 6970029 - DNA, 22 bp, Homo sapiens
ctgcagcttaaaggagttcaat

SEQ ID NO: 6970030 - DNA, 22 bp, Homo sapiens
tggccctgccactcactgctga

SEQ ID NO: 6970031 - DNA, 22 bp, Homo sapiens
atggagctgtgtgaatattcat

SEQ ID NO: 6970032 - DNA, 21 bp, Homo sapiens
taagccaccatgtgaaaccag

SEQ ID NO: 6970033 - DNA, 22 bp, Homo sapiens
gagagccctgctcctatcccag

SEQ ID NO: 6970034 - DNA, 22 bp, Homo sapiens
caatatgcaagctattaagtat

SEQ ID NO: 6970035 - DNA, 22 bp, Homo sapiens
taccttgggttgagttcattct

SEQ ID NO: 6970036 - DNA, 22 bp, Homo sapiens
gccccctaaaggtgtcctcatc

SEQ ID NO: 6970037 - DNA, 22 bp, Homo sapiens
ctttggtctgtccatcctgcct

SEQ ID NO: 6970038 - DNA, 23 bp, Homo sapiens
tgtaacttcttaaattcttcact

SEQ ID NO: 6970039 - DNA, 22 bp, Homo sapiens
tggtatattaactagtttcttc

SEQ ID NO: 6970040 - DNA, 22 bp, Homo sapiens
ttcagtgagtgaatgaatgaat

SEQ ID NO: 6970041 - DNA, 22 bp, Homo sapiens
gttcacagtctacatagtaaag

SEQ ID NO: 6970042 - DNA, 23 bp, Homo sapiens
atagacccaagagtaaaggcatc

SEQ ID NO: 6970043 - DNA, 17 bp, Homo sapiens
tccagccctgcccgacg

SEQ ID NO: 6970044 - DNA, 17 bp, Homo sapiens
agaatgcaaagcaggct

SEQ ID NO: 6970045 - DNA, 22 bp, Homo sapiens
aagtccttcccaagcatgtacc

SEQ ID NO: 6970046 - DNA, 22 bp, Homo sapiens
cgggaggaaaggcgaggctctg

SEQ ID NO: 6970047 - DNA, 22 bp, Homo sapiens
tgcttcttactcatatgctgat

SEQ ID NO: 6970048 - DNA, 22 bp, Homo sapiens
accattaatctcacaaggataa

SEQ ID NO: 6970049 - DNA, 22 bp, Homo sapiens
gcccagtctccaggagactctc

SEQ ID NO: 6970050 - DNA, 22 bp, Homo sapiens
tttgcatttgttcaagtattga

SEQ ID NO: 6970051 - DNA, 22 bp, Homo sapiens
gatcttgagcaagttgcatccc

SEQ ID NO: 6970052 - DNA, 22 bp, Homo sapiens
tcacaggagagctgatgctggt

SEQ ID NO: 6970053 - DNA, 22 bp, Homo sapiens
cactgggagagctggacttggg

SEQ ID NO: 6970054 - DNA, 22 bp, Homo sapiens
tccactgtgcagctctgctgat

SEQ ID NO: 6970055 - DNA, 22 bp, Homo sapiens
ttccatgcctctatttagaatt

SEQ ID NO: 6970056 - DNA, 22 bp, Homo sapiens
gactttggcttttattctaggt

SEQ ID NO: 6970057 - DNA, 22 bp, Homo sapiens
ctttcctgaggagtatggctgt

SEQ ID NO: 6970058 - DNA, 22 bp, Homo sapiens
tccagccctgcccattctctcg

SEQ ID NO: 6970059 - DNA, 22 bp, Homo sapiens
aagtgtaagcaaagctcaagct

SEQ ID NO: 6970060 - DNA, 22 bp, Homo sapiens
tgccctctaggctacagttcca

SEQ ID NO: 6970061 - DNA, 22 bp, Homo sapiens
tcaaatctttaacatgtgcaaa

SEQ ID NO: 6970062 - DNA, 22 bp, Homo sapiens
ttaccacctgtatcacattttt

SEQ ID NO: 6970063 - DNA, 22 bp, Homo sapiens
agtggcagtagatgagctggtt

SEQ ID NO: 6970064 - DNA, 22 bp, Homo sapiens
gtgggcagacagtgctttgcag

SEQ ID NO: 6970065 - DNA, 22 bp, Homo sapiens
agtcgctgttggtcgtggcact

SEQ ID NO: 6970066 - DNA, 22 bp, Homo sapiens
ggtaccaagggcttgccaagtg

SEQ ID NO: 6970067 - DNA, 22 bp, Homo sapiens
tgatgtgtggcagttaaactgt

SEQ ID NO: 6970068 - DNA, 22 bp, Homo sapiens
ggcagggaaacagctgatccca

SEQ ID NO: 6970069 - DNA, 20 bp, Homo sapiens
acacagtagatgagtgactg

SEQ ID NO: 6970070 - DNA, 22 bp, Homo sapiens
ctggtcactcctccacctgctt

SEQ ID NO: 6970071 - DNA, 22 bp, Homo sapiens
ggggcctctgcagtcacgctgg

SEQ ID NO: 6970072 - DNA, 22 bp, Homo sapiens
gtcttttgctagccagagagct

SEQ ID NO: 6970073 - DNA, 22 bp, Homo sapiens
gtttattagagttttctgtctg

SEQ ID NO: 6970074 - DNA, 23 bp, Homo sapiens
atgcttccacagagcttgcagcc

SEQ ID NO: 6970075 - DNA, 22 bp, Homo sapiens
gacctcagattttcccaggcca

SEQ ID NO: 6970076 - DNA, 22 bp, Homo sapiens
cacaagtatctcccaccaggtt

SEQ ID NO: 6970077 - DNA, 22 bp, Homo sapiens
aagtactgtttaaattgcagaa

SEQ ID NO: 6970078 - DNA, 22 bp, Homo sapiens
aactgaacagcaggcttctacc

SEQ ID NO: 6970079 - DNA, 22 bp, Homo sapiens
cacacattgaattcattcttgt

SEQ ID NO: 6970080 - DNA, 22 bp, Homo sapiens
tgcaggtcaatcttcaggttcc

SEQ ID NO: 6970081 - DNA, 22 bp, Homo sapiens
agccctaactcccagtatcttg

SEQ ID NO: 6970082 - DNA, 22 bp, Homo sapiens
agcttgagttttggatgaagtg

SEQ ID NO: 6970083 - DNA, 22 bp, Homo sapiens
tcgtgcatcatgtattcccatt

SEQ ID NO: 6970084 - DNA, 22 bp, Homo sapiens
gggacctggcacctttgctctg

SEQ ID NO: 6970085 - DNA, 22 bp, Homo sapiens
ctggcctagacagaccctgatc

SEQ ID NO: 6970086 - DNA, 21 bp, Homo sapiens
tccctgctttctggcccagtc

SEQ ID NO: 6970087 - DNA, 22 bp, Homo sapiens
aagtccagacctgaggccctca

SEQ ID NO: 6970088 - DNA, 22 bp, Homo sapiens
aagaacaactgctttaaaagca

SEQ ID NO: 6970089 - DNA, 22 bp, Homo sapiens
ggttgcacgctccttatgagaa

SEQ ID NO: 6970090 - DNA, 22 bp, Homo sapiens
tcagcagccgcagctgactcag

SEQ ID NO: 6970091 - DNA, 22 bp, Homo sapiens
gaagattggggcctctgcaccc

SEQ ID NO: 6970092 - DNA, 22 bp, Homo sapiens
gccataaaatgtggatgaggga

SEQ ID NO: 6970093 - DNA, 22 bp, Homo sapiens
ttcttctgattgccttctgcaa

SEQ ID NO: 6970094 - DNA, 22 bp, Homo sapiens
acagagacaaatgttagtagtt

SEQ ID NO: 6970095 - DNA, 22 bp, Homo sapiens
gctcagacttgttttacaggct

SEQ ID NO: 6970096 - DNA, 22 bp, Homo sapiens
tggcaggtttcgttaaaaatgg

SEQ ID NO: 6970097 - DNA, 22 bp, Homo sapiens
atgtagaaagttcatagatgcg

SEQ ID NO: 6970098 - DNA, 22 bp, Homo sapiens
tctctcagaggaagaggcagtg

SEQ ID NO: 6970099 - DNA, 22 bp, Homo sapiens
agtggaatttcatgaagatcca

SEQ ID NO: 6970100 - DNA, 22 bp, Homo sapiens
atgcatatttcatgaatctttg

SEQ ID NO: 6970101 - DNA, 23 bp, Homo sapiens
ttataagaagcatcacaggaaga

SEQ ID NO: 6970102 - DNA, 22 bp, Homo sapiens
tgaaagatgaaagcaggctggt

SEQ ID NO: 6970103 - DNA, 20 bp, Homo sapiens
ccagtgggaagtgattaggt

SEQ ID NO: 6970104 - DNA, 22 bp, Homo sapiens
aagatcataatatttatctcat

SEQ ID NO: 6970105 - DNA, 22 bp, Homo sapiens
acccaggctggagtgcagtgac

SEQ ID NO: 6970106 - DNA, 22 bp, Homo sapiens
tttgctaaaatgtattgggatt

SEQ ID NO: 6970107 - DNA, 22 bp, Homo sapiens
gcgggtggaacggctccacgtg

SEQ ID NO: 6970108 - DNA, 22 bp, Homo sapiens
aaagagcatggaaagttcagga

SEQ ID NO: 6970109 - DNA, 22 bp, Homo sapiens
tctcgttagatgtttctgttga

SEQ ID NO: 6970110 - DNA, 21 bp, Homo sapiens
gaggccactaataggggcaga

SEQ ID NO: 6970111 - DNA, 22 bp, Homo sapiens
tttctcagtgcagtttctacgt

SEQ ID NO: 6970112 - DNA, 22 bp, Homo sapiens
caactgtcacagctgatctgtt

SEQ ID NO: 6970113 - DNA, 22 bp, Homo sapiens
aagttcatcaaagagtaaatat

SEQ ID NO: 6970114 - DNA, 22 bp, Homo sapiens
ttctgggcctcctaggacaggc

SEQ ID NO: 6970115 - DNA, 22 bp, Homo sapiens
aattcaaagactagaattttgc

SEQ ID NO: 6970116 - DNA, 22 bp, Homo sapiens
gctgcagatcccacccattccc

SEQ ID NO: 6970117 - DNA, 22 bp, Homo sapiens
ttacagtttaccaagaatattg

SEQ ID NO: 6970118 - DNA, 22 bp, Homo sapiens
tagaggtgtcactttgggaagt

SEQ ID NO: 6970119 - DNA, 22 bp, Homo sapiens
ccagaaagaatgaactgaaccc

SEQ ID NO: 6970120 - DNA, 22 bp, Homo sapiens
gccaggaagcagttagatgggt

SEQ ID NO: 6970121 - DNA, 22 bp, Homo sapiens
tgggtagaggaattgggctacc

SEQ ID NO: 6970122 - DNA, 22 bp, Homo sapiens
aagtgtacatgaacacatgaca

SEQ ID NO: 6970123 - DNA, 19 bp, Homo sapiens
tacatgcacatgtgcgtgc

SEQ ID NO: 6970124 - DNA, 22 bp, Homo sapiens
aggagggttgaggaggatactt

SEQ ID NO: 6970125 - DNA, 22 bp, Homo sapiens
tggcccttctgagcacagggcc

SEQ ID NO: 6970126 - DNA, 20 bp, Homo sapiens
gtgcagaggcagcctgtggg

SEQ ID NO: 6970127 - DNA, 22 bp, Homo sapiens
gggtgccttggtgtgctgtagg

SEQ ID NO: 6970128 - DNA, 22 bp, Homo sapiens
agccctggcccggctgtgcttt

SEQ ID NO: 6970129 - DNA, 22 bp, Homo sapiens
gcaggaacttgcaaaatgagca

SEQ ID NO: 6970130 - DNA, 22 bp, Homo sapiens
ccagacatgtgcccttgaggaa

SEQ ID NO: 6970131 - DNA, 17 bp, Homo sapiens
tgaagatgcatggcagc

SEQ ID NO: 6970132 - DNA, 22 bp, Homo sapiens
tgaggcttagagaattaagtga

SEQ ID NO: 6970133 - DNA, 22 bp, Homo sapiens
gctcaaagaccagacagaggag

SEQ ID NO: 6970134 - DNA, 19 bp, Homo sapiens
cctgatggagctggtgcaa

SEQ ID NO: 6970135 - DNA, 22 bp, Homo sapiens
ctaggccacagggcaaaaagga

SEQ ID NO: 6970136 - DNA, 22 bp, Homo sapiens
tcacagggatggaatagaaata

SEQ ID NO: 6970137 - DNA, 22 bp, Homo sapiens
aaaaacctcaattacttttgca

SEQ ID NO: 6970138 - DNA, 22 bp, Homo sapiens
gaagtgcaacctgaaatactag

SEQ ID NO: 6970139 - DNA, 22 bp, Homo sapiens
aaaggactggatattaaagagt

SEQ ID NO: 6970140 - DNA, 17 bp, Homo sapiens
tttacattgctcgcagt

SEQ ID NO: 6970141 - DNA, 22 bp, Homo sapiens
aaccattgatacatgcaacaat

SEQ ID NO: 6970142 - DNA, 22 bp, Homo sapiens
ttgaagtgagaggggctggggt

SEQ ID NO: 6970143 - DNA, 22 bp, Homo sapiens
tgtgtatagaaagtaggaaagg

SEQ ID NO: 6970144 - DNA, 22 bp, Homo sapiens
tcacttttgatccctatgcagt

SEQ ID NO: 6970145 - DNA, 22 bp, Homo sapiens
tcagtttttaaatgatataatt

SEQ ID NO: 6970146 - DNA, 19 bp, Homo sapiens
ttgttcattgtgtgtcctt

SEQ ID NO: 6970147 - DNA, 22 bp, Homo sapiens
tttgtcaaagatcagatgcttt

SEQ ID NO: 6970148 - DNA, 22 bp, Homo sapiens
ttccagcacagaagtatacatt

SEQ ID NO: 6970149 - DNA, 22 bp, Homo sapiens
tgtctcaaggttactctatgat

SEQ ID NO: 6970150 - DNA, 22 bp, Homo sapiens
tttggcatagctctttgttcct

SEQ ID NO: 6970151 - DNA, 19 bp, Homo sapiens
caaatgggacaggaaggca

SEQ ID NO: 6970152 - DNA, 22 bp, Homo sapiens
cagaagatctcttagtggaggg

SEQ ID NO: 6970153 - DNA, 20 bp, Homo sapiens
acctggggttgcctgtgctc

SEQ ID NO: 6970154 - DNA, 22 bp, Homo sapiens
ggagaagccacacattgggtgt

SEQ ID NO: 6970155 - DNA, 22 bp, Homo sapiens
ccactgccagctttgtcctccc

SEQ ID NO: 6970156 - DNA, 22 bp, Homo sapiens
tgcaggagctgtgcggtgaggg

SEQ ID NO: 6970157 - DNA, 22 bp, Homo sapiens
acatcacacgccttccaggagg

SEQ ID NO: 6970158 - DNA, 22 bp, Homo sapiens
gaattctagggtaaatatccta

SEQ ID NO: 6970159 - DNA, 22 bp, Homo sapiens
gacaggctttctcaggatgagc

SEQ ID NO: 6970160 - DNA, 22 bp, Homo sapiens
atctttgatctttattgctaag

SEQ ID NO: 6970161 - DNA, 22 bp, Homo sapiens
agctggatgaatttggaacact

SEQ ID NO: 6970162 - DNA, 22 bp, Homo sapiens
cttgaatgggccataagacggt

SEQ ID NO: 6970163 - DNA, 21 bp, Homo sapiens
ttgaagcaagggtggctctga

SEQ ID NO: 6970164 - DNA, 22 bp, Homo sapiens
cattggttgtcatggcaggagg

SEQ ID NO: 6970165 - DNA, 22 bp, Homo sapiens
gtcctgcggcctcagtggtgag

SEQ ID NO: 6970166 - DNA, 22 bp, Homo sapiens
gtgctgaagaagtctgttcgcc

SEQ ID NO: 6970167 - DNA, 22 bp, Homo sapiens
cagaaaataaacatttgtggaa

SEQ ID NO: 6970168 - DNA, 22 bp, Homo sapiens
agaagtttctttgaacgtgtag

SEQ ID NO: 6970169 - DNA, 21 bp, Homo sapiens
agtgtcatttgatcattgtta

SEQ ID NO: 6970170 - DNA, 19 bp, Homo sapiens
cagtgcccaccctagcaca

SEQ ID NO: 6970171 - DNA, 22 bp, Homo sapiens
gctccaggtgaatcctctcacc

SEQ ID NO: 6970172 - DNA, 19 bp, Homo sapiens
tctctaaatggtctttcac

SEQ ID NO: 6970173 - DNA, 22 bp, Homo sapiens
acaagggattgttgagtagtct

SEQ ID NO: 6970174 - DNA, 22 bp, Homo sapiens
aacatccccagcgtctcctagg

SEQ ID NO: 6970175 - DNA, 22 bp, Homo sapiens
ctctcctttgaagcaactgtat

SEQ ID NO: 6970176 - DNA, 21 bp, Homo sapiens
aggaaaggccagcacgtaggg

SEQ ID NO: 6970177 - DNA, 22 bp, Homo sapiens
gaggttatgttcatatcttagt

SEQ ID NO: 6970178 - DNA, 22 bp, Homo sapiens
ctggcagctctgagtcccttct

SEQ ID NO: 6970179 - DNA, 22 bp, Homo sapiens
ctcccagacatgtgcctccttg

SEQ ID NO: 6970180 - DNA, 21 bp, Homo sapiens
tacattgaagaatgggaatga

SEQ ID NO: 6970181 - DNA, 22 bp, Homo sapiens
ctgcatttccacctggccacag

SEQ ID NO: 6970182 - DNA, 22 bp, Homo sapiens
ccagggctgggtttgtcggtgt

SEQ ID NO: 6970183 - DNA, 18 bp, Homo sapiens
tctcagggcatacccaga

SEQ ID NO: 6970184 - DNA, 16 bp, Homo sapiens
gctctttagagggagg

SEQ ID NO: 6970185 - DNA, 22 bp, Homo sapiens
ctgccctgcttgtttccagtgg

SEQ ID NO: 6970186 - DNA, 22 bp, Homo sapiens
tgccagagaagacccagtcact

SEQ ID NO: 6970187 - DNA, 22 bp, Homo sapiens
ttaaactatagcttgatgtgaa

SEQ ID NO: 6970188 - DNA, 22 bp, Homo sapiens
ggacttggggaaggcacagtta

SEQ ID NO: 6970189 - DNA, 22 bp, Homo sapiens
catctacactgattaggtgaac

SEQ ID NO: 6970190 - DNA, 22 bp, Homo sapiens
tggctctcccaatacctttctg

SEQ ID NO: 6970191 - DNA, 22 bp, Homo sapiens
ctggttttggctggcaaggttg

SEQ ID NO: 6970192 - DNA, 22 bp, Homo sapiens
accaaagcgagtgatatgtcat

SEQ ID NO: 6970193 - DNA, 22 bp, Homo sapiens
tgcactgatgttttgccaagga

SEQ ID NO: 6970194 - DNA, 22 bp, Homo sapiens
aatgaacatataaagagatctt

SEQ ID NO: 6970195 - DNA, 22 bp, Homo sapiens
ggtcagaggggattccttggga

SEQ ID NO: 6970196 - DNA, 22 bp, Homo sapiens
tagataaattagaaagtttact

SEQ ID NO: 6970197 - DNA, 22 bp, Homo sapiens
cattctgtgattctaaatccct

SEQ ID NO: 6970198 - DNA, 22 bp, Homo sapiens
tctgagccaatttctgtgtcca

SEQ ID NO: 6970199 - DNA, 22 bp, Homo sapiens
ggttagtagtttgctctattag

SEQ ID NO: 6970200 - DNA, 22 bp, Homo sapiens
acagatgcttactggtggttcc

SEQ ID NO: 6970201 - DNA, 22 bp, Homo sapiens
tgaagcccaatcctgtgttcct

SEQ ID NO: 6970202 - DNA, 22 bp, Homo sapiens
taaacaggagttgaagcagtaa

SEQ ID NO: 6970203 - DNA, 22 bp, Homo sapiens
acagaaatatagaaggtaggaa

SEQ ID NO: 6970204 - DNA, 22 bp, Homo sapiens
aaaatagcatgaaaggcctttg

SEQ ID NO: 6970205 - DNA, 22 bp, Homo sapiens
cagtctggactcaggcatacct

SEQ ID NO: 6970206 - DNA, 22 bp, Homo sapiens
attctacatttggagtgatgtc

SEQ ID NO: 6970207 - DNA, 22 bp, Homo sapiens
caagcaggtcctgaatctggtc

SEQ ID NO: 6970208 - DNA, 19 bp, Homo sapiens
gtgaagctaagtatttgga

SEQ ID NO: 6970209 - DNA, 22 bp, Homo sapiens
ccggcgggcagcggcagtgagc

SEQ ID NO: 6970210 - DNA, 22 bp, Homo sapiens
agtgtttctgtgccccagtgtt

SEQ ID NO: 6970211 - DNA, 22 bp, Homo sapiens
ggagtctggagtggggcccaag

SEQ ID NO: 6970212 - DNA, 22 bp, Homo sapiens
gagaggaaagatatatacttct

SEQ ID NO: 6970213 - DNA, 22 bp, Homo sapiens
ttcatttattcagcaggtattt

SEQ ID NO: 6970214 - DNA, 22 bp, Homo sapiens
ccagccaggctggctgtggagg

SEQ ID NO: 6970215 - DNA, 22 bp, Homo sapiens
cctggaaggacaatagatagtg

SEQ ID NO: 6970216 - DNA, 22 bp, Homo sapiens
ttagttgcaatctattgacgtt

SEQ ID NO: 6970217 - DNA, 22 bp, Homo sapiens
ggactgaatgccagtctatgga

SEQ ID NO: 6970218 - DNA, 22 bp, Homo sapiens
gctgggtgtcacggggctcgtg

SEQ ID NO: 6970219 - DNA, 22 bp, Homo sapiens
gggtgcctgagttagggcagaa

SEQ ID NO: 6970220 - DNA, 22 bp, Homo sapiens
ccaggctagagagcagtggcac

SEQ ID NO: 6970221 - DNA, 22 bp, Homo sapiens
attgatggcggcctctccatat

SEQ ID NO: 6970222 - DNA, 22 bp, Homo sapiens
cagagcatcgcgcagagagcct

SEQ ID NO: 6970223 - DNA, 22 bp, Homo sapiens
ttgtgagatgtctactgaagaa

SEQ ID NO: 6970224 - DNA, 22 bp, Homo sapiens
ttctcagattccccttttaata

SEQ ID NO: 6970225 - DNA, 19 bp, Homo sapiens
tgctgacactagatgtgca

SEQ ID NO: 6970226 - DNA, 22 bp, Homo sapiens
taacctttgaccttgcttgtgc

SEQ ID NO: 6970227 - DNA, 22 bp, Homo sapiens
agccaggccagctgtcttgagt

SEQ ID NO: 6970228 - DNA, 22 bp, Homo sapiens
gttcaagtgtcaagtgttggaa

SEQ ID NO: 6970229 - DNA, 23 bp, Homo sapiens
atatggctgttgtgtgttaacat

SEQ ID NO: 6970230 - DNA, 21 bp, Homo sapiens
tgcacaaactttctgtggctt

SEQ ID NO: 6970231 - DNA, 22 bp, Homo sapiens
aggatgtgagtggacacagtcc

SEQ ID NO: 6970232 - DNA, 22 bp, Homo sapiens
gctgtgcccagctccagctctg

SEQ ID NO: 6970233 - DNA, 20 bp, Homo sapiens
aatagtgctatatattttgt

SEQ ID NO: 6970234 - DNA, 22 bp, Homo sapiens
aatgtcatttaaagacaaagaa

SEQ ID NO: 6970235 - DNA, 22 bp, Homo sapiens
atacatctctttgaagtgcttt

SEQ ID NO: 6970236 - DNA, 23 bp, Homo sapiens
tttcacagaaggattgtagggcc

SEQ ID NO: 6970237 - DNA, 21 bp, Homo sapiens
atctggaaattctgccagaga

SEQ ID NO: 6970238 - DNA, 22 bp, Homo sapiens
attgacaagcagtatgtcttag

SEQ ID NO: 6970239 - DNA, 22 bp, Homo sapiens
tagctaatggtgaagattcaga

SEQ ID NO: 6970240 - DNA, 22 bp, Homo sapiens
gatcctgtggttttcctgtgca

SEQ ID NO: 6970241 - DNA, 22 bp, Homo sapiens
ctgagctgtcaggaatggaaag

SEQ ID NO: 6970242 - DNA, 22 bp, Homo sapiens
ccagtgggaacactggcattgc

SEQ ID NO: 6970243 - DNA, 22 bp, Homo sapiens
tgacaagatagattgagtttta

SEQ ID NO: 6970244 - DNA, 18 bp, Homo sapiens
atattgggagcaggggca

SEQ ID NO: 6970245 - DNA, 22 bp, Homo sapiens
acatggatcaacctattttctt

SEQ ID NO: 6970246 - DNA, 22 bp, Homo sapiens
ttccttctaattttacacctga

SEQ ID NO: 6970247 - DNA, 22 bp, Homo sapiens
gcgctcctcccggccctggtgg

SEQ ID NO: 6970248 - DNA, 22 bp, Homo sapiens
aatgatcccatttagaaacaga

SEQ ID NO: 6970249 - DNA, 19 bp, Homo sapiens
cctgaccagactttgcttc

SEQ ID NO: 6970250 - DNA, 22 bp, Homo sapiens
ggcagaggtgacagtgtctttt

SEQ ID NO: 6970251 - DNA, 22 bp, Homo sapiens
agatggtccatgcacagatatg

SEQ ID NO: 6970252 - DNA, 22 bp, Homo sapiens
agcatttgatatgtttaaaaag

SEQ ID NO: 6970253 - DNA, 22 bp, Homo sapiens
gggacctgaggaggggtttcag

SEQ ID NO: 6970254 - DNA, 22 bp, Homo sapiens
cgaggcaatagagcccagaggt

SEQ ID NO: 6970255 - DNA, 22 bp, Homo sapiens
gatttcagggtgcagatgatga

SEQ ID NO: 6970256 - DNA, 22 bp, Homo sapiens
agtggctgtttataggtgggta

SEQ ID NO: 6970257 - DNA, 22 bp, Homo sapiens
tggctcagcggtggcagcagac

SEQ ID NO: 6970258 - DNA, 22 bp, Homo sapiens
tcagaggagaccaaggggaata

SEQ ID NO: 6970259 - DNA, 22 bp, Homo sapiens
ccattgtttatttagacttaat

SEQ ID NO: 6970260 - DNA, 23 bp, Homo sapiens
cggggccagggtcaggaccggtc

SEQ ID NO: 6970261 - DNA, 22 bp, Homo sapiens
aatgcctctttggagttatttc

SEQ ID NO: 6970262 - DNA, 22 bp, Homo sapiens
caggcacaggggaatgtctttt

SEQ ID NO: 6970263 - DNA, 22 bp, Homo sapiens
acctgcagctaaagatgtaggg

SEQ ID NO: 6970264 - DNA, 22 bp, Homo sapiens
agttgacatccataacaggaag

SEQ ID NO: 6970265 - DNA, 22 bp, Homo sapiens
tacaaatggttgaatggatgaa

SEQ ID NO: 6970266 - DNA, 23 bp, Homo sapiens
tattggctttttaaaggagtata

SEQ ID NO: 6970267 - DNA, 22 bp, Homo sapiens
cactgggcgccagctgctgagc

SEQ ID NO: 6970268 - DNA, 22 bp, Homo sapiens
gaaggaagggctggctgtcttg

SEQ ID NO: 6970269 - DNA, 22 bp, Homo sapiens
ttcagtatttgaaaccataggc

SEQ ID NO: 6970270 - DNA, 22 bp, Homo sapiens
tctgcctgagaagtggggtgcc

SEQ ID NO: 6970271 - DNA, 18 bp, Homo sapiens
gcactctgactgcagagc

SEQ ID NO: 6970272 - DNA, 20 bp, Homo sapiens
actttggggtctttctcaga

SEQ ID NO: 6970273 - DNA, 22 bp, Homo sapiens
tggccaagaatgatatgtgaag

SEQ ID NO: 6970274 - DNA, 22 bp, Homo sapiens
tctcacactaatgctctatcag

SEQ ID NO: 6970275 - DNA, 22 bp, Homo sapiens
atccttgggaactaaatgtaag

SEQ ID NO: 6970276 - DNA, 22 bp, Homo sapiens
ctgtgcagtggggctctgggtt

SEQ ID NO: 6970277 - DNA, 22 bp, Homo sapiens
cttcctctgtgtcctgggcttg

SEQ ID NO: 6970278 - DNA, 22 bp, Homo sapiens
tctcccctagtgcattaaagtg

SEQ ID NO: 6970279 - DNA, 22 bp, Homo sapiens
tgaggcaggaatggggaaaagt

SEQ ID NO: 6970280 - DNA, 22 bp, Homo sapiens
tcttatagctcaaaggaagagt

SEQ ID NO: 6970281 - DNA, 22 bp, Homo sapiens
ttcatagggtatttccatagta

SEQ ID NO: 6970282 - DNA, 22 bp, Homo sapiens
cactagctccatttctgggagg

SEQ ID NO: 6970283 - DNA, 22 bp, Homo sapiens
ggtccaggtatgtggtgtgaat

SEQ ID NO: 6970284 - DNA, 22 bp, Homo sapiens
ttctatgttctaagtctcaagg

SEQ ID NO: 6970285 - DNA, 21 bp, Homo sapiens
tagcttccagctcaagctgag

SEQ ID NO: 6970286 - DNA, 22 bp, Homo sapiens
atgtttgactgagtttggcaga

SEQ ID NO: 6970287 - DNA, 22 bp, Homo sapiens
taaccaagcaaactttcattgt

SEQ ID NO: 6970288 - DNA, 22 bp, Homo sapiens
tctcttctagcttcttgtggtt

SEQ ID NO: 6970289 - DNA, 22 bp, Homo sapiens
tgactctggcttcaagtttctt

SEQ ID NO: 6970290 - DNA, 17 bp, Homo sapiens
agctgagctggccaggg

SEQ ID NO: 6970291 - DNA, 22 bp, Homo sapiens
tggcatctttgtcccagaagct

SEQ ID NO: 6970292 - DNA, 22 bp, Homo sapiens
atttctcagggctgaggaggag

SEQ ID NO: 6970293 - DNA, 22 bp, Homo sapiens
tggtggccccctcaagtctttg

SEQ ID NO: 6970294 - DNA, 22 bp, Homo sapiens
ggacaggtgtgaggctggcaca

SEQ ID NO: 6970295 - DNA, 22 bp, Homo sapiens
atggggctgaaacatggaagag

SEQ ID NO: 6970296 - DNA, 22 bp, Homo sapiens
ttgtctctacagagagtagtag

SEQ ID NO: 6970297 - DNA, 22 bp, Homo sapiens
ttttctgtttgcttcaagacat

SEQ ID NO: 6970298 - DNA, 22 bp, Homo sapiens
ggctcagaaacctctggtgtct

SEQ ID NO: 6970299 - DNA, 22 bp, Homo sapiens
ctgtgtgcatagttgtgctcaa

SEQ ID NO: 6970300 - DNA, 22 bp, Homo sapiens
ctatttgcttgtctagcatcta

SEQ ID NO: 6970301 - DNA, 22 bp, Homo sapiens
aggtgctttatgaaaacttact

SEQ ID NO: 6970302 - DNA, 22 bp, Homo sapiens
ctgcctttgtgatcagttcttt

SEQ ID NO: 6970303 - DNA, 22 bp, Homo sapiens
cacagataaggatgttaatttt

SEQ ID NO: 6970304 - DNA, 22 bp, Homo sapiens
tatcacactagcctatagtgga

SEQ ID NO: 6970305 - DNA, 22 bp, Homo sapiens
ttcatagggctggggtgggagc

SEQ ID NO: 6970306 - DNA, 22 bp, Homo sapiens
tttggaattatgcttaaagttt

SEQ ID NO: 6970307 - DNA, 22 bp, Homo sapiens
tctgccctcgaggagcttgtgt

SEQ ID NO: 6970308 - DNA, 22 bp, Homo sapiens
tctgaattaaaccctttgtgcc

SEQ ID NO: 6970309 - DNA, 22 bp, Homo sapiens
attgtcctgtgtaattcaatgg

SEQ ID NO: 6970310 - DNA, 22 bp, Homo sapiens
tttatgtaatttcataggtgtg

SEQ ID NO: 6970311 - DNA, 22 bp, Homo sapiens
gtctcccatgtccctgtccagt

SEQ ID NO: 6970312 - DNA, 22 bp, Homo sapiens
agccctgcctctccaatgccca

SEQ ID NO: 6970313 - DNA, 22 bp, Homo sapiens
tcttggagaatggcagagaagc

SEQ ID NO: 6970314 - DNA, 22 bp, Homo sapiens
gtactgaaaagttttctaatct

SEQ ID NO: 6970315 - DNA, 22 bp, Homo sapiens
ctcaggatagattgtcctctca

SEQ ID NO: 6970316 - DNA, 22 bp, Homo sapiens
caaggcttaggtggctccctgt

SEQ ID NO: 6970317 - DNA, 22 bp, Homo sapiens
gggcttctctgggagtcctggt

SEQ ID NO: 6970318 - DNA, 18 bp, Homo sapiens
ggacacagataggtacag

SEQ ID NO: 6970319 - DNA, 22 bp, Homo sapiens
agccacagcgaacctctcttcc

SEQ ID NO: 6970320 - DNA, 19 bp, Homo sapiens
gactccaactttaagcatg

SEQ ID NO: 6970321 - DNA, 22 bp, Homo sapiens
gctgggctgagctagacttggc

SEQ ID NO: 6970322 - DNA, 19 bp, Homo sapiens
tgcttctggaatgcaaggc

SEQ ID NO: 6970323 - DNA, 22 bp, Homo sapiens
tatccccacctctgttaaggac

SEQ ID NO: 6970324 - DNA, 22 bp, Homo sapiens
aggctggatttatggggacttc

SEQ ID NO: 6970325 - DNA, 23 bp, Homo sapiens
actctaatgacaagtgtcttcat

SEQ ID NO: 6970326 - DNA, 22 bp, Homo sapiens
tcactgtgctctctagataggc

SEQ ID NO: 6970327 - DNA, 22 bp, Homo sapiens
ctcctgaggaaaagcttggtca

SEQ ID NO: 6970328 - DNA, 22 bp, Homo sapiens
gaggcacagttcttcctccaga

SEQ ID NO: 6970329 - DNA, 21 bp, Homo sapiens
agcaggtgctgttggaggaaa

SEQ ID NO: 6970330 - DNA, 22 bp, Homo sapiens
tctgtttatgcatatttaaaac

SEQ ID NO: 6970331 - DNA, 22 bp, Homo sapiens
tttgtagagaataaaacaaatt

SEQ ID NO: 6970332 - DNA, 22 bp, Homo sapiens
acactggttgaattgtataact

SEQ ID NO: 6970333 - DNA, 22 bp, Homo sapiens
gggaacacagacttgatgatga

SEQ ID NO: 6970334 - DNA, 21 bp, Homo sapiens
cccaggagtcctatttaaatg

SEQ ID NO: 6970335 - DNA, 20 bp, Homo sapiens
ggctgcaggactcattggct

SEQ ID NO: 6970336 - DNA, 22 bp, Homo sapiens
tcctagaggatggtaggaagct

SEQ ID NO: 6970337 - DNA, 22 bp, Homo sapiens
ctgtgtagagcggctgcgagcg

SEQ ID NO: 6970338 - DNA, 22 bp, Homo sapiens
acagaatattgtaagtgccact

SEQ ID NO: 6970339 - DNA, 21 bp, Homo sapiens
tccttcccccttggcctggga

SEQ ID NO: 6970340 - DNA, 17 bp, Homo sapiens
gcttcctgtgctgggga

SEQ ID NO: 6970341 - DNA, 22 bp, Homo sapiens
taggaaactctcagctggtcat

SEQ ID NO: 6970342 - DNA, 22 bp, Homo sapiens
ccgtggttttccctggagcccc

SEQ ID NO: 6970343 - DNA, 22 bp, Homo sapiens
tccaggtctggcctgctaggca

SEQ ID NO: 6970344 - DNA, 22 bp, Homo sapiens
gagacctctgatgtccctgggg

SEQ ID NO: 6970345 - DNA, 22 bp, Homo sapiens
ctatacagtgactagaagtaat

SEQ ID NO: 6970346 - DNA, 22 bp, Homo sapiens
cttgttcatctgcataccaagt

SEQ ID NO: 6970347 - DNA, 22 bp, Homo sapiens
cttaaggaaaagtctcttttaa

SEQ ID NO: 6970348 - DNA, 22 bp, Homo sapiens
tcacataaattatacaatttca

SEQ ID NO: 6970349 - DNA, 22 bp, Homo sapiens
ggcagtgcaggcccttcagcct

SEQ ID NO: 6970350 - DNA, 22 bp, Homo sapiens
gtggatctggctgtgtcctggc

SEQ ID NO: 6970351 - DNA, 22 bp, Homo sapiens
ttggcagaggccgaggtgaaga

SEQ ID NO: 6970352 - DNA, 22 bp, Homo sapiens
gcaggcggaggttgcagtgagc

SEQ ID NO: 6970353 - DNA, 22 bp, Homo sapiens
gagtagttgctgcagagaatac

SEQ ID NO: 6970354 - DNA, 23 bp, Homo sapiens
tccagttaatggttcccagtctg

SEQ ID NO: 6970355 - DNA, 22 bp, Homo sapiens
attctgggcgcctatggctgca

SEQ ID NO: 6970356 - DNA, 22 bp, Homo sapiens
tagtaaggaggacactgtgcct

SEQ ID NO: 6970357 - DNA, 18 bp, Homo sapiens
agtcccatcttcagctct

SEQ ID NO: 6970358 - DNA, 22 bp, Homo sapiens
gctctgcctcccctagtgttac

SEQ ID NO: 6970359 - DNA, 22 bp, Homo sapiens
gctgcctgtggcccttctgggt

SEQ ID NO: 6970360 - DNA, 22 bp, Homo sapiens
gttttggctctggcatgtggaa

SEQ ID NO: 6970361 - DNA, 22 bp, Homo sapiens
ctgcgtttgggtagaggcgagt

SEQ ID NO: 6970362 - DNA, 22 bp, Homo sapiens
cagaagctttgctcataaccat

SEQ ID NO: 6970363 - DNA, 22 bp, Homo sapiens
ctgagcagtctagccaggtgtt

SEQ ID NO: 6970364 - DNA, 22 bp, Homo sapiens
gcatgtctgtaattacagagcc

SEQ ID NO: 6970365 - DNA, 22 bp, Homo sapiens
cacatacaatggtgttatttgg

SEQ ID NO: 6970366 - DNA, 22 bp, Homo sapiens
agtgtgagcctacaggccaaag

SEQ ID NO: 6970367 - DNA, 22 bp, Homo sapiens
actattcatgtttcctaactat

SEQ ID NO: 6970368 - DNA, 22 bp, Homo sapiens
tgctttattggaacctcatcct

SEQ ID NO: 6970369 - DNA, 22 bp, Homo sapiens
cctggctcctgcctctgcaggg

SEQ ID NO: 6970370 - DNA, 21 bp, Homo sapiens
acctttaattcaagcatcagg

SEQ ID NO: 6970371 - DNA, 22 bp, Homo sapiens
ctgggctttgaagccaggctgc

SEQ ID NO: 6970372 - DNA, 22 bp, Homo sapiens
tgggctggctgaacttcaacct

SEQ ID NO: 6970373 - DNA, 19 bp, Homo sapiens
aatgagttccatgaaaaga

SEQ ID NO: 6970374 - DNA, 23 bp, Homo sapiens
agtagcacatacagtacttgttc

SEQ ID NO: 6970375 - DNA, 22 bp, Homo sapiens
acaggtagtgggctagatctgg

SEQ ID NO: 6970376 - DNA, 22 bp, Homo sapiens
cccagcaaggccagctcagggc

SEQ ID NO: 6970377 - DNA, 22 bp, Homo sapiens
gtccttcatctggagcctggtc

SEQ ID NO: 6970378 - DNA, 22 bp, Homo sapiens
gctgctggcactggagtgagcc

SEQ ID NO: 6970379 - DNA, 22 bp, Homo sapiens
gatgctgagagattggagacta

SEQ ID NO: 6970380 - DNA, 22 bp, Homo sapiens
agcaacagggggatggccactg

SEQ ID NO: 6970381 - DNA, 20 bp, Homo sapiens
tattgcctaaataccagaat

SEQ ID NO: 6970382 - DNA, 22 bp, Homo sapiens
ggcccaaaccagctgggcagga

SEQ ID NO: 6970383 - DNA, 17 bp, Homo sapiens
cccctacctccgtttga

SEQ ID NO: 6970384 - DNA, 22 bp, Homo sapiens
cctgtgctccctatgtatctgg

SEQ ID NO: 6970385 - DNA, 22 bp, Homo sapiens
ttagctcagaaaatttaaactt

SEQ ID NO: 6970386 - DNA, 22 bp, Homo sapiens
gtcccctgtccagggccagcca

SEQ ID NO: 6970387 - DNA, 22 bp, Homo sapiens
acctgaactggtctgctgcccg

SEQ ID NO: 6970388 - DNA, 22 bp, Homo sapiens
gcttccagggctcagtcactgc

SEQ ID NO: 6970389 - DNA, 21 bp, Homo sapiens
tggcttcatttgcaacccact

SEQ ID NO: 6970390 - DNA, 22 bp, Homo sapiens
ctgcactgctgatcccaggtct

SEQ ID NO: 6970391 - DNA, 22 bp, Homo sapiens
gggctgaccccacccctcactc

SEQ ID NO: 6970392 - DNA, 22 bp, Homo sapiens
ctgggcgtggcagcggagctgg

SEQ ID NO: 6970393 - DNA, 22 bp, Homo sapiens
cctgaccccagcacttgtccct

SEQ ID NO: 6970394 - DNA, 22 bp, Homo sapiens
atggccagccactcctgatggc

SEQ ID NO: 6970395 - DNA, 22 bp, Homo sapiens
gtgcatgcaaattactgtaaag

SEQ ID NO: 6970396 - DNA, 22 bp, Homo sapiens
agaagcctgttgagagggccgt

SEQ ID NO: 6970397 - DNA, 22 bp, Homo sapiens
aatatgtgaggtatgttcagtg

SEQ ID NO: 6970398 - DNA, 22 bp, Homo sapiens
ggctccagaaacttcagtccat

SEQ ID NO: 6970399 - DNA, 22 bp, Homo sapiens
ccactcagttgctctctgtttt

SEQ ID NO: 6970400 - DNA, 22 bp, Homo sapiens
ctcagagtggggctccctgagg

SEQ ID NO: 6970401 - DNA, 22 bp, Homo sapiens
aagtttctgaatttgaaaggat

SEQ ID NO: 6970402 - DNA, 19 bp, Homo sapiens
tctcttctccctggtttta

SEQ ID NO: 6970403 - DNA, 22 bp, Homo sapiens
gaggctgggaagtccaagatca

SEQ ID NO: 6970404 - DNA, 22 bp, Homo sapiens
aacactgaagccgttaaacctt

SEQ ID NO: 6970405 - DNA, 22 bp, Homo sapiens
agacagtgaggcagagcttccg

SEQ ID NO: 6970406 - DNA, 22 bp, Homo sapiens
cttaacttgatgtctctctgct

SEQ ID NO: 6970407 - DNA, 22 bp, Homo sapiens
ctaaaattatcaagataattcc

SEQ ID NO: 6970408 - DNA, 22 bp, Homo sapiens
tgtccagctgacattcccttcc

SEQ ID NO: 6970409 - DNA, 22 bp, Homo sapiens
gctccagggacccaagagaaaa

SEQ ID NO: 6970410 - DNA, 22 bp, Homo sapiens
ttcagcagtttctgagaagcaa

SEQ ID NO: 6970411 - DNA, 22 bp, Homo sapiens
gaattctgtcgcttactagatg

SEQ ID NO: 6970412 - DNA, 22 bp, Homo sapiens
cctgggtacccttggcggcctt

SEQ ID NO: 6970413 - DNA, 22 bp, Homo sapiens
tggttcatagcctcacaggata

SEQ ID NO: 6970414 - DNA, 22 bp, Homo sapiens
caggtttagttccacacagctc

SEQ ID NO: 6970415 - DNA, 22 bp, Homo sapiens
tctgtaaatcctgctcagcaac

SEQ ID NO: 6970416 - DNA, 22 bp, Homo sapiens
cactgggtaaatttgaggctga

SEQ ID NO: 6970417 - DNA, 22 bp, Homo sapiens
atggcagttttagaacttttca

SEQ ID NO: 6970418 - DNA, 22 bp, Homo sapiens
ggagtctgctcccagacatgat

SEQ ID NO: 6970419 - DNA, 22 bp, Homo sapiens
tgctgacctagaagctgatgtt

SEQ ID NO: 6970420 - DNA, 22 bp, Homo sapiens
tggcaattttctagcagatggc

SEQ ID NO: 6970421 - DNA, 22 bp, Homo sapiens
ctgattaggctaagcaagaggg

SEQ ID NO: 6970422 - DNA, 22 bp, Homo sapiens
tcaaatgttccctgtactggcc

SEQ ID NO: 6970423 - DNA, 22 bp, Homo sapiens
tacagtttacatgagaggaagc

SEQ ID NO: 6970424 - DNA, 22 bp, Homo sapiens
actctgggctgttaggagctgt

SEQ ID NO: 6970425 - DNA, 22 bp, Homo sapiens
actgatttggttagagggccag

SEQ ID NO: 6970426 - DNA, 22 bp, Homo sapiens
tttttctgccattcaaagagga

SEQ ID NO: 6970427 - DNA, 22 bp, Homo sapiens
gctcccacctccagcctgagtt

SEQ ID NO: 6970428 - DNA, 22 bp, Homo sapiens
ggatttacacacctgcctgtca

SEQ ID NO: 6970429 - DNA, 22 bp, Homo sapiens
cagaggacaactggggcaagga

SEQ ID NO: 6970430 - DNA, 21 bp, Homo sapiens
ctgggctggcaggcattacct

SEQ ID NO: 6970431 - DNA, 22 bp, Homo sapiens
agatccactatggtgctgatga

SEQ ID NO: 6970432 - DNA, 22 bp, Homo sapiens
actcagttccatattggtaagt

SEQ ID NO: 6970433 - DNA, 22 bp, Homo sapiens
gttcctatatagccttaaggat

SEQ ID NO: 6970434 - DNA, 22 bp, Homo sapiens
ctctagtgtagtgcaggaagga

SEQ ID NO: 6970435 - DNA, 22 bp, Homo sapiens
tacgttttaaacacggagccag

SEQ ID NO: 6970436 - DNA, 22 bp, Homo sapiens
caattgtcagtgctgtttaaat

SEQ ID NO: 6970437 - DNA, 22 bp, Homo sapiens
actctggggcgctactccaact

SEQ ID NO: 6970438 - DNA, 22 bp, Homo sapiens
aatggagaggctgtgagtgaga

SEQ ID NO: 6970439 - DNA, 18 bp, Homo sapiens
acatttggggagttaagt

SEQ ID NO: 6970440 - DNA, 22 bp, Homo sapiens
gtcaggcagtggaaattaaaaa

SEQ ID NO: 6970441 - DNA, 22 bp, Homo sapiens
atgctgagcagagctgacatgc

SEQ ID NO: 6970442 - DNA, 22 bp, Homo sapiens
agtcccagctactcaagaggct

SEQ ID NO: 6970443 - DNA, 22 bp, Homo sapiens
tctgccacttacctccatgtac

SEQ ID NO: 6970444 - DNA, 19 bp, Homo sapiens
gttatcaaggggctacttt

SEQ ID NO: 6970445 - DNA, 23 bp, Homo sapiens
tagaatctgtatttctgcagttc

SEQ ID NO: 6970446 - DNA, 22 bp, Homo sapiens
gctgcctgtgcgggtcgctagg

SEQ ID NO: 6970447 - DNA, 22 bp, Homo sapiens
gtggccctgtgaacagcgcagt

SEQ ID NO: 6970448 - DNA, 22 bp, Homo sapiens
acaggctggtggtcctggccat

SEQ ID NO: 6970449 - DNA, 22 bp, Homo sapiens
tcttccagaagtgttttcagaa

SEQ ID NO: 6970450 - DNA, 23 bp, Homo sapiens
ttgatttcaaatgcagagaacac

SEQ ID NO: 6970451 - DNA, 22 bp, Homo sapiens
agataattatgtcaatttcttg

SEQ ID NO: 6970452 - DNA, 22 bp, Homo sapiens
gtaatagtctcaaactcctgga

SEQ ID NO: 6970453 - DNA, 22 bp, Homo sapiens
agccctctctatggccctcttg

SEQ ID NO: 6970454 - DNA, 21 bp, Homo sapiens
ttataggctggggtttgcttt

SEQ ID NO: 6970455 - DNA, 22 bp, Homo sapiens
ccagtcctttgagccagttctg

SEQ ID NO: 6970456 - DNA, 19 bp, Homo sapiens
gctttggagggaggttcta

SEQ ID NO: 6970457 - DNA, 22 bp, Homo sapiens
cagcactaatcctgcaatttct

SEQ ID NO: 6970458 - DNA, 22 bp, Homo sapiens
agtgtgagaacggactaataaa

SEQ ID NO: 6970459 - DNA, 22 bp, Homo sapiens
ccctgctgccttcacccaggac

SEQ ID NO: 6970460 - DNA, 22 bp, Homo sapiens
taagtcaggaggtctcctgaca

SEQ ID NO: 6970461 - DNA, 22 bp, Homo sapiens
ctctgagaggtgagaagcagca

SEQ ID NO: 6970462 - DNA, 22 bp, Homo sapiens
ctgtgggagaagttgctggagt

SEQ ID NO: 6970463 - DNA, 22 bp, Homo sapiens
tgagttagaagttccgtttctt

SEQ ID NO: 6970464 - DNA, 22 bp, Homo sapiens
tcgcccaggatggagtgcagta

SEQ ID NO: 6970465 - DNA, 22 bp, Homo sapiens
tctagagaagtttccttttgaa

SEQ ID NO: 6970466 - DNA, 22 bp, Homo sapiens
ttggccaagatacgagcacata

SEQ ID NO: 6970467 - DNA, 22 bp, Homo sapiens
atgctaaatccagaagcagtca

SEQ ID NO: 6970468 - DNA, 22 bp, Homo sapiens
ggctgcatgccaggctttgagc

SEQ ID NO: 6970469 - DNA, 22 bp, Homo sapiens
actgagaaatagcaagtgtctc

SEQ ID NO: 6970470 - DNA, 22 bp, Homo sapiens
atcttggattgactggctctgc

SEQ ID NO: 6970471 - DNA, 22 bp, Homo sapiens
ctagagaattgtcttgagagtt

SEQ ID NO: 6970472 - DNA, 22 bp, Homo sapiens
ataccatggcagtttattcacg

SEQ ID NO: 6970473 - DNA, 23 bp, Homo sapiens
gcattgtagaatgtttagcagca

SEQ ID NO: 6970474 - DNA, 19 bp, Homo sapiens
ctcagctgtagctcatgtg

SEQ ID NO: 6970475 - DNA, 22 bp, Homo sapiens
gcccatgcactttctgtgatgg

SEQ ID NO: 6970476 - DNA, 22 bp, Homo sapiens
tctgactcccatattccacttc

SEQ ID NO: 6970477 - DNA, 18 bp, Homo sapiens
tcatagattcaagagtat

SEQ ID NO: 6970478 - DNA, 22 bp, Homo sapiens
ctcctgtggtactcccagggcc

SEQ ID NO: 6970479 - DNA, 22 bp, Homo sapiens
gacacatacagcagtaagtcta

SEQ ID NO: 6970480 - DNA, 22 bp, Homo sapiens
tcactgaggcattcatgctctg

SEQ ID NO: 6970481 - DNA, 22 bp, Homo sapiens
tcatttgtttctgtttggggct

SEQ ID NO: 6970482 - DNA, 22 bp, Homo sapiens
aagtcaagtactacaggaaaca

SEQ ID NO: 6970483 - DNA, 22 bp, Homo sapiens
gagtgggtgaatgtgctcataa

SEQ ID NO: 6970484 - DNA, 22 bp, Homo sapiens
atttcatggacatctttggagg

SEQ ID NO: 6970485 - DNA, 22 bp, Homo sapiens
gggctctgtccattccttcata

SEQ ID NO: 6970486 - DNA, 22 bp, Homo sapiens
ttaggtaagtaggatcaaaaaa

SEQ ID NO: 6970487 - DNA, 22 bp, Homo sapiens
agctggaacccgggtgggcagc

SEQ ID NO: 6970488 - DNA, 22 bp, Homo sapiens
gttcacagcttgtgttttctct

SEQ ID NO: 6970489 - DNA, 22 bp, Homo sapiens
gctgccatctcctgaggacagg

SEQ ID NO: 6970490 - DNA, 22 bp, Homo sapiens
tcccgtaggttgctgtagtcgg

SEQ ID NO: 6970491 - DNA, 22 bp, Homo sapiens
acaaagggggactgcagagggt

SEQ ID NO: 6970492 - DNA, 22 bp, Homo sapiens
tccacattctctgttacagata

SEQ ID NO: 6970493 - DNA, 22 bp, Homo sapiens
gtggcagccatgagaatataac

SEQ ID NO: 6970494 - DNA, 22 bp, Homo sapiens
gaaatcatagcacatggggctg

SEQ ID NO: 6970495 - DNA, 15 bp, Homo sapiens
aatctggcggcaagt

SEQ ID NO: 6970496 - DNA, 22 bp, Homo sapiens
ttaatgcagctctaccacacag

SEQ ID NO: 6970497 - DNA, 23 bp, Homo sapiens
ctctccaccttcccacccaggga

SEQ ID NO: 6970498 - DNA, 22 bp, Homo sapiens
gaagtccaagatcaaggcccca

SEQ ID NO: 6970499 - DNA, 22 bp, Homo sapiens
tgggagctgagctaaaccccag

SEQ ID NO: 6970500 - DNA, 23 bp, Homo sapiens
agacccagagactggctctgctc

SEQ ID NO: 6970501 - DNA, 22 bp, Homo sapiens
aggcctcctggctccaggcctt

SEQ ID NO: 6970502 - DNA, 22 bp, Homo sapiens
tgcaagagctgtggcaaaagca

SEQ ID NO: 6970503 - DNA, 22 bp, Homo sapiens
tatgtgacatttaacttaagcc

SEQ ID NO: 6970504 - DNA, 22 bp, Homo sapiens
accagggctgggataggtcagg

SEQ ID NO: 6970505 - DNA, 22 bp, Homo sapiens
ccagctgggattaagggaaaat

SEQ ID NO: 6970506 - DNA, 22 bp, Homo sapiens
agtgtccaagtcttctgtttgt

SEQ ID NO: 6970507 - DNA, 22 bp, Homo sapiens
tgggcaagctctgggtggacac

SEQ ID NO: 6970508 - DNA, 22 bp, Homo sapiens
aatggctatacaacatgagtat

SEQ ID NO: 6970509 - DNA, 22 bp, Homo sapiens
ttacatggtaaacactctttta

SEQ ID NO: 6970510 - DNA, 22 bp, Homo sapiens
attgcaaaggtcccattcaaga

SEQ ID NO: 6970511 - DNA, 22 bp, Homo sapiens
ttgactagaattatttaatcga

SEQ ID NO: 6970512 - DNA, 22 bp, Homo sapiens
tcaaggtttgtctgctcagcat

SEQ ID NO: 6970513 - DNA, 22 bp, Homo sapiens
agtaatcaaattaagctaattg

SEQ ID NO: 6970514 - DNA, 22 bp, Homo sapiens
ttggcaactctattggcaaata

SEQ ID NO: 6970515 - DNA, 22 bp, Homo sapiens
aatctgtcttcttttgtggttt

SEQ ID NO: 6970516 - DNA, 22 bp, Homo sapiens
gaatatgaccttatttggagat

SEQ ID NO: 6970517 - DNA, 22 bp, Homo sapiens
acacttcatttacattataggc

SEQ ID NO: 6970518 - DNA, 22 bp, Homo sapiens
taggctaaaacagtttgtttca

SEQ ID NO: 6970519 - DNA, 22 bp, Homo sapiens
attttacttagtgtaatgtcca

SEQ ID NO: 6970520 - DNA, 22 bp, Homo sapiens
ctttatgtccttgaagagttgt

SEQ ID NO: 6970521 - DNA, 22 bp, Homo sapiens
ttttatattgagtgagagttcc

SEQ ID NO: 6970522 - DNA, 21 bp, Homo sapiens
ttcaggtgagatcatgttgac

SEQ ID NO: 6970523 - DNA, 22 bp, Homo sapiens
gagtgcaataaactgttttcta

SEQ ID NO: 6970524 - DNA, 22 bp, Homo sapiens
ttggctctttctcagtcacgtt

SEQ ID NO: 6970525 - DNA, 22 bp, Homo sapiens
aggcgctgcgctggggccagaa

SEQ ID NO: 6970526 - DNA, 22 bp, Homo sapiens
ccttggtttccaggatgaggct

SEQ ID NO: 6970527 - DNA, 22 bp, Homo sapiens
tcttgggaagcccatttccacc

SEQ ID NO: 6970528 - DNA, 22 bp, Homo sapiens
gtgctctgatctgtctgacatc

SEQ ID NO: 6970529 - DNA, 22 bp, Homo sapiens
ctgttcagaaaaaatcttcatg

SEQ ID NO: 6970530 - DNA, 22 bp, Homo sapiens
acttgaaaccctgagatgataa

SEQ ID NO: 6970531 - DNA, 22 bp, Homo sapiens
ggggaagaatgctctctagaga

SEQ ID NO: 6970532 - DNA, 22 bp, Homo sapiens
aaactcctgggctcaagcagtt

SEQ ID NO: 6970533 - DNA, 22 bp, Homo sapiens
acacacagaaggaagccccact

SEQ ID NO: 6970534 - DNA, 22 bp, Homo sapiens
tttgcattagtttagatttcaa

SEQ ID NO: 6970535 - DNA, 22 bp, Homo sapiens
atgttcctgatcctcgttctat

SEQ ID NO: 6970536 - DNA, 22 bp, Homo sapiens
ctgggtctctttagggtgccgt

SEQ ID NO: 6970537 - DNA, 22 bp, Homo sapiens
tctatagattttattgtgtatc

SEQ ID NO: 6970538 - DNA, 22 bp, Homo sapiens
cttgaagaaatggagacaggat

SEQ ID NO: 6970539 - DNA, 22 bp, Homo sapiens
tgcaggagagtgagtcagtagg

SEQ ID NO: 6970540 - DNA, 22 bp, Homo sapiens
tgtgcgtgatggaccgggcctg

SEQ ID NO: 6970541 - DNA, 21 bp, Homo sapiens
ggcatttgccaaagtgatcct

SEQ ID NO: 6970542 - DNA, 22 bp, Homo sapiens
cagagacattcagtaaattatc

SEQ ID NO: 6970543 - DNA, 22 bp, Homo sapiens
ttggtacaaaaccatgaaagaa

SEQ ID NO: 6970544 - DNA, 22 bp, Homo sapiens
agtggtggagagatgaggacac

SEQ ID NO: 6970545 - DNA, 22 bp, Homo sapiens
cagttaaaatgtgctataagaa

SEQ ID NO: 6970546 - DNA, 22 bp, Homo sapiens
tcctcagtattgtggagcagat

SEQ ID NO: 6970547 - DNA, 22 bp, Homo sapiens
taatgtttttctcaacattgct

SEQ ID NO: 6970548 - DNA, 22 bp, Homo sapiens
ttttagcaattggtctctcgtt

SEQ ID NO: 6970549 - DNA, 22 bp, Homo sapiens
cctgtgttagttatgggtctct

SEQ ID NO: 6970550 - DNA, 21 bp, Homo sapiens
ttttaacaaggatttccctag

SEQ ID NO: 6970551 - DNA, 22 bp, Homo sapiens
atgaacatttggtttggcagca

SEQ ID NO: 6970552 - DNA, 22 bp, Homo sapiens
atttcttcaggttcttctagga

SEQ ID NO: 6970553 - DNA, 22 bp, Homo sapiens
tttggaaagttgtcactttaga

SEQ ID NO: 6970554 - DNA, 22 bp, Homo sapiens
gcaatacagttgaagagattga

SEQ ID NO: 6970555 - DNA, 20 bp, Homo sapiens
gaacttgggcaagtggctta

SEQ ID NO: 6970556 - DNA, 22 bp, Homo sapiens
cctggtgcccccaagccagctg

SEQ ID NO: 6970557 - DNA, 22 bp, Homo sapiens
gctctgagaggatgctgagcag

SEQ ID NO: 6970558 - DNA, 21 bp, Homo sapiens
tccatccatcagtccagccag

SEQ ID NO: 6970559 - DNA, 22 bp, Homo sapiens
gcctgggagggcagcagtgtgg

SEQ ID NO: 6970560 - DNA, 22 bp, Homo sapiens
agcctgtgaaatctctgccact

SEQ ID NO: 6970561 - DNA, 22 bp, Homo sapiens
tctgtgctgtctcagagaaagc

SEQ ID NO: 6970562 - DNA, 22 bp, Homo sapiens
ccatggctgcaattcttctgga

SEQ ID NO: 6970563 - DNA, 22 bp, Homo sapiens
cccacaggctaggggtagggca

SEQ ID NO: 6970564 - DNA, 22 bp, Homo sapiens
agctctgactgaagagatgcaa

SEQ ID NO: 6970565 - DNA, 22 bp, Homo sapiens
tcaggtctgtactattgtcttg

SEQ ID NO: 6970566 - DNA, 22 bp, Homo sapiens
ctggcttttggaaacaggctca

SEQ ID NO: 6970567 - DNA, 22 bp, Homo sapiens
gataaatggctgaagaaatagt

SEQ ID NO: 6970568 - DNA, 22 bp, Homo sapiens
aggtggctttactgtttcttac

SEQ ID NO: 6970569 - DNA, 22 bp, Homo sapiens
atgctttgtttaaagattttca

SEQ ID NO: 6970570 - DNA, 22 bp, Homo sapiens
gacaggaacataaatgtaggag

SEQ ID NO: 6970571 - DNA, 18 bp, Homo sapiens
acatttctatgcttctgg

SEQ ID NO: 6970572 - DNA, 22 bp, Homo sapiens
caggcataatctcatcttgttt

SEQ ID NO: 6970573 - DNA, 22 bp, Homo sapiens
aatgtggtctctcttagtagaa

SEQ ID NO: 6970574 - DNA, 21 bp, Homo sapiens
gcagctggtctcagagcttgc

SEQ ID NO: 6970575 - DNA, 22 bp, Homo sapiens
ctccaggaaagcctgaggcccg

SEQ ID NO: 6970576 - DNA, 22 bp, Homo sapiens
ttttacacttcggttgtgtgca

SEQ ID NO: 6970577 - DNA, 21 bp, Homo sapiens
tttgacagctcagagggcatt

SEQ ID NO: 6970578 - DNA, 22 bp, Homo sapiens
tgtcagtttcctgtgccctgct

SEQ ID NO: 6970579 - DNA, 22 bp, Homo sapiens
caggtccttgtttgtaaagcag

SEQ ID NO: 6970580 - DNA, 22 bp, Homo sapiens
tggagagaagaggcagtgtgct

SEQ ID NO: 6970581 - DNA, 22 bp, Homo sapiens
gaggcagcgggtcaggaccgtg

SEQ ID NO: 6970582 - DNA, 23 bp, Homo sapiens
agctccagggaacaggcagtagg

SEQ ID NO: 6970583 - DNA, 20 bp, Homo sapiens
tcaagctagtttccaaagtt

SEQ ID NO: 6970584 - DNA, 23 bp, Homo sapiens
ggctgcgagtgcctgggcctgtg

SEQ ID NO: 6970585 - DNA, 22 bp, Homo sapiens
aagcacagactccctctgagtg

SEQ ID NO: 6970586 - DNA, 22 bp, Homo sapiens
gacaggcccgagtagctgatga

SEQ ID NO: 6970587 - DNA, 22 bp, Homo sapiens
tgacagaatgtgactctcagat

SEQ ID NO: 6970588 - DNA, 22 bp, Homo sapiens
gagtggctttggagaagtaggg

SEQ ID NO: 6970589 - DNA, 22 bp, Homo sapiens
tcataaaacacaccaggtagtt

SEQ ID NO: 6970590 - DNA, 21 bp, Homo sapiens
agtccaggaggaggccaggtt

SEQ ID NO: 6970591 - DNA, 21 bp, Homo sapiens
tcttttctcagctttgtggtt

SEQ ID NO: 6970592 - DNA, 22 bp, Homo sapiens
cttagggaattgggaggatgcc

SEQ ID NO: 6970593 - DNA, 22 bp, Homo sapiens
cacaaagtctgcagctgctgta

SEQ ID NO: 6970594 - DNA, 22 bp, Homo sapiens
agttatgtcctcagcaaatcaa

SEQ ID NO: 6970595 - DNA, 18 bp, Homo sapiens
agctctcccccacatgcc

SEQ ID NO: 6970596 - DNA, 22 bp, Homo sapiens
cagtgattattgattgcattca

SEQ ID NO: 6970597 - DNA, 22 bp, Homo sapiens
gcattgaatcctatcaggcaaa

SEQ ID NO: 6970598 - DNA, 22 bp, Homo sapiens
ggcatgttgtttatgtttctgg

SEQ ID NO: 6970599 - DNA, 23 bp, Homo sapiens
tcctcgtgcctatgagcagtgcc

SEQ ID NO: 6970600 - DNA, 22 bp, Homo sapiens
tggctcaggccacttcttttat

SEQ ID NO: 6970601 - DNA, 22 bp, Homo sapiens
aggacacagacttagatttaaa

SEQ ID NO: 6970602 - DNA, 22 bp, Homo sapiens
tatttcaggtatggtgtgaaat

SEQ ID NO: 6970603 - DNA, 22 bp, Homo sapiens
gattatggagaaataattagaa

SEQ ID NO: 6970604 - DNA, 16 bp, Homo sapiens
tggtggggaggacagc

SEQ ID NO: 6970605 - DNA, 22 bp, Homo sapiens
agcctacagagggcaggtggag

SEQ ID NO: 6970606 - DNA, 22 bp, Homo sapiens
tctgagcttctgcctgctgcaa

SEQ ID NO: 6970607 - DNA, 22 bp, Homo sapiens
aatggtacagtgtacagaactg

SEQ ID NO: 6970608 - DNA, 22 bp, Homo sapiens
catgttgggaatcagctgagag

SEQ ID NO: 6970609 - DNA, 22 bp, Homo sapiens
tggttgaataagatagttttat

SEQ ID NO: 6970610 - DNA, 20 bp, Homo sapiens
ggcctgcagctcccagcaag

SEQ ID NO: 6970611 - DNA, 22 bp, Homo sapiens
cttagtgacatgtattcttcat

SEQ ID NO: 6970612 - DNA, 22 bp, Homo sapiens
agattacagcatgggaatggga

SEQ ID NO: 6970613 - DNA, 22 bp, Homo sapiens
atctggagatgggtctgtcacc

SEQ ID NO: 6970614 - DNA, 22 bp, Homo sapiens
tatattcattttaaagccatct

SEQ ID NO: 6970615 - DNA, 22 bp, Homo sapiens
tttagttcacaccagggtagca

SEQ ID NO: 6970616 - DNA, 22 bp, Homo sapiens
agtgacagaggcaggcctgtgg

SEQ ID NO: 6970617 - DNA, 22 bp, Homo sapiens
tgactttaaaataacaagttta

SEQ ID NO: 6970618 - DNA, 22 bp, Homo sapiens
cacctctgctgtccacaggatg

SEQ ID NO: 6970619 - DNA, 22 bp, Homo sapiens
tcacaggaggactgaaagatat

SEQ ID NO: 6970620 - DNA, 22 bp, Homo sapiens
catcagtgttgatccaccagca

SEQ ID NO: 6970621 - DNA, 22 bp, Homo sapiens
aaatacatacactgtacgtggc

SEQ ID NO: 6970622 - DNA, 22 bp, Homo sapiens
tccagagagatagtggctaata

SEQ ID NO: 6970623 - DNA, 22 bp, Homo sapiens
gactgattgcctggaacaggaa

SEQ ID NO: 6970624 - DNA, 22 bp, Homo sapiens
ttatgacaggaaaatcacagaa

SEQ ID NO: 6970625 - DNA, 22 bp, Homo sapiens
aaggtctgcttgttttcttgag

SEQ ID NO: 6970626 - DNA, 22 bp, Homo sapiens
gcgggtggatcatgaggtcagg

SEQ ID NO: 6970627 - DNA, 22 bp, Homo sapiens
tgcttgctgaaaggcatttaga

SEQ ID NO: 6970628 - DNA, 22 bp, Homo sapiens
attgataaattgcaatggggct

SEQ ID NO: 6970629 - DNA, 18 bp, Homo sapiens
gttcaagccaacatcaag

SEQ ID NO: 6970630 - DNA, 22 bp, Homo sapiens
atctcccaaattagcctcttga

SEQ ID NO: 6970631 - DNA, 21 bp, Homo sapiens
taaaggctttagaatggcaaa

SEQ ID NO: 6970632 - DNA, 22 bp, Homo sapiens
agaggaagccattgcttactga

SEQ ID NO: 6970633 - DNA, 22 bp, Homo sapiens
gccaggttctggggaggtacaa

SEQ ID NO: 6970634 - DNA, 22 bp, Homo sapiens
tcaagtcttcacgtgatatctc

SEQ ID NO: 6970635 - DNA, 22 bp, Homo sapiens
ttgaaactttagtaaactaagg

SEQ ID NO: 6970636 - DNA, 22 bp, Homo sapiens
gacatttgttcctctaagtgac

SEQ ID NO: 6970637 - DNA, 22 bp, Homo sapiens
cagagccagggctaggaactgg

SEQ ID NO: 6970638 - DNA, 22 bp, Homo sapiens
ggtgctgatctaaatttaggac

SEQ ID NO: 6970639 - DNA, 22 bp, Homo sapiens
tttagcatccaaggttatgact

SEQ ID NO: 6970640 - DNA, 22 bp, Homo sapiens
agccctgggagattttctgggt

SEQ ID NO: 6970641 - DNA, 22 bp, Homo sapiens
atttccagcataggcttattga

SEQ ID NO: 6970642 - DNA, 22 bp, Homo sapiens
tctgaaagcattacagtttatt

SEQ ID NO: 6970643 - DNA, 22 bp, Homo sapiens
attgagaatccatttgagatga

SEQ ID NO: 6970644 - DNA, 22 bp, Homo sapiens
tgattaagcaaagagcagtaaa

SEQ ID NO: 6970645 - DNA, 22 bp, Homo sapiens
ccaggcatggggagagccagat

SEQ ID NO: 6970646 - DNA, 22 bp, Homo sapiens
atgtttaaggaactggtttgct

SEQ ID NO: 6970647 - DNA, 22 bp, Homo sapiens
agaatcaggaagacagcctggc

SEQ ID NO: 6970648 - DNA, 22 bp, Homo sapiens
gtgacagtcaaagacatgactt

SEQ ID NO: 6970649 - DNA, 22 bp, Homo sapiens
aagattttcagtgcctaaaaca

SEQ ID NO: 6970650 - DNA, 21 bp, Homo sapiens
tgcgatcctcaatcctctgtt

SEQ ID NO: 6970651 - DNA, 22 bp, Homo sapiens
gctgctggtcctcagagctcat

SEQ ID NO: 6970652 - DNA, 22 bp, Homo sapiens
ggaggaccccagcagctcccca

SEQ ID NO: 6970653 - DNA, 22 bp, Homo sapiens
tttgggactggagcttggagag

SEQ ID NO: 6970654 - DNA, 22 bp, Homo sapiens
ctgggaaagtgtgctcccctcc

SEQ ID NO: 6970655 - DNA, 22 bp, Homo sapiens
ggtcgccagccctagtctgctg

SEQ ID NO: 6970656 - DNA, 22 bp, Homo sapiens
aggtctcaagttgagaaggcag

SEQ ID NO: 6970657 - DNA, 22 bp, Homo sapiens
gaggaggggacagtacttgtgc

SEQ ID NO: 6970658 - DNA, 22 bp, Homo sapiens
tggctggagcccctcaagagca

SEQ ID NO: 6970659 - DNA, 17 bp, Homo sapiens
aggccagatgaggcaag

SEQ ID NO: 6970660 - DNA, 22 bp, Homo sapiens
tgcccattattcagccattaaa

SEQ ID NO: 6970661 - DNA, 22 bp, Homo sapiens
atttgatagtatgacagggcag

SEQ ID NO: 6970662 - DNA, 22 bp, Homo sapiens
tctcagggagggcgagtcagcg

SEQ ID NO: 6970663 - DNA, 23 bp, Homo sapiens
attttagctgaatgacttcttta

SEQ ID NO: 6970664 - DNA, 22 bp, Homo sapiens
gctaatgaggtaatgaatacgt

SEQ ID NO: 6970665 - DNA, 22 bp, Homo sapiens
catgcagtgcctctggattctt

SEQ ID NO: 6970666 - DNA, 18 bp, Homo sapiens
gcccatggtaaatgctgt

SEQ ID NO: 6970667 - DNA, 21 bp, Homo sapiens
atcctatttctgaaaacctgc

SEQ ID NO: 6970668 - DNA, 20 bp, Homo sapiens
ggagtcacattctttactgc

SEQ ID NO: 6970669 - DNA, 22 bp, Homo sapiens
aacagttattatcacattagtg

SEQ ID NO: 6970670 - DNA, 22 bp, Homo sapiens
atgaatgaatgagagtaggtca

SEQ ID NO: 6970671 - DNA, 23 bp, Homo sapiens
tgctggggtagtttgtggcacag

SEQ ID NO: 6970672 - DNA, 21 bp, Homo sapiens
agctgcctgctctggacctgg

SEQ ID NO: 6970673 - DNA, 22 bp, Homo sapiens
gttgctgcaaaggagtgtaggt

SEQ ID NO: 6970674 - DNA, 22 bp, Homo sapiens
caacattcaaccaacatttatg

SEQ ID NO: 6970675 - DNA, 22 bp, Homo sapiens
gtgtggtcgaagttctcccgga

SEQ ID NO: 6970676 - DNA, 22 bp, Homo sapiens
tgtatttatattagaatggttg

SEQ ID NO: 6970677 - DNA, 22 bp, Homo sapiens
taatgcttttccttcaaataag

SEQ ID NO: 6970678 - DNA, 22 bp, Homo sapiens
ttgtagcttatcaaggctgttt

SEQ ID NO: 6970679 - DNA, 22 bp, Homo sapiens
ctgtccatgcatgttgtctgct

SEQ ID NO: 6970680 - DNA, 22 bp, Homo sapiens
tttgagaagataggggaatact

SEQ ID NO: 6970681 - DNA, 22 bp, Homo sapiens
agtcccaggcagccgagccggt

SEQ ID NO: 6970682 - DNA, 22 bp, Homo sapiens
ctatggaaactcaacatttgtt

SEQ ID NO: 6970683 - DNA, 23 bp, Homo sapiens
cccaagcctgtgccctctgactc

SEQ ID NO: 6970684 - DNA, 22 bp, Homo sapiens
ctgggtcccacagcctgctggg

SEQ ID NO: 6970685 - DNA, 22 bp, Homo sapiens
gacagagctcccagagatttgc

SEQ ID NO: 6970686 - DNA, 22 bp, Homo sapiens
cacagaagtgtgtataactctt

SEQ ID NO: 6970687 - DNA, 22 bp, Homo sapiens
tgtcagtgtctgaggttttata

SEQ ID NO: 6970688 - DNA, 22 bp, Homo sapiens
taagacacctctctgcccttca

SEQ ID NO: 6970689 - DNA, 18 bp, Homo sapiens
tcccatgttgtttttaaa

SEQ ID NO: 6970690 - DNA, 22 bp, Homo sapiens
gaaatgttcctgatccctgatt

SEQ ID NO: 6970691 - DNA, 22 bp, Homo sapiens
cacattcagctcattaatggtc

SEQ ID NO: 6970692 - DNA, 22 bp, Homo sapiens
cggcagagcttcctgctcagcg

SEQ ID NO: 6970693 - DNA, 22 bp, Homo sapiens
ttaaagagaaagtgtttgtctt

SEQ ID NO: 6970694 - DNA, 22 bp, Homo sapiens
gaacatttggcatgagaatttg

SEQ ID NO: 6970695 - DNA, 22 bp, Homo sapiens
tcagaacaggactggctgccat

SEQ ID NO: 6970696 - DNA, 22 bp, Homo sapiens
agcagggctgcagtgtgtcttt

SEQ ID NO: 6970697 - DNA, 22 bp, Homo sapiens
aaattgaatttgggaaacattg

SEQ ID NO: 6970698 - DNA, 22 bp, Homo sapiens
cataaagtctcataattcactt

SEQ ID NO: 6970699 - DNA, 22 bp, Homo sapiens
aatctcagctcatgcaattcca

SEQ ID NO: 6970700 - DNA, 21 bp, Homo sapiens
ctggaagaagcagcaggattc

SEQ ID NO: 6970701 - DNA, 22 bp, Homo sapiens
ttctttgtttgataagtatgct

SEQ ID NO: 6970702 - DNA, 22 bp, Homo sapiens
atgcacctgaactccatcagct

SEQ ID NO: 6970703 - DNA, 22 bp, Homo sapiens
aagctgaattttctaaaagaat

SEQ ID NO: 6970704 - DNA, 22 bp, Homo sapiens
tttcagctgctgactagttgta

SEQ ID NO: 6970705 - DNA, 22 bp, Homo sapiens
ataggcattttaagtagtttag

SEQ ID NO: 6970706 - DNA, 22 bp, Homo sapiens
acctaaattctggctgattagg

SEQ ID NO: 6970707 - DNA, 22 bp, Homo sapiens
acacagtggtgagtctggacct

SEQ ID NO: 6970708 - DNA, 22 bp, Homo sapiens
gttattgcagtatagaggtcta

SEQ ID NO: 6970709 - DNA, 22 bp, Homo sapiens
atgttataaatagagacactgg

SEQ ID NO: 6970710 - DNA, 22 bp, Homo sapiens
gccaggctcagtagcgattcct

SEQ ID NO: 6970711 - DNA, 22 bp, Homo sapiens
tatctgtttttacagtgtcttt

SEQ ID NO: 6970712 - DNA, 22 bp, Homo sapiens
cccttagagattctgtcagagt

SEQ ID NO: 6970713 - DNA, 22 bp, Homo sapiens
gagggtgcaggaggatggtagt

SEQ ID NO: 6970714 - DNA, 22 bp, Homo sapiens
agacattgttggcctatcctct

SEQ ID NO: 6970715 - DNA, 22 bp, Homo sapiens
gagtctgtggtattttatcata

SEQ ID NO: 6970716 - DNA, 22 bp, Homo sapiens
agctgggtcttgggccaggaga

SEQ ID NO: 6970717 - DNA, 22 bp, Homo sapiens
gattttctgagccttcaaattt

SEQ ID NO: 6970718 - DNA, 22 bp, Homo sapiens
ttaagcaaatgtcagttgttag

SEQ ID NO: 6970719 - DNA, 22 bp, Homo sapiens
agcagatgttccctggtccctt

SEQ ID NO: 6970720 - DNA, 22 bp, Homo sapiens
tctggagataagcagcaatgaa

SEQ ID NO: 6970721 - DNA, 18 bp, Homo sapiens
tctttggacaactactgg

SEQ ID NO: 6970722 - DNA, 20 bp, Homo sapiens
ggactgaaaacacaaacctg

SEQ ID NO: 6970723 - DNA, 22 bp, Homo sapiens
agttggtgggtgtgagctggac

SEQ ID NO: 6970724 - DNA, 22 bp, Homo sapiens
ctcagtgtcacgttttgcctta

SEQ ID NO: 6970725 - DNA, 22 bp, Homo sapiens
tgccttagggtacctggtgctt

SEQ ID NO: 6970726 - DNA, 22 bp, Homo sapiens
aatggcttaagtataagtgaga

SEQ ID NO: 6970727 - DNA, 22 bp, Homo sapiens
gagtcattgttggtccctcccc

SEQ ID NO: 6970728 - DNA, 22 bp, Homo sapiens
agggcctcctaatttcctcata

SEQ ID NO: 6970729 - DNA, 22 bp, Homo sapiens
gtcagacaggaatgttgcaagt

SEQ ID NO: 6970730 - DNA, 22 bp, Homo sapiens
cctggtcacccctctctctgca

SEQ ID NO: 6970731 - DNA, 22 bp, Homo sapiens
aggaaaggttcagtgattgaaa

SEQ ID NO: 6970732 - DNA, 22 bp, Homo sapiens
agtgacatgagttctcggtaaa

SEQ ID NO: 6970733 - DNA, 22 bp, Homo sapiens
atttcctcatgatcataatgca

SEQ ID NO: 6970734 - DNA, 21 bp, Homo sapiens
tctgggggtgagcctagaaat

SEQ ID NO: 6970735 - DNA, 18 bp, Homo sapiens
gccttcagactgcatgct

SEQ ID NO: 6970736 - DNA, 22 bp, Homo sapiens
cacatgtcctgggaaaataact

SEQ ID NO: 6970737 - DNA, 22 bp, Homo sapiens
ctccccaagtcatggagccagg

SEQ ID NO: 6970738 - DNA, 22 bp, Homo sapiens
aatggtcattggtggttattgg

SEQ ID NO: 6970739 - DNA, 22 bp, Homo sapiens
aagcccagctctgcctgctctg

SEQ ID NO: 6970740 - DNA, 22 bp, Homo sapiens
actagggagaagcacttacaca

SEQ ID NO: 6970741 - DNA, 22 bp, Homo sapiens
gcagatgctgagatttatttct

SEQ ID NO: 6970742 - DNA, 22 bp, Homo sapiens
cagctacacttctgggtgtgtc

SEQ ID NO: 6970743 - DNA, 22 bp, Homo sapiens
agagctgaatttgggtggtgga

SEQ ID NO: 6970744 - DNA, 22 bp, Homo sapiens
gctctcctgtgcagatgctgct

SEQ ID NO: 6970745 - DNA, 22 bp, Homo sapiens
aattgggctatagggaggagcc

SEQ ID NO: 6970746 - DNA, 20 bp, Homo sapiens
agtggcagggaaatggaaag

SEQ ID NO: 6970747 - DNA, 22 bp, Homo sapiens
agaaactgaattatttctgagg

SEQ ID NO: 6970748 - DNA, 22 bp, Homo sapiens
tgagctgataggctgtgagcct

SEQ ID NO: 6970749 - DNA, 22 bp, Homo sapiens
aatatgtctgctaattgtttct

SEQ ID NO: 6970750 - DNA, 22 bp, Homo sapiens
ctttgcaaacgattaccacatg

SEQ ID NO: 6970751 - DNA, 22 bp, Homo sapiens
actaatagagacaaacatagat

SEQ ID NO: 6970752 - DNA, 22 bp, Homo sapiens
atttcgttcagtccttactgtg

SEQ ID NO: 6970753 - DNA, 22 bp, Homo sapiens
tgaatagataaaaattcctgct

SEQ ID NO: 6970754 - DNA, 22 bp, Homo sapiens
ctgcaggccgagctccttctcg

SEQ ID NO: 6970755 - DNA, 22 bp, Homo sapiens
atttcagactgtgttggaaaat

SEQ ID NO: 6970756 - DNA, 22 bp, Homo sapiens
aaacatctactgtaggctggag

SEQ ID NO: 6970757 - DNA, 22 bp, Homo sapiens
aatgtcttttaaatgttgaggt

SEQ ID NO: 6970758 - DNA, 22 bp, Homo sapiens
cccggacagaggggcagagtgt

SEQ ID NO: 6970759 - DNA, 22 bp, Homo sapiens
aaagggtccagatacttggaaa

SEQ ID NO: 6970760 - DNA, 22 bp, Homo sapiens
tgcagagatttggctcttaaag

SEQ ID NO: 6970761 - DNA, 22 bp, Homo sapiens
gtctcagtaagaaaggctcctg

SEQ ID NO: 6970762 - DNA, 22 bp, Homo sapiens
attctattaatatttctaggaa

SEQ ID NO: 6970763 - DNA, 19 bp, Homo sapiens
cccaaggccctgggcaggc

SEQ ID NO: 6970764 - DNA, 22 bp, Homo sapiens
gctggtccacatcctggtacgt

SEQ ID NO: 6970765 - DNA, 22 bp, Homo sapiens
cactgtctgggacatgtggtct

SEQ ID NO: 6970766 - DNA, 22 bp, Homo sapiens
tgtatgtaaagtttgtaataga

SEQ ID NO: 6970767 - DNA, 21 bp, Homo sapiens
tgcagtgaggggagctgtcag

SEQ ID NO: 6970768 - DNA, 20 bp, Homo sapiens
ttgggacacttgctttgcta

SEQ ID NO: 6970769 - DNA, 22 bp, Homo sapiens
gacccgtggcaggctgcctgct

SEQ ID NO: 6970770 - DNA, 21 bp, Homo sapiens
aggctttgaatcatccttcga

SEQ ID NO: 6970771 - DNA, 22 bp, Homo sapiens
gacatagactgagtttagctga

SEQ ID NO: 6970772 - DNA, 22 bp, Homo sapiens
agtggattctgtgtgagatgta

SEQ ID NO: 6970773 - DNA, 22 bp, Homo sapiens
ctctgagagtgctcagagggta

SEQ ID NO: 6970774 - DNA, 22 bp, Homo sapiens
ctcaggaaggaagcagggagcc

SEQ ID NO: 6970775 - DNA, 22 bp, Homo sapiens
ctggcaggagctgtggccgtag

SEQ ID NO: 6970776 - DNA, 22 bp, Homo sapiens
ctggcctgtgggctgtctccgg

SEQ ID NO: 6970777 - DNA, 22 bp, Homo sapiens
cagctgcctgcaacacaagctt

SEQ ID NO: 6970778 - DNA, 16 bp, Homo sapiens
aaggctgattttccct

SEQ ID NO: 6970779 - DNA, 22 bp, Homo sapiens
gggctctggacccaggcaagag

SEQ ID NO: 6970780 - DNA, 18 bp, Homo sapiens
gtttaggctacttaaaat

SEQ ID NO: 6970781 - DNA, 22 bp, Homo sapiens
agccaatgagacttttggagtg

SEQ ID NO: 6970782 - DNA, 22 bp, Homo sapiens
ggcctccaggcctactcagggc

SEQ ID NO: 6970783 - DNA, 22 bp, Homo sapiens
aaaggcttctattggacgttgc

SEQ ID NO: 6970784 - DNA, 22 bp, Homo sapiens
gaggctggtaggaaaggaaaca

SEQ ID NO: 6970785 - DNA, 22 bp, Homo sapiens
ctgggacattataagaaacatt

SEQ ID NO: 6970786 - DNA, 22 bp, Homo sapiens
gttgggatgtcaggcctaggtg

SEQ ID NO: 6970787 - DNA, 22 bp, Homo sapiens
tatctgttctgcttgattttga

SEQ ID NO: 6970788 - DNA, 22 bp, Homo sapiens
attctacaatcatgtagatcct

SEQ ID NO: 6970789 - DNA, 22 bp, Homo sapiens
acatgacttttctcttccagag

SEQ ID NO: 6970790 - DNA, 22 bp, Homo sapiens
ctgggctgagctgtggaaactc

SEQ ID NO: 6970791 - DNA, 22 bp, Homo sapiens
agtgcagcaccatgttacagag

SEQ ID NO: 6970792 - DNA, 22 bp, Homo sapiens
ccctgagccgcctgccgtgtcc

SEQ ID NO: 6970793 - DNA, 22 bp, Homo sapiens
tgattcaagagagttggggtat

SEQ ID NO: 6970794 - DNA, 22 bp, Homo sapiens
tgctcagtgtcttttttggagg

SEQ ID NO: 6970795 - DNA, 22 bp, Homo sapiens
gcttctggagtcttcagaggaa

SEQ ID NO: 6970796 - DNA, 22 bp, Homo sapiens
acagaataggtacagtcagtca

SEQ ID NO: 6970797 - DNA, 20 bp, Homo sapiens
accattaatgtaagctttgt

SEQ ID NO: 6970798 - DNA, 22 bp, Homo sapiens
gggtaggctgctcctggggccc

SEQ ID NO: 6970799 - DNA, 22 bp, Homo sapiens
aaacttgaacccagctcaggct

SEQ ID NO: 6970800 - DNA, 22 bp, Homo sapiens
ttgagatggagtcttgctctct

SEQ ID NO: 6970801 - DNA, 22 bp, Homo sapiens
acagccagatctgagagatctt

SEQ ID NO: 6970802 - DNA, 22 bp, Homo sapiens
atttttcaactttggaaatggc

SEQ ID NO: 6970803 - DNA, 22 bp, Homo sapiens
cggagttgtaagggatgtggct

SEQ ID NO: 6970804 - DNA, 22 bp, Homo sapiens
gattgctgtagttaaaatgatg

SEQ ID NO: 6970805 - DNA, 22 bp, Homo sapiens
ctctggctccatttccctatgt

SEQ ID NO: 6970806 - DNA, 22 bp, Homo sapiens
aatatgcaaagcgtgttatctg

SEQ ID NO: 6970807 - DNA, 22 bp, Homo sapiens
tgctgccagagagacagggact

SEQ ID NO: 6970808 - DNA, 22 bp, Homo sapiens
tctgatttactggaaaaaagga

SEQ ID NO: 6970809 - DNA, 22 bp, Homo sapiens
tgaagtctctgttttctcattt

SEQ ID NO: 6970810 - DNA, 22 bp, Homo sapiens
tgaatagacatctggccataga

SEQ ID NO: 6970811 - DNA, 22 bp, Homo sapiens
ttgcaagaggtgattttattga

SEQ ID NO: 6970812 - DNA, 23 bp, Homo sapiens
gcacagagcagttaggggaagat

SEQ ID NO: 6970813 - DNA, 22 bp, Homo sapiens
gtatagaacctcatcatgccca

SEQ ID NO: 6970814 - DNA, 22 bp, Homo sapiens
gcatgtgtctttatagcagcat

SEQ ID NO: 6970815 - DNA, 22 bp, Homo sapiens
ttcactgtgaactcatattcag

SEQ ID NO: 6970816 - DNA, 22 bp, Homo sapiens
acacctttgtgaagtgatgatg

SEQ ID NO: 6970817 - DNA, 22 bp, Homo sapiens
accctggctctctggccaccgc

SEQ ID NO: 6970818 - DNA, 22 bp, Homo sapiens
ttttggcagcaggtatggggca

SEQ ID NO: 6970819 - DNA, 22 bp, Homo sapiens
aaccctttctcctgggagagtt

SEQ ID NO: 6970820 - DNA, 22 bp, Homo sapiens
gtcctgggaactggacagctaa

SEQ ID NO: 6970821 - DNA, 22 bp, Homo sapiens
cccagcatcccagtgggcagca

SEQ ID NO: 6970822 - DNA, 22 bp, Homo sapiens
tctccacaagctttctcctttt

SEQ ID NO: 6970823 - DNA, 22 bp, Homo sapiens
tggtcaagttaagataaggtga

SEQ ID NO: 6970824 - DNA, 22 bp, Homo sapiens
attggtcatgtttttgtggtaa

SEQ ID NO: 6970825 - DNA, 22 bp, Homo sapiens
ctggctgaggcagagcctgggg

SEQ ID NO: 6970826 - DNA, 22 bp, Homo sapiens
ccttggttgtgcttcaacttct

SEQ ID NO: 6970827 - DNA, 22 bp, Homo sapiens
ttccctcccccagcctggcagg

SEQ ID NO: 6970828 - DNA, 22 bp, Homo sapiens
gtaataggttttcttgctccag

SEQ ID NO: 6970829 - DNA, 22 bp, Homo sapiens
ggcgtgatctggaggtcccagc

SEQ ID NO: 6970830 - DNA, 16 bp, Homo sapiens
atacattcattcccag

SEQ ID NO: 6970831 - DNA, 22 bp, Homo sapiens
gattgcttatacacaagatgaa

SEQ ID NO: 6970832 - DNA, 22 bp, Homo sapiens
catagacaaagatcagaagagt

SEQ ID NO: 6970833 - DNA, 22 bp, Homo sapiens
ctgttattccccttgctgtggt

SEQ ID NO: 6970834 - DNA, 22 bp, Homo sapiens
ataccacaacatggctcagagg

SEQ ID NO: 6970835 - DNA, 22 bp, Homo sapiens
cagtatacgactaacgcatgac

SEQ ID NO: 6970836 - DNA, 22 bp, Homo sapiens
ccttaattagcactctgatggg

SEQ ID NO: 6970837 - DNA, 22 bp, Homo sapiens
acaagactgtgctctaagagtg

SEQ ID NO: 6970838 - DNA, 22 bp, Homo sapiens
gggtgaataggggaaggctatt

SEQ ID NO: 6970839 - DNA, 22 bp, Homo sapiens
caaaagtagtgaagttgtacat

SEQ ID NO: 6970840 - DNA, 22 bp, Homo sapiens
gaacagctctgaagcagtaaat

SEQ ID NO: 6970841 - DNA, 22 bp, Homo sapiens
ctgctccagtagccccatgtgg

SEQ ID NO: 6970842 - DNA, 22 bp, Homo sapiens
atcttcaactttggggctgcct

SEQ ID NO: 6970843 - DNA, 22 bp, Homo sapiens
cccttcagtgcgtgagaatgag

SEQ ID NO: 6970844 - DNA, 22 bp, Homo sapiens
tatgctaattgttagtcacatg

SEQ ID NO: 6970845 - DNA, 22 bp, Homo sapiens
ccatgctccttaccactcactt

SEQ ID NO: 6970846 - DNA, 22 bp, Homo sapiens
aagtgaataaaattgtgttctt

SEQ ID NO: 6970847 - DNA, 22 bp, Homo sapiens
acaaggttcttgtggaggaatt

SEQ ID NO: 6970848 - DNA, 22 bp, Homo sapiens
aataagcaagcctgtgtgcaag

SEQ ID NO: 6970849 - DNA, 22 bp, Homo sapiens
tatagcaagctttgagctttca

SEQ ID NO: 6970850 - DNA, 22 bp, Homo sapiens
tcctggagccaatgtgctgctg

SEQ ID NO: 6970851 - DNA, 22 bp, Homo sapiens
aaatgcagaatctcagacccca

SEQ ID NO: 6970852 - DNA, 22 bp, Homo sapiens
gccactgaacattagagctagt

SEQ ID NO: 6970853 - DNA, 22 bp, Homo sapiens
gttctgggtctggacacacaga

SEQ ID NO: 6970854 - DNA, 22 bp, Homo sapiens
actgtaaagagaactgtgggct

SEQ ID NO: 6970855 - DNA, 22 bp, Homo sapiens
ggcccaaagggctctgtgggct

SEQ ID NO: 6970856 - DNA, 22 bp, Homo sapiens
tgaatatgattgcaaatttggc

SEQ ID NO: 6970857 - DNA, 22 bp, Homo sapiens
tccaggtttcgctacaggagag

SEQ ID NO: 6970858 - DNA, 22 bp, Homo sapiens
aaatactgttgaatgaagtaag

SEQ ID NO: 6970859 - DNA, 22 bp, Homo sapiens
tttcttatattctgtcattgtt

SEQ ID NO: 6970860 - DNA, 23 bp, Homo sapiens
tcacgggtgtatgtctttctttc

SEQ ID NO: 6970861 - DNA, 22 bp, Homo sapiens
tgaagagattaagttggttttg

SEQ ID NO: 6970862 - DNA, 22 bp, Homo sapiens
aagccctcagagcctctttgac

SEQ ID NO: 6970863 - DNA, 22 bp, Homo sapiens
tatagaacaagttatttatgct

SEQ ID NO: 6970864 - DNA, 22 bp, Homo sapiens
cagctggccaatcagggcgccc

SEQ ID NO: 6970865 - DNA, 18 bp, Homo sapiens
ttgaggagttcactgtct

SEQ ID NO: 6970866 - DNA, 22 bp, Homo sapiens
cagagacaggagtgctcccagt

SEQ ID NO: 6970867 - DNA, 22 bp, Homo sapiens
gaaatcagttctgaaatttaca

SEQ ID NO: 6970868 - DNA, 22 bp, Homo sapiens
atttaagggatttggagaccaa

SEQ ID NO: 6970869 - DNA, 22 bp, Homo sapiens
cagtacttgtcctcaggtgtta

SEQ ID NO: 6970870 - DNA, 22 bp, Homo sapiens
ggccaggcactgtgtgagatat

SEQ ID NO: 6970871 - DNA, 22 bp, Homo sapiens
gtgctgaggaaggaagacttat

SEQ ID NO: 6970872 - DNA, 22 bp, Homo sapiens
gcttccagaatgactaggatgt

SEQ ID NO: 6970873 - DNA, 22 bp, Homo sapiens
aaggcagagatattcttgatct

SEQ ID NO: 6970874 - DNA, 22 bp, Homo sapiens
aatggagaccctaaggaagagg

SEQ ID NO: 6970875 - DNA, 22 bp, Homo sapiens
gatcttggaatggcacagctga

SEQ ID NO: 6970876 - DNA, 22 bp, Homo sapiens
atcctgagctacacctgctcct

SEQ ID NO: 6970877 - DNA, 22 bp, Homo sapiens
ttcaactcttcaagatcacatc

SEQ ID NO: 6970878 - DNA, 22 bp, Homo sapiens
tccaggctgtgcatgagtttag

SEQ ID NO: 6970879 - DNA, 22 bp, Homo sapiens
cagatgaccaggctccacccag

SEQ ID NO: 6970880 - DNA, 22 bp, Homo sapiens
ttctgccagtgaaaataatgat

SEQ ID NO: 6970881 - DNA, 22 bp, Homo sapiens
cacagcattaactgggacagct

SEQ ID NO: 6970882 - DNA, 22 bp, Homo sapiens
aataatcctgcccgtctctccg

SEQ ID NO: 6970883 - DNA, 22 bp, Homo sapiens
tggctctcttgtaaggtagtag

SEQ ID NO: 6970884 - DNA, 22 bp, Homo sapiens
ggtgggtatagttagggcctct

SEQ ID NO: 6970885 - DNA, 18 bp, Homo sapiens
agtcatttacttttgtga

SEQ ID NO: 6970886 - DNA, 22 bp, Homo sapiens
tgcatggaattatgggagtggt

SEQ ID NO: 6970887 - DNA, 22 bp, Homo sapiens
ataaaaatgagggcggtagcta

SEQ ID NO: 6970888 - DNA, 23 bp, Homo sapiens
cggatttgactgaggtcctgcca

SEQ ID NO: 6970889 - DNA, 22 bp, Homo sapiens
gagatggccctggcatgtagct

SEQ ID NO: 6970890 - DNA, 22 bp, Homo sapiens
aggccagggtcccacactcgca

SEQ ID NO: 6970891 - DNA, 22 bp, Homo sapiens
agggctgcaccggggcttcgcg

SEQ ID NO: 6970892 - DNA, 22 bp, Homo sapiens
tgtacttctggtgactttatag

SEQ ID NO: 6970893 - DNA, 22 bp, Homo sapiens
gcagccctcgggtactcacgtg

SEQ ID NO: 6970894 - DNA, 22 bp, Homo sapiens
cctgtgcatccggtggtcattg

SEQ ID NO: 6970895 - DNA, 22 bp, Homo sapiens
gagcatgagggaaggcagcaga

SEQ ID NO: 6970896 - DNA, 22 bp, Homo sapiens
cagttgtaatgctttcctctga

SEQ ID NO: 6970897 - DNA, 22 bp, Homo sapiens
tcttcaaaattgattggagaag

SEQ ID NO: 6970898 - DNA, 22 bp, Homo sapiens
tctccagtatctttccaatgaa

SEQ ID NO: 6970899 - DNA, 22 bp, Homo sapiens
atcagcaagactaggggaatac

SEQ ID NO: 6970900 - DNA, 22 bp, Homo sapiens
tgtcagtggtagacccagaggt

SEQ ID NO: 6970901 - DNA, 22 bp, Homo sapiens
ggtgtctgttgcctcctggtta

SEQ ID NO: 6970902 - DNA, 22 bp, Homo sapiens
tttaggaaatacaaggtagcct

SEQ ID NO: 6970903 - DNA, 22 bp, Homo sapiens
gcacttccatctgtcaccaggt

SEQ ID NO: 6970904 - DNA, 22 bp, Homo sapiens
gggctccaaagtaagctttagt

SEQ ID NO: 6970905 - DNA, 22 bp, Homo sapiens
ggccaggctgccctgggagcag

SEQ ID NO: 6970906 - DNA, 22 bp, Homo sapiens
taaacatgttgacatcttacct

SEQ ID NO: 6970907 - DNA, 22 bp, Homo sapiens
atctttggtactattcttatca

SEQ ID NO: 6970908 - DNA, 18 bp, Homo sapiens
tcacagaatattgagtgg

SEQ ID NO: 6970909 - DNA, 22 bp, Homo sapiens
agttctctcccctgctgttcag

SEQ ID NO: 6970910 - DNA, 22 bp, Homo sapiens
agagggctttgattctcagttc

SEQ ID NO: 6970911 - DNA, 22 bp, Homo sapiens
atgcatctatgacttagacatt

SEQ ID NO: 6970912 - DNA, 22 bp, Homo sapiens
tggtaagtaagtgaaacatcca

SEQ ID NO: 6970913 - DNA, 22 bp, Homo sapiens
gaggctgctgagagccctgttt

SEQ ID NO: 6970914 - DNA, 22 bp, Homo sapiens
tcatggattaaattattaagtt

SEQ ID NO: 6970915 - DNA, 22 bp, Homo sapiens
aagcacacctccctggcaggag

SEQ ID NO: 6970916 - DNA, 22 bp, Homo sapiens
gtcttgttaagattttggaata

SEQ ID NO: 6970917 - DNA, 22 bp, Homo sapiens
agcttgttagggcagtggtcgc

SEQ ID NO: 6970918 - DNA, 22 bp, Homo sapiens
atgagcaggaagagcacaaaga

SEQ ID NO: 6970919 - DNA, 22 bp, Homo sapiens
acatgaagcaagaaagatgcta

SEQ ID NO: 6970920 - DNA, 22 bp, Homo sapiens
ggcttctaaggagtatcctttg

SEQ ID NO: 6970921 - DNA, 22 bp, Homo sapiens
agcagtgcctggcacatgtaag

SEQ ID NO: 6970922 - DNA, 22 bp, Homo sapiens
aggtgtgttccaggaatggtga

SEQ ID NO: 6970923 - DNA, 17 bp, Homo sapiens
tgtatttatcatgtcag

SEQ ID NO: 6970924 - DNA, 22 bp, Homo sapiens
ctttggcttgccctggcagtac

SEQ ID NO: 6970925 - DNA, 22 bp, Homo sapiens
aaggccaaagacacctacacag

SEQ ID NO: 6970926 - DNA, 22 bp, Homo sapiens
ttgatctcattgttctcctcag

SEQ ID NO: 6970927 - DNA, 22 bp, Homo sapiens
tcacaaagggagggatagctgg

SEQ ID NO: 6970928 - DNA, 22 bp, Homo sapiens
aaccacagagccccctcagatg

SEQ ID NO: 6970929 - DNA, 22 bp, Homo sapiens
tagattctaagattctaagaat

SEQ ID NO: 6970930 - DNA, 22 bp, Homo sapiens
aaataagtaatgtcttcctttt

SEQ ID NO: 6970931 - DNA, 22 bp, Homo sapiens
actatgtaaactggcgtgggag

SEQ ID NO: 6970932 - DNA, 22 bp, Homo sapiens
tggaagtgctaaactggagtgt

SEQ ID NO: 6970933 - DNA, 22 bp, Homo sapiens
taggaagagctataggtcccca

SEQ ID NO: 6970934 - DNA, 22 bp, Homo sapiens
gctttcagggtcactgtcaaca

SEQ ID NO: 6970935 - DNA, 22 bp, Homo sapiens
gcaggcaattttggaaggtcag

SEQ ID NO: 6970936 - DNA, 22 bp, Homo sapiens
tagttcaaccgtcttctcccct

SEQ ID NO: 6970937 - DNA, 22 bp, Homo sapiens
ctaccagcttctttgtctggga

SEQ ID NO: 6970938 - DNA, 21 bp, Homo sapiens
cagtagtgaggtatttgccaa

SEQ ID NO: 6970939 - DNA, 22 bp, Homo sapiens
atcattgggctccattactaga

SEQ ID NO: 6970940 - DNA, 22 bp, Homo sapiens
cagagacatgtggcctgcacgt

SEQ ID NO: 6970941 - DNA, 19 bp, Homo sapiens
cttctaagtcatttggaat

SEQ ID NO: 6970942 - DNA, 22 bp, Homo sapiens
ttttaagttggattgctaagta

SEQ ID NO: 6970943 - DNA, 22 bp, Homo sapiens
aagtaacaggcatgtgaatgac

SEQ ID NO: 6970944 - DNA, 22 bp, Homo sapiens
gtggagctggcccaagaagctg

SEQ ID NO: 6970945 - DNA, 22 bp, Homo sapiens
agatactacatgaatgggaatt

SEQ ID NO: 6970946 - DNA, 22 bp, Homo sapiens
gattgtaattttcaagaggtaa

SEQ ID NO: 6970947 - DNA, 22 bp, Homo sapiens
ttctcagagctcactgtagtaa

SEQ ID NO: 6970948 - DNA, 22 bp, Homo sapiens
ggagtcccagcaaagccttccc

SEQ ID NO: 6970949 - DNA, 22 bp, Homo sapiens
cagctttctgtctcatgactga

SEQ ID NO: 6970950 - DNA, 22 bp, Homo sapiens
atgcatatatacatacacagtc

SEQ ID NO: 6970951 - DNA, 22 bp, Homo sapiens
ccctggaaggagatgggacatg

SEQ ID NO: 6970952 - DNA, 20 bp, Homo sapiens
ctgaacacagaataagcaca

SEQ ID NO: 6970953 - DNA, 22 bp, Homo sapiens
tgcatatttgtatgatgtttag

SEQ ID NO: 6970954 - DNA, 22 bp, Homo sapiens
ggccagagaatatgccttacgt

SEQ ID NO: 6970955 - DNA, 22 bp, Homo sapiens
tacaaagtgggaaacgaaggtt

SEQ ID NO: 6970956 - DNA, 22 bp, Homo sapiens
atgaagttctcaataatcatgt

SEQ ID NO: 6970957 - DNA, 22 bp, Homo sapiens
atgtttcaaatatatagagttg

SEQ ID NO: 6970958 - DNA, 22 bp, Homo sapiens
agagcttttctgtaataacatc

SEQ ID NO: 6970959 - DNA, 18 bp, Homo sapiens
gtagtagctatgggctca

SEQ ID NO: 6970960 - DNA, 22 bp, Homo sapiens
tctgtgacattgaacatctaca

SEQ ID NO: 6970961 - DNA, 19 bp, Homo sapiens
tgtgatagttgaacctgcc

SEQ ID NO: 6970962 - DNA, 22 bp, Homo sapiens
ctgaggcctcactgtagtccct

SEQ ID NO: 6970963 - DNA, 22 bp, Homo sapiens
tgggagtgaggcagagtctatc

SEQ ID NO: 6970964 - DNA, 22 bp, Homo sapiens
tcaggatccatagactcccaaa

SEQ ID NO: 6970965 - DNA, 22 bp, Homo sapiens
agtgtgtcgagggagggtccag

SEQ ID NO: 6970966 - DNA, 22 bp, Homo sapiens
tagtggcattgttgtgaggatt

SEQ ID NO: 6970967 - DNA, 22 bp, Homo sapiens
ttgagagttaccagcagaggaa

SEQ ID NO: 6970968 - DNA, 18 bp, Homo sapiens
cccttagcctttcctctc

SEQ ID NO: 6970969 - DNA, 22 bp, Homo sapiens
tgatgaggggctcagaggtcag

SEQ ID NO: 6970970 - DNA, 22 bp, Homo sapiens
aagctatgggggagtttcaacc

SEQ ID NO: 6970971 - DNA, 22 bp, Homo sapiens
tatggaatggctattttctagg

SEQ ID NO: 6970972 - DNA, 22 bp, Homo sapiens
tgcatttcccattgtgtggctc

SEQ ID NO: 6970973 - DNA, 22 bp, Homo sapiens
tgtacacacacgtgtgtatcta

SEQ ID NO: 6970974 - DNA, 22 bp, Homo sapiens
caatactgcatctttgcccttt

SEQ ID NO: 6970975 - DNA, 22 bp, Homo sapiens
agaggccagtggctgtgctgtc

SEQ ID NO: 6970976 - DNA, 22 bp, Homo sapiens
ggaagtgtttgtgcagatggcc

SEQ ID NO: 6970977 - DNA, 22 bp, Homo sapiens
aggccaggacacttaagtaaga

SEQ ID NO: 6970978 - DNA, 22 bp, Homo sapiens
acctcctggtgcccaagtgttt

SEQ ID NO: 6970979 - DNA, 22 bp, Homo sapiens
gccagtgtgtcttgcaggctcc

SEQ ID NO: 6970980 - DNA, 22 bp, Homo sapiens
atatcacagtagttgtttagtt

SEQ ID NO: 6970981 - DNA, 22 bp, Homo sapiens
gtggggcttcctggggcaagtt

SEQ ID NO: 6970982 - DNA, 17 bp, Homo sapiens
gggacaccccagtttgt

SEQ ID NO: 6970983 - DNA, 22 bp, Homo sapiens
atattgcatggctttgctggtt

SEQ ID NO: 6970984 - DNA, 22 bp, Homo sapiens
gggatctgagttgtcaggaagg

SEQ ID NO: 6970985 - DNA, 22 bp, Homo sapiens
aagtcttgtctaaggtctctaa

SEQ ID NO: 6970986 - DNA, 22 bp, Homo sapiens
tcagagacctagcaagaaattg

SEQ ID NO: 6970987 - DNA, 22 bp, Homo sapiens
acaatgaacacacaaggaattc

SEQ ID NO: 6970988 - DNA, 22 bp, Homo sapiens
gcgcgcctctgcccggtgttcc

SEQ ID NO: 6970989 - DNA, 22 bp, Homo sapiens
ctgggagacaagagagggctga

SEQ ID NO: 6970990 - DNA, 22 bp, Homo sapiens
aatgcatcagaaatgtgtataa

SEQ ID NO: 6970991 - DNA, 22 bp, Homo sapiens
catctccaggagttctactcat

SEQ ID NO: 6970992 - DNA, 22 bp, Homo sapiens
atacaatgggtgcaaagatgtg

SEQ ID NO: 6970993 - DNA, 22 bp, Homo sapiens
catcattttattaaccaagaaa

SEQ ID NO: 6970994 - DNA, 22 bp, Homo sapiens
gttgggaaggtgaacatgatgc

SEQ ID NO: 6970995 - DNA, 22 bp, Homo sapiens
gatcaaatatattatgccacag

SEQ ID NO: 6970996 - DNA, 22 bp, Homo sapiens
agccaggttgggccttttcttt

SEQ ID NO: 6970997 - DNA, 22 bp, Homo sapiens
tctctctatttatttgtcttgt

SEQ ID NO: 6970998 - DNA, 22 bp, Homo sapiens
tagctcttgatgctggcaggac

SEQ ID NO: 6970999 - DNA, 22 bp, Homo sapiens
aagctcagaggtagataatgtt

SEQ ID NO: 6971000 - DNA, 22 bp, Homo sapiens
tgtttcaagcaatagcatttca

SEQ ID NO: 6971001 - DNA, 22 bp, Homo sapiens
aattcagaagcacaaaacctag

SEQ ID NO: 6971002 - DNA, 22 bp, Homo sapiens
catgtaaaccattgtgagcatc

SEQ ID NO: 6971003 - DNA, 22 bp, Homo sapiens
atgtgtttggttatatggtatt

SEQ ID NO: 6971004 - DNA, 22 bp, Homo sapiens
ccaatttctgcctgagggcttt

SEQ ID NO: 6971005 - DNA, 22 bp, Homo sapiens
cttgatgaggtatgaacctctc

SEQ ID NO: 6971006 - DNA, 22 bp, Homo sapiens
cagtccttgatccaatagtggg

SEQ ID NO: 6971007 - DNA, 22 bp, Homo sapiens
tgcatggagatatactatttga

SEQ ID NO: 6971008 - DNA, 22 bp, Homo sapiens
accagagcgctcaagccttccc

SEQ ID NO: 6971009 - DNA, 22 bp, Homo sapiens
gtgaccatcagagaataacaaa

SEQ ID NO: 6971010 - DNA, 22 bp, Homo sapiens
gctgagagtgtgagatcagatt

SEQ ID NO: 6971011 - DNA, 22 bp, Homo sapiens
accatacacaatttgcaacggt

SEQ ID NO: 6971012 - DNA, 22 bp, Homo sapiens
tacagactgttcaagtgataat

SEQ ID NO: 6971013 - DNA, 22 bp, Homo sapiens
ttaggaaaatggagtcctttta

SEQ ID NO: 6971014 - DNA, 22 bp, Homo sapiens
gtgacccatgcagtggttttgg

SEQ ID NO: 6971015 - DNA, 22 bp, Homo sapiens
cattgcacagccctgtggtgat

SEQ ID NO: 6971016 - DNA, 22 bp, Homo sapiens
ggaagggtttaagcaggagagt

SEQ ID NO: 6971017 - DNA, 23 bp, Homo sapiens
tcagtgcttgggggtgacgcgcc

SEQ ID NO: 6971018 - DNA, 22 bp, Homo sapiens
aggctaaggtgggaggatcgct

SEQ ID NO: 6971019 - DNA, 17 bp, Homo sapiens
atctggaagctagctga

SEQ ID NO: 6971020 - DNA, 22 bp, Homo sapiens
gcttctcggggaggttagccag

SEQ ID NO: 6971021 - DNA, 20 bp, Homo sapiens
acagaactgagaacagtctc

SEQ ID NO: 6971022 - DNA, 22 bp, Homo sapiens
ttctggaggttattaggagtct

SEQ ID NO: 6971023 - DNA, 22 bp, Homo sapiens
agtcttatgtgatttatctttc

SEQ ID NO: 6971024 - DNA, 21 bp, Homo sapiens
taatggtgatggttatgttct

SEQ ID NO: 6971025 - DNA, 22 bp, Homo sapiens
tctcccctggtctcgcgcgctg

SEQ ID NO: 6971026 - DNA, 22 bp, Homo sapiens
ctgctctggtctcttcatgttt

SEQ ID NO: 6971027 - DNA, 22 bp, Homo sapiens
tcaaagtcatggcaggctcaga

SEQ ID NO: 6971028 - DNA, 22 bp, Homo sapiens
gtcaaaacaaagttaagaattc

SEQ ID NO: 6971029 - DNA, 22 bp, Homo sapiens
tcaggcttccaggctctgctga

SEQ ID NO: 6971030 - DNA, 22 bp, Homo sapiens
atccttttcctttgggtgccct

SEQ ID NO: 6971031 - DNA, 22 bp, Homo sapiens
agagagcagtggatcacctagc

SEQ ID NO: 6971032 - DNA, 22 bp, Homo sapiens
ttcagataaactacaaataatt

SEQ ID NO: 6971033 - DNA, 22 bp, Homo sapiens
gacactttaggatttaaaagtc

SEQ ID NO: 6971034 - DNA, 20 bp, Homo sapiens
tacaggagtgagtgggtggg

SEQ ID NO: 6971035 - DNA, 22 bp, Homo sapiens
tgaggattggcaaaactcaggg

SEQ ID NO: 6971036 - DNA, 22 bp, Homo sapiens
ggcagcaaactggcttcaggct

SEQ ID NO: 6971037 - DNA, 22 bp, Homo sapiens
cagctttgtgcaatgcagtctc

SEQ ID NO: 6971038 - DNA, 22 bp, Homo sapiens
tatcacttgcgttttggcagag

SEQ ID NO: 6971039 - DNA, 22 bp, Homo sapiens
ctgctagaatttctggaaaaga

SEQ ID NO: 6971040 - DNA, 22 bp, Homo sapiens
cttgtattgctgttttgcatct

SEQ ID NO: 6971041 - DNA, 22 bp, Homo sapiens
ggagatggagtggattcagcag

SEQ ID NO: 6971042 - DNA, 22 bp, Homo sapiens
catttgaaatagttcattcttg

SEQ ID NO: 6971043 - DNA, 22 bp, Homo sapiens
ggggatctaggatatttcatga

SEQ ID NO: 6971044 - DNA, 23 bp, Homo sapiens
tttcaaattactctgcagatgac

SEQ ID NO: 6971045 - DNA, 22 bp, Homo sapiens
tgggccatttttggaagactgg

SEQ ID NO: 6971046 - DNA, 21 bp, Homo sapiens
agctgcagccatgtacatggc

SEQ ID NO: 6971047 - DNA, 22 bp, Homo sapiens
agaacatctaaatatctgagac

SEQ ID NO: 6971048 - DNA, 22 bp, Homo sapiens
tgctgtgtctttctgtgaaaag

SEQ ID NO: 6971049 - DNA, 22 bp, Homo sapiens
agcatccatccaggaaaattga

SEQ ID NO: 6971050 - DNA, 22 bp, Homo sapiens
agctgctgtggggctcggcctg

SEQ ID NO: 6971051 - DNA, 22 bp, Homo sapiens
caccagagccacttggaggtca

SEQ ID NO: 6971052 - DNA, 22 bp, Homo sapiens
tcactctgcaggaaggagcagc

SEQ ID NO: 6971053 - DNA, 22 bp, Homo sapiens
tcactgctctctaagcatcgcc

SEQ ID NO: 6971054 - DNA, 22 bp, Homo sapiens
cctgggtagactttgaagcatt

SEQ ID NO: 6971055 - DNA, 23 bp, Homo sapiens
tctggccccattctttcccatgt

SEQ ID NO: 6971056 - DNA, 22 bp, Homo sapiens
gtggggcagtggcctgggagca

SEQ ID NO: 6971057 - DNA, 22 bp, Homo sapiens
aatcctgtagattctaattcct

SEQ ID NO: 6971058 - DNA, 22 bp, Homo sapiens
atgaggcagctgctggagaacg

SEQ ID NO: 6971059 - DNA, 22 bp, Homo sapiens
ggaaggcagtgaaggggctgat

SEQ ID NO: 6971060 - DNA, 22 bp, Homo sapiens
catgggctgtgaacccaggctg

SEQ ID NO: 6971061 - DNA, 22 bp, Homo sapiens
ctgggacctgtgtgcctgggcc

SEQ ID NO: 6971062 - DNA, 22 bp, Homo sapiens
tatatggatagtgatcataaga

SEQ ID NO: 6971063 - DNA, 15 bp, Homo sapiens
ctgtggctaacctaa

SEQ ID NO: 6971064 - DNA, 22 bp, Homo sapiens
cacacaggatgaagcagcagaa

SEQ ID NO: 6971065 - DNA, 22 bp, Homo sapiens
agtcatcaccagtacagtgtgc

SEQ ID NO: 6971066 - DNA, 22 bp, Homo sapiens
tgtggtatcaccatccactagt

SEQ ID NO: 6971067 - DNA, 22 bp, Homo sapiens
ctgttgcagaggggcggagagg

SEQ ID NO: 6971068 - DNA, 22 bp, Homo sapiens
gctggcctgagggccgaggctc

SEQ ID NO: 6971069 - DNA, 22 bp, Homo sapiens
attatttgtgtccacagaatac

SEQ ID NO: 6971070 - DNA, 22 bp, Homo sapiens
tgtcctcatcttttccagaaat

SEQ ID NO: 6971071 - DNA, 22 bp, Homo sapiens
cctggctctgaggtatgcctgg

SEQ ID NO: 6971072 - DNA, 22 bp, Homo sapiens
taacagtatagcctaacatttc

SEQ ID NO: 6971073 - DNA, 22 bp, Homo sapiens
tccacagggatgttgagttctt

SEQ ID NO: 6971074 - DNA, 22 bp, Homo sapiens
gaggacctttagtagaagtgca

SEQ ID NO: 6971075 - DNA, 22 bp, Homo sapiens
atgtcactgttgttattgttat

SEQ ID NO: 6971076 - DNA, 22 bp, Homo sapiens
cagggaccctactagctcacac

SEQ ID NO: 6971077 - DNA, 22 bp, Homo sapiens
tcagaatggacccagactatag

SEQ ID NO: 6971078 - DNA, 22 bp, Homo sapiens
agaacactgtaaagtcattgaa

SEQ ID NO: 6971079 - DNA, 22 bp, Homo sapiens
tagatggctggtgttctgagct

SEQ ID NO: 6971080 - DNA, 22 bp, Homo sapiens
cacaggctctccagggcctgga

SEQ ID NO: 6971081 - DNA, 22 bp, Homo sapiens
ggctttgcgaagatggcggcgc

SEQ ID NO: 6971082 - DNA, 22 bp, Homo sapiens
atggccagcaaggtagggcaat

SEQ ID NO: 6971083 - DNA, 22 bp, Homo sapiens
tttttacagtcatggtcactca

SEQ ID NO: 6971084 - DNA, 22 bp, Homo sapiens
tgaagcttgagtgtcagttcct

SEQ ID NO: 6971085 - DNA, 22 bp, Homo sapiens
tggagttaaaaacaggatgcac

SEQ ID NO: 6971086 - DNA, 22 bp, Homo sapiens
tagagggaaggaagaatggatt

SEQ ID NO: 6971087 - DNA, 22 bp, Homo sapiens
gagcaccctacctgccactgag

SEQ ID NO: 6971088 - DNA, 22 bp, Homo sapiens
tcagagtgcagggagtagcagc

SEQ ID NO: 6971089 - DNA, 22 bp, Homo sapiens
aaggctcaaagaagctaagtga

SEQ ID NO: 6971090 - DNA, 22 bp, Homo sapiens
gaatcttagaaaggttaaggaa

SEQ ID NO: 6971091 - DNA, 18 bp, Homo sapiens
ccacagcagagttcttac

SEQ ID NO: 6971092 - DNA, 22 bp, Homo sapiens
cccacagaatgccaatgagacc

SEQ ID NO: 6971093 - DNA, 22 bp, Homo sapiens
tttccaactgtaccccagtgtt

SEQ ID NO: 6971094 - DNA, 22 bp, Homo sapiens
tgaggccagtctcatcacaggc

SEQ ID NO: 6971095 - DNA, 21 bp, Homo sapiens
caatttcatgggaagatggga

SEQ ID NO: 6971096 - DNA, 22 bp, Homo sapiens
ttatggaataacctttctgaaa

SEQ ID NO: 6971097 - DNA, 17 bp, Homo sapiens
tcctgtttatcattgat

SEQ ID NO: 6971098 - DNA, 22 bp, Homo sapiens
cagaatctacaccctcagaaat

SEQ ID NO: 6971099 - DNA, 23 bp, Homo sapiens
tgagtgtgttccctgtgagattt

SEQ ID NO: 6971100 - DNA, 22 bp, Homo sapiens
tgtcatgtaaagagtaaatggt

SEQ ID NO: 6971101 - DNA, 22 bp, Homo sapiens
gtgcaggatttatagcccagct

SEQ ID NO: 6971102 - DNA, 22 bp, Homo sapiens
tcagaggatgctgttctttaat

SEQ ID NO: 6971103 - DNA, 22 bp, Homo sapiens
cagatttactccctgctgctgc

SEQ ID NO: 6971104 - DNA, 22 bp, Homo sapiens
aatgtttgtcatcacacagata

SEQ ID NO: 6971105 - DNA, 22 bp, Homo sapiens
tccttagagatactgtcttgaa

SEQ ID NO: 6971106 - DNA, 22 bp, Homo sapiens
tattagttgcaaaacattgact

SEQ ID NO: 6971107 - DNA, 22 bp, Homo sapiens
ccagctctaaacggctctgtgg

SEQ ID NO: 6971108 - DNA, 22 bp, Homo sapiens
tttcagaaattatattagatgc

SEQ ID NO: 6971109 - DNA, 22 bp, Homo sapiens
tccaaggctccggccctggcgt

SEQ ID NO: 6971110 - DNA, 22 bp, Homo sapiens
tggagagcccgagacatcctgt

SEQ ID NO: 6971111 - DNA, 22 bp, Homo sapiens
tgagagatgaagttagttgttc

SEQ ID NO: 6971112 - DNA, 19 bp, Homo sapiens
atgtaggggagttgtgaag

SEQ ID NO: 6971113 - DNA, 22 bp, Homo sapiens
tagtgacctagtgcctggcctt

SEQ ID NO: 6971114 - DNA, 22 bp, Homo sapiens
tctgcaggtgggcccctagaat

SEQ ID NO: 6971115 - DNA, 22 bp, Homo sapiens
cactaggcgccgggtggctgtg

SEQ ID NO: 6971116 - DNA, 22 bp, Homo sapiens
agcgcctgcggtgtgagcctgc

SEQ ID NO: 6971117 - DNA, 18 bp, Homo sapiens
ggaaggtgatgtgaaaag

SEQ ID NO: 6971118 - DNA, 18 bp, Homo sapiens
gcacagcgaaaaactagt

SEQ ID NO: 6971119 - DNA, 22 bp, Homo sapiens
tttgatgcatggatgtattttc

SEQ ID NO: 6971120 - DNA, 22 bp, Homo sapiens
ctgtgtctgcctgggatccatt

SEQ ID NO: 6971121 - DNA, 22 bp, Homo sapiens
gaagacctgtttatgctgcatt

SEQ ID NO: 6971122 - DNA, 22 bp, Homo sapiens
atctgtactaattaattaatgt

SEQ ID NO: 6971123 - DNA, 22 bp, Homo sapiens
gcttcagattcttttcatgtct

SEQ ID NO: 6971124 - DNA, 22 bp, Homo sapiens
aatgcaaattatcaggcttctc

SEQ ID NO: 6971125 - DNA, 22 bp, Homo sapiens
cagttttaaattttgaatgtct

SEQ ID NO: 6971126 - DNA, 22 bp, Homo sapiens
tttgtaacatcccaacaaattt

SEQ ID NO: 6971127 - DNA, 22 bp, Homo sapiens
agcaaacagatgtctcctttag

SEQ ID NO: 6971128 - DNA, 20 bp, Homo sapiens
acatggaaggtcaaactatc

SEQ ID NO: 6971129 - DNA, 22 bp, Homo sapiens
tgtccaggttagcttcaaacac

SEQ ID NO: 6971130 - DNA, 22 bp, Homo sapiens
tatgaacttttgatgtgacatg

SEQ ID NO: 6971131 - DNA, 22 bp, Homo sapiens
aactgcgattacttttgcacca

SEQ ID NO: 6971132 - DNA, 18 bp, Homo sapiens
gagctcttcccttttctc

SEQ ID NO: 6971133 - DNA, 22 bp, Homo sapiens
tgacagagctgggatttgaagc

SEQ ID NO: 6971134 - DNA, 21 bp, Homo sapiens
gcagagcctgaggttcttgag

SEQ ID NO: 6971135 - DNA, 22 bp, Homo sapiens
ctgcagggtttttcaaggacaa

SEQ ID NO: 6971136 - DNA, 22 bp, Homo sapiens
agcagttacgggcctatctagg

SEQ ID NO: 6971137 - DNA, 22 bp, Homo sapiens
tatccatcttctttgagaatgg

SEQ ID NO: 6971138 - DNA, 22 bp, Homo sapiens
ccagtgacttgccaggtggatc

SEQ ID NO: 6971139 - DNA, 22 bp, Homo sapiens
atgcggtgaattgactgtttct

SEQ ID NO: 6971140 - DNA, 21 bp, Homo sapiens
tctgatgttcacaccctgtat

SEQ ID NO: 6971141 - DNA, 22 bp, Homo sapiens
tttcacataaatggagtaaaga

SEQ ID NO: 6971142 - DNA, 18 bp, Homo sapiens
gcaggcctagaacttggt

SEQ ID NO: 6971143 - DNA, 22 bp, Homo sapiens
gaaagcactgtgagatcttgtt

SEQ ID NO: 6971144 - DNA, 22 bp, Homo sapiens
aatgcattctcggtttgtgtgt

SEQ ID NO: 6971145 - DNA, 22 bp, Homo sapiens
tctttctgatgggaagggtcaa

SEQ ID NO: 6971146 - DNA, 23 bp, Homo sapiens
aaaggtctctgagccttggtttc

SEQ ID NO: 6971147 - DNA, 22 bp, Homo sapiens
aagggctccatccttataaatg

SEQ ID NO: 6971148 - DNA, 22 bp, Homo sapiens
gtgaggcagcaggagcctctgt

SEQ ID NO: 6971149 - DNA, 22 bp, Homo sapiens
cagatatattcatttgcagtgc

SEQ ID NO: 6971150 - DNA, 22 bp, Homo sapiens
aggccaggaccattagcccaga

SEQ ID NO: 6971151 - DNA, 19 bp, Homo sapiens
agaggcaagggctcatgac

SEQ ID NO: 6971152 - DNA, 22 bp, Homo sapiens
atgtggctggtagttgacaact

SEQ ID NO: 6971153 - DNA, 22 bp, Homo sapiens
agccagactgtgatgtgattaa

SEQ ID NO: 6971154 - DNA, 22 bp, Homo sapiens
tggagctgagcacctccagggc

SEQ ID NO: 6971155 - DNA, 22 bp, Homo sapiens
tagtgaaagtcaaagacagcta

SEQ ID NO: 6971156 - DNA, 22 bp, Homo sapiens
gctgcaccagctccaccagggc

SEQ ID NO: 6971157 - DNA, 22 bp, Homo sapiens
gttcagcaagtactcagtccac

SEQ ID NO: 6971158 - DNA, 22 bp, Homo sapiens
gccaggctggtcttgaactcct

SEQ ID NO: 6971159 - DNA, 19 bp, Homo sapiens
tttctgtctgtgttttgcc

SEQ ID NO: 6971160 - DNA, 22 bp, Homo sapiens
atacagatgcttgctcgtgact

SEQ ID NO: 6971161 - DNA, 22 bp, Homo sapiens
taaacagctactgtgtcaaagg

SEQ ID NO: 6971162 - DNA, 22 bp, Homo sapiens
agcagcagggtgatagtgccca

SEQ ID NO: 6971163 - DNA, 22 bp, Homo sapiens
aggcagctttctgtaggggtgt

SEQ ID NO: 6971164 - DNA, 22 bp, Homo sapiens
gctgtactgacttgcttagctg

SEQ ID NO: 6971165 - DNA, 22 bp, Homo sapiens
tttacgaaaagtgactaatagg

SEQ ID NO: 6971166 - DNA, 23 bp, Homo sapiens
tgattacaagggccaaagaaagg

SEQ ID NO: 6971167 - DNA, 22 bp, Homo sapiens
tcctggagagaggcctggaaga

SEQ ID NO: 6971168 - DNA, 22 bp, Homo sapiens
aggctagctttggctcagtaaa

SEQ ID NO: 6971169 - DNA, 22 bp, Homo sapiens
gaggcaggcagattgcttgagg

SEQ ID NO: 6971170 - DNA, 20 bp, Homo sapiens
tctgcccaccccggctccca

SEQ ID NO: 6971171 - DNA, 22 bp, Homo sapiens
tgagaaatgggtctgctgaaga

SEQ ID NO: 6971172 - DNA, 22 bp, Homo sapiens
agcacagcttcaccgagcccat

SEQ ID NO: 6971173 - DNA, 22 bp, Homo sapiens
tggtgactgattggtgttctct

SEQ ID NO: 6971174 - DNA, 14 bp, Homo sapiens
tgtcttggaggtct

SEQ ID NO: 6971175 - DNA, 22 bp, Homo sapiens
aaggccatctacttacggaatt

SEQ ID NO: 6971176 - DNA, 22 bp, Homo sapiens
acagcttgtctaccccagaggt

SEQ ID NO: 6971177 - DNA, 22 bp, Homo sapiens
ttacttttgcaccaaactaata

SEQ ID NO: 6971178 - DNA, 22 bp, Homo sapiens
tgaaatgaatgtgattcgatag

SEQ ID NO: 6971179 - DNA, 22 bp, Homo sapiens
aagtgaagaaatacatgagaat

SEQ ID NO: 6971180 - DNA, 22 bp, Homo sapiens
agcagaatgtgtgtgacaagta

SEQ ID NO: 6971181 - DNA, 22 bp, Homo sapiens
atgcctgtaaaacagcacccag

SEQ ID NO: 6971182 - DNA, 22 bp, Homo sapiens
acgaagacgccgttcttgccga

SEQ ID NO: 6971183 - DNA, 18 bp, Homo sapiens
agtccaatccttgattct

SEQ ID NO: 6971184 - DNA, 22 bp, Homo sapiens
tgacacagttgtcgactctaca

SEQ ID NO: 6971185 - DNA, 22 bp, Homo sapiens
taggccaggaatcagcaagctt

SEQ ID NO: 6971186 - DNA, 22 bp, Homo sapiens
acgcccggtctccatagttttt

SEQ ID NO: 6971187 - DNA, 22 bp, Homo sapiens
ctacctttctgactcttgggat

SEQ ID NO: 6971188 - DNA, 22 bp, Homo sapiens
tcactgctacacaagtttctgc

SEQ ID NO: 6971189 - DNA, 22 bp, Homo sapiens
tggggttgaagaaaggatctag

SEQ ID NO: 6971190 - DNA, 22 bp, Homo sapiens
gtcactatcctgtgttgtttgt

SEQ ID NO: 6971191 - DNA, 22 bp, Homo sapiens
acaggcacctccaggggtatgt

SEQ ID NO: 6971192 - DNA, 22 bp, Homo sapiens
ggagtccggcccagagctccct

SEQ ID NO: 6971193 - DNA, 22 bp, Homo sapiens
aagtaatgatgtcatcacagag

SEQ ID NO: 6971194 - DNA, 22 bp, Homo sapiens
gcagtgttgagtggtggctgaa

SEQ ID NO: 6971195 - DNA, 22 bp, Homo sapiens
ttgctgaaaagctggcctttgt

SEQ ID NO: 6971196 - DNA, 22 bp, Homo sapiens
gcctgcttctcagtcagcttgg

SEQ ID NO: 6971197 - DNA, 22 bp, Homo sapiens
tctgctctgtactgcactggcc

SEQ ID NO: 6971198 - DNA, 22 bp, Homo sapiens
tccttcagaggacggcagccag

SEQ ID NO: 6971199 - DNA, 22 bp, Homo sapiens
ggagccttgggcgctctcccat

SEQ ID NO: 6971200 - DNA, 23 bp, Homo sapiens
agtgttcagcatgtagtaaatac

SEQ ID NO: 6971201 - DNA, 22 bp, Homo sapiens
tgtggttatagtcatgggacag

SEQ ID NO: 6971202 - DNA, 22 bp, Homo sapiens
ggtggactcaaaatgtgcttga

SEQ ID NO: 6971203 - DNA, 22 bp, Homo sapiens
tgaggggagaagcagcagcctg

SEQ ID NO: 6971204 - DNA, 22 bp, Homo sapiens
aagaataagaggatttagaaca

SEQ ID NO: 6971205 - DNA, 20 bp, Homo sapiens
gccagctggtcccaattatg

SEQ ID NO: 6971206 - DNA, 22 bp, Homo sapiens
agtcagagtgtgcaggccggct

SEQ ID NO: 6971207 - DNA, 19 bp, Homo sapiens
ggtcagagagatccaggct

SEQ ID NO: 6971208 - DNA, 22 bp, Homo sapiens
atttagtctcccttatcaagga

SEQ ID NO: 6971209 - DNA, 22 bp, Homo sapiens
gactagaatagggggtaggaag

SEQ ID NO: 6971210 - DNA, 22 bp, Homo sapiens
tgctggctggcctggcctggac

SEQ ID NO: 6971211 - DNA, 22 bp, Homo sapiens
attgttttgtagaatgaccctt

SEQ ID NO: 6971212 - DNA, 22 bp, Homo sapiens
taagacataaataggcttttta

SEQ ID NO: 6971213 - DNA, 22 bp, Homo sapiens
aattgcttgatgactagtaatt

SEQ ID NO: 6971214 - DNA, 22 bp, Homo sapiens
agatgctgaattattgtgcttt

SEQ ID NO: 6971215 - DNA, 22 bp, Homo sapiens
tagctggttaatgcagaaggag

SEQ ID NO: 6971216 - DNA, 22 bp, Homo sapiens
tttcacagctgggaagagatat

SEQ ID NO: 6971217 - DNA, 22 bp, Homo sapiens
atgattcagggagttttcagga

SEQ ID NO: 6971218 - DNA, 22 bp, Homo sapiens
tcttgggcctttagacatgact

SEQ ID NO: 6971219 - DNA, 21 bp, Homo sapiens
ccttagtcttccacatagtcc

SEQ ID NO: 6971220 - DNA, 19 bp, Homo sapiens
agtgagtggggaaggccct

SEQ ID NO: 6971221 - DNA, 22 bp, Homo sapiens
tgcaccaagcccagctggagaa

SEQ ID NO: 6971222 - DNA, 17 bp, Homo sapiens
cactgtgggggcattta

SEQ ID NO: 6971223 - DNA, 16 bp, Homo sapiens
gctggagtcctggagc

SEQ ID NO: 6971224 - DNA, 22 bp, Homo sapiens
aaactttgttcgtctgatgtgg

SEQ ID NO: 6971225 - DNA, 22 bp, Homo sapiens
cacagtgagctgggcatcagtt

SEQ ID NO: 6971226 - DNA, 22 bp, Homo sapiens
catgtcagggcttcctcctctc

SEQ ID NO: 6971227 - DNA, 22 bp, Homo sapiens
tgatgttcaacaagtacatatt

SEQ ID NO: 6971228 - DNA, 22 bp, Homo sapiens
tctgaggaaaagaggaggtagc

SEQ ID NO: 6971229 - DNA, 22 bp, Homo sapiens
ctgcatatgagaataggagaaa

SEQ ID NO: 6971230 - DNA, 22 bp, Homo sapiens
ttctctaaaattaagtgaggta

SEQ ID NO: 6971231 - DNA, 22 bp, Homo sapiens
taggctcagaggcagaggctga

SEQ ID NO: 6971232 - DNA, 22 bp, Homo sapiens
tgtaaacataccagagccaagt

SEQ ID NO: 6971233 - DNA, 22 bp, Homo sapiens
ctggctccctcgctgaggtgct

SEQ ID NO: 6971234 - DNA, 22 bp, Homo sapiens
cctagactagaggcagggagcc

SEQ ID NO: 6971235 - DNA, 23 bp, Homo sapiens
gacacctttgccagatcaagatg

SEQ ID NO: 6971236 - DNA, 22 bp, Homo sapiens
tattgcaagtggcataaaattt

SEQ ID NO: 6971237 - DNA, 22 bp, Homo sapiens
accttagaccagcaagatattt

SEQ ID NO: 6971238 - DNA, 22 bp, Homo sapiens
taaggcacccgtgagctgccag

SEQ ID NO: 6971239 - DNA, 22 bp, Homo sapiens
gccagtctgctcccacaagttc

SEQ ID NO: 6971240 - DNA, 22 bp, Homo sapiens
aagttgctaatgatgtgtttgc

SEQ ID NO: 6971241 - DNA, 22 bp, Homo sapiens
gctcatctgccccaggagatcc

SEQ ID NO: 6971242 - DNA, 22 bp, Homo sapiens
cctggctgtgcatgtttctatg

SEQ ID NO: 6971243 - DNA, 22 bp, Homo sapiens
tatctgtgaaatgtgtttgtat

SEQ ID NO: 6971244 - DNA, 22 bp, Homo sapiens
acatgcttgtttttcacaacct

SEQ ID NO: 6971245 - DNA, 22 bp, Homo sapiens
ggccacctctgccctaccgagt

SEQ ID NO: 6971246 - DNA, 22 bp, Homo sapiens
attgttcattgtacacctagta

SEQ ID NO: 6971247 - DNA, 22 bp, Homo sapiens
caggcagagtgaggtggtctaa

SEQ ID NO: 6971248 - DNA, 22 bp, Homo sapiens
actgaggttgaaatagtgatgt

SEQ ID NO: 6971249 - DNA, 22 bp, Homo sapiens
agaatttgtaaaagataagaca

SEQ ID NO: 6971250 - DNA, 20 bp, Homo sapiens
tggaagaagaactcaggctt

SEQ ID NO: 6971251 - DNA, 22 bp, Homo sapiens
aatgatggatttagacaagctg

SEQ ID NO: 6971252 - DNA, 22 bp, Homo sapiens
taacacattttcctcatacgga

SEQ ID NO: 6971253 - DNA, 22 bp, Homo sapiens
atgtaaggtttcttcctgttcc

SEQ ID NO: 6971254 - DNA, 22 bp, Homo sapiens
gaaggcttattttctttgtaaa

SEQ ID NO: 6971255 - DNA, 22 bp, Homo sapiens
aacagtttatgataaattctta

SEQ ID NO: 6971256 - DNA, 22 bp, Homo sapiens
gaacaatgaaagacataaactc

SEQ ID NO: 6971257 - DNA, 22 bp, Homo sapiens
gccaggaaagcaaaatcaccca

SEQ ID NO: 6971258 - DNA, 22 bp, Homo sapiens
cttgggaggcagaggttgcagt

SEQ ID NO: 6971259 - DNA, 22 bp, Homo sapiens
gacagcattccatctgcaggtt

SEQ ID NO: 6971260 - DNA, 22 bp, Homo sapiens
aaggacatttctgactaatgca

SEQ ID NO: 6971261 - DNA, 22 bp, Homo sapiens
atttctgctctgacctgaaagt

SEQ ID NO: 6971262 - DNA, 22 bp, Homo sapiens
gtgagtctgtgggtgggaactg

SEQ ID NO: 6971263 - DNA, 22 bp, Homo sapiens
cttcagtgttggttcattacga

SEQ ID NO: 6971264 - DNA, 22 bp, Homo sapiens
ttcttgctcaatgtctgtttaa

SEQ ID NO: 6971265 - DNA, 22 bp, Homo sapiens
gttgcataaagccttcctcata

SEQ ID NO: 6971266 - DNA, 22 bp, Homo sapiens
atattaggttggtgcaaaagta

SEQ ID NO: 6971267 - DNA, 22 bp, Homo sapiens
tttctagaggctccaggggagt

SEQ ID NO: 6971268 - DNA, 22 bp, Homo sapiens
tagaggtgttgttgatatagaa

SEQ ID NO: 6971269 - DNA, 22 bp, Homo sapiens
tggctttaaatctgtattcata

SEQ ID NO: 6971270 - DNA, 22 bp, Homo sapiens
gcaattgctttagggaaaggta

SEQ ID NO: 6971271 - DNA, 22 bp, Homo sapiens
aaagaatcgtgtgtagtttgaa

SEQ ID NO: 6971272 - DNA, 19 bp, Homo sapiens
gttccgggagtaggccggg

SEQ ID NO: 6971273 - DNA, 22 bp, Homo sapiens
ccaggcccaccttggccactta

SEQ ID NO: 6971274 - DNA, 22 bp, Homo sapiens
cttagaaggaacagtttagtgc

SEQ ID NO: 6971275 - DNA, 22 bp, Homo sapiens
gtcctgagccctcagcacagca

SEQ ID NO: 6971276 - DNA, 22 bp, Homo sapiens
tgtagactttctttgtgttagt

SEQ ID NO: 6971277 - DNA, 22 bp, Homo sapiens
agcggctggaccagcgttcaag

SEQ ID NO: 6971278 - DNA, 22 bp, Homo sapiens
aaggcagccttttgagttgatt

SEQ ID NO: 6971279 - DNA, 22 bp, Homo sapiens
actcaaatagcaacggtgagaa

SEQ ID NO: 6971280 - DNA, 22 bp, Homo sapiens
tgcccacagctcagggctgctc

SEQ ID NO: 6971281 - DNA, 22 bp, Homo sapiens
tcagccctagcctcagtccagg

SEQ ID NO: 6971282 - DNA, 22 bp, Homo sapiens
aagctaagtataggtgaatcct

SEQ ID NO: 6971283 - DNA, 22 bp, Homo sapiens
taacagtattgaagataaacta

SEQ ID NO: 6971284 - DNA, 22 bp, Homo sapiens
ccgtctgcagcctccaggagtt

SEQ ID NO: 6971285 - DNA, 22 bp, Homo sapiens
tagtcacatgatcacaggatcg

SEQ ID NO: 6971286 - DNA, 21 bp, Homo sapiens
tcctgcagggcagcagagtgg

SEQ ID NO: 6971287 - DNA, 22 bp, Homo sapiens
gaaatgctacacttgttaatga

SEQ ID NO: 6971288 - DNA, 22 bp, Homo sapiens
gagccctgtgattctgttgtgt

SEQ ID NO: 6971289 - DNA, 22 bp, Homo sapiens
tgaggctggatgggatgcctcc

SEQ ID NO: 6971290 - DNA, 22 bp, Homo sapiens
tctgccaccacctacactagta

SEQ ID NO: 6971291 - DNA, 22 bp, Homo sapiens
actgatccccaggaatgaaatt

SEQ ID NO: 6971292 - DNA, 22 bp, Homo sapiens
tctggctgttttagatgagctc

SEQ ID NO: 6971293 - DNA, 22 bp, Homo sapiens
agctccagaagcctgcaaggta

SEQ ID NO: 6971294 - DNA, 22 bp, Homo sapiens
caaatactaaacataagatttt

SEQ ID NO: 6971295 - DNA, 22 bp, Homo sapiens
attgcaagtcagagtgcaggtg

SEQ ID NO: 6971296 - DNA, 22 bp, Homo sapiens
tatcagtagggttgaactttgg

SEQ ID NO: 6971297 - DNA, 22 bp, Homo sapiens
tcagtcatctctgacagctagc

SEQ ID NO: 6971298 - DNA, 22 bp, Homo sapiens
gccaccagggggtgcaaggtcc

SEQ ID NO: 6971299 - DNA, 17 bp, Homo sapiens
tagcacaaagcaggatt

SEQ ID NO: 6971300 - DNA, 22 bp, Homo sapiens
gccctgctgtttagagagctac

SEQ ID NO: 6971301 - DNA, 22 bp, Homo sapiens
gctgagccctcatccctagttt

SEQ ID NO: 6971302 - DNA, 22 bp, Homo sapiens
tacttagtgttcttgtattgac

SEQ ID NO: 6971303 - DNA, 22 bp, Homo sapiens
ggatgtttatcctatcttagtt

SEQ ID NO: 6971304 - DNA, 22 bp, Homo sapiens
atgagcatctgagccagtgact

SEQ ID NO: 6971305 - DNA, 22 bp, Homo sapiens
atgacataaagctatgctaggt

SEQ ID NO: 6971306 - DNA, 22 bp, Homo sapiens
tactagttcccagctaaaagta

SEQ ID NO: 6971307 - DNA, 21 bp, Homo sapiens
tcctcctggccaggcggcccc

SEQ ID NO: 6971308 - DNA, 22 bp, Homo sapiens
cacatcattcaatggtgatatt

SEQ ID NO: 6971309 - DNA, 22 bp, Homo sapiens
cctgacccaggagcaaagtcga

SEQ ID NO: 6971310 - DNA, 22 bp, Homo sapiens
aactttctaattttggctgagc

SEQ ID NO: 6971311 - DNA, 22 bp, Homo sapiens
acttggttgcttctgaaatgac

SEQ ID NO: 6971312 - DNA, 22 bp, Homo sapiens
aagagcaccttaattatgcaga

SEQ ID NO: 6971313 - DNA, 22 bp, Homo sapiens
gcaagcacagatagactcagcc

SEQ ID NO: 6971314 - DNA, 22 bp, Homo sapiens
agctgcagcttcctagtccagc

SEQ ID NO: 6971315 - DNA, 20 bp, Homo sapiens
gcactgttacaaagcacacc

SEQ ID NO: 6971316 - DNA, 22 bp, Homo sapiens
aggagaggaatcattattacaa

SEQ ID NO: 6971317 - DNA, 19 bp, Homo sapiens
gggcggagcctgacctggg

SEQ ID NO: 6971318 - DNA, 22 bp, Homo sapiens
tctgagctgctaggtatgcatt

SEQ ID NO: 6971319 - DNA, 22 bp, Homo sapiens
tgcaatcagaaagttcagcggt

SEQ ID NO: 6971320 - DNA, 23 bp, Homo sapiens
tcagtaaatggtaaagtctcttc

SEQ ID NO: 6971321 - DNA, 22 bp, Homo sapiens
cctctttgactctcaggtcttt

SEQ ID NO: 6971322 - DNA, 22 bp, Homo sapiens
tctctgaagagctcagactagt

SEQ ID NO: 6971323 - DNA, 22 bp, Homo sapiens
ttagaggttctatgtgtctgga

SEQ ID NO: 6971324 - DNA, 22 bp, Homo sapiens
agctcctgcaccaggggcccct

SEQ ID NO: 6971325 - DNA, 22 bp, Homo sapiens
taatgtacaagaggctagggtg

SEQ ID NO: 6971326 - DNA, 22 bp, Homo sapiens
tgggcctgttggggttgagtta

SEQ ID NO: 6971327 - DNA, 19 bp, Homo sapiens
gtatttcaggacaagacgt

SEQ ID NO: 6971328 - DNA, 22 bp, Homo sapiens
aagggcaggcacccaccctcac

SEQ ID NO: 6971329 - DNA, 22 bp, Homo sapiens
ttttgtatcctccctttcactg

SEQ ID NO: 6971330 - DNA, 22 bp, Homo sapiens
attgtattctgcacctttgtta

SEQ ID NO: 6971331 - DNA, 20 bp, Homo sapiens
aagagaggaagttatactag

SEQ ID NO: 6971332 - DNA, 21 bp, Homo sapiens
acctcctggcatcctgttccc

SEQ ID NO: 6971333 - DNA, 22 bp, Homo sapiens
cagattactttgtagcagtcag

SEQ ID NO: 6971334 - DNA, 22 bp, Homo sapiens
aagcacaggggaaataagttgt

SEQ ID NO: 6971335 - DNA, 22 bp, Homo sapiens
atgcctcccctgtgtcttttat

SEQ ID NO: 6971336 - DNA, 22 bp, Homo sapiens
cggtctgatctggaaatagggc

SEQ ID NO: 6971337 - DNA, 22 bp, Homo sapiens
atgacacttggtgatactttgt

SEQ ID NO: 6971338 - DNA, 22 bp, Homo sapiens
gctgtttacatgaaaaatgctc

SEQ ID NO: 6971339 - DNA, 22 bp, Homo sapiens
atgcataaagaaagctatctgg

SEQ ID NO: 6971340 - DNA, 22 bp, Homo sapiens
cggggcagagggtcttctccag

SEQ ID NO: 6971341 - DNA, 22 bp, Homo sapiens
gatgcaaagcatttttgtgtgt

SEQ ID NO: 6971342 - DNA, 22 bp, Homo sapiens
cattcacaactgagcattgttg

SEQ ID NO: 6971343 - DNA, 22 bp, Homo sapiens
ggtcacagctttttcagcagca

SEQ ID NO: 6971344 - DNA, 22 bp, Homo sapiens
tgcagcagggacctctatgtga

SEQ ID NO: 6971345 - DNA, 22 bp, Homo sapiens
cagtgtgggtttgggaggagta

SEQ ID NO: 6971346 - DNA, 22 bp, Homo sapiens
ctttcagggcagacaacgagca

SEQ ID NO: 6971347 - DNA, 21 bp, Homo sapiens
aatgtctttgtccatgctctg

SEQ ID NO: 6971348 - DNA, 23 bp, Homo sapiens
actctctaaggatttgatgcaaa

SEQ ID NO: 6971349 - DNA, 22 bp, Homo sapiens
caagccagtttgtagttctctc

SEQ ID NO: 6971350 - DNA, 21 bp, Homo sapiens
gatgaagcaatctttctgttg

SEQ ID NO: 6971351 - DNA, 22 bp, Homo sapiens
aggctggagtgcagtggcgtga

SEQ ID NO: 6971352 - DNA, 22 bp, Homo sapiens
atgttattttggaaaatacaaa

SEQ ID NO: 6971353 - DNA, 22 bp, Homo sapiens
tctgagcacaattacttacatc

SEQ ID NO: 6971354 - DNA, 22 bp, Homo sapiens
acctagaatgaagcaatgctgt

SEQ ID NO: 6971355 - DNA, 22 bp, Homo sapiens
ggcaaattgctgcaattactta

SEQ ID NO: 6971356 - DNA, 22 bp, Homo sapiens
gggatctgatgcactgctgaaa

SEQ ID NO: 6971357 - DNA, 22 bp, Homo sapiens
gcttccaggcttcctacctttg

SEQ ID NO: 6971358 - DNA, 22 bp, Homo sapiens
ctcacagttggagaatttagat

SEQ ID NO: 6971359 - DNA, 22 bp, Homo sapiens
cacagctttgctttccttaata

SEQ ID NO: 6971360 - DNA, 22 bp, Homo sapiens
tgaggttagctgggatttcatg

SEQ ID NO: 6971361 - DNA, 22 bp, Homo sapiens
tgcctggcatctagccctggga

SEQ ID NO: 6971362 - DNA, 22 bp, Homo sapiens
tctgaaagaagggcagtctttt

SEQ ID NO: 6971363 - DNA, 22 bp, Homo sapiens
ggtcaggaaaagactccccaga

SEQ ID NO: 6971364 - DNA, 22 bp, Homo sapiens
actttcttatccatgatctcac

SEQ ID NO: 6971365 - DNA, 22 bp, Homo sapiens
tttgctgatattttgctgatac

SEQ ID NO: 6971366 - DNA, 22 bp, Homo sapiens
atgaaagcacgtgggaagataa

SEQ ID NO: 6971367 - DNA, 22 bp, Homo sapiens
tcctggtgaggactccaagata

SEQ ID NO: 6971368 - DNA, 22 bp, Homo sapiens
ataatgtaaggctccctacagt

SEQ ID NO: 6971369 - DNA, 22 bp, Homo sapiens
cattctggaccaagctgggtgc

SEQ ID NO: 6971370 - DNA, 23 bp, Homo sapiens
aggaagttaaggcagacagacag

SEQ ID NO: 6971371 - DNA, 22 bp, Homo sapiens
tgggactgtgacctccagggta

SEQ ID NO: 6971372 - DNA, 22 bp, Homo sapiens
tgccaattcgcagtgagtattt

SEQ ID NO: 6971373 - DNA, 22 bp, Homo sapiens
gtcaaataattttctcaatagt

SEQ ID NO: 6971374 - DNA, 22 bp, Homo sapiens
atggccctgtttatggtaaggc

SEQ ID NO: 6971375 - DNA, 22 bp, Homo sapiens
ctggcctctctgagcagggagc

SEQ ID NO: 6971376 - DNA, 22 bp, Homo sapiens
atctgctgtgtgtaatggaatg

SEQ ID NO: 6971377 - DNA, 22 bp, Homo sapiens
gggcaggagagggccacctgga

SEQ ID NO: 6971378 - DNA, 22 bp, Homo sapiens
ctcaacacgtcctcgagaagcg

SEQ ID NO: 6971379 - DNA, 22 bp, Homo sapiens
ggctgaatgttggacacttacg

SEQ ID NO: 6971380 - DNA, 22 bp, Homo sapiens
cggcctgcacttgcctcgaggc

SEQ ID NO: 6971381 - DNA, 22 bp, Homo sapiens
gccatgtgggcagaggaggctg

SEQ ID NO: 6971382 - DNA, 22 bp, Homo sapiens
ctcgcatgccctgcctcatcca

SEQ ID NO: 6971383 - DNA, 22 bp, Homo sapiens
ggtccagaagctggtagggtag

SEQ ID NO: 6971384 - DNA, 22 bp, Homo sapiens
tgtctgggttttgggtcatatt

SEQ ID NO: 6971385 - DNA, 22 bp, Homo sapiens
gtttggcagagcatggggatga

SEQ ID NO: 6971386 - DNA, 22 bp, Homo sapiens
atgacacataaaacaaggactg

SEQ ID NO: 6971387 - DNA, 22 bp, Homo sapiens
atgggagccatcgcatttgctg

SEQ ID NO: 6971388 - DNA, 22 bp, Homo sapiens
agggccaggatcacagccaaga

SEQ ID NO: 6971389 - DNA, 22 bp, Homo sapiens
tgaggcaggaggattgcaggat

SEQ ID NO: 6971390 - DNA, 22 bp, Homo sapiens
gtctccagccattctctgatca

SEQ ID NO: 6971391 - DNA, 22 bp, Homo sapiens
aattcaaatttgagtttgtgat

SEQ ID NO: 6971392 - DNA, 22 bp, Homo sapiens
gtctgcccagaagacatcccct

SEQ ID NO: 6971393 - DNA, 20 bp, Homo sapiens
aggcagagcgcacttttaga

SEQ ID NO: 6971394 - DNA, 15 bp, Homo sapiens
aacatcactattttg

SEQ ID NO: 6971395 - DNA, 22 bp, Homo sapiens
cactgcttagttggtaaatgtg

SEQ ID NO: 6971396 - DNA, 22 bp, Homo sapiens
gcactttagcattggtttacac

SEQ ID NO: 6971397 - DNA, 22 bp, Homo sapiens
ttcccttctagttttgagagac

SEQ ID NO: 6971398 - DNA, 22 bp, Homo sapiens
gcccagagttcaaggctgcagt

SEQ ID NO: 6971399 - DNA, 22 bp, Homo sapiens
ccctgttgggaagagagatggc

SEQ ID NO: 6971400 - DNA, 22 bp, Homo sapiens
aagacttaagtgaaaatccaca

SEQ ID NO: 6971401 - DNA, 22 bp, Homo sapiens
ttatgcaaggacttattacagt

SEQ ID NO: 6971402 - DNA, 22 bp, Homo sapiens
ttcagcacagttcaagatggta

SEQ ID NO: 6971403 - DNA, 22 bp, Homo sapiens
gactctgctacaggccgaggtt

SEQ ID NO: 6971404 - DNA, 22 bp, Homo sapiens
ttagaatccatggttgcagtgg

SEQ ID NO: 6971405 - DNA, 22 bp, Homo sapiens
acccagagactagcacggtaca

SEQ ID NO: 6971406 - DNA, 22 bp, Homo sapiens
cttccagagaagcactacgggt

SEQ ID NO: 6971407 - DNA, 22 bp, Homo sapiens
attgttgggtctcactcctaga

SEQ ID NO: 6971408 - DNA, 22 bp, Homo sapiens
acaatagaaggaaactgacata

SEQ ID NO: 6971409 - DNA, 20 bp, Homo sapiens
ctgaaagacgtaacagtgca

SEQ ID NO: 6971410 - DNA, 22 bp, Homo sapiens
atcagcaggcatattaactgaa

SEQ ID NO: 6971411 - DNA, 22 bp, Homo sapiens
acatatatgtaaagtactttgt

SEQ ID NO: 6971412 - DNA, 22 bp, Homo sapiens
gtaggcagaataattcctcctt

SEQ ID NO: 6971413 - DNA, 22 bp, Homo sapiens
tcagtacttgcatcctctcctt

SEQ ID NO: 6971414 - DNA, 22 bp, Homo sapiens
caagtgacaagacctgtgggcc

SEQ ID NO: 6971415 - DNA, 22 bp, Homo sapiens
aaagcagattctgatgcagtag

SEQ ID NO: 6971416 - DNA, 22 bp, Homo sapiens
aagagatttctgtaaaatgtaa

SEQ ID NO: 6971417 - DNA, 22 bp, Homo sapiens
tggatggttgaaaacgggcagt

SEQ ID NO: 6971418 - DNA, 22 bp, Homo sapiens
tgccttgccactgctcttaatg

SEQ ID NO: 6971419 - DNA, 22 bp, Homo sapiens
tctcacagttgtccactgaaaa

SEQ ID NO: 6971420 - DNA, 22 bp, Homo sapiens
ttggaagtaatgaagaggtggg

SEQ ID NO: 6971421 - DNA, 22 bp, Homo sapiens
atcctgggggcagctggaaaca

SEQ ID NO: 6971422 - DNA, 22 bp, Homo sapiens
ctgacctgctaagcccctgtcc

SEQ ID NO: 6971423 - DNA, 22 bp, Homo sapiens
aagtctttttgaatctataact

SEQ ID NO: 6971424 - DNA, 22 bp, Homo sapiens
tgcattgcatttgtcatgaaga

SEQ ID NO: 6971425 - DNA, 22 bp, Homo sapiens
attctgggtgactacgtgatca

SEQ ID NO: 6971426 - DNA, 22 bp, Homo sapiens
tggcctcagattattgcacagt

SEQ ID NO: 6971427 - DNA, 22 bp, Homo sapiens
ctgtataattcatgctcttatt

SEQ ID NO: 6971428 - DNA, 22 bp, Homo sapiens
accttacatgcttttttcctca

SEQ ID NO: 6971429 - DNA, 20 bp, Homo sapiens
ccagagggtagggccgcccc

SEQ ID NO: 6971430 - DNA, 22 bp, Homo sapiens
gctacaaagagagcccactcta

SEQ ID NO: 6971431 - DNA, 22 bp, Homo sapiens
aggaagtgaaagggaaggagtt

SEQ ID NO: 6971432 - DNA, 22 bp, Homo sapiens
gctgtctgggtgcccaaaagaa

SEQ ID NO: 6971433 - DNA, 22 bp, Homo sapiens
tcagaagctgggtctcagaagc

SEQ ID NO: 6971434 - DNA, 22 bp, Homo sapiens
cagaagcaagagccggagctag

SEQ ID NO: 6971435 - DNA, 22 bp, Homo sapiens
tttgggaatagcagggactgag

SEQ ID NO: 6971436 - DNA, 22 bp, Homo sapiens
ggtcccaggaagtgcggcggcg

SEQ ID NO: 6971437 - DNA, 22 bp, Homo sapiens
ggtcacatgtgatttgagccaa

SEQ ID NO: 6971438 - DNA, 22 bp, Homo sapiens
gaggaggcacttgagcagatgt

SEQ ID NO: 6971439 - DNA, 22 bp, Homo sapiens
aaactctggattggagtccagc

SEQ ID NO: 6971440 - DNA, 19 bp, Homo sapiens
aggtttctaactattcaag

SEQ ID NO: 6971441 - DNA, 22 bp, Homo sapiens
agtgagggactagtgctgggga

SEQ ID NO: 6971442 - DNA, 22 bp, Homo sapiens
tagggctccactcccagagatt

SEQ ID NO: 6971443 - DNA, 22 bp, Homo sapiens
ctgccatgctcaagaagtcttt

SEQ ID NO: 6971444 - DNA, 15 bp, Homo sapiens
aggagtcactgtgct

SEQ ID NO: 6971445 - DNA, 22 bp, Homo sapiens
ctttcccttttgccttgcgtgg

SEQ ID NO: 6971446 - DNA, 22 bp, Homo sapiens
attagcaagttgttatcctttg

SEQ ID NO: 6971447 - DNA, 22 bp, Homo sapiens
tttaggcattgggtgctcaagt

SEQ ID NO: 6971448 - DNA, 22 bp, Homo sapiens
cccttgaagactagaatgagga

SEQ ID NO: 6971449 - DNA, 22 bp, Homo sapiens
cagctacagaggccacatggct

SEQ ID NO: 6971450 - DNA, 22 bp, Homo sapiens
actttgtaataactcctgagtt

SEQ ID NO: 6971451 - DNA, 21 bp, Homo sapiens
ggctggtgtttagctgtgata

SEQ ID NO: 6971452 - DNA, 22 bp, Homo sapiens
caattgctgatatgcagaagac

SEQ ID NO: 6971453 - DNA, 22 bp, Homo sapiens
tgcaagatattatctttgctgc

SEQ ID NO: 6971454 - DNA, 22 bp, Homo sapiens
gcaggtagtgatcgagggtgac

SEQ ID NO: 6971455 - DNA, 22 bp, Homo sapiens
accatgtttagtgcagtgttca

SEQ ID NO: 6971456 - DNA, 20 bp, Homo sapiens
gctgctcgctgcagtcactc

SEQ ID NO: 6971457 - DNA, 22 bp, Homo sapiens
attttatccccactggattaca

SEQ ID NO: 6971458 - DNA, 22 bp, Homo sapiens
atgcagtggcagctcctggtgt

SEQ ID NO: 6971459 - DNA, 22 bp, Homo sapiens
aagactttctgtaaagctacag

SEQ ID NO: 6971460 - DNA, 22 bp, Homo sapiens
ttgcaaatcagaagtatagatt

SEQ ID NO: 6971461 - DNA, 22 bp, Homo sapiens
ttcatgaacgaacatatgtata

SEQ ID NO: 6971462 - DNA, 23 bp, Homo sapiens
ctctgagacccaggtggacacgg

SEQ ID NO: 6971463 - DNA, 22 bp, Homo sapiens
atggccaaggggcctaggcagg

SEQ ID NO: 6971464 - DNA, 22 bp, Homo sapiens
tttagcaaggtaggtccatgga

SEQ ID NO: 6971465 - DNA, 22 bp, Homo sapiens
gtctagagtgcttcctagtcat

SEQ ID NO: 6971466 - DNA, 22 bp, Homo sapiens
atccaattacgttttttgtcat

SEQ ID NO: 6971467 - DNA, 22 bp, Homo sapiens
gcaatgcaatcagatgattatt

SEQ ID NO: 6971468 - DNA, 22 bp, Homo sapiens
gaggccacattacttggtgggt

SEQ ID NO: 6971469 - DNA, 22 bp, Homo sapiens
tttcaaagtcaatatcattacc

SEQ ID NO: 6971470 - DNA, 22 bp, Homo sapiens
tcagagcccctccgctgtccca

SEQ ID NO: 6971471 - DNA, 22 bp, Homo sapiens
tttattgctagcccttggtcca

SEQ ID NO: 6971472 - DNA, 20 bp, Homo sapiens
tggcaggtggcctcagttcc

SEQ ID NO: 6971473 - DNA, 22 bp, Homo sapiens
ttgatgttcctgtacaatctga

SEQ ID NO: 6971474 - DNA, 22 bp, Homo sapiens
cagctttctaccttaggcagtg

SEQ ID NO: 6971475 - DNA, 22 bp, Homo sapiens
tttgttaattcttatgttagag

SEQ ID NO: 6971476 - DNA, 22 bp, Homo sapiens
ctctcagtgccacacagccatt

SEQ ID NO: 6971477 - DNA, 22 bp, Homo sapiens
tcagacttctactttgcagagc

SEQ ID NO: 6971478 - DNA, 22 bp, Homo sapiens
aaagcaatcagattcagatgtc

SEQ ID NO: 6971479 - DNA, 22 bp, Homo sapiens
aataaaatgaactggtagagtt

SEQ ID NO: 6971480 - DNA, 22 bp, Homo sapiens
ttattgacttgtttgtcctggt

SEQ ID NO: 6971481 - DNA, 22 bp, Homo sapiens
tgtcatttatcttatagtaatc

SEQ ID NO: 6971482 - DNA, 22 bp, Homo sapiens
tgcctgataccctctgtctctc

SEQ ID NO: 6971483 - DNA, 22 bp, Homo sapiens
ggcagatggagaagcagcaggt

SEQ ID NO: 6971484 - DNA, 22 bp, Homo sapiens
tatacacacctccaaagcagga

SEQ ID NO: 6971485 - DNA, 22 bp, Homo sapiens
ctggccctggctggagcccagg

SEQ ID NO: 6971486 - DNA, 21 bp, Homo sapiens
ccaggctcctgaggctggtca

SEQ ID NO: 6971487 - DNA, 22 bp, Homo sapiens
gaacacagtacttgttcgtctt

SEQ ID NO: 6971488 - DNA, 22 bp, Homo sapiens
cctgttctgtggctctcaaagg

SEQ ID NO: 6971489 - DNA, 22 bp, Homo sapiens
tcagccagggcagagcaggtga

SEQ ID NO: 6971490 - DNA, 19 bp, Homo sapiens
cagaggcactttctcttag

SEQ ID NO: 6971491 - DNA, 22 bp, Homo sapiens
aaggggatttaaggtaagaaga

SEQ ID NO: 6971492 - DNA, 22 bp, Homo sapiens
atattcttccaaaacatcattt

SEQ ID NO: 6971493 - DNA, 22 bp, Homo sapiens
gaagctttattgcaagtgaggc

SEQ ID NO: 6971494 - DNA, 19 bp, Homo sapiens
ataatgaaggtggagccag

SEQ ID NO: 6971495 - DNA, 22 bp, Homo sapiens
ttgggcagcattgcagttccct

SEQ ID NO: 6971496 - DNA, 22 bp, Homo sapiens
tttacctggattcttacttcct

SEQ ID NO: 6971497 - DNA, 22 bp, Homo sapiens
taattgcttgtaaagccctgaa

SEQ ID NO: 6971498 - DNA, 20 bp, Homo sapiens
ccagctttccctgcagcatc

SEQ ID NO: 6971499 - DNA, 22 bp, Homo sapiens
gctgagtatacagactatgtta

SEQ ID NO: 6971500 - DNA, 22 bp, Homo sapiens
ttcaggaatcaaccaagtcatt

SEQ ID NO: 6971501 - DNA, 22 bp, Homo sapiens
agagcctgaggccaggaaaatg

SEQ ID NO: 6971502 - DNA, 22 bp, Homo sapiens
gagcttcacgggggacagcatt

SEQ ID NO: 6971503 - DNA, 18 bp, Homo sapiens
aggagcctttgcactgga

SEQ ID NO: 6971504 - DNA, 22 bp, Homo sapiens
gtatatgtgtgcaagtgcatgg

SEQ ID NO: 6971505 - DNA, 22 bp, Homo sapiens
gagtggggcgtggatccagcgt

SEQ ID NO: 6971506 - DNA, 22 bp, Homo sapiens
atgacccaagctcatggctccc

SEQ ID NO: 6971507 - DNA, 22 bp, Homo sapiens
attaaacaatgtaaagttcttg

SEQ ID NO: 6971508 - DNA, 22 bp, Homo sapiens
taggtagatatgttgatttgtt

SEQ ID NO: 6971509 - DNA, 22 bp, Homo sapiens
cagatagctgtaaataaatgga

SEQ ID NO: 6971510 - DNA, 21 bp, Homo sapiens
ctgtccaaatttcataacttt

SEQ ID NO: 6971511 - DNA, 22 bp, Homo sapiens
catgcagggacttgtgctccat

SEQ ID NO: 6971512 - DNA, 22 bp, Homo sapiens
ttacagtacagaaaataacaga

SEQ ID NO: 6971513 - DNA, 22 bp, Homo sapiens
tctcacaccgtccctaaaccat

SEQ ID NO: 6971514 - DNA, 22 bp, Homo sapiens
tggacctggggtggcctcctct

SEQ ID NO: 6971515 - DNA, 22 bp, Homo sapiens
gctggtggcagagacatcaggt

SEQ ID NO: 6971516 - DNA, 22 bp, Homo sapiens
tatcagaatgcagccatgtgca

SEQ ID NO: 6971517 - DNA, 22 bp, Homo sapiens
tggcacttaatgcatgtgctat

SEQ ID NO: 6971518 - DNA, 22 bp, Homo sapiens
ttctcctctgttggccttccct

SEQ ID NO: 6971519 - DNA, 22 bp, Homo sapiens
taagtccacaggctgacagcgg

SEQ ID NO: 6971520 - DNA, 21 bp, Homo sapiens
gctcctggtgctgcgtggcgc

SEQ ID NO: 6971521 - DNA, 22 bp, Homo sapiens
aagcagcttaaattagagcctg

SEQ ID NO: 6971522 - DNA, 22 bp, Homo sapiens
gggaatgtggcaggcagcagtt

SEQ ID NO: 6971523 - DNA, 22 bp, Homo sapiens
tgtgtaaatttatttacataaa

SEQ ID NO: 6971524 - DNA, 22 bp, Homo sapiens
caaatgttgactaagagggttt

SEQ ID NO: 6971525 - DNA, 20 bp, Homo sapiens
ctgctgtggtcctttatttt

SEQ ID NO: 6971526 - DNA, 22 bp, Homo sapiens
cagagagaatatgtagtatgga

SEQ ID NO: 6971527 - DNA, 22 bp, Homo sapiens
aagcagagggtatggccaggtt

SEQ ID NO: 6971528 - DNA, 22 bp, Homo sapiens
gaatttatctacgttaagtatg

SEQ ID NO: 6971529 - DNA, 22 bp, Homo sapiens
gccagtggtcagctacgcttag

SEQ ID NO: 6971530 - DNA, 22 bp, Homo sapiens
tttaaccagaaaggtactcatc

SEQ ID NO: 6971531 - DNA, 22 bp, Homo sapiens
ctcaaatacctctccatgtgac

SEQ ID NO: 6971532 - DNA, 22 bp, Homo sapiens
aaggttagttttcaataattac

SEQ ID NO: 6971533 - DNA, 21 bp, Homo sapiens
cggtggctcccgggatggctc

SEQ ID NO: 6971534 - DNA, 22 bp, Homo sapiens
gacctggctttgggccccggca

SEQ ID NO: 6971535 - DNA, 22 bp, Homo sapiens
tggctgaggtaactatgaataa

SEQ ID NO: 6971536 - DNA, 22 bp, Homo sapiens
agccacagaggttgatgtggtt

SEQ ID NO: 6971537 - DNA, 22 bp, Homo sapiens
gtgggcatgggaatctcaatga

SEQ ID NO: 6971538 - DNA, 22 bp, Homo sapiens
gcagggcagtaagagctagagt

SEQ ID NO: 6971539 - DNA, 22 bp, Homo sapiens
gcatcttcacacaaagccagtg

SEQ ID NO: 6971540 - DNA, 22 bp, Homo sapiens
ctttggaaggtcgtccgtgtgg

SEQ ID NO: 6971541 - DNA, 22 bp, Homo sapiens
actgcattccagcctgggcaac

SEQ ID NO: 6971542 - DNA, 22 bp, Homo sapiens
acagccaagtcttctatttcag

SEQ ID NO: 6971543 - DNA, 22 bp, Homo sapiens
agcaggagacatgggggtggtg

SEQ ID NO: 6971544 - DNA, 22 bp, Homo sapiens
ttttgaataattcagaaacagc

SEQ ID NO: 6971545 - DNA, 22 bp, Homo sapiens
cttggagagtggttatccctgt

SEQ ID NO: 6971546 - DNA, 22 bp, Homo sapiens
gcacaagaaatcatggactgaa

SEQ ID NO: 6971547 - DNA, 22 bp, Homo sapiens
tggtataaaagagtaaactatg

SEQ ID NO: 6971548 - DNA, 22 bp, Homo sapiens
aaacatctcaaagaggtatttg

SEQ ID NO: 6971549 - DNA, 22 bp, Homo sapiens
tacttgtggcagtttgaattta

SEQ ID NO: 6971550 - DNA, 22 bp, Homo sapiens
aaattctttggcctactttgaa

SEQ ID NO: 6971551 - DNA, 22 bp, Homo sapiens
cacgactgttaccggacccatg

SEQ ID NO: 6971552 - DNA, 22 bp, Homo sapiens
tctgaatagtatattgaaagca

SEQ ID NO: 6971553 - DNA, 22 bp, Homo sapiens
atacataggagaataacttcag

SEQ ID NO: 6971554 - DNA, 21 bp, Homo sapiens
ctactgtgagacacaaagtgc

SEQ ID NO: 6971555 - DNA, 19 bp, Homo sapiens
tgtccgtggccttctggat

SEQ ID NO: 6971556 - DNA, 21 bp, Homo sapiens
ttcatcagccagaaatcaagc

SEQ ID NO: 6971557 - DNA, 22 bp, Homo sapiens
ggtggcctagggcccagcctgt

SEQ ID NO: 6971558 - DNA, 22 bp, Homo sapiens
cctcctgcacttgctttccttc

SEQ ID NO: 6971559 - DNA, 22 bp, Homo sapiens
ctcaaaatggttaattttaata

SEQ ID NO: 6971560 - DNA, 22 bp, Homo sapiens
gacaagtgcatgatttctatct

SEQ ID NO: 6971561 - DNA, 22 bp, Homo sapiens
ttgagataggtggaatctcttt

SEQ ID NO: 6971562 - DNA, 22 bp, Homo sapiens
ttagttaataggtcttcagctt

SEQ ID NO: 6971563 - DNA, 22 bp, Homo sapiens
gaggtcaggtgaggaattaaga

SEQ ID NO: 6971564 - DNA, 21 bp, Homo sapiens
tgggtgcaagctgcggatgct

SEQ ID NO: 6971565 - DNA, 22 bp, Homo sapiens
gaagggaaagtgacttacccga

SEQ ID NO: 6971566 - DNA, 22 bp, Homo sapiens
gagagtggatggagctgcgaag

SEQ ID NO: 6971567 - DNA, 22 bp, Homo sapiens
tcaggcaggcagagggcaaatg

SEQ ID NO: 6971568 - DNA, 21 bp, Homo sapiens
tggaagtcttgagtagggggc

SEQ ID NO: 6971569 - DNA, 22 bp, Homo sapiens
gagcacattcccaggagctgct

SEQ ID NO: 6971570 - DNA, 22 bp, Homo sapiens
actgcctgtagccctgagatgt

SEQ ID NO: 6971571 - DNA, 22 bp, Homo sapiens
gatgtgtagagggaatttcaaa

SEQ ID NO: 6971572 - DNA, 22 bp, Homo sapiens
cctcattaacacaatgtcattt

SEQ ID NO: 6971573 - DNA, 22 bp, Homo sapiens
tggagggcatagctgttctttc

SEQ ID NO: 6971574 - DNA, 22 bp, Homo sapiens
ttagaaaacataagtggtaaag

SEQ ID NO: 6971575 - DNA, 22 bp, Homo sapiens
ccactgtagagatttgaatgcc

SEQ ID NO: 6971576 - DNA, 22 bp, Homo sapiens
ggctgagggttaagatcagaca

SEQ ID NO: 6971577 - DNA, 22 bp, Homo sapiens
gcagaacctgaattgaacattg

SEQ ID NO: 6971578 - DNA, 22 bp, Homo sapiens
atttctgtaacttatgaaagtt

SEQ ID NO: 6971579 - DNA, 22 bp, Homo sapiens
acccaggctggagtgcagtggt

SEQ ID NO: 6971580 - DNA, 22 bp, Homo sapiens
agactcaagcagataggaatta

SEQ ID NO: 6971581 - DNA, 19 bp, Homo sapiens
aggtgagtgtgggaaaggg

SEQ ID NO: 6971582 - DNA, 22 bp, Homo sapiens
atggtcaagatcctctagttta

SEQ ID NO: 6971583 - DNA, 22 bp, Homo sapiens
ataaaggcaacaccagggtatg

SEQ ID NO: 6971584 - DNA, 22 bp, Homo sapiens
agctgtgaattttatgctagtg

SEQ ID NO: 6971585 - DNA, 22 bp, Homo sapiens
ctacatttgttctatagctttt

SEQ ID NO: 6971586 - DNA, 22 bp, Homo sapiens
tccattatacttctgattcaaa

SEQ ID NO: 6971587 - DNA, 18 bp, Homo sapiens
gcctgccaactcctgatc

SEQ ID NO: 6971588 - DNA, 22 bp, Homo sapiens
gactctggaccatatatttggc

SEQ ID NO: 6971589 - DNA, 22 bp, Homo sapiens
agcaactgggctcattttttaa

SEQ ID NO: 6971590 - DNA, 22 bp, Homo sapiens
tttctctgcagagccccaagga

SEQ ID NO: 6971591 - DNA, 22 bp, Homo sapiens
cttcagctttcagcttccctga

SEQ ID NO: 6971592 - DNA, 22 bp, Homo sapiens
ttacagcttcgacagaggcagt

SEQ ID NO: 6971593 - DNA, 20 bp, Homo sapiens
ccctttaagctttagtatgc

SEQ ID NO: 6971594 - DNA, 22 bp, Homo sapiens
agactttctgtagcatctgtaa

SEQ ID NO: 6971595 - DNA, 22 bp, Homo sapiens
atatggaagttacctgacttca

SEQ ID NO: 6971596 - DNA, 22 bp, Homo sapiens
catgcttttcaatctatcttaa

SEQ ID NO: 6971597 - DNA, 22 bp, Homo sapiens
ctgagagaaacatgactcagga

SEQ ID NO: 6971598 - DNA, 22 bp, Homo sapiens
actttctgccttacaggagtcc

SEQ ID NO: 6971599 - DNA, 22 bp, Homo sapiens
tctgaggtaccagctggtttat

SEQ ID NO: 6971600 - DNA, 22 bp, Homo sapiens
agtgatggttcagcttggttag

SEQ ID NO: 6971601 - DNA, 22 bp, Homo sapiens
ttcagacagttttcagattcat

SEQ ID NO: 6971602 - DNA, 22 bp, Homo sapiens
ccaaaattaagcctcttatgtt

SEQ ID NO: 6971603 - DNA, 22 bp, Homo sapiens
tgatttccaataaggagaatgt

SEQ ID NO: 6971604 - DNA, 22 bp, Homo sapiens
ccattttgtctcctgaaatcta

SEQ ID NO: 6971605 - DNA, 22 bp, Homo sapiens
tgtgtgcttaagggctgaacct

SEQ ID NO: 6971606 - DNA, 22 bp, Homo sapiens
tgcccacatctgcttatttcat

SEQ ID NO: 6971607 - DNA, 22 bp, Homo sapiens
tacttccagcaatctgcatatt

SEQ ID NO: 6971608 - DNA, 22 bp, Homo sapiens
ttgaggtaggcattgttcaaaa

SEQ ID NO: 6971609 - DNA, 22 bp, Homo sapiens
ctgtgtctgtggaatagcgaat

SEQ ID NO: 6971610 - DNA, 22 bp, Homo sapiens
atgtttcaccagttttataaga

SEQ ID NO: 6971611 - DNA, 22 bp, Homo sapiens
tattcatattgtaaaagaagtg

SEQ ID NO: 6971612 - DNA, 19 bp, Homo sapiens
tgcctgctgtattccagag

SEQ ID NO: 6971613 - DNA, 22 bp, Homo sapiens
tagggcacagcttagataaatg

SEQ ID NO: 6971614 - DNA, 22 bp, Homo sapiens
agcaataacagaaaactttcct

SEQ ID NO: 6971615 - DNA, 22 bp, Homo sapiens
acacagagccagggaatacagt

SEQ ID NO: 6971616 - DNA, 22 bp, Homo sapiens
ttctcttttcaccagttgctaa

SEQ ID NO: 6971617 - DNA, 22 bp, Homo sapiens
ttctggctccagatgcttctgt

SEQ ID NO: 6971618 - DNA, 22 bp, Homo sapiens
cgcaggggaggaaggtacacct

SEQ ID NO: 6971619 - DNA, 23 bp, Homo sapiens
caggagggaatgaagttagacaa

SEQ ID NO: 6971620 - DNA, 22 bp, Homo sapiens
agatctggttggagtcctgaca

SEQ ID NO: 6971621 - DNA, 21 bp, Homo sapiens
caattacagatggctcagggg

SEQ ID NO: 6971622 - DNA, 22 bp, Homo sapiens
tcacaaatgaggaaatcgagca

SEQ ID NO: 6971623 - DNA, 21 bp, Homo sapiens
atcacattggctgttattatt

SEQ ID NO: 6971624 - DNA, 22 bp, Homo sapiens
tgaggcaggagaatcaccggaa

SEQ ID NO: 6971625 - DNA, 22 bp, Homo sapiens
tttgttcactgagcaatgatta

SEQ ID NO: 6971626 - DNA, 21 bp, Homo sapiens
ttgaagtcagaaatatatgtg

SEQ ID NO: 6971627 - DNA, 22 bp, Homo sapiens
tgctgtttcattttcctcatcc

SEQ ID NO: 6971628 - DNA, 22 bp, Homo sapiens
actgtaattggattgtctgact

SEQ ID NO: 6971629 - DNA, 22 bp, Homo sapiens
ctgggagagcctttcctgagtc

SEQ ID NO: 6971630 - DNA, 20 bp, Homo sapiens
atgtgaagtaggaagggtgt

SEQ ID NO: 6971631 - DNA, 22 bp, Homo sapiens
atctggaagtctccgaaggcag

SEQ ID NO: 6971632 - DNA, 22 bp, Homo sapiens
ttggaagcgagcacatggagga

SEQ ID NO: 6971633 - DNA, 22 bp, Homo sapiens
aacatgatttagtataatgcag

SEQ ID NO: 6971634 - DNA, 22 bp, Homo sapiens
tgtagccaagattggagatcgt

SEQ ID NO: 6971635 - DNA, 22 bp, Homo sapiens
cgtttgaaagcctttgtacact

SEQ ID NO: 6971636 - DNA, 22 bp, Homo sapiens
agctgggtggcctctcctcggg

SEQ ID NO: 6971637 - DNA, 22 bp, Homo sapiens
cttggctttagaacatgggagc

SEQ ID NO: 6971638 - DNA, 22 bp, Homo sapiens
tgacttgtattttaaataattg

SEQ ID NO: 6971639 - DNA, 22 bp, Homo sapiens
aaacattgtaattttagcatgg

SEQ ID NO: 6971640 - DNA, 21 bp, Homo sapiens
ggtcagggggtgcctccaggt

SEQ ID NO: 6971641 - DNA, 22 bp, Homo sapiens
gcgctgcctctgctctccccac

SEQ ID NO: 6971642 - DNA, 23 bp, Homo sapiens
caggagatggctgctgtgtcagc

SEQ ID NO: 6971643 - DNA, 22 bp, Homo sapiens
atactgtagttgtccaactatc

SEQ ID NO: 6971644 - DNA, 19 bp, Homo sapiens
cattaccctgtaagggcag

SEQ ID NO: 6971645 - DNA, 22 bp, Homo sapiens
atctcgttttgagaactgtgtt

SEQ ID NO: 6971646 - DNA, 22 bp, Homo sapiens
cctgctgtctgctgtgttaagc

SEQ ID NO: 6971647 - DNA, 22 bp, Homo sapiens
ttcttcaataaattcccataag

SEQ ID NO: 6971648 - DNA, 22 bp, Homo sapiens
ctaaggaacagatgtcagcaga

SEQ ID NO: 6971649 - DNA, 22 bp, Homo sapiens
ttcttcctcagcagggctgcct

SEQ ID NO: 6971650 - DNA, 22 bp, Homo sapiens
agctgctactgctctgccagag

SEQ ID NO: 6971651 - DNA, 22 bp, Homo sapiens
gctgccagcccagcaaggtgtg

SEQ ID NO: 6971652 - DNA, 22 bp, Homo sapiens
atagaaatggcagctggtgcta

SEQ ID NO: 6971653 - DNA, 22 bp, Homo sapiens
tatgtatatggctcttccccat

SEQ ID NO: 6971654 - DNA, 22 bp, Homo sapiens
gtagcttacatcagagttggtt

SEQ ID NO: 6971655 - DNA, 22 bp, Homo sapiens
ctgaccctggaggcatttctct

SEQ ID NO: 6971656 - DNA, 22 bp, Homo sapiens
gtgtgttcagcaagaggtaagg

SEQ ID NO: 6971657 - DNA, 22 bp, Homo sapiens
ctcttcatagcaaacatatggg

SEQ ID NO: 6971658 - DNA, 22 bp, Homo sapiens
tgtgccacatacacagtacatt

SEQ ID NO: 6971659 - DNA, 22 bp, Homo sapiens
acctgcccacttcccatgacat

SEQ ID NO: 6971660 - DNA, 22 bp, Homo sapiens
ctcctggcaggctgagtgaaat

SEQ ID NO: 6971661 - DNA, 22 bp, Homo sapiens
tagaacctattagaaatgtatt

SEQ ID NO: 6971662 - DNA, 22 bp, Homo sapiens
aagtccagaactcctgtgatag

SEQ ID NO: 6971663 - DNA, 22 bp, Homo sapiens
tagtgtttgggaattgtagaga

SEQ ID NO: 6971664 - DNA, 22 bp, Homo sapiens
acccagctaaccctaccctgga

SEQ ID NO: 6971665 - DNA, 22 bp, Homo sapiens
cctcagagtctagtaaataata

SEQ ID NO: 6971666 - DNA, 22 bp, Homo sapiens
agtgtttttcaggagcagaaca

SEQ ID NO: 6971667 - DNA, 22 bp, Homo sapiens
tagtgccatatgtgactagaac

SEQ ID NO: 6971668 - DNA, 22 bp, Homo sapiens
taggctgggcattctggccagg

SEQ ID NO: 6971669 - DNA, 22 bp, Homo sapiens
aggaagctgggaaactgacatt

SEQ ID NO: 6971670 - DNA, 22 bp, Homo sapiens
gctgcaagtgcatgttgcaact

SEQ ID NO: 6971671 - DNA, 20 bp, Homo sapiens
gcaatgttggttcctgtcac

SEQ ID NO: 6971672 - DNA, 22 bp, Homo sapiens
ggctcaccattttcactctctg

SEQ ID NO: 6971673 - DNA, 22 bp, Homo sapiens
acttgattgtatgaagttattt

SEQ ID NO: 6971674 - DNA, 22 bp, Homo sapiens
accagagactctttctagtcct

SEQ ID NO: 6971675 - DNA, 22 bp, Homo sapiens
ttctgcatggagaaactgagtc

SEQ ID NO: 6971676 - DNA, 22 bp, Homo sapiens
gtggcatcaagatttagattca

SEQ ID NO: 6971677 - DNA, 22 bp, Homo sapiens
acagtcttgctgtatggtcagg

SEQ ID NO: 6971678 - DNA, 22 bp, Homo sapiens
cagctctggcagagcccaaccc

SEQ ID NO: 6971679 - DNA, 22 bp, Homo sapiens
aggccagggcactgctctttag

SEQ ID NO: 6971680 - DNA, 22 bp, Homo sapiens
ttgtccaaagtaacacatctag

SEQ ID NO: 6971681 - DNA, 22 bp, Homo sapiens
tttagttctgagacagtgggaa

SEQ ID NO: 6971682 - DNA, 22 bp, Homo sapiens
attgttcctggaaaagaacagg

SEQ ID NO: 6971683 - DNA, 19 bp, Homo sapiens
ctggtctgtcatgctcccc

SEQ ID NO: 6971684 - DNA, 22 bp, Homo sapiens
tgaggccggaagaaagggggca

SEQ ID NO: 6971685 - DNA, 22 bp, Homo sapiens
aaagatctatgggcatttagct

SEQ ID NO: 6971686 - DNA, 22 bp, Homo sapiens
atgtatcatgcagggtccatga

SEQ ID NO: 6971687 - DNA, 18 bp, Homo sapiens
ataataggagataaaaat

SEQ ID NO: 6971688 - DNA, 22 bp, Homo sapiens
gaagccacgttaaattggctgt

SEQ ID NO: 6971689 - DNA, 22 bp, Homo sapiens
tccagtggctttgctgctttaa

SEQ ID NO: 6971690 - DNA, 22 bp, Homo sapiens
ttggccagctctggaaagtggt

SEQ ID NO: 6971691 - DNA, 22 bp, Homo sapiens
gctggcaggatagaagtctaat

SEQ ID NO: 6971692 - DNA, 22 bp, Homo sapiens
ttgcaaggtttctctctgccta

SEQ ID NO: 6971693 - DNA, 22 bp, Homo sapiens
cttgggtgctggaggctgccgc

SEQ ID NO: 6971694 - DNA, 22 bp, Homo sapiens
cagttctacttggatgtctgca

SEQ ID NO: 6971695 - DNA, 22 bp, Homo sapiens
tccatttttcatgactcctcaa

SEQ ID NO: 6971696 - DNA, 21 bp, Homo sapiens
atttggtcaaggacaactctg

SEQ ID NO: 6971697 - DNA, 22 bp, Homo sapiens
gtgcctggtatgtaggtagcgg

SEQ ID NO: 6971698 - DNA, 22 bp, Homo sapiens
tcctgtctcagtgtatttgcag

SEQ ID NO: 6971699 - DNA, 22 bp, Homo sapiens
ccacattttgctttgcctaggt

SEQ ID NO: 6971700 - DNA, 22 bp, Homo sapiens
taagagacttaagaataattga

SEQ ID NO: 6971701 - DNA, 22 bp, Homo sapiens
gtgactgttgtttgctacgtgc

SEQ ID NO: 6971702 - DNA, 22 bp, Homo sapiens
ggccactcggccacccctgccg

SEQ ID NO: 6971703 - DNA, 22 bp, Homo sapiens
aaactgtaggagggaaaggaag

SEQ ID NO: 6971704 - DNA, 23 bp, Homo sapiens
gaggcactcaggaaatgtgagtg

SEQ ID NO: 6971705 - DNA, 22 bp, Homo sapiens
gagggaaacagatgggttgtgg

SEQ ID NO: 6971706 - DNA, 22 bp, Homo sapiens
tgacagcctcactttgttaatt

SEQ ID NO: 6971707 - DNA, 22 bp, Homo sapiens
tctacaacattccacaggcatg

SEQ ID NO: 6971708 - DNA, 22 bp, Homo sapiens
ttgacaaaggaattgaatctct

SEQ ID NO: 6971709 - DNA, 21 bp, Homo sapiens
ccaggaaggactgagctccct

SEQ ID NO: 6971710 - DNA, 17 bp, Homo sapiens
tgatagttcattttaag

SEQ ID NO: 6971711 - DNA, 19 bp, Homo sapiens
atgtttacactcaggggct

SEQ ID NO: 6971712 - DNA, 22 bp, Homo sapiens
gtttctcaacatgctttctaac

SEQ ID NO: 6971713 - DNA, 22 bp, Homo sapiens
ctggggaggatgctacgacctg

SEQ ID NO: 6971714 - DNA, 22 bp, Homo sapiens
accctgggcacaccatttcccc

SEQ ID NO: 6971715 - DNA, 20 bp, Homo sapiens
aattatataactccaacatt

SEQ ID NO: 6971716 - DNA, 22 bp, Homo sapiens
tactgcatgggtgcatgctgct

SEQ ID NO: 6971717 - DNA, 22 bp, Homo sapiens
atcctggcccaggtgtggaggg

SEQ ID NO: 6971718 - DNA, 21 bp, Homo sapiens
ccacattctcattctgactgc

SEQ ID NO: 6971719 - DNA, 22 bp, Homo sapiens
attacaagtttcagtgttttgc

SEQ ID NO: 6971720 - DNA, 22 bp, Homo sapiens
tcttctctcatgtaggagggaa

SEQ ID NO: 6971721 - DNA, 22 bp, Homo sapiens
cctgcctgggctcacttgccag

SEQ ID NO: 6971722 - DNA, 23 bp, Homo sapiens
agttcagctcagttcagtgagca

SEQ ID NO: 6971723 - DNA, 22 bp, Homo sapiens
cagctaggaaaccagagggcag

SEQ ID NO: 6971724 - DNA, 22 bp, Homo sapiens
acctactaattgagataatagg

SEQ ID NO: 6971725 - DNA, 22 bp, Homo sapiens
ttctcagaggctgctaagtgca

SEQ ID NO: 6971726 - DNA, 22 bp, Homo sapiens
gctctgtgggggaaatcctggg

SEQ ID NO: 6971727 - DNA, 22 bp, Homo sapiens
agaagcccagcatggaaccagc

SEQ ID NO: 6971728 - DNA, 19 bp, Homo sapiens
ttgaaattgtttgatatgg

SEQ ID NO: 6971729 - DNA, 22 bp, Homo sapiens
gagccccaccctagacattctg

SEQ ID NO: 6971730 - DNA, 17 bp, Homo sapiens
aggaggatcagagagta

SEQ ID NO: 6971731 - DNA, 22 bp, Homo sapiens
ctctccagccaggggcttcctg

SEQ ID NO: 6971732 - DNA, 22 bp, Homo sapiens
tgtgtgtctgcacatgtataat

SEQ ID NO: 6971733 - DNA, 22 bp, Homo sapiens
cccaggcagtagaaagaagagg

SEQ ID NO: 6971734 - DNA, 23 bp, Homo sapiens
tgcaggactactcgagcactgct

SEQ ID NO: 6971735 - DNA, 22 bp, Homo sapiens
gacaggcacgaaattgggctgg

SEQ ID NO: 6971736 - DNA, 22 bp, Homo sapiens
ctaggaaatactgtttcaaggc

SEQ ID NO: 6971737 - DNA, 22 bp, Homo sapiens
agaaatcatgtcttatttctat

SEQ ID NO: 6971738 - DNA, 22 bp, Homo sapiens
tatgaacatgttcattgactta

SEQ ID NO: 6971739 - DNA, 22 bp, Homo sapiens
cccaggagtttgagttcagcat

SEQ ID NO: 6971740 - DNA, 22 bp, Homo sapiens
ctgaggtttgtccatccttggt

SEQ ID NO: 6971741 - DNA, 22 bp, Homo sapiens
ctgagaattactctgatgagta

SEQ ID NO: 6971742 - DNA, 22 bp, Homo sapiens
agtgcatacccttctaaaaagt

SEQ ID NO: 6971743 - DNA, 22 bp, Homo sapiens
ctcaggatgtactacagaaggc

SEQ ID NO: 6971744 - DNA, 22 bp, Homo sapiens
ttgctttgtggtggttcttcca

SEQ ID NO: 6971745 - DNA, 22 bp, Homo sapiens
ctgggaagcttcgagcaggaaa

SEQ ID NO: 6971746 - DNA, 22 bp, Homo sapiens
gtttccacttgagaggactcct

SEQ ID NO: 6971747 - DNA, 22 bp, Homo sapiens
tcctgtggcgttatcatgtgat

SEQ ID NO: 6971748 - DNA, 22 bp, Homo sapiens
atgagtacattgggatcaaaga

SEQ ID NO: 6971749 - DNA, 20 bp, Homo sapiens
ttcagagatagggtctttaa

SEQ ID NO: 6971750 - DNA, 22 bp, Homo sapiens
atgtgtacactggacttctgat

SEQ ID NO: 6971751 - DNA, 22 bp, Homo sapiens
aggtataagtctcatttctgtt

SEQ ID NO: 6971752 - DNA, 22 bp, Homo sapiens
agcctggcggtcgtcggtcagg

SEQ ID NO: 6971753 - DNA, 22 bp, Homo sapiens
cagctctgctgggaggatgcag

SEQ ID NO: 6971754 - DNA, 22 bp, Homo sapiens
acaaatgaatcatacataatgt

SEQ ID NO: 6971755 - DNA, 22 bp, Homo sapiens
gggcacctggctagtgacagtg

SEQ ID NO: 6971756 - DNA, 16 bp, Homo sapiens
gcctggcaccgtcggc

SEQ ID NO: 6971757 - DNA, 22 bp, Homo sapiens
ctggactcagggtgctccagcg

SEQ ID NO: 6971758 - DNA, 21 bp, Homo sapiens
acttggccaggcccccacctg

SEQ ID NO: 6971759 - DNA, 22 bp, Homo sapiens
tgaggataacccaggcaaactg

SEQ ID NO: 6971760 - DNA, 23 bp, Homo sapiens
agagccttttcacacttcaatgt

SEQ ID NO: 6971761 - DNA, 22 bp, Homo sapiens
tatgaggtattacaggaaatat

SEQ ID NO: 6971762 - DNA, 22 bp, Homo sapiens
tacaggaagcactcaagaaatg

SEQ ID NO: 6971763 - DNA, 22 bp, Homo sapiens
tcacacagtgagaaagtgcgga

SEQ ID NO: 6971764 - DNA, 19 bp, Homo sapiens
agtgtgagactccatctca

SEQ ID NO: 6971765 - DNA, 22 bp, Homo sapiens
tgcccttggtgggcccaatagg

SEQ ID NO: 6971766 - DNA, 22 bp, Homo sapiens
tattacaagaaagggcatgaat

SEQ ID NO: 6971767 - DNA, 22 bp, Homo sapiens
agcaaacagtgtgctaagaaat

SEQ ID NO: 6971768 - DNA, 22 bp, Homo sapiens
ttcccttgaccccagaccctgg

SEQ ID NO: 6971769 - DNA, 19 bp, Homo sapiens
acttgaaagcagagagttt

SEQ ID NO: 6971770 - DNA, 22 bp, Homo sapiens
gagcactgtactcatttgcact

SEQ ID NO: 6971771 - DNA, 22 bp, Homo sapiens
tctgatgcaatgtaagtcttgg

SEQ ID NO: 6971772 - DNA, 22 bp, Homo sapiens
aaggtagattctggatcgaagg

SEQ ID NO: 6971773 - DNA, 22 bp, Homo sapiens
ttgtgtctaaataaggagacct

SEQ ID NO: 6971774 - DNA, 22 bp, Homo sapiens
ttcaaacctatctaagaaatag

SEQ ID NO: 6971775 - DNA, 22 bp, Homo sapiens
ctgggatggctccgctgctgct

SEQ ID NO: 6971776 - DNA, 22 bp, Homo sapiens
tgcccagccaatttgttatgtt

SEQ ID NO: 6971777 - DNA, 22 bp, Homo sapiens
aagtcttcagactggagagatt

SEQ ID NO: 6971778 - DNA, 22 bp, Homo sapiens
atctttagtagaggaatatatt

SEQ ID NO: 6971779 - DNA, 22 bp, Homo sapiens
aaatccattctgttttaaaagt

SEQ ID NO: 6971780 - DNA, 22 bp, Homo sapiens
aatctgttttatcatttgttac

SEQ ID NO: 6971781 - DNA, 22 bp, Homo sapiens
gttcagggagggacagatgaag

SEQ ID NO: 6971782 - DNA, 22 bp, Homo sapiens
ttctgctgcgacccaggagtta

SEQ ID NO: 6971783 - DNA, 22 bp, Homo sapiens
agttccagaactggaaaaggac

SEQ ID NO: 6971784 - DNA, 22 bp, Homo sapiens
gaagcggcatcaggaggctgcc

SEQ ID NO: 6971785 - DNA, 22 bp, Homo sapiens
ctgaggctgggcatggggtcca

SEQ ID NO: 6971786 - DNA, 22 bp, Homo sapiens
cactgtaatggaattttcttta

SEQ ID NO: 6971787 - DNA, 22 bp, Homo sapiens
ctcataagccctgggtaggcga

SEQ ID NO: 6971788 - DNA, 22 bp, Homo sapiens
ctgggagtttgttagtaatgca

SEQ ID NO: 6971789 - DNA, 18 bp, Homo sapiens
tacagcttgagttgactg

SEQ ID NO: 6971790 - DNA, 22 bp, Homo sapiens
tgctgagatgaatagagacctc

SEQ ID NO: 6971791 - DNA, 22 bp, Homo sapiens
ggggagaattaccaaaagcgct

SEQ ID NO: 6971792 - DNA, 22 bp, Homo sapiens
catacatatgtggatgtcatat

SEQ ID NO: 6971793 - DNA, 22 bp, Homo sapiens
ggtcttgtttatataaggtggt

SEQ ID NO: 6971794 - DNA, 22 bp, Homo sapiens
tttcagaagtcaactaggtaaa

SEQ ID NO: 6971795 - DNA, 22 bp, Homo sapiens
ggagcctgggcctcctgccctt

SEQ ID NO: 6971796 - DNA, 22 bp, Homo sapiens
cctctgtgctttgtccagcctc

SEQ ID NO: 6971797 - DNA, 22 bp, Homo sapiens
tctgagccctgctgtttattga

SEQ ID NO: 6971798 - DNA, 22 bp, Homo sapiens
aagcacattgtacatttgtgct

SEQ ID NO: 6971799 - DNA, 22 bp, Homo sapiens
gtcagcattagcaatgactggt

SEQ ID NO: 6971800 - DNA, 22 bp, Homo sapiens
ggctgtggtctgggtgctcccc

SEQ ID NO: 6971801 - DNA, 22 bp, Homo sapiens
tgagttctgactgtgatgccag

SEQ ID NO: 6971802 - DNA, 22 bp, Homo sapiens
aaaacaggagttttggtaggct

SEQ ID NO: 6971803 - DNA, 22 bp, Homo sapiens
gatgcaaactgtgacatagagt

SEQ ID NO: 6971804 - DNA, 22 bp, Homo sapiens
ctcaaactgtgcttgtaaattc

SEQ ID NO: 6971805 - DNA, 22 bp, Homo sapiens
tttaatactatggggatgaaca

SEQ ID NO: 6971806 - DNA, 22 bp, Homo sapiens
ctgggctcagcccatgctgtcc

SEQ ID NO: 6971807 - DNA, 22 bp, Homo sapiens
aaggccaaagttttcaggctaa

SEQ ID NO: 6971808 - DNA, 22 bp, Homo sapiens
ggtcaatgccaagtgtggctta

SEQ ID NO: 6971809 - DNA, 22 bp, Homo sapiens
tttgagtcccagctgtgtggct

SEQ ID NO: 6971810 - DNA, 17 bp, Homo sapiens
gcacatgtgttctttta

SEQ ID NO: 6971811 - DNA, 22 bp, Homo sapiens
atgccctgctgccatctggccg

SEQ ID NO: 6971812 - DNA, 22 bp, Homo sapiens
cactgcaagctccgcctctggg

SEQ ID NO: 6971813 - DNA, 22 bp, Homo sapiens
aataccagagacagtgtttacc

SEQ ID NO: 6971814 - DNA, 22 bp, Homo sapiens
ggcatgcattggcatttcggtt

SEQ ID NO: 6971815 - DNA, 22 bp, Homo sapiens
ggggagctgccacagttctctg

SEQ ID NO: 6971816 - DNA, 22 bp, Homo sapiens
cttccaagtggggcacgtgcca

SEQ ID NO: 6971817 - DNA, 22 bp, Homo sapiens
acaggctcacagtcatttcatt

SEQ ID NO: 6971818 - DNA, 22 bp, Homo sapiens
tctgtcacaagtaatccttttc

SEQ ID NO: 6971819 - DNA, 22 bp, Homo sapiens
cagagctggagcttgaatggag

SEQ ID NO: 6971820 - DNA, 19 bp, Homo sapiens
tcctttgaatatcagttga

SEQ ID NO: 6971821 - DNA, 22 bp, Homo sapiens
gatcgagttgtttgttctgggg

SEQ ID NO: 6971822 - DNA, 21 bp, Homo sapiens
agtcccatccggtaagcaagc

SEQ ID NO: 6971823 - DNA, 18 bp, Homo sapiens
tgtcactggataatggtc

SEQ ID NO: 6971824 - DNA, 22 bp, Homo sapiens
tcttaccaggagccctctgagg

SEQ ID NO: 6971825 - DNA, 22 bp, Homo sapiens
ctttcagaggggcgtacacagc

SEQ ID NO: 6971826 - DNA, 22 bp, Homo sapiens
agcacactgacctgaagccttg

SEQ ID NO: 6971827 - DNA, 22 bp, Homo sapiens
tacagtaagatgaaatagcaat

SEQ ID NO: 6971828 - DNA, 22 bp, Homo sapiens
cagtgatgatcattgtaacatc

SEQ ID NO: 6971829 - DNA, 22 bp, Homo sapiens
tgagtcctgctgagcagagagg

SEQ ID NO: 6971830 - DNA, 22 bp, Homo sapiens
gctcccaccgccgctatgggta

SEQ ID NO: 6971831 - DNA, 22 bp, Homo sapiens
aactgcaacttcgtaaagtgag

SEQ ID NO: 6971832 - DNA, 22 bp, Homo sapiens
caaatttaagttagaaagcaat

SEQ ID NO: 6971833 - DNA, 22 bp, Homo sapiens
aggtcatttccttagaggcaga

SEQ ID NO: 6971834 - DNA, 22 bp, Homo sapiens
ttgccagcttgttttaaaacat

SEQ ID NO: 6971835 - DNA, 22 bp, Homo sapiens
aggaagcactggaaggggttgg

SEQ ID NO: 6971836 - DNA, 22 bp, Homo sapiens
aggttattaaagtgtatttttg

SEQ ID NO: 6971837 - DNA, 22 bp, Homo sapiens
tggagaaggggcagggtctcca

SEQ ID NO: 6971838 - DNA, 22 bp, Homo sapiens
acaggctttggcgaggcccatc

SEQ ID NO: 6971839 - DNA, 22 bp, Homo sapiens
ggccctgatacaagtaaggtct

SEQ ID NO: 6971840 - DNA, 22 bp, Homo sapiens
ttcttaactggaaaatgtcaga

SEQ ID NO: 6971841 - DNA, 22 bp, Homo sapiens
gtattcttgagtggcaactagg

SEQ ID NO: 6971842 - DNA, 22 bp, Homo sapiens
tgtaagatgctgggatagatga

SEQ ID NO: 6971843 - DNA, 22 bp, Homo sapiens
agttatcaggtgttttcatgga

SEQ ID NO: 6971844 - DNA, 22 bp, Homo sapiens
aaccatgacaaaccatagacat

SEQ ID NO: 6971845 - DNA, 23 bp, Homo sapiens
atgttaccaatggaggaaattgg

SEQ ID NO: 6971846 - DNA, 22 bp, Homo sapiens
gttacatttggtgatttggtgc

SEQ ID NO: 6971847 - DNA, 22 bp, Homo sapiens
gtcctttgaaggcaaaaggaga

SEQ ID NO: 6971848 - DNA, 22 bp, Homo sapiens
aatgagtttgttctattatttg

SEQ ID NO: 6971849 - DNA, 22 bp, Homo sapiens
cataacatctgtgaagcaggaa

SEQ ID NO: 6971850 - DNA, 22 bp, Homo sapiens
acttcccactgcagtgactgag

SEQ ID NO: 6971851 - DNA, 22 bp, Homo sapiens
caggtccaagagatcctcctac

SEQ ID NO: 6971852 - DNA, 22 bp, Homo sapiens
gggtggggcccaggaaatctat

SEQ ID NO: 6971853 - DNA, 20 bp, Homo sapiens
tctgccacgtctggtgactg

SEQ ID NO: 6971854 - DNA, 22 bp, Homo sapiens
tctaatccttgctacctgggtg

SEQ ID NO: 6971855 - DNA, 23 bp, Homo sapiens
tgagcatcacaggagaaccaggc

SEQ ID NO: 6971856 - DNA, 22 bp, Homo sapiens
aggatcctttttctgctgtttg

SEQ ID NO: 6971857 - DNA, 22 bp, Homo sapiens
agaggggacagccacctgcccg

SEQ ID NO: 6971858 - DNA, 22 bp, Homo sapiens
gcacaaaacacattttgacaat

SEQ ID NO: 6971859 - DNA, 22 bp, Homo sapiens
cgggccgttaggaaggtggggc

SEQ ID NO: 6971860 - DNA, 22 bp, Homo sapiens
aatgctaaatgtgttatgttaa

SEQ ID NO: 6971861 - DNA, 22 bp, Homo sapiens
tcccttaagcacctgagtagtc

SEQ ID NO: 6971862 - DNA, 22 bp, Homo sapiens
gctgcctgccctgggtcatctg

SEQ ID NO: 6971863 - DNA, 22 bp, Homo sapiens
atgcatgtgtgaaagtctggca

SEQ ID NO: 6971864 - DNA, 22 bp, Homo sapiens
acaggaaagagctaggcatagg

SEQ ID NO: 6971865 - DNA, 22 bp, Homo sapiens
atttgtctctctgggtttactt

SEQ ID NO: 6971866 - DNA, 22 bp, Homo sapiens
attggaaagtgtctagtgtggt

SEQ ID NO: 6971867 - DNA, 22 bp, Homo sapiens
agtatactccccatcctagaaa

SEQ ID NO: 6971868 - DNA, 22 bp, Homo sapiens
aactcatcttcgagtgaggctg

SEQ ID NO: 6971869 - DNA, 22 bp, Homo sapiens
gggctccaggcaggcaggaaat

SEQ ID NO: 6971870 - DNA, 22 bp, Homo sapiens
attggcatactttctatattca

SEQ ID NO: 6971871 - DNA, 22 bp, Homo sapiens
gaccatgtgaaaatagaggaga

SEQ ID NO: 6971872 - DNA, 22 bp, Homo sapiens
tggaggcaccactggctgcccg

SEQ ID NO: 6971873 - DNA, 22 bp, Homo sapiens
agcaatgtggaccagctcaggg

SEQ ID NO: 6971874 - DNA, 22 bp, Homo sapiens
acagtttagagcatgatgacca

SEQ ID NO: 6971875 - DNA, 20 bp, Homo sapiens
accaggacaagacaaaagtg

SEQ ID NO: 6971876 - DNA, 22 bp, Homo sapiens
caggaaatgaaagctagctaat

SEQ ID NO: 6971877 - DNA, 22 bp, Homo sapiens
gagccagccgcaagagctgtga

SEQ ID NO: 6971878 - DNA, 22 bp, Homo sapiens
tctgctgtaaccttcagaggta

SEQ ID NO: 6971879 - DNA, 22 bp, Homo sapiens
ggacaaaaatcagccatctcta

SEQ ID NO: 6971880 - DNA, 22 bp, Homo sapiens
tacatcaagataaaaactgtca

SEQ ID NO: 6971881 - DNA, 22 bp, Homo sapiens
ggctgtcagggtgagctggctt

SEQ ID NO: 6971882 - DNA, 22 bp, Homo sapiens
tgccaagcacagaggggccact

SEQ ID NO: 6971883 - DNA, 22 bp, Homo sapiens
ggacagacaaaaatagtaagca

SEQ ID NO: 6971884 - DNA, 22 bp, Homo sapiens
tacctgttgtcacgataacact

SEQ ID NO: 6971885 - DNA, 22 bp, Homo sapiens
tcagctggatgtggaagtgcta

SEQ ID NO: 6971886 - DNA, 22 bp, Homo sapiens
tgggaagagttagagacagctg

SEQ ID NO: 6971887 - DNA, 21 bp, Homo sapiens
tgaaggggtggcagtgtgctt

SEQ ID NO: 6971888 - DNA, 22 bp, Homo sapiens
tgcctgtgtcagcaggtggaag

SEQ ID NO: 6971889 - DNA, 22 bp, Homo sapiens
tagagaaacagaaccaacaggg

SEQ ID NO: 6971890 - DNA, 22 bp, Homo sapiens
agctgggagctgaaggctgatt

SEQ ID NO: 6971891 - DNA, 18 bp, Homo sapiens
cctgtggctcagcccaca

SEQ ID NO: 6971892 - DNA, 22 bp, Homo sapiens
cacatacattcatgttactcta

SEQ ID NO: 6971893 - DNA, 22 bp, Homo sapiens
gtacacaaaagaggaaaccgga

SEQ ID NO: 6971894 - DNA, 22 bp, Homo sapiens
gctcctgtgcaggtctcggttg

SEQ ID NO: 6971895 - DNA, 22 bp, Homo sapiens
atgaacagtacaaagcacagac

SEQ ID NO: 6971896 - DNA, 21 bp, Homo sapiens
cccgtcagcagggcccctcct

SEQ ID NO: 6971897 - DNA, 22 bp, Homo sapiens
atttcagggagtcatttacaca

SEQ ID NO: 6971898 - DNA, 22 bp, Homo sapiens
gatcttctagcagaagtaattt

SEQ ID NO: 6971899 - DNA, 22 bp, Homo sapiens
ctcagttttcccttgggagcgt

SEQ ID NO: 6971900 - DNA, 22 bp, Homo sapiens
gggcaggtggcagggtctctgg

SEQ ID NO: 6971901 - DNA, 22 bp, Homo sapiens
acattgagagttttgaagagta

SEQ ID NO: 6971902 - DNA, 18 bp, Homo sapiens
cagagcagtatgaatgtt

SEQ ID NO: 6971903 - DNA, 22 bp, Homo sapiens
agagactttgtctattttgttc

SEQ ID NO: 6971904 - DNA, 22 bp, Homo sapiens
aggtccctgggacagggcgatt

SEQ ID NO: 6971905 - DNA, 22 bp, Homo sapiens
agttctgactctgaatctggga

SEQ ID NO: 6971906 - DNA, 22 bp, Homo sapiens
gctgtgcagccaagtgcctctg

SEQ ID NO: 6971907 - DNA, 22 bp, Homo sapiens
ggagactacctagcaggctgtt

SEQ ID NO: 6971908 - DNA, 22 bp, Homo sapiens
ggctcctgcacctgtccctctg

SEQ ID NO: 6971909 - DNA, 20 bp, Homo sapiens
acatgaacagggctacagca

SEQ ID NO: 6971910 - DNA, 22 bp, Homo sapiens
ctctgtgggcctgtgctttagt

SEQ ID NO: 6971911 - DNA, 22 bp, Homo sapiens
tccttacaggttacagaaagca

SEQ ID NO: 6971912 - DNA, 18 bp, Homo sapiens
tggagctgagggcaatgc

SEQ ID NO: 6971913 - DNA, 22 bp, Homo sapiens
ctcagcacccgggcctttcctc

SEQ ID NO: 6971914 - DNA, 20 bp, Homo sapiens
tagtagtaaaaagataatct

SEQ ID NO: 6971915 - DNA, 22 bp, Homo sapiens
tgtgttaacactgcatgataat

SEQ ID NO: 6971916 - DNA, 22 bp, Homo sapiens
cacacatgcatgtaagacctct

SEQ ID NO: 6971917 - DNA, 22 bp, Homo sapiens
tcatgtacatgtaagtcagaaa

SEQ ID NO: 6971918 - DNA, 19 bp, Homo sapiens
tggccaggtactgtctgct

SEQ ID NO: 6971919 - DNA, 22 bp, Homo sapiens
tgaggcatggtcctgagggagc

SEQ ID NO: 6971920 - DNA, 22 bp, Homo sapiens
ccttcagcctttgtttatcaga

SEQ ID NO: 6971921 - DNA, 22 bp, Homo sapiens
agtgctgttggataatgctgtc

SEQ ID NO: 6971922 - DNA, 22 bp, Homo sapiens
acattgtataatgattatcaca

SEQ ID NO: 6971923 - DNA, 22 bp, Homo sapiens
agggcccaggacagcatcaggg

SEQ ID NO: 6971924 - DNA, 22 bp, Homo sapiens
gcagggcagaaggtgctgagga

SEQ ID NO: 6971925 - DNA, 22 bp, Homo sapiens
attgaactgatatttggtgtag

SEQ ID NO: 6971926 - DNA, 22 bp, Homo sapiens
cagctctggtccagggagggca

SEQ ID NO: 6971927 - DNA, 22 bp, Homo sapiens
aatgtaaagttgggcacaaatg

SEQ ID NO: 6971928 - DNA, 22 bp, Homo sapiens
atggtacatataaggtgagctt

SEQ ID NO: 6971929 - DNA, 22 bp, Homo sapiens
gtttgcatatctgtgaaatgga

SEQ ID NO: 6971930 - DNA, 22 bp, Homo sapiens
tctgtggcaaacacagtgacca

SEQ ID NO: 6971931 - DNA, 22 bp, Homo sapiens
accattctggtccatactgttc

SEQ ID NO: 6971932 - DNA, 22 bp, Homo sapiens
agcctggccactcagggcctga

SEQ ID NO: 6971933 - DNA, 22 bp, Homo sapiens
tcctgctgaccagtaaatgaat

SEQ ID NO: 6971934 - DNA, 22 bp, Homo sapiens
ctgggacacccaaggaaagagc

SEQ ID NO: 6971935 - DNA, 22 bp, Homo sapiens
gcaggattgggctgaaggagtg

SEQ ID NO: 6971936 - DNA, 22 bp, Homo sapiens
ggcaagaggtccaagaggtctc

SEQ ID NO: 6971937 - DNA, 22 bp, Homo sapiens
gctgaagttgaatattctggga

SEQ ID NO: 6971938 - DNA, 22 bp, Homo sapiens
atgctattccagaatgtaaatt

SEQ ID NO: 6971939 - DNA, 22 bp, Homo sapiens
tcagactgaccgaagcatctgg

SEQ ID NO: 6971940 - DNA, 22 bp, Homo sapiens
agtctcagggccacccggggaa

SEQ ID NO: 6971941 - DNA, 22 bp, Homo sapiens
tgctcatgctggggacagatgt

SEQ ID NO: 6971942 - DNA, 22 bp, Homo sapiens
aatgtctacaccgtatgttgtt

SEQ ID NO: 6971943 - DNA, 22 bp, Homo sapiens
taccatgtcttcaataagtcta

SEQ ID NO: 6971944 - DNA, 22 bp, Homo sapiens
cttcttaaattggattgctatt

SEQ ID NO: 6971945 - DNA, 22 bp, Homo sapiens
gctcagtctaaagacatgctcc

SEQ ID NO: 6971946 - DNA, 22 bp, Homo sapiens
atgtgtgccccttttactcttt

SEQ ID NO: 6971947 - DNA, 22 bp, Homo sapiens
ttgatcttgtgatagttcaact

SEQ ID NO: 6971948 - DNA, 22 bp, Homo sapiens
tagttctagggcatcatcccag

SEQ ID NO: 6971949 - DNA, 22 bp, Homo sapiens
tgagcagtggtgtttttctatc

SEQ ID NO: 6971950 - DNA, 22 bp, Homo sapiens
tagctatttggaaaattccaat

SEQ ID NO: 6971951 - DNA, 22 bp, Homo sapiens
ggagtcttaaaaatcaaatgga

SEQ ID NO: 6971952 - DNA, 22 bp, Homo sapiens
ttggtcacatgagtataaaacg

SEQ ID NO: 6971953 - DNA, 22 bp, Homo sapiens
tctctggagtataaccagggat

SEQ ID NO: 6971954 - DNA, 22 bp, Homo sapiens
tagaaactagattgatagcgga

SEQ ID NO: 6971955 - DNA, 22 bp, Homo sapiens
aagtcactgaaagggcagaaag

SEQ ID NO: 6971956 - DNA, 22 bp, Homo sapiens
atttcacagctgtcagtgttac

SEQ ID NO: 6971957 - DNA, 22 bp, Homo sapiens
gggctgccaagcctgcctgcct

SEQ ID NO: 6971958 - DNA, 22 bp, Homo sapiens
aaggaactaactatgtagagat

SEQ ID NO: 6971959 - DNA, 22 bp, Homo sapiens
tcctgtgtctcagcgtgaagca

SEQ ID NO: 6971960 - DNA, 22 bp, Homo sapiens
aggctaggggaacactagaatc

SEQ ID NO: 6971961 - DNA, 22 bp, Homo sapiens
atcatcatgctacaatcagcaa

SEQ ID NO: 6971962 - DNA, 22 bp, Homo sapiens
tgcgcatgagtctgtgcataca

SEQ ID NO: 6971963 - DNA, 22 bp, Homo sapiens
cacagggcctggggcagctgct

SEQ ID NO: 6971964 - DNA, 19 bp, Homo sapiens
acacagggctagagttaca

SEQ ID NO: 6971965 - DNA, 22 bp, Homo sapiens
ggcttcagaggggaggtagtgc

SEQ ID NO: 6971966 - DNA, 22 bp, Homo sapiens
tattatgtagagtaagggttaa

SEQ ID NO: 6971967 - DNA, 22 bp, Homo sapiens
gggcctgggaacttgcatttag

SEQ ID NO: 6971968 - DNA, 22 bp, Homo sapiens
tgtggcctcctgttcctgggta

SEQ ID NO: 6971969 - DNA, 22 bp, Homo sapiens
tgttcctggtgagccatttttt

SEQ ID NO: 6971970 - DNA, 22 bp, Homo sapiens
cagctgaggaatactagatgta

SEQ ID NO: 6971971 - DNA, 21 bp, Homo sapiens
agatatgaatactgcaggcct

SEQ ID NO: 6971972 - DNA, 20 bp, Homo sapiens
ctgtggctcatgcatctgcc

SEQ ID NO: 6971973 - DNA, 22 bp, Homo sapiens
ggcatttaggatctttagttga

SEQ ID NO: 6971974 - DNA, 22 bp, Homo sapiens
gagctggtccacaatctgcagg

SEQ ID NO: 6971975 - DNA, 22 bp, Homo sapiens
aagtacaacgcatacagagaaa

SEQ ID NO: 6971976 - DNA, 22 bp, Homo sapiens
ttgcttccttgagctggtctga

SEQ ID NO: 6971977 - DNA, 22 bp, Homo sapiens
tcagccagcatcagctaagtgc

SEQ ID NO: 6971978 - DNA, 22 bp, Homo sapiens
ttgtgcaaagggggttaatcat

SEQ ID NO: 6971979 - DNA, 22 bp, Homo sapiens
aggctaagtgagtaaaatgtgg

SEQ ID NO: 6971980 - DNA, 22 bp, Homo sapiens
atgtcaacttgggctggggtct

SEQ ID NO: 6971981 - DNA, 20 bp, Homo sapiens
ggcaggctttatatggaggg

SEQ ID NO: 6971982 - DNA, 22 bp, Homo sapiens
ctcatgatttgagtagtaaact

SEQ ID NO: 6971983 - DNA, 22 bp, Homo sapiens
gttcccatacagtatcagtgct

SEQ ID NO: 6971984 - DNA, 22 bp, Homo sapiens
ctgcccgcaccatccccgggct

SEQ ID NO: 6971985 - DNA, 22 bp, Homo sapiens
cattggccttttatcctagagg

SEQ ID NO: 6971986 - DNA, 22 bp, Homo sapiens
tgcagtgtttttcagggcatat

SEQ ID NO: 6971987 - DNA, 18 bp, Homo sapiens
aaactggcttggcctgtg

SEQ ID NO: 6971988 - DNA, 22 bp, Homo sapiens
tcagccagaggtggatgagtca

SEQ ID NO: 6971989 - DNA, 22 bp, Homo sapiens
gctaaatgatgggaaatctggg

SEQ ID NO: 6971990 - DNA, 22 bp, Homo sapiens
gcacgaggcaccgctgttttgt

SEQ ID NO: 6971991 - DNA, 22 bp, Homo sapiens
agtggctgtatcagtcaaccct

SEQ ID NO: 6971992 - DNA, 22 bp, Homo sapiens
atgccctttaatttcactgtta

SEQ ID NO: 6971993 - DNA, 22 bp, Homo sapiens
gctgtcctggggagggagaatg

SEQ ID NO: 6971994 - DNA, 22 bp, Homo sapiens
ggaatcatgccatttatgacgt

SEQ ID NO: 6971995 - DNA, 22 bp, Homo sapiens
tgatggtattaggaggtgaggc

SEQ ID NO: 6971996 - DNA, 22 bp, Homo sapiens
tgctatgtcaaaacctactcct

SEQ ID NO: 6971997 - DNA, 22 bp, Homo sapiens
attgcttttgagctagaatttt

SEQ ID NO: 6971998 - DNA, 22 bp, Homo sapiens
ctggctttctctgtggtgttca

SEQ ID NO: 6971999 - DNA, 22 bp, Homo sapiens
tcttggaaccctatgtgatttc

SEQ ID NO: 6972000 - DNA, 22 bp, Homo sapiens
acgctcgctgcctcgtggtggt

SEQ ID NO: 6972001 - DNA, 22 bp, Homo sapiens
tgattacacaccacagtgctcc

SEQ ID NO: 6972002 - DNA, 22 bp, Homo sapiens
tctcttctaattagggtccatg

SEQ ID NO: 6972003 - DNA, 22 bp, Homo sapiens
gaggcttggggctggcttgcct

SEQ ID NO: 6972004 - DNA, 22 bp, Homo sapiens
ctcttgaactttctagtttcat

SEQ ID NO: 6972005 - DNA, 20 bp, Homo sapiens
cctgtccaagctccacccca

SEQ ID NO: 6972006 - DNA, 23 bp, Homo sapiens
tcacactggatacacatgcaaga

SEQ ID NO: 6972007 - DNA, 22 bp, Homo sapiens
ttgccttgttattctctcagaa

SEQ ID NO: 6972008 - DNA, 22 bp, Homo sapiens
tgtttagatgcaaagtctcaca

SEQ ID NO: 6972009 - DNA, 22 bp, Homo sapiens
accaggcttaatcctttgctat

SEQ ID NO: 6972010 - DNA, 22 bp, Homo sapiens
caaggccctgcaacctgacttg

SEQ ID NO: 6972011 - DNA, 22 bp, Homo sapiens
cttcatgatgaccaactgccat

SEQ ID NO: 6972012 - DNA, 22 bp, Homo sapiens
tctctatattatatgtagtttg

SEQ ID NO: 6972013 - DNA, 22 bp, Homo sapiens
cctgtattcaattttgtgtgat

SEQ ID NO: 6972014 - DNA, 22 bp, Homo sapiens
gggatcttgaaacagctggatt

SEQ ID NO: 6972015 - DNA, 22 bp, Homo sapiens
cctgccttgacgtaacgcatga

SEQ ID NO: 6972016 - DNA, 22 bp, Homo sapiens
atgtgaatgcagttatctataa

SEQ ID NO: 6972017 - DNA, 22 bp, Homo sapiens
cctgggctgctcatggggatga

SEQ ID NO: 6972018 - DNA, 22 bp, Homo sapiens
gcctgctctccggatccctgat

SEQ ID NO: 6972019 - DNA, 22 bp, Homo sapiens
tctgtgtatttgtgacctgtat

SEQ ID NO: 6972020 - DNA, 22 bp, Homo sapiens
aactgttattattttgcatggt

SEQ ID NO: 6972021 - DNA, 22 bp, Homo sapiens
tgtgtgattgcaggagatgtgg

SEQ ID NO: 6972022 - DNA, 22 bp, Homo sapiens
tggccaggttgggctttgcagc

SEQ ID NO: 6972023 - DNA, 22 bp, Homo sapiens
ttacattttgcacagatgtccc

SEQ ID NO: 6972024 - DNA, 22 bp, Homo sapiens
ttctccaactcttttaagtaat

SEQ ID NO: 6972025 - DNA, 22 bp, Homo sapiens
agggctgctttgctaaatatgg

SEQ ID NO: 6972026 - DNA, 15 bp, Homo sapiens
tagtccagtgatagt

SEQ ID NO: 6972027 - DNA, 22 bp, Homo sapiens
cagccctttccttctcagcttt

SEQ ID NO: 6972028 - DNA, 22 bp, Homo sapiens
aatcacatgtgggtcttgtagc

SEQ ID NO: 6972029 - DNA, 22 bp, Homo sapiens
aagcacaggttgaggattattc

SEQ ID NO: 6972030 - DNA, 22 bp, Homo sapiens
agatggtggactatctgacttg

SEQ ID NO: 6972031 - DNA, 22 bp, Homo sapiens
tttgaatagcataggattacat

SEQ ID NO: 6972032 - DNA, 22 bp, Homo sapiens
aagcatcaacactatattgatg

SEQ ID NO: 6972033 - DNA, 19 bp, Homo sapiens
aatgtgcttgggagactgc

SEQ ID NO: 6972034 - DNA, 22 bp, Homo sapiens
ttcctttctctggactgcagcc

SEQ ID NO: 6972035 - DNA, 22 bp, Homo sapiens
tgctctgtgtgtggttatttcc

SEQ ID NO: 6972036 - DNA, 22 bp, Homo sapiens
agtcttggtctccctggcagct

SEQ ID NO: 6972037 - DNA, 21 bp, Homo sapiens
aggctgcatgcatgagtgtgg

SEQ ID NO: 6972038 - DNA, 22 bp, Homo sapiens
gcttgggactggagaatagggt

SEQ ID NO: 6972039 - DNA, 20 bp, Homo sapiens
atgcttaagtgttcattatt

SEQ ID NO: 6972040 - DNA, 22 bp, Homo sapiens
tggggttgcctcccgccctgga

SEQ ID NO: 6972041 - DNA, 22 bp, Homo sapiens
tgaattgtacagtatgtgaatt

SEQ ID NO: 6972042 - DNA, 22 bp, Homo sapiens
cctgggaagtggaggttacagt

SEQ ID NO: 6972043 - DNA, 22 bp, Homo sapiens
tcagtctcctttcctctagaca

SEQ ID NO: 6972044 - DNA, 22 bp, Homo sapiens
tcatacatctgtcctggagctc

SEQ ID NO: 6972045 - DNA, 22 bp, Homo sapiens
accagaagctggagcacaagga

SEQ ID NO: 6972046 - DNA, 22 bp, Homo sapiens
cctgagcagggctctgcagggc

SEQ ID NO: 6972047 - DNA, 22 bp, Homo sapiens
caggaaccagaaccttcccccg

SEQ ID NO: 6972048 - DNA, 22 bp, Homo sapiens
ttcggagtattgacatgtgaag

SEQ ID NO: 6972049 - DNA, 22 bp, Homo sapiens
cattcataagtttttgtgctgg

SEQ ID NO: 6972050 - DNA, 22 bp, Homo sapiens
cactgcttgattgacatgcacg

SEQ ID NO: 6972051 - DNA, 22 bp, Homo sapiens
tggagcaggtgctcagggtaat

SEQ ID NO: 6972052 - DNA, 21 bp, Homo sapiens
cccgtgccttcagcagtcctg

SEQ ID NO: 6972053 - DNA, 22 bp, Homo sapiens
aaaactacatttgacattttgt

SEQ ID NO: 6972054 - DNA, 19 bp, Homo sapiens
tctggctccgcctcttagt

SEQ ID NO: 6972055 - DNA, 22 bp, Homo sapiens
agtccatgctgtctacagaatc

SEQ ID NO: 6972056 - DNA, 22 bp, Homo sapiens
tccagcaccaccacagggaaga

SEQ ID NO: 6972057 - DNA, 21 bp, Homo sapiens
aaaatgtagacttttccctga

SEQ ID NO: 6972058 - DNA, 22 bp, Homo sapiens
agtttacagatgtagtaggggt

SEQ ID NO: 6972059 - DNA, 22 bp, Homo sapiens
aaagactggtgtgttacatata

SEQ ID NO: 6972060 - DNA, 22 bp, Homo sapiens
tttggctttagtgccttctgat

SEQ ID NO: 6972061 - DNA, 22 bp, Homo sapiens
cattagggactgaggaataagg

SEQ ID NO: 6972062 - DNA, 22 bp, Homo sapiens
tgaatgagtgagttcagacctc

SEQ ID NO: 6972063 - DNA, 22 bp, Homo sapiens
atacaatccagccattgccaca

SEQ ID NO: 6972064 - DNA, 22 bp, Homo sapiens
agtcagcagcctggccaggaga

SEQ ID NO: 6972065 - DNA, 22 bp, Homo sapiens
gctgccacattttcaggactaa

SEQ ID NO: 6972066 - DNA, 22 bp, Homo sapiens
tggtttgggtagttattattat

SEQ ID NO: 6972067 - DNA, 22 bp, Homo sapiens
cgtacccaaacactgatgacca

SEQ ID NO: 6972068 - DNA, 22 bp, Homo sapiens
cctgggttggagagcaatggtg

SEQ ID NO: 6972069 - DNA, 22 bp, Homo sapiens
attagagcagtgtattatgata

SEQ ID NO: 6972070 - DNA, 22 bp, Homo sapiens
caaacattgctaccagaggttt

SEQ ID NO: 6972071 - DNA, 19 bp, Homo sapiens
gagtattttccaacttggt

SEQ ID NO: 6972072 - DNA, 22 bp, Homo sapiens
tgacatctttgatctcatttag

SEQ ID NO: 6972073 - DNA, 22 bp, Homo sapiens
aggcctcagtgatcatcatcag

SEQ ID NO: 6972074 - DNA, 23 bp, Homo sapiens
gagcttttgtagtagtcactgtg

SEQ ID NO: 6972075 - DNA, 22 bp, Homo sapiens
tgactaggaataccatggtgga

SEQ ID NO: 6972076 - DNA, 22 bp, Homo sapiens
aagacattggcattgactgtaa

SEQ ID NO: 6972077 - DNA, 21 bp, Homo sapiens
cctgttcacagatctgtaact

SEQ ID NO: 6972078 - DNA, 23 bp, Homo sapiens
agtcccctacatagttcctgggg

SEQ ID NO: 6972079 - DNA, 22 bp, Homo sapiens
tgtgtcctgtccccttgctgct

SEQ ID NO: 6972080 - DNA, 22 bp, Homo sapiens
gatttgacaaccaattaggttt

SEQ ID NO: 6972081 - DNA, 22 bp, Homo sapiens
gctttcaaggaatttggtattt

SEQ ID NO: 6972082 - DNA, 22 bp, Homo sapiens
tcttgtcctaagagctggattc

SEQ ID NO: 6972083 - DNA, 22 bp, Homo sapiens
cagggctggatttcatttctag

SEQ ID NO: 6972084 - DNA, 22 bp, Homo sapiens
ttcagggcgttgtggctgactg

SEQ ID NO: 6972085 - DNA, 22 bp, Homo sapiens
gtgggcagccccttcaaggcca

SEQ ID NO: 6972086 - DNA, 22 bp, Homo sapiens
cagatccatctctcagaaagag

SEQ ID NO: 6972087 - DNA, 22 bp, Homo sapiens
caagggtggtattgggagcata

SEQ ID NO: 6972088 - DNA, 22 bp, Homo sapiens
ctgttagtaatgaagagaatgg

SEQ ID NO: 6972089 - DNA, 22 bp, Homo sapiens
gggcatgagaggcaggcaagtg

SEQ ID NO: 6972090 - DNA, 22 bp, Homo sapiens
agtacagtggtcataatataaa

SEQ ID NO: 6972091 - DNA, 17 bp, Homo sapiens
gcactcccccacctcct

SEQ ID NO: 6972092 - DNA, 22 bp, Homo sapiens
acatgcatgtgaatatggacac

SEQ ID NO: 6972093 - DNA, 22 bp, Homo sapiens
tagatatgtgtttattatgctg

SEQ ID NO: 6972094 - DNA, 22 bp, Homo sapiens
ctgttttataaagtccaaaagt

SEQ ID NO: 6972095 - DNA, 22 bp, Homo sapiens
ttccaacttcccatccctgctg

SEQ ID NO: 6972096 - DNA, 22 bp, Homo sapiens
tgctctgtaggggaaagagagc

SEQ ID NO: 6972097 - DNA, 22 bp, Homo sapiens
taaagagccattgtatggtttt

SEQ ID NO: 6972098 - DNA, 22 bp, Homo sapiens
aggaaaatgatattctgctgtt

SEQ ID NO: 6972099 - DNA, 21 bp, Homo sapiens
tcccactgccacagcttcagg

SEQ ID NO: 6972100 - DNA, 22 bp, Homo sapiens
ttaaagtctatgtactacactt

SEQ ID NO: 6972101 - DNA, 22 bp, Homo sapiens
cagtttgggctctgcctgtggc

SEQ ID NO: 6972102 - DNA, 22 bp, Homo sapiens
attccactttgctaatcttctg

SEQ ID NO: 6972103 - DNA, 22 bp, Homo sapiens
ctctccagttatagctgatttg

SEQ ID NO: 6972104 - DNA, 22 bp, Homo sapiens
agactctggagtcagctaggat

SEQ ID NO: 6972105 - DNA, 22 bp, Homo sapiens
gtgtccactcgtggtctgtcag

SEQ ID NO: 6972106 - DNA, 23 bp, Homo sapiens
ccagtgtggtaggtccacaggtg

SEQ ID NO: 6972107 - DNA, 22 bp, Homo sapiens
ataccaccatctatgaaaggta

SEQ ID NO: 6972108 - DNA, 22 bp, Homo sapiens
agttcttcataaccttactgtg

SEQ ID NO: 6972109 - DNA, 22 bp, Homo sapiens
actgagccttgaagctagatag

SEQ ID NO: 6972110 - DNA, 22 bp, Homo sapiens
aggcaaatgatcctgctccttg

SEQ ID NO: 6972111 - DNA, 22 bp, Homo sapiens
ggaaaagtgttaaggtgttgat

SEQ ID NO: 6972112 - DNA, 22 bp, Homo sapiens
gaattgctaggctgcatgtgtc

SEQ ID NO: 6972113 - DNA, 22 bp, Homo sapiens
aagacatacagacagtgagcca

SEQ ID NO: 6972114 - DNA, 22 bp, Homo sapiens
actttgaaatgtgtaagagaga

SEQ ID NO: 6972115 - DNA, 22 bp, Homo sapiens
gccagagcctgtggatttaacc

SEQ ID NO: 6972116 - DNA, 22 bp, Homo sapiens
cctgtgggaggggcctggcgcg

SEQ ID NO: 6972117 - DNA, 22 bp, Homo sapiens
tctttgcaaatgttattatctt

SEQ ID NO: 6972118 - DNA, 22 bp, Homo sapiens
gaactgtgtacattgtagataa

SEQ ID NO: 6972119 - DNA, 20 bp, Homo sapiens
tgtggtttttgccagttgaa

SEQ ID NO: 6972120 - DNA, 22 bp, Homo sapiens
aagtccttgaagaaacagttct

SEQ ID NO: 6972121 - DNA, 22 bp, Homo sapiens
taagacatggttgatctagtgt

SEQ ID NO: 6972122 - DNA, 22 bp, Homo sapiens
ttaagactattgtaatagggga

SEQ ID NO: 6972123 - DNA, 22 bp, Homo sapiens
cacatgcagtttacgtcactga

SEQ ID NO: 6972124 - DNA, 22 bp, Homo sapiens
acagtataactccatgccaccc

SEQ ID NO: 6972125 - DNA, 16 bp, Homo sapiens
cagcccaggggcgggc

SEQ ID NO: 6972126 - DNA, 22 bp, Homo sapiens
agagccagaccattgccgtgca

SEQ ID NO: 6972127 - DNA, 22 bp, Homo sapiens
tagatgctagtagcacctgacc

SEQ ID NO: 6972128 - DNA, 22 bp, Homo sapiens
ctggctccactccctgcctgac

SEQ ID NO: 6972129 - DNA, 22 bp, Homo sapiens
gaacagtgaactgatttgtaaa

SEQ ID NO: 6972130 - DNA, 22 bp, Homo sapiens
tctgcagcttcttgccagagag

SEQ ID NO: 6972131 - DNA, 21 bp, Homo sapiens
tgcagaattctgggagccccc

SEQ ID NO: 6972132 - DNA, 22 bp, Homo sapiens
aggatgccttcattgcatggcc

SEQ ID NO: 6972133 - DNA, 22 bp, Homo sapiens
gtccttgggatagaaagatgaa

SEQ ID NO: 6972134 - DNA, 22 bp, Homo sapiens
gccattgcactccagcctaggc

SEQ ID NO: 6972135 - DNA, 22 bp, Homo sapiens
ctttggcacagtgtttactagc

SEQ ID NO: 6972136 - DNA, 22 bp, Homo sapiens
gagcacagcgcagtttgtaatt

SEQ ID NO: 6972137 - DNA, 22 bp, Homo sapiens
attaaatgttccttaaattata

SEQ ID NO: 6972138 - DNA, 22 bp, Homo sapiens
agaattctgttcttcgggtgtg

SEQ ID NO: 6972139 - DNA, 22 bp, Homo sapiens
aacaggcagcagactgaatctg

SEQ ID NO: 6972140 - DNA, 23 bp, Homo sapiens
ccattcccactgtgccttccctg

SEQ ID NO: 6972141 - DNA, 16 bp, Homo sapiens
aaactgacggcatctg

SEQ ID NO: 6972142 - DNA, 22 bp, Homo sapiens
tcagcttcacccagagttgtag

SEQ ID NO: 6972143 - DNA, 22 bp, Homo sapiens
tctgcacagattctctgagaat

SEQ ID NO: 6972144 - DNA, 21 bp, Homo sapiens
tctccagttgacagtgtctcc

SEQ ID NO: 6972145 - DNA, 22 bp, Homo sapiens
gtccacagctctgaggtctccc

SEQ ID NO: 6972146 - DNA, 22 bp, Homo sapiens
tgctcttcaccattacatcatg

SEQ ID NO: 6972147 - DNA, 22 bp, Homo sapiens
gctaggagattgagctctgaag

SEQ ID NO: 6972148 - DNA, 22 bp, Homo sapiens
gcgctgcgcctcctcttccgca

SEQ ID NO: 6972149 - DNA, 18 bp, Homo sapiens
attgcacaccagcctggg

SEQ ID NO: 6972150 - DNA, 22 bp, Homo sapiens
ctgactccctccccaaagctgg

SEQ ID NO: 6972151 - DNA, 22 bp, Homo sapiens
cagtttaaggcaggacatggga

SEQ ID NO: 6972152 - DNA, 22 bp, Homo sapiens
agtcaaactgcctaggaagcag

SEQ ID NO: 6972153 - DNA, 22 bp, Homo sapiens
aagtttctcaatggcaactggg

SEQ ID NO: 6972154 - DNA, 22 bp, Homo sapiens
aactgtggcatgttgaatttgt

SEQ ID NO: 6972155 - DNA, 22 bp, Homo sapiens
tttagagagaaataaatgagat

SEQ ID NO: 6972156 - DNA, 22 bp, Homo sapiens
cagcactggggggattcggagc

SEQ ID NO: 6972157 - DNA, 22 bp, Homo sapiens
taggaagtttatattattctga

SEQ ID NO: 6972158 - DNA, 22 bp, Homo sapiens
atacagttatagtcagggctaa

SEQ ID NO: 6972159 - DNA, 22 bp, Homo sapiens
attgggctggattaggactgtt

SEQ ID NO: 6972160 - DNA, 22 bp, Homo sapiens
acctctcttgtagctgctggtg

SEQ ID NO: 6972161 - DNA, 21 bp, Homo sapiens
acctgtgaatagccactgcac

SEQ ID NO: 6972162 - DNA, 22 bp, Homo sapiens
cccttcctgggtgtcccggagt

SEQ ID NO: 6972163 - DNA, 22 bp, Homo sapiens
cctgggagccgactgactgtgc

SEQ ID NO: 6972164 - DNA, 22 bp, Homo sapiens
cctgccatggtagacttccagg

SEQ ID NO: 6972165 - DNA, 22 bp, Homo sapiens
ccatctccagtttattcttcct

SEQ ID NO: 6972166 - DNA, 22 bp, Homo sapiens
agagctaggaatgaccactctc

SEQ ID NO: 6972167 - DNA, 22 bp, Homo sapiens
tttagcttcagttctagcttct

SEQ ID NO: 6972168 - DNA, 18 bp, Homo sapiens
tcctttcaccccttctct

SEQ ID NO: 6972169 - DNA, 22 bp, Homo sapiens
ttacagttagaatctgatgaaa

SEQ ID NO: 6972170 - DNA, 22 bp, Homo sapiens
ggcatggtggtacacatctgta

SEQ ID NO: 6972171 - DNA, 22 bp, Homo sapiens
tagcagtgttgccgttggctgc

SEQ ID NO: 6972172 - DNA, 20 bp, Homo sapiens
gtgcaatggcgcaatctcgg

SEQ ID NO: 6972173 - DNA, 22 bp, Homo sapiens
cctctctcagcttgctgcaact

SEQ ID NO: 6972174 - DNA, 22 bp, Homo sapiens
tctcatttggctttgttttaaa

SEQ ID NO: 6972175 - DNA, 23 bp, Homo sapiens
tggagctgggcagctgggaaagt

SEQ ID NO: 6972176 - DNA, 22 bp, Homo sapiens
aattctcaggaatttcatctgt

SEQ ID NO: 6972177 - DNA, 22 bp, Homo sapiens
attgctgtacacttctagatct

SEQ ID NO: 6972178 - DNA, 22 bp, Homo sapiens
gtggtgttcccacgcctgctag

SEQ ID NO: 6972179 - DNA, 22 bp, Homo sapiens
gaaattcactgtatttcttggg

SEQ ID NO: 6972180 - DNA, 22 bp, Homo sapiens
ttaggaaaatgaaattacctgt

SEQ ID NO: 6972181 - DNA, 19 bp, Homo sapiens
cctgtgtggggtagagatc

SEQ ID NO: 6972182 - DNA, 22 bp, Homo sapiens
ggctgagccatgggcactgcag

SEQ ID NO: 6972183 - DNA, 22 bp, Homo sapiens
ctgcttccatggtctggagact

SEQ ID NO: 6972184 - DNA, 17 bp, Homo sapiens
tatgtgtgtgtttatac

SEQ ID NO: 6972185 - DNA, 22 bp, Homo sapiens
atctagaagtcatggctttctt

SEQ ID NO: 6972186 - DNA, 22 bp, Homo sapiens
caaagcagagaactgtctcatt

SEQ ID NO: 6972187 - DNA, 22 bp, Homo sapiens
gaagagctgtgattcaggctta

SEQ ID NO: 6972188 - DNA, 22 bp, Homo sapiens
aatgttcaaacagatcacttag

SEQ ID NO: 6972189 - DNA, 22 bp, Homo sapiens
agagctgtatccccttaccagt

SEQ ID NO: 6972190 - DNA, 22 bp, Homo sapiens
cttggattcattgtgggaggga

SEQ ID NO: 6972191 - DNA, 22 bp, Homo sapiens
cccactgtgttgctgttaatct

SEQ ID NO: 6972192 - DNA, 22 bp, Homo sapiens
attcatgttcggggccacgttg

SEQ ID NO: 6972193 - DNA, 22 bp, Homo sapiens
agcttctgaaagtctgttttcc

SEQ ID NO: 6972194 - DNA, 22 bp, Homo sapiens
gacattggctgttcattgggat

SEQ ID NO: 6972195 - DNA, 22 bp, Homo sapiens
tgtcatgagtctcctccatctt

SEQ ID NO: 6972196 - DNA, 19 bp, Homo sapiens
cctagagcagtacctggta

SEQ ID NO: 6972197 - DNA, 22 bp, Homo sapiens
gctttctgcctgggctccattt

SEQ ID NO: 6972198 - DNA, 21 bp, Homo sapiens
agactgccatctttgggccac

SEQ ID NO: 6972199 - DNA, 22 bp, Homo sapiens
ttggtaggggactagagtccag

SEQ ID NO: 6972200 - DNA, 22 bp, Homo sapiens
cttctgtgagtcagtgtttctg

SEQ ID NO: 6972201 - DNA, 22 bp, Homo sapiens
ggctgccccagtgctcatggct

SEQ ID NO: 6972202 - DNA, 22 bp, Homo sapiens
ccagtgcataatcaatacagcc

SEQ ID NO: 6972203 - DNA, 22 bp, Homo sapiens
cagatttaggtcactagaattt

SEQ ID NO: 6972204 - DNA, 22 bp, Homo sapiens
ggcagcaggagccatctggtag

SEQ ID NO: 6972205 - DNA, 22 bp, Homo sapiens
ctgtggctgtgaaacttctcag

SEQ ID NO: 6972206 - DNA, 22 bp, Homo sapiens
tcagtgcaggaatctctagcca

SEQ ID NO: 6972207 - DNA, 22 bp, Homo sapiens
caggtggcttattagggtcagt

SEQ ID NO: 6972208 - DNA, 22 bp, Homo sapiens
tcagttttaaggtttgagaatt

SEQ ID NO: 6972209 - DNA, 22 bp, Homo sapiens
cccagggaggtagcaggagaaa

SEQ ID NO: 6972210 - DNA, 22 bp, Homo sapiens
aagacactttctaaatagaagt

SEQ ID NO: 6972211 - DNA, 22 bp, Homo sapiens
cagaggtacagccattgaagat

SEQ ID NO: 6972212 - DNA, 22 bp, Homo sapiens
cacacattcaccatgactgaaa

SEQ ID NO: 6972213 - DNA, 22 bp, Homo sapiens
taagatgtgacaggcctggaat

SEQ ID NO: 6972214 - DNA, 22 bp, Homo sapiens
tgggagttgggtgggagacttc

SEQ ID NO: 6972215 - DNA, 22 bp, Homo sapiens
taagttggcaataatactgtaa

SEQ ID NO: 6972216 - DNA, 22 bp, Homo sapiens
tgcacagatgggcttgttcata

SEQ ID NO: 6972217 - DNA, 22 bp, Homo sapiens
aggtaagggctgcgactataag

SEQ ID NO: 6972218 - DNA, 22 bp, Homo sapiens
ttattccagtaatctctgtaat

SEQ ID NO: 6972219 - DNA, 22 bp, Homo sapiens
ctggccagttgtcctggcttgg

SEQ ID NO: 6972220 - DNA, 22 bp, Homo sapiens
attttgctggtctgaattactt

SEQ ID NO: 6972221 - DNA, 22 bp, Homo sapiens
tgagtgctcccagggccttcgc

SEQ ID NO: 6972222 - DNA, 22 bp, Homo sapiens
agggctgaagttatggctgagc

SEQ ID NO: 6972223 - DNA, 22 bp, Homo sapiens
tagtgctatagaagtgcttgcg

SEQ ID NO: 6972224 - DNA, 22 bp, Homo sapiens
tctaaggacattggctttggag

SEQ ID NO: 6972225 - DNA, 22 bp, Homo sapiens
ctgtggccagtcccacacctcc

SEQ ID NO: 6972226 - DNA, 22 bp, Homo sapiens
tcagcactgatagaagtcaata

SEQ ID NO: 6972227 - DNA, 16 bp, Homo sapiens
atccaggcaggaaaga

SEQ ID NO: 6972228 - DNA, 22 bp, Homo sapiens
tgtgaaggacttgttccattgt

SEQ ID NO: 6972229 - DNA, 22 bp, Homo sapiens
aacaccttctccttgcaggcca

SEQ ID NO: 6972230 - DNA, 21 bp, Homo sapiens
aaatgcaggctctttgttttc

SEQ ID NO: 6972231 - DNA, 22 bp, Homo sapiens
ttgctgacctttgctctccgtt

SEQ ID NO: 6972232 - DNA, 22 bp, Homo sapiens
accaggcagcaccaaagccggt

SEQ ID NO: 6972233 - DNA, 22 bp, Homo sapiens
gcacttgaaaagatcaggtgca

SEQ ID NO: 6972234 - DNA, 20 bp, Homo sapiens
tgcagggctctgcttctctc

SEQ ID NO: 6972235 - DNA, 22 bp, Homo sapiens
gtcatacagctagtgaagtcag

SEQ ID NO: 6972236 - DNA, 22 bp, Homo sapiens
tttatatcttatgtcatttcaa

SEQ ID NO: 6972237 - DNA, 22 bp, Homo sapiens
gtcactgtatccaggttccagc

SEQ ID NO: 6972238 - DNA, 22 bp, Homo sapiens
catatggacaagaacatttatg

SEQ ID NO: 6972239 - DNA, 22 bp, Homo sapiens
ggacagtgtgggccatctcact

SEQ ID NO: 6972240 - DNA, 22 bp, Homo sapiens
atgaagagtaagaggacctttt

SEQ ID NO: 6972241 - DNA, 22 bp, Homo sapiens
ctctccagtcaggaactctgac

SEQ ID NO: 6972242 - DNA, 19 bp, Homo sapiens
agtcagctagttcctatac

SEQ ID NO: 6972243 - DNA, 22 bp, Homo sapiens
tagcagtgtaaagtggctagaa

SEQ ID NO: 6972244 - DNA, 22 bp, Homo sapiens
tgccaggacaaggaccacatgg

SEQ ID NO: 6972245 - DNA, 22 bp, Homo sapiens
cctgagtggtgctaagcagata

SEQ ID NO: 6972246 - DNA, 22 bp, Homo sapiens
taagagtatctattaagtactt

SEQ ID NO: 6972247 - DNA, 22 bp, Homo sapiens
acatgcaaagggatgcaattat

SEQ ID NO: 6972248 - DNA, 20 bp, Homo sapiens
acagtcctgcactggtgttt

SEQ ID NO: 6972249 - DNA, 22 bp, Homo sapiens
accctcttgagggaagcacttt

SEQ ID NO: 6972250 - DNA, 22 bp, Homo sapiens
atatccaccattctgcaccttc

SEQ ID NO: 6972251 - DNA, 21 bp, Homo sapiens
agcagctgcagtttctatctg

SEQ ID NO: 6972252 - DNA, 22 bp, Homo sapiens
aggctgagggctcctgagggca

SEQ ID NO: 6972253 - DNA, 22 bp, Homo sapiens
tactgtaatgagattagcttcc

SEQ ID NO: 6972254 - DNA, 22 bp, Homo sapiens
accagggcccgggagagctctc

SEQ ID NO: 6972255 - DNA, 22 bp, Homo sapiens
acctggctggttgtgattccca

SEQ ID NO: 6972256 - DNA, 22 bp, Homo sapiens
aatttgacagcaatagaagatt

SEQ ID NO: 6972257 - DNA, 22 bp, Homo sapiens
gcagctttttggatgtcagtta

SEQ ID NO: 6972258 - DNA, 22 bp, Homo sapiens
tggattaaagattaaaatgaca

SEQ ID NO: 6972259 - DNA, 22 bp, Homo sapiens
ctgggcatggacagctgcacag

SEQ ID NO: 6972260 - DNA, 22 bp, Homo sapiens
aagccttggcccttcattataa

SEQ ID NO: 6972261 - DNA, 22 bp, Homo sapiens
taccaaatgtaatcattctaat

SEQ ID NO: 6972262 - DNA, 22 bp, Homo sapiens
agcacattttctcaaagctcat

SEQ ID NO: 6972263 - DNA, 22 bp, Homo sapiens
agctcctgtgtgaagcctccct

SEQ ID NO: 6972264 - DNA, 22 bp, Homo sapiens
agctaaatgtgaaatgtcaacc

SEQ ID NO: 6972265 - DNA, 20 bp, Homo sapiens
gtctcctctttgcattccta

SEQ ID NO: 6972266 - DNA, 22 bp, Homo sapiens
gttttgaatactactagaactt

SEQ ID NO: 6972267 - DNA, 22 bp, Homo sapiens
gctcaaatttcagactcatgaa

SEQ ID NO: 6972268 - DNA, 22 bp, Homo sapiens
ttgggtggtggggagagttcag

SEQ ID NO: 6972269 - DNA, 21 bp, Homo sapiens
gggggaagaggagttgctagt

SEQ ID NO: 6972270 - DNA, 21 bp, Homo sapiens
ggccgccgccttgtgctctgc

SEQ ID NO: 6972271 - DNA, 22 bp, Homo sapiens
gagatccataagtgatagaaat

SEQ ID NO: 6972272 - DNA, 22 bp, Homo sapiens
atctggccctctcagccctgtt

SEQ ID NO: 6972273 - DNA, 22 bp, Homo sapiens
cttggcattttgctctgatatg

SEQ ID NO: 6972274 - DNA, 18 bp, Homo sapiens
ggatgctgtgtgctcctt

SEQ ID NO: 6972275 - DNA, 22 bp, Homo sapiens
gctttacatgatttctcaccct

SEQ ID NO: 6972276 - DNA, 22 bp, Homo sapiens
gtacatttcatttaaatgatgt

SEQ ID NO: 6972277 - DNA, 22 bp, Homo sapiens
tttcacatcctgaagccccact

SEQ ID NO: 6972278 - DNA, 20 bp, Homo sapiens
tcctgagaggctcttggaga

SEQ ID NO: 6972279 - DNA, 22 bp, Homo sapiens
tttctcagaatataaaattctc

SEQ ID NO: 6972280 - DNA, 22 bp, Homo sapiens
tactgacactcggtacacgcag

SEQ ID NO: 6972281 - DNA, 22 bp, Homo sapiens
ctgaagggggtttcactgagct

SEQ ID NO: 6972282 - DNA, 22 bp, Homo sapiens
gctcactgccattctctagatg

SEQ ID NO: 6972283 - DNA, 22 bp, Homo sapiens
gggctcattgggcgctttctaa

SEQ ID NO: 6972284 - DNA, 22 bp, Homo sapiens
caagcatactcattccagactc

SEQ ID NO: 6972285 - DNA, 18 bp, Homo sapiens
ctgggactcaatgctact

SEQ ID NO: 6972286 - DNA, 22 bp, Homo sapiens
gccaggttgctgacgacgatct

SEQ ID NO: 6972287 - DNA, 22 bp, Homo sapiens
ggcatgtctgatggcccaagtc

SEQ ID NO: 6972288 - DNA, 22 bp, Homo sapiens
aaacatgtaagttcagatcacc

SEQ ID NO: 6972289 - DNA, 22 bp, Homo sapiens
ttccaggctgatgggccacagg

SEQ ID NO: 6972290 - DNA, 22 bp, Homo sapiens
ttttaatcctcttggtatctta

SEQ ID NO: 6972291 - DNA, 22 bp, Homo sapiens
ctaagcacaatgctttgagtat

SEQ ID NO: 6972292 - DNA, 22 bp, Homo sapiens
attttgaagggaattgaagttc

SEQ ID NO: 6972293 - DNA, 22 bp, Homo sapiens
tgcccctgacctcaggcgaagg

SEQ ID NO: 6972294 - DNA, 22 bp, Homo sapiens
gaagaatatggctctcagcaat

SEQ ID NO: 6972295 - DNA, 22 bp, Homo sapiens
aaccctgggctcccgacttacg

SEQ ID NO: 6972296 - DNA, 22 bp, Homo sapiens
agccacaaaggcttgcctcgga

SEQ ID NO: 6972297 - DNA, 22 bp, Homo sapiens
aactgaaacggtgatcttttaa

SEQ ID NO: 6972298 - DNA, 22 bp, Homo sapiens
tagctgttgggagagggctaga

SEQ ID NO: 6972299 - DNA, 20 bp, Homo sapiens
gtttttcttgggcgagctat

SEQ ID NO: 6972300 - DNA, 22 bp, Homo sapiens
tcacatgcagtcactgagcagg

SEQ ID NO: 6972301 - DNA, 22 bp, Homo sapiens
tgttttagctgacacatggagc

SEQ ID NO: 6972302 - DNA, 22 bp, Homo sapiens
attctagatacctaggggattt

SEQ ID NO: 6972303 - DNA, 17 bp, Homo sapiens
gctggcttctccttgct

SEQ ID NO: 6972304 - DNA, 22 bp, Homo sapiens
cacagaacatttttagatgcag

SEQ ID NO: 6972305 - DNA, 21 bp, Homo sapiens
gatgagttttctgtgatgttc

SEQ ID NO: 6972306 - DNA, 22 bp, Homo sapiens
ctttggaggtcatagccaagag

SEQ ID NO: 6972307 - DNA, 22 bp, Homo sapiens
tctggagccacaaacctcagct

SEQ ID NO: 6972308 - DNA, 18 bp, Homo sapiens
agaggatgcatctaagag

SEQ ID NO: 6972309 - DNA, 22 bp, Homo sapiens
gatctgttttttcttagacagt

SEQ ID NO: 6972310 - DNA, 22 bp, Homo sapiens
ctgcaaaagtaattggggcttt

SEQ ID NO: 6972311 - DNA, 22 bp, Homo sapiens
agactgggtttgagacttagca

SEQ ID NO: 6972312 - DNA, 22 bp, Homo sapiens
ggcttcaaaacctatctttgat

SEQ ID NO: 6972313 - DNA, 22 bp, Homo sapiens
agtttcctcatctgtaaaatga

SEQ ID NO: 6972314 - DNA, 22 bp, Homo sapiens
ttaatacatttcagactgttat

SEQ ID NO: 6972315 - DNA, 22 bp, Homo sapiens
agcttcatggaacctgaggcta

SEQ ID NO: 6972316 - DNA, 22 bp, Homo sapiens
tgtaacaacatttgatttttag

SEQ ID NO: 6972317 - DNA, 22 bp, Homo sapiens
ttagcaaatttccaggtgatgc

SEQ ID NO: 6972318 - DNA, 22 bp, Homo sapiens
ttctctaaacatattggatctg

SEQ ID NO: 6972319 - DNA, 22 bp, Homo sapiens
tggcaccagcacctagatgggg

SEQ ID NO: 6972320 - DNA, 22 bp, Homo sapiens
gggaacagggcctgagctgggg

SEQ ID NO: 6972321 - DNA, 22 bp, Homo sapiens
tcttcttatgtgccattatctc

SEQ ID NO: 6972322 - DNA, 22 bp, Homo sapiens
tggccagcccttcagccatgcc

SEQ ID NO: 6972323 - DNA, 22 bp, Homo sapiens
gagtagacaaggtacatgttct

SEQ ID NO: 6972324 - DNA, 22 bp, Homo sapiens
ttttcagaaagatgagaaatta

SEQ ID NO: 6972325 - DNA, 16 bp, Homo sapiens
agcagggcgggaagga

SEQ ID NO: 6972326 - DNA, 22 bp, Homo sapiens
tgcagctctgcatggctggttc

SEQ ID NO: 6972327 - DNA, 22 bp, Homo sapiens
tgagagagcctgaatctcttac

SEQ ID NO: 6972328 - DNA, 22 bp, Homo sapiens
ttacatgtggtgtgaagaagag

SEQ ID NO: 6972329 - DNA, 22 bp, Homo sapiens
tgctacattatatggcaaagga

SEQ ID NO: 6972330 - DNA, 22 bp, Homo sapiens
actggagcttctaaggaggagt

SEQ ID NO: 6972331 - DNA, 21 bp, Homo sapiens
tgattgatatttgcaaacaga

SEQ ID NO: 6972332 - DNA, 22 bp, Homo sapiens
cagagcagcagagcttccatgg

SEQ ID NO: 6972333 - DNA, 22 bp, Homo sapiens
cagtgcaggcttgtggccgcag

SEQ ID NO: 6972334 - DNA, 22 bp, Homo sapiens
cattgcactgcagcccgggcaa

SEQ ID NO: 6972335 - DNA, 22 bp, Homo sapiens
aagcaattcacagttcacttaa

SEQ ID NO: 6972336 - DNA, 22 bp, Homo sapiens
aaatgccaaggagagactgtta

SEQ ID NO: 6972337 - DNA, 22 bp, Homo sapiens
aggacctggatcacagagatct

SEQ ID NO: 6972338 - DNA, 22 bp, Homo sapiens
ttggctgagagctgctctgcag

SEQ ID NO: 6972339 - DNA, 22 bp, Homo sapiens
acagcttgggatgctttatttc

SEQ ID NO: 6972340 - DNA, 22 bp, Homo sapiens
ttccgtaagagaaatgattcct

SEQ ID NO: 6972341 - DNA, 22 bp, Homo sapiens
actctgctctttggacaatgcc

SEQ ID NO: 6972342 - DNA, 22 bp, Homo sapiens
ttagccattttattcagcaggt

SEQ ID NO: 6972343 - DNA, 22 bp, Homo sapiens
attggcttagttggcaattgtt

SEQ ID NO: 6972344 - DNA, 22 bp, Homo sapiens
tggcaggggaggtgcttgctta

SEQ ID NO: 6972345 - DNA, 22 bp, Homo sapiens
tgtggagccaggaggtggggac

SEQ ID NO: 6972346 - DNA, 22 bp, Homo sapiens
ataacctggatataaacagatg

SEQ ID NO: 6972347 - DNA, 22 bp, Homo sapiens
cacaataaatgtttgctgatga

SEQ ID NO: 6972348 - DNA, 22 bp, Homo sapiens
cttggtacctgccctgggcctt

SEQ ID NO: 6972349 - DNA, 22 bp, Homo sapiens
caaggttttggaagattttcgt

SEQ ID NO: 6972350 - DNA, 22 bp, Homo sapiens
agtgccaagagtgagccatgag

SEQ ID NO: 6972351 - DNA, 22 bp, Homo sapiens
ccaggtgaaatcttcatggttc

SEQ ID NO: 6972352 - DNA, 22 bp, Homo sapiens
actggtttcctagaataagact

SEQ ID NO: 6972353 - DNA, 22 bp, Homo sapiens
tagcagctacctggctaagagt

SEQ ID NO: 6972354 - DNA, 22 bp, Homo sapiens
tagagctgagttgactccattt

SEQ ID NO: 6972355 - DNA, 22 bp, Homo sapiens
caggccctgcactaggccctgg

SEQ ID NO: 6972356 - DNA, 22 bp, Homo sapiens
cagccagatcagggcaggggtt

SEQ ID NO: 6972357 - DNA, 22 bp, Homo sapiens
tgccttcatccatgttatagtg

SEQ ID NO: 6972358 - DNA, 22 bp, Homo sapiens
cgaggccacacctgcttctggg

SEQ ID NO: 6972359 - DNA, 22 bp, Homo sapiens
aggttcctcttcatgttcaaca

SEQ ID NO: 6972360 - DNA, 22 bp, Homo sapiens
ggctccactgctgaccactcca

SEQ ID NO: 6972361 - DNA, 22 bp, Homo sapiens
agaacagaagggaggaaggcct

SEQ ID NO: 6972362 - DNA, 22 bp, Homo sapiens
gcagttcctacagtggaaagcg

SEQ ID NO: 6972363 - DNA, 22 bp, Homo sapiens
cttggggctgtcactctggcat

SEQ ID NO: 6972364 - DNA, 22 bp, Homo sapiens
atacatctcatgtaagagataa

SEQ ID NO: 6972365 - DNA, 22 bp, Homo sapiens
catgaaatcacaagctgaggac

SEQ ID NO: 6972366 - DNA, 22 bp, Homo sapiens
tgcttactatggaggatgtgtc

SEQ ID NO: 6972367 - DNA, 22 bp, Homo sapiens
aggatcctccttagaaaagacc

SEQ ID NO: 6972368 - DNA, 22 bp, Homo sapiens
gcaaataatatactttgatctc

SEQ ID NO: 6972369 - DNA, 21 bp, Homo sapiens
agtgtaggtcattagctgttg

SEQ ID NO: 6972370 - DNA, 23 bp, Homo sapiens
tgaaggcctggaggacgcgttgt

SEQ ID NO: 6972371 - DNA, 22 bp, Homo sapiens
tgccacactcacttctgtggac

SEQ ID NO: 6972372 - DNA, 22 bp, Homo sapiens
tgtcactcaagttccaatttac

SEQ ID NO: 6972373 - DNA, 22 bp, Homo sapiens
tgtctgtgtgagcaaatgactt

SEQ ID NO: 6972374 - DNA, 21 bp, Homo sapiens
agtatgtgttagggataattt

SEQ ID NO: 6972375 - DNA, 22 bp, Homo sapiens
cagtggccatggtggcaggggt

SEQ ID NO: 6972376 - DNA, 22 bp, Homo sapiens
atgttcttcctctgcacagcta

SEQ ID NO: 6972377 - DNA, 22 bp, Homo sapiens
ggtgcaaagggcctagagagtg

SEQ ID NO: 6972378 - DNA, 22 bp, Homo sapiens
aggcccttcttggtggctcagg

SEQ ID NO: 6972379 - DNA, 22 bp, Homo sapiens
agggacacatgtgattatttat

SEQ ID NO: 6972380 - DNA, 22 bp, Homo sapiens
gtttctacatgcctctttcacc

SEQ ID NO: 6972381 - DNA, 22 bp, Homo sapiens
cagaaagcttggtacaatatgc

SEQ ID NO: 6972382 - DNA, 21 bp, Homo sapiens
ctttggtttctgacttgcata

SEQ ID NO: 6972383 - DNA, 22 bp, Homo sapiens
gaagcacagggctcgatctcag

SEQ ID NO: 6972384 - DNA, 22 bp, Homo sapiens
tattgtgcccctcccaggaaca

SEQ ID NO: 6972385 - DNA, 21 bp, Homo sapiens
tagcaaattggtggaatggga

SEQ ID NO: 6972386 - DNA, 23 bp, Homo sapiens
agagccaagcttctttctcacat

SEQ ID NO: 6972387 - DNA, 22 bp, Homo sapiens
ttctgcattcaaattatgtgag

SEQ ID NO: 6972388 - DNA, 17 bp, Homo sapiens
aagtcccagctaacaca

SEQ ID NO: 6972389 - DNA, 22 bp, Homo sapiens
aagattctgaaaggggtggggc

SEQ ID NO: 6972390 - DNA, 18 bp, Homo sapiens
ctctgaccgccacttgct

SEQ ID NO: 6972391 - DNA, 22 bp, Homo sapiens
ttcctgggaggctgtgtacttg

SEQ ID NO: 6972392 - DNA, 22 bp, Homo sapiens
tagtgaattcctaataggaaga

SEQ ID NO: 6972393 - DNA, 22 bp, Homo sapiens
ctgaggtcagagtttagtctgg

SEQ ID NO: 6972394 - DNA, 18 bp, Homo sapiens
acatcagttaccaggcca

SEQ ID NO: 6972395 - DNA, 22 bp, Homo sapiens
tctagtgttaaggcaaagtaaa

SEQ ID NO: 6972396 - DNA, 19 bp, Homo sapiens
tttagaagttgaaactctg

SEQ ID NO: 6972397 - DNA, 22 bp, Homo sapiens
gagaaggactacacatctggcc

SEQ ID NO: 6972398 - DNA, 22 bp, Homo sapiens
tatgaacatgctgtggttataa

SEQ ID NO: 6972399 - DNA, 22 bp, Homo sapiens
gagccctgtgaggaaagagggt

SEQ ID NO: 6972400 - DNA, 22 bp, Homo sapiens
cttttgtctaccctgattccag

SEQ ID NO: 6972401 - DNA, 22 bp, Homo sapiens
catttgtagctatttactgtat

SEQ ID NO: 6972402 - DNA, 22 bp, Homo sapiens
atgtaaagttcagtacagtttt

SEQ ID NO: 6972403 - DNA, 22 bp, Homo sapiens
ccatgctaggaactctcaggga

SEQ ID NO: 6972404 - DNA, 22 bp, Homo sapiens
tatttcacagcagctcatttaa

SEQ ID NO: 6972405 - DNA, 22 bp, Homo sapiens
tgattgaactgagcttcaagat

SEQ ID NO: 6972406 - DNA, 22 bp, Homo sapiens
tctgtctggtccaggaagatgt

SEQ ID NO: 6972407 - DNA, 22 bp, Homo sapiens
tggcaatattaacagtacttat

SEQ ID NO: 6972408 - DNA, 22 bp, Homo sapiens
ctgatgtcccaagcattcgcag

SEQ ID NO: 6972409 - DNA, 22 bp, Homo sapiens
ctgccccagcctggggccttct

SEQ ID NO: 6972410 - DNA, 18 bp, Homo sapiens
tcattttgtctgcctttg

SEQ ID NO: 6972411 - DNA, 22 bp, Homo sapiens
aaggtccatgactcggcatagt

SEQ ID NO: 6972412 - DNA, 22 bp, Homo sapiens
cctggtgcttaccagagctttt

SEQ ID NO: 6972413 - DNA, 22 bp, Homo sapiens
ccacgacgagtcatcagggcga

SEQ ID NO: 6972414 - DNA, 22 bp, Homo sapiens
gccctgaccttcactgactctc

SEQ ID NO: 6972415 - DNA, 22 bp, Homo sapiens
catggctttgttcatataattt

SEQ ID NO: 6972416 - DNA, 22 bp, Homo sapiens
ctttctagagtatggagtctgt

SEQ ID NO: 6972417 - DNA, 23 bp, Homo sapiens
acaatgcactttaaatggttccc

SEQ ID NO: 6972418 - DNA, 22 bp, Homo sapiens
gtggaaatagtttggttataga

SEQ ID NO: 6972419 - DNA, 22 bp, Homo sapiens
tattctagaagtccaccagtct

SEQ ID NO: 6972420 - DNA, 22 bp, Homo sapiens
tcagcagaagtatagaggccat

SEQ ID NO: 6972421 - DNA, 22 bp, Homo sapiens
tgggaaggataccttggaacat

SEQ ID NO: 6972422 - DNA, 22 bp, Homo sapiens
catcagaaaccttgaggaaact

SEQ ID NO: 6972423 - DNA, 22 bp, Homo sapiens
tcagttcttattttcatgaata

SEQ ID NO: 6972424 - DNA, 22 bp, Homo sapiens
tagaacatgacttatttttgga

SEQ ID NO: 6972425 - DNA, 22 bp, Homo sapiens
tagcaaagttttgtggtgatta

SEQ ID NO: 6972426 - DNA, 21 bp, Homo sapiens
aggcttggataggttatgtga

SEQ ID NO: 6972427 - DNA, 22 bp, Homo sapiens
ggctacagggtacaccacatct

SEQ ID NO: 6972428 - DNA, 22 bp, Homo sapiens
atgtaattgtagcaaaatgatg

SEQ ID NO: 6972429 - DNA, 20 bp, Homo sapiens
tgtggccagctctctactgg

SEQ ID NO: 6972430 - DNA, 22 bp, Homo sapiens
ctagccataccaggattaacaa

SEQ ID NO: 6972431 - DNA, 22 bp, Homo sapiens
ttgagaaacatctaatctttgt

SEQ ID NO: 6972432 - DNA, 22 bp, Homo sapiens
ctgggcatgaaaaggatgccag

SEQ ID NO: 6972433 - DNA, 22 bp, Homo sapiens
ggtgctcaaggtgacaggacat

SEQ ID NO: 6972434 - DNA, 22 bp, Homo sapiens
tttcttttgaatagtgtgtggt

SEQ ID NO: 6972435 - DNA, 22 bp, Homo sapiens
aggactgattgggatgccatgt

SEQ ID NO: 6972436 - DNA, 22 bp, Homo sapiens
gcattcctttataggaaaatgg

SEQ ID NO: 6972437 - DNA, 22 bp, Homo sapiens
tgggccaggggcctcttctgat

SEQ ID NO: 6972438 - DNA, 19 bp, Homo sapiens
atcagctgaagccttcaga

SEQ ID NO: 6972439 - DNA, 22 bp, Homo sapiens
tggaggccacatgaacgctgcg

SEQ ID NO: 6972440 - DNA, 22 bp, Homo sapiens
tataccaaaatatcagaaaggg

SEQ ID NO: 6972441 - DNA, 22 bp, Homo sapiens
aatgttatgtggttcaacttaa

SEQ ID NO: 6972442 - DNA, 22 bp, Homo sapiens
ctctccattccctacagttttc

SEQ ID NO: 6972443 - DNA, 22 bp, Homo sapiens
gtgctctaggggtcagtggtta

SEQ ID NO: 6972444 - DNA, 22 bp, Homo sapiens
ggctcagctggatggttctact

SEQ ID NO: 6972445 - DNA, 22 bp, Homo sapiens
acagtttgaataatttagatag

SEQ ID NO: 6972446 - DNA, 17 bp, Homo sapiens
accactttgccaagttg

SEQ ID NO: 6972447 - DNA, 22 bp, Homo sapiens
aaacctgatagattttcagaat

SEQ ID NO: 6972448 - DNA, 21 bp, Homo sapiens
agggcctgtgctctccaggtc

SEQ ID NO: 6972449 - DNA, 22 bp, Homo sapiens
acaagtattggtgaggatgtag

SEQ ID NO: 6972450 - DNA, 22 bp, Homo sapiens
tacagtgagtggcagagccaga

SEQ ID NO: 6972451 - DNA, 22 bp, Homo sapiens
aagggcaggaaaagatggatgt

SEQ ID NO: 6972452 - DNA, 22 bp, Homo sapiens
aaaggttgtgttctggggtgag

SEQ ID NO: 6972453 - DNA, 21 bp, Homo sapiens
tcagcttgaatctagagatag

SEQ ID NO: 6972454 - DNA, 22 bp, Homo sapiens
tgctgagaatcacaggttataa

SEQ ID NO: 6972455 - DNA, 23 bp, Homo sapiens
ggtgccaagcttctatgtttagc

SEQ ID NO: 6972456 - DNA, 22 bp, Homo sapiens
attgtgcagatagtaattagga

SEQ ID NO: 6972457 - DNA, 22 bp, Homo sapiens
gaggtgtcagggtagtcatgat

SEQ ID NO: 6972458 - DNA, 21 bp, Homo sapiens
ctgcaaatgtaatgagtttgg

SEQ ID NO: 6972459 - DNA, 22 bp, Homo sapiens
ggaactggagaatgccctcttt

SEQ ID NO: 6972460 - DNA, 20 bp, Homo sapiens
acagtgtttttgagtagagc

SEQ ID NO: 6972461 - DNA, 22 bp, Homo sapiens
acccaataatgcaactccactt

SEQ ID NO: 6972462 - DNA, 22 bp, Homo sapiens
ctgggctgtcccagggcggcag

SEQ ID NO: 6972463 - DNA, 22 bp, Homo sapiens
tctgaattggctgcgtgtttaa

SEQ ID NO: 6972464 - DNA, 22 bp, Homo sapiens
tcctcctcctcacagtcacctg

SEQ ID NO: 6972465 - DNA, 22 bp, Homo sapiens
cagccagaacctaggatgagct

SEQ ID NO: 6972466 - DNA, 22 bp, Homo sapiens
tgcgggagggcaacgcggcatt

SEQ ID NO: 6972467 - DNA, 22 bp, Homo sapiens
acccatccagtgtccctgctag

SEQ ID NO: 6972468 - DNA, 22 bp, Homo sapiens
gagactgatggggctcccagaa

SEQ ID NO: 6972469 - DNA, 22 bp, Homo sapiens
caactgcttggaggaatactgc

SEQ ID NO: 6972470 - DNA, 22 bp, Homo sapiens
cagataaaattaatattaccaa

SEQ ID NO: 6972471 - DNA, 22 bp, Homo sapiens
gtcttgtcccagctctgccact

SEQ ID NO: 6972472 - DNA, 22 bp, Homo sapiens
aatgtagttcacaattggtact

SEQ ID NO: 6972473 - DNA, 22 bp, Homo sapiens
tacagcattaacaggctgttta

SEQ ID NO: 6972474 - DNA, 22 bp, Homo sapiens
agagtgggtgatctctgttgtc

SEQ ID NO: 6972475 - DNA, 22 bp, Homo sapiens
tcagttctgctagaaaaacagt

SEQ ID NO: 6972476 - DNA, 22 bp, Homo sapiens
actcttattttgaagtaataat

SEQ ID NO: 6972477 - DNA, 20 bp, Homo sapiens
taatgcttaacacatcccct

SEQ ID NO: 6972478 - DNA, 22 bp, Homo sapiens
aggcaggttggtgagaagactg

SEQ ID NO: 6972479 - DNA, 22 bp, Homo sapiens
acttatttcttggatgatcctg

SEQ ID NO: 6972480 - DNA, 22 bp, Homo sapiens
ttagggaaagcagcattccctt

SEQ ID NO: 6972481 - DNA, 21 bp, Homo sapiens
tctaagaacatgattctccct

SEQ ID NO: 6972482 - DNA, 22 bp, Homo sapiens
tattgacttgggcattgagaga

SEQ ID NO: 6972483 - DNA, 22 bp, Homo sapiens
tctctctatatgtcaacagggg

SEQ ID NO: 6972484 - DNA, 22 bp, Homo sapiens
ccattctgtataaatgctagaa

SEQ ID NO: 6972485 - DNA, 22 bp, Homo sapiens
agacagtgagaatgagttgaaa

SEQ ID NO: 6972486 - DNA, 22 bp, Homo sapiens
gcacctgaggaggcatctggag

SEQ ID NO: 6972487 - DNA, 16 bp, Homo sapiens
tttctagagacgaggc

SEQ ID NO: 6972488 - DNA, 22 bp, Homo sapiens
agcactagagccaaaatttggg

SEQ ID NO: 6972489 - DNA, 22 bp, Homo sapiens
ttgtattaggccctagggagtt

SEQ ID NO: 6972490 - DNA, 22 bp, Homo sapiens
agttcaacaccagcctgaccaa

SEQ ID NO: 6972491 - DNA, 16 bp, Homo sapiens
ttatccaatcagttga

SEQ ID NO: 6972492 - DNA, 22 bp, Homo sapiens
atggggtgaccatgagcattta

SEQ ID NO: 6972493 - DNA, 22 bp, Homo sapiens
actctgaaatagaggctggtgg

SEQ ID NO: 6972494 - DNA, 22 bp, Homo sapiens
agctcaagttcttttaccatat

SEQ ID NO: 6972495 - DNA, 22 bp, Homo sapiens
cagtggggtttctgtgggtgct

SEQ ID NO: 6972496 - DNA, 22 bp, Homo sapiens
gagaagcaatcagtggccaccc

SEQ ID NO: 6972497 - DNA, 22 bp, Homo sapiens
tctgaggtctatgactttgctt

SEQ ID NO: 6972498 - DNA, 22 bp, Homo sapiens
aatcacatttacattgctaatt

SEQ ID NO: 6972499 - DNA, 21 bp, Homo sapiens
tgggagagggctcagctaccc

SEQ ID NO: 6972500 - DNA, 22 bp, Homo sapiens
taacagccctccctccatcctg

SEQ ID NO: 6972501 - DNA, 22 bp, Homo sapiens
aagatgtatctttcctttaatt

SEQ ID NO: 6972502 - DNA, 22 bp, Homo sapiens
ttcaaagattagcatacgcaat

SEQ ID NO: 6972503 - DNA, 22 bp, Homo sapiens
attacaactggaatggtgctgg

SEQ ID NO: 6972504 - DNA, 22 bp, Homo sapiens
agattcattgtggatattttct

SEQ ID NO: 6972505 - DNA, 20 bp, Homo sapiens
tcacacggtgtttgcttgca

SEQ ID NO: 6972506 - DNA, 22 bp, Homo sapiens
tatgaaaatttagctgaagcat

SEQ ID NO: 6972507 - DNA, 22 bp, Homo sapiens
atacactactaagcacagattg

SEQ ID NO: 6972508 - DNA, 22 bp, Homo sapiens
tctgtcctccacactgtaagtt

SEQ ID NO: 6972509 - DNA, 22 bp, Homo sapiens
aggaaggagggcagatattaag

SEQ ID NO: 6972510 - DNA, 22 bp, Homo sapiens
ccgcgaggtggaggttgcagtg

SEQ ID NO: 6972511 - DNA, 22 bp, Homo sapiens
aaagtcacgctgatgggaaatg

SEQ ID NO: 6972512 - DNA, 22 bp, Homo sapiens
ataaggcagaaatagggaaagt

SEQ ID NO: 6972513 - DNA, 20 bp, Homo sapiens
gtgcatttcacctgtactgt

SEQ ID NO: 6972514 - DNA, 22 bp, Homo sapiens
tccaagagtaagaggactcttt

SEQ ID NO: 6972515 - DNA, 22 bp, Homo sapiens
tgagagtgccttgtaaacctgc

SEQ ID NO: 6972516 - DNA, 22 bp, Homo sapiens
tgctgtgagaccatttgttgag

SEQ ID NO: 6972517 - DNA, 22 bp, Homo sapiens
tgcctgaggtggtctgcaaatg

SEQ ID NO: 6972518 - DNA, 22 bp, Homo sapiens
aggcatatactctcagaaaaaa

SEQ ID NO: 6972519 - DNA, 22 bp, Homo sapiens
tttaggcagaacatggactttg

SEQ ID NO: 6972520 - DNA, 22 bp, Homo sapiens
aagatatagataaaactatgca

SEQ ID NO: 6972521 - DNA, 22 bp, Homo sapiens
agtacaactagaaataggtgta

SEQ ID NO: 6972522 - DNA, 22 bp, Homo sapiens
tctcttgagctcagttctgatg

SEQ ID NO: 6972523 - DNA, 22 bp, Homo sapiens
aagagaggacatggtgaacctg

SEQ ID NO: 6972524 - DNA, 22 bp, Homo sapiens
aagatgttagggtggaagggat

SEQ ID NO: 6972525 - DNA, 22 bp, Homo sapiens
taccttgaaaagaaggtgctca

SEQ ID NO: 6972526 - DNA, 21 bp, Homo sapiens
ctctgtttgcctgctgccatc

SEQ ID NO: 6972527 - DNA, 23 bp, Homo sapiens
ctgacctgacccataagcaagga

SEQ ID NO: 6972528 - DNA, 22 bp, Homo sapiens
gacccaggcaatgaacttactt

SEQ ID NO: 6972529 - DNA, 22 bp, Homo sapiens
gggccctgtgatttcttgagga

SEQ ID NO: 6972530 - DNA, 22 bp, Homo sapiens
tgaaaattcatctcatagcaga

SEQ ID NO: 6972531 - DNA, 22 bp, Homo sapiens
gcagcaggtgtgcttttaatga

SEQ ID NO: 6972532 - DNA, 22 bp, Homo sapiens
aatctcactcaaagaattctct

SEQ ID NO: 6972533 - DNA, 22 bp, Homo sapiens
caggaacaactcccagcatctc

SEQ ID NO: 6972534 - DNA, 22 bp, Homo sapiens
tccagctgttccatcagctctt

SEQ ID NO: 6972535 - DNA, 22 bp, Homo sapiens
ctttgctactgtgaatagtgcc

SEQ ID NO: 6972536 - DNA, 22 bp, Homo sapiens
gcagggacatctttgtctagta

SEQ ID NO: 6972537 - DNA, 22 bp, Homo sapiens
cctttacagtagcccttttgaa

SEQ ID NO: 6972538 - DNA, 22 bp, Homo sapiens
ttaagtccttggtaattttctt

SEQ ID NO: 6972539 - DNA, 21 bp, Homo sapiens
tccttccttgaggtcctttcc

SEQ ID NO: 6972540 - DNA, 22 bp, Homo sapiens
tgggggcagccaggctgtcaag

SEQ ID NO: 6972541 - DNA, 21 bp, Homo sapiens
tctgtcagaaaagctgaggct

SEQ ID NO: 6972542 - DNA, 22 bp, Homo sapiens
acagtgtgtgctttcccttacg

SEQ ID NO: 6972543 - DNA, 23 bp, Homo sapiens
tgattgaaagcctgagaaagctg

SEQ ID NO: 6972544 - DNA, 23 bp, Homo sapiens
tactggtcagtgcctctggggct

SEQ ID NO: 6972545 - DNA, 22 bp, Homo sapiens
gttagaaacacattcttattga

SEQ ID NO: 6972546 - DNA, 22 bp, Homo sapiens
taagacttgatccaaagaacta

SEQ ID NO: 6972547 - DNA, 22 bp, Homo sapiens
catctttagggaccattattct

SEQ ID NO: 6972548 - DNA, 22 bp, Homo sapiens
gttttgctgactcccacaggaa

SEQ ID NO: 6972549 - DNA, 20 bp, Homo sapiens
acatttgtggatctgagaga

SEQ ID NO: 6972550 - DNA, 19 bp, Homo sapiens
ggcccctctcacaggagtt

SEQ ID NO: 6972551 - DNA, 22 bp, Homo sapiens
agttcattttatttgtcagggt

SEQ ID NO: 6972552 - DNA, 22 bp, Homo sapiens
tcatggggtagaagcatgttta

SEQ ID NO: 6972553 - DNA, 21 bp, Homo sapiens
gtgaattaattatatgcctta

SEQ ID NO: 6972554 - DNA, 22 bp, Homo sapiens
tcctcaggtcaaagcaggagaa

SEQ ID NO: 6972555 - DNA, 22 bp, Homo sapiens
cctgcttcagggatgatggcac

SEQ ID NO: 6972556 - DNA, 22 bp, Homo sapiens
tagtctctggagactctagggg

SEQ ID NO: 6972557 - DNA, 22 bp, Homo sapiens
caagcaatattttagaaaggta

SEQ ID NO: 6972558 - DNA, 22 bp, Homo sapiens
gagctgtctggggactctgggt

SEQ ID NO: 6972559 - DNA, 22 bp, Homo sapiens
cccaggtgctgcgtgaagcctc

SEQ ID NO: 6972560 - DNA, 22 bp, Homo sapiens
tgcaccactgcattccagcctg

SEQ ID NO: 6972561 - DNA, 22 bp, Homo sapiens
cccaaaggaaggacaaggcaga

SEQ ID NO: 6972562 - DNA, 22 bp, Homo sapiens
cataatcccccatttgtgacat

SEQ ID NO: 6972563 - DNA, 22 bp, Homo sapiens
cctctgagctggcctgtggggc

SEQ ID NO: 6972564 - DNA, 22 bp, Homo sapiens
tcctcatacatatctcagtctt

SEQ ID NO: 6972565 - DNA, 23 bp, Homo sapiens
gctgcagctgtggatgttctcag

SEQ ID NO: 6972566 - DNA, 22 bp, Homo sapiens
tgaagatgtcagcaggggtggt

SEQ ID NO: 6972567 - DNA, 22 bp, Homo sapiens
atgggataacaagaaggctgag

SEQ ID NO: 6972568 - DNA, 22 bp, Homo sapiens
gctggggagctagacctcagca

SEQ ID NO: 6972569 - DNA, 22 bp, Homo sapiens
tgtggagaagaaggccactgca

SEQ ID NO: 6972570 - DNA, 18 bp, Homo sapiens
cagcatcttcattaggcc

SEQ ID NO: 6972571 - DNA, 22 bp, Homo sapiens
ttgaatagtgttttcagtatac

SEQ ID NO: 6972572 - DNA, 22 bp, Homo sapiens
atgaaggcaagactgaggtgtg

SEQ ID NO: 6972573 - DNA, 22 bp, Homo sapiens
atttggtgttgtttggagccta

SEQ ID NO: 6972574 - DNA, 22 bp, Homo sapiens
tcctgggaggtaaaccagcatc

SEQ ID NO: 6972575 - DNA, 22 bp, Homo sapiens
aggtatttcccaaagtggcatg

SEQ ID NO: 6972576 - DNA, 22 bp, Homo sapiens
ttcattgagtggtttattctaa

SEQ ID NO: 6972577 - DNA, 22 bp, Homo sapiens
ccaggagaataatggcagatta

SEQ ID NO: 6972578 - DNA, 22 bp, Homo sapiens
gctctcagggtgatggcatact

SEQ ID NO: 6972579 - DNA, 22 bp, Homo sapiens
aattagcttcagcttgtggggc

SEQ ID NO: 6972580 - DNA, 22 bp, Homo sapiens
gctagtgcagggaaatctttgg

SEQ ID NO: 6972581 - DNA, 22 bp, Homo sapiens
ccaggtggaggtgtgaggtcct

SEQ ID NO: 6972582 - DNA, 22 bp, Homo sapiens
cttcatttggagaactgtgctt

SEQ ID NO: 6972583 - DNA, 22 bp, Homo sapiens
tggagcctccagtctttctaga

SEQ ID NO: 6972584 - DNA, 22 bp, Homo sapiens
ctggacagaaaccagtcctggg

SEQ ID NO: 6972585 - DNA, 22 bp, Homo sapiens
ctgaggaccccacaggaggccc

SEQ ID NO: 6972586 - DNA, 22 bp, Homo sapiens
tccctcagagaccgtggtgcag

SEQ ID NO: 6972587 - DNA, 22 bp, Homo sapiens
ctcttagaaagaaacacactgg

SEQ ID NO: 6972588 - DNA, 22 bp, Homo sapiens
tcaaatgcacgtagagaaaata

SEQ ID NO: 6972589 - DNA, 22 bp, Homo sapiens
taacaactgctgaggtatttga

SEQ ID NO: 6972590 - DNA, 22 bp, Homo sapiens
caaatcatggaataactagaga

SEQ ID NO: 6972591 - DNA, 22 bp, Homo sapiens
atgaggtgggagaatcacttga

SEQ ID NO: 6972592 - DNA, 22 bp, Homo sapiens
atgctgaatagttcactcttct

SEQ ID NO: 6972593 - DNA, 22 bp, Homo sapiens
gggccaggagtggagatatggg

SEQ ID NO: 6972594 - DNA, 17 bp, Homo sapiens
gcctggcccagcctggc

SEQ ID NO: 6972595 - DNA, 22 bp, Homo sapiens
gtttgattcaagaacaaagagt

SEQ ID NO: 6972596 - DNA, 17 bp, Homo sapiens
cctcacagggaccagac

SEQ ID NO: 6972597 - DNA, 22 bp, Homo sapiens
tctcagaggtgccctggcatct

SEQ ID NO: 6972598 - DNA, 22 bp, Homo sapiens
ctaaggatgcatatgttttgtt

SEQ ID NO: 6972599 - DNA, 22 bp, Homo sapiens
gtttacagtggcttcattggat

SEQ ID NO: 6972600 - DNA, 22 bp, Homo sapiens
tagatcatggagtaaaatggaa

SEQ ID NO: 6972601 - DNA, 22 bp, Homo sapiens
ggagaagtttaagacctttgat

SEQ ID NO: 6972602 - DNA, 22 bp, Homo sapiens
tgtgttaaggcactgatatctg

SEQ ID NO: 6972603 - DNA, 22 bp, Homo sapiens
acagattagctggggccattga

SEQ ID NO: 6972604 - DNA, 22 bp, Homo sapiens
agctggtttgcaagtataatca

SEQ ID NO: 6972605 - DNA, 22 bp, Homo sapiens
tgaggtagtttgttgtacagta

SEQ ID NO: 6972606 - DNA, 22 bp, Homo sapiens
ctaccacacacacgtcttagga

SEQ ID NO: 6972607 - DNA, 22 bp, Homo sapiens
gtgcccccaaataccaggctac

SEQ ID NO: 6972608 - DNA, 22 bp, Homo sapiens
acaaattgttgcttcatgaatg

SEQ ID NO: 6972609 - DNA, 19 bp, Homo sapiens
cctgtgtcccacgtagatg

SEQ ID NO: 6972610 - DNA, 22 bp, Homo sapiens
acactgacacctgccctcaggt

SEQ ID NO: 6972611 - DNA, 22 bp, Homo sapiens
ttttatgcaagttatgattaaa

SEQ ID NO: 6972612 - DNA, 22 bp, Homo sapiens
agcacagaatggcttggaagcc

SEQ ID NO: 6972613 - DNA, 22 bp, Homo sapiens
gggccttcagccttggactgag

SEQ ID NO: 6972614 - DNA, 22 bp, Homo sapiens
ctctccagagcccttccggccc

SEQ ID NO: 6972615 - DNA, 22 bp, Homo sapiens
cagttgagtctgctagctagga

SEQ ID NO: 6972616 - DNA, 22 bp, Homo sapiens
attcctggtggcagaaacatga

SEQ ID NO: 6972617 - DNA, 22 bp, Homo sapiens
cattgttgaacacctgctggat

SEQ ID NO: 6972618 - DNA, 22 bp, Homo sapiens
cagggtgcctctgctcccacca

SEQ ID NO: 6972619 - DNA, 22 bp, Homo sapiens
ttaatcacagctctgccatgag

SEQ ID NO: 6972620 - DNA, 22 bp, Homo sapiens
gtaccaaatctgtattaggaaa

SEQ ID NO: 6972621 - DNA, 22 bp, Homo sapiens
ttttaattttgcaaatctggtg

SEQ ID NO: 6972622 - DNA, 23 bp, Homo sapiens
ttcagggcctcagaggtgaagct

SEQ ID NO: 6972623 - DNA, 22 bp, Homo sapiens
tgtgtccttatgaaaatactgt

SEQ ID NO: 6972624 - DNA, 22 bp, Homo sapiens
cctcagacacagtcaagctttt

SEQ ID NO: 6972625 - DNA, 22 bp, Homo sapiens
atgcacatgaggcaagcaaaat

SEQ ID NO: 6972626 - DNA, 22 bp, Homo sapiens
tagtgtcatttcagtggagttt

SEQ ID NO: 6972627 - DNA, 22 bp, Homo sapiens
tggagagctggttcaaagcaga

SEQ ID NO: 6972628 - DNA, 20 bp, Homo sapiens
ggctgtcccgcggctgccgg

SEQ ID NO: 6972629 - DNA, 22 bp, Homo sapiens
ggaggcattatggggaagactt

SEQ ID NO: 6972630 - DNA, 22 bp, Homo sapiens
ctttctgaggagacgggctttg

SEQ ID NO: 6972631 - DNA, 22 bp, Homo sapiens
aggaaatgtacaaatgaagatg

SEQ ID NO: 6972632 - DNA, 22 bp, Homo sapiens
ataatgttgatgattgtctttg

SEQ ID NO: 6972633 - DNA, 22 bp, Homo sapiens
gctgccgttggctcttcaggcc

SEQ ID NO: 6972634 - DNA, 22 bp, Homo sapiens
ttagctatggctattactagtt

SEQ ID NO: 6972635 - DNA, 22 bp, Homo sapiens
gccccagacataagtagggggt

SEQ ID NO: 6972636 - DNA, 22 bp, Homo sapiens
attcacagtttcctcatattct

SEQ ID NO: 6972637 - DNA, 22 bp, Homo sapiens
gtatttgcaaatctaaaagaga

SEQ ID NO: 6972638 - DNA, 22 bp, Homo sapiens
accatcctttagtttgcgtttc

SEQ ID NO: 6972639 - DNA, 22 bp, Homo sapiens
tgaggcagcccactttccttag

SEQ ID NO: 6972640 - DNA, 22 bp, Homo sapiens
ctgggcagagtccggaagatgg

SEQ ID NO: 6972641 - DNA, 22 bp, Homo sapiens
cttaggaaagtttctgcttatg

SEQ ID NO: 6972642 - DNA, 22 bp, Homo sapiens
tctcctgctcagaacagcctca

SEQ ID NO: 6972643 - DNA, 22 bp, Homo sapiens
ccatgtgatgtctcgtcagtcc

SEQ ID NO: 6972644 - DNA, 22 bp, Homo sapiens
tttgccctggtcccccgcaggc

SEQ ID NO: 6972645 - DNA, 22 bp, Homo sapiens
cagtggggggactgaggcctga

SEQ ID NO: 6972646 - DNA, 22 bp, Homo sapiens
tcacacttagagcgaattgttt

SEQ ID NO: 6972647 - DNA, 22 bp, Homo sapiens
atcagaatgattagtaaccaat

SEQ ID NO: 6972648 - DNA, 22 bp, Homo sapiens
aatccagcacatggacacagtc

SEQ ID NO: 6972649 - DNA, 22 bp, Homo sapiens
agattcattattaatgtgatct

SEQ ID NO: 6972650 - DNA, 19 bp, Homo sapiens
tttctgcagctcagagaag

SEQ ID NO: 6972651 - DNA, 22 bp, Homo sapiens
tttggaaattttcatccagaca

SEQ ID NO: 6972652 - DNA, 22 bp, Homo sapiens
aactgaggaataactgagttgc

SEQ ID NO: 6972653 - DNA, 22 bp, Homo sapiens
tggaggagaatttatggtcgaa

SEQ ID NO: 6972654 - DNA, 22 bp, Homo sapiens
acagtcagttgaatccaaggag

SEQ ID NO: 6972655 - DNA, 23 bp, Homo sapiens
atcaagataatccagatgaccta

SEQ ID NO: 6972656 - DNA, 22 bp, Homo sapiens
tgtgaagcgtgtgcaggggaca

SEQ ID NO: 6972657 - DNA, 22 bp, Homo sapiens
tgaaccagagtctccagtggtt

SEQ ID NO: 6972658 - DNA, 22 bp, Homo sapiens
ggcaagtgatcctggagcaccg

SEQ ID NO: 6972659 - DNA, 22 bp, Homo sapiens
tagcaagacaacttttctcagt

SEQ ID NO: 6972660 - DNA, 22 bp, Homo sapiens
attgtgactcctgatatagaaa

SEQ ID NO: 6972661 - DNA, 22 bp, Homo sapiens
accatggaccatagttcctatt

SEQ ID NO: 6972662 - DNA, 22 bp, Homo sapiens
tactactttcccccacatattt

SEQ ID NO: 6972663 - DNA, 22 bp, Homo sapiens
agcccatgcaaatactcggtga

SEQ ID NO: 6972664 - DNA, 22 bp, Homo sapiens
tcctggatggagctgccctcgc

SEQ ID NO: 6972665 - DNA, 22 bp, Homo sapiens
tacacatttctcttagagacac

SEQ ID NO: 6972666 - DNA, 22 bp, Homo sapiens
tgacatagctattaagtgatgc

SEQ ID NO: 6972667 - DNA, 22 bp, Homo sapiens
ctcacagagcctctgtgtcttc

SEQ ID NO: 6972668 - DNA, 22 bp, Homo sapiens
tcctgagctacagtagtatgat

SEQ ID NO: 6972669 - DNA, 22 bp, Homo sapiens
atggcagcagggcttgattatg

SEQ ID NO: 6972670 - DNA, 22 bp, Homo sapiens
tccttttttatgaagctttgag

SEQ ID NO: 6972671 - DNA, 22 bp, Homo sapiens
aaagtacaatattgagattgat

SEQ ID NO: 6972672 - DNA, 22 bp, Homo sapiens
cagcacagtttgcttggcagag

SEQ ID NO: 6972673 - DNA, 22 bp, Homo sapiens
tgtttccagaatgtagctgctt

SEQ ID NO: 6972674 - DNA, 22 bp, Homo sapiens
caggaatgccaaccagtgcatg

SEQ ID NO: 6972675 - DNA, 22 bp, Homo sapiens
gtttcttaaatgtagcaggacc

SEQ ID NO: 6972676 - DNA, 22 bp, Homo sapiens
ttgcagttttgacagaccaaat

SEQ ID NO: 6972677 - DNA, 22 bp, Homo sapiens
ttctatttttgtggaactgtag

SEQ ID NO: 6972678 - DNA, 22 bp, Homo sapiens
ctgacctgcggggaggagggcc

SEQ ID NO: 6972679 - DNA, 22 bp, Homo sapiens
actctggccccaggatctgtgt

SEQ ID NO: 6972680 - DNA, 22 bp, Homo sapiens
taggaactagactcatgactca

SEQ ID NO: 6972681 - DNA, 20 bp, Homo sapiens
gccacagttttctcactgca

SEQ ID NO: 6972682 - DNA, 22 bp, Homo sapiens
gcaggactttgtggatgatgga

SEQ ID NO: 6972683 - DNA, 22 bp, Homo sapiens
agatctttagaagatagaatca

SEQ ID NO: 6972684 - DNA, 20 bp, Homo sapiens
acacacagagacatgcgcat

SEQ ID NO: 6972685 - DNA, 20 bp, Homo sapiens
tctggccccttcctgtcctg

SEQ ID NO: 6972686 - DNA, 22 bp, Homo sapiens
tgctggggagtgattgaccatc

SEQ ID NO: 6972687 - DNA, 22 bp, Homo sapiens
gggctgagagtgactgttctgt

SEQ ID NO: 6972688 - DNA, 22 bp, Homo sapiens
tgatacataaaccatcattttg

SEQ ID NO: 6972689 - DNA, 22 bp, Homo sapiens
ctaaagaagctagcaatctata

SEQ ID NO: 6972690 - DNA, 22 bp, Homo sapiens
attctgtcattacaaaaggcag

SEQ ID NO: 6972691 - DNA, 22 bp, Homo sapiens
gttttataggctgttgctatat

SEQ ID NO: 6972692 - DNA, 22 bp, Homo sapiens
gtatttaattccattaagttag

SEQ ID NO: 6972693 - DNA, 22 bp, Homo sapiens
ggaagagagggctgggcctcaa

SEQ ID NO: 6972694 - DNA, 22 bp, Homo sapiens
ctctggtttatttcttggaaag

SEQ ID NO: 6972695 - DNA, 22 bp, Homo sapiens
tctctaacagtggctgctgcct

SEQ ID NO: 6972696 - DNA, 22 bp, Homo sapiens
tgctactcctttgctcgaaatc

SEQ ID NO: 6972697 - DNA, 22 bp, Homo sapiens
tctgggaatacacactgattta

SEQ ID NO: 6972698 - DNA, 22 bp, Homo sapiens
ggagctggggttggcatcttcc

SEQ ID NO: 6972699 - DNA, 21 bp, Homo sapiens
tcctgtgaggacctgtcagtg

SEQ ID NO: 6972700 - DNA, 22 bp, Homo sapiens
cccaggaagaggggtcaggtgt

SEQ ID NO: 6972701 - DNA, 22 bp, Homo sapiens
gcttaaacccaggaagttgtgg

SEQ ID NO: 6972702 - DNA, 22 bp, Homo sapiens
ctaaagcattctcagattttgc

SEQ ID NO: 6972703 - DNA, 22 bp, Homo sapiens
aacaggagtcattgtcattatt

SEQ ID NO: 6972704 - DNA, 22 bp, Homo sapiens
tatgaatggctcatggtgagtg

SEQ ID NO: 6972705 - DNA, 22 bp, Homo sapiens
taactggttaagggtgaaatcc

SEQ ID NO: 6972706 - DNA, 22 bp, Homo sapiens
ggctccagggtacccctggatg

SEQ ID NO: 6972707 - DNA, 22 bp, Homo sapiens
ctcactgaaccttggcacctca

SEQ ID NO: 6972708 - DNA, 22 bp, Homo sapiens
ataggccatttgagggccaggt

SEQ ID NO: 6972709 - DNA, 22 bp, Homo sapiens
aactcatcccagtttgaccgga

SEQ ID NO: 6972710 - DNA, 22 bp, Homo sapiens
ccaaaggggcttaggatgaagg

SEQ ID NO: 6972711 - DNA, 22 bp, Homo sapiens
tatgcaaactaagttgtttcct

SEQ ID NO: 6972712 - DNA, 22 bp, Homo sapiens
tttagctaagacatagattctt

SEQ ID NO: 6972713 - DNA, 22 bp, Homo sapiens
aaacaagtgtaaactagtctgt

SEQ ID NO: 6972714 - DNA, 22 bp, Homo sapiens
tgttgggaagctctgccagggg

SEQ ID NO: 6972715 - DNA, 22 bp, Homo sapiens
tctctcttctttgttaagaatg

SEQ ID NO: 6972716 - DNA, 22 bp, Homo sapiens
tcctccctaactcatgatgagt

SEQ ID NO: 6972717 - DNA, 22 bp, Homo sapiens
aaccagctaacatgtggaatga

SEQ ID NO: 6972718 - DNA, 18 bp, Homo sapiens
aataatgctgctgtgaac

SEQ ID NO: 6972719 - DNA, 22 bp, Homo sapiens
gttattgaggtggagtctcact

SEQ ID NO: 6972720 - DNA, 22 bp, Homo sapiens
tgattacacagcagtaatttca

SEQ ID NO: 6972721 - DNA, 22 bp, Homo sapiens
ttagttgctcactacaaggtta

SEQ ID NO: 6972722 - DNA, 22 bp, Homo sapiens
tgttcttctagattgcctttta

SEQ ID NO: 6972723 - DNA, 22 bp, Homo sapiens
cgcccaggctggagtgcagtgg

SEQ ID NO: 6972724 - DNA, 22 bp, Homo sapiens
acagattgaagtccagaatggc

SEQ ID NO: 6972725 - DNA, 22 bp, Homo sapiens
cttccaaacccagggtatgggc

SEQ ID NO: 6972726 - DNA, 18 bp, Homo sapiens
ccctttgccctatgagta

SEQ ID NO: 6972727 - DNA, 22 bp, Homo sapiens
gttgaaatcctaaccccctagt

SEQ ID NO: 6972728 - DNA, 22 bp, Homo sapiens
ccctggctcttcaccacctgcc

SEQ ID NO: 6972729 - DNA, 22 bp, Homo sapiens
ctggtgagactcagggatgctt

SEQ ID NO: 6972730 - DNA, 22 bp, Homo sapiens
cttggagacattgatcttttgc

SEQ ID NO: 6972731 - DNA, 22 bp, Homo sapiens
tcactttcctcatcacgactag

SEQ ID NO: 6972732 - DNA, 22 bp, Homo sapiens
tatgcacacatcgcagcaggaa

SEQ ID NO: 6972733 - DNA, 22 bp, Homo sapiens
gctgccctgtttagccagggtt

SEQ ID NO: 6972734 - DNA, 22 bp, Homo sapiens
caggcctcgaggagacagctac

SEQ ID NO: 6972735 - DNA, 22 bp, Homo sapiens
atcttagacccttggtagaaaa

SEQ ID NO: 6972736 - DNA, 22 bp, Homo sapiens
tggtcattgttaaggtcacaca

SEQ ID NO: 6972737 - DNA, 22 bp, Homo sapiens
aaatggaaaatgctgttttggt

SEQ ID NO: 6972738 - DNA, 22 bp, Homo sapiens
cagaggccttgtcttctttgct

SEQ ID NO: 6972739 - DNA, 22 bp, Homo sapiens
gcttcctccctgctgctcacta

SEQ ID NO: 6972740 - DNA, 22 bp, Homo sapiens
ccagaggagggctctgatgagg

SEQ ID NO: 6972741 - DNA, 22 bp, Homo sapiens
tgtcctccaggacctgcagggc

SEQ ID NO: 6972742 - DNA, 22 bp, Homo sapiens
aggggcctcctcattggagtgt

SEQ ID NO: 6972743 - DNA, 18 bp, Homo sapiens
tagctcttgttggtccat

SEQ ID NO: 6972744 - DNA, 22 bp, Homo sapiens
gtctggaggaaaaggttaaatg

SEQ ID NO: 6972745 - DNA, 21 bp, Homo sapiens
gaacaggaaaagctggcttca

SEQ ID NO: 6972746 - DNA, 22 bp, Homo sapiens
agggagctcgatgcctgagtgt

SEQ ID NO: 6972747 - DNA, 22 bp, Homo sapiens
tctctgggaaatggagaatttt

SEQ ID NO: 6972748 - DNA, 22 bp, Homo sapiens
gaggttcacaggctatcacagt

SEQ ID NO: 6972749 - DNA, 22 bp, Homo sapiens
tttctagtaaaagctaattacc

SEQ ID NO: 6972750 - DNA, 22 bp, Homo sapiens
gcctgcctgttggctgaggtgc

SEQ ID NO: 6972751 - DNA, 22 bp, Homo sapiens
tccagagtctcctgttgttgtt

SEQ ID NO: 6972752 - DNA, 22 bp, Homo sapiens
ttgcatctaccatatcaaagat

SEQ ID NO: 6972753 - DNA, 19 bp, Homo sapiens
cgtacctgacacagaacag

SEQ ID NO: 6972754 - DNA, 22 bp, Homo sapiens
taatgtaggggtgtaacacaca

SEQ ID NO: 6972755 - DNA, 22 bp, Homo sapiens
atccatcgttccaaaagaagtg

SEQ ID NO: 6972756 - DNA, 22 bp, Homo sapiens
ttagaacatctctcttctgcca

SEQ ID NO: 6972757 - DNA, 22 bp, Homo sapiens
tctttgcagtggtgaataaaga

SEQ ID NO: 6972758 - DNA, 22 bp, Homo sapiens
tggctgcgttttccgatgtatt

SEQ ID NO: 6972759 - DNA, 22 bp, Homo sapiens
ttcttcaaagatgtctgttgga

SEQ ID NO: 6972760 - DNA, 22 bp, Homo sapiens
ccaccctgggttctgatgtgga

SEQ ID NO: 6972761 - DNA, 22 bp, Homo sapiens
ggcctagggagtggccatgcct

SEQ ID NO: 6972762 - DNA, 22 bp, Homo sapiens
aaccaggaagggcgcaaattat

SEQ ID NO: 6972763 - DNA, 22 bp, Homo sapiens
agacttcactcccagagattct

SEQ ID NO: 6972764 - DNA, 22 bp, Homo sapiens
tttaggaagtttcagataggaa

SEQ ID NO: 6972765 - DNA, 22 bp, Homo sapiens
tgtaggctgaagatgaagtgga

SEQ ID NO: 6972766 - DNA, 22 bp, Homo sapiens
tttctgaagatacagctttgct

SEQ ID NO: 6972767 - DNA, 22 bp, Homo sapiens
ggctctgcgcctgcggggactt

SEQ ID NO: 6972768 - DNA, 22 bp, Homo sapiens
tcagagtttgtactgacaggag

SEQ ID NO: 6972769 - DNA, 22 bp, Homo sapiens
tgagatggagccactgcactct

SEQ ID NO: 6972770 - DNA, 22 bp, Homo sapiens
tctccctgtggaggacccctta

SEQ ID NO: 6972771 - DNA, 22 bp, Homo sapiens
atacaaagtattaatcctggat

SEQ ID NO: 6972772 - DNA, 22 bp, Homo sapiens
aattatggtcactgttcctggg

SEQ ID NO: 6972773 - DNA, 22 bp, Homo sapiens
tgaggtaggataagacaatgag

SEQ ID NO: 6972774 - DNA, 23 bp, Homo sapiens
ggctttgctctgggttctagggt

SEQ ID NO: 6972775 - DNA, 22 bp, Homo sapiens
aggctgaggcaggtggatcact

SEQ ID NO: 6972776 - DNA, 22 bp, Homo sapiens
acagtgtgcaagaaatggggga

SEQ ID NO: 6972777 - DNA, 20 bp, Homo sapiens
tggcagagttgtcccaccca

SEQ ID NO: 6972778 - DNA, 18 bp, Homo sapiens
ggaaggagtggaccccag

SEQ ID NO: 6972779 - DNA, 22 bp, Homo sapiens
ctaaagataaggaaagtatcct

SEQ ID NO: 6972780 - DNA, 22 bp, Homo sapiens
gcttctgcgcctagcctcaggt

SEQ ID NO: 6972781 - DNA, 22 bp, Homo sapiens
tcatttctattgctactgtctg

SEQ ID NO: 6972782 - DNA, 19 bp, Homo sapiens
tctgggtatttggaagatg

SEQ ID NO: 6972783 - DNA, 22 bp, Homo sapiens
gctctccagctacccctttagc

SEQ ID NO: 6972784 - DNA, 21 bp, Homo sapiens
aggtcctctatccaagttaag

SEQ ID NO: 6972785 - DNA, 22 bp, Homo sapiens
gatgctgactttccgctgccac

SEQ ID NO: 6972786 - DNA, 22 bp, Homo sapiens
ctgaagcttagtttacgctcca

SEQ ID NO: 6972787 - DNA, 22 bp, Homo sapiens
tggacacttaaaaacagataaa

SEQ ID NO: 6972788 - DNA, 22 bp, Homo sapiens
ctggccacaactagcccaggac

SEQ ID NO: 6972789 - DNA, 22 bp, Homo sapiens
ctgtacaggtgaggagggggct

SEQ ID NO: 6972790 - DNA, 22 bp, Homo sapiens
cagcctttatctcctgggctca

SEQ ID NO: 6972791 - DNA, 22 bp, Homo sapiens
ctaaatgtcagagtagcttgca

SEQ ID NO: 6972792 - DNA, 22 bp, Homo sapiens
tagttattattgttactatcag

SEQ ID NO: 6972793 - DNA, 22 bp, Homo sapiens
tgagggatccagaggcagtggt

SEQ ID NO: 6972794 - DNA, 22 bp, Homo sapiens
aaaggcatctagccaagttgag

SEQ ID NO: 6972795 - DNA, 22 bp, Homo sapiens
tggaagcagcattaatgagtta

SEQ ID NO: 6972796 - DNA, 22 bp, Homo sapiens
acagtaaaacatttttattagg

SEQ ID NO: 6972797 - DNA, 22 bp, Homo sapiens
gttaccatgagtgggtgggtga

SEQ ID NO: 6972798 - DNA, 22 bp, Homo sapiens
tttcaagtgactatggtttttg

SEQ ID NO: 6972799 - DNA, 22 bp, Homo sapiens
tggcaaggaaattagttctcct

SEQ ID NO: 6972800 - DNA, 22 bp, Homo sapiens
tgcagcaggtatggcaagctcc

SEQ ID NO: 6972801 - DNA, 22 bp, Homo sapiens
cagaagctgcagtgatctggga

SEQ ID NO: 6972802 - DNA, 22 bp, Homo sapiens
agctgcaagatttcttttgtat

SEQ ID NO: 6972803 - DNA, 22 bp, Homo sapiens
atagatgtacgtatgtaaatca

SEQ ID NO: 6972804 - DNA, 21 bp, Homo sapiens
ctgtcctcagatgtggacgag

SEQ ID NO: 6972805 - DNA, 22 bp, Homo sapiens
gaaggccaagaggctccaagat

SEQ ID NO: 6972806 - DNA, 22 bp, Homo sapiens
tgagctgggctgggctgagctg

SEQ ID NO: 6972807 - DNA, 22 bp, Homo sapiens
ggaagtaacattctgtctttcc

SEQ ID NO: 6972808 - DNA, 22 bp, Homo sapiens
aacactgggataggtgatagac

SEQ ID NO: 6972809 - DNA, 22 bp, Homo sapiens
ataagcttttgattcacttcag

SEQ ID NO: 6972810 - DNA, 20 bp, Homo sapiens
gggcagcctcgggagtgggt

SEQ ID NO: 6972811 - DNA, 22 bp, Homo sapiens
tcagcactgaaattcttcacat

SEQ ID NO: 6972812 - DNA, 22 bp, Homo sapiens
tagccccagctactcggaagct

SEQ ID NO: 6972813 - DNA, 22 bp, Homo sapiens
cttgttatctgaaccaaaatta

SEQ ID NO: 6972814 - DNA, 22 bp, Homo sapiens
ttggctgcctgtggatcgcatt

SEQ ID NO: 6972815 - DNA, 22 bp, Homo sapiens
tctgatttctcttgtggatgct

SEQ ID NO: 6972816 - DNA, 22 bp, Homo sapiens
tcagagactggtctgcagatgc

SEQ ID NO: 6972817 - DNA, 22 bp, Homo sapiens
tgagtgatctcagatgccgcat

SEQ ID NO: 6972818 - DNA, 22 bp, Homo sapiens
agctttatagaaaggatcagtg

SEQ ID NO: 6972819 - DNA, 22 bp, Homo sapiens
gactgggacaggacagacatct

SEQ ID NO: 6972820 - DNA, 22 bp, Homo sapiens
cacacttgcttcagagtcaagt

SEQ ID NO: 6972821 - DNA, 20 bp, Homo sapiens
acatgcacgtgtgtatatat

SEQ ID NO: 6972822 - DNA, 22 bp, Homo sapiens
agattcagaaaattctctgttc

SEQ ID NO: 6972823 - DNA, 22 bp, Homo sapiens
aggctgaggctttccttggaga

SEQ ID NO: 6972824 - DNA, 22 bp, Homo sapiens
aaagatcaagtaggcatggcct

SEQ ID NO: 6972825 - DNA, 22 bp, Homo sapiens
gaggctgaggttgcagtgagcc

SEQ ID NO: 6972826 - DNA, 22 bp, Homo sapiens
catttcaatactatctgagaat

SEQ ID NO: 6972827 - DNA, 18 bp, Homo sapiens
tcactcatagacatctat

SEQ ID NO: 6972828 - DNA, 22 bp, Homo sapiens
gttctccattcagcttcctgtg

SEQ ID NO: 6972829 - DNA, 21 bp, Homo sapiens
aatagcattcaggatgggctc

SEQ ID NO: 6972830 - DNA, 22 bp, Homo sapiens
gatcagagccagagatgataac

SEQ ID NO: 6972831 - DNA, 22 bp, Homo sapiens
tccaaaggacatttctgcttct

SEQ ID NO: 6972832 - DNA, 22 bp, Homo sapiens
ttggacctcagttattctatca

SEQ ID NO: 6972833 - DNA, 22 bp, Homo sapiens
atttaattgttcttctggctat

SEQ ID NO: 6972834 - DNA, 22 bp, Homo sapiens
ttcaagtttgcatgcccaagca

SEQ ID NO: 6972835 - DNA, 22 bp, Homo sapiens
gccagctgagcaaattccagct

SEQ ID NO: 6972836 - DNA, 22 bp, Homo sapiens
tcacaatttggatacagctatg

SEQ ID NO: 6972837 - DNA, 22 bp, Homo sapiens
taaagttggacctgattttatt

SEQ ID NO: 6972838 - DNA, 22 bp, Homo sapiens
atcaggctaggaacctcactgc

SEQ ID NO: 6972839 - DNA, 22 bp, Homo sapiens
tctctgtctttgttgtcttcac

SEQ ID NO: 6972840 - DNA, 22 bp, Homo sapiens
gtgctgttgcctggctgcacgg

SEQ ID NO: 6972841 - DNA, 22 bp, Homo sapiens
ttagcttttgagaatgatttct

SEQ ID NO: 6972842 - DNA, 22 bp, Homo sapiens
gtggccctaacaccgtttctca

SEQ ID NO: 6972843 - DNA, 22 bp, Homo sapiens
attctacaggactggcaatccc

SEQ ID NO: 6972844 - DNA, 22 bp, Homo sapiens
catggaatgtgagttgtttagt

SEQ ID NO: 6972845 - DNA, 22 bp, Homo sapiens
gctctgggaaggatcgtagtga

SEQ ID NO: 6972846 - DNA, 22 bp, Homo sapiens
gcctccacccctggggagtgga

SEQ ID NO: 6972847 - DNA, 22 bp, Homo sapiens
tgaaatgcaacagttatttttg

SEQ ID NO: 6972848 - DNA, 22 bp, Homo sapiens
gggaatgtggccctggggctcc

SEQ ID NO: 6972849 - DNA, 21 bp, Homo sapiens
ttacatggtttatcatatgga

SEQ ID NO: 6972850 - DNA, 22 bp, Homo sapiens
gggaagtgatggagccaggatt

SEQ ID NO: 6972851 - DNA, 22 bp, Homo sapiens
tccagtgggttgctgagggagg

SEQ ID NO: 6972852 - DNA, 22 bp, Homo sapiens
atcgtttaccctgagtgattgc

SEQ ID NO: 6972853 - DNA, 22 bp, Homo sapiens
ccctttgggttccccaagcctg

SEQ ID NO: 6972854 - DNA, 22 bp, Homo sapiens
tgcctctgttgagccttggctg

SEQ ID NO: 6972855 - DNA, 22 bp, Homo sapiens
tgcagccaattcattcattctt

SEQ ID NO: 6972856 - DNA, 22 bp, Homo sapiens
ttactgatttttgggccctacc

SEQ ID NO: 6972857 - DNA, 22 bp, Homo sapiens
accagctgttaggcttggtgct

SEQ ID NO: 6972858 - DNA, 22 bp, Homo sapiens
agcagataggacatttcattct

SEQ ID NO: 6972859 - DNA, 22 bp, Homo sapiens
aggggctgactggaaagtgcca

SEQ ID NO: 6972860 - DNA, 22 bp, Homo sapiens
agcattatggtatagtcccata

SEQ ID NO: 6972861 - DNA, 22 bp, Homo sapiens
taattggttttctaggtttaat

SEQ ID NO: 6972862 - DNA, 22 bp, Homo sapiens
agcaggggtctctgctaatgaa

SEQ ID NO: 6972863 - DNA, 22 bp, Homo sapiens
gaccaaggccaggccagggcgt

SEQ ID NO: 6972864 - DNA, 22 bp, Homo sapiens
tgtgggaggattcagaattggg

SEQ ID NO: 6972865 - DNA, 20 bp, Homo sapiens
atagatcctggttctttgca

SEQ ID NO: 6972866 - DNA, 22 bp, Homo sapiens
aatggtcagggcttttgtaggt

SEQ ID NO: 6972867 - DNA, 22 bp, Homo sapiens
tgaaagctgtacatgtggtaca

SEQ ID NO: 6972868 - DNA, 22 bp, Homo sapiens
aactaggtccctggtaggtatg

SEQ ID NO: 6972869 - DNA, 22 bp, Homo sapiens
tccagggacacagagtccttct

SEQ ID NO: 6972870 - DNA, 21 bp, Homo sapiens
tgattctctgactgtcggaca

SEQ ID NO: 6972871 - DNA, 22 bp, Homo sapiens
gcatagtcagtaggattctcaa

SEQ ID NO: 6972872 - DNA, 23 bp, Homo sapiens
atgccctgtgcagaaatgtggaa

SEQ ID NO: 6972873 - DNA, 22 bp, Homo sapiens
tttcaactcatgctaaaggaag

SEQ ID NO: 6972874 - DNA, 22 bp, Homo sapiens
tggcagctcatttggaaatgga

SEQ ID NO: 6972875 - DNA, 22 bp, Homo sapiens
ttcctgtgtcccgggcaccctg

SEQ ID NO: 6972876 - DNA, 22 bp, Homo sapiens
tctgaggaccatcggggagctg

SEQ ID NO: 6972877 - DNA, 22 bp, Homo sapiens
tctgcactcctgtttcacctgg

SEQ ID NO: 6972878 - DNA, 22 bp, Homo sapiens
tggagagcagggctggagttca

SEQ ID NO: 6972879 - DNA, 21 bp, Homo sapiens
agctgcctttagagagaacca

SEQ ID NO: 6972880 - DNA, 22 bp, Homo sapiens
aggtttattaagtaaatagagc

SEQ ID NO: 6972881 - DNA, 22 bp, Homo sapiens
gtcactactgaagtcaatgttg

SEQ ID NO: 6972882 - DNA, 22 bp, Homo sapiens
agacagaacagaataattgttg

SEQ ID NO: 6972883 - DNA, 22 bp, Homo sapiens
cataagttgcagagggtgcatt

SEQ ID NO: 6972884 - DNA, 22 bp, Homo sapiens
ttatctacgtatttaaactctt

SEQ ID NO: 6972885 - DNA, 22 bp, Homo sapiens
ttggcactttctcagcagcctg

SEQ ID NO: 6972886 - DNA, 22 bp, Homo sapiens
agcttcagtgtcaggcccgtgg

SEQ ID NO: 6972887 - DNA, 22 bp, Homo sapiens
aaagatgatctacaagttcatt

SEQ ID NO: 6972888 - DNA, 22 bp, Homo sapiens
ctgtcctatgagtactcactag

SEQ ID NO: 6972889 - DNA, 22 bp, Homo sapiens
agacagctaataaatgagtgtg

SEQ ID NO: 6972890 - DNA, 22 bp, Homo sapiens
catgctctagattctctctaat

SEQ ID NO: 6972891 - DNA, 22 bp, Homo sapiens
ggctcactacaacctccgcctt

SEQ ID NO: 6972892 - DNA, 22 bp, Homo sapiens
atgcacccatgtacatacacat

SEQ ID NO: 6972893 - DNA, 22 bp, Homo sapiens
gtttgcaacatagtcctatgta

SEQ ID NO: 6972894 - DNA, 22 bp, Homo sapiens
ggctgctgagtcacgacagtga

SEQ ID NO: 6972895 - DNA, 22 bp, Homo sapiens
tactgtgccctgggtcagaact

SEQ ID NO: 6972896 - DNA, 22 bp, Homo sapiens
cagaactgggctcgctctggtt

SEQ ID NO: 6972897 - DNA, 22 bp, Homo sapiens
ctggcacataattagtgatcct

SEQ ID NO: 6972898 - DNA, 22 bp, Homo sapiens
aagtacttgatagattaactgt

SEQ ID NO: 6972899 - DNA, 22 bp, Homo sapiens
taagcaatctgtagttggaatc

SEQ ID NO: 6972900 - DNA, 22 bp, Homo sapiens
ggaaaaatagagtatactttaa

SEQ ID NO: 6972901 - DNA, 22 bp, Homo sapiens
ggcagccagcgggtggacgcgc

SEQ ID NO: 6972902 - DNA, 22 bp, Homo sapiens
aggtagctatccagacgctgaa

SEQ ID NO: 6972903 - DNA, 22 bp, Homo sapiens
cagctcttattttctctcctaa

SEQ ID NO: 6972904 - DNA, 22 bp, Homo sapiens
cagtgtttagcacagtgcttgg

SEQ ID NO: 6972905 - DNA, 22 bp, Homo sapiens
tgtaaataatgcatgtaaatca

SEQ ID NO: 6972906 - DNA, 22 bp, Homo sapiens
cagcagcctacaatgcacagaa

SEQ ID NO: 6972907 - DNA, 22 bp, Homo sapiens
tgacaatggatattagttgtgg

SEQ ID NO: 6972908 - DNA, 20 bp, Homo sapiens
ctaatattctactctaagga

SEQ ID NO: 6972909 - DNA, 22 bp, Homo sapiens
aagttcaaaaatgtaatcagtg

SEQ ID NO: 6972910 - DNA, 22 bp, Homo sapiens
aacacatagacgtttgatatca

SEQ ID NO: 6972911 - DNA, 22 bp, Homo sapiens
tgcggcggcgggcagaggacta

SEQ ID NO: 6972912 - DNA, 22 bp, Homo sapiens
cagggagccaccagataattac

SEQ ID NO: 6972913 - DNA, 22 bp, Homo sapiens
tcacacagctagtaagggccga

SEQ ID NO: 6972914 - DNA, 22 bp, Homo sapiens
agtcccagcctaggctgtgctg

SEQ ID NO: 6972915 - DNA, 22 bp, Homo sapiens
atttggtcacaccagtccacat

SEQ ID NO: 6972916 - DNA, 22 bp, Homo sapiens
gagaatgggaatgaaagtagca

SEQ ID NO: 6972917 - DNA, 22 bp, Homo sapiens
ggacttacataattcagagcct

SEQ ID NO: 6972918 - DNA, 22 bp, Homo sapiens
cagaggcttatacctgattagg

SEQ ID NO: 6972919 - DNA, 20 bp, Homo sapiens
gcatcgagattcgttctttt

SEQ ID NO: 6972920 - DNA, 22 bp, Homo sapiens
aacatgagtctgtgtgaaagtg

SEQ ID NO: 6972921 - DNA, 22 bp, Homo sapiens
aagacagcagcacctctcgttt

SEQ ID NO: 6972922 - DNA, 22 bp, Homo sapiens
cagaagcaagtagtgattcttt

SEQ ID NO: 6972923 - DNA, 19 bp, Homo sapiens
taatcttattgggcagatt

SEQ ID NO: 6972924 - DNA, 22 bp, Homo sapiens
tggaatccagggtgtgtaagag

SEQ ID NO: 6972925 - DNA, 22 bp, Homo sapiens
agctgtgtggtttgggcaaatt

SEQ ID NO: 6972926 - DNA, 22 bp, Homo sapiens
agacaggtagcaggacagatat

SEQ ID NO: 6972927 - DNA, 22 bp, Homo sapiens
gctttgcaggaaaccagtgcat

SEQ ID NO: 6972928 - DNA, 22 bp, Homo sapiens
ttttgaccaaataatttagcag

SEQ ID NO: 6972929 - DNA, 22 bp, Homo sapiens
ctgatacaatgtctgctttata

SEQ ID NO: 6972930 - DNA, 22 bp, Homo sapiens
ctctttcagttctgatagtctc

SEQ ID NO: 6972931 - DNA, 22 bp, Homo sapiens
agggctgatgcaccatgtagcc

SEQ ID NO: 6972932 - DNA, 22 bp, Homo sapiens
tatcttggcttgaaagatgctt

SEQ ID NO: 6972933 - DNA, 22 bp, Homo sapiens
atctttcctgttttcagacagc

SEQ ID NO: 6972934 - DNA, 20 bp, Homo sapiens
gtctcctaccctcagctaga

SEQ ID NO: 6972935 - DNA, 21 bp, Homo sapiens
agctggctctctctggagaga

SEQ ID NO: 6972936 - DNA, 22 bp, Homo sapiens
ctttcgatcaagggtcccttca

SEQ ID NO: 6972937 - DNA, 22 bp, Homo sapiens
aggcgcagacatacagggtctg

SEQ ID NO: 6972938 - DNA, 22 bp, Homo sapiens
ctaaatgtgctaatagcatgaa

SEQ ID NO: 6972939 - DNA, 22 bp, Homo sapiens
aagtgccccaggctgttaacat

SEQ ID NO: 6972940 - DNA, 17 bp, Homo sapiens
aagagaggctgagctgg

SEQ ID NO: 6972941 - DNA, 19 bp, Homo sapiens
tagaatgcccacttaaaaa

SEQ ID NO: 6972942 - DNA, 20 bp, Homo sapiens
tctggcaggtgaacgagctg

SEQ ID NO: 6972943 - DNA, 22 bp, Homo sapiens
gcccctctcccttgaggcaggc

SEQ ID NO: 6972944 - DNA, 22 bp, Homo sapiens
tgctttgtgatatgctgtgtct

SEQ ID NO: 6972945 - DNA, 22 bp, Homo sapiens
gcagaagctgggagaagggatt

SEQ ID NO: 6972946 - DNA, 22 bp, Homo sapiens
tctgaaagccctagtttgtaat

SEQ ID NO: 6972947 - DNA, 22 bp, Homo sapiens
gggaagagatttccacatcatt

SEQ ID NO: 6972948 - DNA, 18 bp, Homo sapiens
tctcccggtcaccttcac

SEQ ID NO: 6972949 - DNA, 22 bp, Homo sapiens
agccctggaagccacagtccta

SEQ ID NO: 6972950 - DNA, 22 bp, Homo sapiens
tatctagaactccagaatgtag

SEQ ID NO: 6972951 - DNA, 22 bp, Homo sapiens
agttctgacctaacctttctca

SEQ ID NO: 6972952 - DNA, 22 bp, Homo sapiens
cagagccatggtatgggcttgt

SEQ ID NO: 6972953 - DNA, 22 bp, Homo sapiens
ctgggtcctgcaaatattatta

SEQ ID NO: 6972954 - DNA, 22 bp, Homo sapiens
caggtaggaggctccctagtcc

SEQ ID NO: 6972955 - DNA, 22 bp, Homo sapiens
aagatgttagaggtcatgcaga

SEQ ID NO: 6972956 - DNA, 22 bp, Homo sapiens
ggcaatgtccatggaacaggac

SEQ ID NO: 6972957 - DNA, 22 bp, Homo sapiens
agagcctgaggccctgagaggg

SEQ ID NO: 6972958 - DNA, 22 bp, Homo sapiens
catctgatgggaatataagagc

SEQ ID NO: 6972959 - DNA, 23 bp, Homo sapiens
tttatgcagcatgtagaacatgg

SEQ ID NO: 6972960 - DNA, 22 bp, Homo sapiens
cagcagcattgctctggattcc

SEQ ID NO: 6972961 - DNA, 22 bp, Homo sapiens
aatgtctacattctgaattcgt

SEQ ID NO: 6972962 - DNA, 22 bp, Homo sapiens
ggcatgtatgtgcatttttgta

SEQ ID NO: 6972963 - DNA, 22 bp, Homo sapiens
cagactgagtggattaaacaat

SEQ ID NO: 6972964 - DNA, 22 bp, Homo sapiens
atcagagctgtgattcccactc

SEQ ID NO: 6972965 - DNA, 22 bp, Homo sapiens
caatagatatttgctgactgcc

SEQ ID NO: 6972966 - DNA, 22 bp, Homo sapiens
gaaaccatgcaagctgctagag

SEQ ID NO: 6972967 - DNA, 22 bp, Homo sapiens
tgaagccttgtgtggcctctct

SEQ ID NO: 6972968 - DNA, 22 bp, Homo sapiens
ctaagtttatgtagttctttca

SEQ ID NO: 6972969 - DNA, 22 bp, Homo sapiens
tatgtgtactcgttaaatattt

SEQ ID NO: 6972970 - DNA, 22 bp, Homo sapiens
taagtagatgcaaaatggagtt

SEQ ID NO: 6972971 - DNA, 22 bp, Homo sapiens
tcctggcagggtctaggtctag

SEQ ID NO: 6972972 - DNA, 22 bp, Homo sapiens
tacagaaagacctctcgggaaa

SEQ ID NO: 6972973 - DNA, 22 bp, Homo sapiens
tgcactgtatggtatctggaca

SEQ ID NO: 6972974 - DNA, 22 bp, Homo sapiens
gagaagtttggagtgaaggttt

SEQ ID NO: 6972975 - DNA, 22 bp, Homo sapiens
tgattctgtaagtcatattgtt

SEQ ID NO: 6972976 - DNA, 22 bp, Homo sapiens
tatggtcagaccaaactgttct

SEQ ID NO: 6972977 - DNA, 22 bp, Homo sapiens
tttgaagattatgccagagtga

SEQ ID NO: 6972978 - DNA, 23 bp, Homo sapiens
tgtgtcatggggaaagactcacc

SEQ ID NO: 6972979 - DNA, 22 bp, Homo sapiens
cctgctgcttaggccatatttc

SEQ ID NO: 6972980 - DNA, 22 bp, Homo sapiens
acagcagtgcacagagaaccct

SEQ ID NO: 6972981 - DNA, 22 bp, Homo sapiens
ggctctggaaagtgtccttgat

SEQ ID NO: 6972982 - DNA, 22 bp, Homo sapiens
aacccagggtggaggttgcagt

SEQ ID NO: 6972983 - DNA, 22 bp, Homo sapiens
atctgtcctaaatatacctaca

SEQ ID NO: 6972984 - DNA, 22 bp, Homo sapiens
ggtgggccaggaaggccgccag

SEQ ID NO: 6972985 - DNA, 22 bp, Homo sapiens
tcaagcatcttggtctacgatc

SEQ ID NO: 6972986 - DNA, 22 bp, Homo sapiens
aaagccttctgtctagcagata

SEQ ID NO: 6972987 - DNA, 22 bp, Homo sapiens
aaagtagagttgtggaattact

SEQ ID NO: 6972988 - DNA, 22 bp, Homo sapiens
tccagcagtgctcaggactcac

SEQ ID NO: 6972989 - DNA, 22 bp, Homo sapiens
atgatgaattttaaaagcacca

SEQ ID NO: 6972990 - DNA, 22 bp, Homo sapiens
tgcatgtgtgtattcagagact

SEQ ID NO: 6972991 - DNA, 22 bp, Homo sapiens
tctgccatgggtatttaggatt

SEQ ID NO: 6972992 - DNA, 22 bp, Homo sapiens
gacactaaagtatagggtatct

SEQ ID NO: 6972993 - DNA, 22 bp, Homo sapiens
ggatttactatcttgaaatata

SEQ ID NO: 6972994 - DNA, 22 bp, Homo sapiens
ttgggctcctgttgatcctgtc

SEQ ID NO: 6972995 - DNA, 22 bp, Homo sapiens
cattatccaacagcactttcca

SEQ ID NO: 6972996 - DNA, 22 bp, Homo sapiens
aggaatttttctagccggagtt

SEQ ID NO: 6972997 - DNA, 22 bp, Homo sapiens
attctctgtttccaagatgaaa

SEQ ID NO: 6972998 - DNA, 22 bp, Homo sapiens
ggtgtccttgctccttcagctt

SEQ ID NO: 6972999 - DNA, 22 bp, Homo sapiens
ttatggcttaaatactacaggg

SEQ ID NO: 6973000 - DNA, 22 bp, Homo sapiens
aggcattagttgtaaagtattg

SEQ ID NO: 6973001 - DNA, 22 bp, Homo sapiens
tagagatgtgatatagcagagt

SEQ ID NO: 6973002 - DNA, 22 bp, Homo sapiens
cagctgttactgaagtaaaatg

SEQ ID NO: 6973003 - DNA, 22 bp, Homo sapiens
aaggctttggcccgagggaaga

SEQ ID NO: 6973004 - DNA, 21 bp, Homo sapiens
ttgaggggtattgcttttctc

SEQ ID NO: 6973005 - DNA, 22 bp, Homo sapiens
gggggctgaggctgttctgagg

SEQ ID NO: 6973006 - DNA, 22 bp, Homo sapiens
tgaacaactgcaaaaatctcca

SEQ ID NO: 6973007 - DNA, 22 bp, Homo sapiens
agcccagggagttgattagcat

SEQ ID NO: 6973008 - DNA, 22 bp, Homo sapiens
tctccacattctattggctata

SEQ ID NO: 6973009 - DNA, 22 bp, Homo sapiens
gttcctaaatttgaaggacttt

SEQ ID NO: 6973010 - DNA, 19 bp, Homo sapiens
tgaaacaaacttaaaagga

SEQ ID NO: 6973011 - DNA, 22 bp, Homo sapiens
ttagaagccaggatggagcagg

SEQ ID NO: 6973012 - DNA, 22 bp, Homo sapiens
agcttgcacagagaatacagta

SEQ ID NO: 6973013 - DNA, 22 bp, Homo sapiens
ctgagctgtggaataaacactg

SEQ ID NO: 6973014 - DNA, 22 bp, Homo sapiens
cttatttctccatccagagtca

SEQ ID NO: 6973015 - DNA, 22 bp, Homo sapiens
tagcactgaatcacatgctgct

SEQ ID NO: 6973016 - DNA, 22 bp, Homo sapiens
ttgtaatttgcaaatgtattgt

SEQ ID NO: 6973017 - DNA, 22 bp, Homo sapiens
aatgctattcattaagcctact

SEQ ID NO: 6973018 - DNA, 22 bp, Homo sapiens
agcctgtgttgctctggcgata

SEQ ID NO: 6973019 - DNA, 22 bp, Homo sapiens
ttactttagatcatactgtgtg

SEQ ID NO: 6973020 - DNA, 22 bp, Homo sapiens
ggcagcattgccaatccagaca

SEQ ID NO: 6973021 - DNA, 21 bp, Homo sapiens
ctttggtttcctcctgccttc

SEQ ID NO: 6973022 - DNA, 22 bp, Homo sapiens
ccaatcttatctttattttcta

SEQ ID NO: 6973023 - DNA, 20 bp, Homo sapiens
tcttgagaacaatttctggc

SEQ ID NO: 6973024 - DNA, 22 bp, Homo sapiens
aattcacatgcatgtctgtgca

SEQ ID NO: 6973025 - DNA, 22 bp, Homo sapiens
atacaaattataggccccatcc

SEQ ID NO: 6973026 - DNA, 22 bp, Homo sapiens
ccctcaatgtctacagcagtcc

SEQ ID NO: 6973027 - DNA, 22 bp, Homo sapiens
tttagacaggggcaaaataagg

SEQ ID NO: 6973028 - DNA, 22 bp, Homo sapiens
tttgaacagacactttctacag

SEQ ID NO: 6973029 - DNA, 22 bp, Homo sapiens
gccaaataccattaaccagaaa

SEQ ID NO: 6973030 - DNA, 22 bp, Homo sapiens
acttaaagttataatttgctaa

SEQ ID NO: 6973031 - DNA, 22 bp, Homo sapiens
cagtagccttatttggatcatt

SEQ ID NO: 6973032 - DNA, 22 bp, Homo sapiens
ttcacatgacagggtgaagcat

SEQ ID NO: 6973033 - DNA, 22 bp, Homo sapiens
gtgaggcgaaggtgctggcgcc

SEQ ID NO: 6973034 - DNA, 23 bp, Homo sapiens
ttggttactggatttgaggggcc

SEQ ID NO: 6973035 - DNA, 22 bp, Homo sapiens
ctggaagtggcagtggaaaaga

SEQ ID NO: 6973036 - DNA, 22 bp, Homo sapiens
tacacagatttcagtatcatca

SEQ ID NO: 6973037 - DNA, 22 bp, Homo sapiens
gagaggagttactatttccgag

SEQ ID NO: 6973038 - DNA, 22 bp, Homo sapiens
agcagatgagcctcatgactgg

SEQ ID NO: 6973039 - DNA, 22 bp, Homo sapiens
ttattctgagagttgaagtaat

SEQ ID NO: 6973040 - DNA, 19 bp, Homo sapiens
ggcttgtctcggcagccgc

SEQ ID NO: 6973041 - DNA, 22 bp, Homo sapiens
ctgggagtccaggatacagatg

SEQ ID NO: 6973042 - DNA, 19 bp, Homo sapiens
gccctgaccttggctgctc

SEQ ID NO: 6973043 - DNA, 18 bp, Homo sapiens
aaatggctacctttgtca

SEQ ID NO: 6973044 - DNA, 22 bp, Homo sapiens
ggctttgcctggaatttccttg

SEQ ID NO: 6973045 - DNA, 20 bp, Homo sapiens
acctggctctcaggagcaac

SEQ ID NO: 6973046 - DNA, 21 bp, Homo sapiens
gcacagggacagatcatcaca

SEQ ID NO: 6973047 - DNA, 22 bp, Homo sapiens
gacattgaatttgaatgtatgt

SEQ ID NO: 6973048 - DNA, 22 bp, Homo sapiens
tattgataaaatgctcactatg

SEQ ID NO: 6973049 - DNA, 22 bp, Homo sapiens
tttagaattggctagtgggaat

SEQ ID NO: 6973050 - DNA, 22 bp, Homo sapiens
aagactagggtgtgtttaatct

SEQ ID NO: 6973051 - DNA, 22 bp, Homo sapiens
attttatctgcttactttcagg

SEQ ID NO: 6973052 - DNA, 22 bp, Homo sapiens
gctgggcacctctcccagattg

SEQ ID NO: 6973053 - DNA, 22 bp, Homo sapiens
atcctgagttctcagagtctcc

SEQ ID NO: 6973054 - DNA, 22 bp, Homo sapiens
tcttcccaatgcaaagtaggac

SEQ ID NO: 6973055 - DNA, 18 bp, Homo sapiens
ccctgaagggcaagataa

SEQ ID NO: 6973056 - DNA, 22 bp, Homo sapiens
tgtatctttctactgtctagtt

SEQ ID NO: 6973057 - DNA, 20 bp, Homo sapiens
ttcaatatgaccctggggag

SEQ ID NO: 6973058 - DNA, 22 bp, Homo sapiens
tgaaggaaagagggaacatccc

SEQ ID NO: 6973059 - DNA, 22 bp, Homo sapiens
gacagcaagagacagagcatcc

SEQ ID NO: 6973060 - DNA, 22 bp, Homo sapiens
tcagaattctgaagggcacaaa

SEQ ID NO: 6973061 - DNA, 19 bp, Homo sapiens
tcataaactgggcacagtg

SEQ ID NO: 6973062 - DNA, 22 bp, Homo sapiens
tgtattaggttgatgcgaaagt

SEQ ID NO: 6973063 - DNA, 21 bp, Homo sapiens
aactgcttcccatcttagggc

SEQ ID NO: 6973064 - DNA, 22 bp, Homo sapiens
ccagaggcagacttacactcca

SEQ ID NO: 6973065 - DNA, 22 bp, Homo sapiens
agctggctatacttgaaaagtc

SEQ ID NO: 6973066 - DNA, 22 bp, Homo sapiens
gcagacatgtgttctaacagga

SEQ ID NO: 6973067 - DNA, 23 bp, Homo sapiens
agctttggtgatgtgacagataa

SEQ ID NO: 6973068 - DNA, 22 bp, Homo sapiens
tttactgacctccaatcccact

SEQ ID NO: 6973069 - DNA, 22 bp, Homo sapiens
agctgtctggaagttcctcatg

SEQ ID NO: 6973070 - DNA, 22 bp, Homo sapiens
tggctcagatttttgtaggctt

SEQ ID NO: 6973071 - DNA, 22 bp, Homo sapiens
aaatagaattggaagcagagtt

SEQ ID NO: 6973072 - DNA, 22 bp, Homo sapiens
ctttgttatctgtaaatggtta

SEQ ID NO: 6973073 - DNA, 22 bp, Homo sapiens
aaggctttttcactggtgactc

SEQ ID NO: 6973074 - DNA, 23 bp, Homo sapiens
cttgggctagagacttagcagtg

SEQ ID NO: 6973075 - DNA, 22 bp, Homo sapiens
ggagaagggcatggtagtttta

SEQ ID NO: 6973076 - DNA, 22 bp, Homo sapiens
gacagacaggaggcattcaggg

SEQ ID NO: 6973077 - DNA, 22 bp, Homo sapiens
cagtgtggtgtgcacagcttag

SEQ ID NO: 6973078 - DNA, 22 bp, Homo sapiens
tgtggtcccaaggcaactggaa

SEQ ID NO: 6973079 - DNA, 22 bp, Homo sapiens
gatgctgtaaaatgctaaacat

SEQ ID NO: 6973080 - DNA, 22 bp, Homo sapiens
acactttgaagatggaaacttg

SEQ ID NO: 6973081 - DNA, 22 bp, Homo sapiens
tgtgttttcctccctggcgttt

SEQ ID NO: 6973082 - DNA, 22 bp, Homo sapiens
tcttcactgatgtctctcaaat

SEQ ID NO: 6973083 - DNA, 22 bp, Homo sapiens
tcatttatttgactttggagtg

SEQ ID NO: 6973084 - DNA, 22 bp, Homo sapiens
ctcagtccgtcccgctaggtgc

SEQ ID NO: 6973085 - DNA, 22 bp, Homo sapiens
cagccactgtggaatagccccc

SEQ ID NO: 6973086 - DNA, 22 bp, Homo sapiens
aagatggagtagtgtaatggtt

SEQ ID NO: 6973087 - DNA, 22 bp, Homo sapiens
attatcacatggactttgcttt

SEQ ID NO: 6973088 - DNA, 18 bp, Homo sapiens
aggcccgttgtgtggaat

SEQ ID NO: 6973089 - DNA, 18 bp, Homo sapiens
ttggacctgtgtcagggc

SEQ ID NO: 6973090 - DNA, 22 bp, Homo sapiens
aagggctgagaagtggggctgg

SEQ ID NO: 6973091 - DNA, 18 bp, Homo sapiens
aggccaaacttgtaagca

SEQ ID NO: 6973092 - DNA, 22 bp, Homo sapiens
ggcaagtcaggaagttgacatt

SEQ ID NO: 6973093 - DNA, 22 bp, Homo sapiens
aggctaaaagagaatcatttag

SEQ ID NO: 6973094 - DNA, 21 bp, Homo sapiens
tgtgtatgtccaatgccctac

SEQ ID NO: 6973095 - DNA, 22 bp, Homo sapiens
gctgaggcggaaggattgctag

SEQ ID NO: 6973096 - DNA, 22 bp, Homo sapiens
ggccagctgcctgaccttctgt

SEQ ID NO: 6973097 - DNA, 22 bp, Homo sapiens
gtgaggcagaagttccctttta

SEQ ID NO: 6973098 - DNA, 22 bp, Homo sapiens
aaggactgacaaatgtcttcct

SEQ ID NO: 6973099 - DNA, 22 bp, Homo sapiens
cagtatcttgcttatagacaca

SEQ ID NO: 6973100 - DNA, 22 bp, Homo sapiens
gtgcatttggtgactctcaccc

SEQ ID NO: 6973101 - DNA, 22 bp, Homo sapiens
tttaaagtggtccatttcagaa

SEQ ID NO: 6973102 - DNA, 22 bp, Homo sapiens
catgcatttggagttttcaagt

SEQ ID NO: 6973103 - DNA, 22 bp, Homo sapiens
tacaggaaggagcacatcggga

SEQ ID NO: 6973104 - DNA, 22 bp, Homo sapiens
tgcccaggatctggcgatgctc

SEQ ID NO: 6973105 - DNA, 22 bp, Homo sapiens
attcttcatttactgttacttg

SEQ ID NO: 6973106 - DNA, 22 bp, Homo sapiens
gctgagggggaaggaaagctga

SEQ ID NO: 6973107 - DNA, 22 bp, Homo sapiens
tctgtaaaattagtataattgt

SEQ ID NO: 6973108 - DNA, 22 bp, Homo sapiens
tctgtgggtttcagggggctgt

SEQ ID NO: 6973109 - DNA, 22 bp, Homo sapiens
ttacttgaaaggaaattaaggt

SEQ ID NO: 6973110 - DNA, 22 bp, Homo sapiens
atcataaaattgcaccatttct

SEQ ID NO: 6973111 - DNA, 22 bp, Homo sapiens
gggatctttctgatgctgtggc

SEQ ID NO: 6973112 - DNA, 22 bp, Homo sapiens
gcttaggagtttcaggctctca

SEQ ID NO: 6973113 - DNA, 21 bp, Homo sapiens
caagccagaccaatagcagcc

SEQ ID NO: 6973114 - DNA, 22 bp, Homo sapiens
agacagctggtagcacttcctg

SEQ ID NO: 6973115 - DNA, 22 bp, Homo sapiens
gctgacctgtggcagaagctca

SEQ ID NO: 6973116 - DNA, 22 bp, Homo sapiens
agctgggctgggctgagctgag

SEQ ID NO: 6973117 - DNA, 22 bp, Homo sapiens
taagagctcccttctccttgca

SEQ ID NO: 6973118 - DNA, 22 bp, Homo sapiens
ctgggagattgaggccatggtg

SEQ ID NO: 6973119 - DNA, 22 bp, Homo sapiens
taggcttgctgttattttgaag

SEQ ID NO: 6973120 - DNA, 22 bp, Homo sapiens
gagctgtccgcccctgggccga

SEQ ID NO: 6973121 - DNA, 22 bp, Homo sapiens
ttcaaaatgcacaaagggctag

SEQ ID NO: 6973122 - DNA, 23 bp, Homo sapiens
tgtcactataagagggcttgccc

SEQ ID NO: 6973123 - DNA, 22 bp, Homo sapiens
agtcttatgtttgtgaagaact

SEQ ID NO: 6973124 - DNA, 22 bp, Homo sapiens
tggctggcttgttcactgactg

SEQ ID NO: 6973125 - DNA, 22 bp, Homo sapiens
tggaagtggcagaggaagtggt

SEQ ID NO: 6973126 - DNA, 22 bp, Homo sapiens
cctgaatactggtgctgaaagt

SEQ ID NO: 6973127 - DNA, 22 bp, Homo sapiens
aaagccagggacagtgtgcatg

SEQ ID NO: 6973128 - DNA, 20 bp, Homo sapiens
aggaaaagggtggtggtaga

SEQ ID NO: 6973129 - DNA, 22 bp, Homo sapiens
aatgtcaaatgagaggggagaa

SEQ ID NO: 6973130 - DNA, 22 bp, Homo sapiens
tgcttgaagatatactacttcc

SEQ ID NO: 6973131 - DNA, 22 bp, Homo sapiens
tgtagcaccagtcaccagccca

SEQ ID NO: 6973132 - DNA, 22 bp, Homo sapiens
ttcaaagtgctgttcaaagtag

SEQ ID NO: 6973133 - DNA, 22 bp, Homo sapiens
gagttaatgaggccaagggcag

SEQ ID NO: 6973134 - DNA, 22 bp, Homo sapiens
tttattccagtgtttctcaaat

SEQ ID NO: 6973135 - DNA, 22 bp, Homo sapiens
aaactgtaagagaataaactac

SEQ ID NO: 6973136 - DNA, 22 bp, Homo sapiens
agtcaccaggttttagagacct

SEQ ID NO: 6973137 - DNA, 22 bp, Homo sapiens
agttaggagcaaaataagatag

SEQ ID NO: 6973138 - DNA, 22 bp, Homo sapiens
gcttggcttgggctcagaggcc

SEQ ID NO: 6973139 - DNA, 22 bp, Homo sapiens
ttcaagttttgacttagtcctt

SEQ ID NO: 6973140 - DNA, 23 bp, Homo sapiens
taacctgagttttttagatgcaa

SEQ ID NO: 6973141 - DNA, 22 bp, Homo sapiens
gtttagttgaagaaggggcagc

SEQ ID NO: 6973142 - DNA, 22 bp, Homo sapiens
gtcttgcacttacctaagaact

SEQ ID NO: 6973143 - DNA, 22 bp, Homo sapiens
aggctccatgctaagcgatatg

SEQ ID NO: 6973144 - DNA, 23 bp, Homo sapiens
gtgttggcagcagtgctctgggg

SEQ ID NO: 6973145 - DNA, 22 bp, Homo sapiens
actggtctaagacattgggacc

SEQ ID NO: 6973146 - DNA, 22 bp, Homo sapiens
tgttttcttcctaattgctcat

SEQ ID NO: 6973147 - DNA, 22 bp, Homo sapiens
tcacacaggtttgcaatgattt

SEQ ID NO: 6973148 - DNA, 22 bp, Homo sapiens
tggcttctgctttcagtggagg

SEQ ID NO: 6973149 - DNA, 22 bp, Homo sapiens
aagcactgggaggaggctgaga

SEQ ID NO: 6973150 - DNA, 22 bp, Homo sapiens
gcacctgagcaactatacattg

SEQ ID NO: 6973151 - DNA, 22 bp, Homo sapiens
ttcataggaaatagtgttcttt

SEQ ID NO: 6973152 - DNA, 22 bp, Homo sapiens
attaggaaattatatgtcctcc

SEQ ID NO: 6973153 - DNA, 21 bp, Homo sapiens
acagccaggaacatgaggggc

SEQ ID NO: 6973154 - DNA, 22 bp, Homo sapiens
tctagatttggggcatgaagtt

SEQ ID NO: 6973155 - DNA, 23 bp, Homo sapiens
tcagaagtgggatacaaagctga

SEQ ID NO: 6973156 - DNA, 22 bp, Homo sapiens
cagacctctatggggtaaatct

SEQ ID NO: 6973157 - DNA, 22 bp, Homo sapiens
tggcttcatctgcagcactgcc

SEQ ID NO: 6973158 - DNA, 19 bp, Homo sapiens
tggaatcagcaagaatatt

SEQ ID NO: 6973159 - DNA, 22 bp, Homo sapiens
atctggcttgggtgtgggtagc

SEQ ID NO: 6973160 - DNA, 22 bp, Homo sapiens
gctgagagcaaggacaaagcat

SEQ ID NO: 6973161 - DNA, 22 bp, Homo sapiens
ggagctcataacaaggtagcca

SEQ ID NO: 6973162 - DNA, 22 bp, Homo sapiens
ctgcagcaaatgttaagtgact

SEQ ID NO: 6973163 - DNA, 21 bp, Homo sapiens
ggggtcaagtgaatggtgttg

SEQ ID NO: 6973164 - DNA, 22 bp, Homo sapiens
ggcaatatttatataggcaagg

SEQ ID NO: 6973165 - DNA, 22 bp, Homo sapiens
tgtcctgcaactgaaggagaag

SEQ ID NO: 6973166 - DNA, 22 bp, Homo sapiens
gttgctcaggcaggagtacagt

SEQ ID NO: 6973167 - DNA, 22 bp, Homo sapiens
caacagaggagtggcctgatcc

SEQ ID NO: 6973168 - DNA, 22 bp, Homo sapiens
actcaggctagggaaaaagtgg

SEQ ID NO: 6973169 - DNA, 22 bp, Homo sapiens
gtaggtgataatgcaaaaggaa

SEQ ID NO: 6973170 - DNA, 22 bp, Homo sapiens
atccaggccttgaagtaccagt

SEQ ID NO: 6973171 - DNA, 22 bp, Homo sapiens
aggaaaggtagcgtgccagcag

SEQ ID NO: 6973172 - DNA, 22 bp, Homo sapiens
atagcaaaaggcaccagagtga

SEQ ID NO: 6973173 - DNA, 19 bp, Homo sapiens
ttatgaaggctggggggag

SEQ ID NO: 6973174 - DNA, 22 bp, Homo sapiens
tgttgttcagtctttgctggct

SEQ ID NO: 6973175 - DNA, 22 bp, Homo sapiens
tgacaatttatagaatgtgact

SEQ ID NO: 6973176 - DNA, 22 bp, Homo sapiens
tgtcctgggaggcggggtccag

SEQ ID NO: 6973177 - DNA, 22 bp, Homo sapiens
agaatgcaagataaactttatt

SEQ ID NO: 6973178 - DNA, 22 bp, Homo sapiens
aaccccgctcaggctgggtgag

SEQ ID NO: 6973179 - DNA, 22 bp, Homo sapiens
aaagattaggcggcaactgggc

SEQ ID NO: 6973180 - DNA, 22 bp, Homo sapiens
tccccagagggctgtttaggcc

SEQ ID NO: 6973181 - DNA, 22 bp, Homo sapiens
aagcccataaaaagaggtccct

SEQ ID NO: 6973182 - DNA, 22 bp, Homo sapiens
gcctggcagggagattgtaaga

SEQ ID NO: 6973183 - DNA, 22 bp, Homo sapiens
caagggagttgctgcatgcagg

SEQ ID NO: 6973184 - DNA, 22 bp, Homo sapiens
tctgagcacatcacacagctca

SEQ ID NO: 6973185 - DNA, 22 bp, Homo sapiens
gaggaagttaggatacattggt

SEQ ID NO: 6973186 - DNA, 22 bp, Homo sapiens
ggaagtgtttccttgggcagca

SEQ ID NO: 6973187 - DNA, 22 bp, Homo sapiens
tccttcagttaaagatctcaca

SEQ ID NO: 6973188 - DNA, 22 bp, Homo sapiens
tgttcattcaacatgtcatcta

SEQ ID NO: 6973189 - DNA, 20 bp, Homo sapiens
tggtccccatccttgcgatt

SEQ ID NO: 6973190 - DNA, 22 bp, Homo sapiens
cctccctgctcctcaactggca

SEQ ID NO: 6973191 - DNA, 19 bp, Homo sapiens
aggtggctgaaactacaga

SEQ ID NO: 6973192 - DNA, 22 bp, Homo sapiens
tttctagttctctgccaaaaaa

SEQ ID NO: 6973193 - DNA, 23 bp, Homo sapiens
gcatgcaacttgcagtagtattc

SEQ ID NO: 6973194 - DNA, 16 bp, Homo sapiens
cgagtgaagccttttc

SEQ ID NO: 6973195 - DNA, 22 bp, Homo sapiens
gtgtgagctcagccttgggaga

SEQ ID NO: 6973196 - DNA, 22 bp, Homo sapiens
ttacaggttaagtgacacttaa

SEQ ID NO: 6973197 - DNA, 22 bp, Homo sapiens
aatgttcattagcattgttgac

SEQ ID NO: 6973198 - DNA, 22 bp, Homo sapiens
ctgtacatatacatttttttcc

SEQ ID NO: 6973199 - DNA, 22 bp, Homo sapiens
actgagaactcaagagaaaagg

SEQ ID NO: 6973200 - DNA, 21 bp, Homo sapiens
ccagacttgagtgtatgttgt

SEQ ID NO: 6973201 - DNA, 22 bp, Homo sapiens
gtgcttccccaagccacagcct

SEQ ID NO: 6973202 - DNA, 22 bp, Homo sapiens
actacattatgaggaaagagtg

SEQ ID NO: 6973203 - DNA, 22 bp, Homo sapiens
tgtttaatgaagatggtttttc

SEQ ID NO: 6973204 - DNA, 21 bp, Homo sapiens
ttctgtagctgttagcttttc

SEQ ID NO: 6973205 - DNA, 22 bp, Homo sapiens
ggctgcctagacttggaatttc

SEQ ID NO: 6973206 - DNA, 22 bp, Homo sapiens
acagataaaagttgtttaaaat

SEQ ID NO: 6973207 - DNA, 22 bp, Homo sapiens
cgcggctctgcgggccgctgag

SEQ ID NO: 6973208 - DNA, 22 bp, Homo sapiens
tccaaggtcagcgagagtcact

SEQ ID NO: 6973209 - DNA, 22 bp, Homo sapiens
gctcgtacaccagcgtggaggt

SEQ ID NO: 6973210 - DNA, 22 bp, Homo sapiens
acagtgctgtctatctcactaa

SEQ ID NO: 6973211 - DNA, 22 bp, Homo sapiens
ttggagggactgagcttcagtc

SEQ ID NO: 6973212 - DNA, 22 bp, Homo sapiens
gtctggggtccttttggcttta

SEQ ID NO: 6973213 - DNA, 22 bp, Homo sapiens
actttttacagggtgtatacca

SEQ ID NO: 6973214 - DNA, 22 bp, Homo sapiens
ttgttcagtagagagattatta

SEQ ID NO: 6973215 - DNA, 20 bp, Homo sapiens
tccaagggcagcagaatcag

SEQ ID NO: 6973216 - DNA, 20 bp, Homo sapiens
gagtcacagaagaagctgaa

SEQ ID NO: 6973217 - DNA, 22 bp, Homo sapiens
ctggggctgtaggaggacttat

SEQ ID NO: 6973218 - DNA, 22 bp, Homo sapiens
tgcagcttgctgtaggctaagt

SEQ ID NO: 6973219 - DNA, 22 bp, Homo sapiens
cctggctcttctgtgtcagccc

SEQ ID NO: 6973220 - DNA, 22 bp, Homo sapiens
ttcacatctcagcactgcctct

SEQ ID NO: 6973221 - DNA, 22 bp, Homo sapiens
agacccaggcttcatgtgaatc

SEQ ID NO: 6973222 - DNA, 22 bp, Homo sapiens
tttgtcaggaattgaaaagttt

SEQ ID NO: 6973223 - DNA, 22 bp, Homo sapiens
ctctatttttcttggctagtgt

SEQ ID NO: 6973224 - DNA, 20 bp, Homo sapiens
tggaggcacctgtggagatc

SEQ ID NO: 6973225 - DNA, 22 bp, Homo sapiens
accagcagctgcgggccactgc

SEQ ID NO: 6973226 - DNA, 22 bp, Homo sapiens
aagcagaggaccgacggaggga

SEQ ID NO: 6973227 - DNA, 22 bp, Homo sapiens
tgaggtaggagtgggaaagtag

SEQ ID NO: 6973228 - DNA, 22 bp, Homo sapiens
tcaatgagaatagctttcctta

SEQ ID NO: 6973229 - DNA, 22 bp, Homo sapiens
tttagctcatactgctcttcca

SEQ ID NO: 6973230 - DNA, 22 bp, Homo sapiens
ttaagacatttttggagattat

SEQ ID NO: 6973231 - DNA, 22 bp, Homo sapiens
tgaagtttaaggttagataagt

SEQ ID NO: 6973232 - DNA, 22 bp, Homo sapiens
ttacaacagcgatttacctgtc

SEQ ID NO: 6973233 - DNA, 22 bp, Homo sapiens
atggcaccaaatatgtctcatt

SEQ ID NO: 6973234 - DNA, 22 bp, Homo sapiens
cagtcagttatccacacaccag

SEQ ID NO: 6973235 - DNA, 22 bp, Homo sapiens
ggaaggggtgtcgcccatggat

SEQ ID NO: 6973236 - DNA, 22 bp, Homo sapiens
ggctctgaggctatgctttaca

SEQ ID NO: 6973237 - DNA, 22 bp, Homo sapiens
tggccacatcctttccttgtca

SEQ ID NO: 6973238 - DNA, 22 bp, Homo sapiens
tgtgggcagctggagctgttca

SEQ ID NO: 6973239 - DNA, 22 bp, Homo sapiens
acaggacaatttataatgggca

SEQ ID NO: 6973240 - DNA, 22 bp, Homo sapiens
accagcctggccaacatggcaa

SEQ ID NO: 6973241 - DNA, 22 bp, Homo sapiens
gtcacactagggccaagtggag

SEQ ID NO: 6973242 - DNA, 22 bp, Homo sapiens
aatgccttataggctgaaaatt

SEQ ID NO: 6973243 - DNA, 19 bp, Homo sapiens
tagcccagagcctggctac

SEQ ID NO: 6973244 - DNA, 22 bp, Homo sapiens
aggcttcaggaaatatacattt

SEQ ID NO: 6973245 - DNA, 19 bp, Homo sapiens
tgttttcaagtgggattat

SEQ ID NO: 6973246 - DNA, 22 bp, Homo sapiens
aagccagtattcaatggggcta

SEQ ID NO: 6973247 - DNA, 18 bp, Homo sapiens
agctggtggggagacagc

SEQ ID NO: 6973248 - DNA, 22 bp, Homo sapiens
acaatgtgcttatgaaggcagt

SEQ ID NO: 6973249 - DNA, 22 bp, Homo sapiens
ctctgggcaagtttcttcatga

SEQ ID NO: 6973250 - DNA, 22 bp, Homo sapiens
aagaggttctccttggagtggg

SEQ ID NO: 6973251 - DNA, 22 bp, Homo sapiens
agtgtcctctattatgacttta

SEQ ID NO: 6973252 - DNA, 22 bp, Homo sapiens
acaagctcagatccctgtctct

SEQ ID NO: 6973253 - DNA, 22 bp, Homo sapiens
gcacacatgtgagtgtcctttc

SEQ ID NO: 6973254 - DNA, 22 bp, Homo sapiens
tccagctttggctctagctaca

SEQ ID NO: 6973255 - DNA, 22 bp, Homo sapiens
tgccctggctcttcttgttcca

SEQ ID NO: 6973256 - DNA, 22 bp, Homo sapiens
gcctcctccttcccgagggtct

SEQ ID NO: 6973257 - DNA, 22 bp, Homo sapiens
gcaggtggattatcagaagtgc

SEQ ID NO: 6973258 - DNA, 18 bp, Homo sapiens
acacaggctgacagcacc

SEQ ID NO: 6973259 - DNA, 22 bp, Homo sapiens
tgacctgtgtttgctgttgctc

SEQ ID NO: 6973260 - DNA, 22 bp, Homo sapiens
agctttatcagaggagtctcta

SEQ ID NO: 6973261 - DNA, 22 bp, Homo sapiens
atgtgagactaaaaagatgtgc

SEQ ID NO: 6973262 - DNA, 22 bp, Homo sapiens
tgctggaatgagtcggggaggg

SEQ ID NO: 6973263 - DNA, 22 bp, Homo sapiens
tcaggctttgaagtctagctgg

SEQ ID NO: 6973264 - DNA, 22 bp, Homo sapiens
gtacagtagtaaaagtgaatga

SEQ ID NO: 6973265 - DNA, 22 bp, Homo sapiens
aagagatgatggcagccagagg

SEQ ID NO: 6973266 - DNA, 22 bp, Homo sapiens
gggagggcttggacccagatgt

SEQ ID NO: 6973267 - DNA, 22 bp, Homo sapiens
atgggctggggaagctcactcc

SEQ ID NO: 6973268 - DNA, 22 bp, Homo sapiens
ttgcctggatggtccccagaga

SEQ ID NO: 6973269 - DNA, 22 bp, Homo sapiens
aggagcgtctgtctgtgtctct

SEQ ID NO: 6973270 - DNA, 22 bp, Homo sapiens
ttcaggatgctcagagtagtct

SEQ ID NO: 6973271 - DNA, 22 bp, Homo sapiens
tgagaaccatgaaaagctgtca

SEQ ID NO: 6973272 - DNA, 19 bp, Homo sapiens
gttgtttttcttattatgg

SEQ ID NO: 6973273 - DNA, 22 bp, Homo sapiens
ttcctcttccatcttcccaggg

SEQ ID NO: 6973274 - DNA, 22 bp, Homo sapiens
aaagtgttttgtgagcagtctg

SEQ ID NO: 6973275 - DNA, 22 bp, Homo sapiens
gaactctctcatctgtcagttg

SEQ ID NO: 6973276 - DNA, 22 bp, Homo sapiens
ttggagttctgggcacagctgc

SEQ ID NO: 6973277 - DNA, 22 bp, Homo sapiens
agatgatgttggagtctgtgct

SEQ ID NO: 6973278 - DNA, 22 bp, Homo sapiens
tttcacagcaacactgtctgca

SEQ ID NO: 6973279 - DNA, 22 bp, Homo sapiens
tacttcattcctttgtaaaatg

SEQ ID NO: 6973280 - DNA, 22 bp, Homo sapiens
agatttcctatggtaattatag

SEQ ID NO: 6973281 - DNA, 22 bp, Homo sapiens
agaagaaactgtcggggatatt

SEQ ID NO: 6973282 - DNA, 22 bp, Homo sapiens
agggatgctgctaagtggtcta

SEQ ID NO: 6973283 - DNA, 22 bp, Homo sapiens
tgtcggccacgagggagccgcg

SEQ ID NO: 6973284 - DNA, 22 bp, Homo sapiens
atagcatataagttataaaact

SEQ ID NO: 6973285 - DNA, 22 bp, Homo sapiens
cataactgggagatccaagggt

SEQ ID NO: 6973286 - DNA, 22 bp, Homo sapiens
ctctgcttggaacaggggtttg

SEQ ID NO: 6973287 - DNA, 22 bp, Homo sapiens
taagtgagaactaaaccttctg

SEQ ID NO: 6973288 - DNA, 22 bp, Homo sapiens
actcagagttcctgtgcatagt

SEQ ID NO: 6973289 - DNA, 22 bp, Homo sapiens
tcattgttaattcctgccggcc

SEQ ID NO: 6973290 - DNA, 18 bp, Homo sapiens
ggaagtaggaagaggaag

SEQ ID NO: 6973291 - DNA, 22 bp, Homo sapiens
ccagtgtccttcctttccatgg

SEQ ID NO: 6973292 - DNA, 21 bp, Homo sapiens
gccagggaagagagttggctg

SEQ ID NO: 6973293 - DNA, 22 bp, Homo sapiens
tgacactagacttgaggcactg

SEQ ID NO: 6973294 - DNA, 22 bp, Homo sapiens
acctttatatgaaagatgacat

SEQ ID NO: 6973295 - DNA, 22 bp, Homo sapiens
atgagaaggacataaattatag

SEQ ID NO: 6973296 - DNA, 22 bp, Homo sapiens
tacagtgaatgaatggctgtgc

SEQ ID NO: 6973297 - DNA, 22 bp, Homo sapiens
tctctggaattggctgaggcaa

SEQ ID NO: 6973298 - DNA, 22 bp, Homo sapiens
gagcatcgctgagatcccagac

SEQ ID NO: 6973299 - DNA, 22 bp, Homo sapiens
tgtagcctattaggagaggagc

SEQ ID NO: 6973300 - DNA, 22 bp, Homo sapiens
ggcgggagatggggccgttcag

SEQ ID NO: 6973301 - DNA, 18 bp, Homo sapiens
gtgaagctttattgaatg

SEQ ID NO: 6973302 - DNA, 22 bp, Homo sapiens
attctgggcaagccttcttata

SEQ ID NO: 6973303 - DNA, 20 bp, Homo sapiens
tcaaagcactgcctgtcatc

SEQ ID NO: 6973304 - DNA, 22 bp, Homo sapiens
cagctggttcagtgtctggtga

SEQ ID NO: 6973305 - DNA, 22 bp, Homo sapiens
ggctctcttaactggccatcct

SEQ ID NO: 6973306 - DNA, 22 bp, Homo sapiens
attggtcattttggtttagaag

SEQ ID NO: 6973307 - DNA, 22 bp, Homo sapiens
tggcagctgtctgtggggtctc

SEQ ID NO: 6973308 - DNA, 22 bp, Homo sapiens
tgtgaactctggaacaaaacta

SEQ ID NO: 6973309 - DNA, 22 bp, Homo sapiens
ggctggcacctgccctccgctg

SEQ ID NO: 6973310 - DNA, 22 bp, Homo sapiens
atttgcatgcttctattgtgaa

SEQ ID NO: 6973311 - DNA, 22 bp, Homo sapiens
cttgagcatcggatggaatttc

SEQ ID NO: 6973312 - DNA, 22 bp, Homo sapiens
gtgtgggggcagctctgatatg

SEQ ID NO: 6973313 - DNA, 22 bp, Homo sapiens
tctctaaagtagaaaagacccc

SEQ ID NO: 6973314 - DNA, 22 bp, Homo sapiens
atctcagttcaggctccactgt

SEQ ID NO: 6973315 - DNA, 22 bp, Homo sapiens
gtttcgtcaggcttattctatc

SEQ ID NO: 6973316 - DNA, 22 bp, Homo sapiens
cccgttgccttctgggagttgt

SEQ ID NO: 6973317 - DNA, 22 bp, Homo sapiens
gtgagccgagtatagttcatag

SEQ ID NO: 6973318 - DNA, 22 bp, Homo sapiens
agagtggtcatttgtccaggat

SEQ ID NO: 6973319 - DNA, 22 bp, Homo sapiens
aactagaaatcactacaggtat

SEQ ID NO: 6973320 - DNA, 22 bp, Homo sapiens
atcgaataattgcattctataa

SEQ ID NO: 6973321 - DNA, 19 bp, Homo sapiens
gtcagctggaactctgaaa

SEQ ID NO: 6973322 - DNA, 22 bp, Homo sapiens
gatgtggctgctctaaagccca

SEQ ID NO: 6973323 - DNA, 22 bp, Homo sapiens
tctggcagtgagcaacttgaca

SEQ ID NO: 6973324 - DNA, 19 bp, Homo sapiens
tgcttaccatctgtgctgg

SEQ ID NO: 6973325 - DNA, 16 bp, Homo sapiens
ctctttgggcttccag

SEQ ID NO: 6973326 - DNA, 22 bp, Homo sapiens
aggacctgagagttggaaatcc

SEQ ID NO: 6973327 - DNA, 22 bp, Homo sapiens
attattgtactttcaataaggt

SEQ ID NO: 6973328 - DNA, 22 bp, Homo sapiens
aactggattgacctagtttaag

SEQ ID NO: 6973329 - DNA, 22 bp, Homo sapiens
agctacaagtcatcagctatca

SEQ ID NO: 6973330 - DNA, 22 bp, Homo sapiens
aagtaaacagataagaaatctg

SEQ ID NO: 6973331 - DNA, 22 bp, Homo sapiens
gctcccaggaagagaagggcca

SEQ ID NO: 6973332 - DNA, 22 bp, Homo sapiens
ccccatttgaactccttcaact

SEQ ID NO: 6973333 - DNA, 22 bp, Homo sapiens
ggccactgtcctctagcccaga

SEQ ID NO: 6973334 - DNA, 22 bp, Homo sapiens
gttaatgtgtctgacacaatgg

SEQ ID NO: 6973335 - DNA, 22 bp, Homo sapiens
catagaaaagagtaggtaatgt

SEQ ID NO: 6973336 - DNA, 22 bp, Homo sapiens
taagatgtggaatcacagcttc

SEQ ID NO: 6973337 - DNA, 22 bp, Homo sapiens
atgcatatgcaatgcacaattt

SEQ ID NO: 6973338 - DNA, 22 bp, Homo sapiens
gtgggtctggctttgagggtca

SEQ ID NO: 6973339 - DNA, 22 bp, Homo sapiens
aggctgctttattcacaatagc

SEQ ID NO: 6973340 - DNA, 20 bp, Homo sapiens
acaagagctcagattcagag

SEQ ID NO: 6973341 - DNA, 22 bp, Homo sapiens
gtcctgtgggcccaccatgagc

SEQ ID NO: 6973342 - DNA, 22 bp, Homo sapiens
gagcttcttgtttcttcatctg

SEQ ID NO: 6973343 - DNA, 22 bp, Homo sapiens
acagcagccagccactgtgagc

SEQ ID NO: 6973344 - DNA, 22 bp, Homo sapiens
attcagtgtagttattatcttt

SEQ ID NO: 6973345 - DNA, 22 bp, Homo sapiens
cagcaatccaagctttctttaa

SEQ ID NO: 6973346 - DNA, 22 bp, Homo sapiens
tcttcaaccttgttactatagc

SEQ ID NO: 6973347 - DNA, 22 bp, Homo sapiens
gtcttactgcttctgaaagata

SEQ ID NO: 6973348 - DNA, 21 bp, Homo sapiens
taagaacattatcttcttcct

SEQ ID NO: 6973349 - DNA, 22 bp, Homo sapiens
acaagcataagtgagatgaata

SEQ ID NO: 6973350 - DNA, 19 bp, Homo sapiens
aattctgtttcagcagatc

SEQ ID NO: 6973351 - DNA, 20 bp, Homo sapiens
tttcaaaggcacctatgaag

SEQ ID NO: 6973352 - DNA, 22 bp, Homo sapiens
tgtcccagatactggacataga

SEQ ID NO: 6973353 - DNA, 22 bp, Homo sapiens
agccaaagatcagtgtgcaagt

SEQ ID NO: 6973354 - DNA, 22 bp, Homo sapiens
gccacaggcacttaagggctgg

SEQ ID NO: 6973355 - DNA, 22 bp, Homo sapiens
cgctggtcaccatggcgtcctg

SEQ ID NO: 6973356 - DNA, 22 bp, Homo sapiens
ccagagagagtactgggctctg

SEQ ID NO: 6973357 - DNA, 22 bp, Homo sapiens
gccctgccctgagccgtagacc

SEQ ID NO: 6973358 - DNA, 19 bp, Homo sapiens
ttctaatgttacattttgg

SEQ ID NO: 6973359 - DNA, 22 bp, Homo sapiens
acaagatttggctgaaactcca

SEQ ID NO: 6973360 - DNA, 22 bp, Homo sapiens
ttagaattattgtttccttcta

SEQ ID NO: 6973361 - DNA, 22 bp, Homo sapiens
gcactgggaagaatgagcctgt

SEQ ID NO: 6973362 - DNA, 22 bp, Homo sapiens
attatttacagtgtgctcgaag

SEQ ID NO: 6973363 - DNA, 22 bp, Homo sapiens
ggccagagggagggcacaaatc

SEQ ID NO: 6973364 - DNA, 22 bp, Homo sapiens
aaggtgctcgttatggccagtg

SEQ ID NO: 6973365 - DNA, 22 bp, Homo sapiens
atgctgtcgaaaccaaacatct

SEQ ID NO: 6973366 - DNA, 22 bp, Homo sapiens
aggaggccgggattctggagat

SEQ ID NO: 6973367 - DNA, 22 bp, Homo sapiens
atgtatgtctgatgcacatgca

SEQ ID NO: 6973368 - DNA, 22 bp, Homo sapiens
cctctgggctggaaaattaatg

SEQ ID NO: 6973369 - DNA, 22 bp, Homo sapiens
ttctcttttagaggctccatga

SEQ ID NO: 6973370 - DNA, 22 bp, Homo sapiens
cagagccagcccactgttcccg

SEQ ID NO: 6973371 - DNA, 22 bp, Homo sapiens
ttgtacagaccctgaaaagctc

SEQ ID NO: 6973372 - DNA, 22 bp, Homo sapiens
gtcagagcactgagttgtgggc

SEQ ID NO: 6973373 - DNA, 22 bp, Homo sapiens
agcaaacagtttctggggatct

SEQ ID NO: 6973374 - DNA, 22 bp, Homo sapiens
agctgcaggcccatgctcagtc

SEQ ID NO: 6973375 - DNA, 22 bp, Homo sapiens
gagcggcaggagccacctgcct

SEQ ID NO: 6973376 - DNA, 22 bp, Homo sapiens
ccaggctagagtgcagtggcgt

SEQ ID NO: 6973377 - DNA, 22 bp, Homo sapiens
ccaggctggagtgcaatggcgt

SEQ ID NO: 6973378 - DNA, 22 bp, Homo sapiens
agtgtctgccagctgccaggtg

SEQ ID NO: 6973379 - DNA, 22 bp, Homo sapiens
gtgaaagtaagaaagtaggact

SEQ ID NO: 6973380 - DNA, 22 bp, Homo sapiens
attaatgacgcagataataatt

SEQ ID NO: 6973381 - DNA, 22 bp, Homo sapiens
tgcttccctgctctgcacacct

SEQ ID NO: 6973382 - DNA, 22 bp, Homo sapiens
atggctctttattctgctgcat

SEQ ID NO: 6973383 - DNA, 22 bp, Homo sapiens
gcagcatgttgaaagggccaca

SEQ ID NO: 6973384 - DNA, 19 bp, Homo sapiens
ggccttggggtcccaaagt

SEQ ID NO: 6973385 - DNA, 22 bp, Homo sapiens
acacagagtggtttgtagaata

SEQ ID NO: 6973386 - DNA, 22 bp, Homo sapiens
tcttaaaccacacatgtgctct

SEQ ID NO: 6973387 - DNA, 22 bp, Homo sapiens
gtacagctaagaatttcatctt

SEQ ID NO: 6973388 - DNA, 19 bp, Homo sapiens
tccagcagtgcttgaaatc

SEQ ID NO: 6973389 - DNA, 22 bp, Homo sapiens
ttttcaccagcttgctacaatt

SEQ ID NO: 6973390 - DNA, 22 bp, Homo sapiens
aattcagtggtttctgcaacaa

SEQ ID NO: 6973391 - DNA, 22 bp, Homo sapiens
aggggagccagggctgcgagtt

SEQ ID NO: 6973392 - DNA, 22 bp, Homo sapiens
gggagcactgagaggcaggtag

SEQ ID NO: 6973393 - DNA, 19 bp, Homo sapiens
tttgtcatggtgagttgtt

SEQ ID NO: 6973394 - DNA, 22 bp, Homo sapiens
aggcttgcagtgaatatgacca

SEQ ID NO: 6973395 - DNA, 22 bp, Homo sapiens
taaattatggctggcagagcag

SEQ ID NO: 6973396 - DNA, 22 bp, Homo sapiens
gtacaggccaccactgaatttt

SEQ ID NO: 6973397 - DNA, 22 bp, Homo sapiens
taggaagtctgtgatgttgttt

SEQ ID NO: 6973398 - DNA, 22 bp, Homo sapiens
tcaatactaatcttgctggaag

SEQ ID NO: 6973399 - DNA, 22 bp, Homo sapiens
tccagggccaagtcatggaacc

SEQ ID NO: 6973400 - DNA, 20 bp, Homo sapiens
cccacacccttcccacttgg

SEQ ID NO: 6973401 - DNA, 22 bp, Homo sapiens
ttggtacaaaagtaactgtggt

SEQ ID NO: 6973402 - DNA, 22 bp, Homo sapiens
attggtcagccacgtagggaat

SEQ ID NO: 6973403 - DNA, 22 bp, Homo sapiens
tgatcattatcaaactggtcat

SEQ ID NO: 6973404 - DNA, 22 bp, Homo sapiens
agcttcagggacttgtggcaga

SEQ ID NO: 6973405 - DNA, 22 bp, Homo sapiens
agccacagcctgacttaactgt

SEQ ID NO: 6973406 - DNA, 20 bp, Homo sapiens
atagtaatgaagtcttgttc

SEQ ID NO: 6973407 - DNA, 22 bp, Homo sapiens
agtagaatagatggatactatt

SEQ ID NO: 6973408 - DNA, 22 bp, Homo sapiens
ctggagtgcagtggcatgatca

SEQ ID NO: 6973409 - DNA, 22 bp, Homo sapiens
tagtttagtaagaggagagctg

SEQ ID NO: 6973410 - DNA, 22 bp, Homo sapiens
ctaggctggagtgcagtggcat

SEQ ID NO: 6973411 - DNA, 22 bp, Homo sapiens
attcataagtaaatgattacct

SEQ ID NO: 6973412 - DNA, 22 bp, Homo sapiens
ttccctgatggccccaaggata

SEQ ID NO: 6973413 - DNA, 22 bp, Homo sapiens
atctacaacgggtggagtaggg

SEQ ID NO: 6973414 - DNA, 22 bp, Homo sapiens
tggacagtgcagatacagaatg

SEQ ID NO: 6973415 - DNA, 22 bp, Homo sapiens
tggaggtgtataaggtagcttc

SEQ ID NO: 6973416 - DNA, 22 bp, Homo sapiens
agtgacatttgcaccagctgct

SEQ ID NO: 6973417 - DNA, 22 bp, Homo sapiens
tctctacaaaaattagcatgca

SEQ ID NO: 6973418 - DNA, 22 bp, Homo sapiens
atgaatccagcaaacagtgagg

SEQ ID NO: 6973419 - DNA, 22 bp, Homo sapiens
gagtccttttcatagcagtggg

SEQ ID NO: 6973420 - DNA, 22 bp, Homo sapiens
gtagtgggtgaggaaggaagga

SEQ ID NO: 6973421 - DNA, 22 bp, Homo sapiens
tgggcagcagaaccaggccgac

SEQ ID NO: 6973422 - DNA, 22 bp, Homo sapiens
gaggtggttcaggtagagccca

SEQ ID NO: 6973423 - DNA, 22 bp, Homo sapiens
ggctcacgcaattatcccggcc

SEQ ID NO: 6973424 - DNA, 22 bp, Homo sapiens
catcatctctggcccttgaagt

SEQ ID NO: 6973425 - DNA, 22 bp, Homo sapiens
gtctagagcctgatgaggatga

SEQ ID NO: 6973426 - DNA, 23 bp, Homo sapiens
gcccacattggtgcatgaatgtt

SEQ ID NO: 6973427 - DNA, 22 bp, Homo sapiens
cttcaatacctgcgttgctagt

SEQ ID NO: 6973428 - DNA, 22 bp, Homo sapiens
aggtgtcactttatgttcagtg

SEQ ID NO: 6973429 - DNA, 22 bp, Homo sapiens
ttagggaagtgttattctcagg

SEQ ID NO: 6973430 - DNA, 22 bp, Homo sapiens
agaaatcattttaggcttgatg

SEQ ID NO: 6973431 - DNA, 22 bp, Homo sapiens
gctgtgcagtgggagttcggtg

SEQ ID NO: 6973432 - DNA, 22 bp, Homo sapiens
ctcagcagtaaacgtccggaac

SEQ ID NO: 6973433 - DNA, 22 bp, Homo sapiens
ccaggagatttttccatagcac

SEQ ID NO: 6973434 - DNA, 19 bp, Homo sapiens
caaggccaccatttctccg

SEQ ID NO: 6973435 - DNA, 22 bp, Homo sapiens
tcacagtatcacacaaggatta

SEQ ID NO: 6973436 - DNA, 22 bp, Homo sapiens
gaagtctgtgggttcaaaggca

SEQ ID NO: 6973437 - DNA, 22 bp, Homo sapiens
actctaatgctaatagtatttt

SEQ ID NO: 6973438 - DNA, 20 bp, Homo sapiens
ccaccctgctaagaatacac

SEQ ID NO: 6973439 - DNA, 22 bp, Homo sapiens
actttcttctactacttggaga

SEQ ID NO: 6973440 - DNA, 22 bp, Homo sapiens
actctgcttccacttttgctaa

SEQ ID NO: 6973441 - DNA, 19 bp, Homo sapiens
gcagggtgttgactgtccc

SEQ ID NO: 6973442 - DNA, 22 bp, Homo sapiens
gaggccaagggagaagatctct

SEQ ID NO: 6973443 - DNA, 22 bp, Homo sapiens
gcaatcaatgatttatatttgt

SEQ ID NO: 6973444 - DNA, 22 bp, Homo sapiens
caggcagctcgatgccttgttg

SEQ ID NO: 6973445 - DNA, 22 bp, Homo sapiens
gcacattgcttgcccattgtaa

SEQ ID NO: 6973446 - DNA, 22 bp, Homo sapiens
agcatttattgagtgccctggg

SEQ ID NO: 6973447 - DNA, 22 bp, Homo sapiens
ggaggtgggagtttagttcttg

SEQ ID NO: 6973448 - DNA, 22 bp, Homo sapiens
gccagccttctgtggcctgcaa

SEQ ID NO: 6973449 - DNA, 22 bp, Homo sapiens
tggtataagtaatcataattgc

SEQ ID NO: 6973450 - DNA, 22 bp, Homo sapiens
tatttggacaccaagtagaagt

SEQ ID NO: 6973451 - DNA, 22 bp, Homo sapiens
ggctcctggaggcaccactggt

SEQ ID NO: 6973452 - DNA, 20 bp, Homo sapiens
gctgttcacattattagtag

SEQ ID NO: 6973453 - DNA, 22 bp, Homo sapiens
aacttgcagggatgttctgaat

SEQ ID NO: 6973454 - DNA, 22 bp, Homo sapiens
catctcctttggtctacttcca

SEQ ID NO: 6973455 - DNA, 22 bp, Homo sapiens
ttccatgacaccgagggaagtc

SEQ ID NO: 6973456 - DNA, 22 bp, Homo sapiens
atctgtaacacacagaggagaa

SEQ ID NO: 6973457 - DNA, 21 bp, Homo sapiens
gttattggttacactgcactt

SEQ ID NO: 6973458 - DNA, 22 bp, Homo sapiens
ataatttactaagctctacctt

SEQ ID NO: 6973459 - DNA, 22 bp, Homo sapiens
caggctgcagcagcagtggccc

SEQ ID NO: 6973460 - DNA, 22 bp, Homo sapiens
tcctgggaggcggaggttgcag

SEQ ID NO: 6973461 - DNA, 22 bp, Homo sapiens
agttgggaagtatttttagtgg

SEQ ID NO: 6973462 - DNA, 22 bp, Homo sapiens
cacacagatggtaagggaggga

SEQ ID NO: 6973463 - DNA, 23 bp, Homo sapiens
cctccatggtaagaagcttagag

SEQ ID NO: 6973464 - DNA, 22 bp, Homo sapiens
tggcgcaactcattcatggtgt

SEQ ID NO: 6973465 - DNA, 22 bp, Homo sapiens
ccactgtctgcaggcctcagca

SEQ ID NO: 6973466 - DNA, 22 bp, Homo sapiens
gggctagaaattctgcagtgga

SEQ ID NO: 6973467 - DNA, 18 bp, Homo sapiens
caaagcaggtgacagtgt

SEQ ID NO: 6973468 - DNA, 22 bp, Homo sapiens
gtgtgctagctgcttcacacag

SEQ ID NO: 6973469 - DNA, 19 bp, Homo sapiens
agacacacttacgtggaat

SEQ ID NO: 6973470 - DNA, 22 bp, Homo sapiens
ccagaggagttgaggctttggg

SEQ ID NO: 6973471 - DNA, 22 bp, Homo sapiens
atgaccagtttccccactgtcc

SEQ ID NO: 6973472 - DNA, 22 bp, Homo sapiens
ctccaggggccagaagcctggc

SEQ ID NO: 6973473 - DNA, 22 bp, Homo sapiens
agcaaataaagacaattatgtc

SEQ ID NO: 6973474 - DNA, 22 bp, Homo sapiens
ggctctgacctcccaggcagtt

SEQ ID NO: 6973475 - DNA, 22 bp, Homo sapiens
agctgaatctcaggcatccttt

SEQ ID NO: 6973476 - DNA, 19 bp, Homo sapiens
accaggagtatcagagctg

SEQ ID NO: 6973477 - DNA, 22 bp, Homo sapiens
taatttctaattcattttcagt

SEQ ID NO: 6973478 - DNA, 23 bp, Homo sapiens
ttcctgagtgctggagagagtgc

SEQ ID NO: 6973479 - DNA, 22 bp, Homo sapiens
tagatcataaatactatggtgc

SEQ ID NO: 6973480 - DNA, 22 bp, Homo sapiens
cctgtttagtgaggtgaggagt

SEQ ID NO: 6973481 - DNA, 22 bp, Homo sapiens
attgtgtcctcattgaccttca

SEQ ID NO: 6973482 - DNA, 22 bp, Homo sapiens
cctggctctgcgtgcagctccg

SEQ ID NO: 6973483 - DNA, 20 bp, Homo sapiens
ttcacatttctgtagtgatt

SEQ ID NO: 6973484 - DNA, 22 bp, Homo sapiens
cgcaatcaagttttgagaccca

SEQ ID NO: 6973485 - DNA, 22 bp, Homo sapiens
aaaccattgcatctttcttaat

SEQ ID NO: 6973486 - DNA, 22 bp, Homo sapiens
tttccacccagagcatttgttt

SEQ ID NO: 6973487 - DNA, 22 bp, Homo sapiens
aacacattgccagagatcagca

SEQ ID NO: 6973488 - DNA, 22 bp, Homo sapiens
tatctagtttgtctagctttgc

SEQ ID NO: 6973489 - DNA, 22 bp, Homo sapiens
ccacagaattctgtctccagga

SEQ ID NO: 6973490 - DNA, 22 bp, Homo sapiens
gctggcatggagactctgggtc

SEQ ID NO: 6973491 - DNA, 22 bp, Homo sapiens
ccttatggccaacctttgcctt

SEQ ID NO: 6973492 - DNA, 22 bp, Homo sapiens
tgaccccactgtgctcagaggt

SEQ ID NO: 6973493 - DNA, 22 bp, Homo sapiens
taagttagagcacaattcttac

SEQ ID NO: 6973494 - DNA, 22 bp, Homo sapiens
tcccagcacgtctgctgtttct

SEQ ID NO: 6973495 - DNA, 23 bp, Homo sapiens
aggaagcccattttagtctacct

SEQ ID NO: 6973496 - DNA, 22 bp, Homo sapiens
gttttctaagtaggtagcacca

SEQ ID NO: 6973497 - DNA, 22 bp, Homo sapiens
gcctatatgttaataggaggga

SEQ ID NO: 6973498 - DNA, 22 bp, Homo sapiens
ggagaagggaactgagtttttg

SEQ ID NO: 6973499 - DNA, 22 bp, Homo sapiens
gggtatttgacaaactgacact

SEQ ID NO: 6973500 - DNA, 22 bp, Homo sapiens
cctgggactcggccaggacaga

SEQ ID NO: 6973501 - DNA, 22 bp, Homo sapiens
ctgggtgtcaggagacatgatg

SEQ ID NO: 6973502 - DNA, 22 bp, Homo sapiens
tacaaaggagaatagggtagca

SEQ ID NO: 6973503 - DNA, 22 bp, Homo sapiens
ctgtcctggagggcataggacg

SEQ ID NO: 6973504 - DNA, 22 bp, Homo sapiens
ggccatgggaagaggtggagag

SEQ ID NO: 6973505 - DNA, 22 bp, Homo sapiens
agagagctgactttggagtcag

SEQ ID NO: 6973506 - DNA, 22 bp, Homo sapiens
gcctgagagacccatggggcaa

SEQ ID NO: 6973507 - DNA, 22 bp, Homo sapiens
gaatgttagagattcttaggtt

SEQ ID NO: 6973508 - DNA, 22 bp, Homo sapiens
tctaatgcttgactgggggctt

SEQ ID NO: 6973509 - DNA, 22 bp, Homo sapiens
aactgtggagattcggaaggta

SEQ ID NO: 6973510 - DNA, 21 bp, Homo sapiens
tgacccttctagcagaacaca

SEQ ID NO: 6973511 - DNA, 22 bp, Homo sapiens
cagtacttatttctatttaggg

SEQ ID NO: 6973512 - DNA, 22 bp, Homo sapiens
tgaatatgctttgcaatcctaa

SEQ ID NO: 6973513 - DNA, 18 bp, Homo sapiens
gagaaagtttgggcagaa

SEQ ID NO: 6973514 - DNA, 22 bp, Homo sapiens
tgcttcaggaagaaacgccagg

SEQ ID NO: 6973515 - DNA, 22 bp, Homo sapiens
ggggaaggaaagttattagcag

SEQ ID NO: 6973516 - DNA, 22 bp, Homo sapiens
aggctaagatgtggtctgagca

SEQ ID NO: 6973517 - DNA, 22 bp, Homo sapiens
actcttttataaagcatcttga

SEQ ID NO: 6973518 - DNA, 22 bp, Homo sapiens
ggtggctctcaggcttctcgga

SEQ ID NO: 6973519 - DNA, 22 bp, Homo sapiens
taagtccttcacctaatcctca

SEQ ID NO: 6973520 - DNA, 22 bp, Homo sapiens
tgattacaacagagtcatccat

SEQ ID NO: 6973521 - DNA, 22 bp, Homo sapiens
tttctaagtgaacattcaagtt

SEQ ID NO: 6973522 - DNA, 22 bp, Homo sapiens
gacaggcaccttgtctgtcttg

SEQ ID NO: 6973523 - DNA, 21 bp, Homo sapiens
tgctccaggagggggcagtcc

SEQ ID NO: 6973524 - DNA, 22 bp, Homo sapiens
caggatgccttggacacccggt

SEQ ID NO: 6973525 - DNA, 22 bp, Homo sapiens
gctgaagataggcatttcagca

SEQ ID NO: 6973526 - DNA, 22 bp, Homo sapiens
tctgtcatcaaatatgctttct

SEQ ID NO: 6973527 - DNA, 22 bp, Homo sapiens
atgtcacagctcccattcctcc

SEQ ID NO: 6973528 - DNA, 22 bp, Homo sapiens
tatttgaataaaggataaggaa

SEQ ID NO: 6973529 - DNA, 22 bp, Homo sapiens
cagggctcgctgccagcttcag

SEQ ID NO: 6973530 - DNA, 22 bp, Homo sapiens
aggcctgggtgttcaccagaag

SEQ ID NO: 6973531 - DNA, 20 bp, Homo sapiens
tggctccagcctcccctacc

SEQ ID NO: 6973532 - DNA, 22 bp, Homo sapiens
tcttcacatggaacatgaagct

SEQ ID NO: 6973533 - DNA, 22 bp, Homo sapiens
ttatgctgttaggaaaatcaaa

SEQ ID NO: 6973534 - DNA, 22 bp, Homo sapiens
tgaggatgtctgtattttgcct

SEQ ID NO: 6973535 - DNA, 22 bp, Homo sapiens
cctttcaacaagatttctggcc

SEQ ID NO: 6973536 - DNA, 22 bp, Homo sapiens
ctcctcagctgggaggagtccc

SEQ ID NO: 6973537 - DNA, 22 bp, Homo sapiens
gcagtttgctggactaatgaag

SEQ ID NO: 6973538 - DNA, 22 bp, Homo sapiens
aatctgaatatttatgtgtatt

SEQ ID NO: 6973539 - DNA, 17 bp, Homo sapiens
tcttctcttccagtctt

SEQ ID NO: 6973540 - DNA, 22 bp, Homo sapiens
ggtaaattttatgtgatgaaac

SEQ ID NO: 6973541 - DNA, 22 bp, Homo sapiens
tccgtggggcctgtggcttccg

SEQ ID NO: 6973542 - DNA, 20 bp, Homo sapiens
acaaaataggtactgggtag

SEQ ID NO: 6973543 - DNA, 22 bp, Homo sapiens
tagacatttggcatggttttca

SEQ ID NO: 6973544 - DNA, 22 bp, Homo sapiens
ttgctgaaggcctcttggggtt

SEQ ID NO: 6973545 - DNA, 19 bp, Homo sapiens
agggcgtggtggcacatgt

SEQ ID NO: 6973546 - DNA, 22 bp, Homo sapiens
agtatgaaagttaatcaattta

SEQ ID NO: 6973547 - DNA, 23 bp, Homo sapiens
tgagcagctaaaggtgatgcggg

SEQ ID NO: 6973548 - DNA, 22 bp, Homo sapiens
agctggtgtcacctccagtcca

SEQ ID NO: 6973549 - DNA, 21 bp, Homo sapiens
atgcatgttccataaagtggg

SEQ ID NO: 6973550 - DNA, 22 bp, Homo sapiens
ccactactctctgagctttact

SEQ ID NO: 6973551 - DNA, 19 bp, Homo sapiens
aaatgctgtggagggctcc

SEQ ID NO: 6973552 - DNA, 22 bp, Homo sapiens
tggcttcagagacagaatctat

SEQ ID NO: 6973553 - DNA, 22 bp, Homo sapiens
gtctggctgttcctgcctgtga

SEQ ID NO: 6973554 - DNA, 22 bp, Homo sapiens
acactctttctgtgggtcacat

SEQ ID NO: 6973555 - DNA, 22 bp, Homo sapiens
gtttcctacactgtagtattat

SEQ ID NO: 6973556 - DNA, 22 bp, Homo sapiens
ttcagagagtccagtatgcagt

SEQ ID NO: 6973557 - DNA, 22 bp, Homo sapiens
ctggctgcaaaatctattcact

SEQ ID NO: 6973558 - DNA, 17 bp, Homo sapiens
agacagtgagtgccttg

SEQ ID NO: 6973559 - DNA, 22 bp, Homo sapiens
gctgtccaacctgcactcgcgt

SEQ ID NO: 6973560 - DNA, 22 bp, Homo sapiens
aaatggacattgggtgagctct

SEQ ID NO: 6973561 - DNA, 22 bp, Homo sapiens
tcacaagacagaaaacatttag

SEQ ID NO: 6973562 - DNA, 22 bp, Homo sapiens
tgagacagtatcgccccaaggc

SEQ ID NO: 6973563 - DNA, 22 bp, Homo sapiens
tttagtagaatagtatatcaaa

SEQ ID NO: 6973564 - DNA, 22 bp, Homo sapiens
gcggcggagacagcaggaagcc

SEQ ID NO: 6973565 - DNA, 22 bp, Homo sapiens
gtttcctatggctgctgcagga

SEQ ID NO: 6973566 - DNA, 22 bp, Homo sapiens
tgtagggactgaggctggagag

SEQ ID NO: 6973567 - DNA, 22 bp, Homo sapiens
aatgaatgaaccacatataaca

SEQ ID NO: 6973568 - DNA, 22 bp, Homo sapiens
gcacacatcttgtaatcctgag

SEQ ID NO: 6973569 - DNA, 23 bp, Homo sapiens
tatatgtctgtatcttaggttgc

SEQ ID NO: 6973570 - DNA, 22 bp, Homo sapiens
tgacaatgggtggacaagatag

SEQ ID NO: 6973571 - DNA, 22 bp, Homo sapiens
gagctaagaactgtgccaggtg

SEQ ID NO: 6973572 - DNA, 22 bp, Homo sapiens
gctagcctccattttattacta

SEQ ID NO: 6973573 - DNA, 22 bp, Homo sapiens
gccagagacacttggaggtaga

SEQ ID NO: 6973574 - DNA, 22 bp, Homo sapiens
ggcctgggcctttgtgttttga

SEQ ID NO: 6973575 - DNA, 22 bp, Homo sapiens
gccagtggcttgccaggcagga

SEQ ID NO: 6973576 - DNA, 22 bp, Homo sapiens
gtttccgccctgggcctgtggg

SEQ ID NO: 6973577 - DNA, 22 bp, Homo sapiens
ctggccagctgacagcagggct

SEQ ID NO: 6973578 - DNA, 22 bp, Homo sapiens
ggtttgcacgatatttccatgg

SEQ ID NO: 6973579 - DNA, 22 bp, Homo sapiens
tagagtgtaatacaaactaaac

SEQ ID NO: 6973580 - DNA, 22 bp, Homo sapiens
tgttaaggctcttgtttatgtc

SEQ ID NO: 6973581 - DNA, 22 bp, Homo sapiens
caacatggtaaaaccccgtctc

SEQ ID NO: 6973582 - DNA, 22 bp, Homo sapiens
gattccagcttggtatttactc

SEQ ID NO: 6973583 - DNA, 22 bp, Homo sapiens
atgtttccatagaagtcacagt

SEQ ID NO: 6973584 - DNA, 22 bp, Homo sapiens
ttagttatttttgtcctccaag

SEQ ID NO: 6973585 - DNA, 22 bp, Homo sapiens
tgtgcttctcacatcactgttg

SEQ ID NO: 6973586 - DNA, 20 bp, Homo sapiens
agtcattaaaaatggggcag

SEQ ID NO: 6973587 - DNA, 22 bp, Homo sapiens
aagcaagaggaaatgtggacct

SEQ ID NO: 6973588 - DNA, 23 bp, Homo sapiens
agtgtgtaaggtactttgctgct

SEQ ID NO: 6973589 - DNA, 22 bp, Homo sapiens
taattaacatacaaaacagctg

SEQ ID NO: 6973590 - DNA, 22 bp, Homo sapiens
gaaggggaaagttgagcaaata

SEQ ID NO: 6973591 - DNA, 22 bp, Homo sapiens
aagcagactgggccataaggaa

SEQ ID NO: 6973592 - DNA, 22 bp, Homo sapiens
aattcaaattacaatagttgtt

SEQ ID NO: 6973593 - DNA, 22 bp, Homo sapiens
cagcatccggcagcccgggcct

SEQ ID NO: 6973594 - DNA, 22 bp, Homo sapiens
tggagtcacagtgacctgagtc

SEQ ID NO: 6973595 - DNA, 22 bp, Homo sapiens
ccacagtgttttgtcacattag

SEQ ID NO: 6973596 - DNA, 22 bp, Homo sapiens
aggcatggcatggggcagatgt

SEQ ID NO: 6973597 - DNA, 22 bp, Homo sapiens
ttgcattgatgtctatacgctg

SEQ ID NO: 6973598 - DNA, 22 bp, Homo sapiens
cctgtgaacttgcatgagtttt

SEQ ID NO: 6973599 - DNA, 22 bp, Homo sapiens
aaacctctgtgctatgacaccc

SEQ ID NO: 6973600 - DNA, 22 bp, Homo sapiens
cccaggagacctagatctgttt

SEQ ID NO: 6973601 - DNA, 22 bp, Homo sapiens
aactctgcagtgacttataaag

SEQ ID NO: 6973602 - DNA, 22 bp, Homo sapiens
atttagaactttgtttgccaat

SEQ ID NO: 6973603 - DNA, 22 bp, Homo sapiens
cttcagagagtccagggactgc

SEQ ID NO: 6973604 - DNA, 22 bp, Homo sapiens
ctggagtaagttaagatgttcc

SEQ ID NO: 6973605 - DNA, 22 bp, Homo sapiens
ttctgggctaccttcccggcag

SEQ ID NO: 6973606 - DNA, 18 bp, Homo sapiens
gaggcgagctcttcagaa

SEQ ID NO: 6973607 - DNA, 22 bp, Homo sapiens
tgccaaaatggccaaaagctag

SEQ ID NO: 6973608 - DNA, 22 bp, Homo sapiens
tgtacaaaggtactttgatgtt

SEQ ID NO: 6973609 - DNA, 22 bp, Homo sapiens
ccagccctgcctctcagggccc

SEQ ID NO: 6973610 - DNA, 22 bp, Homo sapiens
agaaggtggctactcagtcatc

SEQ ID NO: 6973611 - DNA, 22 bp, Homo sapiens
agttattaagtcctgttttgag

SEQ ID NO: 6973612 - DNA, 22 bp, Homo sapiens
acattcccttggcttgaagcag

SEQ ID NO: 6973613 - DNA, 22 bp, Homo sapiens
ttattcacctctattagactca

SEQ ID NO: 6973614 - DNA, 22 bp, Homo sapiens
ggtggccttggacaagtaacct

SEQ ID NO: 6973615 - DNA, 22 bp, Homo sapiens
aaggcagatataaagactagag

SEQ ID NO: 6973616 - DNA, 22 bp, Homo sapiens
gcctgaatctgatgaatgatct

SEQ ID NO: 6973617 - DNA, 22 bp, Homo sapiens
ctctgccaagatgacaggtaag

SEQ ID NO: 6973618 - DNA, 22 bp, Homo sapiens
gtggtcatgttaattatgatcc

SEQ ID NO: 6973619 - DNA, 22 bp, Homo sapiens
ggccagctcagtctccatcagg

SEQ ID NO: 6973620 - DNA, 22 bp, Homo sapiens
tcagatttatgaatatactatg

SEQ ID NO: 6973621 - DNA, 22 bp, Homo sapiens
ttgaggagttaggatgtttata

SEQ ID NO: 6973622 - DNA, 22 bp, Homo sapiens
ttcagaatgatttcagcgagca

SEQ ID NO: 6973623 - DNA, 22 bp, Homo sapiens
ggttattgtttatagagcataa

SEQ ID NO: 6973624 - DNA, 22 bp, Homo sapiens
ccagctgctgtgaggaccacag

SEQ ID NO: 6973625 - DNA, 22 bp, Homo sapiens
aagccctggggttgcacaaggc

SEQ ID NO: 6973626 - DNA, 22 bp, Homo sapiens
aaagttctggagaaaataatga

SEQ ID NO: 6973627 - DNA, 22 bp, Homo sapiens
ttgacatcaaatagatatcttt

SEQ ID NO: 6973628 - DNA, 22 bp, Homo sapiens
gctcaggagctgacagcctcaa

SEQ ID NO: 6973629 - DNA, 22 bp, Homo sapiens
ggggcttttgcacgtgggaggc

SEQ ID NO: 6973630 - DNA, 22 bp, Homo sapiens
catacattgaaggagaaaggaa

SEQ ID NO: 6973631 - DNA, 22 bp, Homo sapiens
ccctctgcatacaggcgaggag

SEQ ID NO: 6973632 - DNA, 22 bp, Homo sapiens
tcaggtgttagaagaaatttca

SEQ ID NO: 6973633 - DNA, 22 bp, Homo sapiens
agcctctgcacttcttacaggt

SEQ ID NO: 6973634 - DNA, 22 bp, Homo sapiens
agcctggagaggcgccatacac

SEQ ID NO: 6973635 - DNA, 22 bp, Homo sapiens
tttgaagttcccccatatcaga

SEQ ID NO: 6973636 - DNA, 22 bp, Homo sapiens
atcagtatcctgcagtttctat

SEQ ID NO: 6973637 - DNA, 22 bp, Homo sapiens
tgaatctcagttctgtgtaacc

SEQ ID NO: 6973638 - DNA, 22 bp, Homo sapiens
ctgctgttaggttggtgcaaaa

SEQ ID NO: 6973639 - DNA, 22 bp, Homo sapiens
tacttggtttagtttggaggga

SEQ ID NO: 6973640 - DNA, 22 bp, Homo sapiens
ctgaggggtcgtgggagcccag

SEQ ID NO: 6973641 - DNA, 22 bp, Homo sapiens
aaacagttaattgctttcagtt

SEQ ID NO: 6973642 - DNA, 22 bp, Homo sapiens
tccagcccgagggcgctgatga

SEQ ID NO: 6973643 - DNA, 19 bp, Homo sapiens
atccaggtcatgtagttct

SEQ ID NO: 6973644 - DNA, 22 bp, Homo sapiens
ggccctgcaaggtacccaggcc

SEQ ID NO: 6973645 - DNA, 22 bp, Homo sapiens
tctgccaggcctgcttccgggg

SEQ ID NO: 6973646 - DNA, 22 bp, Homo sapiens
agtaccattccgttggagctgg

SEQ ID NO: 6973647 - DNA, 22 bp, Homo sapiens
tagagtcagagaatcattacag

SEQ ID NO: 6973648 - DNA, 22 bp, Homo sapiens
tttggctctgtgtcttcaccca

SEQ ID NO: 6973649 - DNA, 22 bp, Homo sapiens
caggccctttcctgggcatagg

SEQ ID NO: 6973650 - DNA, 22 bp, Homo sapiens
tgtctgagactgttttactttc

SEQ ID NO: 6973651 - DNA, 22 bp, Homo sapiens
aaccatttgccattatcttaag

SEQ ID NO: 6973652 - DNA, 22 bp, Homo sapiens
ttctccctgccaaagctgcctc

SEQ ID NO: 6973653 - DNA, 22 bp, Homo sapiens
atctgccccagtgatgggccat

SEQ ID NO: 6973654 - DNA, 22 bp, Homo sapiens
tgggctctggggaaactgtgat

SEQ ID NO: 6973655 - DNA, 22 bp, Homo sapiens
cactgactaggtcggtgacctc

SEQ ID NO: 6973656 - DNA, 23 bp, Homo sapiens
tggccctgaatctgtcctggagg

SEQ ID NO: 6973657 - DNA, 22 bp, Homo sapiens
gctgaagcccacgtggcttgta

SEQ ID NO: 6973658 - DNA, 22 bp, Homo sapiens
aaggaatcacttctttaaatga

SEQ ID NO: 6973659 - DNA, 22 bp, Homo sapiens
ctgagctgagccaaatctgtct

SEQ ID NO: 6973660 - DNA, 22 bp, Homo sapiens
aggaagatgtgtttagcaggtt

SEQ ID NO: 6973661 - DNA, 19 bp, Homo sapiens
ccaggcctggcgtctccgc

SEQ ID NO: 6973662 - DNA, 22 bp, Homo sapiens
ccccaccaccaaggctcagttt

SEQ ID NO: 6973663 - DNA, 22 bp, Homo sapiens
ttctacatggaagagccttctt

SEQ ID NO: 6973664 - DNA, 22 bp, Homo sapiens
agagcgagtctggggctcggat

SEQ ID NO: 6973665 - DNA, 22 bp, Homo sapiens
acccgtggttttatactacttc

SEQ ID NO: 6973666 - DNA, 22 bp, Homo sapiens
tattatggttgtaggttaacaa

SEQ ID NO: 6973667 - DNA, 22 bp, Homo sapiens
gtgcctgggacttgctccggat

SEQ ID NO: 6973668 - DNA, 22 bp, Homo sapiens
ctttgctgagctggttgttcaa

SEQ ID NO: 6973669 - DNA, 22 bp, Homo sapiens
aaggaggccctctccttctgga

SEQ ID NO: 6973670 - DNA, 22 bp, Homo sapiens
aaatgctagaacattttaaagg

SEQ ID NO: 6973671 - DNA, 22 bp, Homo sapiens
tccagtttccaatcactgcacg

SEQ ID NO: 6973672 - DNA, 22 bp, Homo sapiens
cagaaaccaaatgggatgggga

SEQ ID NO: 6973673 - DNA, 22 bp, Homo sapiens
ttacttgatagggggatggggt

SEQ ID NO: 6973674 - DNA, 22 bp, Homo sapiens
ggatgcaggggcagcagagcct

SEQ ID NO: 6973675 - DNA, 22 bp, Homo sapiens
gcagagttcagtgacttggcct

SEQ ID NO: 6973676 - DNA, 22 bp, Homo sapiens
aggcagaagccagccagggtcc

SEQ ID NO: 6973677 - DNA, 20 bp, Homo sapiens
cacagactgtatgggcacca

SEQ ID NO: 6973678 - DNA, 22 bp, Homo sapiens
actggctctgcatttttggctc

SEQ ID NO: 6973679 - DNA, 22 bp, Homo sapiens
ctggggactgaaggatgttgct

SEQ ID NO: 6973680 - DNA, 22 bp, Homo sapiens
ctggctttaggttggagagctg

SEQ ID NO: 6973681 - DNA, 22 bp, Homo sapiens
accagtaggagttggagaggaa

SEQ ID NO: 6973682 - DNA, 22 bp, Homo sapiens
gcatcagttactaggagggaaa

SEQ ID NO: 6973683 - DNA, 22 bp, Homo sapiens
gcctccctggcccacagcagcg

SEQ ID NO: 6973684 - DNA, 22 bp, Homo sapiens
tgcaaacatccgactgaaagcc

SEQ ID NO: 6973685 - DNA, 19 bp, Homo sapiens
ggaccagctttcaggaggc

SEQ ID NO: 6973686 - DNA, 22 bp, Homo sapiens
ctccaaggagaaatgggcaaca

SEQ ID NO: 6973687 - DNA, 22 bp, Homo sapiens
atggctggtttgagctttagca

SEQ ID NO: 6973688 - DNA, 22 bp, Homo sapiens
acagtacaccactgtgtacagt

SEQ ID NO: 6973689 - DNA, 22 bp, Homo sapiens
gaggcctggtagccgagcccca

SEQ ID NO: 6973690 - DNA, 22 bp, Homo sapiens
ttttaatcatgcttctatgtcc

SEQ ID NO: 6973691 - DNA, 22 bp, Homo sapiens
taaatactgagttggagttggc

SEQ ID NO: 6973692 - DNA, 22 bp, Homo sapiens
tgggcctggccctgtggaggag

SEQ ID NO: 6973693 - DNA, 22 bp, Homo sapiens
agaatttatgacaacgatagcc

SEQ ID NO: 6973694 - DNA, 22 bp, Homo sapiens
tttggtgttggcttaaccagtt

SEQ ID NO: 6973695 - DNA, 22 bp, Homo sapiens
atgcatatgtgtgcacacgtgt

SEQ ID NO: 6973696 - DNA, 22 bp, Homo sapiens
ccacagaaaataaagcacgatt

SEQ ID NO: 6973697 - DNA, 22 bp, Homo sapiens
tgggctggtgagggatcattta

SEQ ID NO: 6973698 - DNA, 20 bp, Homo sapiens
ctgttaaaaggtatgaattc

SEQ ID NO: 6973699 - DNA, 22 bp, Homo sapiens
atactgttttgtgacttatctt

SEQ ID NO: 6973700 - DNA, 22 bp, Homo sapiens
taacttcaagtctgtggatcag

SEQ ID NO: 6973701 - DNA, 22 bp, Homo sapiens
ttaggaaggacttggattctgg

SEQ ID NO: 6973702 - DNA, 22 bp, Homo sapiens
aacttttaaaatacacagacaa

SEQ ID NO: 6973703 - DNA, 22 bp, Homo sapiens
atgtaaactactgactacacta

SEQ ID NO: 6973704 - DNA, 22 bp, Homo sapiens
cttggaaaggaatcttttacca

SEQ ID NO: 6973705 - DNA, 22 bp, Homo sapiens
attttcagtctggctggaccca

SEQ ID NO: 6973706 - DNA, 22 bp, Homo sapiens
atcactgcacacctgaggtata

SEQ ID NO: 6973707 - DNA, 22 bp, Homo sapiens
gtgccagtctctgagttaggac

SEQ ID NO: 6973708 - DNA, 22 bp, Homo sapiens
ggaaacttggcataattttaag

SEQ ID NO: 6973709 - DNA, 22 bp, Homo sapiens
acatacttatgtgtatatgtgt

SEQ ID NO: 6973710 - DNA, 20 bp, Homo sapiens
tgtttactctagagggtaga

SEQ ID NO: 6973711 - DNA, 20 bp, Homo sapiens
ttgggccacactgattcagc

SEQ ID NO: 6973712 - DNA, 22 bp, Homo sapiens
tagagtatataggcctttgtgt

SEQ ID NO: 6973713 - DNA, 22 bp, Homo sapiens
gatttcagtggctgtctcaaat

SEQ ID NO: 6973714 - DNA, 22 bp, Homo sapiens
tgtatacacgtaccttttcttt

SEQ ID NO: 6973715 - DNA, 20 bp, Homo sapiens
gctgcggttacagagacaca

SEQ ID NO: 6973716 - DNA, 22 bp, Homo sapiens
atagatgttttagtaatactgt

SEQ ID NO: 6973717 - DNA, 22 bp, Homo sapiens
cagtgctgttaataaacacaaa

SEQ ID NO: 6973718 - DNA, 22 bp, Homo sapiens
tttggctacttgatattctgaa

SEQ ID NO: 6973719 - DNA, 22 bp, Homo sapiens
ccctccagtgtcccagtgggga

SEQ ID NO: 6973720 - DNA, 22 bp, Homo sapiens
atactgtgtaaaatttgaacct

SEQ ID NO: 6973721 - DNA, 22 bp, Homo sapiens
gcagggctcagccgctcccacc

SEQ ID NO: 6973722 - DNA, 23 bp, Homo sapiens
gccatgagttccctttcacttgt

SEQ ID NO: 6973723 - DNA, 22 bp, Homo sapiens
ggtcagccttggatttggtagc

SEQ ID NO: 6973724 - DNA, 22 bp, Homo sapiens
ctggctttaatgtcatctttct

SEQ ID NO: 6973725 - DNA, 22 bp, Homo sapiens
atgctttaaactataaatccac

SEQ ID NO: 6973726 - DNA, 22 bp, Homo sapiens
ctagccagatttaaagagagac

SEQ ID NO: 6973727 - DNA, 22 bp, Homo sapiens
gctgagggaccatgtttcagga

SEQ ID NO: 6973728 - DNA, 22 bp, Homo sapiens
tcagaggatagaaatacttatt

SEQ ID NO: 6973729 - DNA, 21 bp, Homo sapiens
aggggacagagtagctccagg

SEQ ID NO: 6973730 - DNA, 22 bp, Homo sapiens
ttcagcactgactgagtggtta

SEQ ID NO: 6973731 - DNA, 22 bp, Homo sapiens
ttctttggggaatattctggtt

SEQ ID NO: 6973732 - DNA, 22 bp, Homo sapiens
acttcacaggttttcataaaac

SEQ ID NO: 6973733 - DNA, 22 bp, Homo sapiens
taggaatggaacactttgattt

SEQ ID NO: 6973734 - DNA, 22 bp, Homo sapiens
tgggtttttgtttctctggtat

SEQ ID NO: 6973735 - DNA, 22 bp, Homo sapiens
ggcctgtgtcggccccgggttc

SEQ ID NO: 6973736 - DNA, 22 bp, Homo sapiens
caggaccccatattcactgaac

SEQ ID NO: 6973737 - DNA, 22 bp, Homo sapiens
cagcattgagcacagaaggaaa

SEQ ID NO: 6973738 - DNA, 22 bp, Homo sapiens
ttcttaaagaggcaaaacacag

SEQ ID NO: 6973739 - DNA, 22 bp, Homo sapiens
aggctcctgggtgtggccgcca

SEQ ID NO: 6973740 - DNA, 22 bp, Homo sapiens
ttggctatgcttgtgttcagtt

SEQ ID NO: 6973741 - DNA, 22 bp, Homo sapiens
tcaggtcatctgtctctgggct

SEQ ID NO: 6973742 - DNA, 22 bp, Homo sapiens
ttggcagtagtctcggctaccc

SEQ ID NO: 6973743 - DNA, 22 bp, Homo sapiens
ctgaaagagccccaggggcctg

SEQ ID NO: 6973744 - DNA, 22 bp, Homo sapiens
tttcttgaagtcctaaccctca

SEQ ID NO: 6973745 - DNA, 22 bp, Homo sapiens
acagtacctgctctcaagcaaa

SEQ ID NO: 6973746 - DNA, 22 bp, Homo sapiens
ccctgaggatgtctccttcctg

SEQ ID NO: 6973747 - DNA, 21 bp, Homo sapiens
ctaactttgagtcctggcccc

SEQ ID NO: 6973748 - DNA, 22 bp, Homo sapiens
gagcagaacaggccgggtggga

SEQ ID NO: 6973749 - DNA, 22 bp, Homo sapiens
tttgtaacctaaagcaccagat

SEQ ID NO: 6973750 - DNA, 22 bp, Homo sapiens
gcaacattgcttctgaacatag

SEQ ID NO: 6973751 - DNA, 22 bp, Homo sapiens
tgggctccttgggagcaagtga

SEQ ID NO: 6973752 - DNA, 22 bp, Homo sapiens
cctggagcatcaggaggaaggg

SEQ ID NO: 6973753 - DNA, 22 bp, Homo sapiens
ttaatcttatatgtaaaggtaa

SEQ ID NO: 6973754 - DNA, 22 bp, Homo sapiens
ttattacagtcccagggagtag

SEQ ID NO: 6973755 - DNA, 22 bp, Homo sapiens
gcagcagccgacatggattgca

SEQ ID NO: 6973756 - DNA, 22 bp, Homo sapiens
acttagaagatgcagtaaagca

SEQ ID NO: 6973757 - DNA, 19 bp, Homo sapiens
ttccaaggcatttctttgc

SEQ ID NO: 6973758 - DNA, 22 bp, Homo sapiens
gaaaggccagctcacagatgag

SEQ ID NO: 6973759 - DNA, 23 bp, Homo sapiens
ccctaactaattctagggcctaa

SEQ ID NO: 6973760 - DNA, 22 bp, Homo sapiens
tcaggaaattaaacacttgaaa

SEQ ID NO: 6973761 - DNA, 22 bp, Homo sapiens
taatcctgatcaattttagctt

SEQ ID NO: 6973762 - DNA, 22 bp, Homo sapiens
ttgctggggtgtgaaatctgat

SEQ ID NO: 6973763 - DNA, 22 bp, Homo sapiens
tttcagagttagtagagcatgt

SEQ ID NO: 6973764 - DNA, 22 bp, Homo sapiens
tgaaccttttgaataaggacca

SEQ ID NO: 6973765 - DNA, 22 bp, Homo sapiens
tgggcaggtgctattttccatg

SEQ ID NO: 6973766 - DNA, 22 bp, Homo sapiens
ggctctggtgtgaagcagcctc

SEQ ID NO: 6973767 - DNA, 22 bp, Homo sapiens
tagatgcttgcagacagaatga

SEQ ID NO: 6973768 - DNA, 22 bp, Homo sapiens
tagcatcttgatttcagaccag

SEQ ID NO: 6973769 - DNA, 22 bp, Homo sapiens
gagctccagagttagacacccg

SEQ ID NO: 6973770 - DNA, 22 bp, Homo sapiens
aaaggttattattactattgtc

SEQ ID NO: 6973771 - DNA, 22 bp, Homo sapiens
gtcctggcccaggagtacacat

SEQ ID NO: 6973772 - DNA, 22 bp, Homo sapiens
cttgtaatagataggatcaaat

SEQ ID NO: 6973773 - DNA, 22 bp, Homo sapiens
gccctgagccaccaatgccatt

SEQ ID NO: 6973774 - DNA, 22 bp, Homo sapiens
ccagaagtcaagtaagatgaag

SEQ ID NO: 6973775 - DNA, 22 bp, Homo sapiens
gggagacaaaggtgaggttctt

SEQ ID NO: 6973776 - DNA, 22 bp, Homo sapiens
taaggccattatggtgggcccg

SEQ ID NO: 6973777 - DNA, 22 bp, Homo sapiens
gaggtgtcctagaagtattcag

SEQ ID NO: 6973778 - DNA, 20 bp, Homo sapiens
tttccactgtaatgtatgat

SEQ ID NO: 6973779 - DNA, 22 bp, Homo sapiens
ttttgcctgcactgtatatata

SEQ ID NO: 6973780 - DNA, 22 bp, Homo sapiens
tgcagggattagaggccgggga

SEQ ID NO: 6973781 - DNA, 22 bp, Homo sapiens
ttataagagtatatagtgtact

SEQ ID NO: 6973782 - DNA, 22 bp, Homo sapiens
gctgacagttactgctgtaaca

SEQ ID NO: 6973783 - DNA, 22 bp, Homo sapiens
tccatctgtcaaatatcatgct

SEQ ID NO: 6973784 - DNA, 22 bp, Homo sapiens
ggccatttttactttgggacag

SEQ ID NO: 6973785 - DNA, 22 bp, Homo sapiens
ttccaagtgtcagatcagattt

SEQ ID NO: 6973786 - DNA, 22 bp, Homo sapiens
tgcaggagagctggtctggccc

SEQ ID NO: 6973787 - DNA, 22 bp, Homo sapiens
gctaacagcaggttccgggctc

SEQ ID NO: 6973788 - DNA, 22 bp, Homo sapiens
cgcattagagctttgaacttct

SEQ ID NO: 6973789 - DNA, 22 bp, Homo sapiens
gtttccagagggaatatttgct

SEQ ID NO: 6973790 - DNA, 23 bp, Homo sapiens
tttgagcaaatcatacaaaggga

SEQ ID NO: 6973791 - DNA, 16 bp, Homo sapiens
agcaccagatcatatc

SEQ ID NO: 6973792 - DNA, 22 bp, Homo sapiens
ttcagtttgtttgactgttaga

SEQ ID NO: 6973793 - DNA, 22 bp, Homo sapiens
ttgctctatcacagtgatggga

SEQ ID NO: 6973794 - DNA, 22 bp, Homo sapiens
agcagggaatagcggaaagaat

SEQ ID NO: 6973795 - DNA, 22 bp, Homo sapiens
ctgaaggacacgtgaggagcca

SEQ ID NO: 6973796 - DNA, 22 bp, Homo sapiens
acaggcaggcttcggccagagc

SEQ ID NO: 6973797 - DNA, 22 bp, Homo sapiens
ccagccttccagccaatggctg

SEQ ID NO: 6973798 - DNA, 22 bp, Homo sapiens
atctttactttcagtgctgagc

SEQ ID NO: 6973799 - DNA, 22 bp, Homo sapiens
tgtcccaaccctgagaagattc

SEQ ID NO: 6973800 - DNA, 22 bp, Homo sapiens
tctgtggctggagaacttgtct

SEQ ID NO: 6973801 - DNA, 22 bp, Homo sapiens
atgtgtcctctggcaggtttag

SEQ ID NO: 6973802 - DNA, 22 bp, Homo sapiens
tctcaatattatatgtcataaa

SEQ ID NO: 6973803 - DNA, 22 bp, Homo sapiens
taatctcttttaggacagagcc

SEQ ID NO: 6973804 - DNA, 22 bp, Homo sapiens
cctttgcattatccttgattga

SEQ ID NO: 6973805 - DNA, 22 bp, Homo sapiens
gccagctggtaggcacctagcc

SEQ ID NO: 6973806 - DNA, 22 bp, Homo sapiens
acagtggaaatgtgggagggga

SEQ ID NO: 6973807 - DNA, 22 bp, Homo sapiens
tagcagaagttgcaaactaggg

SEQ ID NO: 6973808 - DNA, 22 bp, Homo sapiens
ggagctgttggcagctatcttg

SEQ ID NO: 6973809 - DNA, 22 bp, Homo sapiens
ctttgtccattgattcgttcaa

SEQ ID NO: 6973810 - DNA, 22 bp, Homo sapiens
gtccatggttgctttcatgtaa

SEQ ID NO: 6973811 - DNA, 18 bp, Homo sapiens
cttcagtcttcccacctc

SEQ ID NO: 6973812 - DNA, 22 bp, Homo sapiens
aggagataagaggctggtgtgg

SEQ ID NO: 6973813 - DNA, 22 bp, Homo sapiens
gaccacagactggaaagagggc

SEQ ID NO: 6973814 - DNA, 22 bp, Homo sapiens
tgtatatgtcctggcatgtcat

SEQ ID NO: 6973815 - DNA, 22 bp, Homo sapiens
tagggatgggagattctcaaac

SEQ ID NO: 6973816 - DNA, 22 bp, Homo sapiens
agagctgggtggacttgtagtt

SEQ ID NO: 6973817 - DNA, 22 bp, Homo sapiens
acatgctgggtttctttaatgg

SEQ ID NO: 6973818 - DNA, 22 bp, Homo sapiens
atttttccattctctgttagta

SEQ ID NO: 6973819 - DNA, 22 bp, Homo sapiens
attacagttctacacatccttt

SEQ ID NO: 6973820 - DNA, 22 bp, Homo sapiens
gcatgggaggacagtctgggct

SEQ ID NO: 6973821 - DNA, 22 bp, Homo sapiens
tggaagcccagaaggaagcaga

SEQ ID NO: 6973822 - DNA, 22 bp, Homo sapiens
agtgtcctcatctgtaaaatga

SEQ ID NO: 6973823 - DNA, 22 bp, Homo sapiens
gaggctgttcagtgtccagctt

SEQ ID NO: 6973824 - DNA, 22 bp, Homo sapiens
actgcctgtgcactggtctttt

SEQ ID NO: 6973825 - DNA, 22 bp, Homo sapiens
acaaagtcaaattgcagccgcc

SEQ ID NO: 6973826 - DNA, 22 bp, Homo sapiens
gcttctgctgttgaagccacca

SEQ ID NO: 6973827 - DNA, 22 bp, Homo sapiens
tctgttcatgttgggcttttcc

SEQ ID NO: 6973828 - DNA, 22 bp, Homo sapiens
acgctgtccggccactgctgca

SEQ ID NO: 6973829 - DNA, 22 bp, Homo sapiens
tgttgcagtaaaaatggagagg

SEQ ID NO: 6973830 - DNA, 22 bp, Homo sapiens
gtgtgcaagggcatgtacattg

SEQ ID NO: 6973831 - DNA, 22 bp, Homo sapiens
tggcctggttgttgctgccgtt

SEQ ID NO: 6973832 - DNA, 22 bp, Homo sapiens
cagaaagccaactccaactgtc

SEQ ID NO: 6973833 - DNA, 22 bp, Homo sapiens
ccagcaggagactagcaacata

SEQ ID NO: 6973834 - DNA, 23 bp, Homo sapiens
tgacctcatgatccgcccacctc

SEQ ID NO: 6973835 - DNA, 22 bp, Homo sapiens
gggctaaatgcagaaatgcaga

SEQ ID NO: 6973836 - DNA, 22 bp, Homo sapiens
tctgtgagtactttaacgagag

SEQ ID NO: 6973837 - DNA, 22 bp, Homo sapiens
taggattcctattagctttctc

SEQ ID NO: 6973838 - DNA, 22 bp, Homo sapiens
gagctgcagcggctgacgcaac

SEQ ID NO: 6973839 - DNA, 22 bp, Homo sapiens
acactagtatttctataagtga

SEQ ID NO: 6973840 - DNA, 21 bp, Homo sapiens
ctacaagtaaagtattgggac

SEQ ID NO: 6973841 - DNA, 22 bp, Homo sapiens
tgggtggcacttctggggtcca

SEQ ID NO: 6973842 - DNA, 22 bp, Homo sapiens
agaggcaacatggggaacagat

SEQ ID NO: 6973843 - DNA, 22 bp, Homo sapiens
gattgctgcaatcaacaagtat

SEQ ID NO: 6973844 - DNA, 22 bp, Homo sapiens
aagctctgatacttcctacctg

SEQ ID NO: 6973845 - DNA, 22 bp, Homo sapiens
tcctgcaggcctgttcccagta

SEQ ID NO: 6973846 - DNA, 22 bp, Homo sapiens
ttggtttgttcaccatcaagca

SEQ ID NO: 6973847 - DNA, 22 bp, Homo sapiens
agcagctgcagggagggtctgc

SEQ ID NO: 6973848 - DNA, 22 bp, Homo sapiens
gctggctgagttctgtcgtctg

SEQ ID NO: 6973849 - DNA, 22 bp, Homo sapiens
ccctaggcccaaagggtgacat

SEQ ID NO: 6973850 - DNA, 22 bp, Homo sapiens
tcctttctccgggggactgttg

SEQ ID NO: 6973851 - DNA, 21 bp, Homo sapiens
agcagcagggaagcctcatcc

SEQ ID NO: 6973852 - DNA, 22 bp, Homo sapiens
agatccagatccttcctggttg

SEQ ID NO: 6973853 - DNA, 22 bp, Homo sapiens
atgggacacgttttaaggaaaa

SEQ ID NO: 6973854 - DNA, 22 bp, Homo sapiens
gctgccagagctcacttaatgc

SEQ ID NO: 6973855 - DNA, 22 bp, Homo sapiens
gtgtcaataaatagcggtgtgg

SEQ ID NO: 6973856 - DNA, 22 bp, Homo sapiens
gctggaaaaggaggcaaaatat

SEQ ID NO: 6973857 - DNA, 22 bp, Homo sapiens
tctgaggcaaacagaggagtgt

SEQ ID NO: 6973858 - DNA, 22 bp, Homo sapiens
atagaattacagtgtgtttgga

SEQ ID NO: 6973859 - DNA, 22 bp, Homo sapiens
gagaatcatttacagaatgatt

SEQ ID NO: 6973860 - DNA, 22 bp, Homo sapiens
ttgaggagcactagtcaggtat

SEQ ID NO: 6973861 - DNA, 22 bp, Homo sapiens
cctcctggtccagcatctcttt

SEQ ID NO: 6973862 - DNA, 22 bp, Homo sapiens
agcttccaatttctccaagaga

SEQ ID NO: 6973863 - DNA, 22 bp, Homo sapiens
cctgagaataacaaattgctgc

SEQ ID NO: 6973864 - DNA, 22 bp, Homo sapiens
ttccaattgttctttggaatct

SEQ ID NO: 6973865 - DNA, 22 bp, Homo sapiens
tctgctaatgtggttatttcta

SEQ ID NO: 6973866 - DNA, 22 bp, Homo sapiens
taactccacacccctcttggtg

SEQ ID NO: 6973867 - DNA, 22 bp, Homo sapiens
ctgaggcctctcccactccagc

SEQ ID NO: 6973868 - DNA, 22 bp, Homo sapiens
agttgaaagccttatttctctg

SEQ ID NO: 6973869 - DNA, 20 bp, Homo sapiens
cctttattatttgtatgatg

SEQ ID NO: 6973870 - DNA, 22 bp, Homo sapiens
gcaggatgaaggcagaggctga

SEQ ID NO: 6973871 - DNA, 22 bp, Homo sapiens
ggtgtcaggctggttgttgggc

SEQ ID NO: 6973872 - DNA, 19 bp, Homo sapiens
ggcgggtggactggagccc

SEQ ID NO: 6973873 - DNA, 22 bp, Homo sapiens
ttcaacagggcatgatgagacg

SEQ ID NO: 6973874 - DNA, 22 bp, Homo sapiens
gcctgtgggttggagcttggcc

SEQ ID NO: 6973875 - DNA, 22 bp, Homo sapiens
gtacaaattgatacagatttga

SEQ ID NO: 6973876 - DNA, 22 bp, Homo sapiens
tctgtctacagggagaatgata

SEQ ID NO: 6973877 - DNA, 22 bp, Homo sapiens
tccagagcaggtgtctacacag

SEQ ID NO: 6973878 - DNA, 22 bp, Homo sapiens
atgtgagctctcttctgattgg

SEQ ID NO: 6973879 - DNA, 22 bp, Homo sapiens
ttaagagaagagtatctagaac

SEQ ID NO: 6973880 - DNA, 22 bp, Homo sapiens
taggctggaacttaggcagagg

SEQ ID NO: 6973881 - DNA, 22 bp, Homo sapiens
aatcccaagtccaggccattcc

SEQ ID NO: 6973882 - DNA, 22 bp, Homo sapiens
gtcattgattttcagtttgtcc

SEQ ID NO: 6973883 - DNA, 21 bp, Homo sapiens
tgtcctggtcactgctctccc

SEQ ID NO: 6973884 - DNA, 22 bp, Homo sapiens
tggttttagagtatattcaggg

SEQ ID NO: 6973885 - DNA, 22 bp, Homo sapiens
atgacaaacccaggatgtaaca

SEQ ID NO: 6973886 - DNA, 22 bp, Homo sapiens
ggcatcttcaaaattgccaaat

SEQ ID NO: 6973887 - DNA, 22 bp, Homo sapiens
ttggcactattcactccatggg

SEQ ID NO: 6973888 - DNA, 22 bp, Homo sapiens
gggctccagggcccgagtcgtc

SEQ ID NO: 6973889 - DNA, 22 bp, Homo sapiens
taattgtcttagtctgtgcagg

SEQ ID NO: 6973890 - DNA, 22 bp, Homo sapiens
gaaagccatctggctgctggga

SEQ ID NO: 6973891 - DNA, 22 bp, Homo sapiens
cctgtctgtatcggttcagagt

SEQ ID NO: 6973892 - DNA, 22 bp, Homo sapiens
tctcagagttcctctggagtcc

SEQ ID NO: 6973893 - DNA, 22 bp, Homo sapiens
agctcagaactgcagacatgtg

SEQ ID NO: 6973894 - DNA, 22 bp, Homo sapiens
cctttggccctgagagatgatt

SEQ ID NO: 6973895 - DNA, 22 bp, Homo sapiens
aaactgtgaagcaagtacaagg

SEQ ID NO: 6973896 - DNA, 18 bp, Homo sapiens
taatccagggcaggtgat

SEQ ID NO: 6973897 - DNA, 22 bp, Homo sapiens
caataagatgtattgagcagag

SEQ ID NO: 6973898 - DNA, 22 bp, Homo sapiens
gaaacagattaacagcatattt

SEQ ID NO: 6973899 - DNA, 22 bp, Homo sapiens
tctgaagattaccagctaaatg

SEQ ID NO: 6973900 - DNA, 19 bp, Homo sapiens
gccaagggacttgcttctt

SEQ ID NO: 6973901 - DNA, 16 bp, Homo sapiens
gctaggcaacaggctg

SEQ ID NO: 6973902 - DNA, 22 bp, Homo sapiens
atttgccttgtgatttgtaagt

SEQ ID NO: 6973903 - DNA, 22 bp, Homo sapiens
ttacacacaattagcatagtaa

SEQ ID NO: 6973904 - DNA, 22 bp, Homo sapiens
agatattaccagcagtctatgc

SEQ ID NO: 6973905 - DNA, 22 bp, Homo sapiens
tcctgggtggctctgcccggct

SEQ ID NO: 6973906 - DNA, 22 bp, Homo sapiens
attcattctgacctcaagagaa

SEQ ID NO: 6973907 - DNA, 22 bp, Homo sapiens
actgagctgcttgaagtgaact

SEQ ID NO: 6973908 - DNA, 22 bp, Homo sapiens
ggatggaggttctcagatgctc

SEQ ID NO: 6973909 - DNA, 22 bp, Homo sapiens
gaaatacaattttgtcccagct

SEQ ID NO: 6973910 - DNA, 22 bp, Homo sapiens
tccagcttttaccaaatgagca

SEQ ID NO: 6973911 - DNA, 22 bp, Homo sapiens
tcccagggccgcaaacgagttt

SEQ ID NO: 6973912 - DNA, 22 bp, Homo sapiens
aagaaaaggtaaccgcttatct

SEQ ID NO: 6973913 - DNA, 22 bp, Homo sapiens
taaaggccagggcctgagtgct

SEQ ID NO: 6973914 - DNA, 22 bp, Homo sapiens
cctgctgtgaagccaggcctgt

SEQ ID NO: 6973915 - DNA, 22 bp, Homo sapiens
ctctgggttctggcctgcaccc

SEQ ID NO: 6973916 - DNA, 22 bp, Homo sapiens
tccccactcaccactggccaaa

SEQ ID NO: 6973917 - DNA, 22 bp, Homo sapiens
aagtgattcattgatgatgagg

SEQ ID NO: 6973918 - DNA, 22 bp, Homo sapiens
gtctctgtggctggctccttcc

SEQ ID NO: 6973919 - DNA, 22 bp, Homo sapiens
tttgaaatgtatcagtataggt

SEQ ID NO: 6973920 - DNA, 22 bp, Homo sapiens
ggctctctgaggaaacccttcc

SEQ ID NO: 6973921 - DNA, 22 bp, Homo sapiens
ggtctggaacgaggtctaagcc

SEQ ID NO: 6973922 - DNA, 22 bp, Homo sapiens
ggctccaggagatgctgggcag

SEQ ID NO: 6973923 - DNA, 22 bp, Homo sapiens
gtgacatttttactgatgagag

SEQ ID NO: 6973924 - DNA, 22 bp, Homo sapiens
tcctcttcaaaatagctctgaa

SEQ ID NO: 6973925 - DNA, 22 bp, Homo sapiens
gctgaggcaagatttgaaccca

SEQ ID NO: 6973926 - DNA, 22 bp, Homo sapiens
ttgctgatctgtgaatcagcca

SEQ ID NO: 6973927 - DNA, 23 bp, Homo sapiens
ctcagcagcctgctgcagataag

SEQ ID NO: 6973928 - DNA, 22 bp, Homo sapiens
tgcttgacttagtttctcattt

SEQ ID NO: 6973929 - DNA, 22 bp, Homo sapiens
accagctgccttttcttagtag

SEQ ID NO: 6973930 - DNA, 22 bp, Homo sapiens
agaagccattgaagcagacctc

SEQ ID NO: 6973931 - DNA, 22 bp, Homo sapiens
cacccagcattggctaagagag

SEQ ID NO: 6973932 - DNA, 22 bp, Homo sapiens
tggaacacaagtcattgagggg

SEQ ID NO: 6973933 - DNA, 22 bp, Homo sapiens
aatggtgaggctcctaaatttt

SEQ ID NO: 6973934 - DNA, 18 bp, Homo sapiens
tggagtcagtgacaccag

SEQ ID NO: 6973935 - DNA, 22 bp, Homo sapiens
tccatctggtggcttccttttg

SEQ ID NO: 6973936 - DNA, 22 bp, Homo sapiens
ggtgcatgtagccatcaagata

SEQ ID NO: 6973937 - DNA, 22 bp, Homo sapiens
acattgattgagcacccattat

SEQ ID NO: 6973938 - DNA, 22 bp, Homo sapiens
gtctcttatgggcaggagcaca

SEQ ID NO: 6973939 - DNA, 22 bp, Homo sapiens
tgagttctaggcttaaaactaa

SEQ ID NO: 6973940 - DNA, 22 bp, Homo sapiens
taaatacttttactccactgat

SEQ ID NO: 6973941 - DNA, 22 bp, Homo sapiens
aattgtgaacctttacagttgt

SEQ ID NO: 6973942 - DNA, 19 bp, Homo sapiens
tcagtctaggaatgagcta

SEQ ID NO: 6973943 - DNA, 22 bp, Homo sapiens
tctcagcagccagatccagagc

SEQ ID NO: 6973944 - DNA, 22 bp, Homo sapiens
tgaggggatacggtacacattg

SEQ ID NO: 6973945 - DNA, 22 bp, Homo sapiens
ttgaatgaatggtccatataga

SEQ ID NO: 6973946 - DNA, 22 bp, Homo sapiens
tatgtactacactagaacattt

SEQ ID NO: 6973947 - DNA, 22 bp, Homo sapiens
ttctggatgctgttaagatgta

SEQ ID NO: 6973948 - DNA, 22 bp, Homo sapiens
agtgctttggtatagaactatt

SEQ ID NO: 6973949 - DNA, 22 bp, Homo sapiens
actatagatgctggcgaggctg

SEQ ID NO: 6973950 - DNA, 22 bp, Homo sapiens
agatggttatcttttctttgta

SEQ ID NO: 6973951 - DNA, 20 bp, Homo sapiens
cgctccagtcgctggtgtgt

SEQ ID NO: 6973952 - DNA, 22 bp, Homo sapiens
agcctattcatctgatcttgaa

SEQ ID NO: 6973953 - DNA, 22 bp, Homo sapiens
cagggaagagccgatgctgcag

SEQ ID NO: 6973954 - DNA, 22 bp, Homo sapiens
gaaggaaggaaaaatatattta

SEQ ID NO: 6973955 - DNA, 22 bp, Homo sapiens
cttagtttctgttgcgttctgt

SEQ ID NO: 6973956 - DNA, 22 bp, Homo sapiens
gtttctgctgcgtgctccagga

SEQ ID NO: 6973957 - DNA, 22 bp, Homo sapiens
aagtttggaatgatagagacct

SEQ ID NO: 6973958 - DNA, 22 bp, Homo sapiens
atgttagtgatagtaaatagtg

SEQ ID NO: 6973959 - DNA, 22 bp, Homo sapiens
aggctggtgcctgcagtgaatc

SEQ ID NO: 6973960 - DNA, 20 bp, Homo sapiens
gttattggtcatttttgcca

SEQ ID NO: 6973961 - DNA, 22 bp, Homo sapiens
gtgctacagactgagtacactt

SEQ ID NO: 6973962 - DNA, 22 bp, Homo sapiens
ttccaatgactagtggcatcct

SEQ ID NO: 6973963 - DNA, 22 bp, Homo sapiens
agtttcatgtagccatatttac

SEQ ID NO: 6973964 - DNA, 22 bp, Homo sapiens
caagtaacttgattaaggtaag

SEQ ID NO: 6973965 - DNA, 22 bp, Homo sapiens
cagcagagcttatgttgggtca

SEQ ID NO: 6973966 - DNA, 22 bp, Homo sapiens
ctgaggcatgttacaggacata

SEQ ID NO: 6973967 - DNA, 22 bp, Homo sapiens
ggaacagttgcgtcatgggcct

SEQ ID NO: 6973968 - DNA, 19 bp, Homo sapiens
ctctgcctccctcctgggt

SEQ ID NO: 6973969 - DNA, 22 bp, Homo sapiens
agcacttgtcaggcagctctat

SEQ ID NO: 6973970 - DNA, 22 bp, Homo sapiens
caggccctgggcaggcacagag

SEQ ID NO: 6973971 - DNA, 22 bp, Homo sapiens
taaggcagaggtaccactaggc

SEQ ID NO: 6973972 - DNA, 22 bp, Homo sapiens
tttgggaactctatcatggaaa

SEQ ID NO: 6973973 - DNA, 22 bp, Homo sapiens
ttagagttttctgttcctctaa

SEQ ID NO: 6973974 - DNA, 22 bp, Homo sapiens
actaaatgcattggtatctatt

SEQ ID NO: 6973975 - DNA, 22 bp, Homo sapiens
tctcagttctgccgcaagtatt

SEQ ID NO: 6973976 - DNA, 22 bp, Homo sapiens
catggccccaaatcccatgcat

SEQ ID NO: 6973977 - DNA, 23 bp, Homo sapiens
cgttagtatgtaagtcagttgga

SEQ ID NO: 6973978 - DNA, 22 bp, Homo sapiens
caaaagcagttctatctgagtt

SEQ ID NO: 6973979 - DNA, 20 bp, Homo sapiens
agtcttggcatgtggttttc

SEQ ID NO: 6973980 - DNA, 22 bp, Homo sapiens
tgacccatggtctgatcatagg

SEQ ID NO: 6973981 - DNA, 22 bp, Homo sapiens
tctctgtgtcctgaaatgaagg

SEQ ID NO: 6973982 - DNA, 18 bp, Homo sapiens
gcagagcatcaagggtta

SEQ ID NO: 6973983 - DNA, 22 bp, Homo sapiens
catatttattcttctgccagtg

SEQ ID NO: 6973984 - DNA, 22 bp, Homo sapiens
tttacttgttctgctgaattct

SEQ ID NO: 6973985 - DNA, 22 bp, Homo sapiens
taaagtgggcaaactctcatgg

SEQ ID NO: 6973986 - DNA, 22 bp, Homo sapiens
gttgacagtgaccctgaaagca

SEQ ID NO: 6973987 - DNA, 22 bp, Homo sapiens
gagttctgttccttgggagttt

SEQ ID NO: 6973988 - DNA, 22 bp, Homo sapiens
ttagttgatagccaaaatttat

SEQ ID NO: 6973989 - DNA, 22 bp, Homo sapiens
ttttcatctctgctttgtacct

SEQ ID NO: 6973990 - DNA, 22 bp, Homo sapiens
agctggcattacaggagcatgc

SEQ ID NO: 6973991 - DNA, 22 bp, Homo sapiens
tgcagccagcaagtgaatacat

SEQ ID NO: 6973992 - DNA, 22 bp, Homo sapiens
gtcaggactctgacccgtcccg

SEQ ID NO: 6973993 - DNA, 19 bp, Homo sapiens
tgagcaccttctcacgtaa

SEQ ID NO: 6973994 - DNA, 19 bp, Homo sapiens
cctgaccacacaggccttg

SEQ ID NO: 6973995 - DNA, 18 bp, Homo sapiens
aactagagggctgtcaat

SEQ ID NO: 6973996 - DNA, 22 bp, Homo sapiens
ctgtgtggactggttgaggccc

SEQ ID NO: 6973997 - DNA, 22 bp, Homo sapiens
ttaacatacatcatgaacaatg

SEQ ID NO: 6973998 - DNA, 22 bp, Homo sapiens
ccatgcaatatatatcctcaag

SEQ ID NO: 6973999 - DNA, 22 bp, Homo sapiens
aagggtggatttctgagctcta

SEQ ID NO: 6974000 - DNA, 22 bp, Homo sapiens
ttagcaatcctaggctggatca

SEQ ID NO: 6974001 - DNA, 22 bp, Homo sapiens
gttgtatatgtagagaatggtc

SEQ ID NO: 6974002 - DNA, 22 bp, Homo sapiens
gtgggtggaggcgtcgagggca

SEQ ID NO: 6974003 - DNA, 22 bp, Homo sapiens
tcctgtgtgtggcctttcccag

SEQ ID NO: 6974004 - DNA, 20 bp, Homo sapiens
ggggttggctggcacaggga

SEQ ID NO: 6974005 - DNA, 22 bp, Homo sapiens
aactctggaagggtgaggctgt

SEQ ID NO: 6974006 - DNA, 22 bp, Homo sapiens
gaagcctggttcgctggccacc

SEQ ID NO: 6974007 - DNA, 22 bp, Homo sapiens
ttctttcccagtagatgtgaaa

SEQ ID NO: 6974008 - DNA, 22 bp, Homo sapiens
catcaggtgcctctgtgcagtg

SEQ ID NO: 6974009 - DNA, 22 bp, Homo sapiens
aagtctcttttcttcctgtatt

SEQ ID NO: 6974010 - DNA, 22 bp, Homo sapiens
tggaaatttattcatcattcat

SEQ ID NO: 6974011 - DNA, 22 bp, Homo sapiens
gtcacagtgccctggtggtgtt

SEQ ID NO: 6974012 - DNA, 22 bp, Homo sapiens
ggatctggggctctgctgctca

SEQ ID NO: 6974013 - DNA, 22 bp, Homo sapiens
ggctttgggccctcaagtctcc

SEQ ID NO: 6974014 - DNA, 22 bp, Homo sapiens
ggatggctgtaaaaggtgggaa

SEQ ID NO: 6974015 - DNA, 22 bp, Homo sapiens
cagggacaggggagaaaagatg

SEQ ID NO: 6974016 - DNA, 21 bp, Homo sapiens
ctgtttcttgtgaagtgacac

SEQ ID NO: 6974017 - DNA, 22 bp, Homo sapiens
ctgcagagatgaagaaggtggc

SEQ ID NO: 6974018 - DNA, 22 bp, Homo sapiens
tagagatgaattctgcagtctt

SEQ ID NO: 6974019 - DNA, 21 bp, Homo sapiens
tgctgctcctctgggcttcca

SEQ ID NO: 6974020 - DNA, 21 bp, Homo sapiens
cccaggaggctgagaagagca

SEQ ID NO: 6974021 - DNA, 20 bp, Homo sapiens
tccaagccctccttccattc

SEQ ID NO: 6974022 - DNA, 22 bp, Homo sapiens
tggtgctgccacctcctctgct

SEQ ID NO: 6974023 - DNA, 22 bp, Homo sapiens
aagcgactgcaggttaaaacaa

SEQ ID NO: 6974024 - DNA, 22 bp, Homo sapiens
ggcaggactctcaggaccaagc

SEQ ID NO: 6974025 - DNA, 19 bp, Homo sapiens
aaaattgcgtattttgagg

SEQ ID NO: 6974026 - DNA, 23 bp, Homo sapiens
tgctggctaagaatctgcatttt

SEQ ID NO: 6974027 - DNA, 22 bp, Homo sapiens
aagccaaggcctgtctggggct

SEQ ID NO: 6974028 - DNA, 22 bp, Homo sapiens
cttcaatgaaattccatcagaa

SEQ ID NO: 6974029 - DNA, 22 bp, Homo sapiens
aagtcactgaaggccatgaaca

SEQ ID NO: 6974030 - DNA, 22 bp, Homo sapiens
acagaagaccaagaaagcttcc

SEQ ID NO: 6974031 - DNA, 22 bp, Homo sapiens
cccagtgtctgggcctgcaggg

SEQ ID NO: 6974032 - DNA, 22 bp, Homo sapiens
aggaggtggcaactgtcgacag

SEQ ID NO: 6974033 - DNA, 22 bp, Homo sapiens
aaggcatgaaagcgaaatgaga

SEQ ID NO: 6974034 - DNA, 22 bp, Homo sapiens
cttcactgtttggttcacagca

SEQ ID NO: 6974035 - DNA, 22 bp, Homo sapiens
tcctgctgttttctggcccaca

SEQ ID NO: 6974036 - DNA, 18 bp, Homo sapiens
tccagcccacattttctg

SEQ ID NO: 6974037 - DNA, 22 bp, Homo sapiens
agctgtgctgccaagttgctga

SEQ ID NO: 6974038 - DNA, 22 bp, Homo sapiens
tggattaggtactatgaatata

SEQ ID NO: 6974039 - DNA, 18 bp, Homo sapiens
ctctctgggtgaggacaa

SEQ ID NO: 6974040 - DNA, 22 bp, Homo sapiens
ggaagactgcatggcatagtga

SEQ ID NO: 6974041 - DNA, 22 bp, Homo sapiens
cccagactgcagagcgggcaga

SEQ ID NO: 6974042 - DNA, 22 bp, Homo sapiens
cttctgagatgttgttttacag

SEQ ID NO: 6974043 - DNA, 22 bp, Homo sapiens
tgtccaggctaaagtgcagtgg

SEQ ID NO: 6974044 - DNA, 22 bp, Homo sapiens
cggaatgtccttcttaaggtgt

SEQ ID NO: 6974045 - DNA, 22 bp, Homo sapiens
aggaggctgcaaccctgaggcc

SEQ ID NO: 6974046 - DNA, 22 bp, Homo sapiens
tgtcatttattctcttattcta

SEQ ID NO: 6974047 - DNA, 22 bp, Homo sapiens
ttgaggccccatggatgagaac

SEQ ID NO: 6974048 - DNA, 22 bp, Homo sapiens
tacacatcactgtatctttcag

SEQ ID NO: 6974049 - DNA, 22 bp, Homo sapiens
tgtttgctatatcctacttcat

SEQ ID NO: 6974050 - DNA, 22 bp, Homo sapiens
ctccagaagacccatcctcatg

SEQ ID NO: 6974051 - DNA, 22 bp, Homo sapiens
aagaactttaaagcacttatga

SEQ ID NO: 6974052 - DNA, 22 bp, Homo sapiens
cataaagtgctgggtttaggaa

SEQ ID NO: 6974053 - DNA, 22 bp, Homo sapiens
tggtcaggggcttctgagctgt

SEQ ID NO: 6974054 - DNA, 22 bp, Homo sapiens
agtgtattaatgctccaggagt

SEQ ID NO: 6974055 - DNA, 22 bp, Homo sapiens
aagctctgctcagcagactagg

SEQ ID NO: 6974056 - DNA, 22 bp, Homo sapiens
tctgttcctgtcctaagggcca

SEQ ID NO: 6974057 - DNA, 22 bp, Homo sapiens
cttgtttattatgcactgtaga

SEQ ID NO: 6974058 - DNA, 22 bp, Homo sapiens
gagaaggtggacctgaaggagc

SEQ ID NO: 6974059 - DNA, 22 bp, Homo sapiens
tataggaaataggtcttctgtg

SEQ ID NO: 6974060 - DNA, 21 bp, Homo sapiens
ttctgagcactcatcactgtc

SEQ ID NO: 6974061 - DNA, 22 bp, Homo sapiens
ggtgcccagcgaagtggctgtg

SEQ ID NO: 6974062 - DNA, 19 bp, Homo sapiens
atctggaactcgtttgttt

SEQ ID NO: 6974063 - DNA, 22 bp, Homo sapiens
aaggcacatattttagagtcac

SEQ ID NO: 6974064 - DNA, 22 bp, Homo sapiens
cacctgtaatcccagcacttca

SEQ ID NO: 6974065 - DNA, 22 bp, Homo sapiens
tgtggcagattttataaattgc

SEQ ID NO: 6974066 - DNA, 22 bp, Homo sapiens
gtgtcttagtcatttcaggctg

SEQ ID NO: 6974067 - DNA, 22 bp, Homo sapiens
catgttaagtgtttgataacca

SEQ ID NO: 6974068 - DNA, 22 bp, Homo sapiens
tcatgtccctattactgtgacc

SEQ ID NO: 6974069 - DNA, 22 bp, Homo sapiens
atgtcctggggtcttctcttca

SEQ ID NO: 6974070 - DNA, 22 bp, Homo sapiens
aagaattgcctttcaattgttt

SEQ ID NO: 6974071 - DNA, 21 bp, Homo sapiens
tgctcatgcaatgcatgtcca

SEQ ID NO: 6974072 - DNA, 22 bp, Homo sapiens
gagctggtgtgtgcccaagcac

SEQ ID NO: 6974073 - DNA, 22 bp, Homo sapiens
tctgcagctttcccctgattta

SEQ ID NO: 6974074 - DNA, 22 bp, Homo sapiens
aagactgtatattgagaaaaga

SEQ ID NO: 6974075 - DNA, 19 bp, Homo sapiens
gggctctcgagcaaccaac

SEQ ID NO: 6974076 - DNA, 22 bp, Homo sapiens
agctgcttttattaggacaatg

SEQ ID NO: 6974077 - DNA, 22 bp, Homo sapiens
cctgtcttagggaaagactgga

SEQ ID NO: 6974078 - DNA, 22 bp, Homo sapiens
actaagacctaaaattgtgaat

SEQ ID NO: 6974079 - DNA, 22 bp, Homo sapiens
tccgatgcttccagggccacct

SEQ ID NO: 6974080 - DNA, 22 bp, Homo sapiens
ttgcacaaaaaattgttgaata

SEQ ID NO: 6974081 - DNA, 22 bp, Homo sapiens
ttttcagttactgtttatgtga

SEQ ID NO: 6974082 - DNA, 23 bp, Homo sapiens
gctctgccacttaatagctgtgt

SEQ ID NO: 6974083 - DNA, 22 bp, Homo sapiens
tcaccaggctggagtgcagtgg

SEQ ID NO: 6974084 - DNA, 22 bp, Homo sapiens
taagtaaatttataatgtgatt

SEQ ID NO: 6974085 - DNA, 22 bp, Homo sapiens
tgcattagcttttgtgggcttt

SEQ ID NO: 6974086 - DNA, 22 bp, Homo sapiens
ctgggaaaactgtgacccctgt

SEQ ID NO: 6974087 - DNA, 22 bp, Homo sapiens
ttgcaggattttagagatgaca

SEQ ID NO: 6974088 - DNA, 22 bp, Homo sapiens
tcagcagaggcagactctcctt

SEQ ID NO: 6974089 - DNA, 22 bp, Homo sapiens
gactatttccctcatcatcttc

SEQ ID NO: 6974090 - DNA, 22 bp, Homo sapiens
ctgggctcagtgtctcactcct

SEQ ID NO: 6974091 - DNA, 22 bp, Homo sapiens
caatttgacaagttgcatgttt

SEQ ID NO: 6974092 - DNA, 22 bp, Homo sapiens
taaagtgtgtatatacatatgg

SEQ ID NO: 6974093 - DNA, 22 bp, Homo sapiens
aaagagcaagctgagatttgaa

SEQ ID NO: 6974094 - DNA, 22 bp, Homo sapiens
tactatactctccattttatag

SEQ ID NO: 6974095 - DNA, 22 bp, Homo sapiens
gcctgggagcacatcggggtcc

SEQ ID NO: 6974096 - DNA, 22 bp, Homo sapiens
tagttctggacacacgttccca

SEQ ID NO: 6974097 - DNA, 22 bp, Homo sapiens
agtttctaccggtacattcagg

SEQ ID NO: 6974098 - DNA, 22 bp, Homo sapiens
actctggccctcctgctgccag

SEQ ID NO: 6974099 - DNA, 22 bp, Homo sapiens
agctgcagttagccccagatga

SEQ ID NO: 6974100 - DNA, 22 bp, Homo sapiens
actgccttcttggccttcaaaa

SEQ ID NO: 6974101 - DNA, 22 bp, Homo sapiens
tggaggaataacagcaacctta

SEQ ID NO: 6974102 - DNA, 22 bp, Homo sapiens
gtgttaattattggtgaataga

SEQ ID NO: 6974103 - DNA, 22 bp, Homo sapiens
acagagcactgccctgtgccgc

SEQ ID NO: 6974104 - DNA, 22 bp, Homo sapiens
tagaaatccccagtctcatagt

SEQ ID NO: 6974105 - DNA, 22 bp, Homo sapiens
tcatgctgagtcctggctttgt

SEQ ID NO: 6974106 - DNA, 22 bp, Homo sapiens
tttggtaacagtttttggcact

SEQ ID NO: 6974107 - DNA, 22 bp, Homo sapiens
tgggactgtggtcaaggacaaa

SEQ ID NO: 6974108 - DNA, 22 bp, Homo sapiens
tgctgcaaagctggccagtagc

SEQ ID NO: 6974109 - DNA, 22 bp, Homo sapiens
ctcagggcagtatggctgagag

SEQ ID NO: 6974110 - DNA, 22 bp, Homo sapiens
ctatttgtacagcattcgagtt

SEQ ID NO: 6974111 - DNA, 22 bp, Homo sapiens
tttagcaaattagcacctctaa

SEQ ID NO: 6974112 - DNA, 22 bp, Homo sapiens
gatggccttgttttctcccttc

SEQ ID NO: 6974113 - DNA, 20 bp, Homo sapiens
tgcagggcctaaaaagggaa

SEQ ID NO: 6974114 - DNA, 22 bp, Homo sapiens
agaaaagcggtcaggaccctca

SEQ ID NO: 6974115 - DNA, 22 bp, Homo sapiens
aggcatgtgaccctggactcag

SEQ ID NO: 6974116 - DNA, 22 bp, Homo sapiens
tagcagaaactgttacagaagg

SEQ ID NO: 6974117 - DNA, 22 bp, Homo sapiens
atgcaacatacattctgaagct

SEQ ID NO: 6974118 - DNA, 22 bp, Homo sapiens
tcctgcctcaggctctggagta

SEQ ID NO: 6974119 - DNA, 22 bp, Homo sapiens
cagcatctctgcctgcctgcaa

SEQ ID NO: 6974120 - DNA, 22 bp, Homo sapiens
agagttcagttgtagccatatt

SEQ ID NO: 6974121 - DNA, 22 bp, Homo sapiens
ggcacagcaggagctatgtgaa

SEQ ID NO: 6974122 - DNA, 22 bp, Homo sapiens
gctgcctgtgcactttctcgta

SEQ ID NO: 6974123 - DNA, 22 bp, Homo sapiens
tcagcaggtgcctcagattctt

SEQ ID NO: 6974124 - DNA, 22 bp, Homo sapiens
agcagtttttataacactggaa

SEQ ID NO: 6974125 - DNA, 20 bp, Homo sapiens
tttagtttcttctgaggtgt

SEQ ID NO: 6974126 - DNA, 22 bp, Homo sapiens
acagatgaggctggcgagggca

SEQ ID NO: 6974127 - DNA, 20 bp, Homo sapiens
catttgttagctttctactg

SEQ ID NO: 6974128 - DNA, 22 bp, Homo sapiens
aagcaggctagattgaagggct

SEQ ID NO: 6974129 - DNA, 22 bp, Homo sapiens
ttccagtgactaagcttctgct

SEQ ID NO: 6974130 - DNA, 22 bp, Homo sapiens
actgcaacctccgcctgccagg

SEQ ID NO: 6974131 - DNA, 22 bp, Homo sapiens
tggcatttgctcccttgtgttc

SEQ ID NO: 6974132 - DNA, 22 bp, Homo sapiens
gccagctcagatgcaggaagga

SEQ ID NO: 6974133 - DNA, 22 bp, Homo sapiens
tctttctgcagcacaggggcag

SEQ ID NO: 6974134 - DNA, 22 bp, Homo sapiens
tctaggaatttcatctagttct

SEQ ID NO: 6974135 - DNA, 22 bp, Homo sapiens
ccagagcagatgtggccttggt

SEQ ID NO: 6974136 - DNA, 19 bp, Homo sapiens
ggttcagcctgtgttttat

SEQ ID NO: 6974137 - DNA, 23 bp, Homo sapiens
aagttcttaggttgatactaatg

SEQ ID NO: 6974138 - DNA, 22 bp, Homo sapiens
gtctgggtttcatgggcactgg

SEQ ID NO: 6974139 - DNA, 22 bp, Homo sapiens
actgtcactaactaagtctagt

SEQ ID NO: 6974140 - DNA, 22 bp, Homo sapiens
tcctgtctgtctttggtccctt

SEQ ID NO: 6974141 - DNA, 22 bp, Homo sapiens
acaggcaagtacacaggctcat

SEQ ID NO: 6974142 - DNA, 22 bp, Homo sapiens
tctacgaagccaccatggagac

SEQ ID NO: 6974143 - DNA, 22 bp, Homo sapiens
taagagaatgtcaggagtggat

SEQ ID NO: 6974144 - DNA, 22 bp, Homo sapiens
ggttcactgtcctttggttcag

SEQ ID NO: 6974145 - DNA, 22 bp, Homo sapiens
taagtttctacttgtcgggtct

SEQ ID NO: 6974146 - DNA, 22 bp, Homo sapiens
ttgggctggtctttgtttggtc

SEQ ID NO: 6974147 - DNA, 22 bp, Homo sapiens
tcagtgaaccttctgtggcagg

SEQ ID NO: 6974148 - DNA, 21 bp, Homo sapiens
agatggctcccaggtctctgg

SEQ ID NO: 6974149 - DNA, 16 bp, Homo sapiens
tatctagagttgaggt

SEQ ID NO: 6974150 - DNA, 22 bp, Homo sapiens
ggtgtgcacgaaggaccagcag

SEQ ID NO: 6974151 - DNA, 22 bp, Homo sapiens
ttagggaaggacagtgaagaaa

SEQ ID NO: 6974152 - DNA, 22 bp, Homo sapiens
tggaaattactaacacttagag

SEQ ID NO: 6974153 - DNA, 22 bp, Homo sapiens
atgcctttcccaacagggtggg

SEQ ID NO: 6974154 - DNA, 22 bp, Homo sapiens
ctgtgccatctttttgctacct

SEQ ID NO: 6974155 - DNA, 22 bp, Homo sapiens
agctggcattgaagaatggtta

SEQ ID NO: 6974156 - DNA, 22 bp, Homo sapiens
gaggtggcactgtgaggagcac

SEQ ID NO: 6974157 - DNA, 22 bp, Homo sapiens
atacctctgcttgttttttagt

SEQ ID NO: 6974158 - DNA, 23 bp, Homo sapiens
atgtgcaaagtgctacagtatag

SEQ ID NO: 6974159 - DNA, 22 bp, Homo sapiens
tgagtattttaagttctcaatc

SEQ ID NO: 6974160 - DNA, 20 bp, Homo sapiens
tgctgcagtttcatgggact

SEQ ID NO: 6974161 - DNA, 22 bp, Homo sapiens
agcctccacagatgcaaagggc

SEQ ID NO: 6974162 - DNA, 22 bp, Homo sapiens
ctcgttaagttctgcatatctg

SEQ ID NO: 6974163 - DNA, 22 bp, Homo sapiens
ctggtcacctccttcccagcta

SEQ ID NO: 6974164 - DNA, 22 bp, Homo sapiens
cagtaacatgtctgttaagaaa

SEQ ID NO: 6974165 - DNA, 22 bp, Homo sapiens
tctgaacatcctacaacatttt

SEQ ID NO: 6974166 - DNA, 22 bp, Homo sapiens
agcattatgtccatgctaaatt

SEQ ID NO: 6974167 - DNA, 22 bp, Homo sapiens
ctcagagctcgtgggaccttgg

SEQ ID NO: 6974168 - DNA, 20 bp, Homo sapiens
ttgaggcatgtctagaagta

SEQ ID NO: 6974169 - DNA, 22 bp, Homo sapiens
ttagaggtgtcaggagcacagg

SEQ ID NO: 6974170 - DNA, 22 bp, Homo sapiens
gctgccccccggactcggcggg

SEQ ID NO: 6974171 - DNA, 22 bp, Homo sapiens
catgcaatttacatgtgatgcc

SEQ ID NO: 6974172 - DNA, 19 bp, Homo sapiens
cagagcctcagagctagaa

SEQ ID NO: 6974173 - DNA, 21 bp, Homo sapiens
gagtgtctaatccaggctgtc

SEQ ID NO: 6974174 - DNA, 22 bp, Homo sapiens
aattgtacatatttatgagcga

SEQ ID NO: 6974175 - DNA, 22 bp, Homo sapiens
tcgtgagggccctggaggtgct

SEQ ID NO: 6974176 - DNA, 22 bp, Homo sapiens
tgtattctaaatacatcttacc

SEQ ID NO: 6974177 - DNA, 22 bp, Homo sapiens
gccaaattccttgaaaggtggg

SEQ ID NO: 6974178 - DNA, 20 bp, Homo sapiens
tcagaagtttcctggagcat

SEQ ID NO: 6974179 - DNA, 22 bp, Homo sapiens
aggccacagatactgtgaagta

SEQ ID NO: 6974180 - DNA, 22 bp, Homo sapiens
cagctgtgggcctgacgtggca

SEQ ID NO: 6974181 - DNA, 22 bp, Homo sapiens
ctcagtgttaaatataaggtat

SEQ ID NO: 6974182 - DNA, 22 bp, Homo sapiens
tttcccaagtgtaaacatggca

SEQ ID NO: 6974183 - DNA, 22 bp, Homo sapiens
ttgaacttttccagacaaggaa

SEQ ID NO: 6974184 - DNA, 22 bp, Homo sapiens
tttcagatcattttttaagtac

SEQ ID NO: 6974185 - DNA, 19 bp, Homo sapiens
aggctaaagagtcttgcgt

SEQ ID NO: 6974186 - DNA, 22 bp, Homo sapiens
tccagatagagtcctgttagta

SEQ ID NO: 6974187 - DNA, 19 bp, Homo sapiens
agcccagcttatttgtcag

SEQ ID NO: 6974188 - DNA, 22 bp, Homo sapiens
gcagcccacagctggaggccta

SEQ ID NO: 6974189 - DNA, 22 bp, Homo sapiens
cagtcctgggcacagccctggg

SEQ ID NO: 6974190 - DNA, 22 bp, Homo sapiens
tcagtgttttaactgtctttta

SEQ ID NO: 6974191 - DNA, 22 bp, Homo sapiens
tgcatgtgtcgggcctgtgcta

SEQ ID NO: 6974192 - DNA, 22 bp, Homo sapiens
ggaatcagatgaggggcagagc

SEQ ID NO: 6974193 - DNA, 22 bp, Homo sapiens
gctgggagaggccctgaagtga

SEQ ID NO: 6974194 - DNA, 22 bp, Homo sapiens
aacagtaatttgcggtttttgc

SEQ ID NO: 6974195 - DNA, 22 bp, Homo sapiens
gtcaattagtggcaatttcata

SEQ ID NO: 6974196 - DNA, 22 bp, Homo sapiens
cagtcttagccttccctcaccc

SEQ ID NO: 6974197 - DNA, 22 bp, Homo sapiens
agtcttcactcttcactactat

SEQ ID NO: 6974198 - DNA, 22 bp, Homo sapiens
tagtcatttttccactaagtta

SEQ ID NO: 6974199 - DNA, 22 bp, Homo sapiens
gtgtgcatagtcgtgcatgcat

SEQ ID NO: 6974200 - DNA, 22 bp, Homo sapiens
aacaagtcattccatttgacag

SEQ ID NO: 6974201 - DNA, 22 bp, Homo sapiens
tcctggtggtttgaaaactgaa

SEQ ID NO: 6974202 - DNA, 22 bp, Homo sapiens
tattggatgaagaaaggaagga

SEQ ID NO: 6974203 - DNA, 22 bp, Homo sapiens
tccaggactttcttaaggcact

SEQ ID NO: 6974204 - DNA, 22 bp, Homo sapiens
ttagaggtgtgaccttgggcaa

SEQ ID NO: 6974205 - DNA, 17 bp, Homo sapiens
aaggatattatagttct

SEQ ID NO: 6974206 - DNA, 22 bp, Homo sapiens
atgtgccaacgtgcaggtttgt

SEQ ID NO: 6974207 - DNA, 22 bp, Homo sapiens
agggatgttgtcaaggatgtgg

SEQ ID NO: 6974208 - DNA, 22 bp, Homo sapiens
tcccatatatgtttatattgga

SEQ ID NO: 6974209 - DNA, 20 bp, Homo sapiens
aatgggctttgatgagtgtg

SEQ ID NO: 6974210 - DNA, 22 bp, Homo sapiens
ctgccctgtggctctgagtcat

SEQ ID NO: 6974211 - DNA, 22 bp, Homo sapiens
agtttctgttaccatatttgac

SEQ ID NO: 6974212 - DNA, 22 bp, Homo sapiens
ctgtcctgtctgcttttaattt

SEQ ID NO: 6974213 - DNA, 22 bp, Homo sapiens
gacaggaaatatgggggttgtt

SEQ ID NO: 6974214 - DNA, 22 bp, Homo sapiens
gtaaagtacatacatgaactca

SEQ ID NO: 6974215 - DNA, 22 bp, Homo sapiens
ttgaaactgtcagcttttacgc

SEQ ID NO: 6974216 - DNA, 22 bp, Homo sapiens
cttgtattcccctatctctaaa

SEQ ID NO: 6974217 - DNA, 22 bp, Homo sapiens
ccaaagtctgcattttaacatg

SEQ ID NO: 6974218 - DNA, 22 bp, Homo sapiens
gaggaggaggaagtggaaccca

SEQ ID NO: 6974219 - DNA, 22 bp, Homo sapiens
aatctttaaggactcagtctct

SEQ ID NO: 6974220 - DNA, 22 bp, Homo sapiens
ttgacaggatataaagacataa

SEQ ID NO: 6974221 - DNA, 22 bp, Homo sapiens
gaggggctgccctggtgtcagg

SEQ ID NO: 6974222 - DNA, 22 bp, Homo sapiens
agtgtcagcctgggcaaggaac

SEQ ID NO: 6974223 - DNA, 22 bp, Homo sapiens
agcagcagggcatgtcttactc

SEQ ID NO: 6974224 - DNA, 22 bp, Homo sapiens
aggccagaacagctctgcacca

SEQ ID NO: 6974225 - DNA, 22 bp, Homo sapiens
gaggttttaggctgccattatt

SEQ ID NO: 6974226 - DNA, 23 bp, Homo sapiens
gagaaagccggctatgatcctgg

SEQ ID NO: 6974227 - DNA, 22 bp, Homo sapiens
tctctgtgttccctgttttctc

SEQ ID NO: 6974228 - DNA, 22 bp, Homo sapiens
cttcttctctacatcctttgat

SEQ ID NO: 6974229 - DNA, 22 bp, Homo sapiens
cctctggccattctttgatgga

SEQ ID NO: 6974230 - DNA, 22 bp, Homo sapiens
gtgagcagtttgttccagaatc

SEQ ID NO: 6974231 - DNA, 19 bp, Homo sapiens
ctcagagaggggcagtgcc

SEQ ID NO: 6974232 - DNA, 22 bp, Homo sapiens
tagctttgggaatgctctcctg

SEQ ID NO: 6974233 - DNA, 22 bp, Homo sapiens
tgtaatattgtagtgacagtac

SEQ ID NO: 6974234 - DNA, 22 bp, Homo sapiens
aagtccttctttatatgagagt

SEQ ID NO: 6974235 - DNA, 22 bp, Homo sapiens
gaggccataagaagttcttggg

SEQ ID NO: 6974236 - DNA, 22 bp, Homo sapiens
ctaaagagaagatgtttgctga

SEQ ID NO: 6974237 - DNA, 22 bp, Homo sapiens
tgagggtatatattgtgtggag

SEQ ID NO: 6974238 - DNA, 22 bp, Homo sapiens
aacaatgcttgccaagtgtgat

SEQ ID NO: 6974239 - DNA, 22 bp, Homo sapiens
ttcggtcttgtgtaaacactgt

SEQ ID NO: 6974240 - DNA, 22 bp, Homo sapiens
ttcagtatacttcataacattt

SEQ ID NO: 6974241 - DNA, 23 bp, Homo sapiens
ttgcaaatttcagttagttcatg

SEQ ID NO: 6974242 - DNA, 22 bp, Homo sapiens
agctccagccctagtacagctg

SEQ ID NO: 6974243 - DNA, 23 bp, Homo sapiens
attgaatgtgcttttctacttag

SEQ ID NO: 6974244 - DNA, 22 bp, Homo sapiens
aaatctcattatttataccata

SEQ ID NO: 6974245 - DNA, 22 bp, Homo sapiens
gctcactgcaagctccgcctcc

SEQ ID NO: 6974246 - DNA, 22 bp, Homo sapiens
tagaaagaacttcatgtaaaac

SEQ ID NO: 6974247 - DNA, 22 bp, Homo sapiens
gaatcatgtctagaagcagtgg

SEQ ID NO: 6974248 - DNA, 22 bp, Homo sapiens
gaagccttgaactgcaaacccc

SEQ ID NO: 6974249 - DNA, 22 bp, Homo sapiens
agtgtctgaaggatttggcttc

SEQ ID NO: 6974250 - DNA, 22 bp, Homo sapiens
atgatgaaactaggaactagag

SEQ ID NO: 6974251 - DNA, 22 bp, Homo sapiens
gtgttttgtgaggccttctttc

SEQ ID NO: 6974252 - DNA, 22 bp, Homo sapiens
aggctgtgcgaggtctcagagt

SEQ ID NO: 6974253 - DNA, 22 bp, Homo sapiens
catctctgagacctcagctggg

SEQ ID NO: 6974254 - DNA, 22 bp, Homo sapiens
atggccaagaagtattcctgac

SEQ ID NO: 6974255 - DNA, 22 bp, Homo sapiens
ctccaggttgacttcagtcaat

SEQ ID NO: 6974256 - DNA, 22 bp, Homo sapiens
ctcctggagtcctttcctattc

SEQ ID NO: 6974257 - DNA, 22 bp, Homo sapiens
aaggtgtggagtggtgcgactg

SEQ ID NO: 6974258 - DNA, 22 bp, Homo sapiens
tctgagactccataagttgaaa

SEQ ID NO: 6974259 - DNA, 23 bp, Homo sapiens
tggaatcttcgatattgattcag

SEQ ID NO: 6974260 - DNA, 22 bp, Homo sapiens
ggcttggcaggtgccctgcgca

SEQ ID NO: 6974261 - DNA, 22 bp, Homo sapiens
gtgggcattggagggggtacag

SEQ ID NO: 6974262 - DNA, 22 bp, Homo sapiens
ctccccaggttcaggaggtggg

SEQ ID NO: 6974263 - DNA, 22 bp, Homo sapiens
tgctcctgatatctaatgtgta

SEQ ID NO: 6974264 - DNA, 22 bp, Homo sapiens
agccagggtctctcgctctgtt

SEQ ID NO: 6974265 - DNA, 22 bp, Homo sapiens
tttctcaaaagacagaagtgaa

SEQ ID NO: 6974266 - DNA, 22 bp, Homo sapiens
gcacacagtagggattcaatga

SEQ ID NO: 6974267 - DNA, 22 bp, Homo sapiens
ttgttcctttccatttctgagt

SEQ ID NO: 6974268 - DNA, 22 bp, Homo sapiens
tcatgtcagctgttgatgtgca

SEQ ID NO: 6974269 - DNA, 21 bp, Homo sapiens
attcagaaagggaataaactc

SEQ ID NO: 6974270 - DNA, 22 bp, Homo sapiens
agacacatcttaggttgtcagg

SEQ ID NO: 6974271 - DNA, 23 bp, Homo sapiens
cagcccttcctgcatgtttttgt

SEQ ID NO: 6974272 - DNA, 23 bp, Homo sapiens
tctgttcttttagctgatcattt

SEQ ID NO: 6974273 - DNA, 22 bp, Homo sapiens
gctttggtcttctagctgtgag

SEQ ID NO: 6974274 - DNA, 22 bp, Homo sapiens
gtcacctgtgccacatactggg

SEQ ID NO: 6974275 - DNA, 22 bp, Homo sapiens
ggtgttgggagagctggttttg

SEQ ID NO: 6974276 - DNA, 22 bp, Homo sapiens
ttcctgggcaggacgagagtct

SEQ ID NO: 6974277 - DNA, 21 bp, Homo sapiens
acatgagacacacatatatgt

SEQ ID NO: 6974278 - DNA, 22 bp, Homo sapiens
aggaggtcagagccccatgctg

SEQ ID NO: 6974279 - DNA, 22 bp, Homo sapiens
agggtcttcccaccattcctgc

SEQ ID NO: 6974280 - DNA, 22 bp, Homo sapiens
aattccacagatgtctatctgt

SEQ ID NO: 6974281 - DNA, 22 bp, Homo sapiens
gcaggaggttgagccaggactg

SEQ ID NO: 6974282 - DNA, 22 bp, Homo sapiens
ctccagagggtcagactctgag

SEQ ID NO: 6974283 - DNA, 22 bp, Homo sapiens
agaggacagcccccttgtctgg

SEQ ID NO: 6974284 - DNA, 22 bp, Homo sapiens
ttctgggctcacagagcagcag

SEQ ID NO: 6974285 - DNA, 22 bp, Homo sapiens
ggaggcccagaaggaagcccag

SEQ ID NO: 6974286 - DNA, 22 bp, Homo sapiens
cccagctcttcctgggagctaa

SEQ ID NO: 6974287 - DNA, 22 bp, Homo sapiens
ggccccagattctgggctgggt

SEQ ID NO: 6974288 - DNA, 22 bp, Homo sapiens
taagtgtctaaaaggcagaact

SEQ ID NO: 6974289 - DNA, 22 bp, Homo sapiens
tgtcatctttttaaagaagaga

SEQ ID NO: 6974290 - DNA, 22 bp, Homo sapiens
agaatcaactgaaaattggtga

SEQ ID NO: 6974291 - DNA, 22 bp, Homo sapiens
ttgtacaaaggatttggaagag

SEQ ID NO: 6974292 - DNA, 22 bp, Homo sapiens
gcgtcaattccatcattcttct

SEQ ID NO: 6974293 - DNA, 22 bp, Homo sapiens
tacatgtgatcagaaagtgaaa

SEQ ID NO: 6974294 - DNA, 16 bp, Homo sapiens
acatgagataatgcta

SEQ ID NO: 6974295 - DNA, 22 bp, Homo sapiens
agtcctgtctctcccagggcca

SEQ ID NO: 6974296 - DNA, 22 bp, Homo sapiens
agaattcctcctctgggacact

SEQ ID NO: 6974297 - DNA, 22 bp, Homo sapiens
ctcagctccagccctcagcagc

SEQ ID NO: 6974298 - DNA, 22 bp, Homo sapiens
tgggtacctgtgtacatttgca

SEQ ID NO: 6974299 - DNA, 22 bp, Homo sapiens
ctcttacattcttttactagca

SEQ ID NO: 6974300 - DNA, 22 bp, Homo sapiens
aactgagacacgaactatgatt

SEQ ID NO: 6974301 - DNA, 20 bp, Homo sapiens
agtttagaggccaacaagcc

SEQ ID NO: 6974302 - DNA, 22 bp, Homo sapiens
gggaacttatgatatgacttta

SEQ ID NO: 6974303 - DNA, 22 bp, Homo sapiens
ctgattgagaaggaaggggatc

SEQ ID NO: 6974304 - DNA, 22 bp, Homo sapiens
tttttaagagtctggaaatagt

SEQ ID NO: 6974305 - DNA, 21 bp, Homo sapiens
acagaagtggcttggtctcag

SEQ ID NO: 6974306 - DNA, 22 bp, Homo sapiens
ctcagccccagcccagatagca

SEQ ID NO: 6974307 - DNA, 22 bp, Homo sapiens
agacaatttttggttttgcaag

SEQ ID NO: 6974308 - DNA, 22 bp, Homo sapiens
accagaaggaccagaggcaagg

SEQ ID NO: 6974309 - DNA, 22 bp, Homo sapiens
aagataatgtgtctgtctttgc

SEQ ID NO: 6974310 - DNA, 22 bp, Homo sapiens
agtcagtagatccaaacttttg

SEQ ID NO: 6974311 - DNA, 22 bp, Homo sapiens
gcagctcaaaggccacggacgg

SEQ ID NO: 6974312 - DNA, 23 bp, Homo sapiens
gcccaccctcagcgtcctcacgg

SEQ ID NO: 6974313 - DNA, 22 bp, Homo sapiens
tatccaaaggaacaatcacagc

SEQ ID NO: 6974314 - DNA, 22 bp, Homo sapiens
cgctggtgaaggctaggctagc

SEQ ID NO: 6974315 - DNA, 22 bp, Homo sapiens
actttgcaatgggcagaaccca

SEQ ID NO: 6974316 - DNA, 22 bp, Homo sapiens
cccagctctcgcacttactagc

SEQ ID NO: 6974317 - DNA, 22 bp, Homo sapiens
tttattggatgggtcagctcta

SEQ ID NO: 6974318 - DNA, 22 bp, Homo sapiens
tgacatttgagcatacatgtaa

SEQ ID NO: 6974319 - DNA, 22 bp, Homo sapiens
aaggctgaggagggcctgcagg

SEQ ID NO: 6974320 - DNA, 22 bp, Homo sapiens
aggacagtggacactagtccct

SEQ ID NO: 6974321 - DNA, 22 bp, Homo sapiens
tcacagcttcttgcgggtctga

SEQ ID NO: 6974322 - DNA, 22 bp, Homo sapiens
tccctgtgacaagtctgagttc

SEQ ID NO: 6974323 - DNA, 22 bp, Homo sapiens
atcttggtgcgacaacaaacta

SEQ ID NO: 6974324 - DNA, 22 bp, Homo sapiens
tagacacatacccttgcccaaa

SEQ ID NO: 6974325 - DNA, 22 bp, Homo sapiens
tgattccatgcagtaaaaggca

SEQ ID NO: 6974326 - DNA, 22 bp, Homo sapiens
tgagaccttaaaaggtatgtca

SEQ ID NO: 6974327 - DNA, 22 bp, Homo sapiens
catattgtaaaaggttgaatcc

SEQ ID NO: 6974328 - DNA, 22 bp, Homo sapiens
attggcctgaaactggttcagc

SEQ ID NO: 6974329 - DNA, 22 bp, Homo sapiens
tcatgcaggacttacgagagat

SEQ ID NO: 6974330 - DNA, 18 bp, Homo sapiens
aagcacaggtgtttcagg

SEQ ID NO: 6974331 - DNA, 22 bp, Homo sapiens
ttgtttatggattgtagaaact

SEQ ID NO: 6974332 - DNA, 22 bp, Homo sapiens
ggaggccaaggtgggcggatca

SEQ ID NO: 6974333 - DNA, 22 bp, Homo sapiens
tctgtcagcccctcagctgtca

SEQ ID NO: 6974334 - DNA, 22 bp, Homo sapiens
tgcccctcttgagaagctcagc

SEQ ID NO: 6974335 - DNA, 22 bp, Homo sapiens
caagttcacatgcatccttgct

SEQ ID NO: 6974336 - DNA, 22 bp, Homo sapiens
tgccctgttcctgcctccagct

SEQ ID NO: 6974337 - DNA, 22 bp, Homo sapiens
ggctgtgagcaggcagaatgct

SEQ ID NO: 6974338 - DNA, 22 bp, Homo sapiens
atgctggattgagagcaagggg

SEQ ID NO: 6974339 - DNA, 22 bp, Homo sapiens
agtcctgggtctggagaatgga

SEQ ID NO: 6974340 - DNA, 22 bp, Homo sapiens
tagcaagaggtgaaggtttcat

SEQ ID NO: 6974341 - DNA, 23 bp, Homo sapiens
tcagaacagttcttggtgcatag

SEQ ID NO: 6974342 - DNA, 22 bp, Homo sapiens
aatttctcggttttgatattgt

SEQ ID NO: 6974343 - DNA, 19 bp, Homo sapiens
agaggctgtcacctgtagc

SEQ ID NO: 6974344 - DNA, 22 bp, Homo sapiens
tgcctttaaggaatcattcttg

SEQ ID NO: 6974345 - DNA, 22 bp, Homo sapiens
ctcacatatgctgggatttccg

SEQ ID NO: 6974346 - DNA, 22 bp, Homo sapiens
ctgcagaggtcttgctgatggt

SEQ ID NO: 6974347 - DNA, 22 bp, Homo sapiens
cagatttaagatatttgtattg

SEQ ID NO: 6974348 - DNA, 22 bp, Homo sapiens
tacctggaatcacagaggctga

SEQ ID NO: 6974349 - DNA, 18 bp, Homo sapiens
gaagggagctggaatgca

SEQ ID NO: 6974350 - DNA, 22 bp, Homo sapiens
gtggtaggcacagagaacaaga

SEQ ID NO: 6974351 - DNA, 22 bp, Homo sapiens
atttggaatgtgtttgatcacc

SEQ ID NO: 6974352 - DNA, 22 bp, Homo sapiens
tttattgctggccacctgtagc

SEQ ID NO: 6974353 - DNA, 17 bp, Homo sapiens
tagaagttagaacactt

SEQ ID NO: 6974354 - DNA, 22 bp, Homo sapiens
ttcctgattttgatagcggggc

SEQ ID NO: 6974355 - DNA, 22 bp, Homo sapiens
atgtgggagatttcaggaggtg

SEQ ID NO: 6974356 - DNA, 22 bp, Homo sapiens
aggttcttgactctaccttcca

SEQ ID NO: 6974357 - DNA, 18 bp, Homo sapiens
ggtgaggcggcggccagc

SEQ ID NO: 6974358 - DNA, 22 bp, Homo sapiens
tgtcagcattgatgaaatgtgg

SEQ ID NO: 6974359 - DNA, 22 bp, Homo sapiens
ggtgctgactctgtcgtgagca

SEQ ID NO: 6974360 - DNA, 22 bp, Homo sapiens
tgatttctcatattgttcaaaa

SEQ ID NO: 6974361 - DNA, 22 bp, Homo sapiens
tacaaaaaattgatactgacga

SEQ ID NO: 6974362 - DNA, 23 bp, Homo sapiens
gtggttcttaaaggtccccagtc

SEQ ID NO: 6974363 - DNA, 22 bp, Homo sapiens
aacagtgagaaggtggacagga

SEQ ID NO: 6974364 - DNA, 22 bp, Homo sapiens
gcagggcacaaggacgcacagg

SEQ ID NO: 6974365 - DNA, 19 bp, Homo sapiens
tgagtcactcttacagtca

SEQ ID NO: 6974366 - DNA, 21 bp, Homo sapiens
gagtgaattggggagtttcca

SEQ ID NO: 6974367 - DNA, 22 bp, Homo sapiens
agccaaggtcgccccagggcaa

SEQ ID NO: 6974368 - DNA, 22 bp, Homo sapiens
tagcacagttcctgactctttg

SEQ ID NO: 6974369 - DNA, 22 bp, Homo sapiens
gttgcttttttgataggtggaa

SEQ ID NO: 6974370 - DNA, 22 bp, Homo sapiens
aatactatgttgtgacacatga

SEQ ID NO: 6974371 - DNA, 22 bp, Homo sapiens
gcatcagtagctatagttacaa

SEQ ID NO: 6974372 - DNA, 22 bp, Homo sapiens
tcacagcaacactggggcagac

SEQ ID NO: 6974373 - DNA, 22 bp, Homo sapiens
agctgaagtttagaattgtgaa

SEQ ID NO: 6974374 - DNA, 22 bp, Homo sapiens
agcttcttccaggcagtgactc

SEQ ID NO: 6974375 - DNA, 22 bp, Homo sapiens
aaacctattggcaagaataata

SEQ ID NO: 6974376 - DNA, 22 bp, Homo sapiens
atgtgtggtttaagaattgaat

SEQ ID NO: 6974377 - DNA, 22 bp, Homo sapiens
ccagttagaactacatttccca

SEQ ID NO: 6974378 - DNA, 17 bp, Homo sapiens
atgcacatgtaagagga

SEQ ID NO: 6974379 - DNA, 22 bp, Homo sapiens
gcagaggatcaggctctggaaa

SEQ ID NO: 6974380 - DNA, 22 bp, Homo sapiens
aaatcgtttcgttcctggtttt

SEQ ID NO: 6974381 - DNA, 22 bp, Homo sapiens
aggtcagcaggccaggggcgaa

SEQ ID NO: 6974382 - DNA, 21 bp, Homo sapiens
cctgagcctgtttatccagaa

SEQ ID NO: 6974383 - DNA, 20 bp, Homo sapiens
aatataattctctgaattta

SEQ ID NO: 6974384 - DNA, 22 bp, Homo sapiens
taaagtgtgtgggttctaaatt

SEQ ID NO: 6974385 - DNA, 22 bp, Homo sapiens
cattgtcctctgatgccttccc

SEQ ID NO: 6974386 - DNA, 22 bp, Homo sapiens
aagcaggatggaggttgagtta

SEQ ID NO: 6974387 - DNA, 22 bp, Homo sapiens
cgccgcgccttgggagttccct

SEQ ID NO: 6974388 - DNA, 22 bp, Homo sapiens
gagttaaatattttctgaagtt

SEQ ID NO: 6974389 - DNA, 22 bp, Homo sapiens
atgtctctctctgagtgccaga

SEQ ID NO: 6974390 - DNA, 22 bp, Homo sapiens
ggatatcaaattattaggtaga

SEQ ID NO: 6974391 - DNA, 22 bp, Homo sapiens
aaagggaactctaattatcttc

SEQ ID NO: 6974392 - DNA, 22 bp, Homo sapiens
aggcagcttctgattagcagcg

SEQ ID NO: 6974393 - DNA, 22 bp, Homo sapiens
gagcttcagcgtgtgctaaggg

SEQ ID NO: 6974394 - DNA, 21 bp, Homo sapiens
agcagctgggcaacatggagg

SEQ ID NO: 6974395 - DNA, 22 bp, Homo sapiens
tctgtgtcctgctagctgtctt

SEQ ID NO: 6974396 - DNA, 22 bp, Homo sapiens
tgagaaatggcagcattactgg

SEQ ID NO: 6974397 - DNA, 22 bp, Homo sapiens
aatttgattcagcaaatgttca

SEQ ID NO: 6974398 - DNA, 19 bp, Homo sapiens
tggcatgatgatggatggg

SEQ ID NO: 6974399 - DNA, 22 bp, Homo sapiens
tcactgtaaactaggtcagtcc

SEQ ID NO: 6974400 - DNA, 22 bp, Homo sapiens
ttccttggccacactggtgctt

SEQ ID NO: 6974401 - DNA, 22 bp, Homo sapiens
tgccctgtggggatttccagcc

SEQ ID NO: 6974402 - DNA, 22 bp, Homo sapiens
tgtctagaaatgctgagtctca

SEQ ID NO: 6974403 - DNA, 22 bp, Homo sapiens
ctcctggtgctggggctgccgc

SEQ ID NO: 6974404 - DNA, 22 bp, Homo sapiens
taaatgtgtgtagccatctgtg

SEQ ID NO: 6974405 - DNA, 22 bp, Homo sapiens
cagcagaagtgcatttgtgatt

SEQ ID NO: 6974406 - DNA, 22 bp, Homo sapiens
ctgtggatcagtttggaaactt

SEQ ID NO: 6974407 - DNA, 23 bp, Homo sapiens
tgagttctcatcttggcttctat

SEQ ID NO: 6974408 - DNA, 23 bp, Homo sapiens
agtctctatggcaattcctttac

SEQ ID NO: 6974409 - DNA, 22 bp, Homo sapiens
ctgttaatggaggactacagga

SEQ ID NO: 6974410 - DNA, 22 bp, Homo sapiens
aacaaacagttaagtgtggatg

SEQ ID NO: 6974411 - DNA, 22 bp, Homo sapiens
gactttaaaggttctgctgctt

SEQ ID NO: 6974412 - DNA, 22 bp, Homo sapiens
tcctggattctgccctgaaggc

SEQ ID NO: 6974413 - DNA, 19 bp, Homo sapiens
tcaaattcctaagttctgg

SEQ ID NO: 6974414 - DNA, 22 bp, Homo sapiens
tctcatcattccttcaaagccc

SEQ ID NO: 6974415 - DNA, 22 bp, Homo sapiens
acattctatttcatcatgtcta

SEQ ID NO: 6974416 - DNA, 22 bp, Homo sapiens
atgatcatggaagtgcacccat

SEQ ID NO: 6974417 - DNA, 22 bp, Homo sapiens
tactggcaatttcatatggtgc

SEQ ID NO: 6974418 - DNA, 20 bp, Homo sapiens
aaactagattagcagggcag

SEQ ID NO: 6974419 - DNA, 18 bp, Homo sapiens
cagatccaggcagctatt

SEQ ID NO: 6974420 - DNA, 22 bp, Homo sapiens
ctgtgaattgaatatgactatg

SEQ ID NO: 6974421 - DNA, 22 bp, Homo sapiens
gtgagcagaataagggttgaga

SEQ ID NO: 6974422 - DNA, 22 bp, Homo sapiens
gtggcccacttacgtcatgtgt

SEQ ID NO: 6974423 - DNA, 22 bp, Homo sapiens
agtagtgtacatctgttgattt

SEQ ID NO: 6974424 - DNA, 22 bp, Homo sapiens
agctttatcccttgcccatcga

SEQ ID NO: 6974425 - DNA, 22 bp, Homo sapiens
tgtaggtctcagtgtctgagct

SEQ ID NO: 6974426 - DNA, 22 bp, Homo sapiens
ttcacaagtgtgaaggcagagc

SEQ ID NO: 6974427 - DNA, 22 bp, Homo sapiens
taacatcttgcagtagcagaac

SEQ ID NO: 6974428 - DNA, 22 bp, Homo sapiens
tgaattctctttcctggagcat

SEQ ID NO: 6974429 - DNA, 22 bp, Homo sapiens
gcagcagcaagaaggttggact

SEQ ID NO: 6974430 - DNA, 22 bp, Homo sapiens
ggttttaactacagaattgcaa

SEQ ID NO: 6974431 - DNA, 22 bp, Homo sapiens
ggccagctgtggggccgagcct

SEQ ID NO: 6974432 - DNA, 22 bp, Homo sapiens
ggcagcagggtagccatttctc

SEQ ID NO: 6974433 - DNA, 22 bp, Homo sapiens
tgccagcaagaatagacagtaa

SEQ ID NO: 6974434 - DNA, 22 bp, Homo sapiens
tacagcctccacaggccaagtg

SEQ ID NO: 6974435 - DNA, 22 bp, Homo sapiens
tattgatcaggatccttttcca

SEQ ID NO: 6974436 - DNA, 22 bp, Homo sapiens
ctgtgccacctgagggactcta

SEQ ID NO: 6974437 - DNA, 22 bp, Homo sapiens
actgggctcaagtgattgtcct

SEQ ID NO: 6974438 - DNA, 22 bp, Homo sapiens
ctgctggggtcagagcactggg

SEQ ID NO: 6974439 - DNA, 22 bp, Homo sapiens
aagaaaatcagttctggtcagt

SEQ ID NO: 6974440 - DNA, 22 bp, Homo sapiens
tacagctatgtcttggtgttct

SEQ ID NO: 6974441 - DNA, 22 bp, Homo sapiens
caggcctccactccacgcagac

SEQ ID NO: 6974442 - DNA, 22 bp, Homo sapiens
aatactgtgggatgcagtagga

SEQ ID NO: 6974443 - DNA, 22 bp, Homo sapiens
cttattgttcagatagagatga

SEQ ID NO: 6974444 - DNA, 22 bp, Homo sapiens
agagctggagatgcaggtttcg

SEQ ID NO: 6974445 - DNA, 20 bp, Homo sapiens
agtgggtgatgaaggaatag

SEQ ID NO: 6974446 - DNA, 22 bp, Homo sapiens
cctgagtcccataatgttgcca

SEQ ID NO: 6974447 - DNA, 22 bp, Homo sapiens
tgtagaaattagtaagatcaac

SEQ ID NO: 6974448 - DNA, 22 bp, Homo sapiens
atgggaagtgttagaagatttt

SEQ ID NO: 6974449 - DNA, 22 bp, Homo sapiens
caaatagacaagatggcaggaa

SEQ ID NO: 6974450 - DNA, 22 bp, Homo sapiens
aggtccagttgccagaatggcc

SEQ ID NO: 6974451 - DNA, 23 bp, Homo sapiens
tgctgtgcctttgtctgcctcca

SEQ ID NO: 6974452 - DNA, 22 bp, Homo sapiens
aaagtgctcggcgctggtccca

SEQ ID NO: 6974453 - DNA, 22 bp, Homo sapiens
ttcacataaaagctccaaagaa

SEQ ID NO: 6974454 - DNA, 22 bp, Homo sapiens
agggagctctgggggcacacgg

SEQ ID NO: 6974455 - DNA, 22 bp, Homo sapiens
tgaaggtcatggtaatattttt

SEQ ID NO: 6974456 - DNA, 22 bp, Homo sapiens
agctgggatgaggagcatcctt

SEQ ID NO: 6974457 - DNA, 22 bp, Homo sapiens
tctcccataaaatttatgctta

SEQ ID NO: 6974458 - DNA, 22 bp, Homo sapiens
gttacattacttgtgcagttgt

SEQ ID NO: 6974459 - DNA, 22 bp, Homo sapiens
cccagtggtgctggcatctgtg

SEQ ID NO: 6974460 - DNA, 22 bp, Homo sapiens
tccagtcatctcccttcacatt

SEQ ID NO: 6974461 - DNA, 22 bp, Homo sapiens
ttgggcagaggctgtgcagagg

SEQ ID NO: 6974462 - DNA, 22 bp, Homo sapiens
ttgatgtacagaattgttcaca

SEQ ID NO: 6974463 - DNA, 22 bp, Homo sapiens
tgctcgcgctgttccagcagct

SEQ ID NO: 6974464 - DNA, 22 bp, Homo sapiens
ggtctgggcttgagtccttttg

SEQ ID NO: 6974465 - DNA, 22 bp, Homo sapiens
atatacctgaagttggtaatta

SEQ ID NO: 6974466 - DNA, 22 bp, Homo sapiens
ctgttggtgttgattaaatagt

SEQ ID NO: 6974467 - DNA, 22 bp, Homo sapiens
gtcttgaaattctgttaaagga

SEQ ID NO: 6974468 - DNA, 23 bp, Homo sapiens
ggaagtcagcggagaggtggctg

SEQ ID NO: 6974469 - DNA, 22 bp, Homo sapiens
agtgacatttaaaaccacagct

SEQ ID NO: 6974470 - DNA, 22 bp, Homo sapiens
tctgtcaatatatgtgctgcag

SEQ ID NO: 6974471 - DNA, 22 bp, Homo sapiens
tggaagcactactttaatgcat

SEQ ID NO: 6974472 - DNA, 22 bp, Homo sapiens
ctggaatgtagagacagcttag

SEQ ID NO: 6974473 - DNA, 22 bp, Homo sapiens
tatgtctagacccaagaatatg

SEQ ID NO: 6974474 - DNA, 23 bp, Homo sapiens
agtgctcagggcattaggctaga

SEQ ID NO: 6974475 - DNA, 22 bp, Homo sapiens
tcagccagccagctacaggctt

SEQ ID NO: 6974476 - DNA, 22 bp, Homo sapiens
tttggaaaggtttggccattat

SEQ ID NO: 6974477 - DNA, 22 bp, Homo sapiens
ataatgctgggagaaattgtta

SEQ ID NO: 6974478 - DNA, 21 bp, Homo sapiens
aaaaatgaagttgttcaggaa

SEQ ID NO: 6974479 - DNA, 22 bp, Homo sapiens
aagcagctttctttcctgtgaa

SEQ ID NO: 6974480 - DNA, 22 bp, Homo sapiens
caggaggcatatttaaatccaa

SEQ ID NO: 6974481 - DNA, 22 bp, Homo sapiens
agtcactttctacttggtttct

SEQ ID NO: 6974482 - DNA, 22 bp, Homo sapiens
cctccctggccagagcagcagc

SEQ ID NO: 6974483 - DNA, 22 bp, Homo sapiens
gagtgagtgctgggctgaggct

SEQ ID NO: 6974484 - DNA, 22 bp, Homo sapiens
ctacaacatagtcttctacaga

SEQ ID NO: 6974485 - DNA, 19 bp, Homo sapiens
acagagtccagaggaaagg

SEQ ID NO: 6974486 - DNA, 20 bp, Homo sapiens
aaaatatgtataactcttct

SEQ ID NO: 6974487 - DNA, 22 bp, Homo sapiens
tttagtgtagcattcagagtca

SEQ ID NO: 6974488 - DNA, 22 bp, Homo sapiens
aagagccctcagtgcttgaaat

SEQ ID NO: 6974489 - DNA, 22 bp, Homo sapiens
ataacagatgtgaagtgctaat

SEQ ID NO: 6974490 - DNA, 22 bp, Homo sapiens
ggaaggagcatttgccagttta

SEQ ID NO: 6974491 - DNA, 22 bp, Homo sapiens
actgaggtttacttgaaggaga

SEQ ID NO: 6974492 - DNA, 22 bp, Homo sapiens
gtctgtctgttgttgagaagca

SEQ ID NO: 6974493 - DNA, 22 bp, Homo sapiens
aggaatgtgaggcaagttgtga

SEQ ID NO: 6974494 - DNA, 22 bp, Homo sapiens
gctgcctggctgatgaaaattc

SEQ ID NO: 6974495 - DNA, 16 bp, Homo sapiens
cctctgggatgtttgc

SEQ ID NO: 6974496 - DNA, 22 bp, Homo sapiens
aggtacagggtgaaagtttatg

SEQ ID NO: 6974497 - DNA, 22 bp, Homo sapiens
acaaaaagggagatgaggtaga

SEQ ID NO: 6974498 - DNA, 22 bp, Homo sapiens
atttattgaagcttattacgtt

SEQ ID NO: 6974499 - DNA, 22 bp, Homo sapiens
tttcagaacagggattgggcct

SEQ ID NO: 6974500 - DNA, 22 bp, Homo sapiens
ccagatagaaaagaaggcagga

SEQ ID NO: 6974501 - DNA, 22 bp, Homo sapiens
cttttctgtcagtgcccaaatt

SEQ ID NO: 6974502 - DNA, 22 bp, Homo sapiens
tacaaaacagtgctctggtcct

SEQ ID NO: 6974503 - DNA, 22 bp, Homo sapiens
agtcatcatttatatcaagtct

SEQ ID NO: 6974504 - DNA, 22 bp, Homo sapiens
tagtatggtttcatttgagtaa

SEQ ID NO: 6974505 - DNA, 22 bp, Homo sapiens
tgcaggtgccatcgctgctcat

SEQ ID NO: 6974506 - DNA, 22 bp, Homo sapiens
aatcacaaatgcaagttgtcac

SEQ ID NO: 6974507 - DNA, 22 bp, Homo sapiens
agggtaagtttcatgtggctaa

SEQ ID NO: 6974508 - DNA, 22 bp, Homo sapiens
tccatgagtttgaggaaaagag

SEQ ID NO: 6974509 - DNA, 22 bp, Homo sapiens
tctgagaacataaattgacttc

SEQ ID NO: 6974510 - DNA, 22 bp, Homo sapiens
gaagcccatttgtacagcacat

SEQ ID NO: 6974511 - DNA, 22 bp, Homo sapiens
ttaccttttaggcaagcatctt

SEQ ID NO: 6974512 - DNA, 22 bp, Homo sapiens
tcataaacacactagtatgatt

SEQ ID NO: 6974513 - DNA, 22 bp, Homo sapiens
gaggaaaagagacaggttattg

SEQ ID NO: 6974514 - DNA, 22 bp, Homo sapiens
gcacaggccatgggaggacagc

SEQ ID NO: 6974515 - DNA, 22 bp, Homo sapiens
tctgggaacatggcttggaatc

SEQ ID NO: 6974516 - DNA, 22 bp, Homo sapiens
ttgtgtccctgcggctgaggag

SEQ ID NO: 6974517 - DNA, 22 bp, Homo sapiens
gaagcaatgtgttttcaacatt

SEQ ID NO: 6974518 - DNA, 22 bp, Homo sapiens
tcataaattgattatgtgcttt

SEQ ID NO: 6974519 - DNA, 21 bp, Homo sapiens
ttctccaggcaaccatttcag

SEQ ID NO: 6974520 - DNA, 22 bp, Homo sapiens
attgtgcaatgttttacaattt

SEQ ID NO: 6974521 - DNA, 22 bp, Homo sapiens
aggcctgtcttctttctttcca

SEQ ID NO: 6974522 - DNA, 22 bp, Homo sapiens
agaatgttttcatgagaatgaa

SEQ ID NO: 6974523 - DNA, 22 bp, Homo sapiens
agcaggttgtgatacactcaga

SEQ ID NO: 6974524 - DNA, 22 bp, Homo sapiens
agacctctacgtgcgtctcatc

SEQ ID NO: 6974525 - DNA, 19 bp, Homo sapiens
agggtgctaatcccattca

SEQ ID NO: 6974526 - DNA, 20 bp, Homo sapiens
cattcctgaggaattcatgt

SEQ ID NO: 6974527 - DNA, 22 bp, Homo sapiens
ggccaccttccagttgcctgca

SEQ ID NO: 6974528 - DNA, 22 bp, Homo sapiens
agctcctgtctcaagggagcct

SEQ ID NO: 6974529 - DNA, 22 bp, Homo sapiens
ccagattgaactaaaggttata

SEQ ID NO: 6974530 - DNA, 20 bp, Homo sapiens
aggctgtcatttctggcagg

SEQ ID NO: 6974531 - DNA, 22 bp, Homo sapiens
atacatgtgtgagcgaagatgt

SEQ ID NO: 6974532 - DNA, 22 bp, Homo sapiens
aattcagatggaagattctggc

SEQ ID NO: 6974533 - DNA, 22 bp, Homo sapiens
ttgtccctgcccctgcttgctt

SEQ ID NO: 6974534 - DNA, 22 bp, Homo sapiens
ggcgtttcaccatgttgaccag

SEQ ID NO: 6974535 - DNA, 22 bp, Homo sapiens
aggagctgagggagcgcccttg

SEQ ID NO: 6974536 - DNA, 22 bp, Homo sapiens
aatttcaaagctcactggcata

SEQ ID NO: 6974537 - DNA, 22 bp, Homo sapiens
tctgggcctatagaagtctacc

SEQ ID NO: 6974538 - DNA, 22 bp, Homo sapiens
gggtgtcctgtgccaagctggg

SEQ ID NO: 6974539 - DNA, 20 bp, Homo sapiens
agagagacctaggcctagtc

SEQ ID NO: 6974540 - DNA, 22 bp, Homo sapiens
tgaggtgaatggtgtccctgga

SEQ ID NO: 6974541 - DNA, 22 bp, Homo sapiens
agggaggtccatccctgcagag

SEQ ID NO: 6974542 - DNA, 22 bp, Homo sapiens
tcggctcatccaagatcaagca

SEQ ID NO: 6974543 - DNA, 22 bp, Homo sapiens
taattacagaggtttgccagtt

SEQ ID NO: 6974544 - DNA, 22 bp, Homo sapiens
gctggccatggggagtgaggag

SEQ ID NO: 6974545 - DNA, 19 bp, Homo sapiens
ggtccagcacagttccagg

SEQ ID NO: 6974546 - DNA, 22 bp, Homo sapiens
aagttgtaacagaaatttaatg

SEQ ID NO: 6974547 - DNA, 22 bp, Homo sapiens
cagctgcaggagctgagcactt

SEQ ID NO: 6974548 - DNA, 22 bp, Homo sapiens
cgtcccctcgttcccactttgg

SEQ ID NO: 6974549 - DNA, 21 bp, Homo sapiens
tttggtcccctcacctcctgg

SEQ ID NO: 6974550 - DNA, 23 bp, Homo sapiens
ttatggggaaggtgactgggaca

SEQ ID NO: 6974551 - DNA, 22 bp, Homo sapiens
gcctgccacgcatgcagagtca

SEQ ID NO: 6974552 - DNA, 22 bp, Homo sapiens
ttggaaggaattaaggtcatga

SEQ ID NO: 6974553 - DNA, 22 bp, Homo sapiens
ctacttccaggggtggggctca

SEQ ID NO: 6974554 - DNA, 22 bp, Homo sapiens
cagacaaagcggaaactgttta

SEQ ID NO: 6974555 - DNA, 22 bp, Homo sapiens
tgctgtattacttttacaaact

SEQ ID NO: 6974556 - DNA, 22 bp, Homo sapiens
gatggaatgtcacttctgtggt

SEQ ID NO: 6974557 - DNA, 22 bp, Homo sapiens
aaggttggggggatctgcaagg

SEQ ID NO: 6974558 - DNA, 22 bp, Homo sapiens
ccacaggacagttaatgtgcag

SEQ ID NO: 6974559 - DNA, 19 bp, Homo sapiens
aggcttggctagatttact

SEQ ID NO: 6974560 - DNA, 22 bp, Homo sapiens
gcaggctatgagtttctcacca

SEQ ID NO: 6974561 - DNA, 22 bp, Homo sapiens
tggtggggctttccttctgctt

SEQ ID NO: 6974562 - DNA, 22 bp, Homo sapiens
ctcaggctctggccatccaagg

SEQ ID NO: 6974563 - DNA, 22 bp, Homo sapiens
tttattgtcaatctattcccag

SEQ ID NO: 6974564 - DNA, 22 bp, Homo sapiens
tacatgtgctgggttcttggcc

SEQ ID NO: 6974565 - DNA, 22 bp, Homo sapiens
ctgaggagcagctggcccgcta

SEQ ID NO: 6974566 - DNA, 22 bp, Homo sapiens
cagcaaagtaagctgacatgta

SEQ ID NO: 6974567 - DNA, 22 bp, Homo sapiens
tgagccagtctgtctgggtgaa

SEQ ID NO: 6974568 - DNA, 22 bp, Homo sapiens
acagaaaagtttacttttgctc

SEQ ID NO: 6974569 - DNA, 22 bp, Homo sapiens
gatgcacggtcatgtcttttca

SEQ ID NO: 6974570 - DNA, 22 bp, Homo sapiens
tgggtttgattctcagccaagg

SEQ ID NO: 6974571 - DNA, 22 bp, Homo sapiens
ctgtgctccctctggcgccccg

SEQ ID NO: 6974572 - DNA, 22 bp, Homo sapiens
catggaaagcactcagcccagt

SEQ ID NO: 6974573 - DNA, 22 bp, Homo sapiens
ttctacatcacttaacatgcta

SEQ ID NO: 6974574 - DNA, 22 bp, Homo sapiens
gatgcaaaccttacatggacct

SEQ ID NO: 6974575 - DNA, 22 bp, Homo sapiens
tgaggtcttttatagtgtgtca

SEQ ID NO: 6974576 - DNA, 22 bp, Homo sapiens
gcagcaaaaaagtaatatttat

SEQ ID NO: 6974577 - DNA, 22 bp, Homo sapiens
agcagttatattgaaataaaaa

SEQ ID NO: 6974578 - DNA, 22 bp, Homo sapiens
ttggagtccttgctgcttcact

SEQ ID NO: 6974579 - DNA, 22 bp, Homo sapiens
attctgctgcctagtttatgaa

SEQ ID NO: 6974580 - DNA, 22 bp, Homo sapiens
tgtccctcattgacgctgtgcc

SEQ ID NO: 6974581 - DNA, 22 bp, Homo sapiens
gattggggaaggttttactgac

SEQ ID NO: 6974582 - DNA, 21 bp, Homo sapiens
tgcccatgagcagaagtcacc

SEQ ID NO: 6974583 - DNA, 19 bp, Homo sapiens
tgctctctggtgcttcatg

SEQ ID NO: 6974584 - DNA, 22 bp, Homo sapiens
catcatatggaatttaaagtca

SEQ ID NO: 6974585 - DNA, 22 bp, Homo sapiens
ttgcatcaaatatgtaccacag

SEQ ID NO: 6974586 - DNA, 22 bp, Homo sapiens
ctgtggcaagtctgcctgtcac

SEQ ID NO: 6974587 - DNA, 22 bp, Homo sapiens
ggtgcagggagaggcaggcccc

SEQ ID NO: 6974588 - DNA, 21 bp, Homo sapiens
tctcacaatatgatgccagat

SEQ ID NO: 6974589 - DNA, 22 bp, Homo sapiens
gtctcgctgagcccccattcta

SEQ ID NO: 6974590 - DNA, 22 bp, Homo sapiens
tcaatacttggcacactgcaca

SEQ ID NO: 6974591 - DNA, 22 bp, Homo sapiens
taaaggttattgcactggagtt

SEQ ID NO: 6974592 - DNA, 23 bp, Homo sapiens
atgtggctagtgagaccaagaaa

SEQ ID NO: 6974593 - DNA, 22 bp, Homo sapiens
ttcagtgcacagtactgagact

SEQ ID NO: 6974594 - DNA, 22 bp, Homo sapiens
ttgtgagcaggctgcacaaacc

SEQ ID NO: 6974595 - DNA, 22 bp, Homo sapiens
ctggagaggctgggaacaggtt

SEQ ID NO: 6974596 - DNA, 22 bp, Homo sapiens
tcctgaccacactgccttctgc

SEQ ID NO: 6974597 - DNA, 22 bp, Homo sapiens
aagggttagttggattatttat

SEQ ID NO: 6974598 - DNA, 22 bp, Homo sapiens
ccctgtgctgtcatgctgggcg

SEQ ID NO: 6974599 - DNA, 22 bp, Homo sapiens
taattgctcttggccgtgccag

SEQ ID NO: 6974600 - DNA, 22 bp, Homo sapiens
gctcggccccttccctttcttg

SEQ ID NO: 6974601 - DNA, 23 bp, Homo sapiens
cctctgacaatgatgtcacctgc

SEQ ID NO: 6974602 - DNA, 22 bp, Homo sapiens
tgctgggggtgtctcaccaggc

SEQ ID NO: 6974603 - DNA, 18 bp, Homo sapiens
aagaggaggaaacccagg

SEQ ID NO: 6974604 - DNA, 22 bp, Homo sapiens
atcaacatgaatttctctgaag

SEQ ID NO: 6974605 - DNA, 18 bp, Homo sapiens
tagaagtgtgctatacaa

SEQ ID NO: 6974606 - DNA, 23 bp, Homo sapiens
ccgtgtgtatactctgtaataga

SEQ ID NO: 6974607 - DNA, 22 bp, Homo sapiens
ctcttcaatagattgttgaggg

SEQ ID NO: 6974608 - DNA, 22 bp, Homo sapiens
gtcagctcatccatcccggtgg

SEQ ID NO: 6974609 - DNA, 17 bp, Homo sapiens
tagctggcactggggtt

SEQ ID NO: 6974610 - DNA, 22 bp, Homo sapiens
gataatgagtgttctttgagct

SEQ ID NO: 6974611 - DNA, 22 bp, Homo sapiens
gagtcaacaagtcagatctcac

SEQ ID NO: 6974612 - DNA, 22 bp, Homo sapiens
ggaggaggggtttacattggaa

SEQ ID NO: 6974613 - DNA, 18 bp, Homo sapiens
agcaggtggatttattgg

SEQ ID NO: 6974614 - DNA, 22 bp, Homo sapiens
catgcatagtttttctagaagg

SEQ ID NO: 6974615 - DNA, 22 bp, Homo sapiens
cagttggttttgaggctgtact

SEQ ID NO: 6974616 - DNA, 22 bp, Homo sapiens
gctcagcactttctccaaccac

SEQ ID NO: 6974617 - DNA, 22 bp, Homo sapiens
ctgcagagagtgccgggcagcc

SEQ ID NO: 6974618 - DNA, 22 bp, Homo sapiens
gtgaaggcttgacgtcatcagg

SEQ ID NO: 6974619 - DNA, 22 bp, Homo sapiens
tgacgtcaactgcaaaggcctt

SEQ ID NO: 6974620 - DNA, 22 bp, Homo sapiens
tccacttttcttccatcatcat

SEQ ID NO: 6974621 - DNA, 22 bp, Homo sapiens
tacaatctttatgttgagtggt

SEQ ID NO: 6974622 - DNA, 22 bp, Homo sapiens
cagtgcacgggccagtcctgcc

SEQ ID NO: 6974623 - DNA, 22 bp, Homo sapiens
tagcacagggctcctcaaccca

SEQ ID NO: 6974624 - DNA, 22 bp, Homo sapiens
cccactccctgcacgcctgccg

SEQ ID NO: 6974625 - DNA, 22 bp, Homo sapiens
cataggtcactgtacaggttaa

SEQ ID NO: 6974626 - DNA, 22 bp, Homo sapiens
cttcctgaaagtagtaggttga

SEQ ID NO: 6974627 - DNA, 22 bp, Homo sapiens
cactgcactccagcctggcgac

SEQ ID NO: 6974628 - DNA, 22 bp, Homo sapiens
tgctgcctgatgctttctggac

SEQ ID NO: 6974629 - DNA, 22 bp, Homo sapiens
tctcagtcccattgaagaggtg

SEQ ID NO: 6974630 - DNA, 22 bp, Homo sapiens
attgaatctgcactagtatttt

SEQ ID NO: 6974631 - DNA, 22 bp, Homo sapiens
aagctaggcctcagtttcctga

SEQ ID NO: 6974632 - DNA, 22 bp, Homo sapiens
ttcaagaaagagtggctattcc

SEQ ID NO: 6974633 - DNA, 22 bp, Homo sapiens
cataaagtaacatggaccttaa

SEQ ID NO: 6974634 - DNA, 22 bp, Homo sapiens
ctctgggtctacctgtggccag

SEQ ID NO: 6974635 - DNA, 22 bp, Homo sapiens
ctgctgtgcacccaggaaggct

SEQ ID NO: 6974636 - DNA, 22 bp, Homo sapiens
cgcagggccgcgagcgggacca

SEQ ID NO: 6974637 - DNA, 22 bp, Homo sapiens
tgcacagttaatatgtgacaga

SEQ ID NO: 6974638 - DNA, 22 bp, Homo sapiens
tatgtacaccggggaaggtggg

SEQ ID NO: 6974639 - DNA, 22 bp, Homo sapiens
taagccagatacaccactgaaa

SEQ ID NO: 6974640 - DNA, 22 bp, Homo sapiens
taattttatgacagtgtatttt

SEQ ID NO: 6974641 - DNA, 22 bp, Homo sapiens
ttggaatcctgcctctgctact

SEQ ID NO: 6974642 - DNA, 22 bp, Homo sapiens
gctgggccttccgattctcaag

SEQ ID NO: 6974643 - DNA, 22 bp, Homo sapiens
ctttgcatacaatttttagaaa

SEQ ID NO: 6974644 - DNA, 22 bp, Homo sapiens
taacactggtatttcatttagt

SEQ ID NO: 6974645 - DNA, 22 bp, Homo sapiens
aagagctatgttaaggaagaga

SEQ ID NO: 6974646 - DNA, 22 bp, Homo sapiens
cagccacagctgggtgcctgac

SEQ ID NO: 6974647 - DNA, 22 bp, Homo sapiens
aatagctgggaggcacattcat

SEQ ID NO: 6974648 - DNA, 22 bp, Homo sapiens
ctggacagatcccttgtagctt

SEQ ID NO: 6974649 - DNA, 22 bp, Homo sapiens
tgcctctgggtgaccaaggagc

SEQ ID NO: 6974650 - DNA, 22 bp, Homo sapiens
ggggtggatcaggcaggcccag

SEQ ID NO: 6974651 - DNA, 22 bp, Homo sapiens
tctggatttcaaggatggattg

SEQ ID NO: 6974652 - DNA, 22 bp, Homo sapiens
tgccctcaggagtccctgacca

SEQ ID NO: 6974653 - DNA, 22 bp, Homo sapiens
ccctgccctgggcagaagtggg

SEQ ID NO: 6974654 - DNA, 22 bp, Homo sapiens
tcatacaagatcactttggcca

SEQ ID NO: 6974655 - DNA, 22 bp, Homo sapiens
acagctctccctcagagaaatg

SEQ ID NO: 6974656 - DNA, 22 bp, Homo sapiens
agggaagaggcaaggtttatgg

SEQ ID NO: 6974657 - DNA, 22 bp, Homo sapiens
accccttggagtccgcgcccag

SEQ ID NO: 6974658 - DNA, 22 bp, Homo sapiens
caagcagccccaacatgaggat

SEQ ID NO: 6974659 - DNA, 16 bp, Homo sapiens
tgccaattattgtgtc

SEQ ID NO: 6974660 - DNA, 22 bp, Homo sapiens
tcaggcatgtgtactctttgat

SEQ ID NO: 6974661 - DNA, 22 bp, Homo sapiens
aggcaatggggcttcaggcagg

SEQ ID NO: 6974662 - DNA, 21 bp, Homo sapiens
ttgttgagagttagaacatgg

SEQ ID NO: 6974663 - DNA, 22 bp, Homo sapiens
attggaacggctccgcgtctga

SEQ ID NO: 6974664 - DNA, 22 bp, Homo sapiens
ggagcctgtgggatgagatgtg

SEQ ID NO: 6974665 - DNA, 22 bp, Homo sapiens
tgcaacagactttattaactct

SEQ ID NO: 6974666 - DNA, 22 bp, Homo sapiens
tgaggcagaaattcctgttttc

SEQ ID NO: 6974667 - DNA, 23 bp, Homo sapiens
aagtccagaaggagaactgggag

SEQ ID NO: 6974668 - DNA, 22 bp, Homo sapiens
tcagttatcattgctgtaaatt

SEQ ID NO: 6974669 - DNA, 22 bp, Homo sapiens
atcaactgccccaaatgtattt

SEQ ID NO: 6974670 - DNA, 22 bp, Homo sapiens
gctcagggtgcagtgtccatga

SEQ ID NO: 6974671 - DNA, 22 bp, Homo sapiens
atagatacattaggtaacttgt

SEQ ID NO: 6974672 - DNA, 22 bp, Homo sapiens
tggatgcttaaatcgtttgaat

SEQ ID NO: 6974673 - DNA, 22 bp, Homo sapiens
tctggaagtcaccttagttcct

SEQ ID NO: 6974674 - DNA, 22 bp, Homo sapiens
tttggaagacagggcaggaaag

SEQ ID NO: 6974675 - DNA, 22 bp, Homo sapiens
gaaggctggaaggcaagtagga

SEQ ID NO: 6974676 - DNA, 21 bp, Homo sapiens
cttggcctactagaaaacctt

SEQ ID NO: 6974677 - DNA, 22 bp, Homo sapiens
tcactcatattatctctccaca

SEQ ID NO: 6974678 - DNA, 22 bp, Homo sapiens
ctttgcagtatagcctagtaga

SEQ ID NO: 6974679 - DNA, 22 bp, Homo sapiens
tgttacaggaaatagaattacc

SEQ ID NO: 6974680 - DNA, 22 bp, Homo sapiens
tcccagtgagcacaggtagtgc

SEQ ID NO: 6974681 - DNA, 22 bp, Homo sapiens
atggcttgatagaaagctagtt

SEQ ID NO: 6974682 - DNA, 22 bp, Homo sapiens
gctatgggatgtgctgtggatg

SEQ ID NO: 6974683 - DNA, 22 bp, Homo sapiens
taaagtttatttgaacatctct

SEQ ID NO: 6974684 - DNA, 22 bp, Homo sapiens
attagcctgttgcattttcact

SEQ ID NO: 6974685 - DNA, 22 bp, Homo sapiens
ctggagaaacatcaggcatagg

SEQ ID NO: 6974686 - DNA, 22 bp, Homo sapiens
acctgggatggggccaggttta

SEQ ID NO: 6974687 - DNA, 22 bp, Homo sapiens
tggaaatatacaatgtgtctct

SEQ ID NO: 6974688 - DNA, 20 bp, Homo sapiens
aataaaagaagccttcaccc

SEQ ID NO: 6974689 - DNA, 22 bp, Homo sapiens
taagtttgactaactttatgta

SEQ ID NO: 6974690 - DNA, 23 bp, Homo sapiens
tcaggcagctggggtagttggag

SEQ ID NO: 6974691 - DNA, 20 bp, Homo sapiens
taccctggctatgcttctga

SEQ ID NO: 6974692 - DNA, 22 bp, Homo sapiens
tttaggatgctctattctgact

SEQ ID NO: 6974693 - DNA, 22 bp, Homo sapiens
aaaagtgtccagattatgaaga

SEQ ID NO: 6974694 - DNA, 22 bp, Homo sapiens
aggccctgcattgtactgaggg

SEQ ID NO: 6974695 - DNA, 22 bp, Homo sapiens
gctcagtgaagggtgccaagta

SEQ ID NO: 6974696 - DNA, 22 bp, Homo sapiens
tattggtcttggaaggttttgt

SEQ ID NO: 6974697 - DNA, 22 bp, Homo sapiens
tgctatggaaaacagaatggca

SEQ ID NO: 6974698 - DNA, 22 bp, Homo sapiens
gcattcacattgtggttgcacg

SEQ ID NO: 6974699 - DNA, 22 bp, Homo sapiens
aatattaatagaaggggttcta

SEQ ID NO: 6974700 - DNA, 22 bp, Homo sapiens
tagagttatccttcacaggtat

SEQ ID NO: 6974701 - DNA, 22 bp, Homo sapiens
tcaaatagttgacattaacttg

SEQ ID NO: 6974702 - DNA, 22 bp, Homo sapiens
tccttggaacattgatccaaac

SEQ ID NO: 6974703 - DNA, 19 bp, Homo sapiens
ctctcactcgccacatcct

SEQ ID NO: 6974704 - DNA, 22 bp, Homo sapiens
gagcctggacatctcaggccca

SEQ ID NO: 6974705 - DNA, 22 bp, Homo sapiens
tgcagaagaccttccagggctg

SEQ ID NO: 6974706 - DNA, 23 bp, Homo sapiens
tcaaaccgtctgctggaagacat

SEQ ID NO: 6974707 - DNA, 22 bp, Homo sapiens
ttctttatgcttctgtttaggc

SEQ ID NO: 6974708 - DNA, 22 bp, Homo sapiens
atgttcttccttcaatttggaa

SEQ ID NO: 6974709 - DNA, 22 bp, Homo sapiens
gaggctgccaatgtgtgcatgt

SEQ ID NO: 6974710 - DNA, 22 bp, Homo sapiens
gtgtataatgctttgaagatta

SEQ ID NO: 6974711 - DNA, 22 bp, Homo sapiens
ctctgatgtctgggggctggat

SEQ ID NO: 6974712 - DNA, 22 bp, Homo sapiens
taaagctaaccttagtgaacac

SEQ ID NO: 6974713 - DNA, 22 bp, Homo sapiens
ctggttttgaaaacgcaagctg

SEQ ID NO: 6974714 - DNA, 21 bp, Homo sapiens
ggttcccttgatcattgctaa

SEQ ID NO: 6974715 - DNA, 22 bp, Homo sapiens
ttctactttagcatgctcattc

SEQ ID NO: 6974716 - DNA, 22 bp, Homo sapiens
ctacaggtcaagcagtagctct

SEQ ID NO: 6974717 - DNA, 22 bp, Homo sapiens
gctcagagcatcccagtgaatg

SEQ ID NO: 6974718 - DNA, 22 bp, Homo sapiens
tgttctatcaatttaagggaaa

SEQ ID NO: 6974719 - DNA, 23 bp, Homo sapiens
tctcagaggattcctgggccttg

SEQ ID NO: 6974720 - DNA, 22 bp, Homo sapiens
agggagccagagttgggagctc

SEQ ID NO: 6974721 - DNA, 22 bp, Homo sapiens
gtcaggattataatccccatgg

SEQ ID NO: 6974722 - DNA, 22 bp, Homo sapiens
agctgtattctctttgtattaa

SEQ ID NO: 6974723 - DNA, 22 bp, Homo sapiens
catgctgtggtaaatcactgaa

SEQ ID NO: 6974724 - DNA, 22 bp, Homo sapiens
cagtctcctgggggctgttgtt

SEQ ID NO: 6974725 - DNA, 22 bp, Homo sapiens
caggttctatactgaataattt

SEQ ID NO: 6974726 - DNA, 22 bp, Homo sapiens
ctgaggacattgatgaggcaat

SEQ ID NO: 6974727 - DNA, 22 bp, Homo sapiens
tatattcatattgttgtctctc

SEQ ID NO: 6974728 - DNA, 22 bp, Homo sapiens
gtgcaaaagcagttggattttt

SEQ ID NO: 6974729 - DNA, 22 bp, Homo sapiens
ctgctgagaaccagggagaatt

SEQ ID NO: 6974730 - DNA, 20 bp, Homo sapiens
catggtggaggagcagggcc

SEQ ID NO: 6974731 - DNA, 22 bp, Homo sapiens
gatatgtattccactataaagg

SEQ ID NO: 6974732 - DNA, 19 bp, Homo sapiens
tgagaaggcagtggggagc

SEQ ID NO: 6974733 - DNA, 22 bp, Homo sapiens
gaaaggggcatgtagggatcac

SEQ ID NO: 6974734 - DNA, 22 bp, Homo sapiens
ttaaagcttgattcgaagctta

SEQ ID NO: 6974735 - DNA, 17 bp, Homo sapiens
tgccaagaagagcagag

SEQ ID NO: 6974736 - DNA, 22 bp, Homo sapiens
aggctggcagccacctcagcag

SEQ ID NO: 6974737 - DNA, 22 bp, Homo sapiens
ctgcgtttagagtaggaggcat

SEQ ID NO: 6974738 - DNA, 22 bp, Homo sapiens
ggagtggctatttgtgctggtt

SEQ ID NO: 6974739 - DNA, 22 bp, Homo sapiens
aacttccttgggtatgaaaaca

SEQ ID NO: 6974740 - DNA, 22 bp, Homo sapiens
gcaagaacgaatcctacttgct

SEQ ID NO: 6974741 - DNA, 22 bp, Homo sapiens
gatgttttaggtccctgtagct

SEQ ID NO: 6974742 - DNA, 22 bp, Homo sapiens
ttacaggggaccccgatggtga

SEQ ID NO: 6974743 - DNA, 22 bp, Homo sapiens
ggccaaaagcataatcctcaca

SEQ ID NO: 6974744 - DNA, 21 bp, Homo sapiens
tcaggaggctcagactcctgc

SEQ ID NO: 6974745 - DNA, 22 bp, Homo sapiens
ccaggagagcattgcacagagg

SEQ ID NO: 6974746 - DNA, 22 bp, Homo sapiens
atgtttgttgaatgaagaaagg

SEQ ID NO: 6974747 - DNA, 22 bp, Homo sapiens
aggaacaagggagccttttctc

SEQ ID NO: 6974748 - DNA, 22 bp, Homo sapiens
aaggttacctataatgggaagt

SEQ ID NO: 6974749 - DNA, 22 bp, Homo sapiens
cgttcagcgggctggccgtgga

SEQ ID NO: 6974750 - DNA, 22 bp, Homo sapiens
aggctgaggcaggtggatcacc

SEQ ID NO: 6974751 - DNA, 22 bp, Homo sapiens
ttctctttatgtatttagtggg

SEQ ID NO: 6974752 - DNA, 23 bp, Homo sapiens
ggagatctaggttggcatttcct

SEQ ID NO: 6974753 - DNA, 22 bp, Homo sapiens
agaggcctttctgttgagtgaa

SEQ ID NO: 6974754 - DNA, 22 bp, Homo sapiens
gaatgatttagtgttcaaggaa

SEQ ID NO: 6974755 - DNA, 20 bp, Homo sapiens
ttctaatttgatggagtagc

SEQ ID NO: 6974756 - DNA, 22 bp, Homo sapiens
ttgttctatggtgaggcagcca

SEQ ID NO: 6974757 - DNA, 20 bp, Homo sapiens
tgggcctgagcctgtgggct

SEQ ID NO: 6974758 - DNA, 22 bp, Homo sapiens
ttcacagtaacagggggatatg

SEQ ID NO: 6974759 - DNA, 22 bp, Homo sapiens
ttaggcattagagaaatgcaat

SEQ ID NO: 6974760 - DNA, 22 bp, Homo sapiens
gtggaattcaaaatgtaggcat

SEQ ID NO: 6974761 - DNA, 22 bp, Homo sapiens
cctttaagtcctcttttatatt

SEQ ID NO: 6974762 - DNA, 22 bp, Homo sapiens
tacaagaaactacatgaatgca

SEQ ID NO: 6974763 - DNA, 22 bp, Homo sapiens
gagatgaatcattccatggtca

SEQ ID NO: 6974764 - DNA, 22 bp, Homo sapiens
tggaagaagctacaagcggtga

SEQ ID NO: 6974765 - DNA, 22 bp, Homo sapiens
aactgcactgttcttttctaca

SEQ ID NO: 6974766 - DNA, 22 bp, Homo sapiens
atcatcctagaaggaagctagg

SEQ ID NO: 6974767 - DNA, 22 bp, Homo sapiens
ctgtcacctgccagcataccca

SEQ ID NO: 6974768 - DNA, 22 bp, Homo sapiens
caagaatataaatactttcaaa

SEQ ID NO: 6974769 - DNA, 22 bp, Homo sapiens
gtagttattgctgtttacttct

SEQ ID NO: 6974770 - DNA, 22 bp, Homo sapiens
tgcagaatctcaaccttaccca

SEQ ID NO: 6974771 - DNA, 22 bp, Homo sapiens
gaggaagagagctctgccttgt

SEQ ID NO: 6974772 - DNA, 22 bp, Homo sapiens
gagagccagcagtaaagacatt

SEQ ID NO: 6974773 - DNA, 22 bp, Homo sapiens
tctggctgggaagggggcccga

SEQ ID NO: 6974774 - DNA, 22 bp, Homo sapiens
agcaggctccttccttctctgg

SEQ ID NO: 6974775 - DNA, 22 bp, Homo sapiens
tgaacactgtatattcttcttg

SEQ ID NO: 6974776 - DNA, 22 bp, Homo sapiens
gtgctccaggataggctgacct

SEQ ID NO: 6974777 - DNA, 22 bp, Homo sapiens
ttggaagccctctgcaagatcc

SEQ ID NO: 6974778 - DNA, 19 bp, Homo sapiens
ggctgcctcctgggagatt

SEQ ID NO: 6974779 - DNA, 22 bp, Homo sapiens
tccatgcagagaactgaagtac

SEQ ID NO: 6974780 - DNA, 22 bp, Homo sapiens
cagggccaggctgatggcctgg

SEQ ID NO: 6974781 - DNA, 22 bp, Homo sapiens
gactatttatttacagaaagct

SEQ ID NO: 6974782 - DNA, 22 bp, Homo sapiens
tgtagacatgaccattaacatt

SEQ ID NO: 6974783 - DNA, 22 bp, Homo sapiens
gctgctgtctcatgcgatgcgg

SEQ ID NO: 6974784 - DNA, 22 bp, Homo sapiens
ttggtactccctgtgggcctca

SEQ ID NO: 6974785 - DNA, 22 bp, Homo sapiens
agccctttccaatttgatttat

SEQ ID NO: 6974786 - DNA, 22 bp, Homo sapiens
tagataatttggcatcatattg

SEQ ID NO: 6974787 - DNA, 22 bp, Homo sapiens
tccaaaacagaactctgtgaat

SEQ ID NO: 6974788 - DNA, 22 bp, Homo sapiens
actgccaggccagtagaacata

SEQ ID NO: 6974789 - DNA, 22 bp, Homo sapiens
tggaagagcaggcagacaatgc

SEQ ID NO: 6974790 - DNA, 22 bp, Homo sapiens
ggaaaattggcgcgtggggctg

SEQ ID NO: 6974791 - DNA, 22 bp, Homo sapiens
aaactttaggaaggaatttaca

SEQ ID NO: 6974792 - DNA, 22 bp, Homo sapiens
actggattgggaaagtacttca

SEQ ID NO: 6974793 - DNA, 22 bp, Homo sapiens
ttcataggatagagtgagattt

SEQ ID NO: 6974794 - DNA, 22 bp, Homo sapiens
cttagcatgtggtgtccttgta

SEQ ID NO: 6974795 - DNA, 22 bp, Homo sapiens
actgtgacttctgcctcccggg

SEQ ID NO: 6974796 - DNA, 22 bp, Homo sapiens
ttgcatgtggtaggtcgttcta

SEQ ID NO: 6974797 - DNA, 22 bp, Homo sapiens
tgtaaccatgatgagcaggtat

SEQ ID NO: 6974798 - DNA, 22 bp, Homo sapiens
attagaaaatacatgggctgtc

SEQ ID NO: 6974799 - DNA, 22 bp, Homo sapiens
tgctggagatgaaagggccctg

SEQ ID NO: 6974800 - DNA, 22 bp, Homo sapiens
cagaggccccagaactagctct

SEQ ID NO: 6974801 - DNA, 22 bp, Homo sapiens
agttaatgagcattttggaatg

SEQ ID NO: 6974802 - DNA, 22 bp, Homo sapiens
tgagacagttctgcagctgggt

SEQ ID NO: 6974803 - DNA, 22 bp, Homo sapiens
ccaaagtccatagtttacttta

SEQ ID NO: 6974804 - DNA, 22 bp, Homo sapiens
aggaggtgcgtggtgatcccct

SEQ ID NO: 6974805 - DNA, 22 bp, Homo sapiens
tctccctctcagatttattcac

SEQ ID NO: 6974806 - DNA, 22 bp, Homo sapiens
agagaatacagggtaacaggaa

SEQ ID NO: 6974807 - DNA, 22 bp, Homo sapiens
ctcctcacacccactgcaacca

SEQ ID NO: 6974808 - DNA, 22 bp, Homo sapiens
agcaatgttggggttagaggac

SEQ ID NO: 6974809 - DNA, 22 bp, Homo sapiens
ggcccagagctccctggcacct

SEQ ID NO: 6974810 - DNA, 22 bp, Homo sapiens
cagcagcaacaacggaagcctt

SEQ ID NO: 6974811 - DNA, 22 bp, Homo sapiens
aggtaggcctgaaagtgacagc

SEQ ID NO: 6974812 - DNA, 22 bp, Homo sapiens
ttatgcttaaaatcactaggat

SEQ ID NO: 6974813 - DNA, 22 bp, Homo sapiens
gggctccagccaggtgtcccca

SEQ ID NO: 6974814 - DNA, 22 bp, Homo sapiens
tgagcaccttgtgactggctgc

SEQ ID NO: 6974815 - DNA, 22 bp, Homo sapiens
acatgtaaacatttacagtatt

SEQ ID NO: 6974816 - DNA, 22 bp, Homo sapiens
tgtggccattcttgaggtcgac

SEQ ID NO: 6974817 - DNA, 22 bp, Homo sapiens
gcaggtggatcacctgaggtca

SEQ ID NO: 6974818 - DNA, 22 bp, Homo sapiens
gccaagctttgcaggagtgttg

SEQ ID NO: 6974819 - DNA, 22 bp, Homo sapiens
atgcttcttgagatagaaacac

SEQ ID NO: 6974820 - DNA, 22 bp, Homo sapiens
aggattaactgacctagtgttt

SEQ ID NO: 6974821 - DNA, 22 bp, Homo sapiens
agaacatagtggactttggcaa

SEQ ID NO: 6974822 - DNA, 22 bp, Homo sapiens
ctgtaaatacctgcttgcttct

SEQ ID NO: 6974823 - DNA, 22 bp, Homo sapiens
tggagagctcctatttgctgtc

SEQ ID NO: 6974824 - DNA, 22 bp, Homo sapiens
tatgttgcaccaacctaataat

SEQ ID NO: 6974825 - DNA, 22 bp, Homo sapiens
gagcactgagctggaattggag

SEQ ID NO: 6974826 - DNA, 22 bp, Homo sapiens
attttgttgaggtaattgtcaa

SEQ ID NO: 6974827 - DNA, 22 bp, Homo sapiens
aaatgtcagagctggaaggggc

SEQ ID NO: 6974828 - DNA, 22 bp, Homo sapiens
acccgcgagtctcactgccgct

SEQ ID NO: 6974829 - DNA, 22 bp, Homo sapiens
tgaggccacagtatcagaacag

SEQ ID NO: 6974830 - DNA, 22 bp, Homo sapiens
agtgtctgaacctgcagtggga

SEQ ID NO: 6974831 - DNA, 22 bp, Homo sapiens
gatatgtatgaggagtatgtat

SEQ ID NO: 6974832 - DNA, 22 bp, Homo sapiens
gaataaactcctcagcttcctt

SEQ ID NO: 6974833 - DNA, 22 bp, Homo sapiens
ggccctgctcaggctgcgatga

SEQ ID NO: 6974834 - DNA, 22 bp, Homo sapiens
ttcttattcttgaaatgtggga

SEQ ID NO: 6974835 - DNA, 22 bp, Homo sapiens
ttaccatagaaacttccttttt

SEQ ID NO: 6974836 - DNA, 22 bp, Homo sapiens
aagttactggcaagggctgcag

SEQ ID NO: 6974837 - DNA, 22 bp, Homo sapiens
aatatgacatagaattgagatg

SEQ ID NO: 6974838 - DNA, 22 bp, Homo sapiens
cccgggaggtggagcttgcagt

SEQ ID NO: 6974839 - DNA, 22 bp, Homo sapiens
cctgtaatctcagctactcggg

SEQ ID NO: 6974840 - DNA, 22 bp, Homo sapiens
actctcaaaaagagtagcagtt

SEQ ID NO: 6974841 - DNA, 22 bp, Homo sapiens
agacactgaatcagagggacat

SEQ ID NO: 6974842 - DNA, 22 bp, Homo sapiens
aagttctattgtcactttatta

SEQ ID NO: 6974843 - DNA, 22 bp, Homo sapiens
aatgtcaacacaagagaaatgc

SEQ ID NO: 6974844 - DNA, 22 bp, Homo sapiens
acagtgcacatcctgagtgatt

SEQ ID NO: 6974845 - DNA, 22 bp, Homo sapiens
acatagcatgtttggacacatg

SEQ ID NO: 6974846 - DNA, 22 bp, Homo sapiens
cctgtgccatcctgagcatccc

SEQ ID NO: 6974847 - DNA, 22 bp, Homo sapiens
caaagaatagcatggcatttgt

SEQ ID NO: 6974848 - DNA, 22 bp, Homo sapiens
gctggagctgcagcctgggcct

SEQ ID NO: 6974849 - DNA, 22 bp, Homo sapiens
tttttcatctgattgataactc

SEQ ID NO: 6974850 - DNA, 22 bp, Homo sapiens
tctaacattgtttttcacagat

SEQ ID NO: 6974851 - DNA, 22 bp, Homo sapiens
tctcagtgcagcaaggaattta

SEQ ID NO: 6974852 - DNA, 21 bp, Homo sapiens
gagaatcaggaaggattgatg

SEQ ID NO: 6974853 - DNA, 22 bp, Homo sapiens
aagtagacttttgcatcaagga

SEQ ID NO: 6974854 - DNA, 22 bp, Homo sapiens
tgtttgacacctcagtgtttct

SEQ ID NO: 6974855 - DNA, 22 bp, Homo sapiens
tcagctttggtcacattgagtt

SEQ ID NO: 6974856 - DNA, 22 bp, Homo sapiens
tgtagtccaggaattgtgtctg

SEQ ID NO: 6974857 - DNA, 19 bp, Homo sapiens
acagacatttgcaattagc

SEQ ID NO: 6974858 - DNA, 22 bp, Homo sapiens
ttccaccattcatgctaatatt

SEQ ID NO: 6974859 - DNA, 22 bp, Homo sapiens
atacatgtacataaatgtagca

SEQ ID NO: 6974860 - DNA, 22 bp, Homo sapiens
cctttctacagatgcctcttgc

SEQ ID NO: 6974861 - DNA, 22 bp, Homo sapiens
atacgggttgttaaaaaatcat

SEQ ID NO: 6974862 - DNA, 22 bp, Homo sapiens
gagtccaggctcagaaacccgt

SEQ ID NO: 6974863 - DNA, 20 bp, Homo sapiens
gttgctttagtctggtttgg

SEQ ID NO: 6974864 - DNA, 22 bp, Homo sapiens
tttgggaaggcagacatcccac

SEQ ID NO: 6974865 - DNA, 22 bp, Homo sapiens
aaatgctacatacacatcaggg

SEQ ID NO: 6974866 - DNA, 22 bp, Homo sapiens
agctctttggcactgagcagca

SEQ ID NO: 6974867 - DNA, 22 bp, Homo sapiens
ggatagttctggatattttaag

SEQ ID NO: 6974868 - DNA, 22 bp, Homo sapiens
tactacaagggccctaaaaggt

SEQ ID NO: 6974869 - DNA, 22 bp, Homo sapiens
cagtaaacactagcattcttgg

SEQ ID NO: 6974870 - DNA, 22 bp, Homo sapiens
tacaatgtgtgcttcttgtcac

SEQ ID NO: 6974871 - DNA, 22 bp, Homo sapiens
tgcttggctagcttggcagctc

SEQ ID NO: 6974872 - DNA, 22 bp, Homo sapiens
cctgggcatcaacaagcagaga

SEQ ID NO: 6974873 - DNA, 22 bp, Homo sapiens
gtcaagtcatgactcaaaggaa

SEQ ID NO: 6974874 - DNA, 22 bp, Homo sapiens
tgtctgatcatgaggcagggct

SEQ ID NO: 6974875 - DNA, 22 bp, Homo sapiens
aaacacttgcaaaatggttcct

SEQ ID NO: 6974876 - DNA, 22 bp, Homo sapiens
agcctggatccatgtggctacc

SEQ ID NO: 6974877 - DNA, 22 bp, Homo sapiens
gaaggtgcagtggctggaggct

SEQ ID NO: 6974878 - DNA, 22 bp, Homo sapiens
ttggcctttgctgggctgttga

SEQ ID NO: 6974879 - DNA, 22 bp, Homo sapiens
gcagagactccactgtcttgtg

SEQ ID NO: 6974880 - DNA, 22 bp, Homo sapiens
tgcagggacacgaagacaaata

SEQ ID NO: 6974881 - DNA, 22 bp, Homo sapiens
gtggcagcggcccaggccgtct

SEQ ID NO: 6974882 - DNA, 22 bp, Homo sapiens
tctctaaagcctggaagaggag

SEQ ID NO: 6974883 - DNA, 22 bp, Homo sapiens
agaatatatgactgcaagacta

SEQ ID NO: 6974884 - DNA, 22 bp, Homo sapiens
aaatgcttgtatatttcttggt

SEQ ID NO: 6974885 - DNA, 22 bp, Homo sapiens
gtggcatgtgcctgtaatctca

SEQ ID NO: 6974886 - DNA, 22 bp, Homo sapiens
tcacagaattgacatgggaatc

SEQ ID NO: 6974887 - DNA, 22 bp, Homo sapiens
agattttagtttggggaggtgc

SEQ ID NO: 6974888 - DNA, 22 bp, Homo sapiens
gacagagattgaatcaggaaat

SEQ ID NO: 6974889 - DNA, 22 bp, Homo sapiens
tagctgtggccttgctggtctg

SEQ ID NO: 6974890 - DNA, 22 bp, Homo sapiens
tgtgattatattgtagtacatt

SEQ ID NO: 6974891 - DNA, 22 bp, Homo sapiens
gggtgggactctttggcctgag

SEQ ID NO: 6974892 - DNA, 22 bp, Homo sapiens
ttcttcaaaatccagcatgatt

SEQ ID NO: 6974893 - DNA, 22 bp, Homo sapiens
atgcatcaggcactaggaatag

SEQ ID NO: 6974894 - DNA, 22 bp, Homo sapiens
ctctgaggctccatgcaggctt

SEQ ID NO: 6974895 - DNA, 22 bp, Homo sapiens
ttctgacagtaatcagtttgct

SEQ ID NO: 6974896 - DNA, 22 bp, Homo sapiens
ttagtacattcactgtggtagg

SEQ ID NO: 6974897 - DNA, 17 bp, Homo sapiens
ttaaggtggatcagcac

SEQ ID NO: 6974898 - DNA, 22 bp, Homo sapiens
gcatcccctgcattctgttttc

SEQ ID NO: 6974899 - DNA, 22 bp, Homo sapiens
aataacagattttcaagctgtg

SEQ ID NO: 6974900 - DNA, 22 bp, Homo sapiens
aggaaaagtgtgaagtatggag

SEQ ID NO: 6974901 - DNA, 22 bp, Homo sapiens
gtaatgcttttgatacagggac

SEQ ID NO: 6974902 - DNA, 22 bp, Homo sapiens
tgtcaaacaccaacatttctcc

SEQ ID NO: 6974903 - DNA, 22 bp, Homo sapiens
ttagagttttatcattgcctta

SEQ ID NO: 6974904 - DNA, 22 bp, Homo sapiens
acagtggaggccatatggtcct

SEQ ID NO: 6974905 - DNA, 22 bp, Homo sapiens
aatgaggctggatttggagctc

SEQ ID NO: 6974906 - DNA, 22 bp, Homo sapiens
tgaatttcacaaggtgaggata

SEQ ID NO: 6974907 - DNA, 22 bp, Homo sapiens
ccccagcacttggagtggggag

SEQ ID NO: 6974908 - DNA, 22 bp, Homo sapiens
ggccttccttcccagcctactg

SEQ ID NO: 6974909 - DNA, 22 bp, Homo sapiens
gactttataaatgagaggcgga

SEQ ID NO: 6974910 - DNA, 22 bp, Homo sapiens
tgttctcatctggatctcagga

SEQ ID NO: 6974911 - DNA, 22 bp, Homo sapiens
agctcccagagtcctctgccca

SEQ ID NO: 6974912 - DNA, 22 bp, Homo sapiens
agggcaagggttgaagataaga

SEQ ID NO: 6974913 - DNA, 22 bp, Homo sapiens
tgcagcttatctctttggcagt

SEQ ID NO: 6974914 - DNA, 22 bp, Homo sapiens
actctgggatcttgaaaagagt

SEQ ID NO: 6974915 - DNA, 22 bp, Homo sapiens
gtccagggaaatagcgacaggg

SEQ ID NO: 6974916 - DNA, 22 bp, Homo sapiens
gaccttccttctttgctccggg

SEQ ID NO: 6974917 - DNA, 22 bp, Homo sapiens
gcaagagacttttatgtctgcc

SEQ ID NO: 6974918 - DNA, 22 bp, Homo sapiens
actctgtaattctatatgcagt

SEQ ID NO: 6974919 - DNA, 22 bp, Homo sapiens
ataaattatgaatggccctttt

SEQ ID NO: 6974920 - DNA, 22 bp, Homo sapiens
taagagcagacacaacctgaga

SEQ ID NO: 6974921 - DNA, 22 bp, Homo sapiens
gctgagtcttgagcactgagca

SEQ ID NO: 6974922 - DNA, 22 bp, Homo sapiens
gtgcgtgtgcctatcaataaag

SEQ ID NO: 6974923 - DNA, 22 bp, Homo sapiens
taggaaactaatacagtctgga

SEQ ID NO: 6974924 - DNA, 22 bp, Homo sapiens
ttggctcattaaagatgataat

SEQ ID NO: 6974925 - DNA, 22 bp, Homo sapiens
tcagatactagctctcagcctc

SEQ ID NO: 6974926 - DNA, 22 bp, Homo sapiens
tgtcattttcatcctaaggagc

SEQ ID NO: 6974927 - DNA, 20 bp, Homo sapiens
agtgtctgggcctcaggccc

SEQ ID NO: 6974928 - DNA, 22 bp, Homo sapiens
catgttcatcagatcaattgta

SEQ ID NO: 6974929 - DNA, 22 bp, Homo sapiens
cctcaggcttacgggcaatgga

SEQ ID NO: 6974930 - DNA, 22 bp, Homo sapiens
catttagttatactaaaacatt

SEQ ID NO: 6974931 - DNA, 22 bp, Homo sapiens
aggtttctgctgtcctccttct

SEQ ID NO: 6974932 - DNA, 22 bp, Homo sapiens
ctgagccaaggggacagtgaca

SEQ ID NO: 6974933 - DNA, 21 bp, Homo sapiens
ggtcaggcatgtgccctgagc

SEQ ID NO: 6974934 - DNA, 18 bp, Homo sapiens
taggaggctcctgggggc

SEQ ID NO: 6974935 - DNA, 22 bp, Homo sapiens
tatgtactcatcaactattgaa

SEQ ID NO: 6974936 - DNA, 22 bp, Homo sapiens
acatcttcaaagtgctttgcaa

SEQ ID NO: 6974937 - DNA, 22 bp, Homo sapiens
ttctttgggattgtagctgtct

SEQ ID NO: 6974938 - DNA, 22 bp, Homo sapiens
gtgatgtcacacccttgataga

SEQ ID NO: 6974939 - DNA, 22 bp, Homo sapiens
atgtgttcacgtgcacatgtgc

SEQ ID NO: 6974940 - DNA, 22 bp, Homo sapiens
gttgaggaggcactcactgtca

SEQ ID NO: 6974941 - DNA, 22 bp, Homo sapiens
gggaaggaaagttattagcaga

SEQ ID NO: 6974942 - DNA, 22 bp, Homo sapiens
ccagtggctacaggggggttga

SEQ ID NO: 6974943 - DNA, 22 bp, Homo sapiens
ctgtcagttctatctttgtgct

SEQ ID NO: 6974944 - DNA, 22 bp, Homo sapiens
aagacttgaccaggttgaaggc

SEQ ID NO: 6974945 - DNA, 22 bp, Homo sapiens
atgctgttaagataatgggttc

SEQ ID NO: 6974946 - DNA, 22 bp, Homo sapiens
gggcatgttttcgtaaactcag

SEQ ID NO: 6974947 - DNA, 18 bp, Homo sapiens
atctgatgcaattcaata

SEQ ID NO: 6974948 - DNA, 22 bp, Homo sapiens
tttacactttcctgggaacatc

SEQ ID NO: 6974949 - DNA, 23 bp, Homo sapiens
tgggcggggcttttcactctgcc

SEQ ID NO: 6974950 - DNA, 22 bp, Homo sapiens
tttggcaacggagaacttactc

SEQ ID NO: 6974951 - DNA, 22 bp, Homo sapiens
ccagtgtgtttaatgcattcca

SEQ ID NO: 6974952 - DNA, 22 bp, Homo sapiens
gaaattgaataccctgcatgaa

SEQ ID NO: 6974953 - DNA, 22 bp, Homo sapiens
cctgagcctgagtggtgcaggg

SEQ ID NO: 6974954 - DNA, 22 bp, Homo sapiens
cagggtccccgggtctcctgtg

SEQ ID NO: 6974955 - DNA, 20 bp, Homo sapiens
cctcttgcaaaagagatgac

SEQ ID NO: 6974956 - DNA, 22 bp, Homo sapiens
acaggtgatgacatttgaacca

SEQ ID NO: 6974957 - DNA, 22 bp, Homo sapiens
caggaaatgcgtagttgaactt

SEQ ID NO: 6974958 - DNA, 22 bp, Homo sapiens
cagatgctgctcacctgattat

SEQ ID NO: 6974959 - DNA, 22 bp, Homo sapiens
tgcagggcagtttgtttcggca

SEQ ID NO: 6974960 - DNA, 22 bp, Homo sapiens
tcactagcattgttgaaggact

SEQ ID NO: 6974961 - DNA, 22 bp, Homo sapiens
ggtcagcaggtccagccagtgc

SEQ ID NO: 6974962 - DNA, 22 bp, Homo sapiens
agtctctttgtataaataggca

SEQ ID NO: 6974963 - DNA, 22 bp, Homo sapiens
caggatggcagagaaaagggtg

SEQ ID NO: 6974964 - DNA, 22 bp, Homo sapiens
aactgcaaagccaatctcagga

SEQ ID NO: 6974965 - DNA, 22 bp, Homo sapiens
cctgggccaggcttgggaatgc

SEQ ID NO: 6974966 - DNA, 22 bp, Homo sapiens
atccactctaagatctgtggtg

SEQ ID NO: 6974967 - DNA, 22 bp, Homo sapiens
ccaggctgtaaacaccttcaaa

SEQ ID NO: 6974968 - DNA, 22 bp, Homo sapiens
agtgcagagacctggtcaggca

SEQ ID NO: 6974969 - DNA, 22 bp, Homo sapiens
aggtcctgagggttcgtctgca

SEQ ID NO: 6974970 - DNA, 22 bp, Homo sapiens
agagacacatcatataagtata

SEQ ID NO: 6974971 - DNA, 22 bp, Homo sapiens
ttactttatagaacactggggg

SEQ ID NO: 6974972 - DNA, 22 bp, Homo sapiens
ccagccttgactgccccagcac

SEQ ID NO: 6974973 - DNA, 23 bp, Homo sapiens
agtaccatgtgttccttctcgtt

SEQ ID NO: 6974974 - DNA, 22 bp, Homo sapiens
tccaggttttctgaaggcagga

SEQ ID NO: 6974975 - DNA, 22 bp, Homo sapiens
tagagcttagagaatgagtttg

SEQ ID NO: 6974976 - DNA, 22 bp, Homo sapiens
agggctttacttctcagttcta

SEQ ID NO: 6974977 - DNA, 22 bp, Homo sapiens
tgaatttaagcactgatgttaa

SEQ ID NO: 6974978 - DNA, 21 bp, Homo sapiens
actgtgaagatgctataaact

SEQ ID NO: 6974979 - DNA, 22 bp, Homo sapiens
tttggtttttacctgctgagag

SEQ ID NO: 6974980 - DNA, 22 bp, Homo sapiens
ttgggttagaacggtaacatac

SEQ ID NO: 6974981 - DNA, 22 bp, Homo sapiens
tagtgattaaaggcagaatgtt

SEQ ID NO: 6974982 - DNA, 22 bp, Homo sapiens
atttgcttcttgcttccagcac

SEQ ID NO: 6974983 - DNA, 22 bp, Homo sapiens
atacagaatactaattcctgag

SEQ ID NO: 6974984 - DNA, 22 bp, Homo sapiens
atccaaaatttactgtagcatt

SEQ ID NO: 6974985 - DNA, 22 bp, Homo sapiens
gctgtggctgaccaccaggggg

SEQ ID NO: 6974986 - DNA, 22 bp, Homo sapiens
tggaaacttatctgacacgaac

SEQ ID NO: 6974987 - DNA, 22 bp, Homo sapiens
cacccctagtgtttgtgggccc

SEQ ID NO: 6974988 - DNA, 22 bp, Homo sapiens
acatctctgggtcctccatgca

SEQ ID NO: 6974989 - DNA, 22 bp, Homo sapiens
tgcattattacaaggtaagact

SEQ ID NO: 6974990 - DNA, 22 bp, Homo sapiens
gaatttcagaggtaacatcatc

SEQ ID NO: 6974991 - DNA, 22 bp, Homo sapiens
gcttccagtgactttggtcgtg

SEQ ID NO: 6974992 - DNA, 20 bp, Homo sapiens
gaagtcatatgaagcagctt

SEQ ID NO: 6974993 - DNA, 22 bp, Homo sapiens
tggcaacacctggaagacatgg

SEQ ID NO: 6974994 - DNA, 22 bp, Homo sapiens
ataaatcagttagtgccccact

SEQ ID NO: 6974995 - DNA, 22 bp, Homo sapiens
gctctccaggtccaagaatcca

SEQ ID NO: 6974996 - DNA, 22 bp, Homo sapiens
agaatcactggaattgtttttt

SEQ ID NO: 6974997 - DNA, 22 bp, Homo sapiens
gcctggcaccacagcctttcag

SEQ ID NO: 6974998 - DNA, 22 bp, Homo sapiens
tctgcagctttttggtggggtg

SEQ ID NO: 6974999 - DNA, 22 bp, Homo sapiens
aagattcttaaatttgtttctc

SEQ ID NO: 6975000 - DNA, 19 bp, Homo sapiens
gagaatctctttgatgttt

SEQ ID NO: 6975001 - DNA, 22 bp, Homo sapiens
gtgcaggtgacctaatccatgt

SEQ ID NO: 6975002 - DNA, 22 bp, Homo sapiens
atggaatgggaagagtgtgtga

SEQ ID NO: 6975003 - DNA, 22 bp, Homo sapiens
ttattggaaaagggctgtaatt

SEQ ID NO: 6975004 - DNA, 22 bp, Homo sapiens
tagggatgatgtctaaaatcat

SEQ ID NO: 6975005 - DNA, 22 bp, Homo sapiens
ttatgtgtgtacatgcatatgt

SEQ ID NO: 6975006 - DNA, 22 bp, Homo sapiens
tgaaatcttagccattctgcct

SEQ ID NO: 6975007 - DNA, 22 bp, Homo sapiens
gtttgcatttattagtcttctg

SEQ ID NO: 6975008 - DNA, 22 bp, Homo sapiens
tggctctgaccaggtagaggag

SEQ ID NO: 6975009 - DNA, 22 bp, Homo sapiens
tcattttggggtttgtcatctt

SEQ ID NO: 6975010 - DNA, 22 bp, Homo sapiens
cccagccctgacctattggaaa

SEQ ID NO: 6975011 - DNA, 22 bp, Homo sapiens
attatgtgtaacgagtttattg

SEQ ID NO: 6975012 - DNA, 22 bp, Homo sapiens
gcagttctccagaataaagggt

SEQ ID NO: 6975013 - DNA, 21 bp, Homo sapiens
acagtacttgagatcttttga

SEQ ID NO: 6975014 - DNA, 22 bp, Homo sapiens
ggcccagtgtaccccaggcagt

SEQ ID NO: 6975015 - DNA, 22 bp, Homo sapiens
gctttccctgccctcagaagga

SEQ ID NO: 6975016 - DNA, 22 bp, Homo sapiens
actgtgatgtttgtgatcatct

SEQ ID NO: 6975017 - DNA, 22 bp, Homo sapiens
atgctttggccaatgagaagtg

SEQ ID NO: 6975018 - DNA, 22 bp, Homo sapiens
tccgaggccaaagctgtgaata

SEQ ID NO: 6975019 - DNA, 22 bp, Homo sapiens
ctggagttcgactgagttgaat

SEQ ID NO: 6975020 - DNA, 22 bp, Homo sapiens
attcttctctgggttgggttca

SEQ ID NO: 6975021 - DNA, 22 bp, Homo sapiens
cccccagatgcgagccatagcc

SEQ ID NO: 6975022 - DNA, 21 bp, Homo sapiens
tgctctggtagaaactctttc

SEQ ID NO: 6975023 - DNA, 22 bp, Homo sapiens
tgatgcagaatcctagagtgtc

SEQ ID NO: 6975024 - DNA, 20 bp, Homo sapiens
ttctgcctagggttagcctg

SEQ ID NO: 6975025 - DNA, 22 bp, Homo sapiens
ctggatctgtttgtgcttgtgg

SEQ ID NO: 6975026 - DNA, 22 bp, Homo sapiens
taatcactgggcgtttggtact

SEQ ID NO: 6975027 - DNA, 20 bp, Homo sapiens
catttgggatcatgaggttt

SEQ ID NO: 6975028 - DNA, 22 bp, Homo sapiens
tagtaaacaggcaagggaccac

SEQ ID NO: 6975029 - DNA, 22 bp, Homo sapiens
gcctttgcaccatcagtgcaat

SEQ ID NO: 6975030 - DNA, 22 bp, Homo sapiens
tcacagttcatctgataaacta

SEQ ID NO: 6975031 - DNA, 22 bp, Homo sapiens
cttcttgattgctttcaaacca

SEQ ID NO: 6975032 - DNA, 22 bp, Homo sapiens
ctcggagggcaacagaagtgct

SEQ ID NO: 6975033 - DNA, 22 bp, Homo sapiens
actacacagggatgtgactacc

SEQ ID NO: 6975034 - DNA, 22 bp, Homo sapiens
ctcagagagttaagtgaattac

SEQ ID NO: 6975035 - DNA, 22 bp, Homo sapiens
gtagaggtagacttccttgtct

SEQ ID NO: 6975036 - DNA, 22 bp, Homo sapiens
cttgccagggactcagtcaggg

SEQ ID NO: 6975037 - DNA, 22 bp, Homo sapiens
gaatacatgattaaagtttgat

SEQ ID NO: 6975038 - DNA, 22 bp, Homo sapiens
ctgtgactttgaataagaggga

SEQ ID NO: 6975039 - DNA, 22 bp, Homo sapiens
ttctcaggcacttcttccccgc

SEQ ID NO: 6975040 - DNA, 22 bp, Homo sapiens
atccccagaaagaccgatgtac

SEQ ID NO: 6975041 - DNA, 22 bp, Homo sapiens
cttaaaagagatgacggcaggg

SEQ ID NO: 6975042 - DNA, 22 bp, Homo sapiens
aggcaggagtgaccctgacagg

SEQ ID NO: 6975043 - DNA, 22 bp, Homo sapiens
ctcaaatataagctaaatgtgg

SEQ ID NO: 6975044 - DNA, 22 bp, Homo sapiens
atagacaatggtttgccaagaa

SEQ ID NO: 6975045 - DNA, 22 bp, Homo sapiens
aaagttctaaaactctttgtga

SEQ ID NO: 6975046 - DNA, 22 bp, Homo sapiens
aggtagtagcatgtatcagtac

SEQ ID NO: 6975047 - DNA, 22 bp, Homo sapiens
aggtggcctaaggtggcactgg

SEQ ID NO: 6975048 - DNA, 22 bp, Homo sapiens
agcactatgcaacagggacagc

SEQ ID NO: 6975049 - DNA, 22 bp, Homo sapiens
agtatgtagtgcaatcagtcag

SEQ ID NO: 6975050 - DNA, 22 bp, Homo sapiens
gcagcattaccaagacatggca

SEQ ID NO: 6975051 - DNA, 22 bp, Homo sapiens
tcactttaagcgggaggcagag

SEQ ID NO: 6975052 - DNA, 20 bp, Homo sapiens
ttacactttgtagcattttt

SEQ ID NO: 6975053 - DNA, 22 bp, Homo sapiens
aggcagatgaacctgggttgag

SEQ ID NO: 6975054 - DNA, 22 bp, Homo sapiens
taagagcagaacagcaacatat

SEQ ID NO: 6975055 - DNA, 22 bp, Homo sapiens
ttggactcatgatcacttcggg

SEQ ID NO: 6975056 - DNA, 22 bp, Homo sapiens
gtagagtcaggacggcaattct

SEQ ID NO: 6975057 - DNA, 22 bp, Homo sapiens
tctggcagtttgagaaaggcta

SEQ ID NO: 6975058 - DNA, 22 bp, Homo sapiens
ttcctggggctccagctaccag

SEQ ID NO: 6975059 - DNA, 22 bp, Homo sapiens
agcatcaacaatgaacataaat

SEQ ID NO: 6975060 - DNA, 23 bp, Homo sapiens
gcctgggactcaggaggagctca

SEQ ID NO: 6975061 - DNA, 22 bp, Homo sapiens
ctgcaccgtgtctcgggctgcc

SEQ ID NO: 6975062 - DNA, 22 bp, Homo sapiens
atcagaccatccagcgtggatg

SEQ ID NO: 6975063 - DNA, 22 bp, Homo sapiens
gtctggctagagacaccctccc

SEQ ID NO: 6975064 - DNA, 22 bp, Homo sapiens
aaggccagattctctctagggg

SEQ ID NO: 6975065 - DNA, 22 bp, Homo sapiens
ttgtcaagattgagagatgact

SEQ ID NO: 6975066 - DNA, 22 bp, Homo sapiens
aggctccattccaggagctaga

SEQ ID NO: 6975067 - DNA, 21 bp, Homo sapiens
ttggaccatacaagttatgca

SEQ ID NO: 6975068 - DNA, 22 bp, Homo sapiens
ttagataaagtgatgtaggcta

SEQ ID NO: 6975069 - DNA, 22 bp, Homo sapiens
tcctcagtgctagccaactgcc

SEQ ID NO: 6975070 - DNA, 22 bp, Homo sapiens
aggaagctgcctgggatgggaa

SEQ ID NO: 6975071 - DNA, 22 bp, Homo sapiens
cagtaactgatgtgatcaaacg

SEQ ID NO: 6975072 - DNA, 22 bp, Homo sapiens
tgggctgtccagcacctgggct

SEQ ID NO: 6975073 - DNA, 22 bp, Homo sapiens
ctgcaggggaccaaagtctgac

SEQ ID NO: 6975074 - DNA, 22 bp, Homo sapiens
aaaagggacgacaacaggccac

SEQ ID NO: 6975075 - DNA, 22 bp, Homo sapiens
acatgggagagaaataaatgta

SEQ ID NO: 6975076 - DNA, 22 bp, Homo sapiens
tcgttaaatgctaaaactgaca

SEQ ID NO: 6975077 - DNA, 16 bp, Homo sapiens
tggaaggggtctccgg

SEQ ID NO: 6975078 - DNA, 22 bp, Homo sapiens
cactgtacagcattaacaaggc

SEQ ID NO: 6975079 - DNA, 22 bp, Homo sapiens
ttgaggtcatctgaagtactag

SEQ ID NO: 6975080 - DNA, 21 bp, Homo sapiens
aattacagatggaattacaga

SEQ ID NO: 6975081 - DNA, 22 bp, Homo sapiens
aagaacatgttaaaagattcac

SEQ ID NO: 6975082 - DNA, 21 bp, Homo sapiens
tatgtagactcgttagaatgc

SEQ ID NO: 6975083 - DNA, 23 bp, Homo sapiens
tcatttcaggttgcatggtacca

SEQ ID NO: 6975084 - DNA, 22 bp, Homo sapiens
atttacagatgatgctatttga

SEQ ID NO: 6975085 - DNA, 22 bp, Homo sapiens
ggcagtgggtggatctcaggga

SEQ ID NO: 6975086 - DNA, 22 bp, Homo sapiens
tgaaatgtaagcatagaggttg

SEQ ID NO: 6975087 - DNA, 22 bp, Homo sapiens
agcagaaacagccagtctggac

SEQ ID NO: 6975088 - DNA, 22 bp, Homo sapiens
tctgtgcctccgtaacacacca

SEQ ID NO: 6975089 - DNA, 22 bp, Homo sapiens
agtccaggtctctgagtcacaa

SEQ ID NO: 6975090 - DNA, 22 bp, Homo sapiens
ttctgttacaagtgaaaaaatg

SEQ ID NO: 6975091 - DNA, 22 bp, Homo sapiens
gcctttaaagctggcaggcttt

SEQ ID NO: 6975092 - DNA, 22 bp, Homo sapiens
cccaggctgtctgtcctttgct

SEQ ID NO: 6975093 - DNA, 22 bp, Homo sapiens
tcctggactcaggaccacagga

SEQ ID NO: 6975094 - DNA, 22 bp, Homo sapiens
ccactcagcacagtggatgcag

SEQ ID NO: 6975095 - DNA, 22 bp, Homo sapiens
ctgcaccctcaaactcctgggc

SEQ ID NO: 6975096 - DNA, 22 bp, Homo sapiens
tcagcactatacattttgaata

SEQ ID NO: 6975097 - DNA, 17 bp, Homo sapiens
agtggcaggcagatggg

SEQ ID NO: 6975098 - DNA, 22 bp, Homo sapiens
tgagatatctgttaattttctt

SEQ ID NO: 6975099 - DNA, 22 bp, Homo sapiens
ctgttcatggaaaaatagttgg

SEQ ID NO: 6975100 - DNA, 23 bp, Homo sapiens
tgagcacctacctggagccaagc

SEQ ID NO: 6975101 - DNA, 22 bp, Homo sapiens
tgatatgcatgtaagggagaca

SEQ ID NO: 6975102 - DNA, 22 bp, Homo sapiens
gggaaattgtgtgagatctttg

SEQ ID NO: 6975103 - DNA, 22 bp, Homo sapiens
agggcagaccacgtgcaaggat

SEQ ID NO: 6975104 - DNA, 22 bp, Homo sapiens
actggtggtttctccccagaga

SEQ ID NO: 6975105 - DNA, 22 bp, Homo sapiens
ttgccttgcagaatgtctgttt

SEQ ID NO: 6975106 - DNA, 21 bp, Homo sapiens
tttccctcattgtgttggcac

SEQ ID NO: 6975107 - DNA, 22 bp, Homo sapiens
ggcggtggttgagaggacggcg

SEQ ID NO: 6975108 - DNA, 22 bp, Homo sapiens
gtttctggagtgactataactg

SEQ ID NO: 6975109 - DNA, 22 bp, Homo sapiens
aggcagtggatgtcaggaatgg

SEQ ID NO: 6975110 - DNA, 22 bp, Homo sapiens
tgtggtctcctgtcttggcctt

SEQ ID NO: 6975111 - DNA, 22 bp, Homo sapiens
ttctcctggagtgcttgttggg

SEQ ID NO: 6975112 - DNA, 22 bp, Homo sapiens
caagattgaactcaaccctgct

SEQ ID NO: 6975113 - DNA, 18 bp, Homo sapiens
tctgaatattatgcagtg

SEQ ID NO: 6975114 - DNA, 23 bp, Homo sapiens
tacaaggtagcattagtttcttc

SEQ ID NO: 6975115 - DNA, 22 bp, Homo sapiens
tcctgtgagtagatagtattgt

SEQ ID NO: 6975116 - DNA, 22 bp, Homo sapiens
atactgaaagggtgttacctaa

SEQ ID NO: 6975117 - DNA, 22 bp, Homo sapiens
ttgagaaaaccatcgtaagaat

SEQ ID NO: 6975118 - DNA, 22 bp, Homo sapiens
tcctggatcagcgggggcaggc

SEQ ID NO: 6975119 - DNA, 22 bp, Homo sapiens
aagatacagacagagccaaaat

SEQ ID NO: 6975120 - DNA, 22 bp, Homo sapiens
agcccaggagtttgaggctgtg

SEQ ID NO: 6975121 - DNA, 21 bp, Homo sapiens
tatacatgtgcacacacatgc

SEQ ID NO: 6975122 - DNA, 22 bp, Homo sapiens
gggcttcgagggtcgcgtttgg

SEQ ID NO: 6975123 - DNA, 22 bp, Homo sapiens
agagtcagtcactggcactttg

SEQ ID NO: 6975124 - DNA, 22 bp, Homo sapiens
agaacaatgcgtattttactcc

SEQ ID NO: 6975125 - DNA, 22 bp, Homo sapiens
tgctatctctatatccatttat

SEQ ID NO: 6975126 - DNA, 22 bp, Homo sapiens
aggcttctggaatccagtttct

SEQ ID NO: 6975127 - DNA, 22 bp, Homo sapiens
gtgccgcgacgcagtcggtgcc

SEQ ID NO: 6975128 - DNA, 22 bp, Homo sapiens
actgagggccaaaggcactgag

SEQ ID NO: 6975129 - DNA, 22 bp, Homo sapiens
gttcctcagcccttacttagcc

SEQ ID NO: 6975130 - DNA, 20 bp, Homo sapiens
agggcagagggattacaggc

SEQ ID NO: 6975131 - DNA, 22 bp, Homo sapiens
ggagaggaaatgccagcacttc

SEQ ID NO: 6975132 - DNA, 22 bp, Homo sapiens
ttacagtaatgtattatttaac

SEQ ID NO: 6975133 - DNA, 22 bp, Homo sapiens
actttgcagctgaggacatttc

SEQ ID NO: 6975134 - DNA, 22 bp, Homo sapiens
agctcacattctcatcagatgt

SEQ ID NO: 6975135 - DNA, 22 bp, Homo sapiens
gttctaatattttaaaagccaa

SEQ ID NO: 6975136 - DNA, 22 bp, Homo sapiens
gtgtatcagtaactgtggacag

SEQ ID NO: 6975137 - DNA, 22 bp, Homo sapiens
gaggagagatggtagattgggt

SEQ ID NO: 6975138 - DNA, 22 bp, Homo sapiens
ccttgtgcaggttcatgatggg

SEQ ID NO: 6975139 - DNA, 22 bp, Homo sapiens
tgccttggtgcttcttcatgtg

SEQ ID NO: 6975140 - DNA, 22 bp, Homo sapiens
gcatgattaatatgcttactgt

SEQ ID NO: 6975141 - DNA, 22 bp, Homo sapiens
cagtgctttgggaggctgagga

SEQ ID NO: 6975142 - DNA, 22 bp, Homo sapiens
gctggggctgggctgaggaaga

SEQ ID NO: 6975143 - DNA, 21 bp, Homo sapiens
tggtcagtatttcagttacat

SEQ ID NO: 6975144 - DNA, 22 bp, Homo sapiens
aagaacatggactgtggggtta

SEQ ID NO: 6975145 - DNA, 23 bp, Homo sapiens
tgtttttcattcacatgggctgt

SEQ ID NO: 6975146 - DNA, 22 bp, Homo sapiens
ttttacattgggaaatgcctct

SEQ ID NO: 6975147 - DNA, 22 bp, Homo sapiens
ttagggaaggctgctgtcagct

SEQ ID NO: 6975148 - DNA, 22 bp, Homo sapiens
gaacaaacagtcaggacagtct

SEQ ID NO: 6975149 - DNA, 22 bp, Homo sapiens
tggaatctctttggggactgaa

SEQ ID NO: 6975150 - DNA, 22 bp, Homo sapiens
tacctggctggggaatagccag

SEQ ID NO: 6975151 - DNA, 22 bp, Homo sapiens
cttattttaagtcagtttgggt

SEQ ID NO: 6975152 - DNA, 19 bp, Homo sapiens
ggccttgctctgtggcagc

SEQ ID NO: 6975153 - DNA, 22 bp, Homo sapiens
tgctccagcctatgctctccgg

SEQ ID NO: 6975154 - DNA, 21 bp, Homo sapiens
cctgacctaatttgccatcag

SEQ ID NO: 6975155 - DNA, 22 bp, Homo sapiens
ttcaagtctggagatctggaac

SEQ ID NO: 6975156 - DNA, 22 bp, Homo sapiens
cttccagattctgaaattttca

SEQ ID NO: 6975157 - DNA, 22 bp, Homo sapiens
tacagagagctccggacattca

SEQ ID NO: 6975158 - DNA, 22 bp, Homo sapiens
ctgtctgttttgtatacaggcc

SEQ ID NO: 6975159 - DNA, 20 bp, Homo sapiens
tgtagacagtgtgatccagg

SEQ ID NO: 6975160 - DNA, 22 bp, Homo sapiens
ccttccctaaagcgtcgcttag

SEQ ID NO: 6975161 - DNA, 22 bp, Homo sapiens
cctggctggcaagatcgtgaag

SEQ ID NO: 6975162 - DNA, 22 bp, Homo sapiens
tgtataaacttaagcaggaacc

SEQ ID NO: 6975163 - DNA, 22 bp, Homo sapiens
gcttccttgggaaaattagatg

SEQ ID NO: 6975164 - DNA, 22 bp, Homo sapiens
tcctggcagtaatttgatgttg

SEQ ID NO: 6975165 - DNA, 22 bp, Homo sapiens
ttccagccatggtttccctatg

SEQ ID NO: 6975166 - DNA, 22 bp, Homo sapiens
tcctgctggtgatggttaaggt

SEQ ID NO: 6975167 - DNA, 22 bp, Homo sapiens
gacaagataatgaagtgcaatt

SEQ ID NO: 6975168 - DNA, 22 bp, Homo sapiens
aattatgattggtctaaaccag

SEQ ID NO: 6975169 - DNA, 22 bp, Homo sapiens
tgagttctcatgaaatctagtt

SEQ ID NO: 6975170 - DNA, 22 bp, Homo sapiens
ttctattgacattcactgtaac

SEQ ID NO: 6975171 - DNA, 22 bp, Homo sapiens
ctgaaattattgtttaatcaaa

SEQ ID NO: 6975172 - DNA, 22 bp, Homo sapiens
cctcctggtgggcgcttctggc

SEQ ID NO: 6975173 - DNA, 22 bp, Homo sapiens
ctttttcaagtcaaagagggta

SEQ ID NO: 6975174 - DNA, 22 bp, Homo sapiens
aggctttgcaaaaaagctcata

SEQ ID NO: 6975175 - DNA, 22 bp, Homo sapiens
gctgctcttttcagagatgaga

SEQ ID NO: 6975176 - DNA, 22 bp, Homo sapiens
tgaatttaaaataaatgtagtt

SEQ ID NO: 6975177 - DNA, 22 bp, Homo sapiens
tttatgcctccagatcttgctt

SEQ ID NO: 6975178 - DNA, 20 bp, Homo sapiens
acacttcatttgcagcagct

SEQ ID NO: 6975179 - DNA, 22 bp, Homo sapiens
aactacagaaaaggtaagctct

SEQ ID NO: 6975180 - DNA, 22 bp, Homo sapiens
gtccccagaaaggtgaggcagg

SEQ ID NO: 6975181 - DNA, 22 bp, Homo sapiens
tctgaaagctagaaaatgctct

SEQ ID NO: 6975182 - DNA, 22 bp, Homo sapiens
ggctgcctccactgcttgtccc

SEQ ID NO: 6975183 - DNA, 22 bp, Homo sapiens
ggcaagtatttgtgcatctaca

SEQ ID NO: 6975184 - DNA, 22 bp, Homo sapiens
acagaatagtcagctgtaggcc

SEQ ID NO: 6975185 - DNA, 22 bp, Homo sapiens
agagtgtgtctatggaaggggt

SEQ ID NO: 6975186 - DNA, 22 bp, Homo sapiens
ccaaatgtgcctgtttcaacaa

SEQ ID NO: 6975187 - DNA, 22 bp, Homo sapiens
aacacagtcctgctcacttatt

SEQ ID NO: 6975188 - DNA, 22 bp, Homo sapiens
atgcaaagcacacacagaatcc

SEQ ID NO: 6975189 - DNA, 22 bp, Homo sapiens
cattaagatgcaaacctaacta

SEQ ID NO: 6975190 - DNA, 22 bp, Homo sapiens
ctttcagttagtacctagtggc

SEQ ID NO: 6975191 - DNA, 22 bp, Homo sapiens
aggtaatgcaactactttgcta

SEQ ID NO: 6975192 - DNA, 22 bp, Homo sapiens
ggcatgcatgcatgcacctgtg

SEQ ID NO: 6975193 - DNA, 22 bp, Homo sapiens
gcatgtgttagagtgtgcatgc

SEQ ID NO: 6975194 - DNA, 22 bp, Homo sapiens
gcagcagctctcaaagtggtct

SEQ ID NO: 6975195 - DNA, 22 bp, Homo sapiens
ttatttgacttcttgctatgct

SEQ ID NO: 6975196 - DNA, 22 bp, Homo sapiens
gagctgggacatgggtcctctc

SEQ ID NO: 6975197 - DNA, 22 bp, Homo sapiens
ttggctcaggctttcattgtaa

SEQ ID NO: 6975198 - DNA, 22 bp, Homo sapiens
ttgatgtaatactttgcaacca

SEQ ID NO: 6975199 - DNA, 22 bp, Homo sapiens
acttgaaacatctttaaatgta

SEQ ID NO: 6975200 - DNA, 17 bp, Homo sapiens
tctgtgatagtgtagat

SEQ ID NO: 6975201 - DNA, 22 bp, Homo sapiens
aatgtatgtgtatatcaaatca

SEQ ID NO: 6975202 - DNA, 22 bp, Homo sapiens
ttacagggttgcagcattgacg

SEQ ID NO: 6975203 - DNA, 22 bp, Homo sapiens
tagatttcgctgcatctcaatc

SEQ ID NO: 6975204 - DNA, 22 bp, Homo sapiens
tttgtagagaatgttaagcact

SEQ ID NO: 6975205 - DNA, 22 bp, Homo sapiens
tctctcaaatatctaacacctc

SEQ ID NO: 6975206 - DNA, 22 bp, Homo sapiens
tttggaatgaaacagcagagcc

SEQ ID NO: 6975207 - DNA, 22 bp, Homo sapiens
tgagtctggcggagggaggagc

SEQ ID NO: 6975208 - DNA, 22 bp, Homo sapiens
tatcaggaattgaatggcttca

SEQ ID NO: 6975209 - DNA, 22 bp, Homo sapiens
gtctcctatgttgaaacaaaat

SEQ ID NO: 6975210 - DNA, 22 bp, Homo sapiens
tggaaatacaagaagtatgtca

SEQ ID NO: 6975211 - DNA, 22 bp, Homo sapiens
ctgctgaggtatactatgtgac

SEQ ID NO: 6975212 - DNA, 19 bp, Homo sapiens
aggcaccgagggccactct

SEQ ID NO: 6975213 - DNA, 22 bp, Homo sapiens
agtttttctgctggtctcacta

SEQ ID NO: 6975214 - DNA, 22 bp, Homo sapiens
cagggccagttctcgcagcagt

SEQ ID NO: 6975215 - DNA, 22 bp, Homo sapiens
gctcagggcctggctgcggact

SEQ ID NO: 6975216 - DNA, 22 bp, Homo sapiens
atggtgtttataggcaaagatc

SEQ ID NO: 6975217 - DNA, 22 bp, Homo sapiens
ctgctgatgtaagccatgctct

SEQ ID NO: 6975218 - DNA, 18 bp, Homo sapiens
ttattcagacgcatatga

SEQ ID NO: 6975219 - DNA, 22 bp, Homo sapiens
ctctgctggtagctcattccat

SEQ ID NO: 6975220 - DNA, 22 bp, Homo sapiens
agccctgcacagttcgggagga

SEQ ID NO: 6975221 - DNA, 22 bp, Homo sapiens
agagacaagggacctctggaga

SEQ ID NO: 6975222 - DNA, 22 bp, Homo sapiens
tgaaatgcttctctgaaaatac

SEQ ID NO: 6975223 - DNA, 20 bp, Homo sapiens
ataggaaagggaggggcttt

SEQ ID NO: 6975224 - DNA, 22 bp, Homo sapiens
gtctcagtgcccaatgccataa

SEQ ID NO: 6975225 - DNA, 22 bp, Homo sapiens
tagggatgagcaactggtagtg

SEQ ID NO: 6975226 - DNA, 22 bp, Homo sapiens
agcagctgccagagagagttcc

SEQ ID NO: 6975227 - DNA, 18 bp, Homo sapiens
tttgagaatgcatgactg

SEQ ID NO: 6975228 - DNA, 18 bp, Homo sapiens
tctgaggaatggaagagc

SEQ ID NO: 6975229 - DNA, 22 bp, Homo sapiens
tacactcacccagcttggggcc

SEQ ID NO: 6975230 - DNA, 22 bp, Homo sapiens
ctttcacagcacaagcctgcct

SEQ ID NO: 6975231 - DNA, 22 bp, Homo sapiens
tgaagggcaaccccaggcccag

SEQ ID NO: 6975232 - DNA, 22 bp, Homo sapiens
acacagttcaggatcaaatagc

SEQ ID NO: 6975233 - DNA, 22 bp, Homo sapiens
cacaatgcagcatgtaaatgca

SEQ ID NO: 6975234 - DNA, 22 bp, Homo sapiens
tcttgaaagcattttcttcatc

SEQ ID NO: 6975235 - DNA, 22 bp, Homo sapiens
gaatgtttgtgcagagtcatct

SEQ ID NO: 6975236 - DNA, 20 bp, Homo sapiens
actggagtaccctagagaag

SEQ ID NO: 6975237 - DNA, 22 bp, Homo sapiens
aggccttgatttaaattttgat

SEQ ID NO: 6975238 - DNA, 22 bp, Homo sapiens
tatatgttgatactaattctgg

SEQ ID NO: 6975239 - DNA, 18 bp, Homo sapiens
actggctttagcatcaga

SEQ ID NO: 6975240 - DNA, 22 bp, Homo sapiens
tcatcccagaccacttattttc

SEQ ID NO: 6975241 - DNA, 22 bp, Homo sapiens
gtgatggaagtcttgttccggg

SEQ ID NO: 6975242 - DNA, 22 bp, Homo sapiens
tctttccaaggactctgtagca

SEQ ID NO: 6975243 - DNA, 22 bp, Homo sapiens
tctgggtcttagttttcttgat

SEQ ID NO: 6975244 - DNA, 22 bp, Homo sapiens
aacttgaagaggctttttggca

SEQ ID NO: 6975245 - DNA, 22 bp, Homo sapiens
tccaggccccccacgctaatgg

SEQ ID NO: 6975246 - DNA, 22 bp, Homo sapiens
taaaaggaggttgaagctgtca

SEQ ID NO: 6975247 - DNA, 22 bp, Homo sapiens
cacaggagttaacataattaag

SEQ ID NO: 6975248 - DNA, 22 bp, Homo sapiens
tcttcaaaccctggttttgtga

SEQ ID NO: 6975249 - DNA, 22 bp, Homo sapiens
agatgctgtcacacacactgtt

SEQ ID NO: 6975250 - DNA, 22 bp, Homo sapiens
agacaatatgtatattaagaat

SEQ ID NO: 6975251 - DNA, 22 bp, Homo sapiens
ggctggtctccaacccccgatc

SEQ ID NO: 6975252 - DNA, 22 bp, Homo sapiens
gaattttatcttattacttgca

SEQ ID NO: 6975253 - DNA, 22 bp, Homo sapiens
gtctttgccacacttctgtaca

SEQ ID NO: 6975254 - DNA, 22 bp, Homo sapiens
ggcctgctggggcctcagacac

SEQ ID NO: 6975255 - DNA, 22 bp, Homo sapiens
cttagaacatacttagtgtgat

SEQ ID NO: 6975256 - DNA, 20 bp, Homo sapiens
agcacataactctaccagaa

SEQ ID NO: 6975257 - DNA, 22 bp, Homo sapiens
cagattggattaaatagctgcc

SEQ ID NO: 6975258 - DNA, 22 bp, Homo sapiens
tgcttcaggagatgtcaccatg

SEQ ID NO: 6975259 - DNA, 22 bp, Homo sapiens
tgaagtatacaggctctgctaa

SEQ ID NO: 6975260 - DNA, 22 bp, Homo sapiens
gacacagataatttagttaaaa

SEQ ID NO: 6975261 - DNA, 22 bp, Homo sapiens
aaaataggtacggattagaatg

SEQ ID NO: 6975262 - DNA, 22 bp, Homo sapiens
cactttatattctaagacggcc

SEQ ID NO: 6975263 - DNA, 23 bp, Homo sapiens
tgtgaaggtgggtccaagggctg

SEQ ID NO: 6975264 - DNA, 22 bp, Homo sapiens
cactgagctgatttcaggtgcc

SEQ ID NO: 6975265 - DNA, 22 bp, Homo sapiens
tccagggatggtaatgagcagt

SEQ ID NO: 6975266 - DNA, 22 bp, Homo sapiens
gcaaggctcccgcagcccaggg

SEQ ID NO: 6975267 - DNA, 22 bp, Homo sapiens
gctagggaacctcttctgagga

SEQ ID NO: 6975268 - DNA, 22 bp, Homo sapiens
tgtgttccagagcatccaggtc

SEQ ID NO: 6975269 - DNA, 22 bp, Homo sapiens
tggtcttccatgaggagttcat

SEQ ID NO: 6975270 - DNA, 22 bp, Homo sapiens
gggccaccccactgcccacgct

SEQ ID NO: 6975271 - DNA, 22 bp, Homo sapiens
aagcccagaatcaagtctactg

SEQ ID NO: 6975272 - DNA, 19 bp, Homo sapiens
tggtacaaaccaagagaga

SEQ ID NO: 6975273 - DNA, 22 bp, Homo sapiens
tcagttactcaacagaggtgga

SEQ ID NO: 6975274 - DNA, 22 bp, Homo sapiens
tagtggagggtgtagctgctgg

SEQ ID NO: 6975275 - DNA, 22 bp, Homo sapiens
catcagtgcccttggggatgcc

SEQ ID NO: 6975276 - DNA, 22 bp, Homo sapiens
catgtgttaatctttctgcaaa

SEQ ID NO: 6975277 - DNA, 22 bp, Homo sapiens
tccagtcccttgcctccacagc

SEQ ID NO: 6975278 - DNA, 22 bp, Homo sapiens
tttcctcatttatctgctggga

SEQ ID NO: 6975279 - DNA, 22 bp, Homo sapiens
tttctgataattttgtgaaatc

SEQ ID NO: 6975280 - DNA, 22 bp, Homo sapiens
ctgagcccaggcgggagctgag

SEQ ID NO: 6975281 - DNA, 22 bp, Homo sapiens
ctctctggaagggggagctgat

SEQ ID NO: 6975282 - DNA, 22 bp, Homo sapiens
agaaccattttgacagatatac

SEQ ID NO: 6975283 - DNA, 22 bp, Homo sapiens
tggtcctgcttgctgcttaaga

SEQ ID NO: 6975284 - DNA, 22 bp, Homo sapiens
tagatgatagggccagaatttg

SEQ ID NO: 6975285 - DNA, 22 bp, Homo sapiens
agtggcccttagtggcaaagtc

SEQ ID NO: 6975286 - DNA, 22 bp, Homo sapiens
aggctaagttgattaaattgtt

SEQ ID NO: 6975287 - DNA, 22 bp, Homo sapiens
ggcaactcttcttgcaatgggg

SEQ ID NO: 6975288 - DNA, 22 bp, Homo sapiens
agtggagcaggcggcgctcact

SEQ ID NO: 6975289 - DNA, 22 bp, Homo sapiens
aaagaactacctgtatgatatt

SEQ ID NO: 6975290 - DNA, 22 bp, Homo sapiens
gaatgctgagtcttatctctta

SEQ ID NO: 6975291 - DNA, 22 bp, Homo sapiens
aacacagatcaaaatatttcct

SEQ ID NO: 6975292 - DNA, 22 bp, Homo sapiens
ttgacagctacctacatggtgg

SEQ ID NO: 6975293 - DNA, 22 bp, Homo sapiens
ttaggaatttattccattgttg

SEQ ID NO: 6975294 - DNA, 22 bp, Homo sapiens
ctctagaagctgaggggcccaa

SEQ ID NO: 6975295 - DNA, 22 bp, Homo sapiens
ccagcatcagcacccaaggagc

SEQ ID NO: 6975296 - DNA, 22 bp, Homo sapiens
tgggcctggagtttgtccagag

SEQ ID NO: 6975297 - DNA, 20 bp, Homo sapiens
tttattgagcacgtactgtg

SEQ ID NO: 6975298 - DNA, 22 bp, Homo sapiens
attacagtgccacctcgtggtc

SEQ ID NO: 6975299 - DNA, 22 bp, Homo sapiens
gtagcaccgcgagacttggggc

SEQ ID NO: 6975300 - DNA, 22 bp, Homo sapiens
tccaagggaatgtgggcaatgc

SEQ ID NO: 6975301 - DNA, 22 bp, Homo sapiens
tgcatttgtaacattcaagaat

SEQ ID NO: 6975302 - DNA, 22 bp, Homo sapiens
aatgtgtcatttcccacaggtg

SEQ ID NO: 6975303 - DNA, 22 bp, Homo sapiens
tgtcagaggctcagggtctcag

SEQ ID NO: 6975304 - DNA, 22 bp, Homo sapiens
cagacagcaaatctgcttgcat

SEQ ID NO: 6975305 - DNA, 22 bp, Homo sapiens
atgaactaagagtcattagtgt

SEQ ID NO: 6975306 - DNA, 22 bp, Homo sapiens
tgccaagtcactagcaagtggg

SEQ ID NO: 6975307 - DNA, 22 bp, Homo sapiens
tcctcaaattagcagatcatag

SEQ ID NO: 6975308 - DNA, 22 bp, Homo sapiens
agcttgggtgtgcctgcgagct

SEQ ID NO: 6975309 - DNA, 20 bp, Homo sapiens
tgtgacgacatcaaaatatt

SEQ ID NO: 6975310 - DNA, 22 bp, Homo sapiens
tgattggtcaggctgtggtgac

SEQ ID NO: 6975311 - DNA, 22 bp, Homo sapiens
ctgtacaatgttacctatttat

SEQ ID NO: 6975312 - DNA, 22 bp, Homo sapiens
ggactttaggaagggccaagtg

SEQ ID NO: 6975313 - DNA, 20 bp, Homo sapiens
tagggctcattatgatctcc

SEQ ID NO: 6975314 - DNA, 22 bp, Homo sapiens
aaggaagaaatgaataggtgga

SEQ ID NO: 6975315 - DNA, 22 bp, Homo sapiens
cagcctggattgcagaatgcta

SEQ ID NO: 6975316 - DNA, 22 bp, Homo sapiens
tatctccatctggagagcaaaa

SEQ ID NO: 6975317 - DNA, 22 bp, Homo sapiens
aatctaacttcatagctgattt

SEQ ID NO: 6975318 - DNA, 20 bp, Homo sapiens
tcctctaattttaagctgta

SEQ ID NO: 6975319 - DNA, 22 bp, Homo sapiens
agctttgggcagaagaggattc

SEQ ID NO: 6975320 - DNA, 22 bp, Homo sapiens
aagccagtaagtttttgtcatt

SEQ ID NO: 6975321 - DNA, 23 bp, Homo sapiens
tttcagtttggaccagccccgac

SEQ ID NO: 6975322 - DNA, 22 bp, Homo sapiens
taggagtctcaaaaagactcag

SEQ ID NO: 6975323 - DNA, 23 bp, Homo sapiens
catttctaggtgtgtttggccat

SEQ ID NO: 6975324 - DNA, 22 bp, Homo sapiens
gtgctgagtgactttttcttca

SEQ ID NO: 6975325 - DNA, 22 bp, Homo sapiens
agatcagattctgcctttgtga

SEQ ID NO: 6975326 - DNA, 22 bp, Homo sapiens
gatggcctgtatttgggccaga

SEQ ID NO: 6975327 - DNA, 22 bp, Homo sapiens
gcggcgcctaagccccgacctc

SEQ ID NO: 6975328 - DNA, 22 bp, Homo sapiens
tgttttgtttatgagagcacag

SEQ ID NO: 6975329 - DNA, 22 bp, Homo sapiens
aactagaacgtctagttgctgg

SEQ ID NO: 6975330 - DNA, 19 bp, Homo sapiens
tgactgtgttattccaatg

SEQ ID NO: 6975331 - DNA, 22 bp, Homo sapiens
tggccttggacagagcgctcct

SEQ ID NO: 6975332 - DNA, 19 bp, Homo sapiens
agtggctgggcagaagcaa

SEQ ID NO: 6975333 - DNA, 22 bp, Homo sapiens
agaggctgggcaggacccacag

SEQ ID NO: 6975334 - DNA, 22 bp, Homo sapiens
cgaggcagacaaaagttggaag

SEQ ID NO: 6975335 - DNA, 22 bp, Homo sapiens
atattttggcaaatgtctagat

SEQ ID NO: 6975336 - DNA, 22 bp, Homo sapiens
aagccattcccatagacttcag

SEQ ID NO: 6975337 - DNA, 22 bp, Homo sapiens
cagctttcttccttctgtctgt

SEQ ID NO: 6975338 - DNA, 22 bp, Homo sapiens
acattgaactacttgtaatgag

SEQ ID NO: 6975339 - DNA, 22 bp, Homo sapiens
tccttcctggggtctctgctgc

SEQ ID NO: 6975340 - DNA, 22 bp, Homo sapiens
tttgtggaactctcttcttgca

SEQ ID NO: 6975341 - DNA, 22 bp, Homo sapiens
ctggcgcaacagaaaatctgga

SEQ ID NO: 6975342 - DNA, 22 bp, Homo sapiens
aggctggaaatcactagattcc

SEQ ID NO: 6975343 - DNA, 15 bp, Homo sapiens
acaggtagacaattg

SEQ ID NO: 6975344 - DNA, 22 bp, Homo sapiens
cgccgcgcgttgattttctgtt

SEQ ID NO: 6975345 - DNA, 22 bp, Homo sapiens
ccaggtgtggccacatggctgg

SEQ ID NO: 6975346 - DNA, 22 bp, Homo sapiens
ttcatctggaagttcccaaggc

SEQ ID NO: 6975347 - DNA, 22 bp, Homo sapiens
caggagtcccccataccgcgtc

SEQ ID NO: 6975348 - DNA, 18 bp, Homo sapiens
ctaagaggtcgtttctca

SEQ ID NO: 6975349 - DNA, 22 bp, Homo sapiens
ccaagtccccaagcatgccagg

SEQ ID NO: 6975350 - DNA, 22 bp, Homo sapiens
gctggcctgggcagaggctatg

SEQ ID NO: 6975351 - DNA, 22 bp, Homo sapiens
tgctcacatatcacctacctaa

SEQ ID NO: 6975352 - DNA, 22 bp, Homo sapiens
ttctcagtttcatagctgagca

SEQ ID NO: 6975353 - DNA, 22 bp, Homo sapiens
agtttagaattcattttgccca

SEQ ID NO: 6975354 - DNA, 22 bp, Homo sapiens
ccctggcctccaggcagtcctg

SEQ ID NO: 6975355 - DNA, 22 bp, Homo sapiens
tgggagcagctttgcgagggag

SEQ ID NO: 6975356 - DNA, 22 bp, Homo sapiens
gccttcagccctgactggccag

SEQ ID NO: 6975357 - DNA, 22 bp, Homo sapiens
ggctccatccaaggccttctag

SEQ ID NO: 6975358 - DNA, 22 bp, Homo sapiens
ccccagcacaggctcctcagat

SEQ ID NO: 6975359 - DNA, 22 bp, Homo sapiens
attgtgaggcagggaaaggtgg

SEQ ID NO: 6975360 - DNA, 22 bp, Homo sapiens
actgtggccggaacagtgggac

SEQ ID NO: 6975361 - DNA, 22 bp, Homo sapiens
aattgtgcccgtgacatttcat

SEQ ID NO: 6975362 - DNA, 22 bp, Homo sapiens
ttggaagcaatgtaagtcgcat

SEQ ID NO: 6975363 - DNA, 22 bp, Homo sapiens
aggcttctacgtggtcccaggg

SEQ ID NO: 6975364 - DNA, 22 bp, Homo sapiens
gagcatcttgttcccaacttct

SEQ ID NO: 6975365 - DNA, 22 bp, Homo sapiens
ggtggcatcacagtactggggg

SEQ ID NO: 6975366 - DNA, 22 bp, Homo sapiens
actgaaatatttagaagtgaag

SEQ ID NO: 6975367 - DNA, 22 bp, Homo sapiens
ctcaagtttcatatttgtctag

SEQ ID NO: 6975368 - DNA, 22 bp, Homo sapiens
agccaatcatcctcagactctc

SEQ ID NO: 6975369 - DNA, 22 bp, Homo sapiens
ttagtttcctgtggtgtgaagt

SEQ ID NO: 6975370 - DNA, 22 bp, Homo sapiens
tctttataaaagtcattatgtc

SEQ ID NO: 6975371 - DNA, 22 bp, Homo sapiens
ccatgctgtgccattagcagtt

SEQ ID NO: 6975372 - DNA, 22 bp, Homo sapiens
attcctgataaatgctgctctg

SEQ ID NO: 6975373 - DNA, 22 bp, Homo sapiens
aaacagtactcgatttttgtag

SEQ ID NO: 6975374 - DNA, 22 bp, Homo sapiens
gctcccaccttaaccttcacat

SEQ ID NO: 6975375 - DNA, 22 bp, Homo sapiens
tcccagggatcctccgggtcgc

SEQ ID NO: 6975376 - DNA, 22 bp, Homo sapiens
tgctgggctagaagctgaggcc

SEQ ID NO: 6975377 - DNA, 22 bp, Homo sapiens
aggcaactgacagtttctgctt

SEQ ID NO: 6975378 - DNA, 22 bp, Homo sapiens
agatgtaagaccttcatgaggg

SEQ ID NO: 6975379 - DNA, 22 bp, Homo sapiens
aaagctatcatcaatgcaactt

SEQ ID NO: 6975380 - DNA, 22 bp, Homo sapiens
acatttacattttctctggcct

SEQ ID NO: 6975381 - DNA, 22 bp, Homo sapiens
acactggattcttgtagtgaag

SEQ ID NO: 6975382 - DNA, 22 bp, Homo sapiens
atgtgaggttaacctactgtta

SEQ ID NO: 6975383 - DNA, 22 bp, Homo sapiens
ttaaggctgtggggattactgc

SEQ ID NO: 6975384 - DNA, 22 bp, Homo sapiens
agctcctgtgtgcccacctgct

SEQ ID NO: 6975385 - DNA, 22 bp, Homo sapiens
tttgaaacccgtcactttgagt

SEQ ID NO: 6975386 - DNA, 22 bp, Homo sapiens
agggagttcagaggctggtttg

SEQ ID NO: 6975387 - DNA, 22 bp, Homo sapiens
tctactgagtgctgagattttg

SEQ ID NO: 6975388 - DNA, 22 bp, Homo sapiens
ctcaacagactctgccatccct

SEQ ID NO: 6975389 - DNA, 22 bp, Homo sapiens
agctgtcaccaggagccggacc

SEQ ID NO: 6975390 - DNA, 22 bp, Homo sapiens
agcaggcaggctgccagtgaat

SEQ ID NO: 6975391 - DNA, 23 bp, Homo sapiens
atgtgcacatctccttgtccacc

SEQ ID NO: 6975392 - DNA, 22 bp, Homo sapiens
acaagatttagcttaaagggct

SEQ ID NO: 6975393 - DNA, 22 bp, Homo sapiens
caaatgtttttattctacaaca

SEQ ID NO: 6975394 - DNA, 22 bp, Homo sapiens
tctggggttggtgcttacacca

SEQ ID NO: 6975395 - DNA, 22 bp, Homo sapiens
accatcttaaggggacttctta

SEQ ID NO: 6975396 - DNA, 16 bp, Homo sapiens
actgcttttcataaga

SEQ ID NO: 6975397 - DNA, 22 bp, Homo sapiens
tggatacaatgttgggaagggt

SEQ ID NO: 6975398 - DNA, 22 bp, Homo sapiens
taatttacagttcgccatgtct

SEQ ID NO: 6975399 - DNA, 22 bp, Homo sapiens
ggtgggcaacatttggcctgag

SEQ ID NO: 6975400 - DNA, 22 bp, Homo sapiens
gagcaatgcccttcaccagccc

SEQ ID NO: 6975401 - DNA, 22 bp, Homo sapiens
gcactttgtggattgtatttcc

SEQ ID NO: 6975402 - DNA, 22 bp, Homo sapiens
tccaggagggggagccgtgccg

SEQ ID NO: 6975403 - DNA, 22 bp, Homo sapiens
aggtgccttccgcggagctcgc

SEQ ID NO: 6975404 - DNA, 22 bp, Homo sapiens
gaagatttataggagcctatta

SEQ ID NO: 6975405 - DNA, 22 bp, Homo sapiens
cttgggctataaatataaccat

SEQ ID NO: 6975406 - DNA, 21 bp, Homo sapiens
gggaatgagattcttggagat

SEQ ID NO: 6975407 - DNA, 22 bp, Homo sapiens
taacattgttatgaatcaggtc

SEQ ID NO: 6975408 - DNA, 22 bp, Homo sapiens
tagctttagtgaaaaatatcag

SEQ ID NO: 6975409 - DNA, 22 bp, Homo sapiens
gaaataacagctctggaagagt

SEQ ID NO: 6975410 - DNA, 22 bp, Homo sapiens
ctactctgaattgaagtgatat

SEQ ID NO: 6975411 - DNA, 22 bp, Homo sapiens
ataatgtgaagataatgcaaga

SEQ ID NO: 6975412 - DNA, 22 bp, Homo sapiens
tcttcatgtctctgcttgagtc

SEQ ID NO: 6975413 - DNA, 22 bp, Homo sapiens
cagctgttaccaatcttagggc

SEQ ID NO: 6975414 - DNA, 22 bp, Homo sapiens
tacatgtgttctgtttcaagtt

SEQ ID NO: 6975415 - DNA, 20 bp, Homo sapiens
tctgaggctgagcccagcgt

SEQ ID NO: 6975416 - DNA, 22 bp, Homo sapiens
aatactgctgcctgcaaattat

SEQ ID NO: 6975417 - DNA, 22 bp, Homo sapiens
tgcagtggttgagagcccagac

SEQ ID NO: 6975418 - DNA, 21 bp, Homo sapiens
atatacgtatatggtgctcac

SEQ ID NO: 6975419 - DNA, 22 bp, Homo sapiens
ctgtagctgggcctcggcagtg

SEQ ID NO: 6975420 - DNA, 22 bp, Homo sapiens
gcctgtctcttggaacttggta

SEQ ID NO: 6975421 - DNA, 22 bp, Homo sapiens
caaagcgcagaggagcctccgg

SEQ ID NO: 6975422 - DNA, 23 bp, Homo sapiens
tcaattgatgatgttctcttttg

SEQ ID NO: 6975423 - DNA, 22 bp, Homo sapiens
tggacatgtaaaggctcaaggt

SEQ ID NO: 6975424 - DNA, 23 bp, Homo sapiens
agttctcaaaaccagcttgacaa

SEQ ID NO: 6975425 - DNA, 22 bp, Homo sapiens
tggagcagccatgatgacagag

SEQ ID NO: 6975426 - DNA, 22 bp, Homo sapiens
tcttcaaatcctacagtgtctg

SEQ ID NO: 6975427 - DNA, 23 bp, Homo sapiens
catctggggacatcattaggctg

SEQ ID NO: 6975428 - DNA, 22 bp, Homo sapiens
cacactgttgaggacgagatgt

SEQ ID NO: 6975429 - DNA, 22 bp, Homo sapiens
tagttaggaaagtccagggagc

SEQ ID NO: 6975430 - DNA, 22 bp, Homo sapiens
ttttggtcagtgtactgggctg

SEQ ID NO: 6975431 - DNA, 22 bp, Homo sapiens
tgtcagtttagttgaagaaaga

SEQ ID NO: 6975432 - DNA, 22 bp, Homo sapiens
acatgacagtgcttagcaaact

SEQ ID NO: 6975433 - DNA, 22 bp, Homo sapiens
gtccatagagtatatattttga

SEQ ID NO: 6975434 - DNA, 22 bp, Homo sapiens
tacacaatgacttaagatgtca

SEQ ID NO: 6975435 - DNA, 22 bp, Homo sapiens
tgttcttagcatgcaaaatatg

SEQ ID NO: 6975436 - DNA, 22 bp, Homo sapiens
gctgggatgcgtcttcccaggc

SEQ ID NO: 6975437 - DNA, 22 bp, Homo sapiens
aaaagtaatcgcagtttttgcc

SEQ ID NO: 6975438 - DNA, 22 bp, Homo sapiens
gctgggcaccggagagacccca

SEQ ID NO: 6975439 - DNA, 22 bp, Homo sapiens
agaacttaggaacaacagctta

SEQ ID NO: 6975440 - DNA, 22 bp, Homo sapiens
aattaactaaaattcactttat

SEQ ID NO: 6975441 - DNA, 22 bp, Homo sapiens
agttccttacatgtactgttaa

SEQ ID NO: 6975442 - DNA, 22 bp, Homo sapiens
actttggtcttagaggaggaat

SEQ ID NO: 6975443 - DNA, 22 bp, Homo sapiens
cactctgcgctgggcgccagcg

SEQ ID NO: 6975444 - DNA, 23 bp, Homo sapiens
ccacctggactctgggcaggtgc

SEQ ID NO: 6975445 - DNA, 22 bp, Homo sapiens
gttaaaagaacaactcggaggt

SEQ ID NO: 6975446 - DNA, 18 bp, Homo sapiens
tccagcgtgctccagggc

SEQ ID NO: 6975447 - DNA, 22 bp, Homo sapiens
gtgaaggtagactgggcttcct

SEQ ID NO: 6975448 - DNA, 22 bp, Homo sapiens
cagagccagcagtggggacagg

SEQ ID NO: 6975449 - DNA, 22 bp, Homo sapiens
aaagaacatcggagtgggcggg

SEQ ID NO: 6975450 - DNA, 22 bp, Homo sapiens
tgggctcagggtcgaggacttt

SEQ ID NO: 6975451 - DNA, 22 bp, Homo sapiens
ttctctgatcttgctagactga

SEQ ID NO: 6975452 - DNA, 22 bp, Homo sapiens
gccagtggcatgcggcagggac

SEQ ID NO: 6975453 - DNA, 22 bp, Homo sapiens
tggtctggggaccgagggttac

SEQ ID NO: 6975454 - DNA, 22 bp, Homo sapiens
taagaaactatggagaagaact

SEQ ID NO: 6975455 - DNA, 22 bp, Homo sapiens
tatattttagacaccctcacgc

SEQ ID NO: 6975456 - DNA, 21 bp, Homo sapiens
ccgccacctctaagctgggtc

SEQ ID NO: 6975457 - DNA, 22 bp, Homo sapiens
aggctcccatggtgtggcagga

SEQ ID NO: 6975458 - DNA, 22 bp, Homo sapiens
tgtcaatgtgtacaggagctca

SEQ ID NO: 6975459 - DNA, 22 bp, Homo sapiens
cctggaagtcattcctcgttcc

SEQ ID NO: 6975460 - DNA, 22 bp, Homo sapiens
agcagaatctgggagcagcagt

SEQ ID NO: 6975461 - DNA, 22 bp, Homo sapiens
ccagagcctaagatctgatcct

SEQ ID NO: 6975462 - DNA, 22 bp, Homo sapiens
tctggctttattttcatcatct

SEQ ID NO: 6975463 - DNA, 22 bp, Homo sapiens
atccaaagaatgcttagacctg

SEQ ID NO: 6975464 - DNA, 22 bp, Homo sapiens
tggcttcaaaggtagcatacaa

SEQ ID NO: 6975465 - DNA, 22 bp, Homo sapiens
gcattctttttaggaggttcct

SEQ ID NO: 6975466 - DNA, 22 bp, Homo sapiens
gtgaggaatcggttcacggtga

SEQ ID NO: 6975467 - DNA, 22 bp, Homo sapiens
ctgtccttccagccgaaatcta

SEQ ID NO: 6975468 - DNA, 22 bp, Homo sapiens
aatgacatggagcatcttttca

SEQ ID NO: 6975469 - DNA, 22 bp, Homo sapiens
actgggtgtaaaggacttaagc

SEQ ID NO: 6975470 - DNA, 22 bp, Homo sapiens
cttttcctattgattctgttac

SEQ ID NO: 6975471 - DNA, 22 bp, Homo sapiens
aggcttcttcttcctatttagt

SEQ ID NO: 6975472 - DNA, 22 bp, Homo sapiens
atcacaatcttcaaatcgattc

SEQ ID NO: 6975473 - DNA, 22 bp, Homo sapiens
aatgtgttactgtgtaagagca

SEQ ID NO: 6975474 - DNA, 22 bp, Homo sapiens
tgtgtcctttcttaagagtgag

SEQ ID NO: 6975475 - DNA, 21 bp, Homo sapiens
agttttatattataagctaaa

SEQ ID NO: 6975476 - DNA, 22 bp, Homo sapiens
gtgggttcgtggtctcgctggc

SEQ ID NO: 6975477 - DNA, 22 bp, Homo sapiens
gacagcatgatcaaggagccca

SEQ ID NO: 6975478 - DNA, 22 bp, Homo sapiens
gaagggaaattcagatcttcag

SEQ ID NO: 6975479 - DNA, 22 bp, Homo sapiens
aggccctgcggaaatgatcatt

SEQ ID NO: 6975480 - DNA, 22 bp, Homo sapiens
gctccctgtgctctgagtgata

SEQ ID NO: 6975481 - DNA, 22 bp, Homo sapiens
aggatttgtatagctttctttt

SEQ ID NO: 6975482 - DNA, 22 bp, Homo sapiens
ggctgtgcctctggcagcacat

SEQ ID NO: 6975483 - DNA, 22 bp, Homo sapiens
gaatcagaatctgcatttttaa

SEQ ID NO: 6975484 - DNA, 21 bp, Homo sapiens
agctggtgtcagagctctggg

SEQ ID NO: 6975485 - DNA, 21 bp, Homo sapiens
agcaatttttcctcctctgca

SEQ ID NO: 6975486 - DNA, 22 bp, Homo sapiens
aagtccagcatttgggtagatt

SEQ ID NO: 6975487 - DNA, 23 bp, Homo sapiens
tagaattcaatctgttccacatc

SEQ ID NO: 6975488 - DNA, 22 bp, Homo sapiens
tggcctctggctgaggactaac

SEQ ID NO: 6975489 - DNA, 22 bp, Homo sapiens
tcacagaagccctcgcaaacta

SEQ ID NO: 6975490 - DNA, 22 bp, Homo sapiens
gcggagggagataggccttgct

SEQ ID NO: 6975491 - DNA, 22 bp, Homo sapiens
gctcagagaaattataggaatt

SEQ ID NO: 6975492 - DNA, 22 bp, Homo sapiens
gtgctgtcattagcatctagag

SEQ ID NO: 6975493 - DNA, 22 bp, Homo sapiens
tcaggaacttctaggaaagctg

SEQ ID NO: 6975494 - DNA, 22 bp, Homo sapiens
aatctgagggaacttgaactcc

SEQ ID NO: 6975495 - DNA, 22 bp, Homo sapiens
tacccagtctggagtgcagtga

SEQ ID NO: 6975496 - DNA, 22 bp, Homo sapiens
ctttggaagtaaagtcagcagg

SEQ ID NO: 6975497 - DNA, 22 bp, Homo sapiens
aggcctctctccttggcttgta

SEQ ID NO: 6975498 - DNA, 22 bp, Homo sapiens
aggcttctctccttggcttgca

SEQ ID NO: 6975499 - DNA, 22 bp, Homo sapiens
atggaaatccaagtcaccgtag

SEQ ID NO: 6975500 - DNA, 20 bp, Homo sapiens
atggctctgattctgagccc

SEQ ID NO: 6975501 - DNA, 21 bp, Homo sapiens
tcacagactggtcagtgaggc

SEQ ID NO: 6975502 - DNA, 22 bp, Homo sapiens
tgtgtctgcccttagtacatct

SEQ ID NO: 6975503 - DNA, 22 bp, Homo sapiens
tgtagaaaattggagcattcat

SEQ ID NO: 6975504 - DNA, 22 bp, Homo sapiens
ttgctctgactggagtgcagtg

SEQ ID NO: 6975505 - DNA, 22 bp, Homo sapiens
atcaaatacaaagggcataagg

SEQ ID NO: 6975506 - DNA, 22 bp, Homo sapiens
tcctggagctggtgtctttccc

SEQ ID NO: 6975507 - DNA, 22 bp, Homo sapiens
cagctgccagcttctctccatc

SEQ ID NO: 6975508 - DNA, 22 bp, Homo sapiens
gggtggtctggcaggctggaaa

SEQ ID NO: 6975509 - DNA, 22 bp, Homo sapiens
cctctgagtgacagcctcctct

SEQ ID NO: 6975510 - DNA, 22 bp, Homo sapiens
gtctggctcagtcctagctgta

SEQ ID NO: 6975511 - DNA, 19 bp, Homo sapiens
ttaccgtgaaatggttcag

SEQ ID NO: 6975512 - DNA, 22 bp, Homo sapiens
aagacaatattgctgtgaacgt

SEQ ID NO: 6975513 - DNA, 22 bp, Homo sapiens
ttgttgccggaaagatctcgac

SEQ ID NO: 6975514 - DNA, 22 bp, Homo sapiens
tgtggcagggcgtgacatttgg

SEQ ID NO: 6975515 - DNA, 22 bp, Homo sapiens
ctttacaacctaagttgaagct

SEQ ID NO: 6975516 - DNA, 22 bp, Homo sapiens
atcagtgctgagagactatcaa

SEQ ID NO: 6975517 - DNA, 22 bp, Homo sapiens
ttcttcagatggtgagacctcc

SEQ ID NO: 6975518 - DNA, 22 bp, Homo sapiens
tctcaaagtagctcccacagat

SEQ ID NO: 6975519 - DNA, 22 bp, Homo sapiens
agacaatttcaaagtaatatta

SEQ ID NO: 6975520 - DNA, 22 bp, Homo sapiens
tgtggaatgctcctaagtgaat

SEQ ID NO: 6975521 - DNA, 22 bp, Homo sapiens
gtgactgtaattaccttagcaa

SEQ ID NO: 6975522 - DNA, 22 bp, Homo sapiens
gtagaactcccagtggtattgt

SEQ ID NO: 6975523 - DNA, 22 bp, Homo sapiens
tgagagctgctgagactgtcct

SEQ ID NO: 6975524 - DNA, 22 bp, Homo sapiens
tttgtgaatgccttataagcat

SEQ ID NO: 6975525 - DNA, 22 bp, Homo sapiens
gattctcttggatgtaggcata

SEQ ID NO: 6975526 - DNA, 22 bp, Homo sapiens
tgggtgtccagaccctgcacat

SEQ ID NO: 6975527 - DNA, 22 bp, Homo sapiens
tgcctgtgtggggtctgccgcc

SEQ ID NO: 6975528 - DNA, 22 bp, Homo sapiens
acagccagtaatctacccctgt

SEQ ID NO: 6975529 - DNA, 22 bp, Homo sapiens
gttttgcttctcatgttaagtg

SEQ ID NO: 6975530 - DNA, 22 bp, Homo sapiens
aagtttctggaccttacctgct

SEQ ID NO: 6975531 - DNA, 22 bp, Homo sapiens
agcctagggttctgatgtcact

SEQ ID NO: 6975532 - DNA, 22 bp, Homo sapiens
tttctaggatgtgatgacctgc

SEQ ID NO: 6975533 - DNA, 22 bp, Homo sapiens
ttcacacacagcttcctattgt

SEQ ID NO: 6975534 - DNA, 22 bp, Homo sapiens
ggagcctgacagtgcccagcat

SEQ ID NO: 6975535 - DNA, 22 bp, Homo sapiens
gagctcctggattgctcctagg

SEQ ID NO: 6975536 - DNA, 22 bp, Homo sapiens
ctatgtaccatgcctgatgtta

SEQ ID NO: 6975537 - DNA, 20 bp, Homo sapiens
actaacatttgcaaggggct

SEQ ID NO: 6975538 - DNA, 22 bp, Homo sapiens
taagaccatacatttccacaga

SEQ ID NO: 6975539 - DNA, 22 bp, Homo sapiens
ctgggccacttcctcaggggaa

SEQ ID NO: 6975540 - DNA, 22 bp, Homo sapiens
ccgagctgtggtctcttttacg

SEQ ID NO: 6975541 - DNA, 22 bp, Homo sapiens
cccttagctcacaagctaaagc

SEQ ID NO: 6975542 - DNA, 22 bp, Homo sapiens
ggtttctctagggctgaccagt

SEQ ID NO: 6975543 - DNA, 19 bp, Homo sapiens
tgtctcctcatgcaagtgt

SEQ ID NO: 6975544 - DNA, 22 bp, Homo sapiens
cactggacttaaggcagagttt

SEQ ID NO: 6975545 - DNA, 22 bp, Homo sapiens
tggcccgacctctgctcatgca

SEQ ID NO: 6975546 - DNA, 22 bp, Homo sapiens
ctaggccagagagacctcatga

SEQ ID NO: 6975547 - DNA, 22 bp, Homo sapiens
aggcctgtagttcctctttcca

SEQ ID NO: 6975548 - DNA, 22 bp, Homo sapiens
gtcccaggcttatgtggagctt

SEQ ID NO: 6975549 - DNA, 22 bp, Homo sapiens
gcatttgaaatcctctgtgacg

SEQ ID NO: 6975550 - DNA, 22 bp, Homo sapiens
ttccttttgcaaggtcctctag

SEQ ID NO: 6975551 - DNA, 22 bp, Homo sapiens
gtggcagctacatttaatgcaa

SEQ ID NO: 6975552 - DNA, 22 bp, Homo sapiens
acaatactattttcagtatcct

SEQ ID NO: 6975553 - DNA, 22 bp, Homo sapiens
acatctaagccaattttgattt

SEQ ID NO: 6975554 - DNA, 22 bp, Homo sapiens
agtttggctcacatctttggct

SEQ ID NO: 6975555 - DNA, 22 bp, Homo sapiens
atgcatataatggccagaacaa

SEQ ID NO: 6975556 - DNA, 22 bp, Homo sapiens
actccagacacagacactatga

SEQ ID NO: 6975557 - DNA, 22 bp, Homo sapiens
aatcaggacccactctacagtt

SEQ ID NO: 6975558 - DNA, 22 bp, Homo sapiens
tcagggcatcatcatgaatata

SEQ ID NO: 6975559 - DNA, 18 bp, Homo sapiens
gcctcagtttcctcacct

SEQ ID NO: 6975560 - DNA, 22 bp, Homo sapiens
cagtgacaggttccatgccgca

SEQ ID NO: 6975561 - DNA, 22 bp, Homo sapiens
tgcccagaatagatgggctgtg

SEQ ID NO: 6975562 - DNA, 22 bp, Homo sapiens
aataagatgtgcttgagtttgg

SEQ ID NO: 6975563 - DNA, 22 bp, Homo sapiens
cctctggagtcagaccagcttg

SEQ ID NO: 6975564 - DNA, 22 bp, Homo sapiens
tggcagaagtacacaagcatgc

SEQ ID NO: 6975565 - DNA, 22 bp, Homo sapiens
cctgagctggaagagcttgtgc

SEQ ID NO: 6975566 - DNA, 20 bp, Homo sapiens
tctcccaggctcagggaaga

SEQ ID NO: 6975567 - DNA, 22 bp, Homo sapiens
acatgctttgcacttacatcat

SEQ ID NO: 6975568 - DNA, 22 bp, Homo sapiens
gtttgagatgggttattgctct

SEQ ID NO: 6975569 - DNA, 22 bp, Homo sapiens
cagcccttccaggcagaattct

SEQ ID NO: 6975570 - DNA, 22 bp, Homo sapiens
aaattgctgacacttgaccatt

SEQ ID NO: 6975571 - DNA, 21 bp, Homo sapiens
tttagagaagacaatgggcat

SEQ ID NO: 6975572 - DNA, 22 bp, Homo sapiens
aagaggagacttcagcaacttg

SEQ ID NO: 6975573 - DNA, 21 bp, Homo sapiens
tgcagagatatctgaagcaga

SEQ ID NO: 6975574 - DNA, 22 bp, Homo sapiens
tgtgtgccccagatgagtagct

SEQ ID NO: 6975575 - DNA, 22 bp, Homo sapiens
ccatatatgattgcctctttca

SEQ ID NO: 6975576 - DNA, 22 bp, Homo sapiens
acagccaacgtctttcttactt

SEQ ID NO: 6975577 - DNA, 22 bp, Homo sapiens
agagacctgaagagcttcctca

SEQ ID NO: 6975578 - DNA, 22 bp, Homo sapiens
agtccatacattgagaataaca

SEQ ID NO: 6975579 - DNA, 22 bp, Homo sapiens
tttgatgacttcagatctttgt

SEQ ID NO: 6975580 - DNA, 22 bp, Homo sapiens
tgggcaaaggctgtaacccatc

SEQ ID NO: 6975581 - DNA, 20 bp, Homo sapiens
atgtccagtgactggaccat

SEQ ID NO: 6975582 - DNA, 22 bp, Homo sapiens
ggtttcctttgcttctcctgag

SEQ ID NO: 6975583 - DNA, 22 bp, Homo sapiens
acccgggcaaggattctgagag

SEQ ID NO: 6975584 - DNA, 22 bp, Homo sapiens
ctccatacttccaacaaacttt

SEQ ID NO: 6975585 - DNA, 22 bp, Homo sapiens
ctcctccagtcctccaaggaca

SEQ ID NO: 6975586 - DNA, 22 bp, Homo sapiens
cctggcttccatatggcacata

SEQ ID NO: 6975587 - DNA, 22 bp, Homo sapiens
cagtgcctggatagcaacatga

SEQ ID NO: 6975588 - DNA, 22 bp, Homo sapiens
ttctggaagggtggagtagctt

SEQ ID NO: 6975589 - DNA, 19 bp, Homo sapiens
tgctacccagtttcagggg

SEQ ID NO: 6975590 - DNA, 22 bp, Homo sapiens
agtgagatgaaaatatctgtga

SEQ ID NO: 6975591 - DNA, 22 bp, Homo sapiens
cttctctgcccataggaaatgc

SEQ ID NO: 6975592 - DNA, 22 bp, Homo sapiens
tcctgggaactcggaaagctct

SEQ ID NO: 6975593 - DNA, 22 bp, Homo sapiens
atgtcttctaagctctaagctg

SEQ ID NO: 6975594 - DNA, 22 bp, Homo sapiens
ccattgaattagaaggggaagg

SEQ ID NO: 6975595 - DNA, 22 bp, Homo sapiens
tctactttcactcatacttatt

SEQ ID NO: 6975596 - DNA, 22 bp, Homo sapiens
aggaagggtgtcatgagccctt

SEQ ID NO: 6975597 - DNA, 22 bp, Homo sapiens
aatgtaaagctcaggtcaggag

SEQ ID NO: 6975598 - DNA, 22 bp, Homo sapiens
atgacttcgttttctctctgca

SEQ ID NO: 6975599 - DNA, 22 bp, Homo sapiens
gctccactaggaatctgctctt

SEQ ID NO: 6975600 - DNA, 22 bp, Homo sapiens
ctccagggatgagacagagtag

SEQ ID NO: 6975601 - DNA, 22 bp, Homo sapiens
tagatttgatgtaagcatagtc

SEQ ID NO: 6975602 - DNA, 22 bp, Homo sapiens
atgtctatatagtcaataatca

SEQ ID NO: 6975603 - DNA, 22 bp, Homo sapiens
tttgacaagagcaaatgttctt

SEQ ID NO: 6975604 - DNA, 22 bp, Homo sapiens
tttgtgaataggttggcttcca

SEQ ID NO: 6975605 - DNA, 18 bp, Homo sapiens
tcaggctttgagagaatc

SEQ ID NO: 6975606 - DNA, 22 bp, Homo sapiens
agctttgcattcaaactgatgt

SEQ ID NO: 6975607 - DNA, 22 bp, Homo sapiens
aagcacctgggttatatcttag

SEQ ID NO: 6975608 - DNA, 22 bp, Homo sapiens
ttggggaagctttgaaatactt

SEQ ID NO: 6975609 - DNA, 22 bp, Homo sapiens
aataaagactcagaggcccagg

SEQ ID NO: 6975610 - DNA, 22 bp, Homo sapiens
aactgtagggatctgtcttagt

SEQ ID NO: 6975611 - DNA, 19 bp, Homo sapiens
aataagcttgggtaaaact

SEQ ID NO: 6975612 - DNA, 22 bp, Homo sapiens
agtgcgcaaaaatagaagctgt

SEQ ID NO: 6975613 - DNA, 22 bp, Homo sapiens
gctggaaatcatattttgttgt

SEQ ID NO: 6975614 - DNA, 22 bp, Homo sapiens
aggctctgatgcaagcccaggg

SEQ ID NO: 6975615 - DNA, 22 bp, Homo sapiens
gggaaggcaggcctctgttgga

SEQ ID NO: 6975616 - DNA, 22 bp, Homo sapiens
gtggatggctagttgagaaggg

SEQ ID NO: 6975617 - DNA, 22 bp, Homo sapiens
gctgtttccagttacgtggata

SEQ ID NO: 6975618 - DNA, 22 bp, Homo sapiens
cattcatttactttcaacagct

SEQ ID NO: 6975619 - DNA, 23 bp, Homo sapiens
agcagctgtggagttttgcattt

SEQ ID NO: 6975620 - DNA, 22 bp, Homo sapiens
agtagcagtgacagctgaggta

SEQ ID NO: 6975621 - DNA, 22 bp, Homo sapiens
cagaactgggcagggagcagag

SEQ ID NO: 6975622 - DNA, 22 bp, Homo sapiens
gatgaattgaaatcattgggca

SEQ ID NO: 6975623 - DNA, 22 bp, Homo sapiens
ttcaatgcttatatggactaat

SEQ ID NO: 6975624 - DNA, 20 bp, Homo sapiens
tttgattgcccctctgactt

SEQ ID NO: 6975625 - DNA, 17 bp, Homo sapiens
tggggatggttcatgag

SEQ ID NO: 6975626 - DNA, 19 bp, Homo sapiens
gcttgctttatgaaggggg

SEQ ID NO: 6975627 - DNA, 22 bp, Homo sapiens
gggggctaccgtctctggagct

SEQ ID NO: 6975628 - DNA, 22 bp, Homo sapiens
agtattaccctcagaacttgat

SEQ ID NO: 6975629 - DNA, 22 bp, Homo sapiens
agccaggattggctgagcctta

SEQ ID NO: 6975630 - DNA, 22 bp, Homo sapiens
acagttaatcctaaaggcggta

SEQ ID NO: 6975631 - DNA, 22 bp, Homo sapiens
gcctgtttactttgccgcagga

SEQ ID NO: 6975632 - DNA, 22 bp, Homo sapiens
ctctctgggaatattttattct

SEQ ID NO: 6975633 - DNA, 23 bp, Homo sapiens
gaattcttaaggtcactaaagtc

SEQ ID NO: 6975634 - DNA, 22 bp, Homo sapiens
tccaataaaactcttgaattaa

SEQ ID NO: 6975635 - DNA, 22 bp, Homo sapiens
gagtttaaagcatacatatttt

SEQ ID NO: 6975636 - DNA, 22 bp, Homo sapiens
aagatttcttacttattgatgc

SEQ ID NO: 6975637 - DNA, 21 bp, Homo sapiens
agctccctgtttcctcactct

SEQ ID NO: 6975638 - DNA, 23 bp, Homo sapiens
tgctggcttccagctgctccctc

SEQ ID NO: 6975639 - DNA, 22 bp, Homo sapiens
atcacctggccattgggttaac

SEQ ID NO: 6975640 - DNA, 22 bp, Homo sapiens
agaaactaacctggtagggttc

SEQ ID NO: 6975641 - DNA, 22 bp, Homo sapiens
tgtttgtaaagcagagccagta

SEQ ID NO: 6975642 - DNA, 22 bp, Homo sapiens
catgcagggagtgctcctatta

SEQ ID NO: 6975643 - DNA, 22 bp, Homo sapiens
tgagacaacctaattaaacacc

SEQ ID NO: 6975644 - DNA, 22 bp, Homo sapiens
tgccctcagccacctccaagtt

SEQ ID NO: 6975645 - DNA, 20 bp, Homo sapiens
agcggaccaggccattgttg

SEQ ID NO: 6975646 - DNA, 22 bp, Homo sapiens
gatttgtcacggttgagagcca

SEQ ID NO: 6975647 - DNA, 22 bp, Homo sapiens
tgcagccattttctgccaatgc

SEQ ID NO: 6975648 - DNA, 22 bp, Homo sapiens
atggctctgagaacctgagcta

SEQ ID NO: 6975649 - DNA, 22 bp, Homo sapiens
tgcccttcctctggattgcctt

SEQ ID NO: 6975650 - DNA, 17 bp, Homo sapiens
tcaaagtattctgatgc

SEQ ID NO: 6975651 - DNA, 22 bp, Homo sapiens
gcagcacatataaacaaagaga

SEQ ID NO: 6975652 - DNA, 22 bp, Homo sapiens
aagaccgaggtgaggtgttatt

SEQ ID NO: 6975653 - DNA, 22 bp, Homo sapiens
tcagccaggccaccttcagctt

SEQ ID NO: 6975654 - DNA, 22 bp, Homo sapiens
tttacagcaacagtgcagaggt

SEQ ID NO: 6975655 - DNA, 22 bp, Homo sapiens
gttaggtagaagtttactttga

SEQ ID NO: 6975656 - DNA, 22 bp, Homo sapiens
tgcatttttgaggttaactcaa

SEQ ID NO: 6975657 - DNA, 22 bp, Homo sapiens
tcatccaggaaaagatttggaa

SEQ ID NO: 6975658 - DNA, 21 bp, Homo sapiens
aaatgtgttccataatgcttt

SEQ ID NO: 6975659 - DNA, 22 bp, Homo sapiens
cacactatcttcctatcctggc

SEQ ID NO: 6975660 - DNA, 22 bp, Homo sapiens
gagctgaatcagagatattatt

SEQ ID NO: 6975661 - DNA, 22 bp, Homo sapiens
acttcttgggaccctggcaccg

SEQ ID NO: 6975662 - DNA, 22 bp, Homo sapiens
tctgtataaggacaaacattta

SEQ ID NO: 6975663 - DNA, 22 bp, Homo sapiens
aaatcattatttacagttctga

SEQ ID NO: 6975664 - DNA, 22 bp, Homo sapiens
tgcagcagtttaatgcagggtt

SEQ ID NO: 6975665 - DNA, 22 bp, Homo sapiens
caactggtggtcaaccttctgt

SEQ ID NO: 6975666 - DNA, 22 bp, Homo sapiens
ggaatcagaattaggatttgaa

SEQ ID NO: 6975667 - DNA, 22 bp, Homo sapiens
acagcagcgtgaagtgtgttat

SEQ ID NO: 6975668 - DNA, 22 bp, Homo sapiens
cacagtttgcataggaaaaaca

SEQ ID NO: 6975669 - DNA, 22 bp, Homo sapiens
ctccgtttttgaccggcactga

SEQ ID NO: 6975670 - DNA, 22 bp, Homo sapiens
atttggaaacaaatggtttcgc

SEQ ID NO: 6975671 - DNA, 22 bp, Homo sapiens
atgtttcaggcgaactaacatg

SEQ ID NO: 6975672 - DNA, 22 bp, Homo sapiens
aggtaaggggctcccaagtacc

SEQ ID NO: 6975673 - DNA, 17 bp, Homo sapiens
tcagaccctgtgtcagg

SEQ ID NO: 6975674 - DNA, 22 bp, Homo sapiens
atgcctggactgacatgcactg

SEQ ID NO: 6975675 - DNA, 22 bp, Homo sapiens
ttcactgttgttagcagaggcg

SEQ ID NO: 6975676 - DNA, 22 bp, Homo sapiens
ttccaaagaagttcacatttac

SEQ ID NO: 6975677 - DNA, 22 bp, Homo sapiens
tgctggaagaaaattctttaac

SEQ ID NO: 6975678 - DNA, 22 bp, Homo sapiens
ccattatccattttgagtctta

SEQ ID NO: 6975679 - DNA, 22 bp, Homo sapiens
gaccttgtgatccccctgcctt

SEQ ID NO: 6975680 - DNA, 22 bp, Homo sapiens
cctctgtgcctcgtgtcctctg

SEQ ID NO: 6975681 - DNA, 22 bp, Homo sapiens
ggtcagagccatggagcaactg

SEQ ID NO: 6975682 - DNA, 22 bp, Homo sapiens
tgtcaggacattttatgaatca

SEQ ID NO: 6975683 - DNA, 22 bp, Homo sapiens
tagacttttcaaaatctagacc

SEQ ID NO: 6975684 - DNA, 22 bp, Homo sapiens
ctggtctggctagtttaggcca

SEQ ID NO: 6975685 - DNA, 22 bp, Homo sapiens
gtcattatttaatgtaggctaa

SEQ ID NO: 6975686 - DNA, 22 bp, Homo sapiens
gtcagtggtgcttaaagtttca

SEQ ID NO: 6975687 - DNA, 21 bp, Homo sapiens
gtccacttccttcctgcttct

SEQ ID NO: 6975688 - DNA, 22 bp, Homo sapiens
ctggccaggcggcccctgcatg

SEQ ID NO: 6975689 - DNA, 21 bp, Homo sapiens
ctgaatgccccaaatgacctt

SEQ ID NO: 6975690 - DNA, 22 bp, Homo sapiens
ctggagataagcagtcccaggc

SEQ ID NO: 6975691 - DNA, 22 bp, Homo sapiens
tgcatcatataatgtctatgga

SEQ ID NO: 6975692 - DNA, 22 bp, Homo sapiens
agggtggttcttttagtggaag

SEQ ID NO: 6975693 - DNA, 22 bp, Homo sapiens
tatggctttctccatagggcag

SEQ ID NO: 6975694 - DNA, 18 bp, Homo sapiens
ctagggctgtggctctca

SEQ ID NO: 6975695 - DNA, 22 bp, Homo sapiens
aaaggtcagctgccatcgttct

SEQ ID NO: 6975696 - DNA, 22 bp, Homo sapiens
atggccgcctgtccttcccgcc

SEQ ID NO: 6975697 - DNA, 22 bp, Homo sapiens
gtgcaggagcttctggcctgac

SEQ ID NO: 6975698 - DNA, 22 bp, Homo sapiens
tcagatcatttgtggattcact

SEQ ID NO: 6975699 - DNA, 22 bp, Homo sapiens
tctcagatggcatcagctagag

SEQ ID NO: 6975700 - DNA, 22 bp, Homo sapiens
ctggaggcagttgccccagtca

SEQ ID NO: 6975701 - DNA, 22 bp, Homo sapiens
tagaatctgtgttcaaacctac

SEQ ID NO: 6975702 - DNA, 22 bp, Homo sapiens
gtagacagtttgggccgaaatt

SEQ ID NO: 6975703 - DNA, 22 bp, Homo sapiens
aagttatctgatatctttgagg

SEQ ID NO: 6975704 - DNA, 22 bp, Homo sapiens
tcagaattatgtaggcctggtt

SEQ ID NO: 6975705 - DNA, 22 bp, Homo sapiens
atggcttctgtcttggaaactt

SEQ ID NO: 6975706 - DNA, 22 bp, Homo sapiens
agatatagttgttgagaagaac

SEQ ID NO: 6975707 - DNA, 22 bp, Homo sapiens
ccaggcctggacgggtggcctg

SEQ ID NO: 6975708 - DNA, 22 bp, Homo sapiens
ttagtagattgtgatcagtact

SEQ ID NO: 6975709 - DNA, 20 bp, Homo sapiens
tatataggaaatattgtgtt

SEQ ID NO: 6975710 - DNA, 22 bp, Homo sapiens
agggcctgagctctcctccagt

SEQ ID NO: 6975711 - DNA, 22 bp, Homo sapiens
acaagaatgtagattagttaag

SEQ ID NO: 6975712 - DNA, 22 bp, Homo sapiens
gtttaagagggtttcattccca

SEQ ID NO: 6975713 - DNA, 22 bp, Homo sapiens
gaggcctgctttggcactctgg

SEQ ID NO: 6975714 - DNA, 22 bp, Homo sapiens
ctgttctttagttccactgcaa

SEQ ID NO: 6975715 - DNA, 22 bp, Homo sapiens
attcctcatttgttgagaacca

SEQ ID NO: 6975716 - DNA, 22 bp, Homo sapiens
acaggaataaaaggaataagga

SEQ ID NO: 6975717 - DNA, 22 bp, Homo sapiens
gcttcctcaccttctcttgcat

SEQ ID NO: 6975718 - DNA, 22 bp, Homo sapiens
tgcagaatgttatcaaagttag

SEQ ID NO: 6975719 - DNA, 22 bp, Homo sapiens
ttcactgtttcatcctacttct

SEQ ID NO: 6975720 - DNA, 20 bp, Homo sapiens
gctgcgatccgtttcacagt

SEQ ID NO: 6975721 - DNA, 22 bp, Homo sapiens
ggcttgaaagaataggaatgca

SEQ ID NO: 6975722 - DNA, 22 bp, Homo sapiens
ttggactggtttacatttcaag

SEQ ID NO: 6975723 - DNA, 22 bp, Homo sapiens
ggtttcaacttttgtgaggaat

SEQ ID NO: 6975724 - DNA, 22 bp, Homo sapiens
agtaaatgtttatcacacagat

SEQ ID NO: 6975725 - DNA, 22 bp, Homo sapiens
aagtgcaggtctcagctactct

SEQ ID NO: 6975726 - DNA, 22 bp, Homo sapiens
caggaacatttaaccacagggt

SEQ ID NO: 6975727 - DNA, 22 bp, Homo sapiens
tcaggacaccctgtgcttcctt

SEQ ID NO: 6975728 - DNA, 23 bp, Homo sapiens
cacatatagcagccactaaggtc

SEQ ID NO: 6975729 - DNA, 22 bp, Homo sapiens
cagtgccatgtctgagccccta

SEQ ID NO: 6975730 - DNA, 19 bp, Homo sapiens
gacattcctgacactggct

SEQ ID NO: 6975731 - DNA, 22 bp, Homo sapiens
attgacttccatagctacctgg

SEQ ID NO: 6975732 - DNA, 22 bp, Homo sapiens
tagatatcagaaatagaattta

SEQ ID NO: 6975733 - DNA, 22 bp, Homo sapiens
caggtgtttcaaatgtgaaact

SEQ ID NO: 6975734 - DNA, 22 bp, Homo sapiens
ctgtcctctgtcctcagcagga

SEQ ID NO: 6975735 - DNA, 22 bp, Homo sapiens
ggatgtgtcctctagggctcca

SEQ ID NO: 6975736 - DNA, 18 bp, Homo sapiens
atgaacactgagctgaat

SEQ ID NO: 6975737 - DNA, 22 bp, Homo sapiens
tcaggaggcaagtaggtattga

SEQ ID NO: 6975738 - DNA, 22 bp, Homo sapiens
tagttctgtgtagctcaagagt

SEQ ID NO: 6975739 - DNA, 22 bp, Homo sapiens
aagttaattaacctctccatca

SEQ ID NO: 6975740 - DNA, 22 bp, Homo sapiens
agctggggttgcacacattttg

SEQ ID NO: 6975741 - DNA, 21 bp, Homo sapiens
aatgtgtgctatttatctttt

SEQ ID NO: 6975742 - DNA, 20 bp, Homo sapiens
acatttgaagtcgcatttct

SEQ ID NO: 6975743 - DNA, 22 bp, Homo sapiens
tcctgggatgacttttgaaatg

SEQ ID NO: 6975744 - DNA, 22 bp, Homo sapiens
tttggctgaagaccagattaaa

SEQ ID NO: 6975745 - DNA, 22 bp, Homo sapiens
ctctgtgggaggaggagtaggc

SEQ ID NO: 6975746 - DNA, 22 bp, Homo sapiens
gataataagcacagcaggatgt

SEQ ID NO: 6975747 - DNA, 22 bp, Homo sapiens
actgggaagctgttttgctttt

SEQ ID NO: 6975748 - DNA, 22 bp, Homo sapiens
ggcatctcggaacacgcctccg

SEQ ID NO: 6975749 - DNA, 22 bp, Homo sapiens
ttggaactcaataattcttctt

SEQ ID NO: 6975750 - DNA, 22 bp, Homo sapiens
actttctattgtttagattctg

SEQ ID NO: 6975751 - DNA, 22 bp, Homo sapiens
ggcatccaaataccaagatgta

SEQ ID NO: 6975752 - DNA, 22 bp, Homo sapiens
aagtgcaagatcaaggtgtcag

SEQ ID NO: 6975753 - DNA, 22 bp, Homo sapiens
ggcctctcattctccctggtcc

SEQ ID NO: 6975754 - DNA, 22 bp, Homo sapiens
agtgtttctggaatcagtgttt

SEQ ID NO: 6975755 - DNA, 22 bp, Homo sapiens
agacacagctgcaggaggtggg

SEQ ID NO: 6975756 - DNA, 22 bp, Homo sapiens
gtcctggagtggcatggcatgg

SEQ ID NO: 6975757 - DNA, 22 bp, Homo sapiens
acatcagtgctcttggttcttg

SEQ ID NO: 6975758 - DNA, 18 bp, Homo sapiens
gcacagagcaagtttcat

SEQ ID NO: 6975759 - DNA, 22 bp, Homo sapiens
gagaacttcaggattattcaag

SEQ ID NO: 6975760 - DNA, 18 bp, Homo sapiens
atgctcctatctctgagc

SEQ ID NO: 6975761 - DNA, 22 bp, Homo sapiens
taaggccgctgctgagtccttt

SEQ ID NO: 6975762 - DNA, 22 bp, Homo sapiens
gtgctctccagccccacgtgga

SEQ ID NO: 6975763 - DNA, 22 bp, Homo sapiens
cagagcttgaatccaacaaaga

SEQ ID NO: 6975764 - DNA, 22 bp, Homo sapiens
taagcataactaaaaatgattt

SEQ ID NO: 6975765 - DNA, 22 bp, Homo sapiens
gagaaagctaaataagttgatt

SEQ ID NO: 6975766 - DNA, 22 bp, Homo sapiens
cagtaaatgtcctcgcagggaa

SEQ ID NO: 6975767 - DNA, 22 bp, Homo sapiens
gacactgtgctagctgggctta

SEQ ID NO: 6975768 - DNA, 22 bp, Homo sapiens
gtttctgattctagaggcaggc

SEQ ID NO: 6975769 - DNA, 22 bp, Homo sapiens
actgggaaggaaaggaatgtaa

SEQ ID NO: 6975770 - DNA, 22 bp, Homo sapiens
tgagtgggttatcaggaaaggt

SEQ ID NO: 6975771 - DNA, 22 bp, Homo sapiens
tgcagagagacccctgggccag

SEQ ID NO: 6975772 - DNA, 18 bp, Homo sapiens
ttgaagttatttacattc

SEQ ID NO: 6975773 - DNA, 22 bp, Homo sapiens
ttggtcatcatgcttgggtcta

SEQ ID NO: 6975774 - DNA, 22 bp, Homo sapiens
tcatcagactgactgtggttct

SEQ ID NO: 6975775 - DNA, 22 bp, Homo sapiens
tcactggtgtgagaggagcaaa

SEQ ID NO: 6975776 - DNA, 22 bp, Homo sapiens
agtgtctcagccccaactagag

SEQ ID NO: 6975777 - DNA, 22 bp, Homo sapiens
gggggctggaatatccatcaac

SEQ ID NO: 6975778 - DNA, 22 bp, Homo sapiens
tctgaggccttcagcatgaatc

SEQ ID NO: 6975779 - DNA, 22 bp, Homo sapiens
tgaataattcctttttgtcaag

SEQ ID NO: 6975780 - DNA, 22 bp, Homo sapiens
atacagaagaactatagccact

SEQ ID NO: 6975781 - DNA, 20 bp, Homo sapiens
tctgcaaacaagttttagac

SEQ ID NO: 6975782 - DNA, 22 bp, Homo sapiens
ctaatgcagtatcagaatagca

SEQ ID NO: 6975783 - DNA, 22 bp, Homo sapiens
cagttaaatgatgtgccctaga

SEQ ID NO: 6975784 - DNA, 22 bp, Homo sapiens
ggaagctggggagctttggaga

SEQ ID NO: 6975785 - DNA, 22 bp, Homo sapiens
tgaggggcggcctgcagaggcc

SEQ ID NO: 6975786 - DNA, 22 bp, Homo sapiens
aggctaagggatgactggagtg

SEQ ID NO: 6975787 - DNA, 22 bp, Homo sapiens
gcaggaacctggtaagcttcac

SEQ ID NO: 6975788 - DNA, 22 bp, Homo sapiens
tgtgtctaaatggttccttaat

SEQ ID NO: 6975789 - DNA, 19 bp, Homo sapiens
ctgaaaaacattctcagga

SEQ ID NO: 6975790 - DNA, 22 bp, Homo sapiens
tcacagtttccataggtcagca

SEQ ID NO: 6975791 - DNA, 22 bp, Homo sapiens
accagtgggtgtcattccctta

SEQ ID NO: 6975792 - DNA, 22 bp, Homo sapiens
cagcccttaaatagatatacag

SEQ ID NO: 6975793 - DNA, 22 bp, Homo sapiens
agttgaaggttggctgatccat

SEQ ID NO: 6975794 - DNA, 22 bp, Homo sapiens
acaatttatccattgtatagtt

SEQ ID NO: 6975795 - DNA, 22 bp, Homo sapiens
atgtatggaaagaagtggatgg

SEQ ID NO: 6975796 - DNA, 22 bp, Homo sapiens
agtggcacaactgtttagctac

SEQ ID NO: 6975797 - DNA, 17 bp, Homo sapiens
ggagagtgggaatggcc

SEQ ID NO: 6975798 - DNA, 22 bp, Homo sapiens
tttgcttcctagttgggtaata

SEQ ID NO: 6975799 - DNA, 22 bp, Homo sapiens
cagttggaggaatgaggctgta

SEQ ID NO: 6975800 - DNA, 22 bp, Homo sapiens
ccacagggtgtcatcagcttga

SEQ ID NO: 6975801 - DNA, 22 bp, Homo sapiens
atgtgcttgactactctctatt

SEQ ID NO: 6975802 - DNA, 22 bp, Homo sapiens
gtagctgcctttctggcccagg

SEQ ID NO: 6975803 - DNA, 22 bp, Homo sapiens
ttgtggcagaccatgagtctaa

SEQ ID NO: 6975804 - DNA, 22 bp, Homo sapiens
gaacagcatgcatgcaagacta

SEQ ID NO: 6975805 - DNA, 22 bp, Homo sapiens
tggcacagacagcacagcaatg

SEQ ID NO: 6975806 - DNA, 19 bp, Homo sapiens
acactgaatgtagaattgg

SEQ ID NO: 6975807 - DNA, 22 bp, Homo sapiens
ctgtctgtgcctcttctcccag

SEQ ID NO: 6975808 - DNA, 22 bp, Homo sapiens
tggagtcacttccatatgggaa

SEQ ID NO: 6975809 - DNA, 22 bp, Homo sapiens
gagtgaggctggaatcatggct

SEQ ID NO: 6975810 - DNA, 22 bp, Homo sapiens
ttccttttcttaaacatatgtg

SEQ ID NO: 6975811 - DNA, 22 bp, Homo sapiens
cttcatgagtgtacaacctgtg

SEQ ID NO: 6975812 - DNA, 22 bp, Homo sapiens
ctggctgtgtcttggaggagct

SEQ ID NO: 6975813 - DNA, 22 bp, Homo sapiens
aggcagctggcagcacccaggg

SEQ ID NO: 6975814 - DNA, 22 bp, Homo sapiens
tgggtggagaagtggacctgct

SEQ ID NO: 6975815 - DNA, 22 bp, Homo sapiens
tggaggctgtgtgcatgagacc

SEQ ID NO: 6975816 - DNA, 22 bp, Homo sapiens
ttgtccttgtgatagtttgctg

SEQ ID NO: 6975817 - DNA, 22 bp, Homo sapiens
ggtgttaaacatgatccattac

SEQ ID NO: 6975818 - DNA, 22 bp, Homo sapiens
ggcagtgccttagaatctgtgg

SEQ ID NO: 6975819 - DNA, 22 bp, Homo sapiens
cctgaagcacccggagctggca

SEQ ID NO: 6975820 - DNA, 22 bp, Homo sapiens
ttagcaatatgaatgcatttgc

SEQ ID NO: 6975821 - DNA, 22 bp, Homo sapiens
tgatccattaaaatccaagagt

SEQ ID NO: 6975822 - DNA, 22 bp, Homo sapiens
cctaggcaagagttggtgtgga

SEQ ID NO: 6975823 - DNA, 22 bp, Homo sapiens
cttggcctcttctcagggtggg

SEQ ID NO: 6975824 - DNA, 22 bp, Homo sapiens
cttctcccaagtatgcagtttg

SEQ ID NO: 6975825 - DNA, 22 bp, Homo sapiens
taacaaaggttgccaaactaag

SEQ ID NO: 6975826 - DNA, 22 bp, Homo sapiens
ataacagagagctactgaactg

SEQ ID NO: 6975827 - DNA, 22 bp, Homo sapiens
ataccattgtttctaccagctg

SEQ ID NO: 6975828 - DNA, 22 bp, Homo sapiens
tgagctggagtcgtgagcaaag

SEQ ID NO: 6975829 - DNA, 22 bp, Homo sapiens
acagagcataatgtctagcaca

SEQ ID NO: 6975830 - DNA, 22 bp, Homo sapiens
aacactgtggtcttttcagtaa

SEQ ID NO: 6975831 - DNA, 22 bp, Homo sapiens
ctgaatattagtcatgtctgat

SEQ ID NO: 6975832 - DNA, 22 bp, Homo sapiens
aaaccacagttcagtgcttttg

SEQ ID NO: 6975833 - DNA, 22 bp, Homo sapiens
ctttgaagatcacatgttgctc

SEQ ID NO: 6975834 - DNA, 23 bp, Homo sapiens
tttcttcagaagccttgcgaggc

SEQ ID NO: 6975835 - DNA, 23 bp, Homo sapiens
tctctcttagctatgcttatggc

SEQ ID NO: 6975836 - DNA, 22 bp, Homo sapiens
ggtccctgctgaagccttggtg

SEQ ID NO: 6975837 - DNA, 22 bp, Homo sapiens
ctcttattgatgaaggtgctaa

SEQ ID NO: 6975838 - DNA, 22 bp, Homo sapiens
aagaaaacatgatctaatttaa

SEQ ID NO: 6975839 - DNA, 22 bp, Homo sapiens
aggctgctataaacattcccgt

SEQ ID NO: 6975840 - DNA, 21 bp, Homo sapiens
atctgaaatgtcaaagcagat

SEQ ID NO: 6975841 - DNA, 22 bp, Homo sapiens
tattgtgcttctgttgtgcaat

SEQ ID NO: 6975842 - DNA, 22 bp, Homo sapiens
cccagggtccctgctctctgtg

SEQ ID NO: 6975843 - DNA, 22 bp, Homo sapiens
tgaggccagggattccatcatt

SEQ ID NO: 6975844 - DNA, 17 bp, Homo sapiens
gagcccctttccaagtt

SEQ ID NO: 6975845 - DNA, 22 bp, Homo sapiens
gcagagttctcttccagctaac

SEQ ID NO: 6975846 - DNA, 21 bp, Homo sapiens
ttactggcagcagaaacctga

SEQ ID NO: 6975847 - DNA, 18 bp, Homo sapiens
ttcacaagggcttggttt

SEQ ID NO: 6975848 - DNA, 22 bp, Homo sapiens
ggccacatgtggctgctcgtat

SEQ ID NO: 6975849 - DNA, 22 bp, Homo sapiens
attctctgggttccagtaaatg

SEQ ID NO: 6975850 - DNA, 22 bp, Homo sapiens
aaagaggcaggtgttactggaa

SEQ ID NO: 6975851 - DNA, 22 bp, Homo sapiens
cacaggaggttaggaagtggtc

SEQ ID NO: 6975852 - DNA, 22 bp, Homo sapiens
ttagagaagttttacttaagaa

SEQ ID NO: 6975853 - DNA, 22 bp, Homo sapiens
acacagttcgttgttttctact

SEQ ID NO: 6975854 - DNA, 22 bp, Homo sapiens
gcagatggtgggggaggagtac

SEQ ID NO: 6975855 - DNA, 22 bp, Homo sapiens
ctgactccctgattctgggttt

SEQ ID NO: 6975856 - DNA, 20 bp, Homo sapiens
gtaggcatatgaccaattac

SEQ ID NO: 6975857 - DNA, 22 bp, Homo sapiens
tacagtgacagatagggataga

SEQ ID NO: 6975858 - DNA, 22 bp, Homo sapiens
tgggtccttgctgattgctgag

SEQ ID NO: 6975859 - DNA, 22 bp, Homo sapiens
agggagtgtaaatggtgctcag

SEQ ID NO: 6975860 - DNA, 22 bp, Homo sapiens
taagtaattgcagcaatttgcc

SEQ ID NO: 6975861 - DNA, 22 bp, Homo sapiens
ttttcctcacctaactcaaggt

SEQ ID NO: 6975862 - DNA, 22 bp, Homo sapiens
tgtgttcatcatgatatcaggt

SEQ ID NO: 6975863 - DNA, 22 bp, Homo sapiens
acttaaaaccagacagcgtcat

SEQ ID NO: 6975864 - DNA, 22 bp, Homo sapiens
gcggaggttttcttgctcactt

SEQ ID NO: 6975865 - DNA, 22 bp, Homo sapiens
gtggccttgctcacatgtccag

SEQ ID NO: 6975866 - DNA, 22 bp, Homo sapiens
tcctggccttgctcctgatgcc

SEQ ID NO: 6975867 - DNA, 22 bp, Homo sapiens
accaggcccaccgcatgctcct

SEQ ID NO: 6975868 - DNA, 22 bp, Homo sapiens
atgtcctttaaatgacttaata

SEQ ID NO: 6975869 - DNA, 22 bp, Homo sapiens
taggtgtctgctcttatttaac

SEQ ID NO: 6975870 - DNA, 22 bp, Homo sapiens
tgtctgtgacctctttggagcc

SEQ ID NO: 6975871 - DNA, 22 bp, Homo sapiens
tcttggagatgaccaggcatgc

SEQ ID NO: 6975872 - DNA, 22 bp, Homo sapiens
ctgtgggattcatgacattaat

SEQ ID NO: 6975873 - DNA, 20 bp, Homo sapiens
catggctgtgagcccacagg

SEQ ID NO: 6975874 - DNA, 22 bp, Homo sapiens
aaggagtttgggtagtcataca

SEQ ID NO: 6975875 - DNA, 22 bp, Homo sapiens
ttagtggaataaacggtcatgt

SEQ ID NO: 6975876 - DNA, 22 bp, Homo sapiens
tgggggagctcagtccagccca

SEQ ID NO: 6975877 - DNA, 22 bp, Homo sapiens
ctctgtgagggtctgtacagaa

SEQ ID NO: 6975878 - DNA, 22 bp, Homo sapiens
ctagaatatcatatgaagagac

SEQ ID NO: 6975879 - DNA, 22 bp, Homo sapiens
aacacttatccacatttgaaag

SEQ ID NO: 6975880 - DNA, 22 bp, Homo sapiens
ttgtgagcaccagaggttgttc

SEQ ID NO: 6975881 - DNA, 22 bp, Homo sapiens
tggaaatagttgtgagtcaggc

SEQ ID NO: 6975882 - DNA, 19 bp, Homo sapiens
tcctgggctgggccaggtc

SEQ ID NO: 6975883 - DNA, 22 bp, Homo sapiens
tttccaggtattaatactgtat

SEQ ID NO: 6975884 - DNA, 22 bp, Homo sapiens
agtgtctttatagactgacaat

SEQ ID NO: 6975885 - DNA, 22 bp, Homo sapiens
ctctaggggctggtcagcgtct

SEQ ID NO: 6975886 - DNA, 22 bp, Homo sapiens
cttcactaatcactgaactcca

SEQ ID NO: 6975887 - DNA, 22 bp, Homo sapiens
gctcctggctctggccaaggga

SEQ ID NO: 6975888 - DNA, 19 bp, Homo sapiens
ccaggcctctggggcctgt

SEQ ID NO: 6975889 - DNA, 22 bp, Homo sapiens
tggtcattctgttctacagtag

SEQ ID NO: 6975890 - DNA, 22 bp, Homo sapiens
ctgtctctgtcttaactcccag

SEQ ID NO: 6975891 - DNA, 18 bp, Homo sapiens
attttgaactgggaatat

SEQ ID NO: 6975892 - DNA, 21 bp, Homo sapiens
aagtttgttcttgtatagtct

SEQ ID NO: 6975893 - DNA, 19 bp, Homo sapiens
caagacaaagcccatcttc

SEQ ID NO: 6975894 - DNA, 22 bp, Homo sapiens
taggaaacatttgaagaggatt

SEQ ID NO: 6975895 - DNA, 22 bp, Homo sapiens
tggaaagggacttatgagttcc

SEQ ID NO: 6975896 - DNA, 22 bp, Homo sapiens
atttgctggtgaaatagtgaca

SEQ ID NO: 6975897 - DNA, 22 bp, Homo sapiens
atttgcttgtaaatgtatgcct

SEQ ID NO: 6975898 - DNA, 22 bp, Homo sapiens
ctgggacacccagagctgcaga

SEQ ID NO: 6975899 - DNA, 22 bp, Homo sapiens
gtgtcctggttccttgtggctg

SEQ ID NO: 6975900 - DNA, 22 bp, Homo sapiens
tgacccttgtggcagaaaacag

SEQ ID NO: 6975901 - DNA, 22 bp, Homo sapiens
acttcagcccagaggaagggat

SEQ ID NO: 6975902 - DNA, 22 bp, Homo sapiens
atttcactgcttgagctgcagc

SEQ ID NO: 6975903 - DNA, 22 bp, Homo sapiens
tgtgcagctctagagccaagcc

SEQ ID NO: 6975904 - DNA, 22 bp, Homo sapiens
tgtggcaggcaagatgtacaga

SEQ ID NO: 6975905 - DNA, 22 bp, Homo sapiens
ccccaaaattcttaagttgaat

SEQ ID NO: 6975906 - DNA, 22 bp, Homo sapiens
aaggctaaattctgtactgcat

SEQ ID NO: 6975907 - DNA, 22 bp, Homo sapiens
catgtgtctaatctactaatat

SEQ ID NO: 6975908 - DNA, 22 bp, Homo sapiens
tggagttgtgtcatctttgtaa

SEQ ID NO: 6975909 - DNA, 22 bp, Homo sapiens
tccacagaatggaattctccgc

SEQ ID NO: 6975910 - DNA, 22 bp, Homo sapiens
tgtggaagggacactggactgg

SEQ ID NO: 6975911 - DNA, 22 bp, Homo sapiens
gctaagtggttttcttctcctc

SEQ ID NO: 6975912 - DNA, 22 bp, Homo sapiens
cattcaaatgtgccactgtcct

SEQ ID NO: 6975913 - DNA, 22 bp, Homo sapiens
gtgtgtgtgcatataacatata

SEQ ID NO: 6975914 - DNA, 22 bp, Homo sapiens
cagggtgccaaagaacaaatat

SEQ ID NO: 6975915 - DNA, 22 bp, Homo sapiens
gaacatttgatgatgacattgg

SEQ ID NO: 6975916 - DNA, 17 bp, Homo sapiens
cacttgctggtctacct

SEQ ID NO: 6975917 - DNA, 22 bp, Homo sapiens
ttactatctttccagtttggct

SEQ ID NO: 6975918 - DNA, 17 bp, Homo sapiens
tttagaatacaatgttt

SEQ ID NO: 6975919 - DNA, 22 bp, Homo sapiens
ccacagggataggaatggggct

SEQ ID NO: 6975920 - DNA, 21 bp, Homo sapiens
ggacagtagtagtcaggagag

SEQ ID NO: 6975921 - DNA, 22 bp, Homo sapiens
gggcttctattctggcacaaga

SEQ ID NO: 6975922 - DNA, 19 bp, Homo sapiens
acacatgtaacagtttttc

SEQ ID NO: 6975923 - DNA, 22 bp, Homo sapiens
atggatgagtccttgagacaca

SEQ ID NO: 6975924 - DNA, 22 bp, Homo sapiens
ttctgaaatttcaactttacta

SEQ ID NO: 6975925 - DNA, 17 bp, Homo sapiens
ttgaaaagtaagctccc

SEQ ID NO: 6975926 - DNA, 22 bp, Homo sapiens
gagaggagacttatccagattg

SEQ ID NO: 6975927 - DNA, 22 bp, Homo sapiens
ttggagaactggcatttttaat

SEQ ID NO: 6975928 - DNA, 22 bp, Homo sapiens
tcagcttgggaaattgagcaag

SEQ ID NO: 6975929 - DNA, 22 bp, Homo sapiens
tggaccagggtcccagagtatg

SEQ ID NO: 6975930 - DNA, 22 bp, Homo sapiens
gatgaatgtgggtcaagtacct

SEQ ID NO: 6975931 - DNA, 22 bp, Homo sapiens
tgaaatatcattttcatctccc

SEQ ID NO: 6975932 - DNA, 22 bp, Homo sapiens
gggacactggacccagtgtcca

SEQ ID NO: 6975933 - DNA, 22 bp, Homo sapiens
gctgcttgattaggttgacact

SEQ ID NO: 6975934 - DNA, 22 bp, Homo sapiens
atggccacatttagtaactggt

SEQ ID NO: 6975935 - DNA, 22 bp, Homo sapiens
ctgaggaatgagtgaggagcca

SEQ ID NO: 6975936 - DNA, 22 bp, Homo sapiens
gctgccaagggaagcgcagtgc

SEQ ID NO: 6975937 - DNA, 22 bp, Homo sapiens
gttctgctcctgtggcaatcta

SEQ ID NO: 6975938 - DNA, 22 bp, Homo sapiens
aatataatgctgttttatgcca

SEQ ID NO: 6975939 - DNA, 22 bp, Homo sapiens
atgtgtatgtgtatacacacag

SEQ ID NO: 6975940 - DNA, 22 bp, Homo sapiens
tctgagctagaaagtatgccct

SEQ ID NO: 6975941 - DNA, 21 bp, Homo sapiens
ttaagacctgcatcatcatta

SEQ ID NO: 6975942 - DNA, 22 bp, Homo sapiens
atatacttggagactatcattg

SEQ ID NO: 6975943 - DNA, 22 bp, Homo sapiens
tgagagtctttaaattctgaga

SEQ ID NO: 6975944 - DNA, 22 bp, Homo sapiens
aggctggctgagctgcagcctg

SEQ ID NO: 6975945 - DNA, 20 bp, Homo sapiens
tatattttctctttggcctt

SEQ ID NO: 6975946 - DNA, 22 bp, Homo sapiens
acagtaagcggggttggagggc

SEQ ID NO: 6975947 - DNA, 22 bp, Homo sapiens
agctagaagtcctagataaagg

SEQ ID NO: 6975948 - DNA, 22 bp, Homo sapiens
tcacatcaccctgctcttaatt

SEQ ID NO: 6975949 - DNA, 22 bp, Homo sapiens
ttactacagagagagctccagt

SEQ ID NO: 6975950 - DNA, 22 bp, Homo sapiens
cagggccttcgtaagtgtccgg

SEQ ID NO: 6975951 - DNA, 22 bp, Homo sapiens
cagaaatcattgtgatgacagg

SEQ ID NO: 6975952 - DNA, 22 bp, Homo sapiens
agttaagggtattcttttaaat

SEQ ID NO: 6975953 - DNA, 22 bp, Homo sapiens
cattagaaaagcagctgggacc

SEQ ID NO: 6975954 - DNA, 22 bp, Homo sapiens
atcagtttatacttataaatct

SEQ ID NO: 6975955 - DNA, 22 bp, Homo sapiens
taggccttgcctggcttcacac

SEQ ID NO: 6975956 - DNA, 22 bp, Homo sapiens
gcctgcagcccctctgcagtag

SEQ ID NO: 6975957 - DNA, 21 bp, Homo sapiens
actgcacactatgtgaattga

SEQ ID NO: 6975958 - DNA, 22 bp, Homo sapiens
ggctaggcctcaggcctgcctg

SEQ ID NO: 6975959 - DNA, 22 bp, Homo sapiens
atgtccagagaacatttgcttt

SEQ ID NO: 6975960 - DNA, 22 bp, Homo sapiens
tctggcagtggatgagggcagc

SEQ ID NO: 6975961 - DNA, 22 bp, Homo sapiens
tatgttactcacatgttcttgc

SEQ ID NO: 6975962 - DNA, 22 bp, Homo sapiens
agggaaatctcagctctaaaat

SEQ ID NO: 6975963 - DNA, 22 bp, Homo sapiens
taccatgcttgagatacagtga

SEQ ID NO: 6975964 - DNA, 20 bp, Homo sapiens
acactgttcttcacacattt

SEQ ID NO: 6975965 - DNA, 22 bp, Homo sapiens
ccaggactcaatgaccacaggg

SEQ ID NO: 6975966 - DNA, 22 bp, Homo sapiens
aggcactggtctaccccttagt

SEQ ID NO: 6975967 - DNA, 22 bp, Homo sapiens
agagggctaactgggaagcagg

SEQ ID NO: 6975968 - DNA, 22 bp, Homo sapiens
gatacacacccttgataggact

SEQ ID NO: 6975969 - DNA, 22 bp, Homo sapiens
gtgccctccgtgttcatagagc

SEQ ID NO: 6975970 - DNA, 22 bp, Homo sapiens
ctgggctttggtactgtgatta

SEQ ID NO: 6975971 - DNA, 22 bp, Homo sapiens
aggtcaagagtaaatttgggta

SEQ ID NO: 6975972 - DNA, 22 bp, Homo sapiens
agctacacacacaggtgtttta

SEQ ID NO: 6975973 - DNA, 22 bp, Homo sapiens
ccttctgagtgtggacccctgt

SEQ ID NO: 6975974 - DNA, 22 bp, Homo sapiens
atgttagaaggaatgttaaaag

SEQ ID NO: 6975975 - DNA, 22 bp, Homo sapiens
ttcagttttgcttttaatcatg

SEQ ID NO: 6975976 - DNA, 22 bp, Homo sapiens
tttttgtggtgcagactaaagc

SEQ ID NO: 6975977 - DNA, 22 bp, Homo sapiens
agtctgtgagtgatgtacctgc

SEQ ID NO: 6975978 - DNA, 21 bp, Homo sapiens
ggaggtcccttctggtttcag

SEQ ID NO: 6975979 - DNA, 22 bp, Homo sapiens
cgtgtgcgcacacctgtttcca

SEQ ID NO: 6975980 - DNA, 22 bp, Homo sapiens
tgatttcatagtatatacatga

SEQ ID NO: 6975981 - DNA, 22 bp, Homo sapiens
gctctggtaccagctactccta

SEQ ID NO: 6975982 - DNA, 22 bp, Homo sapiens
atcctcagcatctagcatgaag

SEQ ID NO: 6975983 - DNA, 22 bp, Homo sapiens
atgagttcaattgtttcagtca

SEQ ID NO: 6975984 - DNA, 22 bp, Homo sapiens
ttctgtaggcatggaacaggga

SEQ ID NO: 6975985 - DNA, 22 bp, Homo sapiens
gttcttggaccagcagcattga

SEQ ID NO: 6975986 - DNA, 22 bp, Homo sapiens
tgagcactttaaaatattccca

SEQ ID NO: 6975987 - DNA, 22 bp, Homo sapiens
tgtgaagatagctgttacatct

SEQ ID NO: 6975988 - DNA, 22 bp, Homo sapiens
taggctcattaagtccccaggg

SEQ ID NO: 6975989 - DNA, 22 bp, Homo sapiens
cctgcagggtgctgccacagat

SEQ ID NO: 6975990 - DNA, 22 bp, Homo sapiens
tttgcagatgagaaaactgtgg

SEQ ID NO: 6975991 - DNA, 22 bp, Homo sapiens
tcccattgtttgctctaggctg

SEQ ID NO: 6975992 - DNA, 22 bp, Homo sapiens
acatatatgctgggactgtgac

SEQ ID NO: 6975993 - DNA, 22 bp, Homo sapiens
ttcatatgtgaactcagtgatg

SEQ ID NO: 6975994 - DNA, 22 bp, Homo sapiens
agctgctggggagggcagacac

SEQ ID NO: 6975995 - DNA, 20 bp, Homo sapiens
tggggaaagccatcgatgag

SEQ ID NO: 6975996 - DNA, 22 bp, Homo sapiens
actttggttataggagccaaaa

SEQ ID NO: 6975997 - DNA, 22 bp, Homo sapiens
cagagtttgcaagggcagaagc

SEQ ID NO: 6975998 - DNA, 22 bp, Homo sapiens
ctgcacagctgggcaagatata

SEQ ID NO: 6975999 - DNA, 22 bp, Homo sapiens
aagtgtggtttaggcatctttt

SEQ ID NO: 6976000 - DNA, 22 bp, Homo sapiens
gtatttggaaaccaccagtgcc

SEQ ID NO: 6976001 - DNA, 22 bp, Homo sapiens
tctcccttctctggattccgtt

SEQ ID NO: 6976002 - DNA, 22 bp, Homo sapiens
aggctgtgaggggcccgcatgc

SEQ ID NO: 6976003 - DNA, 21 bp, Homo sapiens
tgtgccagggatggggagccc

SEQ ID NO: 6976004 - DNA, 22 bp, Homo sapiens
ggcctgtggtgcgctatttcag

SEQ ID NO: 6976005 - DNA, 22 bp, Homo sapiens
gtttcacataattttaaattgt

SEQ ID NO: 6976006 - DNA, 22 bp, Homo sapiens
atagcacttattgtatgctgag

SEQ ID NO: 6976007 - DNA, 22 bp, Homo sapiens
taattggtagctggtataatgc

SEQ ID NO: 6976008 - DNA, 22 bp, Homo sapiens
tttatgcagcgtttcaccaccc

SEQ ID NO: 6976009 - DNA, 22 bp, Homo sapiens
ggctttgcttaacgtgcttcta

SEQ ID NO: 6976010 - DNA, 22 bp, Homo sapiens
ctctgtgccctactgctcagct

SEQ ID NO: 6976011 - DNA, 22 bp, Homo sapiens
ctgaataattttctgttgtatg

SEQ ID NO: 6976012 - DNA, 22 bp, Homo sapiens
gagaatttcccagtctgtgctg

SEQ ID NO: 6976013 - DNA, 22 bp, Homo sapiens
atgttggctggattttagattt

SEQ ID NO: 6976014 - DNA, 22 bp, Homo sapiens
tttatcagaggctatgtttcat

SEQ ID NO: 6976015 - DNA, 22 bp, Homo sapiens
cctgattctgccactactagcc

SEQ ID NO: 6976016 - DNA, 22 bp, Homo sapiens
gtctaaacaaaaatgcaccttt

SEQ ID NO: 6976017 - DNA, 22 bp, Homo sapiens
ctaggcacactgggccctttac

SEQ ID NO: 6976018 - DNA, 22 bp, Homo sapiens
tctggagagtcctgctcacgtc

SEQ ID NO: 6976019 - DNA, 22 bp, Homo sapiens
tcaagagattgaataataactg

SEQ ID NO: 6976020 - DNA, 22 bp, Homo sapiens
aggagcccagcctgggctcgga

SEQ ID NO: 6976021 - DNA, 22 bp, Homo sapiens
ctggaggtttattattttagat

SEQ ID NO: 6976022 - DNA, 22 bp, Homo sapiens
ctgcaaggctggggtgagctgg

SEQ ID NO: 6976023 - DNA, 22 bp, Homo sapiens
gagaaaccgattctgcatgtca

SEQ ID NO: 6976024 - DNA, 22 bp, Homo sapiens
attctgactttcatctgccttt

SEQ ID NO: 6976025 - DNA, 22 bp, Homo sapiens
tctgttaaatattgatagatat

SEQ ID NO: 6976026 - DNA, 22 bp, Homo sapiens
tttggtaagaagctttggtttt

SEQ ID NO: 6976027 - DNA, 22 bp, Homo sapiens
agctaaagagccctacccaaag

SEQ ID NO: 6976028 - DNA, 22 bp, Homo sapiens
tttgatctatgcgtggtttccc

SEQ ID NO: 6976029 - DNA, 22 bp, Homo sapiens
tggagcatattctggagcttgg

SEQ ID NO: 6976030 - DNA, 22 bp, Homo sapiens
aggtcccagtctgtgatgactc

SEQ ID NO: 6976031 - DNA, 22 bp, Homo sapiens
ttccctaatgtctaacgctatt

SEQ ID NO: 6976032 - DNA, 20 bp, Homo sapiens
acaatctgtttgttgtctgt

SEQ ID NO: 6976033 - DNA, 22 bp, Homo sapiens
ttggagagattatcagaccagc

SEQ ID NO: 6976034 - DNA, 22 bp, Homo sapiens
gcctggcacagtagggacccaa

SEQ ID NO: 6976035 - DNA, 22 bp, Homo sapiens
gtaacactctaaagggatgcac

SEQ ID NO: 6976036 - DNA, 22 bp, Homo sapiens
tctgtgggtgcctccagcagtg

SEQ ID NO: 6976037 - DNA, 22 bp, Homo sapiens
acttcattgctaagaacaaggt

SEQ ID NO: 6976038 - DNA, 22 bp, Homo sapiens
tcttctgaaactagtgggaaag

SEQ ID NO: 6976039 - DNA, 22 bp, Homo sapiens
actcatttttactgcaattgag

SEQ ID NO: 6976040 - DNA, 22 bp, Homo sapiens
taagatatggtaggaagtttgg

SEQ ID NO: 6976041 - DNA, 20 bp, Homo sapiens
ctgtgggcctcacttggggt

SEQ ID NO: 6976042 - DNA, 22 bp, Homo sapiens
cagagcccatggcacatgtgga

SEQ ID NO: 6976043 - DNA, 22 bp, Homo sapiens
ttcctcagccagcacttagggg

SEQ ID NO: 6976044 - DNA, 23 bp, Homo sapiens
acttgattattgttgatagattc

SEQ ID NO: 6976045 - DNA, 22 bp, Homo sapiens
gtggggaggcctaagcaagttg

SEQ ID NO: 6976046 - DNA, 22 bp, Homo sapiens
acatgggatcaatgaggcaggc

SEQ ID NO: 6976047 - DNA, 22 bp, Homo sapiens
cactctgcaggccaaaccaaag

SEQ ID NO: 6976048 - DNA, 22 bp, Homo sapiens
ctcttagtgcatctcattagtt

SEQ ID NO: 6976049 - DNA, 22 bp, Homo sapiens
aatgtcacatacaatggcaagt

SEQ ID NO: 6976050 - DNA, 22 bp, Homo sapiens
gcctggctggtagagggggctc

SEQ ID NO: 6976051 - DNA, 22 bp, Homo sapiens
atatctttcaaagccaaaagta

SEQ ID NO: 6976052 - DNA, 20 bp, Homo sapiens
tgaattctgggtttatctgc

SEQ ID NO: 6976053 - DNA, 22 bp, Homo sapiens
tagcagaggaaatccagagtaa

SEQ ID NO: 6976054 - DNA, 22 bp, Homo sapiens
aatgtgtcagcttgtcgatctt

SEQ ID NO: 6976055 - DNA, 22 bp, Homo sapiens
ggatgcagtgaggagcccgcgc

SEQ ID NO: 6976056 - DNA, 22 bp, Homo sapiens
aagcagtgactctcagaggcag

SEQ ID NO: 6976057 - DNA, 19 bp, Homo sapiens
gatcagagtgtcagcttgt

SEQ ID NO: 6976058 - DNA, 20 bp, Homo sapiens
tcattgcacataatggaagc

SEQ ID NO: 6976059 - DNA, 22 bp, Homo sapiens
gcccagagagatgaagtgatgg

SEQ ID NO: 6976060 - DNA, 22 bp, Homo sapiens
aggcacagagaggttaaatgca

SEQ ID NO: 6976061 - DNA, 22 bp, Homo sapiens
gaagacactctgcagagttatc

SEQ ID NO: 6976062 - DNA, 21 bp, Homo sapiens
acaggccttaggggccattca

SEQ ID NO: 6976063 - DNA, 22 bp, Homo sapiens
gcctccagctggggcatttcag

SEQ ID NO: 6976064 - DNA, 22 bp, Homo sapiens
gaggtggcaatttaatgcagtc

SEQ ID NO: 6976065 - DNA, 22 bp, Homo sapiens
aggtacatggggtgtgtgcacg

SEQ ID NO: 6976066 - DNA, 22 bp, Homo sapiens
gtcaaggcactgacagcctgag

SEQ ID NO: 6976067 - DNA, 22 bp, Homo sapiens
agttcagccatttgttaactat

SEQ ID NO: 6976068 - DNA, 22 bp, Homo sapiens
tatgtgtaatcatatctgatac

SEQ ID NO: 6976069 - DNA, 22 bp, Homo sapiens
tttcatgtaatcatttaggtgg

SEQ ID NO: 6976070 - DNA, 22 bp, Homo sapiens
agcaggaactcagggagttctc

SEQ ID NO: 6976071 - DNA, 22 bp, Homo sapiens
tacatatccaggctgagaagat

SEQ ID NO: 6976072 - DNA, 22 bp, Homo sapiens
cttataaagtccatctgaacaa

SEQ ID NO: 6976073 - DNA, 22 bp, Homo sapiens
cctttagagcaaacgccaccta

SEQ ID NO: 6976074 - DNA, 22 bp, Homo sapiens
tgctgcatttatcttctcaaac

SEQ ID NO: 6976075 - DNA, 18 bp, Homo sapiens
gccagagggaagcaggtg

SEQ ID NO: 6976076 - DNA, 22 bp, Homo sapiens
agtatgcacctcactgtcaggc

SEQ ID NO: 6976077 - DNA, 22 bp, Homo sapiens
tttctcagtgtagcttttcaag

SEQ ID NO: 6976078 - DNA, 22 bp, Homo sapiens
ctttatgaacctgttcagcttg

SEQ ID NO: 6976079 - DNA, 22 bp, Homo sapiens
atttctagtccttgtgtagtca

SEQ ID NO: 6976080 - DNA, 22 bp, Homo sapiens
ctagtgaacgtggtactatgga

SEQ ID NO: 6976081 - DNA, 22 bp, Homo sapiens
catgccagttttgagatgcacc

SEQ ID NO: 6976082 - DNA, 22 bp, Homo sapiens
ttccaggaacagatgaaggttg

SEQ ID NO: 6976083 - DNA, 22 bp, Homo sapiens
cctcctggcttttcccattgaa

SEQ ID NO: 6976084 - DNA, 19 bp, Homo sapiens
ggagactcagcccatgcct

SEQ ID NO: 6976085 - DNA, 22 bp, Homo sapiens
agagttatcactccatgcagct

SEQ ID NO: 6976086 - DNA, 22 bp, Homo sapiens
gtgccacatggtccatgtatca

SEQ ID NO: 6976087 - DNA, 22 bp, Homo sapiens
aatggttttgcaggtttgtgga

SEQ ID NO: 6976088 - DNA, 22 bp, Homo sapiens
atgtacattattcgagtgatgg

SEQ ID NO: 6976089 - DNA, 22 bp, Homo sapiens
acagcagtgtctggtactgagt

SEQ ID NO: 6976090 - DNA, 22 bp, Homo sapiens
ttggaaagtttttactgaagac

SEQ ID NO: 6976091 - DNA, 22 bp, Homo sapiens
aagagagggacttattaaagtc

SEQ ID NO: 6976092 - DNA, 22 bp, Homo sapiens
aatggcttagtgcttcacttct

SEQ ID NO: 6976093 - DNA, 22 bp, Homo sapiens
ttcaacatgctttatttctaaa

SEQ ID NO: 6976094 - DNA, 22 bp, Homo sapiens
ccagctttctcagaggcttcta

SEQ ID NO: 6976095 - DNA, 22 bp, Homo sapiens
gacagctgaaggatgattcagg

SEQ ID NO: 6976096 - DNA, 22 bp, Homo sapiens
aaaaaccattgtcttcagtctc

SEQ ID NO: 6976097 - DNA, 18 bp, Homo sapiens
gtttcatgcatgtgaaac

SEQ ID NO: 6976098 - DNA, 22 bp, Homo sapiens
gagcagagcttctcaaagtaaa

SEQ ID NO: 6976099 - DNA, 22 bp, Homo sapiens
ttaaggtgctttatttagctct

SEQ ID NO: 6976100 - DNA, 20 bp, Homo sapiens
atcttcttggccagcttgct

SEQ ID NO: 6976101 - DNA, 23 bp, Homo sapiens
cttgcctggcctctctgcccaga

SEQ ID NO: 6976102 - DNA, 22 bp, Homo sapiens
tgacagaccactgcaactctgt

SEQ ID NO: 6976103 - DNA, 23 bp, Homo sapiens
gctcacagaatgttgaagggaat

SEQ ID NO: 6976104 - DNA, 22 bp, Homo sapiens
tatctgttcaatggaagatgac

SEQ ID NO: 6976105 - DNA, 22 bp, Homo sapiens
agatgttttgtgtatttcatca

SEQ ID NO: 6976106 - DNA, 22 bp, Homo sapiens
caggcctttgggaatcaccaca

SEQ ID NO: 6976107 - DNA, 22 bp, Homo sapiens
tttttagattactcagccacca

SEQ ID NO: 6976108 - DNA, 22 bp, Homo sapiens
tgaaggtgaatgtctatgggga

SEQ ID NO: 6976109 - DNA, 22 bp, Homo sapiens
ggagccaggcatatcggggcac

SEQ ID NO: 6976110 - DNA, 22 bp, Homo sapiens
aatgttccacagatatagcatg

SEQ ID NO: 6976111 - DNA, 22 bp, Homo sapiens
aatgtctagagttttaagctta

SEQ ID NO: 6976112 - DNA, 22 bp, Homo sapiens
aaacaatccaggaacctgttta

SEQ ID NO: 6976113 - DNA, 22 bp, Homo sapiens
ccagcagctccctcagggtccg

SEQ ID NO: 6976114 - DNA, 20 bp, Homo sapiens
tctctgctgtccacatttgc

SEQ ID NO: 6976115 - DNA, 22 bp, Homo sapiens
caggctggagtgcaatggtgct

SEQ ID NO: 6976116 - DNA, 22 bp, Homo sapiens
gataattttggttccaggttgg

SEQ ID NO: 6976117 - DNA, 23 bp, Homo sapiens
cagcagctgcctggttttttggt

SEQ ID NO: 6976118 - DNA, 22 bp, Homo sapiens
gcacatgcactgtgggggcaat

SEQ ID NO: 6976119 - DNA, 22 bp, Homo sapiens
aagtgattctagtcatgattct

SEQ ID NO: 6976120 - DNA, 22 bp, Homo sapiens
agatcagagtggattgtgctgc

SEQ ID NO: 6976121 - DNA, 22 bp, Homo sapiens
tttctcctcatgactggttgtg

SEQ ID NO: 6976122 - DNA, 22 bp, Homo sapiens
tggcagtgaaagacaattgggc

SEQ ID NO: 6976123 - DNA, 22 bp, Homo sapiens
tgcctgtggttccagttttttc

SEQ ID NO: 6976124 - DNA, 22 bp, Homo sapiens
tgttctcattgttttcatccag

SEQ ID NO: 6976125 - DNA, 22 bp, Homo sapiens
tcatggcagtttaataagtggt

SEQ ID NO: 6976126 - DNA, 22 bp, Homo sapiens
gaccccaaaccctgtattcttc

SEQ ID NO: 6976127 - DNA, 22 bp, Homo sapiens
tctttagtattgagttatggta

SEQ ID NO: 6976128 - DNA, 22 bp, Homo sapiens
aaagcgcttccctttggagcgt

SEQ ID NO: 6976129 - DNA, 22 bp, Homo sapiens
ttctttttatcttcccataaga

SEQ ID NO: 6976130 - DNA, 22 bp, Homo sapiens
tttgctcagtttgataatttga

SEQ ID NO: 6976131 - DNA, 22 bp, Homo sapiens
tcctagggattcaacactgaac

SEQ ID NO: 6976132 - DNA, 22 bp, Homo sapiens
aaacagtggccaattctggaga

SEQ ID NO: 6976133 - DNA, 22 bp, Homo sapiens
aggccttggcagaggccaggct

SEQ ID NO: 6976134 - DNA, 22 bp, Homo sapiens
agtcagtgaaaactagaatgtt

SEQ ID NO: 6976135 - DNA, 22 bp, Homo sapiens
tccctgccagtcctggtctgaa

SEQ ID NO: 6976136 - DNA, 22 bp, Homo sapiens
ttagtgcaaacctcagagacac

SEQ ID NO: 6976137 - DNA, 19 bp, Homo sapiens
attcttctcaaatatccat

SEQ ID NO: 6976138 - DNA, 22 bp, Homo sapiens
agagtgcttagtagtgacatgg

SEQ ID NO: 6976139 - DNA, 22 bp, Homo sapiens
tctgtaaagccctggtacctgg

SEQ ID NO: 6976140 - DNA, 22 bp, Homo sapiens
catgtgtcacagccttttattg

SEQ ID NO: 6976141 - DNA, 22 bp, Homo sapiens
tattttgtcttctgctcatcac

SEQ ID NO: 6976142 - DNA, 22 bp, Homo sapiens
agctgccttccctctcattagg

SEQ ID NO: 6976143 - DNA, 22 bp, Homo sapiens
aaagttcttcatttttattgga

SEQ ID NO: 6976144 - DNA, 22 bp, Homo sapiens
ggtcacacaccaggacctgcag

SEQ ID NO: 6976145 - DNA, 22 bp, Homo sapiens
gctcagctctatggacacaaag

SEQ ID NO: 6976146 - DNA, 22 bp, Homo sapiens
ttcatgtgtttgatagcccaga

SEQ ID NO: 6976147 - DNA, 22 bp, Homo sapiens
ctcagagggttgaaggtgctct

SEQ ID NO: 6976148 - DNA, 22 bp, Homo sapiens
taaaacagcagggcagagaagt

SEQ ID NO: 6976149 - DNA, 22 bp, Homo sapiens
atgtgtaaaaagtgcttaatat

SEQ ID NO: 6976150 - DNA, 20 bp, Homo sapiens
gggtgagatgtaggagaggg

SEQ ID NO: 6976151 - DNA, 22 bp, Homo sapiens
tggggcagcagacctttcttgg

SEQ ID NO: 6976152 - DNA, 22 bp, Homo sapiens
tccagcccagctgtccccttca

SEQ ID NO: 6976153 - DNA, 22 bp, Homo sapiens
gtctttatctttgaaattagtc

SEQ ID NO: 6976154 - DNA, 22 bp, Homo sapiens
cctggctgtgcattgccggccc

SEQ ID NO: 6976155 - DNA, 22 bp, Homo sapiens
tgtcctgtgattccagctcttc

SEQ ID NO: 6976156 - DNA, 22 bp, Homo sapiens
acctctgaacatttttaagact

SEQ ID NO: 6976157 - DNA, 22 bp, Homo sapiens
caggctcaatggccacttgggc

SEQ ID NO: 6976158 - DNA, 22 bp, Homo sapiens
ctcctctcaggctggatggcgc

SEQ ID NO: 6976159 - DNA, 22 bp, Homo sapiens
gccagccacttcccagactggc

SEQ ID NO: 6976160 - DNA, 21 bp, Homo sapiens
ctggccactgcacctcttcct

SEQ ID NO: 6976161 - DNA, 22 bp, Homo sapiens
aggcagacaaggacacagtggg

SEQ ID NO: 6976162 - DNA, 22 bp, Homo sapiens
ggcactgatctgatttccctcc

SEQ ID NO: 6976163 - DNA, 22 bp, Homo sapiens
actcctacatattagcattaac

SEQ ID NO: 6976164 - DNA, 22 bp, Homo sapiens
ttgaagtccttgcctcttgcac

SEQ ID NO: 6976165 - DNA, 22 bp, Homo sapiens
aacctctacatccaggaaagga

SEQ ID NO: 6976166 - DNA, 22 bp, Homo sapiens
agtcacagaaacccaggtgtgg

SEQ ID NO: 6976167 - DNA, 22 bp, Homo sapiens
tttcccagaggtatgaataagt

SEQ ID NO: 6976168 - DNA, 22 bp, Homo sapiens
tccttgaagcttgtatctaata

SEQ ID NO: 6976169 - DNA, 22 bp, Homo sapiens
gaggtccatacagctattctac

SEQ ID NO: 6976170 - DNA, 22 bp, Homo sapiens
tgttctctctggctgccagtac

SEQ ID NO: 6976171 - DNA, 22 bp, Homo sapiens
gctgattaacttcattgtagtt

SEQ ID NO: 6976172 - DNA, 23 bp, Homo sapiens
agaatttcaaagtccagcacatt

SEQ ID NO: 6976173 - DNA, 22 bp, Homo sapiens
agggggtgatcaaggtgcggcg

SEQ ID NO: 6976174 - DNA, 22 bp, Homo sapiens
tctggcagggtgtgtatttaca

SEQ ID NO: 6976175 - DNA, 22 bp, Homo sapiens
tgcctgtctctgactgccatta

SEQ ID NO: 6976176 - DNA, 22 bp, Homo sapiens
aaatgtacactttgcatcttga

SEQ ID NO: 6976177 - DNA, 22 bp, Homo sapiens
tttctagaaatagagatagagt

SEQ ID NO: 6976178 - DNA, 22 bp, Homo sapiens
tgaggcagtcaccccctcctgc

SEQ ID NO: 6976179 - DNA, 22 bp, Homo sapiens
atagcaaaggacaatagtcagt

SEQ ID NO: 6976180 - DNA, 22 bp, Homo sapiens
tgtcttattgcctttgtaattt

SEQ ID NO: 6976181 - DNA, 22 bp, Homo sapiens
agacagtgatggacaggcagac

SEQ ID NO: 6976182 - DNA, 22 bp, Homo sapiens
catgtgcagggccaggcattgc

SEQ ID NO: 6976183 - DNA, 22 bp, Homo sapiens
tcagtagtgtgccagtgggcat

SEQ ID NO: 6976184 - DNA, 22 bp, Homo sapiens
acattcactatgtccaaactct

SEQ ID NO: 6976185 - DNA, 22 bp, Homo sapiens
gtgaggggccaagagtagggca

SEQ ID NO: 6976186 - DNA, 22 bp, Homo sapiens
gcagatggagataaatggaact

SEQ ID NO: 6976187 - DNA, 22 bp, Homo sapiens
tgtgtatacaacttataggagc

SEQ ID NO: 6976188 - DNA, 22 bp, Homo sapiens
atagagctcttcttcttttaac

SEQ ID NO: 6976189 - DNA, 22 bp, Homo sapiens
aaggaatttgaggctgcagtga

SEQ ID NO: 6976190 - DNA, 23 bp, Homo sapiens
ttctggctgtgggtggcgtctct

SEQ ID NO: 6976191 - DNA, 22 bp, Homo sapiens
cagagatgaggtcgttactcag

SEQ ID NO: 6976192 - DNA, 22 bp, Homo sapiens
tagacattttccctaccctcat

SEQ ID NO: 6976193 - DNA, 22 bp, Homo sapiens
cagagcagaagcggtcctcaca

SEQ ID NO: 6976194 - DNA, 22 bp, Homo sapiens
agagatgaacataaaacaagga

SEQ ID NO: 6976195 - DNA, 22 bp, Homo sapiens
agccagctgctcgggggaaaca

SEQ ID NO: 6976196 - DNA, 21 bp, Homo sapiens
tgtcacagattctcagcttgc

SEQ ID NO: 6976197 - DNA, 22 bp, Homo sapiens
attcttcatgttgaagctgtca

SEQ ID NO: 6976198 - DNA, 22 bp, Homo sapiens
agcaaacctgcagccttctgag

SEQ ID NO: 6976199 - DNA, 22 bp, Homo sapiens
tcctcagtctctcaaatgaggc

SEQ ID NO: 6976200 - DNA, 23 bp, Homo sapiens
atgtccaaagggattcgtctgat

SEQ ID NO: 6976201 - DNA, 23 bp, Homo sapiens
aattcaaattcagtgtgactagg

SEQ ID NO: 6976202 - DNA, 21 bp, Homo sapiens
ttcctggggaaggagctgcct

SEQ ID NO: 6976203 - DNA, 22 bp, Homo sapiens
tcctggagaagaggggcttgga

SEQ ID NO: 6976204 - DNA, 19 bp, Homo sapiens
gcaatccacccacctcagc

SEQ ID NO: 6976205 - DNA, 22 bp, Homo sapiens
acagggttttttatgagaacag

SEQ ID NO: 6976206 - DNA, 22 bp, Homo sapiens
acaggtgtagcaggagcatcaa

SEQ ID NO: 6976207 - DNA, 22 bp, Homo sapiens
ttcaggaatataggcattgaca

SEQ ID NO: 6976208 - DNA, 22 bp, Homo sapiens
gcacagttgatttatgctggtg

SEQ ID NO: 6976209 - DNA, 22 bp, Homo sapiens
tgagcagtggggcctgcattct

SEQ ID NO: 6976210 - DNA, 22 bp, Homo sapiens
tggcctggctgccctgtctgga

SEQ ID NO: 6976211 - DNA, 22 bp, Homo sapiens
cggaagacagtccgctctttca

SEQ ID NO: 6976212 - DNA, 22 bp, Homo sapiens
actggttgaagaaaagctagta

SEQ ID NO: 6976213 - DNA, 22 bp, Homo sapiens
caaccctctcgcctcaattctg

SEQ ID NO: 6976214 - DNA, 22 bp, Homo sapiens
aatttggacttgggtgctagag

SEQ ID NO: 6976215 - DNA, 20 bp, Homo sapiens
atacaagatgagtaatttct

SEQ ID NO: 6976216 - DNA, 22 bp, Homo sapiens
gggaaccacccctctgccctga

SEQ ID NO: 6976217 - DNA, 22 bp, Homo sapiens
aattacccataggcagccgagc

SEQ ID NO: 6976218 - DNA, 22 bp, Homo sapiens
aagtctagtatccttcttgact

SEQ ID NO: 6976219 - DNA, 22 bp, Homo sapiens
agcccaggaggtggaggttgca

SEQ ID NO: 6976220 - DNA, 22 bp, Homo sapiens
ccctcccaagcactctgacata

SEQ ID NO: 6976221 - DNA, 22 bp, Homo sapiens
gggtacctccgtgctgactgct

SEQ ID NO: 6976222 - DNA, 22 bp, Homo sapiens
agtgacacggagagacagcatg

SEQ ID NO: 6976223 - DNA, 20 bp, Homo sapiens
agcagtccaaaagggcagac

SEQ ID NO: 6976224 - DNA, 21 bp, Homo sapiens
gagacagcccagtgccagggc

SEQ ID NO: 6976225 - DNA, 21 bp, Homo sapiens
caggatgatgggaaggtggtg

SEQ ID NO: 6976226 - DNA, 23 bp, Homo sapiens
acacagaagaagacccaaggaag

SEQ ID NO: 6976227 - DNA, 22 bp, Homo sapiens
ctcatccacgtgcttttctagt

SEQ ID NO: 6976228 - DNA, 22 bp, Homo sapiens
tgctcatgatgccttttaaaag

SEQ ID NO: 6976229 - DNA, 22 bp, Homo sapiens
gttctccaggggctgttcatct

SEQ ID NO: 6976230 - DNA, 22 bp, Homo sapiens
atgaatgcttattaaattgaaa

SEQ ID NO: 6976231 - DNA, 22 bp, Homo sapiens
agtctaatgtttgtaaaatcat

SEQ ID NO: 6976232 - DNA, 22 bp, Homo sapiens
tccctgatgtgggctgcgtgac

SEQ ID NO: 6976233 - DNA, 22 bp, Homo sapiens
atgctacactatttgctgagca

SEQ ID NO: 6976234 - DNA, 22 bp, Homo sapiens
tagcagggtaaatgtagatgga

SEQ ID NO: 6976235 - DNA, 21 bp, Homo sapiens
atacaagaagatggcagtctg

SEQ ID NO: 6976236 - DNA, 22 bp, Homo sapiens
gcatgggctttctcagagttct

SEQ ID NO: 6976237 - DNA, 22 bp, Homo sapiens
atgacaaattcagaccatagca

SEQ ID NO: 6976238 - DNA, 22 bp, Homo sapiens
tccattcattcaggtatttagt

SEQ ID NO: 6976239 - DNA, 22 bp, Homo sapiens
agctgaagggaggatatgtaca

SEQ ID NO: 6976240 - DNA, 19 bp, Homo sapiens
acatgttttgcagaacagc

SEQ ID NO: 6976241 - DNA, 22 bp, Homo sapiens
tgtgaacatttctggttatttg

SEQ ID NO: 6976242 - DNA, 22 bp, Homo sapiens
tctcagactctttagtgaaggt

SEQ ID NO: 6976243 - DNA, 22 bp, Homo sapiens
tgaacttcagtgatttgctgca

SEQ ID NO: 6976244 - DNA, 22 bp, Homo sapiens
gtgcaggaggatgacaactgca

SEQ ID NO: 6976245 - DNA, 22 bp, Homo sapiens
ggtcgcggctccggagacgccc

SEQ ID NO: 6976246 - DNA, 22 bp, Homo sapiens
tacttttaaaattcacaggtat

SEQ ID NO: 6976247 - DNA, 22 bp, Homo sapiens
ggaatgttttagcttgactttt

SEQ ID NO: 6976248 - DNA, 22 bp, Homo sapiens
actgtccataatattggtgaac

SEQ ID NO: 6976249 - DNA, 22 bp, Homo sapiens
tctggcctgggcctgccggtgc

SEQ ID NO: 6976250 - DNA, 22 bp, Homo sapiens
aattggactgtgctgctcaaaa

SEQ ID NO: 6976251 - DNA, 22 bp, Homo sapiens
tttcataccatatccacacatc

SEQ ID NO: 6976252 - DNA, 22 bp, Homo sapiens
ggctcagtgtttgtggaacata

SEQ ID NO: 6976253 - DNA, 22 bp, Homo sapiens
tgagccctgtgactgctttgag

SEQ ID NO: 6976254 - DNA, 22 bp, Homo sapiens
ccagtttaggtactaggctcta

SEQ ID NO: 6976255 - DNA, 22 bp, Homo sapiens
gaacattcttggaggaaataac

SEQ ID NO: 6976256 - DNA, 20 bp, Homo sapiens
ctctggaagagtttaaatgg

SEQ ID NO: 6976257 - DNA, 22 bp, Homo sapiens
tgtgttaattccacaaacattc

SEQ ID NO: 6976258 - DNA, 22 bp, Homo sapiens
tctgtttatatgtttttcagac

SEQ ID NO: 6976259 - DNA, 22 bp, Homo sapiens
agtcagacacgttttccattag

SEQ ID NO: 6976260 - DNA, 19 bp, Homo sapiens
gccacaggatgaagtttgg

SEQ ID NO: 6976261 - DNA, 22 bp, Homo sapiens
tctttctggttatgtatagaga

SEQ ID NO: 6976262 - DNA, 22 bp, Homo sapiens
tgctacataggatagctcaaat

SEQ ID NO: 6976263 - DNA, 20 bp, Homo sapiens
tccagtccccacttgctcct

SEQ ID NO: 6976264 - DNA, 22 bp, Homo sapiens
acctttcaggtagtggtgagga

SEQ ID NO: 6976265 - DNA, 22 bp, Homo sapiens
ggcagttttaacagaggtagta

SEQ ID NO: 6976266 - DNA, 21 bp, Homo sapiens
gtgcatggagaaaggcttgct

SEQ ID NO: 6976267 - DNA, 22 bp, Homo sapiens
tgagctgtgatctatgataaat

SEQ ID NO: 6976268 - DNA, 18 bp, Homo sapiens
accctttccaaactgcag

SEQ ID NO: 6976269 - DNA, 22 bp, Homo sapiens
caggctggagtgcaatggcaca

SEQ ID NO: 6976270 - DNA, 22 bp, Homo sapiens
actggggtgaaattggagtgtc

SEQ ID NO: 6976271 - DNA, 22 bp, Homo sapiens
atggcattaggaccatgagcct

SEQ ID NO: 6976272 - DNA, 22 bp, Homo sapiens
ccagctccattgcttagtgtaa

SEQ ID NO: 6976273 - DNA, 22 bp, Homo sapiens
agagcaatggcatccagctgat

SEQ ID NO: 6976274 - DNA, 22 bp, Homo sapiens
gaaatgtgggtcatgacccatt

SEQ ID NO: 6976275 - DNA, 22 bp, Homo sapiens
actgtgcctttcacttgcactt

SEQ ID NO: 6976276 - DNA, 22 bp, Homo sapiens
agtgggaggaagtggtgatatt

SEQ ID NO: 6976277 - DNA, 22 bp, Homo sapiens
agggatcagtagggacggcagc

SEQ ID NO: 6976278 - DNA, 22 bp, Homo sapiens
tttggccatgctcaagggtata

SEQ ID NO: 6976279 - DNA, 22 bp, Homo sapiens
tatctttgcaaatatctctaag

SEQ ID NO: 6976280 - DNA, 22 bp, Homo sapiens
atgctgtttgcttttagtctgc

SEQ ID NO: 6976281 - DNA, 22 bp, Homo sapiens
ttcagtatgtagaacaagtgtt

SEQ ID NO: 6976282 - DNA, 22 bp, Homo sapiens
tgcagatgagggatgaaaatga

SEQ ID NO: 6976283 - DNA, 22 bp, Homo sapiens
atcttacctcttcctctgcatt

SEQ ID NO: 6976284 - DNA, 22 bp, Homo sapiens
aagtttagcgctctctcaagga

SEQ ID NO: 6976285 - DNA, 22 bp, Homo sapiens
agtcacatgcattttcttcaat

SEQ ID NO: 6976286 - DNA, 22 bp, Homo sapiens
tacagttacgctgagaaacgaa

SEQ ID NO: 6976287 - DNA, 22 bp, Homo sapiens
acagtaactcttttaccctcct

SEQ ID NO: 6976288 - DNA, 22 bp, Homo sapiens
agaggaggccaggcccacacct

SEQ ID NO: 6976289 - DNA, 23 bp, Homo sapiens
tagatactgcatataggtggaat

SEQ ID NO: 6976290 - DNA, 22 bp, Homo sapiens
ttagttgaatatgcatttttgc

SEQ ID NO: 6976291 - DNA, 22 bp, Homo sapiens
gcagcagggagcaggggtgtca

SEQ ID NO: 6976292 - DNA, 22 bp, Homo sapiens
gagtgctggggtgcagagaggt

SEQ ID NO: 6976293 - DNA, 22 bp, Homo sapiens
tttcagaaaacttatcatcagt

SEQ ID NO: 6976294 - DNA, 22 bp, Homo sapiens
gatagcagctctggggtcagac

SEQ ID NO: 6976295 - DNA, 22 bp, Homo sapiens
cgtggaatattataatggcaca

SEQ ID NO: 6976296 - DNA, 22 bp, Homo sapiens
atatgtttttggaaagaacaca

SEQ ID NO: 6976297 - DNA, 22 bp, Homo sapiens
ttgattcaaaggggacaagtgg

SEQ ID NO: 6976298 - DNA, 22 bp, Homo sapiens
cctggcacatctaactcactct

SEQ ID NO: 6976299 - DNA, 22 bp, Homo sapiens
aggggagagttaatgtgaatgt

SEQ ID NO: 6976300 - DNA, 22 bp, Homo sapiens
ctgggcctcaccctagaccaat

SEQ ID NO: 6976301 - DNA, 22 bp, Homo sapiens
aggcttctctgcaagatgttaa

SEQ ID NO: 6976302 - DNA, 22 bp, Homo sapiens
cctgcctactgagttttatatt

SEQ ID NO: 6976303 - DNA, 21 bp, Homo sapiens
tacagctcggcagataaagcc

SEQ ID NO: 6976304 - DNA, 22 bp, Homo sapiens
tctgggaatggttgatccacac

SEQ ID NO: 6976305 - DNA, 22 bp, Homo sapiens
tactgaggttgagaagctgctc

SEQ ID NO: 6976306 - DNA, 22 bp, Homo sapiens
tgaatttatcaaagattcttaa

SEQ ID NO: 6976307 - DNA, 22 bp, Homo sapiens
gactctgggaggtggactgagg

SEQ ID NO: 6976308 - DNA, 22 bp, Homo sapiens
tctcagaacacccttctatggt

SEQ ID NO: 6976309 - DNA, 20 bp, Homo sapiens
tgattctggtctacgcttta

SEQ ID NO: 6976310 - DNA, 22 bp, Homo sapiens
tagctgtgaagagctaaaaaat

SEQ ID NO: 6976311 - DNA, 22 bp, Homo sapiens
caagaagtcatttagcctctca

SEQ ID NO: 6976312 - DNA, 22 bp, Homo sapiens
gtggagacttctactagagacc

SEQ ID NO: 6976313 - DNA, 22 bp, Homo sapiens
ttccttaggggacagggggata

SEQ ID NO: 6976314 - DNA, 22 bp, Homo sapiens
aagaacaggttctagaaccatt

SEQ ID NO: 6976315 - DNA, 22 bp, Homo sapiens
ggctccaagtctcagagtgaag

SEQ ID NO: 6976316 - DNA, 22 bp, Homo sapiens
agtaacatgctaatttgattat

SEQ ID NO: 6976317 - DNA, 22 bp, Homo sapiens
tgctataagctccacgctgtag

SEQ ID NO: 6976318 - DNA, 22 bp, Homo sapiens
aaagttctgagactgatggcta

SEQ ID NO: 6976319 - DNA, 23 bp, Homo sapiens
aacttaatactgggataagatgc

SEQ ID NO: 6976320 - DNA, 22 bp, Homo sapiens
ttcatttgttgacagagacatg

SEQ ID NO: 6976321 - DNA, 21 bp, Homo sapiens
ggttggtgtgtccagtggcca

SEQ ID NO: 6976322 - DNA, 22 bp, Homo sapiens
atgattctcattttactgtgat

SEQ ID NO: 6976323 - DNA, 22 bp, Homo sapiens
tgtctgatgatagtgtctctcc

SEQ ID NO: 6976324 - DNA, 22 bp, Homo sapiens
aagcacagggactttaggaata

SEQ ID NO: 6976325 - DNA, 22 bp, Homo sapiens
tctgggaaccagtgcggctggg

SEQ ID NO: 6976326 - DNA, 22 bp, Homo sapiens
atgccaggctgtttggcctcag

SEQ ID NO: 6976327 - DNA, 22 bp, Homo sapiens
caggtgcacttgctttgtgttt

SEQ ID NO: 6976328 - DNA, 22 bp, Homo sapiens
tgtaggcatgaaggctctatag

SEQ ID NO: 6976329 - DNA, 22 bp, Homo sapiens
attactgtgactagccatctgg

SEQ ID NO: 6976330 - DNA, 22 bp, Homo sapiens
ggagctgctcagagccagtccc

SEQ ID NO: 6976331 - DNA, 22 bp, Homo sapiens
tgtgtagaaagatctccaagat

SEQ ID NO: 6976332 - DNA, 23 bp, Homo sapiens
aagaactttggtcctgcagagtc

SEQ ID NO: 6976333 - DNA, 22 bp, Homo sapiens
ctggttcatggtggaatgacat

SEQ ID NO: 6976334 - DNA, 22 bp, Homo sapiens
ttctctccagtcctggattctg

SEQ ID NO: 6976335 - DNA, 22 bp, Homo sapiens
ttcacagagagtatgcagagaa

SEQ ID NO: 6976336 - DNA, 22 bp, Homo sapiens
ggctgcctatagaattattagt

SEQ ID NO: 6976337 - DNA, 22 bp, Homo sapiens
tccaaagagcttaggagagaaa

SEQ ID NO: 6976338 - DNA, 23 bp, Homo sapiens
aattcctgtcttgctttatcgga

SEQ ID NO: 6976339 - DNA, 22 bp, Homo sapiens
aggcactgtactaggtacaggg

SEQ ID NO: 6976340 - DNA, 22 bp, Homo sapiens
tgatggggaattaattaatggg

SEQ ID NO: 6976341 - DNA, 22 bp, Homo sapiens
atgctgtggccagagttcaact

SEQ ID NO: 6976342 - DNA, 22 bp, Homo sapiens
aaaaatagaaggattgactgag

SEQ ID NO: 6976343 - DNA, 22 bp, Homo sapiens
agggtcccgaaggagacagcaa

SEQ ID NO: 6976344 - DNA, 22 bp, Homo sapiens
cagcccaggccgacagttcctc

SEQ ID NO: 6976345 - DNA, 22 bp, Homo sapiens
cagactgggagtcaggaagaag

SEQ ID NO: 6976346 - DNA, 22 bp, Homo sapiens
gctggagagtagtaagcagtta

SEQ ID NO: 6976347 - DNA, 22 bp, Homo sapiens
actgcccatgtgcatcaagtag

SEQ ID NO: 6976348 - DNA, 22 bp, Homo sapiens
tttgacaggaggtggctactca

SEQ ID NO: 6976349 - DNA, 22 bp, Homo sapiens
tttttctgtaaagggccagaga

SEQ ID NO: 6976350 - DNA, 22 bp, Homo sapiens
aagtcagaccttgttgatagct

SEQ ID NO: 6976351 - DNA, 22 bp, Homo sapiens
acagatggttattgtcatttct

SEQ ID NO: 6976352 - DNA, 22 bp, Homo sapiens
tagattgtagatcatgagactt

SEQ ID NO: 6976353 - DNA, 22 bp, Homo sapiens
aggctgtgattccaccactctc

SEQ ID NO: 6976354 - DNA, 23 bp, Homo sapiens
gccctgctactcacaagctgtgt

SEQ ID NO: 6976355 - DNA, 23 bp, Homo sapiens
ttcaacatttattgagcgtccgt

SEQ ID NO: 6976356 - DNA, 22 bp, Homo sapiens
agatggctgggccccaccccag

SEQ ID NO: 6976357 - DNA, 22 bp, Homo sapiens
atcttttatgagcgttctgaca

SEQ ID NO: 6976358 - DNA, 22 bp, Homo sapiens
tcccaaggcctctagttgatta

SEQ ID NO: 6976359 - DNA, 22 bp, Homo sapiens
caggattataaactgtgcactg

SEQ ID NO: 6976360 - DNA, 20 bp, Homo sapiens
tcattgtgttgccaattccc

SEQ ID NO: 6976361 - DNA, 22 bp, Homo sapiens
ccaggtctatcaagttgggctc

SEQ ID NO: 6976362 - DNA, 22 bp, Homo sapiens
tgtttacagggtgattttacct

SEQ ID NO: 6976363 - DNA, 20 bp, Homo sapiens
caaggcctggatctagttgc

SEQ ID NO: 6976364 - DNA, 22 bp, Homo sapiens
ggctgcctactttcccagagtt

SEQ ID NO: 6976365 - DNA, 22 bp, Homo sapiens
tagaccaggggagtcaacaggt

SEQ ID NO: 6976366 - DNA, 22 bp, Homo sapiens
ggtctttctttgatagtggaga

SEQ ID NO: 6976367 - DNA, 22 bp, Homo sapiens
tggctaacaaggtgaaaccccg

SEQ ID NO: 6976368 - DNA, 22 bp, Homo sapiens
ttttaattgcaattatggtccc

SEQ ID NO: 6976369 - DNA, 22 bp, Homo sapiens
tggcacgttggattgggagttc

SEQ ID NO: 6976370 - DNA, 22 bp, Homo sapiens
ctgtggccctgtgatctggcac

SEQ ID NO: 6976371 - DNA, 22 bp, Homo sapiens
agaaatcttatcaagaaatgcc

SEQ ID NO: 6976372 - DNA, 22 bp, Homo sapiens
tcacatttgctatcccactcct

SEQ ID NO: 6976373 - DNA, 22 bp, Homo sapiens
tatgcacaatatgatctatttg

SEQ ID NO: 6976374 - DNA, 22 bp, Homo sapiens
aaaacactgcctgcttgactga

SEQ ID NO: 6976375 - DNA, 22 bp, Homo sapiens
caaactgtatgaccctaggccg

SEQ ID NO: 6976376 - DNA, 22 bp, Homo sapiens
ttagggacaaatttgcagaacc

SEQ ID NO: 6976377 - DNA, 22 bp, Homo sapiens
agatgacagtagctcccccatt

SEQ ID NO: 6976378 - DNA, 22 bp, Homo sapiens
ttgtggggaggatttgatgaga

SEQ ID NO: 6976379 - DNA, 22 bp, Homo sapiens
acactgagattttcctgacacc

SEQ ID NO: 6976380 - DNA, 20 bp, Homo sapiens
gcagagcctcactgcaaggg

SEQ ID NO: 6976381 - DNA, 22 bp, Homo sapiens
atgtcacagttgcaacatgaat

SEQ ID NO: 6976382 - DNA, 19 bp, Homo sapiens
ttattctgtcagagcacac

SEQ ID NO: 6976383 - DNA, 22 bp, Homo sapiens
gcaggcacatgggcgggtctgg

SEQ ID NO: 6976384 - DNA, 16 bp, Homo sapiens
gccacttattgattga

SEQ ID NO: 6976385 - DNA, 19 bp, Homo sapiens
gcatgcagagtaagaaggt

SEQ ID NO: 6976386 - DNA, 17 bp, Homo sapiens
ctcagagcaggacagaa

SEQ ID NO: 6976387 - DNA, 22 bp, Homo sapiens
tcctggagaatcctgccacctg

SEQ ID NO: 6976388 - DNA, 22 bp, Homo sapiens
atttatgattagcctattgttg

SEQ ID NO: 6976389 - DNA, 22 bp, Homo sapiens
catctggcagaccctgcctccg

SEQ ID NO: 6976390 - DNA, 22 bp, Homo sapiens
gaggagctgaggctgaggcctc

SEQ ID NO: 6976391 - DNA, 22 bp, Homo sapiens
tacctgttgatttatactgaaa

SEQ ID NO: 6976392 - DNA, 22 bp, Homo sapiens
tagaaatcatttagaagtattg

SEQ ID NO: 6976393 - DNA, 22 bp, Homo sapiens
aagtctctttgggtactttatt

SEQ ID NO: 6976394 - DNA, 18 bp, Homo sapiens
ggcaggatttcaactttc

SEQ ID NO: 6976395 - DNA, 22 bp, Homo sapiens
tgagataaggatgttatactcg

SEQ ID NO: 6976396 - DNA, 22 bp, Homo sapiens
gaaatacagttgggaggaggta

SEQ ID NO: 6976397 - DNA, 22 bp, Homo sapiens
tccagagaggcatatttacaag

SEQ ID NO: 6976398 - DNA, 22 bp, Homo sapiens
ccagagttttatacaacttttt

SEQ ID NO: 6976399 - DNA, 22 bp, Homo sapiens
ttaatgatacctatgttaattt

SEQ ID NO: 6976400 - DNA, 21 bp, Homo sapiens
cagagctctttctgcttgctg

SEQ ID NO: 6976401 - DNA, 22 bp, Homo sapiens
aagccaaaggctccagtgacct

SEQ ID NO: 6976402 - DNA, 22 bp, Homo sapiens
tgaccacagacccaatgactac

SEQ ID NO: 6976403 - DNA, 20 bp, Homo sapiens
atgtactccccacaagcaac

SEQ ID NO: 6976404 - DNA, 22 bp, Homo sapiens
ttggcacagaaaaactcactgt

SEQ ID NO: 6976405 - DNA, 22 bp, Homo sapiens
gggctgctgtgttcctgaggca

SEQ ID NO: 6976406 - DNA, 21 bp, Homo sapiens
acaatgcatggaactcatggc

SEQ ID NO: 6976407 - DNA, 22 bp, Homo sapiens
acagcagttcaggccgcagagg

SEQ ID NO: 6976408 - DNA, 22 bp, Homo sapiens
ctcggtgatggaaggtttctcg

SEQ ID NO: 6976409 - DNA, 22 bp, Homo sapiens
acatgtgggttttattttgcat

SEQ ID NO: 6976410 - DNA, 22 bp, Homo sapiens
tgccaagataacacagctagta

SEQ ID NO: 6976411 - DNA, 22 bp, Homo sapiens
tccattggtctctgtgcccagg

SEQ ID NO: 6976412 - DNA, 22 bp, Homo sapiens
taccttgcagattctattagtt

SEQ ID NO: 6976413 - DNA, 22 bp, Homo sapiens
cctttgtaagatgtgaagactg

SEQ ID NO: 6976414 - DNA, 22 bp, Homo sapiens
ttcttttgcaagactattgatt

SEQ ID NO: 6976415 - DNA, 22 bp, Homo sapiens
atcttcaactcagagagtgctg

SEQ ID NO: 6976416 - DNA, 22 bp, Homo sapiens
aggaactggatataatgtgaga

SEQ ID NO: 6976417 - DNA, 22 bp, Homo sapiens
tttagtactcaggggagaagtt

SEQ ID NO: 6976418 - DNA, 22 bp, Homo sapiens
cctagggtcagtgtggcaggag

SEQ ID NO: 6976419 - DNA, 22 bp, Homo sapiens
agacattttggaaagtattact

SEQ ID NO: 6976420 - DNA, 22 bp, Homo sapiens
atggctggctgagcctggttat

SEQ ID NO: 6976421 - DNA, 22 bp, Homo sapiens
agtgacttcttaaaccatggtc

SEQ ID NO: 6976422 - DNA, 22 bp, Homo sapiens
tcaaacatgttagcagtctgtg

SEQ ID NO: 6976423 - DNA, 22 bp, Homo sapiens
cactgcctttggtgggaacact

SEQ ID NO: 6976424 - DNA, 21 bp, Homo sapiens
gtccagtggaggaggacagga

SEQ ID NO: 6976425 - DNA, 22 bp, Homo sapiens
actgtttcagtttctgaagttt

SEQ ID NO: 6976426 - DNA, 22 bp, Homo sapiens
gggcaggtgcccagggccagag

SEQ ID NO: 6976427 - DNA, 22 bp, Homo sapiens
ttgaagtcaggaagtgtgaggc

SEQ ID NO: 6976428 - DNA, 21 bp, Homo sapiens
atctggaagaactggtaagtg

SEQ ID NO: 6976429 - DNA, 22 bp, Homo sapiens
aggcactgacctgcttccttga

SEQ ID NO: 6976430 - DNA, 22 bp, Homo sapiens
gcagcaataatgttttggagga

SEQ ID NO: 6976431 - DNA, 22 bp, Homo sapiens
ctggctcctcagtattccactt

SEQ ID NO: 6976432 - DNA, 22 bp, Homo sapiens
tcaggcaggatcccagggaagg

SEQ ID NO: 6976433 - DNA, 22 bp, Homo sapiens
atttgaaatcccttctactgta

SEQ ID NO: 6976434 - DNA, 22 bp, Homo sapiens
tagccagtgggacggtgctgca

SEQ ID NO: 6976435 - DNA, 22 bp, Homo sapiens
atgccactgcacttcagcttgg

SEQ ID NO: 6976436 - DNA, 22 bp, Homo sapiens
agcctcagtttcaggcctcctc

SEQ ID NO: 6976437 - DNA, 22 bp, Homo sapiens
actccagttctcttgtttataa

SEQ ID NO: 6976438 - DNA, 22 bp, Homo sapiens
ggcaggacagccccggaaatct

SEQ ID NO: 6976439 - DNA, 19 bp, Homo sapiens
ctgtctggttcatgtgttc

SEQ ID NO: 6976440 - DNA, 22 bp, Homo sapiens
tctcacagcaggggccaggtct

SEQ ID NO: 6976441 - DNA, 22 bp, Homo sapiens
acaccaaagtagaattaatgta

SEQ ID NO: 6976442 - DNA, 22 bp, Homo sapiens
gaagattaatgagaaacctgct

SEQ ID NO: 6976443 - DNA, 22 bp, Homo sapiens
atgcttgtactaaaaaaatatt

SEQ ID NO: 6976444 - DNA, 22 bp, Homo sapiens
gaagccacagggaaggagaaca

SEQ ID NO: 6976445 - DNA, 22 bp, Homo sapiens
ttgcctcaagattttttattga

SEQ ID NO: 6976446 - DNA, 22 bp, Homo sapiens
tagttacaatgggttctgtgac

SEQ ID NO: 6976447 - DNA, 22 bp, Homo sapiens
tttctgcaaacttccacgtctc

SEQ ID NO: 6976448 - DNA, 22 bp, Homo sapiens
caggagtttctattgttccaaa

SEQ ID NO: 6976449 - DNA, 22 bp, Homo sapiens
ctttacaggaaaaggtggctgt

SEQ ID NO: 6976450 - DNA, 22 bp, Homo sapiens
ctgcgtgcattaatatttcctt

SEQ ID NO: 6976451 - DNA, 22 bp, Homo sapiens
cagtttggtcatttgtcttgta

SEQ ID NO: 6976452 - DNA, 21 bp, Homo sapiens
atattgtaggtaaagtgcagg

SEQ ID NO: 6976453 - DNA, 22 bp, Homo sapiens
aacacaggttgctgggcctcac

SEQ ID NO: 6976454 - DNA, 22 bp, Homo sapiens
atagcaaagatgtcaattcccc

SEQ ID NO: 6976455 - DNA, 22 bp, Homo sapiens
gtgttacctgagccatctcgtt

SEQ ID NO: 6976456 - DNA, 19 bp, Homo sapiens
tcccttctatagtaataaa

SEQ ID NO: 6976457 - DNA, 22 bp, Homo sapiens
cctgaggattgttggtgcttcc

SEQ ID NO: 6976458 - DNA, 22 bp, Homo sapiens
tgttgaatcagaagtcctggct

SEQ ID NO: 6976459 - DNA, 22 bp, Homo sapiens
aagatgcagcttccacttttgc

SEQ ID NO: 6976460 - DNA, 22 bp, Homo sapiens
taaagtttggcagacaataaca

SEQ ID NO: 6976461 - DNA, 22 bp, Homo sapiens
ctcttggtttgcctccatggac

SEQ ID NO: 6976462 - DNA, 22 bp, Homo sapiens
gacaggtgggttctcgtatctg

SEQ ID NO: 6976463 - DNA, 22 bp, Homo sapiens
atccaagcttcaccctaggatg

SEQ ID NO: 6976464 - DNA, 22 bp, Homo sapiens
agtgtgtctgatcacttgtgag

SEQ ID NO: 6976465 - DNA, 22 bp, Homo sapiens
acagaattatcaggaaatgtta

SEQ ID NO: 6976466 - DNA, 19 bp, Homo sapiens
tgagccagggaggccatgc

SEQ ID NO: 6976467 - DNA, 22 bp, Homo sapiens
gggctggctgattttcctctct

SEQ ID NO: 6976468 - DNA, 22 bp, Homo sapiens
atcacagattgtgaataactat

SEQ ID NO: 6976469 - DNA, 22 bp, Homo sapiens
gaagcactgcatttcaagatca

SEQ ID NO: 6976470 - DNA, 22 bp, Homo sapiens
actgagactgaatctgaatgat

SEQ ID NO: 6976471 - DNA, 22 bp, Homo sapiens
tgtgaatgaagaatgctaacct

SEQ ID NO: 6976472 - DNA, 22 bp, Homo sapiens
tatgtgtcctaagcaatcatcc

SEQ ID NO: 6976473 - DNA, 22 bp, Homo sapiens
atttcaaggctattaatataaa

SEQ ID NO: 6976474 - DNA, 22 bp, Homo sapiens
ttaaagtttcagaaacttggtc

SEQ ID NO: 6976475 - DNA, 16 bp, Homo sapiens
gaggctatcactaagt

SEQ ID NO: 6976476 - DNA, 20 bp, Homo sapiens
cgctcctgttcccggtccca

SEQ ID NO: 6976477 - DNA, 22 bp, Homo sapiens
attttctgagtccagaatttac

SEQ ID NO: 6976478 - DNA, 22 bp, Homo sapiens
ttaggcaccatttgccaagtga

SEQ ID NO: 6976479 - DNA, 19 bp, Homo sapiens
tttgaatccagctggtaac

SEQ ID NO: 6976480 - DNA, 22 bp, Homo sapiens
tcttcattttacaggcagacct

SEQ ID NO: 6976481 - DNA, 22 bp, Homo sapiens
ttggcagtcaccatcgtgtaga

SEQ ID NO: 6976482 - DNA, 22 bp, Homo sapiens
tcacagaagatgctggatgttg

SEQ ID NO: 6976483 - DNA, 22 bp, Homo sapiens
tttctttatcatagcatctttg

SEQ ID NO: 6976484 - DNA, 18 bp, Homo sapiens
gaggcctgagaaccaggt

SEQ ID NO: 6976485 - DNA, 23 bp, Homo sapiens
tgaacagtatgtgggacattgag

SEQ ID NO: 6976486 - DNA, 22 bp, Homo sapiens
tgttcttatggctatttctccc

SEQ ID NO: 6976487 - DNA, 22 bp, Homo sapiens
ccagtctgtgtgccagcctgcg

SEQ ID NO: 6976488 - DNA, 22 bp, Homo sapiens
caagttcaagtcctggctctgc

SEQ ID NO: 6976489 - DNA, 22 bp, Homo sapiens
tgtgtgattccacttatatggg

SEQ ID NO: 6976490 - DNA, 22 bp, Homo sapiens
tgcacacttagtatgactacat

SEQ ID NO: 6976491 - DNA, 22 bp, Homo sapiens
catgatggttcttacaaaggtg

SEQ ID NO: 6976492 - DNA, 22 bp, Homo sapiens
tacacccacatgcctaggaggg

SEQ ID NO: 6976493 - DNA, 22 bp, Homo sapiens
aaagatgtttgttccaaaattc

SEQ ID NO: 6976494 - DNA, 22 bp, Homo sapiens
gcagtgattggctttcacaaaa

SEQ ID NO: 6976495 - DNA, 22 bp, Homo sapiens
tagttagcctcagagcctttgc

SEQ ID NO: 6976496 - DNA, 22 bp, Homo sapiens
gcagagctatcttctggatttg

SEQ ID NO: 6976497 - DNA, 22 bp, Homo sapiens
tctccatctgtcattcttgtcc

SEQ ID NO: 6976498 - DNA, 22 bp, Homo sapiens
gacaggggctttgcatgcttta

SEQ ID NO: 6976499 - DNA, 22 bp, Homo sapiens
ccgggctggagtgcaatggctc

SEQ ID NO: 6976500 - DNA, 22 bp, Homo sapiens
ctgggcctagcaacagaggagt

SEQ ID NO: 6976501 - DNA, 22 bp, Homo sapiens
acagacagggcacctgcctcct

SEQ ID NO: 6976502 - DNA, 22 bp, Homo sapiens
atggcagtagaatgggggaaaa

SEQ ID NO: 6976503 - DNA, 22 bp, Homo sapiens
tttggaattcagatggcttagg

SEQ ID NO: 6976504 - DNA, 22 bp, Homo sapiens
tggctccagccctgagcaagct

SEQ ID NO: 6976505 - DNA, 20 bp, Homo sapiens
atgaagacaaatccgacttg

SEQ ID NO: 6976506 - DNA, 22 bp, Homo sapiens
cttcacagccaacatgggcaca

SEQ ID NO: 6976507 - DNA, 22 bp, Homo sapiens
ataaggaatttagaatagggaa

SEQ ID NO: 6976508 - DNA, 22 bp, Homo sapiens
gcaaattgggctgactcaaggt

SEQ ID NO: 6976509 - DNA, 22 bp, Homo sapiens
aagctgtgtgcagatgatctca

SEQ ID NO: 6976510 - DNA, 22 bp, Homo sapiens
aaagacacatgtctcttagatt

SEQ ID NO: 6976511 - DNA, 22 bp, Homo sapiens
atgaggatgggaagggagccaa

SEQ ID NO: 6976512 - DNA, 21 bp, Homo sapiens
tgtgataaactccaagtggga

SEQ ID NO: 6976513 - DNA, 22 bp, Homo sapiens
acctgtttaccctgggctcccc

SEQ ID NO: 6976514 - DNA, 22 bp, Homo sapiens
tttcacactgcagcatcagaga

SEQ ID NO: 6976515 - DNA, 22 bp, Homo sapiens
tccttcaaagctcctagtgagc

SEQ ID NO: 6976516 - DNA, 22 bp, Homo sapiens
tgtctcctgggtcccttccacc

SEQ ID NO: 6976517 - DNA, 22 bp, Homo sapiens
gcaaatgttcacggggagcata

SEQ ID NO: 6976518 - DNA, 22 bp, Homo sapiens
tgattctgagggagcattctgc

SEQ ID NO: 6976519 - DNA, 22 bp, Homo sapiens
taattttgtcacagtgacatgc

SEQ ID NO: 6976520 - DNA, 22 bp, Homo sapiens
ccagagggcaaaatgaagctta

SEQ ID NO: 6976521 - DNA, 22 bp, Homo sapiens
ctggctttaaaatgctcctgga

SEQ ID NO: 6976522 - DNA, 22 bp, Homo sapiens
tatggcttttcttcctccccca

SEQ ID NO: 6976523 - DNA, 22 bp, Homo sapiens
gatgtcctttgagggtatctgt

SEQ ID NO: 6976524 - DNA, 22 bp, Homo sapiens
ttataggaaaagttctagaaaa

SEQ ID NO: 6976525 - DNA, 22 bp, Homo sapiens
cacctttgcaaaccaaatctga

SEQ ID NO: 6976526 - DNA, 22 bp, Homo sapiens
aaagtacaggaaagcctagcca

SEQ ID NO: 6976527 - DNA, 22 bp, Homo sapiens
tatagagtcatgtttactctaa

SEQ ID NO: 6976528 - DNA, 22 bp, Homo sapiens
tttgagcagaagggtgacatgc

SEQ ID NO: 6976529 - DNA, 22 bp, Homo sapiens
gaggctgcccacacctgcgccg

SEQ ID NO: 6976530 - DNA, 22 bp, Homo sapiens
ttataggtccactgcaatttgc

SEQ ID NO: 6976531 - DNA, 23 bp, Homo sapiens
atctctctttattcttggggata

SEQ ID NO: 6976532 - DNA, 22 bp, Homo sapiens
gatgatctgcaagaactacatg

SEQ ID NO: 6976533 - DNA, 22 bp, Homo sapiens
agactacaggagaaactcactc

SEQ ID NO: 6976534 - DNA, 22 bp, Homo sapiens
aagtgacacatggcacttctat

SEQ ID NO: 6976535 - DNA, 22 bp, Homo sapiens
tgtatgttgggtcaaagtacat

SEQ ID NO: 6976536 - DNA, 22 bp, Homo sapiens
tgctcagcttcagaggatcccc

SEQ ID NO: 6976537 - DNA, 22 bp, Homo sapiens
ttcctggcatagagagggcaca

SEQ ID NO: 6976538 - DNA, 22 bp, Homo sapiens
ctctgaagatggtaccagcttt

SEQ ID NO: 6976539 - DNA, 22 bp, Homo sapiens
cggagctgcctgccaagcctgc

SEQ ID NO: 6976540 - DNA, 23 bp, Homo sapiens
ttttgtgtgacttaatatctctt

SEQ ID NO: 6976541 - DNA, 22 bp, Homo sapiens
ttaggtcacatcggtgaccaaa

SEQ ID NO: 6976542 - DNA, 23 bp, Homo sapiens
cactgcagcgtggtctggcagga

SEQ ID NO: 6976543 - DNA, 22 bp, Homo sapiens
attaggcattatggggataagg

SEQ ID NO: 6976544 - DNA, 22 bp, Homo sapiens
tgcagaagcagagagttgccaa

SEQ ID NO: 6976545 - DNA, 17 bp, Homo sapiens
agctgaaattgctgaag

SEQ ID NO: 6976546 - DNA, 22 bp, Homo sapiens
aactgtgaggatgtgcaaattc

SEQ ID NO: 6976547 - DNA, 22 bp, Homo sapiens
ttctagaggggagatactagta

SEQ ID NO: 6976548 - DNA, 22 bp, Homo sapiens
aaattgtctttaatcaggtcat

SEQ ID NO: 6976549 - DNA, 22 bp, Homo sapiens
atttctgcatctctggagatct

SEQ ID NO: 6976550 - DNA, 22 bp, Homo sapiens
tcagccagaaagtgattttcag

SEQ ID NO: 6976551 - DNA, 22 bp, Homo sapiens
cttgggtgctcagggaaagctt

SEQ ID NO: 6976552 - DNA, 22 bp, Homo sapiens
agaaagtgcctcccttgggagc

SEQ ID NO: 6976553 - DNA, 22 bp, Homo sapiens
gtgtaacttttattcatgctct

SEQ ID NO: 6976554 - DNA, 22 bp, Homo sapiens
aatagatactacttagatgtag

SEQ ID NO: 6976555 - DNA, 22 bp, Homo sapiens
taaaatcgcactgctgttgtta

SEQ ID NO: 6976556 - DNA, 22 bp, Homo sapiens
gcaagatgttaccattagggaa

SEQ ID NO: 6976557 - DNA, 22 bp, Homo sapiens
tttcaacatcacctagcagttc

SEQ ID NO: 6976558 - DNA, 22 bp, Homo sapiens
ttagaagtaaggtcagatttct

SEQ ID NO: 6976559 - DNA, 22 bp, Homo sapiens
tgtgcttactttgaattatata

SEQ ID NO: 6976560 - DNA, 22 bp, Homo sapiens
tctttagagcctttcctcccga

SEQ ID NO: 6976561 - DNA, 22 bp, Homo sapiens
ctgagaggtaatcacacaaaat

SEQ ID NO: 6976562 - DNA, 22 bp, Homo sapiens
tgcctgggttgactcttagctg

SEQ ID NO: 6976563 - DNA, 22 bp, Homo sapiens
tagcacatgccgggagtgatct

SEQ ID NO: 6976564 - DNA, 22 bp, Homo sapiens
ttcctgtggtccagagtcatcc

SEQ ID NO: 6976565 - DNA, 22 bp, Homo sapiens
tcatctaagagtcttacattta

SEQ ID NO: 6976566 - DNA, 22 bp, Homo sapiens
ctgttcatgttgaggcataggg

SEQ ID NO: 6976567 - DNA, 18 bp, Homo sapiens
ctcagacaggctgtgcta

SEQ ID NO: 6976568 - DNA, 22 bp, Homo sapiens
gaatcccttgcaagttgttgta

SEQ ID NO: 6976569 - DNA, 19 bp, Homo sapiens
tgcttgcacatcaagctac

SEQ ID NO: 6976570 - DNA, 22 bp, Homo sapiens
aaaactgaggtttcctgaagaa

SEQ ID NO: 6976571 - DNA, 22 bp, Homo sapiens
tcatacaattcaatctctgatt

SEQ ID NO: 6976572 - DNA, 22 bp, Homo sapiens
aagtacagccagcacccagact

SEQ ID NO: 6976573 - DNA, 22 bp, Homo sapiens
tgacctgacatgaattaaaaac

SEQ ID NO: 6976574 - DNA, 22 bp, Homo sapiens
gcacagtgggtggtcatgtaca

SEQ ID NO: 6976575 - DNA, 22 bp, Homo sapiens
acccagtctggagtgcagtgac

SEQ ID NO: 6976576 - DNA, 22 bp, Homo sapiens
tgaggtagaagttgggctgctt

SEQ ID NO: 6976577 - DNA, 23 bp, Homo sapiens
tggagcctgggatacaatagatg

SEQ ID NO: 6976578 - DNA, 22 bp, Homo sapiens
cctgtgactctgtctgatggtc

SEQ ID NO: 6976579 - DNA, 22 bp, Homo sapiens
tggtctctgcaggccaggctca

SEQ ID NO: 6976580 - DNA, 21 bp, Homo sapiens
agttaaacctttagagaacta

SEQ ID NO: 6976581 - DNA, 22 bp, Homo sapiens
ctttaggcccttgctggttctg

SEQ ID NO: 6976582 - DNA, 22 bp, Homo sapiens
atacttctctgaggtaggtaaa

SEQ ID NO: 6976583 - DNA, 22 bp, Homo sapiens
ctggcttccatgctgtagtggc

SEQ ID NO: 6976584 - DNA, 20 bp, Homo sapiens
gcttggaccttctgctctgt

SEQ ID NO: 6976585 - DNA, 22 bp, Homo sapiens
acttcctgggcatgcagagtcc

SEQ ID NO: 6976586 - DNA, 22 bp, Homo sapiens
agcagtcattttaggtcatgca

SEQ ID NO: 6976587 - DNA, 22 bp, Homo sapiens
gagacagtgcaggaaatctaaa

SEQ ID NO: 6976588 - DNA, 22 bp, Homo sapiens
cctgtaaatagtttcttctgac

SEQ ID NO: 6976589 - DNA, 23 bp, Homo sapiens
tatctgttctctgagtgtttggt

SEQ ID NO: 6976590 - DNA, 22 bp, Homo sapiens
gggcaaaatacttataaaggct

SEQ ID NO: 6976591 - DNA, 22 bp, Homo sapiens
ctgcagattcagtgagaagccc

SEQ ID NO: 6976592 - DNA, 22 bp, Homo sapiens
atgcaagatcacaccaaacacg

SEQ ID NO: 6976593 - DNA, 22 bp, Homo sapiens
tctggggtgcagcctaggcatc

SEQ ID NO: 6976594 - DNA, 22 bp, Homo sapiens
tcagtgcatcacagaactttgt

SEQ ID NO: 6976595 - DNA, 22 bp, Homo sapiens
ttaaacatttatggaggcagca

SEQ ID NO: 6976596 - DNA, 22 bp, Homo sapiens
aaatcctttggaggacatgatg

SEQ ID NO: 6976597 - DNA, 22 bp, Homo sapiens
tggcatgtggctttgagtcatc

SEQ ID NO: 6976598 - DNA, 22 bp, Homo sapiens
ggtggggagtcaggcattcttg

SEQ ID NO: 6976599 - DNA, 22 bp, Homo sapiens
catttagagtcttgcaatttta

SEQ ID NO: 6976600 - DNA, 22 bp, Homo sapiens
ccaggtggcttctgcccgatgt

SEQ ID NO: 6976601 - DNA, 22 bp, Homo sapiens
accactggttttgcagaggcgc

SEQ ID NO: 6976602 - DNA, 22 bp, Homo sapiens
taggcaatattagactttgtct

SEQ ID NO: 6976603 - DNA, 22 bp, Homo sapiens
agctttctgtcacctgtgcttg

SEQ ID NO: 6976604 - DNA, 21 bp, Homo sapiens
tggctctgggtaggagagtgc

SEQ ID NO: 6976605 - DNA, 22 bp, Homo sapiens
atcttaccttgcactggtcata

SEQ ID NO: 6976606 - DNA, 22 bp, Homo sapiens
gtgtctgctcagcttgctagaa

SEQ ID NO: 6976607 - DNA, 22 bp, Homo sapiens
cacacactgacaccttatcttg

SEQ ID NO: 6976608 - DNA, 22 bp, Homo sapiens
agaaaggagcaccgtgggggat

SEQ ID NO: 6976609 - DNA, 22 bp, Homo sapiens
ctgaagattataaacagacata

SEQ ID NO: 6976610 - DNA, 22 bp, Homo sapiens
tcaggtgtggtcaccacagggt

SEQ ID NO: 6976611 - DNA, 22 bp, Homo sapiens
tactttcatgggttttctttat

SEQ ID NO: 6976612 - DNA, 22 bp, Homo sapiens
ggtgcactgaggtgggaactag

SEQ ID NO: 6976613 - DNA, 22 bp, Homo sapiens
tctctggagggctccaggcggg

SEQ ID NO: 6976614 - DNA, 22 bp, Homo sapiens
cagcactgcttcgcagccaggg

SEQ ID NO: 6976615 - DNA, 22 bp, Homo sapiens
tggcattgacaactttcagttc

SEQ ID NO: 6976616 - DNA, 22 bp, Homo sapiens
tagcagcattaattccatttgc

SEQ ID NO: 6976617 - DNA, 22 bp, Homo sapiens
ttagggaaacaaacattttctt

SEQ ID NO: 6976618 - DNA, 22 bp, Homo sapiens
tggtggcaaaagaggcaaagtg

SEQ ID NO: 6976619 - DNA, 22 bp, Homo sapiens
acaccagcctcgcccgtgtgtt

SEQ ID NO: 6976620 - DNA, 22 bp, Homo sapiens
agcgagagattcaacagcaagt

SEQ ID NO: 6976621 - DNA, 22 bp, Homo sapiens
accagctcagagcaggctcctg

SEQ ID NO: 6976622 - DNA, 22 bp, Homo sapiens
caggacttattatagcattata

SEQ ID NO: 6976623 - DNA, 22 bp, Homo sapiens
agagccctctgcaatgcctcag

SEQ ID NO: 6976624 - DNA, 22 bp, Homo sapiens
agtttttgagaatttactatgt

SEQ ID NO: 6976625 - DNA, 22 bp, Homo sapiens
catggcggtcaggatgtaggtg

SEQ ID NO: 6976626 - DNA, 22 bp, Homo sapiens
tggccatgaaggaggcagcaga

SEQ ID NO: 6976627 - DNA, 22 bp, Homo sapiens
cctgggaacagcagagtcctgg

SEQ ID NO: 6976628 - DNA, 22 bp, Homo sapiens
actttccctctcagaactctta

SEQ ID NO: 6976629 - DNA, 22 bp, Homo sapiens
cacataagtcccctgtgccaag

SEQ ID NO: 6976630 - DNA, 22 bp, Homo sapiens
agccctgcttcaccatttactt

SEQ ID NO: 6976631 - DNA, 19 bp, Homo sapiens
cccaggagcagtattgatg

SEQ ID NO: 6976632 - DNA, 22 bp, Homo sapiens
aataagaattgccagatttgaa

SEQ ID NO: 6976633 - DNA, 22 bp, Homo sapiens
gcagggctaatggggcaagtag

SEQ ID NO: 6976634 - DNA, 23 bp, Homo sapiens
tatctgtatttgttcactgctgt

SEQ ID NO: 6976635 - DNA, 22 bp, Homo sapiens
ggactgagctgacatctgttgg

SEQ ID NO: 6976636 - DNA, 22 bp, Homo sapiens
agtcaggaaaagctttcctgga

SEQ ID NO: 6976637 - DNA, 22 bp, Homo sapiens
gaatgtttttcaaacctgtggc

SEQ ID NO: 6976638 - DNA, 22 bp, Homo sapiens
ttctgcatttaaaatattacta

SEQ ID NO: 6976639 - DNA, 22 bp, Homo sapiens
agggcagagacatgcttcctga

SEQ ID NO: 6976640 - DNA, 22 bp, Homo sapiens
acaggtctactggcaagcagtg

SEQ ID NO: 6976641 - DNA, 22 bp, Homo sapiens
tagaaagctggaggaattcttt

SEQ ID NO: 6976642 - DNA, 22 bp, Homo sapiens
cagtgatcgcactcaacagttt

SEQ ID NO: 6976643 - DNA, 22 bp, Homo sapiens
gagccagccttcttctgaggtc

SEQ ID NO: 6976644 - DNA, 19 bp, Homo sapiens
cagtgcccgacgcaggtct

SEQ ID NO: 6976645 - DNA, 22 bp, Homo sapiens
ctgagccctggctcgcctggag

SEQ ID NO: 6976646 - DNA, 22 bp, Homo sapiens
tgggtcagagctgtgctgccca

SEQ ID NO: 6976647 - DNA, 22 bp, Homo sapiens
tatctagatggattttagtgaa

SEQ ID NO: 6976648 - DNA, 22 bp, Homo sapiens
atttgcataaggatgctactgt

SEQ ID NO: 6976649 - DNA, 22 bp, Homo sapiens
tccaggtcccagactgggcagc

SEQ ID NO: 6976650 - DNA, 22 bp, Homo sapiens
cagcaccctcggaggctgccgt

SEQ ID NO: 6976651 - DNA, 22 bp, Homo sapiens
gcaggtggtgggggagccgttc

SEQ ID NO: 6976652 - DNA, 22 bp, Homo sapiens
agcagggctgtgtaggtaatga

SEQ ID NO: 6976653 - DNA, 22 bp, Homo sapiens
cttttggcctcaaaggaaagaa

SEQ ID NO: 6976654 - DNA, 22 bp, Homo sapiens
gggaagtcgggttgagcactta

SEQ ID NO: 6976655 - DNA, 22 bp, Homo sapiens
aaggaacctgggaacctatcat

SEQ ID NO: 6976656 - DNA, 22 bp, Homo sapiens
aagtcttttgctaagagtaatg

SEQ ID NO: 6976657 - DNA, 22 bp, Homo sapiens
ttgctgtaccaaagattcctga

SEQ ID NO: 6976658 - DNA, 22 bp, Homo sapiens
ggacaagcctgtgagtgggttt

SEQ ID NO: 6976659 - DNA, 22 bp, Homo sapiens
tgctgctccatctgaccattcc

SEQ ID NO: 6976660 - DNA, 22 bp, Homo sapiens
atgcttgctaatagtgggaacc

SEQ ID NO: 6976661 - DNA, 22 bp, Homo sapiens
gaggtgtgatgcagagtggtgg

SEQ ID NO: 6976662 - DNA, 18 bp, Homo sapiens
tatgtataacatagttca

SEQ ID NO: 6976663 - DNA, 22 bp, Homo sapiens
tctcaggtaagcttctttgatg

SEQ ID NO: 6976664 - DNA, 22 bp, Homo sapiens
atcttcttcaaggatctggagc

SEQ ID NO: 6976665 - DNA, 22 bp, Homo sapiens
tttgttaagatgctgttctgct

SEQ ID NO: 6976666 - DNA, 22 bp, Homo sapiens
agtcatctttatccaaaacact

SEQ ID NO: 6976667 - DNA, 22 bp, Homo sapiens
tctctttctcaaaatgtaagca

SEQ ID NO: 6976668 - DNA, 22 bp, Homo sapiens
agggcttgttaacatagagatt

SEQ ID NO: 6976669 - DNA, 22 bp, Homo sapiens
ctgagaaaatttcaggaagtgt

SEQ ID NO: 6976670 - DNA, 22 bp, Homo sapiens
ctgctttgggcagctttgtggc

SEQ ID NO: 6976671 - DNA, 22 bp, Homo sapiens
tgaacatacaattattaagaac

SEQ ID NO: 6976672 - DNA, 22 bp, Homo sapiens
tctgaattttaactacacaaag

SEQ ID NO: 6976673 - DNA, 22 bp, Homo sapiens
acaggcttggggctcagacaga

SEQ ID NO: 6976674 - DNA, 22 bp, Homo sapiens
gtattattaagtgtatttgacc

SEQ ID NO: 6976675 - DNA, 22 bp, Homo sapiens
taagtagctcttggaatatata

SEQ ID NO: 6976676 - DNA, 22 bp, Homo sapiens
ttctggctaccctcctaatgtt

SEQ ID NO: 6976677 - DNA, 22 bp, Homo sapiens
tttgctgtgcttacatatgtat

SEQ ID NO: 6976678 - DNA, 22 bp, Homo sapiens
taaagtggtggtgctaatgtat

SEQ ID NO: 6976679 - DNA, 22 bp, Homo sapiens
ggcttaaagttttctagaataa

SEQ ID NO: 6976680 - DNA, 22 bp, Homo sapiens
ctctccccacaccctctgcatg

SEQ ID NO: 6976681 - DNA, 22 bp, Homo sapiens
ctgagccagcgggctcactttt

SEQ ID NO: 6976682 - DNA, 20 bp, Homo sapiens
aatttctcctgggtaacaga

SEQ ID NO: 6976683 - DNA, 22 bp, Homo sapiens
tcagctcctcatgcaggggata

SEQ ID NO: 6976684 - DNA, 22 bp, Homo sapiens
agtcatatctgaggaggaatcc

SEQ ID NO: 6976685 - DNA, 22 bp, Homo sapiens
ggctgggctgcggctgtacctg

SEQ ID NO: 6976686 - DNA, 22 bp, Homo sapiens
acttagaaattcagttttgtca

SEQ ID NO: 6976687 - DNA, 22 bp, Homo sapiens
tggaagtccctgtgtgtggcct

SEQ ID NO: 6976688 - DNA, 22 bp, Homo sapiens
gcctgtatttattgagagtgta

SEQ ID NO: 6976689 - DNA, 22 bp, Homo sapiens
aagtgattaagtaacctaatat

SEQ ID NO: 6976690 - DNA, 22 bp, Homo sapiens
tgtcaggtgacagtttttacca

SEQ ID NO: 6976691 - DNA, 22 bp, Homo sapiens
ctgctgactcttcctggagtga

SEQ ID NO: 6976692 - DNA, 22 bp, Homo sapiens
tccaggtctgtgagctaaatgg

SEQ ID NO: 6976693 - DNA, 22 bp, Homo sapiens
catttgacttgctttcccagct

SEQ ID NO: 6976694 - DNA, 22 bp, Homo sapiens
gctgtgattgtcagtcttcaat

SEQ ID NO: 6976695 - DNA, 17 bp, Homo sapiens
cagtggcagatcttctc

SEQ ID NO: 6976696 - DNA, 19 bp, Homo sapiens
tttgtctctgaataatatt

SEQ ID NO: 6976697 - DNA, 22 bp, Homo sapiens
tggcaataaatacatctgggca

SEQ ID NO: 6976698 - DNA, 22 bp, Homo sapiens
gggagggaaggaccttatgaat

SEQ ID NO: 6976699 - DNA, 22 bp, Homo sapiens
cccatcacagacactgggttat

SEQ ID NO: 6976700 - DNA, 21 bp, Homo sapiens
tggggaggggacctgattatg

SEQ ID NO: 6976701 - DNA, 22 bp, Homo sapiens
tctgcagaagccatggccttgc

SEQ ID NO: 6976702 - DNA, 22 bp, Homo sapiens
tgcttaaacatccagacagtat

SEQ ID NO: 6976703 - DNA, 19 bp, Homo sapiens
agtttatgcagatactggt

SEQ ID NO: 6976704 - DNA, 21 bp, Homo sapiens
gctgcatcaatctacccaggg

SEQ ID NO: 6976705 - DNA, 22 bp, Homo sapiens
tgaatgaatgaattaatagagt

SEQ ID NO: 6976706 - DNA, 22 bp, Homo sapiens
agtggctgagtgactgtgactc

SEQ ID NO: 6976707 - DNA, 22 bp, Homo sapiens
gaattgctaaccaattcaaaat

SEQ ID NO: 6976708 - DNA, 19 bp, Homo sapiens
tcagggccgcagagggtac

SEQ ID NO: 6976709 - DNA, 22 bp, Homo sapiens
cacctgcctgcaggggctccac

SEQ ID NO: 6976710 - DNA, 22 bp, Homo sapiens
ggaaacttggatgccagcactc

SEQ ID NO: 6976711 - DNA, 22 bp, Homo sapiens
atgagaatatgatttactattg

SEQ ID NO: 6976712 - DNA, 22 bp, Homo sapiens
ttctctgaaggttgtggaacta

SEQ ID NO: 6976713 - DNA, 22 bp, Homo sapiens
tatctcctgtcagggtggtggt

SEQ ID NO: 6976714 - DNA, 22 bp, Homo sapiens
tctctggggcctttctacatca

SEQ ID NO: 6976715 - DNA, 22 bp, Homo sapiens
ttcaagatcgagtttaaagtga

SEQ ID NO: 6976716 - DNA, 22 bp, Homo sapiens
gtcaactttttcatagctctgc

SEQ ID NO: 6976717 - DNA, 22 bp, Homo sapiens
gttagcttctgggccaaggagg

SEQ ID NO: 6976718 - DNA, 20 bp, Homo sapiens
atacacttgcccagcttgtg

SEQ ID NO: 6976719 - DNA, 22 bp, Homo sapiens
tcagggcatgtatgtttcttta

SEQ ID NO: 6976720 - DNA, 22 bp, Homo sapiens
tggccgctgcactcgctcctct

SEQ ID NO: 6976721 - DNA, 22 bp, Homo sapiens
cagtggcacccacgggctgggc

SEQ ID NO: 6976722 - DNA, 22 bp, Homo sapiens
gacactgagaaatattcagaca

SEQ ID NO: 6976723 - DNA, 22 bp, Homo sapiens
ctgctgagcctggtgcgggatg

SEQ ID NO: 6976724 - DNA, 22 bp, Homo sapiens
aagcagtgcgctcatctaaggg

SEQ ID NO: 6976725 - DNA, 22 bp, Homo sapiens
acctccccacatggtagtgagt

SEQ ID NO: 6976726 - DNA, 22 bp, Homo sapiens
tttgtccagatgcacagataat

SEQ ID NO: 6976727 - DNA, 22 bp, Homo sapiens
gcttagcacagaatgagagttc

SEQ ID NO: 6976728 - DNA, 22 bp, Homo sapiens
agtgctctaacagtcaaaaaag

SEQ ID NO: 6976729 - DNA, 22 bp, Homo sapiens
tcagggcaaagggcagagtttg

SEQ ID NO: 6976730 - DNA, 22 bp, Homo sapiens
ccagccttcacctgctctggtc

SEQ ID NO: 6976731 - DNA, 22 bp, Homo sapiens
tttatctgcattctgaccatct

SEQ ID NO: 6976732 - DNA, 22 bp, Homo sapiens
ctggagaggccccaagatattt

SEQ ID NO: 6976733 - DNA, 22 bp, Homo sapiens
agggtctatctctctgcctttg

SEQ ID NO: 6976734 - DNA, 22 bp, Homo sapiens
aaagggctttatatcagtgtgt

SEQ ID NO: 6976735 - DNA, 22 bp, Homo sapiens
tatgtgcaaattaattgctaga

SEQ ID NO: 6976736 - DNA, 22 bp, Homo sapiens
ggctcaagcagtctgcctgcct

SEQ ID NO: 6976737 - DNA, 22 bp, Homo sapiens
actttagaccatcttccacagt

SEQ ID NO: 6976738 - DNA, 22 bp, Homo sapiens
cccagagcatgtgctgcctttg

SEQ ID NO: 6976739 - DNA, 22 bp, Homo sapiens
tggggctcatgcctgctggaac

SEQ ID NO: 6976740 - DNA, 22 bp, Homo sapiens
caacctgacaaggttaatgaat

SEQ ID NO: 6976741 - DNA, 22 bp, Homo sapiens
tctgggtgggcccgagaaatct

SEQ ID NO: 6976742 - DNA, 22 bp, Homo sapiens
cctgggctgaagtcaagtgtgg

SEQ ID NO: 6976743 - DNA, 22 bp, Homo sapiens
acttgtataccgtaaagggaga

SEQ ID NO: 6976744 - DNA, 22 bp, Homo sapiens
agctcctgcgcacggtgcacac

SEQ ID NO: 6976745 - DNA, 22 bp, Homo sapiens
gcacttgtgacagttcctggca

SEQ ID NO: 6976746 - DNA, 22 bp, Homo sapiens
tgtgactgtggtgagatttaag

SEQ ID NO: 6976747 - DNA, 22 bp, Homo sapiens
tatttgtagcttcccaaagctt

SEQ ID NO: 6976748 - DNA, 22 bp, Homo sapiens
tttctgcttgagagaattgctg

SEQ ID NO: 6976749 - DNA, 22 bp, Homo sapiens
gtgacatttcccatcagtatcc

SEQ ID NO: 6976750 - DNA, 22 bp, Homo sapiens
tgtacagttttaactctgaggg

SEQ ID NO: 6976751 - DNA, 22 bp, Homo sapiens
attctatcaagctgtcttcttt

SEQ ID NO: 6976752 - DNA, 22 bp, Homo sapiens
acacagtggtgtttacaaaatt

SEQ ID NO: 6976753 - DNA, 20 bp, Homo sapiens
cttgccagttccctggcaga

SEQ ID NO: 6976754 - DNA, 22 bp, Homo sapiens
cttgggcaagcagcattcagaa

SEQ ID NO: 6976755 - DNA, 23 bp, Homo sapiens
tttatacaagaaaccgctggcct

SEQ ID NO: 6976756 - DNA, 22 bp, Homo sapiens
ccactgaggaacatgggctcca

SEQ ID NO: 6976757 - DNA, 22 bp, Homo sapiens
ttccaggaacactctgtgtccc

SEQ ID NO: 6976758 - DNA, 22 bp, Homo sapiens
atgtggcctagtatagaaatga

SEQ ID NO: 6976759 - DNA, 22 bp, Homo sapiens
aaacagaagggtaggtaaacat

SEQ ID NO: 6976760 - DNA, 22 bp, Homo sapiens
aactttgcataactaactacag

SEQ ID NO: 6976761 - DNA, 22 bp, Homo sapiens
tgctggaattatagaaaaatag

SEQ ID NO: 6976762 - DNA, 22 bp, Homo sapiens
ctggccctgtggaggcaggaac

SEQ ID NO: 6976763 - DNA, 22 bp, Homo sapiens
ctgagctgcggcaggcacctgg

SEQ ID NO: 6976764 - DNA, 22 bp, Homo sapiens
aggtagtaaagttcttgatcct

SEQ ID NO: 6976765 - DNA, 22 bp, Homo sapiens
tgcaaagaagcctttgccttct

SEQ ID NO: 6976766 - DNA, 22 bp, Homo sapiens
caggcagctgaggactttgcta

SEQ ID NO: 6976767 - DNA, 22 bp, Homo sapiens
gtcagttacagccacggcgggt

SEQ ID NO: 6976768 - DNA, 22 bp, Homo sapiens
ctcagctcaaaattcacctttg

SEQ ID NO: 6976769 - DNA, 22 bp, Homo sapiens
gggtgggtggcagcaccgaggc

SEQ ID NO: 6976770 - DNA, 22 bp, Homo sapiens
atgcagaatcttgagaaaaatt

SEQ ID NO: 6976771 - DNA, 22 bp, Homo sapiens
agtggctggacgacaagggtga

SEQ ID NO: 6976772 - DNA, 22 bp, Homo sapiens
cacctttgaccttgcagcgcac

SEQ ID NO: 6976773 - DNA, 22 bp, Homo sapiens
tgacaccacaactagccattga

SEQ ID NO: 6976774 - DNA, 22 bp, Homo sapiens
gagctttgcattattcagaagc

SEQ ID NO: 6976775 - DNA, 22 bp, Homo sapiens
ggcaaagttttcatctcataac

SEQ ID NO: 6976776 - DNA, 22 bp, Homo sapiens
caggatggtcagatgcattgtc

SEQ ID NO: 6976777 - DNA, 22 bp, Homo sapiens
gcacaatttattaatcaggtcc

SEQ ID NO: 6976778 - DNA, 18 bp, Homo sapiens
ctcctccctaagggctca

SEQ ID NO: 6976779 - DNA, 22 bp, Homo sapiens
tatcatctgcaaagcacatcta

SEQ ID NO: 6976780 - DNA, 22 bp, Homo sapiens
tgaccatgctgtggatagcagt

SEQ ID NO: 6976781 - DNA, 20 bp, Homo sapiens
gggagtggtggtagcctgtg

SEQ ID NO: 6976782 - DNA, 22 bp, Homo sapiens
ttccatctgagagctgtgaaga

SEQ ID NO: 6976783 - DNA, 18 bp, Homo sapiens
tgcttacaggagttcctg

SEQ ID NO: 6976784 - DNA, 22 bp, Homo sapiens
atgtcctttgtatccctaggca

SEQ ID NO: 6976785 - DNA, 21 bp, Homo sapiens
tgaatgatctggttgcctttt

SEQ ID NO: 6976786 - DNA, 22 bp, Homo sapiens
aaacttctctccctactttgtg

SEQ ID NO: 6976787 - DNA, 22 bp, Homo sapiens
atgtgttcgctagattgctgtt

SEQ ID NO: 6976788 - DNA, 22 bp, Homo sapiens
tttacacagaggacactgggct

SEQ ID NO: 6976789 - DNA, 22 bp, Homo sapiens
aagtatgacatttaagacaatt

SEQ ID NO: 6976790 - DNA, 22 bp, Homo sapiens
acctcaggatgtggacacagaa

SEQ ID NO: 6976791 - DNA, 22 bp, Homo sapiens
agtggctgctgactttaataca

SEQ ID NO: 6976792 - DNA, 20 bp, Homo sapiens
tcatgcaagattcataaagg

SEQ ID NO: 6976793 - DNA, 22 bp, Homo sapiens
cctgttctgttaattaaacttt

SEQ ID NO: 6976794 - DNA, 16 bp, Homo sapiens
gacaagtggaggggcc

SEQ ID NO: 6976795 - DNA, 20 bp, Homo sapiens
ctctattattaatttcttaa

SEQ ID NO: 6976796 - DNA, 22 bp, Homo sapiens
gaaatgtgcagaatgtgttaga

SEQ ID NO: 6976797 - DNA, 22 bp, Homo sapiens
tgaaatcaataattggtgattg

SEQ ID NO: 6976798 - DNA, 22 bp, Homo sapiens
ataagccaaagaggcctcaatc

SEQ ID NO: 6976799 - DNA, 22 bp, Homo sapiens
tctgcagagggagtgctgggtc

SEQ ID NO: 6976800 - DNA, 22 bp, Homo sapiens
tgtggggctgtcaggcaactgg

SEQ ID NO: 6976801 - DNA, 22 bp, Homo sapiens
ctggggctcactccagccctgg

SEQ ID NO: 6976802 - DNA, 22 bp, Homo sapiens
tgctctgggctcaatggcagct

SEQ ID NO: 6976803 - DNA, 22 bp, Homo sapiens
tccctgggcatcacgttgcttc

SEQ ID NO: 6976804 - DNA, 19 bp, Homo sapiens
acccaggggtttatgtgtg

SEQ ID NO: 6976805 - DNA, 22 bp, Homo sapiens
gaatgttaatgcacttctagct

SEQ ID NO: 6976806 - DNA, 22 bp, Homo sapiens
tccccctcattacctcattcaa

SEQ ID NO: 6976807 - DNA, 22 bp, Homo sapiens
gagataataatagtacctatct

SEQ ID NO: 6976808 - DNA, 22 bp, Homo sapiens
agactctggggctccctccacc

SEQ ID NO: 6976809 - DNA, 22 bp, Homo sapiens
ggccttgatgttcttgggagat

SEQ ID NO: 6976810 - DNA, 22 bp, Homo sapiens
tgtacaaaacaagatgggggta

SEQ ID NO: 6976811 - DNA, 18 bp, Homo sapiens
ttattgtggtcacagcac

SEQ ID NO: 6976812 - DNA, 18 bp, Homo sapiens
ttcggcagatacgcttgg

SEQ ID NO: 6976813 - DNA, 22 bp, Homo sapiens
aagaggaaatgattgactatat

SEQ ID NO: 6976814 - DNA, 22 bp, Homo sapiens
acacactgtaaggactatcact

SEQ ID NO: 6976815 - DNA, 22 bp, Homo sapiens
tagtcattctccttacaaagcc

SEQ ID NO: 6976816 - DNA, 22 bp, Homo sapiens
gccctgttttgaaacttgcata

SEQ ID NO: 6976817 - DNA, 22 bp, Homo sapiens
gtgtgagggcaacacagcaaac

SEQ ID NO: 6976818 - DNA, 22 bp, Homo sapiens
gctgaactacatgaagttgccg

SEQ ID NO: 6976819 - DNA, 22 bp, Homo sapiens
attctagagcagtgattctcat

SEQ ID NO: 6976820 - DNA, 22 bp, Homo sapiens
cagggctgtgcccatcttcccc

SEQ ID NO: 6976821 - DNA, 22 bp, Homo sapiens
ttccaggctcctgcagtttcta

SEQ ID NO: 6976822 - DNA, 22 bp, Homo sapiens
gccgcgtcgatgccctctagtt

SEQ ID NO: 6976823 - DNA, 22 bp, Homo sapiens
ttgcaaaaactgcaattacttt

SEQ ID NO: 6976824 - DNA, 22 bp, Homo sapiens
atgtgctttattaagtaaaaat

SEQ ID NO: 6976825 - DNA, 22 bp, Homo sapiens
cccagctccagagccagaaaca

SEQ ID NO: 6976826 - DNA, 22 bp, Homo sapiens
tgaagtggaccctggacagacc

SEQ ID NO: 6976827 - DNA, 22 bp, Homo sapiens
actgggcttatgctgtggagta

SEQ ID NO: 6976828 - DNA, 22 bp, Homo sapiens
tccaggagatacactgcaccag

SEQ ID NO: 6976829 - DNA, 22 bp, Homo sapiens
tgcctctgctgctgtggcatca

SEQ ID NO: 6976830 - DNA, 22 bp, Homo sapiens
tggctctggagctcctgggccc

SEQ ID NO: 6976831 - DNA, 22 bp, Homo sapiens
tcctgaggaatgtgaagagaac

SEQ ID NO: 6976832 - DNA, 22 bp, Homo sapiens
ttagatcatatttaccacagta

SEQ ID NO: 6976833 - DNA, 22 bp, Homo sapiens
gggcatctggtggagcctcagg

SEQ ID NO: 6976834 - DNA, 22 bp, Homo sapiens
tgtgctcttgggcaatagctgc

SEQ ID NO: 6976835 - DNA, 22 bp, Homo sapiens
gagggtggtggcttaaggtgct

SEQ ID NO: 6976836 - DNA, 22 bp, Homo sapiens
ttggcagactgttttcaaaagt

SEQ ID NO: 6976837 - DNA, 22 bp, Homo sapiens
tatgatgactctagataaagtc

SEQ ID NO: 6976838 - DNA, 22 bp, Homo sapiens
gttctcctggctcccaccctgc

SEQ ID NO: 6976839 - DNA, 22 bp, Homo sapiens
tacaaaggaaacttcttttccc

SEQ ID NO: 6976840 - DNA, 22 bp, Homo sapiens
tgccaaaatgggctttataccg

SEQ ID NO: 6976841 - DNA, 22 bp, Homo sapiens
tctggatctccctcatcctggg

SEQ ID NO: 6976842 - DNA, 22 bp, Homo sapiens
aactggagcccctctgccactg

SEQ ID NO: 6976843 - DNA, 22 bp, Homo sapiens
gctcacagaagtgttttttcca

SEQ ID NO: 6976844 - DNA, 22 bp, Homo sapiens
gataaaatatgtggcctttagt

SEQ ID NO: 6976845 - DNA, 22 bp, Homo sapiens
acactggtgttaacttttggtt

SEQ ID NO: 6976846 - DNA, 22 bp, Homo sapiens
gttcagtgccagttctaagact

SEQ ID NO: 6976847 - DNA, 21 bp, Homo sapiens
actgcctggggtgctggccaa

SEQ ID NO: 6976848 - DNA, 22 bp, Homo sapiens
ggtgggaaataattaggattat

SEQ ID NO: 6976849 - DNA, 22 bp, Homo sapiens
cactgcttttttggctatgtac

SEQ ID NO: 6976850 - DNA, 22 bp, Homo sapiens
tcttcagctgtagtcattgttc

SEQ ID NO: 6976851 - DNA, 22 bp, Homo sapiens
gttcatgagctcttaactgaga

SEQ ID NO: 6976852 - DNA, 23 bp, Homo sapiens
cccggtttgcccacatgtccttg

SEQ ID NO: 6976853 - DNA, 22 bp, Homo sapiens
atcttgtgactggtttttaaat

SEQ ID NO: 6976854 - DNA, 23 bp, Homo sapiens
ggagctggacccttacacctttc

SEQ ID NO: 6976855 - DNA, 22 bp, Homo sapiens
ctttctcttcagcacccagccc

SEQ ID NO: 6976856 - DNA, 22 bp, Homo sapiens
aatatttatgacaggaagtagc

SEQ ID NO: 6976857 - DNA, 19 bp, Homo sapiens
agtgtgtactgaaagcact

SEQ ID NO: 6976858 - DNA, 22 bp, Homo sapiens
tgagcccagagcccttgtaggg

SEQ ID NO: 6976859 - DNA, 22 bp, Homo sapiens
agcacattcttgccttaacctc

SEQ ID NO: 6976860 - DNA, 22 bp, Homo sapiens
agggctgacagtggcgtggcgt

SEQ ID NO: 6976861 - DNA, 22 bp, Homo sapiens
tacatattctacccctttttct

SEQ ID NO: 6976862 - DNA, 23 bp, Homo sapiens
aatgccatattggatttcttcag

SEQ ID NO: 6976863 - DNA, 22 bp, Homo sapiens
tttacactgacagcacataagg

SEQ ID NO: 6976864 - DNA, 22 bp, Homo sapiens
ggcctctggttcgtggtgacct

SEQ ID NO: 6976865 - DNA, 22 bp, Homo sapiens
aagtgttctacactttgacctt

SEQ ID NO: 6976866 - DNA, 22 bp, Homo sapiens
tttttatgcctacgctgaaaag

SEQ ID NO: 6976867 - DNA, 22 bp, Homo sapiens
agccactgcccttagccatttg

SEQ ID NO: 6976868 - DNA, 22 bp, Homo sapiens
tcagaggattgcctcagcgagc

SEQ ID NO: 6976869 - DNA, 22 bp, Homo sapiens
aacttaccagctgtgcactgaa

SEQ ID NO: 6976870 - DNA, 22 bp, Homo sapiens
gatgctgtgctatgtctacaga

SEQ ID NO: 6976871 - DNA, 22 bp, Homo sapiens
ttttggcactttgtctgattct

SEQ ID NO: 6976872 - DNA, 18 bp, Homo sapiens
gcagtgaagaaagagctt

SEQ ID NO: 6976873 - DNA, 22 bp, Homo sapiens
cataacagtggcttcagcaagt

SEQ ID NO: 6976874 - DNA, 22 bp, Homo sapiens
attcctatcattagtgaagccc

SEQ ID NO: 6976875 - DNA, 22 bp, Homo sapiens
tataggtgaataaatgagttta

SEQ ID NO: 6976876 - DNA, 22 bp, Homo sapiens
gcaggctggtctgaccatccct

SEQ ID NO: 6976877 - DNA, 22 bp, Homo sapiens
tgctttttgcaccctttgccgt

SEQ ID NO: 6976878 - DNA, 22 bp, Homo sapiens
ggacaagcctcagacaaaactc

SEQ ID NO: 6976879 - DNA, 22 bp, Homo sapiens
aaaggtagtacttctagaaggg

SEQ ID NO: 6976880 - DNA, 20 bp, Homo sapiens
agtgaatagagacattgccc

SEQ ID NO: 6976881 - DNA, 22 bp, Homo sapiens
cttctcagcattttgtcagtct

SEQ ID NO: 6976882 - DNA, 22 bp, Homo sapiens
attggtcaagtcttgcaggtga

SEQ ID NO: 6976883 - DNA, 22 bp, Homo sapiens
tccagagaggtttctccatgct

SEQ ID NO: 6976884 - DNA, 22 bp, Homo sapiens
gctgcctggtttctcagctgca

SEQ ID NO: 6976885 - DNA, 22 bp, Homo sapiens
agttacacaacttatcacatct

SEQ ID NO: 6976886 - DNA, 22 bp, Homo sapiens
gaaggcttcctgatgccaacca

SEQ ID NO: 6976887 - DNA, 17 bp, Homo sapiens
gtggctgcacacacatg

SEQ ID NO: 6976888 - DNA, 22 bp, Homo sapiens
attgtagcccatgcataaaccg

SEQ ID NO: 6976889 - DNA, 22 bp, Homo sapiens
gtcagctgggcatctgcagatg

SEQ ID NO: 6976890 - DNA, 22 bp, Homo sapiens
ctgcccctgccaggcagctgtc

SEQ ID NO: 6976891 - DNA, 22 bp, Homo sapiens
ccagtccatatttatactgccg

SEQ ID NO: 6976892 - DNA, 22 bp, Homo sapiens
acatatgcatacccaaagcagt

SEQ ID NO: 6976893 - DNA, 22 bp, Homo sapiens
agagaatgcagggcttcggaca

SEQ ID NO: 6976894 - DNA, 22 bp, Homo sapiens
agcactgtgatttataacattt

SEQ ID NO: 6976895 - DNA, 22 bp, Homo sapiens
tgcgtggctgcgaggacccagc

SEQ ID NO: 6976896 - DNA, 22 bp, Homo sapiens
gtgtcccaggagaggagacaat

SEQ ID NO: 6976897 - DNA, 22 bp, Homo sapiens
gtgctgtatcagaatctgctct

SEQ ID NO: 6976898 - DNA, 22 bp, Homo sapiens
ttggaaacaattgctttcttcc

SEQ ID NO: 6976899 - DNA, 22 bp, Homo sapiens
acagcagacagtcggcttcctg

SEQ ID NO: 6976900 - DNA, 22 bp, Homo sapiens
tttgctcttatgaacaaggtgg

SEQ ID NO: 6976901 - DNA, 22 bp, Homo sapiens
gggacccaggtaatcctgtgct

SEQ ID NO: 6976902 - DNA, 22 bp, Homo sapiens
gctctgtttatccctgacaatt

SEQ ID NO: 6976903 - DNA, 22 bp, Homo sapiens
tttatttaaagtcgtgtgttaa

SEQ ID NO: 6976904 - DNA, 22 bp, Homo sapiens
atcagaggaaattaactctctc

SEQ ID NO: 6976905 - DNA, 22 bp, Homo sapiens
catgcagatctgagttctagct

SEQ ID NO: 6976906 - DNA, 22 bp, Homo sapiens
tggcctggcagagcaaggcctg

SEQ ID NO: 6976907 - DNA, 22 bp, Homo sapiens
gcctggggtctctgactcacag

SEQ ID NO: 6976908 - DNA, 22 bp, Homo sapiens
agggttgcatttttagaggctc

SEQ ID NO: 6976909 - DNA, 22 bp, Homo sapiens
tcattatttgctttagttatgt

SEQ ID NO: 6976910 - DNA, 22 bp, Homo sapiens
aggcaggctgctatggagtaga

SEQ ID NO: 6976911 - DNA, 20 bp, Homo sapiens
cagtccactggagttcctac

SEQ ID NO: 6976912 - DNA, 22 bp, Homo sapiens
cctttagaaagtcagtagttgc

SEQ ID NO: 6976913 - DNA, 22 bp, Homo sapiens
acattcttcagctttgtcaggc

SEQ ID NO: 6976914 - DNA, 22 bp, Homo sapiens
agctgccgatgcccagctgcat

SEQ ID NO: 6976915 - DNA, 22 bp, Homo sapiens
atgctttctaggtgatctgagg

SEQ ID NO: 6976916 - DNA, 22 bp, Homo sapiens
agcctctcatgttctcccccag

SEQ ID NO: 6976917 - DNA, 22 bp, Homo sapiens
actgggagaaactgacacctta

SEQ ID NO: 6976918 - DNA, 22 bp, Homo sapiens
ctctgtgttccgggttgctgct

SEQ ID NO: 6976919 - DNA, 22 bp, Homo sapiens
ttggtcttcagagatctggtgg

SEQ ID NO: 6976920 - DNA, 22 bp, Homo sapiens
gtgagtgttaacccactgcttc

SEQ ID NO: 6976921 - DNA, 22 bp, Homo sapiens
ctgctgagactggctttgtgtc

SEQ ID NO: 6976922 - DNA, 22 bp, Homo sapiens
tctgagagctgtagaagcctat

SEQ ID NO: 6976923 - DNA, 22 bp, Homo sapiens
gaaagctgggaaataaatatta

SEQ ID NO: 6976924 - DNA, 22 bp, Homo sapiens
tgccatgtttaaagttgaaggg

SEQ ID NO: 6976925 - DNA, 22 bp, Homo sapiens
tcactcaggttcatgtctttgt

SEQ ID NO: 6976926 - DNA, 22 bp, Homo sapiens
caggaagaaagaggtgaggtgt

SEQ ID NO: 6976927 - DNA, 22 bp, Homo sapiens
taattgctgtatagattgtcat

SEQ ID NO: 6976928 - DNA, 22 bp, Homo sapiens
gtgcctgtgccaggggtgtgct

SEQ ID NO: 6976929 - DNA, 19 bp, Homo sapiens
aatgcagagtgtggtcttt

SEQ ID NO: 6976930 - DNA, 22 bp, Homo sapiens
ttagaaccataatgaatcaatg

SEQ ID NO: 6976931 - DNA, 22 bp, Homo sapiens
tctcccactgcaagcccaggct

SEQ ID NO: 6976932 - DNA, 22 bp, Homo sapiens
tctcgatctcctgaccttgtga

SEQ ID NO: 6976933 - DNA, 22 bp, Homo sapiens
gtccctctgtgtccctgcagtc

SEQ ID NO: 6976934 - DNA, 22 bp, Homo sapiens
atggaggtggaagaatgagtta

SEQ ID NO: 6976935 - DNA, 22 bp, Homo sapiens
tgtgagagttgagatattttgc

SEQ ID NO: 6976936 - DNA, 22 bp, Homo sapiens
gtaatgtgttttgaaaaacagt

SEQ ID NO: 6976937 - DNA, 22 bp, Homo sapiens
catgcatagagcagaacttggc

SEQ ID NO: 6976938 - DNA, 22 bp, Homo sapiens
gtgcaggtggcttctagcttct

SEQ ID NO: 6976939 - DNA, 22 bp, Homo sapiens
cctgttgagagagctcactgag

SEQ ID NO: 6976940 - DNA, 22 bp, Homo sapiens
gggcctgtatgggtctcagata

SEQ ID NO: 6976941 - DNA, 22 bp, Homo sapiens
agatgcagagtttgctgtggac

SEQ ID NO: 6976942 - DNA, 22 bp, Homo sapiens
acaatgtcacctctcatgtttt

SEQ ID NO: 6976943 - DNA, 23 bp, Homo sapiens
tggcctgcagagtttctgctggg

SEQ ID NO: 6976944 - DNA, 20 bp, Homo sapiens
tagcattccagaaaactcag

SEQ ID NO: 6976945 - DNA, 22 bp, Homo sapiens
ttcaaaagtaatcagtattaga

SEQ ID NO: 6976946 - DNA, 22 bp, Homo sapiens
gggtcagagccgtaacaggact

SEQ ID NO: 6976947 - DNA, 22 bp, Homo sapiens
taggatgacacagcaagtatag

SEQ ID NO: 6976948 - DNA, 19 bp, Homo sapiens
atgaagcattgtttttgta

SEQ ID NO: 6976949 - DNA, 22 bp, Homo sapiens
gggagcgcccctgcctgtttga

SEQ ID NO: 6976950 - DNA, 22 bp, Homo sapiens
tggcttccaaattatccctaga

SEQ ID NO: 6976951 - DNA, 22 bp, Homo sapiens
tcctcatcaataaaatcaggat

SEQ ID NO: 6976952 - DNA, 22 bp, Homo sapiens
cagagccatcccagcctgtggt

SEQ ID NO: 6976953 - DNA, 22 bp, Homo sapiens
gagatggttgcaatagtttaaa

SEQ ID NO: 6976954 - DNA, 22 bp, Homo sapiens
tcccagtgctacagacagggca

SEQ ID NO: 6976955 - DNA, 22 bp, Homo sapiens
ccagtgtctgtggtatagaaag

SEQ ID NO: 6976956 - DNA, 22 bp, Homo sapiens
ttagagatttgtctgatagtag

SEQ ID NO: 6976957 - DNA, 22 bp, Homo sapiens
ggttttctgctgaagatttcac

SEQ ID NO: 6976958 - DNA, 22 bp, Homo sapiens
tgtgctctgactttctcctggt

SEQ ID NO: 6976959 - DNA, 22 bp, Homo sapiens
caggctccttcccagggatggt

SEQ ID NO: 6976960 - DNA, 22 bp, Homo sapiens
gagctctgcagattgttttagg

SEQ ID NO: 6976961 - DNA, 19 bp, Homo sapiens
tcctggggatgtggtcacc

SEQ ID NO: 6976962 - DNA, 22 bp, Homo sapiens
tgaagatttagacctctttgcc

SEQ ID NO: 6976963 - DNA, 22 bp, Homo sapiens
acaagttcatggtgctttcctg

SEQ ID NO: 6976964 - DNA, 22 bp, Homo sapiens
cctgttgtctcttcctgttgac

SEQ ID NO: 6976965 - DNA, 17 bp, Homo sapiens
ctttggcaggagggagg

SEQ ID NO: 6976966 - DNA, 22 bp, Homo sapiens
caggcccagcccttagccaggt

SEQ ID NO: 6976967 - DNA, 22 bp, Homo sapiens
cttttagctgcaagtgttcaca

SEQ ID NO: 6976968 - DNA, 22 bp, Homo sapiens
tctcagggcctccctctgtttc

SEQ ID NO: 6976969 - DNA, 22 bp, Homo sapiens
ctatgtactggattagctccca

SEQ ID NO: 6976970 - DNA, 22 bp, Homo sapiens
cttcagaaataacaacaattac

SEQ ID NO: 6976971 - DNA, 22 bp, Homo sapiens
aaagagctttagaaatctcaga

SEQ ID NO: 6976972 - DNA, 22 bp, Homo sapiens
aataatatttgaagcttcaaag

SEQ ID NO: 6976973 - DNA, 22 bp, Homo sapiens
gagctggtcagtttcagggcca

SEQ ID NO: 6976974 - DNA, 22 bp, Homo sapiens
tctcaaatggcaaatgtgggtc

SEQ ID NO: 6976975 - DNA, 22 bp, Homo sapiens
gtcattatctacagaagtgtgt

SEQ ID NO: 6976976 - DNA, 22 bp, Homo sapiens
ttgcccactcagccctgtggag

SEQ ID NO: 6976977 - DNA, 22 bp, Homo sapiens
ctgccctgggttttatgggagt

SEQ ID NO: 6976978 - DNA, 22 bp, Homo sapiens
ctgttattaaaaagctcaggct

SEQ ID NO: 6976979 - DNA, 22 bp, Homo sapiens
acagagagggagtgataaatcc

SEQ ID NO: 6976980 - DNA, 22 bp, Homo sapiens
gctgctaagcgtttctgttcca

SEQ ID NO: 6976981 - DNA, 22 bp, Homo sapiens
tctggagtcctggaatcagcta

SEQ ID NO: 6976982 - DNA, 22 bp, Homo sapiens
tactgtatatgcttgtatctga

SEQ ID NO: 6976983 - DNA, 22 bp, Homo sapiens
atgctggtttcatgataacata

SEQ ID NO: 6976984 - DNA, 22 bp, Homo sapiens
tctggaacagttacttgctgat

SEQ ID NO: 6976985 - DNA, 22 bp, Homo sapiens
tgtatcttagtgtgaaaatatt

SEQ ID NO: 6976986 - DNA, 22 bp, Homo sapiens
tcatgaacttcctagccagact

SEQ ID NO: 6976987 - DNA, 22 bp, Homo sapiens
gacaaaggatcagaggttggga

SEQ ID NO: 6976988 - DNA, 22 bp, Homo sapiens
acaggatgggcgcacagagcta

SEQ ID NO: 6976989 - DNA, 22 bp, Homo sapiens
atactgctgctgctgaaatcac

SEQ ID NO: 6976990 - DNA, 22 bp, Homo sapiens
agtgaattctgcactactgaag

SEQ ID NO: 6976991 - DNA, 22 bp, Homo sapiens
taacaatgcaaaatgaatttag

SEQ ID NO: 6976992 - DNA, 22 bp, Homo sapiens
tcttgcagacagcttccagcct

SEQ ID NO: 6976993 - DNA, 22 bp, Homo sapiens
atctacattctcaccaatgttt

SEQ ID NO: 6976994 - DNA, 23 bp, Homo sapiens
gtgacccaaggaccttccagaat

SEQ ID NO: 6976995 - DNA, 22 bp, Homo sapiens
tgttacttatctcacgtgatgc

SEQ ID NO: 6976996 - DNA, 22 bp, Homo sapiens
tcccaggcaaaggcagctcatt

SEQ ID NO: 6976997 - DNA, 22 bp, Homo sapiens
tcccttcctcataggcagaagg

SEQ ID NO: 6976998 - DNA, 22 bp, Homo sapiens
aggcaggcaagttcatatgagg

SEQ ID NO: 6976999 - DNA, 22 bp, Homo sapiens
agtatttcttcatatgattact

SEQ ID NO: 6977000 - DNA, 22 bp, Homo sapiens
tctctcagggggaaggctgaag

SEQ ID NO: 6977001 - DNA, 22 bp, Homo sapiens
tctccaggggctgctgtgccac

SEQ ID NO: 6977002 - DNA, 22 bp, Homo sapiens
ctgtattgaagtgttggctgag

SEQ ID NO: 6977003 - DNA, 22 bp, Homo sapiens
aatctagagtgctaggtctgtg

SEQ ID NO: 6977004 - DNA, 22 bp, Homo sapiens
gttacccagtgctgtggaggga

SEQ ID NO: 6977005 - DNA, 22 bp, Homo sapiens
ttatgaagttcctgttacagtg

SEQ ID NO: 6977006 - DNA, 22 bp, Homo sapiens
ttcatttgtgtgcctgatgcaa

SEQ ID NO: 6977007 - DNA, 22 bp, Homo sapiens
ggactctggctcagtgttgctt

SEQ ID NO: 6977008 - DNA, 22 bp, Homo sapiens
gaaggcattttatgccttatag

SEQ ID NO: 6977009 - DNA, 23 bp, Homo sapiens
tgagctgagtgagttggcctggg

SEQ ID NO: 6977010 - DNA, 22 bp, Homo sapiens
ttaccaaatcccgtgcacattc

SEQ ID NO: 6977011 - DNA, 22 bp, Homo sapiens
ctgcagtgcaagcccagatgga

SEQ ID NO: 6977012 - DNA, 17 bp, Homo sapiens
ccagtagcctgagatgt

SEQ ID NO: 6977013 - DNA, 22 bp, Homo sapiens
gggtaggccgtgggtcaccagg

SEQ ID NO: 6977014 - DNA, 22 bp, Homo sapiens
gaattccactttggcttttggg

SEQ ID NO: 6977015 - DNA, 22 bp, Homo sapiens
gaacaaattctcatcaacttgt

SEQ ID NO: 6977016 - DNA, 23 bp, Homo sapiens
atagaagattattgcaacagtcc

SEQ ID NO: 6977017 - DNA, 22 bp, Homo sapiens
tacagtaatgtgtccctgcagg

SEQ ID NO: 6977018 - DNA, 22 bp, Homo sapiens
aaattgcattcaggatgcagga

SEQ ID NO: 6977019 - DNA, 23 bp, Homo sapiens
ggaaagagaggagttgtgcatag

SEQ ID NO: 6977020 - DNA, 22 bp, Homo sapiens
agcaatttcccatctcttctgc

SEQ ID NO: 6977021 - DNA, 22 bp, Homo sapiens
tggcttctgtccctgctacatt

SEQ ID NO: 6977022 - DNA, 22 bp, Homo sapiens
tttagtaggaaattgtcttata

SEQ ID NO: 6977023 - DNA, 22 bp, Homo sapiens
atatcatgttctctgtgtgtca

SEQ ID NO: 6977024 - DNA, 22 bp, Homo sapiens
ggcatgggagtgagcaacctta

SEQ ID NO: 6977025 - DNA, 22 bp, Homo sapiens
tccctcagctcatatttatgcc

SEQ ID NO: 6977026 - DNA, 22 bp, Homo sapiens
agttatagaaccaggtcctcac

SEQ ID NO: 6977027 - DNA, 20 bp, Homo sapiens
tttcactggcttgataaggt

SEQ ID NO: 6977028 - DNA, 22 bp, Homo sapiens
ttgttcattagcgcttgggcac

SEQ ID NO: 6977029 - DNA, 22 bp, Homo sapiens
tgctgtgacctttgagtacgca

SEQ ID NO: 6977030 - DNA, 22 bp, Homo sapiens
gccaggaaggctgaagccagaa

SEQ ID NO: 6977031 - DNA, 22 bp, Homo sapiens
caggcacagacgcaaacttctt

SEQ ID NO: 6977032 - DNA, 22 bp, Homo sapiens
aggaggcaactgagatttagaa

SEQ ID NO: 6977033 - DNA, 22 bp, Homo sapiens
ctgggctttcaggccctaaggc

SEQ ID NO: 6977034 - DNA, 22 bp, Homo sapiens
gccccttcttctggagattcaa

SEQ ID NO: 6977035 - DNA, 20 bp, Homo sapiens
tgtctgaaaaggaagctatc

SEQ ID NO: 6977036 - DNA, 22 bp, Homo sapiens
actttgcctccttgatagtttc

SEQ ID NO: 6977037 - DNA, 22 bp, Homo sapiens
actgttctgcatgctgtgaggg

SEQ ID NO: 6977038 - DNA, 22 bp, Homo sapiens
aaagcagggatgaggctagagg

SEQ ID NO: 6977039 - DNA, 22 bp, Homo sapiens
atctttgactgccattcttgac

SEQ ID NO: 6977040 - DNA, 22 bp, Homo sapiens
cctgctgttctgtttagtgaac

SEQ ID NO: 6977041 - DNA, 23 bp, Homo sapiens
gccaagtagggggaaagcccgtg

SEQ ID NO: 6977042 - DNA, 22 bp, Homo sapiens
ctgacagccatgttttagagaa

SEQ ID NO: 6977043 - DNA, 22 bp, Homo sapiens
ccttggttctgcctggcctgga

SEQ ID NO: 6977044 - DNA, 20 bp, Homo sapiens
gccagccctgacacaggagc

SEQ ID NO: 6977045 - DNA, 22 bp, Homo sapiens
aagtttagaactataagagtga

SEQ ID NO: 6977046 - DNA, 20 bp, Homo sapiens
tcaatgagatttaaaaggat

SEQ ID NO: 6977047 - DNA, 22 bp, Homo sapiens
agtttagaaaatctgtttcttc

SEQ ID NO: 6977048 - DNA, 21 bp, Homo sapiens
acccaggggaagcagaaactg

SEQ ID NO: 6977049 - DNA, 22 bp, Homo sapiens
cagtgtttctgtgcccagtggg

SEQ ID NO: 6977050 - DNA, 22 bp, Homo sapiens
tagtaaacagctctgccacaat

SEQ ID NO: 6977051 - DNA, 21 bp, Homo sapiens
tgcaaagctgctgaagtggta

SEQ ID NO: 6977052 - DNA, 22 bp, Homo sapiens
tatgctttggtagagagttgtg

SEQ ID NO: 6977053 - DNA, 22 bp, Homo sapiens
agtgcatgttcactggcatggt

SEQ ID NO: 6977054 - DNA, 20 bp, Homo sapiens
ccaggcactgtcccatgcag

SEQ ID NO: 6977055 - DNA, 22 bp, Homo sapiens
cacagtgctgtttgtaaagaga

SEQ ID NO: 6977056 - DNA, 22 bp, Homo sapiens
ttccaggaagcagttagcagcc

SEQ ID NO: 6977057 - DNA, 18 bp, Homo sapiens
tgatgcaagagtgagcta

SEQ ID NO: 6977058 - DNA, 22 bp, Homo sapiens
gcacatgagctgctgggatggg

SEQ ID NO: 6977059 - DNA, 22 bp, Homo sapiens
tgctcctggcttcaggttgggc

SEQ ID NO: 6977060 - DNA, 22 bp, Homo sapiens
ctctgcttggaactggacagaa

SEQ ID NO: 6977061 - DNA, 22 bp, Homo sapiens
tcaggagcttggtagtgtgatt

SEQ ID NO: 6977062 - DNA, 23 bp, Homo sapiens
tgtgtcataaaattaaaacttca

SEQ ID NO: 6977063 - DNA, 22 bp, Homo sapiens
ttgctgccttccgaatcctctc

SEQ ID NO: 6977064 - DNA, 22 bp, Homo sapiens
aagtgtgagacacacaaaatta

SEQ ID NO: 6977065 - DNA, 22 bp, Homo sapiens
ctacataaatttatcacagact

SEQ ID NO: 6977066 - DNA, 20 bp, Homo sapiens
aagcccattaccatgcttgg

SEQ ID NO: 6977067 - DNA, 22 bp, Homo sapiens
gtttcaaaatgatgctgtaact

SEQ ID NO: 6977068 - DNA, 22 bp, Homo sapiens
acgatatctgtaatattttatt

SEQ ID NO: 6977069 - DNA, 22 bp, Homo sapiens
aaatgtctactcctgtgtttat

SEQ ID NO: 6977070 - DNA, 22 bp, Homo sapiens
catatttatagatctggcattt

SEQ ID NO: 6977071 - DNA, 22 bp, Homo sapiens
atgtttgtccctgacatcctct

SEQ ID NO: 6977072 - DNA, 19 bp, Homo sapiens
agctgggctgtcacagtga

SEQ ID NO: 6977073 - DNA, 22 bp, Homo sapiens
ttgtgcttttgagctgagatga

SEQ ID NO: 6977074 - DNA, 22 bp, Homo sapiens
cctggcttccttcatgacctgg

SEQ ID NO: 6977075 - DNA, 22 bp, Homo sapiens
gggactggccagggtttggaat

SEQ ID NO: 6977076 - DNA, 22 bp, Homo sapiens
atttctagacttagaactctta

SEQ ID NO: 6977077 - DNA, 22 bp, Homo sapiens
atcattgagtaaaatgaataca

SEQ ID NO: 6977078 - DNA, 22 bp, Homo sapiens
agtctggacatgctgaacttgg

SEQ ID NO: 6977079 - DNA, 22 bp, Homo sapiens
tgtggaaaagccccacaggact

SEQ ID NO: 6977080 - DNA, 23 bp, Homo sapiens
tttccaggtgaccgtcagaatta

SEQ ID NO: 6977081 - DNA, 22 bp, Homo sapiens
gccctgctgagtccggctcaga

SEQ ID NO: 6977082 - DNA, 23 bp, Homo sapiens
atttgcatggccggattatggat

SEQ ID NO: 6977083 - DNA, 23 bp, Homo sapiens
aagaatcagtaagtaaggagacc

SEQ ID NO: 6977084 - DNA, 22 bp, Homo sapiens
cagctggcgcctggggaccaga

SEQ ID NO: 6977085 - DNA, 22 bp, Homo sapiens
gccagtgctgtcatggaaatcc

SEQ ID NO: 6977086 - DNA, 22 bp, Homo sapiens
aaagttgctgtcctagctggct

SEQ ID NO: 6977087 - DNA, 22 bp, Homo sapiens
gctctggcactggcgcgggatg

SEQ ID NO: 6977088 - DNA, 22 bp, Homo sapiens
ctgctttggctcagtgacatca

SEQ ID NO: 6977089 - DNA, 22 bp, Homo sapiens
tattgtacatggttatgcagga

SEQ ID NO: 6977090 - DNA, 22 bp, Homo sapiens
actggtactgttctgcggatca

SEQ ID NO: 6977091 - DNA, 22 bp, Homo sapiens
actgtataaggcataggtaagc

SEQ ID NO: 6977092 - DNA, 22 bp, Homo sapiens
ctagtccaaaccagggtccctc

SEQ ID NO: 6977093 - DNA, 22 bp, Homo sapiens
gggcttgctgtttagttccatt

SEQ ID NO: 6977094 - DNA, 22 bp, Homo sapiens
agctggcctccgggtgcctggg

SEQ ID NO: 6977095 - DNA, 22 bp, Homo sapiens
agatttccagaccaatttctca

SEQ ID NO: 6977096 - DNA, 22 bp, Homo sapiens
ttcccttcaaggtggcctaaag

SEQ ID NO: 6977097 - DNA, 22 bp, Homo sapiens
cagaggagaattgcgggatcat

SEQ ID NO: 6977098 - DNA, 22 bp, Homo sapiens
actttggcacagaacttccatt

SEQ ID NO: 6977099 - DNA, 22 bp, Homo sapiens
cagtatgtactcttatcatgta

SEQ ID NO: 6977100 - DNA, 22 bp, Homo sapiens
tcagctttttacatgtgaaata

SEQ ID NO: 6977101 - DNA, 22 bp, Homo sapiens
tcaaatgtgtaaggtcaggaca

SEQ ID NO: 6977102 - DNA, 22 bp, Homo sapiens
actgggctgtggacacccagcg

SEQ ID NO: 6977103 - DNA, 22 bp, Homo sapiens
ttgctgacctcaaagtgctcag

SEQ ID NO: 6977104 - DNA, 22 bp, Homo sapiens
cattatattttactgcatggga

SEQ ID NO: 6977105 - DNA, 22 bp, Homo sapiens
aatagtttgaatttatcagatg

SEQ ID NO: 6977106 - DNA, 22 bp, Homo sapiens
gagctcttgtagtatgcggtaa

SEQ ID NO: 6977107 - DNA, 22 bp, Homo sapiens
gatgtgtctattcaacatgaaa

SEQ ID NO: 6977108 - DNA, 22 bp, Homo sapiens
ttctggatgttgtagtctgaga

SEQ ID NO: 6977109 - DNA, 22 bp, Homo sapiens
acagcttttcaattctgctgag

SEQ ID NO: 6977110 - DNA, 22 bp, Homo sapiens
tcacttatgtgtgattgatgcc

SEQ ID NO: 6977111 - DNA, 22 bp, Homo sapiens
tcttagttgtttgctgtctaac

SEQ ID NO: 6977112 - DNA, 22 bp, Homo sapiens
cagaaatgtttatatgtggtgt

SEQ ID NO: 6977113 - DNA, 22 bp, Homo sapiens
gtgaataatcacccttctggat

SEQ ID NO: 6977114 - DNA, 22 bp, Homo sapiens
cttatagatggcgatcttcttg

SEQ ID NO: 6977115 - DNA, 22 bp, Homo sapiens
ccctggagaggactcacccctg

SEQ ID NO: 6977116 - DNA, 22 bp, Homo sapiens
tcacagttttaagtgtgatcca

SEQ ID NO: 6977117 - DNA, 22 bp, Homo sapiens
tgtcaccaagttgatgaatgca

SEQ ID NO: 6977118 - DNA, 22 bp, Homo sapiens
catcatttgtttgcatgcagga

SEQ ID NO: 6977119 - DNA, 22 bp, Homo sapiens
gccataaattgctggtcaaaat

SEQ ID NO: 6977120 - DNA, 22 bp, Homo sapiens
aaggaagatgaggtgctgctta

SEQ ID NO: 6977121 - DNA, 23 bp, Homo sapiens
ctgctccaggacagcatggaggt

SEQ ID NO: 6977122 - DNA, 22 bp, Homo sapiens
ctttccaggacttgcatttctg

SEQ ID NO: 6977123 - DNA, 22 bp, Homo sapiens
ccttcaaactttcattaaccag

SEQ ID NO: 6977124 - DNA, 22 bp, Homo sapiens
tcagtgcttatattctgagcct

SEQ ID NO: 6977125 - DNA, 22 bp, Homo sapiens
ttggaattgctattgataacaa

SEQ ID NO: 6977126 - DNA, 22 bp, Homo sapiens
tggctgagtttcatgcatcatg

SEQ ID NO: 6977127 - DNA, 22 bp, Homo sapiens
tgggcctgccccaggcttcagc

SEQ ID NO: 6977128 - DNA, 22 bp, Homo sapiens
acagtgttctgaaagttgaggg

SEQ ID NO: 6977129 - DNA, 22 bp, Homo sapiens
ggatacaactagaagatggcag

SEQ ID NO: 6977130 - DNA, 22 bp, Homo sapiens
agctgcctgcatttatatcctg

SEQ ID NO: 6977131 - DNA, 22 bp, Homo sapiens
tctgggagtttctgtgggagct

SEQ ID NO: 6977132 - DNA, 22 bp, Homo sapiens
agccaggaaccagctacagtct

SEQ ID NO: 6977133 - DNA, 23 bp, Homo sapiens
tgaagcatggataactcacacct

SEQ ID NO: 6977134 - DNA, 22 bp, Homo sapiens
ttggaggattgctctcagccca

SEQ ID NO: 6977135 - DNA, 22 bp, Homo sapiens
tgtcttttagtttgtgagatct

SEQ ID NO: 6977136 - DNA, 22 bp, Homo sapiens
cagtaatacccctggctcaggt

SEQ ID NO: 6977137 - DNA, 22 bp, Homo sapiens
tacacatgtatttatgtgtaca

SEQ ID NO: 6977138 - DNA, 22 bp, Homo sapiens
aaagttctgtagtgcactgact

SEQ ID NO: 6977139 - DNA, 22 bp, Homo sapiens
cacgggtggaatcagggactcc

SEQ ID NO: 6977140 - DNA, 22 bp, Homo sapiens
cagggtcaccagagatctgcat

SEQ ID NO: 6977141 - DNA, 22 bp, Homo sapiens
ggcagcaaccaaccaggcattt

SEQ ID NO: 6977142 - DNA, 22 bp, Homo sapiens
ccagctggtgacatccccaacc

SEQ ID NO: 6977143 - DNA, 22 bp, Homo sapiens
ctgaagagactggagggggcat

SEQ ID NO: 6977144 - DNA, 20 bp, Homo sapiens
tgcagagctgacattacctg

SEQ ID NO: 6977145 - DNA, 22 bp, Homo sapiens
aaagtcattgctgttatcaatg

SEQ ID NO: 6977146 - DNA, 22 bp, Homo sapiens
aggcttaactttactgttatgc

SEQ ID NO: 6977147 - DNA, 22 bp, Homo sapiens
tggcttctccctacaacatgcc

SEQ ID NO: 6977148 - DNA, 22 bp, Homo sapiens
gcctggaatgcaatgtgacgaa

SEQ ID NO: 6977149 - DNA, 22 bp, Homo sapiens
tggtcaaaagctactatgaatg

SEQ ID NO: 6977150 - DNA, 23 bp, Homo sapiens
cactcctgtttctaagccagcat

SEQ ID NO: 6977151 - DNA, 22 bp, Homo sapiens
taatactgaaagggaaatgtcc

SEQ ID NO: 6977152 - DNA, 22 bp, Homo sapiens
ttcacatttactggtttgtccg

SEQ ID NO: 6977153 - DNA, 22 bp, Homo sapiens
catgcttttttctagtataaat

SEQ ID NO: 6977154 - DNA, 22 bp, Homo sapiens
tcagatgccaactgaacaacag

SEQ ID NO: 6977155 - DNA, 22 bp, Homo sapiens
cctggcagtggtgaagaagagg

SEQ ID NO: 6977156 - DNA, 22 bp, Homo sapiens
aaaggctacgggggccgtgtgc

SEQ ID NO: 6977157 - DNA, 22 bp, Homo sapiens
tgaaccacaggagggttcatgt

SEQ ID NO: 6977158 - DNA, 17 bp, Homo sapiens
acatttcctaactgaag

SEQ ID NO: 6977159 - DNA, 20 bp, Homo sapiens
ttgtggtttagattatctga

SEQ ID NO: 6977160 - DNA, 22 bp, Homo sapiens
accacagaggaatttgaagagg

SEQ ID NO: 6977161 - DNA, 21 bp, Homo sapiens
gagtgtcagcaagaggtttgg

SEQ ID NO: 6977162 - DNA, 22 bp, Homo sapiens
tgctgaaaactcaaccattgtg

SEQ ID NO: 6977163 - DNA, 22 bp, Homo sapiens
ctggcacagttaacatatgcta

SEQ ID NO: 6977164 - DNA, 22 bp, Homo sapiens
tctgctctccatacttccgcac

SEQ ID NO: 6977165 - DNA, 22 bp, Homo sapiens
agctgcactgtgaagttcatag

SEQ ID NO: 6977166 - DNA, 22 bp, Homo sapiens
acttgaagcctggttatgtcaa

SEQ ID NO: 6977167 - DNA, 22 bp, Homo sapiens
agcacattagtatctaagaaca

SEQ ID NO: 6977168 - DNA, 22 bp, Homo sapiens
aaatactgtctctgagagagcc

SEQ ID NO: 6977169 - DNA, 22 bp, Homo sapiens
ctgagccatccataccagctta

SEQ ID NO: 6977170 - DNA, 23 bp, Homo sapiens
attccagagctagagtcaagtgg

SEQ ID NO: 6977171 - DNA, 22 bp, Homo sapiens
tccaggaactcttgatggtgat

SEQ ID NO: 6977172 - DNA, 22 bp, Homo sapiens
ctctctggatatttgtatgctg

SEQ ID NO: 6977173 - DNA, 22 bp, Homo sapiens
aactacatagaaattagtattt

SEQ ID NO: 6977174 - DNA, 17 bp, Homo sapiens
ggctccctgactatgga

SEQ ID NO: 6977175 - DNA, 21 bp, Homo sapiens
tgaggctcatcttatgtggct

SEQ ID NO: 6977176 - DNA, 22 bp, Homo sapiens
tcctagggttggagacagtgac

SEQ ID NO: 6977177 - DNA, 22 bp, Homo sapiens
tggctgcagttcacaggagcaa

SEQ ID NO: 6977178 - DNA, 22 bp, Homo sapiens
gcctctctccttggcttgcagt

SEQ ID NO: 6977179 - DNA, 22 bp, Homo sapiens
gggggcagtaacctcaaagtgt

SEQ ID NO: 6977180 - DNA, 22 bp, Homo sapiens
aattagttcaatggatgataga

SEQ ID NO: 6977181 - DNA, 22 bp, Homo sapiens
actgtatacttctgtatacaat

SEQ ID NO: 6977182 - DNA, 22 bp, Homo sapiens
agatgctgtgaggaagctagga

SEQ ID NO: 6977183 - DNA, 22 bp, Homo sapiens
atagtgtgtggtataggtagag

SEQ ID NO: 6977184 - DNA, 22 bp, Homo sapiens
gaccctggctagggcttaacct

SEQ ID NO: 6977185 - DNA, 21 bp, Homo sapiens
gcaaggcctatcatggcagct

SEQ ID NO: 6977186 - DNA, 22 bp, Homo sapiens
taggaaggtgtttttaaggagc

SEQ ID NO: 6977187 - DNA, 20 bp, Homo sapiens
tctgtacactcatcttctgc

SEQ ID NO: 6977188 - DNA, 22 bp, Homo sapiens
tcaaaattaaaccaacgtccag

SEQ ID NO: 6977189 - DNA, 22 bp, Homo sapiens
aggaacaggcctcgttttctat

SEQ ID NO: 6977190 - DNA, 17 bp, Homo sapiens
acagataggagccccat

SEQ ID NO: 6977191 - DNA, 22 bp, Homo sapiens
cagggccctgctcaatttctcc

SEQ ID NO: 6977192 - DNA, 22 bp, Homo sapiens
agagaaatagattggtccagaa

SEQ ID NO: 6977193 - DNA, 22 bp, Homo sapiens
tggtcctgagcaccagcctgac

SEQ ID NO: 6977194 - DNA, 23 bp, Homo sapiens
agtgttggttgggaagccaagca

SEQ ID NO: 6977195 - DNA, 22 bp, Homo sapiens
atagcatgcagtagaaactggg

SEQ ID NO: 6977196 - DNA, 21 bp, Homo sapiens
tcctgctgagaaacagatggt

SEQ ID NO: 6977197 - DNA, 22 bp, Homo sapiens
aggctgtgactacgcagggaag

SEQ ID NO: 6977198 - DNA, 22 bp, Homo sapiens
catatatgtagatgtatgtgaa

SEQ ID NO: 6977199 - DNA, 22 bp, Homo sapiens
cagggtgtatagtgtagaagtt

SEQ ID NO: 6977200 - DNA, 22 bp, Homo sapiens
tccacacacatttctatgtgca

SEQ ID NO: 6977201 - DNA, 23 bp, Homo sapiens
gagtggggagaaattggttaaac

SEQ ID NO: 6977202 - DNA, 22 bp, Homo sapiens
caccaggagcatctaggaggcg

SEQ ID NO: 6977203 - DNA, 22 bp, Homo sapiens
gtgcaagacttcctaagcaata

SEQ ID NO: 6977204 - DNA, 22 bp, Homo sapiens
ccagctgaggcagccacacagg

SEQ ID NO: 6977205 - DNA, 22 bp, Homo sapiens
tcctgtgttactgcctggagcg

SEQ ID NO: 6977206 - DNA, 22 bp, Homo sapiens
agtagtcctactgaaggaatga

SEQ ID NO: 6977207 - DNA, 22 bp, Homo sapiens
tggctactgtatttggacgaca

SEQ ID NO: 6977208 - DNA, 22 bp, Homo sapiens
gaggccagggatgcaatgagag

SEQ ID NO: 6977209 - DNA, 21 bp, Homo sapiens
aactttggaaggcagcttggc

SEQ ID NO: 6977210 - DNA, 22 bp, Homo sapiens
tagcaggctcgcaataaaatgt

SEQ ID NO: 6977211 - DNA, 21 bp, Homo sapiens
catcttaattgaaagcagaga

SEQ ID NO: 6977212 - DNA, 22 bp, Homo sapiens
atatatactttgacacattctg

SEQ ID NO: 6977213 - DNA, 22 bp, Homo sapiens
tttatccatatcattaaaatct

SEQ ID NO: 6977214 - DNA, 22 bp, Homo sapiens
ctcgcggcgcccgaagcccttg

SEQ ID NO: 6977215 - DNA, 22 bp, Homo sapiens
tgcatgtatttaaagttgcaat

SEQ ID NO: 6977216 - DNA, 22 bp, Homo sapiens
aaacttgtcattgtaatggtat

SEQ ID NO: 6977217 - DNA, 22 bp, Homo sapiens
agtgtatatgtgctgagaaacg

SEQ ID NO: 6977218 - DNA, 23 bp, Homo sapiens
acaaaatgttctgctgggaggtg

SEQ ID NO: 6977219 - DNA, 22 bp, Homo sapiens
tactctggctgaggtttggatc

SEQ ID NO: 6977220 - DNA, 22 bp, Homo sapiens
gtcatttatcatcagaagtcat

SEQ ID NO: 6977221 - DNA, 22 bp, Homo sapiens
cattttcctctgctggtgttca

SEQ ID NO: 6977222 - DNA, 22 bp, Homo sapiens
ttggctcatgctgttttgtgca

SEQ ID NO: 6977223 - DNA, 22 bp, Homo sapiens
tggaaggcctgttgtgtcctag

SEQ ID NO: 6977224 - DNA, 22 bp, Homo sapiens
ttacagaagagtaacttggcaa

SEQ ID NO: 6977225 - DNA, 22 bp, Homo sapiens
atctggagatcagctggtggca

SEQ ID NO: 6977226 - DNA, 22 bp, Homo sapiens
ctggagggagttaggacccgga

SEQ ID NO: 6977227 - DNA, 22 bp, Homo sapiens
agtggctgccaagagcaatgct

SEQ ID NO: 6977228 - DNA, 22 bp, Homo sapiens
attgattgaagtaaaataacct

SEQ ID NO: 6977229 - DNA, 22 bp, Homo sapiens
aggttcagatgacttttatgct

SEQ ID NO: 6977230 - DNA, 22 bp, Homo sapiens
tcccagctactctagaggctga

SEQ ID NO: 6977231 - DNA, 22 bp, Homo sapiens
ccgaggacattgggcttctgtt

SEQ ID NO: 6977232 - DNA, 22 bp, Homo sapiens
gtgagcagaacaggtggcttct

SEQ ID NO: 6977233 - DNA, 22 bp, Homo sapiens
tcttacatatagcatgagtaca

SEQ ID NO: 6977234 - DNA, 20 bp, Homo sapiens
gcttagcaggcatagtagct

SEQ ID NO: 6977235 - DNA, 22 bp, Homo sapiens
acaggtggagtggttagcaggc

SEQ ID NO: 6977236 - DNA, 22 bp, Homo sapiens
ggctctggagcacagacgtctg

SEQ ID NO: 6977237 - DNA, 23 bp, Homo sapiens
aagcatggttcacagttagtact

SEQ ID NO: 6977238 - DNA, 22 bp, Homo sapiens
cctgagtggagggattctgcag

SEQ ID NO: 6977239 - DNA, 22 bp, Homo sapiens
gggccacaggagaggctgtcag

SEQ ID NO: 6977240 - DNA, 22 bp, Homo sapiens
tggcttccagaactgagcaaca

SEQ ID NO: 6977241 - DNA, 22 bp, Homo sapiens
tgttcatatcattttgaaagct

SEQ ID NO: 6977242 - DNA, 22 bp, Homo sapiens
ggactgggcatgggtgctctgc

SEQ ID NO: 6977243 - DNA, 22 bp, Homo sapiens
ggaccaggagctcagagccctc

SEQ ID NO: 6977244 - DNA, 23 bp, Homo sapiens
cagctggttgtgggagtggctgc

SEQ ID NO: 6977245 - DNA, 22 bp, Homo sapiens
cagggcaaggcagagcgtcccc

SEQ ID NO: 6977246 - DNA, 22 bp, Homo sapiens
atatttgagggcaatagggtgg

SEQ ID NO: 6977247 - DNA, 22 bp, Homo sapiens
gtcagagctggaggcaagttct

SEQ ID NO: 6977248 - DNA, 22 bp, Homo sapiens
gtcccctcaaaattcatatgtt

SEQ ID NO: 6977249 - DNA, 22 bp, Homo sapiens
aaagctgcaagctcctgaggaa

SEQ ID NO: 6977250 - DNA, 22 bp, Homo sapiens
catcagaggtacttaatgaatg

SEQ ID NO: 6977251 - DNA, 22 bp, Homo sapiens
atgttgcacaaagtccatccat

SEQ ID NO: 6977252 - DNA, 22 bp, Homo sapiens
gctgggcagcaggctctccggg

SEQ ID NO: 6977253 - DNA, 22 bp, Homo sapiens
aaacttgaccctatccaattac

SEQ ID NO: 6977254 - DNA, 20 bp, Homo sapiens
tgatccctggcggcctttcc

SEQ ID NO: 6977255 - DNA, 22 bp, Homo sapiens
ttacaaagcaggtcagctgaaa

SEQ ID NO: 6977256 - DNA, 22 bp, Homo sapiens
accttcaagtatgtgggctgaa

SEQ ID NO: 6977257 - DNA, 22 bp, Homo sapiens
aatacagtcttactagaaaatc

SEQ ID NO: 6977258 - DNA, 22 bp, Homo sapiens
gtggccctcagcagttgccaag

SEQ ID NO: 6977259 - DNA, 22 bp, Homo sapiens
ctctggcaattgctgctgactc

SEQ ID NO: 6977260 - DNA, 22 bp, Homo sapiens
ggctctttaacttgtctaaatt

SEQ ID NO: 6977261 - DNA, 22 bp, Homo sapiens
atggaaatggagggtgctagaa

SEQ ID NO: 6977262 - DNA, 22 bp, Homo sapiens
gtaaagttctactagaatcaac

SEQ ID NO: 6977263 - DNA, 22 bp, Homo sapiens
ttcttaatctgtgtgggttcga

SEQ ID NO: 6977264 - DNA, 18 bp, Homo sapiens
ttgaagtcagatcaatgg

SEQ ID NO: 6977265 - DNA, 22 bp, Homo sapiens
taattcctagaaattattctca

SEQ ID NO: 6977266 - DNA, 22 bp, Homo sapiens
tattgacactttttgtgtagcc

SEQ ID NO: 6977267 - DNA, 22 bp, Homo sapiens
tcacattttctactactgtacg

SEQ ID NO: 6977268 - DNA, 22 bp, Homo sapiens
attccgtggaagtggcaggggt

SEQ ID NO: 6977269 - DNA, 22 bp, Homo sapiens
ttgagactgccttgtcgtctgc

SEQ ID NO: 6977270 - DNA, 22 bp, Homo sapiens
tgccacagggtcctcaggccag

SEQ ID NO: 6977271 - DNA, 22 bp, Homo sapiens
acacaagggcctatagtgtatt

SEQ ID NO: 6977272 - DNA, 22 bp, Homo sapiens
tcacattggaccttcctgacaa

SEQ ID NO: 6977273 - DNA, 22 bp, Homo sapiens
gacacatagatctatctcactc

SEQ ID NO: 6977274 - DNA, 22 bp, Homo sapiens
aaggcagaaagggatgtgagtg

SEQ ID NO: 6977275 - DNA, 19 bp, Homo sapiens
atcttcattttacaggcag

SEQ ID NO: 6977276 - DNA, 22 bp, Homo sapiens
cctctcagcgattcctcttgga

SEQ ID NO: 6977277 - DNA, 22 bp, Homo sapiens
caggcccaggccagtggttccc

SEQ ID NO: 6977278 - DNA, 22 bp, Homo sapiens
agatgaagcctgtacttagtct

SEQ ID NO: 6977279 - DNA, 22 bp, Homo sapiens
cagtaacaggctctgtggtata

SEQ ID NO: 6977280 - DNA, 22 bp, Homo sapiens
tcctgaaatttgttttaattct

SEQ ID NO: 6977281 - DNA, 22 bp, Homo sapiens
ggtctggccaatagacagcccc

SEQ ID NO: 6977282 - DNA, 22 bp, Homo sapiens
ccagggaatcaggcagaagtca

SEQ ID NO: 6977283 - DNA, 22 bp, Homo sapiens
gggatttagtaggatagtatac

SEQ ID NO: 6977284 - DNA, 22 bp, Homo sapiens
tggcagagactcctcctgggag

SEQ ID NO: 6977285 - DNA, 22 bp, Homo sapiens
ctcgttgctgaagccaaagtca

SEQ ID NO: 6977286 - DNA, 22 bp, Homo sapiens
ctttcagttacagttacacaca

SEQ ID NO: 6977287 - DNA, 22 bp, Homo sapiens
acgatgagatggggctggaagg

SEQ ID NO: 6977288 - DNA, 22 bp, Homo sapiens
ttctcagatatttgtatggaac

SEQ ID NO: 6977289 - DNA, 17 bp, Homo sapiens
taaatacacaagggtat

SEQ ID NO: 6977290 - DNA, 22 bp, Homo sapiens
ttgtaacacttttctattaata

SEQ ID NO: 6977291 - DNA, 22 bp, Homo sapiens
gggctcaggtcagggcatcagc

SEQ ID NO: 6977292 - DNA, 22 bp, Homo sapiens
ctcattgattcagtgctgctct

SEQ ID NO: 6977293 - DNA, 22 bp, Homo sapiens
gggctctaggatggctccagcc

SEQ ID NO: 6977294 - DNA, 22 bp, Homo sapiens
gtcccaggagttgctgggcctt

SEQ ID NO: 6977295 - DNA, 22 bp, Homo sapiens
tgagagggcccagagcacacca

SEQ ID NO: 6977296 - DNA, 22 bp, Homo sapiens
tgcataaacttctctggtgtga

SEQ ID NO: 6977297 - DNA, 23 bp, Homo sapiens
aacaggatgtgcttcatcttttg

SEQ ID NO: 6977298 - DNA, 22 bp, Homo sapiens
ttctctgctacatactagggct

SEQ ID NO: 6977299 - DNA, 22 bp, Homo sapiens
caccagccagagtgacagctcc

SEQ ID NO: 6977300 - DNA, 22 bp, Homo sapiens
ccagtacatcgcatggtgacca

SEQ ID NO: 6977301 - DNA, 22 bp, Homo sapiens
aaagtcatccaaatttttatgt

SEQ ID NO: 6977302 - DNA, 22 bp, Homo sapiens
agtgtttagtgatgaaagagaa

SEQ ID NO: 6977303 - DNA, 22 bp, Homo sapiens
gtaagcctgagaaacaccacct

SEQ ID NO: 6977304 - DNA, 22 bp, Homo sapiens
gcctggaaacagtgagcgaagg

SEQ ID NO: 6977305 - DNA, 19 bp, Homo sapiens
aattagggagtcggttaag

SEQ ID NO: 6977306 - DNA, 22 bp, Homo sapiens
tcacagaatgtctagcataatt

SEQ ID NO: 6977307 - DNA, 22 bp, Homo sapiens
cagtgcagaggccagggaggat

SEQ ID NO: 6977308 - DNA, 22 bp, Homo sapiens
ggccatttgcttggagaacttt

SEQ ID NO: 6977309 - DNA, 19 bp, Homo sapiens
gtccactccactcggtctc

SEQ ID NO: 6977310 - DNA, 22 bp, Homo sapiens
gacaaggcgcccagcctgccaa

SEQ ID NO: 6977311 - DNA, 22 bp, Homo sapiens
tagctgcttcagtctaggtctc

SEQ ID NO: 6977312 - DNA, 22 bp, Homo sapiens
ggctgtgaaccctggcagtgtg

SEQ ID NO: 6977313 - DNA, 22 bp, Homo sapiens
cctcacagggccaggcccctca

SEQ ID NO: 6977314 - DNA, 22 bp, Homo sapiens
tttcaggacacctttaaaaacg

SEQ ID NO: 6977315 - DNA, 22 bp, Homo sapiens
actgcctgatgtggttctaaat

SEQ ID NO: 6977316 - DNA, 22 bp, Homo sapiens
taatttctagggactaaggtgc

SEQ ID NO: 6977317 - DNA, 22 bp, Homo sapiens
cgtgccccggtgaggagttcag

SEQ ID NO: 6977318 - DNA, 22 bp, Homo sapiens
ccccgccctgcgcggggataac

SEQ ID NO: 6977319 - DNA, 22 bp, Homo sapiens
tccaggtccctggggagatttt

SEQ ID NO: 6977320 - DNA, 19 bp, Homo sapiens
tcatggatcaggtagttta

SEQ ID NO: 6977321 - DNA, 22 bp, Homo sapiens
gaatttcaacagtcctcaaatg

SEQ ID NO: 6977322 - DNA, 22 bp, Homo sapiens
aggacacaggtaagccagtgga

SEQ ID NO: 6977323 - DNA, 22 bp, Homo sapiens
taggtgtctggacaactttgta

SEQ ID NO: 6977324 - DNA, 22 bp, Homo sapiens
cacagtttggttttgctgtaat

SEQ ID NO: 6977325 - DNA, 22 bp, Homo sapiens
tgcttctttaaatgatagtcaa

SEQ ID NO: 6977326 - DNA, 22 bp, Homo sapiens
taggctaggctgaaggttttgg

SEQ ID NO: 6977327 - DNA, 22 bp, Homo sapiens
tgcaatttatgtgcaagtggtt

SEQ ID NO: 6977328 - DNA, 22 bp, Homo sapiens
ttctatgtgttgacaagcctga

SEQ ID NO: 6977329 - DNA, 22 bp, Homo sapiens
cattttcagcacccatctgaaa

SEQ ID NO: 6977330 - DNA, 22 bp, Homo sapiens
tttctgtaagttcaggctttcc

SEQ ID NO: 6977331 - DNA, 22 bp, Homo sapiens
gagttagtctgctaaatcccag

SEQ ID NO: 6977332 - DNA, 22 bp, Homo sapiens
tgagcatagtgatttttctaga

SEQ ID NO: 6977333 - DNA, 22 bp, Homo sapiens
gtggcagagccaggctttgaac

SEQ ID NO: 6977334 - DNA, 22 bp, Homo sapiens
tggcaggtgaagttgttaggga

SEQ ID NO: 6977335 - DNA, 22 bp, Homo sapiens
ggattagtcttactcgtccaat

SEQ ID NO: 6977336 - DNA, 19 bp, Homo sapiens
tttgtgaagaaaatgatgc

SEQ ID NO: 6977337 - DNA, 22 bp, Homo sapiens
tctaagacactgtactttcagt

SEQ ID NO: 6977338 - DNA, 22 bp, Homo sapiens
cggcaggtgtgctcactctgcc

SEQ ID NO: 6977339 - DNA, 22 bp, Homo sapiens
tttacgactgctaaatgcctgc

SEQ ID NO: 6977340 - DNA, 20 bp, Homo sapiens
gcattagagtactatatgct

SEQ ID NO: 6977341 - DNA, 22 bp, Homo sapiens
tttgttcattttgagctcatca

SEQ ID NO: 6977342 - DNA, 18 bp, Homo sapiens
caagagctgctcctggcc

SEQ ID NO: 6977343 - DNA, 22 bp, Homo sapiens
actgccacgttccaggcttagc

SEQ ID NO: 6977344 - DNA, 22 bp, Homo sapiens
cagatctatctgttgatggtgc

SEQ ID NO: 6977345 - DNA, 22 bp, Homo sapiens
aaggcatacctgaatgtttgtg

SEQ ID NO: 6977346 - DNA, 20 bp, Homo sapiens
catcagaaatcctgacccac

SEQ ID NO: 6977347 - DNA, 22 bp, Homo sapiens
ctggccactgattcctcccctg

SEQ ID NO: 6977348 - DNA, 23 bp, Homo sapiens
ctgttatatgggtgttatgtgct

SEQ ID NO: 6977349 - DNA, 22 bp, Homo sapiens
tgattacattggtaatgtttat

SEQ ID NO: 6977350 - DNA, 22 bp, Homo sapiens
agcacagatgtgagtggaggct

SEQ ID NO: 6977351 - DNA, 22 bp, Homo sapiens
atgtagtaatcacacccagcaa

SEQ ID NO: 6977352 - DNA, 22 bp, Homo sapiens
cactgcttcagtcagagaaatt

SEQ ID NO: 6977353 - DNA, 22 bp, Homo sapiens
agtgttattgaggcaaaactgt

SEQ ID NO: 6977354 - DNA, 22 bp, Homo sapiens
ctcttcagttcacccctaagca

SEQ ID NO: 6977355 - DNA, 22 bp, Homo sapiens
taacagaagttgttcattgtgg

SEQ ID NO: 6977356 - DNA, 23 bp, Homo sapiens
tctttggtaaataaagtggggat

SEQ ID NO: 6977357 - DNA, 22 bp, Homo sapiens
cagcagactgaccttcaacccc

SEQ ID NO: 6977358 - DNA, 22 bp, Homo sapiens
tatcttgttttggcctccaggg

SEQ ID NO: 6977359 - DNA, 22 bp, Homo sapiens
agcatggcctgcagcggccacc

SEQ ID NO: 6977360 - DNA, 22 bp, Homo sapiens
actgttcatctcttagaaagta

SEQ ID NO: 6977361 - DNA, 22 bp, Homo sapiens
ggtgagggagtggaacgaggtg

SEQ ID NO: 6977362 - DNA, 22 bp, Homo sapiens
cctgccagcgcttatctctcgg

SEQ ID NO: 6977363 - DNA, 22 bp, Homo sapiens
aggcagggctcatttcttaggc

SEQ ID NO: 6977364 - DNA, 23 bp, Homo sapiens
catgtgcaggaactgtgcttttg

SEQ ID NO: 6977365 - DNA, 22 bp, Homo sapiens
aacactagtctagaccagacca

SEQ ID NO: 6977366 - DNA, 22 bp, Homo sapiens
ctccctgggcagatgtggctct

SEQ ID NO: 6977367 - DNA, 22 bp, Homo sapiens
tattttgcaaacctgagtttga

SEQ ID NO: 6977368 - DNA, 22 bp, Homo sapiens
tcagaaagacgaaacagatggg

SEQ ID NO: 6977369 - DNA, 22 bp, Homo sapiens
ctgccctgtgagggtccttggg

SEQ ID NO: 6977370 - DNA, 22 bp, Homo sapiens
aaactgcacacgatgtgcctga

SEQ ID NO: 6977371 - DNA, 22 bp, Homo sapiens
ctggtttatgagggaagggatg

SEQ ID NO: 6977372 - DNA, 19 bp, Homo sapiens
atgaggtagcagctggtgc

SEQ ID NO: 6977373 - DNA, 22 bp, Homo sapiens
gggagacacttgctttagaggg

SEQ ID NO: 6977374 - DNA, 22 bp, Homo sapiens
tctgggttattatgatggctac

SEQ ID NO: 6977375 - DNA, 22 bp, Homo sapiens
cagtgcatgtggcactctccag

SEQ ID NO: 6977376 - DNA, 22 bp, Homo sapiens
atgtaagtttaagcacaacaag

SEQ ID NO: 6977377 - DNA, 22 bp, Homo sapiens
ttctgcctgatgtagtcatacc

SEQ ID NO: 6977378 - DNA, 22 bp, Homo sapiens
ccagttctttctgtgtgcaaca

SEQ ID NO: 6977379 - DNA, 22 bp, Homo sapiens
ctggtcaggaaggtggggacag

SEQ ID NO: 6977380 - DNA, 22 bp, Homo sapiens
gcctgcctttgtgaggaagcgg

SEQ ID NO: 6977381 - DNA, 22 bp, Homo sapiens
cagatgagcatgggcacaagca

SEQ ID NO: 6977382 - DNA, 21 bp, Homo sapiens
tggtcattgatagtgcaggga

SEQ ID NO: 6977383 - DNA, 22 bp, Homo sapiens
ggaagggcctcgggcgtgggac

SEQ ID NO: 6977384 - DNA, 22 bp, Homo sapiens
gtcactttattaattttggtga

SEQ ID NO: 6977385 - DNA, 22 bp, Homo sapiens
tacattacaggaaagataaaga

SEQ ID NO: 6977386 - DNA, 22 bp, Homo sapiens
tcaggaagggctcagtctgtgc

SEQ ID NO: 6977387 - DNA, 22 bp, Homo sapiens
ccaagctttcgatcaaccagaa

SEQ ID NO: 6977388 - DNA, 17 bp, Homo sapiens
tgacaatgacaagcact

SEQ ID NO: 6977389 - DNA, 22 bp, Homo sapiens
tatgtctttttctcactatagt

SEQ ID NO: 6977390 - DNA, 22 bp, Homo sapiens
gggtatgagatataggtgaata

SEQ ID NO: 6977391 - DNA, 22 bp, Homo sapiens
acagcagttaacgatcagactc

SEQ ID NO: 6977392 - DNA, 22 bp, Homo sapiens
cacagtcaatgtagaaatatga

SEQ ID NO: 6977393 - DNA, 22 bp, Homo sapiens
agagccagatggagccgtgtgt

SEQ ID NO: 6977394 - DNA, 22 bp, Homo sapiens
tgctggaagagaatactggtgg

SEQ ID NO: 6977395 - DNA, 22 bp, Homo sapiens
atggtgtattcatgtttttaaa

SEQ ID NO: 6977396 - DNA, 21 bp, Homo sapiens
tgtcatatttcaatacagttt

SEQ ID NO: 6977397 - DNA, 22 bp, Homo sapiens
ttagtgctaaatactcccacag

SEQ ID NO: 6977398 - DNA, 22 bp, Homo sapiens
accagtgcttcctgctggagct

SEQ ID NO: 6977399 - DNA, 22 bp, Homo sapiens
aaaggtcttaaggttaagcagg

SEQ ID NO: 6977400 - DNA, 22 bp, Homo sapiens
atgtggctggtgactgccgtac

SEQ ID NO: 6977401 - DNA, 22 bp, Homo sapiens
tcctcacagatgggtgcatagc

SEQ ID NO: 6977402 - DNA, 22 bp, Homo sapiens
ggcttctttttagtaaatgtca

SEQ ID NO: 6977403 - DNA, 22 bp, Homo sapiens
taagaagtgttgcctaatgcaa

SEQ ID NO: 6977404 - DNA, 22 bp, Homo sapiens
gggcacagcccagtggggtccc

SEQ ID NO: 6977405 - DNA, 22 bp, Homo sapiens
acagagtttatgtgtgtacaaa

SEQ ID NO: 6977406 - DNA, 22 bp, Homo sapiens
gtttggacctctgctagatgga

SEQ ID NO: 6977407 - DNA, 23 bp, Homo sapiens
attgacctgtttagtctctccct

SEQ ID NO: 6977408 - DNA, 22 bp, Homo sapiens
tctccttccaacaaaaggtcac

SEQ ID NO: 6977409 - DNA, 22 bp, Homo sapiens
tattagcgtcaggaggtgagta

SEQ ID NO: 6977410 - DNA, 21 bp, Homo sapiens
gcagaagtggctacatctcca

SEQ ID NO: 6977411 - DNA, 23 bp, Homo sapiens
agagctttctaaaatgtaaatct

SEQ ID NO: 6977412 - DNA, 22 bp, Homo sapiens
tggaatgaatatgttttaagga

SEQ ID NO: 6977413 - DNA, 20 bp, Homo sapiens
tatttgaaatggccaagtgt

SEQ ID NO: 6977414 - DNA, 22 bp, Homo sapiens
tgtctctagggcaatgtgaact

SEQ ID NO: 6977415 - DNA, 22 bp, Homo sapiens
aatgaacaacactgaaggaaga

SEQ ID NO: 6977416 - DNA, 22 bp, Homo sapiens
ccaatttcctgccagtaccttc

SEQ ID NO: 6977417 - DNA, 22 bp, Homo sapiens
ttgctttaccatttgatctcta

SEQ ID NO: 6977418 - DNA, 22 bp, Homo sapiens
gggatgacacaaacttcctaag

SEQ ID NO: 6977419 - DNA, 18 bp, Homo sapiens
ggtggcaggtcagatgcc

SEQ ID NO: 6977420 - DNA, 22 bp, Homo sapiens
gagatgcttttggtccaagagt

SEQ ID NO: 6977421 - DNA, 22 bp, Homo sapiens
agcaaggctcggtcagggtgat

SEQ ID NO: 6977422 - DNA, 22 bp, Homo sapiens
tgagtaggtggttaagcatgga

SEQ ID NO: 6977423 - DNA, 22 bp, Homo sapiens
cctgcctgctttctgctttgca

SEQ ID NO: 6977424 - DNA, 22 bp, Homo sapiens
attctagtgtttccattacaag

SEQ ID NO: 6977425 - DNA, 22 bp, Homo sapiens
gtccacttgctgtgttcttaat

SEQ ID NO: 6977426 - DNA, 22 bp, Homo sapiens
atgccctgaggaatgtcacgct

SEQ ID NO: 6977427 - DNA, 22 bp, Homo sapiens
gtctcggttattcctcatttaa

SEQ ID NO: 6977428 - DNA, 22 bp, Homo sapiens
gagctagtagaacaagtgagga

SEQ ID NO: 6977429 - DNA, 22 bp, Homo sapiens
tctcctggagcccagatgctgg

SEQ ID NO: 6977430 - DNA, 22 bp, Homo sapiens
ctgatgatagtgatttattgag

SEQ ID NO: 6977431 - DNA, 22 bp, Homo sapiens
tcaagtcctgctgtggaccaca

SEQ ID NO: 6977432 - DNA, 22 bp, Homo sapiens
ttggcagcatccaagtctcggg

SEQ ID NO: 6977433 - DNA, 22 bp, Homo sapiens
tggcttaaccttgtgagtgtta

SEQ ID NO: 6977434 - DNA, 22 bp, Homo sapiens
caaaggtattctcattttggaa

SEQ ID NO: 6977435 - DNA, 22 bp, Homo sapiens
taagcatagtaccgtagcagct

SEQ ID NO: 6977436 - DNA, 22 bp, Homo sapiens
acatgcttttcccacaattata

SEQ ID NO: 6977437 - DNA, 20 bp, Homo sapiens
ataacaaggctctgcaagct

SEQ ID NO: 6977438 - DNA, 22 bp, Homo sapiens
agctgcatttcagtgaaatatt

SEQ ID NO: 6977439 - DNA, 22 bp, Homo sapiens
gtctgggacaggactggggaac

SEQ ID NO: 6977440 - DNA, 22 bp, Homo sapiens
agtttgtaataatgaaggaagt

SEQ ID NO: 6977441 - DNA, 22 bp, Homo sapiens
ttgcacagatgagggtgatgct

SEQ ID NO: 6977442 - DNA, 22 bp, Homo sapiens
ccaccctgagccgcaagagcag

SEQ ID NO: 6977443 - DNA, 22 bp, Homo sapiens
ctgagcagaccatggcagaggt

SEQ ID NO: 6977444 - DNA, 22 bp, Homo sapiens
tgcaaattcagaagaactgccc

SEQ ID NO: 6977445 - DNA, 22 bp, Homo sapiens
cctcaggcttcgtcttccaccc

SEQ ID NO: 6977446 - DNA, 22 bp, Homo sapiens
agaagctgacagatgcagcagg

SEQ ID NO: 6977447 - DNA, 22 bp, Homo sapiens
gagggtcttacctaagcagggt

SEQ ID NO: 6977448 - DNA, 22 bp, Homo sapiens
tttagaacaatgtgtagaaaaa

SEQ ID NO: 6977449 - DNA, 22 bp, Homo sapiens
acctcaaggaaaatctagacag

SEQ ID NO: 6977450 - DNA, 22 bp, Homo sapiens
ctgcctgcatcccacagtgggg

SEQ ID NO: 6977451 - DNA, 22 bp, Homo sapiens
ggagcagcactgccacacagag

SEQ ID NO: 6977452 - DNA, 22 bp, Homo sapiens
ccacctgtgcttggtactccat

SEQ ID NO: 6977453 - DNA, 22 bp, Homo sapiens
gattctgaggccttgctcaaga

SEQ ID NO: 6977454 - DNA, 19 bp, Homo sapiens
cttggcttagcttcttagc

SEQ ID NO: 6977455 - DNA, 22 bp, Homo sapiens
tactgtatgatttcatgtatat

SEQ ID NO: 6977456 - DNA, 22 bp, Homo sapiens
actggagactgtgtcttttgat

SEQ ID NO: 6977457 - DNA, 22 bp, Homo sapiens
tgccttaattttctaagctgtg

SEQ ID NO: 6977458 - DNA, 22 bp, Homo sapiens
atgaggttttactgccattttc

SEQ ID NO: 6977459 - DNA, 22 bp, Homo sapiens
aaagagtctggcactgtaccag

SEQ ID NO: 6977460 - DNA, 19 bp, Homo sapiens
cttcacatctgtgagggga

SEQ ID NO: 6977461 - DNA, 21 bp, Homo sapiens
tgggagacacagccttgagct

SEQ ID NO: 6977462 - DNA, 22 bp, Homo sapiens
tacatgcaattaagagggtgaa

SEQ ID NO: 6977463 - DNA, 22 bp, Homo sapiens
ttccaagtcacccttagggtca

SEQ ID NO: 6977464 - DNA, 22 bp, Homo sapiens
catgcaattttttcttgtcagt

SEQ ID NO: 6977465 - DNA, 22 bp, Homo sapiens
aggagctgggcccaaggatgct

SEQ ID NO: 6977466 - DNA, 22 bp, Homo sapiens
agcagcagtcctttgtgtaatt

SEQ ID NO: 6977467 - DNA, 22 bp, Homo sapiens
accatacttgaaatggatagga

SEQ ID NO: 6977468 - DNA, 22 bp, Homo sapiens
tgtaaaaccaaatcaatctagt

SEQ ID NO: 6977469 - DNA, 22 bp, Homo sapiens
taaggcttcttggaatactgca

SEQ ID NO: 6977470 - DNA, 22 bp, Homo sapiens
ggaagtttgggagctggtaatc

SEQ ID NO: 6977471 - DNA, 22 bp, Homo sapiens
ggtgtggcagtggacctgtgaa

SEQ ID NO: 6977472 - DNA, 22 bp, Homo sapiens
attggtctaggctttaaaaaga

SEQ ID NO: 6977473 - DNA, 22 bp, Homo sapiens
tctaaatcccaacatgatatca

SEQ ID NO: 6977474 - DNA, 22 bp, Homo sapiens
gagctctaaccagggacaatta

SEQ ID NO: 6977475 - DNA, 22 bp, Homo sapiens
gtgcagagtgtctgtggactga

SEQ ID NO: 6977476 - DNA, 22 bp, Homo sapiens
tcatttgtttaggtagcaccat

SEQ ID NO: 6977477 - DNA, 22 bp, Homo sapiens
tagcaagtgtgagttcatttta

SEQ ID NO: 6977478 - DNA, 22 bp, Homo sapiens
ttttgtgacacttcttgagaca

SEQ ID NO: 6977479 - DNA, 22 bp, Homo sapiens
aagacactaagctttcaggata

SEQ ID NO: 6977480 - DNA, 22 bp, Homo sapiens
ctgatattctttgagctgctaa

SEQ ID NO: 6977481 - DNA, 22 bp, Homo sapiens
aggtctgacttcaagcctgtgg

SEQ ID NO: 6977482 - DNA, 22 bp, Homo sapiens
tagtaacaacaactagcatttt

SEQ ID NO: 6977483 - DNA, 22 bp, Homo sapiens
ttgcttttgggaaaacatgcct

SEQ ID NO: 6977484 - DNA, 22 bp, Homo sapiens
tttcctctccaccaggaggtct

SEQ ID NO: 6977485 - DNA, 22 bp, Homo sapiens
gttattcccttgccagaggctt

SEQ ID NO: 6977486 - DNA, 22 bp, Homo sapiens
aggcaactctgaccttatgaag

SEQ ID NO: 6977487 - DNA, 22 bp, Homo sapiens
ttggaaatgcaaatatattgaa

SEQ ID NO: 6977488 - DNA, 22 bp, Homo sapiens
tggaacaaattacaattaactt

SEQ ID NO: 6977489 - DNA, 22 bp, Homo sapiens
cgtgcatgatatatgagttgtt

SEQ ID NO: 6977490 - DNA, 17 bp, Homo sapiens
caaaccagtaagactgc

SEQ ID NO: 6977491 - DNA, 22 bp, Homo sapiens
gctgctgttatgatgttacttt

SEQ ID NO: 6977492 - DNA, 22 bp, Homo sapiens
gcctgtgacccagggcccagga

SEQ ID NO: 6977493 - DNA, 22 bp, Homo sapiens
acagggggtcccatggcctgga

SEQ ID NO: 6977494 - DNA, 22 bp, Homo sapiens
atgacatgtcctagttggtcta

SEQ ID NO: 6977495 - DNA, 22 bp, Homo sapiens
aggacagcagttggtgaggttc

SEQ ID NO: 6977496 - DNA, 22 bp, Homo sapiens
tggcctctgcaatggattcacc

SEQ ID NO: 6977497 - DNA, 22 bp, Homo sapiens
tatacactgttgttgggagtct

SEQ ID NO: 6977498 - DNA, 22 bp, Homo sapiens
cttaatgaatgctgctgtattt

SEQ ID NO: 6977499 - DNA, 22 bp, Homo sapiens
accaaaaattgtggggctgaat

SEQ ID NO: 6977500 - DNA, 22 bp, Homo sapiens
ctcaggagtagttcagcagctg

SEQ ID NO: 6977501 - DNA, 23 bp, Homo sapiens
agctctgctcgggcatgccctgc

SEQ ID NO: 6977502 - DNA, 22 bp, Homo sapiens
tgcctgctaggcactttcaaac

SEQ ID NO: 6977503 - DNA, 22 bp, Homo sapiens
tcaccccctgtattagtagcta

SEQ ID NO: 6977504 - DNA, 22 bp, Homo sapiens
tctgatgtgtttaagaaagaag

SEQ ID NO: 6977505 - DNA, 22 bp, Homo sapiens
agagaggttggctaggatgttt

SEQ ID NO: 6977506 - DNA, 22 bp, Homo sapiens
agagggagaagctaaaataact

SEQ ID NO: 6977507 - DNA, 22 bp, Homo sapiens
catttatataaaatgtccagaa

SEQ ID NO: 6977508 - DNA, 22 bp, Homo sapiens
ggggtgtctgtgttcttcagtt

SEQ ID NO: 6977509 - DNA, 22 bp, Homo sapiens
tgctccagcatgaccctcaatg

SEQ ID NO: 6977510 - DNA, 22 bp, Homo sapiens
tggaaggcactgggagaagact

SEQ ID NO: 6977511 - DNA, 22 bp, Homo sapiens
aaagactacacgggaaagagct

SEQ ID NO: 6977512 - DNA, 22 bp, Homo sapiens
tgagcacagctttcactagaaa

SEQ ID NO: 6977513 - DNA, 22 bp, Homo sapiens
caggagaagtctctagggggtg

SEQ ID NO: 6977514 - DNA, 22 bp, Homo sapiens
aggcagtgagtgtgacttcaca

SEQ ID NO: 6977515 - DNA, 22 bp, Homo sapiens
accagttacatcttagcaagca

SEQ ID NO: 6977516 - DNA, 22 bp, Homo sapiens
tgattgcttctttgctatctgt

SEQ ID NO: 6977517 - DNA, 22 bp, Homo sapiens
actggcatctgtgggtagaggc

SEQ ID NO: 6977518 - DNA, 22 bp, Homo sapiens
attgctgtggaaatataagatg

SEQ ID NO: 6977519 - DNA, 22 bp, Homo sapiens
cacccccacctgtgggctcctg

SEQ ID NO: 6977520 - DNA, 22 bp, Homo sapiens
tcctttgttgtacaattatttt

SEQ ID NO: 6977521 - DNA, 22 bp, Homo sapiens
tttaggaatattttctttcagg

SEQ ID NO: 6977522 - DNA, 22 bp, Homo sapiens
caggtgtcaaaatactaagtgg

SEQ ID NO: 6977523 - DNA, 22 bp, Homo sapiens
agaacagcctatagtggccttt

SEQ ID NO: 6977524 - DNA, 22 bp, Homo sapiens
ataaggctttattagctattgt

SEQ ID NO: 6977525 - DNA, 22 bp, Homo sapiens
gcggcgcctgggacccgccagc

SEQ ID NO: 6977526 - DNA, 20 bp, Homo sapiens
gttaggaggttggacatgga

SEQ ID NO: 6977527 - DNA, 22 bp, Homo sapiens
tggggatggatgaatctttgct

SEQ ID NO: 6977528 - DNA, 22 bp, Homo sapiens
aaagtcacatagcatcacttct

SEQ ID NO: 6977529 - DNA, 20 bp, Homo sapiens
aacattgcttcaatgtaacc

SEQ ID NO: 6977530 - DNA, 22 bp, Homo sapiens
tctgggcactgctgagcctgta

SEQ ID NO: 6977531 - DNA, 22 bp, Homo sapiens
cacagatgaagtaaacaactct

SEQ ID NO: 6977532 - DNA, 22 bp, Homo sapiens
aataaatgttaagattgtctca

SEQ ID NO: 6977533 - DNA, 22 bp, Homo sapiens
tgcaggtgtctccagggcaggt

SEQ ID NO: 6977534 - DNA, 22 bp, Homo sapiens
tactataacttcgaagtcctgg

SEQ ID NO: 6977535 - DNA, 22 bp, Homo sapiens
aaaggtcaagctggactcaggt

SEQ ID NO: 6977536 - DNA, 22 bp, Homo sapiens
cttcagagcatcacttcagctg

SEQ ID NO: 6977537 - DNA, 21 bp, Homo sapiens
taagagtaggctgattgcttc

SEQ ID NO: 6977538 - DNA, 22 bp, Homo sapiens
tagctgtgtaagcttggtaaga

SEQ ID NO: 6977539 - DNA, 22 bp, Homo sapiens
tgtttttgtctccttgtctgct

SEQ ID NO: 6977540 - DNA, 22 bp, Homo sapiens
ggcagtgtgcatctgtgtggcc

SEQ ID NO: 6977541 - DNA, 17 bp, Homo sapiens
attattccaactctcca

SEQ ID NO: 6977542 - DNA, 20 bp, Homo sapiens
caagccctctttagcctgcc

SEQ ID NO: 6977543 - DNA, 22 bp, Homo sapiens
tgattcagaggctattctcctt

SEQ ID NO: 6977544 - DNA, 22 bp, Homo sapiens
atacagtagacaatctcatgaa

SEQ ID NO: 6977545 - DNA, 22 bp, Homo sapiens
ccctaggaattctatggccaag

SEQ ID NO: 6977546 - DNA, 22 bp, Homo sapiens
gaggtctgggatggggcctgaa

SEQ ID NO: 6977547 - DNA, 22 bp, Homo sapiens
gtggcctggggtttgttctgag

SEQ ID NO: 6977548 - DNA, 22 bp, Homo sapiens
aagtgatttctgcctgcatgtt

SEQ ID NO: 6977549 - DNA, 22 bp, Homo sapiens
tgagtcagccagagctgccatg

SEQ ID NO: 6977550 - DNA, 22 bp, Homo sapiens
tcaccaagtccatatgcatcat

SEQ ID NO: 6977551 - DNA, 22 bp, Homo sapiens
tgggcaggagagaagctaaaga

SEQ ID NO: 6977552 - DNA, 22 bp, Homo sapiens
gcttggagatgggggatgagcc

SEQ ID NO: 6977553 - DNA, 22 bp, Homo sapiens
cctgtgacttggcaaacctcca

SEQ ID NO: 6977554 - DNA, 22 bp, Homo sapiens
tctggagaatctgtcagtgtgg

SEQ ID NO: 6977555 - DNA, 22 bp, Homo sapiens
tattaagtggtgagtactgcca

SEQ ID NO: 6977556 - DNA, 22 bp, Homo sapiens
attggcaaggctgcggtgtctg

SEQ ID NO: 6977557 - DNA, 22 bp, Homo sapiens
ataggactttgtatcaggatga

SEQ ID NO: 6977558 - DNA, 22 bp, Homo sapiens
aagcacagtaaaagcagatttt

SEQ ID NO: 6977559 - DNA, 22 bp, Homo sapiens
tcagaaatagctctaagctcct

SEQ ID NO: 6977560 - DNA, 22 bp, Homo sapiens
ctcatgtcaggggtgtcaatgt

SEQ ID NO: 6977561 - DNA, 19 bp, Homo sapiens
gtggccagggcaggggctg

SEQ ID NO: 6977562 - DNA, 22 bp, Homo sapiens
acatggtatttctattataatt

SEQ ID NO: 6977563 - DNA, 22 bp, Homo sapiens
agtccaggtggaccttggccag

SEQ ID NO: 6977564 - DNA, 22 bp, Homo sapiens
tcacattgttatgtaaatgttt

SEQ ID NO: 6977565 - DNA, 22 bp, Homo sapiens
cagaggtcaggttggacattat

SEQ ID NO: 6977566 - DNA, 22 bp, Homo sapiens
cagccctggcagctttcagggt

SEQ ID NO: 6977567 - DNA, 22 bp, Homo sapiens
tcaacaagaataccatcctcct

SEQ ID NO: 6977568 - DNA, 22 bp, Homo sapiens
ggtgtgggtccttgtgcttgct

SEQ ID NO: 6977569 - DNA, 22 bp, Homo sapiens
attgacagaaaagatgttggat

SEQ ID NO: 6977570 - DNA, 22 bp, Homo sapiens
catttgctctgtgtcagtggca

SEQ ID NO: 6977571 - DNA, 22 bp, Homo sapiens
agcaggcagcatgggaccctcc

SEQ ID NO: 6977572 - DNA, 22 bp, Homo sapiens
ctagagagccgctgtggaaaat

SEQ ID NO: 6977573 - DNA, 22 bp, Homo sapiens
tgctttaaaccatggatgtgag

SEQ ID NO: 6977574 - DNA, 22 bp, Homo sapiens
ctggagagtaatctctgtgtta

SEQ ID NO: 6977575 - DNA, 22 bp, Homo sapiens
tgcttcaagttgaaatattctt

SEQ ID NO: 6977576 - DNA, 22 bp, Homo sapiens
catgttaaattgagtttgcaat

SEQ ID NO: 6977577 - DNA, 22 bp, Homo sapiens
tcttgcagaaataagtttaaat

SEQ ID NO: 6977578 - DNA, 22 bp, Homo sapiens
ttgaatacaagtagagaagaca

SEQ ID NO: 6977579 - DNA, 22 bp, Homo sapiens
ttcttagtccatccctcctttg

SEQ ID NO: 6977580 - DNA, 22 bp, Homo sapiens
ttatttgtaaggcagggccagt

SEQ ID NO: 6977581 - DNA, 22 bp, Homo sapiens
caaatgtgtaaggaagtgttag

SEQ ID NO: 6977582 - DNA, 22 bp, Homo sapiens
acagcccagaaagcctaagggg

SEQ ID NO: 6977583 - DNA, 20 bp, Homo sapiens
atatggctgtgtgttgggag

SEQ ID NO: 6977584 - DNA, 22 bp, Homo sapiens
aatgtcaagtagccaatgcttc

SEQ ID NO: 6977585 - DNA, 22 bp, Homo sapiens
ccagagaagaaaagcacctttt

SEQ ID NO: 6977586 - DNA, 22 bp, Homo sapiens
tattaaagggaagttatgcatg

SEQ ID NO: 6977587 - DNA, 22 bp, Homo sapiens
tcctttcaccaaaaagtgttgt

SEQ ID NO: 6977588 - DNA, 22 bp, Homo sapiens
cccaaagggcttcctgttctca

SEQ ID NO: 6977589 - DNA, 22 bp, Homo sapiens
gtttctgttgctcagataatgc

SEQ ID NO: 6977590 - DNA, 22 bp, Homo sapiens
tgccaaggagctggatcagggc

SEQ ID NO: 6977591 - DNA, 22 bp, Homo sapiens
tggaggccatgccagagcccta

SEQ ID NO: 6977592 - DNA, 20 bp, Homo sapiens
ttgcaaatatcgtgggtcag

SEQ ID NO: 6977593 - DNA, 22 bp, Homo sapiens
ttctaatgatttcattcaaagc

SEQ ID NO: 6977594 - DNA, 22 bp, Homo sapiens
tattgcatagaaggaaggagtt

SEQ ID NO: 6977595 - DNA, 21 bp, Homo sapiens
tgcagacagggacagaatgga

SEQ ID NO: 6977596 - DNA, 22 bp, Homo sapiens
tctgaaggtctgagctagaggt

SEQ ID NO: 6977597 - DNA, 22 bp, Homo sapiens
tctgaaagagagtacatacagt

SEQ ID NO: 6977598 - DNA, 22 bp, Homo sapiens
ttcaacatgcaaactttgggag

SEQ ID NO: 6977599 - DNA, 22 bp, Homo sapiens
ggtcactgtcttctgggctctg

SEQ ID NO: 6977600 - DNA, 22 bp, Homo sapiens
actgtgttcctctttggtatcc

SEQ ID NO: 6977601 - DNA, 18 bp, Homo sapiens
tgctttctagcttcagat

SEQ ID NO: 6977602 - DNA, 22 bp, Homo sapiens
attcacagggctttccgcatgg

SEQ ID NO: 6977603 - DNA, 22 bp, Homo sapiens
agaagccactgctcccagtgag

SEQ ID NO: 6977604 - DNA, 22 bp, Homo sapiens
cttggtcttgggagcagggaca

SEQ ID NO: 6977605 - DNA, 22 bp, Homo sapiens
ttgttttaacgactcagcttgt

SEQ ID NO: 6977606 - DNA, 22 bp, Homo sapiens
tagtgcacacgcatgtagcagt

SEQ ID NO: 6977607 - DNA, 22 bp, Homo sapiens
tatgcatatattttcccatctt

SEQ ID NO: 6977608 - DNA, 22 bp, Homo sapiens
taggccttctgaggtgacctgc

SEQ ID NO: 6977609 - DNA, 22 bp, Homo sapiens
tccttttctcttccccagagta

SEQ ID NO: 6977610 - DNA, 22 bp, Homo sapiens
tctggcctactggagtccatga

SEQ ID NO: 6977611 - DNA, 22 bp, Homo sapiens
gcagtggtccagctaagatttg

SEQ ID NO: 6977612 - DNA, 22 bp, Homo sapiens
tagagagagctgtggtggctct

SEQ ID NO: 6977613 - DNA, 22 bp, Homo sapiens
ctgctgatgacctcaaactctt

SEQ ID NO: 6977614 - DNA, 22 bp, Homo sapiens
aacagctttgcttctggagaca

SEQ ID NO: 6977615 - DNA, 22 bp, Homo sapiens
agcaagatgcaaacatccgtcc

SEQ ID NO: 6977616 - DNA, 22 bp, Homo sapiens
tttattgccctgtagtacagga

SEQ ID NO: 6977617 - DNA, 22 bp, Homo sapiens
cacatgctcattggcactgttc

SEQ ID NO: 6977618 - DNA, 22 bp, Homo sapiens
tgctcaggacagtggaacctaa

SEQ ID NO: 6977619 - DNA, 22 bp, Homo sapiens
gtccttggcattctgagtcttg

SEQ ID NO: 6977620 - DNA, 22 bp, Homo sapiens
gcaaggtgttttataggcagga

SEQ ID NO: 6977621 - DNA, 22 bp, Homo sapiens
tggaaggcttcatatgtaaaga

SEQ ID NO: 6977622 - DNA, 22 bp, Homo sapiens
tctttatcaagtctgttctttg

SEQ ID NO: 6977623 - DNA, 22 bp, Homo sapiens
acaggcaaacacagaaagtagg

SEQ ID NO: 6977624 - DNA, 22 bp, Homo sapiens
tggtgggagtgacgttgccttc

SEQ ID NO: 6977625 - DNA, 22 bp, Homo sapiens
gtagcacccactacttttcgct

SEQ ID NO: 6977626 - DNA, 22 bp, Homo sapiens
gctctgacctggccgccctgct

SEQ ID NO: 6977627 - DNA, 22 bp, Homo sapiens
attcttaaatttaggtctgtga

SEQ ID NO: 6977628 - DNA, 20 bp, Homo sapiens
ttggggcatccaccgaatgg

SEQ ID NO: 6977629 - DNA, 22 bp, Homo sapiens
acagaggggtcacagcctgaag

SEQ ID NO: 6977630 - DNA, 22 bp, Homo sapiens
ttgagaaactaacggcttgagc

SEQ ID NO: 6977631 - DNA, 22 bp, Homo sapiens
gctttcctggccctgtccctgc

SEQ ID NO: 6977632 - DNA, 20 bp, Homo sapiens
agttgtaaggaggaacccat

SEQ ID NO: 6977633 - DNA, 20 bp, Homo sapiens
tctggagtagagcacaggca

SEQ ID NO: 6977634 - DNA, 22 bp, Homo sapiens
gcctttattgtttattcagtgc

SEQ ID NO: 6977635 - DNA, 22 bp, Homo sapiens
acattctatgaagataatttta

SEQ ID NO: 6977636 - DNA, 22 bp, Homo sapiens
tacaccattcccaggtggattt

SEQ ID NO: 6977637 - DNA, 22 bp, Homo sapiens
actctaaatagcctcttaaaca

SEQ ID NO: 6977638 - DNA, 22 bp, Homo sapiens
gtcacagtgtatctcttcagct

SEQ ID NO: 6977639 - DNA, 22 bp, Homo sapiens
gagaggctccgccactgctcag

SEQ ID NO: 6977640 - DNA, 22 bp, Homo sapiens
ctggcaagtggttgggatggat

SEQ ID NO: 6977641 - DNA, 22 bp, Homo sapiens
ttaaaagaatcctgttatcctc

SEQ ID NO: 6977642 - DNA, 22 bp, Homo sapiens
tataagaaacaaggcaaatttt

SEQ ID NO: 6977643 - DNA, 22 bp, Homo sapiens
agtcctagacttttctgccact

SEQ ID NO: 6977644 - DNA, 22 bp, Homo sapiens
tggacacaaagatcaaatattg

SEQ ID NO: 6977645 - DNA, 22 bp, Homo sapiens
gtacaggtcttatctcctagga

SEQ ID NO: 6977646 - DNA, 22 bp, Homo sapiens
gctgccatggtccaggctccag

SEQ ID NO: 6977647 - DNA, 22 bp, Homo sapiens
acttccagttttaattaaattg

SEQ ID NO: 6977648 - DNA, 22 bp, Homo sapiens
agcttctgttcatcttccaggc

SEQ ID NO: 6977649 - DNA, 22 bp, Homo sapiens
tcagatttagggtgattacctt

SEQ ID NO: 6977650 - DNA, 22 bp, Homo sapiens
ttcagaggtgggctgagaggat

SEQ ID NO: 6977651 - DNA, 22 bp, Homo sapiens
gacactccagcttttggctcaa

SEQ ID NO: 6977652 - DNA, 22 bp, Homo sapiens
tgctgtctgcaacagtactaca

SEQ ID NO: 6977653 - DNA, 22 bp, Homo sapiens
atgtccagaggcttggtcccca

SEQ ID NO: 6977654 - DNA, 21 bp, Homo sapiens
tcacttataatgtatttgctg

SEQ ID NO: 6977655 - DNA, 22 bp, Homo sapiens
tgttcgtagcacgtagtttctt

SEQ ID NO: 6977656 - DNA, 23 bp, Homo sapiens
atggtttatgtcacacttttgat

SEQ ID NO: 6977657 - DNA, 22 bp, Homo sapiens
tgttttggtggtacatgctgga

SEQ ID NO: 6977658 - DNA, 22 bp, Homo sapiens
ctattaggcttccatttcatgc

SEQ ID NO: 6977659 - DNA, 22 bp, Homo sapiens
cctgctgtgaccggggagcagg

SEQ ID NO: 6977660 - DNA, 22 bp, Homo sapiens
ggacttgagccgctcggagttc

SEQ ID NO: 6977661 - DNA, 22 bp, Homo sapiens
aaatgctgtagatcagtgagtt

SEQ ID NO: 6977662 - DNA, 22 bp, Homo sapiens
tctcctccagaggctgtgggga

SEQ ID NO: 6977663 - DNA, 22 bp, Homo sapiens
atgacagtaggtaaatgatagc

SEQ ID NO: 6977664 - DNA, 22 bp, Homo sapiens
aaatctcaatttgaattgtagc

SEQ ID NO: 6977665 - DNA, 22 bp, Homo sapiens
tcttcttaaagtatgttctctt

SEQ ID NO: 6977666 - DNA, 22 bp, Homo sapiens
tgtttacaaggagaatttgagg

SEQ ID NO: 6977667 - DNA, 22 bp, Homo sapiens
ttggtctgtagttttcttatgt

SEQ ID NO: 6977668 - DNA, 19 bp, Homo sapiens
aagctttcccattaacccc

SEQ ID NO: 6977669 - DNA, 17 bp, Homo sapiens
gggctttaggtggtgta

SEQ ID NO: 6977670 - DNA, 22 bp, Homo sapiens
gcccaagaatatttcccaagtt

SEQ ID NO: 6977671 - DNA, 22 bp, Homo sapiens
tccctgcagtagtggctaagat

SEQ ID NO: 6977672 - DNA, 22 bp, Homo sapiens
tgggccacattccaaaccagct

SEQ ID NO: 6977673 - DNA, 22 bp, Homo sapiens
tgttacacagcagaatagcaag

SEQ ID NO: 6977674 - DNA, 22 bp, Homo sapiens
agcctggcctgggcaggcacat

SEQ ID NO: 6977675 - DNA, 22 bp, Homo sapiens
ggtgttcttagtggcactggca

SEQ ID NO: 6977676 - DNA, 22 bp, Homo sapiens
tagcacagcttcttgatgtcac

SEQ ID NO: 6977677 - DNA, 22 bp, Homo sapiens
cagagacccttctcagtggcca

SEQ ID NO: 6977678 - DNA, 22 bp, Homo sapiens
aggctgtgggtgatttactgtg

SEQ ID NO: 6977679 - DNA, 22 bp, Homo sapiens
ccaccattatatctcccatgcc

SEQ ID NO: 6977680 - DNA, 22 bp, Homo sapiens
tcagctggaagatggtgcagaa

SEQ ID NO: 6977681 - DNA, 22 bp, Homo sapiens
gtgcatctgaatttgaaaatct

SEQ ID NO: 6977682 - DNA, 22 bp, Homo sapiens
aggtgcagctgacaccatgtgg

SEQ ID NO: 6977683 - DNA, 22 bp, Homo sapiens
gccctggagggccagcgactgg

SEQ ID NO: 6977684 - DNA, 22 bp, Homo sapiens
tcaacacaacagagaaatgctg

SEQ ID NO: 6977685 - DNA, 22 bp, Homo sapiens
tttgttgtgataatggtctgca

SEQ ID NO: 6977686 - DNA, 22 bp, Homo sapiens
aagtgttaaagacttgaacact

SEQ ID NO: 6977687 - DNA, 22 bp, Homo sapiens
agagggggtgtcagcactgcag

SEQ ID NO: 6977688 - DNA, 22 bp, Homo sapiens
tttgacagacatttactacatt

SEQ ID NO: 6977689 - DNA, 22 bp, Homo sapiens
tctggccagtgaaatgcagaat

SEQ ID NO: 6977690 - DNA, 22 bp, Homo sapiens
tttcagctggtaaaggagtagc

SEQ ID NO: 6977691 - DNA, 23 bp, Homo sapiens
cagggccctgctcaatttctcca

SEQ ID NO: 6977692 - DNA, 19 bp, Homo sapiens
agcggttctcaaagtcagg

SEQ ID NO: 6977693 - DNA, 22 bp, Homo sapiens
ttttagtgcctgattaatgggt

SEQ ID NO: 6977694 - DNA, 22 bp, Homo sapiens
cagtaaacaatgcctttttggg

SEQ ID NO: 6977695 - DNA, 22 bp, Homo sapiens
attggttagaagtagtatgact

SEQ ID NO: 6977696 - DNA, 22 bp, Homo sapiens
ttctggagatctgcctatggga

SEQ ID NO: 6977697 - DNA, 22 bp, Homo sapiens
ggaggtccatgtgaatgtggcc

SEQ ID NO: 6977698 - DNA, 22 bp, Homo sapiens
ggagtccaaattttttgaatca

SEQ ID NO: 6977699 - DNA, 22 bp, Homo sapiens
tgagagattgctgtatgttttg

SEQ ID NO: 6977700 - DNA, 22 bp, Homo sapiens
aaagatgttaatagcaccattt

SEQ ID NO: 6977701 - DNA, 22 bp, Homo sapiens
tgtcttatggtcttgggcttcc

SEQ ID NO: 6977702 - DNA, 22 bp, Homo sapiens
tgaggaatgttttgagtgccga

SEQ ID NO: 6977703 - DNA, 22 bp, Homo sapiens
tcagtgttacattatatagaac

SEQ ID NO: 6977704 - DNA, 22 bp, Homo sapiens
atgcaatatagggaagatagat

SEQ ID NO: 6977705 - DNA, 22 bp, Homo sapiens
actcattgggaaagtgctctct

SEQ ID NO: 6977706 - DNA, 22 bp, Homo sapiens
tgtctgagcgagaaagtagtgt

SEQ ID NO: 6977707 - DNA, 22 bp, Homo sapiens
tactggaaggctggaagtcagg

SEQ ID NO: 6977708 - DNA, 22 bp, Homo sapiens
cccaggggtatccatggagaag

SEQ ID NO: 6977709 - DNA, 22 bp, Homo sapiens
cagagccagggttgcacccctg

SEQ ID NO: 6977710 - DNA, 22 bp, Homo sapiens
agtaggaggcgggagcatgaag

SEQ ID NO: 6977711 - DNA, 22 bp, Homo sapiens
tgtgaagcattttggacagcgc

SEQ ID NO: 6977712 - DNA, 22 bp, Homo sapiens
gtactcagtaatataacatatt

SEQ ID NO: 6977713 - DNA, 22 bp, Homo sapiens
gatcaaagccagtgaggagtga

SEQ ID NO: 6977714 - DNA, 22 bp, Homo sapiens
aggctctgagtagagctgccag

SEQ ID NO: 6977715 - DNA, 22 bp, Homo sapiens
cccttgggtgccagccacaagt

SEQ ID NO: 6977716 - DNA, 22 bp, Homo sapiens
cacagcataatgaaatatactt

SEQ ID NO: 6977717 - DNA, 22 bp, Homo sapiens
gaaggagctactaataagaggg

SEQ ID NO: 6977718 - DNA, 22 bp, Homo sapiens
atgttatttattgaaacacttt

SEQ ID NO: 6977719 - DNA, 22 bp, Homo sapiens
aggagacatactataggaatat

SEQ ID NO: 6977720 - DNA, 22 bp, Homo sapiens
caccttgagggggaaaataatc

SEQ ID NO: 6977721 - DNA, 22 bp, Homo sapiens
catggcaggatctgggcccaca

SEQ ID NO: 6977722 - DNA, 22 bp, Homo sapiens
tctttgcaggagccctttgaac

SEQ ID NO: 6977723 - DNA, 18 bp, Homo sapiens
tctgccatgtgaggacac

SEQ ID NO: 6977724 - DNA, 22 bp, Homo sapiens
tgtcctggaaaaatggagagtt

SEQ ID NO: 6977725 - DNA, 22 bp, Homo sapiens
aggagccctgcgggaggcagag

SEQ ID NO: 6977726 - DNA, 22 bp, Homo sapiens
tgccatattgatgtgctgtacc

SEQ ID NO: 6977727 - DNA, 22 bp, Homo sapiens
atgatgtcatagtgtcagcagt

SEQ ID NO: 6977728 - DNA, 22 bp, Homo sapiens
tgaggccggagacaagagactt

SEQ ID NO: 6977729 - DNA, 22 bp, Homo sapiens
gtctccagttacagcagccagg

SEQ ID NO: 6977730 - DNA, 22 bp, Homo sapiens
tgccctcagtttcacatgagtg

SEQ ID NO: 6977731 - DNA, 21 bp, Homo sapiens
ggctatgattaatgactagga

SEQ ID NO: 6977732 - DNA, 22 bp, Homo sapiens
tcactggattaagcattgacat

SEQ ID NO: 6977733 - DNA, 22 bp, Homo sapiens
ctctagacaacttgctgtgggt

SEQ ID NO: 6977734 - DNA, 22 bp, Homo sapiens
ccatgtggtctgtgtagcaact

SEQ ID NO: 6977735 - DNA, 19 bp, Homo sapiens
tatttacttcttgattgca

SEQ ID NO: 6977736 - DNA, 22 bp, Homo sapiens
gcctttcacagagatttaaaaa

SEQ ID NO: 6977737 - DNA, 18 bp, Homo sapiens
tgcatgccaggttctgtg

SEQ ID NO: 6977738 - DNA, 22 bp, Homo sapiens
ggcaagggttgaagataaggta

SEQ ID NO: 6977739 - DNA, 22 bp, Homo sapiens
caatgatagattttacaaatta

SEQ ID NO: 6977740 - DNA, 22 bp, Homo sapiens
agcctctgcacgggcacgggtg

SEQ ID NO: 6977741 - DNA, 22 bp, Homo sapiens
ctcttcaaaagatgtattagaa

SEQ ID NO: 6977742 - DNA, 22 bp, Homo sapiens
ccgcggggcgtgggctcttacc

SEQ ID NO: 6977743 - DNA, 22 bp, Homo sapiens
gttagcacaaccaagaaatgcg

SEQ ID NO: 6977744 - DNA, 22 bp, Homo sapiens
tgctacataccacgatgcagta

SEQ ID NO: 6977745 - DNA, 22 bp, Homo sapiens
tcttgaagaggaagtggagtag

SEQ ID NO: 6977746 - DNA, 22 bp, Homo sapiens
gacattctaaaaaatatggaag

SEQ ID NO: 6977747 - DNA, 22 bp, Homo sapiens
cagggagtgtacaccatgtgta

SEQ ID NO: 6977748 - DNA, 22 bp, Homo sapiens
gactatgtgaagtgtgaatagg

SEQ ID NO: 6977749 - DNA, 22 bp, Homo sapiens
cttgttgcaaacattcactcca

SEQ ID NO: 6977750 - DNA, 22 bp, Homo sapiens
tcagtgttcttatttaattagg

SEQ ID NO: 6977751 - DNA, 22 bp, Homo sapiens
tgtgacctcatcttaactggaa

SEQ ID NO: 6977752 - DNA, 22 bp, Homo sapiens
tgaggattgagtcaagcagtat

SEQ ID NO: 6977753 - DNA, 22 bp, Homo sapiens
gacctgtgaccattctgggtag

SEQ ID NO: 6977754 - DNA, 22 bp, Homo sapiens
cttgtgcttttatgaatgcaga

SEQ ID NO: 6977755 - DNA, 22 bp, Homo sapiens
tgacaagtacataatttcatgt

SEQ ID NO: 6977756 - DNA, 22 bp, Homo sapiens
tctatgtctctggaaggagtgt

SEQ ID NO: 6977757 - DNA, 22 bp, Homo sapiens
tggctgtcagctgcctggtgcg

SEQ ID NO: 6977758 - DNA, 22 bp, Homo sapiens
gggaaattgtaacaagtctgtt

SEQ ID NO: 6977759 - DNA, 22 bp, Homo sapiens
ctccttcctgcagatctgagat

SEQ ID NO: 6977760 - DNA, 22 bp, Homo sapiens
tggggctgaggagcctcactct

SEQ ID NO: 6977761 - DNA, 22 bp, Homo sapiens
ccagatggtttgcatgggaggg

SEQ ID NO: 6977762 - DNA, 19 bp, Homo sapiens
ggcagtcacggtcaggagc

SEQ ID NO: 6977763 - DNA, 22 bp, Homo sapiens
ctggtacagggaaataaaggaa

SEQ ID NO: 6977764 - DNA, 21 bp, Homo sapiens
tctgaggagaaactcttggtg

SEQ ID NO: 6977765 - DNA, 21 bp, Homo sapiens
gcctgtggagcccaagggccc

SEQ ID NO: 6977766 - DNA, 22 bp, Homo sapiens
tatttctcagcattttacatcc

SEQ ID NO: 6977767 - DNA, 22 bp, Homo sapiens
ttcctggctggcggttttggtg

SEQ ID NO: 6977768 - DNA, 22 bp, Homo sapiens
atttcgatagacctaacaattg

SEQ ID NO: 6977769 - DNA, 22 bp, Homo sapiens
gaaagcagtatttagttctgtt

SEQ ID NO: 6977770 - DNA, 22 bp, Homo sapiens
aaggaagggaaatagtgatgtc

SEQ ID NO: 6977771 - DNA, 22 bp, Homo sapiens
aagtgctcagggaacatttgtt

SEQ ID NO: 6977772 - DNA, 22 bp, Homo sapiens
gggggcggagcacgtgaccacg

SEQ ID NO: 6977773 - DNA, 22 bp, Homo sapiens
cttgaatccaaatgggagatga

SEQ ID NO: 6977774 - DNA, 22 bp, Homo sapiens
catgagactgccttttcaaacc

SEQ ID NO: 6977775 - DNA, 22 bp, Homo sapiens
agccacctggacacaggcttgc

SEQ ID NO: 6977776 - DNA, 22 bp, Homo sapiens
actctgggcccaccctcagagt

SEQ ID NO: 6977777 - DNA, 22 bp, Homo sapiens
gcagtccattgacagaggtctt

SEQ ID NO: 6977778 - DNA, 22 bp, Homo sapiens
ttattgagttgtaagagctctt

SEQ ID NO: 6977779 - DNA, 22 bp, Homo sapiens
tgtgctctgtggatctgagcaa

SEQ ID NO: 6977780 - DNA, 22 bp, Homo sapiens
gagctctgggaaacaaagtgta

SEQ ID NO: 6977781 - DNA, 22 bp, Homo sapiens
ggctggagtgggctccagagtt

SEQ ID NO: 6977782 - DNA, 22 bp, Homo sapiens
aagttatcagaatgctgctttc

SEQ ID NO: 6977783 - DNA, 22 bp, Homo sapiens
ggacagtagtcactaaactaga

SEQ ID NO: 6977784 - DNA, 22 bp, Homo sapiens
agggcagagatctgagtgggca

SEQ ID NO: 6977785 - DNA, 22 bp, Homo sapiens
ctgaccctggtcaagttgcctc

SEQ ID NO: 6977786 - DNA, 22 bp, Homo sapiens
ctgccatgtgtgaaaggggagg

SEQ ID NO: 6977787 - DNA, 22 bp, Homo sapiens
tatgtagatgtcatataaattg

SEQ ID NO: 6977788 - DNA, 22 bp, Homo sapiens
tgagttctccaggaagcagact

SEQ ID NO: 6977789 - DNA, 22 bp, Homo sapiens
atgtttaatcggctgcctttcc

SEQ ID NO: 6977790 - DNA, 20 bp, Homo sapiens
cctgtgctgccctcggggcc

SEQ ID NO: 6977791 - DNA, 22 bp, Homo sapiens
attctctgtctttttgaaaaca

SEQ ID NO: 6977792 - DNA, 22 bp, Homo sapiens
tggcttctttgtagaaattgaa

SEQ ID NO: 6977793 - DNA, 22 bp, Homo sapiens
ccatctgtatctgacaaattct

SEQ ID NO: 6977794 - DNA, 22 bp, Homo sapiens
gtgtgccagacatgatgctatg

SEQ ID NO: 6977795 - DNA, 22 bp, Homo sapiens
ttgaatagttttggatagcata

SEQ ID NO: 6977796 - DNA, 22 bp, Homo sapiens
aatcttcacagagaaaattagg

SEQ ID NO: 6977797 - DNA, 22 bp, Homo sapiens
ggtccaggtttgctctacttgt

SEQ ID NO: 6977798 - DNA, 22 bp, Homo sapiens
gctttcttttcaagaatgtatt

SEQ ID NO: 6977799 - DNA, 18 bp, Homo sapiens
gccaggaagcatggggac

SEQ ID NO: 6977800 - DNA, 22 bp, Homo sapiens
ccttccagtgatatgcgtgaat

SEQ ID NO: 6977801 - DNA, 22 bp, Homo sapiens
agcttccacatctgtcttcagt

SEQ ID NO: 6977802 - DNA, 22 bp, Homo sapiens
ggcccagcatcttgtgaagttt

SEQ ID NO: 6977803 - DNA, 22 bp, Homo sapiens
acaggtgaagtattacactaag

SEQ ID NO: 6977804 - DNA, 22 bp, Homo sapiens
ttcacaatgccagcaaccactt

SEQ ID NO: 6977805 - DNA, 22 bp, Homo sapiens
tggagtcagagggggaagtcac

SEQ ID NO: 6977806 - DNA, 22 bp, Homo sapiens
acaatgaaaaaatttactgtgg

SEQ ID NO: 6977807 - DNA, 16 bp, Homo sapiens
ggtgaagcattatgtc

SEQ ID NO: 6977808 - DNA, 22 bp, Homo sapiens
atgcctccgcatgtgcctttga

SEQ ID NO: 6977809 - DNA, 22 bp, Homo sapiens
catgaccccccaaggcctgcag

SEQ ID NO: 6977810 - DNA, 22 bp, Homo sapiens
aatgtggagtaggtagttgggc

SEQ ID NO: 6977811 - DNA, 22 bp, Homo sapiens
aatgcattaaagttagagactt

SEQ ID NO: 6977812 - DNA, 22 bp, Homo sapiens
gggctcgaagcgctggtggttg

SEQ ID NO: 6977813 - DNA, 22 bp, Homo sapiens
gggcagtcacagtgctggagca

SEQ ID NO: 6977814 - DNA, 22 bp, Homo sapiens
gctctgtgggtgagtagaatct

SEQ ID NO: 6977815 - DNA, 22 bp, Homo sapiens
ttgcactataggaaaatgtgtc

SEQ ID NO: 6977816 - DNA, 22 bp, Homo sapiens
atacaggttctctagggaacag

SEQ ID NO: 6977817 - DNA, 22 bp, Homo sapiens
cagctctgttcaaactatccag

SEQ ID NO: 6977818 - DNA, 22 bp, Homo sapiens
gcagtagcagcctagatgccat

SEQ ID NO: 6977819 - DNA, 22 bp, Homo sapiens
gcagagttgatgcaagtactga

SEQ ID NO: 6977820 - DNA, 22 bp, Homo sapiens
agagttgctaatgtgcagaata

SEQ ID NO: 6977821 - DNA, 22 bp, Homo sapiens
tctctgcacttgcacataagct

SEQ ID NO: 6977822 - DNA, 22 bp, Homo sapiens
atgaattaaggataactggtct

SEQ ID NO: 6977823 - DNA, 22 bp, Homo sapiens
caagtctagcttggtcacttgg

SEQ ID NO: 6977824 - DNA, 22 bp, Homo sapiens
catgtacaaggatgctcagagt

SEQ ID NO: 6977825 - DNA, 22 bp, Homo sapiens
gtatttgatacatgaaatggtg

SEQ ID NO: 6977826 - DNA, 22 bp, Homo sapiens
attcttgtaaattttgtgtgaa

SEQ ID NO: 6977827 - DNA, 22 bp, Homo sapiens
gcccccaggcactacatgtgaa

SEQ ID NO: 6977828 - DNA, 22 bp, Homo sapiens
gttcatttatgatgtaacatgt

SEQ ID NO: 6977829 - DNA, 22 bp, Homo sapiens
tcacaagacaagacaaattgca

SEQ ID NO: 6977830 - DNA, 22 bp, Homo sapiens
tgtattagagcatataatttga

SEQ ID NO: 6977831 - DNA, 22 bp, Homo sapiens
ctgataggatttagtttctgtt

SEQ ID NO: 6977832 - DNA, 19 bp, Homo sapiens
tgctggagtgacattctga

SEQ ID NO: 6977833 - DNA, 22 bp, Homo sapiens
atcttcaaagggatgtccatgg

SEQ ID NO: 6977834 - DNA, 22 bp, Homo sapiens
gcaagcagactgggcccctgtg

SEQ ID NO: 6977835 - DNA, 22 bp, Homo sapiens
aacagtttgagctttgaatttc

SEQ ID NO: 6977836 - DNA, 22 bp, Homo sapiens
tgccatcactgaacttctgaaa

SEQ ID NO: 6977837 - DNA, 19 bp, Homo sapiens
tctctgcttctcttggcat

SEQ ID NO: 6977838 - DNA, 22 bp, Homo sapiens
tcctgtggtcagacattgccaa

SEQ ID NO: 6977839 - DNA, 22 bp, Homo sapiens
aggccctaatccaacatgactg

SEQ ID NO: 6977840 - DNA, 22 bp, Homo sapiens
agtgagcaagacttcgttgtcc

SEQ ID NO: 6977841 - DNA, 18 bp, Homo sapiens
tgagacagctaccacttg

SEQ ID NO: 6977842 - DNA, 22 bp, Homo sapiens
gtgtcagaaacaggaaggggaa

SEQ ID NO: 6977843 - DNA, 22 bp, Homo sapiens
ttccaatccaaacttcaccttt

SEQ ID NO: 6977844 - DNA, 22 bp, Homo sapiens
tgaacacatctgcgtgtgtctc

SEQ ID NO: 6977845 - DNA, 22 bp, Homo sapiens
ttttgtgtccttcacatcatgt

SEQ ID NO: 6977846 - DNA, 22 bp, Homo sapiens
agctgtttgtacttagatagta

SEQ ID NO: 6977847 - DNA, 22 bp, Homo sapiens
cagcaggaggtgagtagcaggt

SEQ ID NO: 6977848 - DNA, 22 bp, Homo sapiens
caggaagaggacaggcttcccc

SEQ ID NO: 6977849 - DNA, 22 bp, Homo sapiens
atagacacatgttattatactt

SEQ ID NO: 6977850 - DNA, 22 bp, Homo sapiens
tgaacgttcatagttatttgtt

SEQ ID NO: 6977851 - DNA, 22 bp, Homo sapiens
agagacttctgccttagcaaga

SEQ ID NO: 6977852 - DNA, 22 bp, Homo sapiens
ttcttttaatagagatcctgtg

SEQ ID NO: 6977853 - DNA, 22 bp, Homo sapiens
ccactgcactccagcctgccaa

SEQ ID NO: 6977854 - DNA, 22 bp, Homo sapiens
ggcaattcataatcggttaacc

SEQ ID NO: 6977855 - DNA, 22 bp, Homo sapiens
cctgtggctgccacttgggtga

SEQ ID NO: 6977856 - DNA, 22 bp, Homo sapiens
tgctcaggaggaggctgtgagg

SEQ ID NO: 6977857 - DNA, 22 bp, Homo sapiens
tcctcagggggccaacccagcc

SEQ ID NO: 6977858 - DNA, 22 bp, Homo sapiens
cgggtggagacagagggcataa

SEQ ID NO: 6977859 - DNA, 22 bp, Homo sapiens
aggcagatgtgattaatttcct

SEQ ID NO: 6977860 - DNA, 22 bp, Homo sapiens
ttttagctgttgattgttcccc

SEQ ID NO: 6977861 - DNA, 22 bp, Homo sapiens
tagggatgaagttgctatttac

SEQ ID NO: 6977862 - DNA, 22 bp, Homo sapiens
ggcagagactgggttggcagag

SEQ ID NO: 6977863 - DNA, 22 bp, Homo sapiens
tcagactgactagtcaatgaaa

SEQ ID NO: 6977864 - DNA, 22 bp, Homo sapiens
agtgtgagtgctcatgtccatc

SEQ ID NO: 6977865 - DNA, 22 bp, Homo sapiens
ttccttgagatgactgtcttgt

SEQ ID NO: 6977866 - DNA, 22 bp, Homo sapiens
aagcatgaatcgactcggcaac

SEQ ID NO: 6977867 - DNA, 21 bp, Homo sapiens
aatgatgaaagatgacagagt

SEQ ID NO: 6977868 - DNA, 22 bp, Homo sapiens
gcattaaatgctagggacctaa

SEQ ID NO: 6977869 - DNA, 17 bp, Homo sapiens
agggagtcagaggatcg

SEQ ID NO: 6977870 - DNA, 22 bp, Homo sapiens
aagtgtagattatggagtgtct

SEQ ID NO: 6977871 - DNA, 22 bp, Homo sapiens
caccatgcccggctaattttgg

SEQ ID NO: 6977872 - DNA, 22 bp, Homo sapiens
agggctttgagaatagtggaac

SEQ ID NO: 6977873 - DNA, 22 bp, Homo sapiens
gttcttcctcattgctttgaag

SEQ ID NO: 6977874 - DNA, 22 bp, Homo sapiens
gagcatccatgactttggcttt

SEQ ID NO: 6977875 - DNA, 23 bp, Homo sapiens
cctgaagggtcagggtcctcagc

SEQ ID NO: 6977876 - DNA, 22 bp, Homo sapiens
gctttgcacaacctttaagaca

SEQ ID NO: 6977877 - DNA, 22 bp, Homo sapiens
gaattccttccagaccctgtac

SEQ ID NO: 6977878 - DNA, 22 bp, Homo sapiens
tcatgtgtctgctgcagctgtt

SEQ ID NO: 6977879 - DNA, 17 bp, Homo sapiens
acaggcagatcacctga

SEQ ID NO: 6977880 - DNA, 22 bp, Homo sapiens
ttctgtcagctgctttgtctca

SEQ ID NO: 6977881 - DNA, 22 bp, Homo sapiens
acaggtctccagagtgagagga

SEQ ID NO: 6977882 - DNA, 23 bp, Homo sapiens
agtctgtgcttggtgggagggcc

SEQ ID NO: 6977883 - DNA, 22 bp, Homo sapiens
cactggtcagcatggtagacca

SEQ ID NO: 6977884 - DNA, 22 bp, Homo sapiens
tgcccacacctgggggaggctg

SEQ ID NO: 6977885 - DNA, 22 bp, Homo sapiens
ctaggctgtgcattgcatgaca

SEQ ID NO: 6977886 - DNA, 22 bp, Homo sapiens
tgtgatctgccttggatctgca

SEQ ID NO: 6977887 - DNA, 22 bp, Homo sapiens
aggaagcctgcaggtgactgct

SEQ ID NO: 6977888 - DNA, 22 bp, Homo sapiens
cttgttgctaacatatgcttct

SEQ ID NO: 6977889 - DNA, 22 bp, Homo sapiens
cacagaggaatgcatcagcaga

SEQ ID NO: 6977890 - DNA, 22 bp, Homo sapiens
taggatttactttgacaatatt

SEQ ID NO: 6977891 - DNA, 22 bp, Homo sapiens
tgcctgcctgcatagtcccacg

SEQ ID NO: 6977892 - DNA, 22 bp, Homo sapiens
gggatgctggtgcctgtggcac

SEQ ID NO: 6977893 - DNA, 22 bp, Homo sapiens
aggctcctagcctgtggctggt

SEQ ID NO: 6977894 - DNA, 22 bp, Homo sapiens
aagatttccttcagtagagcta

SEQ ID NO: 6977895 - DNA, 22 bp, Homo sapiens
gatttctttgcaagctgtgttc

SEQ ID NO: 6977896 - DNA, 22 bp, Homo sapiens
ctggggtggagattggcaatct

SEQ ID NO: 6977897 - DNA, 22 bp, Homo sapiens
tttttgtctagcgtctctagtt

SEQ ID NO: 6977898 - DNA, 22 bp, Homo sapiens
cctggagcaaaaatctaaggag

SEQ ID NO: 6977899 - DNA, 22 bp, Homo sapiens
ctagacagaggcaagcgcatta

SEQ ID NO: 6977900 - DNA, 22 bp, Homo sapiens
tgtcaagagctgttgaggctga

SEQ ID NO: 6977901 - DNA, 22 bp, Homo sapiens
atcatcatcaacaagaaacatt

SEQ ID NO: 6977902 - DNA, 22 bp, Homo sapiens
gtattgtatatttgcaaataca

SEQ ID NO: 6977903 - DNA, 22 bp, Homo sapiens
acagaagataatgctgccttgg

SEQ ID NO: 6977904 - DNA, 22 bp, Homo sapiens
accccagctctgagccacacca

SEQ ID NO: 6977905 - DNA, 20 bp, Homo sapiens
ggcatccttttggtcacagc

SEQ ID NO: 6977906 - DNA, 22 bp, Homo sapiens
ttacaagttcagattttctcat

SEQ ID NO: 6977907 - DNA, 22 bp, Homo sapiens
gctggagtccctgcctttcctt

SEQ ID NO: 6977908 - DNA, 22 bp, Homo sapiens
tcctcagacttccctttgtgta

SEQ ID NO: 6977909 - DNA, 22 bp, Homo sapiens
gagagacagcacacagtgtggg

SEQ ID NO: 6977910 - DNA, 22 bp, Homo sapiens
tgtggctgctcaggtgcagacc

SEQ ID NO: 6977911 - DNA, 22 bp, Homo sapiens
atggggctgttctctgccctgc

SEQ ID NO: 6977912 - DNA, 22 bp, Homo sapiens
gtgggagagaccccgcttaggg

SEQ ID NO: 6977913 - DNA, 22 bp, Homo sapiens
actgtgcatttcatgtcttttc

SEQ ID NO: 6977914 - DNA, 22 bp, Homo sapiens
aagcaggttacatacattatct

SEQ ID NO: 6977915 - DNA, 22 bp, Homo sapiens
agctctggggtggagcccagga

SEQ ID NO: 6977916 - DNA, 22 bp, Homo sapiens
cagcccccatggggaggtcaag

SEQ ID NO: 6977917 - DNA, 22 bp, Homo sapiens
agctgtaatataagcaatgaaa

SEQ ID NO: 6977918 - DNA, 20 bp, Homo sapiens
atggggtgagtgacgccctc

SEQ ID NO: 6977919 - DNA, 22 bp, Homo sapiens
ctgactgggttaagttcatgta

SEQ ID NO: 6977920 - DNA, 22 bp, Homo sapiens
ttaatggcagggcagaatatta

SEQ ID NO: 6977921 - DNA, 22 bp, Homo sapiens
acattgtagttgttctgcagca

SEQ ID NO: 6977922 - DNA, 22 bp, Homo sapiens
ttggccagtgcttgtgattttc

SEQ ID NO: 6977923 - DNA, 22 bp, Homo sapiens
cacgaaatctaggagagtaaca

SEQ ID NO: 6977924 - DNA, 17 bp, Homo sapiens
tgctcctgtggcagcct

SEQ ID NO: 6977925 - DNA, 22 bp, Homo sapiens
tctcagggagagctgctggcat

SEQ ID NO: 6977926 - DNA, 22 bp, Homo sapiens
tgacatcagaatggcatagaaa

SEQ ID NO: 6977927 - DNA, 22 bp, Homo sapiens
gtctggcttttgccctgtgttt

SEQ ID NO: 6977928 - DNA, 22 bp, Homo sapiens
gctgtttctaccagaagaatca

SEQ ID NO: 6977929 - DNA, 20 bp, Homo sapiens
gctgaggtcattatgcctca

SEQ ID NO: 6977930 - DNA, 22 bp, Homo sapiens
ttgtaactgtgggttgattaga

SEQ ID NO: 6977931 - DNA, 22 bp, Homo sapiens
tgggctagatttggtgacccag

SEQ ID NO: 6977932 - DNA, 22 bp, Homo sapiens
gcgctgaggctggaggcgcacg

SEQ ID NO: 6977933 - DNA, 22 bp, Homo sapiens
atcaaggctattatcttgtcag

SEQ ID NO: 6977934 - DNA, 20 bp, Homo sapiens
gctcagggaattcaggaagc

SEQ ID NO: 6977935 - DNA, 22 bp, Homo sapiens
tacaacatgtaaagtggtttaa

SEQ ID NO: 6977936 - DNA, 22 bp, Homo sapiens
tgcttagatgaggcagcaggag

SEQ ID NO: 6977937 - DNA, 22 bp, Homo sapiens
aggctggaggtttgttgcggct

SEQ ID NO: 6977938 - DNA, 23 bp, Homo sapiens
acttccagttataggaactcttc

SEQ ID NO: 6977939 - DNA, 22 bp, Homo sapiens
cttccccaagtagagaggggag

SEQ ID NO: 6977940 - DNA, 22 bp, Homo sapiens
cctgacagttaattgtcctgta

SEQ ID NO: 6977941 - DNA, 22 bp, Homo sapiens
aatgttctgggagagaagctgt

SEQ ID NO: 6977942 - DNA, 22 bp, Homo sapiens
ttcattcagcacatatttattg

SEQ ID NO: 6977943 - DNA, 22 bp, Homo sapiens
tgtaccaggtgatggagtcata

SEQ ID NO: 6977944 - DNA, 22 bp, Homo sapiens
gatgacatctcaatttgttctt

SEQ ID NO: 6977945 - DNA, 22 bp, Homo sapiens
tcttatatgcacatacattggg

SEQ ID NO: 6977946 - DNA, 22 bp, Homo sapiens
aacatttattgagcacctactg

SEQ ID NO: 6977947 - DNA, 22 bp, Homo sapiens
aggtatatgctattacttctgc

SEQ ID NO: 6977948 - DNA, 22 bp, Homo sapiens
ccactgtatcttccttgaattt

SEQ ID NO: 6977949 - DNA, 22 bp, Homo sapiens
agacagtgatgtaagcaggagt

SEQ ID NO: 6977950 - DNA, 22 bp, Homo sapiens
acatcctcccgatctactggct

SEQ ID NO: 6977951 - DNA, 22 bp, Homo sapiens
acgtagaaaccaaatagcatca

SEQ ID NO: 6977952 - DNA, 22 bp, Homo sapiens
acagaggttaggatgggttgta

SEQ ID NO: 6977953 - DNA, 22 bp, Homo sapiens
ggaatgcagtaagtgatttgaa

SEQ ID NO: 6977954 - DNA, 21 bp, Homo sapiens
tctggctttcattccccttct

SEQ ID NO: 6977955 - DNA, 22 bp, Homo sapiens
atgatggatatgtaaagtgttg

SEQ ID NO: 6977956 - DNA, 22 bp, Homo sapiens
aggcttgtctcagaagatgctg

SEQ ID NO: 6977957 - DNA, 18 bp, Homo sapiens
gcacagctaggagggtcc

SEQ ID NO: 6977958 - DNA, 22 bp, Homo sapiens
tccaggacttggcaggagatga

SEQ ID NO: 6977959 - DNA, 22 bp, Homo sapiens
ttgcttgcttcttgggagtggt

SEQ ID NO: 6977960 - DNA, 22 bp, Homo sapiens
cttcagcagatgcaaaacccct

SEQ ID NO: 6977961 - DNA, 20 bp, Homo sapiens
ggcaagcaactgagggagga

SEQ ID NO: 6977962 - DNA, 22 bp, Homo sapiens
aggctggagacccgccaagaaa

SEQ ID NO: 6977963 - DNA, 22 bp, Homo sapiens
gacctcatctgaacatatgcaa

SEQ ID NO: 6977964 - DNA, 22 bp, Homo sapiens
ttccagaaggaagccggggagc

SEQ ID NO: 6977965 - DNA, 22 bp, Homo sapiens
caagacctcaaaatgagagggg

SEQ ID NO: 6977966 - DNA, 22 bp, Homo sapiens
tatgtgaatacagcagtggatg

SEQ ID NO: 6977967 - DNA, 22 bp, Homo sapiens
tatcatgcttaccattttcaaa

SEQ ID NO: 6977968 - DNA, 22 bp, Homo sapiens
acagctgattggatcaaggaca

SEQ ID NO: 6977969 - DNA, 22 bp, Homo sapiens
agaaatcttggagtctgtggta

SEQ ID NO: 6977970 - DNA, 22 bp, Homo sapiens
tggcctggccacatccagcagg

SEQ ID NO: 6977971 - DNA, 22 bp, Homo sapiens
ttgacctatgtttcttcatctg

SEQ ID NO: 6977972 - DNA, 22 bp, Homo sapiens
ctcacaggttagttgtgtggat

SEQ ID NO: 6977973 - DNA, 22 bp, Homo sapiens
aaagctgtagaatcatcttaat

SEQ ID NO: 6977974 - DNA, 22 bp, Homo sapiens
tggtggcttctgaggatggcga

SEQ ID NO: 6977975 - DNA, 22 bp, Homo sapiens
tgcctggcaactgtggtgggct

SEQ ID NO: 6977976 - DNA, 22 bp, Homo sapiens
ggtgcaggacgaagtgggggtt

SEQ ID NO: 6977977 - DNA, 20 bp, Homo sapiens
aggctcactcaccttgtgga

SEQ ID NO: 6977978 - DNA, 22 bp, Homo sapiens
aggattaaagtatatttttgag

SEQ ID NO: 6977979 - DNA, 22 bp, Homo sapiens
tttcttcaattgctaacaagga

SEQ ID NO: 6977980 - DNA, 22 bp, Homo sapiens
acatctggaaagttacttgaga

SEQ ID NO: 6977981 - DNA, 22 bp, Homo sapiens
cagcaacctaaatccactaact

SEQ ID NO: 6977982 - DNA, 22 bp, Homo sapiens
tgtagaaagctcttctgaaatc

SEQ ID NO: 6977983 - DNA, 22 bp, Homo sapiens
aaggtattggcagggctgagtt

SEQ ID NO: 6977984 - DNA, 22 bp, Homo sapiens
tcattgtcagctcttgacttct

SEQ ID NO: 6977985 - DNA, 22 bp, Homo sapiens
ttttcgttggtcattccccagc

SEQ ID NO: 6977986 - DNA, 22 bp, Homo sapiens
aggcagtgtattgctagcggct

SEQ ID NO: 6977987 - DNA, 22 bp, Homo sapiens
cacattgaaatgacccaataat

SEQ ID NO: 6977988 - DNA, 22 bp, Homo sapiens
cacaatttgtattttgcatcca

SEQ ID NO: 6977989 - DNA, 15 bp, Homo sapiens
tgtggctggctcctg

SEQ ID NO: 6977990 - DNA, 22 bp, Homo sapiens
ttttctggtcacatgttattaa

SEQ ID NO: 6977991 - DNA, 22 bp, Homo sapiens
ggcctggagtttggggaataga

SEQ ID NO: 6977992 - DNA, 22 bp, Homo sapiens
ttattcactcatttaacattat

SEQ ID NO: 6977993 - DNA, 22 bp, Homo sapiens
tccctctacagggaagcgcttt

SEQ ID NO: 6977994 - DNA, 22 bp, Homo sapiens
tctgggaagacggatggaccct

SEQ ID NO: 6977995 - DNA, 22 bp, Homo sapiens
ttctgtgtgcttactggtgttc

SEQ ID NO: 6977996 - DNA, 22 bp, Homo sapiens
ggtgccctgccaggatgtgcca

SEQ ID NO: 6977997 - DNA, 22 bp, Homo sapiens
atgcaaaataaggcagaaacat

SEQ ID NO: 6977998 - DNA, 22 bp, Homo sapiens
gacctactgtgtgcccagcatg

SEQ ID NO: 6977999 - DNA, 22 bp, Homo sapiens
ctggcagttggcagggctgcca

SEQ ID NO: 6978000 - DNA, 22 bp, Homo sapiens
aaacaagctgcagacaagccat

SEQ ID NO: 6978001 - DNA, 18 bp, Homo sapiens
gttcccagatggtgctga

SEQ ID NO: 6978002 - DNA, 22 bp, Homo sapiens
gacacagtagccagtgcagtga

SEQ ID NO: 6978003 - DNA, 22 bp, Homo sapiens
agaccgagaagttctccaggcc

SEQ ID NO: 6978004 - DNA, 21 bp, Homo sapiens
tctgatatatccccaagttac

SEQ ID NO: 6978005 - DNA, 22 bp, Homo sapiens
aggaagaggtagctgtcaaggg

SEQ ID NO: 6978006 - DNA, 22 bp, Homo sapiens
ctgcttctaagaacctgcagct

SEQ ID NO: 6978007 - DNA, 22 bp, Homo sapiens
ggtctgtctttatatctggttc

SEQ ID NO: 6978008 - DNA, 22 bp, Homo sapiens
tttcttctctaatctcaatgat

SEQ ID NO: 6978009 - DNA, 22 bp, Homo sapiens
ttctgaggctttcccgtcccct

SEQ ID NO: 6978010 - DNA, 22 bp, Homo sapiens
tttgtcataactctgctgcaag

SEQ ID NO: 6978011 - DNA, 21 bp, Homo sapiens
aagtgcaagatgcgcgcttgc

SEQ ID NO: 6978012 - DNA, 22 bp, Homo sapiens
ctttcagtcagttaactcagaa

SEQ ID NO: 6978013 - DNA, 22 bp, Homo sapiens
ttgtttaatgcctcatacatct

SEQ ID NO: 6978014 - DNA, 22 bp, Homo sapiens
catgaaagcaggaatggtttta

SEQ ID NO: 6978015 - DNA, 22 bp, Homo sapiens
cctagggaaacagagtccacac

SEQ ID NO: 6978016 - DNA, 22 bp, Homo sapiens
tattgtctcacagttttggagg

SEQ ID NO: 6978017 - DNA, 19 bp, Homo sapiens
tgctcagctcctgtgagtc

SEQ ID NO: 6978018 - DNA, 22 bp, Homo sapiens
tgttctttgccagtgatttaat

SEQ ID NO: 6978019 - DNA, 19 bp, Homo sapiens
cctgcagggatgagaggtt

SEQ ID NO: 6978020 - DNA, 22 bp, Homo sapiens
tttctcagcgttcttagggctc

SEQ ID NO: 6978021 - DNA, 22 bp, Homo sapiens
agggccagctgatgagaatgag

SEQ ID NO: 6978022 - DNA, 22 bp, Homo sapiens
gctggtgagattttatgtttcc

SEQ ID NO: 6978023 - DNA, 20 bp, Homo sapiens
ctccatgacttgaattagta

SEQ ID NO: 6978024 - DNA, 22 bp, Homo sapiens
gagtcctggagaaacgcaggtg

SEQ ID NO: 6978025 - DNA, 23 bp, Homo sapiens
tgagcaagtgaccaactgtctgt

SEQ ID NO: 6978026 - DNA, 22 bp, Homo sapiens
atggtttattgctttaatgaaa

SEQ ID NO: 6978027 - DNA, 22 bp, Homo sapiens
gcgtatgtttactccaaaacag

SEQ ID NO: 6978028 - DNA, 22 bp, Homo sapiens
agttgtgagaaacagaatgagc

SEQ ID NO: 6978029 - DNA, 22 bp, Homo sapiens
gttcttaaccttctttggttgt

SEQ ID NO: 6978030 - DNA, 22 bp, Homo sapiens
agactctgcatttctaataagc

SEQ ID NO: 6978031 - DNA, 22 bp, Homo sapiens
cttagcaaatgcctgtgctgct

SEQ ID NO: 6978032 - DNA, 22 bp, Homo sapiens
tccagtccatggcctcagtctt

SEQ ID NO: 6978033 - DNA, 17 bp, Homo sapiens
ttaagcatgtaatctgc

SEQ ID NO: 6978034 - DNA, 22 bp, Homo sapiens
ggagggttagcaaaggcacaga

SEQ ID NO: 6978035 - DNA, 22 bp, Homo sapiens
ctgggtgtagcccagtatgagg

SEQ ID NO: 6978036 - DNA, 22 bp, Homo sapiens
tcaaagacagacatcagtcaaa

SEQ ID NO: 6978037 - DNA, 23 bp, Homo sapiens
cctgcctccccatcagttataca

SEQ ID NO: 6978038 - DNA, 22 bp, Homo sapiens
ctgctggcaagcccagttggag

SEQ ID NO: 6978039 - DNA, 22 bp, Homo sapiens
ttggtcttttctattaaatata

SEQ ID NO: 6978040 - DNA, 20 bp, Homo sapiens
agcaggctgcagggtgaaat

SEQ ID NO: 6978041 - DNA, 22 bp, Homo sapiens
tcttaaagagcgcaatttgagg

SEQ ID NO: 6978042 - DNA, 22 bp, Homo sapiens
atgacctacaacctagcatgat

SEQ ID NO: 6978043 - DNA, 22 bp, Homo sapiens
ttcagcaactgagtgtctttta

SEQ ID NO: 6978044 - DNA, 22 bp, Homo sapiens
cttggcctgtggctcaagaatt

SEQ ID NO: 6978045 - DNA, 17 bp, Homo sapiens
tgtgtaagttgcataga

SEQ ID NO: 6978046 - DNA, 22 bp, Homo sapiens
ccaggcctgtgttgtgtggagg

SEQ ID NO: 6978047 - DNA, 22 bp, Homo sapiens
atagagttttattttccaataa

SEQ ID NO: 6978048 - DNA, 22 bp, Homo sapiens
tggcatggcatttagagaatta

SEQ ID NO: 6978049 - DNA, 22 bp, Homo sapiens
ttctgaaatgagatataaggta

SEQ ID NO: 6978050 - DNA, 22 bp, Homo sapiens
tctgttttgtaccagatacagc

SEQ ID NO: 6978051 - DNA, 22 bp, Homo sapiens
tttgggaacttggttcagggaa

SEQ ID NO: 6978052 - DNA, 22 bp, Homo sapiens
tccagactggggccatgtctgc

SEQ ID NO: 6978053 - DNA, 22 bp, Homo sapiens
ttcttaagtgagaaagcaggag

SEQ ID NO: 6978054 - DNA, 22 bp, Homo sapiens
gagcactcaggacactcatagg

SEQ ID NO: 6978055 - DNA, 19 bp, Homo sapiens
gagtcctgtgctccttgtt

SEQ ID NO: 6978056 - DNA, 21 bp, Homo sapiens
ggagctggggagctggcccca

SEQ ID NO: 6978057 - DNA, 22 bp, Homo sapiens
tttaggcacagggagttggttt

SEQ ID NO: 6978058 - DNA, 22 bp, Homo sapiens
aatgactttgaaatatttgagt

SEQ ID NO: 6978059 - DNA, 22 bp, Homo sapiens
agcatccagcatcctatagaaa

SEQ ID NO: 6978060 - DNA, 22 bp, Homo sapiens
aggcctcatagtagacctgccc

SEQ ID NO: 6978061 - DNA, 22 bp, Homo sapiens
ctggcccctgtggctaaaatca

SEQ ID NO: 6978062 - DNA, 22 bp, Homo sapiens
ccctatcctgcaggcctgggct

SEQ ID NO: 6978063 - DNA, 22 bp, Homo sapiens
tgtgttctgaaggagaagagtg

SEQ ID NO: 6978064 - DNA, 19 bp, Homo sapiens
tctccagtttattcttcca

SEQ ID NO: 6978065 - DNA, 22 bp, Homo sapiens
tagagctctccttcctctgtgg

SEQ ID NO: 6978066 - DNA, 22 bp, Homo sapiens
ttggaaagaccgaattcctgtt

SEQ ID NO: 6978067 - DNA, 22 bp, Homo sapiens
gtgtgtaatgcttattgtgctt

SEQ ID NO: 6978068 - DNA, 22 bp, Homo sapiens
gtctccggccgccctggtgctg

SEQ ID NO: 6978069 - DNA, 22 bp, Homo sapiens
gctggctttatcgtcagactcc

SEQ ID NO: 6978070 - DNA, 19 bp, Homo sapiens
ccctgggggtttctggtac

SEQ ID NO: 6978071 - DNA, 22 bp, Homo sapiens
attctgtatttggatataaggg

SEQ ID NO: 6978072 - DNA, 22 bp, Homo sapiens
tgtggaattgacatggtaaaca

SEQ ID NO: 6978073 - DNA, 22 bp, Homo sapiens
atatttagataaaaatgggctt

SEQ ID NO: 6978074 - DNA, 22 bp, Homo sapiens
agtggcagagttgaataattga

SEQ ID NO: 6978075 - DNA, 22 bp, Homo sapiens
tgaagccctgtgtcagcttcca

SEQ ID NO: 6978076 - DNA, 22 bp, Homo sapiens
ttgtatttcgatgcacgtgtag

SEQ ID NO: 6978077 - DNA, 22 bp, Homo sapiens
tgatctttggtagtacgataat

SEQ ID NO: 6978078 - DNA, 22 bp, Homo sapiens
caggcgggcaggtgcggcccct

SEQ ID NO: 6978079 - DNA, 22 bp, Homo sapiens
cctgtaccgcgatctgctgcgc

SEQ ID NO: 6978080 - DNA, 22 bp, Homo sapiens
cttctcccgaagccggttctgc

SEQ ID NO: 6978081 - DNA, 22 bp, Homo sapiens
atatggtaagagtatatttact

SEQ ID NO: 6978082 - DNA, 22 bp, Homo sapiens
gcagagtgggagcccagggctg

SEQ ID NO: 6978083 - DNA, 22 bp, Homo sapiens
ccaggcttccctgagaggctgc

SEQ ID NO: 6978084 - DNA, 22 bp, Homo sapiens
agacagctgcctccaccacagc

SEQ ID NO: 6978085 - DNA, 22 bp, Homo sapiens
ctccaagggttgtgggtggtca

SEQ ID NO: 6978086 - DNA, 23 bp, Homo sapiens
tggagctgacagtcagagggagg

SEQ ID NO: 6978087 - DNA, 22 bp, Homo sapiens
cagatacctgggtatcatttag

SEQ ID NO: 6978088 - DNA, 22 bp, Homo sapiens
atttattatgggatttggctca

SEQ ID NO: 6978089 - DNA, 22 bp, Homo sapiens
catgcacattattcaaagccca

SEQ ID NO: 6978090 - DNA, 22 bp, Homo sapiens
tgagcagggactttgagtgtag

SEQ ID NO: 6978091 - DNA, 22 bp, Homo sapiens
acttataggccaagtagactgt

SEQ ID NO: 6978092 - DNA, 22 bp, Homo sapiens
tctgtctgagggagtgacattt

SEQ ID NO: 6978093 - DNA, 22 bp, Homo sapiens
aggtcattccagccattcccct

SEQ ID NO: 6978094 - DNA, 22 bp, Homo sapiens
acactttgttgtggcatatacg

SEQ ID NO: 6978095 - DNA, 22 bp, Homo sapiens
tgcataaaatatgagaaatgta

SEQ ID NO: 6978096 - DNA, 22 bp, Homo sapiens
gagtaacatctggaaccgacac

SEQ ID NO: 6978097 - DNA, 22 bp, Homo sapiens
ctgcctggcatagtctggtcga

SEQ ID NO: 6978098 - DNA, 22 bp, Homo sapiens
agctacatgaaattgctgatat

SEQ ID NO: 6978099 - DNA, 22 bp, Homo sapiens
cttaccatgtgagaaacaaaca

SEQ ID NO: 6978100 - DNA, 22 bp, Homo sapiens
aagcagtagggccaacttgcag

SEQ ID NO: 6978101 - DNA, 22 bp, Homo sapiens
tgcatgaaatattttctgtagg

SEQ ID NO: 6978102 - DNA, 21 bp, Homo sapiens
tggcacagcaagtgggctcat

SEQ ID NO: 6978103 - DNA, 22 bp, Homo sapiens
tatataattttctgccatatcc

SEQ ID NO: 6978104 - DNA, 22 bp, Homo sapiens
caggactcttgtcatcatcagt

SEQ ID NO: 6978105 - DNA, 22 bp, Homo sapiens
tcaggaaagaagatgctcagtg

SEQ ID NO: 6978106 - DNA, 22 bp, Homo sapiens
tgttctcagtaattctatttta

SEQ ID NO: 6978107 - DNA, 22 bp, Homo sapiens
tgcagggtggagcggaagcgga

SEQ ID NO: 6978108 - DNA, 22 bp, Homo sapiens
tcaggaaatggcttcatggttt

SEQ ID NO: 6978109 - DNA, 22 bp, Homo sapiens
cctctgggggtcctcagagtct

SEQ ID NO: 6978110 - DNA, 22 bp, Homo sapiens
gcttgaaaatgactcttgtgaa

SEQ ID NO: 6978111 - DNA, 22 bp, Homo sapiens
tctgcaggtgttggaagggtca

SEQ ID NO: 6978112 - DNA, 22 bp, Homo sapiens
tattttacatgacaggtgttta

SEQ ID NO: 6978113 - DNA, 22 bp, Homo sapiens
ttggcagattctgaacaaagcc

SEQ ID NO: 6978114 - DNA, 22 bp, Homo sapiens
caatttcttgttaattctcagg

SEQ ID NO: 6978115 - DNA, 22 bp, Homo sapiens
tcatcagctcatctgctcctag

SEQ ID NO: 6978116 - DNA, 22 bp, Homo sapiens
acaggtgtgagaacatgccttg

SEQ ID NO: 6978117 - DNA, 22 bp, Homo sapiens
gtgctgaggccaatgtcagggt

SEQ ID NO: 6978118 - DNA, 22 bp, Homo sapiens
catgtcttgccctgattagtag

SEQ ID NO: 6978119 - DNA, 22 bp, Homo sapiens
tagaaagtaaatcagttttatt

SEQ ID NO: 6978120 - DNA, 22 bp, Homo sapiens
gcagtaggggctggagggctgt

SEQ ID NO: 6978121 - DNA, 22 bp, Homo sapiens
tgggcactcaggctgaggccgt

SEQ ID NO: 6978122 - DNA, 19 bp, Homo sapiens
tctagtgtgaccaccagat

SEQ ID NO: 6978123 - DNA, 22 bp, Homo sapiens
ttggggtgttggatggagcaag

SEQ ID NO: 6978124 - DNA, 22 bp, Homo sapiens
gtatttttagtagagtcggggt

SEQ ID NO: 6978125 - DNA, 22 bp, Homo sapiens
ttgctgtgtaactcctggcctg

SEQ ID NO: 6978126 - DNA, 22 bp, Homo sapiens
ctggctgtattagtttgatcct

SEQ ID NO: 6978127 - DNA, 22 bp, Homo sapiens
gaagccccatggatatatgtga

SEQ ID NO: 6978128 - DNA, 22 bp, Homo sapiens
atttagcctcatttttgacata

SEQ ID NO: 6978129 - DNA, 22 bp, Homo sapiens
aggcacttggagttctttgccc

SEQ ID NO: 6978130 - DNA, 22 bp, Homo sapiens
cagatgctaggccaattcctga

SEQ ID NO: 6978131 - DNA, 22 bp, Homo sapiens
ttgttcagaagtttaaagaatt

SEQ ID NO: 6978132 - DNA, 22 bp, Homo sapiens
ctgggaaattgacactgataaa

SEQ ID NO: 6978133 - DNA, 22 bp, Homo sapiens
aagctggcctcaaactcctagc

SEQ ID NO: 6978134 - DNA, 21 bp, Homo sapiens
tttagggaggatatttaactt

SEQ ID NO: 6978135 - DNA, 22 bp, Homo sapiens
agctggttcagaaattagatgg

SEQ ID NO: 6978136 - DNA, 22 bp, Homo sapiens
atattcactcctggtgagacta

SEQ ID NO: 6978137 - DNA, 22 bp, Homo sapiens
tctcagtgtgttttctctcaga

SEQ ID NO: 6978138 - DNA, 22 bp, Homo sapiens
actgctgactaaacagctccat

SEQ ID NO: 6978139 - DNA, 22 bp, Homo sapiens
tggtttacccctgtcctatatc

SEQ ID NO: 6978140 - DNA, 22 bp, Homo sapiens
tctatttacagaaagcagaatt

SEQ ID NO: 6978141 - DNA, 22 bp, Homo sapiens
ttgaataatatgcttcgttctc

SEQ ID NO: 6978142 - DNA, 22 bp, Homo sapiens
atatggcttgtagcatgaataa

SEQ ID NO: 6978143 - DNA, 16 bp, Homo sapiens
gtgctgacagctctgg

SEQ ID NO: 6978144 - DNA, 22 bp, Homo sapiens
gatgtttcatgctagcatgtgt

SEQ ID NO: 6978145 - DNA, 22 bp, Homo sapiens
agatttctgtggtcatgtaatg

SEQ ID NO: 6978146 - DNA, 22 bp, Homo sapiens
tagggaaggagaccaagccaca

SEQ ID NO: 6978147 - DNA, 22 bp, Homo sapiens
aaggctgattagactgatagct

SEQ ID NO: 6978148 - DNA, 22 bp, Homo sapiens
agcagccttgtgactccggggt

SEQ ID NO: 6978149 - DNA, 22 bp, Homo sapiens
caggcagcagccactctggtat

SEQ ID NO: 6978150 - DNA, 22 bp, Homo sapiens
tctcatctagactctgcccttg

SEQ ID NO: 6978151 - DNA, 23 bp, Homo sapiens
tggaataataaggtacattaaca

SEQ ID NO: 6978152 - DNA, 22 bp, Homo sapiens
ccatgattcctctaagacctct

SEQ ID NO: 6978153 - DNA, 22 bp, Homo sapiens
tgtccccagcactcactctcca

SEQ ID NO: 6978154 - DNA, 22 bp, Homo sapiens
ctgagatcccaggcagggtggc

SEQ ID NO: 6978155 - DNA, 21 bp, Homo sapiens
ttaggcactgcaattttatgc

SEQ ID NO: 6978156 - DNA, 22 bp, Homo sapiens
tggggaaagatagttttctcta

SEQ ID NO: 6978157 - DNA, 21 bp, Homo sapiens
catcatgcttgtgttggagaa

SEQ ID NO: 6978158 - DNA, 22 bp, Homo sapiens
tgcaggctggaggagggactaa

SEQ ID NO: 6978159 - DNA, 22 bp, Homo sapiens
aaactggtattcaaatgtttgg

SEQ ID NO: 6978160 - DNA, 22 bp, Homo sapiens
gagctcttccccatcttacatc

SEQ ID NO: 6978161 - DNA, 22 bp, Homo sapiens
tatgggtagggtttgataagat

SEQ ID NO: 6978162 - DNA, 17 bp, Homo sapiens
tagtaaatgagtagagc

SEQ ID NO: 6978163 - DNA, 20 bp, Homo sapiens
agcatcttgcatcttcaagt

SEQ ID NO: 6978164 - DNA, 22 bp, Homo sapiens
tatcaatatctcagtgtgcttc

SEQ ID NO: 6978165 - DNA, 22 bp, Homo sapiens
gtctacaaagcatataaaagag

SEQ ID NO: 6978166 - DNA, 22 bp, Homo sapiens
agtagacatgagcaatgataat

SEQ ID NO: 6978167 - DNA, 22 bp, Homo sapiens
aaggcaatatcaagagaattcg

SEQ ID NO: 6978168 - DNA, 22 bp, Homo sapiens
tgctttcattgcctgcggtttt

SEQ ID NO: 6978169 - DNA, 22 bp, Homo sapiens
taatgcttaattttcacaagcc

SEQ ID NO: 6978170 - DNA, 22 bp, Homo sapiens
attcacaaagtcacccttacac

SEQ ID NO: 6978171 - DNA, 22 bp, Homo sapiens
ttgggaaggcgtggaagcagaa

SEQ ID NO: 6978172 - DNA, 22 bp, Homo sapiens
ggcatgctgcgtacagatgaac

SEQ ID NO: 6978173 - DNA, 22 bp, Homo sapiens
gccctccagctgttgcgcgtcg

SEQ ID NO: 6978174 - DNA, 22 bp, Homo sapiens
cagagtactgggagaacagaag

SEQ ID NO: 6978175 - DNA, 22 bp, Homo sapiens
gacctggcctgcacagccctta

SEQ ID NO: 6978176 - DNA, 21 bp, Homo sapiens
aatgaagtggctattttgagg

SEQ ID NO: 6978177 - DNA, 22 bp, Homo sapiens
atggaaagtgcatggaagtcat

SEQ ID NO: 6978178 - DNA, 19 bp, Homo sapiens
ccagaggactgttaatgaa

SEQ ID NO: 6978179 - DNA, 22 bp, Homo sapiens
ctctctgtcttggcatttggtc

SEQ ID NO: 6978180 - DNA, 22 bp, Homo sapiens
tagtgtctgaatgcacctgttt

SEQ ID NO: 6978181 - DNA, 22 bp, Homo sapiens
tttctgattgtcatgctgggtg

SEQ ID NO: 6978182 - DNA, 22 bp, Homo sapiens
aaagctatttattacagagaat

SEQ ID NO: 6978183 - DNA, 20 bp, Homo sapiens
acagaatatgctggttgtgg

SEQ ID NO: 6978184 - DNA, 22 bp, Homo sapiens
cagggccaagctgcagcatctg

SEQ ID NO: 6978185 - DNA, 20 bp, Homo sapiens
aaacactggctggggcacag

SEQ ID NO: 6978186 - DNA, 18 bp, Homo sapiens
aaggccctgagcatatgc

SEQ ID NO: 6978187 - DNA, 19 bp, Homo sapiens
gctggcccctgggatccag

SEQ ID NO: 6978188 - DNA, 22 bp, Homo sapiens
tctgtattgagaaagccggaca

SEQ ID NO: 6978189 - DNA, 23 bp, Homo sapiens
ttgcaaaatgagtcttgagtgaa

SEQ ID NO: 6978190 - DNA, 22 bp, Homo sapiens
taccagcttccttcaagatgtg

SEQ ID NO: 6978191 - DNA, 22 bp, Homo sapiens
tccccagattcatgtctgctgt

SEQ ID NO: 6978192 - DNA, 22 bp, Homo sapiens
gatgcacagagggcctggaact

SEQ ID NO: 6978193 - DNA, 22 bp, Homo sapiens
ctgtttgtgattagcagtgggt

SEQ ID NO: 6978194 - DNA, 22 bp, Homo sapiens
caggtccagtaaaaagagtcct

SEQ ID NO: 6978195 - DNA, 22 bp, Homo sapiens
tatctgttccaatggagtcagg

SEQ ID NO: 6978196 - DNA, 22 bp, Homo sapiens
ctggaaggttctttgtgtgcct

SEQ ID NO: 6978197 - DNA, 22 bp, Homo sapiens
ggcacagccctctctgtggaca

SEQ ID NO: 6978198 - DNA, 22 bp, Homo sapiens
atcagtaaatattcattgtgca

SEQ ID NO: 6978199 - DNA, 22 bp, Homo sapiens
taaatcagggagtcatctgcga

SEQ ID NO: 6978200 - DNA, 22 bp, Homo sapiens
taaggtcatggtgaataataag

SEQ ID NO: 6978201 - DNA, 20 bp, Homo sapiens
caccttcaaatttcctggca

SEQ ID NO: 6978202 - DNA, 22 bp, Homo sapiens
ctctgctgatatagcttttcaa

SEQ ID NO: 6978203 - DNA, 22 bp, Homo sapiens
ccatcatttgatacagctgtct

SEQ ID NO: 6978204 - DNA, 22 bp, Homo sapiens
agtttgtctgtcttcaaagcct

SEQ ID NO: 6978205 - DNA, 22 bp, Homo sapiens
catggctttccctcaagagcaa

SEQ ID NO: 6978206 - DNA, 22 bp, Homo sapiens
acagtgtttcacttaaccgttt

SEQ ID NO: 6978207 - DNA, 22 bp, Homo sapiens
aattccagggttagctcatttg

SEQ ID NO: 6978208 - DNA, 22 bp, Homo sapiens
ctttattctgcaaattgccttg

SEQ ID NO: 6978209 - DNA, 22 bp, Homo sapiens
agacatctcccatgcattttta

SEQ ID NO: 6978210 - DNA, 22 bp, Homo sapiens
caggcctttgcacgtgcagttg

SEQ ID NO: 6978211 - DNA, 22 bp, Homo sapiens
atctgcaggaatgtgtgcagag

SEQ ID NO: 6978212 - DNA, 22 bp, Homo sapiens
ttttgcaacacaggctacttca

SEQ ID NO: 6978213 - DNA, 22 bp, Homo sapiens
gaaggaagtttattttagaaga

SEQ ID NO: 6978214 - DNA, 19 bp, Homo sapiens
ttactcacatttagattcc

SEQ ID NO: 6978215 - DNA, 22 bp, Homo sapiens
aaatgtagacctatagggacct

SEQ ID NO: 6978216 - DNA, 22 bp, Homo sapiens
gactttgtgccaaacgccagaa

SEQ ID NO: 6978217 - DNA, 22 bp, Homo sapiens
tgagtcatgggcttgaggttac

SEQ ID NO: 6978218 - DNA, 22 bp, Homo sapiens
aagatatactattaagtaccat

SEQ ID NO: 6978219 - DNA, 22 bp, Homo sapiens
gaagcccttagcagagtctgac

SEQ ID NO: 6978220 - DNA, 22 bp, Homo sapiens
tattccagaaatcaccatttcc

SEQ ID NO: 6978221 - DNA, 21 bp, Homo sapiens
ccagaggttctgggcctccct

SEQ ID NO: 6978222 - DNA, 22 bp, Homo sapiens
acaggggctccgaaggtgaggg

SEQ ID NO: 6978223 - DNA, 22 bp, Homo sapiens
gagctctgttctcgtcctgctg

SEQ ID NO: 6978224 - DNA, 22 bp, Homo sapiens
tcagtccttggaggattctctt

SEQ ID NO: 6978225 - DNA, 22 bp, Homo sapiens
tcccagggactctctgccttcc

SEQ ID NO: 6978226 - DNA, 22 bp, Homo sapiens
acaaggcttcatattcttttta

SEQ ID NO: 6978227 - DNA, 22 bp, Homo sapiens
tcagcaagaagtcatttgtagc

SEQ ID NO: 6978228 - DNA, 22 bp, Homo sapiens
cagagctgttactattcatgaa

SEQ ID NO: 6978229 - DNA, 22 bp, Homo sapiens
ctgtatcaccccagggttcttt

SEQ ID NO: 6978230 - DNA, 22 bp, Homo sapiens
gccaggcacagttctaggtgct

SEQ ID NO: 6978231 - DNA, 22 bp, Homo sapiens
tgtcaccagttccaggaaataa

SEQ ID NO: 6978232 - DNA, 22 bp, Homo sapiens
agtataaagtggttttcagcac

SEQ ID NO: 6978233 - DNA, 22 bp, Homo sapiens
tggctatactctcagttaatac

SEQ ID NO: 6978234 - DNA, 22 bp, Homo sapiens
agtttgataaacaccagctagt

SEQ ID NO: 6978235 - DNA, 22 bp, Homo sapiens
agtgacaaaacggaacatacag

SEQ ID NO: 6978236 - DNA, 22 bp, Homo sapiens
agcagccttaggtattgtgatt

SEQ ID NO: 6978237 - DNA, 22 bp, Homo sapiens
ggtgactcatgtgtgttttcag

SEQ ID NO: 6978238 - DNA, 22 bp, Homo sapiens
tggaaactctacctctctaaga

SEQ ID NO: 6978239 - DNA, 22 bp, Homo sapiens
tttgacaaatatttattggcac

SEQ ID NO: 6978240 - DNA, 22 bp, Homo sapiens
agacatggagaaggagccagtg

SEQ ID NO: 6978241 - DNA, 22 bp, Homo sapiens
acttttgaacaaactcctctgt

SEQ ID NO: 6978242 - DNA, 22 bp, Homo sapiens
tttgaaaacttaatttggtcgt

SEQ ID NO: 6978243 - DNA, 22 bp, Homo sapiens
ttgtattctgttacagcaacat

SEQ ID NO: 6978244 - DNA, 22 bp, Homo sapiens
cctggaattcaaagtttggctg

SEQ ID NO: 6978245 - DNA, 22 bp, Homo sapiens
aatcagtgcaaaggagagggta

SEQ ID NO: 6978246 - DNA, 22 bp, Homo sapiens
tgacagtgttgggggtaaattt

SEQ ID NO: 6978247 - DNA, 22 bp, Homo sapiens
ccagaggtgccacagaaagagc

SEQ ID NO: 6978248 - DNA, 22 bp, Homo sapiens
gcatctaaacttgcatcattgt

SEQ ID NO: 6978249 - DNA, 22 bp, Homo sapiens
aggggacacggcttctccaggg

SEQ ID NO: 6978250 - DNA, 22 bp, Homo sapiens
ttacaacctaattttactctcc

SEQ ID NO: 6978251 - DNA, 20 bp, Homo sapiens
tctcaggccccagttttctt

SEQ ID NO: 6978252 - DNA, 22 bp, Homo sapiens
ccctagggctaagcaggactgc

SEQ ID NO: 6978253 - DNA, 22 bp, Homo sapiens
agtttctagcaaggattgttga

SEQ ID NO: 6978254 - DNA, 22 bp, Homo sapiens
tctcctggtcacctcagaagtc

SEQ ID NO: 6978255 - DNA, 22 bp, Homo sapiens
agtgctccacattgcactattc

SEQ ID NO: 6978256 - DNA, 22 bp, Homo sapiens
accactgcactccagtctgggc

SEQ ID NO: 6978257 - DNA, 22 bp, Homo sapiens
tcctagggatgccatcgtgtaa

SEQ ID NO: 6978258 - DNA, 22 bp, Homo sapiens
ttcagtgtgtgatacctgctgt

SEQ ID NO: 6978259 - DNA, 22 bp, Homo sapiens
tattattatagttattgggaag

SEQ ID NO: 6978260 - DNA, 22 bp, Homo sapiens
cagtgcaattacaagctaattc

SEQ ID NO: 6978261 - DNA, 22 bp, Homo sapiens
cccagcttgtctgattcagcct

SEQ ID NO: 6978262 - DNA, 22 bp, Homo sapiens
gttctactttctgtgtctttga

SEQ ID NO: 6978263 - DNA, 22 bp, Homo sapiens
aggcttgggactgcttaggagc

SEQ ID NO: 6978264 - DNA, 22 bp, Homo sapiens
gtgctggcacccctctccagtt

SEQ ID NO: 6978265 - DNA, 22 bp, Homo sapiens
ctctatattctgaaacagttag

SEQ ID NO: 6978266 - DNA, 22 bp, Homo sapiens
agataaagtccaaactgtgtag

SEQ ID NO: 6978267 - DNA, 23 bp, Homo sapiens
accatgatgggagtgcaaataag

SEQ ID NO: 6978268 - DNA, 22 bp, Homo sapiens
gctgtttcgggtggaggtggag

SEQ ID NO: 6978269 - DNA, 22 bp, Homo sapiens
ctccttaactttgaagtgggta

SEQ ID NO: 6978270 - DNA, 22 bp, Homo sapiens
tccccagggctgcagagggtgt

SEQ ID NO: 6978271 - DNA, 22 bp, Homo sapiens
taagacaggtagtaagaacatt

SEQ ID NO: 6978272 - DNA, 21 bp, Homo sapiens
acacactctgagtcttctatt

SEQ ID NO: 6978273 - DNA, 22 bp, Homo sapiens
ccagtgttgaacagtatttgga

SEQ ID NO: 6978274 - DNA, 22 bp, Homo sapiens
tggtgacctgcagagaaaattt

SEQ ID NO: 6978275 - DNA, 22 bp, Homo sapiens
ccctgctgcatggcctccacga

SEQ ID NO: 6978276 - DNA, 22 bp, Homo sapiens
cgctgggcatggtgccttattt

SEQ ID NO: 6978277 - DNA, 22 bp, Homo sapiens
acaagtttcattgtttagaacc

SEQ ID NO: 6978278 - DNA, 22 bp, Homo sapiens
ggaccagctatcaatgccaggg

SEQ ID NO: 6978279 - DNA, 22 bp, Homo sapiens
ctcagtggtggtcacttggtgg

SEQ ID NO: 6978280 - DNA, 17 bp, Homo sapiens
gcaaggaagttctttgc

SEQ ID NO: 6978281 - DNA, 19 bp, Homo sapiens
ctctgccctacagaaagct

SEQ ID NO: 6978282 - DNA, 22 bp, Homo sapiens
tcatgacatctgtttatctcaa

SEQ ID NO: 6978283 - DNA, 22 bp, Homo sapiens
tttacaattctggtgccagcta

SEQ ID NO: 6978284 - DNA, 22 bp, Homo sapiens
ctggaagtggggttggcttgaa

SEQ ID NO: 6978285 - DNA, 22 bp, Homo sapiens
tacagcatgatcacaatggaaa

SEQ ID NO: 6978286 - DNA, 22 bp, Homo sapiens
ttgagatttggaggtaattccc

SEQ ID NO: 6978287 - DNA, 22 bp, Homo sapiens
ggaggggtggtcgcgaagagca

SEQ ID NO: 6978288 - DNA, 22 bp, Homo sapiens
tggcaatacataatcttaatgg

SEQ ID NO: 6978289 - DNA, 22 bp, Homo sapiens
gatccctgccctcagcctggac

SEQ ID NO: 6978290 - DNA, 22 bp, Homo sapiens
tggaatgaagacatgttgtttg

SEQ ID NO: 6978291 - DNA, 22 bp, Homo sapiens
tccactttagcaatgattgaat

SEQ ID NO: 6978292 - DNA, 19 bp, Homo sapiens
ctggaatgtggctggtgca

SEQ ID NO: 6978293 - DNA, 22 bp, Homo sapiens
atgctgatgctgttaaccctaa

SEQ ID NO: 6978294 - DNA, 22 bp, Homo sapiens
ttgtacactctttttattccgt

SEQ ID NO: 6978295 - DNA, 22 bp, Homo sapiens
aagggaccctggatcaaatgga

SEQ ID NO: 6978296 - DNA, 22 bp, Homo sapiens
ccagtacacctcacttcccttt

SEQ ID NO: 6978297 - DNA, 22 bp, Homo sapiens
aagggtgcattgcgcggggctg

SEQ ID NO: 6978298 - DNA, 22 bp, Homo sapiens
cctcagaggcatggttagaata

SEQ ID NO: 6978299 - DNA, 22 bp, Homo sapiens
aattgtcttctccttcctggca

SEQ ID NO: 6978300 - DNA, 22 bp, Homo sapiens
cctctctccaagggaaatccta

SEQ ID NO: 6978301 - DNA, 22 bp, Homo sapiens
aagcacaatttcaccttcttgt

SEQ ID NO: 6978302 - DNA, 23 bp, Homo sapiens
ttactacacaagtaacgattccc

SEQ ID NO: 6978303 - DNA, 22 bp, Homo sapiens
tcaggatcggcctttttttaag

SEQ ID NO: 6978304 - DNA, 22 bp, Homo sapiens
aactcccactcagcttcttaat

SEQ ID NO: 6978305 - DNA, 22 bp, Homo sapiens
tgccaaattgccctataaatga

SEQ ID NO: 6978306 - DNA, 22 bp, Homo sapiens
cctggagggcgccgcacagtcc

SEQ ID NO: 6978307 - DNA, 22 bp, Homo sapiens
agataatttgagtaaattaatt

SEQ ID NO: 6978308 - DNA, 18 bp, Homo sapiens
tgcaccctaagggcccca

SEQ ID NO: 6978309 - DNA, 22 bp, Homo sapiens
ctgttgtaaagctattcatttg

SEQ ID NO: 6978310 - DNA, 22 bp, Homo sapiens
ctgccctgggagtacctgtcct

SEQ ID NO: 6978311 - DNA, 22 bp, Homo sapiens
gatcatcatggctctggagctg

SEQ ID NO: 6978312 - DNA, 22 bp, Homo sapiens
tcagggtcaggacccagctgtt

SEQ ID NO: 6978313 - DNA, 22 bp, Homo sapiens
tcacaccttgctggctgagtgc

SEQ ID NO: 6978314 - DNA, 22 bp, Homo sapiens
ggtggcctcttgtttagccagc

SEQ ID NO: 6978315 - DNA, 22 bp, Homo sapiens
ggtaactgaggccatattctga

SEQ ID NO: 6978316 - DNA, 22 bp, Homo sapiens
tgttcattattcttcatctgcc

SEQ ID NO: 6978317 - DNA, 22 bp, Homo sapiens
gagctgttaagagggagtgaca

SEQ ID NO: 6978318 - DNA, 22 bp, Homo sapiens
tgatttcagtaatgaggatgaa

SEQ ID NO: 6978319 - DNA, 23 bp, Homo sapiens
aggaggcctgaaactgaggctga

SEQ ID NO: 6978320 - DNA, 22 bp, Homo sapiens
ttcatacatgagactagatgca

SEQ ID NO: 6978321 - DNA, 22 bp, Homo sapiens
catgacaataagccagcagaaa

SEQ ID NO: 6978322 - DNA, 22 bp, Homo sapiens
aaactgcagagccatggttcaa

SEQ ID NO: 6978323 - DNA, 22 bp, Homo sapiens
gagtggggctttaaaggctcag

SEQ ID NO: 6978324 - DNA, 20 bp, Homo sapiens
tcttcagcactccttaggta

SEQ ID NO: 6978325 - DNA, 22 bp, Homo sapiens
ctgggcttctccccctggcaga

SEQ ID NO: 6978326 - DNA, 22 bp, Homo sapiens
tgtgaaggtttttatgggatat

SEQ ID NO: 6978327 - DNA, 22 bp, Homo sapiens
tgttcgattagatcatgatgac

SEQ ID NO: 6978328 - DNA, 22 bp, Homo sapiens
aatatctgttgttctaagccac

SEQ ID NO: 6978329 - DNA, 22 bp, Homo sapiens
tagcagagaggggacagtggca

SEQ ID NO: 6978330 - DNA, 22 bp, Homo sapiens
tggctcaggcctacgacgcctt

SEQ ID NO: 6978331 - DNA, 22 bp, Homo sapiens
gcagaagtacctcgttctagtt

SEQ ID NO: 6978332 - DNA, 22 bp, Homo sapiens
aagcagcacagcaatgactcta

SEQ ID NO: 6978333 - DNA, 22 bp, Homo sapiens
caaagcaccacaaaccaggtga

SEQ ID NO: 6978334 - DNA, 22 bp, Homo sapiens
agcttgaaacgtaccaacattg

SEQ ID NO: 6978335 - DNA, 22 bp, Homo sapiens
ctccagttggccccagttggtt

SEQ ID NO: 6978336 - DNA, 22 bp, Homo sapiens
cacagcagccagaacatttttg

SEQ ID NO: 6978337 - DNA, 22 bp, Homo sapiens
ttgagcacaactcttggagagc

SEQ ID NO: 6978338 - DNA, 22 bp, Homo sapiens
gctaagaattctgagcagctga

SEQ ID NO: 6978339 - DNA, 22 bp, Homo sapiens
aggaacattctcatttcctgcc

SEQ ID NO: 6978340 - DNA, 22 bp, Homo sapiens
ctacaaagctcttctacaggca

SEQ ID NO: 6978341 - DNA, 22 bp, Homo sapiens
tatttaaccagttaaatttcca

SEQ ID NO: 6978342 - DNA, 22 bp, Homo sapiens
tgccttcaatcaggatggtctc

SEQ ID NO: 6978343 - DNA, 22 bp, Homo sapiens
atgaggcatagcagggatcgga

SEQ ID NO: 6978344 - DNA, 22 bp, Homo sapiens
cagccctgggagttggggccga

SEQ ID NO: 6978345 - DNA, 21 bp, Homo sapiens
tcaaggccagcctgggcagcc

SEQ ID NO: 6978346 - DNA, 22 bp, Homo sapiens
aggtctgggattgaagacatca

SEQ ID NO: 6978347 - DNA, 22 bp, Homo sapiens
catgtctgagtagagtgtgatt

SEQ ID NO: 6978348 - DNA, 22 bp, Homo sapiens
tggtgctgtgatacgaggcact

SEQ ID NO: 6978349 - DNA, 22 bp, Homo sapiens
ctggagttttggaaaaatgctt

SEQ ID NO: 6978350 - DNA, 22 bp, Homo sapiens
aaggggtgagcagaggcttcgc

SEQ ID NO: 6978351 - DNA, 22 bp, Homo sapiens
cctccaaccataggtccagggg

SEQ ID NO: 6978352 - DNA, 22 bp, Homo sapiens
attcgctgacttgcacatttgg

SEQ ID NO: 6978353 - DNA, 21 bp, Homo sapiens
gttcatgtcagcattaaggga

SEQ ID NO: 6978354 - DNA, 22 bp, Homo sapiens
gtacttccgtggactaattgtt

SEQ ID NO: 6978355 - DNA, 22 bp, Homo sapiens
aggccacagtactttgcagacc

SEQ ID NO: 6978356 - DNA, 22 bp, Homo sapiens
tctgcagggtcccagcctcagc

SEQ ID NO: 6978357 - DNA, 22 bp, Homo sapiens
aaaagtaattgcagttttcgcc

SEQ ID NO: 6978358 - DNA, 22 bp, Homo sapiens
catttgtatagtgcttagacca

SEQ ID NO: 6978359 - DNA, 22 bp, Homo sapiens
aaactggtagcaatttaagggt

SEQ ID NO: 6978360 - DNA, 22 bp, Homo sapiens
ttggctgctgaaatatgttctg

SEQ ID NO: 6978361 - DNA, 22 bp, Homo sapiens
ataaatagtgctgccatgagta

SEQ ID NO: 6978362 - DNA, 22 bp, Homo sapiens
ttgaggagaagactttgcttcc

SEQ ID NO: 6978363 - DNA, 22 bp, Homo sapiens
tttgatagttgattaaattcca

SEQ ID NO: 6978364 - DNA, 22 bp, Homo sapiens
atggctccagcttggcttcacc

SEQ ID NO: 6978365 - DNA, 22 bp, Homo sapiens
gagcgcgccacaaggagcggcg

SEQ ID NO: 6978366 - DNA, 22 bp, Homo sapiens
ctgggacttgatgaaatgactg

SEQ ID NO: 6978367 - DNA, 22 bp, Homo sapiens
caagttaaatttgcatttcaga

SEQ ID NO: 6978368 - DNA, 20 bp, Homo sapiens
tccagcccagcagcctgaca

SEQ ID NO: 6978369 - DNA, 22 bp, Homo sapiens
gctttgcccaagggccctaccc

SEQ ID NO: 6978370 - DNA, 22 bp, Homo sapiens
ttgcgcaactttaaattaattc

SEQ ID NO: 6978371 - DNA, 22 bp, Homo sapiens
aagtggtgtgttggaagaaatc

SEQ ID NO: 6978372 - DNA, 22 bp, Homo sapiens
gagcagcaagcactcaaaggct

SEQ ID NO: 6978373 - DNA, 22 bp, Homo sapiens
tcctgcagacatttacaccttt

SEQ ID NO: 6978374 - DNA, 22 bp, Homo sapiens
gagagtattacaaattttacaa

SEQ ID NO: 6978375 - DNA, 22 bp, Homo sapiens
ctgtcctggtgctggggatccc

SEQ ID NO: 6978376 - DNA, 22 bp, Homo sapiens
acagcaatgagtaactccttgg

SEQ ID NO: 6978377 - DNA, 22 bp, Homo sapiens
tcactgctcgataacatgatta

SEQ ID NO: 6978378 - DNA, 22 bp, Homo sapiens
ggagacttgagtttttgtctta

SEQ ID NO: 6978379 - DNA, 22 bp, Homo sapiens
atattgcctaggtgaatagaat

SEQ ID NO: 6978380 - DNA, 22 bp, Homo sapiens
aaacatgatgtcatatatgcca

SEQ ID NO: 6978381 - DNA, 22 bp, Homo sapiens
tgggcagagttgtgatgaactg

SEQ ID NO: 6978382 - DNA, 22 bp, Homo sapiens
tgcatggatttgacatgtgtac

SEQ ID NO: 6978383 - DNA, 22 bp, Homo sapiens
tttgctaagagaactcgtggac

SEQ ID NO: 6978384 - DNA, 22 bp, Homo sapiens
ataaagctaagacttacatgaa

SEQ ID NO: 6978385 - DNA, 22 bp, Homo sapiens
aggtcctgtgtccaggggcctg

SEQ ID NO: 6978386 - DNA, 22 bp, Homo sapiens
ttccactctgtcccctgtggga

SEQ ID NO: 6978387 - DNA, 22 bp, Homo sapiens
ccacaatttatgtattctccta

SEQ ID NO: 6978388 - DNA, 22 bp, Homo sapiens
tacttctggatattcagaactt

SEQ ID NO: 6978389 - DNA, 22 bp, Homo sapiens
cttaaggcttcagcacaggtat

SEQ ID NO: 6978390 - DNA, 22 bp, Homo sapiens
gccacagtgggctggggccaga

SEQ ID NO: 6978391 - DNA, 22 bp, Homo sapiens
ggctgctggaagactgaacaag

SEQ ID NO: 6978392 - DNA, 22 bp, Homo sapiens
tgactgagggaggaagcaggtg

SEQ ID NO: 6978393 - DNA, 22 bp, Homo sapiens
ctcaggaggccattctcaaggt

SEQ ID NO: 6978394 - DNA, 22 bp, Homo sapiens
tttggacaaacagaatagagct

SEQ ID NO: 6978395 - DNA, 22 bp, Homo sapiens
agaagcactagagggtatggaa

SEQ ID NO: 6978396 - DNA, 22 bp, Homo sapiens
tttccaaataaggtcacactca

SEQ ID NO: 6978397 - DNA, 22 bp, Homo sapiens
tttcttctgtttgtagttacac

SEQ ID NO: 6978398 - DNA, 22 bp, Homo sapiens
tgatatttaagcaaaaatatgg

SEQ ID NO: 6978399 - DNA, 22 bp, Homo sapiens
tgcaaacacttcaacgtgcatc

SEQ ID NO: 6978400 - DNA, 22 bp, Homo sapiens
acatttcttgatgcctctgtga

SEQ ID NO: 6978401 - DNA, 22 bp, Homo sapiens
tgagtatacaatggcactgcca

SEQ ID NO: 6978402 - DNA, 21 bp, Homo sapiens
gctggctttcctggatgtgca

SEQ ID NO: 6978403 - DNA, 23 bp, Homo sapiens
atgaagacccgtggtgtccccac

SEQ ID NO: 6978404 - DNA, 22 bp, Homo sapiens
aggttctgatttgttggggagg

SEQ ID NO: 6978405 - DNA, 22 bp, Homo sapiens
tggtaaagtgctctaacttcat

SEQ ID NO: 6978406 - DNA, 20 bp, Homo sapiens
tttctccggtcttgagatcc

SEQ ID NO: 6978407 - DNA, 22 bp, Homo sapiens
tgcttataaagatattagtttc

SEQ ID NO: 6978408 - DNA, 22 bp, Homo sapiens
aggtgcctgtcgtctctggtta

SEQ ID NO: 6978409 - DNA, 22 bp, Homo sapiens
tcacagtgggacttttatcgct

SEQ ID NO: 6978410 - DNA, 20 bp, Homo sapiens
cagcaactttggactgagtt

SEQ ID NO: 6978411 - DNA, 22 bp, Homo sapiens
tatttggatagacagggagatg

SEQ ID NO: 6978412 - DNA, 22 bp, Homo sapiens
taggggaaagcagaatcctgga

SEQ ID NO: 6978413 - DNA, 22 bp, Homo sapiens
atatttaactggtcccaatata

SEQ ID NO: 6978414 - DNA, 20 bp, Homo sapiens
tgtgtgcatctgtatgtatt

SEQ ID NO: 6978415 - DNA, 22 bp, Homo sapiens
tgcaccttcattttaggcagct

SEQ ID NO: 6978416 - DNA, 22 bp, Homo sapiens
cagtgtttctgagttccagctc

SEQ ID NO: 6978417 - DNA, 22 bp, Homo sapiens
acagggaaggcatccgcgaatg

SEQ ID NO: 6978418 - DNA, 21 bp, Homo sapiens
ctgctttacttcagaggatct

SEQ ID NO: 6978419 - DNA, 22 bp, Homo sapiens
gagaaacaggaattgagtcgct

SEQ ID NO: 6978420 - DNA, 22 bp, Homo sapiens
taggcttgcaattaggatggaa

SEQ ID NO: 6978421 - DNA, 22 bp, Homo sapiens
aggaaacggcaaaactgcttag

SEQ ID NO: 6978422 - DNA, 19 bp, Homo sapiens
tagtctttattcttaattt

SEQ ID NO: 6978423 - DNA, 22 bp, Homo sapiens
agtgcaaaaaagtgttgtgaca

SEQ ID NO: 6978424 - DNA, 20 bp, Homo sapiens
cacaagagaatacacactgg

SEQ ID NO: 6978425 - DNA, 22 bp, Homo sapiens
catgattttgtcttgtgttaat

SEQ ID NO: 6978426 - DNA, 23 bp, Homo sapiens
ggttctgccgcttactgctgtgc

SEQ ID NO: 6978427 - DNA, 21 bp, Homo sapiens
cggacacctgtgatgtgcctg

SEQ ID NO: 6978428 - DNA, 18 bp, Homo sapiens
agactttgagttagaggg

SEQ ID NO: 6978429 - DNA, 22 bp, Homo sapiens
tttctataactggactggattg

SEQ ID NO: 6978430 - DNA, 22 bp, Homo sapiens
agaggcaagttcagagctagga

SEQ ID NO: 6978431 - DNA, 17 bp, Homo sapiens
cagacctctgtgaagcc

SEQ ID NO: 6978432 - DNA, 22 bp, Homo sapiens
cggggtccctgcccacccatac

SEQ ID NO: 6978433 - DNA, 20 bp, Homo sapiens
tgatcatgtgaaagtcatgt

SEQ ID NO: 6978434 - DNA, 22 bp, Homo sapiens
ttggggtatggagtttaaaagt

SEQ ID NO: 6978435 - DNA, 22 bp, Homo sapiens
attgttgaggcagttcatcttg

SEQ ID NO: 6978436 - DNA, 22 bp, Homo sapiens
tctcttagtcttatatgtaaaa

SEQ ID NO: 6978437 - DNA, 20 bp, Homo sapiens
tcaggctccgcattaactta

SEQ ID NO: 6978438 - DNA, 22 bp, Homo sapiens
cacagaggatttttagggcagt

SEQ ID NO: 6978439 - DNA, 22 bp, Homo sapiens
taatgtatttgttcagaagagt

SEQ ID NO: 6978440 - DNA, 22 bp, Homo sapiens
tgagctggagtctgtggctcct

SEQ ID NO: 6978441 - DNA, 22 bp, Homo sapiens
taggatacaaattctgtaattt

SEQ ID NO: 6978442 - DNA, 22 bp, Homo sapiens
atatgctatgtatgtaaatgag

SEQ ID NO: 6978443 - DNA, 22 bp, Homo sapiens
cagaataaacagaaacgtagct

SEQ ID NO: 6978444 - DNA, 22 bp, Homo sapiens
acaggcacaggtgtgccccacc

SEQ ID NO: 6978445 - DNA, 22 bp, Homo sapiens
gcacttcaccactgtcctggtt

SEQ ID NO: 6978446 - DNA, 22 bp, Homo sapiens
gagcctgcccctccaccaggat

SEQ ID NO: 6978447 - DNA, 22 bp, Homo sapiens
taagatgatcaccaaatgctgg

SEQ ID NO: 6978448 - DNA, 22 bp, Homo sapiens
gttcctgcaagtaagtggctga

SEQ ID NO: 6978449 - DNA, 22 bp, Homo sapiens
tgataagatgctgagtgcattg

SEQ ID NO: 6978450 - DNA, 22 bp, Homo sapiens
tcatatgtcactcatgggcata

SEQ ID NO: 6978451 - DNA, 21 bp, Homo sapiens
tgatggaaaggattttgggtc

SEQ ID NO: 6978452 - DNA, 22 bp, Homo sapiens
ctgaggtctattttgaaactgc

SEQ ID NO: 6978453 - DNA, 22 bp, Homo sapiens
gcaagctgctcttatgtggagg

SEQ ID NO: 6978454 - DNA, 22 bp, Homo sapiens
ttgcacttatcctagcaaaagg

SEQ ID NO: 6978455 - DNA, 22 bp, Homo sapiens
gagctttcacagggtctcattg

SEQ ID NO: 6978456 - DNA, 22 bp, Homo sapiens
tctgtggtggagtgggcatgag

SEQ ID NO: 6978457 - DNA, 22 bp, Homo sapiens
ccctgggagctgcctggctgac

SEQ ID NO: 6978458 - DNA, 22 bp, Homo sapiens
tagctctttgagattggttctt

SEQ ID NO: 6978459 - DNA, 22 bp, Homo sapiens
atcatcgtcccttctcttgtca

SEQ ID NO: 6978460 - DNA, 22 bp, Homo sapiens
tgtaaagaaatagcatttgtag

SEQ ID NO: 6978461 - DNA, 22 bp, Homo sapiens
tgtgaaatctgatgaattgacc

SEQ ID NO: 6978462 - DNA, 22 bp, Homo sapiens
atagcttacaggtgatatcagc

SEQ ID NO: 6978463 - DNA, 19 bp, Homo sapiens
cagaggccagaagcacagg

SEQ ID NO: 6978464 - DNA, 22 bp, Homo sapiens
tcctaaaggctgcttttatatt

SEQ ID NO: 6978465 - DNA, 22 bp, Homo sapiens
gtggctttggaattgtagactc

SEQ ID NO: 6978466 - DNA, 22 bp, Homo sapiens
tccagagttgtaagtgttgaca

SEQ ID NO: 6978467 - DNA, 22 bp, Homo sapiens
ggtctgaagcccacgtggtacc

SEQ ID NO: 6978468 - DNA, 20 bp, Homo sapiens
tgttattagcaagcttcttt

SEQ ID NO: 6978469 - DNA, 22 bp, Homo sapiens
tcaggctgggagacaatcactg

SEQ ID NO: 6978470 - DNA, 22 bp, Homo sapiens
aggaggcctctatccagagaga

SEQ ID NO: 6978471 - DNA, 22 bp, Homo sapiens
atcactgtggaaaactgtatgg

SEQ ID NO: 6978472 - DNA, 22 bp, Homo sapiens
ccagctgctatcatgccatttc

SEQ ID NO: 6978473 - DNA, 22 bp, Homo sapiens
atgattttttctaacacagtcg

SEQ ID NO: 6978474 - DNA, 22 bp, Homo sapiens
tatctgttcatgtttatatgtc

SEQ ID NO: 6978475 - DNA, 22 bp, Homo sapiens
tcggaatgatacataatagtta

SEQ ID NO: 6978476 - DNA, 22 bp, Homo sapiens
cagacagggttttggtctttgg

SEQ ID NO: 6978477 - DNA, 22 bp, Homo sapiens
caaggatctcagctcactccct

SEQ ID NO: 6978478 - DNA, 22 bp, Homo sapiens
tgtttgctgttttctccaatga

SEQ ID NO: 6978479 - DNA, 22 bp, Homo sapiens
ggaccctgggcagctggctgct

SEQ ID NO: 6978480 - DNA, 22 bp, Homo sapiens
cagggacccgcacaggtagcat

SEQ ID NO: 6978481 - DNA, 22 bp, Homo sapiens
ttgctgtagggggaaaatactt

SEQ ID NO: 6978482 - DNA, 22 bp, Homo sapiens
tctgcagggatgtgaggggtga

SEQ ID NO: 6978483 - DNA, 22 bp, Homo sapiens
taagagcttagctaaggatgtg

SEQ ID NO: 6978484 - DNA, 22 bp, Homo sapiens
aggagactcagagacctggccg

SEQ ID NO: 6978485 - DNA, 22 bp, Homo sapiens
tttctacagctggtgcaacttt

SEQ ID NO: 6978486 - DNA, 22 bp, Homo sapiens
ttactagcaggattcagattct

SEQ ID NO: 6978487 - DNA, 22 bp, Homo sapiens
ggaaggagtctttaacacccat

SEQ ID NO: 6978488 - DNA, 22 bp, Homo sapiens
atctgcctccaagtccatgtgt

SEQ ID NO: 6978489 - DNA, 22 bp, Homo sapiens
tgagggtaacctggagctgctg

SEQ ID NO: 6978490 - DNA, 22 bp, Homo sapiens
aagtgaataccatcaagagctt

SEQ ID NO: 6978491 - DNA, 22 bp, Homo sapiens
actgccctgtaactgccaggta

SEQ ID NO: 6978492 - DNA, 22 bp, Homo sapiens
ttttatctgcttcattagttga

SEQ ID NO: 6978493 - DNA, 22 bp, Homo sapiens
gcacagagagcagtgggggaca

SEQ ID NO: 6978494 - DNA, 19 bp, Homo sapiens
ggtgtcaggcctctctcct

SEQ ID NO: 6978495 - DNA, 22 bp, Homo sapiens
tgaagctggaagttaggtagac

SEQ ID NO: 6978496 - DNA, 22 bp, Homo sapiens
cagagtcttgtgtgttcagccc

SEQ ID NO: 6978497 - DNA, 22 bp, Homo sapiens
ccctccttaccaccacagctcc

SEQ ID NO: 6978498 - DNA, 22 bp, Homo sapiens
cttcagtgacagccacccaggc

SEQ ID NO: 6978499 - DNA, 22 bp, Homo sapiens
tatggtcatttgttagtgcttt

SEQ ID NO: 6978500 - DNA, 22 bp, Homo sapiens
tgcatctgttcattcgttccca

SEQ ID NO: 6978501 - DNA, 22 bp, Homo sapiens
tggaaggggagctggaaagggg

SEQ ID NO: 6978502 - DNA, 22 bp, Homo sapiens
atttcacatctatctcagattt

SEQ ID NO: 6978503 - DNA, 22 bp, Homo sapiens
acaaggcaattcctggtgaatt

SEQ ID NO: 6978504 - DNA, 17 bp, Homo sapiens
ttcccctgaccaagcct

SEQ ID NO: 6978505 - DNA, 22 bp, Homo sapiens
agtgtctttctctctccaagtg

SEQ ID NO: 6978506 - DNA, 22 bp, Homo sapiens
gcagctggtctggcctagagta

SEQ ID NO: 6978507 - DNA, 22 bp, Homo sapiens
tcagtaaaataaaacatgggac

SEQ ID NO: 6978508 - DNA, 22 bp, Homo sapiens
ctgtctgctatgcttgttgtca

SEQ ID NO: 6978509 - DNA, 22 bp, Homo sapiens
ttgcatttcccattgagtaatg

SEQ ID NO: 6978510 - DNA, 22 bp, Homo sapiens
cacaagtttgggtcactcagct

SEQ ID NO: 6978511 - DNA, 22 bp, Homo sapiens
gaagttctgggatttccacagt

SEQ ID NO: 6978512 - DNA, 22 bp, Homo sapiens
gtctttatggtatgaaaactga

SEQ ID NO: 6978513 - DNA, 22 bp, Homo sapiens
aaagggaaaatatttagacata

SEQ ID NO: 6978514 - DNA, 22 bp, Homo sapiens
ggctctgtgagaacaaaggcta

SEQ ID NO: 6978515 - DNA, 22 bp, Homo sapiens
ggtgcaggagcggggtgctcgg

SEQ ID NO: 6978516 - DNA, 22 bp, Homo sapiens
atgtttcagttctaaagttaga

SEQ ID NO: 6978517 - DNA, 22 bp, Homo sapiens
tggcagctgcgttgtgtttctg

SEQ ID NO: 6978518 - DNA, 22 bp, Homo sapiens
tggctctgtggtcttagcatgc

SEQ ID NO: 6978519 - DNA, 22 bp, Homo sapiens
ccatggctccttgccctgtagc

SEQ ID NO: 6978520 - DNA, 22 bp, Homo sapiens
agctgaggaggaatgatgggta

SEQ ID NO: 6978521 - DNA, 22 bp, Homo sapiens
tcagaagcatgtggggagcctg

SEQ ID NO: 6978522 - DNA, 22 bp, Homo sapiens
tctgccaggggcacttgcggct

SEQ ID NO: 6978523 - DNA, 22 bp, Homo sapiens
aactgtaatgaattgttcatga

SEQ ID NO: 6978524 - DNA, 22 bp, Homo sapiens
ggctgctgaagtgtggcaatct

SEQ ID NO: 6978525 - DNA, 22 bp, Homo sapiens
tttgtgtgtgtataggaaagga

SEQ ID NO: 6978526 - DNA, 22 bp, Homo sapiens
agacaagaaactgggagtctct

SEQ ID NO: 6978527 - DNA, 22 bp, Homo sapiens
tctgagcagagcatcatttcag

SEQ ID NO: 6978528 - DNA, 22 bp, Homo sapiens
gggatgataatgccagagttaa

SEQ ID NO: 6978529 - DNA, 22 bp, Homo sapiens
agtgcccggggtgccagacaca

SEQ ID NO: 6978530 - DNA, 22 bp, Homo sapiens
ccaggaaatagtgctgtgatct

SEQ ID NO: 6978531 - DNA, 22 bp, Homo sapiens
gttcatgtggtttttaaaggat

SEQ ID NO: 6978532 - DNA, 22 bp, Homo sapiens
tgggggctgggatgtcactttc

SEQ ID NO: 6978533 - DNA, 22 bp, Homo sapiens
aagggctgcatttgatgtgtca

SEQ ID NO: 6978534 - DNA, 22 bp, Homo sapiens
ctgtttccatacaggtttttgg

SEQ ID NO: 6978535 - DNA, 22 bp, Homo sapiens
ggcagggactttgcaaatcttt

SEQ ID NO: 6978536 - DNA, 22 bp, Homo sapiens
gctcgcctggctggatctgggt

SEQ ID NO: 6978537 - DNA, 22 bp, Homo sapiens
tatgccagcacttagatgagat

SEQ ID NO: 6978538 - DNA, 22 bp, Homo sapiens
gaggccttagagcttttctaga

SEQ ID NO: 6978539 - DNA, 22 bp, Homo sapiens
atgtggccagtcatgtagtaac

SEQ ID NO: 6978540 - DNA, 22 bp, Homo sapiens
ttcatttgccatcagtgtaatg

SEQ ID NO: 6978541 - DNA, 23 bp, Homo sapiens
catgacaaaggatctcatgggcc

SEQ ID NO: 6978542 - DNA, 22 bp, Homo sapiens
cttagcacatatcagaaaatag

SEQ ID NO: 6978543 - DNA, 22 bp, Homo sapiens
tgtagcacatgcattagagtgt

SEQ ID NO: 6978544 - DNA, 22 bp, Homo sapiens
tgttccctcctccccactgggt

SEQ ID NO: 6978545 - DNA, 22 bp, Homo sapiens
agctggcaaggctttagattca

SEQ ID NO: 6978546 - DNA, 22 bp, Homo sapiens
catagaacagctcctagcacat

SEQ ID NO: 6978547 - DNA, 22 bp, Homo sapiens
aatctgtttttgaaactttgta

SEQ ID NO: 6978548 - DNA, 22 bp, Homo sapiens
acacatgtttccaaaagcaccc

SEQ ID NO: 6978549 - DNA, 22 bp, Homo sapiens
gtggttttacaaagagaaagat

SEQ ID NO: 6978550 - DNA, 22 bp, Homo sapiens
caagcttggccttccagggacc

SEQ ID NO: 6978551 - DNA, 22 bp, Homo sapiens
gacaagtcatctggggcctgtg

SEQ ID NO: 6978552 - DNA, 22 bp, Homo sapiens
aacatgaaaagcccagagaggt

SEQ ID NO: 6978553 - DNA, 19 bp, Homo sapiens
tgcagctcagggcaggggc

SEQ ID NO: 6978554 - DNA, 22 bp, Homo sapiens
aaagtggtctgcatcccttctg

SEQ ID NO: 6978555 - DNA, 22 bp, Homo sapiens
gggtgagacagaaagagcaaaa

SEQ ID NO: 6978556 - DNA, 22 bp, Homo sapiens
gccagtgttcttcaccccctct

SEQ ID NO: 6978557 - DNA, 22 bp, Homo sapiens
gaccactggggtgagggccatc

SEQ ID NO: 6978558 - DNA, 21 bp, Homo sapiens
ggctgctgggggttggcacag

SEQ ID NO: 6978559 - DNA, 22 bp, Homo sapiens
ccactgccgatgttccatcttg

SEQ ID NO: 6978560 - DNA, 22 bp, Homo sapiens
agcccaggagtccttaaggacc

SEQ ID NO: 6978561 - DNA, 22 bp, Homo sapiens
aagttctatgaatctactccaa

SEQ ID NO: 6978562 - DNA, 22 bp, Homo sapiens
accaggaagtgtgggccaacgt

SEQ ID NO: 6978563 - DNA, 22 bp, Homo sapiens
gatgtacttgccttatctatcc

SEQ ID NO: 6978564 - DNA, 22 bp, Homo sapiens
gacaagactatgtagaaagtat

SEQ ID NO: 6978565 - DNA, 17 bp, Homo sapiens
gaaatcggacgatttta

SEQ ID NO: 6978566 - DNA, 22 bp, Homo sapiens
ttaggcatgcaagattaagctc

SEQ ID NO: 6978567 - DNA, 18 bp, Homo sapiens
gccattcttctaagtact

SEQ ID NO: 6978568 - DNA, 22 bp, Homo sapiens
agtggtgccgggtgggttttgc

SEQ ID NO: 6978569 - DNA, 20 bp, Homo sapiens
agcaacaataaaatgtcctg

SEQ ID NO: 6978570 - DNA, 22 bp, Homo sapiens
cctgcctggtgtaagtctaagg

SEQ ID NO: 6978571 - DNA, 22 bp, Homo sapiens
ggccactgccctggctacaccg

SEQ ID NO: 6978572 - DNA, 22 bp, Homo sapiens
ttgtagatgtgtttttatctca

SEQ ID NO: 6978573 - DNA, 22 bp, Homo sapiens
gatctttactactgccttctct

SEQ ID NO: 6978574 - DNA, 22 bp, Homo sapiens
cattctatgaaaactaggcaat

SEQ ID NO: 6978575 - DNA, 22 bp, Homo sapiens
ggctgtgcagggcagagtctca

SEQ ID NO: 6978576 - DNA, 22 bp, Homo sapiens
cacaggcttccagtccccagct

SEQ ID NO: 6978577 - DNA, 22 bp, Homo sapiens
tttgactcttctagcaagtgtg

SEQ ID NO: 6978578 - DNA, 22 bp, Homo sapiens
gaggccaggagtgctgtaagtt

SEQ ID NO: 6978579 - DNA, 22 bp, Homo sapiens
tgctcacagcccagaacataat

SEQ ID NO: 6978580 - DNA, 22 bp, Homo sapiens
caggcagtggctcacagcaacc

SEQ ID NO: 6978581 - DNA, 22 bp, Homo sapiens
tggaatgtaatcatgtggtggt

SEQ ID NO: 6978582 - DNA, 22 bp, Homo sapiens
aataagataagatttctgctct

SEQ ID NO: 6978583 - DNA, 22 bp, Homo sapiens
cggagtggggactggggtaatc

SEQ ID NO: 6978584 - DNA, 22 bp, Homo sapiens
aatgcccccaggcctggaggag

SEQ ID NO: 6978585 - DNA, 22 bp, Homo sapiens
atgtatttgcgtatggacatac

SEQ ID NO: 6978586 - DNA, 22 bp, Homo sapiens
tggtttctgggtttgtctagga

SEQ ID NO: 6978587 - DNA, 22 bp, Homo sapiens
ctggaaggcagaggttgcagtg

SEQ ID NO: 6978588 - DNA, 22 bp, Homo sapiens
tagtgccattgccaggaagggc

SEQ ID NO: 6978589 - DNA, 22 bp, Homo sapiens
aaaccttcacatctactctaca

SEQ ID NO: 6978590 - DNA, 20 bp, Homo sapiens
tctgggcagggcacatggaa

SEQ ID NO: 6978591 - DNA, 22 bp, Homo sapiens
agtaagcaccgggatggtcaag

SEQ ID NO: 6978592 - DNA, 22 bp, Homo sapiens
caagttttagaaatatctggat

SEQ ID NO: 6978593 - DNA, 22 bp, Homo sapiens
ctggacatttcgcacccttcca

SEQ ID NO: 6978594 - DNA, 22 bp, Homo sapiens
cttaggaaagttggctgatttc

SEQ ID NO: 6978595 - DNA, 22 bp, Homo sapiens
aagatgatggtatatagggtat

SEQ ID NO: 6978596 - DNA, 23 bp, Homo sapiens
agcttcattgacctccgcagggg

SEQ ID NO: 6978597 - DNA, 22 bp, Homo sapiens
gaacacagtggttgtttggagg

SEQ ID NO: 6978598 - DNA, 22 bp, Homo sapiens
tggtatttgtcattcgagttct

SEQ ID NO: 6978599 - DNA, 22 bp, Homo sapiens
tggaggagtgtgattgtctgcc

SEQ ID NO: 6978600 - DNA, 22 bp, Homo sapiens
ctctgtgtctgaagccctattt

SEQ ID NO: 6978601 - DNA, 22 bp, Homo sapiens
gctgccttggtagtgaccatct

SEQ ID NO: 6978602 - DNA, 22 bp, Homo sapiens
tggtatttctgtgcccagctca

SEQ ID NO: 6978603 - DNA, 22 bp, Homo sapiens
agagcctgaggatgtcccagct

SEQ ID NO: 6978604 - DNA, 22 bp, Homo sapiens
tctttcagctcttcaggaccca

SEQ ID NO: 6978605 - DNA, 17 bp, Homo sapiens
gagagtgtattggatgc

SEQ ID NO: 6978606 - DNA, 22 bp, Homo sapiens
gcctgtgatgcccccataagta

SEQ ID NO: 6978607 - DNA, 22 bp, Homo sapiens
tcatcagcaccctatgtccttt

SEQ ID NO: 6978608 - DNA, 22 bp, Homo sapiens
aacatgttgagttgaaagtagc

SEQ ID NO: 6978609 - DNA, 22 bp, Homo sapiens
acaaggcagttaaaatggttaa

SEQ ID NO: 6978610 - DNA, 22 bp, Homo sapiens
aactgatgctagaagagacgtt

SEQ ID NO: 6978611 - DNA, 22 bp, Homo sapiens
aaggggcctcacagatgggctt

SEQ ID NO: 6978612 - DNA, 22 bp, Homo sapiens
tacaaggcaaatccatgatgtc

SEQ ID NO: 6978613 - DNA, 22 bp, Homo sapiens
aactcttaattttcatgaaatg

SEQ ID NO: 6978614 - DNA, 23 bp, Homo sapiens
catgctgtgatacaggaaggttg

SEQ ID NO: 6978615 - DNA, 22 bp, Homo sapiens
tgtgtgaacatgttttcatttc

SEQ ID NO: 6978616 - DNA, 22 bp, Homo sapiens
cataaactcttgagattcttgt

SEQ ID NO: 6978617 - DNA, 22 bp, Homo sapiens
cagagtggcatgaatgaagcct

SEQ ID NO: 6978618 - DNA, 22 bp, Homo sapiens
tgggcctgtttcccttcagggc

SEQ ID NO: 6978619 - DNA, 22 bp, Homo sapiens
agcaacctcatgagagtgaaat

SEQ ID NO: 6978620 - DNA, 22 bp, Homo sapiens
tataggtagccatatttgatag

SEQ ID NO: 6978621 - DNA, 22 bp, Homo sapiens
ttcttttaatgttctgaagttt

SEQ ID NO: 6978622 - DNA, 22 bp, Homo sapiens
aatatcaacagtgtccttctaa

SEQ ID NO: 6978623 - DNA, 22 bp, Homo sapiens
ttgtggcttctacgcccacagg

SEQ ID NO: 6978624 - DNA, 22 bp, Homo sapiens
aatggtttctgaagttaggcag

SEQ ID NO: 6978625 - DNA, 22 bp, Homo sapiens
agctttggccctggaggttact

SEQ ID NO: 6978626 - DNA, 22 bp, Homo sapiens
gatggtcctcctgctgcctctc

SEQ ID NO: 6978627 - DNA, 22 bp, Homo sapiens
tcagggaagagagatctcctag

SEQ ID NO: 6978628 - DNA, 22 bp, Homo sapiens
gcagaccctgaactgggcatgg

SEQ ID NO: 6978629 - DNA, 22 bp, Homo sapiens
ataagctgaatagtcaacacaa

SEQ ID NO: 6978630 - DNA, 22 bp, Homo sapiens
gcctgggtaggagacaaaaggt

SEQ ID NO: 6978631 - DNA, 22 bp, Homo sapiens
gtgcagtgagcagtgcagcacc

SEQ ID NO: 6978632 - DNA, 22 bp, Homo sapiens
aaacatgtttagaaagcagctg

SEQ ID NO: 6978633 - DNA, 22 bp, Homo sapiens
tggcaggaaaaagggccagagg

SEQ ID NO: 6978634 - DNA, 22 bp, Homo sapiens
acaccacaagtaactcttttcc

SEQ ID NO: 6978635 - DNA, 22 bp, Homo sapiens
tttcacactgtgatgtacgttt

SEQ ID NO: 6978636 - DNA, 22 bp, Homo sapiens
ggggacagttaaagaccaagac

SEQ ID NO: 6978637 - DNA, 22 bp, Homo sapiens
ataaatatcactgttgtccctc

SEQ ID NO: 6978638 - DNA, 22 bp, Homo sapiens
ctggctggcaagtagaacacaa

SEQ ID NO: 6978639 - DNA, 22 bp, Homo sapiens
ctccaggttttacaaggtctat

SEQ ID NO: 6978640 - DNA, 19 bp, Homo sapiens
ggtttgaagaaaatcttgc

SEQ ID NO: 6978641 - DNA, 22 bp, Homo sapiens
tgggagctggggttggacgtct

SEQ ID NO: 6978642 - DNA, 22 bp, Homo sapiens
tgcatgtatgtgctcacatgtg

SEQ ID NO: 6978643 - DNA, 22 bp, Homo sapiens
agttttgggaatatgtaattat

SEQ ID NO: 6978644 - DNA, 22 bp, Homo sapiens
agatgtggaaagaagttagaag

SEQ ID NO: 6978645 - DNA, 22 bp, Homo sapiens
tattattatctttgaatgggac

SEQ ID NO: 6978646 - DNA, 20 bp, Homo sapiens
tgtattctttgctctccact

SEQ ID NO: 6978647 - DNA, 22 bp, Homo sapiens
ggagacccaggttaggaagtaa

SEQ ID NO: 6978648 - DNA, 22 bp, Homo sapiens
atggtggtagaagcactatgtg

SEQ ID NO: 6978649 - DNA, 22 bp, Homo sapiens
cctgggcagtgctggagttgaa

SEQ ID NO: 6978650 - DNA, 22 bp, Homo sapiens
gccagctgtgcttttcctaaaa

SEQ ID NO: 6978651 - DNA, 20 bp, Homo sapiens
acatgaaaggaaacaggaaa

SEQ ID NO: 6978652 - DNA, 23 bp, Homo sapiens
ctgcttccttgcttcattgctgg

SEQ ID NO: 6978653 - DNA, 22 bp, Homo sapiens
ctcacctgcaatcccttccagg

SEQ ID NO: 6978654 - DNA, 22 bp, Homo sapiens
tctgtgcctcatctggttcagg

SEQ ID NO: 6978655 - DNA, 21 bp, Homo sapiens
agctgcttcacctggacaaca

SEQ ID NO: 6978656 - DNA, 22 bp, Homo sapiens
actttctgtggttaccagggag

SEQ ID NO: 6978657 - DNA, 22 bp, Homo sapiens
ttcctcatggggttccttcaga

SEQ ID NO: 6978658 - DNA, 22 bp, Homo sapiens
tcctcagtcacggtagcacatt

SEQ ID NO: 6978659 - DNA, 22 bp, Homo sapiens
ctccaggactgaggacagagct

SEQ ID NO: 6978660 - DNA, 22 bp, Homo sapiens
tagaaaactaatacatgcttga

SEQ ID NO: 6978661 - DNA, 22 bp, Homo sapiens
tgccttcaagacccatcctcca

SEQ ID NO: 6978662 - DNA, 22 bp, Homo sapiens
gatgtagattcatatgtggtgt

SEQ ID NO: 6978663 - DNA, 22 bp, Homo sapiens
gcagagattatgccatggaaag

SEQ ID NO: 6978664 - DNA, 22 bp, Homo sapiens
tgattctgtaaacatgtcttta

SEQ ID NO: 6978665 - DNA, 22 bp, Homo sapiens
tggctcctaatcggcttctttc

SEQ ID NO: 6978666 - DNA, 22 bp, Homo sapiens
gggtcttggctctggaaatgct

SEQ ID NO: 6978667 - DNA, 22 bp, Homo sapiens
gcacagagctggccctccaggc

SEQ ID NO: 6978668 - DNA, 22 bp, Homo sapiens
ttgacaatccctgttagaagtg

SEQ ID NO: 6978669 - DNA, 22 bp, Homo sapiens
tccagccccgaggccggcgacg

SEQ ID NO: 6978670 - DNA, 22 bp, Homo sapiens
ttacatgggcttgtgagtcctt

SEQ ID NO: 6978671 - DNA, 22 bp, Homo sapiens
tgcatagggaacctcatgcatt

SEQ ID NO: 6978672 - DNA, 22 bp, Homo sapiens
gagattctatgttgttgattat

SEQ ID NO: 6978673 - DNA, 22 bp, Homo sapiens
tcaattctgcatacatttcact

SEQ ID NO: 6978674 - DNA, 22 bp, Homo sapiens
tccataaatgaaatagaacgct

SEQ ID NO: 6978675 - DNA, 22 bp, Homo sapiens
cagccaggagcctctgcaacta

SEQ ID NO: 6978676 - DNA, 21 bp, Homo sapiens
atagaccagtatggataacag

SEQ ID NO: 6978677 - DNA, 22 bp, Homo sapiens
ctggaggtgcctagatgagctc

SEQ ID NO: 6978678 - DNA, 22 bp, Homo sapiens
cacgccagccggacactgggcc

SEQ ID NO: 6978679 - DNA, 22 bp, Homo sapiens
tacagtcacattctgaggtctt

SEQ ID NO: 6978680 - DNA, 22 bp, Homo sapiens
gtgctgtcaattgctttcagta

SEQ ID NO: 6978681 - DNA, 22 bp, Homo sapiens
ttagagcaggagttgacagatt

SEQ ID NO: 6978682 - DNA, 22 bp, Homo sapiens
tagggagaaacaccaatttatt

SEQ ID NO: 6978683 - DNA, 22 bp, Homo sapiens
cagccatcccagcctgtggttc

SEQ ID NO: 6978684 - DNA, 22 bp, Homo sapiens
gctggcagacttcctctggaac

SEQ ID NO: 6978685 - DNA, 22 bp, Homo sapiens
ccaggcccagggtactgaccaa

SEQ ID NO: 6978686 - DNA, 22 bp, Homo sapiens
aagtttgggatgctccttggac

SEQ ID NO: 6978687 - DNA, 23 bp, Homo sapiens
atgttaagaaggtagttaggata

SEQ ID NO: 6978688 - DNA, 22 bp, Homo sapiens
atttaatttggagagagaaacc

SEQ ID NO: 6978689 - DNA, 22 bp, Homo sapiens
tgcttctgaaatgcaggtcttc

SEQ ID NO: 6978690 - DNA, 22 bp, Homo sapiens
cataatttcactgtcgtatggc

SEQ ID NO: 6978691 - DNA, 22 bp, Homo sapiens
cagaggccagtggacaagggcc

SEQ ID NO: 6978692 - DNA, 20 bp, Homo sapiens
cctctctgaagaggtcatct

SEQ ID NO: 6978693 - DNA, 22 bp, Homo sapiens
acagatttgttcttttgggcta

SEQ ID NO: 6978694 - DNA, 22 bp, Homo sapiens
aggtctagatttatagacagca

SEQ ID NO: 6978695 - DNA, 22 bp, Homo sapiens
cggagctggcgtctgtgtggac

SEQ ID NO: 6978696 - DNA, 20 bp, Homo sapiens
ctgcagggttagaggctcca

SEQ ID NO: 6978697 - DNA, 22 bp, Homo sapiens
atggagtacagggaaatatgat

SEQ ID NO: 6978698 - DNA, 22 bp, Homo sapiens
tcttcagagatgtaacatatgg

SEQ ID NO: 6978699 - DNA, 22 bp, Homo sapiens
acactgatgttggccctggtca

SEQ ID NO: 6978700 - DNA, 22 bp, Homo sapiens
ccagagcctcaacacaggtcct

SEQ ID NO: 6978701 - DNA, 22 bp, Homo sapiens
gcatgtggatatgttagggtga

SEQ ID NO: 6978702 - DNA, 22 bp, Homo sapiens
ccaaggaggccccaggtcagct

SEQ ID NO: 6978703 - DNA, 22 bp, Homo sapiens
ggcaaaggaaccaggccacact

SEQ ID NO: 6978704 - DNA, 22 bp, Homo sapiens
gactgtgacttctgaagcaata

SEQ ID NO: 6978705 - DNA, 23 bp, Homo sapiens
tgtaaaccattttgcatcccatg

SEQ ID NO: 6978706 - DNA, 19 bp, Homo sapiens
atcaggcttctattttctc

SEQ ID NO: 6978707 - DNA, 22 bp, Homo sapiens
agatatctccagtgatgctcgt

SEQ ID NO: 6978708 - DNA, 22 bp, Homo sapiens
cattcataggaagaaaatgggc

SEQ ID NO: 6978709 - DNA, 22 bp, Homo sapiens
tcatctcttttgtattggggtt

SEQ ID NO: 6978710 - DNA, 22 bp, Homo sapiens
acttccctgtgggcaggtagtg

SEQ ID NO: 6978711 - DNA, 19 bp, Homo sapiens
ctagattatggaatgctgc

SEQ ID NO: 6978712 - DNA, 22 bp, Homo sapiens
attatgcatatacatttgacta

SEQ ID NO: 6978713 - DNA, 22 bp, Homo sapiens
ttctagttttgccacaggatac

SEQ ID NO: 6978714 - DNA, 22 bp, Homo sapiens
agaagcaggcctcacagatctg

SEQ ID NO: 6978715 - DNA, 22 bp, Homo sapiens
ttctgggtgccacctaagacat

SEQ ID NO: 6978716 - DNA, 22 bp, Homo sapiens
gtcattgactagaattccaaag

SEQ ID NO: 6978717 - DNA, 22 bp, Homo sapiens
acttcattcattttcacgaatg

SEQ ID NO: 6978718 - DNA, 22 bp, Homo sapiens
aggtcctggtgaccatggagtt

SEQ ID NO: 6978719 - DNA, 22 bp, Homo sapiens
ttgttcttggagcaggcagaga

SEQ ID NO: 6978720 - DNA, 22 bp, Homo sapiens
ataagtaggaaaatttgaatat

SEQ ID NO: 6978721 - DNA, 22 bp, Homo sapiens
catgctgagcacattctgtatt

SEQ ID NO: 6978722 - DNA, 22 bp, Homo sapiens
agatggctccagtgtccagagg

SEQ ID NO: 6978723 - DNA, 22 bp, Homo sapiens
aaagtgttgggattacaggtgt

SEQ ID NO: 6978724 - DNA, 22 bp, Homo sapiens
cttaggcaagcagagcccatcc

SEQ ID NO: 6978725 - DNA, 22 bp, Homo sapiens
agttagtacaagaaagatgaac

SEQ ID NO: 6978726 - DNA, 22 bp, Homo sapiens
tgacaattcattatatctacag

SEQ ID NO: 6978727 - DNA, 22 bp, Homo sapiens
tgcctgccatgcagaaagctga

SEQ ID NO: 6978728 - DNA, 22 bp, Homo sapiens
gtcctctgggctttgagcagtc

SEQ ID NO: 6978729 - DNA, 22 bp, Homo sapiens
tattttgacgattttatgcaaa

SEQ ID NO: 6978730 - DNA, 22 bp, Homo sapiens
tgtggcagctgctgcaggagct

SEQ ID NO: 6978731 - DNA, 22 bp, Homo sapiens
gagaaactgaatatttaacggg

SEQ ID NO: 6978732 - DNA, 22 bp, Homo sapiens
ctattaaatactcttcaaattg

SEQ ID NO: 6978733 - DNA, 22 bp, Homo sapiens
cagcatgattggtgtctggtga

SEQ ID NO: 6978734 - DNA, 22 bp, Homo sapiens
cctggcttctctgcattgttct

SEQ ID NO: 6978735 - DNA, 22 bp, Homo sapiens
cagttttctaaagtctctttaa

SEQ ID NO: 6978736 - DNA, 22 bp, Homo sapiens
gtgtcctttccgggcctggagg

SEQ ID NO: 6978737 - DNA, 22 bp, Homo sapiens
tgagccctacctgctcatctcc

SEQ ID NO: 6978738 - DNA, 22 bp, Homo sapiens
ggtcagtctctcccgagtgttg

SEQ ID NO: 6978739 - DNA, 14 bp, Homo sapiens
gcaggtggatcacc

SEQ ID NO: 6978740 - DNA, 14 bp, Homo sapiens
gcaggcggatcact

SEQ ID NO: 6978741 - DNA, 22 bp, Homo sapiens
agtttgaagaaggtgagatgca

SEQ ID NO: 6978742 - DNA, 22 bp, Homo sapiens
ttgaaggaggcgaaaattggtc

SEQ ID NO: 6978743 - DNA, 22 bp, Homo sapiens
gaaaggtttcatctacttttca

SEQ ID NO: 6978744 - DNA, 22 bp, Homo sapiens
aattttcacagtgctgtgagat

SEQ ID NO: 6978745 - DNA, 22 bp, Homo sapiens
tcagcttgatccatccaactat

SEQ ID NO: 6978746 - DNA, 22 bp, Homo sapiens
aacatgtgtctggctagattgt

SEQ ID NO: 6978747 - DNA, 22 bp, Homo sapiens
agtaaaggaaggaccttggaag

SEQ ID NO: 6978748 - DNA, 22 bp, Homo sapiens
agcccaggttctaaagccaaac

SEQ ID NO: 6978749 - DNA, 18 bp, Homo sapiens
agcagtgtggcaagcaga

SEQ ID NO: 6978750 - DNA, 23 bp, Homo sapiens
tgcaggtgattaatccagtttca

SEQ ID NO: 6978751 - DNA, 22 bp, Homo sapiens
aagcatgcagactacccctagg

SEQ ID NO: 6978752 - DNA, 22 bp, Homo sapiens
cagcttagatggatacaaaggt

SEQ ID NO: 6978753 - DNA, 22 bp, Homo sapiens
ttgaaaggcacaggcacctggg

SEQ ID NO: 6978754 - DNA, 22 bp, Homo sapiens
tgctgatgctgttctgttagga

SEQ ID NO: 6978755 - DNA, 22 bp, Homo sapiens
cagaacttggcaaagccgactg

SEQ ID NO: 6978756 - DNA, 22 bp, Homo sapiens
tctcagagtggtggtccctctg

SEQ ID NO: 6978757 - DNA, 20 bp, Homo sapiens
tcccatcacgcctgtgccag

SEQ ID NO: 6978758 - DNA, 22 bp, Homo sapiens
tacagcaatgctacaagatgac

SEQ ID NO: 6978759 - DNA, 22 bp, Homo sapiens
cagtgaagtgtggacgtcacca

SEQ ID NO: 6978760 - DNA, 22 bp, Homo sapiens
gggttcctccagttcctagagc

SEQ ID NO: 6978761 - DNA, 22 bp, Homo sapiens
agaagtgaaactgcaaaagtgt

SEQ ID NO: 6978762 - DNA, 22 bp, Homo sapiens
cttgaaaataagaaagactttc

SEQ ID NO: 6978763 - DNA, 22 bp, Homo sapiens
ggggcattgtgtctgggttcct

SEQ ID NO: 6978764 - DNA, 20 bp, Homo sapiens
cactgccctccagcctgagc

SEQ ID NO: 6978765 - DNA, 22 bp, Homo sapiens
gaaatacaggaatgccacacag

SEQ ID NO: 6978766 - DNA, 22 bp, Homo sapiens
tgctggagacatagcaggcagc

SEQ ID NO: 6978767 - DNA, 22 bp, Homo sapiens
tatattgagatttgagcattgt

SEQ ID NO: 6978768 - DNA, 20 bp, Homo sapiens
tcctggaggcttcatccata

SEQ ID NO: 6978769 - DNA, 22 bp, Homo sapiens
ttcccacaggatgagagctgag

SEQ ID NO: 6978770 - DNA, 22 bp, Homo sapiens
caaatagacttcaatctcttga

SEQ ID NO: 6978771 - DNA, 22 bp, Homo sapiens
gcagtagtgtcagtacagcaaa

SEQ ID NO: 6978772 - DNA, 22 bp, Homo sapiens
ttggccctccacctggctgtgc

SEQ ID NO: 6978773 - DNA, 22 bp, Homo sapiens
atcatcctattgtgccccaggt

SEQ ID NO: 6978774 - DNA, 22 bp, Homo sapiens
tttccaataaagtgtcattgtt

SEQ ID NO: 6978775 - DNA, 23 bp, Homo sapiens
cctcagaggcctcatagtctggc

SEQ ID NO: 6978776 - DNA, 18 bp, Homo sapiens
ccagagctggctcctcgc

SEQ ID NO: 6978777 - DNA, 22 bp, Homo sapiens
ggagacaacaatcatgtgtgaa

SEQ ID NO: 6978778 - DNA, 22 bp, Homo sapiens
atactgtaatacctaaatgaac

SEQ ID NO: 6978779 - DNA, 22 bp, Homo sapiens
attgcctggggaagagggtgtt

SEQ ID NO: 6978780 - DNA, 22 bp, Homo sapiens
acaggtggccccgagggagtgg

SEQ ID NO: 6978781 - DNA, 20 bp, Homo sapiens
gtcttgaaggggtcatggag

SEQ ID NO: 6978782 - DNA, 21 bp, Homo sapiens
gtattgcagagttatgtgctc

SEQ ID NO: 6978783 - DNA, 22 bp, Homo sapiens
agtgcagccgagatcaggtgct

SEQ ID NO: 6978784 - DNA, 22 bp, Homo sapiens
ctcatgtcttcacccattctaa

SEQ ID NO: 6978785 - DNA, 22 bp, Homo sapiens
ctctttactgctactacaaaga

SEQ ID NO: 6978786 - DNA, 22 bp, Homo sapiens
gaccctgagcaaaagcagttct

SEQ ID NO: 6978787 - DNA, 22 bp, Homo sapiens
gtcttattaggttaaccctgct

SEQ ID NO: 6978788 - DNA, 22 bp, Homo sapiens
agggtccagtaacagatgccag

SEQ ID NO: 6978789 - DNA, 22 bp, Homo sapiens
tcctggtgtcgcctggtcagtt

SEQ ID NO: 6978790 - DNA, 22 bp, Homo sapiens
tagcatggtctggaattctcag

SEQ ID NO: 6978791 - DNA, 22 bp, Homo sapiens
tttctagcatgacacagtcctc

SEQ ID NO: 6978792 - DNA, 22 bp, Homo sapiens
gtcaggatttgaactcaggtct

SEQ ID NO: 6978793 - DNA, 22 bp, Homo sapiens
agtcctagacgtttgacaatgt

SEQ ID NO: 6978794 - DNA, 22 bp, Homo sapiens
cccaggaggcagaagttgcagt

SEQ ID NO: 6978795 - DNA, 22 bp, Homo sapiens
tagaatctagttcattcatttg

SEQ ID NO: 6978796 - DNA, 22 bp, Homo sapiens
tgcaggaatgaggttctcagtt

SEQ ID NO: 6978797 - DNA, 22 bp, Homo sapiens
aactctgccaggtttcaggagc

SEQ ID NO: 6978798 - DNA, 22 bp, Homo sapiens
aggtccctggctagcactggaa

SEQ ID NO: 6978799 - DNA, 22 bp, Homo sapiens
cactgttcacattttagtctat

SEQ ID NO: 6978800 - DNA, 22 bp, Homo sapiens
tttgactcaagcctttctttag

SEQ ID NO: 6978801 - DNA, 22 bp, Homo sapiens
cactagtaattcttgtgctgga

SEQ ID NO: 6978802 - DNA, 19 bp, Homo sapiens
atttttcttcctctgtgca

SEQ ID NO: 6978803 - DNA, 22 bp, Homo sapiens
tttcacaggatgctgttttata

SEQ ID NO: 6978804 - DNA, 22 bp, Homo sapiens
acctggcacacactggggagtg

SEQ ID NO: 6978805 - DNA, 22 bp, Homo sapiens
caagaaattctgttcagatagc

SEQ ID NO: 6978806 - DNA, 22 bp, Homo sapiens
agcacagaggtggaagtgtata

SEQ ID NO: 6978807 - DNA, 22 bp, Homo sapiens
ggcactttccagtctatagagc

SEQ ID NO: 6978808 - DNA, 22 bp, Homo sapiens
ggcgtgctgcccgggcctgctg

SEQ ID NO: 6978809 - DNA, 22 bp, Homo sapiens
atacttgtagccatcatagcat

SEQ ID NO: 6978810 - DNA, 22 bp, Homo sapiens
gacctcgtgatctgccggcctt

SEQ ID NO: 6978811 - DNA, 22 bp, Homo sapiens
gtggggcctgtggcttccgtgg

SEQ ID NO: 6978812 - DNA, 17 bp, Homo sapiens
ggtggaagtttctagtt

SEQ ID NO: 6978813 - DNA, 22 bp, Homo sapiens
tgtgttctggaaagctcactga

SEQ ID NO: 6978814 - DNA, 22 bp, Homo sapiens
gcttttgtggtgatggagaggc

SEQ ID NO: 6978815 - DNA, 22 bp, Homo sapiens
tagagctatacactgagtaaaa

SEQ ID NO: 6978816 - DNA, 22 bp, Homo sapiens
gccagggttcaagctattctcc

SEQ ID NO: 6978817 - DNA, 22 bp, Homo sapiens
gggagaactgggtggagcatct

SEQ ID NO: 6978818 - DNA, 22 bp, Homo sapiens
ttgcagcttcgagtctatctgt

SEQ ID NO: 6978819 - DNA, 22 bp, Homo sapiens
agctatgtatttgtgtgttaaa

SEQ ID NO: 6978820 - DNA, 22 bp, Homo sapiens
acaaagataagtcagaaagtca

SEQ ID NO: 6978821 - DNA, 22 bp, Homo sapiens
aaggtttccagtgatattgtgg

SEQ ID NO: 6978822 - DNA, 21 bp, Homo sapiens
tagcccttctccacctcgccc

SEQ ID NO: 6978823 - DNA, 22 bp, Homo sapiens
tgcctaccctgcccgcagacac

SEQ ID NO: 6978824 - DNA, 22 bp, Homo sapiens
ctgcatgctgagccaacagtga

SEQ ID NO: 6978825 - DNA, 22 bp, Homo sapiens
tcaccactcactcaggcaagtc

SEQ ID NO: 6978826 - DNA, 22 bp, Homo sapiens
cgtctgcccgactgttcttcac

SEQ ID NO: 6978827 - DNA, 22 bp, Homo sapiens
tcaggagctatggactgtcaaa

SEQ ID NO: 6978828 - DNA, 22 bp, Homo sapiens
agcatggggctccgcaatgaac

SEQ ID NO: 6978829 - DNA, 22 bp, Homo sapiens
ttgaagagttttatgccaacct

SEQ ID NO: 6978830 - DNA, 22 bp, Homo sapiens
gttcacatggcattttcacatc

SEQ ID NO: 6978831 - DNA, 22 bp, Homo sapiens
cagtaaaggttttatggggctt

SEQ ID NO: 6978832 - DNA, 22 bp, Homo sapiens
gacatacatctctggaaaaaaa

SEQ ID NO: 6978833 - DNA, 22 bp, Homo sapiens
gttctagacaccagggattcag

SEQ ID NO: 6978834 - DNA, 22 bp, Homo sapiens
acatagaaggaggctggcagct

SEQ ID NO: 6978835 - DNA, 19 bp, Homo sapiens
gctagggttggtggcgtgc

SEQ ID NO: 6978836 - DNA, 22 bp, Homo sapiens
ccttaagaaatagcatttaaat

SEQ ID NO: 6978837 - DNA, 22 bp, Homo sapiens
tccattgacacaacaggaggaa

SEQ ID NO: 6978838 - DNA, 22 bp, Homo sapiens
agatgctgggaggctgagtgca

SEQ ID NO: 6978839 - DNA, 22 bp, Homo sapiens
ttggttccttctgaaagtattg

SEQ ID NO: 6978840 - DNA, 23 bp, Homo sapiens
ctgccccaattataaaagaagat

SEQ ID NO: 6978841 - DNA, 22 bp, Homo sapiens
cactggtacgtaggttggggca

SEQ ID NO: 6978842 - DNA, 22 bp, Homo sapiens
agaaataagagctttccttggg

SEQ ID NO: 6978843 - DNA, 18 bp, Homo sapiens
ccaggtggtgacagagat

SEQ ID NO: 6978844 - DNA, 23 bp, Homo sapiens
gtgaagatgtattatggattggc

SEQ ID NO: 6978845 - DNA, 22 bp, Homo sapiens
tgcttccttgatcattcccaaa

SEQ ID NO: 6978846 - DNA, 22 bp, Homo sapiens
gggtggggtgtatcggatccta

SEQ ID NO: 6978847 - DNA, 22 bp, Homo sapiens
ttttaagatgctagtatttcag

SEQ ID NO: 6978848 - DNA, 22 bp, Homo sapiens
ccactggcagttggctagcctt

SEQ ID NO: 6978849 - DNA, 22 bp, Homo sapiens
ctctggatatgcactgggtgag

SEQ ID NO: 6978850 - DNA, 22 bp, Homo sapiens
ggagggcacaggaccagaaatc

SEQ ID NO: 6978851 - DNA, 22 bp, Homo sapiens
acctgcttgagccagtatgaga

SEQ ID NO: 6978852 - DNA, 22 bp, Homo sapiens
ttgctgaaaggtagctgtgtgg

SEQ ID NO: 6978853 - DNA, 22 bp, Homo sapiens
tttccaagtactgagctgtcaa

SEQ ID NO: 6978854 - DNA, 22 bp, Homo sapiens
gtagatgtcttcaaactgattt

SEQ ID NO: 6978855 - DNA, 19 bp, Homo sapiens
ccacatggctggatgacag

SEQ ID NO: 6978856 - DNA, 22 bp, Homo sapiens
atcccatttcctagtacatcat

SEQ ID NO: 6978857 - DNA, 23 bp, Homo sapiens
ctgcaactcagtctggagcagtt

SEQ ID NO: 6978858 - DNA, 22 bp, Homo sapiens
cattaaaatatctcatggtgtt

SEQ ID NO: 6978859 - DNA, 20 bp, Homo sapiens
tgaaggtgactcctttcttg

SEQ ID NO: 6978860 - DNA, 22 bp, Homo sapiens
ctggccttggtgcttgcagaca

SEQ ID NO: 6978861 - DNA, 22 bp, Homo sapiens
ctttagaagggtaacggaatta

SEQ ID NO: 6978862 - DNA, 22 bp, Homo sapiens
gccagccataggccagcactgg

SEQ ID NO: 6978863 - DNA, 23 bp, Homo sapiens
caggaagcagatggggtagaaga

SEQ ID NO: 6978864 - DNA, 22 bp, Homo sapiens
tcctgcctgagcgtggaggagg

SEQ ID NO: 6978865 - DNA, 20 bp, Homo sapiens
aggatttgagaaggcgtctt

SEQ ID NO: 6978866 - DNA, 22 bp, Homo sapiens
tagctcttttaatccttaggac

SEQ ID NO: 6978867 - DNA, 22 bp, Homo sapiens
aggcactgactcaagggagcca

SEQ ID NO: 6978868 - DNA, 22 bp, Homo sapiens
ttgaggtctttgagcaaacgca

SEQ ID NO: 6978869 - DNA, 22 bp, Homo sapiens
gagaggccctgaagcccacaga

SEQ ID NO: 6978870 - DNA, 22 bp, Homo sapiens
tcatcagagaacattttgcctt

SEQ ID NO: 6978871 - DNA, 22 bp, Homo sapiens
tagatgcatagagcacagcaca

SEQ ID NO: 6978872 - DNA, 22 bp, Homo sapiens
aagtttagtgaaactctagggg

SEQ ID NO: 6978873 - DNA, 22 bp, Homo sapiens
tcttttcttcttaatggttaat

SEQ ID NO: 6978874 - DNA, 22 bp, Homo sapiens
cttacagtgatcaacacaaaga

SEQ ID NO: 6978875 - DNA, 22 bp, Homo sapiens
catcactgtcaccatctttcct

SEQ ID NO: 6978876 - DNA, 21 bp, Homo sapiens
ccatttgtaggtttccctctg

SEQ ID NO: 6978877 - DNA, 22 bp, Homo sapiens
tcaggacagttccctgcaaatt

SEQ ID NO: 6978878 - DNA, 22 bp, Homo sapiens
tttcagttcagtttattatatc

SEQ ID NO: 6978879 - DNA, 22 bp, Homo sapiens
aaaaagatagcattgtgctcct

SEQ ID NO: 6978880 - DNA, 22 bp, Homo sapiens
gctcctgcaggacccaggagac

SEQ ID NO: 6978881 - DNA, 20 bp, Homo sapiens
tagattctgtctgtccaaac

SEQ ID NO: 6978882 - DNA, 21 bp, Homo sapiens
gcaaatgttcaggaaaaaaga

SEQ ID NO: 6978883 - DNA, 22 bp, Homo sapiens
aagaccatcacagagacacttg

SEQ ID NO: 6978884 - DNA, 20 bp, Homo sapiens
tcctgccacacctcagttgc

SEQ ID NO: 6978885 - DNA, 22 bp, Homo sapiens
tggggatgaaacccaggcatct

SEQ ID NO: 6978886 - DNA, 22 bp, Homo sapiens
tcaaggtgctgtgctgtgctag

SEQ ID NO: 6978887 - DNA, 22 bp, Homo sapiens
tccctgctttcttgtgagggga

SEQ ID NO: 6978888 - DNA, 22 bp, Homo sapiens
gaaaataggcagatgcattgta

SEQ ID NO: 6978889 - DNA, 22 bp, Homo sapiens
ttctggagaataatcagcattg

SEQ ID NO: 6978890 - DNA, 22 bp, Homo sapiens
aaagctagtaatattttaatcc

SEQ ID NO: 6978891 - DNA, 20 bp, Homo sapiens
aggtctgattccagaatcag

SEQ ID NO: 6978892 - DNA, 22 bp, Homo sapiens
tctttatgcacataaagaaact

SEQ ID NO: 6978893 - DNA, 22 bp, Homo sapiens
tctgcagaattcgaggaagaaa

SEQ ID NO: 6978894 - DNA, 22 bp, Homo sapiens
acatttgtctggctagaaagtt

SEQ ID NO: 6978895 - DNA, 18 bp, Homo sapiens
gccagtcagtctttggta

SEQ ID NO: 6978896 - DNA, 22 bp, Homo sapiens
cacaggctgggaagcctaggcc

SEQ ID NO: 6978897 - DNA, 22 bp, Homo sapiens
ggagatggctggcaggtagatg

SEQ ID NO: 6978898 - DNA, 22 bp, Homo sapiens
ctttccaactgggtgggcagct

SEQ ID NO: 6978899 - DNA, 22 bp, Homo sapiens
ttcagagctcagaaaagtgtct

SEQ ID NO: 6978900 - DNA, 22 bp, Homo sapiens
ggtgggcaggcgaggcccaggt

SEQ ID NO: 6978901 - DNA, 23 bp, Homo sapiens
gtgatttcagggaacagaatcag

SEQ ID NO: 6978902 - DNA, 22 bp, Homo sapiens
acaggagaccctgctggttctg

SEQ ID NO: 6978903 - DNA, 22 bp, Homo sapiens
tgcccacatggtgccatggcca

SEQ ID NO: 6978904 - DNA, 22 bp, Homo sapiens
aatagtatttatttggaaaaag

SEQ ID NO: 6978905 - DNA, 22 bp, Homo sapiens
aggacatgaagaaagggcaagg

SEQ ID NO: 6978906 - DNA, 22 bp, Homo sapiens
cctggagcttggtcacgctgcg

SEQ ID NO: 6978907 - DNA, 22 bp, Homo sapiens
agacgagggcctggcacacagt

SEQ ID NO: 6978908 - DNA, 22 bp, Homo sapiens
aaggactaaaagaagggtttct

SEQ ID NO: 6978909 - DNA, 22 bp, Homo sapiens
agaggcagtatacaatccgagc

SEQ ID NO: 6978910 - DNA, 22 bp, Homo sapiens
tagtcagtgatcagtggagttg

SEQ ID NO: 6978911 - DNA, 22 bp, Homo sapiens
aattgggagagttagcaatgct

SEQ ID NO: 6978912 - DNA, 22 bp, Homo sapiens
agcttaaagtatttaaatttca

SEQ ID NO: 6978913 - DNA, 22 bp, Homo sapiens
tgcacagtaaacatgactggag

SEQ ID NO: 6978914 - DNA, 22 bp, Homo sapiens
tgttaagcaagcaatggagggt

SEQ ID NO: 6978915 - DNA, 22 bp, Homo sapiens
atggcagacctgggctggagaa

SEQ ID NO: 6978916 - DNA, 22 bp, Homo sapiens
gctgcctgaatgaaccttgttc

SEQ ID NO: 6978917 - DNA, 22 bp, Homo sapiens
gcaggtcccagaaagttaattc

SEQ ID NO: 6978918 - DNA, 22 bp, Homo sapiens
aaatctggttcagtaagtcctc

SEQ ID NO: 6978919 - DNA, 22 bp, Homo sapiens
tgaaccaggaggcagccagcac

SEQ ID NO: 6978920 - DNA, 22 bp, Homo sapiens
gggtctcctaatggaggatgac

SEQ ID NO: 6978921 - DNA, 22 bp, Homo sapiens
agggctccaggggaccatcagt

SEQ ID NO: 6978922 - DNA, 22 bp, Homo sapiens
gcctggaaattgaggcacagtt

SEQ ID NO: 6978923 - DNA, 22 bp, Homo sapiens
ggtgctgattcactgacttctg

SEQ ID NO: 6978924 - DNA, 22 bp, Homo sapiens
tatcacactcggaaatctagga

SEQ ID NO: 6978925 - DNA, 22 bp, Homo sapiens
tgtggggacctggctgccaccc

SEQ ID NO: 6978926 - DNA, 22 bp, Homo sapiens
actgcaaagccagatattatca

SEQ ID NO: 6978927 - DNA, 22 bp, Homo sapiens
ctccaaaggataaaagcagagt

SEQ ID NO: 6978928 - DNA, 22 bp, Homo sapiens
agtatcttcaagtttcttctag

SEQ ID NO: 6978929 - DNA, 22 bp, Homo sapiens
ttgctttaggtatagaatccat

SEQ ID NO: 6978930 - DNA, 22 bp, Homo sapiens
acacactgagtgccataggacc

SEQ ID NO: 6978931 - DNA, 19 bp, Homo sapiens
tcaaaacacaaatggttga

SEQ ID NO: 6978932 - DNA, 23 bp, Homo sapiens
agacacataggagcagctattgg

SEQ ID NO: 6978933 - DNA, 22 bp, Homo sapiens
ctatttgtcacaactggtgttt

SEQ ID NO: 6978934 - DNA, 22 bp, Homo sapiens
agagttcttgccctagaaaatg

SEQ ID NO: 6978935 - DNA, 22 bp, Homo sapiens
acatccatttgctttatttgct

SEQ ID NO: 6978936 - DNA, 22 bp, Homo sapiens
gtggacagacataatcctaatt

SEQ ID NO: 6978937 - DNA, 22 bp, Homo sapiens
agtgatcagcttgaagtagttt

SEQ ID NO: 6978938 - DNA, 22 bp, Homo sapiens
ggtacaatggaccataaaagct

SEQ ID NO: 6978939 - DNA, 22 bp, Homo sapiens
tgtctttttacctgtgatgagt

SEQ ID NO: 6978940 - DNA, 22 bp, Homo sapiens
ggtgagagttatgattccaatt

SEQ ID NO: 6978941 - DNA, 23 bp, Homo sapiens
actcagagaccccgggaagtgac

SEQ ID NO: 6978942 - DNA, 21 bp, Homo sapiens
ctctgggacatttcttagcag

SEQ ID NO: 6978943 - DNA, 22 bp, Homo sapiens
tacaaatgtattttattttggt

SEQ ID NO: 6978944 - DNA, 22 bp, Homo sapiens
ttggccaatttagaacgtgttg

SEQ ID NO: 6978945 - DNA, 22 bp, Homo sapiens
caaggccagggaatttttctgg

SEQ ID NO: 6978946 - DNA, 22 bp, Homo sapiens
gaaatgcataatcttagtagat

SEQ ID NO: 6978947 - DNA, 22 bp, Homo sapiens
aaagtacatagcatattccaac

SEQ ID NO: 6978948 - DNA, 22 bp, Homo sapiens
aaggatcatagtaaacattgat

SEQ ID NO: 6978949 - DNA, 22 bp, Homo sapiens
caaggctgctgcgggtcgcacc

SEQ ID NO: 6978950 - DNA, 22 bp, Homo sapiens
agttgtcagtcaaagacatttg

SEQ ID NO: 6978951 - DNA, 22 bp, Homo sapiens
tgggatggcctttgaaagccag

SEQ ID NO: 6978952 - DNA, 22 bp, Homo sapiens
caaatggcaacaagaacactgg

SEQ ID NO: 6978953 - DNA, 22 bp, Homo sapiens
gcttagaagattgaccctggtt

SEQ ID NO: 6978954 - DNA, 22 bp, Homo sapiens
catagaggtgtcagggacatct

SEQ ID NO: 6978955 - DNA, 22 bp, Homo sapiens
tctgttattttcttgtgtggaa

SEQ ID NO: 6978956 - DNA, 22 bp, Homo sapiens
tggtatggtcaaagcctgtgta

SEQ ID NO: 6978957 - DNA, 22 bp, Homo sapiens
atatgcatgcatgcttgtgaga

SEQ ID NO: 6978958 - DNA, 22 bp, Homo sapiens
ggggaggagtgtacaggtttat

SEQ ID NO: 6978959 - DNA, 22 bp, Homo sapiens
aaggggggcacctgcatgcccg

SEQ ID NO: 6978960 - DNA, 22 bp, Homo sapiens
aggcatgcaaacagtctagagt

SEQ ID NO: 6978961 - DNA, 22 bp, Homo sapiens
gcttggctttactagggggaca

SEQ ID NO: 6978962 - DNA, 22 bp, Homo sapiens
gcacagactcaccttaatttga

SEQ ID NO: 6978963 - DNA, 22 bp, Homo sapiens
tgagttctcacccattcttctt

SEQ ID NO: 6978964 - DNA, 22 bp, Homo sapiens
agaaagtttggggctgggcacg

SEQ ID NO: 6978965 - DNA, 22 bp, Homo sapiens
gtgccagagcaatcaggctctg

SEQ ID NO: 6978966 - DNA, 22 bp, Homo sapiens
agccacacctgtcctgccagct

SEQ ID NO: 6978967 - DNA, 22 bp, Homo sapiens
gcagctcctcctgggctggaga

SEQ ID NO: 6978968 - DNA, 22 bp, Homo sapiens
tttgggaagtttaaaataagta

SEQ ID NO: 6978969 - DNA, 22 bp, Homo sapiens
tatgtatatggtagaagtatgt

SEQ ID NO: 6978970 - DNA, 22 bp, Homo sapiens
agaagccagattgtagtgggac

SEQ ID NO: 6978971 - DNA, 22 bp, Homo sapiens
gagggaagaaagaattgatgcg

SEQ ID NO: 6978972 - DNA, 22 bp, Homo sapiens
caagggtgaaggcagaggacat

SEQ ID NO: 6978973 - DNA, 22 bp, Homo sapiens
ttgtccttcatgttggatttat

SEQ ID NO: 6978974 - DNA, 22 bp, Homo sapiens
gtggcctgccgcaccccaatat

SEQ ID NO: 6978975 - DNA, 22 bp, Homo sapiens
tgtgaaccttggtgagtcagta

SEQ ID NO: 6978976 - DNA, 22 bp, Homo sapiens
acacagcaacttgcagtatgga

SEQ ID NO: 6978977 - DNA, 19 bp, Homo sapiens
tgcctggagcataacaggc

SEQ ID NO: 6978978 - DNA, 22 bp, Homo sapiens
tctgccagataatcattttctc

SEQ ID NO: 6978979 - DNA, 22 bp, Homo sapiens
gaaatattcttgtcttgttttc

SEQ ID NO: 6978980 - DNA, 22 bp, Homo sapiens
ctctagaatgaattagcgcagg

SEQ ID NO: 6978981 - DNA, 22 bp, Homo sapiens
ttgcatccaagaaggttcttaa

SEQ ID NO: 6978982 - DNA, 22 bp, Homo sapiens
acatacaaatagagctgtagta

SEQ ID NO: 6978983 - DNA, 22 bp, Homo sapiens
aatgacagtattccctttatca

SEQ ID NO: 6978984 - DNA, 22 bp, Homo sapiens
agtgagtgggttacagatggga

SEQ ID NO: 6978985 - DNA, 22 bp, Homo sapiens
aaggcagtaaaatctaccttgc

SEQ ID NO: 6978986 - DNA, 22 bp, Homo sapiens
caggcggccatgatctggcagg

SEQ ID NO: 6978987 - DNA, 22 bp, Homo sapiens
attctaagcacgctgaagtctt

SEQ ID NO: 6978988 - DNA, 22 bp, Homo sapiens
atgtttattgttttaagctgct

SEQ ID NO: 6978989 - DNA, 22 bp, Homo sapiens
ggccgggcaggtctcagccagc

SEQ ID NO: 6978990 - DNA, 22 bp, Homo sapiens
gaatagcttgacaattattttt

SEQ ID NO: 6978991 - DNA, 22 bp, Homo sapiens
ggcatttaatccatctgattga

SEQ ID NO: 6978992 - DNA, 22 bp, Homo sapiens
cagcaataaggtaagcttctcc

SEQ ID NO: 6978993 - DNA, 22 bp, Homo sapiens
acagtttgtgttggccatgggc

SEQ ID NO: 6978994 - DNA, 22 bp, Homo sapiens
aaccagctccagcctccattca

SEQ ID NO: 6978995 - DNA, 21 bp, Homo sapiens
gctcaccagttgggaatagac

SEQ ID NO: 6978996 - DNA, 22 bp, Homo sapiens
cagttataagactaagctattc

SEQ ID NO: 6978997 - DNA, 22 bp, Homo sapiens
ttacatgtggagtctgattgca

SEQ ID NO: 6978998 - DNA, 22 bp, Homo sapiens
agcggctgctcttttcagatcc

SEQ ID NO: 6978999 - DNA, 22 bp, Homo sapiens
ggccccagggattaggccaacc

SEQ ID NO: 6979000 - DNA, 22 bp, Homo sapiens
tgtcctgggccggcgactggtc

SEQ ID NO: 6979001 - DNA, 22 bp, Homo sapiens
tagactatttcttttgcatagg

SEQ ID NO: 6979002 - DNA, 22 bp, Homo sapiens
ttggcttcaatgtcagagacag

SEQ ID NO: 6979003 - DNA, 22 bp, Homo sapiens
tctcctgaagaccatgtgcact

SEQ ID NO: 6979004 - DNA, 22 bp, Homo sapiens
ttcacacagaatctgaggagct

SEQ ID NO: 6979005 - DNA, 22 bp, Homo sapiens
tagtggagaagtggagtctgtg

SEQ ID NO: 6979006 - DNA, 22 bp, Homo sapiens
tgtagatagtgatttatgacca

SEQ ID NO: 6979007 - DNA, 22 bp, Homo sapiens
ctgtcccaggatcctgactcca

SEQ ID NO: 6979008 - DNA, 22 bp, Homo sapiens
aagccactgcggtttcccatcc

SEQ ID NO: 6979009 - DNA, 22 bp, Homo sapiens
gtcagctcagcaggtgggagtg

SEQ ID NO: 6979010 - DNA, 22 bp, Homo sapiens
aaacatgtaattctgcttaaga

SEQ ID NO: 6979011 - DNA, 22 bp, Homo sapiens
agggtcagggagtgagtattta

SEQ ID NO: 6979012 - DNA, 22 bp, Homo sapiens
tttcacagaggaggaagctgag

SEQ ID NO: 6979013 - DNA, 22 bp, Homo sapiens
tcacagaagagcattaagatga

SEQ ID NO: 6979014 - DNA, 22 bp, Homo sapiens
aaaggttttggtaaggctttaa

SEQ ID NO: 6979015 - DNA, 22 bp, Homo sapiens
tccttagcaggcattcaggacc

SEQ ID NO: 6979016 - DNA, 22 bp, Homo sapiens
atgtgcctgtgtttggagttaa

SEQ ID NO: 6979017 - DNA, 22 bp, Homo sapiens
catgacacctaccatattaagt

SEQ ID NO: 6979018 - DNA, 22 bp, Homo sapiens
ctggctcattttagcatcaggt

SEQ ID NO: 6979019 - DNA, 21 bp, Homo sapiens
tgattctgcatttctaacagg

SEQ ID NO: 6979020 - DNA, 22 bp, Homo sapiens
tcacagaagcttgaagattttc

SEQ ID NO: 6979021 - DNA, 22 bp, Homo sapiens
tctgtataaagtaccggtggca

SEQ ID NO: 6979022 - DNA, 22 bp, Homo sapiens
tttctcaaaattcagtggtatc

SEQ ID NO: 6979023 - DNA, 17 bp, Homo sapiens
gtcagcagcttgcttgt

SEQ ID NO: 6979024 - DNA, 22 bp, Homo sapiens
ttaacacatccctgctctaccc

SEQ ID NO: 6979025 - DNA, 22 bp, Homo sapiens
tagcatctgttctttcattaaa

SEQ ID NO: 6979026 - DNA, 22 bp, Homo sapiens
gtgcaatagactgtggtattaa

SEQ ID NO: 6979027 - DNA, 21 bp, Homo sapiens
tcagaggcactgagagcaatg

SEQ ID NO: 6979028 - DNA, 22 bp, Homo sapiens
tattctactagcattgttcact

SEQ ID NO: 6979029 - DNA, 22 bp, Homo sapiens
tttggtgtctgaaaataacagt

SEQ ID NO: 6979030 - DNA, 23 bp, Homo sapiens
atgtatttaaatttcagtgatga

SEQ ID NO: 6979031 - DNA, 22 bp, Homo sapiens
aggtcacccgtttgactatcca

SEQ ID NO: 6979032 - DNA, 22 bp, Homo sapiens
tctttcaagggccctagtttgg

SEQ ID NO: 6979033 - DNA, 22 bp, Homo sapiens
cccagggaaggcagatggagga

SEQ ID NO: 6979034 - DNA, 22 bp, Homo sapiens
gcccccagaagggccacagatt

SEQ ID NO: 6979035 - DNA, 22 bp, Homo sapiens
cttatttatgtctgtctctaat

SEQ ID NO: 6979036 - DNA, 22 bp, Homo sapiens
cctgaagacaacttttatcacc

SEQ ID NO: 6979037 - DNA, 22 bp, Homo sapiens
agggcttgtggtcgtggctgtg

SEQ ID NO: 6979038 - DNA, 22 bp, Homo sapiens
tagacgagaggtaaatgaaagg

SEQ ID NO: 6979039 - DNA, 22 bp, Homo sapiens
gctctctggaggccatggacag

SEQ ID NO: 6979040 - DNA, 22 bp, Homo sapiens
atctccagggtgcccttgttct

SEQ ID NO: 6979041 - DNA, 22 bp, Homo sapiens
tggcttcatggctgtgcaatct

SEQ ID NO: 6979042 - DNA, 22 bp, Homo sapiens
tgtagcagtttttcattatcca

SEQ ID NO: 6979043 - DNA, 22 bp, Homo sapiens
tgtcctcgtccgcctcgaactc

SEQ ID NO: 6979044 - DNA, 22 bp, Homo sapiens
ttcctatactttattgctgtat

SEQ ID NO: 6979045 - DNA, 22 bp, Homo sapiens
acatgctttaacttattttgat

SEQ ID NO: 6979046 - DNA, 22 bp, Homo sapiens
gcctgtgtctgggtggccagag

SEQ ID NO: 6979047 - DNA, 22 bp, Homo sapiens
gtggcttctggctgggcctcag

SEQ ID NO: 6979048 - DNA, 22 bp, Homo sapiens
agccagcagggcttagaggaca

SEQ ID NO: 6979049 - DNA, 22 bp, Homo sapiens
ctgggtgagttgatgaaggaga

SEQ ID NO: 6979050 - DNA, 22 bp, Homo sapiens
atcttgttataagagataatgg

SEQ ID NO: 6979051 - DNA, 22 bp, Homo sapiens
ataggcgtgtttaggaggacgt

SEQ ID NO: 6979052 - DNA, 22 bp, Homo sapiens
aaccacttatttaagctctgat

SEQ ID NO: 6979053 - DNA, 22 bp, Homo sapiens
ctcatagttagagacacagaga

SEQ ID NO: 6979054 - DNA, 22 bp, Homo sapiens
atgattgaccatctgctgggct

SEQ ID NO: 6979055 - DNA, 22 bp, Homo sapiens
aggcatgtcatttcttttctga

SEQ ID NO: 6979056 - DNA, 22 bp, Homo sapiens
aggaccagtatgagagcatctg

SEQ ID NO: 6979057 - DNA, 22 bp, Homo sapiens
agcttgaaccacatgaaattgc

SEQ ID NO: 6979058 - DNA, 20 bp, Homo sapiens
gtgcagccaagctgagccgc

SEQ ID NO: 6979059 - DNA, 22 bp, Homo sapiens
aacaagatagatatcacttagg

SEQ ID NO: 6979060 - DNA, 22 bp, Homo sapiens
agatgtttaaaaagatgactct

SEQ ID NO: 6979061 - DNA, 21 bp, Homo sapiens
gactttaatttgagagcaaaa

SEQ ID NO: 6979062 - DNA, 22 bp, Homo sapiens
accttattttgaaatagattgt

SEQ ID NO: 6979063 - DNA, 22 bp, Homo sapiens
cctcatcgtttccagaatgtgg

SEQ ID NO: 6979064 - DNA, 22 bp, Homo sapiens
attcacccacgtcttagtctgt

SEQ ID NO: 6979065 - DNA, 22 bp, Homo sapiens
tagggctttgcgatggctattc

SEQ ID NO: 6979066 - DNA, 22 bp, Homo sapiens
ggcttctgaaatctctgtgcgt

SEQ ID NO: 6979067 - DNA, 22 bp, Homo sapiens
taggctcccagatcgtttgctg

SEQ ID NO: 6979068 - DNA, 20 bp, Homo sapiens
tcctactcttttaatatgtg

SEQ ID NO: 6979069 - DNA, 22 bp, Homo sapiens
taagatgaaggctcacctagaa

SEQ ID NO: 6979070 - DNA, 22 bp, Homo sapiens
ctttagttgttatttcttcaca

SEQ ID NO: 6979071 - DNA, 22 bp, Homo sapiens
aggaacacaagctatgatccac

SEQ ID NO: 6979072 - DNA, 22 bp, Homo sapiens
tatgagtgtgaagtgagaatag

SEQ ID NO: 6979073 - DNA, 22 bp, Homo sapiens
ttgcctgtttgagagctgtgtt

SEQ ID NO: 6979074 - DNA, 22 bp, Homo sapiens
gagctggcagtggtagacatgg

SEQ ID NO: 6979075 - DNA, 22 bp, Homo sapiens
gggctgcgtgtggaggatgtaa

SEQ ID NO: 6979076 - DNA, 22 bp, Homo sapiens
ttcccctttttgtgtgcagctg

SEQ ID NO: 6979077 - DNA, 22 bp, Homo sapiens
tttgtactatggtttttcacta

SEQ ID NO: 6979078 - DNA, 20 bp, Homo sapiens
tgctcctaccacttctgccc

SEQ ID NO: 6979079 - DNA, 22 bp, Homo sapiens
gagaactcagacgcaggtcatg

SEQ ID NO: 6979080 - DNA, 22 bp, Homo sapiens
aactttgctggaaaattggagc

SEQ ID NO: 6979081 - DNA, 22 bp, Homo sapiens
gtttccaagttttctttgagct

SEQ ID NO: 6979082 - DNA, 22 bp, Homo sapiens
ctgctgtttgccgtcattgcct

SEQ ID NO: 6979083 - DNA, 22 bp, Homo sapiens
acttagtgccctggcccttaca

SEQ ID NO: 6979084 - DNA, 18 bp, Homo sapiens
gttatagcagcagcattt

SEQ ID NO: 6979085 - DNA, 22 bp, Homo sapiens
gattgggccaaggggttagtag

SEQ ID NO: 6979086 - DNA, 22 bp, Homo sapiens
ttatgcatatagcagatacgag

SEQ ID NO: 6979087 - DNA, 22 bp, Homo sapiens
tgagggactcagaattcagcct

SEQ ID NO: 6979088 - DNA, 22 bp, Homo sapiens
tcttagaattgaagtcagaggg

SEQ ID NO: 6979089 - DNA, 22 bp, Homo sapiens
tccccatgtctgcagggagggt

SEQ ID NO: 6979090 - DNA, 22 bp, Homo sapiens
cctcagggactccatgctgcag

SEQ ID NO: 6979091 - DNA, 22 bp, Homo sapiens
gccctggaatctctccatggga

SEQ ID NO: 6979092 - DNA, 22 bp, Homo sapiens
gccctcccctctgggtggtgag

SEQ ID NO: 6979093 - DNA, 22 bp, Homo sapiens
acaggcttcttttgaaatcaga

SEQ ID NO: 6979094 - DNA, 22 bp, Homo sapiens
gtgcctcagttggaaatgcaga

SEQ ID NO: 6979095 - DNA, 19 bp, Homo sapiens
acaggatatatcaggaaat

SEQ ID NO: 6979096 - DNA, 22 bp, Homo sapiens
aggtcatgccaggcaggggaca

SEQ ID NO: 6979097 - DNA, 22 bp, Homo sapiens
gggcttctctgatcaatatttc

SEQ ID NO: 6979098 - DNA, 22 bp, Homo sapiens
atagtgttgatagcagtggagt

SEQ ID NO: 6979099 - DNA, 22 bp, Homo sapiens
ttcacaatgccttgttgatggt

SEQ ID NO: 6979100 - DNA, 22 bp, Homo sapiens
tccctgggttacctttcaaggt

SEQ ID NO: 6979101 - DNA, 22 bp, Homo sapiens
tggagaattttgtcaccagaca

SEQ ID NO: 6979102 - DNA, 20 bp, Homo sapiens
atgcttgagatcacaatcct

SEQ ID NO: 6979103 - DNA, 22 bp, Homo sapiens
caacttttgacacgtgtgctaa

SEQ ID NO: 6979104 - DNA, 22 bp, Homo sapiens
agtctacatttttgttaatggt

SEQ ID NO: 6979105 - DNA, 19 bp, Homo sapiens
ggcaaattgaggccagtca

SEQ ID NO: 6979106 - DNA, 22 bp, Homo sapiens
ttcaaacagttgcacaacttat

SEQ ID NO: 6979107 - DNA, 22 bp, Homo sapiens
agagctggagcagccccactgg

SEQ ID NO: 6979108 - DNA, 22 bp, Homo sapiens
gcctcctaattgccactctgga

SEQ ID NO: 6979109 - DNA, 22 bp, Homo sapiens
gagcatccagaggtgttttctc

SEQ ID NO: 6979110 - DNA, 22 bp, Homo sapiens
ttcctggttggattctgattaa

SEQ ID NO: 6979111 - DNA, 18 bp, Homo sapiens
tgtctttggaccactgaa

SEQ ID NO: 6979112 - DNA, 22 bp, Homo sapiens
tatgtacatcttgagcaatgaa

SEQ ID NO: 6979113 - DNA, 20 bp, Homo sapiens
tcaaagaagattcagctcaa

SEQ ID NO: 6979114 - DNA, 22 bp, Homo sapiens
gcccaggagttggtggctgcag

SEQ ID NO: 6979115 - DNA, 22 bp, Homo sapiens
agccatgctccttcccctctgg

SEQ ID NO: 6979116 - DNA, 22 bp, Homo sapiens
ttctggaagcttttggagagaa

SEQ ID NO: 6979117 - DNA, 22 bp, Homo sapiens
aactgttccttaggaattattt

SEQ ID NO: 6979118 - DNA, 22 bp, Homo sapiens
aggacccagaggcagaggacgt

SEQ ID NO: 6979119 - DNA, 22 bp, Homo sapiens
aatctgacagctaggcaggcac

SEQ ID NO: 6979120 - DNA, 22 bp, Homo sapiens
tctgaccagtgagctctgaaat

SEQ ID NO: 6979121 - DNA, 22 bp, Homo sapiens
catgtggatggtctcctcatca

SEQ ID NO: 6979122 - DNA, 22 bp, Homo sapiens
cagagcggccactagagggcgc

SEQ ID NO: 6979123 - DNA, 22 bp, Homo sapiens
tagcccgggcaccagatggatc

SEQ ID NO: 6979124 - DNA, 22 bp, Homo sapiens
aaagtcctgactgcaggggatg

SEQ ID NO: 6979125 - DNA, 22 bp, Homo sapiens
ttaggatagtctgttagaaaag

SEQ ID NO: 6979126 - DNA, 21 bp, Homo sapiens
tcaggcaggtcccactgaaca

SEQ ID NO: 6979127 - DNA, 22 bp, Homo sapiens
ccacatctcggtcccctctttg

SEQ ID NO: 6979128 - DNA, 22 bp, Homo sapiens
gtgcaatgtatgtctcaatgat

SEQ ID NO: 6979129 - DNA, 22 bp, Homo sapiens
gaggtcaggggagaggctgatg

SEQ ID NO: 6979130 - DNA, 22 bp, Homo sapiens
atttttcctgggtgctttagtt

SEQ ID NO: 6979131 - DNA, 20 bp, Homo sapiens
tacattcaaaacaaactctg

SEQ ID NO: 6979132 - DNA, 22 bp, Homo sapiens
ttggctttagacctgagactgt

SEQ ID NO: 6979133 - DNA, 18 bp, Homo sapiens
tatggtactgggagcccc

SEQ ID NO: 6979134 - DNA, 22 bp, Homo sapiens
tgcatgttatagaattttaact

SEQ ID NO: 6979135 - DNA, 18 bp, Homo sapiens
atacaagatcaagtgttc

SEQ ID NO: 6979136 - DNA, 22 bp, Homo sapiens
atctcagacatgttgtccatga

SEQ ID NO: 6979137 - DNA, 22 bp, Homo sapiens
actttcagaattgtacagagtc

SEQ ID NO: 6979138 - DNA, 22 bp, Homo sapiens
atggcagcctgaacacttcctg

SEQ ID NO: 6979139 - DNA, 22 bp, Homo sapiens
gacatttgttaaagcacttagc

SEQ ID NO: 6979140 - DNA, 22 bp, Homo sapiens
gctttagacataaagttcttca

SEQ ID NO: 6979141 - DNA, 22 bp, Homo sapiens
tgggccctggtggccatgcctc

SEQ ID NO: 6979142 - DNA, 22 bp, Homo sapiens
ttacagcatttaatgagatctg

SEQ ID NO: 6979143 - DNA, 22 bp, Homo sapiens
tactgcactccagcctgggtga

SEQ ID NO: 6979144 - DNA, 22 bp, Homo sapiens
cagagaaagacttgcccttagt

SEQ ID NO: 6979145 - DNA, 22 bp, Homo sapiens
caaagggcattttagtgaactg

SEQ ID NO: 6979146 - DNA, 22 bp, Homo sapiens
cgctggcttcctcctggggcca

SEQ ID NO: 6979147 - DNA, 22 bp, Homo sapiens
tctttcggccatagcgatgatt

SEQ ID NO: 6979148 - DNA, 22 bp, Homo sapiens
gtgctggctggacatggagcac

SEQ ID NO: 6979149 - DNA, 22 bp, Homo sapiens
agcagggcagttaaagggtcct

SEQ ID NO: 6979150 - DNA, 22 bp, Homo sapiens
tatatgtttttctaattaggga

SEQ ID NO: 6979151 - DNA, 22 bp, Homo sapiens
ctctagcagcagcccttcctta

SEQ ID NO: 6979152 - DNA, 22 bp, Homo sapiens
tgagaatcatccagaggcttct

SEQ ID NO: 6979153 - DNA, 22 bp, Homo sapiens
ttgtagaatttggatctcggca

SEQ ID NO: 6979154 - DNA, 22 bp, Homo sapiens
tctcaactaatggtgcaagatg

SEQ ID NO: 6979155 - DNA, 22 bp, Homo sapiens
tcacacataaaaagaagactag

SEQ ID NO: 6979156 - DNA, 22 bp, Homo sapiens
gctattacttttggagtgtggg

SEQ ID NO: 6979157 - DNA, 22 bp, Homo sapiens
tagcaggagtgatgttgtgtga

SEQ ID NO: 6979158 - DNA, 22 bp, Homo sapiens
agaaatgtgaatttcatttcct

SEQ ID NO: 6979159 - DNA, 22 bp, Homo sapiens
gggctctgtgttctagctctcg

SEQ ID NO: 6979160 - DNA, 22 bp, Homo sapiens
gctgcctgctcggctcctggga

SEQ ID NO: 6979161 - DNA, 22 bp, Homo sapiens
taccagcaatgctagtcaactc

SEQ ID NO: 6979162 - DNA, 22 bp, Homo sapiens
aaggcagttaccgcaatggagg

SEQ ID NO: 6979163 - DNA, 22 bp, Homo sapiens
ctctgtacaggagacatctcta

SEQ ID NO: 6979164 - DNA, 22 bp, Homo sapiens
gggggcagtaaggatatggaaa

SEQ ID NO: 6979165 - DNA, 22 bp, Homo sapiens
gtaagagcactgtctcctgctg

SEQ ID NO: 6979166 - DNA, 22 bp, Homo sapiens
tctgtgctggactgatttcata

SEQ ID NO: 6979167 - DNA, 22 bp, Homo sapiens
aatgttacagttttaattctga

SEQ ID NO: 6979168 - DNA, 22 bp, Homo sapiens
aaggcaatagtattaaactgga

SEQ ID NO: 6979169 - DNA, 22 bp, Homo sapiens
aagacgcaccctttgagggcac

SEQ ID NO: 6979170 - DNA, 22 bp, Homo sapiens
ccatgagacagcaactgaaagt

SEQ ID NO: 6979171 - DNA, 22 bp, Homo sapiens
gcagagcaccctgcagtggtat

SEQ ID NO: 6979172 - DNA, 22 bp, Homo sapiens
agattatttccagactaatgaa

SEQ ID NO: 6979173 - DNA, 22 bp, Homo sapiens
acaaggaacaagcatgtagttt

SEQ ID NO: 6979174 - DNA, 22 bp, Homo sapiens
ggaggcacccttcattgagttt

SEQ ID NO: 6979175 - DNA, 22 bp, Homo sapiens
ttgaaacataaaatatttcctg

SEQ ID NO: 6979176 - DNA, 22 bp, Homo sapiens
gaacagcttcttgggagctggg

SEQ ID NO: 6979177 - DNA, 22 bp, Homo sapiens
tcacatctgcaaaatccctttt

SEQ ID NO: 6979178 - DNA, 22 bp, Homo sapiens
ttggctctggcaaggggcaccg

SEQ ID NO: 6979179 - DNA, 22 bp, Homo sapiens
tctcatgtgattcccgtgcatg

SEQ ID NO: 6979180 - DNA, 22 bp, Homo sapiens
agcagccagagaatgatgcagt

SEQ ID NO: 6979181 - DNA, 21 bp, Homo sapiens
actgagagatgttggatcata

SEQ ID NO: 6979182 - DNA, 22 bp, Homo sapiens
attctccttctattaagttatt

SEQ ID NO: 6979183 - DNA, 22 bp, Homo sapiens
ttcaggaataattatcatatga

SEQ ID NO: 6979184 - DNA, 22 bp, Homo sapiens
ggccacctggctgtgggggcag

SEQ ID NO: 6979185 - DNA, 22 bp, Homo sapiens
cacagtttctgaacactttgca

SEQ ID NO: 6979186 - DNA, 22 bp, Homo sapiens
atgtcctggtcctccaccatgg

SEQ ID NO: 6979187 - DNA, 22 bp, Homo sapiens
cagagccacttggagatgagaa

SEQ ID NO: 6979188 - DNA, 22 bp, Homo sapiens
tggctctgtggatgttctgacc

SEQ ID NO: 6979189 - DNA, 21 bp, Homo sapiens
tctggccctaggttgggcctc

SEQ ID NO: 6979190 - DNA, 22 bp, Homo sapiens
actagaaatgtattggtagctg

SEQ ID NO: 6979191 - DNA, 20 bp, Homo sapiens
attctgctttgaaaataagg

SEQ ID NO: 6979192 - DNA, 22 bp, Homo sapiens
atcacacagcaaggtggaggca

SEQ ID NO: 6979193 - DNA, 22 bp, Homo sapiens
aggctgcttcaatggataagat

SEQ ID NO: 6979194 - DNA, 22 bp, Homo sapiens
tgacagttgtattacatgggaa

SEQ ID NO: 6979195 - DNA, 22 bp, Homo sapiens
cagacctagcactctagattgc

SEQ ID NO: 6979196 - DNA, 20 bp, Homo sapiens
tccctcaggtcattgggctg

SEQ ID NO: 6979197 - DNA, 22 bp, Homo sapiens
tcttttattaggctgaaatggg

SEQ ID NO: 6979198 - DNA, 22 bp, Homo sapiens
accaggcatgatgtggagcaca

SEQ ID NO: 6979199 - DNA, 22 bp, Homo sapiens
tgctttcattcacaaaatagca

SEQ ID NO: 6979200 - DNA, 22 bp, Homo sapiens
agaatcagtgagcagttgtgat

SEQ ID NO: 6979201 - DNA, 22 bp, Homo sapiens
tgatatctaagaaattctacca

SEQ ID NO: 6979202 - DNA, 22 bp, Homo sapiens
agaactgctagctctccttctg

SEQ ID NO: 6979203 - DNA, 22 bp, Homo sapiens
cgagagatgggttggcaggggc

SEQ ID NO: 6979204 - DNA, 20 bp, Homo sapiens
tccctcagcacttctacctc

SEQ ID NO: 6979205 - DNA, 22 bp, Homo sapiens
gtacaagtgtgtgtttgagcag

SEQ ID NO: 6979206 - DNA, 22 bp, Homo sapiens
gagtgggtgacagaaggaggta

SEQ ID NO: 6979207 - DNA, 22 bp, Homo sapiens
tacaaaggacagcagaaaaata

SEQ ID NO: 6979208 - DNA, 22 bp, Homo sapiens
ttagataaattgcaacttgatt

SEQ ID NO: 6979209 - DNA, 22 bp, Homo sapiens
ctggaggagcatggactggagt

SEQ ID NO: 6979210 - DNA, 22 bp, Homo sapiens
tcaggaggcctgagtagctcta

SEQ ID NO: 6979211 - DNA, 22 bp, Homo sapiens
ttggatcactctgaagccttac

SEQ ID NO: 6979212 - DNA, 17 bp, Homo sapiens
caccaattaagaccctc

SEQ ID NO: 6979213 - DNA, 22 bp, Homo sapiens
acttattttgattcctcggggg

SEQ ID NO: 6979214 - DNA, 22 bp, Homo sapiens
tccccactgggcctcctctttc

SEQ ID NO: 6979215 - DNA, 22 bp, Homo sapiens
gtgtgtccacacatacatacat

SEQ ID NO: 6979216 - DNA, 22 bp, Homo sapiens
ttggctctggaactatttctga

SEQ ID NO: 6979217 - DNA, 19 bp, Homo sapiens
gaatgggaatgggaaagct

SEQ ID NO: 6979218 - DNA, 21 bp, Homo sapiens
aggattccagcacactgcttc

SEQ ID NO: 6979219 - DNA, 22 bp, Homo sapiens
cacagggcaggtactctcagag

SEQ ID NO: 6979220 - DNA, 22 bp, Homo sapiens
tacccaaggccctttcaatttc

SEQ ID NO: 6979221 - DNA, 22 bp, Homo sapiens
gccaaattcctggcagaagcat

SEQ ID NO: 6979222 - DNA, 22 bp, Homo sapiens
aatctgtttccaatacttgcta

SEQ ID NO: 6979223 - DNA, 22 bp, Homo sapiens
ggctgaagttctttttgttcag

SEQ ID NO: 6979224 - DNA, 22 bp, Homo sapiens
aggatttgaacctgcatccagt

SEQ ID NO: 6979225 - DNA, 22 bp, Homo sapiens
atggcagagaacaaagcaacaa

SEQ ID NO: 6979226 - DNA, 22 bp, Homo sapiens
gggactgtaaattcatatggcc

SEQ ID NO: 6979227 - DNA, 22 bp, Homo sapiens
tcttggctatccaagttatcca

SEQ ID NO: 6979228 - DNA, 22 bp, Homo sapiens
ctggtccctggacctccctgga

SEQ ID NO: 6979229 - DNA, 22 bp, Homo sapiens
tggaagagggagctgggtggcc

SEQ ID NO: 6979230 - DNA, 22 bp, Homo sapiens
tgcctgggtgtaaagggccaac

SEQ ID NO: 6979231 - DNA, 22 bp, Homo sapiens
gttcatttttccctaatgagta

SEQ ID NO: 6979232 - DNA, 21 bp, Homo sapiens
tggtttgcggccaaagttaaa

SEQ ID NO: 6979233 - DNA, 22 bp, Homo sapiens
tggggacagggctcagcaattt

SEQ ID NO: 6979234 - DNA, 22 bp, Homo sapiens
tctttctttatcacctgatatg

SEQ ID NO: 6979235 - DNA, 21 bp, Homo sapiens
tgcagtatgtatttgtatcca

SEQ ID NO: 6979236 - DNA, 22 bp, Homo sapiens
ggctttgctttggctgtttcag

SEQ ID NO: 6979237 - DNA, 22 bp, Homo sapiens
acagtgtgtgggaaatgtgact

SEQ ID NO: 6979238 - DNA, 22 bp, Homo sapiens
aaagctcacagtaatacaaggc

SEQ ID NO: 6979239 - DNA, 22 bp, Homo sapiens
cttaggaatatccacagcaggt

SEQ ID NO: 6979240 - DNA, 20 bp, Homo sapiens
tctgaggtatgatagggtct

SEQ ID NO: 6979241 - DNA, 22 bp, Homo sapiens
aaaggcacacactccttgttat

SEQ ID NO: 6979242 - DNA, 22 bp, Homo sapiens
tgtgttctatggttcagggtgg

SEQ ID NO: 6979243 - DNA, 22 bp, Homo sapiens
ggggagtggttgcctgtgatcc

SEQ ID NO: 6979244 - DNA, 22 bp, Homo sapiens
gtcaggatgggcagccaaacta

SEQ ID NO: 6979245 - DNA, 22 bp, Homo sapiens
ttaacaaagtaacgggaaaaga

SEQ ID NO: 6979246 - DNA, 22 bp, Homo sapiens
ttctgctgaaaacagccatgta

SEQ ID NO: 6979247 - DNA, 22 bp, Homo sapiens
tgtcagtggacctggagaggcc

SEQ ID NO: 6979248 - DNA, 22 bp, Homo sapiens
ggcaatcattggcattctctgg

SEQ ID NO: 6979249 - DNA, 22 bp, Homo sapiens
tcagatttatgtggctaggctc

SEQ ID NO: 6979250 - DNA, 22 bp, Homo sapiens
cacatggattcgtgcatcaaac

SEQ ID NO: 6979251 - DNA, 22 bp, Homo sapiens
gatgagaatgtttatcaaatgc

SEQ ID NO: 6979252 - DNA, 22 bp, Homo sapiens
taagtgcatctgatctttcatg

SEQ ID NO: 6979253 - DNA, 22 bp, Homo sapiens
aatttgttacacagcaatataa

SEQ ID NO: 6979254 - DNA, 22 bp, Homo sapiens
gttcagttttgaaatgttaatt

SEQ ID NO: 6979255 - DNA, 22 bp, Homo sapiens
cctctgagtgttttccccgggt

SEQ ID NO: 6979256 - DNA, 22 bp, Homo sapiens
attttgatgtatctttgtagct

SEQ ID NO: 6979257 - DNA, 22 bp, Homo sapiens
gcagctgtgggttccaagtcta

SEQ ID NO: 6979258 - DNA, 22 bp, Homo sapiens
agctcctcctgagtgtctggga

SEQ ID NO: 6979259 - DNA, 22 bp, Homo sapiens
atcttcaatatttttgtgtaga

SEQ ID NO: 6979260 - DNA, 22 bp, Homo sapiens
tgtcatttactccataccctca

SEQ ID NO: 6979261 - DNA, 22 bp, Homo sapiens
gaggactgcagatgggtgcatc

SEQ ID NO: 6979262 - DNA, 22 bp, Homo sapiens
ccactttttagagaacaaaact

SEQ ID NO: 6979263 - DNA, 22 bp, Homo sapiens
cagaaacagacatgacgcagta

SEQ ID NO: 6979264 - DNA, 22 bp, Homo sapiens
gggctgtgagagtggggctgct

SEQ ID NO: 6979265 - DNA, 22 bp, Homo sapiens
gagctctgtgtggcttgggtgg

SEQ ID NO: 6979266 - DNA, 22 bp, Homo sapiens
actgttcttgtaacacttaaat

SEQ ID NO: 6979267 - DNA, 22 bp, Homo sapiens
ccttccagccccatctcatcgt

SEQ ID NO: 6979268 - DNA, 22 bp, Homo sapiens
agggtaggaactgagtggaagg

SEQ ID NO: 6979269 - DNA, 22 bp, Homo sapiens
ccaggctggagtgtagtcgcat

SEQ ID NO: 6979270 - DNA, 22 bp, Homo sapiens
attggtaagcaagatggcaata

SEQ ID NO: 6979271 - DNA, 22 bp, Homo sapiens
accatttaaggaaaatgtatca

SEQ ID NO: 6979272 - DNA, 22 bp, Homo sapiens
gtgtcctgttcagaagcttggg

SEQ ID NO: 6979273 - DNA, 22 bp, Homo sapiens
gagctcagactcgggcctgggg

SEQ ID NO: 6979274 - DNA, 22 bp, Homo sapiens
aatgtgaatcttcctttttgat

SEQ ID NO: 6979275 - DNA, 22 bp, Homo sapiens
agctccagggaaagagtggatc

SEQ ID NO: 6979276 - DNA, 22 bp, Homo sapiens
taactgtacaactggttagtca

SEQ ID NO: 6979277 - DNA, 19 bp, Homo sapiens
cagaacaggaccaggggcc

SEQ ID NO: 6979278 - DNA, 22 bp, Homo sapiens
atgccactgcactccagcctgg

SEQ ID NO: 6979279 - DNA, 22 bp, Homo sapiens
agagaaacccttcagtgttttg

SEQ ID NO: 6979280 - DNA, 22 bp, Homo sapiens
tagcttctgggagtgtttacta

SEQ ID NO: 6979281 - DNA, 22 bp, Homo sapiens
gcccaagacatttagtaaagag

SEQ ID NO: 6979282 - DNA, 22 bp, Homo sapiens
tcagggtatgttctagatctga

SEQ ID NO: 6979283 - DNA, 22 bp, Homo sapiens
ttctctggcctgaggcgaggcc

SEQ ID NO: 6979284 - DNA, 22 bp, Homo sapiens
aggctgtgggacagttaggaga

SEQ ID NO: 6979285 - DNA, 19 bp, Homo sapiens
tgcttcagaaatagaaagc

SEQ ID NO: 6979286 - DNA, 22 bp, Homo sapiens
tgtgcagggaagggcatgctat

SEQ ID NO: 6979287 - DNA, 22 bp, Homo sapiens
atcctctctcccataccagtct

SEQ ID NO: 6979288 - DNA, 22 bp, Homo sapiens
ttcacaatttcccttcatcagg

SEQ ID NO: 6979289 - DNA, 22 bp, Homo sapiens
gggatcgtcatggaaagtgcta

SEQ ID NO: 6979290 - DNA, 22 bp, Homo sapiens
ctggtttgcccacaccagccac

SEQ ID NO: 6979291 - DNA, 22 bp, Homo sapiens
ccacaggctgctgcaggtcccg

SEQ ID NO: 6979292 - DNA, 22 bp, Homo sapiens
acccagtgttgggcagaactgt

SEQ ID NO: 6979293 - DNA, 22 bp, Homo sapiens
taaagatgttctcatttcatag

SEQ ID NO: 6979294 - DNA, 22 bp, Homo sapiens
cctgtatttgcaacttttctta

SEQ ID NO: 6979295 - DNA, 22 bp, Homo sapiens
agctggccttagtgagcacctg

SEQ ID NO: 6979296 - DNA, 22 bp, Homo sapiens
gatgctgagaggtggagggaac

SEQ ID NO: 6979297 - DNA, 22 bp, Homo sapiens
tagtaaacatgcctcggctgct

SEQ ID NO: 6979298 - DNA, 22 bp, Homo sapiens
ctttggcactgcgcagccattt

SEQ ID NO: 6979299 - DNA, 22 bp, Homo sapiens
ggcctgcctcacagtcagcacc

SEQ ID NO: 6979300 - DNA, 22 bp, Homo sapiens
ctgaagatttttggtaatcatg

SEQ ID NO: 6979301 - DNA, 22 bp, Homo sapiens
ctccagataggagggggtcccc

SEQ ID NO: 6979302 - DNA, 22 bp, Homo sapiens
gggcacagcctaactatggaga

SEQ ID NO: 6979303 - DNA, 22 bp, Homo sapiens
tgcttcagaggaaaggcaaaag

SEQ ID NO: 6979304 - DNA, 22 bp, Homo sapiens
ttcacattaagcctcctcctac

SEQ ID NO: 6979305 - DNA, 22 bp, Homo sapiens
gcttccagtaactcttgaaagg

SEQ ID NO: 6979306 - DNA, 22 bp, Homo sapiens
ggagatccaggctgagtctttc

SEQ ID NO: 6979307 - DNA, 22 bp, Homo sapiens
atcacactgttattttagttaa

SEQ ID NO: 6979308 - DNA, 22 bp, Homo sapiens
ttgaatgattaaagtcatctga

SEQ ID NO: 6979309 - DNA, 22 bp, Homo sapiens
cttgctgtcttgcatttagagc

SEQ ID NO: 6979310 - DNA, 22 bp, Homo sapiens
cagtgcatgcacacacatggta

SEQ ID NO: 6979311 - DNA, 20 bp, Homo sapiens
gtgcaggttccccttgcact

SEQ ID NO: 6979312 - DNA, 22 bp, Homo sapiens
ttcaatgcctttctctaagctc

SEQ ID NO: 6979313 - DNA, 22 bp, Homo sapiens
gttattgctctactcaatgtta

SEQ ID NO: 6979314 - DNA, 22 bp, Homo sapiens
acaggagaaatctggtcaaaag

SEQ ID NO: 6979315 - DNA, 22 bp, Homo sapiens
aaattgagctcatttcctctgt

SEQ ID NO: 6979316 - DNA, 22 bp, Homo sapiens
ggcagctgcaaatctgctctgt

SEQ ID NO: 6979317 - DNA, 22 bp, Homo sapiens
ttcacattataatcagttctgc

SEQ ID NO: 6979318 - DNA, 22 bp, Homo sapiens
agcaaataccaaaggctgatgt

SEQ ID NO: 6979319 - DNA, 22 bp, Homo sapiens
gaaagcagtaaatgggtcccat

SEQ ID NO: 6979320 - DNA, 22 bp, Homo sapiens
acagtctctgttgctgctgttt

SEQ ID NO: 6979321 - DNA, 22 bp, Homo sapiens
gaattccttggcaaaacaccca

SEQ ID NO: 6979322 - DNA, 22 bp, Homo sapiens
atgtactatgcagtcaactgtt

SEQ ID NO: 6979323 - DNA, 22 bp, Homo sapiens
tattactgttacttcacactgt

SEQ ID NO: 6979324 - DNA, 22 bp, Homo sapiens
gaaaggccacgtgccaagatta

SEQ ID NO: 6979325 - DNA, 19 bp, Homo sapiens
agctaactcactaactatg

SEQ ID NO: 6979326 - DNA, 22 bp, Homo sapiens
gcagtgaaacaataggatcaaa

SEQ ID NO: 6979327 - DNA, 22 bp, Homo sapiens
ggaagggaaaattcattcggct

SEQ ID NO: 6979328 - DNA, 22 bp, Homo sapiens
gtggaattaattcagttaatgc

SEQ ID NO: 6979329 - DNA, 22 bp, Homo sapiens
tcctagaatagtgtgtctggag

SEQ ID NO: 6979330 - DNA, 22 bp, Homo sapiens
gctctgagcactgtgcggctgg

SEQ ID NO: 6979331 - DNA, 22 bp, Homo sapiens
acattgatcagcctcccatgca

SEQ ID NO: 6979332 - DNA, 22 bp, Homo sapiens
ggctctctggaggagctcaccc

SEQ ID NO: 6979333 - DNA, 22 bp, Homo sapiens
atccttcagctgccctgttacc

SEQ ID NO: 6979334 - DNA, 22 bp, Homo sapiens
actagcagggatattatataag

SEQ ID NO: 6979335 - DNA, 22 bp, Homo sapiens
ggcttgtccttctggttgtctt

SEQ ID NO: 6979336 - DNA, 20 bp, Homo sapiens
aggccttgtttatagtgaga

SEQ ID NO: 6979337 - DNA, 22 bp, Homo sapiens
tttattattctgttctctctac

SEQ ID NO: 6979338 - DNA, 22 bp, Homo sapiens
cagtactttgcatcattccact

SEQ ID NO: 6979339 - DNA, 22 bp, Homo sapiens
ctgctctgttcccccatcatct

SEQ ID NO: 6979340 - DNA, 23 bp, Homo sapiens
tcagcggattggctcagacaggc

SEQ ID NO: 6979341 - DNA, 23 bp, Homo sapiens
ggcctctcaccagggtcctttca

SEQ ID NO: 6979342 - DNA, 20 bp, Homo sapiens
atctttgtctctgtagttgt

SEQ ID NO: 6979343 - DNA, 22 bp, Homo sapiens
tgcaagtgccatgtgcacagtg

SEQ ID NO: 6979344 - DNA, 22 bp, Homo sapiens
atctttttactaacactgctta

SEQ ID NO: 6979345 - DNA, 22 bp, Homo sapiens
ctgctgggggacacaggtccgg

SEQ ID NO: 6979346 - DNA, 22 bp, Homo sapiens
tgccacagagactttcattgta

SEQ ID NO: 6979347 - DNA, 22 bp, Homo sapiens
gatggcccgctagctggcctct

SEQ ID NO: 6979348 - DNA, 22 bp, Homo sapiens
gagatggcttgctctcacgtgg

SEQ ID NO: 6979349 - DNA, 22 bp, Homo sapiens
gggagatggctcagaggccgcg

SEQ ID NO: 6979350 - DNA, 22 bp, Homo sapiens
ttttttatatcaactgaagtct

SEQ ID NO: 6979351 - DNA, 22 bp, Homo sapiens
caaaaactgcaattacttttac

SEQ ID NO: 6979352 - DNA, 22 bp, Homo sapiens
tgcacacaccgtgcttcactga

SEQ ID NO: 6979353 - DNA, 20 bp, Homo sapiens
agacagtgtggagattcctt

SEQ ID NO: 6979354 - DNA, 22 bp, Homo sapiens
agatgatgataattgaaaggca

SEQ ID NO: 6979355 - DNA, 22 bp, Homo sapiens
gctgcctgatcatacaccaggg

SEQ ID NO: 6979356 - DNA, 22 bp, Homo sapiens
tctactaggtgtactactgcag

SEQ ID NO: 6979357 - DNA, 22 bp, Homo sapiens
agggacacttgctttcaggccc

SEQ ID NO: 6979358 - DNA, 22 bp, Homo sapiens
agctaagagtggaagctcatct

SEQ ID NO: 6979359 - DNA, 22 bp, Homo sapiens
aagccatatggtaggtatatgt

SEQ ID NO: 6979360 - DNA, 22 bp, Homo sapiens
tttattgacccaaagcgagagt

SEQ ID NO: 6979361 - DNA, 22 bp, Homo sapiens
ccatactgaggacacattgtga

SEQ ID NO: 6979362 - DNA, 22 bp, Homo sapiens
actccaggaaacttaggggaaa

SEQ ID NO: 6979363 - DNA, 22 bp, Homo sapiens
gagggctgctgccagatatgcc

SEQ ID NO: 6979364 - DNA, 22 bp, Homo sapiens
agcataggcggtggtaggaccc

SEQ ID NO: 6979365 - DNA, 22 bp, Homo sapiens
cagtttatgcagctggaataga

SEQ ID NO: 6979366 - DNA, 22 bp, Homo sapiens
ccctactcaccacacatcttta

SEQ ID NO: 6979367 - DNA, 22 bp, Homo sapiens
ttcttcatgctgttgctgcttg

SEQ ID NO: 6979368 - DNA, 22 bp, Homo sapiens
ggagaggcttggcccagcctgg

SEQ ID NO: 6979369 - DNA, 22 bp, Homo sapiens
ggagctggagagctagcctagg

SEQ ID NO: 6979370 - DNA, 21 bp, Homo sapiens
tgtcagcaacaatactttctc

SEQ ID NO: 6979371 - DNA, 22 bp, Homo sapiens
gaggctgaagtgtacatgggtg

SEQ ID NO: 6979372 - DNA, 22 bp, Homo sapiens
cagagagagcaggaaacctccg

SEQ ID NO: 6979373 - DNA, 22 bp, Homo sapiens
tgtaggaatggattctagaagg

SEQ ID NO: 6979374 - DNA, 22 bp, Homo sapiens
ggcctctgttctgcattcctcc

SEQ ID NO: 6979375 - DNA, 22 bp, Homo sapiens
tgaaattccaggagagttaaaa

SEQ ID NO: 6979376 - DNA, 22 bp, Homo sapiens
acaagtgttgcattttgccatt

SEQ ID NO: 6979377 - DNA, 22 bp, Homo sapiens
atgaacaatctgttgacttctg

SEQ ID NO: 6979378 - DNA, 22 bp, Homo sapiens
tggggacatagccagtctggct

SEQ ID NO: 6979379 - DNA, 22 bp, Homo sapiens
gtggctgacaaccactggagga

SEQ ID NO: 6979380 - DNA, 22 bp, Homo sapiens
gtataggtgagggacttgatca

SEQ ID NO: 6979381 - DNA, 22 bp, Homo sapiens
atggtcacagagcttaattaat

SEQ ID NO: 6979382 - DNA, 22 bp, Homo sapiens
cacatgcaagtcctcagttcta

SEQ ID NO: 6979383 - DNA, 22 bp, Homo sapiens
aggtgcttgagggaagaaatta

SEQ ID NO: 6979384 - DNA, 20 bp, Homo sapiens
ttcaggaataagatagcagc

SEQ ID NO: 6979385 - DNA, 22 bp, Homo sapiens
catcttaaccctcagcctccca

SEQ ID NO: 6979386 - DNA, 22 bp, Homo sapiens
tgtcttcagcagtcatctgggg

SEQ ID NO: 6979387 - DNA, 22 bp, Homo sapiens
actggtttcccggaactacagt

SEQ ID NO: 6979388 - DNA, 21 bp, Homo sapiens
aagaatgttccaggtcttgcc

SEQ ID NO: 6979389 - DNA, 22 bp, Homo sapiens
cagagccctgggcacatggtag

SEQ ID NO: 6979390 - DNA, 22 bp, Homo sapiens
tcttaagcagagaagaagttga

SEQ ID NO: 6979391 - DNA, 22 bp, Homo sapiens
gccaggaaaagaagctggtgct

SEQ ID NO: 6979392 - DNA, 22 bp, Homo sapiens
cactagtcctggtttcatgcta

SEQ ID NO: 6979393 - DNA, 22 bp, Homo sapiens
gagtgggaatgttctaagaatt

SEQ ID NO: 6979394 - DNA, 22 bp, Homo sapiens
acatgatattaatgtcttattt

SEQ ID NO: 6979395 - DNA, 22 bp, Homo sapiens
aaatgctgttcttttaggtaga

SEQ ID NO: 6979396 - DNA, 22 bp, Homo sapiens
tagttatgtcagctctgcagag

SEQ ID NO: 6979397 - DNA, 22 bp, Homo sapiens
ataatgtacaactgcttttaat

SEQ ID NO: 6979398 - DNA, 22 bp, Homo sapiens
ggctgccctctgctgactgcaa

SEQ ID NO: 6979399 - DNA, 22 bp, Homo sapiens
tcaacaccacaatttcttaact

SEQ ID NO: 6979400 - DNA, 22 bp, Homo sapiens
gcaggtccagtcaccagagaga

SEQ ID NO: 6979401 - DNA, 19 bp, Homo sapiens
actcagggaaaggagaatt

SEQ ID NO: 6979402 - DNA, 22 bp, Homo sapiens
cagctgaagaaagagtggttag

SEQ ID NO: 6979403 - DNA, 22 bp, Homo sapiens
ttgctgaatgcaagttggatag

SEQ ID NO: 6979404 - DNA, 22 bp, Homo sapiens
ttgatttgtaggaatggagacc

SEQ ID NO: 6979405 - DNA, 20 bp, Homo sapiens
aaagtcttatggttaatttt

SEQ ID NO: 6979406 - DNA, 22 bp, Homo sapiens
acagacagattttgtctgatgt

SEQ ID NO: 6979407 - DNA, 22 bp, Homo sapiens
aggcaattgtttgtgtaatagg

SEQ ID NO: 6979408 - DNA, 22 bp, Homo sapiens
ttgcagctgcagtaaatgttca

SEQ ID NO: 6979409 - DNA, 22 bp, Homo sapiens
ctgttttgtaggtgagcacctt

SEQ ID NO: 6979410 - DNA, 22 bp, Homo sapiens
ttgtttgcccacaactattaag

SEQ ID NO: 6979411 - DNA, 22 bp, Homo sapiens
aaagaatactccttttgccttg

SEQ ID NO: 6979412 - DNA, 22 bp, Homo sapiens
aattgttgagcataaattatcg

SEQ ID NO: 6979413 - DNA, 22 bp, Homo sapiens
tttgcattgtttcaaaagtgaa

SEQ ID NO: 6979414 - DNA, 22 bp, Homo sapiens
caagtctgtctgctcctgtgtg

SEQ ID NO: 6979415 - DNA, 22 bp, Homo sapiens
agtaagtgcagaaaagatgtgg

SEQ ID NO: 6979416 - DNA, 22 bp, Homo sapiens
atccaggctgtctaatgggaga

SEQ ID NO: 6979417 - DNA, 22 bp, Homo sapiens
cagttgattgacttaagtacct

SEQ ID NO: 6979418 - DNA, 19 bp, Homo sapiens
ttgagaaatgggaaaagca

SEQ ID NO: 6979419 - DNA, 17 bp, Homo sapiens
tagattaaacacggcca

SEQ ID NO: 6979420 - DNA, 23 bp, Homo sapiens
atggaagtcactgttttcttgtc

SEQ ID NO: 6979421 - DNA, 22 bp, Homo sapiens
ggatgctgctgcacatcctgca

SEQ ID NO: 6979422 - DNA, 22 bp, Homo sapiens
ttctttgtagcaaaacgtgtat

SEQ ID NO: 6979423 - DNA, 22 bp, Homo sapiens
agtactgtcagcagggtgttga

SEQ ID NO: 6979424 - DNA, 22 bp, Homo sapiens
atgctatttaccacacatcatt

SEQ ID NO: 6979425 - DNA, 22 bp, Homo sapiens
tccaggattgtcagccagaagg

SEQ ID NO: 6979426 - DNA, 22 bp, Homo sapiens
caagagttatcaatctatgtgc

SEQ ID NO: 6979427 - DNA, 22 bp, Homo sapiens
agcaggcagcctaggaagtgaa

SEQ ID NO: 6979428 - DNA, 19 bp, Homo sapiens
ctgtggcctccaggaggga

SEQ ID NO: 6979429 - DNA, 21 bp, Homo sapiens
agtttacaactgtccagcccc

SEQ ID NO: 6979430 - DNA, 22 bp, Homo sapiens
gacaaagagaagtaacagtacc

SEQ ID NO: 6979431 - DNA, 21 bp, Homo sapiens
agggcagattagctgtaagag

SEQ ID NO: 6979432 - DNA, 22 bp, Homo sapiens
tttatgcagcctcagtatcaga

SEQ ID NO: 6979433 - DNA, 22 bp, Homo sapiens
cgttcttttcatatttacatgg

SEQ ID NO: 6979434 - DNA, 22 bp, Homo sapiens
gagggctcactgagaaagcagt

SEQ ID NO: 6979435 - DNA, 22 bp, Homo sapiens
accaggctgttgggcccagtgt

SEQ ID NO: 6979436 - DNA, 22 bp, Homo sapiens
tcttgaagtctgtcatttaaat

SEQ ID NO: 6979437 - DNA, 22 bp, Homo sapiens
cctgggacttggtctggggttt

SEQ ID NO: 6979438 - DNA, 22 bp, Homo sapiens
ttctggagttgtgacctcaggg

SEQ ID NO: 6979439 - DNA, 22 bp, Homo sapiens
ttctgcatgatattaaatgtaa

SEQ ID NO: 6979440 - DNA, 22 bp, Homo sapiens
tcctctgacttctggttgagtt

SEQ ID NO: 6979441 - DNA, 22 bp, Homo sapiens
gccatggggctcagctgcacta

SEQ ID NO: 6979442 - DNA, 22 bp, Homo sapiens
gggctgctgctgccagcgacac

SEQ ID NO: 6979443 - DNA, 22 bp, Homo sapiens
catgctgattcttcctgagctt

SEQ ID NO: 6979444 - DNA, 22 bp, Homo sapiens
atgcaggtatattttattaaag

SEQ ID NO: 6979445 - DNA, 22 bp, Homo sapiens
agaactgtccttggaggagagt

SEQ ID NO: 6979446 - DNA, 22 bp, Homo sapiens
aggctgtgtttcttgcgttttc

SEQ ID NO: 6979447 - DNA, 22 bp, Homo sapiens
agaccctgcattttccagggtt

SEQ ID NO: 6979448 - DNA, 22 bp, Homo sapiens
aaagtaacaataaggttctatt

SEQ ID NO: 6979449 - DNA, 22 bp, Homo sapiens
taataattggcaatgttgagca

SEQ ID NO: 6979450 - DNA, 22 bp, Homo sapiens
tccagccaagggaggttactag

SEQ ID NO: 6979451 - DNA, 22 bp, Homo sapiens
agggatcaaaaaatgtacatgc

SEQ ID NO: 6979452 - DNA, 22 bp, Homo sapiens
aactcattctaagtataccaaa

SEQ ID NO: 6979453 - DNA, 22 bp, Homo sapiens
gcggccttgtggcggagcaggc

SEQ ID NO: 6979454 - DNA, 19 bp, Homo sapiens
tgagaaggtttccgtgggt

SEQ ID NO: 6979455 - DNA, 22 bp, Homo sapiens
ggctgatgggcatgagctgtca

SEQ ID NO: 6979456 - DNA, 22 bp, Homo sapiens
gaggaagcattgacataatctc

SEQ ID NO: 6979457 - DNA, 22 bp, Homo sapiens
cttctcagcttaggtatggttt

SEQ ID NO: 6979458 - DNA, 20 bp, Homo sapiens
tcctaaagtcattgaatttc

SEQ ID NO: 6979459 - DNA, 22 bp, Homo sapiens
cagagaagagtctggcctctct

SEQ ID NO: 6979460 - DNA, 22 bp, Homo sapiens
cactgactaagtttgtgaaggt

SEQ ID NO: 6979461 - DNA, 22 bp, Homo sapiens
gcaccatgatggagcctcatta

SEQ ID NO: 6979462 - DNA, 22 bp, Homo sapiens
tatgaagaaacctatcctctag

SEQ ID NO: 6979463 - DNA, 22 bp, Homo sapiens
gaagttctcttgggggcctgag

SEQ ID NO: 6979464 - DNA, 22 bp, Homo sapiens
gtactacagtttctcattaaat

SEQ ID NO: 6979465 - DNA, 22 bp, Homo sapiens
tccttcagcctcccagctcaaa

SEQ ID NO: 6979466 - DNA, 19 bp, Homo sapiens
ggctgccttctgctcatct

SEQ ID NO: 6979467 - DNA, 22 bp, Homo sapiens
aattcttggtcctagtgtataa

SEQ ID NO: 6979468 - DNA, 22 bp, Homo sapiens
atgaatgtttggtgatcagata

SEQ ID NO: 6979469 - DNA, 22 bp, Homo sapiens
actgggaatggagcctgggcct

SEQ ID NO: 6979470 - DNA, 22 bp, Homo sapiens
tcagggacaataagggaattga

SEQ ID NO: 6979471 - DNA, 20 bp, Homo sapiens
aggaggcctgcagatagttc

SEQ ID NO: 6979472 - DNA, 22 bp, Homo sapiens
tcttgctaaagaccaacacatt

SEQ ID NO: 6979473 - DNA, 22 bp, Homo sapiens
aaagggctgatgtgacatagct

SEQ ID NO: 6979474 - DNA, 22 bp, Homo sapiens
ctagtgtagctcttgtaagcag

SEQ ID NO: 6979475 - DNA, 22 bp, Homo sapiens
ccttcacacaggtagaagcaga

SEQ ID NO: 6979476 - DNA, 22 bp, Homo sapiens
gtggctgctgtcctctctggtt

SEQ ID NO: 6979477 - DNA, 22 bp, Homo sapiens
cctgaccttcaagtctgttctt

SEQ ID NO: 6979478 - DNA, 22 bp, Homo sapiens
ctggccaacatctggggcacat

SEQ ID NO: 6979479 - DNA, 22 bp, Homo sapiens
tttatccattggttagaaaatc

SEQ ID NO: 6979480 - DNA, 17 bp, Homo sapiens
caagagagatgactgga

SEQ ID NO: 6979481 - DNA, 22 bp, Homo sapiens
ctgctctgcagcttggactccc

SEQ ID NO: 6979482 - DNA, 22 bp, Homo sapiens
tcttgagggatcttcagtgtgt

SEQ ID NO: 6979483 - DNA, 22 bp, Homo sapiens
tggagccaatgaacatttgctg

SEQ ID NO: 6979484 - DNA, 22 bp, Homo sapiens
gaagaaagatcaaatagtttcc

SEQ ID NO: 6979485 - DNA, 22 bp, Homo sapiens
tggcagtgaaccaaggctccaa

SEQ ID NO: 6979486 - DNA, 22 bp, Homo sapiens
caggaacccccactctcagctc

SEQ ID NO: 6979487 - DNA, 22 bp, Homo sapiens
atgtaaacaaagatcttcctgc

SEQ ID NO: 6979488 - DNA, 22 bp, Homo sapiens
gccaggagcatgtcattgttga

SEQ ID NO: 6979489 - DNA, 22 bp, Homo sapiens
attcaaagaacctttagcattg

SEQ ID NO: 6979490 - DNA, 22 bp, Homo sapiens
tgcagccatttgaaaagcagtt

SEQ ID NO: 6979491 - DNA, 22 bp, Homo sapiens
tcctgtagttgctaagtttgtt

SEQ ID NO: 6979492 - DNA, 22 bp, Homo sapiens
tgcagaaaccaattcaagtaag

SEQ ID NO: 6979493 - DNA, 22 bp, Homo sapiens
acctttggataatttgagtttg

SEQ ID NO: 6979494 - DNA, 22 bp, Homo sapiens
tgagcattggatcaaatgactt

SEQ ID NO: 6979495 - DNA, 22 bp, Homo sapiens
ttgttcataaagacagttcaga

SEQ ID NO: 6979496 - DNA, 22 bp, Homo sapiens
tggggcaagaagtgccctgaag

SEQ ID NO: 6979497 - DNA, 22 bp, Homo sapiens
ggcagcttgccctggtctcaac

SEQ ID NO: 6979498 - DNA, 22 bp, Homo sapiens
ggaaggaagattctaactggag

SEQ ID NO: 6979499 - DNA, 22 bp, Homo sapiens
tgtggctgctcctgggtggtca

SEQ ID NO: 6979500 - DNA, 22 bp, Homo sapiens
aacagtttctatgttagtggtt

SEQ ID NO: 6979501 - DNA, 22 bp, Homo sapiens
cagcactcccaggagaaccagc

SEQ ID NO: 6979502 - DNA, 21 bp, Homo sapiens
acagagcataatggtgtggca

SEQ ID NO: 6979503 - DNA, 19 bp, Homo sapiens
cagagtttgcaggcagagg

SEQ ID NO: 6979504 - DNA, 22 bp, Homo sapiens
gcaggtggaagcagcagactca

SEQ ID NO: 6979505 - DNA, 22 bp, Homo sapiens
ctgccttgaaaatgaagcttta

SEQ ID NO: 6979506 - DNA, 22 bp, Homo sapiens
ctggcccaggaagacgtgtccc

SEQ ID NO: 6979507 - DNA, 22 bp, Homo sapiens
gttggaagaagactgtaaatta

SEQ ID NO: 6979508 - DNA, 22 bp, Homo sapiens
gccactgattattcagcagaca

SEQ ID NO: 6979509 - DNA, 22 bp, Homo sapiens
aagatgttctattttcactttt

SEQ ID NO: 6979510 - DNA, 22 bp, Homo sapiens
ctctggccgagcatgggggtta

SEQ ID NO: 6979511 - DNA, 22 bp, Homo sapiens
tgccaagattatcgaagtctta

SEQ ID NO: 6979512 - DNA, 22 bp, Homo sapiens
caggtagggatatgatggtgat

SEQ ID NO: 6979513 - DNA, 22 bp, Homo sapiens
taatttacagagatacagtcag

SEQ ID NO: 6979514 - DNA, 22 bp, Homo sapiens
gaggctcttttctgctgtgtct

SEQ ID NO: 6979515 - DNA, 22 bp, Homo sapiens
ttgtgagaaatcttaatcccaa

SEQ ID NO: 6979516 - DNA, 22 bp, Homo sapiens
atagcagtggatgtggagaaag

SEQ ID NO: 6979517 - DNA, 22 bp, Homo sapiens
atccccctcttggatggcggca

SEQ ID NO: 6979518 - DNA, 22 bp, Homo sapiens
cagggatggcctggcgggccac

SEQ ID NO: 6979519 - DNA, 22 bp, Homo sapiens
cactctgagaaacactaaacca

SEQ ID NO: 6979520 - DNA, 22 bp, Homo sapiens
tgggttaagcctcattcatagc

SEQ ID NO: 6979521 - DNA, 22 bp, Homo sapiens
cagtccttcattcctcctttga

SEQ ID NO: 6979522 - DNA, 22 bp, Homo sapiens
ctggaaagacctgcttgctttt

SEQ ID NO: 6979523 - DNA, 22 bp, Homo sapiens
atattcattgaacacctactac

SEQ ID NO: 6979524 - DNA, 22 bp, Homo sapiens
gatatgaagtggcattgtgaag

SEQ ID NO: 6979525 - DNA, 22 bp, Homo sapiens
tgacctctattcctccgcacat

SEQ ID NO: 6979526 - DNA, 22 bp, Homo sapiens
atcctctctgttttcgtgtatg

SEQ ID NO: 6979527 - DNA, 22 bp, Homo sapiens
gattgctgggtcccatccaagg

SEQ ID NO: 6979528 - DNA, 22 bp, Homo sapiens
agcactggaaagttaagagttt

SEQ ID NO: 6979529 - DNA, 18 bp, Homo sapiens
aaacagtgcctaagtgtc

SEQ ID NO: 6979530 - DNA, 22 bp, Homo sapiens
acaggatgataaaggatggcca

SEQ ID NO: 6979531 - DNA, 22 bp, Homo sapiens
gaggacaaggccttgcaattct

SEQ ID NO: 6979532 - DNA, 22 bp, Homo sapiens
tactcagaaggaattgtgtttt

SEQ ID NO: 6979533 - DNA, 22 bp, Homo sapiens
tgttaatgtgctttgaaagact

SEQ ID NO: 6979534 - DNA, 22 bp, Homo sapiens
aggcccagtgtggcttcctgga

SEQ ID NO: 6979535 - DNA, 22 bp, Homo sapiens
ctggctggggtaccagttgaac

SEQ ID NO: 6979536 - DNA, 22 bp, Homo sapiens
cagaagcactaggaggaaacgt

SEQ ID NO: 6979537 - DNA, 22 bp, Homo sapiens
tgttacttcttatttcttacat

SEQ ID NO: 6979538 - DNA, 20 bp, Homo sapiens
gcctagggtcacttcagtga

SEQ ID NO: 6979539 - DNA, 22 bp, Homo sapiens
aacagataagtatatctatgta

SEQ ID NO: 6979540 - DNA, 22 bp, Homo sapiens
gcctagagaagcttactgaagc

SEQ ID NO: 6979541 - DNA, 22 bp, Homo sapiens
gggctgaggctaccactggtct

SEQ ID NO: 6979542 - DNA, 22 bp, Homo sapiens
tacattcccccaattaccaatg

SEQ ID NO: 6979543 - DNA, 22 bp, Homo sapiens
actgaggagaaatttgagtgaa

SEQ ID NO: 6979544 - DNA, 22 bp, Homo sapiens
attagagtccctttggagtttt

SEQ ID NO: 6979545 - DNA, 22 bp, Homo sapiens
aagacattttagagatagggaa

SEQ ID NO: 6979546 - DNA, 19 bp, Homo sapiens
gcacaggacatctgatgga

SEQ ID NO: 6979547 - DNA, 22 bp, Homo sapiens
gcagagtcaggattccatccca

SEQ ID NO: 6979548 - DNA, 22 bp, Homo sapiens
ggaccttcctggctcctggggt

SEQ ID NO: 6979549 - DNA, 22 bp, Homo sapiens
gtacaacatgattttactctct

SEQ ID NO: 6979550 - DNA, 22 bp, Homo sapiens
tggctcaggatctaagcagaat

SEQ ID NO: 6979551 - DNA, 22 bp, Homo sapiens
aagtgatacatctagtctataa

SEQ ID NO: 6979552 - DNA, 22 bp, Homo sapiens
agtcatctggttttgcatggca

SEQ ID NO: 6979553 - DNA, 22 bp, Homo sapiens
ccaggcagctctgatttatgtc

SEQ ID NO: 6979554 - DNA, 16 bp, Homo sapiens
ccacaggtgtcctgca

SEQ ID NO: 6979555 - DNA, 22 bp, Homo sapiens
gcacagagacagtcctgagatc

SEQ ID NO: 6979556 - DNA, 22 bp, Homo sapiens
acatccattttgttcaaaagca

SEQ ID NO: 6979557 - DNA, 22 bp, Homo sapiens
cagctgctgcctcatccacttt

SEQ ID NO: 6979558 - DNA, 22 bp, Homo sapiens
tcctggatatcaaacaaacatt

SEQ ID NO: 6979559 - DNA, 22 bp, Homo sapiens
gttttctgccggtggtgggctc

SEQ ID NO: 6979560 - DNA, 22 bp, Homo sapiens
acaggacaggtaggattcgcag

SEQ ID NO: 6979561 - DNA, 22 bp, Homo sapiens
tcaggctgaaaggactccagtt

SEQ ID NO: 6979562 - DNA, 22 bp, Homo sapiens
tgaacagtttcaagaaaacttt

SEQ ID NO: 6979563 - DNA, 22 bp, Homo sapiens
aagttacagattgggagcagag

SEQ ID NO: 6979564 - DNA, 23 bp, Homo sapiens
gcttctagtcaatttcaccagga

SEQ ID NO: 6979565 - DNA, 21 bp, Homo sapiens
agaagccatgccagtaaaatt

SEQ ID NO: 6979566 - DNA, 22 bp, Homo sapiens
ggggaagatttttaattagtaa

SEQ ID NO: 6979567 - DNA, 22 bp, Homo sapiens
cagggcatccgtgctccatgct

SEQ ID NO: 6979568 - DNA, 22 bp, Homo sapiens
caggcagctgctgggttcagcc

SEQ ID NO: 6979569 - DNA, 22 bp, Homo sapiens
tctttggccttaggagcccttg

SEQ ID NO: 6979570 - DNA, 22 bp, Homo sapiens
aaagttgataaggtatcgtagt

SEQ ID NO: 6979571 - DNA, 22 bp, Homo sapiens
gctgtgcaggggatttggttat

SEQ ID NO: 6979572 - DNA, 22 bp, Homo sapiens
acaaggacataggaaactacaa

SEQ ID NO: 6979573 - DNA, 22 bp, Homo sapiens
gacaaatgaatgatgaacacca

SEQ ID NO: 6979574 - DNA, 22 bp, Homo sapiens
agggtgagggtctggccttgag

SEQ ID NO: 6979575 - DNA, 16 bp, Homo sapiens
tggaaggcttccccca

SEQ ID NO: 6979576 - DNA, 22 bp, Homo sapiens
agtaacatatagcacttttgga

SEQ ID NO: 6979577 - DNA, 22 bp, Homo sapiens
tcatgaatattgaatgcttcat

SEQ ID NO: 6979578 - DNA, 22 bp, Homo sapiens
ttgctgaagctgccaaaccagt

SEQ ID NO: 6979579 - DNA, 15 bp, Homo sapiens
cagtttctgatcatc

SEQ ID NO: 6979580 - DNA, 22 bp, Homo sapiens
ctggcttctgggccagggcaga

SEQ ID NO: 6979581 - DNA, 22 bp, Homo sapiens
ttacagagggcttctctgaact

SEQ ID NO: 6979582 - DNA, 22 bp, Homo sapiens
gggcagcccagaactgctgcag

SEQ ID NO: 6979583 - DNA, 22 bp, Homo sapiens
catgtgtgcaccaaccctatgt

SEQ ID NO: 6979584 - DNA, 18 bp, Homo sapiens
ggaaggttatgccaggtc

SEQ ID NO: 6979585 - DNA, 22 bp, Homo sapiens
gcccacaccatttattctttgt

SEQ ID NO: 6979586 - DNA, 22 bp, Homo sapiens
caaatcacaatgtgagactgag

SEQ ID NO: 6979587 - DNA, 22 bp, Homo sapiens
gtggttgtatagttaaggttca

SEQ ID NO: 6979588 - DNA, 22 bp, Homo sapiens
ggagatgcaatgtagaatctgg

SEQ ID NO: 6979589 - DNA, 22 bp, Homo sapiens
tcataaatatttgtgggggctt

SEQ ID NO: 6979590 - DNA, 22 bp, Homo sapiens
tttgcatttctaatgagctccg

SEQ ID NO: 6979591 - DNA, 22 bp, Homo sapiens
tttctcatggacccttcatgat

SEQ ID NO: 6979592 - DNA, 22 bp, Homo sapiens
ctggagatgtccgggtgctgtt

SEQ ID NO: 6979593 - DNA, 22 bp, Homo sapiens
attaaattggacgctgggggaa

SEQ ID NO: 6979594 - DNA, 22 bp, Homo sapiens
ttcttcaattttccatatactg

SEQ ID NO: 6979595 - DNA, 22 bp, Homo sapiens
agcatctggcagaaagtcagaa

SEQ ID NO: 6979596 - DNA, 22 bp, Homo sapiens
acagggagtgcaattcatattg

SEQ ID NO: 6979597 - DNA, 22 bp, Homo sapiens
aacaaatgattgttggttggag

SEQ ID NO: 6979598 - DNA, 22 bp, Homo sapiens
caaacttggtggattagtacag

SEQ ID NO: 6979599 - DNA, 22 bp, Homo sapiens
acttttttataaggaagaagat

SEQ ID NO: 6979600 - DNA, 22 bp, Homo sapiens
agagtgaagttcatcgtgcagc

SEQ ID NO: 6979601 - DNA, 22 bp, Homo sapiens
gcccagaaagcatcattgtgga

SEQ ID NO: 6979602 - DNA, 17 bp, Homo sapiens
tcacagttggtctcagt

SEQ ID NO: 6979603 - DNA, 22 bp, Homo sapiens
taacattatacagagaggacag

SEQ ID NO: 6979604 - DNA, 22 bp, Homo sapiens
cccagcagaccgctgtgatggc

SEQ ID NO: 6979605 - DNA, 22 bp, Homo sapiens
cacgagaacctctcatttgatt

SEQ ID NO: 6979606 - DNA, 19 bp, Homo sapiens
tatgaagaatgtggcaaag

SEQ ID NO: 6979607 - DNA, 22 bp, Homo sapiens
tgtctcagaatggctcataata

SEQ ID NO: 6979608 - DNA, 22 bp, Homo sapiens
aggctggctggcaggggacaca

SEQ ID NO: 6979609 - DNA, 22 bp, Homo sapiens
tcctgggaagactgtgaggaca

SEQ ID NO: 6979610 - DNA, 21 bp, Homo sapiens
gcacagtgccaggcacacagt

SEQ ID NO: 6979611 - DNA, 22 bp, Homo sapiens
tctcagtctttgcaaggatgct

SEQ ID NO: 6979612 - DNA, 22 bp, Homo sapiens
atacatacatgtacacataaat

SEQ ID NO: 6979613 - DNA, 22 bp, Homo sapiens
agagcagctgcattcagcacct

SEQ ID NO: 6979614 - DNA, 22 bp, Homo sapiens
gctcacaggtctgtggctattg

SEQ ID NO: 6979615 - DNA, 22 bp, Homo sapiens
gagggtgacagttctggtctct

SEQ ID NO: 6979616 - DNA, 22 bp, Homo sapiens
ccgggcgggggctctcgtcacc

SEQ ID NO: 6979617 - DNA, 22 bp, Homo sapiens
tcagacttgcctttttataaaa

SEQ ID NO: 6979618 - DNA, 22 bp, Homo sapiens
tgcctcagtcagcttccctggg

SEQ ID NO: 6979619 - DNA, 22 bp, Homo sapiens
tgtgcatcaaacccatttaaat

SEQ ID NO: 6979620 - DNA, 22 bp, Homo sapiens
taaagcaccatttgtttatcca

SEQ ID NO: 6979621 - DNA, 22 bp, Homo sapiens
ttggatcatggaatgtctgctt

SEQ ID NO: 6979622 - DNA, 22 bp, Homo sapiens
tggcccagctgcagatggtgga

SEQ ID NO: 6979623 - DNA, 22 bp, Homo sapiens
gctgctcatttgtatcctttgt

SEQ ID NO: 6979624 - DNA, 20 bp, Homo sapiens
tccaggcagctcagagtgtc

SEQ ID NO: 6979625 - DNA, 22 bp, Homo sapiens
catgcatattactagcacagca

SEQ ID NO: 6979626 - DNA, 21 bp, Homo sapiens
agctccaggctcctggggttc

SEQ ID NO: 6979627 - DNA, 22 bp, Homo sapiens
tattgacaggtgcctgcagaca

SEQ ID NO: 6979628 - DNA, 22 bp, Homo sapiens
agcaggtgaattcctggatgtg

SEQ ID NO: 6979629 - DNA, 22 bp, Homo sapiens
attgtttccccggaattattca

SEQ ID NO: 6979630 - DNA, 21 bp, Homo sapiens
actgaccacttctgcctgtct

SEQ ID NO: 6979631 - DNA, 22 bp, Homo sapiens
ttcagcacaagactagacaggt

SEQ ID NO: 6979632 - DNA, 22 bp, Homo sapiens
gggagctgcggtcttgcgaaga

SEQ ID NO: 6979633 - DNA, 22 bp, Homo sapiens
agaattctgacaatagaattgg

SEQ ID NO: 6979634 - DNA, 22 bp, Homo sapiens
agtgtttgagacacatttcact

SEQ ID NO: 6979635 - DNA, 22 bp, Homo sapiens
cttaagatttgcgatacctaat

SEQ ID NO: 6979636 - DNA, 22 bp, Homo sapiens
ggcatcagcccggtcctgggct

SEQ ID NO: 6979637 - DNA, 19 bp, Homo sapiens
acagatgcttttgctgccc

SEQ ID NO: 6979638 - DNA, 22 bp, Homo sapiens
ttgtgtgctgagggcctgctgt

SEQ ID NO: 6979639 - DNA, 22 bp, Homo sapiens
gcttgcattgtcagaatgacta

SEQ ID NO: 6979640 - DNA, 22 bp, Homo sapiens
atgaagcagcgttgtagagtga

SEQ ID NO: 6979641 - DNA, 22 bp, Homo sapiens
ggagagctgaagcatggacagg

SEQ ID NO: 6979642 - DNA, 22 bp, Homo sapiens
ccaggcaaggtctcctagagag

SEQ ID NO: 6979643 - DNA, 16 bp, Homo sapiens
attctgctgcctgctc

SEQ ID NO: 6979644 - DNA, 22 bp, Homo sapiens
tgggaatgctgatttcaggaac

SEQ ID NO: 6979645 - DNA, 22 bp, Homo sapiens
ggtggctcaaagagagcacaga

SEQ ID NO: 6979646 - DNA, 22 bp, Homo sapiens
tctgagacaggaagtggagggt

SEQ ID NO: 6979647 - DNA, 22 bp, Homo sapiens
tgctatcaccaactctgctaag

SEQ ID NO: 6979648 - DNA, 22 bp, Homo sapiens
tgttttatcaagatggcatgtc

SEQ ID NO: 6979649 - DNA, 22 bp, Homo sapiens
aatggcatgggaaatgcagtgg

SEQ ID NO: 6979650 - DNA, 19 bp, Homo sapiens
tgtctttggtctgagtttc

SEQ ID NO: 6979651 - DNA, 22 bp, Homo sapiens
cttccctgagctttctcaggct

SEQ ID NO: 6979652 - DNA, 22 bp, Homo sapiens
ctgattccagagtctgtgttct

SEQ ID NO: 6979653 - DNA, 22 bp, Homo sapiens
ggttcattctgaagtcttcagc

SEQ ID NO: 6979654 - DNA, 22 bp, Homo sapiens
agatgctggggcccctcggatg

SEQ ID NO: 6979655 - DNA, 22 bp, Homo sapiens
gatgttgaggaagaaagggcag

SEQ ID NO: 6979656 - DNA, 22 bp, Homo sapiens
tctcagcttgagtggatgagct

SEQ ID NO: 6979657 - DNA, 22 bp, Homo sapiens
ttgaggacagtgcttggggccc

SEQ ID NO: 6979658 - DNA, 22 bp, Homo sapiens
acaactgggggcattactggca

SEQ ID NO: 6979659 - DNA, 22 bp, Homo sapiens
agtcctgtcacctctactttcg

SEQ ID NO: 6979660 - DNA, 22 bp, Homo sapiens
tccagctcccactctcactgct

SEQ ID NO: 6979661 - DNA, 22 bp, Homo sapiens
ctctttcctcgatgggctcctg

SEQ ID NO: 6979662 - DNA, 22 bp, Homo sapiens
tgcctcagagacctgacagtac

SEQ ID NO: 6979663 - DNA, 22 bp, Homo sapiens
aggcagcagcttgctggttgcc

SEQ ID NO: 6979664 - DNA, 22 bp, Homo sapiens
taaggctgggaattgctgagct

SEQ ID NO: 6979665 - DNA, 20 bp, Homo sapiens
ggaagccagggtgcagggga

SEQ ID NO: 6979666 - DNA, 22 bp, Homo sapiens
atcaaaacttctttagagttta

SEQ ID NO: 6979667 - DNA, 22 bp, Homo sapiens
atgttctttcagccagtgcatc

SEQ ID NO: 6979668 - DNA, 22 bp, Homo sapiens
ctgagagaatcatgctgcaggt

SEQ ID NO: 6979669 - DNA, 22 bp, Homo sapiens
actccctgtacttgcctctctt

SEQ ID NO: 6979670 - DNA, 22 bp, Homo sapiens
attttgttaatgtcaccgtgct

SEQ ID NO: 6979671 - DNA, 22 bp, Homo sapiens
aatcatgacaggaatagaaggg

SEQ ID NO: 6979672 - DNA, 22 bp, Homo sapiens
tttgaaagggttatgagactga

SEQ ID NO: 6979673 - DNA, 22 bp, Homo sapiens
tggacacacatgtatgtcagag

SEQ ID NO: 6979674 - DNA, 22 bp, Homo sapiens
gtatcctcacctatacaatgga

SEQ ID NO: 6979675 - DNA, 22 bp, Homo sapiens
aaagaatagcctttgtccaaat

SEQ ID NO: 6979676 - DNA, 22 bp, Homo sapiens
agcagagccaggtctctctgta

SEQ ID NO: 6979677 - DNA, 22 bp, Homo sapiens
actgccttttccattacttaat

SEQ ID NO: 6979678 - DNA, 19 bp, Homo sapiens
agctagtgctcagctgtca

SEQ ID NO: 6979679 - DNA, 22 bp, Homo sapiens
tgctgagtcgtattatttttta

SEQ ID NO: 6979680 - DNA, 22 bp, Homo sapiens
cacaggagctgtggggcagtgt

SEQ ID NO: 6979681 - DNA, 22 bp, Homo sapiens
ttcaattttgcagaggaatgca

SEQ ID NO: 6979682 - DNA, 22 bp, Homo sapiens
tcaacacttttgtctttgtccc

SEQ ID NO: 6979683 - DNA, 19 bp, Homo sapiens
cttctggccctgagccacc

SEQ ID NO: 6979684 - DNA, 22 bp, Homo sapiens
gtctgtctcctgggtgcgcacc

SEQ ID NO: 6979685 - DNA, 22 bp, Homo sapiens
actttcctggccctgtcctctg

SEQ ID NO: 6979686 - DNA, 22 bp, Homo sapiens
agatgcaacctctgcttaacaa

SEQ ID NO: 6979687 - DNA, 22 bp, Homo sapiens
tgtgagctgaagtgacaggctg

SEQ ID NO: 6979688 - DNA, 22 bp, Homo sapiens
aggaagtgcagggggaagtact

SEQ ID NO: 6979689 - DNA, 19 bp, Homo sapiens
tggcccagatggtcctggg

SEQ ID NO: 6979690 - DNA, 19 bp, Homo sapiens
gctggagtcacttttgaga

SEQ ID NO: 6979691 - DNA, 22 bp, Homo sapiens
catgttttctaggctttcacaa

SEQ ID NO: 6979692 - DNA, 22 bp, Homo sapiens
ctgtgccccacagagctccaca

SEQ ID NO: 6979693 - DNA, 22 bp, Homo sapiens
ttcctcagagggcgctggggaa

SEQ ID NO: 6979694 - DNA, 17 bp, Homo sapiens
gccctgcctgctgccct

SEQ ID NO: 6979695 - DNA, 19 bp, Homo sapiens
ggtatatgggcctcacttg

SEQ ID NO: 6979696 - DNA, 22 bp, Homo sapiens
ctcagggcttgagtgtccagga

SEQ ID NO: 6979697 - DNA, 22 bp, Homo sapiens
tctgttcagaaatggaagtgcc

SEQ ID NO: 6979698 - DNA, 22 bp, Homo sapiens
tcacataaatttaccagatgat

SEQ ID NO: 6979699 - DNA, 22 bp, Homo sapiens
gtcattcctatccatttgatac

SEQ ID NO: 6979700 - DNA, 23 bp, Homo sapiens
ttgaaaaatatagtcccattgtc

SEQ ID NO: 6979701 - DNA, 23 bp, Homo sapiens
gttgtaatggataatgcaaattg

SEQ ID NO: 6979702 - DNA, 22 bp, Homo sapiens
caggatgtggtgtacatattaa

SEQ ID NO: 6979703 - DNA, 22 bp, Homo sapiens
ctggaggaaaacaactgcagac

SEQ ID NO: 6979704 - DNA, 22 bp, Homo sapiens
gggtaaggtcagccagaagttc

SEQ ID NO: 6979705 - DNA, 22 bp, Homo sapiens
tgggtagcagggctgagctgtg

SEQ ID NO: 6979706 - DNA, 22 bp, Homo sapiens
ccagggaaggctctgcctgctt

SEQ ID NO: 6979707 - DNA, 22 bp, Homo sapiens
gttattgctggatagatacatc

SEQ ID NO: 6979708 - DNA, 23 bp, Homo sapiens
agagaaagggataacacgttgaa

SEQ ID NO: 6979709 - DNA, 22 bp, Homo sapiens
gttcatgtggaaatttaaaaca

SEQ ID NO: 6979710 - DNA, 22 bp, Homo sapiens
tcattatcttggctcatttctg

SEQ ID NO: 6979711 - DNA, 18 bp, Homo sapiens
tccagctcacagatgggc

SEQ ID NO: 6979712 - DNA, 20 bp, Homo sapiens
cactgaagacttcttgctca

SEQ ID NO: 6979713 - DNA, 19 bp, Homo sapiens
agaatcccaggccccactg

SEQ ID NO: 6979714 - DNA, 22 bp, Homo sapiens
tggcagagtaggatggccctgt

SEQ ID NO: 6979715 - DNA, 22 bp, Homo sapiens
cagctgcttctcctccagagct

SEQ ID NO: 6979716 - DNA, 22 bp, Homo sapiens
cagcagtggaactacccaggga

SEQ ID NO: 6979717 - DNA, 22 bp, Homo sapiens
agggctttaatgattattttct

SEQ ID NO: 6979718 - DNA, 22 bp, Homo sapiens
gcctcagtgatatgtgggacaa

SEQ ID NO: 6979719 - DNA, 22 bp, Homo sapiens
aagctgaagccggatcaaaaag

SEQ ID NO: 6979720 - DNA, 22 bp, Homo sapiens
gtgcatatggttacagcaccgc

SEQ ID NO: 6979721 - DNA, 22 bp, Homo sapiens
tctaaccttgtggtctgctggt

SEQ ID NO: 6979722 - DNA, 22 bp, Homo sapiens
gctctgcccaaagctgtggctg

SEQ ID NO: 6979723 - DNA, 22 bp, Homo sapiens
ctggaaagtgtctccatcctgg

SEQ ID NO: 6979724 - DNA, 22 bp, Homo sapiens
agaaatcaatatctatatgttg

SEQ ID NO: 6979725 - DNA, 22 bp, Homo sapiens
gcagtaggagggacaactacct

SEQ ID NO: 6979726 - DNA, 17 bp, Homo sapiens
taggctgtgcaatacca

SEQ ID NO: 6979727 - DNA, 22 bp, Homo sapiens
aaatgcagattttgatgcagca

SEQ ID NO: 6979728 - DNA, 22 bp, Homo sapiens
actgtaaggtaaggataaaacc

SEQ ID NO: 6979729 - DNA, 22 bp, Homo sapiens
tgcaggctccaggtgcacatat

SEQ ID NO: 6979730 - DNA, 22 bp, Homo sapiens
gcttcctgtaggcaggtccaag

SEQ ID NO: 6979731 - DNA, 22 bp, Homo sapiens
ctggcattcttgtttctggaaa

SEQ ID NO: 6979732 - DNA, 22 bp, Homo sapiens
ctttcctctggcactgtctggt

SEQ ID NO: 6979733 - DNA, 22 bp, Homo sapiens
ctgttcccggtggccgggccag

SEQ ID NO: 6979734 - DNA, 22 bp, Homo sapiens
taggaatgggctatcccaagct

SEQ ID NO: 6979735 - DNA, 22 bp, Homo sapiens
actctggcgggcgggcgagcca

SEQ ID NO: 6979736 - DNA, 22 bp, Homo sapiens
ggacagaaaccatatgagtgta

SEQ ID NO: 6979737 - DNA, 18 bp, Homo sapiens
atgtctgtgcactggata

SEQ ID NO: 6979738 - DNA, 22 bp, Homo sapiens
ggactatctcttcaggattgtt

SEQ ID NO: 6979739 - DNA, 22 bp, Homo sapiens
ggtctcagatctttattaaggc

SEQ ID NO: 6979740 - DNA, 22 bp, Homo sapiens
acacatcttagactgaaatatg

SEQ ID NO: 6979741 - DNA, 22 bp, Homo sapiens
tgcttgtcaccctgcctgagtg

SEQ ID NO: 6979742 - DNA, 23 bp, Homo sapiens
aacatttgtaaggtgattttgtt

SEQ ID NO: 6979743 - DNA, 23 bp, Homo sapiens
tagccaggcccagcatggacacc

SEQ ID NO: 6979744 - DNA, 22 bp, Homo sapiens
caagggccctcggatgatgatg

SEQ ID NO: 6979745 - DNA, 22 bp, Homo sapiens
ttacataacggtatgaaaaatg

SEQ ID NO: 6979746 - DNA, 22 bp, Homo sapiens
tcaggatgagtcatcaagctgc

SEQ ID NO: 6979747 - DNA, 18 bp, Homo sapiens
gacaaatgcaatttaaag

SEQ ID NO: 6979748 - DNA, 22 bp, Homo sapiens
aatacagtaattttgatgagtt

SEQ ID NO: 6979749 - DNA, 22 bp, Homo sapiens
agttgctgggaaagatttcagt

SEQ ID NO: 6979750 - DNA, 22 bp, Homo sapiens
taactgcaggtcatcctcgcat

SEQ ID NO: 6979751 - DNA, 22 bp, Homo sapiens
tggtttgtctaaatgagtaata

SEQ ID NO: 6979752 - DNA, 22 bp, Homo sapiens
gaggatgcctgggtcggggaag

SEQ ID NO: 6979753 - DNA, 22 bp, Homo sapiens
acatttcatttgcagtatggat

SEQ ID NO: 6979754 - DNA, 22 bp, Homo sapiens
ctttccagatttgtccagttat

SEQ ID NO: 6979755 - DNA, 22 bp, Homo sapiens
gccttagcctgcacttcctgtt

SEQ ID NO: 6979756 - DNA, 20 bp, Homo sapiens
aggtcctggttctctgggat

SEQ ID NO: 6979757 - DNA, 22 bp, Homo sapiens
ttcactgaagtttcttccatgt

SEQ ID NO: 6979758 - DNA, 22 bp, Homo sapiens
tcatgaacatggaatatctttt

SEQ ID NO: 6979759 - DNA, 22 bp, Homo sapiens
agtggagacaggacagtcgata

SEQ ID NO: 6979760 - DNA, 22 bp, Homo sapiens
tcccagggacccagcctgatac

SEQ ID NO: 6979761 - DNA, 22 bp, Homo sapiens
caaggctttctcattatccttt

SEQ ID NO: 6979762 - DNA, 22 bp, Homo sapiens
caggttctcagaaggcagtcac

SEQ ID NO: 6979763 - DNA, 22 bp, Homo sapiens
ccaggcaaatccctctggcaga

SEQ ID NO: 6979764 - DNA, 21 bp, Homo sapiens
tggctctgagcctcatggctg

SEQ ID NO: 6979765 - DNA, 22 bp, Homo sapiens
gcaggctgaaactcggggtcta

SEQ ID NO: 6979766 - DNA, 22 bp, Homo sapiens
tcttttctccagacctgggatc

SEQ ID NO: 6979767 - DNA, 22 bp, Homo sapiens
ttttcctgcctttgctcaggga

SEQ ID NO: 6979768 - DNA, 22 bp, Homo sapiens
ggtgggtgaaatctaggtgtgt

SEQ ID NO: 6979769 - DNA, 22 bp, Homo sapiens
gaattataggtttgcatgctaa

SEQ ID NO: 6979770 - DNA, 22 bp, Homo sapiens
ttgtctctaagtgtgatcttca

SEQ ID NO: 6979771 - DNA, 22 bp, Homo sapiens
tgaaagataagttattatgtac

SEQ ID NO: 6979772 - DNA, 22 bp, Homo sapiens
gcagctttctttttgcatgtct

SEQ ID NO: 6979773 - DNA, 22 bp, Homo sapiens
aggcagccatccaggaggctca

SEQ ID NO: 6979774 - DNA, 22 bp, Homo sapiens
gtggggctggaagatgggtact

SEQ ID NO: 6979775 - DNA, 22 bp, Homo sapiens
agtatttgtggatttgtattgg

SEQ ID NO: 6979776 - DNA, 22 bp, Homo sapiens
tacccaggaggaaactgaggct

SEQ ID NO: 6979777 - DNA, 22 bp, Homo sapiens
gtttatacagtgcatggtgtta

SEQ ID NO: 6979778 - DNA, 22 bp, Homo sapiens
ccaggctcagcgcgcacgtctg

SEQ ID NO: 6979779 - DNA, 22 bp, Homo sapiens
gaatttaagaggatgaatctgt

SEQ ID NO: 6979780 - DNA, 22 bp, Homo sapiens
accaggaagctgtgagaccttt

SEQ ID NO: 6979781 - DNA, 22 bp, Homo sapiens
aaagctttgggtaggaatggga

SEQ ID NO: 6979782 - DNA, 22 bp, Homo sapiens
gtgtctgcttgctgagcattta

SEQ ID NO: 6979783 - DNA, 22 bp, Homo sapiens
cagcccacctggcacgtgtgtt

SEQ ID NO: 6979784 - DNA, 22 bp, Homo sapiens
acatgaggtgctataggtctac

SEQ ID NO: 6979785 - DNA, 22 bp, Homo sapiens
ccagggtttaaattctgactat

SEQ ID NO: 6979786 - DNA, 18 bp, Homo sapiens
gggcatggatgcagcatc

SEQ ID NO: 6979787 - DNA, 22 bp, Homo sapiens
tgcacagatgctaggaggtgaa

SEQ ID NO: 6979788 - DNA, 22 bp, Homo sapiens
ggaggccagggtgggtggatcg

SEQ ID NO: 6979789 - DNA, 22 bp, Homo sapiens
tgctaaataagtggaatagaca

SEQ ID NO: 6979790 - DNA, 22 bp, Homo sapiens
caggaacagcaccaggagctag

SEQ ID NO: 6979791 - DNA, 22 bp, Homo sapiens
cctgaagcaagggtaggcaggt

SEQ ID NO: 6979792 - DNA, 20 bp, Homo sapiens
aataaactactgagagatgt

SEQ ID NO: 6979793 - DNA, 22 bp, Homo sapiens
aggaaacatccttatctattct

SEQ ID NO: 6979794 - DNA, 22 bp, Homo sapiens
atgtctctttactcttagaacc

SEQ ID NO: 6979795 - DNA, 22 bp, Homo sapiens
gtgttgtggagcttgtcagggg

SEQ ID NO: 6979796 - DNA, 22 bp, Homo sapiens
gggaagagtaactagcccatgt

SEQ ID NO: 6979797 - DNA, 22 bp, Homo sapiens
agtgacagtctcagagatcagg

SEQ ID NO: 6979798 - DNA, 22 bp, Homo sapiens
ggctgaaacagatttcaagaca

SEQ ID NO: 6979799 - DNA, 22 bp, Homo sapiens
tttctgccagtcactgctctag

SEQ ID NO: 6979800 - DNA, 17 bp, Homo sapiens
ttcctggaagtcattcc

SEQ ID NO: 6979801 - DNA, 23 bp, Homo sapiens
aaatgacatatggtttctgaagg

SEQ ID NO: 6979802 - DNA, 22 bp, Homo sapiens
tagatataggacagtactgtat

SEQ ID NO: 6979803 - DNA, 22 bp, Homo sapiens
attctccactgtaaggttatta

SEQ ID NO: 6979804 - DNA, 22 bp, Homo sapiens
tctaaattcagtttattttgat

SEQ ID NO: 6979805 - DNA, 22 bp, Homo sapiens
gagatggggaataggagcaagc

SEQ ID NO: 6979806 - DNA, 22 bp, Homo sapiens
tggttcgtctcttttacagttc

SEQ ID NO: 6979807 - DNA, 22 bp, Homo sapiens
tcactgcaggtttttcaggagg

SEQ ID NO: 6979808 - DNA, 20 bp, Homo sapiens
tgttctgtcgtctttcttca

SEQ ID NO: 6979809 - DNA, 22 bp, Homo sapiens
tacctgaagtaacaatgaatat

SEQ ID NO: 6979810 - DNA, 22 bp, Homo sapiens
tgcttgcttcagccctcatctt

SEQ ID NO: 6979811 - DNA, 21 bp, Homo sapiens
tttggcattatgtcaccagag

SEQ ID NO: 6979812 - DNA, 23 bp, Homo sapiens
gctaggtgcttccacacgtgctg

SEQ ID NO: 6979813 - DNA, 22 bp, Homo sapiens
tctggaagaggtgggttgggag

SEQ ID NO: 6979814 - DNA, 23 bp, Homo sapiens
ctgtggatctagagggggcccta

SEQ ID NO: 6979815 - DNA, 22 bp, Homo sapiens
agggaggtctttgaggggctta

SEQ ID NO: 6979816 - DNA, 22 bp, Homo sapiens
gacaactgccccattttaaatg

SEQ ID NO: 6979817 - DNA, 22 bp, Homo sapiens
tttctttgttgttatcacatca

SEQ ID NO: 6979818 - DNA, 22 bp, Homo sapiens
tggcacagtcctgggtgcctgc

SEQ ID NO: 6979819 - DNA, 22 bp, Homo sapiens
agctgaatcttgactaggaaga

SEQ ID NO: 6979820 - DNA, 22 bp, Homo sapiens
cagttctggagtttcattcttt

SEQ ID NO: 6979821 - DNA, 22 bp, Homo sapiens
cagctttggcccagtcgggagg

SEQ ID NO: 6979822 - DNA, 22 bp, Homo sapiens
aagaatctttccagttttgatg

SEQ ID NO: 6979823 - DNA, 22 bp, Homo sapiens
tggagtccgctccaagttctct

SEQ ID NO: 6979824 - DNA, 22 bp, Homo sapiens
atctgtgtgttattgtttatca

SEQ ID NO: 6979825 - DNA, 22 bp, Homo sapiens
gcttccagatcccatgctctta

SEQ ID NO: 6979826 - DNA, 22 bp, Homo sapiens
agcctgcgatcccacctggcct

SEQ ID NO: 6979827 - DNA, 22 bp, Homo sapiens
aggacagcagtgctggcacttg

SEQ ID NO: 6979828 - DNA, 22 bp, Homo sapiens
gggtgtgtcttttgctcctgga

SEQ ID NO: 6979829 - DNA, 21 bp, Homo sapiens
tgaaactacctacaagctacc

SEQ ID NO: 6979830 - DNA, 20 bp, Homo sapiens
agtgagattgctgctctagc

SEQ ID NO: 6979831 - DNA, 22 bp, Homo sapiens
gacagtcccccagcagcaaacc

SEQ ID NO: 6979832 - DNA, 22 bp, Homo sapiens
tccattttcttgctctaggtaa

SEQ ID NO: 6979833 - DNA, 22 bp, Homo sapiens
tctaccacttattagctctgtg

SEQ ID NO: 6979834 - DNA, 22 bp, Homo sapiens
cttgagaatgtgagccacagat

SEQ ID NO: 6979835 - DNA, 22 bp, Homo sapiens
agagagaggcagcagtgctcac

SEQ ID NO: 6979836 - DNA, 22 bp, Homo sapiens
tgggacacggaggccccagcac

SEQ ID NO: 6979837 - DNA, 18 bp, Homo sapiens
agggctctctgctgggtt

SEQ ID NO: 6979838 - DNA, 22 bp, Homo sapiens
gctgtgcactacctatacatcc

SEQ ID NO: 6979839 - DNA, 22 bp, Homo sapiens
taaagcagtgcaaaagcgtttt

SEQ ID NO: 6979840 - DNA, 22 bp, Homo sapiens
ctgtttaatgaggtgtaacaac

SEQ ID NO: 6979841 - DNA, 22 bp, Homo sapiens
cagggagcagcatgggcaaagg

SEQ ID NO: 6979842 - DNA, 22 bp, Homo sapiens
gagtttgtgggaatggagtatt

SEQ ID NO: 6979843 - DNA, 22 bp, Homo sapiens
gtggccaggtcagggacttgtg

SEQ ID NO: 6979844 - DNA, 22 bp, Homo sapiens
acagtggaaagaacatggattt

SEQ ID NO: 6979845 - DNA, 22 bp, Homo sapiens
gagctgctgtgaggggagcttc

SEQ ID NO: 6979846 - DNA, 22 bp, Homo sapiens
ctcagccagtgatctttccttt

SEQ ID NO: 6979847 - DNA, 22 bp, Homo sapiens
tgagacagcagattagcaatga

SEQ ID NO: 6979848 - DNA, 22 bp, Homo sapiens
gtgtgcccgggggaagcaggtg

SEQ ID NO: 6979849 - DNA, 22 bp, Homo sapiens
tggcagcagctaacttaggcag

SEQ ID NO: 6979850 - DNA, 22 bp, Homo sapiens
ccaggctagagtgcagtggcat

SEQ ID NO: 6979851 - DNA, 22 bp, Homo sapiens
ccaggctggagtgcaatggcat

SEQ ID NO: 6979852 - DNA, 22 bp, Homo sapiens
ctccgtgctattttagtatcgc

SEQ ID NO: 6979853 - DNA, 23 bp, Homo sapiens
gcctgggactggtagtgtgacct

SEQ ID NO: 6979854 - DNA, 22 bp, Homo sapiens
actgtggccttgtgggttcagg

SEQ ID NO: 6979855 - DNA, 22 bp, Homo sapiens
accaggactaataaaaatgttc

SEQ ID NO: 6979856 - DNA, 21 bp, Homo sapiens
cattgagataggagagattgt

SEQ ID NO: 6979857 - DNA, 22 bp, Homo sapiens
tttattcaagatgaggttcatg

SEQ ID NO: 6979858 - DNA, 22 bp, Homo sapiens
tgaaggtgtttatacctcagat

SEQ ID NO: 6979859 - DNA, 22 bp, Homo sapiens
atgttgtgtttgactgttaccc

SEQ ID NO: 6979860 - DNA, 22 bp, Homo sapiens
gtattttatggcatgcagtggc

SEQ ID NO: 6979861 - DNA, 22 bp, Homo sapiens
atctgtggcagtgatgagtctt

SEQ ID NO: 6979862 - DNA, 22 bp, Homo sapiens
tgccacatggtgcatttcctag

SEQ ID NO: 6979863 - DNA, 23 bp, Homo sapiens
actcaaaatttggcatttgagga

SEQ ID NO: 6979864 - DNA, 22 bp, Homo sapiens
gttcatccatattatagcatgt

SEQ ID NO: 6979865 - DNA, 22 bp, Homo sapiens
cagctcattcctcaatctagga

SEQ ID NO: 6979866 - DNA, 22 bp, Homo sapiens
gggcgcatcacctgaggtcagg

SEQ ID NO: 6979867 - DNA, 22 bp, Homo sapiens
tagggacaaagagctgaggcct

SEQ ID NO: 6979868 - DNA, 22 bp, Homo sapiens
gaaagcacatactataaatcac

SEQ ID NO: 6979869 - DNA, 19 bp, Homo sapiens
tgctttgcatctgattgtt

SEQ ID NO: 6979870 - DNA, 22 bp, Homo sapiens
gggttcagagtcaggtgtgata

SEQ ID NO: 6979871 - DNA, 22 bp, Homo sapiens
cttgcttgttttgaagaaagat

SEQ ID NO: 6979872 - DNA, 22 bp, Homo sapiens
agtatcatctccatttcactga

SEQ ID NO: 6979873 - DNA, 22 bp, Homo sapiens
gtggccttggcttctaccctga

SEQ ID NO: 6979874 - DNA, 22 bp, Homo sapiens
agtggagttgagttgatggatt

SEQ ID NO: 6979875 - DNA, 22 bp, Homo sapiens
agaaacatcttggcaactggaa

SEQ ID NO: 6979876 - DNA, 22 bp, Homo sapiens
aataagtgatgatgagtcactc

SEQ ID NO: 6979877 - DNA, 18 bp, Homo sapiens
taggaggatactgagatg

SEQ ID NO: 6979878 - DNA, 18 bp, Homo sapiens
tgtcattgccagggaagc

SEQ ID NO: 6979879 - DNA, 21 bp, Homo sapiens
aggccctggaggtcagagaaa

SEQ ID NO: 6979880 - DNA, 22 bp, Homo sapiens
atgtatagtggtgatgattaca

SEQ ID NO: 6979881 - DNA, 22 bp, Homo sapiens
aagttctaacaggaggtctctt

SEQ ID NO: 6979882 - DNA, 22 bp, Homo sapiens
tctgccttgtttgagctttgac

SEQ ID NO: 6979883 - DNA, 22 bp, Homo sapiens
tggggccagggaggaccagaca

SEQ ID NO: 6979884 - DNA, 22 bp, Homo sapiens
ctttagtttgtgatacgaagat

SEQ ID NO: 6979885 - DNA, 22 bp, Homo sapiens
cggggcgagcagacggcggcaa

SEQ ID NO: 6979886 - DNA, 22 bp, Homo sapiens
ctgacatttactgagcacttac

SEQ ID NO: 6979887 - DNA, 22 bp, Homo sapiens
tcctggccataggctatttcag

SEQ ID NO: 6979888 - DNA, 22 bp, Homo sapiens
gtctcccatcgtttgtgaggaa

SEQ ID NO: 6979889 - DNA, 22 bp, Homo sapiens
aacatttcataacttgactttt

SEQ ID NO: 6979890 - DNA, 22 bp, Homo sapiens
ttctcccatctcagtcttacat

SEQ ID NO: 6979891 - DNA, 22 bp, Homo sapiens
gcatttcagaagcatgccctct

SEQ ID NO: 6979892 - DNA, 22 bp, Homo sapiens
gaaacttttaaacctcatgagt

SEQ ID NO: 6979893 - DNA, 22 bp, Homo sapiens
atgtacattctaagtatgtgta

SEQ ID NO: 6979894 - DNA, 21 bp, Homo sapiens
ggaactttcatgaatctagca

SEQ ID NO: 6979895 - DNA, 21 bp, Homo sapiens
gacattgcatggtggcctctt

SEQ ID NO: 6979896 - DNA, 22 bp, Homo sapiens
tccaaatatagatgagttgtaa

SEQ ID NO: 6979897 - DNA, 22 bp, Homo sapiens
aggcactgattctcagagttac

SEQ ID NO: 6979898 - DNA, 22 bp, Homo sapiens
aacaatgaggatctgttctgag

SEQ ID NO: 6979899 - DNA, 22 bp, Homo sapiens
ttggctctgaaacccaagctct

SEQ ID NO: 6979900 - DNA, 22 bp, Homo sapiens
atagtaatcagttgttggatca

SEQ ID NO: 6979901 - DNA, 22 bp, Homo sapiens
tgggaattgaggtgattgtgag

SEQ ID NO: 6979902 - DNA, 22 bp, Homo sapiens
atacagtgaatacttacagtgt

SEQ ID NO: 6979903 - DNA, 22 bp, Homo sapiens
agtgacttaattcattatattt

SEQ ID NO: 6979904 - DNA, 22 bp, Homo sapiens
gagctggctccgccatgctgct

SEQ ID NO: 6979905 - DNA, 22 bp, Homo sapiens
acaggcctatgttccattgcag

SEQ ID NO: 6979906 - DNA, 22 bp, Homo sapiens
cttgaaagcacttagtaaatta

SEQ ID NO: 6979907 - DNA, 22 bp, Homo sapiens
atagaatgtattatagtacaga

SEQ ID NO: 6979908 - DNA, 22 bp, Homo sapiens
agtgcccacgccacactggtgg

SEQ ID NO: 6979909 - DNA, 22 bp, Homo sapiens
acaggagttcagaggacacccc

SEQ ID NO: 6979910 - DNA, 22 bp, Homo sapiens
cacagcgccttccccgggagcg

SEQ ID NO: 6979911 - DNA, 22 bp, Homo sapiens
gtgctatgattggacagaatag

SEQ ID NO: 6979912 - DNA, 22 bp, Homo sapiens
ctgatgttcatttcttttgtac

SEQ ID NO: 6979913 - DNA, 22 bp, Homo sapiens
tagagttatgtggctccacagg

SEQ ID NO: 6979914 - DNA, 22 bp, Homo sapiens
cctcagcatcctcatgctcagt

SEQ ID NO: 6979915 - DNA, 22 bp, Homo sapiens
tcactgttagagcaaacgtatg

SEQ ID NO: 6979916 - DNA, 22 bp, Homo sapiens
aggaagagcattcacatggtag

SEQ ID NO: 6979917 - DNA, 22 bp, Homo sapiens
cacactgtctttatgagctgta

SEQ ID NO: 6979918 - DNA, 22 bp, Homo sapiens
tcagacttttaaagactgaatg

SEQ ID NO: 6979919 - DNA, 22 bp, Homo sapiens
tcagtgatctaagggtatggcc

SEQ ID NO: 6979920 - DNA, 22 bp, Homo sapiens
gatgaggcgagcacgttgtttg

SEQ ID NO: 6979921 - DNA, 22 bp, Homo sapiens
ctgatctatttacaggaaccaa

SEQ ID NO: 6979922 - DNA, 22 bp, Homo sapiens
ctcccaggttgattctttccct

SEQ ID NO: 6979923 - DNA, 15 bp, Homo sapiens
tatggctgtaaagct

SEQ ID NO: 6979924 - DNA, 22 bp, Homo sapiens
gatttttatataaagtgagaaa

SEQ ID NO: 6979925 - DNA, 22 bp, Homo sapiens
cctgcctgaaggtcagccaccc

SEQ ID NO: 6979926 - DNA, 22 bp, Homo sapiens
atagcatttacttttcagaaat

SEQ ID NO: 6979927 - DNA, 22 bp, Homo sapiens
tagtgtctcggggcccaggatt

SEQ ID NO: 6979928 - DNA, 22 bp, Homo sapiens
actgtggtgcacggcctgctcc

SEQ ID NO: 6979929 - DNA, 22 bp, Homo sapiens
ccttagaaggctgaataattct

SEQ ID NO: 6979930 - DNA, 22 bp, Homo sapiens
gcagattattattaggctgagt

SEQ ID NO: 6979931 - DNA, 22 bp, Homo sapiens
atgctgcctcctcttcagccgc

SEQ ID NO: 6979932 - DNA, 22 bp, Homo sapiens
ctcatccaccctcaacaaagat

SEQ ID NO: 6979933 - DNA, 22 bp, Homo sapiens
gttttccactggattgtttgga

SEQ ID NO: 6979934 - DNA, 22 bp, Homo sapiens
ccaggcctggaccatgccaggg

SEQ ID NO: 6979935 - DNA, 22 bp, Homo sapiens
cagcagcctccactcgccccac

SEQ ID NO: 6979936 - DNA, 20 bp, Homo sapiens
tcactctgatgctagggtgg

SEQ ID NO: 6979937 - DNA, 22 bp, Homo sapiens
caatgctgtgctcctcatgagg

SEQ ID NO: 6979938 - DNA, 22 bp, Homo sapiens
ttctctgcctctagctatattc

SEQ ID NO: 6979939 - DNA, 22 bp, Homo sapiens
aaggaacctgagggaccccaaa

SEQ ID NO: 6979940 - DNA, 22 bp, Homo sapiens
aggataataatagtgctcactc

SEQ ID NO: 6979941 - DNA, 22 bp, Homo sapiens
atacagctgccttctaactatg

SEQ ID NO: 6979942 - DNA, 22 bp, Homo sapiens
ggggcagaagtagtgcccctga

SEQ ID NO: 6979943 - DNA, 22 bp, Homo sapiens
ggctcagaaggccatgctctgc

SEQ ID NO: 6979944 - DNA, 22 bp, Homo sapiens
attcattcttggtatgaacagc

SEQ ID NO: 6979945 - DNA, 22 bp, Homo sapiens
ggctggctggctggtagacaag

SEQ ID NO: 6979946 - DNA, 22 bp, Homo sapiens
tagcagagcgggtgcgaggcgg

SEQ ID NO: 6979947 - DNA, 22 bp, Homo sapiens
ggctgccctgggaggcaagggt

SEQ ID NO: 6979948 - DNA, 22 bp, Homo sapiens
ggagcaagtcccaggcactagt

SEQ ID NO: 6979949 - DNA, 22 bp, Homo sapiens
agcttgtcgggcctcagctccc

SEQ ID NO: 6979950 - DNA, 22 bp, Homo sapiens
aaattgtataatgttccagctg

SEQ ID NO: 6979951 - DNA, 22 bp, Homo sapiens
ttgacagggccaagaatggacc

SEQ ID NO: 6979952 - DNA, 22 bp, Homo sapiens
aggtgccagatgcacagctgaa

SEQ ID NO: 6979953 - DNA, 22 bp, Homo sapiens
tagaggggaaaatgcgtattaa

SEQ ID NO: 6979954 - DNA, 22 bp, Homo sapiens
cttttgttctacagctggggaa

SEQ ID NO: 6979955 - DNA, 22 bp, Homo sapiens
tctttcttctttcatagtgtga

SEQ ID NO: 6979956 - DNA, 22 bp, Homo sapiens
taggtgtctgtcctgggctgtg

SEQ ID NO: 6979957 - DNA, 22 bp, Homo sapiens
agaaaggaagggaggagtttat

SEQ ID NO: 6979958 - DNA, 22 bp, Homo sapiens
atggcagtgataggctagtgat

SEQ ID NO: 6979959 - DNA, 22 bp, Homo sapiens
atgtctgcggcccaggccaggg

SEQ ID NO: 6979960 - DNA, 22 bp, Homo sapiens
aagggcatgggatgaaaagtag

SEQ ID NO: 6979961 - DNA, 22 bp, Homo sapiens
ttgtccagtttctagaggcctc

SEQ ID NO: 6979962 - DNA, 22 bp, Homo sapiens
tccaggacctcccaggctagag

SEQ ID NO: 6979963 - DNA, 22 bp, Homo sapiens
ctgccttggccctagttcatgg

SEQ ID NO: 6979964 - DNA, 22 bp, Homo sapiens
atagtttccattgctgaccaaa

SEQ ID NO: 6979965 - DNA, 22 bp, Homo sapiens
tggtggcatcactcagcctccc

SEQ ID NO: 6979966 - DNA, 22 bp, Homo sapiens
ttcacaaaacactattttctgg

SEQ ID NO: 6979967 - DNA, 22 bp, Homo sapiens
ggcaatgtagattctgtagatt

SEQ ID NO: 6979968 - DNA, 22 bp, Homo sapiens
cagcttgtattgaagctatacc

SEQ ID NO: 6979969 - DNA, 22 bp, Homo sapiens
tagcatttagaacaccttgaga

SEQ ID NO: 6979970 - DNA, 22 bp, Homo sapiens
attcagttagtagatttggtca

SEQ ID NO: 6979971 - DNA, 22 bp, Homo sapiens
gtatacatttattacaggtctt

SEQ ID NO: 6979972 - DNA, 22 bp, Homo sapiens
ggggaagaaatagaacattttg

SEQ ID NO: 6979973 - DNA, 22 bp, Homo sapiens
acttggaatattgcgtttttgc

SEQ ID NO: 6979974 - DNA, 22 bp, Homo sapiens
tccttcagcttatttcttagga

SEQ ID NO: 6979975 - DNA, 19 bp, Homo sapiens
gtggaatcggtgtttttta

SEQ ID NO: 6979976 - DNA, 22 bp, Homo sapiens
cagtgtttgcttaagttatatg

SEQ ID NO: 6979977 - DNA, 22 bp, Homo sapiens
atgagttgaagctacaagaggc

SEQ ID NO: 6979978 - DNA, 22 bp, Homo sapiens
cagggaatccatggtcataagg

SEQ ID NO: 6979979 - DNA, 22 bp, Homo sapiens
tgattcacagacttcacaaggc

SEQ ID NO: 6979980 - DNA, 22 bp, Homo sapiens
atcagctggaacaagtgtctga

SEQ ID NO: 6979981 - DNA, 22 bp, Homo sapiens
acagtaaaaagccttagaattt

SEQ ID NO: 6979982 - DNA, 22 bp, Homo sapiens
tctggaggcaggctgccaggat

SEQ ID NO: 6979983 - DNA, 22 bp, Homo sapiens
accaagctgtatattattggtt

SEQ ID NO: 6979984 - DNA, 22 bp, Homo sapiens
ctcaggctcatatcccatcagc

SEQ ID NO: 6979985 - DNA, 22 bp, Homo sapiens
tggcagagttatgggtatttat

SEQ ID NO: 6979986 - DNA, 22 bp, Homo sapiens
aatggctttaagtagtctcaca

SEQ ID NO: 6979987 - DNA, 22 bp, Homo sapiens
tcacacgtgaggttctatcctg

SEQ ID NO: 6979988 - DNA, 21 bp, Homo sapiens
tggaccgggaagtgaagtggg

SEQ ID NO: 6979989 - DNA, 22 bp, Homo sapiens
acaggcctcaagacacccaggt

SEQ ID NO: 6979990 - DNA, 22 bp, Homo sapiens
tacttgttatcatcttttcctt

SEQ ID NO: 6979991 - DNA, 22 bp, Homo sapiens
tagaaatcagcaggcatatgta

SEQ ID NO: 6979992 - DNA, 22 bp, Homo sapiens
ctcaggccattcctaccaaggg

SEQ ID NO: 6979993 - DNA, 22 bp, Homo sapiens
tgtgactaggcctgagctcttg

SEQ ID NO: 6979994 - DNA, 22 bp, Homo sapiens
tttggcagatgaccctcaagtt

SEQ ID NO: 6979995 - DNA, 22 bp, Homo sapiens
ttcaacaaatatttattgagct

SEQ ID NO: 6979996 - DNA, 23 bp, Homo sapiens
tcagcatcacctgggaacttact

SEQ ID NO: 6979997 - DNA, 22 bp, Homo sapiens
tgtcagtgctatagtgggaata

SEQ ID NO: 6979998 - DNA, 22 bp, Homo sapiens
tcctgagggctcggggctcatg

SEQ ID NO: 6979999 - DNA, 22 bp, Homo sapiens
ggagggctcaattgactcctga

SEQ ID NO: 6980000 - DNA, 22 bp, Homo sapiens
tttacaggaagctgaaaaacat

SEQ ID NO: 6980001 - DNA, 21 bp, Homo sapiens
acctcaagcaacaaccaaggt

SEQ ID NO: 6980002 - DNA, 23 bp, Homo sapiens
actgggctgaaattaaaggtgtc

SEQ ID NO: 6980003 - DNA, 22 bp, Homo sapiens
agtcagaatctgcattttaacc

SEQ ID NO: 6980004 - DNA, 22 bp, Homo sapiens
aagaggtcataccagataaggg

SEQ ID NO: 6980005 - DNA, 22 bp, Homo sapiens
cagtgcaatattcaaagtggag

SEQ ID NO: 6980006 - DNA, 22 bp, Homo sapiens
tcttggccactaccacctggag

SEQ ID NO: 6980007 - DNA, 22 bp, Homo sapiens
tagtccagccttgggtgtagcc

SEQ ID NO: 6980008 - DNA, 22 bp, Homo sapiens
gtgaggattgctctggagaatt

SEQ ID NO: 6980009 - DNA, 22 bp, Homo sapiens
tgcaggctcttggtgacgtggg

SEQ ID NO: 6980010 - DNA, 22 bp, Homo sapiens
tgcccagagcctcttacctcca

SEQ ID NO: 6980011 - DNA, 22 bp, Homo sapiens
atcactgatgaagttagaccta

SEQ ID NO: 6980012 - DNA, 20 bp, Homo sapiens
tggagagcctctggactgtg

SEQ ID NO: 6980013 - DNA, 20 bp, Homo sapiens
cactgcattgatggaaacag

SEQ ID NO: 6980014 - DNA, 22 bp, Homo sapiens
gatcatttgcaggaaacattaa

SEQ ID NO: 6980015 - DNA, 22 bp, Homo sapiens
tccatgtgttttcctgtccaca

SEQ ID NO: 6980016 - DNA, 22 bp, Homo sapiens
agctttgcatactttgggctgt

SEQ ID NO: 6980017 - DNA, 22 bp, Homo sapiens
agcagctgagatggtaagattc

SEQ ID NO: 6980018 - DNA, 21 bp, Homo sapiens
aatcagtgttctcaggggcaa

SEQ ID NO: 6980019 - DNA, 22 bp, Homo sapiens
gccctccagcctgtggaaccgg

SEQ ID NO: 6980020 - DNA, 22 bp, Homo sapiens
gttatgtatgggggccttatga

SEQ ID NO: 6980021 - DNA, 22 bp, Homo sapiens
tcatgcacctctccatgtcccc

SEQ ID NO: 6980022 - DNA, 22 bp, Homo sapiens
gtgtatacatcacagaggacca

SEQ ID NO: 6980023 - DNA, 22 bp, Homo sapiens
agtggagctaaggtatctttta

SEQ ID NO: 6980024 - DNA, 21 bp, Homo sapiens
tcttggctctgccacttatta

SEQ ID NO: 6980025 - DNA, 22 bp, Homo sapiens
agccagctaagggaagcatgat

SEQ ID NO: 6980026 - DNA, 22 bp, Homo sapiens
taaataagtcactgaccattta

SEQ ID NO: 6980027 - DNA, 22 bp, Homo sapiens
gccaggatgactatacaacagc

SEQ ID NO: 6980028 - DNA, 20 bp, Homo sapiens
aattgcccatcctcctagcc

SEQ ID NO: 6980029 - DNA, 22 bp, Homo sapiens
tgaagcacaggcatacacaacc

SEQ ID NO: 6980030 - DNA, 22 bp, Homo sapiens
gaggatttgatggctttctccc

SEQ ID NO: 6980031 - DNA, 22 bp, Homo sapiens
ttattcagtgcctttgaaagaa

SEQ ID NO: 6980032 - DNA, 22 bp, Homo sapiens
caggtaagtctgtcctcacaag

SEQ ID NO: 6980033 - DNA, 22 bp, Homo sapiens
tcagaggaggcatttaaacaga

SEQ ID NO: 6980034 - DNA, 22 bp, Homo sapiens
gggggactggaccgtcctgggt

SEQ ID NO: 6980035 - DNA, 19 bp, Homo sapiens
ggtggctctccctcaggga

SEQ ID NO: 6980036 - DNA, 18 bp, Homo sapiens
ggtcaggggcggagagaa

SEQ ID NO: 6980037 - DNA, 22 bp, Homo sapiens
gagttctgtagggtgaaatagt

SEQ ID NO: 6980038 - DNA, 22 bp, Homo sapiens
ttctaagtcctacctgaaagca

SEQ ID NO: 6980039 - DNA, 22 bp, Homo sapiens
agccttacataaacagccttat

SEQ ID NO: 6980040 - DNA, 22 bp, Homo sapiens
ttccttgggtgcctacttagag

SEQ ID NO: 6980041 - DNA, 22 bp, Homo sapiens
acccagggcagccagcggggag

SEQ ID NO: 6980042 - DNA, 22 bp, Homo sapiens
atagaggcagtgaagctagttg

SEQ ID NO: 6980043 - DNA, 22 bp, Homo sapiens
attgttgatcttctggtaagcc

SEQ ID NO: 6980044 - DNA, 22 bp, Homo sapiens
tggctctgagctgcaaagctgc

SEQ ID NO: 6980045 - DNA, 22 bp, Homo sapiens
tgatccctgattgccttgactc

SEQ ID NO: 6980046 - DNA, 22 bp, Homo sapiens
tatttctgaatccaaaaggtca

SEQ ID NO: 6980047 - DNA, 22 bp, Homo sapiens
ggagaaagtcagctccaagcag

SEQ ID NO: 6980048 - DNA, 22 bp, Homo sapiens
gaaggcataaaaccaattttgt

SEQ ID NO: 6980049 - DNA, 22 bp, Homo sapiens
tcccttaaccgtaggacagtct

SEQ ID NO: 6980050 - DNA, 22 bp, Homo sapiens
cacccctgtggagcatggtggc

SEQ ID NO: 6980051 - DNA, 22 bp, Homo sapiens
ccagcagcccctcaatgatctg

SEQ ID NO: 6980052 - DNA, 22 bp, Homo sapiens
caagtgtctatatcagtgcttg

SEQ ID NO: 6980053 - DNA, 22 bp, Homo sapiens
gcccagcagctggtggagaagg

SEQ ID NO: 6980054 - DNA, 22 bp, Homo sapiens
tgcaggtctctgcaaggcctat

SEQ ID NO: 6980055 - DNA, 20 bp, Homo sapiens
agtcacattgagcttttgga

SEQ ID NO: 6980056 - DNA, 22 bp, Homo sapiens
tgcccttgaggacagctcccag

SEQ ID NO: 6980057 - DNA, 22 bp, Homo sapiens
tcaggtgtctgcctctttgagt

SEQ ID NO: 6980058 - DNA, 22 bp, Homo sapiens
atgatacattgcaaaattttaa

SEQ ID NO: 6980059 - DNA, 22 bp, Homo sapiens
tgttatttctttgccatatctt

SEQ ID NO: 6980060 - DNA, 22 bp, Homo sapiens
caccttgtgatcctcttgcctt

SEQ ID NO: 6980061 - DNA, 22 bp, Homo sapiens
agctctgagaaagttagaaagt

SEQ ID NO: 6980062 - DNA, 22 bp, Homo sapiens
ggcttcttaatcatgagagtga

SEQ ID NO: 6980063 - DNA, 22 bp, Homo sapiens
tgcagtggaatctggagagcag

SEQ ID NO: 6980064 - DNA, 22 bp, Homo sapiens
ttgctggagtagaaaacttaac

SEQ ID NO: 6980065 - DNA, 22 bp, Homo sapiens
actctgctaaatgtaagttggt

SEQ ID NO: 6980066 - DNA, 20 bp, Homo sapiens
ttatctgtcaatctgtctca

SEQ ID NO: 6980067 - DNA, 20 bp, Homo sapiens
cttccttttccttcgtcaaa

SEQ ID NO: 6980068 - DNA, 22 bp, Homo sapiens
agcattgtctccaagcaggtct

SEQ ID NO: 6980069 - DNA, 22 bp, Homo sapiens
tggggagtgatgcctcggataa

SEQ ID NO: 6980070 - DNA, 20 bp, Homo sapiens
ctctttgaaatgctcttggg

SEQ ID NO: 6980071 - DNA, 22 bp, Homo sapiens
ctcatttactgtagaacagtta

SEQ ID NO: 6980072 - DNA, 22 bp, Homo sapiens
atggctgtgcagagattgggaa

SEQ ID NO: 6980073 - DNA, 22 bp, Homo sapiens
acagaagaccagagagctaact

SEQ ID NO: 6980074 - DNA, 19 bp, Homo sapiens
tccataagcttgtgttcat

SEQ ID NO: 6980075 - DNA, 22 bp, Homo sapiens
gaagtttacctctgccttgctt

SEQ ID NO: 6980076 - DNA, 22 bp, Homo sapiens
tctgacagctccaggcagcaat

SEQ ID NO: 6980077 - DNA, 22 bp, Homo sapiens
ggcaggcaaggcagcctggtga

SEQ ID NO: 6980078 - DNA, 22 bp, Homo sapiens
atagaattatggaaagcatctt

SEQ ID NO: 6980079 - DNA, 22 bp, Homo sapiens
agagaacagcctcctagagaaa

SEQ ID NO: 6980080 - DNA, 22 bp, Homo sapiens
ggctcttgcccgcccaggctgg

SEQ ID NO: 6980081 - DNA, 22 bp, Homo sapiens
tgtatacatttaactagataga

SEQ ID NO: 6980082 - DNA, 22 bp, Homo sapiens
cccactgtctgttcccagggcc

SEQ ID NO: 6980083 - DNA, 22 bp, Homo sapiens
tgtaccatgcgacgcctctcac

SEQ ID NO: 6980084 - DNA, 22 bp, Homo sapiens
tttcataatagtgcagtttgtt

SEQ ID NO: 6980085 - DNA, 22 bp, Homo sapiens
agcccaaggcttccctgctggc

SEQ ID NO: 6980086 - DNA, 22 bp, Homo sapiens
aagtgaatctcctttctttatt

SEQ ID NO: 6980087 - DNA, 22 bp, Homo sapiens
gaaatctgaacaacagctgtca

SEQ ID NO: 6980088 - DNA, 22 bp, Homo sapiens
gtgcatttatatttgcctttgg

SEQ ID NO: 6980089 - DNA, 19 bp, Homo sapiens
tatgtccctttcccccatt

SEQ ID NO: 6980090 - DNA, 22 bp, Homo sapiens
caaactatttacaatggaatca

SEQ ID NO: 6980091 - DNA, 22 bp, Homo sapiens
tttaagttccttttcaacaact

SEQ ID NO: 6980092 - DNA, 22 bp, Homo sapiens
aggacagacctaggactggagc

SEQ ID NO: 6980093 - DNA, 22 bp, Homo sapiens
gccggactgctgcagctgctag

SEQ ID NO: 6980094 - DNA, 22 bp, Homo sapiens
agcttgaagccttggcgagatt

SEQ ID NO: 6980095 - DNA, 22 bp, Homo sapiens
tcagtccctaaggatatgggct

SEQ ID NO: 6980096 - DNA, 22 bp, Homo sapiens
tcagaacagttcttaatattgc

SEQ ID NO: 6980097 - DNA, 22 bp, Homo sapiens
ttcagcactttgttttgctcat

SEQ ID NO: 6980098 - DNA, 22 bp, Homo sapiens
cacttcacttggatgccttttc

SEQ ID NO: 6980099 - DNA, 22 bp, Homo sapiens
aggctctggagaagaatccgct

SEQ ID NO: 6980100 - DNA, 22 bp, Homo sapiens
cagatactcaagcttagacttt

SEQ ID NO: 6980101 - DNA, 22 bp, Homo sapiens
tgagcctgtcattattcagaga

SEQ ID NO: 6980102 - DNA, 22 bp, Homo sapiens
ttatcttggcaattctaaggta

SEQ ID NO: 6980103 - DNA, 22 bp, Homo sapiens
atgtgtattacctcgattgtga

SEQ ID NO: 6980104 - DNA, 22 bp, Homo sapiens
ctcagcaaccctagaacatttg

SEQ ID NO: 6980105 - DNA, 22 bp, Homo sapiens
ttggaggaaattgcttttgtgg

SEQ ID NO: 6980106 - DNA, 17 bp, Homo sapiens
tatttcactggctcccc

SEQ ID NO: 6980107 - DNA, 22 bp, Homo sapiens
tcaatcacgtgttccatgttct

SEQ ID NO: 6980108 - DNA, 22 bp, Homo sapiens
aaattcttcaggtaattttgat

SEQ ID NO: 6980109 - DNA, 22 bp, Homo sapiens
cggcttcaaagggagcgagatc

SEQ ID NO: 6980110 - DNA, 22 bp, Homo sapiens
acagagcaatgcgtgttctcta

SEQ ID NO: 6980111 - DNA, 22 bp, Homo sapiens
acacagctttcagtcattatct

SEQ ID NO: 6980112 - DNA, 22 bp, Homo sapiens
gtgcctgccccactcctcagca

SEQ ID NO: 6980113 - DNA, 22 bp, Homo sapiens
atgcctgtaattccagcatttt

SEQ ID NO: 6980114 - DNA, 22 bp, Homo sapiens
tccagccaggatggcccaggga

SEQ ID NO: 6980115 - DNA, 22 bp, Homo sapiens
taagtgaatactaaggatggag

SEQ ID NO: 6980116 - DNA, 22 bp, Homo sapiens
gatggtggagtaacattgccta

SEQ ID NO: 6980117 - DNA, 22 bp, Homo sapiens
taacttttgtgatctgtcgatt

SEQ ID NO: 6980118 - DNA, 22 bp, Homo sapiens
tgctctggaatagtcctaggca

SEQ ID NO: 6980119 - DNA, 22 bp, Homo sapiens
ggcagctcctcaaaaaattaaa

SEQ ID NO: 6980120 - DNA, 22 bp, Homo sapiens
attcccacacttgaagccctct

SEQ ID NO: 6980121 - DNA, 20 bp, Homo sapiens
aacctgaggcagtgttccag

SEQ ID NO: 6980122 - DNA, 22 bp, Homo sapiens
tgtttctataacctctgaagca

SEQ ID NO: 6980123 - DNA, 22 bp, Homo sapiens
tctggagaaggaagagtctttg

SEQ ID NO: 6980124 - DNA, 22 bp, Homo sapiens
tttagttattgcacagaattag

SEQ ID NO: 6980125 - DNA, 22 bp, Homo sapiens
ggcagtcccaggctgcatgttg

SEQ ID NO: 6980126 - DNA, 22 bp, Homo sapiens
atctctgatttacagcatctct

SEQ ID NO: 6980127 - DNA, 22 bp, Homo sapiens
gctatgaatatggatggtggtg

SEQ ID NO: 6980128 - DNA, 22 bp, Homo sapiens
aagtgtcctcattcaacatgca

SEQ ID NO: 6980129 - DNA, 22 bp, Homo sapiens
aagttattgcagcaatccaagt

SEQ ID NO: 6980130 - DNA, 22 bp, Homo sapiens
tagcattagtcagatatgtttt

SEQ ID NO: 6980131 - DNA, 22 bp, Homo sapiens
tggggtaggtatgaaaactagg

SEQ ID NO: 6980132 - DNA, 22 bp, Homo sapiens
tgaaggtggaagggtggttctg

SEQ ID NO: 6980133 - DNA, 22 bp, Homo sapiens
tgtttccagaaggacaaagaaa

SEQ ID NO: 6980134 - DNA, 19 bp, Homo sapiens
gagcaggccacacatgtgt

SEQ ID NO: 6980135 - DNA, 22 bp, Homo sapiens
gtgctttaccttattggtctcg

SEQ ID NO: 6980136 - DNA, 22 bp, Homo sapiens
ccagtcacaggtgtgtttatat

SEQ ID NO: 6980137 - DNA, 22 bp, Homo sapiens
tccctgagaaagcccaggaggt

SEQ ID NO: 6980138 - DNA, 22 bp, Homo sapiens
tggctatttacaaggtaggtga

SEQ ID NO: 6980139 - DNA, 22 bp, Homo sapiens
tcagggccctcacttgcatagg

SEQ ID NO: 6980140 - DNA, 22 bp, Homo sapiens
aaagcttttcagtatgttcatg

SEQ ID NO: 6980141 - DNA, 22 bp, Homo sapiens
ttggaatcaattcatgttgcaa

SEQ ID NO: 6980142 - DNA, 22 bp, Homo sapiens
gaatcttttttcttgccaggca

SEQ ID NO: 6980143 - DNA, 22 bp, Homo sapiens
agtgtctttgtctctcaagcac

SEQ ID NO: 6980144 - DNA, 22 bp, Homo sapiens
atgagggaggcaaggagatgct

SEQ ID NO: 6980145 - DNA, 22 bp, Homo sapiens
tcactgttttgcctgcacttcc

SEQ ID NO: 6980146 - DNA, 22 bp, Homo sapiens
cactagttcacaaaataggaaa

SEQ ID NO: 6980147 - DNA, 19 bp, Homo sapiens
atctaagagatgggggaaa

SEQ ID NO: 6980148 - DNA, 22 bp, Homo sapiens
tatgagataatagatgtgtaaa

SEQ ID NO: 6980149 - DNA, 22 bp, Homo sapiens
tgaatggtgattggtgcttctc

SEQ ID NO: 6980150 - DNA, 23 bp, Homo sapiens
cctagattcaaagcttataattc

SEQ ID NO: 6980151 - DNA, 22 bp, Homo sapiens
ttctacacttttcattagctag

SEQ ID NO: 6980152 - DNA, 22 bp, Homo sapiens
taggagcttttggagtcctgtg

SEQ ID NO: 6980153 - DNA, 22 bp, Homo sapiens
gtgattatgttatattaaggca

SEQ ID NO: 6980154 - DNA, 18 bp, Homo sapiens
actgtgtgaattagctcc

SEQ ID NO: 6980155 - DNA, 22 bp, Homo sapiens
tagaatcatacctctaggaaca

SEQ ID NO: 6980156 - DNA, 22 bp, Homo sapiens
gccctgagactgagcatgggtt

SEQ ID NO: 6980157 - DNA, 22 bp, Homo sapiens
agcatccagatgcctgatgtca

SEQ ID NO: 6980158 - DNA, 22 bp, Homo sapiens
cctaagagattattgctcctgc

SEQ ID NO: 6980159 - DNA, 23 bp, Homo sapiens
cttgagctcaggaagagctgagt

SEQ ID NO: 6980160 - DNA, 22 bp, Homo sapiens
tagaagtgggaatataaaatat

SEQ ID NO: 6980161 - DNA, 22 bp, Homo sapiens
ggcagggcagcgctgattaggg

SEQ ID NO: 6980162 - DNA, 22 bp, Homo sapiens
cctccatgtaaaggtcccctca

SEQ ID NO: 6980163 - DNA, 22 bp, Homo sapiens
tcccacttaactgtgacttctc

SEQ ID NO: 6980164 - DNA, 22 bp, Homo sapiens
cttcagatccctctgccactgt

SEQ ID NO: 6980165 - DNA, 22 bp, Homo sapiens
tagcagggatacaaggtcgcct

SEQ ID NO: 6980166 - DNA, 22 bp, Homo sapiens
agtctggtaatgtagctcaacc

SEQ ID NO: 6980167 - DNA, 22 bp, Homo sapiens
acagcatgtctagttaaatact

SEQ ID NO: 6980168 - DNA, 22 bp, Homo sapiens
gcacagtattgcacaactctag

SEQ ID NO: 6980169 - DNA, 20 bp, Homo sapiens
gccatccagcctcccaggag

SEQ ID NO: 6980170 - DNA, 22 bp, Homo sapiens
tgcctcttggagcctttcctct

SEQ ID NO: 6980171 - DNA, 23 bp, Homo sapiens
agctaaggaagctgaggcacagt

SEQ ID NO: 6980172 - DNA, 22 bp, Homo sapiens
tgttttggtagattgattatgg

SEQ ID NO: 6980173 - DNA, 22 bp, Homo sapiens
aaactctgggggtggagcccag

SEQ ID NO: 6980174 - DNA, 23 bp, Homo sapiens
cagagctgattaaacttaatctc

SEQ ID NO: 6980175 - DNA, 22 bp, Homo sapiens
tgggagagagaattcccagtgg

SEQ ID NO: 6980176 - DNA, 22 bp, Homo sapiens
agggcaatggactacaaaaggt

SEQ ID NO: 6980177 - DNA, 22 bp, Homo sapiens
tgtttaactagttttcacactt

SEQ ID NO: 6980178 - DNA, 22 bp, Homo sapiens
acttgctggctccttgcttcta

SEQ ID NO: 6980179 - DNA, 22 bp, Homo sapiens
ttcaacatagctgaggcatata

SEQ ID NO: 6980180 - DNA, 22 bp, Homo sapiens
ttcatacatgtgtactgttcca

SEQ ID NO: 6980181 - DNA, 22 bp, Homo sapiens
gagccaggcaccttctgtgttg

SEQ ID NO: 6980182 - DNA, 18 bp, Homo sapiens
aatgaaatgtacaccttt

SEQ ID NO: 6980183 - DNA, 22 bp, Homo sapiens
ttccatttggagctcgcagcct

SEQ ID NO: 6980184 - DNA, 22 bp, Homo sapiens
ggcctggaaggacagcgtgatg

SEQ ID NO: 6980185 - DNA, 22 bp, Homo sapiens
tcagcagaacaaggaagcttaa

SEQ ID NO: 6980186 - DNA, 19 bp, Homo sapiens
tggctctttttatgacatt

SEQ ID NO: 6980187 - DNA, 22 bp, Homo sapiens
ccagggtgtgagaaggaagtag

SEQ ID NO: 6980188 - DNA, 22 bp, Homo sapiens
agtggggattgtgacatattac

SEQ ID NO: 6980189 - DNA, 22 bp, Homo sapiens
tgctgaattctcattccctgga

SEQ ID NO: 6980190 - DNA, 22 bp, Homo sapiens
tggctttatccatcatcgccaa

SEQ ID NO: 6980191 - DNA, 22 bp, Homo sapiens
caagataaagccaccagaagct

SEQ ID NO: 6980192 - DNA, 22 bp, Homo sapiens
ggaagctgcttagctaatgtag

SEQ ID NO: 6980193 - DNA, 22 bp, Homo sapiens
ctctgccatcttggagctcaag

SEQ ID NO: 6980194 - DNA, 22 bp, Homo sapiens
tgccttgctttggcggaggctg

SEQ ID NO: 6980195 - DNA, 22 bp, Homo sapiens
ctgtgcactaaccacacccacg

SEQ ID NO: 6980196 - DNA, 22 bp, Homo sapiens
aggcaggctcaggcccatgctt

SEQ ID NO: 6980197 - DNA, 23 bp, Homo sapiens
gctcacagggtgtaactcctagt

SEQ ID NO: 6980198 - DNA, 22 bp, Homo sapiens
aagtaacacggaacttgaagca

SEQ ID NO: 6980199 - DNA, 22 bp, Homo sapiens
agaacacactgggggaaacaag

SEQ ID NO: 6980200 - DNA, 22 bp, Homo sapiens
cagacttgacggcagctgcttt

SEQ ID NO: 6980201 - DNA, 22 bp, Homo sapiens
tgctgctggatcttactcatct

SEQ ID NO: 6980202 - DNA, 22 bp, Homo sapiens
gttattctgcacacctttaaaa

SEQ ID NO: 6980203 - DNA, 22 bp, Homo sapiens
tccagcaggtgtttgccaactt

SEQ ID NO: 6980204 - DNA, 22 bp, Homo sapiens
cagaacttcatattgacgttag

SEQ ID NO: 6980205 - DNA, 22 bp, Homo sapiens
gattattttgtgcaataatcgg

SEQ ID NO: 6980206 - DNA, 23 bp, Homo sapiens
gcagtgcttggcacagctgggtc

SEQ ID NO: 6980207 - DNA, 22 bp, Homo sapiens
tgtgtacacgagaggttatata

SEQ ID NO: 6980208 - DNA, 22 bp, Homo sapiens
tcattcccccataatggtattt

SEQ ID NO: 6980209 - DNA, 23 bp, Homo sapiens
atgctctgggctgtgggacctgc

SEQ ID NO: 6980210 - DNA, 22 bp, Homo sapiens
gtgctctgagtttgcatgtcag

SEQ ID NO: 6980211 - DNA, 22 bp, Homo sapiens
ttcattagaaaagtaaaaatgc

SEQ ID NO: 6980212 - DNA, 22 bp, Homo sapiens
gggcagcagaattggacagaaa

SEQ ID NO: 6980213 - DNA, 22 bp, Homo sapiens
tggacatgtccggccagacaat

SEQ ID NO: 6980214 - DNA, 22 bp, Homo sapiens
ttaccacacttatttacattgg

SEQ ID NO: 6980215 - DNA, 22 bp, Homo sapiens
tctttgaactctgtgtattaac

SEQ ID NO: 6980216 - DNA, 22 bp, Homo sapiens
catttcagtgtcttgtgatgaa

SEQ ID NO: 6980217 - DNA, 22 bp, Homo sapiens
agttctgtctgattctaatgca

SEQ ID NO: 6980218 - DNA, 20 bp, Homo sapiens
gcagtgatttgtctatgttt

SEQ ID NO: 6980219 - DNA, 22 bp, Homo sapiens
tgctggcatcttaatgttctgt

SEQ ID NO: 6980220 - DNA, 22 bp, Homo sapiens
tacagcttgacccataatgtct

SEQ ID NO: 6980221 - DNA, 22 bp, Homo sapiens
tgctcctgctcctcccggttga

SEQ ID NO: 6980222 - DNA, 22 bp, Homo sapiens
cctgggatttgcgccagacctt

SEQ ID NO: 6980223 - DNA, 22 bp, Homo sapiens
gaaggctatatgactcagccct

SEQ ID NO: 6980224 - DNA, 23 bp, Homo sapiens
cggaggcaaatcggccatttaag

SEQ ID NO: 6980225 - DNA, 22 bp, Homo sapiens
aagaaagcattagacaggcatt

SEQ ID NO: 6980226 - DNA, 22 bp, Homo sapiens
tttatgacaagcattactgatt

SEQ ID NO: 6980227 - DNA, 22 bp, Homo sapiens
tgcctgcctctggcagccctgc

SEQ ID NO: 6980228 - DNA, 22 bp, Homo sapiens
ttcaaaatccgggaggcgcccc

SEQ ID NO: 6980229 - DNA, 22 bp, Homo sapiens
tgttaggactccccagaagctg

SEQ ID NO: 6980230 - DNA, 22 bp, Homo sapiens
gcccatggcttccctaggcaca

SEQ ID NO: 6980231 - DNA, 22 bp, Homo sapiens
agatttgatatcatgcaacaaa

SEQ ID NO: 6980232 - DNA, 22 bp, Homo sapiens
gcggaaacacagggaagtagca

SEQ ID NO: 6980233 - DNA, 22 bp, Homo sapiens
aagcatatattttatatgttgt

SEQ ID NO: 6980234 - DNA, 22 bp, Homo sapiens
atttggacatttacaatagtga

SEQ ID NO: 6980235 - DNA, 22 bp, Homo sapiens
tcagcaagaagctgtgggcttc

SEQ ID NO: 6980236 - DNA, 20 bp, Homo sapiens
tcagttaagttgctgaatct

SEQ ID NO: 6980237 - DNA, 22 bp, Homo sapiens
tagcccatttgttggaagcatg

SEQ ID NO: 6980238 - DNA, 22 bp, Homo sapiens
ctgccaccaaatagctgcatga

SEQ ID NO: 6980239 - DNA, 22 bp, Homo sapiens
gagcatggttccataggttggt

SEQ ID NO: 6980240 - DNA, 18 bp, Homo sapiens
aggttttcaggatatgtg

SEQ ID NO: 6980241 - DNA, 22 bp, Homo sapiens
tgctgagacagtggataggggc

SEQ ID NO: 6980242 - DNA, 22 bp, Homo sapiens
ttgatcaagtgggaaatagtaa

SEQ ID NO: 6980243 - DNA, 22 bp, Homo sapiens
cttcacaaagctctctttatgt

SEQ ID NO: 6980244 - DNA, 22 bp, Homo sapiens
ctgccctggcagcctaccatgg

SEQ ID NO: 6980245 - DNA, 22 bp, Homo sapiens
cagctgccacaggactttctga

SEQ ID NO: 6980246 - DNA, 22 bp, Homo sapiens
atatgctacaaataaactttta

SEQ ID NO: 6980247 - DNA, 22 bp, Homo sapiens
gtggaagtagatttgagaaggt

SEQ ID NO: 6980248 - DNA, 17 bp, Homo sapiens
tggcgctcccagggtgc

SEQ ID NO: 6980249 - DNA, 22 bp, Homo sapiens
tccctcctgcatgaggctcggc

SEQ ID NO: 6980250 - DNA, 18 bp, Homo sapiens
agcatggcacaggctccc

SEQ ID NO: 6980251 - DNA, 22 bp, Homo sapiens
tgacaccctctcctggagagag

SEQ ID NO: 6980252 - DNA, 22 bp, Homo sapiens
tcaggctccctgctgggctctg

SEQ ID NO: 6980253 - DNA, 22 bp, Homo sapiens
tgagaggaacaggcagtaggtt

SEQ ID NO: 6980254 - DNA, 22 bp, Homo sapiens
aagtttaaggtggaagtggtgg

SEQ ID NO: 6980255 - DNA, 22 bp, Homo sapiens
tgttttaatctcccattgctct

SEQ ID NO: 6980256 - DNA, 22 bp, Homo sapiens
ggtcccagctgctcaagaggct

SEQ ID NO: 6980257 - DNA, 22 bp, Homo sapiens
agcaggccaaggaactttgtgg

SEQ ID NO: 6980258 - DNA, 22 bp, Homo sapiens
atacaagttctcatgtgtatct

SEQ ID NO: 6980259 - DNA, 22 bp, Homo sapiens
cagagagaatcttggcagctga

SEQ ID NO: 6980260 - DNA, 22 bp, Homo sapiens
tagatcattagcgggggtgaga

SEQ ID NO: 6980261 - DNA, 22 bp, Homo sapiens
aacatgtacctacaatcagaat

SEQ ID NO: 6980262 - DNA, 22 bp, Homo sapiens
tgatctttcctcttgtttgtct

SEQ ID NO: 6980263 - DNA, 22 bp, Homo sapiens
cccacccctggacaggtgagtg

SEQ ID NO: 6980264 - DNA, 22 bp, Homo sapiens
ttcaagtagctaaattagctgc

SEQ ID NO: 6980265 - DNA, 22 bp, Homo sapiens
cagtcctgtctttatgacttca

SEQ ID NO: 6980266 - DNA, 18 bp, Homo sapiens
aggagacagcctcacctg

SEQ ID NO: 6980267 - DNA, 22 bp, Homo sapiens
ttgtacaggttcctagggtgga

SEQ ID NO: 6980268 - DNA, 22 bp, Homo sapiens
ctggagccccagacagggagag

SEQ ID NO: 6980269 - DNA, 22 bp, Homo sapiens
cacacatgtgtgcagcttagaa

SEQ ID NO: 6980270 - DNA, 22 bp, Homo sapiens
accccactcacacatggacctg

SEQ ID NO: 6980271 - DNA, 22 bp, Homo sapiens
tctgctgttgagcacaagtgaa

SEQ ID NO: 6980272 - DNA, 22 bp, Homo sapiens
atgctgaactgagatgtaactt

SEQ ID NO: 6980273 - DNA, 22 bp, Homo sapiens
ggagaaggtggctcagcaaagg

SEQ ID NO: 6980274 - DNA, 22 bp, Homo sapiens
gtggcccaggctggagtgcagt

SEQ ID NO: 6980275 - DNA, 22 bp, Homo sapiens
atgtaaactcacattttcttca

SEQ ID NO: 6980276 - DNA, 22 bp, Homo sapiens
tgtttcaggacctatcttttag

SEQ ID NO: 6980277 - DNA, 22 bp, Homo sapiens
cttctttactttctagaaataa

SEQ ID NO: 6980278 - DNA, 22 bp, Homo sapiens
tttagaacagatattgtaactt

SEQ ID NO: 6980279 - DNA, 22 bp, Homo sapiens
actgcactccagcctgggtgac

SEQ ID NO: 6980280 - DNA, 22 bp, Homo sapiens
ccttgagacacagccaaagatg

SEQ ID NO: 6980281 - DNA, 22 bp, Homo sapiens
tattctcagcaacacacatgga

SEQ ID NO: 6980282 - DNA, 20 bp, Homo sapiens
aagctctgcttcatgtggtc

SEQ ID NO: 6980283 - DNA, 22 bp, Homo sapiens
gctggctgccttactttgtgga

SEQ ID NO: 6980284 - DNA, 22 bp, Homo sapiens
agggctgcagtcctaaggtgct

SEQ ID NO: 6980285 - DNA, 22 bp, Homo sapiens
gtgagaagataagtattgcaaa

SEQ ID NO: 6980286 - DNA, 20 bp, Homo sapiens
cactctgagggagtccatgt

SEQ ID NO: 6980287 - DNA, 22 bp, Homo sapiens
ttgtaacatcaccatcaaaatc

SEQ ID NO: 6980288 - DNA, 22 bp, Homo sapiens
accccaggtcatctgagagtcc

SEQ ID NO: 6980289 - DNA, 22 bp, Homo sapiens
gccaagaaagtggcacccctag

SEQ ID NO: 6980290 - DNA, 22 bp, Homo sapiens
cagcatctgaccaatatctaca

SEQ ID NO: 6980291 - DNA, 22 bp, Homo sapiens
gagaaggactacggaaaacaga

SEQ ID NO: 6980292 - DNA, 22 bp, Homo sapiens
ctgccttgcaccggctctctgg

SEQ ID NO: 6980293 - DNA, 22 bp, Homo sapiens
ctggagctcttctgagtgtgct

SEQ ID NO: 6980294 - DNA, 22 bp, Homo sapiens
catgcagcaggatctcattccc

SEQ ID NO: 6980295 - DNA, 22 bp, Homo sapiens
tgcacacaaatgtgaacgtgcc

SEQ ID NO: 6980296 - DNA, 22 bp, Homo sapiens
ggtaccatgattcccacttttg

SEQ ID NO: 6980297 - DNA, 22 bp, Homo sapiens
taggaagcattatcatcactga

SEQ ID NO: 6980298 - DNA, 22 bp, Homo sapiens
tgtctagtggtttataaaatca

SEQ ID NO: 6980299 - DNA, 22 bp, Homo sapiens
agtcccagatctacaggaggga

SEQ ID NO: 6980300 - DNA, 22 bp, Homo sapiens
attctgggaggtagaactgaaa

SEQ ID NO: 6980301 - DNA, 22 bp, Homo sapiens
agggcagcagctcctcctagct

SEQ ID NO: 6980302 - DNA, 22 bp, Homo sapiens
actgttttctgtaaagggccag

SEQ ID NO: 6980303 - DNA, 18 bp, Homo sapiens
gcctgccagccgagggac

SEQ ID NO: 6980304 - DNA, 21 bp, Homo sapiens
actctgctgcgggcttggcct

SEQ ID NO: 6980305 - DNA, 22 bp, Homo sapiens
cagccctcctaccctgccaggc

SEQ ID NO: 6980306 - DNA, 22 bp, Homo sapiens
caggaagaccagggctgtggct

SEQ ID NO: 6980307 - DNA, 22 bp, Homo sapiens
aggacaattagactctttgttt

SEQ ID NO: 6980308 - DNA, 22 bp, Homo sapiens
cacagtgctttacatgttttct

SEQ ID NO: 6980309 - DNA, 22 bp, Homo sapiens
atggcagtttcactctgggatt

SEQ ID NO: 6980310 - DNA, 22 bp, Homo sapiens
cagggccagcgcccaggcccag

SEQ ID NO: 6980311 - DNA, 22 bp, Homo sapiens
gatggcaggcaggtgagtagag

SEQ ID NO: 6980312 - DNA, 22 bp, Homo sapiens
tggagactctgcatctgtgaca

SEQ ID NO: 6980313 - DNA, 22 bp, Homo sapiens
cagtctcagaggtgggagtggg

SEQ ID NO: 6980314 - DNA, 22 bp, Homo sapiens
gtgctatgtgctgaactcaggt

SEQ ID NO: 6980315 - DNA, 22 bp, Homo sapiens
tatcacactgttttaattactt

SEQ ID NO: 6980316 - DNA, 22 bp, Homo sapiens
tttctagtcttccctacctccc

SEQ ID NO: 6980317 - DNA, 22 bp, Homo sapiens
aggctgtggtgctgaaggaggg

SEQ ID NO: 6980318 - DNA, 22 bp, Homo sapiens
tagcacacgcattagcaaatca

SEQ ID NO: 6980319 - DNA, 22 bp, Homo sapiens
acggggctagagaaggtttctt

SEQ ID NO: 6980320 - DNA, 22 bp, Homo sapiens
ttctagggttcgagtataatcc

SEQ ID NO: 6980321 - DNA, 22 bp, Homo sapiens
attgtaagtagaaatgttatgg

SEQ ID NO: 6980322 - DNA, 22 bp, Homo sapiens
ccctgcagacgtcttgatgcct

SEQ ID NO: 6980323 - DNA, 22 bp, Homo sapiens
tggcacttaggtacaagggaat

SEQ ID NO: 6980324 - DNA, 22 bp, Homo sapiens
aggtgagttggtaggaagtttg

SEQ ID NO: 6980325 - DNA, 22 bp, Homo sapiens
gtggagagcaaataattggaat

SEQ ID NO: 6980326 - DNA, 22 bp, Homo sapiens
taggaattttgcatgggaattt

SEQ ID NO: 6980327 - DNA, 18 bp, Homo sapiens
tagactgctttctcagag

SEQ ID NO: 6980328 - DNA, 22 bp, Homo sapiens
aacattcaaaacccagttcagt

SEQ ID NO: 6980329 - DNA, 22 bp, Homo sapiens
ctgagggaccctgtgagtacct

SEQ ID NO: 6980330 - DNA, 22 bp, Homo sapiens
aatgactgtagtcatattaagg

SEQ ID NO: 6980331 - DNA, 22 bp, Homo sapiens
cgtgagcaaaatggacactccc

SEQ ID NO: 6980332 - DNA, 22 bp, Homo sapiens
atcgccaatggggaggaaagaa

SEQ ID NO: 6980333 - DNA, 22 bp, Homo sapiens
tttaatgcccaaggctttgatg

SEQ ID NO: 6980334 - DNA, 22 bp, Homo sapiens
atagtacagatccattaattat

SEQ ID NO: 6980335 - DNA, 22 bp, Homo sapiens
aatcagctttgaaagagggtct

SEQ ID NO: 6980336 - DNA, 22 bp, Homo sapiens
aaaggcttcagtgagtgggtat

SEQ ID NO: 6980337 - DNA, 22 bp, Homo sapiens
gatgtaatagatatagattgct

SEQ ID NO: 6980338 - DNA, 22 bp, Homo sapiens
gatttttcagtataaaatatat

SEQ ID NO: 6980339 - DNA, 22 bp, Homo sapiens
tattatcagagctatttggaat

SEQ ID NO: 6980340 - DNA, 22 bp, Homo sapiens
cagggcaggaatttgacattgc

SEQ ID NO: 6980341 - DNA, 22 bp, Homo sapiens
tgtaataatgaggcatccagcc

SEQ ID NO: 6980342 - DNA, 22 bp, Homo sapiens
ggggcagtttctcgtttgccat

SEQ ID NO: 6980343 - DNA, 22 bp, Homo sapiens
ctctgcaaggccctccagtagc

SEQ ID NO: 6980344 - DNA, 17 bp, Homo sapiens
aggtgctggagcatcag

SEQ ID NO: 6980345 - DNA, 22 bp, Homo sapiens
tgtttcatgaagtctggatatc

SEQ ID NO: 6980346 - DNA, 18 bp, Homo sapiens
ggaatgtggacaggctgg

SEQ ID NO: 6980347 - DNA, 19 bp, Homo sapiens
cacagcgaagacaaggtgg

SEQ ID NO: 6980348 - DNA, 22 bp, Homo sapiens
ggcaggctttcagcatcaagtc

SEQ ID NO: 6980349 - DNA, 22 bp, Homo sapiens
cagggacaaagtgagaaaggaa

SEQ ID NO: 6980350 - DNA, 22 bp, Homo sapiens
cttcttcacactggtctgaagc

SEQ ID NO: 6980351 - DNA, 18 bp, Homo sapiens
gatcgggggcgccccaag

SEQ ID NO: 6980352 - DNA, 18 bp, Homo sapiens
tagtggaactgctctggg

SEQ ID NO: 6980353 - DNA, 22 bp, Homo sapiens
agcaacattgagactgcagttg

SEQ ID NO: 6980354 - DNA, 22 bp, Homo sapiens
tgattctaggtccattatttgc

SEQ ID NO: 6980355 - DNA, 22 bp, Homo sapiens
ctggccagttactgctattggc

SEQ ID NO: 6980356 - DNA, 22 bp, Homo sapiens
aagatggcaggaatcataagct

SEQ ID NO: 6980357 - DNA, 19 bp, Homo sapiens
ccacacagtgtgcaattta

SEQ ID NO: 6980358 - DNA, 22 bp, Homo sapiens
agtgtttattgtgtgccacaca

SEQ ID NO: 6980359 - DNA, 22 bp, Homo sapiens
gagcatcactgtcctctccccg

SEQ ID NO: 6980360 - DNA, 22 bp, Homo sapiens
actgtggcctgctgtatgggct

SEQ ID NO: 6980361 - DNA, 18 bp, Homo sapiens
gcaccttaccaattctac

SEQ ID NO: 6980362 - DNA, 22 bp, Homo sapiens
ctgcatgcaacagtgccctgga

SEQ ID NO: 6980363 - DNA, 22 bp, Homo sapiens
tgagtaaatatcagtattgtgc

SEQ ID NO: 6980364 - DNA, 22 bp, Homo sapiens
tatgtcttagaacaaaacagtg

SEQ ID NO: 6980365 - DNA, 22 bp, Homo sapiens
agagagagggaaactgctaaac

SEQ ID NO: 6980366 - DNA, 22 bp, Homo sapiens
tacagttactgttatatgtgct

SEQ ID NO: 6980367 - DNA, 22 bp, Homo sapiens
tattgataaggatggctgcaat

SEQ ID NO: 6980368 - DNA, 22 bp, Homo sapiens
aaaggctctaacaaggagagag

SEQ ID NO: 6980369 - DNA, 19 bp, Homo sapiens
ggcagctcttgtcttctgc

SEQ ID NO: 6980370 - DNA, 22 bp, Homo sapiens
aaaactgaaccttgagatcttt

SEQ ID NO: 6980371 - DNA, 22 bp, Homo sapiens
gggaaggcatacctgagggaga

SEQ ID NO: 6980372 - DNA, 22 bp, Homo sapiens
acacagccagggtagtaaggct

SEQ ID NO: 6980373 - DNA, 23 bp, Homo sapiens
tagattgctacaagtcattgaat

SEQ ID NO: 6980374 - DNA, 22 bp, Homo sapiens
tttctcacccaagagttatttt

SEQ ID NO: 6980375 - DNA, 22 bp, Homo sapiens
tagcaccatttaaacatctctg

SEQ ID NO: 6980376 - DNA, 22 bp, Homo sapiens
tgttctcactggatgcttcaca

SEQ ID NO: 6980377 - DNA, 22 bp, Homo sapiens
gctgtgaagaggccactgcatg

SEQ ID NO: 6980378 - DNA, 22 bp, Homo sapiens
tggcctggtgctcaggcagtag

SEQ ID NO: 6980379 - DNA, 20 bp, Homo sapiens
tggtggccagtgctgcaggc

SEQ ID NO: 6980380 - DNA, 23 bp, Homo sapiens
tagttacattattgtcagagctg

SEQ ID NO: 6980381 - DNA, 18 bp, Homo sapiens
gagctcagcgtgtttcta

SEQ ID NO: 6980382 - DNA, 22 bp, Homo sapiens
ggtatgggcctgagaatctgtc

SEQ ID NO: 6980383 - DNA, 22 bp, Homo sapiens
taggctcctgaggactccatgc

SEQ ID NO: 6980384 - DNA, 21 bp, Homo sapiens
ctcaggggattttgagattag

SEQ ID NO: 6980385 - DNA, 22 bp, Homo sapiens
attacccagggtaggaattcct

SEQ ID NO: 6980386 - DNA, 22 bp, Homo sapiens
agcgtggatgtggggcgcggct

SEQ ID NO: 6980387 - DNA, 22 bp, Homo sapiens
atctattctctacagtagacag

SEQ ID NO: 6980388 - DNA, 22 bp, Homo sapiens
gcaccatgacagtgaggagaac

SEQ ID NO: 6980389 - DNA, 22 bp, Homo sapiens
agaaagtgtgtcatactaagtg

SEQ ID NO: 6980390 - DNA, 22 bp, Homo sapiens
aagtagccaacaccctttccat

SEQ ID NO: 6980391 - DNA, 22 bp, Homo sapiens
ttgatattttgcacgcttggta

SEQ ID NO: 6980392 - DNA, 22 bp, Homo sapiens
tcagggacgtgagctcagagtc

SEQ ID NO: 6980393 - DNA, 22 bp, Homo sapiens
tggccagccataaaagaaccca

SEQ ID NO: 6980394 - DNA, 22 bp, Homo sapiens
gttcagggagacagactaaact

SEQ ID NO: 6980395 - DNA, 22 bp, Homo sapiens
tgacttccagcaacttcctcca

SEQ ID NO: 6980396 - DNA, 22 bp, Homo sapiens
tctgctgaggccttcccactcc

SEQ ID NO: 6980397 - DNA, 22 bp, Homo sapiens
cctcacagtcagttcttagtct

SEQ ID NO: 6980398 - DNA, 22 bp, Homo sapiens
ctgtctacagatgaaataagca

SEQ ID NO: 6980399 - DNA, 22 bp, Homo sapiens
atgacatggtgcagacagtgtc

SEQ ID NO: 6980400 - DNA, 22 bp, Homo sapiens
gggaagtttgtgggaggaatat

SEQ ID NO: 6980401 - DNA, 22 bp, Homo sapiens
gttctgggttctgggttattgg

SEQ ID NO: 6980402 - DNA, 22 bp, Homo sapiens
ataacagatactctctgtgagg

SEQ ID NO: 6980403 - DNA, 22 bp, Homo sapiens
taactctagtcccaggcatgaa

SEQ ID NO: 6980404 - DNA, 22 bp, Homo sapiens
cagagacaatgtctctgcttgt

SEQ ID NO: 6980405 - DNA, 22 bp, Homo sapiens
ttggatctgtactctaggggat

SEQ ID NO: 6980406 - DNA, 18 bp, Homo sapiens
cacaggaaggggaatatc

SEQ ID NO: 6980407 - DNA, 22 bp, Homo sapiens
cgccccagccagttgagcggcg

SEQ ID NO: 6980408 - DNA, 22 bp, Homo sapiens
gaaggccctggtattcttgagg

SEQ ID NO: 6980409 - DNA, 22 bp, Homo sapiens
aaggcactagcagaattagtga

SEQ ID NO: 6980410 - DNA, 22 bp, Homo sapiens
tggcagaaagaaccatgtgcaa

SEQ ID NO: 6980411 - DNA, 22 bp, Homo sapiens
acctgcaagcattacacttcta

SEQ ID NO: 6980412 - DNA, 22 bp, Homo sapiens
aggaactgtcatgtattgctca

SEQ ID NO: 6980413 - DNA, 22 bp, Homo sapiens
tgctgggggctttctggatacc

SEQ ID NO: 6980414 - DNA, 22 bp, Homo sapiens
gcacttatggcatcttcctgtg

SEQ ID NO: 6980415 - DNA, 22 bp, Homo sapiens
tgtcagtgttttatgtgccctt

SEQ ID NO: 6980416 - DNA, 22 bp, Homo sapiens
aggcccagtagtgctgccttta

SEQ ID NO: 6980417 - DNA, 22 bp, Homo sapiens
aatggctgaagaagtgtggcca

SEQ ID NO: 6980418 - DNA, 21 bp, Homo sapiens
tgtgtgaccttggacttgagc

SEQ ID NO: 6980419 - DNA, 22 bp, Homo sapiens
actacatcttgcatatctataa

SEQ ID NO: 6980420 - DNA, 22 bp, Homo sapiens
taatactgggaaatacttgggt

SEQ ID NO: 6980421 - DNA, 22 bp, Homo sapiens
tggtattctttctgtagatcat

SEQ ID NO: 6980422 - DNA, 22 bp, Homo sapiens
aaggcttagagacagacagcag

SEQ ID NO: 6980423 - DNA, 22 bp, Homo sapiens
tcctgctggaaacttcctcttg

SEQ ID NO: 6980424 - DNA, 22 bp, Homo sapiens
gtgaggggtctggacgcacagt

SEQ ID NO: 6980425 - DNA, 22 bp, Homo sapiens
catgacaaatcagaggggcttg

SEQ ID NO: 6980426 - DNA, 22 bp, Homo sapiens
tttgcgtctatgtgtgagcctt

SEQ ID NO: 6980427 - DNA, 22 bp, Homo sapiens
tgagcttagagcctccaagttc

SEQ ID NO: 6980428 - DNA, 18 bp, Homo sapiens
acctccccattttctgaa

SEQ ID NO: 6980429 - DNA, 22 bp, Homo sapiens
agagtccatgaagacagctgag

SEQ ID NO: 6980430 - DNA, 22 bp, Homo sapiens
tatattaaagtgctttgcagtg

SEQ ID NO: 6980431 - DNA, 22 bp, Homo sapiens
cacagctgaccaccctgctccc

SEQ ID NO: 6980432 - DNA, 22 bp, Homo sapiens
tatttcttgagactcgtcttcc

SEQ ID NO: 6980433 - DNA, 22 bp, Homo sapiens
gcctagagagggagtgccacac

SEQ ID NO: 6980434 - DNA, 22 bp, Homo sapiens
agcaccaggcagtatatcaaag

SEQ ID NO: 6980435 - DNA, 22 bp, Homo sapiens
ttctgataataccacatcgcag

SEQ ID NO: 6980436 - DNA, 22 bp, Homo sapiens
tcacagcattgagtgtactaga

SEQ ID NO: 6980437 - DNA, 22 bp, Homo sapiens
ggctttgcttctccagatgctt

SEQ ID NO: 6980438 - DNA, 22 bp, Homo sapiens
gtcgcagcaccggagcatcgac

SEQ ID NO: 6980439 - DNA, 22 bp, Homo sapiens
acagagcatgctcagtgtgtga

SEQ ID NO: 6980440 - DNA, 22 bp, Homo sapiens
ggagctgtaacgagccattgct

SEQ ID NO: 6980441 - DNA, 19 bp, Homo sapiens
attctctagtggtgcaatg

SEQ ID NO: 6980442 - DNA, 22 bp, Homo sapiens
tgtgagttcttagaaagtcagt

SEQ ID NO: 6980443 - DNA, 22 bp, Homo sapiens
ttgaattatttgtttgcaagct

SEQ ID NO: 6980444 - DNA, 22 bp, Homo sapiens
acattgacaaagattgagctgt

SEQ ID NO: 6980445 - DNA, 22 bp, Homo sapiens
ctgatttctacatggaccacat

SEQ ID NO: 6980446 - DNA, 22 bp, Homo sapiens
ttcaccctggaccagaaattgg

SEQ ID NO: 6980447 - DNA, 22 bp, Homo sapiens
agagtttggggtatgattgttt

SEQ ID NO: 6980448 - DNA, 22 bp, Homo sapiens
ttatttaatgtgatctgaagag

SEQ ID NO: 6980449 - DNA, 22 bp, Homo sapiens
cattctcttgacaggacagccc

SEQ ID NO: 6980450 - DNA, 16 bp, Homo sapiens
aacattcatatgagtg

SEQ ID NO: 6980451 - DNA, 16 bp, Homo sapiens
tgtatgaacgtctcca

SEQ ID NO: 6980452 - DNA, 22 bp, Homo sapiens
cagggctgaagaaattcaaaag

SEQ ID NO: 6980453 - DNA, 22 bp, Homo sapiens
cagccactacaattggttccat

SEQ ID NO: 6980454 - DNA, 22 bp, Homo sapiens
atgtctacatttctgaccatga

SEQ ID NO: 6980455 - DNA, 22 bp, Homo sapiens
actttgcactaagttactcatt

SEQ ID NO: 6980456 - DNA, 22 bp, Homo sapiens
cctctgctccctggtgtctgag

SEQ ID NO: 6980457 - DNA, 22 bp, Homo sapiens
acacacaactcattgtgtaata

SEQ ID NO: 6980458 - DNA, 22 bp, Homo sapiens
tcacaattcagaaaccaagtag

SEQ ID NO: 6980459 - DNA, 22 bp, Homo sapiens
tctgaaggcctggagggtccca

SEQ ID NO: 6980460 - DNA, 22 bp, Homo sapiens
ggcttaaaactttgaaagtgtt

SEQ ID NO: 6980461 - DNA, 22 bp, Homo sapiens
gggctgactcaaccttgcaaag

SEQ ID NO: 6980462 - DNA, 22 bp, Homo sapiens
tcagaagggaaacacaagtgac

SEQ ID NO: 6980463 - DNA, 22 bp, Homo sapiens
ccactgccagccgcccggaggc

SEQ ID NO: 6980464 - DNA, 22 bp, Homo sapiens
agagggagaaaagaatcagttg

SEQ ID NO: 6980465 - DNA, 22 bp, Homo sapiens
catttaaaggttgtgggtaaaa

SEQ ID NO: 6980466 - DNA, 22 bp, Homo sapiens
gcatccaggctgcccctctgcg

SEQ ID NO: 6980467 - DNA, 22 bp, Homo sapiens
tcagctaggcacttctcactga

SEQ ID NO: 6980468 - DNA, 22 bp, Homo sapiens
tgtaggaatgtttttaagttgg

SEQ ID NO: 6980469 - DNA, 22 bp, Homo sapiens
ggctcctgggatgggactgagc

SEQ ID NO: 6980470 - DNA, 22 bp, Homo sapiens
tattccgtggctccaggtggta

SEQ ID NO: 6980471 - DNA, 22 bp, Homo sapiens
taagttacacttaacttactag

SEQ ID NO: 6980472 - DNA, 22 bp, Homo sapiens
atgggatgcatggctgtggcca

SEQ ID NO: 6980473 - DNA, 22 bp, Homo sapiens
ccagatgtccctctcaggtttg

SEQ ID NO: 6980474 - DNA, 22 bp, Homo sapiens
gctggccatatattttgctgtt

SEQ ID NO: 6980475 - DNA, 22 bp, Homo sapiens
cagttctctgtgcctcgctggg

SEQ ID NO: 6980476 - DNA, 18 bp, Homo sapiens
actgtggtttatgtgtag

SEQ ID NO: 6980477 - DNA, 22 bp, Homo sapiens
gacagcatgagagatgccagtg

SEQ ID NO: 6980478 - DNA, 22 bp, Homo sapiens
tttggtgttccggtcattgctg

SEQ ID NO: 6980479 - DNA, 22 bp, Homo sapiens
gtctgctgcttctgttgaagca

SEQ ID NO: 6980480 - DNA, 22 bp, Homo sapiens
agaaatcacttagaggaagtga

SEQ ID NO: 6980481 - DNA, 22 bp, Homo sapiens
tgagtgggacctgcgtgtgtca

SEQ ID NO: 6980482 - DNA, 22 bp, Homo sapiens
cccacgttgaaccgcttacaga

SEQ ID NO: 6980483 - DNA, 22 bp, Homo sapiens
ccaggctatctggccttgagct

SEQ ID NO: 6980484 - DNA, 22 bp, Homo sapiens
aggcttttgctctggctcctct

SEQ ID NO: 6980485 - DNA, 22 bp, Homo sapiens
gtcattttgctgcatatttaga

SEQ ID NO: 6980486 - DNA, 22 bp, Homo sapiens
ctggcacatcactcctagttta

SEQ ID NO: 6980487 - DNA, 22 bp, Homo sapiens
gccttggttggccagcaggtcc

SEQ ID NO: 6980488 - DNA, 22 bp, Homo sapiens
ctgggtcacccaaaagggccag

SEQ ID NO: 6980489 - DNA, 22 bp, Homo sapiens
agaaatgttgaatacatcagga

SEQ ID NO: 6980490 - DNA, 22 bp, Homo sapiens
acaccagggcctagccagggcg

SEQ ID NO: 6980491 - DNA, 22 bp, Homo sapiens
caagtcctccatgtgactaggt

SEQ ID NO: 6980492 - DNA, 21 bp, Homo sapiens
ttaagccagcttcttctccta

SEQ ID NO: 6980493 - DNA, 22 bp, Homo sapiens
gactccagaatctggacggtcc

SEQ ID NO: 6980494 - DNA, 19 bp, Homo sapiens
acagagggcaactgagaaa

SEQ ID NO: 6980495 - DNA, 23 bp, Homo sapiens
tctggaatcctcccccttggttc

SEQ ID NO: 6980496 - DNA, 22 bp, Homo sapiens
gtacctatctcaccgagtcgtt

SEQ ID NO: 6980497 - DNA, 20 bp, Homo sapiens
agcggctggcggaggacacg

SEQ ID NO: 6980498 - DNA, 22 bp, Homo sapiens
ataaatgtgaattagagctttg

SEQ ID NO: 6980499 - DNA, 22 bp, Homo sapiens
acttctgtcctccaagccacgt

SEQ ID NO: 6980500 - DNA, 23 bp, Homo sapiens
ggagatcagagactagggcagtt

SEQ ID NO: 6980501 - DNA, 22 bp, Homo sapiens
ggcacacagatggagcactagc

SEQ ID NO: 6980502 - DNA, 22 bp, Homo sapiens
gacagcaacacatgcttagtgc

SEQ ID NO: 6980503 - DNA, 22 bp, Homo sapiens
acaagcagaaggtggggtctta

SEQ ID NO: 6980504 - DNA, 22 bp, Homo sapiens
tgcctcaagccctccactgcac

SEQ ID NO: 6980505 - DNA, 22 bp, Homo sapiens
gaattgcttgctgagattaaag

SEQ ID NO: 6980506 - DNA, 22 bp, Homo sapiens
aaagaccatgtttacagctagg

SEQ ID NO: 6980507 - DNA, 22 bp, Homo sapiens
aacttgcttatattattacatt

SEQ ID NO: 6980508 - DNA, 22 bp, Homo sapiens
cattgagagaatcacatagaag

SEQ ID NO: 6980509 - DNA, 22 bp, Homo sapiens
acagacctctagattacatttg

SEQ ID NO: 6980510 - DNA, 19 bp, Homo sapiens
tgtctcctccccgccgtct

SEQ ID NO: 6980511 - DNA, 23 bp, Homo sapiens
tactgggcagctgctctgacacc

SEQ ID NO: 6980512 - DNA, 21 bp, Homo sapiens
agcagcagcagtggggcttct

SEQ ID NO: 6980513 - DNA, 22 bp, Homo sapiens
tgagctgctctaatctcgcctt

SEQ ID NO: 6980514 - DNA, 22 bp, Homo sapiens
agcatttatcttttgtttgagt

SEQ ID NO: 6980515 - DNA, 22 bp, Homo sapiens
ccttgaaagtatatgctcaatt

SEQ ID NO: 6980516 - DNA, 22 bp, Homo sapiens
ggcggccctgcacgtgctgagg

SEQ ID NO: 6980517 - DNA, 22 bp, Homo sapiens
cctgtccagggactgagggaga

SEQ ID NO: 6980518 - DNA, 22 bp, Homo sapiens
tgtcagtgcacagatggttgat

SEQ ID NO: 6980519 - DNA, 22 bp, Homo sapiens
ggtgcactgcacatcgtcaata

SEQ ID NO: 6980520 - DNA, 22 bp, Homo sapiens
atcaatgttttgatagcccaga

SEQ ID NO: 6980521 - DNA, 21 bp, Homo sapiens
gctcttggaaggggctcagct

SEQ ID NO: 6980522 - DNA, 22 bp, Homo sapiens
taataaagatgtgggctttgaa

SEQ ID NO: 6980523 - DNA, 22 bp, Homo sapiens
tagtgatataattaacttcatt

SEQ ID NO: 6980524 - DNA, 22 bp, Homo sapiens
gcttaattctggctcagtttcc

SEQ ID NO: 6980525 - DNA, 22 bp, Homo sapiens
atatgcattcatacttagtgga

SEQ ID NO: 6980526 - DNA, 23 bp, Homo sapiens
tgggaatgacatctagagcagag

SEQ ID NO: 6980527 - DNA, 22 bp, Homo sapiens
atcccaggaggctgcgcagtta

SEQ ID NO: 6980528 - DNA, 22 bp, Homo sapiens
acacagcagaaggcccgtgtct

SEQ ID NO: 6980529 - DNA, 20 bp, Homo sapiens
tggggtctagttggcctggg

SEQ ID NO: 6980530 - DNA, 20 bp, Homo sapiens
agcatacatcataagaaacc

SEQ ID NO: 6980531 - DNA, 22 bp, Homo sapiens
tccaggccacatggatggcgat

SEQ ID NO: 6980532 - DNA, 22 bp, Homo sapiens
tgttaacaaaggttggctgggc

SEQ ID NO: 6980533 - DNA, 18 bp, Homo sapiens
actgtctgccagattggg

SEQ ID NO: 6980534 - DNA, 22 bp, Homo sapiens
aactacagtagtttgcccttct

SEQ ID NO: 6980535 - DNA, 22 bp, Homo sapiens
attgagcacctactttgtgcca

SEQ ID NO: 6980536 - DNA, 22 bp, Homo sapiens
tacagctcccggggagcttcgt

SEQ ID NO: 6980537 - DNA, 22 bp, Homo sapiens
gtggttatgagcatggacttgg

SEQ ID NO: 6980538 - DNA, 22 bp, Homo sapiens
tggcaaaggaacctattttaaa

SEQ ID NO: 6980539 - DNA, 22 bp, Homo sapiens
ctttatcgcaaacactgggtaa

SEQ ID NO: 6980540 - DNA, 22 bp, Homo sapiens
gctgccctctgtgtttgtcctt

SEQ ID NO: 6980541 - DNA, 22 bp, Homo sapiens
tatattagtgagatttatccat

SEQ ID NO: 6980542 - DNA, 22 bp, Homo sapiens
acagttctgaagactagagcct

SEQ ID NO: 6980543 - DNA, 20 bp, Homo sapiens
gctcagagcctgaacttcat

SEQ ID NO: 6980544 - DNA, 20 bp, Homo sapiens
agttagcaggtgctggtgtc

SEQ ID NO: 6980545 - DNA, 22 bp, Homo sapiens
agtggggccggtgaggccgagg

SEQ ID NO: 6980546 - DNA, 19 bp, Homo sapiens
tgacagcatgaattaggac

SEQ ID NO: 6980547 - DNA, 22 bp, Homo sapiens
gaccacacgtcccagagagccc

SEQ ID NO: 6980548 - DNA, 22 bp, Homo sapiens
cagcaggttctacgggtgagat

SEQ ID NO: 6980549 - DNA, 22 bp, Homo sapiens
gcttaaattgtttgtggatagt

SEQ ID NO: 6980550 - DNA, 18 bp, Homo sapiens
tcttccgagaccctggta

SEQ ID NO: 6980551 - DNA, 22 bp, Homo sapiens
cagatgaaggcctgaatgtcta

SEQ ID NO: 6980552 - DNA, 22 bp, Homo sapiens
gccaccaggttagatccagcct

SEQ ID NO: 6980553 - DNA, 22 bp, Homo sapiens
ttgtacaacgttttaaatttga

SEQ ID NO: 6980554 - DNA, 22 bp, Homo sapiens
tacatttcctgtcagagatata

SEQ ID NO: 6980555 - DNA, 22 bp, Homo sapiens
cttggggatgcaaagccagtgt

SEQ ID NO: 6980556 - DNA, 22 bp, Homo sapiens
aggaccagaccgaactagctaa

SEQ ID NO: 6980557 - DNA, 22 bp, Homo sapiens
tttgcattttgataagatcact

SEQ ID NO: 6980558 - DNA, 22 bp, Homo sapiens
catggtttggtctttgtagtgg

SEQ ID NO: 6980559 - DNA, 22 bp, Homo sapiens
ggggcagagagaaggaagcttg

SEQ ID NO: 6980560 - DNA, 22 bp, Homo sapiens
aacacacgcctcctccatgggg

SEQ ID NO: 6980561 - DNA, 22 bp, Homo sapiens
gttcaattaagttacaaattta

SEQ ID NO: 6980562 - DNA, 22 bp, Homo sapiens
ttatggggttgctgaattaggg

SEQ ID NO: 6980563 - DNA, 22 bp, Homo sapiens
aggcaacataacacgaaagtct

SEQ ID NO: 6980564 - DNA, 22 bp, Homo sapiens
tagagacagaaagtagaatggt

SEQ ID NO: 6980565 - DNA, 22 bp, Homo sapiens
tggccccctgattgtcaccttt

SEQ ID NO: 6980566 - DNA, 22 bp, Homo sapiens
tgggccagtcctgcctaaggtg

SEQ ID NO: 6980567 - DNA, 22 bp, Homo sapiens
attcaatgggggtttctagttg

SEQ ID NO: 6980568 - DNA, 22 bp, Homo sapiens
tcctttatgtgagttgtttccc

SEQ ID NO: 6980569 - DNA, 22 bp, Homo sapiens
agactgtaaagggccagaaagt

SEQ ID NO: 6980570 - DNA, 22 bp, Homo sapiens
ttccaggcattacagggtttgc

SEQ ID NO: 6980571 - DNA, 22 bp, Homo sapiens
tcactatgcccagaatacagtt

SEQ ID NO: 6980572 - DNA, 20 bp, Homo sapiens
ggccttagggagggctgtaa

SEQ ID NO: 6980573 - DNA, 22 bp, Homo sapiens
tagtcatctgggtaatgttcaa

SEQ ID NO: 6980574 - DNA, 22 bp, Homo sapiens
ggtcacaaggtactgtaagaaa

SEQ ID NO: 6980575 - DNA, 20 bp, Homo sapiens
acctgaggtccctatggtct

SEQ ID NO: 6980576 - DNA, 22 bp, Homo sapiens
caggaacctgtgcgtagggatg

SEQ ID NO: 6980577 - DNA, 22 bp, Homo sapiens
cttcatgacccataaaaattta

SEQ ID NO: 6980578 - DNA, 22 bp, Homo sapiens
agttttattccaatgtgcagca

SEQ ID NO: 6980579 - DNA, 22 bp, Homo sapiens
gaggcggccagcgaggccgcaa

SEQ ID NO: 6980580 - DNA, 22 bp, Homo sapiens
cctcttgagaggcactcaggtt

SEQ ID NO: 6980581 - DNA, 22 bp, Homo sapiens
tgcccacttcaaaatcttcatt

SEQ ID NO: 6980582 - DNA, 23 bp, Homo sapiens
atggacagggtttcagggtcaca

SEQ ID NO: 6980583 - DNA, 22 bp, Homo sapiens
ttccaaggttagtttttagggt

SEQ ID NO: 6980584 - DNA, 22 bp, Homo sapiens
cacaagctgggcaagtgtatat

SEQ ID NO: 6980585 - DNA, 22 bp, Homo sapiens
gctcacagtctgctgagtgcag

SEQ ID NO: 6980586 - DNA, 22 bp, Homo sapiens
tgtgtaaaatgagcctaaagtc

SEQ ID NO: 6980587 - DNA, 22 bp, Homo sapiens
aaaaatacttcacttctgggtg

SEQ ID NO: 6980588 - DNA, 22 bp, Homo sapiens
aggcatatgattgtaaccttta

SEQ ID NO: 6980589 - DNA, 22 bp, Homo sapiens
gagaaatgcatgcatgtcatca

SEQ ID NO: 6980590 - DNA, 22 bp, Homo sapiens
tgtggactggcgggacgcaatg

SEQ ID NO: 6980591 - DNA, 22 bp, Homo sapiens
tggtacaagggttgggagacag

SEQ ID NO: 6980592 - DNA, 22 bp, Homo sapiens
acatttttgggttgatgtctga

SEQ ID NO: 6980593 - DNA, 22 bp, Homo sapiens
tggtctcccagagcagggacgc

SEQ ID NO: 6980594 - DNA, 22 bp, Homo sapiens
tttcatgtgcatttaggttcat

SEQ ID NO: 6980595 - DNA, 22 bp, Homo sapiens
agagagaagcaatcagtggcca

SEQ ID NO: 6980596 - DNA, 22 bp, Homo sapiens
catgcatgtgcagaaaggggtt

SEQ ID NO: 6980597 - DNA, 22 bp, Homo sapiens
aggttattctctatctcatccc

SEQ ID NO: 6980598 - DNA, 22 bp, Homo sapiens
aaacctgtagcagtttgttaca

SEQ ID NO: 6980599 - DNA, 22 bp, Homo sapiens
tgagcacaagtttgcatgtgtg

SEQ ID NO: 6980600 - DNA, 22 bp, Homo sapiens
agtgggtcagagagctccagat

SEQ ID NO: 6980601 - DNA, 22 bp, Homo sapiens
ccctaagaccctcaagatctcc

SEQ ID NO: 6980602 - DNA, 22 bp, Homo sapiens
tgaatgcagagactgtgggaaa

SEQ ID NO: 6980603 - DNA, 22 bp, Homo sapiens
agctgggtgaaggcagatggct

SEQ ID NO: 6980604 - DNA, 22 bp, Homo sapiens
tcaaaaataagatattctggac

SEQ ID NO: 6980605 - DNA, 22 bp, Homo sapiens
tgtctattattctggagagtca

SEQ ID NO: 6980606 - DNA, 22 bp, Homo sapiens
attacctatttcattttctgtc

SEQ ID NO: 6980607 - DNA, 22 bp, Homo sapiens
ataagattgtcatagtatggac

SEQ ID NO: 6980608 - DNA, 22 bp, Homo sapiens
tcagtgtgactgatggctttat

SEQ ID NO: 6980609 - DNA, 22 bp, Homo sapiens
taatgagactcaattgtgtgtg

SEQ ID NO: 6980610 - DNA, 22 bp, Homo sapiens
agtgccaaacagtacataacat

SEQ ID NO: 6980611 - DNA, 22 bp, Homo sapiens
tgaggctcagaaatgtaagttt

SEQ ID NO: 6980612 - DNA, 22 bp, Homo sapiens
gcacatgtcttattcactgtta

SEQ ID NO: 6980613 - DNA, 22 bp, Homo sapiens
gtgtgccaactatattaatatt

SEQ ID NO: 6980614 - DNA, 22 bp, Homo sapiens
gttccacagtgagataaaagca

SEQ ID NO: 6980615 - DNA, 22 bp, Homo sapiens
agccacagtcaacctgtccata

SEQ ID NO: 6980616 - DNA, 22 bp, Homo sapiens
ttattctgaactagactctcat

SEQ ID NO: 6980617 - DNA, 22 bp, Homo sapiens
attcttcagcaggggacactat

SEQ ID NO: 6980618 - DNA, 22 bp, Homo sapiens
cttgcttggagaagagatcagt

SEQ ID NO: 6980619 - DNA, 22 bp, Homo sapiens
atacttctcatgggctctgagc

SEQ ID NO: 6980620 - DNA, 22 bp, Homo sapiens
ctggcagtgtgaccctggacag

SEQ ID NO: 6980621 - DNA, 22 bp, Homo sapiens
ccaagcgggaatgcaatggcgt

SEQ ID NO: 6980622 - DNA, 22 bp, Homo sapiens
agtatgtattttatacttacag

SEQ ID NO: 6980623 - DNA, 20 bp, Homo sapiens
tcctgagatttaaggggttc

SEQ ID NO: 6980624 - DNA, 22 bp, Homo sapiens
ttgactttaaagctttgtctct

SEQ ID NO: 6980625 - DNA, 22 bp, Homo sapiens
aagatgcttccactgcagtggc

SEQ ID NO: 6980626 - DNA, 22 bp, Homo sapiens
cagacaggagactggatcatgg

SEQ ID NO: 6980627 - DNA, 22 bp, Homo sapiens
gtctgcctgtctggatgacaga

SEQ ID NO: 6980628 - DNA, 22 bp, Homo sapiens
tggcagggcctaccccaatatc

SEQ ID NO: 6980629 - DNA, 22 bp, Homo sapiens
taacattacagacaccttgtgt

SEQ ID NO: 6980630 - DNA, 22 bp, Homo sapiens
cctgccagcatggcttatctcc

SEQ ID NO: 6980631 - DNA, 22 bp, Homo sapiens
agacatagggaggcatataaat

SEQ ID NO: 6980632 - DNA, 22 bp, Homo sapiens
tgaagcaatgatcttttggtgg

SEQ ID NO: 6980633 - DNA, 22 bp, Homo sapiens
tgctggcagccccagctttaac

SEQ ID NO: 6980634 - DNA, 22 bp, Homo sapiens
acacaagtccctccatactctc

SEQ ID NO: 6980635 - DNA, 22 bp, Homo sapiens
agaaaaacacaatcgggcctcc

SEQ ID NO: 6980636 - DNA, 22 bp, Homo sapiens
ctggcaggtggatggggactcc

SEQ ID NO: 6980637 - DNA, 22 bp, Homo sapiens
caaaggttgttgagagtgcagg

SEQ ID NO: 6980638 - DNA, 22 bp, Homo sapiens
accaggagagattttattgaga

SEQ ID NO: 6980639 - DNA, 22 bp, Homo sapiens
tcctgaggagaagagtgctagg

SEQ ID NO: 6980640 - DNA, 22 bp, Homo sapiens
ttttccaccttctagagattgt

SEQ ID NO: 6980641 - DNA, 22 bp, Homo sapiens
gtggcagattgctcaccatggt

SEQ ID NO: 6980642 - DNA, 22 bp, Homo sapiens
atgctgagaaacctgtctggca

SEQ ID NO: 6980643 - DNA, 22 bp, Homo sapiens
gccttctgtccaaccccacgat

SEQ ID NO: 6980644 - DNA, 22 bp, Homo sapiens
caaatgtttcttgaacaccaac

SEQ ID NO: 6980645 - DNA, 22 bp, Homo sapiens
tcacagtatctagaaatgaggg

SEQ ID NO: 6980646 - DNA, 22 bp, Homo sapiens
ccagggcctacagcttaagtcc

SEQ ID NO: 6980647 - DNA, 22 bp, Homo sapiens
ttaggaatcaaattccgaaagg

SEQ ID NO: 6980648 - DNA, 22 bp, Homo sapiens
tggtccagtcgttcctttcctt

SEQ ID NO: 6980649 - DNA, 22 bp, Homo sapiens
tgatggtatgggattaccatgt

SEQ ID NO: 6980650 - DNA, 22 bp, Homo sapiens
cagtagtggggagcccagtgtc

SEQ ID NO: 6980651 - DNA, 22 bp, Homo sapiens
cactgcagcctcaaattcctgg

SEQ ID NO: 6980652 - DNA, 22 bp, Homo sapiens
catacatatgcatgtgtgtata

SEQ ID NO: 6980653 - DNA, 22 bp, Homo sapiens
agctgcttgtacatgaccacat

SEQ ID NO: 6980654 - DNA, 22 bp, Homo sapiens
gtggctggccctggaccctaag

SEQ ID NO: 6980655 - DNA, 22 bp, Homo sapiens
ctggcagcttattagaaatgca

SEQ ID NO: 6980656 - DNA, 22 bp, Homo sapiens
ttctatgtcagtgtgctctgtg

SEQ ID NO: 6980657 - DNA, 22 bp, Homo sapiens
aggagccaatctgataaagcca

SEQ ID NO: 6980658 - DNA, 22 bp, Homo sapiens
tgcttctgattcatggttattg

SEQ ID NO: 6980659 - DNA, 23 bp, Homo sapiens
ttgaagtcactccactggtaagc

SEQ ID NO: 6980660 - DNA, 22 bp, Homo sapiens
accaccttcctgcgtgtctctt

SEQ ID NO: 6980661 - DNA, 22 bp, Homo sapiens
atggtttgtgtggcccagatga

SEQ ID NO: 6980662 - DNA, 22 bp, Homo sapiens
atttacactggttctcagagct

SEQ ID NO: 6980663 - DNA, 22 bp, Homo sapiens
tgtcattatttgcctactgact

SEQ ID NO: 6980664 - DNA, 22 bp, Homo sapiens
aggccctgtccatggtgctgaa

SEQ ID NO: 6980665 - DNA, 22 bp, Homo sapiens
tcttgggatcacctcctggctt

SEQ ID NO: 6980666 - DNA, 22 bp, Homo sapiens
ggcaataatgacattttaaaaa

SEQ ID NO: 6980667 - DNA, 22 bp, Homo sapiens
acactcttgcattacctgaata

SEQ ID NO: 6980668 - DNA, 22 bp, Homo sapiens
ttcaaagaattttgagacctga

SEQ ID NO: 6980669 - DNA, 22 bp, Homo sapiens
tgggagacactggtgggagctt

SEQ ID NO: 6980670 - DNA, 21 bp, Homo sapiens
accgtcagtactagtattgac

SEQ ID NO: 6980671 - DNA, 18 bp, Homo sapiens
gccagccaggcgttgctc

SEQ ID NO: 6980672 - DNA, 22 bp, Homo sapiens
tccaatatggataaaaggggcc

SEQ ID NO: 6980673 - DNA, 22 bp, Homo sapiens
gctggcttgatagtttctgctt

SEQ ID NO: 6980674 - DNA, 22 bp, Homo sapiens
agcaccagtttcgtcgtgacaa

SEQ ID NO: 6980675 - DNA, 22 bp, Homo sapiens
ggcagacactcaaaagctggga

SEQ ID NO: 6980676 - DNA, 22 bp, Homo sapiens
ggcaaatttgtcttaagacacc

SEQ ID NO: 6980677 - DNA, 22 bp, Homo sapiens
ccaggagacccagggaaggagc

SEQ ID NO: 6980678 - DNA, 20 bp, Homo sapiens
aggtctgaatgtcagggctg

SEQ ID NO: 6980679 - DNA, 21 bp, Homo sapiens
tggtaatgttcagtatccact

SEQ ID NO: 6980680 - DNA, 19 bp, Homo sapiens
ggaaggccacggcaggctt

SEQ ID NO: 6980681 - DNA, 22 bp, Homo sapiens
cacaggaatgaacagggaaaga

SEQ ID NO: 6980682 - DNA, 22 bp, Homo sapiens
aggcactttaggatcaggttga

SEQ ID NO: 6980683 - DNA, 22 bp, Homo sapiens
gaggtaacactgttcagtgggc

SEQ ID NO: 6980684 - DNA, 22 bp, Homo sapiens
caggactagatgttgggcagtt

SEQ ID NO: 6980685 - DNA, 22 bp, Homo sapiens
tctgggcttttgcactggccat

SEQ ID NO: 6980686 - DNA, 22 bp, Homo sapiens
ctgtggcttttccggggagcct

SEQ ID NO: 6980687 - DNA, 22 bp, Homo sapiens
atggcagacgaggcagcagggg

SEQ ID NO: 6980688 - DNA, 22 bp, Homo sapiens
ggctcagtaagtcaggttcatt

SEQ ID NO: 6980689 - DNA, 22 bp, Homo sapiens
agagctggtttactcaggaatt

SEQ ID NO: 6980690 - DNA, 22 bp, Homo sapiens
ggccacctccgtgaaggaatga

SEQ ID NO: 6980691 - DNA, 21 bp, Homo sapiens
aggtccctaattaattgacct

SEQ ID NO: 6980692 - DNA, 19 bp, Homo sapiens
tctcaggctgggcggctgc

SEQ ID NO: 6980693 - DNA, 22 bp, Homo sapiens
taagtgttattattctcacttt

SEQ ID NO: 6980694 - DNA, 18 bp, Homo sapiens
tcccttctcccttgcctc

SEQ ID NO: 6980695 - DNA, 22 bp, Homo sapiens
cctgggtcaccaggcccaggca

SEQ ID NO: 6980696 - DNA, 21 bp, Homo sapiens
gcctgcagaccccaccaggct

SEQ ID NO: 6980697 - DNA, 22 bp, Homo sapiens
tgcattccacataaagcgataa

SEQ ID NO: 6980698 - DNA, 22 bp, Homo sapiens
ctgattaaaaacaggttctgag

SEQ ID NO: 6980699 - DNA, 22 bp, Homo sapiens
ttgattctatgaggtaagctat

SEQ ID NO: 6980700 - DNA, 22 bp, Homo sapiens
tgggcaagggacaggcctggct

SEQ ID NO: 6980701 - DNA, 22 bp, Homo sapiens
tcagggctgactgctactctcc

SEQ ID NO: 6980702 - DNA, 22 bp, Homo sapiens
ctccctcaccatgacccgctgt

SEQ ID NO: 6980703 - DNA, 22 bp, Homo sapiens
aatagttaagcaactttttcca

SEQ ID NO: 6980704 - DNA, 22 bp, Homo sapiens
ttcactgtgatgtttaagagaa

SEQ ID NO: 6980705 - DNA, 22 bp, Homo sapiens
atctcttagcagtctagtgacc

SEQ ID NO: 6980706 - DNA, 21 bp, Homo sapiens
cttggaacgggtagaactcac

SEQ ID NO: 6980707 - DNA, 22 bp, Homo sapiens
cggccctgaccagaccttagtt

SEQ ID NO: 6980708 - DNA, 22 bp, Homo sapiens
tctccatggatttggaaatgat

SEQ ID NO: 6980709 - DNA, 22 bp, Homo sapiens
acagggaagttctgcaacagga

SEQ ID NO: 6980710 - DNA, 22 bp, Homo sapiens
tgcaacagtggggcatgctgaa

SEQ ID NO: 6980711 - DNA, 21 bp, Homo sapiens
tgagagagtagcaggacatat

SEQ ID NO: 6980712 - DNA, 22 bp, Homo sapiens
ctgcattattggggcctgtttc

SEQ ID NO: 6980713 - DNA, 22 bp, Homo sapiens
aagaagctaagactatctgggt

SEQ ID NO: 6980714 - DNA, 22 bp, Homo sapiens
taatgctttgttttgatctaac

SEQ ID NO: 6980715 - DNA, 22 bp, Homo sapiens
gcctcagtttatacacctgtaa

SEQ ID NO: 6980716 - DNA, 22 bp, Homo sapiens
ctgtctgtcctgagttcaacca

SEQ ID NO: 6980717 - DNA, 22 bp, Homo sapiens
tgatacagagcaagcatctttt

SEQ ID NO: 6980718 - DNA, 19 bp, Homo sapiens
cctgtacattattctcccc

SEQ ID NO: 6980719 - DNA, 22 bp, Homo sapiens
agaggctgaatgatgtcatcat

SEQ ID NO: 6980720 - DNA, 22 bp, Homo sapiens
acaaaattgtgttaaactttat

SEQ ID NO: 6980721 - DNA, 22 bp, Homo sapiens
tttctcagggaggagtcaagcc

SEQ ID NO: 6980722 - DNA, 22 bp, Homo sapiens
tggtgtggtccagtgacatact

SEQ ID NO: 6980723 - DNA, 20 bp, Homo sapiens
aggcagacaaggagtctgtt

SEQ ID NO: 6980724 - DNA, 22 bp, Homo sapiens
ctcaacatatgactttggtggg

SEQ ID NO: 6980725 - DNA, 22 bp, Homo sapiens
tagctctggagtcttctcagaa

SEQ ID NO: 6980726 - DNA, 23 bp, Homo sapiens
accttggacttcccagcttccag

SEQ ID NO: 6980727 - DNA, 22 bp, Homo sapiens
taagggggcacttactctcagg

SEQ ID NO: 6980728 - DNA, 21 bp, Homo sapiens
agaggccaagtcatcatttcc

SEQ ID NO: 6980729 - DNA, 22 bp, Homo sapiens
cactgcaccctcaaactcctgg

SEQ ID NO: 6980730 - DNA, 22 bp, Homo sapiens
attagaagcgtgaatcctttca

SEQ ID NO: 6980731 - DNA, 22 bp, Homo sapiens
gtgtcaggcagtcagcatggag

SEQ ID NO: 6980732 - DNA, 22 bp, Homo sapiens
caggccaataaatgtgatggcc

SEQ ID NO: 6980733 - DNA, 22 bp, Homo sapiens
tttcctctgggccctgccaccc

SEQ ID NO: 6980734 - DNA, 23 bp, Homo sapiens
ttcattgagctgttcttgaggat

SEQ ID NO: 6980735 - DNA, 22 bp, Homo sapiens
ggccaggcgatgacccctccac

SEQ ID NO: 6980736 - DNA, 22 bp, Homo sapiens
gggtgcaagccaaagaagactg

SEQ ID NO: 6980737 - DNA, 22 bp, Homo sapiens
acataacatagttgacattttt

SEQ ID NO: 6980738 - DNA, 22 bp, Homo sapiens
tttactgtttacagctaatgca

SEQ ID NO: 6980739 - DNA, 22 bp, Homo sapiens
tgcagcaaacaggccttcaggg

SEQ ID NO: 6980740 - DNA, 22 bp, Homo sapiens
atagatcaatgagcaatttaat

SEQ ID NO: 6980741 - DNA, 22 bp, Homo sapiens
ttaggcaattttgtcattgtgt

SEQ ID NO: 6980742 - DNA, 22 bp, Homo sapiens
tgcagctgaggccagctatgcc

SEQ ID NO: 6980743 - DNA, 22 bp, Homo sapiens
gtatttataggggaatgagagt

SEQ ID NO: 6980744 - DNA, 22 bp, Homo sapiens
atctttggaaagccaagcacag

SEQ ID NO: 6980745 - DNA, 22 bp, Homo sapiens
tggtccctaaagatgtctacat

SEQ ID NO: 6980746 - DNA, 22 bp, Homo sapiens
cacacctcagccatgtggaggc

SEQ ID NO: 6980747 - DNA, 22 bp, Homo sapiens
gacctggaggcttttcccaaga

SEQ ID NO: 6980748 - DNA, 22 bp, Homo sapiens
tctgtctcctcagatgactcca

SEQ ID NO: 6980749 - DNA, 23 bp, Homo sapiens
ttgaccttatcaagggcatttgc

SEQ ID NO: 6980750 - DNA, 22 bp, Homo sapiens
cagaaagcaagccattcactgt

SEQ ID NO: 6980751 - DNA, 22 bp, Homo sapiens
atgcacactgaatgcttacttt

SEQ ID NO: 6980752 - DNA, 22 bp, Homo sapiens
ttccccttgggctgtggaggag

SEQ ID NO: 6980753 - DNA, 22 bp, Homo sapiens
ataagtgctgtgctttaagact

SEQ ID NO: 6980754 - DNA, 22 bp, Homo sapiens
gtttttactaaggttgctaagt

SEQ ID NO: 6980755 - DNA, 22 bp, Homo sapiens
aagcagcattcagtgaaatgtg

SEQ ID NO: 6980756 - DNA, 21 bp, Homo sapiens
tgcacagcaaaagttgagtaa

SEQ ID NO: 6980757 - DNA, 19 bp, Homo sapiens
gggtccatggtgtcaagga

SEQ ID NO: 6980758 - DNA, 22 bp, Homo sapiens
gctgccctgcctcagactcctc

SEQ ID NO: 6980759 - DNA, 22 bp, Homo sapiens
catcttgactgggataagggat

SEQ ID NO: 6980760 - DNA, 22 bp, Homo sapiens
cccagtggaaggagtagaagac

SEQ ID NO: 6980761 - DNA, 16 bp, Homo sapiens
acagtgtgctaagcat

SEQ ID NO: 6980762 - DNA, 20 bp, Homo sapiens
atgaatattttggtctttcc

SEQ ID NO: 6980763 - DNA, 22 bp, Homo sapiens
ttgaagctgccgtttttctcca

SEQ ID NO: 6980764 - DNA, 18 bp, Homo sapiens
atgtggctagtgcaactg

SEQ ID NO: 6980765 - DNA, 22 bp, Homo sapiens
cgaaacatctatgatcattaat

SEQ ID NO: 6980766 - DNA, 22 bp, Homo sapiens
tctggacagagcttcaggagct

SEQ ID NO: 6980767 - DNA, 19 bp, Homo sapiens
catgatgagcatcctgcag

SEQ ID NO: 6980768 - DNA, 22 bp, Homo sapiens
catgtgacaggagcagctctaa

SEQ ID NO: 6980769 - DNA, 22 bp, Homo sapiens
agctgctatgaacattcacata

SEQ ID NO: 6980770 - DNA, 22 bp, Homo sapiens
ttattagtgttgatattaggat

SEQ ID NO: 6980771 - DNA, 22 bp, Homo sapiens
gtccagccactcaccttccagc

SEQ ID NO: 6980772 - DNA, 22 bp, Homo sapiens
agaaacctccatttattcactc

SEQ ID NO: 6980773 - DNA, 22 bp, Homo sapiens
tggtgttttctaagaaagtgtg

SEQ ID NO: 6980774 - DNA, 22 bp, Homo sapiens
acagactgtttggttcatgtct

SEQ ID NO: 6980775 - DNA, 22 bp, Homo sapiens
actggcccttgattgcatcagc

SEQ ID NO: 6980776 - DNA, 22 bp, Homo sapiens
atccctggacggcgcctcccca

SEQ ID NO: 6980777 - DNA, 22 bp, Homo sapiens
atggctgtgagacaaagagctg

SEQ ID NO: 6980778 - DNA, 22 bp, Homo sapiens
ccagcttctctgttccagcccc

SEQ ID NO: 6980779 - DNA, 23 bp, Homo sapiens
ccaagcttgtccctgcctgcttt

SEQ ID NO: 6980780 - DNA, 22 bp, Homo sapiens
ctcccactcctggctcaccaca

SEQ ID NO: 6980781 - DNA, 22 bp, Homo sapiens
agagtgattctagttagggaat

SEQ ID NO: 6980782 - DNA, 17 bp, Homo sapiens
agcttctgccctttctt

SEQ ID NO: 6980783 - DNA, 22 bp, Homo sapiens
taacacatgaaagcaccttctt

SEQ ID NO: 6980784 - DNA, 22 bp, Homo sapiens
tgtgttaatttattgcctcaga

SEQ ID NO: 6980785 - DNA, 22 bp, Homo sapiens
ccttctagcaaatcaacataaa

SEQ ID NO: 6980786 - DNA, 18 bp, Homo sapiens
ttgtgaaatattggagtc

SEQ ID NO: 6980787 - DNA, 22 bp, Homo sapiens
ctagttgtttaatattgattga

SEQ ID NO: 6980788 - DNA, 22 bp, Homo sapiens
atacagtttaccacactccttg

SEQ ID NO: 6980789 - DNA, 22 bp, Homo sapiens
agtctacaagaactccagtgca

SEQ ID NO: 6980790 - DNA, 22 bp, Homo sapiens
agaattctccacgctcagggtc

SEQ ID NO: 6980791 - DNA, 22 bp, Homo sapiens
actgtaatatggttcttttgat

SEQ ID NO: 6980792 - DNA, 19 bp, Homo sapiens
gcgaggaagtcactgtggt

SEQ ID NO: 6980793 - DNA, 22 bp, Homo sapiens
cctggaggctctgggagggcag

SEQ ID NO: 6980794 - DNA, 22 bp, Homo sapiens
ctgaggtaaaatttctattttg

SEQ ID NO: 6980795 - DNA, 22 bp, Homo sapiens
gctgtccctttcacaaggtttt

SEQ ID NO: 6980796 - DNA, 22 bp, Homo sapiens
cagaatatgactcgggcactac

SEQ ID NO: 6980797 - DNA, 22 bp, Homo sapiens
gctgccagcacacaggtgttag

SEQ ID NO: 6980798 - DNA, 22 bp, Homo sapiens
acagtttatcgattcacctacc

SEQ ID NO: 6980799 - DNA, 22 bp, Homo sapiens
ttagttacttataggtgataga

SEQ ID NO: 6980800 - DNA, 22 bp, Homo sapiens
atttggtcctgctgggggattt

SEQ ID NO: 6980801 - DNA, 17 bp, Homo sapiens
ttccagtttagtattgt

SEQ ID NO: 6980802 - DNA, 22 bp, Homo sapiens
taacaacatgcaatttaacctt

SEQ ID NO: 6980803 - DNA, 22 bp, Homo sapiens
tgtaatcatgcatcagttagtt

SEQ ID NO: 6980804 - DNA, 22 bp, Homo sapiens
cttattagtgtctgtctgagtt

SEQ ID NO: 6980805 - DNA, 23 bp, Homo sapiens
tgggccctggagtcgccagtctg

SEQ ID NO: 6980806 - DNA, 20 bp, Homo sapiens
gggtacagttctgcagttac

SEQ ID NO: 6980807 - DNA, 22 bp, Homo sapiens
tcctgaaattctggttgtcact

SEQ ID NO: 6980808 - DNA, 22 bp, Homo sapiens
gtctgtacccacgtcctgctag

SEQ ID NO: 6980809 - DNA, 22 bp, Homo sapiens
actgaggttattgcaataaaat

SEQ ID NO: 6980810 - DNA, 22 bp, Homo sapiens
catggcagcctgccctgcttgc

SEQ ID NO: 6980811 - DNA, 21 bp, Homo sapiens
cagttctcttagatttccagt

SEQ ID NO: 6980812 - DNA, 22 bp, Homo sapiens
cacaggttcaaattcaggtcgc

SEQ ID NO: 6980813 - DNA, 22 bp, Homo sapiens
gggcctgctgcaggttcaggat

SEQ ID NO: 6980814 - DNA, 22 bp, Homo sapiens
gtttttcctgctgacttgggtc

SEQ ID NO: 6980815 - DNA, 22 bp, Homo sapiens
agagacatggagaggcaaagtt

SEQ ID NO: 6980816 - DNA, 22 bp, Homo sapiens
gggtgcaggggaccctagggac

SEQ ID NO: 6980817 - DNA, 22 bp, Homo sapiens
cctctgcccttttcctgtatca

SEQ ID NO: 6980818 - DNA, 22 bp, Homo sapiens
caggacacttgttcttctctgc

SEQ ID NO: 6980819 - DNA, 22 bp, Homo sapiens
ttgcccctggtcagaggaggct

SEQ ID NO: 6980820 - DNA, 22 bp, Homo sapiens
gacagttacccccaaaagaatt

SEQ ID NO: 6980821 - DNA, 22 bp, Homo sapiens
tagatcatcagtgggctcttat

SEQ ID NO: 6980822 - DNA, 22 bp, Homo sapiens
aggtacatctatggggatagaa

SEQ ID NO: 6980823 - DNA, 20 bp, Homo sapiens
ttggcatttagacaagagtt

SEQ ID NO: 6980824 - DNA, 22 bp, Homo sapiens
gccataaatgaaggaaaggtat

SEQ ID NO: 6980825 - DNA, 22 bp, Homo sapiens
aacatcaggatcttgttacagt

SEQ ID NO: 6980826 - DNA, 22 bp, Homo sapiens
cttgctgttatccatattatct

SEQ ID NO: 6980827 - DNA, 22 bp, Homo sapiens
tatgagatcccttttcctagag

SEQ ID NO: 6980828 - DNA, 22 bp, Homo sapiens
gtctggaaatttaaggtatgag

SEQ ID NO: 6980829 - DNA, 22 bp, Homo sapiens
ctcaggttttggctttgtgtac

SEQ ID NO: 6980830 - DNA, 22 bp, Homo sapiens
gctgtttagatccacactgttg

SEQ ID NO: 6980831 - DNA, 22 bp, Homo sapiens
caggtggggggcttccgagcct

SEQ ID NO: 6980832 - DNA, 22 bp, Homo sapiens
gcagctcaagagaggtgctatg

SEQ ID NO: 6980833 - DNA, 22 bp, Homo sapiens
tcctggctggaatttctcactc

SEQ ID NO: 6980834 - DNA, 22 bp, Homo sapiens
tcacagtaaatccagaagaaat

SEQ ID NO: 6980835 - DNA, 22 bp, Homo sapiens
ttggcctacctgggaatgctgg

SEQ ID NO: 6980836 - DNA, 22 bp, Homo sapiens
tggctgagctccctgtgtgttg

SEQ ID NO: 6980837 - DNA, 22 bp, Homo sapiens
gttttggtaggactgtaaaaga

SEQ ID NO: 6980838 - DNA, 22 bp, Homo sapiens
tcatgcagtttcttatctgcca

SEQ ID NO: 6980839 - DNA, 22 bp, Homo sapiens
aaggaaaggatgagcatgcatt

SEQ ID NO: 6980840 - DNA, 22 bp, Homo sapiens
atttattcctttatggctggag

SEQ ID NO: 6980841 - DNA, 23 bp, Homo sapiens
acagttatagctgtgaataacat

SEQ ID NO: 6980842 - DNA, 22 bp, Homo sapiens
tgaaagctgcccagtggaatta

SEQ ID NO: 6980843 - DNA, 22 bp, Homo sapiens
aagagactgtaaaggcgtgagt

SEQ ID NO: 6980844 - DNA, 22 bp, Homo sapiens
agctgtggattgggtactttct

SEQ ID NO: 6980845 - DNA, 22 bp, Homo sapiens
gctcaggcctccagaggggcaa

SEQ ID NO: 6980846 - DNA, 22 bp, Homo sapiens
agattgaagactggtggagctg

SEQ ID NO: 6980847 - DNA, 20 bp, Homo sapiens
cagggacagcagtgggtttt

SEQ ID NO: 6980848 - DNA, 18 bp, Homo sapiens
gctgtctgaggtctgagg

SEQ ID NO: 6980849 - DNA, 22 bp, Homo sapiens
caagtttagtcatggtggtagt

SEQ ID NO: 6980850 - DNA, 22 bp, Homo sapiens
cactgggagtacaaagaatggg

SEQ ID NO: 6980851 - DNA, 22 bp, Homo sapiens
ttgagagtagagatggcagggc

SEQ ID NO: 6980852 - DNA, 20 bp, Homo sapiens
gctactgtgggaaaattgtg

SEQ ID NO: 6980853 - DNA, 22 bp, Homo sapiens
ctgggccttgagaatcatgttt

SEQ ID NO: 6980854 - DNA, 22 bp, Homo sapiens
gattttattagcccaaactttg

SEQ ID NO: 6980855 - DNA, 22 bp, Homo sapiens
taatcttagacatgtatttttc

SEQ ID NO: 6980856 - DNA, 22 bp, Homo sapiens
atgggaagctgacctgcatgga

SEQ ID NO: 6980857 - DNA, 22 bp, Homo sapiens
tttatttgtcttgccatttagt

SEQ ID NO: 6980858 - DNA, 22 bp, Homo sapiens
aagttcaatggaaaagctttag

SEQ ID NO: 6980859 - DNA, 22 bp, Homo sapiens
atgtacctctgcattcctgcct

SEQ ID NO: 6980860 - DNA, 22 bp, Homo sapiens
aaagcaatgcccgttcattatc

SEQ ID NO: 6980861 - DNA, 22 bp, Homo sapiens
gttccgtactgcaaagaatata

SEQ ID NO: 6980862 - DNA, 22 bp, Homo sapiens
catgttggcttgtcacaatgaa

SEQ ID NO: 6980863 - DNA, 22 bp, Homo sapiens
agacagtgataccttgggatgt

SEQ ID NO: 6980864 - DNA, 22 bp, Homo sapiens
tctgcccgttcaaatccttgtt

SEQ ID NO: 6980865 - DNA, 22 bp, Homo sapiens
tagagcaatgctctactccttg

SEQ ID NO: 6980866 - DNA, 22 bp, Homo sapiens
ggaggcagaatagagtgtgggt

SEQ ID NO: 6980867 - DNA, 22 bp, Homo sapiens
tggctctgatgggaggtattgg

SEQ ID NO: 6980868 - DNA, 22 bp, Homo sapiens
gcctggagaggaagccggtgga

SEQ ID NO: 6980869 - DNA, 22 bp, Homo sapiens
actcttggccactcttggtgtc

SEQ ID NO: 6980870 - DNA, 22 bp, Homo sapiens
cctaattatctcccaaagatcc

SEQ ID NO: 6980871 - DNA, 16 bp, Homo sapiens
aaagaaacaggtgtcc

SEQ ID NO: 6980872 - DNA, 22 bp, Homo sapiens
ttctgctttggttccatggatg

SEQ ID NO: 6980873 - DNA, 22 bp, Homo sapiens
aggcattgaggcggatgtggct

SEQ ID NO: 6980874 - DNA, 22 bp, Homo sapiens
ctgtgcagtggcagcgtgtggg

SEQ ID NO: 6980875 - DNA, 22 bp, Homo sapiens
ttattgccatcctggaacctag

SEQ ID NO: 6980876 - DNA, 22 bp, Homo sapiens
aaatctgtttcaggtatatttg

SEQ ID NO: 6980877 - DNA, 22 bp, Homo sapiens
aggctgtgttctggttcttagc

SEQ ID NO: 6980878 - DNA, 22 bp, Homo sapiens
agctctgcagcccagcaggtgg

SEQ ID NO: 6980879 - DNA, 22 bp, Homo sapiens
tgcacagaataatatatgttct

SEQ ID NO: 6980880 - DNA, 22 bp, Homo sapiens
cctctgggctgcctgcacgggt

SEQ ID NO: 6980881 - DNA, 22 bp, Homo sapiens
cacatgagtgagaacatgcagt

SEQ ID NO: 6980882 - DNA, 22 bp, Homo sapiens
gtgggtggacggtgcttttgtt

SEQ ID NO: 6980883 - DNA, 22 bp, Homo sapiens
tctggaaggaacccttagagga

SEQ ID NO: 6980884 - DNA, 17 bp, Homo sapiens
ttgaatgcattacttgg

SEQ ID NO: 6980885 - DNA, 22 bp, Homo sapiens
aattttacataggggatatggg

SEQ ID NO: 6980886 - DNA, 22 bp, Homo sapiens
aaagtttggatccagcaaaaga

SEQ ID NO: 6980887 - DNA, 22 bp, Homo sapiens
tgccagcaccttcctgctccct

SEQ ID NO: 6980888 - DNA, 20 bp, Homo sapiens
atccatcagagaaaataaag

SEQ ID NO: 6980889 - DNA, 22 bp, Homo sapiens
ctgagccagtagtcagggacaa

SEQ ID NO: 6980890 - DNA, 22 bp, Homo sapiens
ttacaagtatttaagatgctgt

SEQ ID NO: 6980891 - DNA, 22 bp, Homo sapiens
aagttacataaatgtcctctag

SEQ ID NO: 6980892 - DNA, 22 bp, Homo sapiens
gtgaacaggagaaagtgatgga

SEQ ID NO: 6980893 - DNA, 22 bp, Homo sapiens
agtgacaaggtagttagttgga

SEQ ID NO: 6980894 - DNA, 22 bp, Homo sapiens
attcacactttacttctttcca

SEQ ID NO: 6980895 - DNA, 22 bp, Homo sapiens
tagagctcattttaagcagaca

SEQ ID NO: 6980896 - DNA, 20 bp, Homo sapiens
gcacccagcttcttgttcta

SEQ ID NO: 6980897 - DNA, 22 bp, Homo sapiens
tcagggcaggcgagcagctgct

SEQ ID NO: 6980898 - DNA, 20 bp, Homo sapiens
ctgctccacccggctctcag

SEQ ID NO: 6980899 - DNA, 22 bp, Homo sapiens
tgccacacagtctggtagaata

SEQ ID NO: 6980900 - DNA, 22 bp, Homo sapiens
tggccttgataactggggagag

SEQ ID NO: 6980901 - DNA, 22 bp, Homo sapiens
agttttcagtaaatattagtga

SEQ ID NO: 6980902 - DNA, 22 bp, Homo sapiens
cagggtccggctgcctggctgt

SEQ ID NO: 6980903 - DNA, 22 bp, Homo sapiens
ggagctgcacgctctgaagcct

SEQ ID NO: 6980904 - DNA, 22 bp, Homo sapiens
tctgcaagctcagttctgactt

SEQ ID NO: 6980905 - DNA, 22 bp, Homo sapiens
tccaggtgtgctctgtgccctg

SEQ ID NO: 6980906 - DNA, 22 bp, Homo sapiens
ccaggagttggaagctgccatg

SEQ ID NO: 6980907 - DNA, 19 bp, Homo sapiens
gcagagtcaagagctgctg

SEQ ID NO: 6980908 - DNA, 22 bp, Homo sapiens
gtcaaggcaacatgtagtactg

SEQ ID NO: 6980909 - DNA, 22 bp, Homo sapiens
gtggccaccctcggcacacaca

SEQ ID NO: 6980910 - DNA, 22 bp, Homo sapiens
tctctaaatacagatgtcatgg

SEQ ID NO: 6980911 - DNA, 22 bp, Homo sapiens
attacagttaatttaccttctt

SEQ ID NO: 6980912 - DNA, 22 bp, Homo sapiens
tgccctggctggagtgcagtgg

SEQ ID NO: 6980913 - DNA, 22 bp, Homo sapiens
cctggctttctcatttacaggc

SEQ ID NO: 6980914 - DNA, 22 bp, Homo sapiens
ggggccaggtccagcttccaaa

SEQ ID NO: 6980915 - DNA, 22 bp, Homo sapiens
atgatatttgcaatgtgcttgc

SEQ ID NO: 6980916 - DNA, 19 bp, Homo sapiens
tggagcagggcccttgttt

SEQ ID NO: 6980917 - DNA, 22 bp, Homo sapiens
ttgggatctacatagctatgta

SEQ ID NO: 6980918 - DNA, 22 bp, Homo sapiens
tgggtgctctgcgaccgtaggg

SEQ ID NO: 6980919 - DNA, 22 bp, Homo sapiens
tggctctgggcaccgtgtccac

SEQ ID NO: 6980920 - DNA, 19 bp, Homo sapiens
agcccccagacagcaggcc

SEQ ID NO: 6980921 - DNA, 22 bp, Homo sapiens
catttgtatgttcctccttagg

SEQ ID NO: 6980922 - DNA, 22 bp, Homo sapiens
ctcaggcacttttgtcacagac

SEQ ID NO: 6980923 - DNA, 22 bp, Homo sapiens
gtgtcctgggcattaggcttag

SEQ ID NO: 6980924 - DNA, 22 bp, Homo sapiens
cagcttctaaagtgtgaagcca

SEQ ID NO: 6980925 - DNA, 22 bp, Homo sapiens
ggaaatccttctaaaaagtcag

SEQ ID NO: 6980926 - DNA, 22 bp, Homo sapiens
gcagatggagacgaggttccgc

SEQ ID NO: 6980927 - DNA, 22 bp, Homo sapiens
ttctatattggaagtgagaaat

SEQ ID NO: 6980928 - DNA, 22 bp, Homo sapiens
ggcatctctgtgtgtgtgaatc

SEQ ID NO: 6980929 - DNA, 22 bp, Homo sapiens
tctgtgcaccagaatgatattt

SEQ ID NO: 6980930 - DNA, 22 bp, Homo sapiens
tgtaggaaaaacaatgatctgc

SEQ ID NO: 6980931 - DNA, 22 bp, Homo sapiens
actttctaggtctcagtccttt

SEQ ID NO: 6980932 - DNA, 22 bp, Homo sapiens
gtttaacattgtaccaacacct

SEQ ID NO: 6980933 - DNA, 22 bp, Homo sapiens
gttcacaagctgattgtctttc

SEQ ID NO: 6980934 - DNA, 22 bp, Homo sapiens
gcagaatacatttgggattact

SEQ ID NO: 6980935 - DNA, 22 bp, Homo sapiens
atggtctgttaggagctacttt

SEQ ID NO: 6980936 - DNA, 22 bp, Homo sapiens
catttgatctcctgaataaaca

SEQ ID NO: 6980937 - DNA, 22 bp, Homo sapiens
tttccagatgctaggttgaaag

SEQ ID NO: 6980938 - DNA, 22 bp, Homo sapiens
tgtctgtattgaggtgcatatt

SEQ ID NO: 6980939 - DNA, 22 bp, Homo sapiens
gcctcacatattcatggttact

SEQ ID NO: 6980940 - DNA, 22 bp, Homo sapiens
gccccaggttgcctgtcccagg

SEQ ID NO: 6980941 - DNA, 22 bp, Homo sapiens
agtggcagaagtcactgggtag

SEQ ID NO: 6980942 - DNA, 22 bp, Homo sapiens
ggagaattctttattagctttt

SEQ ID NO: 6980943 - DNA, 22 bp, Homo sapiens
aaggcagccatagcaccatcca

SEQ ID NO: 6980944 - DNA, 20 bp, Homo sapiens
tacagttctgtagaagtaga

SEQ ID NO: 6980945 - DNA, 22 bp, Homo sapiens
taggaagcctgctgtgcacagc

SEQ ID NO: 6980946 - DNA, 22 bp, Homo sapiens
tccctggggaagggcaagcaag

SEQ ID NO: 6980947 - DNA, 21 bp, Homo sapiens
gggctaagagtgaccaggcag

SEQ ID NO: 6980948 - DNA, 22 bp, Homo sapiens
cacagacttgagaagcacctta

SEQ ID NO: 6980949 - DNA, 22 bp, Homo sapiens
aaagattaaggtattgttagct

SEQ ID NO: 6980950 - DNA, 22 bp, Homo sapiens
cctccctgcgctcctgcggcgg

SEQ ID NO: 6980951 - DNA, 22 bp, Homo sapiens
aacaatctccaagaccaatgtg

SEQ ID NO: 6980952 - DNA, 22 bp, Homo sapiens
gctatgaaggagaggaaggttt

SEQ ID NO: 6980953 - DNA, 22 bp, Homo sapiens
ttgtgtggtagcttcattgaac

SEQ ID NO: 6980954 - DNA, 22 bp, Homo sapiens
tcatttgttgaactttagtgcg

SEQ ID NO: 6980955 - DNA, 22 bp, Homo sapiens
actttagagaaatgtagaagta

SEQ ID NO: 6980956 - DNA, 22 bp, Homo sapiens
atgccagctatagacttgttat

SEQ ID NO: 6980957 - DNA, 22 bp, Homo sapiens
accctgtatgctatatccctaa

SEQ ID NO: 6980958 - DNA, 18 bp, Homo sapiens
acaggctattgcaggaga

SEQ ID NO: 6980959 - DNA, 22 bp, Homo sapiens
tttggcagcttccatattcact

SEQ ID NO: 6980960 - DNA, 22 bp, Homo sapiens
cagccccttcctggcatctgga

SEQ ID NO: 6980961 - DNA, 22 bp, Homo sapiens
cccagtgtgatgaggttgctaa

SEQ ID NO: 6980962 - DNA, 19 bp, Homo sapiens
tagcagctgccaaaggaga

SEQ ID NO: 6980963 - DNA, 22 bp, Homo sapiens
tactcagacttgaatctcaaga

SEQ ID NO: 6980964 - DNA, 23 bp, Homo sapiens
ccacaaaccatttgtgaaggagc

SEQ ID NO: 6980965 - DNA, 21 bp, Homo sapiens
tggagagcccttgcctgagtc

SEQ ID NO: 6980966 - DNA, 22 bp, Homo sapiens
gatccccagggcaggcctcccg

SEQ ID NO: 6980967 - DNA, 22 bp, Homo sapiens
tcacaactgggtgtcttcatca

SEQ ID NO: 6980968 - DNA, 22 bp, Homo sapiens
ggtggctggaggagctgatgga

SEQ ID NO: 6980969 - DNA, 22 bp, Homo sapiens
acacagggcaatgctttgacct

SEQ ID NO: 6980970 - DNA, 22 bp, Homo sapiens
ggacccagaggggagtctggca

SEQ ID NO: 6980971 - DNA, 18 bp, Homo sapiens
atatggaatgcctggcta

SEQ ID NO: 6980972 - DNA, 22 bp, Homo sapiens
ggccttggtggctttgctgatg

SEQ ID NO: 6980973 - DNA, 22 bp, Homo sapiens
gcctccggagttgcagtgtctt

SEQ ID NO: 6980974 - DNA, 22 bp, Homo sapiens
taagttaaccctgttaatagat

SEQ ID NO: 6980975 - DNA, 22 bp, Homo sapiens
ccagtttgaggtttcaagatgt

SEQ ID NO: 6980976 - DNA, 22 bp, Homo sapiens
actgggaagacaagaaagatag

SEQ ID NO: 6980977 - DNA, 21 bp, Homo sapiens
tgcatttaacagaaacaggaa

SEQ ID NO: 6980978 - DNA, 23 bp, Homo sapiens
ggaggtcagtgcctgagggtgag

SEQ ID NO: 6980979 - DNA, 22 bp, Homo sapiens
gcccttagtcagcactttcact

SEQ ID NO: 6980980 - DNA, 22 bp, Homo sapiens
tacctacagatgtaaatgaaac

SEQ ID NO: 6980981 - DNA, 22 bp, Homo sapiens
catgtcttatatcctgtcttca

SEQ ID NO: 6980982 - DNA, 22 bp, Homo sapiens
aactgtgtggtatacctgtgat

SEQ ID NO: 6980983 - DNA, 19 bp, Homo sapiens
agctgcagaccagaagtgc

SEQ ID NO: 6980984 - DNA, 22 bp, Homo sapiens
tctgttcttcctacattcacat

SEQ ID NO: 6980985 - DNA, 22 bp, Homo sapiens
gtgaggccgcacgccccggagt

SEQ ID NO: 6980986 - DNA, 21 bp, Homo sapiens
acacattatgagcatagactc

SEQ ID NO: 6980987 - DNA, 22 bp, Homo sapiens
taggtcctcatggggcagagat

SEQ ID NO: 6980988 - DNA, 22 bp, Homo sapiens
gagggccagagtcctggggtca

SEQ ID NO: 6980989 - DNA, 22 bp, Homo sapiens
acttgggtcacatgacctacct

SEQ ID NO: 6980990 - DNA, 22 bp, Homo sapiens
agcagagctattcttgtgcaat

SEQ ID NO: 6980991 - DNA, 22 bp, Homo sapiens
aataagtacttggggataactt

SEQ ID NO: 6980992 - DNA, 22 bp, Homo sapiens
gccctacctcagtccagatctg

SEQ ID NO: 6980993 - DNA, 22 bp, Homo sapiens
tgaatgagaacactgaaagagg

SEQ ID NO: 6980994 - DNA, 23 bp, Homo sapiens
tgctcccaggtgacgctgctgtt

SEQ ID NO: 6980995 - DNA, 22 bp, Homo sapiens
gagcacagtaaagcagtgtcac

SEQ ID NO: 6980996 - DNA, 22 bp, Homo sapiens
ttatctgtctatcaagactagc

SEQ ID NO: 6980997 - DNA, 22 bp, Homo sapiens
ttatggaagtgcaaattgtgtg

SEQ ID NO: 6980998 - DNA, 22 bp, Homo sapiens
cagttgatattgcagacaagca

SEQ ID NO: 6980999 - DNA, 22 bp, Homo sapiens
atgctgggaaactgaaaggaat

SEQ ID NO: 6981000 - DNA, 22 bp, Homo sapiens
tgcctgctcttgagacttacaa

SEQ ID NO: 6981001 - DNA, 22 bp, Homo sapiens
attgctcctgatgcatagagct

SEQ ID NO: 6981002 - DNA, 22 bp, Homo sapiens
acagcagattacattctgctat

SEQ ID NO: 6981003 - DNA, 22 bp, Homo sapiens
aatgatgtatgtataaggcagg

SEQ ID NO: 6981004 - DNA, 22 bp, Homo sapiens
ctgtgcttcagagtcagtgctg

SEQ ID NO: 6981005 - DNA, 22 bp, Homo sapiens
atcggggaaaagggaggctgtg

SEQ ID NO: 6981006 - DNA, 22 bp, Homo sapiens
acagtgaatgagaatggagaaa

SEQ ID NO: 6981007 - DNA, 23 bp, Homo sapiens
tggctctgagcttcctggtggcc

SEQ ID NO: 6981008 - DNA, 22 bp, Homo sapiens
gccaccatgtagcccattagag

SEQ ID NO: 6981009 - DNA, 22 bp, Homo sapiens
agcagggctggatttggcaaga

SEQ ID NO: 6981010 - DNA, 22 bp, Homo sapiens
tgccatggaatcacctccagct

SEQ ID NO: 6981011 - DNA, 22 bp, Homo sapiens
gtattttcatgatttcagacca

SEQ ID NO: 6981012 - DNA, 22 bp, Homo sapiens
ttgctgtgaaaccatgggaagt

SEQ ID NO: 6981013 - DNA, 22 bp, Homo sapiens
cagatttctatttcaaatacat

SEQ ID NO: 6981014 - DNA, 21 bp, Homo sapiens
gcttgccttcctatctttggc

SEQ ID NO: 6981015 - DNA, 22 bp, Homo sapiens
ccccacaactcatgttgaaact

SEQ ID NO: 6981016 - DNA, 22 bp, Homo sapiens
tttgggcaggcttttccctaga

SEQ ID NO: 6981017 - DNA, 22 bp, Homo sapiens
ctgttgttcatcatctgtcatt

SEQ ID NO: 6981018 - DNA, 22 bp, Homo sapiens
tcctgggttaattatgattcac

SEQ ID NO: 6981019 - DNA, 22 bp, Homo sapiens
tcgggccataggctaggtccct

SEQ ID NO: 6981020 - DNA, 22 bp, Homo sapiens
tggccagtgattaatgacgctt

SEQ ID NO: 6981021 - DNA, 22 bp, Homo sapiens
tgcatccttcccatttaaacca

SEQ ID NO: 6981022 - DNA, 22 bp, Homo sapiens
cagctgagctcccaggccatca

SEQ ID NO: 6981023 - DNA, 23 bp, Homo sapiens
aaacttgctatggctgaaatcat

SEQ ID NO: 6981024 - DNA, 22 bp, Homo sapiens
atacagatgggtcagatttcat

SEQ ID NO: 6981025 - DNA, 22 bp, Homo sapiens
tcagaggaatttgcttttcatg

SEQ ID NO: 6981026 - DNA, 22 bp, Homo sapiens
aacaatgtgattgaagctagaa

SEQ ID NO: 6981027 - DNA, 22 bp, Homo sapiens
taacagcaactgagggcctttt

SEQ ID NO: 6981028 - DNA, 22 bp, Homo sapiens
cgaggctcagagagggtgactt

SEQ ID NO: 6981029 - DNA, 22 bp, Homo sapiens
cctgtagaatctgtagacccat

SEQ ID NO: 6981030 - DNA, 18 bp, Homo sapiens
acatacattctgtctgca

SEQ ID NO: 6981031 - DNA, 22 bp, Homo sapiens
tctgatgttcctcagttctctt

SEQ ID NO: 6981032 - DNA, 22 bp, Homo sapiens
cgtgtagctgatctgagatttt

SEQ ID NO: 6981033 - DNA, 22 bp, Homo sapiens
ctggaatgggccatttgaggcc

SEQ ID NO: 6981034 - DNA, 22 bp, Homo sapiens
tcaaagactatatattttattt

SEQ ID NO: 6981035 - DNA, 22 bp, Homo sapiens
aaattagaagtgctcaggaata

SEQ ID NO: 6981036 - DNA, 21 bp, Homo sapiens
agccagcaacacagcatctcc

SEQ ID NO: 6981037 - DNA, 22 bp, Homo sapiens
aggcccatgttcacttgctcag

SEQ ID NO: 6981038 - DNA, 22 bp, Homo sapiens
aaacagctgcactgctgatgtc

SEQ ID NO: 6981039 - DNA, 22 bp, Homo sapiens
agtgcaggttaaggaactggcc

SEQ ID NO: 6981040 - DNA, 22 bp, Homo sapiens
ttattgagcaactctggggctc

SEQ ID NO: 6981041 - DNA, 22 bp, Homo sapiens
gtgcccaccggtgccctgagct

SEQ ID NO: 6981042 - DNA, 22 bp, Homo sapiens
actgggccttgccatggcagcc

SEQ ID NO: 6981043 - DNA, 22 bp, Homo sapiens
atgaagacaaacgacgttgcaa

SEQ ID NO: 6981044 - DNA, 22 bp, Homo sapiens
ggcggggcctcgcgaacggcct

SEQ ID NO: 6981045 - DNA, 22 bp, Homo sapiens
cgtttactgtgtaccaggcact

SEQ ID NO: 6981046 - DNA, 22 bp, Homo sapiens
aagttaagcatggccatgtgac

SEQ ID NO: 6981047 - DNA, 17 bp, Homo sapiens
agttttgatataatggc

SEQ ID NO: 6981048 - DNA, 22 bp, Homo sapiens
ttgaataggactcagcagtgat

SEQ ID NO: 6981049 - DNA, 22 bp, Homo sapiens
gccaggagaatgctagcagagg

SEQ ID NO: 6981050 - DNA, 22 bp, Homo sapiens
tgtgaggcttgaagtaattcca

SEQ ID NO: 6981051 - DNA, 22 bp, Homo sapiens
cactggcccagccaggcctgtt

SEQ ID NO: 6981052 - DNA, 22 bp, Homo sapiens
agatggctctcaagtctgatta

SEQ ID NO: 6981053 - DNA, 22 bp, Homo sapiens
ctggctgtgctggagttgagga

SEQ ID NO: 6981054 - DNA, 22 bp, Homo sapiens
ccaggagttggaggttgcagtg

SEQ ID NO: 6981055 - DNA, 22 bp, Homo sapiens
atggcagagtcctaagccttta

SEQ ID NO: 6981056 - DNA, 22 bp, Homo sapiens
gaaaactgtgattagaatgcct

SEQ ID NO: 6981057 - DNA, 22 bp, Homo sapiens
tgtcaccagctgctcctcagga

SEQ ID NO: 6981058 - DNA, 22 bp, Homo sapiens
actgcactccagcctgggcaca

SEQ ID NO: 6981059 - DNA, 22 bp, Homo sapiens
accccagccctgcttctgggag

SEQ ID NO: 6981060 - DNA, 22 bp, Homo sapiens
aaacaccagcactgtttacaaa

SEQ ID NO: 6981061 - DNA, 22 bp, Homo sapiens
gaggtagtgagcagctgaacta

SEQ ID NO: 6981062 - DNA, 22 bp, Homo sapiens
agggatgggaactcctccagca

SEQ ID NO: 6981063 - DNA, 22 bp, Homo sapiens
ctgctgtgtgcttacttgggtt

SEQ ID NO: 6981064 - DNA, 22 bp, Homo sapiens
ggcccctcagcatctgagtcag

SEQ ID NO: 6981065 - DNA, 22 bp, Homo sapiens
acacgcatagaaaattgcacta

SEQ ID NO: 6981066 - DNA, 22 bp, Homo sapiens
tgagccagcctcagaagtcacg

SEQ ID NO: 6981067 - DNA, 22 bp, Homo sapiens
gctccacttgcagctaggcttg

SEQ ID NO: 6981068 - DNA, 22 bp, Homo sapiens
aacatgtattttccttggcaac

SEQ ID NO: 6981069 - DNA, 22 bp, Homo sapiens
tctagggaacatgggtcaagct

SEQ ID NO: 6981070 - DNA, 22 bp, Homo sapiens
gttcaagaccagcctggccaac

SEQ ID NO: 6981071 - DNA, 22 bp, Homo sapiens
aagatgttgggtgcctccggaa

SEQ ID NO: 6981072 - DNA, 22 bp, Homo sapiens
cctgtctgaatcatgatttcct

SEQ ID NO: 6981073 - DNA, 22 bp, Homo sapiens
attgaactgtctttgaagaaat

SEQ ID NO: 6981074 - DNA, 22 bp, Homo sapiens
cagtgctgcatctccatgccag

SEQ ID NO: 6981075 - DNA, 22 bp, Homo sapiens
agttcactccagatgttctgac

SEQ ID NO: 6981076 - DNA, 22 bp, Homo sapiens
aggtccatcgtggatgaactgc

SEQ ID NO: 6981077 - DNA, 22 bp, Homo sapiens
ctttgattccaggcacatgttt

SEQ ID NO: 6981078 - DNA, 22 bp, Homo sapiens
actccaggtaggcacattgaca

SEQ ID NO: 6981079 - DNA, 22 bp, Homo sapiens
aggcttgaaatgaaatctgtaa

SEQ ID NO: 6981080 - DNA, 22 bp, Homo sapiens
caaggccttcttgggagagatt

SEQ ID NO: 6981081 - DNA, 22 bp, Homo sapiens
ttctgatgcatgggtctctgtt

SEQ ID NO: 6981082 - DNA, 22 bp, Homo sapiens
tacacagggaaaggtctcagag

SEQ ID NO: 6981083 - DNA, 22 bp, Homo sapiens
tcttaaagcctcatcactccgt

SEQ ID NO: 6981084 - DNA, 21 bp, Homo sapiens
gggagctggaaactgggtgac

SEQ ID NO: 6981085 - DNA, 22 bp, Homo sapiens
attgatttaggcttgttatgac

SEQ ID NO: 6981086 - DNA, 22 bp, Homo sapiens
cctgtgtttagatatgatgctg

SEQ ID NO: 6981087 - DNA, 22 bp, Homo sapiens
tttgcagccacagtgccttgta

SEQ ID NO: 6981088 - DNA, 22 bp, Homo sapiens
cattagcaggcactaagaaggt

SEQ ID NO: 6981089 - DNA, 19 bp, Homo sapiens
gcagatgatgaggctggtc

SEQ ID NO: 6981090 - DNA, 22 bp, Homo sapiens
ccacacagggggatgagttatt

SEQ ID NO: 6981091 - DNA, 23 bp, Homo sapiens
ttcttccaaggtgctttgtggtt

SEQ ID NO: 6981092 - DNA, 22 bp, Homo sapiens
tggggccaggtggctgcaggtc

SEQ ID NO: 6981093 - DNA, 22 bp, Homo sapiens
accatgattcacccaccactgt

SEQ ID NO: 6981094 - DNA, 20 bp, Homo sapiens
ggcagggcatcaacagctct

SEQ ID NO: 6981095 - DNA, 22 bp, Homo sapiens
caggcttgggttctctgagtta

SEQ ID NO: 6981096 - DNA, 22 bp, Homo sapiens
tttacaactttctgttctgtat

SEQ ID NO: 6981097 - DNA, 22 bp, Homo sapiens
tagaaacatataggatggcagg

SEQ ID NO: 6981098 - DNA, 22 bp, Homo sapiens
gtgtggcttgggtgaggcgcct

SEQ ID NO: 6981099 - DNA, 22 bp, Homo sapiens
ccaggaggatcatcctgttttc

SEQ ID NO: 6981100 - DNA, 22 bp, Homo sapiens
gatactgtgtcattctcacatg

SEQ ID NO: 6981101 - DNA, 22 bp, Homo sapiens
agctgcaagaagaggtccctga

SEQ ID NO: 6981102 - DNA, 22 bp, Homo sapiens
agaagcaggcagatttcagctc

SEQ ID NO: 6981103 - DNA, 22 bp, Homo sapiens
gacagcaggtgcttgggaaagg

SEQ ID NO: 6981104 - DNA, 22 bp, Homo sapiens
ccaccatgggaagagagactaa

SEQ ID NO: 6981105 - DNA, 22 bp, Homo sapiens
tgccaatctttgtgataattgc

SEQ ID NO: 6981106 - DNA, 22 bp, Homo sapiens
ctgtggctgtatttggccagag

SEQ ID NO: 6981107 - DNA, 22 bp, Homo sapiens
tacagctttatacccatcaaaa

SEQ ID NO: 6981108 - DNA, 21 bp, Homo sapiens
atgcacaaaaagactctttct

SEQ ID NO: 6981109 - DNA, 22 bp, Homo sapiens
agaggccatggggcatttttca

SEQ ID NO: 6981110 - DNA, 22 bp, Homo sapiens
cagctagggagtggcagagctt

SEQ ID NO: 6981111 - DNA, 22 bp, Homo sapiens
agatgacaatgaaggaaaatgt

SEQ ID NO: 6981112 - DNA, 22 bp, Homo sapiens
ttaagtctctttgaagtgctct

SEQ ID NO: 6981113 - DNA, 22 bp, Homo sapiens
ttttcaggccagaagatagacc

SEQ ID NO: 6981114 - DNA, 22 bp, Homo sapiens
tccagtcggataactagacggt

SEQ ID NO: 6981115 - DNA, 22 bp, Homo sapiens
tttgagatggagtcttgctctg

SEQ ID NO: 6981116 - DNA, 18 bp, Homo sapiens
cttcctgactagctctgg

SEQ ID NO: 6981117 - DNA, 22 bp, Homo sapiens
agcattaagagagactgaactg

SEQ ID NO: 6981118 - DNA, 22 bp, Homo sapiens
tcagaagccttgattatctaga

SEQ ID NO: 6981119 - DNA, 22 bp, Homo sapiens
tttgacaattcatgacatttat

SEQ ID NO: 6981120 - DNA, 22 bp, Homo sapiens
tcgggctgctcgctgcggaact

SEQ ID NO: 6981121 - DNA, 22 bp, Homo sapiens
ctgggtgacagagtgagatggt

SEQ ID NO: 6981122 - DNA, 22 bp, Homo sapiens
accaaggagccacatacaacct

SEQ ID NO: 6981123 - DNA, 22 bp, Homo sapiens
tgctggagcccaggcggccttt

SEQ ID NO: 6981124 - DNA, 22 bp, Homo sapiens
ttcttctgagagaaaaagctca

SEQ ID NO: 6981125 - DNA, 22 bp, Homo sapiens
ttctgggtttacatctgacttc

SEQ ID NO: 6981126 - DNA, 22 bp, Homo sapiens
gcccaagatctggagctgcagg

SEQ ID NO: 6981127 - DNA, 22 bp, Homo sapiens
aattccacagctgcacagaggt

SEQ ID NO: 6981128 - DNA, 22 bp, Homo sapiens
gtctgcctttatcatctcctta

SEQ ID NO: 6981129 - DNA, 22 bp, Homo sapiens
aaattctgcaatttgacaagat

SEQ ID NO: 6981130 - DNA, 22 bp, Homo sapiens
aaactacatctcatggatgagg

SEQ ID NO: 6981131 - DNA, 22 bp, Homo sapiens
tgagaatatttgaagatgttag

SEQ ID NO: 6981132 - DNA, 23 bp, Homo sapiens
tcagtcttggcttctgattttcc

SEQ ID NO: 6981133 - DNA, 22 bp, Homo sapiens
ctcatctaggataaagcatctt

SEQ ID NO: 6981134 - DNA, 22 bp, Homo sapiens
ttctgggagaatctaaatggtt

SEQ ID NO: 6981135 - DNA, 22 bp, Homo sapiens
gttctctcaaactttgtgtttg

SEQ ID NO: 6981136 - DNA, 22 bp, Homo sapiens
tcgtaagattgaaacttggaag

SEQ ID NO: 6981137 - DNA, 22 bp, Homo sapiens
tttcagacatagcctgattctg

SEQ ID NO: 6981138 - DNA, 22 bp, Homo sapiens
atccttcaaggggctgacagct

SEQ ID NO: 6981139 - DNA, 22 bp, Homo sapiens
gtttttctttgtgtgaagacaa

SEQ ID NO: 6981140 - DNA, 22 bp, Homo sapiens
aaatccgtcattggcctggttg

SEQ ID NO: 6981141 - DNA, 22 bp, Homo sapiens
cagctttattgaggtataattg

SEQ ID NO: 6981142 - DNA, 22 bp, Homo sapiens
acagtagtgtgtgaaacttgcc

SEQ ID NO: 6981143 - DNA, 22 bp, Homo sapiens
gtcaaaaagtagtcatttctgt

SEQ ID NO: 6981144 - DNA, 22 bp, Homo sapiens
ttctgagacatcatacttttag

SEQ ID NO: 6981145 - DNA, 22 bp, Homo sapiens
atagtttgctttaatacaactg

SEQ ID NO: 6981146 - DNA, 22 bp, Homo sapiens
agcagtgacttgctttgtttcc

SEQ ID NO: 6981147 - DNA, 22 bp, Homo sapiens
agggcccatgtcgggcgctctg

SEQ ID NO: 6981148 - DNA, 20 bp, Homo sapiens
atctgggcatcaattttgtg

SEQ ID NO: 6981149 - DNA, 22 bp, Homo sapiens
ttagataatgtagagatatgag

SEQ ID NO: 6981150 - DNA, 22 bp, Homo sapiens
tggtcagttgtgactagaacac

SEQ ID NO: 6981151 - DNA, 17 bp, Homo sapiens
catacctgagagttata

SEQ ID NO: 6981152 - DNA, 22 bp, Homo sapiens
ggaggagtcagttgggctgctt

SEQ ID NO: 6981153 - DNA, 22 bp, Homo sapiens
aggcagactgtgcgggaagagt

SEQ ID NO: 6981154 - DNA, 22 bp, Homo sapiens
ttgggcaggctggcagactgct

SEQ ID NO: 6981155 - DNA, 22 bp, Homo sapiens
aagcagaaaaactgagctccaa

SEQ ID NO: 6981156 - DNA, 22 bp, Homo sapiens
caaagaggtgagaggagccttt

SEQ ID NO: 6981157 - DNA, 22 bp, Homo sapiens
tagcacattgttgaccagaagg

SEQ ID NO: 6981158 - DNA, 22 bp, Homo sapiens
caacagtgattctgcatgagga

SEQ ID NO: 6981159 - DNA, 22 bp, Homo sapiens
tcctgttgctgtagtggttaag

SEQ ID NO: 6981160 - DNA, 22 bp, Homo sapiens
ttgctactgttctttgctagag

SEQ ID NO: 6981161 - DNA, 22 bp, Homo sapiens
cccaacaacatgaaactaccta

SEQ ID NO: 6981162 - DNA, 22 bp, Homo sapiens
ggctgctgcccacccctgcatg

SEQ ID NO: 6981163 - DNA, 21 bp, Homo sapiens
tcatgaacattcactgactgc

SEQ ID NO: 6981164 - DNA, 22 bp, Homo sapiens
cagttaccatcttcagtgatga

SEQ ID NO: 6981165 - DNA, 22 bp, Homo sapiens
gggggaagtaattataaaccaa

SEQ ID NO: 6981166 - DNA, 22 bp, Homo sapiens
cacttagaaaacttgagcaagt

SEQ ID NO: 6981167 - DNA, 22 bp, Homo sapiens
tagctgtttatcaagttcttga

SEQ ID NO: 6981168 - DNA, 22 bp, Homo sapiens
cttcccactaaagcccttgttg

SEQ ID NO: 6981169 - DNA, 22 bp, Homo sapiens
aggtggatcatatactagacca

SEQ ID NO: 6981170 - DNA, 22 bp, Homo sapiens
gggtcagggaggccccaccatg

SEQ ID NO: 6981171 - DNA, 22 bp, Homo sapiens
taatcacagaaacagactgttt

SEQ ID NO: 6981172 - DNA, 23 bp, Homo sapiens
agacagcttagagtttgcctctc

SEQ ID NO: 6981173 - DNA, 22 bp, Homo sapiens
ttggttaaaatcaaattaatca

SEQ ID NO: 6981174 - DNA, 22 bp, Homo sapiens
tcagtgaaatgcatattcttcg

SEQ ID NO: 6981175 - DNA, 22 bp, Homo sapiens
tacactaatagccacactaatg

SEQ ID NO: 6981176 - DNA, 22 bp, Homo sapiens
aggtgcagcatgagtccaacgg

SEQ ID NO: 6981177 - DNA, 22 bp, Homo sapiens
tcttagcacagctatataagtt

SEQ ID NO: 6981178 - DNA, 19 bp, Homo sapiens
tttcttaggcctttggcct

SEQ ID NO: 6981179 - DNA, 23 bp, Homo sapiens
aacctagactacttactatgtgg

SEQ ID NO: 6981180 - DNA, 18 bp, Homo sapiens
ctgctttgccttcattcc

SEQ ID NO: 6981181 - DNA, 22 bp, Homo sapiens
aatgttacacaggtataatcag

SEQ ID NO: 6981182 - DNA, 22 bp, Homo sapiens
tttcttaatttgagttccacta

SEQ ID NO: 6981183 - DNA, 22 bp, Homo sapiens
cttatttcctgacatggaaaga

SEQ ID NO: 6981184 - DNA, 22 bp, Homo sapiens
tgaattctctgcctgcgtattt

SEQ ID NO: 6981185 - DNA, 22 bp, Homo sapiens
gtcacatgccagtggggatcct

SEQ ID NO: 6981186 - DNA, 22 bp, Homo sapiens
gagcttggacaagctctgaagg

SEQ ID NO: 6981187 - DNA, 23 bp, Homo sapiens
ctccaagggagggcaaacaacag

SEQ ID NO: 6981188 - DNA, 22 bp, Homo sapiens
tgtgtgtgaaccattgagggct

SEQ ID NO: 6981189 - DNA, 22 bp, Homo sapiens
ttccataaaggtgatagtatac

SEQ ID NO: 6981190 - DNA, 17 bp, Homo sapiens
gaaggtttctcttaggt

SEQ ID NO: 6981191 - DNA, 22 bp, Homo sapiens
gggcactcagctgtagagcagg

SEQ ID NO: 6981192 - DNA, 22 bp, Homo sapiens
gaagccacaactttttcttagc

SEQ ID NO: 6981193 - DNA, 22 bp, Homo sapiens
aacaaagatgggtgggaaagag

SEQ ID NO: 6981194 - DNA, 22 bp, Homo sapiens
gtaattttggagtataacctgg

SEQ ID NO: 6981195 - DNA, 21 bp, Homo sapiens
ctagagtgggaccggagtcta

SEQ ID NO: 6981196 - DNA, 22 bp, Homo sapiens
ggcacagtccctggcacagagt

SEQ ID NO: 6981197 - DNA, 22 bp, Homo sapiens
tgatgcaatagagagatagata

SEQ ID NO: 6981198 - DNA, 22 bp, Homo sapiens
aattttacaaaatacctccgat

SEQ ID NO: 6981199 - DNA, 22 bp, Homo sapiens
acagagggggccttggagtgca

SEQ ID NO: 6981200 - DNA, 22 bp, Homo sapiens
ctcctggcactcagtgtggaag

SEQ ID NO: 6981201 - DNA, 22 bp, Homo sapiens
tggaacaagggttcatttaaat

SEQ ID NO: 6981202 - DNA, 22 bp, Homo sapiens
agctagaactacaggcatgtgc

SEQ ID NO: 6981203 - DNA, 22 bp, Homo sapiens
gatttcaaggatgttagaggtg

SEQ ID NO: 6981204 - DNA, 22 bp, Homo sapiens
gagcaaaggtgcagtttgaaat

SEQ ID NO: 6981205 - DNA, 22 bp, Homo sapiens
acagaaataactttttatgttt

SEQ ID NO: 6981206 - DNA, 22 bp, Homo sapiens
cagtttatagttgttatgtgtg

SEQ ID NO: 6981207 - DNA, 22 bp, Homo sapiens
attggtgcattttacaaaactc

SEQ ID NO: 6981208 - DNA, 22 bp, Homo sapiens
aggactttaacatattaactgt

SEQ ID NO: 6981209 - DNA, 22 bp, Homo sapiens
gttgctgatggcaagattccag

SEQ ID NO: 6981210 - DNA, 22 bp, Homo sapiens
caatgtttactggggacccaga

SEQ ID NO: 6981211 - DNA, 22 bp, Homo sapiens
tttcacaggggcaacctccatg

SEQ ID NO: 6981212 - DNA, 22 bp, Homo sapiens
gagggctgataacaggaataca

SEQ ID NO: 6981213 - DNA, 22 bp, Homo sapiens
agccttcagtaaatccactgtg

SEQ ID NO: 6981214 - DNA, 23 bp, Homo sapiens
tgggaagatatgtatgttcaagg

SEQ ID NO: 6981215 - DNA, 22 bp, Homo sapiens
ctgactgtgagagcaggaatgg

SEQ ID NO: 6981216 - DNA, 22 bp, Homo sapiens
ccttgactgtaatggagtaggg

SEQ ID NO: 6981217 - DNA, 22 bp, Homo sapiens
aggcttcttctgcctgtctttg

SEQ ID NO: 6981218 - DNA, 22 bp, Homo sapiens
acccagggtagaacctcagagc

SEQ ID NO: 6981219 - DNA, 22 bp, Homo sapiens
cagggatggagagactactggc

SEQ ID NO: 6981220 - DNA, 23 bp, Homo sapiens
tatggcatggtacttccagcaga

SEQ ID NO: 6981221 - DNA, 22 bp, Homo sapiens
tggcatgtttaaatggcaataa

SEQ ID NO: 6981222 - DNA, 23 bp, Homo sapiens
gctcagatgccctaggaggtggc

SEQ ID NO: 6981223 - DNA, 15 bp, Homo sapiens
gggaatgttttacaa

SEQ ID NO: 6981224 - DNA, 22 bp, Homo sapiens
ccaaggctggagggcttatgta

SEQ ID NO: 6981225 - DNA, 22 bp, Homo sapiens
aatatcagcacttttgtggtat

SEQ ID NO: 6981226 - DNA, 22 bp, Homo sapiens
tatgacaagaaatacagaggta

SEQ ID NO: 6981227 - DNA, 22 bp, Homo sapiens
aactacattgtcctttctgaag

SEQ ID NO: 6981228 - DNA, 22 bp, Homo sapiens
gccaggtgggagacagacagca

SEQ ID NO: 6981229 - DNA, 22 bp, Homo sapiens
ttcaatgcatatagatatagaa

SEQ ID NO: 6981230 - DNA, 22 bp, Homo sapiens
ttctaagaaatggaaaacgatt

SEQ ID NO: 6981231 - DNA, 22 bp, Homo sapiens
ccatgcctggactccactctca

SEQ ID NO: 6981232 - DNA, 22 bp, Homo sapiens
gcttggctggaaataggttgag

SEQ ID NO: 6981233 - DNA, 22 bp, Homo sapiens
aacagcagcaagtaagcaggtc

SEQ ID NO: 6981234 - DNA, 22 bp, Homo sapiens
agagcacagcagatctctgatg

SEQ ID NO: 6981235 - DNA, 22 bp, Homo sapiens
ctgggttccatgtagccaagag

SEQ ID NO: 6981236 - DNA, 22 bp, Homo sapiens
agccaactccctctcattgagc

SEQ ID NO: 6981237 - DNA, 23 bp, Homo sapiens
ggcactcggccgtgaactcgtgc

SEQ ID NO: 6981238 - DNA, 22 bp, Homo sapiens
tgtggcaggcattctgaggctg

SEQ ID NO: 6981239 - DNA, 22 bp, Homo sapiens
cagtgaggtggagtagttccca

SEQ ID NO: 6981240 - DNA, 22 bp, Homo sapiens
tctttgtttgcctttatcaaga

SEQ ID NO: 6981241 - DNA, 22 bp, Homo sapiens
aaagccagggtccaggcctgcc

SEQ ID NO: 6981242 - DNA, 22 bp, Homo sapiens
gcatggctattctaactcacat

SEQ ID NO: 6981243 - DNA, 23 bp, Homo sapiens
aattacaaccaagaactggaagg

SEQ ID NO: 6981244 - DNA, 22 bp, Homo sapiens
gggtgtccacaaaatggctttg

SEQ ID NO: 6981245 - DNA, 22 bp, Homo sapiens
cagtggcagagaacagagacct

SEQ ID NO: 6981246 - DNA, 22 bp, Homo sapiens
tctagggaatagtagagtttct

SEQ ID NO: 6981247 - DNA, 22 bp, Homo sapiens
gctccaggtggcttatttgtat

SEQ ID NO: 6981248 - DNA, 22 bp, Homo sapiens
cactgcactccagcctgggcga

SEQ ID NO: 6981249 - DNA, 22 bp, Homo sapiens
cctgtctatcaagacatcttca

SEQ ID NO: 6981250 - DNA, 22 bp, Homo sapiens
ctgctgagatgccaggagctct

SEQ ID NO: 6981251 - DNA, 22 bp, Homo sapiens
tgagctcgagagctttggtcca

SEQ ID NO: 6981252 - DNA, 22 bp, Homo sapiens
gaggggtgggctggaagttata

SEQ ID NO: 6981253 - DNA, 22 bp, Homo sapiens
atccttcttcaaagagggaaaa

SEQ ID NO: 6981254 - DNA, 22 bp, Homo sapiens
aaagttagtcagaaccagccat

SEQ ID NO: 6981255 - DNA, 22 bp, Homo sapiens
tttaacatgtaattgctgcttt

SEQ ID NO: 6981256 - DNA, 22 bp, Homo sapiens
taggttctctattgcccccaaa

SEQ ID NO: 6981257 - DNA, 22 bp, Homo sapiens
ttcattccttccctaagcaact

SEQ ID NO: 6981258 - DNA, 22 bp, Homo sapiens
atggcacagatgttctgattat

SEQ ID NO: 6981259 - DNA, 22 bp, Homo sapiens
tggaagatcaaccaggattgac

SEQ ID NO: 6981260 - DNA, 22 bp, Homo sapiens
aggcatggcactgagcagcttc

SEQ ID NO: 6981261 - DNA, 22 bp, Homo sapiens
gaggaagccccattgaagccag

SEQ ID NO: 6981262 - DNA, 22 bp, Homo sapiens
agcagctcaagacttaaatttg

SEQ ID NO: 6981263 - DNA, 22 bp, Homo sapiens
tgggtcctgtctccttgttctg

SEQ ID NO: 6981264 - DNA, 22 bp, Homo sapiens
tcctggcagttcagccccctaa

SEQ ID NO: 6981265 - DNA, 22 bp, Homo sapiens
tgaattccctaagacaggtctt

SEQ ID NO: 6981266 - DNA, 22 bp, Homo sapiens
gctgtgaattattcttaactgg

SEQ ID NO: 6981267 - DNA, 22 bp, Homo sapiens
cagaatgcagaatgttcatttt

SEQ ID NO: 6981268 - DNA, 22 bp, Homo sapiens
ttctcctggggccgtgatgtga

SEQ ID NO: 6981269 - DNA, 22 bp, Homo sapiens
aaagagttcacggaggccaaag

SEQ ID NO: 6981270 - DNA, 22 bp, Homo sapiens
caaacttgtctatctaggaatc

SEQ ID NO: 6981271 - DNA, 22 bp, Homo sapiens
ccctggagtgccggaatcaaga

SEQ ID NO: 6981272 - DNA, 22 bp, Homo sapiens
ttcagactttgtggggccctcc

SEQ ID NO: 6981273 - DNA, 22 bp, Homo sapiens
catggctttgttctgttagatg

SEQ ID NO: 6981274 - DNA, 22 bp, Homo sapiens
acattaaaatggagaattttga

SEQ ID NO: 6981275 - DNA, 22 bp, Homo sapiens
cgtgtttcagccagggccacct

SEQ ID NO: 6981276 - DNA, 22 bp, Homo sapiens
tccctagaggtcttcacaagat

SEQ ID NO: 6981277 - DNA, 22 bp, Homo sapiens
gcaggccaggctaggggctgtc

SEQ ID NO: 6981278 - DNA, 22 bp, Homo sapiens
acccagagaactgaggcatgaa

SEQ ID NO: 6981279 - DNA, 22 bp, Homo sapiens
ggtcacattctgaggaatcagg

SEQ ID NO: 6981280 - DNA, 20 bp, Homo sapiens
aagtgttttgacttctgacc

SEQ ID NO: 6981281 - DNA, 22 bp, Homo sapiens
gagaaagatggaatcttacagg

SEQ ID NO: 6981282 - DNA, 22 bp, Homo sapiens
tgggttttccatctatttactc

SEQ ID NO: 6981283 - DNA, 21 bp, Homo sapiens
aacattggttcaaataaaact

SEQ ID NO: 6981284 - DNA, 22 bp, Homo sapiens
ttacatgcttagagatgcatgc

SEQ ID NO: 6981285 - DNA, 22 bp, Homo sapiens
ccacagttgctgaaatcgctta

SEQ ID NO: 6981286 - DNA, 23 bp, Homo sapiens
catctagcatccagtgagtagtg

SEQ ID NO: 6981287 - DNA, 22 bp, Homo sapiens
ctgctccaggaacagagctgct

SEQ ID NO: 6981288 - DNA, 22 bp, Homo sapiens
tctgtggagtgacctgggcttt

SEQ ID NO: 6981289 - DNA, 18 bp, Homo sapiens
acaggcctcagtcctgca

SEQ ID NO: 6981290 - DNA, 22 bp, Homo sapiens
catgaaaatgtcaagttctgct

SEQ ID NO: 6981291 - DNA, 23 bp, Homo sapiens
ctggctcatcctggttgcagtgg

SEQ ID NO: 6981292 - DNA, 23 bp, Homo sapiens
gctgatggagacttgtggcctcc

SEQ ID NO: 6981293 - DNA, 18 bp, Homo sapiens
tctggtttctaggggagt

SEQ ID NO: 6981294 - DNA, 22 bp, Homo sapiens
tcaggcctcaagctgctttaag

SEQ ID NO: 6981295 - DNA, 22 bp, Homo sapiens
gcagaagcccggtcagcgcacg

SEQ ID NO: 6981296 - DNA, 22 bp, Homo sapiens
tgctgaatgggtgattttggag

SEQ ID NO: 6981297 - DNA, 21 bp, Homo sapiens
gctctctgcatggtggctcag

SEQ ID NO: 6981298 - DNA, 22 bp, Homo sapiens
cagtgaacttgagtacttcatt

SEQ ID NO: 6981299 - DNA, 22 bp, Homo sapiens
catgcaaacacgtaaacattca

SEQ ID NO: 6981300 - DNA, 23 bp, Homo sapiens
attgatgacttgattacactttt

SEQ ID NO: 6981301 - DNA, 22 bp, Homo sapiens
aagacagaccacgtgacagggc

SEQ ID NO: 6981302 - DNA, 22 bp, Homo sapiens
actaggaattcaagtagacaga

SEQ ID NO: 6981303 - DNA, 17 bp, Homo sapiens
caggcacatgaagccag

SEQ ID NO: 6981304 - DNA, 22 bp, Homo sapiens
cagcaatagtgtgtttgtttca

SEQ ID NO: 6981305 - DNA, 22 bp, Homo sapiens
tgagcaaggagcagtctttctt

SEQ ID NO: 6981306 - DNA, 22 bp, Homo sapiens
gagggaaggtcacccttgtagc

SEQ ID NO: 6981307 - DNA, 22 bp, Homo sapiens
ttgatttgggaatggtctggca

SEQ ID NO: 6981308 - DNA, 15 bp, Homo sapiens
tccctgggagatggt

SEQ ID NO: 6981309 - DNA, 19 bp, Homo sapiens
gaattatttttatgggatg

SEQ ID NO: 6981310 - DNA, 22 bp, Homo sapiens
gcaccaggagaatcacgttaga

SEQ ID NO: 6981311 - DNA, 20 bp, Homo sapiens
atcggcttgcctggaaacaa

SEQ ID NO: 6981312 - DNA, 22 bp, Homo sapiens
agtgtctttcatatcctccatc

SEQ ID NO: 6981313 - DNA, 22 bp, Homo sapiens
gggtaaaggtcgccctcaaggt

SEQ ID NO: 6981314 - DNA, 22 bp, Homo sapiens
agctttgtttcacatacacctt

SEQ ID NO: 6981315 - DNA, 22 bp, Homo sapiens
caggacaggccctgtggggtct

SEQ ID NO: 6981316 - DNA, 19 bp, Homo sapiens
tgtacatatagagctcagt

SEQ ID NO: 6981317 - DNA, 22 bp, Homo sapiens
atggaaattaagatttgtctca

SEQ ID NO: 6981318 - DNA, 17 bp, Homo sapiens
gctgagaaggggaagag

SEQ ID NO: 6981319 - DNA, 18 bp, Homo sapiens
atacagagacctcaagga

SEQ ID NO: 6981320 - DNA, 22 bp, Homo sapiens
accgaatatgtgagtattatgc

SEQ ID NO: 6981321 - DNA, 22 bp, Homo sapiens
gacagctgtgcaggagaagggg

SEQ ID NO: 6981322 - DNA, 18 bp, Homo sapiens
gacagctgtcctgagccc

SEQ ID NO: 6981323 - DNA, 22 bp, Homo sapiens
tgaaaaaacaagttggcccatt

SEQ ID NO: 6981324 - DNA, 22 bp, Homo sapiens
ctgtgccaggcccgggtgggtg

SEQ ID NO: 6981325 - DNA, 22 bp, Homo sapiens
agtccttcacgtcctgcttatt

SEQ ID NO: 6981326 - DNA, 22 bp, Homo sapiens
tccctgaaatttgaagaggaat

SEQ ID NO: 6981327 - DNA, 22 bp, Homo sapiens
tcctccgggcacgtcagtccct

SEQ ID NO: 6981328 - DNA, 22 bp, Homo sapiens
taggaaattaagtctcttttgt

SEQ ID NO: 6981329 - DNA, 22 bp, Homo sapiens
cttcagcaccatagctccttct

SEQ ID NO: 6981330 - DNA, 22 bp, Homo sapiens
gggtccagagcctcagcccaga

SEQ ID NO: 6981331 - DNA, 22 bp, Homo sapiens
taaatgtgtctttttaaggcct

SEQ ID NO: 6981332 - DNA, 22 bp, Homo sapiens
acaataacttctgtttccttgc

SEQ ID NO: 6981333 - DNA, 22 bp, Homo sapiens
tcatccaaggagaccttgcaga

SEQ ID NO: 6981334 - DNA, 22 bp, Homo sapiens
gctaggctcggaagcagcaggg

SEQ ID NO: 6981335 - DNA, 22 bp, Homo sapiens
atgataagccatgtcgtggtca

SEQ ID NO: 6981336 - DNA, 22 bp, Homo sapiens
cctgctagagacctggtgtgta

SEQ ID NO: 6981337 - DNA, 22 bp, Homo sapiens
atgcacaggaagtgtccccatt

SEQ ID NO: 6981338 - DNA, 22 bp, Homo sapiens
tcagtcacttttgcctgctaca

SEQ ID NO: 6981339 - DNA, 22 bp, Homo sapiens
acatgaaagttattctgagttg

SEQ ID NO: 6981340 - DNA, 22 bp, Homo sapiens
tatgttgtagctagtaataaat

SEQ ID NO: 6981341 - DNA, 22 bp, Homo sapiens
ggctgaaggaactttttccatg

SEQ ID NO: 6981342 - DNA, 20 bp, Homo sapiens
aaagttcatgtttgcacttt

SEQ ID NO: 6981343 - DNA, 22 bp, Homo sapiens
tccaagctactgaaggtttggg

SEQ ID NO: 6981344 - DNA, 22 bp, Homo sapiens
ggtatttcagtattatacaact

SEQ ID NO: 6981345 - DNA, 22 bp, Homo sapiens
tagaggagagttgctggatgga

SEQ ID NO: 6981346 - DNA, 22 bp, Homo sapiens
aattttgtgtgggatcaaagga

SEQ ID NO: 6981347 - DNA, 22 bp, Homo sapiens
aagtttcatgtggaggtagact

SEQ ID NO: 6981348 - DNA, 22 bp, Homo sapiens
tatttggagatgggatcttcaa

SEQ ID NO: 6981349 - DNA, 22 bp, Homo sapiens
caagcctcagaatcttctccat

SEQ ID NO: 6981350 - DNA, 22 bp, Homo sapiens
catgcaagaagatagattaaat

SEQ ID NO: 6981351 - DNA, 22 bp, Homo sapiens
tgcaatgaattacttcccaaac

SEQ ID NO: 6981352 - DNA, 22 bp, Homo sapiens
tggaatgttaaacctcaatgat

SEQ ID NO: 6981353 - DNA, 19 bp, Homo sapiens
tgaggcacatgataagaac

SEQ ID NO: 6981354 - DNA, 22 bp, Homo sapiens
atgctactatccttctgcttaa

SEQ ID NO: 6981355 - DNA, 22 bp, Homo sapiens
tctctgtgactgcagctttgca

SEQ ID NO: 6981356 - DNA, 22 bp, Homo sapiens
tttggctgtcatttgaaaatgt

SEQ ID NO: 6981357 - DNA, 22 bp, Homo sapiens
gtcaatataggtttcaaacatg

SEQ ID NO: 6981358 - DNA, 22 bp, Homo sapiens
tgcatttcttttgagtatatgc

SEQ ID NO: 6981359 - DNA, 22 bp, Homo sapiens
gccctgccctgttgaaactaga

SEQ ID NO: 6981360 - DNA, 22 bp, Homo sapiens
ggctgtgctttgcccaaagggc

SEQ ID NO: 6981361 - DNA, 22 bp, Homo sapiens
gggcctctccggcctttgcatc

SEQ ID NO: 6981362 - DNA, 19 bp, Homo sapiens
agggccaggattctggaac

SEQ ID NO: 6981363 - DNA, 22 bp, Homo sapiens
gggctaagctcgcccagggcca

SEQ ID NO: 6981364 - DNA, 22 bp, Homo sapiens
aagattctccctgagatattta

SEQ ID NO: 6981365 - DNA, 22 bp, Homo sapiens
ggcagagaatctggctgtttac

SEQ ID NO: 6981366 - DNA, 22 bp, Homo sapiens
gctgccccagctgggggctgga

SEQ ID NO: 6981367 - DNA, 22 bp, Homo sapiens
acagtgttttatgagaattgtt

SEQ ID NO: 6981368 - DNA, 22 bp, Homo sapiens
cagtacttcttggaaactggat

SEQ ID NO: 6981369 - DNA, 22 bp, Homo sapiens
tgagatggcaacaccagctttg

SEQ ID NO: 6981370 - DNA, 22 bp, Homo sapiens
cagcagagaaattaaacttctg

SEQ ID NO: 6981371 - DNA, 22 bp, Homo sapiens
tacaaagtgctttagaaatgaa

SEQ ID NO: 6981372 - DNA, 22 bp, Homo sapiens
agagtgccctgctctgagctct

SEQ ID NO: 6981373 - DNA, 22 bp, Homo sapiens
tcacatttcgcatcagtccgat

SEQ ID NO: 6981374 - DNA, 18 bp, Homo sapiens
tactggtccttttatgat

SEQ ID NO: 6981375 - DNA, 22 bp, Homo sapiens
ttgcagcttcttgcatcagaaa

SEQ ID NO: 6981376 - DNA, 22 bp, Homo sapiens
gggtggaattgttggcatcgga

SEQ ID NO: 6981377 - DNA, 22 bp, Homo sapiens
actgtgcaccctggacagtgtc

SEQ ID NO: 6981378 - DNA, 22 bp, Homo sapiens
tacctggatcctggtagacatc

SEQ ID NO: 6981379 - DNA, 22 bp, Homo sapiens
gaagaagacatggaacaatagt

SEQ ID NO: 6981380 - DNA, 20 bp, Homo sapiens
aaggtccaaactctgtgttc

SEQ ID NO: 6981381 - DNA, 22 bp, Homo sapiens
ctcttattcctacagtaacagg

SEQ ID NO: 6981382 - DNA, 22 bp, Homo sapiens
ccaggctctgttccccgaggag

SEQ ID NO: 6981383 - DNA, 22 bp, Homo sapiens
tatccatggccaatcaaataca

SEQ ID NO: 6981384 - DNA, 22 bp, Homo sapiens
cactggtacactgaatggcgtt

SEQ ID NO: 6981385 - DNA, 22 bp, Homo sapiens
gtcaggattaatgggagtatgc

SEQ ID NO: 6981386 - DNA, 22 bp, Homo sapiens
caaggtagagaaggatttgatt

SEQ ID NO: 6981387 - DNA, 22 bp, Homo sapiens
ttgcccaccttcttttcgtgcc

SEQ ID NO: 6981388 - DNA, 22 bp, Homo sapiens
ctgagctcagtcccagctctac

SEQ ID NO: 6981389 - DNA, 22 bp, Homo sapiens
agttcacaagtgcatttcagga

SEQ ID NO: 6981390 - DNA, 22 bp, Homo sapiens
tctcatctgcgagctctgccag

SEQ ID NO: 6981391 - DNA, 22 bp, Homo sapiens
gtgaccatcatctcagctagtt

SEQ ID NO: 6981392 - DNA, 22 bp, Homo sapiens
agtccagtgtgttctggcagca

SEQ ID NO: 6981393 - DNA, 22 bp, Homo sapiens
tttggtcataagcttttggggt

SEQ ID NO: 6981394 - DNA, 19 bp, Homo sapiens
attggagcagaaaggtggt

SEQ ID NO: 6981395 - DNA, 22 bp, Homo sapiens
atggtacagtgcactgaatgga

SEQ ID NO: 6981396 - DNA, 22 bp, Homo sapiens
tggcagagaataaatcttgact

SEQ ID NO: 6981397 - DNA, 22 bp, Homo sapiens
acagatgcaaggaaatgattgc

SEQ ID NO: 6981398 - DNA, 22 bp, Homo sapiens
aaccaccattctctcctcttcc

SEQ ID NO: 6981399 - DNA, 22 bp, Homo sapiens
ccatgttgtatctcttatcggc

SEQ ID NO: 6981400 - DNA, 22 bp, Homo sapiens
taaggcagtgaaactattctgt

SEQ ID NO: 6981401 - DNA, 22 bp, Homo sapiens
cctgacagtccttttctagtgt

SEQ ID NO: 6981402 - DNA, 22 bp, Homo sapiens
acagcagagtgtgagatagcca

SEQ ID NO: 6981403 - DNA, 22 bp, Homo sapiens
attacaactacataatctcaga

SEQ ID NO: 6981404 - DNA, 22 bp, Homo sapiens
aagtccttatgtggaggggcta

SEQ ID NO: 6981405 - DNA, 22 bp, Homo sapiens
gttgggctgggagctgccctga

SEQ ID NO: 6981406 - DNA, 22 bp, Homo sapiens
attgatgtgtcacaagagattt

SEQ ID NO: 6981407 - DNA, 22 bp, Homo sapiens
tgaaatcataacagtttggctt

SEQ ID NO: 6981408 - DNA, 22 bp, Homo sapiens
tgggctcagccatgacctccac

SEQ ID NO: 6981409 - DNA, 22 bp, Homo sapiens
atgaagcagcctcttccctctg

SEQ ID NO: 6981410 - DNA, 22 bp, Homo sapiens
ttggcatttatctttaatcaaa

SEQ ID NO: 6981411 - DNA, 22 bp, Homo sapiens
cattgttttgagaacaacctga

SEQ ID NO: 6981412 - DNA, 23 bp, Homo sapiens
agattgaagtattgaccagagct

SEQ ID NO: 6981413 - DNA, 22 bp, Homo sapiens
acagggccaatgttagcattga

SEQ ID NO: 6981414 - DNA, 19 bp, Homo sapiens
gtctctgctccagggtctc

SEQ ID NO: 6981415 - DNA, 22 bp, Homo sapiens
gatggaggaaaagttggaatgc

SEQ ID NO: 6981416 - DNA, 22 bp, Homo sapiens
tacaggtagcaaaacctttcct

SEQ ID NO: 6981417 - DNA, 22 bp, Homo sapiens
attgctgtaaattatcttatta

SEQ ID NO: 6981418 - DNA, 20 bp, Homo sapiens
acccagctctgtgccctggg

SEQ ID NO: 6981419 - DNA, 22 bp, Homo sapiens
tcatttggtcctcccaacaagc

SEQ ID NO: 6981420 - DNA, 22 bp, Homo sapiens
attgctctaatgtgggcagttt

SEQ ID NO: 6981421 - DNA, 22 bp, Homo sapiens
caggccagggagaatatgaagc

SEQ ID NO: 6981422 - DNA, 22 bp, Homo sapiens
tggcatttctgttagactctca

SEQ ID NO: 6981423 - DNA, 22 bp, Homo sapiens
aataggtttaggaaagcgtttt

SEQ ID NO: 6981424 - DNA, 22 bp, Homo sapiens
tctaggaaataatgactcatcc

SEQ ID NO: 6981425 - DNA, 23 bp, Homo sapiens
tgacaggctttgctccttctgcc

SEQ ID NO: 6981426 - DNA, 22 bp, Homo sapiens
tgtcacatgacacaaatatcta

SEQ ID NO: 6981427 - DNA, 22 bp, Homo sapiens
aaaggcttgcgattccttgtaa

SEQ ID NO: 6981428 - DNA, 22 bp, Homo sapiens
attcagtttttgaagggaaatt

SEQ ID NO: 6981429 - DNA, 22 bp, Homo sapiens
tggctcagcaggttagaaacta

SEQ ID NO: 6981430 - DNA, 22 bp, Homo sapiens
gtctgtgtgcacagcgagtgcc

SEQ ID NO: 6981431 - DNA, 22 bp, Homo sapiens
cctgtgtggtagccagcggtgc

SEQ ID NO: 6981432 - DNA, 22 bp, Homo sapiens
aggcactgcagattacaggcgc

SEQ ID NO: 6981433 - DNA, 22 bp, Homo sapiens
acacagtatcaaatttcatctt

SEQ ID NO: 6981434 - DNA, 20 bp, Homo sapiens
tccaggcagacagctatggg

SEQ ID NO: 6981435 - DNA, 22 bp, Homo sapiens
gcagctctcctctgtgaggaac

SEQ ID NO: 6981436 - DNA, 22 bp, Homo sapiens
tctaaagaagagggttctgcgg

SEQ ID NO: 6981437 - DNA, 22 bp, Homo sapiens
ggcaggtgtggtgaccagagat

SEQ ID NO: 6981438 - DNA, 22 bp, Homo sapiens
atgttctgaatcaagcaactct

SEQ ID NO: 6981439 - DNA, 22 bp, Homo sapiens
gagaggctatgaggttctgtgt

SEQ ID NO: 6981440 - DNA, 22 bp, Homo sapiens
cagagggcgtccgggttaactt

SEQ ID NO: 6981441 - DNA, 22 bp, Homo sapiens
ccttagtgaaacagaggcaatt

SEQ ID NO: 6981442 - DNA, 22 bp, Homo sapiens
cagggccactgcatgaggttca

SEQ ID NO: 6981443 - DNA, 22 bp, Homo sapiens
ttcaatagaaagtccctagtta

SEQ ID NO: 6981444 - DNA, 22 bp, Homo sapiens
agcaggagaacactgtggctct

SEQ ID NO: 6981445 - DNA, 22 bp, Homo sapiens
gtcagcatgagcaagggctgac

SEQ ID NO: 6981446 - DNA, 22 bp, Homo sapiens
tgaggaatttctttatgaatga

SEQ ID NO: 6981447 - DNA, 22 bp, Homo sapiens
tgaccttatttggagacacagt

SEQ ID NO: 6981448 - DNA, 17 bp, Homo sapiens
ctctgcagtgcatggct

SEQ ID NO: 6981449 - DNA, 22 bp, Homo sapiens
gtgtgtggcatgtcctattttg

SEQ ID NO: 6981450 - DNA, 22 bp, Homo sapiens
tgccatcacctttctgaacgtt

SEQ ID NO: 6981451 - DNA, 22 bp, Homo sapiens
cacatttaatcctttataagta

SEQ ID NO: 6981452 - DNA, 22 bp, Homo sapiens
aggtgcttggtaaatattttag

SEQ ID NO: 6981453 - DNA, 22 bp, Homo sapiens
ttacagtgtgcaatcccagaat

SEQ ID NO: 6981454 - DNA, 22 bp, Homo sapiens
ctggagtcttcagcttgctgcc

SEQ ID NO: 6981455 - DNA, 22 bp, Homo sapiens
ccatagtacataatacatttta

SEQ ID NO: 6981456 - DNA, 22 bp, Homo sapiens
aaagcaggcagcaggctggatt

SEQ ID NO: 6981457 - DNA, 23 bp, Homo sapiens
gaacagacattagtgagccaggc

SEQ ID NO: 6981458 - DNA, 22 bp, Homo sapiens
ttggaaaagcgttctctgtagc

SEQ ID NO: 6981459 - DNA, 22 bp, Homo sapiens
ttccttagtgacttctagctac

SEQ ID NO: 6981460 - DNA, 22 bp, Homo sapiens
gcctggagtgttggtatttctc

SEQ ID NO: 6981461 - DNA, 23 bp, Homo sapiens
caatttcatatgattctacctaa

SEQ ID NO: 6981462 - DNA, 22 bp, Homo sapiens
gtgccagggagtggaggagctt

SEQ ID NO: 6981463 - DNA, 22 bp, Homo sapiens
tcagcacaggtcttgcaaaaca

SEQ ID NO: 6981464 - DNA, 22 bp, Homo sapiens
gtggccagagattaaatagagt

SEQ ID NO: 6981465 - DNA, 18 bp, Homo sapiens
tcatgaggtagaggctgg

SEQ ID NO: 6981466 - DNA, 22 bp, Homo sapiens
agccaagacatttagaaaagct

SEQ ID NO: 6981467 - DNA, 22 bp, Homo sapiens
cagagcacctgctcattgccag

SEQ ID NO: 6981468 - DNA, 22 bp, Homo sapiens
aggagccagattctctcacttt

SEQ ID NO: 6981469 - DNA, 21 bp, Homo sapiens
tatacagcaaagtctggagca

SEQ ID NO: 6981470 - DNA, 22 bp, Homo sapiens
cacagctgtatccaggagatcc

SEQ ID NO: 6981471 - DNA, 22 bp, Homo sapiens
agccatctctgaaatcaaagct

SEQ ID NO: 6981472 - DNA, 22 bp, Homo sapiens
ctgctctatgtcctcacccagg

SEQ ID NO: 6981473 - DNA, 22 bp, Homo sapiens
tacagtatagaatgtgtattaa

SEQ ID NO: 6981474 - DNA, 22 bp, Homo sapiens
ttgtgtgcataaattctgatgt

SEQ ID NO: 6981475 - DNA, 23 bp, Homo sapiens
tgagaagccattagagcaggtgg

SEQ ID NO: 6981476 - DNA, 23 bp, Homo sapiens
aacttgctgtaaagttctaggca

SEQ ID NO: 6981477 - DNA, 22 bp, Homo sapiens
tgctttcatgaagtctatagag

SEQ ID NO: 6981478 - DNA, 22 bp, Homo sapiens
gccaggaatgcataaatgacct

SEQ ID NO: 6981479 - DNA, 22 bp, Homo sapiens
agcttcttctgatttgtcagtc

SEQ ID NO: 6981480 - DNA, 18 bp, Homo sapiens
ttcagagtctggtgagga

SEQ ID NO: 6981481 - DNA, 22 bp, Homo sapiens
ctgcccacagttctctgccatg

SEQ ID NO: 6981482 - DNA, 22 bp, Homo sapiens
gcactgccacataatctcagca

SEQ ID NO: 6981483 - DNA, 20 bp, Homo sapiens
gccaacgcgctggggctgcc

SEQ ID NO: 6981484 - DNA, 22 bp, Homo sapiens
tttcttgaatatgggttaaact

SEQ ID NO: 6981485 - DNA, 22 bp, Homo sapiens
gtcccttggctcacaaacagct

SEQ ID NO: 6981486 - DNA, 22 bp, Homo sapiens
cctgagctggcagtgacctgga

SEQ ID NO: 6981487 - DNA, 22 bp, Homo sapiens
aaatgagtttcctcaatgtcct

SEQ ID NO: 6981488 - DNA, 22 bp, Homo sapiens
tagctacactgaggctgcttaa

SEQ ID NO: 6981489 - DNA, 22 bp, Homo sapiens
gcatgcacagtttttcacctca

SEQ ID NO: 6981490 - DNA, 22 bp, Homo sapiens
gggatcagactctgggatgtag

SEQ ID NO: 6981491 - DNA, 22 bp, Homo sapiens
acataaatttcactgttccgtg

SEQ ID NO: 6981492 - DNA, 22 bp, Homo sapiens
gtccaagtcttccttcccaaac

SEQ ID NO: 6981493 - DNA, 22 bp, Homo sapiens
gagggccctggctggctccagc

SEQ ID NO: 6981494 - DNA, 20 bp, Homo sapiens
tcagagcagttggcttgtct

SEQ ID NO: 6981495 - DNA, 21 bp, Homo sapiens
gactctctagtgctgtccagt

SEQ ID NO: 6981496 - DNA, 22 bp, Homo sapiens
ttgcagggtcccagaggcctgg

SEQ ID NO: 6981497 - DNA, 22 bp, Homo sapiens
caaaattgatgaatgtatgatt

SEQ ID NO: 6981498 - DNA, 22 bp, Homo sapiens
caaataattactatcctcactt

SEQ ID NO: 6981499 - DNA, 22 bp, Homo sapiens
tgcactttgcaggcatggaaac

SEQ ID NO: 6981500 - DNA, 22 bp, Homo sapiens
ggcactgggagaggtgagacgg

SEQ ID NO: 6981501 - DNA, 22 bp, Homo sapiens
atagctgtggaagatgtgggaa

SEQ ID NO: 6981502 - DNA, 22 bp, Homo sapiens
agatatgagattttcaaacaag

SEQ ID NO: 6981503 - DNA, 22 bp, Homo sapiens
agccccctccctagtgactgga

SEQ ID NO: 6981504 - DNA, 22 bp, Homo sapiens
gaagttcctcgtaggagtctct

SEQ ID NO: 6981505 - DNA, 22 bp, Homo sapiens
atcaatgcttgccaaatggaag

SEQ ID NO: 6981506 - DNA, 22 bp, Homo sapiens
attgggctgcaccccagagttt

SEQ ID NO: 6981507 - DNA, 22 bp, Homo sapiens
ccagatgggccaggggtttgtt

SEQ ID NO: 6981508 - DNA, 22 bp, Homo sapiens
tccccacctaagatacccatct

SEQ ID NO: 6981509 - DNA, 18 bp, Homo sapiens
ggcatgtataagaagtag

SEQ ID NO: 6981510 - DNA, 19 bp, Homo sapiens
cctgttcttggctgaggct

SEQ ID NO: 6981511 - DNA, 22 bp, Homo sapiens
tctgggcctcacctgctgctca

SEQ ID NO: 6981512 - DNA, 22 bp, Homo sapiens
tggcagagacaaggccgggcct

SEQ ID NO: 6981513 - DNA, 22 bp, Homo sapiens
tgtaactgccatgtagcctgtc

SEQ ID NO: 6981514 - DNA, 22 bp, Homo sapiens
atattgccctggggtgtaaaat

SEQ ID NO: 6981515 - DNA, 22 bp, Homo sapiens
accaggaagaacaggcaaggca

SEQ ID NO: 6981516 - DNA, 22 bp, Homo sapiens
tcaatagagccttctttcaggt

SEQ ID NO: 6981517 - DNA, 22 bp, Homo sapiens
gcacatgtgggaatggtgctga

SEQ ID NO: 6981518 - DNA, 22 bp, Homo sapiens
gggcgcgcacgccagacagcct

SEQ ID NO: 6981519 - DNA, 22 bp, Homo sapiens
gccaccccataggtgttaggtg

SEQ ID NO: 6981520 - DNA, 22 bp, Homo sapiens
agcctttaacacttcacattga

SEQ ID NO: 6981521 - DNA, 19 bp, Homo sapiens
ctggcctgtgtcctgtgct

SEQ ID NO: 6981522 - DNA, 22 bp, Homo sapiens
ttagctagttattatcaaatga

SEQ ID NO: 6981523 - DNA, 22 bp, Homo sapiens
tgcattaaaatgtgcctctctt

SEQ ID NO: 6981524 - DNA, 22 bp, Homo sapiens
cctggcttttgtttataaattc

SEQ ID NO: 6981525 - DNA, 22 bp, Homo sapiens
tgggtcacaaaggccagatgat

SEQ ID NO: 6981526 - DNA, 22 bp, Homo sapiens
tgctgaaagtcccaaatctcat

SEQ ID NO: 6981527 - DNA, 22 bp, Homo sapiens
ggcctgctctgtttagaggggg

SEQ ID NO: 6981528 - DNA, 22 bp, Homo sapiens
aatttatatgtaattaggcaca

SEQ ID NO: 6981529 - DNA, 16 bp, Homo sapiens
tagagagggcagggag

SEQ ID NO: 6981530 - DNA, 22 bp, Homo sapiens
ttaacagacatatatatttgta

SEQ ID NO: 6981531 - DNA, 22 bp, Homo sapiens
taacagctggcgttataggaat

SEQ ID NO: 6981532 - DNA, 22 bp, Homo sapiens
tatatgtagattgtaccaatgt

SEQ ID NO: 6981533 - DNA, 22 bp, Homo sapiens
tggtggcagtgagaaggagagg

SEQ ID NO: 6981534 - DNA, 22 bp, Homo sapiens
atgtgacaatatttggtcttat

SEQ ID NO: 6981535 - DNA, 22 bp, Homo sapiens
aatcttcaaaatgttctgcttg

SEQ ID NO: 6981536 - DNA, 22 bp, Homo sapiens
tttagacatttgtggtttgcaa

SEQ ID NO: 6981537 - DNA, 22 bp, Homo sapiens
tcttttgtggatgaagaaatgg

SEQ ID NO: 6981538 - DNA, 22 bp, Homo sapiens
tgtaaaaagcccagccgctgag

SEQ ID NO: 6981539 - DNA, 22 bp, Homo sapiens
ttggccaggcatgaataaaaga

SEQ ID NO: 6981540 - DNA, 22 bp, Homo sapiens
agcgagtgggtcagcgttgcag

SEQ ID NO: 6981541 - DNA, 20 bp, Homo sapiens
gcatgaggaatcattgcagc

SEQ ID NO: 6981542 - DNA, 22 bp, Homo sapiens
tacctggcagtcagtctttccg

SEQ ID NO: 6981543 - DNA, 22 bp, Homo sapiens
aggcaggtgggtcacttgagtc

SEQ ID NO: 6981544 - DNA, 22 bp, Homo sapiens
gaaactagatgtattagagatt

SEQ ID NO: 6981545 - DNA, 22 bp, Homo sapiens
gggcttggcacatgggctcagc

SEQ ID NO: 6981546 - DNA, 22 bp, Homo sapiens
ttgcttcatttcctcaggcttt

SEQ ID NO: 6981547 - DNA, 22 bp, Homo sapiens
cagaacagaaacgttgttccat

SEQ ID NO: 6981548 - DNA, 22 bp, Homo sapiens
tgttacagtgactaatgtttta

SEQ ID NO: 6981549 - DNA, 22 bp, Homo sapiens
tcatccattgtcctcacattag

SEQ ID NO: 6981550 - DNA, 22 bp, Homo sapiens
tctccaaggagctcctgtgccg

SEQ ID NO: 6981551 - DNA, 22 bp, Homo sapiens
tcaaccttgtgagaactgagtc

SEQ ID NO: 6981552 - DNA, 22 bp, Homo sapiens
acttttcaaatgggaaactcag

SEQ ID NO: 6981553 - DNA, 22 bp, Homo sapiens
tgctctgaaggggaagggatgg

SEQ ID NO: 6981554 - DNA, 22 bp, Homo sapiens
actgtggccaaagcctctggga

SEQ ID NO: 6981555 - DNA, 22 bp, Homo sapiens
tcatggcacttagtgtctcaaa

SEQ ID NO: 6981556 - DNA, 22 bp, Homo sapiens
acaatcagcactgagtttatct

SEQ ID NO: 6981557 - DNA, 22 bp, Homo sapiens
ttggtaattgtgtttattaaat

SEQ ID NO: 6981558 - DNA, 22 bp, Homo sapiens
ttggcaggatgatagctttgtg

SEQ ID NO: 6981559 - DNA, 22 bp, Homo sapiens
gtcctgagatgtcacaaggttt

SEQ ID NO: 6981560 - DNA, 22 bp, Homo sapiens
aaatctagtacctttttgatta

SEQ ID NO: 6981561 - DNA, 22 bp, Homo sapiens
cagcaagggttatatcaaagat

SEQ ID NO: 6981562 - DNA, 22 bp, Homo sapiens
taaatgcagtacaaattgttct

SEQ ID NO: 6981563 - DNA, 22 bp, Homo sapiens
tgtcccagggaaggcccagcac

SEQ ID NO: 6981564 - DNA, 23 bp, Homo sapiens
tttgggaagggagagagtaagca

SEQ ID NO: 6981565 - DNA, 22 bp, Homo sapiens
agtgctgtccagtttcacaggt

SEQ ID NO: 6981566 - DNA, 22 bp, Homo sapiens
aacagtaggcatcacataatga

SEQ ID NO: 6981567 - DNA, 22 bp, Homo sapiens
atgcaggagagcatgtttaaga

SEQ ID NO: 6981568 - DNA, 23 bp, Homo sapiens
agcatagttgtggggccttttga

SEQ ID NO: 6981569 - DNA, 20 bp, Homo sapiens
tacaatattcccactttgct

SEQ ID NO: 6981570 - DNA, 22 bp, Homo sapiens
aggtccagtgctcttggtggtt

SEQ ID NO: 6981571 - DNA, 22 bp, Homo sapiens
aaggtgtgagacatcctgccat

SEQ ID NO: 6981572 - DNA, 22 bp, Homo sapiens
aagtcagagcaactgagacatt

SEQ ID NO: 6981573 - DNA, 22 bp, Homo sapiens
gaattataaactagtgacttca

SEQ ID NO: 6981574 - DNA, 20 bp, Homo sapiens
tgtattgttattgggacaga

SEQ ID NO: 6981575 - DNA, 22 bp, Homo sapiens
ctccgtggctgtggacgcagcc

SEQ ID NO: 6981576 - DNA, 22 bp, Homo sapiens
cagagagaggtgccgataatgg

SEQ ID NO: 6981577 - DNA, 22 bp, Homo sapiens
acagtctttctacattctgtgc

SEQ ID NO: 6981578 - DNA, 17 bp, Homo sapiens
ttctctgagctgtattg

SEQ ID NO: 6981579 - DNA, 22 bp, Homo sapiens
ccattctgtttaatgaatgaaa

SEQ ID NO: 6981580 - DNA, 22 bp, Homo sapiens
acattgatgtgatgcagaagtg

SEQ ID NO: 6981581 - DNA, 22 bp, Homo sapiens
agcccctgtaccctgagtgctt

SEQ ID NO: 6981582 - DNA, 22 bp, Homo sapiens
agcagtgcttgccttagtgtga

SEQ ID NO: 6981583 - DNA, 22 bp, Homo sapiens
atgttcatagcatcggtattca

SEQ ID NO: 6981584 - DNA, 20 bp, Homo sapiens
gctgaggggtctatggcata

SEQ ID NO: 6981585 - DNA, 22 bp, Homo sapiens
aaagctacctttgtgttcatag

SEQ ID NO: 6981586 - DNA, 22 bp, Homo sapiens
ttctgaaatttctgtagatctt

SEQ ID NO: 6981587 - DNA, 22 bp, Homo sapiens
aggtggagaagagatgggcagt

SEQ ID NO: 6981588 - DNA, 22 bp, Homo sapiens
aaacaaggtacacagtaatggt

SEQ ID NO: 6981589 - DNA, 22 bp, Homo sapiens
atctggctgactttgtgggaca

SEQ ID NO: 6981590 - DNA, 22 bp, Homo sapiens
tcagcagaatgtggcatgtcac

SEQ ID NO: 6981591 - DNA, 22 bp, Homo sapiens
gaggcagcttggggctgtgggt

SEQ ID NO: 6981592 - DNA, 22 bp, Homo sapiens
taagtgggctcaggtgcttgga

SEQ ID NO: 6981593 - DNA, 17 bp, Homo sapiens
tggtggctggagtcagg

SEQ ID NO: 6981594 - DNA, 22 bp, Homo sapiens
agcacctgcttaatgtgcagtg

SEQ ID NO: 6981595 - DNA, 22 bp, Homo sapiens
gtagcagctctgagcatgctgc

SEQ ID NO: 6981596 - DNA, 22 bp, Homo sapiens
acctccatggctcagtttcaga

SEQ ID NO: 6981597 - DNA, 22 bp, Homo sapiens
aggccgaagtggatgggcatct

SEQ ID NO: 6981598 - DNA, 22 bp, Homo sapiens
tctctaaaattcccggccaact

SEQ ID NO: 6981599 - DNA, 22 bp, Homo sapiens
tgggcttcataattggtcctag

SEQ ID NO: 6981600 - DNA, 22 bp, Homo sapiens
ttgcagggacctgcagaaagct

SEQ ID NO: 6981601 - DNA, 22 bp, Homo sapiens
ttgctttagggcaaatatttca

SEQ ID NO: 6981602 - DNA, 22 bp, Homo sapiens
tcagtggtatgcgtgggagctg

SEQ ID NO: 6981603 - DNA, 22 bp, Homo sapiens
caattaaagaagacctgcctca

SEQ ID NO: 6981604 - DNA, 22 bp, Homo sapiens
gtgagaataccagcagtgagaa

SEQ ID NO: 6981605 - DNA, 22 bp, Homo sapiens
gcttaggatgaatgctgtagaa

SEQ ID NO: 6981606 - DNA, 22 bp, Homo sapiens
aagatacaccaagagcctagta

SEQ ID NO: 6981607 - DNA, 22 bp, Homo sapiens
agttgtaacagattctaacata

SEQ ID NO: 6981608 - DNA, 22 bp, Homo sapiens
ctgtgtctcccaaggagggtca

SEQ ID NO: 6981609 - DNA, 22 bp, Homo sapiens
tggagcaaacccatggctgtgc

SEQ ID NO: 6981610 - DNA, 22 bp, Homo sapiens
cagctcagacgcaggtcgagca

SEQ ID NO: 6981611 - DNA, 22 bp, Homo sapiens
atgggctgagaatcaagaatat

SEQ ID NO: 6981612 - DNA, 22 bp, Homo sapiens
actgcaagtcacttggctatgt

SEQ ID NO: 6981613 - DNA, 22 bp, Homo sapiens
atggctccaagatggagagcca

SEQ ID NO: 6981614 - DNA, 22 bp, Homo sapiens
aacactttcctgcctttctgat

SEQ ID NO: 6981615 - DNA, 22 bp, Homo sapiens
tagatgctgtagaaatacttat

SEQ ID NO: 6981616 - DNA, 22 bp, Homo sapiens
acattcattccaggtcagtcag

SEQ ID NO: 6981617 - DNA, 22 bp, Homo sapiens
tcactttttgatatcattctgc

SEQ ID NO: 6981618 - DNA, 20 bp, Homo sapiens
tgggcctctggtgcctctgg

SEQ ID NO: 6981619 - DNA, 22 bp, Homo sapiens
actttgtgcccaacagaaagaa

SEQ ID NO: 6981620 - DNA, 22 bp, Homo sapiens
attgacaggagagcttggagtg

SEQ ID NO: 6981621 - DNA, 23 bp, Homo sapiens
aggcaggcagttcagctgttgtt

SEQ ID NO: 6981622 - DNA, 22 bp, Homo sapiens
tttctggaacagtaattgaaga

SEQ ID NO: 6981623 - DNA, 22 bp, Homo sapiens
gtccctctgctctagagagcca

SEQ ID NO: 6981624 - DNA, 22 bp, Homo sapiens
ttgtattcttccttagcagtac

SEQ ID NO: 6981625 - DNA, 22 bp, Homo sapiens
cccaaccccaacttcctatgtt

SEQ ID NO: 6981626 - DNA, 22 bp, Homo sapiens
ttcagagaaaggaaagccggat

SEQ ID NO: 6981627 - DNA, 22 bp, Homo sapiens
tatgtaaaaattcatcaggctg

SEQ ID NO: 6981628 - DNA, 22 bp, Homo sapiens
aaaaccacaatgacttttgcag

SEQ ID NO: 6981629 - DNA, 22 bp, Homo sapiens
agcaaagtccagtctgtgtaca

SEQ ID NO: 6981630 - DNA, 22 bp, Homo sapiens
agcaggctgggcaatatgggca

SEQ ID NO: 6981631 - DNA, 22 bp, Homo sapiens
gtctaaacttagggatcgaaca

SEQ ID NO: 6981632 - DNA, 19 bp, Homo sapiens
cttccttgctccccatgtg

SEQ ID NO: 6981633 - DNA, 22 bp, Homo sapiens
actcctgggttccggagattct

SEQ ID NO: 6981634 - DNA, 22 bp, Homo sapiens
ctgggctctgcggtgtcgctct

SEQ ID NO: 6981635 - DNA, 22 bp, Homo sapiens
actgttcaagttttatgctgga

SEQ ID NO: 6981636 - DNA, 22 bp, Homo sapiens
gacctcagctgtggggatgctg

SEQ ID NO: 6981637 - DNA, 22 bp, Homo sapiens
catgttggcactgtctctgcct

SEQ ID NO: 6981638 - DNA, 22 bp, Homo sapiens
ttgaggtccctgccttgccttc

SEQ ID NO: 6981639 - DNA, 22 bp, Homo sapiens
ttttctcctttcaagatagcat

SEQ ID NO: 6981640 - DNA, 22 bp, Homo sapiens
gaatacatgatacatgaactgc

SEQ ID NO: 6981641 - DNA, 23 bp, Homo sapiens
atgaggtaaagatcagctttaaa

SEQ ID NO: 6981642 - DNA, 22 bp, Homo sapiens
cacccagagcagacactgtcca

SEQ ID NO: 6981643 - DNA, 22 bp, Homo sapiens
aggtggcaggaggtcagagaaa

SEQ ID NO: 6981644 - DNA, 22 bp, Homo sapiens
agttacaagtacaggctttgga

SEQ ID NO: 6981645 - DNA, 22 bp, Homo sapiens
tagtgatttagaattcaaatgt

SEQ ID NO: 6981646 - DNA, 22 bp, Homo sapiens
tggggctggcacagtctctatt

SEQ ID NO: 6981647 - DNA, 21 bp, Homo sapiens
cctgaccattcagcttgtctt

SEQ ID NO: 6981648 - DNA, 22 bp, Homo sapiens
atagttttatagatattgtgta

SEQ ID NO: 6981649 - DNA, 22 bp, Homo sapiens
gcacccagatagcaaggattag

SEQ ID NO: 6981650 - DNA, 22 bp, Homo sapiens
tacagagttttcctgccaagaa

SEQ ID NO: 6981651 - DNA, 22 bp, Homo sapiens
tgtcctggagttataatgcctg

SEQ ID NO: 6981652 - DNA, 22 bp, Homo sapiens
atatgcttgggactgatacagt

SEQ ID NO: 6981653 - DNA, 22 bp, Homo sapiens
ggaaaacagcgattggtatcat

SEQ ID NO: 6981654 - DNA, 22 bp, Homo sapiens
tctgctttagaatccagtagct

SEQ ID NO: 6981655 - DNA, 22 bp, Homo sapiens
ctgtggcatttagaggttgcgt

SEQ ID NO: 6981656 - DNA, 22 bp, Homo sapiens
tttcatgttagttggttcttgg

SEQ ID NO: 6981657 - DNA, 22 bp, Homo sapiens
gctggctgctaggacagctaca

SEQ ID NO: 6981658 - DNA, 22 bp, Homo sapiens
catgctgtgttacttggcatct

SEQ ID NO: 6981659 - DNA, 22 bp, Homo sapiens
ttcttacagatttggtgaatga

SEQ ID NO: 6981660 - DNA, 22 bp, Homo sapiens
aacttggtaaattgtgtcagat

SEQ ID NO: 6981661 - DNA, 22 bp, Homo sapiens
acctgtttgtgtttggactgca

SEQ ID NO: 6981662 - DNA, 22 bp, Homo sapiens
gctgaaggagcctggggtggga

SEQ ID NO: 6981663 - DNA, 22 bp, Homo sapiens
ttcctggaaattatgctcacct

SEQ ID NO: 6981664 - DNA, 22 bp, Homo sapiens
taggtagttacacagcaatgta

SEQ ID NO: 6981665 - DNA, 22 bp, Homo sapiens
tgaatgaatcctaacaaagaca

SEQ ID NO: 6981666 - DNA, 22 bp, Homo sapiens
caggggctgtttgcctcaggcc

SEQ ID NO: 6981667 - DNA, 22 bp, Homo sapiens
caggatgcactaggaaccaggg

SEQ ID NO: 6981668 - DNA, 22 bp, Homo sapiens
catcagcctggaaggcagcctg

SEQ ID NO: 6981669 - DNA, 23 bp, Homo sapiens
tccggcaacttcactcctcccgc

SEQ ID NO: 6981670 - DNA, 22 bp, Homo sapiens
caaacattgcactttctgctat

SEQ ID NO: 6981671 - DNA, 23 bp, Homo sapiens
cactgcaatctctgcctcctggg

SEQ ID NO: 6981672 - DNA, 22 bp, Homo sapiens
acatttctccctgcatgcctgc

SEQ ID NO: 6981673 - DNA, 22 bp, Homo sapiens
atctgcctgtatttaccatcat

SEQ ID NO: 6981674 - DNA, 22 bp, Homo sapiens
ccctgagctcaggcccttgggg

SEQ ID NO: 6981675 - DNA, 22 bp, Homo sapiens
ctgtgcatggccatcagtgccc

SEQ ID NO: 6981676 - DNA, 20 bp, Homo sapiens
tgaagaggaagaggacggcc

SEQ ID NO: 6981677 - DNA, 22 bp, Homo sapiens
tgtctccagaaagcaccaggag

SEQ ID NO: 6981678 - DNA, 22 bp, Homo sapiens
agtcaagtaggacctgttctag

SEQ ID NO: 6981679 - DNA, 22 bp, Homo sapiens
cctggcacataatagtggctca

SEQ ID NO: 6981680 - DNA, 22 bp, Homo sapiens
cttctaagctgagaatgccttt

SEQ ID NO: 6981681 - DNA, 22 bp, Homo sapiens
agagatattatttaccaagtta

SEQ ID NO: 6981682 - DNA, 22 bp, Homo sapiens
aggcacttgtaattgcagtcat

SEQ ID NO: 6981683 - DNA, 22 bp, Homo sapiens
gatctgtccagaaagtgtgtac

SEQ ID NO: 6981684 - DNA, 22 bp, Homo sapiens
ataaattgtgcttttgacatct

SEQ ID NO: 6981685 - DNA, 22 bp, Homo sapiens
ttttggtgccctggttcccacc

SEQ ID NO: 6981686 - DNA, 22 bp, Homo sapiens
tttcaaaagcgtacgtagtgaa

SEQ ID NO: 6981687 - DNA, 22 bp, Homo sapiens
tacagagggattatctaagggt

SEQ ID NO: 6981688 - DNA, 22 bp, Homo sapiens
atctccagtcctggtttcctgg

SEQ ID NO: 6981689 - DNA, 22 bp, Homo sapiens
gctgcctcaggcacctcctggc

SEQ ID NO: 6981690 - DNA, 22 bp, Homo sapiens
tgtacagtgtagtcatgaggtt

SEQ ID NO: 6981691 - DNA, 22 bp, Homo sapiens
tttggtcctaagctgctctcta

SEQ ID NO: 6981692 - DNA, 21 bp, Homo sapiens
accttctgaattacctaccaa

SEQ ID NO: 6981693 - DNA, 22 bp, Homo sapiens
aattgatgattcttatgtgaaa

SEQ ID NO: 6981694 - DNA, 22 bp, Homo sapiens
aggaattaacaatatatttagg

SEQ ID NO: 6981695 - DNA, 22 bp, Homo sapiens
aatgttcattgattaaatgaat

SEQ ID NO: 6981696 - DNA, 22 bp, Homo sapiens
ggaggagcccactcaaagggga

SEQ ID NO: 6981697 - DNA, 18 bp, Homo sapiens
aaagagccacccagggcc

SEQ ID NO: 6981698 - DNA, 22 bp, Homo sapiens
aggagggcaggctggctgccta

SEQ ID NO: 6981699 - DNA, 22 bp, Homo sapiens
agaggtcactccaccttcttct

SEQ ID NO: 6981700 - DNA, 22 bp, Homo sapiens
tcagtcccttaaaggtggcagc

SEQ ID NO: 6981701 - DNA, 22 bp, Homo sapiens
atggttattggccagatgccat

SEQ ID NO: 6981702 - DNA, 22 bp, Homo sapiens
ttctttggcttacgtctggcct

SEQ ID NO: 6981703 - DNA, 22 bp, Homo sapiens
gcatcccaaatctgaaagtcca

SEQ ID NO: 6981704 - DNA, 22 bp, Homo sapiens
tgcccaagatcctacatcctga

SEQ ID NO: 6981705 - DNA, 22 bp, Homo sapiens
cacatgaagagagtctagtaat

SEQ ID NO: 6981706 - DNA, 22 bp, Homo sapiens
tgtctcagagtatccctgaact

SEQ ID NO: 6981707 - DNA, 22 bp, Homo sapiens
acggaaggctggagaagtacca

SEQ ID NO: 6981708 - DNA, 22 bp, Homo sapiens
gcctgttttcctgctgtggttg

SEQ ID NO: 6981709 - DNA, 22 bp, Homo sapiens
actttctaaaattgctagcact

SEQ ID NO: 6981710 - DNA, 23 bp, Homo sapiens
cagaaatgacagtaagcaccctg

SEQ ID NO: 6981711 - DNA, 22 bp, Homo sapiens
ccaggtctggcactggccagtc

SEQ ID NO: 6981712 - DNA, 22 bp, Homo sapiens
ttgtttctttgaagtttctaga

SEQ ID NO: 6981713 - DNA, 22 bp, Homo sapiens
tttgggcagtgggcttagcggc

SEQ ID NO: 6981714 - DNA, 22 bp, Homo sapiens
tttaacccaaataaccacagga

SEQ ID NO: 6981715 - DNA, 22 bp, Homo sapiens
agttatttaaaatgattgtcct

SEQ ID NO: 6981716 - DNA, 22 bp, Homo sapiens
aaagtacacacagagccaagaa

SEQ ID NO: 6981717 - DNA, 22 bp, Homo sapiens
ttgtgctccctcccgtctggcc

SEQ ID NO: 6981718 - DNA, 22 bp, Homo sapiens
tcagaaatactatcagcttttg

SEQ ID NO: 6981719 - DNA, 22 bp, Homo sapiens
aatgtctctggtttaggatcgc

SEQ ID NO: 6981720 - DNA, 22 bp, Homo sapiens
cagaccagaaggaagccgacaa

SEQ ID NO: 6981721 - DNA, 22 bp, Homo sapiens
agaacatggattgtcaaaggta

SEQ ID NO: 6981722 - DNA, 22 bp, Homo sapiens
tggcttccaaaggaatgggcct

SEQ ID NO: 6981723 - DNA, 22 bp, Homo sapiens
gtggtcagccccggtgagccct

SEQ ID NO: 6981724 - DNA, 22 bp, Homo sapiens
ggaagagaatgatggctatggg

SEQ ID NO: 6981725 - DNA, 18 bp, Homo sapiens
ctgttctagaactcctgt

SEQ ID NO: 6981726 - DNA, 22 bp, Homo sapiens
tgagatgggtgtccagggagga

SEQ ID NO: 6981727 - DNA, 22 bp, Homo sapiens
aatgccatctggtgatgtatta

SEQ ID NO: 6981728 - DNA, 17 bp, Homo sapiens
caggtacattgctactg

SEQ ID NO: 6981729 - DNA, 22 bp, Homo sapiens
cctcattctcgcgtgtgtttct

SEQ ID NO: 6981730 - DNA, 22 bp, Homo sapiens
aggaggaagggaagacaagtaa

SEQ ID NO: 6981731 - DNA, 23 bp, Homo sapiens
cattcctgatatggccacaagag

SEQ ID NO: 6981732 - DNA, 22 bp, Homo sapiens
caccgtttggtttggatttaca

SEQ ID NO: 6981733 - DNA, 22 bp, Homo sapiens
aaagtactgggattacaggtct

SEQ ID NO: 6981734 - DNA, 22 bp, Homo sapiens
tggcaatatgctttcagtggcc

SEQ ID NO: 6981735 - DNA, 22 bp, Homo sapiens
tcctgaagaggctacactgctt

SEQ ID NO: 6981736 - DNA, 22 bp, Homo sapiens
ataccatttccatgttacatta

SEQ ID NO: 6981737 - DNA, 20 bp, Homo sapiens
acctccctctgtgggtggga

SEQ ID NO: 6981738 - DNA, 19 bp, Homo sapiens
tcaaggctccctgagggat

SEQ ID NO: 6981739 - DNA, 22 bp, Homo sapiens
tggccagccctcttcccacact

SEQ ID NO: 6981740 - DNA, 22 bp, Homo sapiens
tggtgttacctattgactgagt

SEQ ID NO: 6981741 - DNA, 22 bp, Homo sapiens
tggtcatttctgggttctgacc

SEQ ID NO: 6981742 - DNA, 22 bp, Homo sapiens
tgctggagatcattaatgttca

SEQ ID NO: 6981743 - DNA, 22 bp, Homo sapiens
cctgcagctgtaggagaaggcg

SEQ ID NO: 6981744 - DNA, 22 bp, Homo sapiens
tggagctggtaaacagtgacat

SEQ ID NO: 6981745 - DNA, 23 bp, Homo sapiens
tctgaccatttgacaacatcctg

SEQ ID NO: 6981746 - DNA, 22 bp, Homo sapiens
gctgtgaatctgaagactaaaa

SEQ ID NO: 6981747 - DNA, 22 bp, Homo sapiens
gttccacagagtctcactatga

SEQ ID NO: 6981748 - DNA, 18 bp, Homo sapiens
gcctgttccctactatcc

SEQ ID NO: 6981749 - DNA, 22 bp, Homo sapiens
atggtttataatctaggtgtga

SEQ ID NO: 6981750 - DNA, 22 bp, Homo sapiens
ttggcacataatttgggaactc

SEQ ID NO: 6981751 - DNA, 22 bp, Homo sapiens
ctgaaacattgcaataacaaag

SEQ ID NO: 6981752 - DNA, 22 bp, Homo sapiens
ttctaggatgctgatgagaccc

SEQ ID NO: 6981753 - DNA, 22 bp, Homo sapiens
cataaagttaagctgtaagtat

SEQ ID NO: 6981754 - DNA, 22 bp, Homo sapiens
tgaaatagtctaaaaaaccaga

SEQ ID NO: 6981755 - DNA, 22 bp, Homo sapiens
tccttcagaacctgtgatggaa

SEQ ID NO: 6981756 - DNA, 20 bp, Homo sapiens
ctaaatgttggaggggcttc

SEQ ID NO: 6981757 - DNA, 20 bp, Homo sapiens
agtgatttgttagtacattg

SEQ ID NO: 6981758 - DNA, 22 bp, Homo sapiens
tggacctgcgtaggtgctgggc

SEQ ID NO: 6981759 - DNA, 22 bp, Homo sapiens
tggtgtgtacatttttgcttct

SEQ ID NO: 6981760 - DNA, 22 bp, Homo sapiens
agttaccacccacaagcttgtt

SEQ ID NO: 6981761 - DNA, 22 bp, Homo sapiens
gcacatgactttgaggaaacca

SEQ ID NO: 6981762 - DNA, 22 bp, Homo sapiens
gctggaggtttcacctgagttt

SEQ ID NO: 6981763 - DNA, 22 bp, Homo sapiens
tgtacaagtgaaagatgtgggc

SEQ ID NO: 6981764 - DNA, 22 bp, Homo sapiens
agctgtgtgtttccactgagct

SEQ ID NO: 6981765 - DNA, 22 bp, Homo sapiens
tgtttaagtgctggtagggttg

SEQ ID NO: 6981766 - DNA, 22 bp, Homo sapiens
tgcttcaaaaggcagcttaatg

SEQ ID NO: 6981767 - DNA, 22 bp, Homo sapiens
tctttgtaagttatatgtagta

SEQ ID NO: 6981768 - DNA, 21 bp, Homo sapiens
tgaatgatgccccagagttgt

SEQ ID NO: 6981769 - DNA, 22 bp, Homo sapiens
aagggctgtagtttgttgatca

SEQ ID NO: 6981770 - DNA, 22 bp, Homo sapiens
cccatatactttttctggtcca

SEQ ID NO: 6981771 - DNA, 22 bp, Homo sapiens
tcttcttcctcatttatacata

SEQ ID NO: 6981772 - DNA, 22 bp, Homo sapiens
tagtcccattttgaggtatttg

SEQ ID NO: 6981773 - DNA, 22 bp, Homo sapiens
cctctctcttgtagtccctgcc

SEQ ID NO: 6981774 - DNA, 22 bp, Homo sapiens
ggggtggggttactcattgtgc

SEQ ID NO: 6981775 - DNA, 22 bp, Homo sapiens
tggtttctcccttcgcagtgag

SEQ ID NO: 6981776 - DNA, 22 bp, Homo sapiens
ttagtgcaattcagagaacaat

SEQ ID NO: 6981777 - DNA, 22 bp, Homo sapiens
gagtctaaggaaaaatagagta

SEQ ID NO: 6981778 - DNA, 22 bp, Homo sapiens
actgaaggaaagcctttgcatg

SEQ ID NO: 6981779 - DNA, 17 bp, Homo sapiens
cacaactggctgattga

SEQ ID NO: 6981780 - DNA, 18 bp, Homo sapiens
gtcacctggatcagatta

SEQ ID NO: 6981781 - DNA, 22 bp, Homo sapiens
gagtacatagagccaggcgtgt

SEQ ID NO: 6981782 - DNA, 22 bp, Homo sapiens
gttggctatagggagatggggc

SEQ ID NO: 6981783 - DNA, 17 bp, Homo sapiens
atttcctgcaagcccct

SEQ ID NO: 6981784 - DNA, 22 bp, Homo sapiens
aataaagcatgaggcatttatc

SEQ ID NO: 6981785 - DNA, 22 bp, Homo sapiens
gctgatgtccctaattagtttt

SEQ ID NO: 6981786 - DNA, 20 bp, Homo sapiens
ggcctctgaggacaaggaga

SEQ ID NO: 6981787 - DNA, 22 bp, Homo sapiens
acagtcagggcttactcaggga

SEQ ID NO: 6981788 - DNA, 22 bp, Homo sapiens
caagggggagatttagggtaat

SEQ ID NO: 6981789 - DNA, 22 bp, Homo sapiens
ggctgggcaaacaagactcttc

SEQ ID NO: 6981790 - DNA, 22 bp, Homo sapiens
agggaagcaggaatagctctga

SEQ ID NO: 6981791 - DNA, 22 bp, Homo sapiens
tttccttcatcatctgagagct

SEQ ID NO: 6981792 - DNA, 19 bp, Homo sapiens
gggagcaggaaagctgtgg

SEQ ID NO: 6981793 - DNA, 22 bp, Homo sapiens
gcaggctcactctgtttggctc

SEQ ID NO: 6981794 - DNA, 22 bp, Homo sapiens
ttcaccatgtaaaccatgtggc

SEQ ID NO: 6981795 - DNA, 22 bp, Homo sapiens
tcagggctcagcatctggcatt

SEQ ID NO: 6981796 - DNA, 22 bp, Homo sapiens
tacatgtttggtaaatgatggc

SEQ ID NO: 6981797 - DNA, 22 bp, Homo sapiens
cacccccagcagggaaaggagg

SEQ ID NO: 6981798 - DNA, 22 bp, Homo sapiens
ttggcccactctcagaatgtgg

SEQ ID NO: 6981799 - DNA, 22 bp, Homo sapiens
atccctgaggttcctcctgagc

SEQ ID NO: 6981800 - DNA, 22 bp, Homo sapiens
tatgtgcacattagagagatgg

SEQ ID NO: 6981801 - DNA, 19 bp, Homo sapiens
ctgacctggctcagcaaag

SEQ ID NO: 6981802 - DNA, 20 bp, Homo sapiens
gctaccagaacaaggccatt

SEQ ID NO: 6981803 - DNA, 22 bp, Homo sapiens
aggtctgagctcagggcctggc

SEQ ID NO: 6981804 - DNA, 23 bp, Homo sapiens
tgctactcaaagtgtggtcccag

SEQ ID NO: 6981805 - DNA, 22 bp, Homo sapiens
aggcaacttgcatctcggcaag

SEQ ID NO: 6981806 - DNA, 22 bp, Homo sapiens
atgctacagccctctttgcata

SEQ ID NO: 6981807 - DNA, 22 bp, Homo sapiens
tggctttaggttgcatgtttct

SEQ ID NO: 6981808 - DNA, 22 bp, Homo sapiens
gctgtggtccctctgtcctcat

SEQ ID NO: 6981809 - DNA, 22 bp, Homo sapiens
tgcggaggtcggtgctgcgggc

SEQ ID NO: 6981810 - DNA, 22 bp, Homo sapiens
ttcagagcagatattgaagggt

SEQ ID NO: 6981811 - DNA, 22 bp, Homo sapiens
ctaggctgcagatgcatggaat

SEQ ID NO: 6981812 - DNA, 21 bp, Homo sapiens
cactgcattaagtctgtaggt

SEQ ID NO: 6981813 - DNA, 22 bp, Homo sapiens
ttagatacattctcatttgttt

SEQ ID NO: 6981814 - DNA, 22 bp, Homo sapiens
gctgctgggatcctgggtctca

SEQ ID NO: 6981815 - DNA, 22 bp, Homo sapiens
tcatttctcctaagtgaaatat

SEQ ID NO: 6981816 - DNA, 22 bp, Homo sapiens
gctctgagctgtcttgcaggtc

SEQ ID NO: 6981817 - DNA, 17 bp, Homo sapiens
gcaggcactgctgcctg

SEQ ID NO: 6981818 - DNA, 22 bp, Homo sapiens
ttccactctccagtcaatttca

SEQ ID NO: 6981819 - DNA, 22 bp, Homo sapiens
atgtcctggcccgaggatggag

SEQ ID NO: 6981820 - DNA, 23 bp, Homo sapiens
aaacttcagtagtgtcatcagcc

SEQ ID NO: 6981821 - DNA, 22 bp, Homo sapiens
acacttgtaatggagaacacta

SEQ ID NO: 6981822 - DNA, 22 bp, Homo sapiens
ttagatcattttagctaaatgg

SEQ ID NO: 6981823 - DNA, 22 bp, Homo sapiens
caagctctgggatagcagagag

SEQ ID NO: 6981824 - DNA, 22 bp, Homo sapiens
aacagctagtggtctagacttt

SEQ ID NO: 6981825 - DNA, 22 bp, Homo sapiens
ggcaaagctgggattcaaaccc

SEQ ID NO: 6981826 - DNA, 22 bp, Homo sapiens
ctctggctttaaggatgccaca

SEQ ID NO: 6981827 - DNA, 22 bp, Homo sapiens
ttggacttaacaaagggtgatg

SEQ ID NO: 6981828 - DNA, 22 bp, Homo sapiens
taggtggtgggatatgagcatc

SEQ ID NO: 6981829 - DNA, 22 bp, Homo sapiens
ttggccacaatccaagccttgg

SEQ ID NO: 6981830 - DNA, 22 bp, Homo sapiens
tacagcacttaattaccttgag

SEQ ID NO: 6981831 - DNA, 21 bp, Homo sapiens
ttcttcagtttaatataaaat

SEQ ID NO: 6981832 - DNA, 22 bp, Homo sapiens
ccagtgctaaggtagcctctgc

SEQ ID NO: 6981833 - DNA, 22 bp, Homo sapiens
tattctgagctgtctcaggttg

SEQ ID NO: 6981834 - DNA, 22 bp, Homo sapiens
ctgggagctggatgccctgccc

SEQ ID NO: 6981835 - DNA, 23 bp, Homo sapiens
tgacacatttcctttccactgca

SEQ ID NO: 6981836 - DNA, 22 bp, Homo sapiens
atgtatcagataaagcatgtgg

SEQ ID NO: 6981837 - DNA, 22 bp, Homo sapiens
aaagtgtaaggaatttaagtaa

SEQ ID NO: 6981838 - DNA, 22 bp, Homo sapiens
acttcccatttctctgctttag

SEQ ID NO: 6981839 - DNA, 16 bp, Homo sapiens
tggggatggggaagag

SEQ ID NO: 6981840 - DNA, 22 bp, Homo sapiens
ataaaaggaaagcctgttgtga

SEQ ID NO: 6981841 - DNA, 22 bp, Homo sapiens
catgtgtttcgagactgttgag

SEQ ID NO: 6981842 - DNA, 16 bp, Homo sapiens
tgcttcttttgcatca

SEQ ID NO: 6981843 - DNA, 22 bp, Homo sapiens
aggacagatttttggccaccag

SEQ ID NO: 6981844 - DNA, 22 bp, Homo sapiens
tgtctgtcagcagtgggtcagg

SEQ ID NO: 6981845 - DNA, 20 bp, Homo sapiens
ctaggcagcgagtgactgag

SEQ ID NO: 6981846 - DNA, 22 bp, Homo sapiens
tggccctgtgtgcaggctgcac

SEQ ID NO: 6981847 - DNA, 22 bp, Homo sapiens
tctaatgctctgagaacagtgc

SEQ ID NO: 6981848 - DNA, 22 bp, Homo sapiens
cggcagagtgtgtgcgtgcatg

SEQ ID NO: 6981849 - DNA, 22 bp, Homo sapiens
attgtataacagcatgtatttt

SEQ ID NO: 6981850 - DNA, 22 bp, Homo sapiens
agagaaggaaagctgacatggg

SEQ ID NO: 6981851 - DNA, 22 bp, Homo sapiens
aatggcaattcagtgaaattat

SEQ ID NO: 6981852 - DNA, 22 bp, Homo sapiens
agtgtctgttgcttttgcagtg

SEQ ID NO: 6981853 - DNA, 22 bp, Homo sapiens
gcttatgatgtttacataaaag

SEQ ID NO: 6981854 - DNA, 22 bp, Homo sapiens
attattcaatcatattaaaagt

SEQ ID NO: 6981855 - DNA, 22 bp, Homo sapiens
attcacagtatggacgaaatga

SEQ ID NO: 6981856 - DNA, 22 bp, Homo sapiens
cccaggagttcgaggctgtagt

SEQ ID NO: 6981857 - DNA, 22 bp, Homo sapiens
cggcttctattaggtcggtgca

SEQ ID NO: 6981858 - DNA, 22 bp, Homo sapiens
ttgggaaagggattatgagtag

SEQ ID NO: 6981859 - DNA, 22 bp, Homo sapiens
tggtatgcaaatgttgggttag

SEQ ID NO: 6981860 - DNA, 22 bp, Homo sapiens
tgcagagtgaagacatcacccc

SEQ ID NO: 6981861 - DNA, 22 bp, Homo sapiens
ttctgctgctgctgcacccaat

SEQ ID NO: 6981862 - DNA, 22 bp, Homo sapiens
ttccagaaacctgaaagtttct

SEQ ID NO: 6981863 - DNA, 22 bp, Homo sapiens
ggacttacagctgatcaccttt

SEQ ID NO: 6981864 - DNA, 22 bp, Homo sapiens
ggacatctgggccccaggtcta

SEQ ID NO: 6981865 - DNA, 20 bp, Homo sapiens
actggacactgaggtgagct

SEQ ID NO: 6981866 - DNA, 22 bp, Homo sapiens
aactccaggtcctttgaatctg

SEQ ID NO: 6981867 - DNA, 22 bp, Homo sapiens
tttatgattattttaaagcagc

SEQ ID NO: 6981868 - DNA, 22 bp, Homo sapiens
tgtgtgtgggcggaacggcccc

SEQ ID NO: 6981869 - DNA, 22 bp, Homo sapiens
tggcattgctagtgacccagca

SEQ ID NO: 6981870 - DNA, 19 bp, Homo sapiens
gaggcagtagtcaaagctt

SEQ ID NO: 6981871 - DNA, 19 bp, Homo sapiens
atagggcaccctaaggagt

SEQ ID NO: 6981872 - DNA, 22 bp, Homo sapiens
tagccaatctgaccagtctttt

SEQ ID NO: 6981873 - DNA, 22 bp, Homo sapiens
tagatgtgttcagttggtgcag

SEQ ID NO: 6981874 - DNA, 22 bp, Homo sapiens
ctgaagttaatcagaggtacaa

SEQ ID NO: 6981875 - DNA, 22 bp, Homo sapiens
ctgactctgcccttcagggcac

SEQ ID NO: 6981876 - DNA, 22 bp, Homo sapiens
aaaggaatgagcttctgttagg

SEQ ID NO: 6981877 - DNA, 22 bp, Homo sapiens
ggtcagggctcttccagtggct

SEQ ID NO: 6981878 - DNA, 22 bp, Homo sapiens
acatgaggaaacaagggtatat

SEQ ID NO: 6981879 - DNA, 22 bp, Homo sapiens
cagcctggtccccggctcaccc

SEQ ID NO: 6981880 - DNA, 21 bp, Homo sapiens
caggaaagaaaacgtacatat

SEQ ID NO: 6981881 - DNA, 22 bp, Homo sapiens
gaggaagatggttgagtggtcc

SEQ ID NO: 6981882 - DNA, 22 bp, Homo sapiens
tttgacctccagaactataaga

SEQ ID NO: 6981883 - DNA, 22 bp, Homo sapiens
tttgtactcaggctcagcctct

SEQ ID NO: 6981884 - DNA, 22 bp, Homo sapiens
aaagtgacaaccagcaggactt

SEQ ID NO: 6981885 - DNA, 22 bp, Homo sapiens
ttttattgtctcccagttctgg

SEQ ID NO: 6981886 - DNA, 22 bp, Homo sapiens
catctgaatttgccttagtttc

SEQ ID NO: 6981887 - DNA, 22 bp, Homo sapiens
gtctgcacgtgccagggagggg

SEQ ID NO: 6981888 - DNA, 20 bp, Homo sapiens
agcctggggaattccacccc

SEQ ID NO: 6981889 - DNA, 22 bp, Homo sapiens
gccagggcaggggagcatctgc

SEQ ID NO: 6981890 - DNA, 21 bp, Homo sapiens
cacaatgttggccaggttggt

SEQ ID NO: 6981891 - DNA, 23 bp, Homo sapiens
tccagggctggccagacctcggt

SEQ ID NO: 6981892 - DNA, 20 bp, Homo sapiens
agaaggctccttttgccaag

SEQ ID NO: 6981893 - DNA, 22 bp, Homo sapiens
ctttttgttgtataagcccttt

SEQ ID NO: 6981894 - DNA, 22 bp, Homo sapiens
ggtggctcggccagtgcaggcc

SEQ ID NO: 6981895 - DNA, 22 bp, Homo sapiens
acgcaatatatggtactagtgc

SEQ ID NO: 6981896 - DNA, 22 bp, Homo sapiens
ggcacagagcaggccactaatc

SEQ ID NO: 6981897 - DNA, 22 bp, Homo sapiens
tagcaagatgtcactccaagtt

SEQ ID NO: 6981898 - DNA, 22 bp, Homo sapiens
ctcccgagttcaagctattttc

SEQ ID NO: 6981899 - DNA, 22 bp, Homo sapiens
agaggccatctgctctgtgggg

SEQ ID NO: 6981900 - DNA, 22 bp, Homo sapiens
aggaaggggagaagttaaagct

SEQ ID NO: 6981901 - DNA, 21 bp, Homo sapiens
tcctggcaggcccaggaccct

SEQ ID NO: 6981902 - DNA, 22 bp, Homo sapiens
aatgtttcaattaagtctttta

SEQ ID NO: 6981903 - DNA, 22 bp, Homo sapiens
agcctggcttagctctctcact

SEQ ID NO: 6981904 - DNA, 22 bp, Homo sapiens
tcgaggcagtgcgctggctgtt

SEQ ID NO: 6981905 - DNA, 22 bp, Homo sapiens
cccagcctctgtttgctcctct

SEQ ID NO: 6981906 - DNA, 22 bp, Homo sapiens
agctcaggccggagctacaggc

SEQ ID NO: 6981907 - DNA, 21 bp, Homo sapiens
attagaaggtatttagggcct

SEQ ID NO: 6981908 - DNA, 22 bp, Homo sapiens
ccagctggtctgtgctcatgtt

SEQ ID NO: 6981909 - DNA, 22 bp, Homo sapiens
aggacaagacaaggaccagaga

SEQ ID NO: 6981910 - DNA, 22 bp, Homo sapiens
atatccttttcggaagagcagc

SEQ ID NO: 6981911 - DNA, 22 bp, Homo sapiens
accagaggcagtttcggctggt

SEQ ID NO: 6981912 - DNA, 22 bp, Homo sapiens
tccaggctcctgactttttggg

SEQ ID NO: 6981913 - DNA, 22 bp, Homo sapiens
taagatgtcatccacatagagt

SEQ ID NO: 6981914 - DNA, 22 bp, Homo sapiens
aggaagtgctaagagaacatca

SEQ ID NO: 6981915 - DNA, 22 bp, Homo sapiens
tgcctagaactttattctttat

SEQ ID NO: 6981916 - DNA, 22 bp, Homo sapiens
attaggaagtaagtatcacaag

SEQ ID NO: 6981917 - DNA, 22 bp, Homo sapiens
acagagtaaatccaagaacgct

SEQ ID NO: 6981918 - DNA, 22 bp, Homo sapiens
tccagccttctcaaggctggct

SEQ ID NO: 6981919 - DNA, 22 bp, Homo sapiens
gcttgtttgtgcctctgcagaa

SEQ ID NO: 6981920 - DNA, 22 bp, Homo sapiens
ggcctctgcaactggctgtggc

SEQ ID NO: 6981921 - DNA, 22 bp, Homo sapiens
cagtcactggttctataggccc

SEQ ID NO: 6981922 - DNA, 22 bp, Homo sapiens
tcaaaacctaggctctctgctt

SEQ ID NO: 6981923 - DNA, 22 bp, Homo sapiens
ctcatacatatgccattcctgc

SEQ ID NO: 6981924 - DNA, 22 bp, Homo sapiens
gccagtgtttatagcagtgagg

SEQ ID NO: 6981925 - DNA, 22 bp, Homo sapiens
cttcctgagcaaggaactatag

SEQ ID NO: 6981926 - DNA, 22 bp, Homo sapiens
ttgatgctagaagtaaaccaag

SEQ ID NO: 6981927 - DNA, 22 bp, Homo sapiens
tcactcaggctggagtgcagtg

SEQ ID NO: 6981928 - DNA, 22 bp, Homo sapiens
ctgttttcaaagagagagaatg

SEQ ID NO: 6981929 - DNA, 22 bp, Homo sapiens
tgccctgccaagaccaagtggt

SEQ ID NO: 6981930 - DNA, 22 bp, Homo sapiens
cagctctggggcagagtgacta

SEQ ID NO: 6981931 - DNA, 22 bp, Homo sapiens
tcacaaaaggccatgtggcttc

SEQ ID NO: 6981932 - DNA, 20 bp, Homo sapiens
aggcagtgtagagatgagta

SEQ ID NO: 6981933 - DNA, 22 bp, Homo sapiens
gtttctcagcatgtcagtacaa

SEQ ID NO: 6981934 - DNA, 22 bp, Homo sapiens
gttaggattatatatcccatga

SEQ ID NO: 6981935 - DNA, 21 bp, Homo sapiens
ttcaatactatttcaatagtc

SEQ ID NO: 6981936 - DNA, 22 bp, Homo sapiens
aggacacagtggtggggaaaag

SEQ ID NO: 6981937 - DNA, 22 bp, Homo sapiens
agcagggctgtgctccttccga

SEQ ID NO: 6981938 - DNA, 22 bp, Homo sapiens
tggtcatttttatttcagttgc

SEQ ID NO: 6981939 - DNA, 22 bp, Homo sapiens
cctctgagaccagctctgcacc

SEQ ID NO: 6981940 - DNA, 22 bp, Homo sapiens
atgtctgataaataatgcataa

SEQ ID NO: 6981941 - DNA, 22 bp, Homo sapiens
aaacttcatggataatataaag

SEQ ID NO: 6981942 - DNA, 22 bp, Homo sapiens
ggccatggttggggaagacatg

SEQ ID NO: 6981943 - DNA, 22 bp, Homo sapiens
tttagagttggtcccctgtgag

SEQ ID NO: 6981944 - DNA, 22 bp, Homo sapiens
aggcattttctgtatggacaga

SEQ ID NO: 6981945 - DNA, 21 bp, Homo sapiens
ccattcttagtcaagtgtctc

SEQ ID NO: 6981946 - DNA, 20 bp, Homo sapiens
tctggtccaggtcttcatgg

SEQ ID NO: 6981947 - DNA, 22 bp, Homo sapiens
cagcacctgctcttagacacgg

SEQ ID NO: 6981948 - DNA, 22 bp, Homo sapiens
atgaggtcatcctggagtaagg

SEQ ID NO: 6981949 - DNA, 22 bp, Homo sapiens
catgaattttaagactgttttt

SEQ ID NO: 6981950 - DNA, 22 bp, Homo sapiens
ggtctgagagccactgaatccc

SEQ ID NO: 6981951 - DNA, 22 bp, Homo sapiens
aagcaataatcccaaagtgctg

SEQ ID NO: 6981952 - DNA, 22 bp, Homo sapiens
gtttacatgcagaaaatcaatg

SEQ ID NO: 6981953 - DNA, 22 bp, Homo sapiens
tcagtagttttaagtctgttaa

SEQ ID NO: 6981954 - DNA, 22 bp, Homo sapiens
actgtgctggagccctctggag

SEQ ID NO: 6981955 - DNA, 22 bp, Homo sapiens
gtctgagaatcttgcatatcat

SEQ ID NO: 6981956 - DNA, 19 bp, Homo sapiens
cacatgagggctgagggac

SEQ ID NO: 6981957 - DNA, 22 bp, Homo sapiens
gtggcagctctcttgatttccc

SEQ ID NO: 6981958 - DNA, 22 bp, Homo sapiens
aagtgtcttaactccttttggg

SEQ ID NO: 6981959 - DNA, 22 bp, Homo sapiens
ttgagaaggtggtcatttgcaa

SEQ ID NO: 6981960 - DNA, 22 bp, Homo sapiens
aggaacccggtctgtcactgtg

SEQ ID NO: 6981961 - DNA, 21 bp, Homo sapiens
tggagagtgatttcagtgtgg

SEQ ID NO: 6981962 - DNA, 22 bp, Homo sapiens
atcctggctttaggtcagaggc

SEQ ID NO: 6981963 - DNA, 22 bp, Homo sapiens
actttgcaaaataatgctgatt

SEQ ID NO: 6981964 - DNA, 22 bp, Homo sapiens
ttacaaagattatattcagtta

SEQ ID NO: 6981965 - DNA, 22 bp, Homo sapiens
ttcaggaaatgtctgcctacca

SEQ ID NO: 6981966 - DNA, 22 bp, Homo sapiens
cttcctcaggcattagctggac

SEQ ID NO: 6981967 - DNA, 22 bp, Homo sapiens
ctgaagaggagaccgcgcccac

SEQ ID NO: 6981968 - DNA, 22 bp, Homo sapiens
aaggcattggactagtatcaga

SEQ ID NO: 6981969 - DNA, 22 bp, Homo sapiens
aactacagtgggcagaggcaat

SEQ ID NO: 6981970 - DNA, 20 bp, Homo sapiens
tccagtgtggggactggggc

SEQ ID NO: 6981971 - DNA, 22 bp, Homo sapiens
tccttagagacaagaccagttt

SEQ ID NO: 6981972 - DNA, 22 bp, Homo sapiens
taggagtaggagtggccatccc

SEQ ID NO: 6981973 - DNA, 22 bp, Homo sapiens
tgaggccccgaagctgaggttt

SEQ ID NO: 6981974 - DNA, 22 bp, Homo sapiens
tcataaagttgttttaatggga

SEQ ID NO: 6981975 - DNA, 22 bp, Homo sapiens
ttgtgctcctgtgagaatctag

SEQ ID NO: 6981976 - DNA, 18 bp, Homo sapiens
gcctttggactgctccca

SEQ ID NO: 6981977 - DNA, 22 bp, Homo sapiens
ttgggctatgttatataatgtt

SEQ ID NO: 6981978 - DNA, 22 bp, Homo sapiens
tgaggctctatgtggtagatta

SEQ ID NO: 6981979 - DNA, 22 bp, Homo sapiens
ctaggaatcaccaagattctag

SEQ ID NO: 6981980 - DNA, 22 bp, Homo sapiens
aagagacttgtccgaagttgta

SEQ ID NO: 6981981 - DNA, 23 bp, Homo sapiens
aactttgccaggagacagcacag

SEQ ID NO: 6981982 - DNA, 22 bp, Homo sapiens
aaaggctcagaatcggcagacc

SEQ ID NO: 6981983 - DNA, 22 bp, Homo sapiens
cccttgagctgtggctgggtga

SEQ ID NO: 6981984 - DNA, 22 bp, Homo sapiens
ctttgaagatggcaaatttaga

SEQ ID NO: 6981985 - DNA, 20 bp, Homo sapiens
gacagcttggggtgtcacct

SEQ ID NO: 6981986 - DNA, 22 bp, Homo sapiens
ctcagcaggcactgtgccttac

SEQ ID NO: 6981987 - DNA, 23 bp, Homo sapiens
agtaaagcaattgttggcgagag

SEQ ID NO: 6981988 - DNA, 22 bp, Homo sapiens
ctgggctgcagcgggagcgacg

SEQ ID NO: 6981989 - DNA, 22 bp, Homo sapiens
gagtccttctggctggcaggat

SEQ ID NO: 6981990 - DNA, 22 bp, Homo sapiens
agatgacatggttcaagtttcc

SEQ ID NO: 6981991 - DNA, 22 bp, Homo sapiens
ttttaatactgctattgtagga

SEQ ID NO: 6981992 - DNA, 19 bp, Homo sapiens
ccctgaggcaaaagccttt

SEQ ID NO: 6981993 - DNA, 22 bp, Homo sapiens
tttattaaaactgttggctctg

SEQ ID NO: 6981994 - DNA, 22 bp, Homo sapiens
caggcataagtaatgttttatg

SEQ ID NO: 6981995 - DNA, 22 bp, Homo sapiens
ttaaaagggatgttatctgtaa

SEQ ID NO: 6981996 - DNA, 22 bp, Homo sapiens
ttctctaaatgtgaaccggctt

SEQ ID NO: 6981997 - DNA, 22 bp, Homo sapiens
aagggagaaagaatgagtttag

SEQ ID NO: 6981998 - DNA, 22 bp, Homo sapiens
gagtaacagcataaatttgtga

SEQ ID NO: 6981999 - DNA, 22 bp, Homo sapiens
tagagatgccctagctgaagta

SEQ ID NO: 6982000 - DNA, 22 bp, Homo sapiens
aatcttcattttgacaagattc

SEQ ID NO: 6982001 - DNA, 22 bp, Homo sapiens
tccaggcatagaaggcacgcac

SEQ ID NO: 6982002 - DNA, 22 bp, Homo sapiens
ctgggctctgcagttgatgttt

SEQ ID NO: 6982003 - DNA, 22 bp, Homo sapiens
gcacatgcagactcattatcta

SEQ ID NO: 6982004 - DNA, 22 bp, Homo sapiens
tgtttttccatgtgcagaacaa

SEQ ID NO: 6982005 - DNA, 19 bp, Homo sapiens
agtcccaggcccgaaagag

SEQ ID NO: 6982006 - DNA, 22 bp, Homo sapiens
tctccctctttgtctgctttgg

SEQ ID NO: 6982007 - DNA, 22 bp, Homo sapiens
tcactacacaatatatttcaga

SEQ ID NO: 6982008 - DNA, 22 bp, Homo sapiens
aaaaacctttcattgcaaatgt

SEQ ID NO: 6982009 - DNA, 22 bp, Homo sapiens
tgtcaagttgttaagttctggg

SEQ ID NO: 6982010 - DNA, 22 bp, Homo sapiens
gtgcaggaggtaacatagcaaa

SEQ ID NO: 6982011 - DNA, 22 bp, Homo sapiens
actaacatttgtgtatgtcttg

SEQ ID NO: 6982012 - DNA, 22 bp, Homo sapiens
atgtttcaataatgctgtgagt

SEQ ID NO: 6982013 - DNA, 22 bp, Homo sapiens
atgtaaggagccacagtggggg

SEQ ID NO: 6982014 - DNA, 22 bp, Homo sapiens
tggtatgcctacctcagccgct

SEQ ID NO: 6982015 - DNA, 22 bp, Homo sapiens
aagactgtatgagacaatataa

SEQ ID NO: 6982016 - DNA, 22 bp, Homo sapiens
ctgaggagaaatgggatggttc

SEQ ID NO: 6982017 - DNA, 22 bp, Homo sapiens
gggcaattaaggtcccgtttcc

SEQ ID NO: 6982018 - DNA, 22 bp, Homo sapiens
gaagttcttagtctcatttgca

SEQ ID NO: 6982019 - DNA, 22 bp, Homo sapiens
gagcctcatggtcatcttgagt

SEQ ID NO: 6982020 - DNA, 22 bp, Homo sapiens
tctcctcaccaccagcagcaga

SEQ ID NO: 6982021 - DNA, 22 bp, Homo sapiens
tactgagggctgtgtatgtatt

SEQ ID NO: 6982022 - DNA, 22 bp, Homo sapiens
aagagaacagtcaccatgcaca

SEQ ID NO: 6982023 - DNA, 22 bp, Homo sapiens
ttactgggaatgttatggagaa

SEQ ID NO: 6982024 - DNA, 22 bp, Homo sapiens
ccacttgaaacttagtggcata

SEQ ID NO: 6982025 - DNA, 22 bp, Homo sapiens
tcagtgtgagtaccatgctcag

SEQ ID NO: 6982026 - DNA, 22 bp, Homo sapiens
tgtgcaactccttccacagaca

SEQ ID NO: 6982027 - DNA, 23 bp, Homo sapiens
catgtgcctgctgtgtggaagcc

SEQ ID NO: 6982028 - DNA, 22 bp, Homo sapiens
gcagtgtgtggtgagggctgcc

SEQ ID NO: 6982029 - DNA, 22 bp, Homo sapiens
gaatgaaaaccttggctcaaat

SEQ ID NO: 6982030 - DNA, 22 bp, Homo sapiens
taagccatacatttcagactct

SEQ ID NO: 6982031 - DNA, 22 bp, Homo sapiens
tacagacaaagagcatgcggta

SEQ ID NO: 6982032 - DNA, 22 bp, Homo sapiens
ctgaggagcgttggtcacgtgt

SEQ ID NO: 6982033 - DNA, 22 bp, Homo sapiens
taatggttttttggagactgct

SEQ ID NO: 6982034 - DNA, 22 bp, Homo sapiens
tccaggctctcaggtgtcagca

SEQ ID NO: 6982035 - DNA, 22 bp, Homo sapiens
ctgtagttgggcattataatag

SEQ ID NO: 6982036 - DNA, 22 bp, Homo sapiens
gatgggtggtctcagacttgcc

SEQ ID NO: 6982037 - DNA, 22 bp, Homo sapiens
ttgggagcatttagaaaagacg

SEQ ID NO: 6982038 - DNA, 22 bp, Homo sapiens
ttattgcaactttagggataga

SEQ ID NO: 6982039 - DNA, 20 bp, Homo sapiens
ggaaaaatgcatgctcaaga

SEQ ID NO: 6982040 - DNA, 22 bp, Homo sapiens
aagctgtggcttggaggaaaca

SEQ ID NO: 6982041 - DNA, 22 bp, Homo sapiens
cagagtcagctagtcttgggat

SEQ ID NO: 6982042 - DNA, 22 bp, Homo sapiens
cagccctggcctcttcgctttc

SEQ ID NO: 6982043 - DNA, 21 bp, Homo sapiens
agaggccctcggactgggcgt

SEQ ID NO: 6982044 - DNA, 22 bp, Homo sapiens
tttgacatctaagaattcttac

SEQ ID NO: 6982045 - DNA, 21 bp, Homo sapiens
taggtgggagccccagtatgc

SEQ ID NO: 6982046 - DNA, 22 bp, Homo sapiens
gtcaaatattatgcagcttgga

SEQ ID NO: 6982047 - DNA, 22 bp, Homo sapiens
tgaccactgaaaacatggctag

SEQ ID NO: 6982048 - DNA, 22 bp, Homo sapiens
tggcatccacaaatgcttagat

SEQ ID NO: 6982049 - DNA, 22 bp, Homo sapiens
tcactagtcatcatatattttt

SEQ ID NO: 6982050 - DNA, 22 bp, Homo sapiens
actggggaatggaactgggaat

SEQ ID NO: 6982051 - DNA, 22 bp, Homo sapiens
ctgatgaggatatagatacaca

SEQ ID NO: 6982052 - DNA, 22 bp, Homo sapiens
cccaaaggcattttgctgacca

SEQ ID NO: 6982053 - DNA, 22 bp, Homo sapiens
ttctgttccctaggacctgggg

SEQ ID NO: 6982054 - DNA, 22 bp, Homo sapiens
tagctttaagacatggtgaatg

SEQ ID NO: 6982055 - DNA, 22 bp, Homo sapiens
caggtgttggaagggcagtggg

SEQ ID NO: 6982056 - DNA, 22 bp, Homo sapiens
cagctttaggactcataataaa

SEQ ID NO: 6982057 - DNA, 22 bp, Homo sapiens
gcttaaaagccacttagtctat

SEQ ID NO: 6982058 - DNA, 22 bp, Homo sapiens
caggttctgggtcctgggtcct

SEQ ID NO: 6982059 - DNA, 22 bp, Homo sapiens
ggcaggtactggggagtgaaga

SEQ ID NO: 6982060 - DNA, 22 bp, Homo sapiens
agccaagagatgaggctgcagg

SEQ ID NO: 6982061 - DNA, 22 bp, Homo sapiens
gtgtctgagtttggaaagtcca

SEQ ID NO: 6982062 - DNA, 22 bp, Homo sapiens
gtttcctataactcaggcacca

SEQ ID NO: 6982063 - DNA, 21 bp, Homo sapiens
actggctggctgagtttcctg

SEQ ID NO: 6982064 - DNA, 22 bp, Homo sapiens
ggcaggaagaggagggtgaact

SEQ ID NO: 6982065 - DNA, 22 bp, Homo sapiens
tctagagatacattggtcattt

SEQ ID NO: 6982066 - DNA, 22 bp, Homo sapiens
aattagagtggcgagtgattta

SEQ ID NO: 6982067 - DNA, 22 bp, Homo sapiens
caggcaagttcatttccaggca

SEQ ID NO: 6982068 - DNA, 22 bp, Homo sapiens
tcaaaattttatttctcaagga

SEQ ID NO: 6982069 - DNA, 22 bp, Homo sapiens
gaacaactcttcttgagagatg

SEQ ID NO: 6982070 - DNA, 22 bp, Homo sapiens
cagtgtttaatcattgtgaatt

SEQ ID NO: 6982071 - DNA, 19 bp, Homo sapiens
tcacagagttcttacggga

SEQ ID NO: 6982072 - DNA, 22 bp, Homo sapiens
agaataatactgaaatgctgaa

SEQ ID NO: 6982073 - DNA, 22 bp, Homo sapiens
agaggcacatggagggtggaag

SEQ ID NO: 6982074 - DNA, 22 bp, Homo sapiens
actataaaaggataaaccagaa

SEQ ID NO: 6982075 - DNA, 22 bp, Homo sapiens
tggtcagttgcatcagagaagt

SEQ ID NO: 6982076 - DNA, 22 bp, Homo sapiens
cctgggctcaagtgatcctcct

SEQ ID NO: 6982077 - DNA, 22 bp, Homo sapiens
ggtctccaaagctgcattgatg

SEQ ID NO: 6982078 - DNA, 18 bp, Homo sapiens
atcctctagcttctcaga

SEQ ID NO: 6982079 - DNA, 22 bp, Homo sapiens
gtggaaggaagagatggcccca

SEQ ID NO: 6982080 - DNA, 22 bp, Homo sapiens
cagcacctacccatcctgagtc

SEQ ID NO: 6982081 - DNA, 22 bp, Homo sapiens
atgtttttggcttcaagtttct

SEQ ID NO: 6982082 - DNA, 22 bp, Homo sapiens
ttatttggcaatgcttcaccat

SEQ ID NO: 6982083 - DNA, 23 bp, Homo sapiens
tcagctgttcttttccctgggac

SEQ ID NO: 6982084 - DNA, 22 bp, Homo sapiens
aaagaaggggtctacatccaat

SEQ ID NO: 6982085 - DNA, 22 bp, Homo sapiens
tgccatttgccccagcactgtc

SEQ ID NO: 6982086 - DNA, 22 bp, Homo sapiens
agtctctgtgagctcccaatgg

SEQ ID NO: 6982087 - DNA, 22 bp, Homo sapiens
ccctcctggaggcggatgccca

SEQ ID NO: 6982088 - DNA, 22 bp, Homo sapiens
agtcactgtcaaagccacacac

SEQ ID NO: 6982089 - DNA, 21 bp, Homo sapiens
tgggccagtagaaaggaaggc

SEQ ID NO: 6982090 - DNA, 22 bp, Homo sapiens
ctggcagaggatggggacccag

SEQ ID NO: 6982091 - DNA, 18 bp, Homo sapiens
taactggtttcttcccat

SEQ ID NO: 6982092 - DNA, 22 bp, Homo sapiens
gaagtttagagtgttgtaattt

SEQ ID NO: 6982093 - DNA, 20 bp, Homo sapiens
atgtttctctgtcgtgattt

SEQ ID NO: 6982094 - DNA, 22 bp, Homo sapiens
atgcaatcatatggcatacagc

SEQ ID NO: 6982095 - DNA, 22 bp, Homo sapiens
atgttatttcaaaattcccttg

SEQ ID NO: 6982096 - DNA, 22 bp, Homo sapiens
attagctgtgacgaggcattgt

SEQ ID NO: 6982097 - DNA, 20 bp, Homo sapiens
agttttcagcagaacaccca

SEQ ID NO: 6982098 - DNA, 22 bp, Homo sapiens
gggttgttggaggtgagtgtta

SEQ ID NO: 6982099 - DNA, 22 bp, Homo sapiens
cagatcaagctgtatggtcaga

SEQ ID NO: 6982100 - DNA, 22 bp, Homo sapiens
atacaagatcactccagaaaat

SEQ ID NO: 6982101 - DNA, 22 bp, Homo sapiens
tgaagccctgtcttatggaaga

SEQ ID NO: 6982102 - DNA, 22 bp, Homo sapiens
atgcagtaaatgttctagtttg

SEQ ID NO: 6982103 - DNA, 22 bp, Homo sapiens
atagaaaacagatgtccttaaa

SEQ ID NO: 6982104 - DNA, 22 bp, Homo sapiens
tgtgtctgtgtatacacggcat

SEQ ID NO: 6982105 - DNA, 22 bp, Homo sapiens
tccctgtccaaagtcttcctat

SEQ ID NO: 6982106 - DNA, 22 bp, Homo sapiens
tgtgagacaattgcatcagggc

SEQ ID NO: 6982107 - DNA, 22 bp, Homo sapiens
agaggaaggatgcatatccaaa

SEQ ID NO: 6982108 - DNA, 22 bp, Homo sapiens
agtatttagagacacaagacgg

SEQ ID NO: 6982109 - DNA, 22 bp, Homo sapiens
gcagagtgaggaagagcttcca

SEQ ID NO: 6982110 - DNA, 22 bp, Homo sapiens
attgttaaaaaggtggaaatgc

SEQ ID NO: 6982111 - DNA, 22 bp, Homo sapiens
atgctaatgagctaaggagtcc

SEQ ID NO: 6982112 - DNA, 22 bp, Homo sapiens
aattggaaaatgctacatatca

SEQ ID NO: 6982113 - DNA, 22 bp, Homo sapiens
caagactcacacacagaagagg

SEQ ID NO: 6982114 - DNA, 22 bp, Homo sapiens
tgctgagacaacaggaaacaag

SEQ ID NO: 6982115 - DNA, 22 bp, Homo sapiens
aggagccacttaggtgagataa

SEQ ID NO: 6982116 - DNA, 22 bp, Homo sapiens
agctgctgagccaggctgatgt

SEQ ID NO: 6982117 - DNA, 19 bp, Homo sapiens
acaatagaaaagtcttttg

SEQ ID NO: 6982118 - DNA, 22 bp, Homo sapiens
cagctgggagctccattagata

SEQ ID NO: 6982119 - DNA, 22 bp, Homo sapiens
ttggcatccactttgcaagttt

SEQ ID NO: 6982120 - DNA, 22 bp, Homo sapiens
ttgctgaagttaatgcttgcaa

SEQ ID NO: 6982121 - DNA, 22 bp, Homo sapiens
attgctttgtacatgcctagca

SEQ ID NO: 6982122 - DNA, 22 bp, Homo sapiens
tcagagtacgcatgctctgatt

SEQ ID NO: 6982123 - DNA, 22 bp, Homo sapiens
aaattgaatgattaagtggtga

SEQ ID NO: 6982124 - DNA, 22 bp, Homo sapiens
ttcccacattctttacattcat

SEQ ID NO: 6982125 - DNA, 22 bp, Homo sapiens
tgtgcgcgtgtatatatgtata

SEQ ID NO: 6982126 - DNA, 22 bp, Homo sapiens
agggcatgaagcagtggacagc

SEQ ID NO: 6982127 - DNA, 22 bp, Homo sapiens
caggccttaaggactcggagaa

SEQ ID NO: 6982128 - DNA, 22 bp, Homo sapiens
acaaatgattttccaagccagt

SEQ ID NO: 6982129 - DNA, 22 bp, Homo sapiens
cacaggcaggaggttctccagt

SEQ ID NO: 6982130 - DNA, 22 bp, Homo sapiens
tctctgttcatggcactatgtc

SEQ ID NO: 6982131 - DNA, 22 bp, Homo sapiens
gctctgggtgaagggtaccatt

SEQ ID NO: 6982132 - DNA, 22 bp, Homo sapiens
tttactgtgtccatctgtgact

SEQ ID NO: 6982133 - DNA, 22 bp, Homo sapiens
atcagcatctttaacaattacc

SEQ ID NO: 6982134 - DNA, 22 bp, Homo sapiens
cgtgattttgttgactggggcc

SEQ ID NO: 6982135 - DNA, 22 bp, Homo sapiens
ttgtctacattttgtggcatgt

SEQ ID NO: 6982136 - DNA, 22 bp, Homo sapiens
tccaggaactgaagccaggtgt

SEQ ID NO: 6982137 - DNA, 22 bp, Homo sapiens
tgtgttcagtatgacattcaca

SEQ ID NO: 6982138 - DNA, 22 bp, Homo sapiens
caacatggcgaaaccccatctc

SEQ ID NO: 6982139 - DNA, 22 bp, Homo sapiens
tatggcaaaactctttatccaa

SEQ ID NO: 6982140 - DNA, 22 bp, Homo sapiens
tccaggaccaaagacacatgta

SEQ ID NO: 6982141 - DNA, 22 bp, Homo sapiens
ctgatatggatgcctcattgtc

SEQ ID NO: 6982142 - DNA, 22 bp, Homo sapiens
gctcttggccaagtggaagggt

SEQ ID NO: 6982143 - DNA, 22 bp, Homo sapiens
ctcaggcagtgccctctggccg

SEQ ID NO: 6982144 - DNA, 22 bp, Homo sapiens
tgaaagggaacctgctggactg

SEQ ID NO: 6982145 - DNA, 22 bp, Homo sapiens
ttacgaatgttagattgcatct

SEQ ID NO: 6982146 - DNA, 22 bp, Homo sapiens
tgctggaatttgccttctggaa

SEQ ID NO: 6982147 - DNA, 22 bp, Homo sapiens
gtgtgcagggggccagcgcagc

SEQ ID NO: 6982148 - DNA, 22 bp, Homo sapiens
agagccttgcctggggccctgt

SEQ ID NO: 6982149 - DNA, 22 bp, Homo sapiens
atatttctgggggtgtgtttct

SEQ ID NO: 6982150 - DNA, 22 bp, Homo sapiens
ttcctgagggccccagaggagg

SEQ ID NO: 6982151 - DNA, 22 bp, Homo sapiens
ccccagaaggggacagagggta

SEQ ID NO: 6982152 - DNA, 22 bp, Homo sapiens
tggaagacaagtgttagcatgg

SEQ ID NO: 6982153 - DNA, 22 bp, Homo sapiens
agtctctggactgggagatggc

SEQ ID NO: 6982154 - DNA, 22 bp, Homo sapiens
gctgcctggagaggcagggatg

SEQ ID NO: 6982155 - DNA, 19 bp, Homo sapiens
acagcaggtgtggggataa

SEQ ID NO: 6982156 - DNA, 23 bp, Homo sapiens
aagctgccttcgcagttggtctg

SEQ ID NO: 6982157 - DNA, 22 bp, Homo sapiens
gaaagtattcacaaagttcttg

SEQ ID NO: 6982158 - DNA, 22 bp, Homo sapiens
aggttaactgggataacacatt

SEQ ID NO: 6982159 - DNA, 22 bp, Homo sapiens
catgagtgtcatctcagcagct

SEQ ID NO: 6982160 - DNA, 23 bp, Homo sapiens
tacctttccctgggagactgctc

SEQ ID NO: 6982161 - DNA, 22 bp, Homo sapiens
tgcctcatttttaagtgttata

SEQ ID NO: 6982162 - DNA, 22 bp, Homo sapiens
cactggttttcaaaccctgggt

SEQ ID NO: 6982163 - DNA, 22 bp, Homo sapiens
ctggctggccatgcagcgccag

SEQ ID NO: 6982164 - DNA, 18 bp, Homo sapiens
cccagcctctcctttcta

SEQ ID NO: 6982165 - DNA, 22 bp, Homo sapiens
tctggcagagtgataggataag

SEQ ID NO: 6982166 - DNA, 22 bp, Homo sapiens
ccctctgactgggccagttctg

SEQ ID NO: 6982167 - DNA, 22 bp, Homo sapiens
aatgatgtcgaaaagtaagctc

SEQ ID NO: 6982168 - DNA, 19 bp, Homo sapiens
tccataatgaagatagagg

SEQ ID NO: 6982169 - DNA, 22 bp, Homo sapiens
tgtgattatttgattaacatgt

SEQ ID NO: 6982170 - DNA, 22 bp, Homo sapiens
tgacccatcaggccacatgagg

SEQ ID NO: 6982171 - DNA, 22 bp, Homo sapiens
aagagtttatgatataacatgt

SEQ ID NO: 6982172 - DNA, 22 bp, Homo sapiens
tttcggaataaatacgaacatc

SEQ ID NO: 6982173 - DNA, 20 bp, Homo sapiens
tgatccggctggaagtgctt

SEQ ID NO: 6982174 - DNA, 22 bp, Homo sapiens
ggatgggagcagaggacgacca

SEQ ID NO: 6982175 - DNA, 22 bp, Homo sapiens
acattttgcccttatttgctga

SEQ ID NO: 6982176 - DNA, 18 bp, Homo sapiens
agaggggaggtaagtctg

SEQ ID NO: 6982177 - DNA, 22 bp, Homo sapiens
atggataagtcaaagagtatcc

SEQ ID NO: 6982178 - DNA, 22 bp, Homo sapiens
gtgattctgaccttcagggagt

SEQ ID NO: 6982179 - DNA, 22 bp, Homo sapiens
atgaacagcattgaaatccagc

SEQ ID NO: 6982180 - DNA, 22 bp, Homo sapiens
atacaggaactctctacacttt

SEQ ID NO: 6982181 - DNA, 22 bp, Homo sapiens
aactgtacgataataaatttgt

SEQ ID NO: 6982182 - DNA, 22 bp, Homo sapiens
ctctcagggacccagccagcct

SEQ ID NO: 6982183 - DNA, 22 bp, Homo sapiens
atttaggaatgttctgcacaaa

SEQ ID NO: 6982184 - DNA, 20 bp, Homo sapiens
atgcattgtgattctgtttt

SEQ ID NO: 6982185 - DNA, 21 bp, Homo sapiens
ttggatgtatttatgttttag

SEQ ID NO: 6982186 - DNA, 22 bp, Homo sapiens
atattaggagttaaatgtatta

SEQ ID NO: 6982187 - DNA, 22 bp, Homo sapiens
ttcacagtgctgcacctggctt

SEQ ID NO: 6982188 - DNA, 22 bp, Homo sapiens
tggactgattttcattttaaat

SEQ ID NO: 6982189 - DNA, 22 bp, Homo sapiens
cctggctcaaggcgaggactcc

SEQ ID NO: 6982190 - DNA, 22 bp, Homo sapiens
gtcctggggaatacagaagccg

SEQ ID NO: 6982191 - DNA, 22 bp, Homo sapiens
tgccttgtggggaaggatttag

SEQ ID NO: 6982192 - DNA, 22 bp, Homo sapiens
cacaatactatttttaggtctt

SEQ ID NO: 6982193 - DNA, 22 bp, Homo sapiens
tcagaccctgcggtgtttggat

SEQ ID NO: 6982194 - DNA, 22 bp, Homo sapiens
tggcttgtacggttgggagaaa

SEQ ID NO: 6982195 - DNA, 22 bp, Homo sapiens
agctgtgggcctgggagagctg

SEQ ID NO: 6982196 - DNA, 21 bp, Homo sapiens
tgggtgggcagagtctcttca

SEQ ID NO: 6982197 - DNA, 22 bp, Homo sapiens
tggcactttgagcaaaggtgca

SEQ ID NO: 6982198 - DNA, 23 bp, Homo sapiens
tgggagttgagtgaggttgcttt

SEQ ID NO: 6982199 - DNA, 22 bp, Homo sapiens
aaagcacatgagtagtgtagta

SEQ ID NO: 6982200 - DNA, 22 bp, Homo sapiens
gacttgggctgagggccagcag

SEQ ID NO: 6982201 - DNA, 22 bp, Homo sapiens
tgctggcttggaaggaaagcgc

SEQ ID NO: 6982202 - DNA, 22 bp, Homo sapiens
ctcctgggaaaggctggacaca

SEQ ID NO: 6982203 - DNA, 22 bp, Homo sapiens
cctggctgagggacctcgggta

SEQ ID NO: 6982204 - DNA, 22 bp, Homo sapiens
accagctgagtaggggagggcc

SEQ ID NO: 6982205 - DNA, 22 bp, Homo sapiens
atcctgaggaaggtgcagagat

SEQ ID NO: 6982206 - DNA, 22 bp, Homo sapiens
gcaaggcctgaggtgggtgctc

SEQ ID NO: 6982207 - DNA, 22 bp, Homo sapiens
ttgaaagtgatggggaagatgg

SEQ ID NO: 6982208 - DNA, 22 bp, Homo sapiens
cctggcttagaggttgcctttc

SEQ ID NO: 6982209 - DNA, 22 bp, Homo sapiens
aaatatacggtccctaacagtc

SEQ ID NO: 6982210 - DNA, 22 bp, Homo sapiens
tgttcccatggatatctgcata

SEQ ID NO: 6982211 - DNA, 22 bp, Homo sapiens
catgtcaagactgaagatccag

SEQ ID NO: 6982212 - DNA, 22 bp, Homo sapiens
gctacaaactgtcatggtgctt

SEQ ID NO: 6982213 - DNA, 22 bp, Homo sapiens
taagccactagtctgttatgaa

SEQ ID NO: 6982214 - DNA, 22 bp, Homo sapiens
cgtcactaccttaatgtatgca

SEQ ID NO: 6982215 - DNA, 22 bp, Homo sapiens
gagctcttgcttctagtccagg

SEQ ID NO: 6982216 - DNA, 22 bp, Homo sapiens
agacactgaatgtttggtggtc

SEQ ID NO: 6982217 - DNA, 21 bp, Homo sapiens
gttctgttgactgtgggcatc

SEQ ID NO: 6982218 - DNA, 22 bp, Homo sapiens
aaggaaagacatataaatgact

SEQ ID NO: 6982219 - DNA, 22 bp, Homo sapiens
tctgcacataggtaggctggaa

SEQ ID NO: 6982220 - DNA, 22 bp, Homo sapiens
ttggaaagcaagctggacatac

SEQ ID NO: 6982221 - DNA, 22 bp, Homo sapiens
tagccactcccttaaggaggtt

SEQ ID NO: 6982222 - DNA, 17 bp, Homo sapiens
gtgtccaggccgatggc

SEQ ID NO: 6982223 - DNA, 22 bp, Homo sapiens
aagtgctgggattacaagcgtg

SEQ ID NO: 6982224 - DNA, 22 bp, Homo sapiens
tcagtcctatccaaactatata

SEQ ID NO: 6982225 - DNA, 22 bp, Homo sapiens
ctcctgtgggtcaccaataggc

SEQ ID NO: 6982226 - DNA, 22 bp, Homo sapiens
aaactctgtatttgctgtgggt

SEQ ID NO: 6982227 - DNA, 22 bp, Homo sapiens
tttgacagcagataaaataaaa

SEQ ID NO: 6982228 - DNA, 21 bp, Homo sapiens
aaccaagccagccagcctctc

SEQ ID NO: 6982229 - DNA, 22 bp, Homo sapiens
ggcttcattttatcttatcatg

SEQ ID NO: 6982230 - DNA, 22 bp, Homo sapiens
ttctggaatactaagttccttt

SEQ ID NO: 6982231 - DNA, 22 bp, Homo sapiens
actttagtaaacttatgttact

SEQ ID NO: 6982232 - DNA, 21 bp, Homo sapiens
agagctcaaggcaaaaataat

SEQ ID NO: 6982233 - DNA, 22 bp, Homo sapiens
gtgagagggctgggctcatgat

SEQ ID NO: 6982234 - DNA, 22 bp, Homo sapiens
ctcccaggactcagaggagaag

SEQ ID NO: 6982235 - DNA, 22 bp, Homo sapiens
ggcttcaggggtctgtctgcac

SEQ ID NO: 6982236 - DNA, 23 bp, Homo sapiens
tgagataggtattattatcatgc

SEQ ID NO: 6982237 - DNA, 22 bp, Homo sapiens
aagcactaatattttggcacct

SEQ ID NO: 6982238 - DNA, 22 bp, Homo sapiens
ttgtacagaaaaaattcttggt

SEQ ID NO: 6982239 - DNA, 22 bp, Homo sapiens
cttaaagatgtcaaggctgttt

SEQ ID NO: 6982240 - DNA, 20 bp, Homo sapiens
atggagtgaagagtgaaagc

SEQ ID NO: 6982241 - DNA, 22 bp, Homo sapiens
aaatcctggcctcaagtggtcc

SEQ ID NO: 6982242 - DNA, 22 bp, Homo sapiens
agatgtttcagtaatttatctt

SEQ ID NO: 6982243 - DNA, 18 bp, Homo sapiens
cagaaatcacaccagcac

SEQ ID NO: 6982244 - DNA, 22 bp, Homo sapiens
ctgcacagtttgatttcttgct

SEQ ID NO: 6982245 - DNA, 22 bp, Homo sapiens
atgtctagagcaagagatgctg

SEQ ID NO: 6982246 - DNA, 22 bp, Homo sapiens
gtgtgtattattgcatacacat

SEQ ID NO: 6982247 - DNA, 22 bp, Homo sapiens
gacagtgttacaatttaatgga

SEQ ID NO: 6982248 - DNA, 22 bp, Homo sapiens
ggcagtcatcccacttggaacc

SEQ ID NO: 6982249 - DNA, 21 bp, Homo sapiens
cctcaaagatgatggggtttc

SEQ ID NO: 6982250 - DNA, 22 bp, Homo sapiens
ctgtgcaatattataaaggcca

SEQ ID NO: 6982251 - DNA, 22 bp, Homo sapiens
tgctttgctttggagagccagc

SEQ ID NO: 6982252 - DNA, 22 bp, Homo sapiens
cttcctgaggtgctgagcacag

SEQ ID NO: 6982253 - DNA, 22 bp, Homo sapiens
agtgagcattcgtttggaaccc

SEQ ID NO: 6982254 - DNA, 22 bp, Homo sapiens
gcagcaatcccaagtctgagtg

SEQ ID NO: 6982255 - DNA, 22 bp, Homo sapiens
acatcttttttctctaattgtg

SEQ ID NO: 6982256 - DNA, 17 bp, Homo sapiens
agctcctgcccatggct

SEQ ID NO: 6982257 - DNA, 22 bp, Homo sapiens
tgggatggagcctgagtatagt

SEQ ID NO: 6982258 - DNA, 22 bp, Homo sapiens
tcacaggacagccttccacccg

SEQ ID NO: 6982259 - DNA, 22 bp, Homo sapiens
ttcagaaaggtaaatggatttc

SEQ ID NO: 6982260 - DNA, 22 bp, Homo sapiens
ccactggagatgtcagacaggt

SEQ ID NO: 6982261 - DNA, 22 bp, Homo sapiens
acttcccaggtggtgtggagtt

SEQ ID NO: 6982262 - DNA, 19 bp, Homo sapiens
ctgtttcaagtaggaggag

SEQ ID NO: 6982263 - DNA, 22 bp, Homo sapiens
gatctctgggtcctgttggcct

SEQ ID NO: 6982264 - DNA, 22 bp, Homo sapiens
tctggcccagcccctgaggtca

SEQ ID NO: 6982265 - DNA, 22 bp, Homo sapiens
catctgtttttgtcaattacat

SEQ ID NO: 6982266 - DNA, 22 bp, Homo sapiens
gtccagccctctgcctccaggt

SEQ ID NO: 6982267 - DNA, 17 bp, Homo sapiens
ccgtccattaaactcat

SEQ ID NO: 6982268 - DNA, 22 bp, Homo sapiens
aagctgcaggttgaatccaggt

SEQ ID NO: 6982269 - DNA, 22 bp, Homo sapiens
agtgccttacaagagtgagggg

SEQ ID NO: 6982270 - DNA, 22 bp, Homo sapiens
agactaaataatgatttactgg

SEQ ID NO: 6982271 - DNA, 22 bp, Homo sapiens
agggaggaccaatgtgtggtta

SEQ ID NO: 6982272 - DNA, 22 bp, Homo sapiens
gagaataaatctaaagtttctt

SEQ ID NO: 6982273 - DNA, 22 bp, Homo sapiens
taggacccctgtggtagatggg

SEQ ID NO: 6982274 - DNA, 22 bp, Homo sapiens
gtaggaattttgtgagctttcc

SEQ ID NO: 6982275 - DNA, 22 bp, Homo sapiens
cagctgctttagttttccatcc

SEQ ID NO: 6982276 - DNA, 22 bp, Homo sapiens
tcctacacagataacagagacg

SEQ ID NO: 6982277 - DNA, 22 bp, Homo sapiens
gaattgtcttggccagtgagaa

SEQ ID NO: 6982278 - DNA, 22 bp, Homo sapiens
gatttctgtaacacttcagata

SEQ ID NO: 6982279 - DNA, 22 bp, Homo sapiens
tttgaaatatgtgatgagagag

SEQ ID NO: 6982280 - DNA, 22 bp, Homo sapiens
gactggttgaactcaggacaga

SEQ ID NO: 6982281 - DNA, 22 bp, Homo sapiens
ttaaagtatagaggacaaaaac

SEQ ID NO: 6982282 - DNA, 22 bp, Homo sapiens
cattgcacttctgcttttcctc

SEQ ID NO: 6982283 - DNA, 22 bp, Homo sapiens
tggccagtcttagctgtgcctg

SEQ ID NO: 6982284 - DNA, 22 bp, Homo sapiens
ttggaaggggcagagtggctgc

SEQ ID NO: 6982285 - DNA, 22 bp, Homo sapiens
acacttgaggaatgtggtgatt

SEQ ID NO: 6982286 - DNA, 22 bp, Homo sapiens
ttaacagagtgcctggcatgta

SEQ ID NO: 6982287 - DNA, 18 bp, Homo sapiens
tgctcagagaaatcaagg

SEQ ID NO: 6982288 - DNA, 22 bp, Homo sapiens
atggagtgggccaattttagtg

SEQ ID NO: 6982289 - DNA, 20 bp, Homo sapiens
tgcctgacttcagcatcagt

SEQ ID NO: 6982290 - DNA, 22 bp, Homo sapiens
ctacttgttcactgtaggtcgc

SEQ ID NO: 6982291 - DNA, 22 bp, Homo sapiens
gtaaaggcccattcaaacagct

SEQ ID NO: 6982292 - DNA, 20 bp, Homo sapiens
actttctcggtttctcacct

SEQ ID NO: 6982293 - DNA, 22 bp, Homo sapiens
ccaggctgtggtttagatagag

SEQ ID NO: 6982294 - DNA, 22 bp, Homo sapiens
ggaatcgggctgaagctagacc

SEQ ID NO: 6982295 - DNA, 22 bp, Homo sapiens
caagttttagcaagtggaaagg

SEQ ID NO: 6982296 - DNA, 22 bp, Homo sapiens
tttctgcttccttgagaaggag

SEQ ID NO: 6982297 - DNA, 20 bp, Homo sapiens
ccttcagatgactttttcag

SEQ ID NO: 6982298 - DNA, 22 bp, Homo sapiens
acacttctctttgaagaacaat

SEQ ID NO: 6982299 - DNA, 22 bp, Homo sapiens
ttgatacaggctctatttcatc

SEQ ID NO: 6982300 - DNA, 21 bp, Homo sapiens
aatgaggcaaggaggaggata

SEQ ID NO: 6982301 - DNA, 22 bp, Homo sapiens
aagccagctccagcatatcact

SEQ ID NO: 6982302 - DNA, 22 bp, Homo sapiens
ctctgagatgataccttctgga

SEQ ID NO: 6982303 - DNA, 22 bp, Homo sapiens
ataatataatcctacttcccat

SEQ ID NO: 6982304 - DNA, 22 bp, Homo sapiens
ccttgagccagggagctggcag

SEQ ID NO: 6982305 - DNA, 22 bp, Homo sapiens
acaggtggaaacatggtgttgg

SEQ ID NO: 6982306 - DNA, 22 bp, Homo sapiens
gcccctgttgtggctttgtcta

SEQ ID NO: 6982307 - DNA, 17 bp, Homo sapiens
gggtgggcactgctggc

SEQ ID NO: 6982308 - DNA, 22 bp, Homo sapiens
gacacagtcaagagtggaggaa

SEQ ID NO: 6982309 - DNA, 22 bp, Homo sapiens
gcagactggtcttcagccttgg

SEQ ID NO: 6982310 - DNA, 21 bp, Homo sapiens
actttgcatctaccttgggtt

SEQ ID NO: 6982311 - DNA, 22 bp, Homo sapiens
tgctttaccttccatttaagga

SEQ ID NO: 6982312 - DNA, 22 bp, Homo sapiens
tccaaagtgttgggattatagg

SEQ ID NO: 6982313 - DNA, 22 bp, Homo sapiens
tgaggcagttcttacttgtatt

SEQ ID NO: 6982314 - DNA, 22 bp, Homo sapiens
tacaggtcttgccatggcaatg

SEQ ID NO: 6982315 - DNA, 22 bp, Homo sapiens
cacctggagtagcaaggtaatt

SEQ ID NO: 6982316 - DNA, 22 bp, Homo sapiens
tactgatattttcaactagaag

SEQ ID NO: 6982317 - DNA, 22 bp, Homo sapiens
ctgaggctttgtgtgcatgcct

SEQ ID NO: 6982318 - DNA, 22 bp, Homo sapiens
tcagagatcttcaggatgggac

SEQ ID NO: 6982319 - DNA, 22 bp, Homo sapiens
agagttcacactcagtgcaccc

SEQ ID NO: 6982320 - DNA, 22 bp, Homo sapiens
aagcagatattgtgggagtggg

SEQ ID NO: 6982321 - DNA, 22 bp, Homo sapiens
cagctatattgttttctactgt

SEQ ID NO: 6982322 - DNA, 19 bp, Homo sapiens
agaaatagccttccttgtc

SEQ ID NO: 6982323 - DNA, 22 bp, Homo sapiens
ttgcagggtcctgtggctctcc

SEQ ID NO: 6982324 - DNA, 22 bp, Homo sapiens
tagtcagtatgaaattgctcaa

SEQ ID NO: 6982325 - DNA, 22 bp, Homo sapiens
atggactcactaattcctccac

SEQ ID NO: 6982326 - DNA, 22 bp, Homo sapiens
gtgtcctgagtgaggcctggcc

SEQ ID NO: 6982327 - DNA, 22 bp, Homo sapiens
acattttacaccaagacttctt

SEQ ID NO: 6982328 - DNA, 22 bp, Homo sapiens
taattcagagtagttgtggagc

SEQ ID NO: 6982329 - DNA, 22 bp, Homo sapiens
tcaggaagcatcctgaggtgtc

SEQ ID NO: 6982330 - DNA, 22 bp, Homo sapiens
ggtccctgcccacctgggagct

SEQ ID NO: 6982331 - DNA, 22 bp, Homo sapiens
attccatttacaaggactagat

SEQ ID NO: 6982332 - DNA, 22 bp, Homo sapiens
gccttgctttgcttctggacag

SEQ ID NO: 6982333 - DNA, 22 bp, Homo sapiens
tacagcgatcagtgtcattagc

SEQ ID NO: 6982334 - DNA, 22 bp, Homo sapiens
aatagatcacagagagctagtg

SEQ ID NO: 6982335 - DNA, 22 bp, Homo sapiens
agtagcagaaggtcttgaaggg

SEQ ID NO: 6982336 - DNA, 22 bp, Homo sapiens
gagctctgggtgtgttgtcagt

SEQ ID NO: 6982337 - DNA, 22 bp, Homo sapiens
ttcatgaatatattgaattagc

SEQ ID NO: 6982338 - DNA, 22 bp, Homo sapiens
aagcttcatctgatgccgaact

SEQ ID NO: 6982339 - DNA, 22 bp, Homo sapiens
tttttccacataccctaggcca

SEQ ID NO: 6982340 - DNA, 21 bp, Homo sapiens
ataaagacaaacactatttgg

SEQ ID NO: 6982341 - DNA, 22 bp, Homo sapiens
tggttgatgtgtctgttttagg

SEQ ID NO: 6982342 - DNA, 22 bp, Homo sapiens
tagttacagcaggcaggatata

SEQ ID NO: 6982343 - DNA, 22 bp, Homo sapiens
ctcataaaagctttgtttacac

SEQ ID NO: 6982344 - DNA, 22 bp, Homo sapiens
ctacaaagaatttctctagctc

SEQ ID NO: 6982345 - DNA, 22 bp, Homo sapiens
cacacagtaggcactcattaat

SEQ ID NO: 6982346 - DNA, 22 bp, Homo sapiens
ctgcagctttggaaacctgttt

SEQ ID NO: 6982347 - DNA, 22 bp, Homo sapiens
cctgtgaccactctggttctgc

SEQ ID NO: 6982348 - DNA, 22 bp, Homo sapiens
aaagcatgttgggtccctcttt

SEQ ID NO: 6982349 - DNA, 22 bp, Homo sapiens
ccagcagctcagctactggtca

SEQ ID NO: 6982350 - DNA, 22 bp, Homo sapiens
ctggagggatgtagggtgtatt

SEQ ID NO: 6982351 - DNA, 22 bp, Homo sapiens
gaagccaagccagctgatggag

SEQ ID NO: 6982352 - DNA, 22 bp, Homo sapiens
taggccacagatgagacataag

SEQ ID NO: 6982353 - DNA, 22 bp, Homo sapiens
tttagcagtgaagtgaagtgaa

SEQ ID NO: 6982354 - DNA, 22 bp, Homo sapiens
tgtacaatctgatgatgtatgg

SEQ ID NO: 6982355 - DNA, 22 bp, Homo sapiens
gctgggcaagtgccttgggttt

SEQ ID NO: 6982356 - DNA, 22 bp, Homo sapiens
gctgctttggggatgaatgaga

SEQ ID NO: 6982357 - DNA, 19 bp, Homo sapiens
gtcccttcactcctgctgg

SEQ ID NO: 6982358 - DNA, 22 bp, Homo sapiens
agcttctcagaagagtcctgta

SEQ ID NO: 6982359 - DNA, 21 bp, Homo sapiens
gcacccagccggttctcccag

SEQ ID NO: 6982360 - DNA, 22 bp, Homo sapiens
gccacagcttagatcacagcct

SEQ ID NO: 6982361 - DNA, 22 bp, Homo sapiens
gagctctgctactcaaagtatg

SEQ ID NO: 6982362 - DNA, 22 bp, Homo sapiens
aagctgtatgttaccactgtca

SEQ ID NO: 6982363 - DNA, 22 bp, Homo sapiens
tatttcagccctactacttggc

SEQ ID NO: 6982364 - DNA, 20 bp, Homo sapiens
agcaggaatgatgctttcat

SEQ ID NO: 6982365 - DNA, 22 bp, Homo sapiens
tgcctaggtcacacctcatacc

SEQ ID NO: 6982366 - DNA, 22 bp, Homo sapiens
tataaatctttgttcctagaat

SEQ ID NO: 6982367 - DNA, 22 bp, Homo sapiens
cttcacaaatggcctagagttc

SEQ ID NO: 6982368 - DNA, 22 bp, Homo sapiens
atcacagagattgcttttaaaa

SEQ ID NO: 6982369 - DNA, 22 bp, Homo sapiens
cactggaatggatagagcagag

SEQ ID NO: 6982370 - DNA, 22 bp, Homo sapiens
tgctgagaggaaggtgcactgg

SEQ ID NO: 6982371 - DNA, 22 bp, Homo sapiens
acagggcctggctccaaaagat

SEQ ID NO: 6982372 - DNA, 18 bp, Homo sapiens
aggtctgaggaagagcct

SEQ ID NO: 6982373 - DNA, 22 bp, Homo sapiens
gtttgtttatacaaaagatcct

SEQ ID NO: 6982374 - DNA, 22 bp, Homo sapiens
taggatatggtagaaatcattc

SEQ ID NO: 6982375 - DNA, 22 bp, Homo sapiens
tctggaagtcccttgatgccag

SEQ ID NO: 6982376 - DNA, 22 bp, Homo sapiens
tagctagtgtttggagatggat

SEQ ID NO: 6982377 - DNA, 23 bp, Homo sapiens
tttcagttgagaatgcacggacc

SEQ ID NO: 6982378 - DNA, 22 bp, Homo sapiens
gtgccaggtgctaagctgtgct

SEQ ID NO: 6982379 - DNA, 22 bp, Homo sapiens
gtcttctttgtcatcttaggtt

SEQ ID NO: 6982380 - DNA, 20 bp, Homo sapiens
tatcatgtttctagaccttt

SEQ ID NO: 6982381 - DNA, 21 bp, Homo sapiens
gctttgatgctgccttgctcc

SEQ ID NO: 6982382 - DNA, 22 bp, Homo sapiens
actgtgtttcacctgagtatgg

SEQ ID NO: 6982383 - DNA, 21 bp, Homo sapiens
acactgtgtcataatgcttaa

SEQ ID NO: 6982384 - DNA, 22 bp, Homo sapiens
gaggctgagactctgaattttt

SEQ ID NO: 6982385 - DNA, 22 bp, Homo sapiens
tgcttgtgtgagggcctgggag

SEQ ID NO: 6982386 - DNA, 22 bp, Homo sapiens
tgcagggtcccgaagggaagac

SEQ ID NO: 6982387 - DNA, 22 bp, Homo sapiens
gctgtagatggactggcatcca

SEQ ID NO: 6982388 - DNA, 22 bp, Homo sapiens
ttgaaaggtgaacatgatgcac

SEQ ID NO: 6982389 - DNA, 22 bp, Homo sapiens
actgtgagcagcgacctgagga

SEQ ID NO: 6982390 - DNA, 22 bp, Homo sapiens
tgctcctggactggtgtgagat

SEQ ID NO: 6982391 - DNA, 22 bp, Homo sapiens
tgtcagcatcatttgttgaagg

SEQ ID NO: 6982392 - DNA, 22 bp, Homo sapiens
ggtctggagctaatcttgttgg

SEQ ID NO: 6982393 - DNA, 22 bp, Homo sapiens
gggtctctctcggctccacgcg

SEQ ID NO: 6982394 - DNA, 22 bp, Homo sapiens
aaatgtctatctggcatattcc

SEQ ID NO: 6982395 - DNA, 22 bp, Homo sapiens
aaattgttgatctacagtaagg

SEQ ID NO: 6982396 - DNA, 22 bp, Homo sapiens
tcagagaaggaggcacgagggc

SEQ ID NO: 6982397 - DNA, 22 bp, Homo sapiens
gcctgctgagggaagttgggca

SEQ ID NO: 6982398 - DNA, 22 bp, Homo sapiens
gcctggcagggcccggacggca

SEQ ID NO: 6982399 - DNA, 22 bp, Homo sapiens
gccaagggtagtggaggcccct

SEQ ID NO: 6982400 - DNA, 22 bp, Homo sapiens
aagtcttacataaacaggaaat

SEQ ID NO: 6982401 - DNA, 22 bp, Homo sapiens
cccaggagaatataatgttctt

SEQ ID NO: 6982402 - DNA, 22 bp, Homo sapiens
ttggtcctggtctaggcagagt

SEQ ID NO: 6982403 - DNA, 22 bp, Homo sapiens
gtgggcagattaatttctcaat

SEQ ID NO: 6982404 - DNA, 22 bp, Homo sapiens
tgtgtcagaaatcagtgcctcg

SEQ ID NO: 6982405 - DNA, 22 bp, Homo sapiens
tagaaatgttggtattaacatt

SEQ ID NO: 6982406 - DNA, 21 bp, Homo sapiens
ggccttgtaacagagttgacc

SEQ ID NO: 6982407 - DNA, 22 bp, Homo sapiens
gtgagtctttggagacagttca

SEQ ID NO: 6982408 - DNA, 22 bp, Homo sapiens
tgcataatgctggacttttcaa

SEQ ID NO: 6982409 - DNA, 22 bp, Homo sapiens
ttccccaggggctcctgccttt

SEQ ID NO: 6982410 - DNA, 22 bp, Homo sapiens
gttgggaacatgacctaatggt

SEQ ID NO: 6982411 - DNA, 22 bp, Homo sapiens
aaagagatgtgccaaatagcct

SEQ ID NO: 6982412 - DNA, 22 bp, Homo sapiens
agcattcatgatgacaacagga

SEQ ID NO: 6982413 - DNA, 22 bp, Homo sapiens
tttcaaggccttctggttcagt

SEQ ID NO: 6982414 - DNA, 22 bp, Homo sapiens
taacagaatcctgttattgcca

SEQ ID NO: 6982415 - DNA, 21 bp, Homo sapiens
tttgggcttttactggacgtg

SEQ ID NO: 6982416 - DNA, 22 bp, Homo sapiens
tgaaggaaatgacggcagaaga

SEQ ID NO: 6982417 - DNA, 22 bp, Homo sapiens
tgaggaacagagaggtaaaata

SEQ ID NO: 6982418 - DNA, 19 bp, Homo sapiens
atcttacagagcagagtac

SEQ ID NO: 6982419 - DNA, 22 bp, Homo sapiens
agctgctccctatcctttcctt

SEQ ID NO: 6982420 - DNA, 22 bp, Homo sapiens
agctgggttcagaggcacatgg

SEQ ID NO: 6982421 - DNA, 22 bp, Homo sapiens
cccagctctctgctcttagcct

SEQ ID NO: 6982422 - DNA, 22 bp, Homo sapiens
ctgaggtgatggcccgttttcc

SEQ ID NO: 6982423 - DNA, 22 bp, Homo sapiens
gaaacctacctgaaatgaattg

SEQ ID NO: 6982424 - DNA, 22 bp, Homo sapiens
ttatttgggtttgagtgtggca

SEQ ID NO: 6982425 - DNA, 22 bp, Homo sapiens
gctgcctctgcacagctcactc

SEQ ID NO: 6982426 - DNA, 22 bp, Homo sapiens
ttgatacccaagtgttatgggt

SEQ ID NO: 6982427 - DNA, 22 bp, Homo sapiens
taagcttcaaagaacatattgg

SEQ ID NO: 6982428 - DNA, 22 bp, Homo sapiens
catgcatatgtcaaaaaagcta

SEQ ID NO: 6982429 - DNA, 22 bp, Homo sapiens
ttcatagtgattgttcagatag

SEQ ID NO: 6982430 - DNA, 22 bp, Homo sapiens
agcctggaattaaggaaatgca

SEQ ID NO: 6982431 - DNA, 22 bp, Homo sapiens
tcagcctggcaggatggcctgg

SEQ ID NO: 6982432 - DNA, 22 bp, Homo sapiens
taccaggagcccccttctggtc

SEQ ID NO: 6982433 - DNA, 22 bp, Homo sapiens
atatacactccactgatacagg

SEQ ID NO: 6982434 - DNA, 22 bp, Homo sapiens
taatttatggtatgtgtgtaat

SEQ ID NO: 6982435 - DNA, 22 bp, Homo sapiens
agcaggcactatgccaggatct

SEQ ID NO: 6982436 - DNA, 22 bp, Homo sapiens
tttttgctgataagcagaattc

SEQ ID NO: 6982437 - DNA, 19 bp, Homo sapiens
aggtccctgtcacctctca

SEQ ID NO: 6982438 - DNA, 22 bp, Homo sapiens
attggagaagaacatgaattag

SEQ ID NO: 6982439 - DNA, 22 bp, Homo sapiens
tctgggtttgaagtagagccca

SEQ ID NO: 6982440 - DNA, 22 bp, Homo sapiens
ccagggactttgcattgtttat

SEQ ID NO: 6982441 - DNA, 22 bp, Homo sapiens
ggccacaagtggtcctgagtcc

SEQ ID NO: 6982442 - DNA, 22 bp, Homo sapiens
acagggagtctgaggggatagt

SEQ ID NO: 6982443 - DNA, 19 bp, Homo sapiens
tgtctagctgcacagctga

SEQ ID NO: 6982444 - DNA, 22 bp, Homo sapiens
agtcacatagtgttttggaatc

SEQ ID NO: 6982445 - DNA, 18 bp, Homo sapiens
gctgctggtggagggagc

SEQ ID NO: 6982446 - DNA, 19 bp, Homo sapiens
tggaggcctcaggaaaaga

SEQ ID NO: 6982447 - DNA, 22 bp, Homo sapiens
tctgtggctgtctttccagagg

SEQ ID NO: 6982448 - DNA, 22 bp, Homo sapiens
tatggttatgtaatcagttgtt

SEQ ID NO: 6982449 - DNA, 22 bp, Homo sapiens
tcctgagatgctgatttcgggg

SEQ ID NO: 6982450 - DNA, 20 bp, Homo sapiens
ggagggtggaagaaagcaag

SEQ ID NO: 6982451 - DNA, 22 bp, Homo sapiens
agtagatttttgaatgtaagtt

SEQ ID NO: 6982452 - DNA, 22 bp, Homo sapiens
gacttcaaacagttaaaggcta

SEQ ID NO: 6982453 - DNA, 20 bp, Homo sapiens
aactcagagatgaaaaagac

SEQ ID NO: 6982454 - DNA, 22 bp, Homo sapiens
aatggtttggactattcaatag

SEQ ID NO: 6982455 - DNA, 19 bp, Homo sapiens
ctctgcatatgtgaggata

SEQ ID NO: 6982456 - DNA, 22 bp, Homo sapiens
tggctgcctgaatgcaagacag

SEQ ID NO: 6982457 - DNA, 22 bp, Homo sapiens
cttctgtgaccaccagcagccc

SEQ ID NO: 6982458 - DNA, 22 bp, Homo sapiens
tctgggtggctgccaatctgcc

SEQ ID NO: 6982459 - DNA, 22 bp, Homo sapiens
gctgggagcaaagccatgcata

SEQ ID NO: 6982460 - DNA, 22 bp, Homo sapiens
tttaggccagatttatttgaca

SEQ ID NO: 6982461 - DNA, 22 bp, Homo sapiens
tgactttaataggattttgcat

SEQ ID NO: 6982462 - DNA, 22 bp, Homo sapiens
cggcagcaaaggaagccaggtc

SEQ ID NO: 6982463 - DNA, 22 bp, Homo sapiens
gagataaatttttgataaatat

SEQ ID NO: 6982464 - DNA, 22 bp, Homo sapiens
agcagcatctcttattgcagtg

SEQ ID NO: 6982465 - DNA, 22 bp, Homo sapiens
aattagaagggagttattgata

SEQ ID NO: 6982466 - DNA, 22 bp, Homo sapiens
gctcatttctgtttcttgcaac

SEQ ID NO: 6982467 - DNA, 22 bp, Homo sapiens
caaagattttagaatttgcaat

SEQ ID NO: 6982468 - DNA, 22 bp, Homo sapiens
tcattgagttcaaatccttcat

SEQ ID NO: 6982469 - DNA, 22 bp, Homo sapiens
tgctcccaggactcttgagcca

SEQ ID NO: 6982470 - DNA, 22 bp, Homo sapiens
ggaggctccatgagctcctgca

SEQ ID NO: 6982471 - DNA, 22 bp, Homo sapiens
atagaagtatcaagatcttgaa

SEQ ID NO: 6982472 - DNA, 22 bp, Homo sapiens
aatttcagaccatttgcaatta

SEQ ID NO: 6982473 - DNA, 22 bp, Homo sapiens
atccatttgacataatttcagc

SEQ ID NO: 6982474 - DNA, 22 bp, Homo sapiens
taagctctgttatccagagccc

SEQ ID NO: 6982475 - DNA, 22 bp, Homo sapiens
aagcaataaataatttttagta

SEQ ID NO: 6982476 - DNA, 22 bp, Homo sapiens
gacaacagtggtttcaggttcc

SEQ ID NO: 6982477 - DNA, 22 bp, Homo sapiens
tcccaggacccaggcattcaca

SEQ ID NO: 6982478 - DNA, 22 bp, Homo sapiens
acagttaggcacgggtacagca

SEQ ID NO: 6982479 - DNA, 22 bp, Homo sapiens
gtgcagtgaccctggagagctg

SEQ ID NO: 6982480 - DNA, 22 bp, Homo sapiens
tcaacctatgagagagtctgtt

SEQ ID NO: 6982481 - DNA, 22 bp, Homo sapiens
cttccaaaatttatatgttgaa

SEQ ID NO: 6982482 - DNA, 22 bp, Homo sapiens
tacagatgaggaaactgaggca

SEQ ID NO: 6982483 - DNA, 22 bp, Homo sapiens
gccattcatattttagcattaa

SEQ ID NO: 6982484 - DNA, 22 bp, Homo sapiens
cttgcctgtggctagttggctc

SEQ ID NO: 6982485 - DNA, 17 bp, Homo sapiens
atggcttccattgacca

SEQ ID NO: 6982486 - DNA, 22 bp, Homo sapiens
gccttccacgtcaggggaaata

SEQ ID NO: 6982487 - DNA, 22 bp, Homo sapiens
acaaagctagagaagagaattg

SEQ ID NO: 6982488 - DNA, 22 bp, Homo sapiens
atcagaatgttttggtgtgctc

SEQ ID NO: 6982489 - DNA, 22 bp, Homo sapiens
tgcttcctgctaaggctgcctg

SEQ ID NO: 6982490 - DNA, 22 bp, Homo sapiens
aagatgcagctttacaataagg

SEQ ID NO: 6982491 - DNA, 22 bp, Homo sapiens
tggcttccagagctgctccacc

SEQ ID NO: 6982492 - DNA, 22 bp, Homo sapiens
ttcattaagtataaaatgtggt

SEQ ID NO: 6982493 - DNA, 22 bp, Homo sapiens
caagatatgtcctgttactaag

SEQ ID NO: 6982494 - DNA, 22 bp, Homo sapiens
ttttccaaattagaagtagaga

SEQ ID NO: 6982495 - DNA, 18 bp, Homo sapiens
tgggatggagagtaactg

SEQ ID NO: 6982496 - DNA, 22 bp, Homo sapiens
gcttctaattcactttgggaag

SEQ ID NO: 6982497 - DNA, 23 bp, Homo sapiens
agctgagaataaggagccgtttg

SEQ ID NO: 6982498 - DNA, 22 bp, Homo sapiens
ccacaaagaatgggggaagcat

SEQ ID NO: 6982499 - DNA, 22 bp, Homo sapiens
aggtggtgtttggttacatgag

SEQ ID NO: 6982500 - DNA, 22 bp, Homo sapiens
cttttgttaggagaaaacatca

SEQ ID NO: 6982501 - DNA, 22 bp, Homo sapiens
gtccagagtagtcgagtattct

SEQ ID NO: 6982502 - DNA, 22 bp, Homo sapiens
tctgccatcttacatggtcact

SEQ ID NO: 6982503 - DNA, 22 bp, Homo sapiens
aagctgaaaatgagactctaca

SEQ ID NO: 6982504 - DNA, 22 bp, Homo sapiens
tggcctgctttcttaggtgttc

SEQ ID NO: 6982505 - DNA, 22 bp, Homo sapiens
aaatagttgtttggatcaataa

SEQ ID NO: 6982506 - DNA, 17 bp, Homo sapiens
ttcattaataaaagcaa

SEQ ID NO: 6982507 - DNA, 22 bp, Homo sapiens
tgaggcctggagggaggagttt

SEQ ID NO: 6982508 - DNA, 20 bp, Homo sapiens
tgcaaacattacttgggtgt

SEQ ID NO: 6982509 - DNA, 22 bp, Homo sapiens
aggtgtccaggaagatgctggc

SEQ ID NO: 6982510 - DNA, 20 bp, Homo sapiens
acacatgtcaagctaaaggc

SEQ ID NO: 6982511 - DNA, 22 bp, Homo sapiens
gtgtccttttatgtgactggtt

SEQ ID NO: 6982512 - DNA, 22 bp, Homo sapiens
ctccaggcccacggccgcggcc

SEQ ID NO: 6982513 - DNA, 22 bp, Homo sapiens
tccttatatggcagacagcaga

SEQ ID NO: 6982514 - DNA, 22 bp, Homo sapiens
tctgaaattttagttatagaaa

SEQ ID NO: 6982515 - DNA, 22 bp, Homo sapiens
agtcctagggtctgcgggctgg

SEQ ID NO: 6982516 - DNA, 22 bp, Homo sapiens
tttctgtaaggacttaatgcaa

SEQ ID NO: 6982517 - DNA, 22 bp, Homo sapiens
tgcctgccacgcttgctaccac

SEQ ID NO: 6982518 - DNA, 18 bp, Homo sapiens
agaccagacaagaatggt

SEQ ID NO: 6982519 - DNA, 22 bp, Homo sapiens
gcgcgggcaggccttccgagtg

SEQ ID NO: 6982520 - DNA, 22 bp, Homo sapiens
tcttagcaaatactacttagaa

SEQ ID NO: 6982521 - DNA, 22 bp, Homo sapiens
aacatgatgacattgtaagctt

SEQ ID NO: 6982522 - DNA, 22 bp, Homo sapiens
tttaatgtattctttggaacca

SEQ ID NO: 6982523 - DNA, 21 bp, Homo sapiens
tctctgggccctcctgtgggg

SEQ ID NO: 6982524 - DNA, 22 bp, Homo sapiens
ttcattctttgaatctgaggta

SEQ ID NO: 6982525 - DNA, 22 bp, Homo sapiens
caagcagggagcatcaagggag

SEQ ID NO: 6982526 - DNA, 22 bp, Homo sapiens
gtgtccatcagcagccactgtg

SEQ ID NO: 6982527 - DNA, 22 bp, Homo sapiens
ccttgaaaccctgacactctgt

SEQ ID NO: 6982528 - DNA, 22 bp, Homo sapiens
agggctgaaacataatccttct

SEQ ID NO: 6982529 - DNA, 22 bp, Homo sapiens
tcttattggataaaaggaaacc

SEQ ID NO: 6982530 - DNA, 22 bp, Homo sapiens
tcagtgtctatagataaggttt

SEQ ID NO: 6982531 - DNA, 22 bp, Homo sapiens
gcctccaccgaacgctctcttg

SEQ ID NO: 6982532 - DNA, 21 bp, Homo sapiens
agacttctagaagtgagatag

SEQ ID NO: 6982533 - DNA, 22 bp, Homo sapiens
cagatgcttcgtgggtgagcac

SEQ ID NO: 6982534 - DNA, 20 bp, Homo sapiens
tgcacagacaatgagcccag

SEQ ID NO: 6982535 - DNA, 22 bp, Homo sapiens
ggaccacaatatttgtgaggtt

SEQ ID NO: 6982536 - DNA, 22 bp, Homo sapiens
cagcagagctgggctttgaatt

SEQ ID NO: 6982537 - DNA, 22 bp, Homo sapiens
tcttccagatggttctttagct

SEQ ID NO: 6982538 - DNA, 17 bp, Homo sapiens
tactgaggggtctggag

SEQ ID NO: 6982539 - DNA, 22 bp, Homo sapiens
ttccaaggctctcttcccacaa

SEQ ID NO: 6982540 - DNA, 22 bp, Homo sapiens
catctgttgcttcctaacaagt

SEQ ID NO: 6982541 - DNA, 22 bp, Homo sapiens
agccaccctaccagccctgaaa

SEQ ID NO: 6982542 - DNA, 22 bp, Homo sapiens
ctctagcaggtgccttgtaaca

SEQ ID NO: 6982543 - DNA, 19 bp, Homo sapiens
aatgtcctcctctcttttc

SEQ ID NO: 6982544 - DNA, 22 bp, Homo sapiens
tctcctggatggaccttctctt

SEQ ID NO: 6982545 - DNA, 22 bp, Homo sapiens
cacagcttcttccattccactc

SEQ ID NO: 6982546 - DNA, 22 bp, Homo sapiens
atttgtagtgaagtgaaaataa

SEQ ID NO: 6982547 - DNA, 22 bp, Homo sapiens
aggagctaattcataagccact

SEQ ID NO: 6982548 - DNA, 22 bp, Homo sapiens
tctgttcctcaaggtctgtgtg

SEQ ID NO: 6982549 - DNA, 22 bp, Homo sapiens
gcttcccctccaagcactgcct

SEQ ID NO: 6982550 - DNA, 22 bp, Homo sapiens
tctttggaaatgctttgagaat

SEQ ID NO: 6982551 - DNA, 22 bp, Homo sapiens
ctggcgagggtcgctggggact

SEQ ID NO: 6982552 - DNA, 22 bp, Homo sapiens
aagccttcagtccgttgcagag

SEQ ID NO: 6982553 - DNA, 22 bp, Homo sapiens
ttgatcttacagtgttcttcca

SEQ ID NO: 6982554 - DNA, 22 bp, Homo sapiens
gcttcaggctgaattcctccta

SEQ ID NO: 6982555 - DNA, 22 bp, Homo sapiens
agctgtctgtctcctgaggaga

SEQ ID NO: 6982556 - DNA, 22 bp, Homo sapiens
aaaggattagagataccatgcc

SEQ ID NO: 6982557 - DNA, 18 bp, Homo sapiens
gtcctgagctctgctgta

SEQ ID NO: 6982558 - DNA, 22 bp, Homo sapiens
aacatgtagcagaaacgactaa

SEQ ID NO: 6982559 - DNA, 22 bp, Homo sapiens
ctcagaaaggtgccatttatgt

SEQ ID NO: 6982560 - DNA, 22 bp, Homo sapiens
ggctcaggtttaaagtgcttta

SEQ ID NO: 6982561 - DNA, 22 bp, Homo sapiens
gatactcttcaggtcttgcaga

SEQ ID NO: 6982562 - DNA, 22 bp, Homo sapiens
gctgaaatcccagcattcccca

SEQ ID NO: 6982563 - DNA, 22 bp, Homo sapiens
ctgggatgtctatagaacactt

SEQ ID NO: 6982564 - DNA, 22 bp, Homo sapiens
tgaaatagacacagtgctatac

SEQ ID NO: 6982565 - DNA, 22 bp, Homo sapiens
tgtgcgggtgcgcatgcagagg

SEQ ID NO: 6982566 - DNA, 22 bp, Homo sapiens
tttcctggtttgaagcagcagc

SEQ ID NO: 6982567 - DNA, 22 bp, Homo sapiens
cctgagggcgccgagctcccag

SEQ ID NO: 6982568 - DNA, 22 bp, Homo sapiens
caggaaatgtataattttataa

SEQ ID NO: 6982569 - DNA, 22 bp, Homo sapiens
ttcacatttgcccttatgtgtg

SEQ ID NO: 6982570 - DNA, 17 bp, Homo sapiens
taagttatagcagaaga

SEQ ID NO: 6982571 - DNA, 22 bp, Homo sapiens
atttccagtactattttctgct

SEQ ID NO: 6982572 - DNA, 22 bp, Homo sapiens
ctggaaagtgaggagagttcca

SEQ ID NO: 6982573 - DNA, 22 bp, Homo sapiens
acatgctctccaaggacagagc

SEQ ID NO: 6982574 - DNA, 22 bp, Homo sapiens
ggctgctggattgtgtatctgt

SEQ ID NO: 6982575 - DNA, 22 bp, Homo sapiens
tatgttctgactctacatggga

SEQ ID NO: 6982576 - DNA, 22 bp, Homo sapiens
aggctatggtggggccagtggc

SEQ ID NO: 6982577 - DNA, 22 bp, Homo sapiens
gagggggcgaacagaagcaagg

SEQ ID NO: 6982578 - DNA, 22 bp, Homo sapiens
acacttcaaatggttggaaaat

SEQ ID NO: 6982579 - DNA, 22 bp, Homo sapiens
tccagaccaaggaaggctgggc

SEQ ID NO: 6982580 - DNA, 22 bp, Homo sapiens
caggtggccttgccatctcctg

SEQ ID NO: 6982581 - DNA, 22 bp, Homo sapiens
tcaggcatgcattctgcaggtt

SEQ ID NO: 6982582 - DNA, 22 bp, Homo sapiens
acctccctgcctcttggcgtca

SEQ ID NO: 6982583 - DNA, 22 bp, Homo sapiens
ctgtaggcttagctagaagtga

SEQ ID NO: 6982584 - DNA, 22 bp, Homo sapiens
ttggaacatccaggacagatat

SEQ ID NO: 6982585 - DNA, 22 bp, Homo sapiens
aaatgacactcattcagtgtca

SEQ ID NO: 6982586 - DNA, 22 bp, Homo sapiens
tttctggacccttctgtgagtg

SEQ ID NO: 6982587 - DNA, 22 bp, Homo sapiens
ctcctgtgcacctccagcggca

SEQ ID NO: 6982588 - DNA, 22 bp, Homo sapiens
tccagctcatctgtctccatta

SEQ ID NO: 6982589 - DNA, 22 bp, Homo sapiens
tggcctctcctggcagcatcca

SEQ ID NO: 6982590 - DNA, 23 bp, Homo sapiens
agaggccagcctttggagacacc

SEQ ID NO: 6982591 - DNA, 19 bp, Homo sapiens
ctctgggctgcatcttggt

SEQ ID NO: 6982592 - DNA, 22 bp, Homo sapiens
ccaccctggactcgaggcccga

SEQ ID NO: 6982593 - DNA, 22 bp, Homo sapiens
ttctttctcaacatgaatgttt

SEQ ID NO: 6982594 - DNA, 22 bp, Homo sapiens
ggagatctgagagctggaagtg

SEQ ID NO: 6982595 - DNA, 22 bp, Homo sapiens
ttgctaatttaactaccttgtt

SEQ ID NO: 6982596 - DNA, 22 bp, Homo sapiens
aggttccagggattaggatgtg

SEQ ID NO: 6982597 - DNA, 22 bp, Homo sapiens
agctggctatgccctgtgaacc

SEQ ID NO: 6982598 - DNA, 22 bp, Homo sapiens
tctcagggctcagagctcaggc

SEQ ID NO: 6982599 - DNA, 22 bp, Homo sapiens
tttgggcagtcctggaatttgt

SEQ ID NO: 6982600 - DNA, 22 bp, Homo sapiens
ctgcccagaagcttagagctta

SEQ ID NO: 6982601 - DNA, 22 bp, Homo sapiens
gagcatccacaaagtttggtgt

SEQ ID NO: 6982602 - DNA, 22 bp, Homo sapiens
attgttaatgttgcactaaggt

SEQ ID NO: 6982603 - DNA, 22 bp, Homo sapiens
tagggtacatgtgcacaacatg

SEQ ID NO: 6982604 - DNA, 22 bp, Homo sapiens
tttggtaagtcaggaatgcttc

SEQ ID NO: 6982605 - DNA, 22 bp, Homo sapiens
tgtgtacatctcttctcacatt

SEQ ID NO: 6982606 - DNA, 22 bp, Homo sapiens
aagttacaggagaaagagatca

SEQ ID NO: 6982607 - DNA, 22 bp, Homo sapiens
gctgccatggcctcctgcaagg

SEQ ID NO: 6982608 - DNA, 22 bp, Homo sapiens
tgaggtagtgcttgtcatgttt

SEQ ID NO: 6982609 - DNA, 22 bp, Homo sapiens
gagggacagctaaagagaaatt

SEQ ID NO: 6982610 - DNA, 22 bp, Homo sapiens
cctctctctcctgcacacacac

SEQ ID NO: 6982611 - DNA, 22 bp, Homo sapiens
ggaactgagaagcagctatgcc

SEQ ID NO: 6982612 - DNA, 22 bp, Homo sapiens
tattcctgggctgtcctttgga

SEQ ID NO: 6982613 - DNA, 23 bp, Homo sapiens
aagttagtttcaataaagcaatt

SEQ ID NO: 6982614 - DNA, 22 bp, Homo sapiens
gcattgcaggtgtacccagtta

SEQ ID NO: 6982615 - DNA, 22 bp, Homo sapiens
gggcaccttgggtctcaggcaa

SEQ ID NO: 6982616 - DNA, 22 bp, Homo sapiens
gcagtgcattactcacatgttt

SEQ ID NO: 6982617 - DNA, 22 bp, Homo sapiens
tttgggcaaaggtagaaggaga

SEQ ID NO: 6982618 - DNA, 18 bp, Homo sapiens
tcacagacttactgggcc

SEQ ID NO: 6982619 - DNA, 22 bp, Homo sapiens
tggctctgtcaaactgcacaca

SEQ ID NO: 6982620 - DNA, 22 bp, Homo sapiens
cctagatgggatggcggccggg

SEQ ID NO: 6982621 - DNA, 22 bp, Homo sapiens
atgccagggtcccttcagagat

SEQ ID NO: 6982622 - DNA, 22 bp, Homo sapiens
atgtaagtattcaaaatatttc

SEQ ID NO: 6982623 - DNA, 23 bp, Homo sapiens
tttctcatccagagagtcagtcc

SEQ ID NO: 6982624 - DNA, 22 bp, Homo sapiens
gcattgcaagggaaatagctgc

SEQ ID NO: 6982625 - DNA, 22 bp, Homo sapiens
agacagtaataaaataggtaag

SEQ ID NO: 6982626 - DNA, 19 bp, Homo sapiens
gtagtacaattaggacaat

SEQ ID NO: 6982627 - DNA, 22 bp, Homo sapiens
agaccactggcctcctgcagac

SEQ ID NO: 6982628 - DNA, 22 bp, Homo sapiens
catttagaagtcttagaactat

SEQ ID NO: 6982629 - DNA, 22 bp, Homo sapiens
gttggccagagatgctgatata

SEQ ID NO: 6982630 - DNA, 22 bp, Homo sapiens
cgctgggggaacagcgagggtg

SEQ ID NO: 6982631 - DNA, 22 bp, Homo sapiens
tgacagtgacagccaaaggctt

SEQ ID NO: 6982632 - DNA, 22 bp, Homo sapiens
ctatgtatgcgattagaatttt

SEQ ID NO: 6982633 - DNA, 22 bp, Homo sapiens
actggaattaggtttgtataca

SEQ ID NO: 6982634 - DNA, 22 bp, Homo sapiens
tcagactgtgtcataagtaggt

SEQ ID NO: 6982635 - DNA, 19 bp, Homo sapiens
ctgtgtcacatttatgaaa

SEQ ID NO: 6982636 - DNA, 22 bp, Homo sapiens
tagtggggcctgggagggttcc

SEQ ID NO: 6982637 - DNA, 22 bp, Homo sapiens
agtctgggagaaggtgagatta

SEQ ID NO: 6982638 - DNA, 22 bp, Homo sapiens
gcagggacgccagggacagcaa

SEQ ID NO: 6982639 - DNA, 22 bp, Homo sapiens
ctggatccaacagagttgggtt

SEQ ID NO: 6982640 - DNA, 21 bp, Homo sapiens
ttgtatgcatacatacacaca

SEQ ID NO: 6982641 - DNA, 22 bp, Homo sapiens
tgatttccagttgctgggtgct

SEQ ID NO: 6982642 - DNA, 22 bp, Homo sapiens
ttccctgatcacgtgtcaggag

SEQ ID NO: 6982643 - DNA, 18 bp, Homo sapiens
aggtttggtggaaacata

SEQ ID NO: 6982644 - DNA, 20 bp, Homo sapiens
aggaaggctgttggccttgc

SEQ ID NO: 6982645 - DNA, 22 bp, Homo sapiens
gctgtcttgctcactcttgcag

SEQ ID NO: 6982646 - DNA, 22 bp, Homo sapiens
ggaatagtagttggggaatggc

SEQ ID NO: 6982647 - DNA, 18 bp, Homo sapiens
cctgtgctccagcatctg

SEQ ID NO: 6982648 - DNA, 21 bp, Homo sapiens
aagttgtctcttttggttcct

SEQ ID NO: 6982649 - DNA, 18 bp, Homo sapiens
gcatttatgcggggctac

SEQ ID NO: 6982650 - DNA, 22 bp, Homo sapiens
tggcctgaattatggcagatct

SEQ ID NO: 6982651 - DNA, 23 bp, Homo sapiens
ctgaggggaaaagggcttcaggc

SEQ ID NO: 6982652 - DNA, 22 bp, Homo sapiens
cccaggaaagtgaatctaattg

SEQ ID NO: 6982653 - DNA, 22 bp, Homo sapiens
gcctgtgctttcttccctcctg

SEQ ID NO: 6982654 - DNA, 22 bp, Homo sapiens
tcaggccagcaccatccctatc

SEQ ID NO: 6982655 - DNA, 22 bp, Homo sapiens
tcctgaggcacaatcctagaat

SEQ ID NO: 6982656 - DNA, 22 bp, Homo sapiens
ctccccacatttctccctgtct

SEQ ID NO: 6982657 - DNA, 22 bp, Homo sapiens
gccaggctctcagtgactgccc

SEQ ID NO: 6982658 - DNA, 22 bp, Homo sapiens
aaacagctgtcattgttttaaa

SEQ ID NO: 6982659 - DNA, 22 bp, Homo sapiens
tttagaggctgcctatcacaac

SEQ ID NO: 6982660 - DNA, 22 bp, Homo sapiens
tcatgcattggaatcttcctag

SEQ ID NO: 6982661 - DNA, 22 bp, Homo sapiens
caatttcagtctcagagagttc

SEQ ID NO: 6982662 - DNA, 20 bp, Homo sapiens
ctgaggggtctgacttggac

SEQ ID NO: 6982663 - DNA, 22 bp, Homo sapiens
gcttcagaagttgggctctgac

SEQ ID NO: 6982664 - DNA, 22 bp, Homo sapiens
caaaataccacgacttgtttta

SEQ ID NO: 6982665 - DNA, 22 bp, Homo sapiens
atctctgtaaaccataaattga

SEQ ID NO: 6982666 - DNA, 22 bp, Homo sapiens
cctaagtttatcatagttttac

SEQ ID NO: 6982667 - DNA, 22 bp, Homo sapiens
ttttcagttccatctctgctct

SEQ ID NO: 6982668 - DNA, 22 bp, Homo sapiens
tcagaaaataactgttagtttg

SEQ ID NO: 6982669 - DNA, 22 bp, Homo sapiens
tcagggaacaatgttatggctt

SEQ ID NO: 6982670 - DNA, 22 bp, Homo sapiens
aagcacagccaggttaggggct

SEQ ID NO: 6982671 - DNA, 22 bp, Homo sapiens
ctgtgacttccactactgatca

SEQ ID NO: 6982672 - DNA, 22 bp, Homo sapiens
caaatgtataaatgtactttct

SEQ ID NO: 6982673 - DNA, 22 bp, Homo sapiens
aaggccaggcctagcacggagg

SEQ ID NO: 6982674 - DNA, 22 bp, Homo sapiens
agtataattagatatcaaaagt

SEQ ID NO: 6982675 - DNA, 22 bp, Homo sapiens
ttgttttaagccagtctgccta

SEQ ID NO: 6982676 - DNA, 22 bp, Homo sapiens
tgcgttgcgctcctgcagcagg

SEQ ID NO: 6982677 - DNA, 22 bp, Homo sapiens
attcagactgtctaaatggttt

SEQ ID NO: 6982678 - DNA, 22 bp, Homo sapiens
attatgcattccaaccttattc

SEQ ID NO: 6982679 - DNA, 23 bp, Homo sapiens
tactgtcttctattaagtaagga

SEQ ID NO: 6982680 - DNA, 20 bp, Homo sapiens
ttggagatacaacctttaag

SEQ ID NO: 6982681 - DNA, 22 bp, Homo sapiens
tttaaggagctactcaccgtca

SEQ ID NO: 6982682 - DNA, 22 bp, Homo sapiens
ttctacccgttgagagaatgct

SEQ ID NO: 6982683 - DNA, 22 bp, Homo sapiens
catgatacttgaatttggaagg

SEQ ID NO: 6982684 - DNA, 22 bp, Homo sapiens
gtccatcttcttggtgtagcat

SEQ ID NO: 6982685 - DNA, 22 bp, Homo sapiens
agccctcgtttctgcatcctgt

SEQ ID NO: 6982686 - DNA, 22 bp, Homo sapiens
cctggcagcagcacatgccttc

SEQ ID NO: 6982687 - DNA, 22 bp, Homo sapiens
ttgagagaaaaaatttattggt

SEQ ID NO: 6982688 - DNA, 22 bp, Homo sapiens
agtctgaggcaccctgaatatt

SEQ ID NO: 6982689 - DNA, 19 bp, Homo sapiens
tcgctgtgttcatagagct

SEQ ID NO: 6982690 - DNA, 22 bp, Homo sapiens
ctctctggcacttcattgctgt

SEQ ID NO: 6982691 - DNA, 22 bp, Homo sapiens
tcttctactataataattttct

SEQ ID NO: 6982692 - DNA, 22 bp, Homo sapiens
aggggaaaagtgttgtctctag

SEQ ID NO: 6982693 - DNA, 22 bp, Homo sapiens
gtgtgagcacactcgggccagc

SEQ ID NO: 6982694 - DNA, 22 bp, Homo sapiens
tcgggctcgctctcctagcgga

SEQ ID NO: 6982695 - DNA, 22 bp, Homo sapiens
gtgtgtggcaaactgggcctgc

SEQ ID NO: 6982696 - DNA, 22 bp, Homo sapiens
tgtttcactaagcagaaatata
